United States Patent 7,901,882 (ANALYSIS OF METHYLATION USING NUCLEIC ACID ARRAYS) - sequence listing, part 5

SEQ ID NO: 157309 - DNA, 25 bp, Homo sapien
cggcgctgcgctgtgacattttcac

SEQ ID NO: 157310 - DNA, 25 bp, Homo sapien
tgccgaaatgccgagagcgccggca

SEQ ID NO: 157311 - DNA, 25 bp, Homo sapien
cagtcggggtgcttaaatcgtgttt

SEQ ID NO: 157312 - DNA, 25 bp, Homo sapien
caggtgcctaagcttgccaatcata

SEQ ID NO: 157313 - DNA, 25 bp, Homo sapien
gcgaaaagttttcggccagcgcagc

SEQ ID NO: 157314 - DNA, 25 bp, Homo sapien
cccgggaattgagtgcccgagattc

SEQ ID NO: 157315 - DNA, 25 bp, Homo sapien
atttttcaccatccgcgggccgaga

SEQ ID NO: 157316 - DNA, 25 bp, Homo sapien
cgcgcctcatttcggagtccctaaa

SEQ ID NO: 157317 - DNA, 25 bp, Homo sapien
gccgaccagcctaggcgcgaaaagt

SEQ ID NO: 157318 - DNA, 25 bp, Homo sapien
tcaaggtcttgtacactagcgtaga

SEQ ID NO: 157319 - DNA, 25 bp, Homo sapien
tttgcttcttcggaagcctttgagt

SEQ ID NO: 157320 - DNA, 25 bp, Homo sapien
gttggaagccgaaaagacaggcgcc

SEQ ID NO: 157321 - DNA, 25 bp, Homo sapien
tgccaccctcggcaccatctctgaa

SEQ ID NO: 157322 - DNA, 25 bp, Homo sapien
gaagcctttgagtgtggcctggacc

SEQ ID NO: 157323 - DNA, 25 bp, Homo sapien
caagccgcaaaagtggggtagagct

SEQ ID NO: 157324 - DNA, 25 bp, Homo sapien
aactcgggagcggtatccatgcacc

SEQ ID NO: 157325 - DNA, 25 bp, Homo sapien
tgctcctccaaactcgggagcggta

SEQ ID NO: 157326 - DNA, 25 bp, Homo sapien
tttgagtgtggcctggaccttagat

SEQ ID NO: 157327 - DNA, 25 bp, Homo sapien
aagcggcttggcttgacctgcggaa

SEQ ID NO: 157328 - DNA, 25 bp, Homo sapien
tgccactgggctgcagatgacgagt

SEQ ID NO: 157329 - DNA, 25 bp, Homo sapien
ctgtgggacaagaggttcaggttcc

SEQ ID NO: 157330 - DNA, 25 bp, Homo sapien
acaagaggttcaggttccggcctgc

SEQ ID NO: 157331 - DNA, 25 bp, Homo sapien
ggcgctctctgcctgcggttttcca

SEQ ID NO: 157332 - DNA, 25 bp, Homo sapien
ctgcggttttccaggaggccgatct

SEQ ID NO: 157333 - DNA, 25 bp, Homo sapien
aggaggccgatctaccccagggaca

SEQ ID NO: 157334 - DNA, 25 bp, Homo sapien
gcggttttccaggaggccgatctac

SEQ ID NO: 157335 - DNA, 25 bp, Homo sapien
agcaaggcgagttcctcaactacga

SEQ ID NO: 157336 - DNA, 25 bp, Homo sapien
ttcatgtacacagactgggccgata

SEQ ID NO: 157337 - DNA, 25 bp, Homo sapien
cgggagactatcaagttcatgtaca

SEQ ID NO: 157338 - DNA, 25 bp, Homo sapien
ctaccctgaagggaaagacactttg

SEQ ID NO: 157339 - DNA, 25 bp, Homo sapien
tggacaacctttacggctaccctga

SEQ ID NO: 157340 - DNA, 25 bp, Homo sapien
gacttctccgtgtccaacttcgtgg

SEQ ID NO: 157341 - DNA, 25 bp, Homo sapien
gtgtgacgcccaacgactttgactt

SEQ ID NO: 157342 - DNA, 25 bp, Homo sapien
acgacatcatgctgggcgtcaacca

SEQ ID NO: 157343 - DNA, 25 bp, Homo sapien
tcggcttatgagcatctggcggccc

SEQ ID NO: 157344 - DNA, 25 bp, Homo sapien
tgggtttctgccatccttgcctgcc

SEQ ID NO: 157345 - DNA, 25 bp, Homo sapien
aacgggcgcgatgcttttaccgctg

SEQ ID NO: 157346 - DNA, 25 bp, Homo sapien
ggccacagactacccatccagaaga

SEQ ID NO: 157347 - DNA, 25 bp, Homo sapien
gtcgcggcaacccagccatgacgta

SEQ ID NO: 157348 - DNA, 25 bp, Homo sapien
cacacatagggcgaccggaatcagg

SEQ ID NO: 157349 - DNA, 25 bp, Homo sapien
tacgtgcccaggtcccacacatagg

SEQ ID NO: 157350 - DNA, 25 bp, Homo sapien
cgcatcactgcgagccataaggttg

SEQ ID NO: 157351 - DNA, 25 bp, Homo sapien
cgccgttcccaggatggcgatcgga

SEQ ID NO: 157352 - DNA, 25 bp, Homo sapien
ctcaccaaagatgaggttgtcggcc

SEQ ID NO: 157353 - DNA, 25 bp, Homo sapien
ccaaagatgaggttgtcggcctgaa

SEQ ID NO: 157354 - DNA, 25 bp, Homo sapien
aagatgaggttgtcggcctgaagat

SEQ ID NO: 157355 - DNA, 25 bp, Homo sapien
cacctgagtgggacaggagggtatt

SEQ ID NO: 157356 - DNA, 25 bp, Homo sapien
cgttcccaggatggcgatcggagaa

SEQ ID NO: 157357 - DNA, 25 bp, Homo sapien
cgatcggagaaggtctgggttctca

SEQ ID NO: 157358 - DNA, 25 bp, Homo sapien
cgcagggcacgtaccagccacctga

SEQ ID NO: 157359 - DNA, 25 bp, Homo sapien
atggtccagtgcatggccttgtctg

SEQ ID NO: 157360 - DNA, 25 bp, Homo sapien
cgtcggaggaatggagaccaaccag

SEQ ID NO: 157361 - DNA, 25 bp, Homo sapien
ggaatggagaccaaccagagagccc

SEQ ID NO: 157362 - DNA, 25 bp, Homo sapien
agcggatggacacctctggcgtcct

SEQ ID NO: 157363 - DNA, 25 bp, Homo sapien
gccttgtctgctatggctggagccc

SEQ ID NO: 157364 - DNA, 25 bp, Homo sapien
agtggcttagagttgtcccgatcca

SEQ ID NO: 157365 - DNA, 25 bp, Homo sapien
tgtcccgatccaagccgcgtggctt

SEQ ID NO: 157366 - DNA, 25 bp, Homo sapien
cgaagtctgtgcagcggatggacac

SEQ ID NO: 157367 - DNA, 25 bp, Homo sapien
cgttcacggcggacgttcttgttct

SEQ ID NO: 157368 - DNA, 25 bp, Homo sapien
agtcgcgttctctgttttgctgttg

SEQ ID NO: 157369 - DNA, 25 bp, Homo sapien
cctttgtgacgggatcgctttctcc

SEQ ID NO: 157370 - DNA, 25 bp, Homo sapien
ccaggctgatcccacgagggacttg

SEQ ID NO: 157371 - DNA, 25 bp, Homo sapien
tccctgcacgcaggagaactcagcg

SEQ ID NO: 157372 - DNA, 25 bp, Homo sapien
gcgtgttgagccctttagtaatgta

SEQ ID NO: 157373 - DNA, 25 bp, Homo sapien
ctccgctggtgaatggagtcgcgtt

SEQ ID NO: 157374 - DNA, 25 bp, Homo sapien
tttgcatcgtcatcaggcgcgtgtt

SEQ ID NO: 157375 - DNA, 25 bp, Homo sapien
catctcttatcgagtgggagggacc

SEQ ID NO: 157376 - DNA, 25 bp, Homo sapien
cgctcaacagaggaggcagcatctc

SEQ ID NO: 157377 - DNA, 25 bp, Homo sapien
aacaaggaacttggcgctcaacaga

SEQ ID NO: 157378 - DNA, 25 bp, Homo sapien
tcgctcctgcgtcgtgggcgcactt

SEQ ID NO: 157379 - DNA, 25 bp, Homo sapien
gtacacagaatcttaccgcactcgc

SEQ ID NO: 157380 - DNA, 25 bp, Homo sapien
gaggccgacacaacacgatagtaca

SEQ ID NO: 157381 - DNA, 25 bp, Homo sapien
acgacctcttcaggatgcacttgca

SEQ ID NO: 157382 - DNA, 25 bp, Homo sapien
gcacttgcaaacaccgtggtggcgg

SEQ ID NO: 157383 - DNA, 25 bp, Homo sapien
ctcgcggaaggacccagttggaact

SEQ ID NO: 157384 - DNA, 25 bp, Homo sapien
gactggttcatatcccatcgccgcg

SEQ ID NO: 157385 - DNA, 25 bp, Homo sapien
tcggacaaccactcctgagtcattc

SEQ ID NO: 157386 - DNA, 25 bp, Homo sapien
accaggctcggtgaatccaatctca

SEQ ID NO: 157387 - DNA, 25 bp, Homo sapien
aggggagccacctctacctcagcaa

SEQ ID NO: 157388 - DNA, 25 bp, Homo sapien
tctcgcgagagacacccactgcgtg

SEQ ID NO: 157389 - DNA, 25 bp, Homo sapien
tgacatcttatggacccagggctcg

SEQ ID NO: 157390 - DNA, 25 bp, Homo sapien
ccagcgctcgccgatgacatcttat

SEQ ID NO: 157391 - DNA, 25 bp, Homo sapien
ataagatgtcatcggcgagcgctgg

SEQ ID NO: 157392 - DNA, 25 bp, Homo sapien
gcgagccctgggtccataagatgtc

SEQ ID NO: 157393 - DNA, 25 bp, Homo sapien
gtctctcgcgagagctcatcggcgc

SEQ ID NO: 157394 - DNA, 25 bp, Homo sapien
ctgagattggattcaccgagcctgg

SEQ ID NO: 157395 - DNA, 25 bp, Homo sapien
caccgagcctggtgagaatgactca

SEQ ID NO: 157396 - DNA, 25 bp, Homo sapien
atcacgcagtgggtgtctctcgcga

SEQ ID NO: 157397 - DNA, 25 bp, Homo sapien
agttccaactgggtccttccgcgag

SEQ ID NO: 157398 - DNA, 25 bp, Homo sapien
cgcggcgatgggatatgaaccagtc

SEQ ID NO: 157399 - DNA, 25 bp, Homo sapien
agcgagtgcggtaagattctgtgta

SEQ ID NO: 157400 - DNA, 25 bp, Homo sapien
aagtgcgcccacgacgcaggagcga

SEQ ID NO: 157401 - DNA, 25 bp, Homo sapien
tctgttgagcgccaagttccttgtt

SEQ ID NO: 157402 - DNA, 25 bp, Homo sapien
agagatgctgcctcctctgttgagc

SEQ ID NO: 157403 - DNA, 25 bp, Homo sapien
ggtccctcccactcgataagagatg

SEQ ID NO: 157404 - DNA, 25 bp, Homo sapien
tttgcaagtgcatcctgaagaggtc

SEQ ID NO: 157405 - DNA, 25 bp, Homo sapien
ccgccaccacggtgtttgcaagtgc

SEQ ID NO: 157406 - DNA, 25 bp, Homo sapien
tgtactatcgtgttgtgtcggcctc

SEQ ID NO: 157407 - DNA, 25 bp, Homo sapien
actccaaagccacgcggcttggatc

SEQ ID NO: 157408 - DNA, 25 bp, Homo sapien
ggatcgggacaactctaagccactc

SEQ ID NO: 157409 - DNA, 25 bp, Homo sapien
ctggttggtctccattcctccgacg

SEQ ID NO: 157410 - DNA, 25 bp, Homo sapien
gggctctctggttggtctccattcc

SEQ ID NO: 157411 - DNA, 25 bp, Homo sapien
tgtccatccgctgcacagacttcgg

SEQ ID NO: 157412 - DNA, 25 bp, Homo sapien
aggacgccagaggtgtccatccgct

SEQ ID NO: 157413 - DNA, 25 bp, Homo sapien
gggctccagccatagcagacaaggc

SEQ ID NO: 157414 - DNA, 25 bp, Homo sapien
aaggccatgcactggaccatctcgg

SEQ ID NO: 157415 - DNA, 25 bp, Homo sapien
ccgatcgccatcctgggaacggcgg

SEQ ID NO: 157416 - DNA, 25 bp, Homo sapien
ttctccgatcgccatcctgggaacg

SEQ ID NO: 157417 - DNA, 25 bp, Homo sapien
tcgctaataccctcctgtcccactc

SEQ ID NO: 157418 - DNA, 25 bp, Homo sapien
tcaggtggctggtacgtgccctgcg

SEQ ID NO: 157419 - DNA, 25 bp, Homo sapien
cggggcccttcgggctcatcttcag

SEQ ID NO: 157420 - DNA, 25 bp, Homo sapien
ttcaggccgacaacctcatctttgg

SEQ ID NO: 157421 - DNA, 25 bp, Homo sapien
gccgacaacctcatctttggtgagc

SEQ ID NO: 157422 - DNA, 25 bp, Homo sapien
tgagaacccagaccttctccgatcg

SEQ ID NO: 157423 - DNA, 25 bp, Homo sapien
gctgcaaactacacggtttcggtcc

SEQ ID NO: 157424 - DNA, 25 bp, Homo sapien
tcgtgtcagccaggcgcagtgagct

SEQ ID NO: 157425 - DNA, 25 bp, Homo sapien
ctagcgcgaacccttcccggctggt

SEQ ID NO: 157426 - DNA, 25 bp, Homo sapien
tgtcccggtccggagcgatctgcgc

SEQ ID NO: 157427 - DNA, 25 bp, Homo sapien
ttctgtgagcgcctcgtgtcagcca

SEQ ID NO: 157428 - DNA, 25 bp, Homo sapien
gcccttgctttgttctgtgagcgcc

SEQ ID NO: 157429 - DNA, 25 bp, Homo sapien
gctgcctgacgctgcaaactacacg

SEQ ID NO: 157430 - DNA, 25 bp, Homo sapien
cccgaagcccttgctttgttctgtg

SEQ ID NO: 157431 - DNA, 25 bp, Homo sapien
gcatctggccgcaagctcaccggag

SEQ ID NO: 157432 - DNA, 25 bp, Homo sapien
agcgctgggaggcaaaacgtctgcc

SEQ ID NO: 157433 - DNA, 25 bp, Homo sapien
gcggcgtctcttactgggattcgaa

SEQ ID NO: 157434 - DNA, 25 bp, Homo sapien
tgggattcgaagactggacggctcc

SEQ ID NO: 157435 - DNA, 25 bp, Homo sapien
gcacctgttgcggaggactactgag

SEQ ID NO: 157436 - DNA, 25 bp, Homo sapien
ctgacagtctctgtgacagctctga

SEQ ID NO: 157437 - DNA, 25 bp, Homo sapien
tcctgcgtaagggagcacacgaccc

SEQ ID NO: 157438 - DNA, 25 bp, Homo sapien
ggggcctggcaattggtctttccaa

SEQ ID NO: 157439 - DNA, 25 bp, Homo sapien
tcctcggccacctctattggttttc

SEQ ID NO: 157440 - DNA, 25 bp, Homo sapien
gctcggtgtcagaattgcctacaaa

SEQ ID NO: 157441 - DNA, 25 bp, Homo sapien
gatcttctaccaaccgagcccggga

SEQ ID NO: 157442 - DNA, 25 bp, Homo sapien
ggaggattcccaaagcgatcttcta

SEQ ID NO: 157443 - DNA, 25 bp, Homo sapien
cccagtcttacttggtcctcgtaga

SEQ ID NO: 157444 - DNA, 25 bp, Homo sapien
cccaggcactgcgagacagaactca

SEQ ID NO: 157445 - DNA, 25 bp, Homo sapien
gccctccgcaagtgacttttaaaga

SEQ ID NO: 157446 - DNA, 25 bp, Homo sapien
agccttggaccgcttgcttctccta

SEQ ID NO: 157447 - DNA, 25 bp, Homo sapien
gcgccaagacgattggtgccaaaca

SEQ ID NO: 157448 - DNA, 25 bp, Homo sapien
gcagcgattggtcgccagagttata

SEQ ID NO: 157449 - DNA, 25 bp, Homo sapien
gcgctaggtatgaaagccacgtgtg

SEQ ID NO: 157450 - DNA, 25 bp, Homo sapien
cgccctgatctcagcgggaagagtg

SEQ ID NO: 157451 - DNA, 25 bp, Homo sapien
caactcagctctggggtgggttcct

SEQ ID NO: 157452 - DNA, 25 bp, Homo sapien
ctccggtcacgtgtggtacttggca

SEQ ID NO: 157453 - DNA, 25 bp, Homo sapien
ctgccggttttgctgcggaagtcac

SEQ ID NO: 157454 - DNA, 25 bp, Homo sapien
aagtccatgagcttccgtgagggta

SEQ ID NO: 157455 - DNA, 25 bp, Homo sapien
ttctaacggcggtactggccactgc

SEQ ID NO: 157456 - DNA, 25 bp, Homo sapien
ggagctgggaatgccctatttggtc

SEQ ID NO: 157457 - DNA, 25 bp, Homo sapien
acagacgccatttttgtggggcctc

SEQ ID NO: 157458 - DNA, 25 bp, Homo sapien
cctccttcggaagatagcgggcttt

SEQ ID NO: 157459 - DNA, 25 bp, Homo sapien
agcgggcttttgctgctgatttcac

SEQ ID NO: 157460 - DNA, 25 bp, Homo sapien
ctgctgatttcacgccagacggaaa

SEQ ID NO: 157461 - DNA, 25 bp, Homo sapien
tccaggccgcagtgactgttctaac

SEQ ID NO: 157462 - DNA, 25 bp, Homo sapien
ccagcactgtgttcgggaaaggagc

SEQ ID NO: 157463 - DNA, 25 bp, Homo sapien
ccaactgcgggaaggactgctggaa

SEQ ID NO: 157464 - DNA, 25 bp, Homo sapien
ctggcggcggaggattccgacacac

SEQ ID NO: 157465 - DNA, 25 bp, Homo sapien
gcccggctctcatgtcgtatgcatc

SEQ ID NO: 157466 - DNA, 25 bp, Homo sapien
atgcatccggctttgggacaccacg

SEQ ID NO: 157467 - DNA, 25 bp, Homo sapien
attgcgaggactgtaggcgtcttac

SEQ ID NO: 157468 - DNA, 25 bp, Homo sapien
taggcgtcttacgaggcaccctgcc

SEQ ID NO: 157469 - DNA, 25 bp, Homo sapien
cctcctctgagaagctgcttgtgcc

SEQ ID NO: 157470 - DNA, 25 bp, Homo sapien
gcgtcgaccagttattgcgaggact

SEQ ID NO: 157471 - DNA, 25 bp, Homo sapien
cggaacaccacagggccaactgcgg

SEQ ID NO: 157472 - DNA, 25 bp, Homo sapien
cttcggaacaccacagggccaactg

SEQ ID NO: 157473 - DNA, 25 bp, Homo sapien
aactcttccgagaccacgcttgtgc

SEQ ID NO: 157474 - DNA, 25 bp, Homo sapien
ggtaactcttccgagaccacgcttg

SEQ ID NO: 157475 - DNA, 25 bp, Homo sapien
tcgcggtaactcttccgagaccacg

SEQ ID NO: 157476 - DNA, 25 bp, Homo sapien
tcagccagttactgcaaaggctgtg

SEQ ID NO: 157477 - DNA, 25 bp, Homo sapien
gggcgtcagccagttactgcaaagg

SEQ ID NO: 157478 - DNA, 25 bp, Homo sapien
cgtaaccggcttcggaacaccacag

SEQ ID NO: 157479 - DNA, 25 bp, Homo sapien
ttaccgcgacataatggagctgcag

SEQ ID NO: 157480 - DNA, 25 bp, Homo sapien
gacataatggagctgcaggcccgca

SEQ ID NO: 157481 - DNA, 25 bp, Homo sapien
agagttaccgcgacataatggagct

SEQ ID NO: 157482 - DNA, 25 bp, Homo sapien
agttaccgcgacataatggagctgc

SEQ ID NO: 157483 - DNA, 25 bp, Homo sapien
gttaccgcgacataatggagctgca

SEQ ID NO: 157484 - DNA, 25 bp, Homo sapien
accgcgacataatggagctgcaggc

SEQ ID NO: 157485 - DNA, 25 bp, Homo sapien
cgcgacataatggagctgcaggccc

SEQ ID NO: 157486 - DNA, 25 bp, Homo sapien
cgacataatggagctgcaggcccgc

SEQ ID NO: 157487 - DNA, 25 bp, Homo sapien
ctgtggtgttccgaagccggttacg

SEQ ID NO: 157488 - DNA, 25 bp, Homo sapien
caagcgtggtctcggaagagttacc

SEQ ID NO: 157489 - DNA, 25 bp, Homo sapien
cgtggtctcggaagagttaccgcga

SEQ ID NO: 157490 - DNA, 25 bp, Homo sapien
cacagcctttgcagtaactggctga

SEQ ID NO: 157491 - DNA, 25 bp, Homo sapien
cctttgcagtaactggctgacgccc

SEQ ID NO: 157492 - DNA, 25 bp, Homo sapien
ctgtccctcccgcagttggccctgt

SEQ ID NO: 157493 - DNA, 25 bp, Homo sapien
gcagttggccctgtggtgttccgaa

SEQ ID NO: 157494 - DNA, 25 bp, Homo sapien
gcacaagcgtggtctcggaagagtt

SEQ ID NO: 157495 - DNA, 25 bp, Homo sapien
ccgtcgtggtcaacgggccagccga

SEQ ID NO: 157496 - DNA, 25 bp, Homo sapien
agatagcgttcatcgcccgtcgtgg

SEQ ID NO: 157497 - DNA, 25 bp, Homo sapien
gagatccttgttcctcagatagcgt

SEQ ID NO: 157498 - DNA, 25 bp, Homo sapien
tgttccgcgccgatggcgagatcct

SEQ ID NO: 157499 - DNA, 25 bp, Homo sapien
tgcgacatacgtagcggccgccatt

SEQ ID NO: 157500 - DNA, 25 bp, Homo sapien
tgacgcaattcctgtgcgacatacg

SEQ ID NO: 157501 - DNA, 25 bp, Homo sapien
ttttgcctttgcctctccatgacgc

SEQ ID NO: 157502 - DNA, 25 bp, Homo sapien
cggcgcgggagtaactcctcgcaga

SEQ ID NO: 157503 - DNA, 25 bp, Homo sapien
ctgctggtgaagtccgctggaacac

SEQ ID NO: 157504 - DNA, 25 bp, Homo sapien
aaatggcttccggaatgcacaggtt

SEQ ID NO: 157505 - DNA, 25 bp, Homo sapien
cagcagctcccgacaggctcaagga

SEQ ID NO: 157506 - DNA, 25 bp, Homo sapien
cccgacaggctcaaggaggaacaga

SEQ ID NO: 157507 - DNA, 25 bp, Homo sapien
accacttctgggtctgctggtgaag

SEQ ID NO: 157508 - DNA, 25 bp, Homo sapien
ccctcggaggtagaaccgccaggct

SEQ ID NO: 157509 - DNA, 25 bp, Homo sapien
aaaatgataatgtgtctgggctgta

SEQ ID NO: 157510 - DNA, 25 bp, Homo sapien
tgggctgtagtttcaaaatggcttc

SEQ ID NO: 157511 - DNA, 25 bp, Homo sapien
agcggacttcaccagcagacccaga

SEQ ID NO: 157512 - DNA, 25 bp, Homo sapien
ctgttcctccttgagcctgtcggga

SEQ ID NO: 157513 - DNA, 25 bp, Homo sapien
ccacagcgtgttccagcggacttca

SEQ ID NO: 157514 - DNA, 25 bp, Homo sapien
ttccttacaccttagcctttggctc

SEQ ID NO: 157515 - DNA, 25 bp, Homo sapien
agcccagacacattatcatttttta

SEQ ID NO: 157516 - DNA, 25 bp, Homo sapien
agccattttgaaactacagcccaga

SEQ ID NO: 157517 - DNA, 25 bp, Homo sapien
ctgtgcattccggaagccattttga

SEQ ID NO: 157518 - DNA, 25 bp, Homo sapien
tcagcctggcggttctacctccgag

SEQ ID NO: 157519 - DNA, 25 bp, Homo sapien
gggccgttatggtgcacgtgctcgc

SEQ ID NO: 157520 - DNA, 25 bp, Homo sapien
cttgttgtgcttcagaggcggtgat

SEQ ID NO: 157521 - DNA, 25 bp, Homo sapien
cgccagagagctgctacggtggttt

SEQ ID NO: 157522 - DNA, 25 bp, Homo sapien
gttgtgcttcagaggcggtgatccc

SEQ ID NO: 157523 - DNA, 25 bp, Homo sapien
cattgcttgttgtgcttcagaggcg

SEQ ID NO: 157524 - DNA, 25 bp, Homo sapien
tgcattgcttgttgtgcttcagagg

SEQ ID NO: 157525 - DNA, 25 bp, Homo sapien
ccagagagctgctacggtggtttct

SEQ ID NO: 157526 - DNA, 25 bp, Homo sapien
ttgcttgttgtgcttcagaggcggt

SEQ ID NO: 157527 - DNA, 25 bp, Homo sapien
cccaggcttccatgaagctccgggg

SEQ ID NO: 157528 - DNA, 25 bp, Homo sapien
cgccgcttggaagtgcaccctggat

SEQ ID NO: 157529 - DNA, 25 bp, Homo sapien
cgctgcccctgcgaaaggaaaggcg

SEQ ID NO: 157530 - DNA, 25 bp, Homo sapien
tcccaggcttccatgaagctccggg

SEQ ID NO: 157531 - DNA, 25 bp, Homo sapien
cgccggctgcctctctgggcaccgc

SEQ ID NO: 157532 - DNA, 25 bp, Homo sapien
gcttggaagtgcaccctggattcgg

SEQ ID NO: 157533 - DNA, 25 bp, Homo sapien
ccgcttggaagtgcaccctggattc

SEQ ID NO: 157534 - DNA, 25 bp, Homo sapien
cctgcgaaaggaaaggcggccccag

SEQ ID NO: 157535 - DNA, 25 bp, Homo sapien
cgctgacaaccgcattccgaggacc

SEQ ID NO: 157536 - DNA, 25 bp, Homo sapien
tcaagttcgacctggtgtgggaacg

SEQ ID NO: 157537 - DNA, 25 bp, Homo sapien
cccttttcaagttcgacctggtgtg

SEQ ID NO: 157538 - DNA, 25 bp, Homo sapien
tacaggtgggcgacgtcccttttca

SEQ ID NO: 157539 - DNA, 25 bp, Homo sapien
gcccgagttacctgaccccatgatg

SEQ ID NO: 157540 - DNA, 25 bp, Homo sapien
cccatgatgtagcgcgagccgactc

SEQ ID NO: 157541 - DNA, 25 bp, Homo sapien
cgagccgactcctcggtacaggtgg

SEQ ID NO: 157542 - DNA, 25 bp, Homo sapien
attccgaggaccctctgggacgccg

SEQ ID NO: 157543 - DNA, 25 bp, Homo sapien
aacgcagcaggcctagccgtgtcgc

SEQ ID NO: 157544 - DNA, 25 bp, Homo sapien
gcttcatgcggaagtcagcggcgtc

SEQ ID NO: 157545 - DNA, 25 bp, Homo sapien
ctgccattggaggagcgctcccact

SEQ ID NO: 157546 - DNA, 25 bp, Homo sapien
ctcccagaatgcagtacggctcctg

SEQ ID NO: 157547 - DNA, 25 bp, Homo sapien
ctcagtgatactccaaccggaacta

SEQ ID NO: 157548 - DNA, 25 bp, Homo sapien
gctgtcgaacgaacgtgaaacactc

SEQ ID NO: 157549 - DNA, 25 bp, Homo sapien
cggcatttgacgctgtttaccacaa

SEQ ID NO: 157550 - DNA, 25 bp, Homo sapien
ctcccaagaggccacgcgtagacgg

SEQ ID NO: 157551 - DNA, 25 bp, Homo sapien
cccaagtggtgtcccggagatgcag

SEQ ID NO: 157552 - DNA, 25 bp, Homo sapien
cccaggtgtctcgaagccgcggtct

SEQ ID NO: 157553 - DNA, 25 bp, Homo sapien
ggccgcaaagtgactgccgctgtgt

SEQ ID NO: 157554 - DNA, 25 bp, Homo sapien
tcatagtggccgcaaagtgactgcc

SEQ ID NO: 157555 - DNA, 25 bp, Homo sapien
tcagtcctcatagtggccgcaaagt

SEQ ID NO: 157556 - DNA, 25 bp, Homo sapien
gggagaggaagctcagtcctcatag

SEQ ID NO: 157557 - DNA, 25 bp, Homo sapien
gcggtctctcccatgcgggtcctgg

SEQ ID NO: 157558 - DNA, 25 bp, Homo sapien
aagccgcggtctctcccatgcgggt

SEQ ID NO: 157559 - DNA, 25 bp, Homo sapien
gtcggtaagcgagtccacggaccac

SEQ ID NO: 157560 - DNA, 25 bp, Homo sapien
gcgccatctgccgtcgactcagctc

SEQ ID NO: 157561 - DNA, 25 bp, Homo sapien
cattgcagacacagctggctcggga

SEQ ID NO: 157562 - DNA, 25 bp, Homo sapien
gtggccgcattgcagacacagctgg

SEQ ID NO: 157563 - DNA, 25 bp, Homo sapien
tgcaggtggccgcattgcagacaca

SEQ ID NO: 157564 - DNA, 25 bp, Homo sapien
atgatggctccggagggtgagctct

SEQ ID NO: 157565 - DNA, 25 bp, Homo sapien
gtaagcgagtccacggaccaccacg

SEQ ID NO: 157566 - DNA, 25 bp, Homo sapien
tccacggaccaccacgcaggccctg

SEQ ID NO: 157567 - DNA, 25 bp, Homo sapien
agtttggttgtggagcacagatgcc

SEQ ID NO: 157568 - DNA, 25 bp, Homo sapien
tgcacctgcgtttctcctgcacggg

SEQ ID NO: 157569 - DNA, 25 bp, Homo sapien
ggatctctgtggagtgatcacgtca

SEQ ID NO: 157570 - DNA, 25 bp, Homo sapien
tgacagcgcgactgaaggccacgct

SEQ ID NO: 157571 - DNA, 25 bp, Homo sapien
agtgatcacgtcagtgggctctcgg

SEQ ID NO: 157572 - DNA, 25 bp, Homo sapien
cagcccagggatgatgacggctcta

SEQ ID NO: 157573 - DNA, 25 bp, Homo sapien
tctaggagtttggttgtggagcaca

SEQ ID NO: 157574 - DNA, 25 bp, Homo sapien
gtcccacaggctggtgacagcgcga

SEQ ID NO: 157575 - DNA, 25 bp, Homo sapien
gcgtgagctacacacagaggacctg

SEQ ID NO: 157576 - DNA, 25 bp, Homo sapien
acagtttttacacgagccgcggtgg

SEQ ID NO: 157577 - DNA, 25 bp, Homo sapien
ctcagagatcctgtggggacacctc

SEQ ID NO: 157578 - DNA, 25 bp, Homo sapien
cggaccacacagactctcagagatc

SEQ ID NO: 157579 - DNA, 25 bp, Homo sapien
aggaccacagtttagacacattctc

SEQ ID NO: 157580 - DNA, 25 bp, Homo sapien
tgcacgggacctgtgtttacaactg

SEQ ID NO: 157581 - DNA, 25 bp, Homo sapien
ttttccgggaaacacaggctgctcg

SEQ ID NO: 157582 - DNA, 25 bp, Homo sapien
tacaactgggtcgtggtgtccacac

SEQ ID NO: 157583 - DNA, 25 bp, Homo sapien
tctgagtcataaaggcctcccgctc

SEQ ID NO: 157584 - DNA, 25 bp, Homo sapien
gctgtgacttctacacggcgccagg

SEQ ID NO: 157585 - DNA, 25 bp, Homo sapien
tgtttcaccgagacccgaacggctg

SEQ ID NO: 157586 - DNA, 25 bp, Homo sapien
gggcttgtccaagcgggacctccta

SEQ ID NO: 157587 - DNA, 25 bp, Homo sapien
acagctacgccatggtgaggacacg

SEQ ID NO: 157588 - DNA, 25 bp, Homo sapien
tccttgtggtcaggacccactcgtg

SEQ ID NO: 157589 - DNA, 25 bp, Homo sapien
cgctgtcagccacaggatgtgtgtc

SEQ ID NO: 157590 - DNA, 25 bp, Homo sapien
gctgtagccacgcagcagcgtcttg

SEQ ID NO: 157591 - DNA, 25 bp, Homo sapien
ggggacccacgattgtcattcagag

SEQ ID NO: 157592 - DNA, 25 bp, Homo sapien
cacttctccggcaaaggtgtcggtg

SEQ ID NO: 157593 - DNA, 25 bp, Homo sapien
atctccaaggggtgacggccacgaa

SEQ ID NO: 157594 - DNA, 25 bp, Homo sapien
cagggaggcctctcatgtctcagcc

SEQ ID NO: 157595 - DNA, 25 bp, Homo sapien
gtctcagccttgaaccctaattggg

SEQ ID NO: 157596 - DNA, 25 bp, Homo sapien
ggagcacctggtgacactgaggaca

SEQ ID NO: 157597 - DNA, 25 bp, Homo sapien
cccagaacacgtggagggcatgact

SEQ ID NO: 157598 - DNA, 25 bp, Homo sapien
gccctggaacatcctggcttctggc

SEQ ID NO: 157599 - DNA, 25 bp, Homo sapien
gaacggagcccgcacacggcacagt

SEQ ID NO: 157600 - DNA, 25 bp, Homo sapien
caagtcggaggcttctcaccacagc

SEQ ID NO: 157601 - DNA, 25 bp, Homo sapien
acaggcagcccaacaccagaatggc

SEQ ID NO: 157602 - DNA, 25 bp, Homo sapien
caaggacgggctgagtctaagattc

SEQ ID NO: 157603 - DNA, 25 bp, Homo sapien
cacgttcccacaggacggcagagca

SEQ ID NO: 157604 - DNA, 25 bp, Homo sapien
agagtccaacacacgttcccacagg

SEQ ID NO: 157605 - DNA, 25 bp, Homo sapien
atggcaaaagtgaccacgtcgctcc

SEQ ID NO: 157606 - DNA, 25 bp, Homo sapien
ctgagaagctcagcacgggatggca

SEQ ID NO: 157607 - DNA, 25 bp, Homo sapien
cgcgtcctgtcacacgtgcttaagg

SEQ ID NO: 157608 - DNA, 25 bp, Homo sapien
gtcaccgtcctggaggaagcacacg

SEQ ID NO: 157609 - DNA, 25 bp, Homo sapien
aggtcctgcagcgtgatcttccctg

SEQ ID NO: 157610 - DNA, 25 bp, Homo sapien
acgttagccagcttgcagcgcttca

SEQ ID NO: 157611 - DNA, 25 bp, Homo sapien
gatgtcgtactcctcggccgcgtac

SEQ ID NO: 157612 - DNA, 25 bp, Homo sapien
tctgctcgtggtcgaggtacttctc

SEQ ID NO: 157613 - DNA, 25 bp, Homo sapien
gaagcacacgggttacgtacacggc

SEQ ID NO: 157614 - DNA, 25 bp, Homo sapien
cccaaggatgcgtggactgggacta

SEQ ID NO: 157615 - DNA, 25 bp, Homo sapien
tctggaaatcaagcggcacgtacta

SEQ ID NO: 157616 - DNA, 25 bp, Homo sapien
gccctcccgtgaaggataaggcctg

SEQ ID NO: 157617 - DNA, 25 bp, Homo sapien
aagggtttctcctctcactgcggca

SEQ ID NO: 157618 - DNA, 25 bp, Homo sapien
tcgctccagccttcaatcagtcatg

SEQ ID NO: 157619 - DNA, 25 bp, Homo sapien
cggacggcgacagaaacatctcatg

SEQ ID NO: 157620 - DNA, 25 bp, Homo sapien
tctcatggaatgtgtgggacgcacc

SEQ ID NO: 157621 - DNA, 25 bp, Homo sapien
gacccatggcaggttcacagcctta

SEQ ID NO: 157622 - DNA, 25 bp, Homo sapien
ctgggcatctgcaaactcaacgtgg

SEQ ID NO: 157623 - DNA, 25 bp, Homo sapien
aggagtgcaccttcgttactgctca

SEQ ID NO: 157624 - DNA, 25 bp, Homo sapien
tgcctctagatcgaaagccaggatg

SEQ ID NO: 157625 - DNA, 25 bp, Homo sapien
tccgcctggggacacatgtcacatg

SEQ ID NO: 157626 - DNA, 25 bp, Homo sapien
ccaggtccatgcagcggaaccagta

SEQ ID NO: 157627 - DNA, 25 bp, Homo sapien
actcgagctcgaacatggacagggc

SEQ ID NO: 157628 - DNA, 25 bp, Homo sapien
cggcactgctcctcgtagaagtact

SEQ ID NO: 157629 - DNA, 25 bp, Homo sapien
ctggggtgacaaccactcgctgtcg

SEQ ID NO: 157630 - DNA, 25 bp, Homo sapien
tgtcggggcacaaaaagctcacgtc

SEQ ID NO: 157631 - DNA, 25 bp, Homo sapien
atccagggaatgctacgtctgctca

SEQ ID NO: 157632 - DNA, 25 bp, Homo sapien
ttcaggccgcagtgcgtgagaaaca

SEQ ID NO: 157633 - DNA, 25 bp, Homo sapien
caggtggctccctgaactgagcgca

SEQ ID NO: 157634 - DNA, 25 bp, Homo sapien
tgcagctcacgttcggggaaccagg

SEQ ID NO: 157635 - DNA, 25 bp, Homo sapien
ccaggcgtattatgagtcgaccaca

SEQ ID NO: 157636 - DNA, 25 bp, Homo sapien
cgtaattcggaaacagtcttggtca

SEQ ID NO: 157637 - DNA, 25 bp, Homo sapien
aggccgctttgagttcctgcaagtg

SEQ ID NO: 157638 - DNA, 25 bp, Homo sapien
tgggccgattcccagctgtgcaggt

SEQ ID NO: 157639 - DNA, 25 bp, Homo sapien
gcccgaacacgaccgagtggacatg

SEQ ID NO: 157640 - DNA, 25 bp, Homo sapien
ctggcgcacctgtggatgacttgaa

SEQ ID NO: 157641 - DNA, 25 bp, Homo sapien
gtgcccgtgagagcctgcacagatg

SEQ ID NO: 157642 - DNA, 25 bp, Homo sapien
acaagaacatgacacgcgcggctga

SEQ ID NO: 157643 - DNA, 25 bp, Homo sapien
catcagtgagaaagaggcccgaaca

SEQ ID NO: 157644 - DNA, 25 bp, Homo sapien
gctaccggcacggtgaacaccatga

SEQ ID NO: 157645 - DNA, 25 bp, Homo sapien
caaggtttctttcacgggccacacg

SEQ ID NO: 157646 - DNA, 25 bp, Homo sapien
gtcctcccagaagcacaccagtggg

SEQ ID NO: 157647 - DNA, 25 bp, Homo sapien
acccggccatctgcggacttttaga

SEQ ID NO: 157648 - DNA, 25 bp, Homo sapien
caagaggacgatctgcagacacgta

SEQ ID NO: 157649 - DNA, 25 bp, Homo sapien
gcaagttcagcacgcgttcctcggc

SEQ ID NO: 157650 - DNA, 25 bp, Homo sapien
cgagcgtctacagtcgcacagggca

SEQ ID NO: 157651 - DNA, 25 bp, Homo sapien
ggatcgtctgcctgtgtactgctga

SEQ ID NO: 157652 - DNA, 25 bp, Homo sapien
tgtgggactcacacaccttgctctg

SEQ ID NO: 157653 - DNA, 25 bp, Homo sapien
ttccctcgctcagcacatgcgtgtg

SEQ ID NO: 157654 - DNA, 25 bp, Homo sapien
ccaagctatgtgagcgagtgacatc

SEQ ID NO: 157655 - DNA, 25 bp, Homo sapien
tccagccaacggaccaggttctttc

SEQ ID NO: 157656 - DNA, 25 bp, Homo sapien
ctctggggcgtcgaagacaacgaca

SEQ ID NO: 157657 - DNA, 25 bp, Homo sapien
ttaagtcgcgacagcgcacaccctg

SEQ ID NO: 157658 - DNA, 25 bp, Homo sapien
cgccacagcgcaggtggattaagtc

SEQ ID NO: 157659 - DNA, 25 bp, Homo sapien
aaccgtcccaaaggcacacgatgga

SEQ ID NO: 157660 - DNA, 25 bp, Homo sapien
cattcagtcactcacgcgacgggga

SEQ ID NO: 157661 - DNA, 25 bp, Homo sapien
acccgcctgacaacacgcgtgtgga

SEQ ID NO: 157662 - DNA, 25 bp, Homo sapien
tgaaacgcgcacatgagaaccaggc

SEQ ID NO: 157663 - DNA, 25 bp, Homo sapien
tacgggctgcaacgcacagccgtgc

SEQ ID NO: 157664 - DNA, 25 bp, Homo sapien
ggacgctcagtacgggctgcaacgc

SEQ ID NO: 157665 - DNA, 25 bp, Homo sapien
tcaaagccacagaggaggtgccgga

SEQ ID NO: 157666 - DNA, 25 bp, Homo sapien
ggacaccacgatcaaagccacagag

SEQ ID NO: 157667 - DNA, 25 bp, Homo sapien
acggcagcaggaccggacaccacga

SEQ ID NO: 157668 - DNA, 25 bp, Homo sapien
gcggtgaccagcagaaatgaccctc

SEQ ID NO: 157669 - DNA, 25 bp, Homo sapien
gagaacacaggccacgtgcaccgtg

SEQ ID NO: 157670 - DNA, 25 bp, Homo sapien
cccgcatgtgcagagggtgcgcaca

SEQ ID NO: 157671 - DNA, 25 bp, Homo sapien
agtctcgggccgtgacaggaagagc

SEQ ID NO: 157672 - DNA, 25 bp, Homo sapien
aagagcgggtctcaggttgtgacag

SEQ ID NO: 157673 - DNA, 25 bp, Homo sapien
agcgggtctcaggttgtgacaggaa

SEQ ID NO: 157674 - DNA, 25 bp, Homo sapien
ggccgtgacaggaagaggggatctc

SEQ ID NO: 157675 - DNA, 25 bp, Homo sapien
tctccggccgtgacaggaagaggga

SEQ ID NO: 157676 - DNA, 25 bp, Homo sapien
ggatctcgggccgtgacaggaagag

SEQ ID NO: 157677 - DNA, 25 bp, Homo sapien
ctccggccgtgacaggaagagggag

SEQ ID NO: 157678 - DNA, 25 bp, Homo sapien
ccgtgacaggaagaggggatctcgg

SEQ ID NO: 157679 - DNA, 25 bp, Homo sapien
tgtccaccagccaaggggtgacggt

SEQ ID NO: 157680 - DNA, 25 bp, Homo sapien
cgtgagtctccacagagctcggaag

SEQ ID NO: 157681 - DNA, 25 bp, Homo sapien
tctccacagagctcggaaggctggg

SEQ ID NO: 157682 - DNA, 25 bp, Homo sapien
tggggatcattctgtccaccagcca

SEQ ID NO: 157683 - DNA, 25 bp, Homo sapien
gtgacggtggatgccgcgcaacaca

SEQ ID NO: 157684 - DNA, 25 bp, Homo sapien
atgccgcgcaacacagcgaggggag

SEQ ID NO: 157685 - DNA, 25 bp, Homo sapien
gaggatccggcaccctccctgcgtc

SEQ ID NO: 157686 - DNA, 25 bp, Homo sapien
ggacgtggggatcattctgtccacc

SEQ ID NO: 157687 - DNA, 25 bp, Homo sapien
gtcgcacagtcagaagatcaagctc

SEQ ID NO: 157688 - DNA, 25 bp, Homo sapien
aaggtctgagctgtcctgctgttgc

SEQ ID NO: 157689 - DNA, 25 bp, Homo sapien
tggctccggcaagaagagctcagcc

SEQ ID NO: 157690 - DNA, 25 bp, Homo sapien
cactccaggtacatgctgggtccta

SEQ ID NO: 157691 - DNA, 25 bp, Homo sapien
tcctacagtgagagcatgagccgtg

SEQ ID NO: 157692 - DNA, 25 bp, Homo sapien
cccacggtgagagtacgtgtaacac

SEQ ID NO: 157693 - DNA, 25 bp, Homo sapien
acgcatgctgttccgttcccaaggc

SEQ ID NO: 157694 - DNA, 25 bp, Homo sapien
cccgagtttggtttgtcaaggatgc

SEQ ID NO: 157695 - DNA, 25 bp, Homo sapien
ttcctaacaagcttggcaccgcttc

SEQ ID NO: 157696 - DNA, 25 bp, Homo sapien
ccgcgcgcattcctcaggctgagga

SEQ ID NO: 157697 - DNA, 25 bp, Homo sapien
tcagccgcttcttgaaccgagaggg

SEQ ID NO: 157698 - DNA, 25 bp, Homo sapien
acgcaacaacgggtgcacggccagc

SEQ ID NO: 157699 - DNA, 25 bp, Homo sapien
ctcacagccaaaactcccgggaaag

SEQ ID NO: 157700 - DNA, 25 bp, Homo sapien
tgcgcccacaactggccctgtaaat

SEQ ID NO: 157701 - DNA, 25 bp, Homo sapien
ggagcgagtgctcttttcaaagccc

SEQ ID NO: 157702 - DNA, 25 bp, Homo sapien
ctggccctgtaaatctggcgtttgg

SEQ ID NO: 157703 - DNA, 25 bp, Homo sapien
caaacgcagctaggggaaccagatt

SEQ ID NO: 157704 - DNA, 25 bp, Homo sapien
gaagcgagccaacgggcgcgatcct

SEQ ID NO: 157705 - DNA, 25 bp, Homo sapien
gtcaaagatcaaacccaaaatgcgg

SEQ ID NO: 157706 - DNA, 25 bp, Homo sapien
ttgggagccaacctcctgtgatctc

SEQ ID NO: 157707 - DNA, 25 bp, Homo sapien
ggacggcctcccaaacgcagctagg

SEQ ID NO: 157708 - DNA, 25 bp, Homo sapien
tatcagcactacacacggacggcct

SEQ ID NO: 157709 - DNA, 25 bp, Homo sapien
cccttcagttcatatcagcactaca

SEQ ID NO: 157710 - DNA, 25 bp, Homo sapien
tgtgatctccctccgaaagtcaaag

SEQ ID NO: 157711 - DNA, 25 bp, Homo sapien
agcccatctttctccttcgcccttg

SEQ ID NO: 157712 - DNA, 25 bp, Homo sapien
acggcgcagctttacgcggccgtag

SEQ ID NO: 157713 - DNA, 25 bp, Homo sapien
cagccgacggcgcagctttacgcgg

SEQ ID NO: 157714 - DNA, 25 bp, Homo sapien
caacgtggtgttcgccgtcacttcc

SEQ ID NO: 157715 - DNA, 25 bp, Homo sapien
cggggttgagtggtgtcctagcaac

SEQ ID NO: 157716 - DNA, 25 bp, Homo sapien
tcccaacgtggtgttcgccgtcact

SEQ ID NO: 157717 - DNA, 25 bp, Homo sapien
ccctgtctctccttccgcgagccca

SEQ ID NO: 157718 - DNA, 25 bp, Homo sapien
ctctctgcactaccctggacccatc

SEQ ID NO: 157719 - DNA, 25 bp, Homo sapien
accagggtttgcatgtcgctgtcta

SEQ ID NO: 157720 - DNA, 25 bp, Homo sapien
tcatagaccagggtttgcatgtcgc

SEQ ID NO: 157721 - DNA, 25 bp, Homo sapien
atagaccagggtttgcatgtcgctg

SEQ ID NO: 157722 - DNA, 25 bp, Homo sapien
agaccagggtttgcatgtcgctgtc

SEQ ID NO: 157723 - DNA, 25 bp, Homo sapien
ccagggtttgcatgtcgctgtctag

SEQ ID NO: 157724 - DNA, 25 bp, Homo sapien
gggtttgcatgtcgctgtctagagc

SEQ ID NO: 157725 - DNA, 25 bp, Homo sapien
cagggtttgcatgtcgctgtctaga

SEQ ID NO: 157726 - DNA, 25 bp, Homo sapien
tagaccagggtttgcatgtcgctgt

SEQ ID NO: 157727 - DNA, 25 bp, Homo sapien
cgatgtcatcacgaggcgacgccgc

SEQ ID NO: 157728 - DNA, 25 bp, Homo sapien
ttaggatttttagaggcgcggccca

SEQ ID NO: 157729 - DNA, 25 bp, Homo sapien
aacttactactctcgtccctgcgga

SEQ ID NO: 157730 - DNA, 25 bp, Homo sapien
gcctcgctgagccagtacaggaaca

SEQ ID NO: 157731 - DNA, 25 bp, Homo sapien
agctcgtccaccttcatcttcagga

SEQ ID NO: 157732 - DNA, 25 bp, Homo sapien
ctcagggcagcttcaaaacgggcgc

SEQ ID NO: 157733 - DNA, 25 bp, Homo sapien
cagtcctagagctgcggaaatgcga

SEQ ID NO: 157734 - DNA, 25 bp, Homo sapien
gttcacgtcactgcgtcgcgtcatc

SEQ ID NO: 157735 - DNA, 25 bp, Homo sapien
gcagcccgttccaatgtctcattta

SEQ ID NO: 157736 - DNA, 25 bp, Homo sapien
ggaagagaaatcaaacggcaccgtc

SEQ ID NO: 157737 - DNA, 25 bp, Homo sapien
tctgggatgacaagactgatggttc

SEQ ID NO: 157738 - DNA, 25 bp, Homo sapien
ctgatggttcctaacccaggccggg

SEQ ID NO: 157739 - DNA, 25 bp, Homo sapien
gccggggcaacgcatgacttttgac

SEQ ID NO: 157740 - DNA, 25 bp, Homo sapien
ttgacgcctcggagaagcccttcct

SEQ ID NO: 157741 - DNA, 25 bp, Homo sapien
ttccttcctggactgtattctgaca

SEQ ID NO: 157742 - DNA, 25 bp, Homo sapien
gacagggagtgcgtctcacgcttta

SEQ ID NO: 157743 - DNA, 25 bp, Homo sapien
tggtgacgccgtttctcccgagtag

SEQ ID NO: 157744 - DNA, 25 bp, Homo sapien
ctggtgacgccgtttctcccgagta

SEQ ID NO: 157745 - DNA, 25 bp, Homo sapien
gagtgacgccgtttctcccgagtag

SEQ ID NO: 157746 - DNA, 25 bp, Homo sapien
agtgacgccgtttctcccgagtagc

SEQ ID NO: 157747 - DNA, 25 bp, Homo sapien
gctggtgacgccgtttctcccgagt

SEQ ID NO: 157748 - DNA, 25 bp, Homo sapien
gtagctgagtgacgccgtttctccc

SEQ ID NO: 157749 - DNA, 25 bp, Homo sapien
cagagtagctgagtgacgccgtttc

SEQ ID NO: 157750 - DNA, 25 bp, Homo sapien
ccagagtagctgagtgacgccgttt

SEQ ID NO: 157751 - DNA, 25 bp, Homo sapien
gcccacggctctgcgacagaataga

SEQ ID NO: 157752 - DNA, 25 bp, Homo sapien
cttcccgtaagaacacccgtgtctg

SEQ ID NO: 157753 - DNA, 25 bp, Homo sapien
gctgcgcctcagaacacaacttgtt

SEQ ID NO: 157754 - DNA, 25 bp, Homo sapien
cagccaggagctcgatctttgcttc

SEQ ID NO: 157755 - DNA, 25 bp, Homo sapien
ctctatagtggcctcacggtctcca

SEQ ID NO: 157756 - DNA, 25 bp, Homo sapien
agccagcatccgtggtctctctata

SEQ ID NO: 157757 - DNA, 25 bp, Homo sapien
gggagccgtgcaaacaccataaatc

SEQ ID NO: 157758 - DNA, 25 bp, Homo sapien
acgccgcgtggcttgttctgaagcc

SEQ ID NO: 157759 - DNA, 25 bp, Homo sapien
ccgggtcccaagctgtgcagaaaag

SEQ ID NO: 157760 - DNA, 25 bp, Homo sapien
atcagccgcgtttcactttgcaccg

SEQ ID NO: 157761 - DNA, 25 bp, Homo sapien
gacatattttctcttcggccacagg

SEQ ID NO: 157762 - DNA, 25 bp, Homo sapien
cgttgtcggaccctttgctgagttt

SEQ ID NO: 157763 - DNA, 25 bp, Homo sapien
ggggctcaggtctttacattcatcc

SEQ ID NO: 157764 - DNA, 25 bp, Homo sapien
aactgacgtcgtgaaacctttgctc

SEQ ID NO: 157765 - DNA, 25 bp, Homo sapien
tgctcgactgtgtttctgacgctcc

SEQ ID NO: 157766 - DNA, 25 bp, Homo sapien
tggtctagcccaggagaggaaaatc

SEQ ID NO: 157767 - DNA, 25 bp, Homo sapien
cactgcgtctgcagcgttctggctt

SEQ ID NO: 157768 - DNA, 25 bp, Homo sapien
gccgggcagcaatcgcgaatttgta

SEQ ID NO: 157769 - DNA, 25 bp, Homo sapien
gccacatcgggtgtccactgcgtct

SEQ ID NO: 157770 - DNA, 25 bp, Homo sapien
ggccgtatgaggcttggccacatcg

SEQ ID NO: 157771 - DNA, 25 bp, Homo sapien
gaggcaaggtgatacgccttgaccc

SEQ ID NO: 157772 - DNA, 25 bp, Homo sapien
ctctgcgtcgatagaggcaaggtga

SEQ ID NO: 157773 - DNA, 25 bp, Homo sapien
tcctgtaccggctgcatccggagca

SEQ ID NO: 157774 - DNA, 25 bp, Homo sapien
atttgtagagactaaggggcctccg

SEQ ID NO: 157775 - DNA, 25 bp, Homo sapien
cggcagaggcggtttcattttgtgc

SEQ ID NO: 157776 - DNA, 25 bp, Homo sapien
ccgggcttcgtttccactttctgtg

SEQ ID NO: 157777 - DNA, 25 bp, Homo sapien
tgagtcttactcagcgtgcttgagc

SEQ ID NO: 157778 - DNA, 25 bp, Homo sapien
ggatgacaccttgggccgttctgtt

SEQ ID NO: 157779 - DNA, 25 bp, Homo sapien
tcccgttcaccggtcaagacgctga

SEQ ID NO: 157780 - DNA, 25 bp, Homo sapien
cttgagccgaaatgtcaccagctgc

SEQ ID NO: 157781 - DNA, 25 bp, Homo sapien
tttgtgctttgagacggccgttttg

SEQ ID NO: 157782 - DNA, 25 bp, Homo sapien
agacgctgaaactcgggagcttttg

SEQ ID NO: 157783 - DNA, 25 bp, Homo sapien
taaatccatcaagggtgcgtcctgg

SEQ ID NO: 157784 - DNA, 25 bp, Homo sapien
cgggccgcctttgtagacaacgcca

SEQ ID NO: 157785 - DNA, 25 bp, Homo sapien
cgacgtgcttcatctaccacgaggc

SEQ ID NO: 157786 - DNA, 25 bp, Homo sapien
cggcttccggaatatgcggcaactt

SEQ ID NO: 157787 - DNA, 25 bp, Homo sapien
gtcaggacatgacacgtggagcgtc

SEQ ID NO: 157788 - DNA, 25 bp, Homo sapien
tgctgtttgatttccgacgtgagtc

SEQ ID NO: 157789 - DNA, 25 bp, Homo sapien
cgtgagtctataggtgaggctgaca

SEQ ID NO: 157790 - DNA, 25 bp, Homo sapien
ggcgcgttgtctgggtaaatccatc

SEQ ID NO: 157791 - DNA, 25 bp, Homo sapien
ggagccctggttcacccagcaccgt

SEQ ID NO: 157792 - DNA, 25 bp, Homo sapien
agtccctcggggcaatgatttaatg

SEQ ID NO: 157793 - DNA, 25 bp, Homo sapien
gtaccagcgcgcgttgccagagtga

SEQ ID NO: 157794 - DNA, 25 bp, Homo sapien
agtcagccgggcctgtcagcttcgg

SEQ ID NO: 157795 - DNA, 25 bp, Homo sapien
tcatgtcgacgaccggtccacacgg

SEQ ID NO: 157796 - DNA, 25 bp, Homo sapien
tatgacacatcatgtcgacgaccgg

SEQ ID NO: 157797 - DNA, 25 bp, Homo sapien
tgtcagcttcggaggccaaattatg

SEQ ID NO: 157798 - DNA, 25 bp, Homo sapien
ttcggaggccaaattatgacacatc

SEQ ID NO: 157799 - DNA, 25 bp, Homo sapien
tctaggtcccagtccgagatgtagc

SEQ ID NO: 157800 - DNA, 25 bp, Homo sapien
gaagagcaattccacgtggcagccg

SEQ ID NO: 157801 - DNA, 25 bp, Homo sapien
ccacatgtcgggcacagtcgtagca

SEQ ID NO: 157802 - DNA, 25 bp, Homo sapien
cctcgcagaaagtcggccacatgtc

SEQ ID NO: 157803 - DNA, 25 bp, Homo sapien
gcgcggtgaagatcctcagactgag

SEQ ID NO: 157804 - DNA, 25 bp, Homo sapien
gcggaaggccctttcgcacctttga

SEQ ID NO: 157805 - DNA, 25 bp, Homo sapien
ccttgcggtcctcacagaagtagag

SEQ ID NO: 157806 - DNA, 25 bp, Homo sapien
gcacctttgaaggtcatgatggcta

SEQ ID NO: 157807 - DNA, 25 bp, Homo sapien
gccgcgtgagagtgttgcttatatc

SEQ ID NO: 157808 - DNA, 25 bp, Homo sapien
tcgaaaccgtcttcagcccagaagg

SEQ ID NO: 157809 - DNA, 25 bp, Homo sapien
ggtcactcgtggcaataatggtctc

SEQ ID NO: 157810 - DNA, 25 bp, Homo sapien
ggtctcgttagacacgccatccatc

SEQ ID NO: 157811 - DNA, 25 bp, Homo sapien
atcgcaatttagagcccgcgtttca

SEQ ID NO: 157812 - DNA, 25 bp, Homo sapien
ttcatgccgggctggtttaatcacc

SEQ ID NO: 157813 - DNA, 25 bp, Homo sapien
tgaagggcctcattcgcctgggatt

SEQ ID NO: 157814 - DNA, 25 bp, Homo sapien
ttgcgtgatttagcagacgtgaccc

SEQ ID NO: 157815 - DNA, 25 bp, Homo sapien
ctggggatgtctttttgattttgtc

SEQ ID NO: 157816 - DNA, 25 bp, Homo sapien
tgattttgtcgttaggaagccgtac

SEQ ID NO: 157817 - DNA, 25 bp, Homo sapien
caaagctcagcgaagtgggctcggc

SEQ ID NO: 157818 - DNA, 25 bp, Homo sapien
cgaaggctcgtaggcaaagctcagc

SEQ ID NO: 157819 - DNA, 25 bp, Homo sapien
ctgcgttggtcgctaacgaaggctc

SEQ ID NO: 157820 - DNA, 25 bp, Homo sapien
ctgaatcattccaaagggaaccggg

SEQ ID NO: 157821 - DNA, 25 bp, Homo sapien
cggggtgacacgcagctgaatcatt

SEQ ID NO: 157822 - DNA, 25 bp, Homo sapien
aagccgtaccgtagtctctccgagg

SEQ ID NO: 157823 - DNA, 25 bp, Homo sapien
tcgaggcttgatcttggcgaaagct

SEQ ID NO: 157824 - DNA, 25 bp, Homo sapien
tccataaaaaccactcccgtgagcg

SEQ ID NO: 157825 - DNA, 25 bp, Homo sapien
gcgaaagctgttgggtccataaaaa

SEQ ID NO: 157826 - DNA, 25 bp, Homo sapien
ggcgcgtcctaagtcaaggttgtca

SEQ ID NO: 157827 - DNA, 25 bp, Homo sapien
ggaacccttcattattatttcattg

SEQ ID NO: 157828 - DNA, 25 bp, Homo sapien
ggtcagctcggttctgtttccttta

SEQ ID NO: 157829 - DNA, 25 bp, Homo sapien
agatcacgggaagactcgaggctgc

SEQ ID NO: 157830 - DNA, 25 bp, Homo sapien
ttcctttgaacgtcgaggcttgatc

SEQ ID NO: 157831 - DNA, 25 bp, Homo sapien
tccggagcacttgttacgggagccc

SEQ ID NO: 157832 - DNA, 25 bp, Homo sapien
cggaccgcctgagtccggagcactt

SEQ ID NO: 157833 - DNA, 25 bp, Homo sapien
cgggctggacacatcttcaaggttc

SEQ ID NO: 157834 - DNA, 25 bp, Homo sapien
catctttaacctcggtgggaagctc

SEQ ID NO: 157835 - DNA, 25 bp, Homo sapien
ggttttctgccgagagtccctcctg

SEQ ID NO: 157836 - DNA, 25 bp, Homo sapien
cgcgggcgagagctcatctttaacc

SEQ ID NO: 157837 - DNA, 25 bp, Homo sapien
cacatcttcaaggttccgtaagggt

SEQ ID NO: 157838 - DNA, 25 bp, Homo sapien
ggctacgacaacctctacgtgacct

SEQ ID NO: 157839 - DNA, 25 bp, Homo sapien
agcgactcttcgacgagacccatta

SEQ ID NO: 157840 - DNA, 25 bp, Homo sapien
cgcggttctgctgttctgctgagaa

SEQ ID NO: 157841 - DNA, 25 bp, Homo sapien
gcattcaggtactcagacgcggttc

SEQ ID NO: 157842 - DNA, 25 bp, Homo sapien
cccacgcagggatttatgaatgcaa

SEQ ID NO: 157843 - DNA, 25 bp, Homo sapien
gggatcccacagttggcagctcttc

SEQ ID NO: 157844 - DNA, 25 bp, Homo sapien
caaagcgcattggttttcgagggcc

SEQ ID NO: 157845 - DNA, 25 bp, Homo sapien
agcgtctctccgtaggcctagaatc

SEQ ID NO: 157846 - DNA, 25 bp, Homo sapien
cgctcgtgcaaagcccaggtttttg

SEQ ID NO: 157847 - DNA, 25 bp, Homo sapien
tgaaattaggccgttggagcccgca

SEQ ID NO: 157848 - DNA, 25 bp, Homo sapien
tcgcggagcccaagcttcccaaggg

SEQ ID NO: 157849 - DNA, 25 bp, Homo sapien
tctcctgggtacctggccttgaggt

SEQ ID NO: 157850 - DNA, 25 bp, Homo sapien
gaacgagcctacttcttgtaccgtc

SEQ ID NO: 157851 - DNA, 25 bp, Homo sapien
tcttgtaccgtcttttgccgacggc

SEQ ID NO: 157852 - DNA, 25 bp, Homo sapien
tgccgacggcgggacccagtgaaat

SEQ ID NO: 157853 - DNA, 25 bp, Homo sapien
ggagcgcggaaggtataaacgtata

SEQ ID NO: 157854 - DNA, 25 bp, Homo sapien
cgttttattccaaggggacaggctg

SEQ ID NO: 157855 - DNA, 25 bp, Homo sapien
ttcagcggaatggatcccccgatta

SEQ ID NO: 157856 - DNA, 25 bp, Homo sapien
tgtcagatccgctcggcagtgctcg

SEQ ID NO: 157857 - DNA, 25 bp, Homo sapien
ccatccgtttccctttctcagtgaa

SEQ ID NO: 157858 - DNA, 25 bp, Homo sapien
cctttctcagtgaagacggtttggg

SEQ ID NO: 157859 - DNA, 25 bp, Homo sapien
ggctctcgacgcaggtgtcagatcc

SEQ ID NO: 157860 - DNA, 25 bp, Homo sapien
cgacccaggtgagcggtacgaccgc

SEQ ID NO: 157861 - DNA, 25 bp, Homo sapien
acgaccgctgttgccctcgggtgta

SEQ ID NO: 157862 - DNA, 25 bp, Homo sapien
cgcgcgcgatccatcgcctctcttc

SEQ ID NO: 157863 - DNA, 25 bp, Homo sapien
acctgcggctcaaggcgcggaagca

SEQ ID NO: 157864 - DNA, 25 bp, Homo sapien
ctccctaggggagaagaggcacgtt

SEQ ID NO: 157865 - DNA, 25 bp, Homo sapien
tttgcagggagctgttcggattccc

SEQ ID NO: 157866 - DNA, 25 bp, Homo sapien
cgaagagagcgcatcgggagctccc

SEQ ID NO: 157867 - DNA, 25 bp, Homo sapien
gccgccaaaagcaacagcaagaatt

SEQ ID NO: 157868 - DNA, 25 bp, Homo sapien
cagaccctcgcggagatggtgcaga

SEQ ID NO: 157869 - DNA, 25 bp, Homo sapien
cctgagggcgttccatttgtggacc

SEQ ID NO: 157870 - DNA, 25 bp, Homo sapien
gcatccagtggcagcgccaattctg

SEQ ID NO: 157871 - DNA, 25 bp, Homo sapien
tcccatctgtttgggtggccgtgcc

SEQ ID NO: 157872 - DNA, 25 bp, Homo sapien
cccagcactctgttgttcacgcaag

SEQ ID NO: 157873 - DNA, 25 bp, Homo sapien
cgtctgcatctgtctcgaaccttca

SEQ ID NO: 157874 - DNA, 25 bp, Homo sapien
cgaaccttcacagctttgcagaata

SEQ ID NO: 157875 - DNA, 25 bp, Homo sapien
gcagaatatcctgtttctcaatacg

SEQ ID NO: 157876 - DNA, 25 bp, Homo sapien
atacggatggagaaacacgagacgc

SEQ ID NO: 157877 - DNA, 25 bp, Homo sapien
cacgagacgcgttttctgggttatt

SEQ ID NO: 157878 - DNA, 25 bp, Homo sapien
gccttttaaaatcttcccagcactc

SEQ ID NO: 157879 - DNA, 25 bp, Homo sapien
ggcgtcaacagtacgagtgtcttca

SEQ ID NO: 157880 - DNA, 25 bp, Homo sapien
cggatgctcagggaacacgtatcgg

SEQ ID NO: 157881 - DNA, 25 bp, Homo sapien
ggttctcaaagttcccacatcctgg

SEQ ID NO: 157882 - DNA, 25 bp, Homo sapien
tcgggtgtcgtttcgatgacatctc

SEQ ID NO: 157883 - DNA, 25 bp, Homo sapien
gtcttcactacaaaacggatgctca

SEQ ID NO: 157884 - DNA, 25 bp, Homo sapien
ggacgtccagtacgacctgtacttg

SEQ ID NO: 157885 - DNA, 25 bp, Homo sapien
tgaacgttgccaagtaggtgtgccc

SEQ ID NO: 157886 - DNA, 25 bp, Homo sapien
tctcgactctccagcggttctcaaa

SEQ ID NO: 157887 - DNA, 25 bp, Homo sapien
ttctcgaaggttgatggtccgcacg

SEQ ID NO: 157888 - DNA, 25 bp, Homo sapien
gtgatcaagacacggaatcggctgc

SEQ ID NO: 157889 - DNA, 25 bp, Homo sapien
ctgccgatggttggatcgcaatgcg

SEQ ID NO: 157890 - DNA, 25 bp, Homo sapien
tggtccgcacggttgaggattctac

SEQ ID NO: 157891 - DNA, 25 bp, Homo sapien
cgcggcccttagatcaccttcttga

SEQ ID NO: 157892 - DNA, 25 bp, Homo sapien
gacgttggaccacgcacccttgaag

SEQ ID NO: 157893 - DNA, 25 bp, Homo sapien
accacgcacccttgaagaaggcctt

SEQ ID NO: 157894 - DNA, 25 bp, Homo sapien
aatcggctgccgatggttggatcgc

SEQ ID NO: 157895 - DNA, 25 bp, Homo sapien
aaagtcagctcggttgtggctgccg

SEQ ID NO: 157896 - DNA, 25 bp, Homo sapien
cacagccttggaactgatcgcagca

SEQ ID NO: 157897 - DNA, 25 bp, Homo sapien
gtcgggttcacagcgggcaataaag

SEQ ID NO: 157898 - DNA, 25 bp, Homo sapien
cagcgggcaataaaggcagccgttc

SEQ ID NO: 157899 - DNA, 25 bp, Homo sapien
ggcagccgttcttcaaagtcagctc

SEQ ID NO: 157900 - DNA, 25 bp, Homo sapien
ggaactgatcgcagcatcccggctc

SEQ ID NO: 157901 - DNA, 25 bp, Homo sapien
gtaacacggtgtttcggccacagcc

SEQ ID NO: 157902 - DNA, 25 bp, Homo sapien
cattcccgcagcagcgtcgggttca

SEQ ID NO: 157903 - DNA, 25 bp, Homo sapien
ccctgaggtggtgccgagctcttcc

SEQ ID NO: 157904 - DNA, 25 bp, Homo sapien
gggaacggcacgtcaccgtctccag

SEQ ID NO: 157905 - DNA, 25 bp, Homo sapien
atgcctgcgcgggaacggcacgtca

SEQ ID NO: 157906 - DNA, 25 bp, Homo sapien
tgtcgaaggggtaggacaccacgcc

SEQ ID NO: 157907 - DNA, 25 bp, Homo sapien
tccacgtggctgctcagtgccagct

SEQ ID NO: 157908 - DNA, 25 bp, Homo sapien
gctgctcagtgccagctgacgttta

SEQ ID NO: 157909 - DNA, 25 bp, Homo sapien
agtgccagctgacgtttacaacacg

SEQ ID NO: 157910 - DNA, 25 bp, Homo sapien
ctgacgtttacaacacgagaggtcg

SEQ ID NO: 157911 - DNA, 25 bp, Homo sapien
caggaagtgacaggcccggagcgag

SEQ ID NO: 157912 - DNA, 25 bp, Homo sapien
ccaccttctcggccgggcaggaagt

SEQ ID NO: 157913 - DNA, 25 bp, Homo sapien
ggcgactggggaccccggcacatga

SEQ ID NO: 157914 - DNA, 25 bp, Homo sapien
gccaggcgagaaggtaaccgggcga

SEQ ID NO: 157915 - DNA, 25 bp, Homo sapien
cccgggagctgcgtcgccatggcaa

SEQ ID NO: 157916 - DNA, 25 bp, Homo sapien
ccggggaagacttgggtgcacagcc

SEQ ID NO: 157917 - DNA, 25 bp, Homo sapien
cccggggaagacttgggtgcacagc

SEQ ID NO: 157918 - DNA, 25 bp, Homo sapien
gaccccggcacatgaggtggacgcc

SEQ ID NO: 157919 - DNA, 25 bp, Homo sapien
ggtacacgaagcagagggaggtcgc

SEQ ID NO: 157920 - DNA, 25 bp, Homo sapien
ttctggcgaaatccagcgggtacac

SEQ ID NO: 157921 - DNA, 25 bp, Homo sapien
ggttctggcgaaatccagcgggtac

SEQ ID NO: 157922 - DNA, 25 bp, Homo sapien
cgcccggtagatgatgatgccctgc

SEQ ID NO: 157923 - DNA, 25 bp, Homo sapien
gccgcccggtagatgatgatgccct

SEQ ID NO: 157924 - DNA, 25 bp, Homo sapien
aggccgcccggtagatgatgatgcc

SEQ ID NO: 157925 - DNA, 25 bp, Homo sapien
cacgccgaagtaggccgcccggtag

SEQ ID NO: 157926 - DNA, 25 bp, Homo sapien
atcgtacacgccgaagtaggccgcc

SEQ ID NO: 157927 - DNA, 25 bp, Homo sapien
ttgacccgctcgatcggagccacgg

SEQ ID NO: 157928 - DNA, 25 bp, Homo sapien
ccgcctggaccgaaaggacggagca

SEQ ID NO: 157929 - DNA, 25 bp, Homo sapien
tttcaacactctccggggtcgtgcg

SEQ ID NO: 157930 - DNA, 25 bp, Homo sapien
cggcagccttgaccttgtgaaggtc

SEQ ID NO: 157931 - DNA, 25 bp, Homo sapien
ctgcggagtcagaagcccaccctga

SEQ ID NO: 157932 - DNA, 25 bp, Homo sapien
gcccagttcgctccgagtgcgtcgt

SEQ ID NO: 157933 - DNA, 25 bp, Homo sapien
gtgcgtcgtccgctttctcccggag

SEQ ID NO: 157934 - DNA, 25 bp, Homo sapien
gatgcctccggccaagaagtctttg

SEQ ID NO: 157935 - DNA, 25 bp, Homo sapien
cttggacagacaccgccatcttgga

SEQ ID NO: 157936 - DNA, 25 bp, Homo sapien
ccatcttggccatcgtggacacaca

SEQ ID NO: 157937 - DNA, 25 bp, Homo sapien
cgtggacacacactgccatctggga

SEQ ID NO: 157938 - DNA, 25 bp, Homo sapien
atcttggacacacaccgccatcttg

SEQ ID NO: 157939 - DNA, 25 bp, Homo sapien
tcttggacacacaccgccatcatgg

SEQ ID NO: 157940 - DNA, 25 bp, Homo sapien
gacagacaccgccatcgtggacaga

SEQ ID NO: 157941 - DNA, 25 bp, Homo sapien
tgccatcttggccatcgtggacaca

SEQ ID NO: 157942 - DNA, 25 bp, Homo sapien
tcgtggacacacactgccatcttgg

SEQ ID NO: 157943 - DNA, 25 bp, Homo sapien
aatcaccgggcacagcaccatggcg

SEQ ID NO: 157944 - DNA, 25 bp, Homo sapien
gtgcagcagcttcccaatcaccggg

SEQ ID NO: 157945 - DNA, 25 bp, Homo sapien
cgcttgtgcagcagcttcccaatca

SEQ ID NO: 157946 - DNA, 25 bp, Homo sapien
ttgctgaggatctcctgacggcgtg

SEQ ID NO: 157947 - DNA, 25 bp, Homo sapien
taccgcgttgctgaggatctcctga

SEQ ID NO: 157948 - DNA, 25 bp, Homo sapien
aggcccaggccgtaccgcgttgctg

SEQ ID NO: 157949 - DNA, 25 bp, Homo sapien
ggcgtccgcacttctgagcccggag

SEQ ID NO: 157950 - DNA, 25 bp, Homo sapien
gcagcgcggctgcaaaaaaaacagg

SEQ ID NO: 157951 - DNA, 25 bp, Homo sapien
tgcaagctgtgtgcgctcttcccac

SEQ ID NO: 157952 - DNA, 25 bp, Homo sapien
cctttgcaagctgtgtgcgctcttc

SEQ ID NO: 157953 - DNA, 25 bp, Homo sapien
tcccaccacctccaggcggtgcacg

SEQ ID NO: 157954 - DNA, 25 bp, Homo sapien
cctgggacgaggactccagaggctt

SEQ ID NO: 157955 - DNA, 25 bp, Homo sapien
cgaggactccagaggcttctgtgga

SEQ ID NO: 157956 - DNA, 25 bp, Homo sapien
ctccagaggcttctgtggaatctgc

SEQ ID NO: 157957 - DNA, 25 bp, Homo sapien
atctgccgctgccttccaaggccgg

SEQ ID NO: 157958 - DNA, 25 bp, Homo sapien
tgcccctgctatcctttgaccttgg

SEQ ID NO: 157959 - DNA, 25 bp, Homo sapien
cgcggcatgtgaccatagaaccatt

SEQ ID NO: 157960 - DNA, 25 bp, Homo sapien
gtgatgtgcgtcctggctttcttaa

SEQ ID NO: 157961 - DNA, 25 bp, Homo sapien
cgggctccctgataatcttaaactc

SEQ ID NO: 157962 - DNA, 25 bp, Homo sapien
agctccaatcactatcgaggttgtc

SEQ ID NO: 157963 - DNA, 25 bp, Homo sapien
gcctttctttcaatggggtcccaga

SEQ ID NO: 157964 - DNA, 25 bp, Homo sapien
tagttctcacgctaggtctcctccg

SEQ ID NO: 157965 - DNA, 25 bp, Homo sapien
cgcgtggaagcttcgagtctcgact

SEQ ID NO: 157966 - DNA, 25 bp, Homo sapien
ccggtcccagagctagtttcagagg

SEQ ID NO: 157967 - DNA, 25 bp, Homo sapien
cgcgtgagctgtgcgaggatttttc

SEQ ID NO: 157968 - DNA, 25 bp, Homo sapien
tccacataaacccagcgtggcgtgg

SEQ ID NO: 157969 - DNA, 25 bp, Homo sapien
tgctccacataaacccagcgtggcg

SEQ ID NO: 157970 - DNA, 25 bp, Homo sapien
gctgtgcgaggatttttcttaaacc

SEQ ID NO: 157971 - DNA, 25 bp, Homo sapien
gagctgtgcgaggatttttcttaaa

SEQ ID NO: 157972 - DNA, 25 bp, Homo sapien
cgtgagctgtgcgaggatttttctt

SEQ ID NO: 157973 - DNA, 25 bp, Homo sapien
ctaaacggagcccacctccagggca

SEQ ID NO: 157974 - DNA, 25 bp, Homo sapien
tgagctgtgcgaggatttttcttaa

SEQ ID NO: 157975 - DNA, 25 bp, Homo sapien
acgccttcacgatgtccttgccata

SEQ ID NO: 157976 - DNA, 25 bp, Homo sapien
tctcctggtaggtcttggaaagctc

SEQ ID NO: 157977 - DNA, 25 bp, Homo sapien
aagctccttggcgatgacctccttg

SEQ ID NO: 157978 - DNA, 25 bp, Homo sapien
aggtggccacgttgagaaacatgtc

SEQ ID NO: 157979 - DNA, 25 bp, Homo sapien
ccgtgttctcttcgggcacctcgaa

SEQ ID NO: 157980 - DNA, 25 bp, Homo sapien
gcgatgacgaactgctgctccttga

SEQ ID NO: 157981 - DNA, 25 bp, Homo sapien
taggcgcggttctgattctcactcc

SEQ ID NO: 157982 - DNA, 25 bp, Homo sapien
tggttgttgctgtcctccaccaaga

SEQ ID NO: 157983 - DNA, 25 bp, Homo sapien
gcctacatccgctccgccgcgacgc

SEQ ID NO: 157984 - DNA, 25 bp, Homo sapien
cctcgggcctacatccgctccgccg

SEQ ID NO: 157985 - DNA, 25 bp, Homo sapien
cgcagctgcagtcgcgccagccctc

SEQ ID NO: 157986 - DNA, 25 bp, Homo sapien
cgcggctcacaaactagggagggga

SEQ ID NO: 157987 - DNA, 25 bp, Homo sapien
gctccgccgcgacgcggctcacaaa

SEQ ID NO: 157988 - DNA, 25 bp, Homo sapien
ggtcgcagctgcagtcgcgccagcc

SEQ ID NO: 157989 - DNA, 25 bp, Homo sapien
agggtggcgttcctgagtccgcgga

SEQ ID NO: 157990 - DNA, 25 bp, Homo sapien
tgagtccgcggaggaaagggtcgca

SEQ ID NO: 157991 - DNA, 25 bp, Homo sapien
cctcctgtgaccctcagcgaccctc

SEQ ID NO: 157992 - DNA, 25 bp, Homo sapien
tggagactctgcaccgtcgcggcct

SEQ ID NO: 157993 - DNA, 25 bp, Homo sapien
ggccaccgagggctccaggagcacc

SEQ ID NO: 157994 - DNA, 25 bp, Homo sapien
ctgtctggagactctgcaccgtcgc

SEQ ID NO: 157995 - DNA, 25 bp, Homo sapien
ccctcagcgaccctcctgtcctgcc

SEQ ID NO: 157996 - DNA, 25 bp, Homo sapien
tgcggagcgcaggaaccttcacctc

SEQ ID NO: 157997 - DNA, 25 bp, Homo sapien
cgcggctgtctggagactctgcacc

SEQ ID NO: 157998 - DNA, 25 bp, Homo sapien
aggcccgttcttctggcccacagcg

SEQ ID NO: 157999 - DNA, 25 bp, Homo sapien
gcgacggttttaaacaaggcagctc

SEQ ID NO: 158000 - DNA, 25 bp, Homo sapien
aggcagctcggaacagagcagcttc

SEQ ID NO: 158001 - DNA, 25 bp, Homo sapien
cagcttcgggaatcgcacctgcaga

SEQ ID NO: 158002 - DNA, 25 bp, Homo sapien
cgcacctgcagaatgagatcacgta

SEQ ID NO: 158003 - DNA, 25 bp, Homo sapien
agatcacgtagcctccggtctcggc

SEQ ID NO: 158004 - DNA, 25 bp, Homo sapien
acgcaggtgtgctctgagcccgtca

SEQ ID NO: 158005 - DNA, 25 bp, Homo sapien
cccatgctgttgaaacccgggtccg

SEQ ID NO: 158006 - DNA, 25 bp, Homo sapien
gggctcccagctttgtgcctctgtt

SEQ ID NO: 158007 - DNA, 25 bp, Homo sapien
ttaatccgactgcagcgatgccgca

SEQ ID NO: 158008 - DNA, 25 bp, Homo sapien
acatacaggtttgcgagtgagcacg

SEQ ID NO: 158009 - DNA, 25 bp, Homo sapien
gcgatgccgcacgtgtcaacataca

SEQ ID NO: 158010 - DNA, 25 bp, Homo sapien
cgctttcaaccaaagggcactgggg

SEQ ID NO: 158011 - DNA, 25 bp, Homo sapien
cttccttgcgggtcacttttgcaga

SEQ ID NO: 158012 - DNA, 25 bp, Homo sapien
acctagcgcaggaatacgctctttc

SEQ ID NO: 158013 - DNA, 25 bp, Homo sapien
ggcagctccgctttcaaccaaaggg

SEQ ID NO: 158014 - DNA, 25 bp, Homo sapien
cgctctttcttccacgttaatccga

SEQ ID NO: 158015 - DNA, 25 bp, Homo sapien
cccggtactactgaatcgtccagtt

SEQ ID NO: 158016 - DNA, 25 bp, Homo sapien
gtgtggcgcttcatcacgcctgcca

SEQ ID NO: 158017 - DNA, 25 bp, Homo sapien
actacacctgataccctgcggccca

SEQ ID NO: 158018 - DNA, 25 bp, Homo sapien
ctatggagaggtacagcgtccagtt

SEQ ID NO: 158019 - DNA, 25 bp, Homo sapien
tcttaagtgtagtttcggggccgca

SEQ ID NO: 158020 - DNA, 25 bp, Homo sapien
ataaagtggcgtcgcacaggagcga

SEQ ID NO: 158021 - DNA, 25 bp, Homo sapien
cgagggactcttaagtgtagtttcg

SEQ ID NO: 158022 - DNA, 25 bp, Homo sapien
cgtccagtttaagagggataaagtg

SEQ ID NO: 158023 - DNA, 25 bp, Homo sapien
aattcggttatgatccttgaggcgg

SEQ ID NO: 158024 - DNA, 25 bp, Homo sapien
ctgctgggcctattttcgctatgta

SEQ ID NO: 158025 - DNA, 25 bp, Homo sapien
cccgtttgtccggaaggcagttgat

SEQ ID NO: 158026 - DNA, 25 bp, Homo sapien
tgattatccagttgccctgagcggc

SEQ ID NO: 158027 - DNA, 25 bp, Homo sapien
ccgcagttaggcctagtgattatcc

SEQ ID NO: 158028 - DNA, 25 bp, Homo sapien
agtgcgcgcgcagtaacctgtttgt

SEQ ID NO: 158029 - DNA, 25 bp, Homo sapien
cgttgtgacggaaactccagctgcc

SEQ ID NO: 158030 - DNA, 25 bp, Homo sapien
cggcccttgcctttgtcgccatatg

SEQ ID NO: 158031 - DNA, 25 bp, Homo sapien
ccaggccggagaaccctgttcttca

SEQ ID NO: 158032 - DNA, 25 bp, Homo sapien
gagcgcctttgcctaccaggccgga

SEQ ID NO: 158033 - DNA, 25 bp, Homo sapien
agttcccaaaagctgagtcccgctg

SEQ ID NO: 158034 - DNA, 25 bp, Homo sapien
ctccctcgactaaattaagaattgc

SEQ ID NO: 158035 - DNA, 25 bp, Homo sapien
cgagagatggatgcgctaaggtcta

SEQ ID NO: 158036 - DNA, 25 bp, Homo sapien
ttcttcagtcgccttggcaggggca

SEQ ID NO: 158037 - DNA, 25 bp, Homo sapien
ccttctggcaatgatgtcagctgca

SEQ ID NO: 158038 - DNA, 25 bp, Homo sapien
tcgctcctcagaggcgcgctaaggc

SEQ ID NO: 158039 - DNA, 25 bp, Homo sapien
gctcgtgatctgctcccggaggcgc

SEQ ID NO: 158040 - DNA, 25 bp, Homo sapien
ggccacgggaagaacttgcagcgac

SEQ ID NO: 158041 - DNA, 25 bp, Homo sapien
gcggagcggtgttcgcacacaaagc

SEQ ID NO: 158042 - DNA, 25 bp, Homo sapien
gttcgcacacaaagcgctggggctg

SEQ ID NO: 158043 - DNA, 25 bp, Homo sapien
gtcttcagggtcctcccggcactgg

SEQ ID NO: 158044 - DNA, 25 bp, Homo sapien
tgaccgccgagctagacgcgcctga

SEQ ID NO: 158045 - DNA, 25 bp, Homo sapien
ccagggctcgtgatctgctcccgga

SEQ ID NO: 158046 - DNA, 25 bp, Homo sapien
agaacttgcagcgacgtcatccctg

SEQ ID NO: 158047 - DNA, 25 bp, Homo sapien
gatctgcaatattccttatgtacca

SEQ ID NO: 158048 - DNA, 25 bp, Homo sapien
ctagcctacagtgcagacgaattcc

SEQ ID NO: 158049 - DNA, 25 bp, Homo sapien
gacgaattccacctctgcacaagca

SEQ ID NO: 158050 - DNA, 25 bp, Homo sapien
agcaggtgactttcctcccacatac

SEQ ID NO: 158051 - DNA, 25 bp, Homo sapien
tattccttatgtaccatctacctgg

SEQ ID NO: 158052 - DNA, 25 bp, Homo sapien
tgccagggttctagcctacagtgca

SEQ ID NO: 158053 - DNA, 25 bp, Homo sapien
gagagtacatgccagggttctagcc

SEQ ID NO: 158054 - DNA, 25 bp, Homo sapien
tctgcacaagcaggtgactttcctc

SEQ ID NO: 158055 - DNA, 25 bp, Homo sapien
agtcgtcgcctctagaggccagaac

SEQ ID NO: 158056 - DNA, 25 bp, Homo sapien
ttgcagacctagaggctcccgcacg

SEQ ID NO: 158057 - DNA, 25 bp, Homo sapien
gccgtcgatatcctgcgtgcacaca

SEQ ID NO: 158058 - DNA, 25 bp, Homo sapien
tatgccctaggcacaccggagacca

SEQ ID NO: 158059 - DNA, 25 bp, Homo sapien
aagtgcctctcgtcctatgccctag

SEQ ID NO: 158060 - DNA, 25 bp, Homo sapien
tccggggagcattccaaagtgcctc

SEQ ID NO: 158061 - DNA, 25 bp, Homo sapien
ccggcaagcgctctcgcaggtcgag

SEQ ID NO: 158062 - DNA, 25 bp, Homo sapien
ttatgcttgggtggaagtcgtcgcc

SEQ ID NO: 158063 - DNA, 25 bp, Homo sapien
acagaaagggcagcgcagggttcct

SEQ ID NO: 158064 - DNA, 25 bp, Homo sapien
tcagggtgcaccgtcttcactctgc

SEQ ID NO: 158065 - DNA, 25 bp, Homo sapien
ctccaggtgccctttgagtgcagtc

SEQ ID NO: 158066 - DNA, 25 bp, Homo sapien
ccctttgagtgcagtccgttaggtg

SEQ ID NO: 158067 - DNA, 25 bp, Homo sapien
ccacccacaggctacagaaagggca

SEQ ID NO: 158068 - DNA, 25 bp, Homo sapien
cctgtgctatgggtcgggctgcaca

SEQ ID NO: 158069 - DNA, 25 bp, Homo sapien
gagtccggagaaggacaccgtcttc

SEQ ID NO: 158070 - DNA, 25 bp, Homo sapien
gacaccgtcttcagggtgcaccgtc

SEQ ID NO: 158071 - DNA, 25 bp, Homo sapien
gccacagttgcgctgctagcgacga

SEQ ID NO: 158072 - DNA, 25 bp, Homo sapien
tttctgagtcgcaaaaccgtcaagg

SEQ ID NO: 158073 - DNA, 25 bp, Homo sapien
aaacttttgcgtacggcgctgactc

SEQ ID NO: 158074 - DNA, 25 bp, Homo sapien
tgttaccgcagcacttggactaggg

SEQ ID NO: 158075 - DNA, 25 bp, Homo sapien
cgccagggtaaagcgcagacctgtt

SEQ ID NO: 158076 - DNA, 25 bp, Homo sapien
ctggactcaacaataccgggaggtt

SEQ ID NO: 158077 - DNA, 25 bp, Homo sapien
ttgtttgccgctcttgggatctgct

SEQ ID NO: 158078 - DNA, 25 bp, Homo sapien
ggccttgcttcccagtggtaccttc

SEQ ID NO: 158079 - DNA, 25 bp, Homo sapien
ctctcggagaactggagcgcaccct

SEQ ID NO: 158080 - DNA, 25 bp, Homo sapien
tattgctgctagtgccgtgagcacc

SEQ ID NO: 158081 - DNA, 25 bp, Homo sapien
agcctccgttgatgctgccgcggct

SEQ ID NO: 158082 - DNA, 25 bp, Homo sapien
agagcaactcccgagaggtgacgga

SEQ ID NO: 158083 - DNA, 25 bp, Homo sapien
aacgccgagggctcctctggaagac

SEQ ID NO: 158084 - DNA, 25 bp, Homo sapien
tcctctggaagaccactctgtatcc

SEQ ID NO: 158085 - DNA, 25 bp, Homo sapien
cgacgtcacaaaacttcctgtagga

SEQ ID NO: 158086 - DNA, 25 bp, Homo sapien
cctgtaggacatctcgcctagagta

SEQ ID NO: 158087 - DNA, 25 bp, Homo sapien
ggctgccgacatcccgctgcttggt

SEQ ID NO: 158088 - DNA, 25 bp, Homo sapien
cctggcagtagacagagccttttcc

SEQ ID NO: 158089 - DNA, 25 bp, Homo sapien
ttgagactccggcaggaagcctcgt

SEQ ID NO: 158090 - DNA, 25 bp, Homo sapien
gtccgtctaccatgtggcgtccaca

SEQ ID NO: 158091 - DNA, 25 bp, Homo sapien
ggcgctaccgtggtccgtctaccat

SEQ ID NO: 158092 - DNA, 25 bp, Homo sapien
tggcgtccacagtccgttgagactc

SEQ ID NO: 158093 - DNA, 25 bp, Homo sapien
ccgtggtgctaccaggcgctaccgt

SEQ ID NO: 158094 - DNA, 25 bp, Homo sapien
gcgagctaccgcacatggctcctgg

SEQ ID NO: 158095 - DNA, 25 bp, Homo sapien
tcctgtgtgcacctaaccctgaagg

SEQ ID NO: 158096 - DNA, 25 bp, Homo sapien
cctcagatgttggtctgtgggacca

SEQ ID NO: 158097 - DNA, 25 bp, Homo sapien
tgattctcagctgggcgaggcccac

SEQ ID NO: 158098 - DNA, 25 bp, Homo sapien
ccctgaagggaatccgggccctatg

SEQ ID NO: 158099 - DNA, 25 bp, Homo sapien
ccgcagtacctgctaggagggctgt

SEQ ID NO: 158100 - DNA, 25 bp, Homo sapien
agcaccggccgcagtacctgctagg

SEQ ID NO: 158101 - DNA, 25 bp, Homo sapien
tccacgtaggtgtgagacgtgattc

SEQ ID NO: 158102 - DNA, 25 bp, Homo sapien
tgtgggaccattttaacgcctggca

SEQ ID NO: 158103 - DNA, 25 bp, Homo sapien
cgcgtgtcatctgcgggtggcactg

SEQ ID NO: 158104 - DNA, 25 bp, Homo sapien
tttagattctgagacgggaagtgga

SEQ ID NO: 158105 - DNA, 25 bp, Homo sapien
ctcgaaggtgaccacgtttagattc

SEQ ID NO: 158106 - DNA, 25 bp, Homo sapien
cgaaggtgaccacgtttagattctg

SEQ ID NO: 158107 - DNA, 25 bp, Homo sapien
aggtgaccacgtttagattctgaga

SEQ ID NO: 158108 - DNA, 25 bp, Homo sapien
tgaccacgtttagattctgagacgg

SEQ ID NO: 158109 - DNA, 25 bp, Homo sapien
ccacgtttagattctgagacgggaa

SEQ ID NO: 158110 - DNA, 25 bp, Homo sapien
cgtttagattctgagacgggaagtg

SEQ ID NO: 158111 - DNA, 25 bp, Homo sapien
tggacagagaccctacaggccaggc

SEQ ID NO: 158112 - DNA, 25 bp, Homo sapien
tgatgtgtcaggaggccctacactc

SEQ ID NO: 158113 - DNA, 25 bp, Homo sapien
cgtgcactggctcgcagtttggaca

SEQ ID NO: 158114 - DNA, 25 bp, Homo sapien
tgtggctcacatctccacgcctttg

SEQ ID NO: 158115 - DNA, 25 bp, Homo sapien
gcccgagtcagaaacctgtgcttca

SEQ ID NO: 158116 - DNA, 25 bp, Homo sapien
ggttgtccgtcctgtcttctcatcg

SEQ ID NO: 158117 - DNA, 25 bp, Homo sapien
gcaggagaaggtaccgcagagctcc

SEQ ID NO: 158118 - DNA, 25 bp, Homo sapien
ggactcgcgccagagtaggacaaga

SEQ ID NO: 158119 - DNA, 25 bp, Homo sapien
tctggaaacaacacgagctgcgggg

SEQ ID NO: 158120 - DNA, 25 bp, Homo sapien
acggggcaggcacagccacagcagc

SEQ ID NO: 158121 - DNA, 25 bp, Homo sapien
agcgcacagacaagccacggggcta

SEQ ID NO: 158122 - DNA, 25 bp, Homo sapien
aaagcggcctccagcggacacacga

SEQ ID NO: 158123 - DNA, 25 bp, Homo sapien
acacgagggcgcgtctggaaacaac

SEQ ID NO: 158124 - DNA, 25 bp, Homo sapien
cggcaagtgcaagtgagttttcgtc

SEQ ID NO: 158125 - DNA, 25 bp, Homo sapien
cgcctgttgtcacggcaagtgcaag

SEQ ID NO: 158126 - DNA, 25 bp, Homo sapien
gcaagtgagttttcgtctcccggcc

SEQ ID NO: 158127 - DNA, 25 bp, Homo sapien
cggccctggacaaccgtaaaggctg

SEQ ID NO: 158128 - DNA, 25 bp, Homo sapien
cctgcacatggagctaggcaggacg

SEQ ID NO: 158129 - DNA, 25 bp, Homo sapien
gcacagcgccgtcctgcacatggag

SEQ ID NO: 158130 - DNA, 25 bp, Homo sapien
gccgtcctgcacatggagctaggca

SEQ ID NO: 158131 - DNA, 25 bp, Homo sapien
agtgcattccacctagagccgcaca

SEQ ID NO: 158132 - DNA, 25 bp, Homo sapien
aggacagcacggccagggccttcgt

SEQ ID NO: 158133 - DNA, 25 bp, Homo sapien
tggaactctccacgccggacgaaaa

SEQ ID NO: 158134 - DNA, 25 bp, Homo sapien
caaccgtaaaggctggaactctcca

SEQ ID NO: 158135 - DNA, 25 bp, Homo sapien
attcatccattgacagcgcagcgca

SEQ ID NO: 158136 - DNA, 25 bp, Homo sapien
gcgcgccagcatccagaactcaagg

SEQ ID NO: 158137 - DNA, 25 bp, Homo sapien
agcgcgccagcatccagaactcaag

SEQ ID NO: 158138 - DNA, 25 bp, Homo sapien
gcagcgcgctagcatccagaactca

SEQ ID NO: 158139 - DNA, 25 bp, Homo sapien
ttcatccattgacagcgcagcgcgc

SEQ ID NO: 158140 - DNA, 25 bp, Homo sapien
attcatccattgtcagcgcagcgcg

SEQ ID NO: 158141 - DNA, 25 bp, Homo sapien
gcgcaccagcatccagaactcaagg

SEQ ID NO: 158142 - DNA, 25 bp, Homo sapien
attcatccattgacagcgcagcgcg

SEQ ID NO: 158143 - DNA, 25 bp, Homo sapien
aggcggtgggcacttgccctttgcc

SEQ ID NO: 158144 - DNA, 25 bp, Homo sapien
ttcccagaggtcaccggcaaacatg

SEQ ID NO: 158145 - DNA, 25 bp, Homo sapien
accggcaaacatgtgcagacgcaga

SEQ ID NO: 158146 - DNA, 25 bp, Homo sapien
agacgcagagcccacgagctcacgg

SEQ ID NO: 158147 - DNA, 25 bp, Homo sapien
agagcccacgagctcacggcgctgg

SEQ ID NO: 158148 - DNA, 25 bp, Homo sapien
tcgtcgaaacacttcccagaggtca

SEQ ID NO: 158149 - DNA, 25 bp, Homo sapien
ccggagcctccatcagctgagagct

SEQ ID NO: 158150 - DNA, 25 bp, Homo sapien
ctggctcggcaacggcaaagccgtc

SEQ ID NO: 158151 - DNA, 25 bp, Homo sapien
cagtcagcacttcgcctcccgcctt

SEQ ID NO: 158152 - DNA, 25 bp, Homo sapien
gtgggcgttggacgccttactctgc

SEQ ID NO: 158153 - DNA, 25 bp, Homo sapien
ccctcgggctacaggagaccgggct

SEQ ID NO: 158154 - DNA, 25 bp, Homo sapien
cgcggcgcagtcagcacttcgcctc

SEQ ID NO: 158155 - DNA, 25 bp, Homo sapien
caccctcgggctacaggagaccggg

SEQ ID NO: 158156 - DNA, 25 bp, Homo sapien
gctcccagcaggagcgaaggtgagc

SEQ ID NO: 158157 - DNA, 25 bp, Homo sapien
acgccttactctgcacgggggaccg

SEQ ID NO: 158158 - DNA, 25 bp, Homo sapien
cgttggacgccttactctgcacggg

SEQ ID NO: 158159 - DNA, 25 bp, Homo sapien
cccgcatcgctgtgcagtgatagca

SEQ ID NO: 158160 - DNA, 25 bp, Homo sapien
ctgacggtctcgctttgggagaaac

SEQ ID NO: 158161 - DNA, 25 bp, Homo sapien
acacgcttgagacaacggtttcgga

SEQ ID NO: 158162 - DNA, 25 bp, Homo sapien
gcgagatcgtttctaccacctgaga

SEQ ID NO: 158163 - DNA, 25 bp, Homo sapien
acaacagaggacttgccgggccttg

SEQ ID NO: 158164 - DNA, 25 bp, Homo sapien
ccgggccttgatctccacatctgga

SEQ ID NO: 158165 - DNA, 25 bp, Homo sapien
tctgcgcatgcgcaaatgcttcctc

SEQ ID NO: 158166 - DNA, 25 bp, Homo sapien
acggaacgacactctggtctgagca

SEQ ID NO: 158167 - DNA, 25 bp, Homo sapien
cgacctacacacgggccacgagcca

SEQ ID NO: 158168 - DNA, 25 bp, Homo sapien
cacacgcatgacaggatgcacccag

SEQ ID NO: 158169 - DNA, 25 bp, Homo sapien
acacacgcatgagaggatgcaccca

SEQ ID NO: 158170 - DNA, 25 bp, Homo sapien
acacacgggccacgagccaggacac

SEQ ID NO: 158171 - DNA, 25 bp, Homo sapien
tacacacgggccacgagccaggaca

SEQ ID NO: 158172 - DNA, 25 bp, Homo sapien
caggacacacgcatgacaggatgca

SEQ ID NO: 158173 - DNA, 25 bp, Homo sapien
cacacgcatgagaggatgcacccag

SEQ ID NO: 158174 - DNA, 25 bp, Homo sapien
agccaggacacacgcatgacaggat

SEQ ID NO: 158175 - DNA, 25 bp, Homo sapien
ccagcgtgattgacaagcgggaacc

SEQ ID NO: 158176 - DNA, 25 bp, Homo sapien
tcagtggcgtttgccctgattcccg

SEQ ID NO: 158177 - DNA, 25 bp, Homo sapien
tggcgtttgccctgattcccggggc

SEQ ID NO: 158178 - DNA, 25 bp, Homo sapien
gggcctggctttcagcgtagcaatt

SEQ ID NO: 158179 - DNA, 25 bp, Homo sapien
ctggctttcagcgtagcaattctgc

SEQ ID NO: 158180 - DNA, 25 bp, Homo sapien
agcgtagcaattctgccggcgaaga

SEQ ID NO: 158181 - DNA, 25 bp, Homo sapien
aaatcgcaaactgggcgtctgttcc

SEQ ID NO: 158182 - DNA, 25 bp, Homo sapien
aattctgccggcgaagaaggtgagc

SEQ ID NO: 158183 - DNA, 25 bp, Homo sapien
tgccctcgtcagtgctgagcgcctg

SEQ ID NO: 158184 - DNA, 25 bp, Homo sapien
tgcccagtgggctccgggcattgca

SEQ ID NO: 158185 - DNA, 25 bp, Homo sapien
agtagaggaagctgccggcctgccc

SEQ ID NO: 158186 - DNA, 25 bp, Homo sapien
gctggcactcgcctgagcgcaggtt

SEQ ID NO: 158187 - DNA, 25 bp, Homo sapien
ccgtggtcatcgctgtagaaggcga

SEQ ID NO: 158188 - DNA, 25 bp, Homo sapien
ggctggtccggcagatcttgccaaa

SEQ ID NO: 158189 - DNA, 25 bp, Homo sapien
tcttgccaaaacactctcggcggtc

SEQ ID NO: 158190 - DNA, 25 bp, Homo sapien
aaggaggtgccctcgtcagtgctga

SEQ ID NO: 158191 - DNA, 25 bp, Homo sapien
tccgctgaccaggacgtccagggac

SEQ ID NO: 158192 - DNA, 25 bp, Homo sapien
cagggcacccaggatcgctgagcct

SEQ ID NO: 158193 - DNA, 25 bp, Homo sapien
accgatggcctcctcggtgaggtcc

SEQ ID NO: 158194 - DNA, 25 bp, Homo sapien
gttccttcccgtggcgatctgcacg

SEQ ID NO: 158195 - DNA, 25 bp, Homo sapien
tgcacggcctcaggcgtgtggccca

SEQ ID NO: 158196 - DNA, 25 bp, Homo sapien
aggaagttccgctgaccaggacgtc

SEQ ID NO: 158197 - DNA, 25 bp, Homo sapien
acgcggtaggtcaggcccgtcctct

SEQ ID NO: 158198 - DNA, 25 bp, Homo sapien
tgcccgtgccagcatcgtgcacagg

SEQ ID NO: 158199 - DNA, 25 bp, Homo sapien
cagagacccgggtaaaggcgcaaca

SEQ ID NO: 158200 - DNA, 25 bp, Homo sapien
ggacccactgacagagacccgggta

SEQ ID NO: 158201 - DNA, 25 bp, Homo sapien
cagaacgcctgcctacgacggggac

SEQ ID NO: 158202 - DNA, 25 bp, Homo sapien
agatggccggatgccggacaccacg

SEQ ID NO: 158203 - DNA, 25 bp, Homo sapien
ccaccatgcaggagcggtcagatcc

SEQ ID NO: 158204 - DNA, 25 bp, Homo sapien
acggagccgagcgtgagcacgcaca

SEQ ID NO: 158205 - DNA, 25 bp, Homo sapien
tggcacagctgcagacagtgggaac

SEQ ID NO: 158206 - DNA, 25 bp, Homo sapien
gggaacgctggtcctccaccatgca

SEQ ID NO: 158207 - DNA, 25 bp, Homo sapien
gccatgtactggagctcaggcatca

SEQ ID NO: 158208 - DNA, 25 bp, Homo sapien
tggcacacgcccagcgtctggttgt

SEQ ID NO: 158209 - DNA, 25 bp, Homo sapien
tctgatctgcgtgtggttcttgagc

SEQ ID NO: 158210 - DNA, 25 bp, Homo sapien
tgaaatgctcgtacaggcgccagtc

SEQ ID NO: 158211 - DNA, 25 bp, Homo sapien
agccgaagtcgaaccacatgttgtt

SEQ ID NO: 158212 - DNA, 25 bp, Homo sapien
catgttgttcttggcgtagacgttc

SEQ ID NO: 158213 - DNA, 25 bp, Homo sapien
ctccagctggaacacggggttcctc

SEQ ID NO: 158214 - DNA, 25 bp, Homo sapien
ttgggcatgactttctgcacctgtg

SEQ ID NO: 158215 - DNA, 25 bp, Homo sapien
ctggggagcagcgatccagagtcca

SEQ ID NO: 158216 - DNA, 25 bp, Homo sapien
actcaagagctccagcaagagcaga

SEQ ID NO: 158217 - DNA, 25 bp, Homo sapien
agcaggcgtcacagggctcactcaa

SEQ ID NO: 158218 - DNA, 25 bp, Homo sapien
acctcacctagcaggcgtcacaggg

SEQ ID NO: 158219 - DNA, 25 bp, Homo sapien
agggtcacgccaccgcgccctgttt

SEQ ID NO: 158220 - DNA, 25 bp, Homo sapien
gcagcgatccagagtccaggttctg

SEQ ID NO: 158221 - DNA, 25 bp, Homo sapien
ctccacagaccacagcgaccgcgcc

SEQ ID NO: 158222 - DNA, 25 bp, Homo sapien
gtcacagggctcactcaagagctcc

SEQ ID NO: 158223 - DNA, 25 bp, Homo sapien
ccctgctgggctccaaagccgaaga

SEQ ID NO: 158224 - DNA, 25 bp, Homo sapien
caaagccgaagaacccgggctgagc

SEQ ID NO: 158225 - DNA, 25 bp, Homo sapien
cgagtgcaggaggtcccttgcattc

SEQ ID NO: 158226 - DNA, 25 bp, Homo sapien
tgcattcctccttcggaatggcctc

SEQ ID NO: 158227 - DNA, 25 bp, Homo sapien
cctcttggacagtggaagcgctttc

SEQ ID NO: 158228 - DNA, 25 bp, Homo sapien
cgctttcagcaacagaatggctgga

SEQ ID NO: 158229 - DNA, 25 bp, Homo sapien
tgccttctcactccagggcagtggg

SEQ ID NO: 158230 - DNA, 25 bp, Homo sapien
aggtcccttgcattcctccttcgga

SEQ ID NO: 158231 - DNA, 25 bp, Homo sapien
tcagctcatccagcttctcctgtag

SEQ ID NO: 158232 - DNA, 25 bp, Homo sapien
tctgcacggcttccgtggctggctt

SEQ ID NO: 158233 - DNA, 25 bp, Homo sapien
gctacttggataggggacgctcact

SEQ ID NO: 158234 - DNA, 25 bp, Homo sapien
gcaggctcttcagctcgccgttctt

SEQ ID NO: 158235 - DNA, 25 bp, Homo sapien
agtgagtcgatgagcttgcaggccc

SEQ ID NO: 158236 - DNA, 25 bp, Homo sapien
ctgacgccgacaggatgacctcgtt

SEQ ID NO: 158237 - DNA, 25 bp, Homo sapien
tgacctcgttgatggacatggggct

SEQ ID NO: 158238 - DNA, 25 bp, Homo sapien
tgggcgacagcaggctacttggata

SEQ ID NO: 158239 - DNA, 25 bp, Homo sapien
gcgtatttccgctcgcgcgccgtat

SEQ ID NO: 158240 - DNA, 25 bp, Homo sapien
agttcacggccgcacagcagatcac

SEQ ID NO: 158241 - DNA, 25 bp, Homo sapien
agcagatcaccatcgcgggccttgg

SEQ ID NO: 158242 - DNA, 25 bp, Homo sapien
ggcaagtccgtaccgcgacatgggc

SEQ ID NO: 158243 - DNA, 25 bp, Homo sapien
cgtccgtaccgcaagatggctgctc

SEQ ID NO: 158244 - DNA, 25 bp, Homo sapien
ctctaagaggaggaagcgccaccca

SEQ ID NO: 158245 - DNA, 25 bp, Homo sapien
atggcacacagtgtcccgtcggaca

SEQ ID NO: 158246 - DNA, 25 bp, Homo sapien
tcggacagcagaaccagccgtcgtc

SEQ ID NO: 158247 - DNA, 25 bp, Homo sapien
ggtccttggaaccaggtgccactcc

SEQ ID NO: 158248 - DNA, 25 bp, Homo sapien
gcaacggattccctgccggagctga

SEQ ID NO: 158249 - DNA, 25 bp, Homo sapien
tcactttcagcgcatcgtcgtcacg

SEQ ID NO: 158250 - DNA, 25 bp, Homo sapien
tcgtcgtcacgtggccatttgtgca

SEQ ID NO: 158251 - DNA, 25 bp, Homo sapien
tgaggcacgtccatcagtaggcacg

SEQ ID NO: 158252 - DNA, 25 bp, Homo sapien
gcacgtgctgctttcgttctgcaag

SEQ ID NO: 158253 - DNA, 25 bp, Homo sapien
ttctgcaagtgtcaaggcgagtgtc

SEQ ID NO: 158254 - DNA, 25 bp, Homo sapien
ggcgccactgcgtttcctgcagatt

SEQ ID NO: 158255 - DNA, 25 bp, Homo sapien
acaagcgacagtgctggcgcccgac

SEQ ID NO: 158256 - DNA, 25 bp, Homo sapien
acgaaaagctgcgtgaccagcatca

SEQ ID NO: 158257 - DNA, 25 bp, Homo sapien
tgcgtgaccagcatcatctgcaggc

SEQ ID NO: 158258 - DNA, 25 bp, Homo sapien
gaccagcatcatctgcaggcacagc

SEQ ID NO: 158259 - DNA, 25 bp, Homo sapien
aagggactgaagctccgcgggccgt

SEQ ID NO: 158260 - DNA, 25 bp, Homo sapien
ggccgtggccacaagcgacagtgct

SEQ ID NO: 158261 - DNA, 25 bp, Homo sapien
gacgtgccagaagccctggctgccg

SEQ ID NO: 158262 - DNA, 25 bp, Homo sapien
cgggaaacgaaaagctgcgtgacca

SEQ ID NO: 158263 - DNA, 25 bp, Homo sapien
ctggatggttccctgaccagatgaa

SEQ ID NO: 158264 - DNA, 25 bp, Homo sapien
tgaccagatgaaacatcagccgatg

SEQ ID NO: 158265 - DNA, 25 bp, Homo sapien
agcggctcctccacacggagagatg

SEQ ID NO: 158266 - DNA, 25 bp, Homo sapien
tcctccacacggagagatggtgtca

SEQ ID NO: 158267 - DNA, 25 bp, Homo sapien
tggtgtcagtcaaaggccgtctaga

SEQ ID NO: 158268 - DNA, 25 bp, Homo sapien
ggccgtctagatgacgagtttatga

SEQ ID NO: 158269 - DNA, 25 bp, Homo sapien
atgaaattgttcctggcccgtgccg

SEQ ID NO: 158270 - DNA, 25 bp, Homo sapien
agctgcggggtgtgagattaatccc

SEQ ID NO: 158271 - DNA, 25 bp, Homo sapien
tccacgccctccagcactatgagag

SEQ ID NO: 158272 - DNA, 25 bp, Homo sapien
attggccggcgtcaacagcgcgcgc

SEQ ID NO: 158273 - DNA, 25 bp, Homo sapien
cgcgcgccgtgattagctagtattt

SEQ ID NO: 158274 - DNA, 25 bp, Homo sapien
ttagctagtatttcccggcctcggc

SEQ ID NO: 158275 - DNA, 25 bp, Homo sapien
gcctcggccaaattcgaagggattg

SEQ ID NO: 158276 - DNA, 25 bp, Homo sapien
cgcgagacgaacgagcgagatgctt

SEQ ID NO: 158277 - DNA, 25 bp, Homo sapien
acgagcgagatgcttcccgaagcgc

SEQ ID NO: 158278 - DNA, 25 bp, Homo sapien
ccagcttgcggctctgcgtgctctt

SEQ ID NO: 158279 - DNA, 25 bp, Homo sapien
catgtacttggagcactatctggac

SEQ ID NO: 158280 - DNA, 25 bp, Homo sapien
agcgcgcgcgactcatgaatagtga

SEQ ID NO: 158281 - DNA, 25 bp, Homo sapien
tggcgaccgccatgtacttggagca

SEQ ID NO: 158282 - DNA, 25 bp, Homo sapien
cactatctggacagtaagcgcgccc

SEQ ID NO: 158283 - DNA, 25 bp, Homo sapien
ggtcgcgccaattccaggtgcgtca

SEQ ID NO: 158284 - DNA, 25 bp, Homo sapien
gccggcctcttgtgtgaccgcggct

SEQ ID NO: 158285 - DNA, 25 bp, Homo sapien
cccgccggaagctgaaaggcgtgtc

SEQ ID NO: 158286 - DNA, 25 bp, Homo sapien
catgaatagtgagcgcgctggcacc

SEQ ID NO: 158287 - DNA, 25 bp, Homo sapien
cgtggcagcgtgtttgaaactccgg

SEQ ID NO: 158288 - DNA, 25 bp, Homo sapien
aggctggccgagctcacggtgtcat

SEQ ID NO: 158289 - DNA, 25 bp, Homo sapien
acacagggaaaggatgccgtgtctc

SEQ ID NO: 158290 - DNA, 25 bp, Homo sapien
ccttggtgttcggtgtgaggacaca

SEQ ID NO: 158291 - DNA, 25 bp, Homo sapien
agagccagttatccttggtgttcgg

SEQ ID NO: 158292 - DNA, 25 bp, Homo sapien
cgcccgagttggtaagagccagtta

SEQ ID NO: 158293 - DNA, 25 bp, Homo sapien
ttgaaactccggcagactcgcccga

SEQ ID NO: 158294 - DNA, 25 bp, Homo sapien
ctcacggtgtcatgtggcgtcaaca

SEQ ID NO: 158295 - DNA, 25 bp, Homo sapien
ggctgatgctccgtttctctgggaa

SEQ ID NO: 158296 - DNA, 25 bp, Homo sapien
tcacctccggagtaaacggctcttc

SEQ ID NO: 158297 - DNA, 25 bp, Homo sapien
cgccgcctttttagcttggacttca

SEQ ID NO: 158298 - DNA, 25 bp, Homo sapien
ctcgcgtagctttcctgtggttttc

SEQ ID NO: 158299 - DNA, 25 bp, Homo sapien
tcttcattagcttggagtggccgca

SEQ ID NO: 158300 - DNA, 25 bp, Homo sapien
gaagcgctggatgtttcctagaaca

SEQ ID NO: 158301 - DNA, 25 bp, Homo sapien
ctgtcccttcattcgtgtcgcaata

SEQ ID NO: 158302 - DNA, 25 bp, Homo sapien
actgcgcctttcttgtcacaggttc

SEQ ID NO: 158303 - DNA, 25 bp, Homo sapien
cgagcctgcgcgtcgctaagtccag

SEQ ID NO: 158304 - DNA, 25 bp, Homo sapien
tcgctaagtccaggcctgctgcgtg

SEQ ID NO: 158305 - DNA, 25 bp, Homo sapien
ccctgcttctgcaagcgtgtttcaa

SEQ ID NO: 158306 - DNA, 25 bp, Homo sapien
cagctcgtcacgtgaccgcgtggaa

SEQ ID NO: 158307 - DNA, 25 bp, Homo sapien
cgtgtttcaatttgtacaacgtgca

SEQ ID NO: 158308 - DNA, 25 bp, Homo sapien
aacatgaaattacccttggccactt

SEQ ID NO: 158309 - DNA, 25 bp, Homo sapien
cgttctccacggtgtctaagcagga

SEQ ID NO: 158310 - DNA, 25 bp, Homo sapien
acctggccgcctttgagcgcatcgt

SEQ ID NO: 158311 - DNA, 25 bp, Homo sapien
ttcgatgtcataaagcgcaagggcg

SEQ ID NO: 158312 - DNA, 25 bp, Homo sapien
ctgatgtgcatgtgtcggctgaacc

SEQ ID NO: 158313 - DNA, 25 bp, Homo sapien
tgtccatgaccgtgtgcgtcttctg

SEQ ID NO: 158314 - DNA, 25 bp, Homo sapien
gccctacgaggacttctggatctgg

SEQ ID NO: 158315 - DNA, 25 bp, Homo sapien
gtccaggttccacaaggcccgctgt

SEQ ID NO: 158316 - DNA, 25 bp, Homo sapien
tcccaaggctattaccagaagaggc

SEQ ID NO: 158317 - DNA, 25 bp, Homo sapien
ggcaatggctgcttctcccaaggct

SEQ ID NO: 158318 - DNA, 25 bp, Homo sapien
atctacccgcagcaagtgtgacgcc

SEQ ID NO: 158319 - DNA, 25 bp, Homo sapien
cctttttctctgtgcatcctcagtg

SEQ ID NO: 158320 - DNA, 25 bp, Homo sapien
ctctgtgcatcctcagtgacgcggg

SEQ ID NO: 158321 - DNA, 25 bp, Homo sapien
catcctcagtgacgcggggcacagc

SEQ ID NO: 158322 - DNA, 25 bp, Homo sapien
gcgtggccacgagcgaggagactaa

SEQ ID NO: 158323 - DNA, 25 bp, Homo sapien
ctgctcgggtttccgcttcctccgc

SEQ ID NO: 158324 - DNA, 25 bp, Homo sapien
tagcgggcttgccacgcccaggcag

SEQ ID NO: 158325 - DNA, 25 bp, Homo sapien
gcgggaaaactagcgggcttgccac

SEQ ID NO: 158326 - DNA, 25 bp, Homo sapien
tggtcatgtgcgaggaggctgaaca

SEQ ID NO: 158327 - DNA, 25 bp, Homo sapien
agaactggttccacgtctgatcttc

SEQ ID NO: 158328 - DNA, 25 bp, Homo sapien
ccagccgaaatgttcaccgtgaatc

SEQ ID NO: 158329 - DNA, 25 bp, Homo sapien
ccctggatacgtcccagccgaaatg

SEQ ID NO: 158330 - DNA, 25 bp, Homo sapien
tctgatcttccttagacaaacctgc

SEQ ID NO: 158331 - DNA, 25 bp, Homo sapien
tgagaagtacaggagcttcacattc

SEQ ID NO: 158332 - DNA, 25 bp, Homo sapien
cctgtggagctgatttccatttcta

SEQ ID NO: 158333 - DNA, 25 bp, Homo sapien
ccgtgaatccggcaacctgtggagc

SEQ ID NO: 158334 - DNA, 25 bp, Homo sapien
cctgccttcagaggaaattgtgttc

SEQ ID NO: 158335 - DNA, 25 bp, Homo sapien
acaccggcctacacttcaaaacttg

SEQ ID NO: 158336 - DNA, 25 bp, Homo sapien
catgccgcagcgcacagaatgcaca

SEQ ID NO: 158337 - DNA, 25 bp, Homo sapien
gaagacgccggtgagaaccagcagc

SEQ ID NO: 158338 - DNA, 25 bp, Homo sapien
gctgcttcagaaaaaccgctgcgtg

SEQ ID NO: 158339 - DNA, 25 bp, Homo sapien
gcaccgatgggaggaagccacctaa

SEQ ID NO: 158340 - DNA, 25 bp, Homo sapien
cgagaggccaaaccaaccagcaatc

SEQ ID NO: 158341 - DNA, 25 bp, Homo sapien
tgcacaaggtggaaagacggtgctc

SEQ ID NO: 158342 - DNA, 25 bp, Homo sapien
cagcaggactgcgtttttgtaaagc

SEQ ID NO: 158343 - DNA, 25 bp, Homo sapien
gtgtgcggcatcacccagctctgtc

SEQ ID NO: 158344 - DNA, 25 bp, Homo sapien
gccaccggacgctggacctgagaac

SEQ ID NO: 158345 - DNA, 25 bp, Homo sapien
cgctggacctgagaacctggaccca

SEQ ID NO: 158346 - DNA, 25 bp, Homo sapien
aggacagctcctgaagcatcctggc

SEQ ID NO: 158347 - DNA, 25 bp, Homo sapien
agaacctggacccaggcccggtctg

SEQ ID NO: 158348 - DNA, 25 bp, Homo sapien
ggggcctccacgcacctaaaggaca

SEQ ID NO: 158349 - DNA, 25 bp, Homo sapien
acgcacctaaaggacagctcctgaa

SEQ ID NO: 158350 - DNA, 25 bp, Homo sapien
tggcaagtgctgagcactgtgtccc

SEQ ID NO: 158351 - DNA, 25 bp, Homo sapien
acccttacagtcactaactcttttg

SEQ ID NO: 158352 - DNA, 25 bp, Homo sapien
ccttcccggaatccgtgcaggggca

SEQ ID NO: 158353 - DNA, 25 bp, Homo sapien
gtagcaagaaatagcacggcgcgcc

SEQ ID NO: 158354 - DNA, 25 bp, Homo sapien
tcccagtggggaccattcagtagca

SEQ ID NO: 158355 - DNA, 25 bp, Homo sapien
ccgtgtttaggtagaaacatgactc

SEQ ID NO: 158356 - DNA, 25 bp, Homo sapien
caggctgccagcactggggacctct

SEQ ID NO: 158357 - DNA, 25 bp, Homo sapien
ctgtcttcctttcaaacactgattc

SEQ ID NO: 158358 - DNA, 25 bp, Homo sapien
gtcttgcgaaagaatttcctcctta

SEQ ID NO: 158359 - DNA, 25 bp, Homo sapien
acaagcgccagaagcgccggcggct

SEQ ID NO: 158360 - DNA, 25 bp, Homo sapien
caagcaaatctcccgcgggcgcgtg

SEQ ID NO: 158361 - DNA, 25 bp, Homo sapien
tggcggaaacttgaggcttggagtc

SEQ ID NO: 158362 - DNA, 25 bp, Homo sapien
gagagcctagaagcccatgtagccg

SEQ ID NO: 158363 - DNA, 25 bp, Homo sapien
ctagaagcccatgtagccgcgaatc

SEQ ID NO: 158364 - DNA, 25 bp, Homo sapien
gaagcccatgtagccgcgaatcccg

SEQ ID NO: 158365 - DNA, 25 bp, Homo sapien
catgtagccgcgaatcccgcagccc

SEQ ID NO: 158366 - DNA, 25 bp, Homo sapien
ggtcacaagcgccagaagcgccggc

SEQ ID NO: 158367 - DNA, 25 bp, Homo sapien
tcgtgcctcaggtgcccgcgcttgt

SEQ ID NO: 158368 - DNA, 25 bp, Homo sapien
cccgtgtcccggctcttcaggcacg

SEQ ID NO: 158369 - DNA, 25 bp, Homo sapien
gctcttcaggcacgccctcgggacg

SEQ ID NO: 158370 - DNA, 25 bp, Homo sapien
cgacccaggcgggaaagataagagc

SEQ ID NO: 158371 - DNA, 25 bp, Homo sapien
gacccaggcgggaaagataagagca

SEQ ID NO: 158372 - DNA, 25 bp, Homo sapien
gcaaggtgtccgcagcctgacactc

SEQ ID NO: 158373 - DNA, 25 bp, Homo sapien
agcctgacactcgtgcctcaggtgc

SEQ ID NO: 158374 - DNA, 25 bp, Homo sapien
ggtgtccgcagcctgacactcgtgc

SEQ ID NO: 158375 - DNA, 25 bp, Homo sapien
catcggagagcttcgtgctaaactg

SEQ ID NO: 158376 - DNA, 25 bp, Homo sapien
gtgtcacacaactgcccaacgggcg

SEQ ID NO: 158377 - DNA, 25 bp, Homo sapien
ggactgccgcttccgtgtcacacaa

SEQ ID NO: 158378 - DNA, 25 bp, Homo sapien
tgctaaactggtaccgcatgagccc

SEQ ID NO: 158379 - DNA, 25 bp, Homo sapien
cccaacgggcgtgacttccacatga

SEQ ID NO: 158380 - DNA, 25 bp, Homo sapien
gacttccacatgagcgtggtcaggg

SEQ ID NO: 158381 - DNA, 25 bp, Homo sapien
tgcagcttctccaacacatcggaga

SEQ ID NO: 158382 - DNA, 25 bp, Homo sapien
accagacggacaagctggccgcctt

SEQ ID NO: 158383 - DNA, 25 bp, Homo sapien
tcgccgaggacgaacagatcaacgc

SEQ ID NO: 158384 - DNA, 25 bp, Homo sapien
tcaaaatcaaaaatcgccgaggacg

SEQ ID NO: 158385 - DNA, 25 bp, Homo sapien
ccctcgagcgggaatcaaaatcaaa

SEQ ID NO: 158386 - DNA, 25 bp, Homo sapien
tatcatgtccttgcagacgcctggc

SEQ ID NO: 158387 - DNA, 25 bp, Homo sapien
cgcgactcggcctatcatgtccttg

SEQ ID NO: 158388 - DNA, 25 bp, Homo sapien
cgagctggagcacagccgagcccaa

SEQ ID NO: 158389 - DNA, 25 bp, Homo sapien
cagttgcagttgaagtcagctggcg

SEQ ID NO: 158390 - DNA, 25 bp, Homo sapien
ctggcggaggccagacctcagcagc

SEQ ID NO: 158391 - DNA, 25 bp, Homo sapien
actcgggactccttgcccgctggag

SEQ ID NO: 158392 - DNA, 25 bp, Homo sapien
tgcgggtttttacgtttcagcgagc

SEQ ID NO: 158393 - DNA, 25 bp, Homo sapien
agcgagctcgcaacaacgtcctgtg

SEQ ID NO: 158394 - DNA, 25 bp, Homo sapien
agagtcctctccagtcactatcgtc

SEQ ID NO: 158395 - DNA, 25 bp, Homo sapien
cccgcatttcctttgctaggctgtc

SEQ ID NO: 158396 - DNA, 25 bp, Homo sapien
tgggcatatcactccctcggttttc

SEQ ID NO: 158397 - DNA, 25 bp, Homo sapien
ctcggttttctgagactcgggactc

SEQ ID NO: 158398 - DNA, 25 bp, Homo sapien
aggccatgaatctgggtcccgcact

SEQ ID NO: 158399 - DNA, 25 bp, Homo sapien
aagccgccggtatttctccatctgg

SEQ ID NO: 158400 - DNA, 25 bp, Homo sapien
ctgcagctattctgagcacaccttg

SEQ ID NO: 158401 - DNA, 25 bp, Homo sapien
cggagcggacgtttctgcagctatt

SEQ ID NO: 158402 - DNA, 25 bp, Homo sapien
cagtgagacagagcgctcggccacc

SEQ ID NO: 158403 - DNA, 25 bp, Homo sapien
gacgcgccacccagctgtttttgtg

SEQ ID NO: 158404 - DNA, 25 bp, Homo sapien
ctgtttttgtgctcccagctctagc

SEQ ID NO: 158405 - DNA, 25 bp, Homo sapien
cagctctagcgaaaagccgccggta

SEQ ID NO: 158406 - DNA, 25 bp, Homo sapien
gcacaccttgacgtcggctgaggga

SEQ ID NO: 158407 - DNA, 25 bp, Homo sapien
agccctagactaaagcgtgaaagcc

SEQ ID NO: 158408 - DNA, 25 bp, Homo sapien
ctccagaaactcgtgcccaaacttg

SEQ ID NO: 158409 - DNA, 25 bp, Homo sapien
tgtgccctacgtagtagcgcaggta

SEQ ID NO: 158410 - DNA, 25 bp, Homo sapien
gcgcaggtagaaatcgctagccaca

SEQ ID NO: 158411 - DNA, 25 bp, Homo sapien
gtccggccgaaattcgaactccaga

SEQ ID NO: 158412 - DNA, 25 bp, Homo sapien
cgtcatcgcgcggaataagtgcgtc

SEQ ID NO: 158413 - DNA, 25 bp, Homo sapien
aaagccgagtatcgcgtgagagtcc

SEQ ID NO: 158414 - DNA, 25 bp, Homo sapien
gccacagccatttttgtacccggga

SEQ ID NO: 158415 - DNA, 25 bp, Homo sapien
tcactccggtttccgatggcaccgg

SEQ ID NO: 158416 - DNA, 25 bp, Homo sapien
gcaaggtgtgccagcctcaaggaaa

SEQ ID NO: 158417 - DNA, 25 bp, Homo sapien
gtgtgccagcctcaaggaaatgctt

SEQ ID NO: 158418 - DNA, 25 bp, Homo sapien
tcaaggaaatgcttttcagtccctc

SEQ ID NO: 158419 - DNA, 25 bp, Homo sapien
gaagtctgcgggctccgaggtttcc

SEQ ID NO: 158420 - DNA, 25 bp, Homo sapien
gctccgaggtttccgggactcgcca

SEQ ID NO: 158421 - DNA, 25 bp, Homo sapien
tcctctggtcactccggtttccgat

SEQ ID NO: 158422 - DNA, 25 bp, Homo sapien
tttccgatggcaccggcccagtcgg

SEQ ID NO: 158423 - DNA, 25 bp, Homo sapien
gcctgtccctcgttgcggcttgtcg

SEQ ID NO: 158424 - DNA, 25 bp, Homo sapien
ttcacgcccttttcgttcacgaatc

SEQ ID NO: 158425 - DNA, 25 bp, Homo sapien
tttcgttcacgaatccgagcccgct

SEQ ID NO: 158426 - DNA, 25 bp, Homo sapien
tccagcgaaccgaccatgtctggcg

SEQ ID NO: 158427 - DNA, 25 bp, Homo sapien
cgccgcagagaagcagagcagcact

SEQ ID NO: 158428 - DNA, 25 bp, Homo sapien
ccgacgctgtgaccggcaggaccga

SEQ ID NO: 158429 - DNA, 25 bp, Homo sapien
gccgccgccacactatggacaagga

SEQ ID NO: 158430 - DNA, 25 bp, Homo sapien
ggttccctgcagacctctgcgcggg

SEQ ID NO: 158431 - DNA, 25 bp, Homo sapien
cgggccctggactctcattagcatt

SEQ ID NO: 158432 - DNA, 25 bp, Homo sapien
cggtgcgctttctatggctccaatc

SEQ ID NO: 158433 - DNA, 25 bp, Homo sapien
cgggtcgcgttgcagaaccaaggaa

SEQ ID NO: 158434 - DNA, 25 bp, Homo sapien
tctgggagacagaagttaagaccta

SEQ ID NO: 158435 - DNA, 25 bp, Homo sapien
gagatgtagcgcgagctgcccacac

SEQ ID NO: 158436 - DNA, 25 bp, Homo sapien
cacaagtttttctaggcggcgcacc

SEQ ID NO: 158437 - DNA, 25 bp, Homo sapien
gcctgactcaccgagaacttttttc

SEQ ID NO: 158438 - DNA, 25 bp, Homo sapien
cattagcatttaaaggcgcccggtg

SEQ ID NO: 158439 - DNA, 25 bp, Homo sapien
ctgaacgagctgagcgcctagaatc

SEQ ID NO: 158440 - DNA, 25 bp, Homo sapien
aggaacatcttcaggaccacggaca

SEQ ID NO: 158441 - DNA, 25 bp, Homo sapien
cgcctagaatcgcagcctgtgggag

SEQ ID NO: 158442 - DNA, 25 bp, Homo sapien
ccgagctggcatcgtttcagaacca

SEQ ID NO: 158443 - DNA, 25 bp, Homo sapien
agggccatcgtgctgaaccaacaga

SEQ ID NO: 158444 - DNA, 25 bp, Homo sapien
gcttggagagacttctggagaatcc

SEQ ID NO: 158445 - DNA, 25 bp, Homo sapien
gaaccacgaacagctcctggcgcaa

SEQ ID NO: 158446 - DNA, 25 bp, Homo sapien
ctgaaccaacagaggctcgtccgca

SEQ ID NO: 158447 - DNA, 25 bp, Homo sapien
acgaaattggcttcggtgctcctcc

SEQ ID NO: 158448 - DNA, 25 bp, Homo sapien
gtcgctgtaggagaccaccagaagc

SEQ ID NO: 158449 - DNA, 25 bp, Homo sapien
acttctgcaaaggtagctgggtcca

SEQ ID NO: 158450 - DNA, 25 bp, Homo sapien
ggctgcttgccttccgactccgatt

SEQ ID NO: 158451 - DNA, 25 bp, Homo sapien
ccgattcctgagattcctggtacca

SEQ ID NO: 158452 - DNA, 25 bp, Homo sapien
cccacaggggtgtaatgctcctcta

SEQ ID NO: 158453 - DNA, 25 bp, Homo sapien
acggcattgattcttcctcttagga

SEQ ID NO: 158454 - DNA, 25 bp, Homo sapien
aagcagctgcggagatcccaccaga

SEQ ID NO: 158455 - DNA, 25 bp, Homo sapien
acccgatctcccatttcctggtgga

SEQ ID NO: 158456 - DNA, 25 bp, Homo sapien
cggaatggcccttcatagataatta

SEQ ID NO: 158457 - DNA, 25 bp, Homo sapien
gcgtcctaaccggaatggcccttca

SEQ ID NO: 158458 - DNA, 25 bp, Homo sapien
tatttcctccttcggattccgcgtc

SEQ ID NO: 158459 - DNA, 25 bp, Homo sapien
ccgtgtgcaggctgtaacccgatct

SEQ ID NO: 158460 - DNA, 25 bp, Homo sapien
ggcagcggtcgagaagcagaacaaa

SEQ ID NO: 158461 - DNA, 25 bp, Homo sapien
ctttcgttgcatctgcgcttagtga

SEQ ID NO: 158462 - DNA, 25 bp, Homo sapien
tcctggtggattctcttaaagaggc

SEQ ID NO: 158463 - DNA, 25 bp, Homo sapien
ggagagatgctggaagaaacttctt

SEQ ID NO: 158464 - DNA, 25 bp, Homo sapien
tggaagaaacttcttaaatgaccgc

SEQ ID NO: 158465 - DNA, 25 bp, Homo sapien
gaaacttcttaaatgaccgcgtctg

SEQ ID NO: 158466 - DNA, 25 bp, Homo sapien
aacttcttaaatgaccgcgtctggc

SEQ ID NO: 158467 - DNA, 25 bp, Homo sapien
cttcttaaatgaccgcgtctggctg

SEQ ID NO: 158468 - DNA, 25 bp, Homo sapien
tcttaaatgaccgcgtctggctggc

SEQ ID NO: 158469 - DNA, 25 bp, Homo sapien
gagatgctggaagaaacttcttaaa

SEQ ID NO: 158470 - DNA, 25 bp, Homo sapien
gctggaagaaacttcttaaatgacc

SEQ ID NO: 158471 - DNA, 25 bp, Homo sapien
tgcctgagaccctgggagaggttct

SEQ ID NO: 158472 - DNA, 25 bp, Homo sapien
tcccagcttcccagcgagagaagaa

SEQ ID NO: 158473 - DNA, 25 bp, Homo sapien
gcggaatttttgaacgctgtttaca

SEQ ID NO: 158474 - DNA, 25 bp, Homo sapien
tactgcctcctgtacggccagggaa

SEQ ID NO: 158475 - DNA, 25 bp, Homo sapien
gttgaacaacattggagccggcgtg

SEQ ID NO: 158476 - DNA, 25 bp, Homo sapien
tgagctccgtcttcggggttggaaa

SEQ ID NO: 158477 - DNA, 25 bp, Homo sapien
tacaccggctttcagcgtggatctg

SEQ ID NO: 158478 - DNA, 25 bp, Homo sapien
agggctgcacgctcatacttcccag

SEQ ID NO: 158479 - DNA, 25 bp, Homo sapien
actctctccgcaggtagcgacgtcg

SEQ ID NO: 158480 - DNA, 25 bp, Homo sapien
catccaggtgcgaggacagctctgt

SEQ ID NO: 158481 - DNA, 25 bp, Homo sapien
ggttttgtggttagcaagttcctgc

SEQ ID NO: 158482 - DNA, 25 bp, Homo sapien
gttagcaagttcctgcttccgtcgc

SEQ ID NO: 158483 - DNA, 25 bp, Homo sapien
ccgtcgcagcgacggcaagtttgcc

SEQ ID NO: 158484 - DNA, 25 bp, Homo sapien
gaagggcacgttcctgccctgcaac

SEQ ID NO: 158485 - DNA, 25 bp, Homo sapien
tgcttcccggcaacattagcgcgtc

SEQ ID NO: 158486 - DNA, 25 bp, Homo sapien
ctgcaggtgagccttgcctcgcggc

SEQ ID NO: 158487 - DNA, 25 bp, Homo sapien
gtgcggcaaagccagtgtcatctgc

SEQ ID NO: 158488 - DNA, 25 bp, Homo sapien
tcatctgccggttctcttagggctc

SEQ ID NO: 158489 - DNA, 25 bp, Homo sapien
tgaaccagtgagtgaaagcggcgcc

SEQ ID NO: 158490 - DNA, 25 bp, Homo sapien
gcccatctgcgtcccggaaggagcg

SEQ ID NO: 158491 - DNA, 25 bp, Homo sapien
actgaaggtcttgcgtagccggcac

SEQ ID NO: 158492 - DNA, 25 bp, Homo sapien
ctcctaatccggaactgaaggtctt

SEQ ID NO: 158493 - DNA, 25 bp, Homo sapien
ccctaagtcgcaggagcgggtctct

SEQ ID NO: 158494 - DNA, 25 bp, Homo sapien
caccgctgtcggcaccatgggcagt

SEQ ID NO: 158495 - DNA, 25 bp, Homo sapien
ttcgcccgcaaaggtgccgcgtccc

SEQ ID NO: 158496 - DNA, 25 bp, Homo sapien
cctcagagggaaacgaaagttgtca

SEQ ID NO: 158497 - DNA, 25 bp, Homo sapien
gccgggagcgcacccactgcgaccc

SEQ ID NO: 158498 - DNA, 25 bp, Homo sapien
gaagtgagcagcttcgcccgcaaag

SEQ ID NO: 158499 - DNA, 25 bp, Homo sapien
cgcctggaagtgagcagcttcgccc

SEQ ID NO: 158500 - DNA, 25 bp, Homo sapien
taacagtcgcgcctggaagtgagca

SEQ ID NO: 158501 - DNA, 25 bp, Homo sapien
gtgttgtgtaacagtcgcgcctgga

SEQ ID NO: 158502 - DNA, 25 bp, Homo sapien
gacctcccaattccctcagagggaa

SEQ ID NO: 158503 - DNA, 25 bp, Homo sapien
ctgaacctccgctatgtagtccacg

SEQ ID NO: 158504 - DNA, 25 bp, Homo sapien
cggctctccagagcgtctgtaaaca

SEQ ID NO: 158505 - DNA, 25 bp, Homo sapien
agggtccgctctgccattcctgaac

SEQ ID NO: 158506 - DNA, 25 bp, Homo sapien
ctggcatcagggaagcgaactgtta

SEQ ID NO: 158507 - DNA, 25 bp, Homo sapien
tgccgcgatggatgacagtaaggta

SEQ ID NO: 158508 - DNA, 25 bp, Homo sapien
taagtcttgtggtttgcacgcgccg

SEQ ID NO: 158509 - DNA, 25 bp, Homo sapien
gctcaatgctagtcccgcggctgaa

SEQ ID NO: 158510 - DNA, 25 bp, Homo sapien
gccgccttcttgtcgctcaatgcta

SEQ ID NO: 158511 - DNA, 25 bp, Homo sapien
tcgtcaggccttcagcggctagtta

SEQ ID NO: 158512 - DNA, 25 bp, Homo sapien
ttctcgacccggaagctgagccttc

SEQ ID NO: 158513 - DNA, 25 bp, Homo sapien
tgcacacagggagctcgatctaggc

SEQ ID NO: 158514 - DNA, 25 bp, Homo sapien
cggtgctggcttttacgttctgagc

SEQ ID NO: 158515 - DNA, 25 bp, Homo sapien
tgtcagagaccttcccagattccgc

SEQ ID NO: 158516 - DNA, 25 bp, Homo sapien
ggcctctggactcagcatctctacg

SEQ ID NO: 158517 - DNA, 25 bp, Homo sapien
ggcccgggtggttcacacttcacat

SEQ ID NO: 158518 - DNA, 25 bp, Homo sapien
tgcggcagccgtaaagcaacctgga

SEQ ID NO: 158519 - DNA, 25 bp, Homo sapien
aaatcggaccgcctctcactaggcg

SEQ ID NO: 158520 - DNA, 25 bp, Homo sapien
ttttccgtggcgttgagatcccacc

SEQ ID NO: 158521 - DNA, 25 bp, Homo sapien
tggccggctagtatgaaggttttcc

SEQ ID NO: 158522 - DNA, 25 bp, Homo sapien
tcctcaggcagatctcgcgtggttt

SEQ ID NO: 158523 - DNA, 25 bp, Homo sapien
caaacgtgcactcccggggtggcgc

SEQ ID NO: 158524 - DNA, 25 bp, Homo sapien
cagacgcatgcgcaaacgtgcactc

SEQ ID NO: 158525 - DNA, 25 bp, Homo sapien
tctcactaggcggaaagttttgaaa

SEQ ID NO: 158526 - DNA, 25 bp, Homo sapien
ctaaaaatgatgagccagacgcatg

SEQ ID NO: 158527 - DNA, 25 bp, Homo sapien
gccagcgcaagtggaatttcgattt

SEQ ID NO: 158528 - DNA, 25 bp, Homo sapien
agcaggtttgttggcagcagtaccc

SEQ ID NO: 158529 - DNA, 25 bp, Homo sapien
ggatctcctcctctgtttaaataga

SEQ ID NO: 158530 - DNA, 25 bp, Homo sapien
ccaccgccatattgggccactaaaa

SEQ ID NO: 158531 - DNA, 25 bp, Homo sapien
tccatttgatcagcggagactcggc

SEQ ID NO: 158532 - DNA, 25 bp, Homo sapien
taacccgggacttggagaagcactg

SEQ ID NO: 158533 - DNA, 25 bp, Homo sapien
actcgccgtgtcaatcattttcttc

SEQ ID NO: 158534 - DNA, 25 bp, Homo sapien
aacgtgcgagtgtctaacgggagcc

SEQ ID NO: 158535 - DNA, 25 bp, Homo sapien
gccagtgatagggacggtcactctg

SEQ ID NO: 158536 - DNA, 25 bp, Homo sapien
gctccagtgatagggacggtcactc

SEQ ID NO: 158537 - DNA, 25 bp, Homo sapien
tccagtgatagggacggtcactctg

SEQ ID NO: 158538 - DNA, 25 bp, Homo sapien
cggtcactctgggatcggctccagt

SEQ ID NO: 158539 - DNA, 25 bp, Homo sapien
ggtcactctgggatcggctccagtg

SEQ ID NO: 158540 - DNA, 25 bp, Homo sapien
cggctccagtgatagggacggtcac

SEQ ID NO: 158541 - DNA, 25 bp, Homo sapien
gcgccagtgatagggacggtcactc

SEQ ID NO: 158542 - DNA, 25 bp, Homo sapien
atcggctccagtgatagggacggtc

SEQ ID NO: 158543 - DNA, 25 bp, Homo sapien
tcgcgcagccgtggagctacctcaa

SEQ ID NO: 158544 - DNA, 25 bp, Homo sapien
tacctcaaggcggaactggggagtc

SEQ ID NO: 158545 - DNA, 25 bp, Homo sapien
cggcagcctgaacacccggtgtgaa

SEQ ID NO: 158546 - DNA, 25 bp, Homo sapien
gcgcagcagctcactctgctgaagg

SEQ ID NO: 158547 - DNA, 25 bp, Homo sapien
ggacgtgctaaccaccctgaagatc

SEQ ID NO: 158548 - DNA, 25 bp, Homo sapien
gccgcgacgggaactgtaaactgca

SEQ ID NO: 158549 - DNA, 25 bp, Homo sapien
aactgtaaactgcagcggcgggctc

SEQ ID NO: 158550 - DNA, 25 bp, Homo sapien
cttgcctcgaacctctcggggttca

SEQ ID NO: 158551 - DNA, 25 bp, Homo sapien
taggatctcctgtctggtgttcaga

SEQ ID NO: 158552 - DNA, 25 bp, Homo sapien
acttgctgtgtctttcacctgggcc

SEQ ID NO: 158553 - DNA, 25 bp, Homo sapien
cccgcagaaccgaaagtgccgagtt

SEQ ID NO: 158554 - DNA, 25 bp, Homo sapien
ccgagttgacacgtaaggcccagcc

SEQ ID NO: 158555 - DNA, 25 bp, Homo sapien
catcggagcgagcagtacaaaaaga

SEQ ID NO: 158556 - DNA, 25 bp, Homo sapien
tcgacgcgcctctaaaggaacgttg

SEQ ID NO: 158557 - DNA, 25 bp, Homo sapien
gcctcggacgcgcatttcacaaaca

SEQ ID NO: 158558 - DNA, 25 bp, Homo sapien
ggacgctgccttcgccatttcatct

SEQ ID NO: 158559 - DNA, 25 bp, Homo sapien
tgctccgctgaactcgtgccaagtt

SEQ ID NO: 158560 - DNA, 25 bp, Homo sapien
ctgtctacttcatcgtcttctttgg

SEQ ID NO: 158561 - DNA, 25 bp, Homo sapien
ccatcgccctgtacaattctgtcta

SEQ ID NO: 158562 - DNA, 25 bp, Homo sapien
gcctcgagtttttctgccgctggca

SEQ ID NO: 158563 - DNA, 25 bp, Homo sapien
gagagatcctgagctgcctcgagtt

SEQ ID NO: 158564 - DNA, 25 bp, Homo sapien
tgccaggaccagatgcgagagatcc

SEQ ID NO: 158565 - DNA, 25 bp, Homo sapien
cgctgatcttctgcaactcccggga

SEQ ID NO: 158566 - DNA, 25 bp, Homo sapien
ttctttggctcacgtggcttcctca

SEQ ID NO: 158567 - DNA, 25 bp, Homo sapien
agagcacgtcgtccggggagaacta

SEQ ID NO: 158568 - DNA, 25 bp, Homo sapien
ggaacacgattctccgaccgaagcg

SEQ ID NO: 158569 - DNA, 25 bp, Homo sapien
ggatctattccgcaagcctacgcgc

SEQ ID NO: 158570 - DNA, 25 bp, Homo sapien
agcctacgcgcccatattcactggg

SEQ ID NO: 158571 - DNA, 25 bp, Homo sapien
acctgcctagcggacgggtgcaatc

SEQ ID NO: 158572 - DNA, 25 bp, Homo sapien
ttccggagacctcacacaagatggc

SEQ ID NO: 158573 - DNA, 25 bp, Homo sapien
acaagatggcggcacccgaggaaca

SEQ ID NO: 158574 - DNA, 25 bp, Homo sapien
gcggcacccgaggaacacgattctc

SEQ ID NO: 158575 - DNA, 25 bp, Homo sapien
cgagggccgcctttataacaactgc

SEQ ID NO: 158576 - DNA, 25 bp, Homo sapien
catgaagtgccgtggaactggaata

SEQ ID NO: 158577 - DNA, 25 bp, Homo sapien
cagacggtttttgggtcattccctg

SEQ ID NO: 158578 - DNA, 25 bp, Homo sapien
ctgtgcctctgacgtcagacggttt

SEQ ID NO: 158579 - DNA, 25 bp, Homo sapien
ccaacgccttggcactagggtaagt

SEQ ID NO: 158580 - DNA, 25 bp, Homo sapien
cggatttaaatcgtctggggagagc

SEQ ID NO: 158581 - DNA, 25 bp, Homo sapien
ctggaataggcgtgtcctctccctc

SEQ ID NO: 158582 - DNA, 25 bp, Homo sapien
agcagcaccaagttcacggccaacg

SEQ ID NO: 158583 - DNA, 25 bp, Homo sapien
gtggagagccgcactcgcgacagac

SEQ ID NO: 158584 - DNA, 25 bp, Homo sapien
ggagagccgcactcgcgacagacac

SEQ ID NO: 158585 - DNA, 25 bp, Homo sapien
gacagacaccagaacgcaccttcga

SEQ ID NO: 158586 - DNA, 25 bp, Homo sapien
cagacaccagaacgcaccttcgata

SEQ ID NO: 158587 - DNA, 25 bp, Homo sapien
gacaccagaacgcaccttcgatagc

SEQ ID NO: 158588 - DNA, 25 bp, Homo sapien
accagaacgcaccttcgatagcaca

SEQ ID NO: 158589 - DNA, 25 bp, Homo sapien
agaacgcaccttcgatagcacattc

SEQ ID NO: 158590 - DNA, 25 bp, Homo sapien
acgcaccttcgatagcacattcctg

SEQ ID NO: 158591 - DNA, 25 bp, Homo sapien
gggaggcagcaatccttcaggtcct

SEQ ID NO: 158592 - DNA, 25 bp, Homo sapien
ttgtagccgagacgctcccgacgca

SEQ ID NO: 158593 - DNA, 25 bp, Homo sapien
ccaacatgttgtagccgagacgctc

SEQ ID NO: 158594 - DNA, 25 bp, Homo sapien
gttcttgatcatgcccaacatgttg

SEQ ID NO: 158595 - DNA, 25 bp, Homo sapien
agcgagttcttgatcatgcccaaca

SEQ ID NO: 158596 - DNA, 25 bp, Homo sapien
tacgcttccgaacagcgagttcttg

SEQ ID NO: 158597 - DNA, 25 bp, Homo sapien
ccctttgcttaggacctgccaaggc

SEQ ID NO: 158598 - DNA, 25 bp, Homo sapien
acgtctctacgcttccgaacagcga

SEQ ID NO: 158599 - DNA, 25 bp, Homo sapien
agtctaacctatccgctggggccct

SEQ ID NO: 158600 - DNA, 25 bp, Homo sapien
gagtctaacctatccgctggggccc

SEQ ID NO: 158601 - DNA, 25 bp, Homo sapien
attctgagtctaacctatccgctgg

SEQ ID NO: 158602 - DNA, 25 bp, Homo sapien
ttctgagtctaacctatccgctggg

SEQ ID NO: 158603 - DNA, 25 bp, Homo sapien
tctgagtctaacctatccgctgggg

SEQ ID NO: 158604 - DNA, 25 bp, Homo sapien
ctgagtctaacctatccgctggggc

SEQ ID NO: 158605 - DNA, 25 bp, Homo sapien
tgagtctaacctatccgctggggcc

SEQ ID NO: 158606 - DNA, 25 bp, Homo sapien
tattctgagtctaacctatccgctg

SEQ ID NO: 158607 - DNA, 25 bp, Homo sapien
gcgattctcgcctggagtggcttta

SEQ ID NO: 158608 - DNA, 25 bp, Homo sapien
tacccgaaggctcgatcccgctggt

SEQ ID NO: 158609 - DNA, 25 bp, Homo sapien
gggttgctcacgcttctccggtcct

SEQ ID NO: 158610 - DNA, 25 bp, Homo sapien
gggaacgtcctctctcaggtgcctg

SEQ ID NO: 158611 - DNA, 25 bp, Homo sapien
ctcgcctggagtggctttaggcagc

SEQ ID NO: 158612 - DNA, 25 bp, Homo sapien
cggtggtggggaacgtcctctctca

SEQ ID NO: 158613 - DNA, 25 bp, Homo sapien
gctcgatcccgctggtacagcggcg

SEQ ID NO: 158614 - DNA, 25 bp, Homo sapien
ccctggaaagcgattctcgcctgga

SEQ ID NO: 158615 - DNA, 25 bp, Homo sapien
cggcgcagtgatggatgttaacagc

SEQ ID NO: 158616 - DNA, 25 bp, Homo sapien
gctctttcctcctgccggaggtggg

SEQ ID NO: 158617 - DNA, 25 bp, Homo sapien
cggccgcggggagcaaatcaagaaa

SEQ ID NO: 158618 - DNA, 25 bp, Homo sapien
caagaaagggccgagaaagttgtga

SEQ ID NO: 158619 - DNA, 25 bp, Homo sapien
cggcttcttgggcagcgccacacgg

SEQ ID NO: 158620 - DNA, 25 bp, Homo sapien
tgtcctgacgctcatctctctgcga

SEQ ID NO: 158621 - DNA, 25 bp, Homo sapien
catctctctgcgatcgcgggcaact

SEQ ID NO: 158622 - DNA, 25 bp, Homo sapien
gccaacctctcggtggccatggcgg

SEQ ID NO: 158623 - DNA, 25 bp, Homo sapien
tacacttcccggcagaacgcgggcg

SEQ ID NO: 158624 - DNA, 25 bp, Homo sapien
tcagccatggcgaccgtgctgtcca

SEQ ID NO: 158625 - DNA, 25 bp, Homo sapien
ctgccgggtaaggagtcgcatgctt

SEQ ID NO: 158626 - DNA, 25 bp, Homo sapien
agtcgcatgcttgcgaccacccagt

SEQ ID NO: 158627 - DNA, 25 bp, Homo sapien
cgagtggccctctgtggatcatccc

SEQ ID NO: 158628 - DNA, 25 bp, Homo sapien
ggcgccttctgtcttggctggacct

SEQ ID NO: 158629 - DNA, 25 bp, Homo sapien
gagaggagcatccttcccgagcgcc

SEQ ID NO: 158630 - DNA, 25 bp, Homo sapien
ttacggcggggaatgtcagaacgcc

SEQ ID NO: 158631 - DNA, 25 bp, Homo sapien
agaccactaatttcgcggccgcgtt

SEQ ID NO: 158632 - DNA, 25 bp, Homo sapien
ccgcgttccacgaagctaaggggca

SEQ ID NO: 158633 - DNA, 25 bp, Homo sapien
gcgccgcttaggtttgggaagacac

SEQ ID NO: 158634 - DNA, 25 bp, Homo sapien
gcgtccacttcctacggcaagcagg

SEQ ID NO: 158635 - DNA, 25 bp, Homo sapien
cgcccatcactctgtttcggtgcta

SEQ ID NO: 158636 - DNA, 25 bp, Homo sapien
ttcggtgctaatcgaccgccgtggc

SEQ ID NO: 158637 - DNA, 25 bp, Homo sapien
agtgctgaggctttcgcctttccta

SEQ ID NO: 158638 - DNA, 25 bp, Homo sapien
cccgcgagtctcaggtcagaagacc

SEQ ID NO: 158639 - DNA, 25 bp, Homo sapien
acccatggcttcctgaccgggtcgg

SEQ ID NO: 158640 - DNA, 25 bp, Homo sapien
gtgtttggcattgtttgcgaggccc

SEQ ID NO: 158641 - DNA, 25 bp, Homo sapien
tcggagggattccttacacccaggc

SEQ ID NO: 158642 - DNA, 25 bp, Homo sapien
ctgggtcttcctccgtcggttgaga

SEQ ID NO: 158643 - DNA, 25 bp, Homo sapien
tcctccgtcggttgagaacggtgtc

SEQ ID NO: 158644 - DNA, 25 bp, Homo sapien
tgggtagtcggagggattccttaca

SEQ ID NO: 158645 - DNA, 25 bp, Homo sapien
caccctgatgagtaacgcgccgtct

SEQ ID NO: 158646 - DNA, 25 bp, Homo sapien
acaggccggccgtgtttggcattgt

SEQ ID NO: 158647 - DNA, 25 bp, Homo sapien
ccggaaatttcactgcgcgtggcta

SEQ ID NO: 158648 - DNA, 25 bp, Homo sapien
cttagctggcccgattgccggaaat

SEQ ID NO: 158649 - DNA, 25 bp, Homo sapien
gctgcggtgcaaatcccgtgtctta

SEQ ID NO: 158650 - DNA, 25 bp, Homo sapien
cccttcgcactttaggagagaaatt

SEQ ID NO: 158651 - DNA, 25 bp, Homo sapien
atgtttcctgactgccggtcccagc

SEQ ID NO: 158652 - DNA, 25 bp, Homo sapien
agcgaggccttctcatgtttcctga

SEQ ID NO: 158653 - DNA, 25 bp, Homo sapien
tcagaggcaagcgatggcaaaggtc

SEQ ID NO: 158654 - DNA, 25 bp, Homo sapien
tccaccagaccttggagggaagttg

SEQ ID NO: 158655 - DNA, 25 bp, Homo sapien
tggctctcgaaacttccctcgggga

SEQ ID NO: 158656 - DNA, 25 bp, Homo sapien
acggtgcttgtaaagccactgcttg

SEQ ID NO: 158657 - DNA, 25 bp, Homo sapien
cacacagtttctggatggggagatc

SEQ ID NO: 158658 - DNA, 25 bp, Homo sapien
tcgccgactggacatagggaataaa

SEQ ID NO: 158659 - DNA, 25 bp, Homo sapien
agccgagggccaagagtatcttctc

SEQ ID NO: 158660 - DNA, 25 bp, Homo sapien
tgcactagcgtcatctgcgagccga

SEQ ID NO: 158661 - DNA, 25 bp, Homo sapien
aatgggtcctgattacctgcactag

SEQ ID NO: 158662 - DNA, 25 bp, Homo sapien
tgtctgctcccagaggctttccgtc

SEQ ID NO: 158663 - DNA, 25 bp, Homo sapien
gccgcgcgtggttcttcaatcacag

SEQ ID NO: 158664 - DNA, 25 bp, Homo sapien
actgtccaggacaccgctgtagggc

SEQ ID NO: 158665 - DNA, 25 bp, Homo sapien
agcaccgcaccgctgagcttgttga

SEQ ID NO: 158666 - DNA, 25 bp, Homo sapien
aaggtgcatctcgttacttactggc

SEQ ID NO: 158667 - DNA, 25 bp, Homo sapien
gggaatcattcacccgcagaggcaa

SEQ ID NO: 158668 - DNA, 25 bp, Homo sapien
tgagtcccaggccataccgggattt

SEQ ID NO: 158669 - DNA, 25 bp, Homo sapien
ccgggaagtgcatggtcctaaggtc

SEQ ID NO: 158670 - DNA, 25 bp, Homo sapien
ggcgtcaggacgaaagcaccacttc

SEQ ID NO: 158671 - DNA, 25 bp, Homo sapien
ggtaggccagctcgatctcgtcaaa

SEQ ID NO: 158672 - DNA, 25 bp, Homo sapien
gcaaaggtgctctcgccagctgaca

SEQ ID NO: 158673 - DNA, 25 bp, Homo sapien
taggggctcccatccatgaatcggc

SEQ ID NO: 158674 - DNA, 25 bp, Homo sapien
gcgcagtttgttccggttcttcttc

SEQ ID NO: 158675 - DNA, 25 bp, Homo sapien
ccagttcctgcagggagttgtcctc

SEQ ID NO: 158676 - DNA, 25 bp, Homo sapien
ggtcaggttcttctcccaaggtgca

SEQ ID NO: 158677 - DNA, 25 bp, Homo sapien
ttccttgtccctgaagtagcgcttg

SEQ ID NO: 158678 - DNA, 25 bp, Homo sapien
ctggtccaggtagaagtcccgtagc

SEQ ID NO: 158679 - DNA, 25 bp, Homo sapien
ctggtctggatttgggtctcacact

SEQ ID NO: 158680 - DNA, 25 bp, Homo sapien
ctcctcttgctaagactctggcgga

SEQ ID NO: 158681 - DNA, 25 bp, Homo sapien
tcccacgtcatgtgctggggaagtg

SEQ ID NO: 158682 - DNA, 25 bp, Homo sapien
gaagatactgcttctgctcccaggg

SEQ ID NO: 158683 - DNA, 25 bp, Homo sapien
acccacgaagctggggaagatactg

SEQ ID NO: 158684 - DNA, 25 bp, Homo sapien
gtctcacactcaaaaacgtgccgcg

SEQ ID NO: 158685 - DNA, 25 bp, Homo sapien
ctgtgcaagtcaaccgcgcggcagc

SEQ ID NO: 158686 - DNA, 25 bp, Homo sapien
ctgcggaaagcatctccaaggcgga

SEQ ID NO: 158687 - DNA, 25 bp, Homo sapien
actgaagcgcgcgaaaagctgaggc

SEQ ID NO: 158688 - DNA, 25 bp, Homo sapien
ggtttgtttttgaatctgcggaggc

SEQ ID NO: 158689 - DNA, 25 bp, Homo sapien
cccaaaaggtatatgtgaatcccag

SEQ ID NO: 158690 - DNA, 25 bp, Homo sapien
atcccaggggctgttaaaaccacat

SEQ ID NO: 158691 - DNA, 25 bp, Homo sapien
tttctgaagagtcaagaccgcatta

SEQ ID NO: 158692 - DNA, 25 bp, Homo sapien
gctgcatgggagcacgtgatcttgc

SEQ ID NO: 158693 - DNA, 25 bp, Homo sapien
tcgggctctagctgcagttgtgcag

SEQ ID NO: 158694 - DNA, 25 bp, Homo sapien
cccgcccatattaatttgcataacg

SEQ ID NO: 158695 - DNA, 25 bp, Homo sapien
cggggtcgaccatttatctccagca

SEQ ID NO: 158696 - DNA, 25 bp, Homo sapien
agcgaaccgatttgttggccaagaa

SEQ ID NO: 158697 - DNA, 25 bp, Homo sapien
ttgtaaagttggcagacgcactcgc

SEQ ID NO: 158698 - DNA, 25 bp, Homo sapien
cggctccgcggtgactaacaacagc

SEQ ID NO: 158699 - DNA, 25 bp, Homo sapien
ggcggatcctttacgtctgaccctc

SEQ ID NO: 158700 - DNA, 25 bp, Homo sapien
cccagctgcacttctgggaaatgca

SEQ ID NO: 158701 - DNA, 25 bp, Homo sapien
tgccgctttctttcgcagttttgcg

SEQ ID NO: 158702 - DNA, 25 bp, Homo sapien
caaggcttgggcgaatcagttcaca

SEQ ID NO: 158703 - DNA, 25 bp, Homo sapien
gctcgggccgcgaatatcccatttc

SEQ ID NO: 158704 - DNA, 25 bp, Homo sapien
cgccaagtctaatcccgagcagatg

SEQ ID NO: 158705 - DNA, 25 bp, Homo sapien
ctggattttgggaggtcactactgc

SEQ ID NO: 158706 - DNA, 25 bp, Homo sapien
ccggtatccggaaggcgacatcaaa

SEQ ID NO: 158707 - DNA, 25 bp, Homo sapien
gccgcttagaagaccatgaccagtt

SEQ ID NO: 158708 - DNA, 25 bp, Homo sapien
tacgcgccacactagagctgcattc

SEQ ID NO: 158709 - DNA, 25 bp, Homo sapien
cggccgccttaatctcagcatctga

SEQ ID NO: 158710 - DNA, 25 bp, Homo sapien
tacccgcttggcgtaggcaacttta

SEQ ID NO: 158711 - DNA, 25 bp, Homo sapien
cgcgcgtgacaacaagaagaccagg

SEQ ID NO: 158712 - DNA, 25 bp, Homo sapien
agagcggtttgtctccgtctctgga

SEQ ID NO: 158713 - DNA, 25 bp, Homo sapien
tgatcatgtccggtcgcgggaaaca

SEQ ID NO: 158714 - DNA, 25 bp, Homo sapien
taccttacggcggagatcctggagc

SEQ ID NO: 158715 - DNA, 25 bp, Homo sapien
gaagagcaaatgaccctgacgccgc

SEQ ID NO: 158716 - DNA, 25 bp, Homo sapien
gcaaaggcccttttcatggtcgtcc

SEQ ID NO: 158717 - DNA, 25 bp, Homo sapien
ggtcgtcccgcaatgcttttgaatg

SEQ ID NO: 158718 - DNA, 25 bp, Homo sapien
ccgagtgcacagactgctgcgcaaa

SEQ ID NO: 158719 - DNA, 25 bp, Homo sapien
ggctgaccgaccatgactcgaggta

SEQ ID NO: 158720 - DNA, 25 bp, Homo sapien
gtacaagacgtcaaacctaaggcta

SEQ ID NO: 158721 - DNA, 25 bp, Homo sapien
cgaaaccatagcgacggctgaccga

SEQ ID NO: 158722 - DNA, 25 bp, Homo sapien
ttctgctgtgctcccaggactacga

SEQ ID NO: 158723 - DNA, 25 bp, Homo sapien
ctaaggctactaatcaacgtgcgta

SEQ ID NO: 158724 - DNA, 25 bp, Homo sapien
aggcccaggaatagcccagtccgca

SEQ ID NO: 158725 - DNA, 25 bp, Homo sapien
gtccgcaacagggagacctcaacca

SEQ ID NO: 158726 - DNA, 25 bp, Homo sapien
gccttcaactgggtctctcggtcaa

SEQ ID NO: 158727 - DNA, 25 bp, Homo sapien
aagtcgtcccgaaagagctgcctgg

SEQ ID NO: 158728 - DNA, 25 bp, Homo sapien
gggtctttaacgtgctgcacccaag

SEQ ID NO: 158729 - DNA, 25 bp, Homo sapien
cccggtgaccaagaggaccgactca

SEQ ID NO: 158730 - DNA, 25 bp, Homo sapien
caggcttgcgagcttgggtctttaa

SEQ ID NO: 158731 - DNA, 25 bp, Homo sapien
ctgcctggacacgtgcgtgacactc

SEQ ID NO: 158732 - DNA, 25 bp, Homo sapien
agctacggtcctctgcaagttcgga

SEQ ID NO: 158733 - DNA, 25 bp, Homo sapien
ctcgccgcagaagcaagtgccagtg

SEQ ID NO: 158734 - DNA, 25 bp, Homo sapien
gcagcccaggcttcaggttgcgttt

SEQ ID NO: 158735 - DNA, 25 bp, Homo sapien
acgctttgttgtcctcgcgtgtgcg

SEQ ID NO: 158736 - DNA, 25 bp, Homo sapien
cattaaagaacagcagcgcctggca

SEQ ID NO: 158737 - DNA, 25 bp, Homo sapien
cgcctggcacgttcttggaggaccc

SEQ ID NO: 158738 - DNA, 25 bp, Homo sapien
actggaaaggcagcatgcgctcgcc

SEQ ID NO: 158739 - DNA, 25 bp, Homo sapien
atgcgctcgccaggagcaacctcgg

SEQ ID NO: 158740 - DNA, 25 bp, Homo sapien
agttcgccattgtgagccgccgccg

SEQ ID NO: 158741 - DNA, 25 bp, Homo sapien
tgctgttcaaggtaggggagctcct

SEQ ID NO: 158742 - DNA, 25 bp, Homo sapien
tggctctttgtgctgttcaaggtag

SEQ ID NO: 158743 - DNA, 25 bp, Homo sapien
ggacatgcaggtaagcgccggccct

SEQ ID NO: 158744 - DNA, 25 bp, Homo sapien
acatgcaggtaagcgccggccctcg

SEQ ID NO: 158745 - DNA, 25 bp, Homo sapien
cgcagccaacttgggccgaaacttc

SEQ ID NO: 158746 - DNA, 25 bp, Homo sapien
cccggcgagatcgacggcggcctcc

SEQ ID NO: 158747 - DNA, 25 bp, Homo sapien
cctccctccggatcggccgcaggct

SEQ ID NO: 158748 - DNA, 25 bp, Homo sapien
ctccggtggacacctcggaggctgc

SEQ ID NO: 158749 - DNA, 25 bp, Homo sapien
gcggcgaacaaagctggggaccgcc

SEQ ID NO: 158750 - DNA, 25 bp, Homo sapien
ccgcggatgaagagtcggaggcggc

SEQ ID NO: 158751 - DNA, 25 bp, Homo sapien
gttgcaccgtatgcccgcgccagag

SEQ ID NO: 158752 - DNA, 25 bp, Homo sapien
gaccgcagcccagtccgttaccctg

SEQ ID NO: 158753 - DNA, 25 bp, Homo sapien
ccggcgcccttgtgggaggcctaca

SEQ ID NO: 158754 - DNA, 25 bp, Homo sapien
aggacgcgggtcaacactgcgcgcc

SEQ ID NO: 158755 - DNA, 25 bp, Homo sapien
cctgttgctaggacgcgggtcaaca

SEQ ID NO: 158756 - DNA, 25 bp, Homo sapien
cccgcctgttgctaggacgcgggtc

SEQ ID NO: 158757 - DNA, 25 bp, Homo sapien
tgtttcccgatccacgcgggcggct

SEQ ID NO: 158758 - DNA, 25 bp, Homo sapien
agagagccgcctctgtttcccgatc

SEQ ID NO: 158759 - DNA, 25 bp, Homo sapien
gcgccaagttatcaaggccgcgatc

SEQ ID NO: 158760 - DNA, 25 bp, Homo sapien
tgcacccagctaaagagcagcgatc

SEQ ID NO: 158761 - DNA, 25 bp, Homo sapien
gcgcctttcgccaaggggctcttac

SEQ ID NO: 158762 - DNA, 25 bp, Homo sapien
ttccagcacacaaaggcggattttt

SEQ ID NO: 158763 - DNA, 25 bp, Homo sapien
gcgagtcgacagcaggtttccagaa

SEQ ID NO: 158764 - DNA, 25 bp, Homo sapien
agatcgggatactcggtctgcagtc

SEQ ID NO: 158765 - DNA, 25 bp, Homo sapien
tgtatctgcggaagctcaggttacc

SEQ ID NO: 158766 - DNA, 25 bp, Homo sapien
agcgaaatccgctatccgggtcttg

SEQ ID NO: 158767 - DNA, 25 bp, Homo sapien
gccttcagtggcatcacgccttatg

SEQ ID NO: 158768 - DNA, 25 bp, Homo sapien
gaacaactttcaactcggccgcgga

SEQ ID NO: 158769 - DNA, 25 bp, Homo sapien
gcgccagttacctcacgagcactga

SEQ ID NO: 158770 - DNA, 25 bp, Homo sapien
ttcaagtcacttctacccggcgagc

SEQ ID NO: 158771 - DNA, 25 bp, Homo sapien
ccaatcgtcatttccggcgggtgct

SEQ ID NO: 158772 - DNA, 25 bp, Homo sapien
cgacccgtggttgatttggccttca

SEQ ID NO: 158773 - DNA, 25 bp, Homo sapien
tttacgtcgtcacttcctgccgatg

SEQ ID NO: 158774 - DNA, 25 bp, Homo sapien
tggctcgtgtccgtctagatattca

SEQ ID NO: 158775 - DNA, 25 bp, Homo sapien
agcagcgagatttccttgcggagca

SEQ ID NO: 158776 - DNA, 25 bp, Homo sapien
gctccggttcggtacctcgtggaga

SEQ ID NO: 158777 - DNA, 25 bp, Homo sapien
cttgcggagcaatattcctagggta

SEQ ID NO: 158778 - DNA, 25 bp, Homo sapien
ttcctagggtacagacctcgtagcc

SEQ ID NO: 158779 - DNA, 25 bp, Homo sapien
gccatgtccgcgcacaatcggggca

SEQ ID NO: 158780 - DNA, 25 bp, Homo sapien
acaatcggggcaccgagctcggtaa

SEQ ID NO: 158781 - DNA, 25 bp, Homo sapien
aagcagtggcgtctggtcagccctc

SEQ ID NO: 158782 - DNA, 25 bp, Homo sapien
agctacttagcgctccggttcggta

SEQ ID NO: 158783 - DNA, 25 bp, Homo sapien
cggtcctggacttacgggatcacca

SEQ ID NO: 158784 - DNA, 25 bp, Homo sapien
tgctgcgatcctctctgtgacaggg

SEQ ID NO: 158785 - DNA, 25 bp, Homo sapien
gcttcctcctcctaggtgggacttg

SEQ ID NO: 158786 - DNA, 25 bp, Homo sapien
cgccgggataacgtaaccacatcct

SEQ ID NO: 158787 - DNA, 25 bp, Homo sapien
cccagcaatcttcaggcagtcctta

SEQ ID NO: 158788 - DNA, 25 bp, Homo sapien
ctgagtttttcctccgcggccgcta

SEQ ID NO: 158789 - DNA, 25 bp, Homo sapien
tcgcgaccctagagtggcgacgctc

SEQ ID NO: 158790 - DNA, 25 bp, Homo sapien
tcatcagcacttggagacggcgccc

SEQ ID NO: 158791 - DNA, 25 bp, Homo sapien
taataggtgactgatctccccgggc

SEQ ID NO: 158792 - DNA, 25 bp, Homo sapien
ttcacctttgccaatcgcaatctcg

SEQ ID NO: 158793 - DNA, 25 bp, Homo sapien
gcaagatcgacgaaccacacctctt

SEQ ID NO: 158794 - DNA, 25 bp, Homo sapien
agcactgcggatccgggccctagcg

SEQ ID NO: 158795 - DNA, 25 bp, Homo sapien
ccctccttgctgtgtgtttgatgtg

SEQ ID NO: 158796 - DNA, 25 bp, Homo sapien
tcgtgctctccaactagcgtgctct

SEQ ID NO: 158797 - DNA, 25 bp, Homo sapien
gtttgttttctcgtgctctccaact

SEQ ID NO: 158798 - DNA, 25 bp, Homo sapien
cttcccgccggataattcacctttg

SEQ ID NO: 158799 - DNA, 25 bp, Homo sapien
ccaaggcgacgttttgccgcgatcc

SEQ ID NO: 158800 - DNA, 25 bp, Homo sapien
aggtcagtgctctgaagcgtttccc

SEQ ID NO: 158801 - DNA, 25 bp, Homo sapien
gactcggaggacaggtcagtgctct

SEQ ID NO: 158802 - DNA, 25 bp, Homo sapien
ccctgagccgcatggactcggagga

SEQ ID NO: 158803 - DNA, 25 bp, Homo sapien
tagcagcagcgtagtctccagcggc

SEQ ID NO: 158804 - DNA, 25 bp, Homo sapien
ctatcaccgacatggccgacctgga

SEQ ID NO: 158805 - DNA, 25 bp, Homo sapien
cagagacgatgtcggagccgagccc

SEQ ID NO: 158806 - DNA, 25 bp, Homo sapien
agcagcgacgagacccgctcgttga

SEQ ID NO: 158807 - DNA, 25 bp, Homo sapien
acaccgtcgccactgctgtggtagc

SEQ ID NO: 158808 - DNA, 25 bp, Homo sapien
cgaggggccacgataactggttgcc

SEQ ID NO: 158809 - DNA, 25 bp, Homo sapien
ccacgataactggttgcccgcagta

SEQ ID NO: 158810 - DNA, 25 bp, Homo sapien
gttgcccgcagtaggagcagaattc

SEQ ID NO: 158811 - DNA, 25 bp, Homo sapien
cccgcagtaggagcagaattcggta

SEQ ID NO: 158812 - DNA, 25 bp, Homo sapien
gtaggagcagaattcggtatgtacc

SEQ ID NO: 158813 - DNA, 25 bp, Homo sapien
aattcggtatgtaccgccgccagga

SEQ ID NO: 158814 - DNA, 25 bp, Homo sapien
atgtaccgccgccaggaagatggag

SEQ ID NO: 158815 - DNA, 25 bp, Homo sapien
cagtctcctgtgtgccttcttctgg

SEQ ID NO: 158816 - DNA, 25 bp, Homo sapien
tcggaaactttcctccgcgctgtgc

SEQ ID NO: 158817 - DNA, 25 bp, Homo sapien
agagggcaccctataccatggcagt

SEQ ID NO: 158818 - DNA, 25 bp, Homo sapien
agcatctagcattctccaggagtta

SEQ ID NO: 158819 - DNA, 25 bp, Homo sapien
cttgagcgtgctagcctttaacttg

SEQ ID NO: 158820 - DNA, 25 bp, Homo sapien
ctgcccgtgcttgttttcaacttga

SEQ ID NO: 158821 - DNA, 25 bp, Homo sapien
ggaatcctgatcgtttctgcccgtg

SEQ ID NO: 158822 - DNA, 25 bp, Homo sapien
cttcttctggatgggcttgtacctc

SEQ ID NO: 158823 - DNA, 25 bp, Homo sapien
ttccgagtccaggtcagcgagtcgg

SEQ ID NO: 158824 - DNA, 25 bp, Homo sapien
ggctgaccatgcagtatccagaagg

SEQ ID NO: 158825 - DNA, 25 bp, Homo sapien
gaaactcaccaacaccaacagggcg

SEQ ID NO: 158826 - DNA, 25 bp, Homo sapien
accgcggaacagtcttgtgatcaga

SEQ ID NO: 158827 - DNA, 25 bp, Homo sapien
ggtcgagagctttccggcaacaaga

SEQ ID NO: 158828 - DNA, 25 bp, Homo sapien
tgacgtggaccatgggaattttttc

SEQ ID NO: 158829 - DNA, 25 bp, Homo sapien
gacggagcgtactccctagtcctgg

SEQ ID NO: 158830 - DNA, 25 bp, Homo sapien
catccatggccggagcaacgacgga

SEQ ID NO: 158831 - DNA, 25 bp, Homo sapien
ctggagtccagagtcccgttgctcc

SEQ ID NO: 158832 - DNA, 25 bp, Homo sapien
gttgcttccgaaacgcagccggcag

SEQ ID NO: 158833 - DNA, 25 bp, Homo sapien
ctcgagatgagtagtgtgagctccc

SEQ ID NO: 158834 - DNA, 25 bp, Homo sapien
tatctggtaaggcaccggaagtgac

SEQ ID NO: 158835 - DNA, 25 bp, Homo sapien
gctccgccgcgatattcagtaaacc

SEQ ID NO: 158836 - DNA, 25 bp, Homo sapien
gtaaaccactgggagtccggcagca

SEQ ID NO: 158837 - DNA, 25 bp, Homo sapien
ggtgctcaggcggttccgcctcttt

SEQ ID NO: 158838 - DNA, 25 bp, Homo sapien
ccgagcacccgtaggtcggattatc

SEQ ID NO: 158839 - DNA, 25 bp, Homo sapien
cgcagaacgcacgagcccagtggga

SEQ ID NO: 158840 - DNA, 25 bp, Homo sapien
cgccgcagaggacaatcgggagcca

SEQ ID NO: 158841 - DNA, 25 bp, Homo sapien
ccaccgccgcagaggacaatcggga

SEQ ID NO: 158842 - DNA, 25 bp, Homo sapien
aacgcacgagcccagtgggagcccg

SEQ ID NO: 158843 - DNA, 25 bp, Homo sapien
tccagcccggctagtaaccaacacg

SEQ ID NO: 158844 - DNA, 25 bp, Homo sapien
taagaggggcctgctgataggctgc

SEQ ID NO: 158845 - DNA, 25 bp, Homo sapien
ctgcgaaggcgataggcgtctcaga

SEQ ID NO: 158846 - DNA, 25 bp, Homo sapien
gcgataggcgtctcagacttgaaga

SEQ ID NO: 158847 - DNA, 25 bp, Homo sapien
atcaaacgaagggatacgcgtgaga

SEQ ID NO: 158848 - DNA, 25 bp, Homo sapien
gacaagggagcgtcccacttcggga

SEQ ID NO: 158849 - DNA, 25 bp, Homo sapien
tgctgctaggtttattttccaccgg

SEQ ID NO: 158850 - DNA, 25 bp, Homo sapien
cggacatgctgctaggtttattttc

SEQ ID NO: 158851 - DNA, 25 bp, Homo sapien
aacctgaagcgtcacggacatgctg

SEQ ID NO: 158852 - DNA, 25 bp, Homo sapien
gagtgtcttgaacgctgcacccatt

SEQ ID NO: 158853 - DNA, 25 bp, Homo sapien
tgaggcgctgtgaggatcaaacgaa

SEQ ID NO: 158854 - DNA, 25 bp, Homo sapien
ccacaaacctgaagcgtcacggaca

SEQ ID NO: 158855 - DNA, 25 bp, Homo sapien
gtttcgccaataggaagcgctctta

SEQ ID NO: 158856 - DNA, 25 bp, Homo sapien
ctgcagccatgatctccttaacgga

SEQ ID NO: 158857 - DNA, 25 bp, Homo sapien
gactgtcctgtgtccgactctccga

SEQ ID NO: 158858 - DNA, 25 bp, Homo sapien
aggcctcgagcagatctttccgcta

SEQ ID NO: 158859 - DNA, 25 bp, Homo sapien
tccgctactcgggagtaaaatcttc

SEQ ID NO: 158860 - DNA, 25 bp, Homo sapien
tgcgcgtcaccgaacaacattacga

SEQ ID NO: 158861 - DNA, 25 bp, Homo sapien
ttaacggacacgcagagtaagcacc

SEQ ID NO: 158862 - DNA, 25 bp, Homo sapien
gtcggtccgttcagccaatcacaga

SEQ ID NO: 158863 - DNA, 25 bp, Homo sapien
gggctttcctccagagctccagggc

SEQ ID NO: 158864 - DNA, 25 bp, Homo sapien
tcctcaccggaaagacgcggctctg

SEQ ID NO: 158865 - DNA, 25 bp, Homo sapien
tgccgaaagaaagcgtctcctcacc

SEQ ID NO: 158866 - DNA, 25 bp, Homo sapien
ctagtcctgcgcttttggaatagga

SEQ ID NO: 158867 - DNA, 25 bp, Homo sapien
gagaaaggacctctccgaccggcca

SEQ ID NO: 158868 - DNA, 25 bp, Homo sapien
ccaggtctcgtttttgcagagggtc

SEQ ID NO: 158869 - DNA, 25 bp, Homo sapien
ctcagatacagtccgcccgagggca

SEQ ID NO: 158870 - DNA, 25 bp, Homo sapien
agagggtcgccgcttcatctccgac

SEQ ID NO: 158871 - DNA, 25 bp, Homo sapien
ggctctggagacctctgtaacagtc

SEQ ID NO: 158872 - DNA, 25 bp, Homo sapien
aactgagcggcaaagtcagggcccg

SEQ ID NO: 158873 - DNA, 25 bp, Homo sapien
cgcggccggatgctcagagctaaag

SEQ ID NO: 158874 - DNA, 25 bp, Homo sapien
cgcggaggacagatgtgcttcttcc

SEQ ID NO: 158875 - DNA, 25 bp, Homo sapien
gcacgtcccatcaggcttgcctgtg

SEQ ID NO: 158876 - DNA, 25 bp, Homo sapien
ctgagccgaaacctaccaggagaga

SEQ ID NO: 158877 - DNA, 25 bp, Homo sapien
cagtcgtgcggagaagacaaagtca

SEQ ID NO: 158878 - DNA, 25 bp, Homo sapien
agacaaagtcagctgcgtgcgtctc

SEQ ID NO: 158879 - DNA, 25 bp, Homo sapien
ccggattttctcaagagccagtttt

SEQ ID NO: 158880 - DNA, 25 bp, Homo sapien
cgcagtgcgccggaacggattattt

SEQ ID NO: 158881 - DNA, 25 bp, Homo sapien
gctgctgcctcctatcgagtttcta

SEQ ID NO: 158882 - DNA, 25 bp, Homo sapien
gcgacgccgcgattttacaaaccca

SEQ ID NO: 158883 - DNA, 25 bp, Homo sapien
ttagccacgtaaggaagcggatttg

SEQ ID NO: 158884 - DNA, 25 bp, Homo sapien
acccactgctgggttatgagtgcac

SEQ ID NO: 158885 - DNA, 25 bp, Homo sapien
gtgagacgctgattcccatggactg

SEQ ID NO: 158886 - DNA, 25 bp, Homo sapien
caaggctggctcaagtctaattttc

SEQ ID NO: 158887 - DNA, 25 bp, Homo sapien
gccttccagaggtgcgcatgtgcga

SEQ ID NO: 158888 - DNA, 25 bp, Homo sapien
tgagggactagctcccggatgtgga

SEQ ID NO: 158889 - DNA, 25 bp, Homo sapien
tgcagcgcaactctcgcggcggcca

SEQ ID NO: 158890 - DNA, 25 bp, Homo sapien
ggcagccctaattctggcccgggga

SEQ ID NO: 158891 - DNA, 25 bp, Homo sapien
ggaggcagcaaaggcatccccctga

SEQ ID NO: 158892 - DNA, 25 bp, Homo sapien
ccctgaagaacattaagcacctggc

SEQ ID NO: 158893 - DNA, 25 bp, Homo sapien
cgctcattggctgggtcctgcgtgc

SEQ ID NO: 158894 - DNA, 25 bp, Homo sapien
gaagaacattaagcacctggcgggg

SEQ ID NO: 158895 - DNA, 25 bp, Homo sapien
gaagtcacgatctatggccatggtc

SEQ ID NO: 158896 - DNA, 25 bp, Homo sapien
tcctaaacatgtggcccgtggcgtc

SEQ ID NO: 158897 - DNA, 25 bp, Homo sapien
tctgcgccgcaccaagtccttggaa

SEQ ID NO: 158898 - DNA, 25 bp, Homo sapien
tgatccttcgacaagcggccggtgt

SEQ ID NO: 158899 - DNA, 25 bp, Homo sapien
tcatcagttaattcagcggcgcgcc

SEQ ID NO: 158900 - DNA, 25 bp, Homo sapien
cttcgcagacaaacgcccggggatt

SEQ ID NO: 158901 - DNA, 25 bp, Homo sapien
ctcgtgcccttgttctttggagata

SEQ ID NO: 158902 - DNA, 25 bp, Homo sapien
caaaggtcagcgcaaggattttttc

SEQ ID NO: 158903 - DNA, 25 bp, Homo sapien
aacgctccatcttgcgggccgaagc

SEQ ID NO: 158904 - DNA, 25 bp, Homo sapien
ctccacgaaggcatcagtcaggtca

SEQ ID NO: 158905 - DNA, 25 bp, Homo sapien
acacactgaggtctcggcggtcatc

SEQ ID NO: 158906 - DNA, 25 bp, Homo sapien
tcttgggctcctgcagaaacaaaca

SEQ ID NO: 158907 - DNA, 25 bp, Homo sapien
cggccacgattttcaccttcagctt

SEQ ID NO: 158908 - DNA, 25 bp, Homo sapien
gtcaggtcactagcacggtccatca

SEQ ID NO: 158909 - DNA, 25 bp, Homo sapien
aaatgggccgagtcctgcatcatcc

SEQ ID NO: 158910 - DNA, 25 bp, Homo sapien
gcgcggaagaaagcatcgatcgttc

SEQ ID NO: 158911 - DNA, 25 bp, Homo sapien
ggtccagctccgacaacaggaattt

SEQ ID NO: 158912 - DNA, 25 bp, Homo sapien
tccagacccggatcggcaacagtgc

SEQ ID NO: 158913 - DNA, 25 bp, Homo sapien
gtcccattgtgaccggaggcgagaa

SEQ ID NO: 158914 - DNA, 25 bp, Homo sapien
gatcggcaacagtgccgcctccaga

SEQ ID NO: 158915 - DNA, 25 bp, Homo sapien
ccgggacggaaggatccaccagtct

SEQ ID NO: 158916 - DNA, 25 bp, Homo sapien
cggaaggatccaccagtctgtcggc

SEQ ID NO: 158917 - DNA, 25 bp, Homo sapien
ggctcagttcagctgctgtccagac

SEQ ID NO: 158918 - DNA, 25 bp, Homo sapien
caggaattttctccgagagcgggcc

SEQ ID NO: 158919 - DNA, 25 bp, Homo sapien
ccttggaggtctgcccacaacaaca

SEQ ID NO: 158920 - DNA, 25 bp, Homo sapien
gcggcgattacccacaccgtgcagg

SEQ ID NO: 158921 - DNA, 25 bp, Homo sapien
tggctcgcctttttcactctgtgtg

SEQ ID NO: 158922 - DNA, 25 bp, Homo sapien
cgtctgctgcagagtaactagattg

SEQ ID NO: 158923 - DNA, 25 bp, Homo sapien
ggcggcttcagagacaaacaacaca

SEQ ID NO: 158924 - DNA, 25 bp, Homo sapien
tttgtcaacttcttcccggcgcctg

SEQ ID NO: 158925 - DNA, 25 bp, Homo sapien
ggtgaaatccctttgctggtcatga

SEQ ID NO: 158926 - DNA, 25 bp, Homo sapien
tctctagatctcgatggagctcgca

SEQ ID NO: 158927 - DNA, 25 bp, Homo sapien
gcgcccgagcgagactatccctaaa

SEQ ID NO: 158928 - DNA, 25 bp, Homo sapien
ggggctgttcctccttatctggagc

SEQ ID NO: 158929 - DNA, 25 bp, Homo sapien
gctgcagcctcccttatttagtccg

SEQ ID NO: 158930 - DNA, 25 bp, Homo sapien
tatttagtccgcgatggcttccctc

SEQ ID NO: 158931 - DNA, 25 bp, Homo sapien
cagactggtcgcgaagagaagatcc

SEQ ID NO: 158932 - DNA, 25 bp, Homo sapien
cagtaactgggagctgatgagagtc

SEQ ID NO: 158933 - DNA, 25 bp, Homo sapien
caggccgggcattgatggtaatgta

SEQ ID NO: 158934 - DNA, 25 bp, Homo sapien
cagcagagactcagtgatgggtaaa

SEQ ID NO: 158935 - DNA, 25 bp, Homo sapien
ttacccatgagggtgctagacctgg

SEQ ID NO: 158936 - DNA, 25 bp, Homo sapien
cctttccaagcgcagatatttcgcg

SEQ ID NO: 158937 - DNA, 25 bp, Homo sapien
aggcccgagaatgcgcgccacgaac

SEQ ID NO: 158938 - DNA, 25 bp, Homo sapien
tgcagtcgctaaaaccgaagcggtt

SEQ ID NO: 158939 - DNA, 25 bp, Homo sapien
cccagtctgtctgcagtcgctaaaa

SEQ ID NO: 158940 - DNA, 25 bp, Homo sapien
tccagcatcccttggggaggagcct

SEQ ID NO: 158941 - DNA, 25 bp, Homo sapien
gccaggcgcagggtacgacgcaacc

SEQ ID NO: 158942 - DNA, 25 bp, Homo sapien
aggctgggactccagatttcgggca

SEQ ID NO: 158943 - DNA, 25 bp, Homo sapien
ctcaggatctgcacccggcggatgc

SEQ ID NO: 158944 - DNA, 25 bp, Homo sapien
caggcatgagatgtgggtctccatc

SEQ ID NO: 158945 - DNA, 25 bp, Homo sapien
agcagctccgggaacaggcatgaga

SEQ ID NO: 158946 - DNA, 25 bp, Homo sapien
gaggaggcttcctgctgcctttgtc

SEQ ID NO: 158947 - DNA, 25 bp, Homo sapien
gccatgccctggatcacgtagctga

SEQ ID NO: 158948 - DNA, 25 bp, Homo sapien
tgaggctctcgatgttggccatgcc

SEQ ID NO: 158949 - DNA, 25 bp, Homo sapien
cggacgtccaggtagccgaagatca

SEQ ID NO: 158950 - DNA, 25 bp, Homo sapien
cacaccgacttgtggtaggcggcgt

SEQ ID NO: 158951 - DNA, 25 bp, Homo sapien
gccggttcgattcacgcacacattt

SEQ ID NO: 158952 - DNA, 25 bp, Homo sapien
tttcttggagaaatcgccggttcga

SEQ ID NO: 158953 - DNA, 25 bp, Homo sapien
aagccatggttgtctcgccttcctc

SEQ ID NO: 158954 - DNA, 25 bp, Homo sapien
cacgtcctgcgagtggaggttaaac

SEQ ID NO: 158955 - DNA, 25 bp, Homo sapien
aaaagtccgagaaggcacgtcctgc

SEQ ID NO: 158956 - DNA, 25 bp, Homo sapien
tcccaaaagcgaatgtgaaaaagtc

SEQ ID NO: 158957 - DNA, 25 bp, Homo sapien
taccttcattgttccgtcggccacg

SEQ ID NO: 158958 - DNA, 25 bp, Homo sapien
ccctgccaactatgtttcttggaga

SEQ ID NO: 158959 - DNA, 25 bp, Homo sapien
tagcggtcgaggcttttgcggctcc

SEQ ID NO: 158960 - DNA, 25 bp, Homo sapien
cgcagagtcggagcagaaattgtgt

SEQ ID NO: 158961 - DNA, 25 bp, Homo sapien
aagagggttctgagcgtctcctgac

SEQ ID NO: 158962 - DNA, 25 bp, Homo sapien
ttctgagcgtctcctgacgttgacg

SEQ ID NO: 158963 - DNA, 25 bp, Homo sapien
cgaaatatgctctgggcgaggacca

SEQ ID NO: 158964 - DNA, 25 bp, Homo sapien
cgcttcgcagtagacggacagagga

SEQ ID NO: 158965 - DNA, 25 bp, Homo sapien
ctccaggaaaagagcgcagccgcgc

SEQ ID NO: 158966 - DNA, 25 bp, Homo sapien
attgtgtggacaaacgctcccgggt

SEQ ID NO: 158967 - DNA, 25 bp, Homo sapien
aggaatgagttgtggctcctaacta

SEQ ID NO: 158968 - DNA, 25 bp, Homo sapien
cgtgagctcgcgctaaactaaggac

SEQ ID NO: 158969 - DNA, 25 bp, Homo sapien
aactaaggacaccagccgagcattc

SEQ ID NO: 158970 - DNA, 25 bp, Homo sapien
gccgagcattcagcgcggttcccta

SEQ ID NO: 158971 - DNA, 25 bp, Homo sapien
gccctccaggaattttggaaagcta

SEQ ID NO: 158972 - DNA, 25 bp, Homo sapien
ggaaagctatccaagctcggcgcta

SEQ ID NO: 158973 - DNA, 25 bp, Homo sapien
agctcggcgctatctttaaaaggaa

SEQ ID NO: 158974 - DNA, 25 bp, Homo sapien
tcctaactagcttgccgaggagagc

SEQ ID NO: 158975 - DNA, 25 bp, Homo sapien
gggcggcgtaacctcgcttatttgc

SEQ ID NO: 158976 - DNA, 25 bp, Homo sapien
cccgctcttttgagattcctgatcc

SEQ ID NO: 158977 - DNA, 25 bp, Homo sapien
agtactgtagaagctgcagcgtttc

SEQ ID NO: 158978 - DNA, 25 bp, Homo sapien
tttccagaaaccgagcgaggacgtg

SEQ ID NO: 158979 - DNA, 25 bp, Homo sapien
cgggaacctttcaagtcctgagtca

SEQ ID NO: 158980 - DNA, 25 bp, Homo sapien
tataaatactacaggcgctcggcgc

SEQ ID NO: 158981 - DNA, 25 bp, Homo sapien
cgcttatttgcataggccgattgca

SEQ ID NO: 158982 - DNA, 25 bp, Homo sapien
caccctggaacgtgtaaggacgctc

SEQ ID NO: 158983 - DNA, 25 bp, Homo sapien
agtcccgagtcagagccagctttaa

SEQ ID NO: 158984 - DNA, 25 bp, Homo sapien
ctgtgtcagaatggtttgaggagtc

SEQ ID NO: 158985 - DNA, 25 bp, Homo sapien
gccgctcggaaactgctgtgtcaga

SEQ ID NO: 158986 - DNA, 25 bp, Homo sapien
ttctgaggcgggtgtcgaccttcgc

SEQ ID NO: 158987 - DNA, 25 bp, Homo sapien
ccagctttaattcgggagggatgac

SEQ ID NO: 158988 - DNA, 25 bp, Homo sapien
ggatgactacccagggctggcccgc

SEQ ID NO: 158989 - DNA, 25 bp, Homo sapien
gcccagacatgtgcgggcacacgtg

SEQ ID NO: 158990 - DNA, 25 bp, Homo sapien
cgtctggagaactgtggacgcgcac

SEQ ID NO: 158991 - DNA, 25 bp, Homo sapien
acaacaccgaggacaggcaggggaa

SEQ ID NO: 158992 - DNA, 25 bp, Homo sapien
tgtcggtgtccgtgtcgttctcggc

SEQ ID NO: 158993 - DNA, 25 bp, Homo sapien
cgccgtagccgctgtcggtgtccgt

SEQ ID NO: 158994 - DNA, 25 bp, Homo sapien
ctcctgcttgatggtgacgcggctc

SEQ ID NO: 158995 - DNA, 25 bp, Homo sapien
cgccgcgggaatccagcttcatcct

SEQ ID NO: 158996 - DNA, 25 bp, Homo sapien
aggccgctcttgtccaggaagggct

SEQ ID NO: 158997 - DNA, 25 bp, Homo sapien
cagatacttctccaggccgctcttg

SEQ ID NO: 158998 - DNA, 25 bp, Homo sapien
gccgccgggtacagatacttctcca

SEQ ID NO: 158999 - DNA, 25 bp, Homo sapien
tgtgcagagcccacgtttactaccg

SEQ ID NO: 159000 - DNA, 25 bp, Homo sapien
tctcaaacgggtaccagcacagggc

SEQ ID NO: 159001 - DNA, 25 bp, Homo sapien
agggccagcaacgtgatccgacctg

SEQ ID NO: 159002 - DNA, 25 bp, Homo sapien
tgctgccacatcactgctcggggaa

SEQ ID NO: 159003 - DNA, 25 bp, Homo sapien
aaccaaggtttttcctgcacagaga

SEQ ID NO: 159004 - DNA, 25 bp, Homo sapien
gccggaattgcggtgccactaatca

SEQ ID NO: 159005 - DNA, 25 bp, Homo sapien
cggggtgatctctgaaacgttgatt

SEQ ID NO: 159006 - DNA, 25 bp, Homo sapien
gcacgagaggggctaccacagaaaa

SEQ ID NO: 159007 - DNA, 25 bp, Homo sapien
ttctaactcgcgctctgctcggtga

SEQ ID NO: 159008 - DNA, 25 bp, Homo sapien
gtctgttttgcctaagcgcgtttgc

SEQ ID NO: 159009 - DNA, 25 bp, Homo sapien
cggtgagtcggctccaaatgttttc

SEQ ID NO: 159010 - DNA, 25 bp, Homo sapien
ttgccaaacaggaatgcgaagtcgc

SEQ ID NO: 159011 - DNA, 25 bp, Homo sapien
cataattcgaataccagggcaggcc

SEQ ID NO: 159012 - DNA, 25 bp, Homo sapien
ttgagactaacccagctgcatgtgc

SEQ ID NO: 159013 - DNA, 25 bp, Homo sapien
tgctagtcagggacactccattttg

SEQ ID NO: 159014 - DNA, 25 bp, Homo sapien
cctcgcagcgccatgggcaagaaca

SEQ ID NO: 159015 - DNA, 25 bp, Homo sapien
atcacctctcagataatctcggggc

SEQ ID NO: 159016 - DNA, 25 bp, Homo sapien
cgcgcatcacctctcaatctcgggg

SEQ ID NO: 159017 - DNA, 25 bp, Homo sapien
gcgcatcacctctcagataatctcg

SEQ ID NO: 159018 - DNA, 25 bp, Homo sapien
ctcagataatctcggggcccacaac

SEQ ID NO: 159019 - DNA, 25 bp, Homo sapien
ctcagataatctcggggcccgcgac

SEQ ID NO: 159020 - DNA, 25 bp, Homo sapien
tctcagataatctcggggcccgcga

SEQ ID NO: 159021 - DNA, 25 bp, Homo sapien
tcacgcgcatcacctctcagataat

SEQ ID NO: 159022 - DNA, 25 bp, Homo sapien
ctctcagataatctcggggcccaca

SEQ ID NO: 159023 - DNA, 25 bp, Homo sapien
tgaagttttctctccaacacctttg

SEQ ID NO: 159024 - DNA, 25 bp, Homo sapien
gcaggtttcctgttcctttctgaag

SEQ ID NO: 159025 - DNA, 25 bp, Homo sapien
gagccactgagcgtcgcggctcagc

SEQ ID NO: 159026 - DNA, 25 bp, Homo sapien
atcgcgggactacagcggccaagag

SEQ ID NO: 159027 - DNA, 25 bp, Homo sapien
gaggaagctggacattttctcagtc

SEQ ID NO: 159028 - DNA, 25 bp, Homo sapien
caaggtgctgatgaagccgttgacc

SEQ ID NO: 159029 - DNA, 25 bp, Homo sapien
ctcaggggaatttttggaccaggtg

SEQ ID NO: 159030 - DNA, 25 bp, Homo sapien
atgctgcttcatgttccacagtgga

SEQ ID NO: 159031 - DNA, 25 bp, Homo sapien
agactttgcgagaggccgagcgaaa

SEQ ID NO: 159032 - DNA, 25 bp, Homo sapien
cccgccggtgatggcgttgaacgcc

SEQ ID NO: 159033 - DNA, 25 bp, Homo sapien
gtccgattctgcgtctgcttgctga

SEQ ID NO: 159034 - DNA, 25 bp, Homo sapien
tggactaaatccagggacgggagca

SEQ ID NO: 159035 - DNA, 25 bp, Homo sapien
ctcctcttaatggagatgcggtgcg

SEQ ID NO: 159036 - DNA, 25 bp, Homo sapien
ccgactccgagctcctcttaatgga

SEQ ID NO: 159037 - DNA, 25 bp, Homo sapien
ggccggtgccttgcgcctcttgaac

SEQ ID NO: 159038 - DNA, 25 bp, Homo sapien
ccctggaaaaactcgcgagactttg

SEQ ID NO: 159039 - DNA, 25 bp, Homo sapien
tctcagtcgatacagttacgtcttc

SEQ ID NO: 159040 - DNA, 25 bp, Homo sapien
catagctggggcatttctgcctctc

SEQ ID NO: 159041 - DNA, 25 bp, Homo sapien
tggggcctgaaacatgagcaatgga

SEQ ID NO: 159042 - DNA, 25 bp, Homo sapien
cagcgattacggagcaattaaattc

SEQ ID NO: 159043 - DNA, 25 bp, Homo sapien
ctgagaaaccggcaccacgcactgg

SEQ ID NO: 159044 - DNA, 25 bp, Homo sapien
ggatagccctgcattggcatagctg

SEQ ID NO: 159045 - DNA, 25 bp, Homo sapien
cgtcgttgccgctaggcagcagcaa

SEQ ID NO: 159046 - DNA, 25 bp, Homo sapien
ccagccagtgtttacccagcgatta

SEQ ID NO: 159047 - DNA, 25 bp, Homo sapien
gtcccgaggcgcaggctcgctctag

SEQ ID NO: 159048 - DNA, 25 bp, Homo sapien
gcaggctcgctctagcagcactgac

SEQ ID NO: 159049 - DNA, 25 bp, Homo sapien
agaggaacaggcgtgggttacagca

SEQ ID NO: 159050 - DNA, 25 bp, Homo sapien
gcatttgatgccagagctgccgcct

SEQ ID NO: 159051 - DNA, 25 bp, Homo sapien
gctgatgacccgaagcacccgccgc

SEQ ID NO: 159052 - DNA, 25 bp, Homo sapien
gatgccagagctgccgcctggcgtc

SEQ ID NO: 159053 - DNA, 25 bp, Homo sapien
gcgtcctcagctcaggcatttgatg

SEQ ID NO: 159054 - DNA, 25 bp, Homo sapien
gtggcatctggaagatgcgtcctca

SEQ ID NO: 159055 - DNA, 25 bp, Homo sapien
agaggtttcctcttccggcacctga

SEQ ID NO: 159056 - DNA, 25 bp, Homo sapien
ttaccctcgctggaattcccgaaga

SEQ ID NO: 159057 - DNA, 25 bp, Homo sapien
ggaattcccgaagacctcggctgca

SEQ ID NO: 159058 - DNA, 25 bp, Homo sapien
cagccacccggtgttcggatgccag

SEQ ID NO: 159059 - DNA, 25 bp, Homo sapien
tgttcggatgccagcaccgctacga

SEQ ID NO: 159060 - DNA, 25 bp, Homo sapien
ggtgcagacgcttcgcacctgccag

SEQ ID NO: 159061 - DNA, 25 bp, Homo sapien
ctctcgctgcgtcacagcggcgggt

SEQ ID NO: 159062 - DNA, 25 bp, Homo sapien
cccagcgagaggtttcctcttccgg

SEQ ID NO: 159063 - DNA, 25 bp, Homo sapien
ggcttcggcataaagcgctctctcg

SEQ ID NO: 159064 - DNA, 25 bp, Homo sapien
ccagtcgcggaagagcagctgtttt

SEQ ID NO: 159065 - DNA, 25 bp, Homo sapien
gcgtctgtttgctgcggtaggaaca

SEQ ID NO: 159066 - DNA, 25 bp, Homo sapien
tcggctcacgcagcttcaggacgct

SEQ ID NO: 159067 - DNA, 25 bp, Homo sapien
aagatcgttcttgtccgggtgaggc

SEQ ID NO: 159068 - DNA, 25 bp, Homo sapien
gagcagactctttcgcttgaggaga

SEQ ID NO: 159069 - DNA, 25 bp, Homo sapien
ttccaaggacgcagccctgtgattg

SEQ ID NO: 159070 - DNA, 25 bp, Homo sapien
ctgtgattggccatgacgcgtgcca

SEQ ID NO: 159071 - DNA, 25 bp, Homo sapien
acccagccaccgagaagccgaggag

SEQ ID NO: 159072 - DNA, 25 bp, Homo sapien
cccgcctgggcttcacaaacaataa

SEQ ID NO: 159073 - DNA, 25 bp, Homo sapien
tgtctttgggtgtccagggaaagcc

SEQ ID NO: 159074 - DNA, 25 bp, Homo sapien
gggaggaatctttgtcctctgctcc

SEQ ID NO: 159075 - DNA, 25 bp, Homo sapien
ctggaaatgtctccggggaacctgc

SEQ ID NO: 159076 - DNA, 25 bp, Homo sapien
aataacaaatgtcgcggatcctctc

SEQ ID NO: 159077 - DNA, 25 bp, Homo sapien
ggcgttgacgacagaaggctacttc

SEQ ID NO: 159078 - DNA, 25 bp, Homo sapien
ccgggctaattctggggctggaaat

SEQ ID NO: 159079 - DNA, 25 bp, Homo sapien
cgacaggcggctcgtgtctttcacc

SEQ ID NO: 159080 - DNA, 25 bp, Homo sapien
gcgacagccctccataagcgacagg

SEQ ID NO: 159081 - DNA, 25 bp, Homo sapien
agctgataatactcgcggcttcccg

SEQ ID NO: 159082 - DNA, 25 bp, Homo sapien
tgtaaaccagttgtcagcagcctcg

SEQ ID NO: 159083 - DNA, 25 bp, Homo sapien
ctgctgcggggacttcctatatttc

SEQ ID NO: 159084 - DNA, 25 bp, Homo sapien
cgtcggcatggcatgcactgctgcg

SEQ ID NO: 159085 - DNA, 25 bp, Homo sapien
agccgaccaagtggctcctgcgatg

SEQ ID NO: 159086 - DNA, 25 bp, Homo sapien
ggctccagtccgcatgctcagtagc

SEQ ID NO: 159087 - DNA, 25 bp, Homo sapien
cggaataccggcctcatgaagggtg

SEQ ID NO: 159088 - DNA, 25 bp, Homo sapien
tcccgacacctagcctgcgtgagtg

SEQ ID NO: 159089 - DNA, 25 bp, Homo sapien
gcccgtctggtaggaaaaccatgga

SEQ ID NO: 159090 - DNA, 25 bp, Homo sapien
tgagtgcgcagaccaacgtgtttcc

SEQ ID NO: 159091 - DNA, 25 bp, Homo sapien
tctctgcagtcgagggcaaggactc

SEQ ID NO: 159092 - DNA, 25 bp, Homo sapien
tctttctccagcctagggcggtgcc

SEQ ID NO: 159093 - DNA, 25 bp, Homo sapien
aaaccatggacgtgggtctgtgctc

SEQ ID NO: 159094 - DNA, 25 bp, Homo sapien
aggactctgcgtgcattctccactg

SEQ ID NO: 159095 - DNA, 25 bp, Homo sapien
ggagctggaattcccttcccgcctg

SEQ ID NO: 159096 - DNA, 25 bp, Homo sapien
tgcgcttcatggtcgtccacttcca

SEQ ID NO: 159097 - DNA, 25 bp, Homo sapien
taactgcctggagatgtaccgcctg

SEQ ID NO: 159098 - DNA, 25 bp, Homo sapien
tcccaggtgcggctcaataactgcc

SEQ ID NO: 159099 - DNA, 25 bp, Homo sapien
tgctggacttcatcaacgccggcgg

SEQ ID NO: 159100 - DNA, 25 bp, Homo sapien
ctcatcgagcagagcgactacttcc

SEQ ID NO: 159101 - DNA, 25 bp, Homo sapien
ccgaggagatggtgcagatccgcct

SEQ ID NO: 159102 - DNA, 25 bp, Homo sapien
aggaccgctgctacccggtgagcaa

SEQ ID NO: 159103 - DNA, 25 bp, Homo sapien
ttcgattgaaccgaaatggcgctgc

SEQ ID NO: 159104 - DNA, 25 bp, Homo sapien
tggatgttctccctgcctaaaacgg

SEQ ID NO: 159105 - DNA, 25 bp, Homo sapien
gtgcctctctccagcgtttgcattt

SEQ ID NO: 159106 - DNA, 25 bp, Homo sapien
gcctcggcaccattaccttcaatta

SEQ ID NO: 159107 - DNA, 25 bp, Homo sapien
atgatgtaaaacagcgcggagctcc

SEQ ID NO: 159108 - DNA, 25 bp, Homo sapien
cggggtcgctcaatgagtcagcaca

SEQ ID NO: 159109 - DNA, 25 bp, Homo sapien
cagggatgtctccagttcctataga

SEQ ID NO: 159110 - DNA, 25 bp, Homo sapien
accaggatcggtacagggatgtctc

SEQ ID NO: 159111 - DNA, 25 bp, Homo sapien
cgggctgttggcctgtgaatttaag

SEQ ID NO: 159112 - DNA, 25 bp, Homo sapien
aaccgagcggaggaatgttcacacg

SEQ ID NO: 159113 - DNA, 25 bp, Homo sapien
tgttcacacgctccgaggcaaacct

SEQ ID NO: 159114 - DNA, 25 bp, Homo sapien
aacctgccggagaagtgagctagtc

SEQ ID NO: 159115 - DNA, 25 bp, Homo sapien
ctagtcgcaaagaggtggcgcccta

SEQ ID NO: 159116 - DNA, 25 bp, Homo sapien
agctgtcaggagctctgccgagccc

SEQ ID NO: 159117 - DNA, 25 bp, Homo sapien
ttaaggagcccgaagctcgcctggc

SEQ ID NO: 159118 - DNA, 25 bp, Homo sapien
gccaagaccaccaggggcggaccga

SEQ ID NO: 159119 - DNA, 25 bp, Homo sapien
ttattgaggtctttgcgttctgccc

SEQ ID NO: 159120 - DNA, 25 bp, Homo sapien
gggcttcagtccctaagagtctgga

SEQ ID NO: 159121 - DNA, 25 bp, Homo sapien
ggactgccgcacagaatccttcttg

SEQ ID NO: 159122 - DNA, 25 bp, Homo sapien
ccttcttgcccggagcggtattatt

SEQ ID NO: 159123 - DNA, 25 bp, Homo sapien
atactcggagtctctggtcctgcgc

SEQ ID NO: 159124 - DNA, 25 bp, Homo sapien
taagccctaggcagacggtgacgct

SEQ ID NO: 159125 - DNA, 25 bp, Homo sapien
ggcccgtgagcggatctagctacta

SEQ ID NO: 159126 - DNA, 25 bp, Homo sapien
cgcgaacttcctctgagcagggctc

SEQ ID NO: 159127 - DNA, 25 bp, Homo sapien
tacgcccacgaacacgtgattattg

SEQ ID NO: 159128 - DNA, 25 bp, Homo sapien
gagtgttttcgaaagtctacgccca

SEQ ID NO: 159129 - DNA, 25 bp, Homo sapien
cacgtgacgcgcgtgtttacgttga

SEQ ID NO: 159130 - DNA, 25 bp, Homo sapien
gcacgtcccagaatcgagtgttttc

SEQ ID NO: 159131 - DNA, 25 bp, Homo sapien
ggtaccggtatctgcacgtcccaga

SEQ ID NO: 159132 - DNA, 25 bp, Homo sapien
gtgaccaacctcctgcgggaacgga

SEQ ID NO: 159133 - DNA, 25 bp, Homo sapien
agcaggtaagtgaacgctcgccttc

SEQ ID NO: 159134 - DNA, 25 bp, Homo sapien
tattgtgtcaccgaagcgcctaccg

SEQ ID NO: 159135 - DNA, 25 bp, Homo sapien
ccgaaagactggagccgtttccttg

SEQ ID NO: 159136 - DNA, 25 bp, Homo sapien
ttcctggagagagcgcgaaaatgcc

SEQ ID NO: 159137 - DNA, 25 bp, Homo sapien
cgctccaaaagcagagaccggactg

SEQ ID NO: 159138 - DNA, 25 bp, Homo sapien
gcaggatttagaggaccactagttg

SEQ ID NO: 159139 - DNA, 25 bp, Homo sapien
ccacgtgtgaaacggcagcggtcct

SEQ ID NO: 159140 - DNA, 25 bp, Homo sapien
agagtgtcacgtttgggagccgaaa

SEQ ID NO: 159141 - DNA, 25 bp, Homo sapien
ctccgagccggatatatagagtgtc

SEQ ID NO: 159142 - DNA, 25 bp, Homo sapien
cccatcctcgtgctggaggaacagg

SEQ ID NO: 159143 - DNA, 25 bp, Homo sapien
gcaggcagccgagagaccgccttca

SEQ ID NO: 159144 - DNA, 25 bp, Homo sapien
gtggtcaacgccatcagccgggcct

SEQ ID NO: 159145 - DNA, 25 bp, Homo sapien
gacaacgtggagtacggctaccgct

SEQ ID NO: 159146 - DNA, 25 bp, Homo sapien
cgcttaccgccctggcctcattctg

SEQ ID NO: 159147 - DNA, 25 bp, Homo sapien
tggagtacggctaccgcttcgccaa

SEQ ID NO: 159148 - DNA, 25 bp, Homo sapien
cggctaccgcttcgccaaggagttt

SEQ ID NO: 159149 - DNA, 25 bp, Homo sapien
agaggagagcgcacccgcttaccgc

SEQ ID NO: 159150 - DNA, 25 bp, Homo sapien
ctgcaggcagccgagagaccgcctt

SEQ ID NO: 159151 - DNA, 25 bp, Homo sapien
ggaaaagtagtgacagtcgaacctg

SEQ ID NO: 159152 - DNA, 25 bp, Homo sapien
ggcaaggccaagactcttaaagaga

SEQ ID NO: 159153 - DNA, 25 bp, Homo sapien
acagtcgaacctgtctctcagcatc

SEQ ID NO: 159154 - DNA, 25 bp, Homo sapien
cctgcgccgaggaaaagtagtgaca

SEQ ID NO: 159155 - DNA, 25 bp, Homo sapien
aagcactgtgcgaaactccttccgg

SEQ ID NO: 159156 - DNA, 25 bp, Homo sapien
ttctcattttccgaagcactgtgcg

SEQ ID NO: 159157 - DNA, 25 bp, Homo sapien
cgagttgacacgttgccttcggaag

SEQ ID NO: 159158 - DNA, 25 bp, Homo sapien
gccttcggaaggtttcctgcgccga

SEQ ID NO: 159159 - DNA, 25 bp, Homo sapien
ttttaggtgtaatcgcgccgccagt

SEQ ID NO: 159160 - DNA, 25 bp, Homo sapien
cgtgcctacagggaaatgaggttgc

SEQ ID NO: 159161 - DNA, 25 bp, Homo sapien
gcttacgacgtgcttagggaatgaa

SEQ ID NO: 159162 - DNA, 25 bp, Homo sapien
cgatattccctttgcttacgacgtg

SEQ ID NO: 159163 - DNA, 25 bp, Homo sapien
caatgtacagatctcgcgatattcc

SEQ ID NO: 159164 - DNA, 25 bp, Homo sapien
gcgactatcacagctgaaaacgtca

SEQ ID NO: 159165 - DNA, 25 bp, Homo sapien
cgcgagaacaaaagcgactatcaca

SEQ ID NO: 159166 - DNA, 25 bp, Homo sapien
cgtacccggaaatatcgcgagaaca

SEQ ID NO: 159167 - DNA, 25 bp, Homo sapien
aaatgaacattcaactgagcagagc

SEQ ID NO: 159168 - DNA, 25 bp, Homo sapien
atctaacttcagttccggtctggca

SEQ ID NO: 159169 - DNA, 25 bp, Homo sapien
tttcctgatacaaaaatctaacttc

SEQ ID NO: 159170 - DNA, 25 bp, Homo sapien
tgtgatttttatgtacatgatgaac

SEQ ID NO: 159171 - DNA, 25 bp, Homo sapien
cccacctggatgactgatggcggcg

SEQ ID NO: 159172 - DNA, 25 bp, Homo sapien
gagcagagcagaagatatttttata

SEQ ID NO: 159173 - DNA, 25 bp, Homo sapien
tgtacatgatgaactgtcttaatta

SEQ ID NO: 159174 - DNA, 25 bp, Homo sapien
gagcagaagatatttttatatttcc

SEQ ID NO: 159175 - DNA, 25 bp, Homo sapien
tcgggcagaggtggtcaccaccatc

SEQ ID NO: 159176 - DNA, 25 bp, Homo sapien
ctagcgcgaggtgagggactcactt

SEQ ID NO: 159177 - DNA, 25 bp, Homo sapien
gaaagggcggcaaaaatgaaatgcc

SEQ ID NO: 159178 - DNA, 25 bp, Homo sapien
agtgccatgcacatcctggagagga

SEQ ID NO: 159179 - DNA, 25 bp, Homo sapien
tggatcccggagcaaagtgccatgc

SEQ ID NO: 159180 - DNA, 25 bp, Homo sapien
cccgccttgcttgcaggtggaccgg

SEQ ID NO: 159181 - DNA, 25 bp, Homo sapien
caggttcccacttgcggtgtccggc

SEQ ID NO: 159182 - DNA, 25 bp, Homo sapien
cggagttggcccagctgcaaataaa

SEQ ID NO: 159183 - DNA, 25 bp, Homo sapien
ctgcaggcgcttgagtaccagatgg

SEQ ID NO: 159184 - DNA, 25 bp, Homo sapien
tccagtcgccagcttcgtgatcttc

SEQ ID NO: 159185 - DNA, 25 bp, Homo sapien
cctggcgctaggctacccaggagag

SEQ ID NO: 159186 - DNA, 25 bp, Homo sapien
tcgtgatcttctgcccggactttct

SEQ ID NO: 159187 - DNA, 25 bp, Homo sapien
gggatcctggcgctaggctacccag

SEQ ID NO: 159188 - DNA, 25 bp, Homo sapien
tttaccgcagcgctctcactgcagg

SEQ ID NO: 159189 - DNA, 25 bp, Homo sapien
cgctctcactgcaggcgcttgagta

SEQ ID NO: 159190 - DNA, 25 bp, Homo sapien
ccagcttcgtgatcttctgcccgga

SEQ ID NO: 159191 - DNA, 25 bp, Homo sapien
ctctcttcgctgagaacggccgcta

SEQ ID NO: 159192 - DNA, 25 bp, Homo sapien
agctacatcttcatctggctgcagc

SEQ ID NO: 159193 - DNA, 25 bp, Homo sapien
gggcgtcaatggatcgccactccag

SEQ ID NO: 159194 - DNA, 25 bp, Homo sapien
tgtggagaccctactctcttcgctg

SEQ ID NO: 159195 - DNA, 25 bp, Homo sapien
gatacccttgcgtgctgtggagacc

SEQ ID NO: 159196 - DNA, 25 bp, Homo sapien
gggaacgctgaccacccgaggctga

SEQ ID NO: 159197 - DNA, 25 bp, Homo sapien
ccgtgctgctcaccaaaggtgggtg

SEQ ID NO: 159198 - DNA, 25 bp, Homo sapien
gcctcgcgaaggtcactgacgcgca

SEQ ID NO: 159199 - DNA, 25 bp, Homo sapien
tccaggcttcgcacctgctaaacct

SEQ ID NO: 159200 - DNA, 25 bp, Homo sapien
cccgcggcttgagcgctgcggtaaa

SEQ ID NO: 159201 - DNA, 25 bp, Homo sapien
atctgggactcaagcgcccgcggct

SEQ ID NO: 159202 - DNA, 25 bp, Homo sapien
tgctaaacctgcctcgtcacctggg

SEQ ID NO: 159203 - DNA, 25 bp, Homo sapien
ccaatgctgttgttccgggtgctga

SEQ ID NO: 159204 - DNA, 25 bp, Homo sapien
ccctgcgccaatgctgttgttccgg

SEQ ID NO: 159205 - DNA, 25 bp, Homo sapien
acctgcctcgtcacctgggaggggt

SEQ ID NO: 159206 - DNA, 25 bp, Homo sapien
caaggggcgaatggagagcgtctcc

SEQ ID NO: 159207 - DNA, 25 bp, Homo sapien
tcacctggttgagctcgttctcggc

SEQ ID NO: 159208 - DNA, 25 bp, Homo sapien
cggccgctatgcttccgtacggtaa

SEQ ID NO: 159209 - DNA, 25 bp, Homo sapien
cgccatgctgctgtacggaaaacgg

SEQ ID NO: 159210 - DNA, 25 bp, Homo sapien
aagcagagcttcctttacggcggcc

SEQ ID NO: 159211 - DNA, 25 bp, Homo sapien
aggccggactgcagctttagttttc

SEQ ID NO: 159212 - DNA, 25 bp, Homo sapien
atgatccggttgaggtccatctccc

SEQ ID NO: 159213 - DNA, 25 bp, Homo sapien
aacttcgggtcgatggtgcccttca

SEQ ID NO: 159214 - DNA, 25 bp, Homo sapien
gttctcggctgcaatccgcaacttc

SEQ ID NO: 159215 - DNA, 25 bp, Homo sapien
cccgggtacgcagaagccgcttctg

SEQ ID NO: 159216 - DNA, 25 bp, Homo sapien
ggctgacctgcggaaaacgcaccga

SEQ ID NO: 159217 - DNA, 25 bp, Homo sapien
ggtctcccagcctttgcgcagattg

SEQ ID NO: 159218 - DNA, 25 bp, Homo sapien
aggtgactccaatagctccaggagg

SEQ ID NO: 159219 - DNA, 25 bp, Homo sapien
tttcgcgaccttgaacaggtgactc

SEQ ID NO: 159220 - DNA, 25 bp, Homo sapien
ggacctcgctgattgccggcggcac

SEQ ID NO: 159221 - DNA, 25 bp, Homo sapien
cctttgcgcagattgcggggcacca

SEQ ID NO: 159222 - DNA, 25 bp, Homo sapien
gagcctgagcgaagagcacctctcc

SEQ ID NO: 159223 - DNA, 25 bp, Homo sapien
aggctcctcggcagcattatgggca

SEQ ID NO: 159224 - DNA, 25 bp, Homo sapien
ggggccagcaagctctagaacagca

SEQ ID NO: 159225 - DNA, 25 bp, Homo sapien
ctttcccttgggcagctaagtccga

SEQ ID NO: 159226 - DNA, 25 bp, Homo sapien
agtcagctctactcggatttccagc

SEQ ID NO: 159227 - DNA, 25 bp, Homo sapien
ggggaccatgcctaggagagtaatc

SEQ ID NO: 159228 - DNA, 25 bp, Homo sapien
ggcgagccgtcaccttactctctag

SEQ ID NO: 159229 - DNA, 25 bp, Homo sapien
ccagctcgggtgagtagccctgaaa

SEQ ID NO: 159230 - DNA, 25 bp, Homo sapien
tgcgccgcgatttttgtgtccaagc

SEQ ID NO: 159231 - DNA, 25 bp, Homo sapien
aggtggcgagaacagtgagcacttc

SEQ ID NO: 159232 - DNA, 25 bp, Homo sapien
cgcagttcactaaaggcaagagggc

SEQ ID NO: 159233 - DNA, 25 bp, Homo sapien
agcacttctgaagcaagcccattag

SEQ ID NO: 159234 - DNA, 25 bp, Homo sapien
ggactccgcgtcttgtcccaataca

SEQ ID NO: 159235 - DNA, 25 bp, Homo sapien
aagcaggccctttacacaccggact

SEQ ID NO: 159236 - DNA, 25 bp, Homo sapien
gcggcctttcttccctcaaagcagg

SEQ ID NO: 159237 - DNA, 25 bp, Homo sapien
tgctgggtgtaggtcaagtgatccc

SEQ ID NO: 159238 - DNA, 25 bp, Homo sapien
tgaagtaaatctgaagcctaacgcc

SEQ ID NO: 159239 - DNA, 25 bp, Homo sapien
cgcaacgagagcacgggctccctgg

SEQ ID NO: 159240 - DNA, 25 bp, Homo sapien
tgcgcaacgagagcacgggctccct

SEQ ID NO: 159241 - DNA, 25 bp, Homo sapien
ctactgcctgcgcaacgagagcacg

SEQ ID NO: 159242 - DNA, 25 bp, Homo sapien
agcgcggccgccatgcgcgtcaccc

SEQ ID NO: 159243 - DNA, 25 bp, Homo sapien
gcagcctcaagacctgctggctgca

SEQ ID NO: 159244 - DNA, 25 bp, Homo sapien
gtcctgcagcctcaagacctgctgg

SEQ ID NO: 159245 - DNA, 25 bp, Homo sapien
ggctggagctggtcaacagccgctt

SEQ ID NO: 159246 - DNA, 25 bp, Homo sapien
cagctggccgagttccgcaaggtcg

SEQ ID NO: 159247 - DNA, 25 bp, Homo sapien
tcccgagctagactgtcccgagctt

SEQ ID NO: 159248 - DNA, 25 bp, Homo sapien
gccggcagtcccgagctagactgtc

SEQ ID NO: 159249 - DNA, 25 bp, Homo sapien
cgctctcagtctctctaggcgcagc

SEQ ID NO: 159250 - DNA, 25 bp, Homo sapien
acaaagagccggcagctcgcgtgcg

SEQ ID NO: 159251 - DNA, 25 bp, Homo sapien
ctctgaatcgcagagaggcaaaccc

SEQ ID NO: 159252 - DNA, 25 bp, Homo sapien
tctgacttaattccctccgcgtgct

SEQ ID NO: 159253 - DNA, 25 bp, Homo sapien
gtttgaaagccgctccaccgcccta

SEQ ID NO: 159254 - DNA, 25 bp, Homo sapien
acagctgcctcggactctgacttaa

SEQ ID NO: 159255 - DNA, 25 bp, Homo sapien
tgagatcccagttcccgcgtgcgca

SEQ ID NO: 159256 - DNA, 25 bp, Homo sapien
ccagttcccgcgtgcgcaaaccacg

SEQ ID NO: 159257 - DNA, 25 bp, Homo sapien
gagatcccagttcccgcgtgcgcaa

SEQ ID NO: 159258 - DNA, 25 bp, Homo sapien
gggttgagatcccagttcccgcgtg

SEQ ID NO: 159259 - DNA, 25 bp, Homo sapien
ttgagatcccagttcccgcgtgcgc

SEQ ID NO: 159260 - DNA, 25 bp, Homo sapien
ggttgagatcccagttcccgcgtgc

SEQ ID NO: 159261 - DNA, 25 bp, Homo sapien
agatcccagttcccgcgtgcgcaaa

SEQ ID NO: 159262 - DNA, 25 bp, Homo sapien
gttgagatcccagttcccgcgtgcg

SEQ ID NO: 159263 - DNA, 25 bp, Homo sapien
ggaaaatttcctggataattccatg

SEQ ID NO: 159264 - DNA, 25 bp, Homo sapien
tcttactcattcattaccaaaaata

SEQ ID NO: 159265 - DNA, 25 bp, Homo sapien
tttaataatcacagagatagtctta

SEQ ID NO: 159266 - DNA, 25 bp, Homo sapien
caggaatattttaattccttgtaag

SEQ ID NO: 159267 - DNA, 25 bp, Homo sapien
ttcttctctttaatacaggaatatt

SEQ ID NO: 159268 - DNA, 25 bp, Homo sapien
tgccgtcttcgccagccgcttggga

SEQ ID NO: 159269 - DNA, 25 bp, Homo sapien
cctcggtaagagttggtgttcatcc

SEQ ID NO: 159270 - DNA, 25 bp, Homo sapien
gagatagtcttattcttactcattc

SEQ ID NO: 159271 - DNA, 25 bp, Homo sapien
aaaccacattgtcctgccggccgga

SEQ ID NO: 159272 - DNA, 25 bp, Homo sapien
agtgccctgcggagttcactgactc

SEQ ID NO: 159273 - DNA, 25 bp, Homo sapien
cttgatgagaaacgcccggagtatc

SEQ ID NO: 159274 - DNA, 25 bp, Homo sapien
tggcaacttagtttccgagcgaatg

SEQ ID NO: 159275 - DNA, 25 bp, Homo sapien
ttccctggccatcttacagcgcgga

SEQ ID NO: 159276 - DNA, 25 bp, Homo sapien
ggctgcagtcaactaaaccacgagg

SEQ ID NO: 159277 - DNA, 25 bp, Homo sapien
gcgtttattgtccaccctagtccga

SEQ ID NO: 159278 - DNA, 25 bp, Homo sapien
gacactggacgatcaccctgggtag

SEQ ID NO: 159279 - DNA, 25 bp, Homo sapien
ccggctggaaatagaaacgtctccg

SEQ ID NO: 159280 - DNA, 25 bp, Homo sapien
catgttgagcacaagtgggaggcta

SEQ ID NO: 159281 - DNA, 25 bp, Homo sapien
gcgcgggcctccaaatgcaagggtt

SEQ ID NO: 159282 - DNA, 25 bp, Homo sapien
cgctctgggtccactgatctcttga

SEQ ID NO: 159283 - DNA, 25 bp, Homo sapien
agccgtcactgatgtggcaaactca

SEQ ID NO: 159284 - DNA, 25 bp, Homo sapien
aacgtctccgcttcacgatggcgca

SEQ ID NO: 159285 - DNA, 25 bp, Homo sapien
tttagagaaaccttcccaggccagc

SEQ ID NO: 159286 - DNA, 25 bp, Homo sapien
gatctcttgatgcacgcgtcccatc

SEQ ID NO: 159287 - DNA, 25 bp, Homo sapien
cccgcacgcggaataaataacaatg

SEQ ID NO: 159288 - DNA, 25 bp, Homo sapien
agtgtcggcctgagaggccctcgca

SEQ ID NO: 159289 - DNA, 25 bp, Homo sapien
cgtcgatcccgcacagcacgaagta

SEQ ID NO: 159290 - DNA, 25 bp, Homo sapien
atgtcattaaatcgcgcccgagcgc

SEQ ID NO: 159291 - DNA, 25 bp, Homo sapien
aagaggcccgaaagccgcgtcacgt

SEQ ID NO: 159292 - DNA, 25 bp, Homo sapien
attccaaaaggtgacttggccggca

SEQ ID NO: 159293 - DNA, 25 bp, Homo sapien
ccaccgggagctgactttgtctgga

SEQ ID NO: 159294 - DNA, 25 bp, Homo sapien
ccgcgcctgttattaataacccagc

SEQ ID NO: 159295 - DNA, 25 bp, Homo sapien
ttggaagccattgccttcgcgagga

SEQ ID NO: 159296 - DNA, 25 bp, Homo sapien
cgcaggagtttggaagccattgcct

SEQ ID NO: 159297 - DNA, 25 bp, Homo sapien
cgcgcaggagtttggaagccattgc

SEQ ID NO: 159298 - DNA, 25 bp, Homo sapien
tccgctctcactgggactcgccggc

SEQ ID NO: 159299 - DNA, 25 bp, Homo sapien
ccctacctctggcaccctccgctct

SEQ ID NO: 159300 - DNA, 25 bp, Homo sapien
agtttggaagccattgccttcgcga

SEQ ID NO: 159301 - DNA, 25 bp, Homo sapien
caggagtttggaagccattgccttc

SEQ ID NO: 159302 - DNA, 25 bp, Homo sapien
accctccgctctcactgggactcgc

SEQ ID NO: 159303 - DNA, 25 bp, Homo sapien
ttgtagttctttcacctggcgggcg

SEQ ID NO: 159304 - DNA, 25 bp, Homo sapien
ctcagccaggaaacgacagatcagg

SEQ ID NO: 159305 - DNA, 25 bp, Homo sapien
tacccttggcgatgcacactggaga

SEQ ID NO: 159306 - DNA, 25 bp, Homo sapien
acagggtagactcacagatccagga

SEQ ID NO: 159307 - DNA, 25 bp, Homo sapien
atcgctgcagcgtctgaagcctctt

SEQ ID NO: 159308 - DNA, 25 bp, Homo sapien
aggccctaaactcggatgcaacgtg

SEQ ID NO: 159309 - DNA, 25 bp, Homo sapien
gagcgctgagaagtcgctactctta

SEQ ID NO: 159310 - DNA, 25 bp, Homo sapien
cccgctcggatacggactccattaa

SEQ ID NO: 159311 - DNA, 25 bp, Homo sapien
cgacactggtccaacgaacgaccaa

SEQ ID NO: 159312 - DNA, 25 bp, Homo sapien
gaaccgacactggtccaacgaacga

SEQ ID NO: 159313 - DNA, 25 bp, Homo sapien
gcgaagaaccgacactggtccaacg

SEQ ID NO: 159314 - DNA, 25 bp, Homo sapien
gcgagcgaagaaccgacactggtcc

SEQ ID NO: 159315 - DNA, 25 bp, Homo sapien
tcgcgagcgaagaaccgacactggt

SEQ ID NO: 159316 - DNA, 25 bp, Homo sapien
agccgcagtcgcgagcgaagaaccg

SEQ ID NO: 159317 - DNA, 25 bp, Homo sapien
gccacggtcccaggcctgtagcgat

SEQ ID NO: 159318 - DNA, 25 bp, Homo sapien
cattttctttcacccaacgccgaag

SEQ ID NO: 159319 - DNA, 25 bp, Homo sapien
agatgaaagcgctctgcaagcccgg

SEQ ID NO: 159320 - DNA, 25 bp, Homo sapien
ctcgctggctgttttccctcattgc

SEQ ID NO: 159321 - DNA, 25 bp, Homo sapien
cattttgtcgaactgcgaggcgcgg

SEQ ID NO: 159322 - DNA, 25 bp, Homo sapien
agcgcttttgttctgcggcaaagac

SEQ ID NO: 159323 - DNA, 25 bp, Homo sapien
ctcttccctttgtcggtaagtgtga

SEQ ID NO: 159324 - DNA, 25 bp, Homo sapien
cacttgacttaaactctggggcccg

SEQ ID NO: 159325 - DNA, 25 bp, Homo sapien
cggagcgtagctgttcctggatcct

SEQ ID NO: 159326 - DNA, 25 bp, Homo sapien
ggcgaaggctaggacgcattttgtc

SEQ ID NO: 159327 - DNA, 25 bp, Homo sapien
ccatgttgcatttctcgtcagtttc

SEQ ID NO: 159328 - DNA, 25 bp, Homo sapien
cgggcgtctctgaataagcagaatc

SEQ ID NO: 159329 - DNA, 25 bp, Homo sapien
gggtcttctactgccaccgggacaa

SEQ ID NO: 159330 - DNA, 25 bp, Homo sapien
gagcttcggccctcgacgtagcaaa

SEQ ID NO: 159331 - DNA, 25 bp, Homo sapien
tttctcgggagaaagcgttccaggc

SEQ ID NO: 159332 - DNA, 25 bp, Homo sapien
accgcgaccgcgatagttttgtttg

SEQ ID NO: 159333 - DNA, 25 bp, Homo sapien
caaaaagccttctgcgcgcccaggg

SEQ ID NO: 159334 - DNA, 25 bp, Homo sapien
ggcatcgcgctgctcattcatccgg

SEQ ID NO: 159335 - DNA, 25 bp, Homo sapien
agattcctgattcccggcctcgcgg

SEQ ID NO: 159336 - DNA, 25 bp, Homo sapien
gagctgccttcaggggccgtatgca

SEQ ID NO: 159337 - DNA, 25 bp, Homo sapien
tcaggggccgtatgcagcgactccc

SEQ ID NO: 159338 - DNA, 25 bp, Homo sapien
cgcagagcgagtcacacgtgcatcc

SEQ ID NO: 159339 - DNA, 25 bp, Homo sapien
tggctaaagaacactgcagacttgg

SEQ ID NO: 159340 - DNA, 25 bp, Homo sapien
ctgcagagctggctaaagaacactg

SEQ ID NO: 159341 - DNA, 25 bp, Homo sapien
gggcgcatggacgtcttcctcccag

SEQ ID NO: 159342 - DNA, 25 bp, Homo sapien
cactgcagacttgggccaatttgcc

SEQ ID NO: 159343 - DNA, 25 bp, Homo sapien
agacacatacgcgaccctcagagtg

SEQ ID NO: 159344 - DNA, 25 bp, Homo sapien
ggcgctaacaggctgaaccctctgc

SEQ ID NO: 159345 - DNA, 25 bp, Homo sapien
acctgctggcgattggctccagaga

SEQ ID NO: 159346 - DNA, 25 bp, Homo sapien
cgggagctgcagataccgagacgct

SEQ ID NO: 159347 - DNA, 25 bp, Homo sapien
gctccaacttcaggcgggtggcgat

SEQ ID NO: 159348 - DNA, 25 bp, Homo sapien
accgctgccttcaagggccaggtgc

SEQ ID NO: 159349 - DNA, 25 bp, Homo sapien
tctgcgagaatgcaagcaccctgga

SEQ ID NO: 159350 - DNA, 25 bp, Homo sapien
gtagctggacttcttcccgagggca

SEQ ID NO: 159351 - DNA, 25 bp, Homo sapien
ccagctgcctcaaatcgtcgtagtg

SEQ ID NO: 159352 - DNA, 25 bp, Homo sapien
attccaccaggtttcgagaacgccg

SEQ ID NO: 159353 - DNA, 25 bp, Homo sapien
agcgccagtgttttcctgcagtata

SEQ ID NO: 159354 - DNA, 25 bp, Homo sapien
ctctgttgaggctgagagacgctac

SEQ ID NO: 159355 - DNA, 25 bp, Homo sapien
cccatcactgttggctttcgtgaga

SEQ ID NO: 159356 - DNA, 25 bp, Homo sapien
cagcgttgcatcaaggcggagaatc

SEQ ID NO: 159357 - DNA, 25 bp, Homo sapien
gctccaggacgtcttcaacacggtg

SEQ ID NO: 159358 - DNA, 25 bp, Homo sapien
catggaggcgctaattcctgtcata

SEQ ID NO: 159359 - DNA, 25 bp, Homo sapien
tgtttttctgcgcatgcccgagacg

SEQ ID NO: 159360 - DNA, 25 bp, Homo sapien
ttacagctcctagggaaggtgcttc

SEQ ID NO: 159361 - DNA, 25 bp, Homo sapien
gtccttgaacagacctcgagccttc

SEQ ID NO: 159362 - DNA, 25 bp, Homo sapien
tggcccgctcgctgcaaatgaaaca

SEQ ID NO: 159363 - DNA, 25 bp, Homo sapien
gcccagcagcgcaagtagatgaccc

SEQ ID NO: 159364 - DNA, 25 bp, Homo sapien
tgacccacatgaagcgagtctgccg

SEQ ID NO: 159365 - DNA, 25 bp, Homo sapien
agctctgggagctctattttcgtcc

SEQ ID NO: 159366 - DNA, 25 bp, Homo sapien
cggagcttgcgctctcagcagttga

SEQ ID NO: 159367 - DNA, 25 bp, Homo sapien
tttccgcacggagaattacgccgca

SEQ ID NO: 159368 - DNA, 25 bp, Homo sapien
agaagcagcaacagacccgcgtatt

SEQ ID NO: 159369 - DNA, 25 bp, Homo sapien
cccgcgtattcatgagctcgtgtca

SEQ ID NO: 159370 - DNA, 25 bp, Homo sapien
gcccaaccaccatttcgtttcagga

SEQ ID NO: 159371 - DNA, 25 bp, Homo sapien
cgtttcaggaaatgctgccagactc

SEQ ID NO: 159372 - DNA, 25 bp, Homo sapien
caaggctgtcctgatacttagatgc

SEQ ID NO: 159373 - DNA, 25 bp, Homo sapien
acttagatgcgtaaatcagggccgc

SEQ ID NO: 159374 - DNA, 25 bp, Homo sapien
cggtaatgtcagctcggccaagaga

SEQ ID NO: 159375 - DNA, 25 bp, Homo sapien
gtcgcgcacgttgtcggagtcccag

SEQ ID NO: 159376 - DNA, 25 bp, Homo sapien
cgcggacacctggagacttgtaccc

SEQ ID NO: 159377 - DNA, 25 bp, Homo sapien
gtcggagtcccagcggataccgcct

SEQ ID NO: 159378 - DNA, 25 bp, Homo sapien
ctggagacttgtacccgcccgcggg

SEQ ID NO: 159379 - DNA, 25 bp, Homo sapien
gagcggcgggctccactcaccgttg

SEQ ID NO: 159380 - DNA, 25 bp, Homo sapien
gtcataccgaagacggcgagcaaca

SEQ ID NO: 159381 - DNA, 25 bp, Homo sapien
cgctggacaggatggatttccgctc

SEQ ID NO: 159382 - DNA, 25 bp, Homo sapien
aggctcttgactgtctggccgccgc

SEQ ID NO: 159383 - DNA, 25 bp, Homo sapien
tgagagccggcaactcttaggagcc

SEQ ID NO: 159384 - DNA, 25 bp, Homo sapien
ctaagccatagtccgcccgcggtga

SEQ ID NO: 159385 - DNA, 25 bp, Homo sapien
cctccttgtggaaactcatcgtttg

SEQ ID NO: 159386 - DNA, 25 bp, Homo sapien
ctgttcactccgtcctccttgtgga

SEQ ID NO: 159387 - DNA, 25 bp, Homo sapien
agagccttctggcacagactgttca

SEQ ID NO: 159388 - DNA, 25 bp, Homo sapien
gcgaagcacagctcggtgacgatgt

SEQ ID NO: 159389 - DNA, 25 bp, Homo sapien
ccctcgaagtcgtcaggagctgagc

SEQ ID NO: 159390 - DNA, 25 bp, Homo sapien
gctggaactagagacccggcatgga

SEQ ID NO: 159391 - DNA, 25 bp, Homo sapien
caatgcgattgagagggtaatcatc

SEQ ID NO: 159392 - DNA, 25 bp, Homo sapien
cgacccgatctttccggatccgcgc

SEQ ID NO: 159393 - DNA, 25 bp, Homo sapien
ggcaatgcgattgagagggtaatca

SEQ ID NO: 159394 - DNA, 25 bp, Homo sapien
actccgggaaacagcgacccgatct

SEQ ID NO: 159395 - DNA, 25 bp, Homo sapien
ctccgggaaacagcgacccgatctt

SEQ ID NO: 159396 - DNA, 25 bp, Homo sapien
acagcgacccgatctttccggatcc

SEQ ID NO: 159397 - DNA, 25 bp, Homo sapien
ttttgacactttgtgcgccccgggc

SEQ ID NO: 159398 - DNA, 25 bp, Homo sapien
ttgacactttgtgcgccccgggcaa

SEQ ID NO: 159399 - DNA, 25 bp, Homo sapien
tcgagatccgaaccgctcagacctg

SEQ ID NO: 159400 - DNA, 25 bp, Homo sapien
aggcgatatcagagaggcttcagca

SEQ ID NO: 159401 - DNA, 25 bp, Homo sapien
gcctggctacgcgtgtgcacctgct

SEQ ID NO: 159402 - DNA, 25 bp, Homo sapien
ggctgccacagggaccgctcgagat

SEQ ID NO: 159403 - DNA, 25 bp, Homo sapien
ggctgacccactgcgcgggtttccg

SEQ ID NO: 159404 - DNA, 25 bp, Homo sapien
gtttccgtagagctcgctgtccacc

SEQ ID NO: 159405 - DNA, 25 bp, Homo sapien
cgcaggcttctgttgcacagcatgc

SEQ ID NO: 159406 - DNA, 25 bp, Homo sapien
tcccaggacagggaccacaaactct

SEQ ID NO: 159407 - DNA, 25 bp, Homo sapien
gaggtccacactggccgtctcgcca

SEQ ID NO: 159408 - DNA, 25 bp, Homo sapien
caagagattggaggggccagacgag

SEQ ID NO: 159409 - DNA, 25 bp, Homo sapien
agtctgcgtgaacgctatctccctc

SEQ ID NO: 159410 - DNA, 25 bp, Homo sapien
aggggccgcaaacgcaggggcgcca

SEQ ID NO: 159411 - DNA, 25 bp, Homo sapien
cagccggccagttccaccgcgtccc

SEQ ID NO: 159412 - DNA, 25 bp, Homo sapien
tggccgtctcgccagccggccagtt

SEQ ID NO: 159413 - DNA, 25 bp, Homo sapien
tcaggaggccaggacgccggaggcg

SEQ ID NO: 159414 - DNA, 25 bp, Homo sapien
tgtccctgaggtccacactggccgt

SEQ ID NO: 159415 - DNA, 25 bp, Homo sapien
gcgatcagacccagttggaacctta

SEQ ID NO: 159416 - DNA, 25 bp, Homo sapien
tcccgaagacacagcgggcaccagt

SEQ ID NO: 159417 - DNA, 25 bp, Homo sapien
accagtggtctctcgggagggacac

SEQ ID NO: 159418 - DNA, 25 bp, Homo sapien
ggaacgacgagcatgggcgacaccc

SEQ ID NO: 159419 - DNA, 25 bp, Homo sapien
agccattctcaccaggcccgataaa

SEQ ID NO: 159420 - DNA, 25 bp, Homo sapien
cagtggccaccactgggcatgcgtg

SEQ ID NO: 159421 - DNA, 25 bp, Homo sapien
tggaaccttatcacaccgagcctgc

SEQ ID NO: 159422 - DNA, 25 bp, Homo sapien
cgctcgccgccgacatttggtggac

SEQ ID NO: 159423 - DNA, 25 bp, Homo sapien
aacggcgcagcagagaaagggtctt

SEQ ID NO: 159424 - DNA, 25 bp, Homo sapien
agcccagcgggttgccgtccaaagc

SEQ ID NO: 159425 - DNA, 25 bp, Homo sapien
catgcgcggagtcctgggttcgcac

SEQ ID NO: 159426 - DNA, 25 bp, Homo sapien
gcagagcacaggtcttgatccctgg

SEQ ID NO: 159427 - DNA, 25 bp, Homo sapien
ctgccacacatgcttatgtttctgg

SEQ ID NO: 159428 - DNA, 25 bp, Homo sapien
cggaaggaaaataaacggcgcagca

SEQ ID NO: 159429 - DNA, 25 bp, Homo sapien
cccttccgcgaatgtgtggggtccg

SEQ ID NO: 159430 - DNA, 25 bp, Homo sapien
acatgcttatgtttctggggaccct

SEQ ID NO: 159431 - DNA, 25 bp, Homo sapien
aatgcagatcgtggcgtcttccctg

SEQ ID NO: 159432 - DNA, 25 bp, Homo sapien
ccctgtgaggatcgtgagcctatgc

SEQ ID NO: 159433 - DNA, 25 bp, Homo sapien
cctgcgcctcctgtcggtaaaatgc

SEQ ID NO: 159434 - DNA, 25 bp, Homo sapien
tgctctgcgatctccggcaagttcc

SEQ ID NO: 159435 - DNA, 25 bp, Homo sapien
agcagcgcttcctgaagctcggtta

SEQ ID NO: 159436 - DNA, 25 bp, Homo sapien
attccctcagggcacaagcagcgct

SEQ ID NO: 159437 - DNA, 25 bp, Homo sapien
cctgggcacgaacctgctctgcgat

SEQ ID NO: 159438 - DNA, 25 bp, Homo sapien
cctatgcgtgtgaggccaccaaatc

SEQ ID NO: 159439 - DNA, 25 bp, Homo sapien
agaccctgaggtcctgggtttgcgc

SEQ ID NO: 159440 - DNA, 25 bp, Homo sapien
ttcgcgctgccggagttgctggaca

SEQ ID NO: 159441 - DNA, 25 bp, Homo sapien
ccctgaggtcctgggtttgcgctgc

SEQ ID NO: 159442 - DNA, 25 bp, Homo sapien
gcgtcccaaagaccctgaggtcctg

SEQ ID NO: 159443 - DNA, 25 bp, Homo sapien
gtggcgtcccaaagaccctgaggtc

SEQ ID NO: 159444 - DNA, 25 bp, Homo sapien
gcatgcgtggcgtcccaaagaccct

SEQ ID NO: 159445 - DNA, 25 bp, Homo sapien
ccacgcatgcgtggcgtcccaaaga

SEQ ID NO: 159446 - DNA, 25 bp, Homo sapien
cgctgccggagttgctggacaccgc

SEQ ID NO: 159447 - DNA, 25 bp, Homo sapien
gttttgaaagtggagatcgtggtcc

SEQ ID NO: 159448 - DNA, 25 bp, Homo sapien
cccggagctgctggacacatcgggg

SEQ ID NO: 159449 - DNA, 25 bp, Homo sapien
tatgcacggggtctctgggactctg

SEQ ID NO: 159450 - DNA, 25 bp, Homo sapien
catatgcacggggtctctgggactc

SEQ ID NO: 159451 - DNA, 25 bp, Homo sapien
tgccgcatatgcacggggtctctgg

SEQ ID NO: 159452 - DNA, 25 bp, Homo sapien
ggagatcgtggtccccatggaaaga

SEQ ID NO: 159453 - DNA, 25 bp, Homo sapien
ccgggttcgtgctcctggtgaggtt

SEQ ID NO: 159454 - DNA, 25 bp, Homo sapien
cctgccgcatatgcacggggtctct

SEQ ID NO: 159455 - DNA, 25 bp, Homo sapien
acaaggacaccaagtcccgcacaag

SEQ ID NO: 159456 - DNA, 25 bp, Homo sapien
agcgaccagtactaggccgccggtc

SEQ ID NO: 159457 - DNA, 25 bp, Homo sapien
gggcctgactgacaggagcgccctc

SEQ ID NO: 159458 - DNA, 25 bp, Homo sapien
ggccgtgacgtcatagaagtgcgaa

SEQ ID NO: 159459 - DNA, 25 bp, Homo sapien
ggtccacgctccgtctgcgcggaga

SEQ ID NO: 159460 - DNA, 25 bp, Homo sapien
agccgctcctcgtgagtgaggtcgc

SEQ ID NO: 159461 - DNA, 25 bp, Homo sapien
ttcgtccctgcgagggttccctgca

SEQ ID NO: 159462 - DNA, 25 bp, Homo sapien
gagccctccgcgacgtcaggatgcg

SEQ ID NO: 159463 - DNA, 25 bp, Homo sapien
gacacataaggaactcgccctccgg

SEQ ID NO: 159464 - DNA, 25 bp, Homo sapien
aaccgctgcaagtgtccacgatggc

SEQ ID NO: 159465 - DNA, 25 bp, Homo sapien
tgggaactgtcaaccgctgcaagtg

SEQ ID NO: 159466 - DNA, 25 bp, Homo sapien
tccgtagccgctgtctcttgggccg

SEQ ID NO: 159467 - DNA, 25 bp, Homo sapien
tgcaccctgaagagcctcatcatcg

SEQ ID NO: 159468 - DNA, 25 bp, Homo sapien
agctcccgctgctgaatagctgaga

SEQ ID NO: 159469 - DNA, 25 bp, Homo sapien
tcagagcccaccgtgtcagcaaaga

SEQ ID NO: 159470 - DNA, 25 bp, Homo sapien
acgaggacgtgttgcaccctgaaga

SEQ ID NO: 159471 - DNA, 25 bp, Homo sapien
gcttgaaagttgaggtcgaggaccc

SEQ ID NO: 159472 - DNA, 25 bp, Homo sapien
agcacggttcttggaccctgcaacc

SEQ ID NO: 159473 - DNA, 25 bp, Homo sapien
tagggaccctgaggtctcgggttca

SEQ ID NO: 159474 - DNA, 25 bp, Homo sapien
gctagatcccttgcggggcagccca

SEQ ID NO: 159475 - DNA, 25 bp, Homo sapien
aggaaaaattctggcgcctcagagc

SEQ ID NO: 159476 - DNA, 25 bp, Homo sapien
atccctgccatgcatgtgcggggtc

SEQ ID NO: 159477 - DNA, 25 bp, Homo sapien
aaccgccgtggtagagcacggttct

SEQ ID NO: 159478 - DNA, 25 bp, Homo sapien
atgggaggtcgaatcaccggtgaaa

SEQ ID NO: 159479 - DNA, 25 bp, Homo sapien
tcgtcccgcggggtcgagccgctct

SEQ ID NO: 159480 - DNA, 25 bp, Homo sapien
agcacccaagagtcctggggacctc

SEQ ID NO: 159481 - DNA, 25 bp, Homo sapien
tctacagcggcgaattttttccttc

SEQ ID NO: 159482 - DNA, 25 bp, Homo sapien
ctggttctttgggcgtcgtcccgcg

SEQ ID NO: 159483 - DNA, 25 bp, Homo sapien
tcgagccgctctgggagcgcgaacc

SEQ ID NO: 159484 - DNA, 25 bp, Homo sapien
agccgctctgggagcgcgaaccctg

SEQ ID NO: 159485 - DNA, 25 bp, Homo sapien
tggaccccaggcatgcgcagcaagg

SEQ ID NO: 159486 - DNA, 25 bp, Homo sapien
cccgcaatgtccaaccactccgggg

SEQ ID NO: 159487 - DNA, 25 bp, Homo sapien
tatctgctctgccatgccggttttt

SEQ ID NO: 159488 - DNA, 25 bp, Homo sapien
gggccaagatatctgctctgccatg

SEQ ID NO: 159489 - DNA, 25 bp, Homo sapien
tttttatcattccaggagtgcctcg

SEQ ID NO: 159490 - DNA, 25 bp, Homo sapien
ggccataacgggtgcctgcgcatgc

SEQ ID NO: 159491 - DNA, 25 bp, Homo sapien
atcattccaggagtgcctcgacctc

SEQ ID NO: 159492 - DNA, 25 bp, Homo sapien
caagatatctgctctgccatgccgg

SEQ ID NO: 159493 - DNA, 25 bp, Homo sapien
gggcgcgcactcgagaccccaggtt

SEQ ID NO: 159494 - DNA, 25 bp, Homo sapien
ctgccatgccggtttttttatcatt

SEQ ID NO: 159495 - DNA, 25 bp, Homo sapien
gtggcgcacctgctcgtagttccac

SEQ ID NO: 159496 - DNA, 25 bp, Homo sapien
taagattccaactgggtccgaccgc

SEQ ID NO: 159497 - DNA, 25 bp, Homo sapien
gccggctctgtgtgataagattcca

SEQ ID NO: 159498 - DNA, 25 bp, Homo sapien
ctgccgggttcaaccagcggacagt

SEQ ID NO: 159499 - DNA, 25 bp, Homo sapien
acacagcgggtgtctctcgccagag

SEQ ID NO: 159500 - DNA, 25 bp, Homo sapien
atcggattcattgagcctgttgaga

SEQ ID NO: 159501 - DNA, 25 bp, Homo sapien
accggcgggctttccaagatgccac

SEQ ID NO: 159502 - DNA, 25 bp, Homo sapien
tctgtcccagtaatgttcacgcatg

SEQ ID NO: 159503 - DNA, 25 bp, Homo sapien
cagagcctccctccgtcgccggctg

SEQ ID NO: 159504 - DNA, 25 bp, Homo sapien
gatctcccttctggcgatgctccag

SEQ ID NO: 159505 - DNA, 25 bp, Homo sapien
tacgggcgatctcccttctggcgat

SEQ ID NO: 159506 - DNA, 25 bp, Homo sapien
tggatgccgcaagagcccggcactg

SEQ ID NO: 159507 - DNA, 25 bp, Homo sapien
actgctggccaccactctgtgcctt

SEQ ID NO: 159508 - DNA, 25 bp, Homo sapien
gcttaggggtctacgggcgatctcc

SEQ ID NO: 159509 - DNA, 25 bp, Homo sapien
ccctgcccaggcttaggggtctacg

SEQ ID NO: 159510 - DNA, 25 bp, Homo sapien
ttctggcgatgctccaggccttcac

SEQ ID NO: 159511 - DNA, 25 bp, Homo sapien
gacccgctgttttccggatccgcgc

SEQ ID NO: 159512 - DNA, 25 bp, Homo sapien
actgtgcgccccgagtaatgtgatg

SEQ ID NO: 159513 - DNA, 25 bp, Homo sapien
gttttgacactgtgcgccccgagta

SEQ ID NO: 159514 - DNA, 25 bp, Homo sapien
actccaggaaacagcgacccgctgt

SEQ ID NO: 159515 - DNA, 25 bp, Homo sapien
ctccaggaaacagcgacccgctgtt

SEQ ID NO: 159516 - DNA, 25 bp, Homo sapien
caggaaacagcgacccgctgttttc

SEQ ID NO: 159517 - DNA, 25 bp, Homo sapien
tgcgccccgagtaatgtgatggaga

SEQ ID NO: 159518 - DNA, 25 bp, Homo sapien
acagcgacccgctgttttccggatc

SEQ ID NO: 159519 - DNA, 25 bp, Homo sapien
gcgcgcccatttcgagcccaagttt

SEQ ID NO: 159520 - DNA, 25 bp, Homo sapien
gagggtaatcatccggtccgttatc

SEQ ID NO: 159521 - DNA, 25 bp, Homo sapien
tagcgcgcccatttcgagcccaagt

SEQ ID NO: 159522 - DNA, 25 bp, Homo sapien
atcctttgccttccggtatgtggcc

SEQ ID NO: 159523 - DNA, 25 bp, Homo sapien
ccagcatcctttgccttccggtatg

SEQ ID NO: 159524 - DNA, 25 bp, Homo sapien
gtaatcatccggtccgttatctaaa

SEQ ID NO: 159525 - DNA, 25 bp, Homo sapien
tttcgagcccaagtttccagctcgg

SEQ ID NO: 159526 - DNA, 25 bp, Homo sapien
gagagggtaatcatccggtccgtta

SEQ ID NO: 159527 - DNA, 25 bp, Homo sapien
gtcctgggtgaaactgacgctgcca

SEQ ID NO: 159528 - DNA, 25 bp, Homo sapien
cgatgcccgcagtgctgttgtagcg

SEQ ID NO: 159529 - DNA, 25 bp, Homo sapien
gttgtagcggctgtccatattggga

SEQ ID NO: 159530 - DNA, 25 bp, Homo sapien
cacaaccacagctcgggcggactga

SEQ ID NO: 159531 - DNA, 25 bp, Homo sapien
cggactgagggctagctcccgtcag

SEQ ID NO: 159532 - DNA, 25 bp, Homo sapien
acctccgcgcagagccacgagggaa

SEQ ID NO: 159533 - DNA, 25 bp, Homo sapien
acgagggaaccgctagccagtcctg

SEQ ID NO: 159534 - DNA, 25 bp, Homo sapien
tggcagcgctcagctggttcaagtc

SEQ ID NO: 159535 - DNA, 25 bp, Homo sapien
cgccaccaggcggcgacggagaaca

SEQ ID NO: 159536 - DNA, 25 bp, Homo sapien
cggagtcgtggcaaaagcatccgga

SEQ ID NO: 159537 - DNA, 25 bp, Homo sapien
cgtggcaaaagcatccggaggtaga

SEQ ID NO: 159538 - DNA, 25 bp, Homo sapien
aaaagcatccggaggtagacgaggc

SEQ ID NO: 159539 - DNA, 25 bp, Homo sapien
ggtgtccgtccgatttaacgctcca

SEQ ID NO: 159540 - DNA, 25 bp, Homo sapien
tccgtccgatttaacgctccaagca

SEQ ID NO: 159541 - DNA, 25 bp, Homo sapien
ccctccactgcagggacctttgttc

SEQ ID NO: 159542 - DNA, 25 bp, Homo sapien
acggagaacaggatgcggcgcagct

SEQ ID NO: 159543 - DNA, 25 bp, Homo sapien
tcttattggctcgaaccgcctcgtg

SEQ ID NO: 159544 - DNA, 25 bp, Homo sapien
cggccctcaacacccagtatagttt

SEQ ID NO: 159545 - DNA, 25 bp, Homo sapien
ctcaccttcgggtgcagttgctcca

SEQ ID NO: 159546 - DNA, 25 bp, Homo sapien
ccaagaagtccgagacacgcggtga

SEQ ID NO: 159547 - DNA, 25 bp, Homo sapien
gcacccaggttttagagcggtcaga

SEQ ID NO: 159548 - DNA, 25 bp, Homo sapien
agctcccacgatgcacccaggtttt

SEQ ID NO: 159549 - DNA, 25 bp, Homo sapien
atagttttcgctaagttcctggccg

SEQ ID NO: 159550 - DNA, 25 bp, Homo sapien
gcccgcaacttgattcctaactctg

SEQ ID NO: 159551 - DNA, 25 bp, Homo sapien
agtgcccagttcttgacgtcggatc

SEQ ID NO: 159552 - DNA, 25 bp, Homo sapien
cgactaggtctctagcgacagaatc

SEQ ID NO: 159553 - DNA, 25 bp, Homo sapien
acaccgagggtgtccatccggtcca

SEQ ID NO: 159554 - DNA, 25 bp, Homo sapien
ggttccgcggcccttatcactacag

SEQ ID NO: 159555 - DNA, 25 bp, Homo sapien
gcacgccgcgactctcttttttaaa

SEQ ID NO: 159556 - DNA, 25 bp, Homo sapien
aggcgccaacttatgtccctcttgc

SEQ ID NO: 159557 - DNA, 25 bp, Homo sapien
gtccctcttgctcttcggggcttca

SEQ ID NO: 159558 - DNA, 25 bp, Homo sapien
cggggcttcatgaagggacctccta

SEQ ID NO: 159559 - DNA, 25 bp, Homo sapien
gtcgcccgagtgaactcttccagca

SEQ ID NO: 159560 - DNA, 25 bp, Homo sapien
tgaatcggcataagcacgtcctatc

SEQ ID NO: 159561 - DNA, 25 bp, Homo sapien
tggcccaaggaaaccgcgatgaatc

SEQ ID NO: 159562 - DNA, 25 bp, Homo sapien
cttcccaaaacaggggccagtgcgc

SEQ ID NO: 159563 - DNA, 25 bp, Homo sapien
agcaccctcggactgggcaaggatc

SEQ ID NO: 159564 - DNA, 25 bp, Homo sapien
ctgagcgaaactctggaggggacca

SEQ ID NO: 159565 - DNA, 25 bp, Homo sapien
gagggactttgctcacctacccggc

SEQ ID NO: 159566 - DNA, 25 bp, Homo sapien
tgattcacttcgctccttacctgga

SEQ ID NO: 159567 - DNA, 25 bp, Homo sapien
ccagcggggactcactgcctcagtt

SEQ ID NO: 159568 - DNA, 25 bp, Homo sapien
ccagacctgaggtgactgatcccgc

SEQ ID NO: 159569 - DNA, 25 bp, Homo sapien
gccacctgcaaacacagacggcgtg

SEQ ID NO: 159570 - DNA, 25 bp, Homo sapien
tccagccatgttgggcgactgaatg

SEQ ID NO: 159571 - DNA, 25 bp, Homo sapien
gacaaagcgcgcttgaacggcgagc

SEQ ID NO: 159572 - DNA, 25 bp, Homo sapien
agcgcgcctgtggagaagccaacag

SEQ ID NO: 159573 - DNA, 25 bp, Homo sapien
tcccggacaggcgatagcccaaggc

SEQ ID NO: 159574 - DNA, 25 bp, Homo sapien
tcggcaccgcagagctgaggcgcca

SEQ ID NO: 159575 - DNA, 25 bp, Homo sapien
agtctcggcgagctagacagcccga

SEQ ID NO: 159576 - DNA, 25 bp, Homo sapien
ttcacggagcccgaactcaccgatg

SEQ ID NO: 159577 - DNA, 25 bp, Homo sapien
cagtgtctccttgttgttggccgca

SEQ ID NO: 159578 - DNA, 25 bp, Homo sapien
tccagactgagctgccgcttgagca

SEQ ID NO: 159579 - DNA, 25 bp, Homo sapien
catagccaaacaggaagccgcccag

SEQ ID NO: 159580 - DNA, 25 bp, Homo sapien
tctcgcttgccttgcgggacatagg

SEQ ID NO: 159581 - DNA, 25 bp, Homo sapien
ctccggggagaaagttgctgcccgc

SEQ ID NO: 159582 - DNA, 25 bp, Homo sapien
gcgtgtactccacattctcgcttgc

SEQ ID NO: 159583 - DNA, 25 bp, Homo sapien
ctgccggttccctgagcagcggacg

SEQ ID NO: 159584 - DNA, 25 bp, Homo sapien
ggagtccgctgagtcagtttcttcc

SEQ ID NO: 159585 - DNA, 25 bp, Homo sapien
ccgctgcggtggaatctggtcccag

SEQ ID NO: 159586 - DNA, 25 bp, Homo sapien
ggggccacggtcacggtcatcccag

SEQ ID NO: 159587 - DNA, 25 bp, Homo sapien
cctgtggactcagcggagtccgctg

SEQ ID NO: 159588 - DNA, 25 bp, Homo sapien
tcctcataaacaggcgggcgtgggc

SEQ ID NO: 159589 - DNA, 25 bp, Homo sapien
ccctgagcagcggacgttcatgctg

SEQ ID NO: 159590 - DNA, 25 bp, Homo sapien
ctccttcctcataaacaggcgggcg

SEQ ID NO: 159591 - DNA, 25 bp, Homo sapien
tgttaagatctagctcccttcagga

SEQ ID NO: 159592 - DNA, 25 bp, Homo sapien
agggatgccatatcgcctcggcagg

SEQ ID NO: 159593 - DNA, 25 bp, Homo sapien
tggctagcgcatcccggaaaacctg

SEQ ID NO: 159594 - DNA, 25 bp, Homo sapien
gggaagaatccctgcaactcgaagg

SEQ ID NO: 159595 - DNA, 25 bp, Homo sapien
tcgaagggcacgttccgattaatta

SEQ ID NO: 159596 - DNA, 25 bp, Homo sapien
attacgtctccgttgagaaggcacc

SEQ ID NO: 159597 - DNA, 25 bp, Homo sapien
gtgtctcgtcaactttcctttcgga

SEQ ID NO: 159598 - DNA, 25 bp, Homo sapien
ccttctccacgatctgcggcaggtg

SEQ ID NO: 159599 - DNA, 25 bp, Homo sapien
ccaggagaagttcacccaatacatg

SEQ ID NO: 159600 - DNA, 25 bp, Homo sapien
cagcctcatccagaagctgcgagtc

SEQ ID NO: 159601 - DNA, 25 bp, Homo sapien
gacccggctctggagtgcaaactgt

SEQ ID NO: 159602 - DNA, 25 bp, Homo sapien
ctttgccctggagcgcttcgcagaa

SEQ ID NO: 159603 - DNA, 25 bp, Homo sapien
tacatggctcacgtccgcaacttcg

SEQ ID NO: 159604 - DNA, 25 bp, Homo sapien
catccctaacatgggctttgccctg

SEQ ID NO: 159605 - DNA, 25 bp, Homo sapien
gctcggagaagacggactctgcttt

SEQ ID NO: 159606 - DNA, 25 bp, Homo sapien
aggcgcacgtcgagcactgcgactt

SEQ ID NO: 159607 - DNA, 25 bp, Homo sapien
cgggacacggtacatcacaaagaga

SEQ ID NO: 159608 - DNA, 25 bp, Homo sapien
agcagcacctggttagggccaaaga

SEQ ID NO: 159609 - DNA, 25 bp, Homo sapien
cgtgccttaaagatcaaggaagagc

SEQ ID NO: 159610 - DNA, 25 bp, Homo sapien
gccgtcgccgtgagttcatgatgcg

SEQ ID NO: 159611 - DNA, 25 bp, Homo sapien
cggagtggcatgaccacagacgatg

SEQ ID NO: 159612 - DNA, 25 bp, Homo sapien
acagacgatgacaccatgagcgaga

SEQ ID NO: 159613 - DNA, 25 bp, Homo sapien
gacccgtgcgagaccgaatcctgaa

SEQ ID NO: 159614 - DNA, 25 bp, Homo sapien
ccgaatcctgaaggaacgtgcctta

SEQ ID NO: 159615 - DNA, 25 bp, Homo sapien
gtacctgtccgacacgccgggatgc

SEQ ID NO: 159616 - DNA, 25 bp, Homo sapien
agggctatagctagcgcaggccgac

SEQ ID NO: 159617 - DNA, 25 bp, Homo sapien
agccgcgggcgcaacaagttcctca

SEQ ID NO: 159618 - DNA, 25 bp, Homo sapien
gcccaccacctaggcgagcgcagtc

SEQ ID NO: 159619 - DNA, 25 bp, Homo sapien
gctccggagccgaaggactacccgc

SEQ ID NO: 159620 - DNA, 25 bp, Homo sapien
cacaccgggaactgcccgtacctgt

SEQ ID NO: 159621 - DNA, 25 bp, Homo sapien
cgcgcctgagggctatagctagcgc

SEQ ID NO: 159622 - DNA, 25 bp, Homo sapien
ccttcttccagggacacggcgagct

SEQ ID NO: 159623 - DNA, 25 bp, Homo sapien
tacaacttagagacaaaatagtctg

SEQ ID NO: 159624 - DNA, 25 bp, Homo sapien
catttaaatagacatcttgagagga

SEQ ID NO: 159625 - DNA, 25 bp, Homo sapien
gtcaaatttgaagaaacattaattg

SEQ ID NO: 159626 - DNA, 25 bp, Homo sapien
ggtgtcaaatagcaatagtcaaatt

SEQ ID NO: 159627 - DNA, 25 bp, Homo sapien
cgccaggtgtcaaatagcaatagtc

SEQ ID NO: 159628 - DNA, 25 bp, Homo sapien
gaaaagcaacgccaggtgtcaaata

SEQ ID NO: 159629 - DNA, 25 bp, Homo sapien
tattggaaaagcaacgccaggtgtc

SEQ ID NO: 159630 - DNA, 25 bp, Homo sapien
caaacatagtgttcaaaattattgg

SEQ ID NO: 159631 - DNA, 25 bp, Homo sapien
ccctctgaggaggaaaacgtctgtc

SEQ ID NO: 159632 - DNA, 25 bp, Homo sapien
ggtgcagacgctacagtcccagtaa

SEQ ID NO: 159633 - DNA, 25 bp, Homo sapien
gcacatcatgcacttgaaggcctcg

SEQ ID NO: 159634 - DNA, 25 bp, Homo sapien
tgcaggacacaacccggacacgacg

SEQ ID NO: 159635 - DNA, 25 bp, Homo sapien
cttcttgtctcccatggcttggcta

SEQ ID NO: 159636 - DNA, 25 bp, Homo sapien
tggctatcaccgcacgccgagagtc

SEQ ID NO: 159637 - DNA, 25 bp, Homo sapien
cagcctccagctgtcggggaaactc

SEQ ID NO: 159638 - DNA, 25 bp, Homo sapien
gccgcgaccgctctgtttgtcaata

SEQ ID NO: 159639 - DNA, 25 bp, Homo sapien
ggagcgcagagccagttttcaattc

SEQ ID NO: 159640 - DNA, 25 bp, Homo sapien
cagccgtgtatactctcagccttca

SEQ ID NO: 159641 - DNA, 25 bp, Homo sapien
gcgaagtcacttgcccacggtcata

SEQ ID NO: 159642 - DNA, 25 bp, Homo sapien
ggcgggttataactagcggcttcca

SEQ ID NO: 159643 - DNA, 25 bp, Homo sapien
agtgtctactctgaagccctcgctt

SEQ ID NO: 159644 - DNA, 25 bp, Homo sapien
tcaacgctgcacagaacccggggtg

SEQ ID NO: 159645 - DNA, 25 bp, Homo sapien
actgttaaatggtgtgccacgggcc

SEQ ID NO: 159646 - DNA, 25 bp, Homo sapien
cgtgggctctgcacttagacgcatc

SEQ ID NO: 159647 - DNA, 25 bp, Homo sapien
gggcgggttccagatcccataaatg

SEQ ID NO: 159648 - DNA, 25 bp, Homo sapien
tcccataaatgagataattaacggg

SEQ ID NO: 159649 - DNA, 25 bp, Homo sapien
taattaacgggatttacagcactcc

SEQ ID NO: 159650 - DNA, 25 bp, Homo sapien
tttacagcactcctaggcggggctc

SEQ ID NO: 159651 - DNA, 25 bp, Homo sapien
ggcagctgcgattagcgccctaatc

SEQ ID NO: 159652 - DNA, 25 bp, Homo sapien
tggaaccggagcgacgtcccagctg

SEQ ID NO: 159653 - DNA, 25 bp, Homo sapien
cgcggagatctgagcgcagagaccc

SEQ ID NO: 159654 - DNA, 25 bp, Homo sapien
atctgagcgcagagaccctaggagg

SEQ ID NO: 159655 - DNA, 25 bp, Homo sapien
cctcattcaattcttgtaaagatta

SEQ ID NO: 159656 - DNA, 25 bp, Homo sapien
tttgtaaaatggacatacctcattc

SEQ ID NO: 159657 - DNA, 25 bp, Homo sapien
cttaacttctctgtgacttggtttc

SEQ ID NO: 159658 - DNA, 25 bp, Homo sapien
gtctctataaagctaaggagcagga

SEQ ID NO: 159659 - DNA, 25 bp, Homo sapien
tttaaagtgcttcaagaggggagcc

SEQ ID NO: 159660 - DNA, 25 bp, Homo sapien
ctaaggagcaggaacattccgattc

SEQ ID NO: 159661 - DNA, 25 bp, Homo sapien
cattccgattcgaaatatccctcct

SEQ ID NO: 159662 - DNA, 25 bp, Homo sapien
taaaacatgtagatgacttaacttc

SEQ ID NO: 159663 - DNA, 25 bp, Homo sapien
acggctgcatttacggggtctcccg

SEQ ID NO: 159664 - DNA, 25 bp, Homo sapien
cgcggagagcagataatagcagcca

SEQ ID NO: 159665 - DNA, 25 bp, Homo sapien
gcgctttttacctttcccagagatg

SEQ ID NO: 159666 - DNA, 25 bp, Homo sapien
ccagagtcggtgagcgctttttacc

SEQ ID NO: 159667 - DNA, 25 bp, Homo sapien
gcgccggaagtacctacctgggata

SEQ ID NO: 159668 - DNA, 25 bp, Homo sapien
acggtgcttcttcccgactgtttga

SEQ ID NO: 159669 - DNA, 25 bp, Homo sapien
cagcggccttggcatcacgagtcct

SEQ ID NO: 159670 - DNA, 25 bp, Homo sapien
gctaacgtcattgcgcgcgccggaa

SEQ ID NO: 159671 - DNA, 25 bp, Homo sapien
cgcacccactcatttccggaggaga

SEQ ID NO: 159672 - DNA, 25 bp, Homo sapien
gcagccgtgaggcatcccacaaaag

SEQ ID NO: 159673 - DNA, 25 bp, Homo sapien
tggagtcacctcgtccaggccactg

SEQ ID NO: 159674 - DNA, 25 bp, Homo sapien
gggccggcgatcttcaaaagtaatc

SEQ ID NO: 159675 - DNA, 25 bp, Homo sapien
tcaaaagtaatcagagcccgcagta

SEQ ID NO: 159676 - DNA, 25 bp, Homo sapien
gtaaccatttcgtttcctgccgatc

SEQ ID NO: 159677 - DNA, 25 bp, Homo sapien
tcctctgcggggagaaaaactcgtc

SEQ ID NO: 159678 - DNA, 25 bp, Homo sapien
ttggcgccgtgtcacctccacggag

SEQ ID NO: 159679 - DNA, 25 bp, Homo sapien
gtgagcagcgcacgaaccatccaga

SEQ ID NO: 159680 - DNA, 25 bp, Homo sapien
tctgcgacaccgacccagtctgggt

SEQ ID NO: 159681 - DNA, 25 bp, Homo sapien
tgaccttctccctgatcttctgcga

SEQ ID NO: 159682 - DNA, 25 bp, Homo sapien
tccagagcccagaaagtctccgtgc

SEQ ID NO: 159683 - DNA, 25 bp, Homo sapien
ccctggcgatgctgcagccaatatc

SEQ ID NO: 159684 - DNA, 25 bp, Homo sapien
tgtgatgcagcaaacaggagccatg

SEQ ID NO: 159685 - DNA, 25 bp, Homo sapien
cagaacctgtttccacgccggagaa

SEQ ID NO: 159686 - DNA, 25 bp, Homo sapien
cgaccctcgggctacagaacctgtt

SEQ ID NO: 159687 - DNA, 25 bp, Homo sapien
tgtctcgtgtaatcccacaggctgg

SEQ ID NO: 159688 - DNA, 25 bp, Homo sapien
ggacccgtttggactcgatcctgtc

SEQ ID NO: 159689 - DNA, 25 bp, Homo sapien
cgtggcgcacttaaaagcgggttca

SEQ ID NO: 159690 - DNA, 25 bp, Homo sapien
cacaggctggtctgagtctctgccc

SEQ ID NO: 159691 - DNA, 25 bp, Homo sapien
accggaggagtgatctttcagagca

SEQ ID NO: 159692 - DNA, 25 bp, Homo sapien
ccaaagttcagcctctagtccgttc

SEQ ID NO: 159693 - DNA, 25 bp, Homo sapien
acggccctggtcgtctccatgaaaa

SEQ ID NO: 159694 - DNA, 25 bp, Homo sapien
tccagagcctgacccaagtgaacgt

SEQ ID NO: 159695 - DNA, 25 bp, Homo sapien
tgcaacaacagcgacaggaccagtg

SEQ ID NO: 159696 - DNA, 25 bp, Homo sapien
agtgtcctcaccagggcttctgcaa

SEQ ID NO: 159697 - DNA, 25 bp, Homo sapien
ccgctcggggatcactacttcgtag

SEQ ID NO: 159698 - DNA, 25 bp, Homo sapien
gcgattcctcgaaacccggcgcagt

SEQ ID NO: 159699 - DNA, 25 bp, Homo sapien
aggcgtctcgcggtgactttacctt

SEQ ID NO: 159700 - DNA, 25 bp, Homo sapien
acggttagtgctctgctttcccaca

SEQ ID NO: 159701 - DNA, 25 bp, Homo sapien
tagagcagcccagtcagccacttgg

SEQ ID NO: 159702 - DNA, 25 bp, Homo sapien
tgagccgctgcttcatcgcactgca

SEQ ID NO: 159703 - DNA, 25 bp, Homo sapien
cggactgtgtgctcttccgcatgcg

SEQ ID NO: 159704 - DNA, 25 bp, Homo sapien
actgtgtgctcttccgcatgcggtt

SEQ ID NO: 159705 - DNA, 25 bp, Homo sapien
tgtgctcttccgcatgcggttgagg

SEQ ID NO: 159706 - DNA, 25 bp, Homo sapien
gctcttccgcatgcggttgagggca

SEQ ID NO: 159707 - DNA, 25 bp, Homo sapien
gcatgcggttgagggcagcgcagaa

SEQ ID NO: 159708 - DNA, 25 bp, Homo sapien
cgcagaagttgggcaccgtagcccg

SEQ ID NO: 159709 - DNA, 25 bp, Homo sapien
tcctcaggggagtacgcccgcgcat

SEQ ID NO: 159710 - DNA, 25 bp, Homo sapien
agtacgcccgcgcatcggtgccgga

SEQ ID NO: 159711 - DNA, 25 bp, Homo sapien
ttaatgcctcggtcaaacgtcgtcc

SEQ ID NO: 159712 - DNA, 25 bp, Homo sapien
tggaggcgccaagatgaagcccatc

SEQ ID NO: 159713 - DNA, 25 bp, Homo sapien
ttctcactttgtggagccgcctgga

SEQ ID NO: 159714 - DNA, 25 bp, Homo sapien
cgcgccctacgcaatacgtggagtt

SEQ ID NO: 159715 - DNA, 25 bp, Homo sapien
tcagcctccgacaggggcgtaatta

SEQ ID NO: 159716 - DNA, 25 bp, Homo sapien
cgcatgcccggaagccttaagtgtt

SEQ ID NO: 159717 - DNA, 25 bp, Homo sapien
tacctcggttcagtggaaggcattc

SEQ ID NO: 159718 - DNA, 25 bp, Homo sapien
aggcattcatttgcacaacgctgtg

SEQ ID NO: 159719 - DNA, 25 bp, Homo sapien
accaggccgcctcgaaagccaattt

SEQ ID NO: 159720 - DNA, 25 bp, Homo sapien
gcctggttctcgacagcgtactgaa

SEQ ID NO: 159721 - DNA, 25 bp, Homo sapien
cccgaatttcggatcaatctgcaac

SEQ ID NO: 159722 - DNA, 25 bp, Homo sapien
atctgcaacgtgacggcagcaggga

SEQ ID NO: 159723 - DNA, 25 bp, Homo sapien
ctatcctagttctctgcttggggtc

SEQ ID NO: 159724 - DNA, 25 bp, Homo sapien
gggacatgccgcagaatctagactg

SEQ ID NO: 159725 - DNA, 25 bp, Homo sapien
gaatctagactgctcagtgctccga

SEQ ID NO: 159726 - DNA, 25 bp, Homo sapien
cccgtgaggttgactgagtgcccga

SEQ ID NO: 159727 - DNA, 25 bp, Homo sapien
cgcgcgacccttcgggtgagtacgt

SEQ ID NO: 159728 - DNA, 25 bp, Homo sapien
ccgcgcttcccagcgaggccgccgg

SEQ ID NO: 159729 - DNA, 25 bp, Homo sapien
ccgagggctgtgctcgaccgcgaat

SEQ ID NO: 159730 - DNA, 25 bp, Homo sapien
tcgaccgcgaatcccgtgtgcagtc

SEQ ID NO: 159731 - DNA, 25 bp, Homo sapien
gtcactgcccgcgagtgcggaagca

SEQ ID NO: 159732 - DNA, 25 bp, Homo sapien
cggtatttatagctccgtgacagca

SEQ ID NO: 159733 - DNA, 25 bp, Homo sapien
tgggccgagccggtatttatagctc

SEQ ID NO: 159734 - DNA, 25 bp, Homo sapien
agtgcggaagcagccgcggaacccc

SEQ ID NO: 159735 - DNA, 25 bp, Homo sapien
cacaggttcaaacgggtcaagagcc

SEQ ID NO: 159736 - DNA, 25 bp, Homo sapien
tcttctccgggcacacaggttcaaa

SEQ ID NO: 159737 - DNA, 25 bp, Homo sapien
aaggctgctcgtctctcctaaggtc

SEQ ID NO: 159738 - DNA, 25 bp, Homo sapien
gccgctggactcgagttcttctccg

SEQ ID NO: 159739 - DNA, 25 bp, Homo sapien
tgtgggacggaactacagggcaaac

SEQ ID NO: 159740 - DNA, 25 bp, Homo sapien
gcactagcgcgaagctgaaaggtca

SEQ ID NO: 159741 - DNA, 25 bp, Homo sapien
gttcctgggcaactcaaaagcctga

SEQ ID NO: 159742 - DNA, 25 bp, Homo sapien
ctcctaaggtctttggccacagttc

SEQ ID NO: 159743 - DNA, 25 bp, Homo sapien
cacttccgcattggatggcaggtca

SEQ ID NO: 159744 - DNA, 25 bp, Homo sapien
gctcctccgcagatccgaactggtt

SEQ ID NO: 159745 - DNA, 25 bp, Homo sapien
gtcgtattcagctggattcctcgta

SEQ ID NO: 159746 - DNA, 25 bp, Homo sapien
gctgttggaaatctaggcctggatc

SEQ ID NO: 159747 - DNA, 25 bp, Homo sapien
acgctgtcacgtgtcgcacttcttg

SEQ ID NO: 159748 - DNA, 25 bp, Homo sapien
agagccactgtcaagcacttccgca

SEQ ID NO: 159749 - DNA, 25 bp, Homo sapien
tggcaggtcaaaggtcacattctta

SEQ ID NO: 159750 - DNA, 25 bp, Homo sapien
gaactggttgccttccaccttgaaa

SEQ ID NO: 159751 - DNA, 25 bp, Homo sapien
atcattcccacacgcagggccgagg

SEQ ID NO: 159752 - DNA, 25 bp, Homo sapien
ggggaattagctcccgagccgaata

SEQ ID NO: 159753 - DNA, 25 bp, Homo sapien
gccaaagactcgcacacccggtaga

SEQ ID NO: 159754 - DNA, 25 bp, Homo sapien
cgcccgaacctgttgtaaaggcaga

SEQ ID NO: 159755 - DNA, 25 bp, Homo sapien
tcctggatgccaaacccggtctagg

SEQ ID NO: 159756 - DNA, 25 bp, Homo sapien
cgtgaagaacttagaccctccaatg

SEQ ID NO: 159757 - DNA, 25 bp, Homo sapien
tagcgctcgcctgccctttaagcaa

SEQ ID NO: 159758 - DNA, 25 bp, Homo sapien
gggcaatgccaacctcctttcggga

SEQ ID NO: 159759 - DNA, 25 bp, Homo sapien
tgtccgcagagggactgagcacttg

SEQ ID NO: 159760 - DNA, 25 bp, Homo sapien
gagcacttgaaaagcccaccgcgtt

SEQ ID NO: 159761 - DNA, 25 bp, Homo sapien
gcggcggacttggaacgatattatt

SEQ ID NO: 159762 - DNA, 25 bp, Homo sapien
gacccgcagcaaattctcgatcagg

SEQ ID NO: 159763 - DNA, 25 bp, Homo sapien
cggaggaagccacaacgtcccagta

SEQ ID NO: 159764 - DNA, 25 bp, Homo sapien
cgcggccaacaataagggtagtgct

SEQ ID NO: 159765 - DNA, 25 bp, Homo sapien
aaggtgtgtccagcccatccattca

SEQ ID NO: 159766 - DNA, 25 bp, Homo sapien
gtgagtttctctggccgacagcgta

SEQ ID NO: 159767 - DNA, 25 bp, Homo sapien
aacttcgcgccaagttcggagccgc

SEQ ID NO: 159768 - DNA, 25 bp, Homo sapien
agttcaatcattccgcagcgagccg

SEQ ID NO: 159769 - DNA, 25 bp, Homo sapien
aggatcgcactactccctctgcagt

SEQ ID NO: 159770 - DNA, 25 bp, Homo sapien
tggaaaccctttcccatctgcggag

SEQ ID NO: 159771 - DNA, 25 bp, Homo sapien
gccgccttctgagggagacatgaaa

SEQ ID NO: 159772 - DNA, 25 bp, Homo sapien
agtctccactcagaagcaactttgg

SEQ ID NO: 159773 - DNA, 25 bp, Homo sapien
actcgcagagtgctagggttgccca

SEQ ID NO: 159774 - DNA, 25 bp, Homo sapien
gtgtgacccatctgaatcctcgtta

SEQ ID NO: 159775 - DNA, 25 bp, Homo sapien
tggggtttccaaactcggatgcatc

SEQ ID NO: 159776 - DNA, 25 bp, Homo sapien
tccaagagattctggtcagctgccg

SEQ ID NO: 159777 - DNA, 25 bp, Homo sapien
ggagcagtcacctcagctttccgtt

SEQ ID NO: 159778 - DNA, 25 bp, Homo sapien
tctggcgcttccttcgagaaaatga

SEQ ID NO: 159779 - DNA, 25 bp, Homo sapien
agcagaggttttccatgttgacaga

SEQ ID NO: 159780 - DNA, 25 bp, Homo sapien
gctttccgttctccctctagttaca

SEQ ID NO: 159781 - DNA, 25 bp, Homo sapien
cgtggactgtggcattttaaaacta

SEQ ID NO: 159782 - DNA, 25 bp, Homo sapien
cgcaagtgcggcgtttagggaatcc

SEQ ID NO: 159783 - DNA, 25 bp, Homo sapien
ccggggccgaaatacacgctgtcac

SEQ ID NO: 159784 - DNA, 25 bp, Homo sapien
gacgagctgcggcagttccaccaca

SEQ ID NO: 159785 - DNA, 25 bp, Homo sapien
aaagggactcgctttcctggacgag

SEQ ID NO: 159786 - DNA, 25 bp, Homo sapien
taatggcaaactcgacggggaaggc

SEQ ID NO: 159787 - DNA, 25 bp, Homo sapien
tgcccttctagtttcgctccgattt

SEQ ID NO: 159788 - DNA, 25 bp, Homo sapien
cccggcagcagcaccatgttgaatc

SEQ ID NO: 159789 - DNA, 25 bp, Homo sapien
gccgccgaaactcttgggcctctgg

SEQ ID NO: 159790 - DNA, 25 bp, Homo sapien
cggcagttccaccacagcagagggt

SEQ ID NO: 159791 - DNA, 25 bp, Homo sapien
tacagggtctctaggacactgactc

SEQ ID NO: 159792 - DNA, 25 bp, Homo sapien
attctgcttactcgctcgctctggc

SEQ ID NO: 159793 - DNA, 25 bp, Homo sapien
ccctgagtgcatgttcgtagtaccc

SEQ ID NO: 159794 - DNA, 25 bp, Homo sapien
ccttcgtccgctttgtggtgttaca

SEQ ID NO: 159795 - DNA, 25 bp, Homo sapien
cttcgagaggtagctccaactttcc

SEQ ID NO: 159796 - DNA, 25 bp, Homo sapien
gccgcgcgagattccgaaactttgt

SEQ ID NO: 159797 - DNA, 25 bp, Homo sapien
cgaccagtgtttacctcagaccgag

SEQ ID NO: 159798 - DNA, 25 bp, Homo sapien
acagtaggttcccaggtcccagtca

SEQ ID NO: 159799 - DNA, 25 bp, Homo sapien
acgcctgcccgggatgagtttcctc

SEQ ID NO: 159800 - DNA, 25 bp, Homo sapien
ttctgttcgcgcgtgctgcgctctc

SEQ ID NO: 159801 - DNA, 25 bp, Homo sapien
gccgcgcgctcacacgttttcctgt

SEQ ID NO: 159802 - DNA, 25 bp, Homo sapien
tcacccaggtcccagtcgctttcag

SEQ ID NO: 159803 - DNA, 25 bp, Homo sapien
cttgtcctgcttgcggctcccgcag

SEQ ID NO: 159804 - DNA, 25 bp, Homo sapien
tctcgcagactacgttgcggcgtcc

SEQ ID NO: 159805 - DNA, 25 bp, Homo sapien
cgctctccagccaccctgacgcctg

SEQ ID NO: 159806 - DNA, 25 bp, Homo sapien
ttcctgcattctcgcagactacgtt

SEQ ID NO: 159807 - DNA, 25 bp, Homo sapien
atcacacgatctcctctgggccttg

SEQ ID NO: 159808 - DNA, 25 bp, Homo sapien
ggccttgcggacacaggaaattttc

SEQ ID NO: 159809 - DNA, 25 bp, Homo sapien
tccgggccgattgcatcagaatctc

SEQ ID NO: 159810 - DNA, 25 bp, Homo sapien
gtggttcctggctctcgtaaaaatg

SEQ ID NO: 159811 - DNA, 25 bp, Homo sapien
gtggcccttccgcaaccatggcttg

SEQ ID NO: 159812 - DNA, 25 bp, Homo sapien
ttacatcgacatgcaccggcgctga

SEQ ID NO: 159813 - DNA, 25 bp, Homo sapien
accctcggcagtttgatgtcctttg

SEQ ID NO: 159814 - DNA, 25 bp, Homo sapien
ggcacagccgagctctctctgcttt

SEQ ID NO: 159815 - DNA, 25 bp, Homo sapien
cacgcagacgtcttcagtgggtttc

SEQ ID NO: 159816 - DNA, 25 bp, Homo sapien
cgcgttacctcggtggtctctattc

SEQ ID NO: 159817 - DNA, 25 bp, Homo sapien
cccaatcttggcctctcctgtaata

SEQ ID NO: 159818 - DNA, 25 bp, Homo sapien
gtttgtttacacacgcgcgccagtg

SEQ ID NO: 159819 - DNA, 25 bp, Homo sapien
gcaatgctgcgtaatctgtccttta

SEQ ID NO: 159820 - DNA, 25 bp, Homo sapien
tgcacaggcactcagggcacacatc

SEQ ID NO: 159821 - DNA, 25 bp, Homo sapien
cggctttccgtttctagcatttgga

SEQ ID NO: 159822 - DNA, 25 bp, Homo sapien
accctggctcgtgtgcatgcaacct

SEQ ID NO: 159823 - DNA, 25 bp, Homo sapien
ccctgggactccagagaagcgccga

SEQ ID NO: 159824 - DNA, 25 bp, Homo sapien
taagatatacgaccttccctgggga

SEQ ID NO: 159825 - DNA, 25 bp, Homo sapien
gggaagggcacaaccacctcttgca

SEQ ID NO: 159826 - DNA, 25 bp, Homo sapien
cccggggattcccatgcagaaatgg

SEQ ID NO: 159827 - DNA, 25 bp, Homo sapien
tccgccactaagacgccttgggtca

SEQ ID NO: 159828 - DNA, 25 bp, Homo sapien
gagggcgcgagtacactaagatata

SEQ ID NO: 159829 - DNA, 25 bp, Homo sapien
cgggcagtctctttctgtttacgga

SEQ ID NO: 159830 - DNA, 25 bp, Homo sapien
tggcttaccctgcaaccgggcagtc

SEQ ID NO: 159831 - DNA, 25 bp, Homo sapien
acctagagagccctacagcgtcagg

SEQ ID NO: 159832 - DNA, 25 bp, Homo sapien
ccctgcgtcgtggaaaacctagaga

SEQ ID NO: 159833 - DNA, 25 bp, Homo sapien
acagcgtcagggctaatcccgggac

SEQ ID NO: 159834 - DNA, 25 bp, Homo sapien
atccagtcgagcctgggcaagctga

SEQ ID NO: 159835 - DNA, 25 bp, Homo sapien
cgacccacgtgacggtgattcattc

SEQ ID NO: 159836 - DNA, 25 bp, Homo sapien
aaattttccactaacgctccgagcg

SEQ ID NO: 159837 - DNA, 25 bp, Homo sapien
ctctcaggataccagcaggctacac

SEQ ID NO: 159838 - DNA, 25 bp, Homo sapien
ggggtctcactcaatgcggaacgga

SEQ ID NO: 159839 - DNA, 25 bp, Homo sapien
tgaggccgacgtttgatgacagttg

SEQ ID NO: 159840 - DNA, 25 bp, Homo sapien
cgggcggccatcagagtctacacaa

SEQ ID NO: 159841 - DNA, 25 bp, Homo sapien
ttctcgtccctctcgttgatcagga

SEQ ID NO: 159842 - DNA, 25 bp, Homo sapien
cagaaccgagcctgcgcaatcttgg

SEQ ID NO: 159843 - DNA, 25 bp, Homo sapien
cccaacttggtgcagcgtgtgttga

SEQ ID NO: 159844 - DNA, 25 bp, Homo sapien
gggcgattcgggacaaaaatatcca

SEQ ID NO: 159845 - DNA, 25 bp, Homo sapien
gagtctacacaagcacccgcggcgg

SEQ ID NO: 159846 - DNA, 25 bp, Homo sapien
ctccacttctcgcaggccaggaagg

SEQ ID NO: 159847 - DNA, 25 bp, Homo sapien
ggactcaagggtgctcccggcttac

SEQ ID NO: 159848 - DNA, 25 bp, Homo sapien
ctcgggtaacaccttgccagcagga

SEQ ID NO: 159849 - DNA, 25 bp, Homo sapien
gacgacagttctattttaagccttc

SEQ ID NO: 159850 - DNA, 25 bp, Homo sapien
ggcgacccagctatcagagacgaca

SEQ ID NO: 159851 - DNA, 25 bp, Homo sapien
cctaggcttctcttagctcggttgc

SEQ ID NO: 159852 - DNA, 25 bp, Homo sapien
atgaagagtacctcaccgcgcgctg

SEQ ID NO: 159853 - DNA, 25 bp, Homo sapien
gtccacctgtaccaccgctagatga

SEQ ID NO: 159854 - DNA, 25 bp, Homo sapien
aaccgctggcgcagttttcagactc

SEQ ID NO: 159855 - DNA, 25 bp, Homo sapien
ccgggttcctctcattgcaggctga

SEQ ID NO: 159856 - DNA, 25 bp, Homo sapien
tgcctacgcagtgccttccgaaggt

SEQ ID NO: 159857 - DNA, 25 bp, Homo sapien
cccatccaggaaaaaactcacggtg

SEQ ID NO: 159858 - DNA, 25 bp, Homo sapien
tgtctgtcactcttgcaccttccga

SEQ ID NO: 159859 - DNA, 25 bp, Homo sapien
ggacgcagcagccaagctcttcgct

SEQ ID NO: 159860 - DNA, 25 bp, Homo sapien
tccaggaaggctaaaggggacacgc

SEQ ID NO: 159861 - DNA, 25 bp, Homo sapien
gtccagctccaagccgggcggtaat

SEQ ID NO: 159862 - DNA, 25 bp, Homo sapien
tctagccggctctcaactttgagga

SEQ ID NO: 159863 - DNA, 25 bp, Homo sapien
cggggccacatgcacaacggcctta

SEQ ID NO: 159864 - DNA, 25 bp, Homo sapien
cttcgatgtactggacttgcatttc

SEQ ID NO: 159865 - DNA, 25 bp, Homo sapien
gccaccgaggcacgtaaacataact

SEQ ID NO: 159866 - DNA, 25 bp, Homo sapien
gagtcttgcctcctggtgtggaaca

SEQ ID NO: 159867 - DNA, 25 bp, Homo sapien
cgaactcctggagaagctacctgga

SEQ ID NO: 159868 - DNA, 25 bp, Homo sapien
cgcgtgtactccgattacctccaga

SEQ ID NO: 159869 - DNA, 25 bp, Homo sapien
gctccgaccaccatctggtacgttt

SEQ ID NO: 159870 - DNA, 25 bp, Homo sapien
gccttaactaccgtgaggtccgcga

SEQ ID NO: 159871 - DNA, 25 bp, Homo sapien
gcccggcagtgactcacgcaaagcc

SEQ ID NO: 159872 - DNA, 25 bp, Homo sapien
tcctacgctgctccgggcagcgaga

SEQ ID NO: 159873 - DNA, 25 bp, Homo sapien
caaggatctcctacgctgctccggg

SEQ ID NO: 159874 - DNA, 25 bp, Homo sapien
agcactgcaaaatcgcagcagggtg

SEQ ID NO: 159875 - DNA, 25 bp, Homo sapien
tgccttcccgagcactgcaaaatcg

SEQ ID NO: 159876 - DNA, 25 bp, Homo sapien
gcaatcaaaaacttccagcgctggg

SEQ ID NO: 159877 - DNA, 25 bp, Homo sapien
gggtatcactttcacacccgctgtc

SEQ ID NO: 159878 - DNA, 25 bp, Homo sapien
ggggtgcgagccagcaatcaaaaac

SEQ ID NO: 159879 - DNA, 25 bp, Homo sapien
gggacgccacccagccaccggcgac

SEQ ID NO: 159880 - DNA, 25 bp, Homo sapien
cacccgggggtaccagagtggacat

SEQ ID NO: 159881 - DNA, 25 bp, Homo sapien
cactggcaggctttggagtccgcac

SEQ ID NO: 159882 - DNA, 25 bp, Homo sapien
ctgccttacggtagaggaatgcgta

SEQ ID NO: 159883 - DNA, 25 bp, Homo sapien
gcgccctgccttacggtagaggaat

SEQ ID NO: 159884 - DNA, 25 bp, Homo sapien
agcctgcgccttcgtctcagacgaa

SEQ ID NO: 159885 - DNA, 25 bp, Homo sapien
tcgtctcagacgaaggagccagctg

SEQ ID NO: 159886 - DNA, 25 bp, Homo sapien
tcagacgaaggagccagctggcacc

SEQ ID NO: 159887 - DNA, 25 bp, Homo sapien
ggagaccgggcattccagcgccctg

SEQ ID NO: 159888 - DNA, 25 bp, Homo sapien
tcttcgccccactcctgagagggtg

SEQ ID NO: 159889 - DNA, 25 bp, Homo sapien
ccactgtgcaaatggcccagcgcgg

SEQ ID NO: 159890 - DNA, 25 bp, Homo sapien
tcagtttccaccactgtgcaaatgg

SEQ ID NO: 159891 - DNA, 25 bp, Homo sapien
accgaggctccacgcctccctgggc

SEQ ID NO: 159892 - DNA, 25 bp, Homo sapien
tccagcgccctgctaggcaggcttg

SEQ ID NO: 159893 - DNA, 25 bp, Homo sapien
ggacagcgacccgtaattcaggacg

SEQ ID NO: 159894 - DNA, 25 bp, Homo sapien
ggcaggcttgctaccgaggctccac

SEQ ID NO: 159895 - DNA, 25 bp, Homo sapien
cccgggttatctgtcacggcacact

SEQ ID NO: 159896 - DNA, 25 bp, Homo sapien
tctggacggtggtctaccgacagcc

SEQ ID NO: 159897 - DNA, 25 bp, Homo sapien
tccgcgccgcctactccggcatcag

SEQ ID NO: 159898 - DNA, 25 bp, Homo sapien
ctccatcttcctcgtctggacggtg

SEQ ID NO: 159899 - DNA, 25 bp, Homo sapien
ggtggagtgtttactcgaaaacagc

SEQ ID NO: 159900 - DNA, 25 bp, Homo sapien
ttactcgaaaacagcggttggcggc

SEQ ID NO: 159901 - DNA, 25 bp, Homo sapien
gccgcccgggttatctgtcacggca

SEQ ID NO: 159902 - DNA, 25 bp, Homo sapien
ggcatcagctccgtggccggcttct

SEQ ID NO: 159903 - DNA, 25 bp, Homo sapien
agttctataacctgaacgcgcctgg

SEQ ID NO: 159904 - DNA, 25 bp, Homo sapien
tggggcaagcaaaacaagacggtta

SEQ ID NO: 159905 - DNA, 25 bp, Homo sapien
ctgtcattctgagagcagttctata

SEQ ID NO: 159906 - DNA, 25 bp, Homo sapien
gtgccaccagcctgtcattctgaga

SEQ ID NO: 159907 - DNA, 25 bp, Homo sapien
cgaaacaaggctgctgctattttta

SEQ ID NO: 159908 - DNA, 25 bp, Homo sapien
gcctccacatttgctaaccgaaaca

SEQ ID NO: 159909 - DNA, 25 bp, Homo sapien
aagcacagccctgcgctgcgggcaa

SEQ ID NO: 159910 - DNA, 25 bp, Homo sapien
acaagacggttacagcccaatcgcc

SEQ ID NO: 159911 - DNA, 25 bp, Homo sapien
accagtcaggcgaggagaattagct

SEQ ID NO: 159912 - DNA, 25 bp, Homo sapien
cggcggtggcatccatattcatgaa

SEQ ID NO: 159913 - DNA, 25 bp, Homo sapien
tcgccatcctagcaactcgagctta

SEQ ID NO: 159914 - DNA, 25 bp, Homo sapien
agctgcgtcatttgtcgccatccta

SEQ ID NO: 159915 - DNA, 25 bp, Homo sapien
ttaactctgaaaggctcggcggggc

SEQ ID NO: 159916 - DNA, 25 bp, Homo sapien
ggactcccgagcacgcacttgtgcg

SEQ ID NO: 159917 - DNA, 25 bp, Homo sapien
tttctttatgcacgcctcgccgagg

SEQ ID NO: 159918 - DNA, 25 bp, Homo sapien
cgaccactcgggctttcaattagga

SEQ ID NO: 159919 - DNA, 25 bp, Homo sapien
tccatgtttacaaggggcagaatca

SEQ ID NO: 159920 - DNA, 25 bp, Homo sapien
tgacaatggaaggaaatgctttatc

SEQ ID NO: 159921 - DNA, 25 bp, Homo sapien
tttatctgagtctgagagcgggcca

SEQ ID NO: 159922 - DNA, 25 bp, Homo sapien
ccgagccgtgcacaattcccggaaa

SEQ ID NO: 159923 - DNA, 25 bp, Homo sapien
cgtacacgagcacgcatccatgttt

SEQ ID NO: 159924 - DNA, 25 bp, Homo sapien
gtgcacacactacatacccgtacag

SEQ ID NO: 159925 - DNA, 25 bp, Homo sapien
ctcgcatacacaacgtacacgagca

SEQ ID NO: 159926 - DNA, 25 bp, Homo sapien
ggggcagaatcatttacacagcaca

SEQ ID NO: 159927 - DNA, 25 bp, Homo sapien
ctagctccgcacgaatgggaaatcc

SEQ ID NO: 159928 - DNA, 25 bp, Homo sapien
acaggtccagtcctctcttgccagg

SEQ ID NO: 159929 - DNA, 25 bp, Homo sapien
ttggcgctgcaaccatcttgacttg

SEQ ID NO: 159930 - DNA, 25 bp, Homo sapien
ggccacgctgtagccttagatactc

SEQ ID NO: 159931 - DNA, 25 bp, Homo sapien
cgtgaaattttcatcgaccgtcgtc

SEQ ID NO: 159932 - DNA, 25 bp, Homo sapien
cggatacccgcttcagcctgtgtta

SEQ ID NO: 159933 - DNA, 25 bp, Homo sapien
tgtcgcgaatctcacccaagggagc

SEQ ID NO: 159934 - DNA, 25 bp, Homo sapien
tcgtccatagggcaaggcacgcttc

SEQ ID NO: 159935 - DNA, 25 bp, Homo sapien
ccacgtccacgatgcggttgatata

SEQ ID NO: 159936 - DNA, 25 bp, Homo sapien
cttggaagccactctcaatagatcg

SEQ ID NO: 159937 - DNA, 25 bp, Homo sapien
ccgggtcctcaagtcctgagtctga

SEQ ID NO: 159938 - DNA, 25 bp, Homo sapien
gagcgagctgcctcgcaaccgagaa

SEQ ID NO: 159939 - DNA, 25 bp, Homo sapien
agacgcaaggcctcactaatcgatg

SEQ ID NO: 159940 - DNA, 25 bp, Homo sapien
cactgaggatcgttgccactggcaa

SEQ ID NO: 159941 - DNA, 25 bp, Homo sapien
actggcaacgacaagcccaggcctg

SEQ ID NO: 159942 - DNA, 25 bp, Homo sapien
ccgatggccgaaggtgtacagagcc

SEQ ID NO: 159943 - DNA, 25 bp, Homo sapien
gagccagacagctgcgatattggga

SEQ ID NO: 159944 - DNA, 25 bp, Homo sapien
cagctgcgatattgggaaggcctcc

SEQ ID NO: 159945 - DNA, 25 bp, Homo sapien
ccgcgttctcctggcgggcttggta

SEQ ID NO: 159946 - DNA, 25 bp, Homo sapien
accgaagaggctggtaagtcctcaa

SEQ ID NO: 159947 - DNA, 25 bp, Homo sapien
tggtaagtcctcaagctggcaggtg

SEQ ID NO: 159948 - DNA, 25 bp, Homo sapien
agttcgtgccctgcaggtctgcgac

SEQ ID NO: 159949 - DNA, 25 bp, Homo sapien
ctgcaggtctgcgacgctggcgttc

SEQ ID NO: 159950 - DNA, 25 bp, Homo sapien
tctaccggaaccgagggagccagac

SEQ ID NO: 159951 - DNA, 25 bp, Homo sapien
ccgcagggccgtataagtgattctt

SEQ ID NO: 159952 - DNA, 25 bp, Homo sapien
gggaactgttttgcttcaccgccgc

SEQ ID NO: 159953 - DNA, 25 bp, Homo sapien
ctggacctcgtctctcatgaatggg

SEQ ID NO: 159954 - DNA, 25 bp, Homo sapien
ggggcttttctcgagcgcacacaga

SEQ ID NO: 159955 - DNA, 25 bp, Homo sapien
gagcccgattcacaggtctccgcga

SEQ ID NO: 159956 - DNA, 25 bp, Homo sapien
tctccgcgaggaaccagtttaaata

SEQ ID NO: 159957 - DNA, 25 bp, Homo sapien
tgctgctccaaaacggctgccgata

SEQ ID NO: 159958 - DNA, 25 bp, Homo sapien
ctcgctcacagacaccgggagagtg

SEQ ID NO: 159959 - DNA, 25 bp, Homo sapien
ggggaagacttacggacatcctggc

SEQ ID NO: 159960 - DNA, 25 bp, Homo sapien
ctagaccaaggacggaaaagacatg

SEQ ID NO: 159961 - DNA, 25 bp, Homo sapien
ggccgagagccctagaccaaggacg

SEQ ID NO: 159962 - DNA, 25 bp, Homo sapien
gctgggctgtaacctgaaccgcccg

SEQ ID NO: 159963 - DNA, 25 bp, Homo sapien
cgccctcatgcaggaggcccttgga

SEQ ID NO: 159964 - DNA, 25 bp, Homo sapien
ccgaggcgaatcatggctcaccgcg

SEQ ID NO: 159965 - DNA, 25 bp, Homo sapien
atcctggccctgacaccgaaggaca

SEQ ID NO: 159966 - DNA, 25 bp, Homo sapien
caccgaaggacagcggcgacgagca

SEQ ID NO: 159967 - DNA, 25 bp, Homo sapien
cgagttctgtgagccggggagaagc

SEQ ID NO: 159968 - DNA, 25 bp, Homo sapien
ggagaagcgccagaatttcccagtc

SEQ ID NO: 159969 - DNA, 25 bp, Homo sapien
agaagcgccagaatttcccagtcgg

SEQ ID NO: 159970 - DNA, 25 bp, Homo sapien
aagcgccagaatttcccagtcggcc

SEQ ID NO: 159971 - DNA, 25 bp, Homo sapien
gatccagctggcgagttctgtgagc

SEQ ID NO: 159972 - DNA, 25 bp, Homo sapien
gaggccgatccagctggcgagttct

SEQ ID NO: 159973 - DNA, 25 bp, Homo sapien
ctggccagggatcggggaggccgat

SEQ ID NO: 159974 - DNA, 25 bp, Homo sapien
tggccagggacggttggtcactgct

SEQ ID NO: 159975 - DNA, 25 bp, Homo sapien
cagtctgggctttttcgctttctcg

SEQ ID NO: 159976 - DNA, 25 bp, Homo sapien
agcttttcgcggtggccctaaatct

SEQ ID NO: 159977 - DNA, 25 bp, Homo sapien
tcggaatactgttagtgagcccttc

SEQ ID NO: 159978 - DNA, 25 bp, Homo sapien
gcgaagggagcatttaagactagtc

SEQ ID NO: 159979 - DNA, 25 bp, Homo sapien
ttcacagcaccggaagagtcgctag

SEQ ID NO: 159980 - DNA, 25 bp, Homo sapien
accgggtccgacacagtctcctgga

SEQ ID NO: 159981 - DNA, 25 bp, Homo sapien
gaacggcctcaggtagcctaacggc

SEQ ID NO: 159982 - DNA, 25 bp, Homo sapien
gttccagtttccatggcagcttttc

SEQ ID NO: 159983 - DNA, 25 bp, Homo sapien
ttcgccctccagaggcctagttagg

SEQ ID NO: 159984 - DNA, 25 bp, Homo sapien
cagatcgcagcaatcccggtaggtc

SEQ ID NO: 159985 - DNA, 25 bp, Homo sapien
actagagcacttcgaccagggagta

SEQ ID NO: 159986 - DNA, 25 bp, Homo sapien
cgcactcaccgaattgctgggctga

SEQ ID NO: 159987 - DNA, 25 bp, Homo sapien
ggcaggccctctgtttaccggacta

SEQ ID NO: 159988 - DNA, 25 bp, Homo sapien
tgcgcagacttgtgcagcagctttc

SEQ ID NO: 159989 - DNA, 25 bp, Homo sapien
tgtcactttctgcacgggctctaaa

SEQ ID NO: 159990 - DNA, 25 bp, Homo sapien
gcccggaaataagtctcagcctcga

SEQ ID NO: 159991 - DNA, 25 bp, Homo sapien
ttctgccactcaatggaggacggtc

SEQ ID NO: 159992 - DNA, 25 bp, Homo sapien
atcatgaccaaggacggcggcgaca

SEQ ID NO: 159993 - DNA, 25 bp, Homo sapien
tacaacggcggcatgaaggaactga

SEQ ID NO: 159994 - DNA, 25 bp, Homo sapien
gaactgatggagcacctgaaagccc

SEQ ID NO: 159995 - DNA, 25 bp, Homo sapien
ctgcaagccctgtttgaggacgtga

SEQ ID NO: 159996 - DNA, 25 bp, Homo sapien
cacatccaggtgctctcggacgacg

SEQ ID NO: 159997 - DNA, 25 bp, Homo sapien
gcgatcccaagagacgccggctctg

SEQ ID NO: 159998 - DNA, 25 bp, Homo sapien
gccatcgtctccatgtgccagatta

SEQ ID NO: 159999 - DNA, 25 bp, Homo sapien
ttacctgctgtgatccgaattctca

SEQ ID NO: 160000 - DNA, 25 bp, Homo sapien
cccgctgccgtaattacctgctgtg

SEQ ID NO: 160001 - DNA, 25 bp, Homo sapien
ctcattggttgggaggggatctcac

SEQ ID NO: 160002 - DNA, 25 bp, Homo sapien
gtgatctgaattctcattggttggg

SEQ ID NO: 160003 - DNA, 25 bp, Homo sapien
tgccgtaattacctgctgtgatccg

SEQ ID NO: 160004 - DNA, 25 bp, Homo sapien
ctgtgatccgaattctcattggttg

SEQ ID NO: 160005 - DNA, 25 bp, Homo sapien
ccgctgccgtaattacctgctgtga

SEQ ID NO: 160006 - DNA, 25 bp, Homo sapien
ctgtgatctgaattctcattggttg

SEQ ID NO: 160007 - DNA, 25 bp, Homo sapien
gcctcggaaatatggcgacagcttc

SEQ ID NO: 160008 - DNA, 25 bp, Homo sapien
aaggctgattcgtcacaggccgtca

SEQ ID NO: 160009 - DNA, 25 bp, Homo sapien
atattttcggtctttgggctgcgcc

SEQ ID NO: 160010 - DNA, 25 bp, Homo sapien
tgcgtgctcaccagcgacaagtgtc

SEQ ID NO: 160011 - DNA, 25 bp, Homo sapien
ggcaatttgtgtcctccagagacca

SEQ ID NO: 160012 - DNA, 25 bp, Homo sapien
aagcagttctaggtcactcggcctg

SEQ ID NO: 160013 - DNA, 25 bp, Homo sapien
agttctacgacgaagcgggcgattc

SEQ ID NO: 160014 - DNA, 25 bp, Homo sapien
cgggcgattcctcttgcctggaatt

SEQ ID NO: 160015 - DNA, 25 bp, Homo sapien
tgaaggaagacaccacgccgaggtc

SEQ ID NO: 160016 - DNA, 25 bp, Homo sapien
cgaaacgccggctacgaagtgcgca

SEQ ID NO: 160017 - DNA, 25 bp, Homo sapien
cgccggctacttcagggtctggaag

SEQ ID NO: 160018 - DNA, 25 bp, Homo sapien
gtctggaaggttcccaagcccagga

SEQ ID NO: 160019 - DNA, 25 bp, Homo sapien
cgcgagggcgaaagccaaggccaat

SEQ ID NO: 160020 - DNA, 25 bp, Homo sapien
caagcccaggagaaagccgggacgc

SEQ ID NO: 160021 - DNA, 25 bp, Homo sapien
gacaagaggcgaagctccaagccca

SEQ ID NO: 160022 - DNA, 25 bp, Homo sapien
cggaccatccagtagccaacgcggg

SEQ ID NO: 160023 - DNA, 25 bp, Homo sapien
tggaattgcgtaaccgcccgttaca

SEQ ID NO: 160024 - DNA, 25 bp, Homo sapien
gggttcgtcaattacctggaattgc

SEQ ID NO: 160025 - DNA, 25 bp, Homo sapien
ggagttctgtcctcagggttcgtca

SEQ ID NO: 160026 - DNA, 25 bp, Homo sapien
tactgggcctcccacggagttctgt

SEQ ID NO: 160027 - DNA, 25 bp, Homo sapien
cattttccgctctggctactgggcc

SEQ ID NO: 160028 - DNA, 25 bp, Homo sapien
cgcactcttgcctgactgaccattt

SEQ ID NO: 160029 - DNA, 25 bp, Homo sapien
gcagcaacccggaagacgcgccgat

SEQ ID NO: 160030 - DNA, 25 bp, Homo sapien
gttacaggccagaccgaggccgaga

SEQ ID NO: 160031 - DNA, 25 bp, Homo sapien
ggtgcagatcgccaaccagaacata

SEQ ID NO: 160032 - DNA, 25 bp, Homo sapien
agcgggaccctcatgatggctttcc

SEQ ID NO: 160033 - DNA, 25 bp, Homo sapien
tcaagaccatgtgctccctgcggga

SEQ ID NO: 160034 - DNA, 25 bp, Homo sapien
ctcagcacgtggagcctcaagacca

SEQ ID NO: 160035 - DNA, 25 bp, Homo sapien
ggtgcaatccctggccaagtccatc

SEQ ID NO: 160036 - DNA, 25 bp, Homo sapien
tggaggactccttcaccgagcaggt

SEQ ID NO: 160037 - DNA, 25 bp, Homo sapien
atccgcaactcgcttctggagagcc

SEQ ID NO: 160038 - DNA, 25 bp, Homo sapien
ccgagaaagcgctcatggagggcta

SEQ ID NO: 160039 - DNA, 25 bp, Homo sapien
acatgtgggctagcacctgaggatg

SEQ ID NO: 160040 - DNA, 25 bp, Homo sapien
tcctccgccgctcacctacacccac

SEQ ID NO: 160041 - DNA, 25 bp, Homo sapien
acccacctctccactgctgttgacc

SEQ ID NO: 160042 - DNA, 25 bp, Homo sapien
cacgccgcgtgtgttctcattcgca

SEQ ID NO: 160043 - DNA, 25 bp, Homo sapien
gcgtgtgttctcattcgcacccaca

SEQ ID NO: 160044 - DNA, 25 bp, Homo sapien
gttctcattcgcacccacatgtggg

SEQ ID NO: 160045 - DNA, 25 bp, Homo sapien
cccacatgtgggctagcacctgagg

SEQ ID NO: 160046 - DNA, 25 bp, Homo sapien
gtgcagatgtgaagcccagcgcgcc

SEQ ID NO: 160047 - DNA, 25 bp, Homo sapien
agaagccgtatttggtctccctcga

SEQ ID NO: 160048 - DNA, 25 bp, Homo sapien
acggccctgccctgatacgcaggag

SEQ ID NO: 160049 - DNA, 25 bp, Homo sapien
gctcatcctggagcggctcagggcc

SEQ ID NO: 160050 - DNA, 25 bp, Homo sapien
gagctgagcattccggtcacgcctc

SEQ ID NO: 160051 - DNA, 25 bp, Homo sapien
cccgggatagagaaacccagatgaa

SEQ ID NO: 160052 - DNA, 25 bp, Homo sapien
agcccagtgagatgttggcctcctc

SEQ ID NO: 160053 - DNA, 25 bp, Homo sapien
atttggtctccctcgatgggcgaga

SEQ ID NO: 160054 - DNA, 25 bp, Homo sapien
gctcagggccgtttagcagcttccg

SEQ ID NO: 160055 - DNA, 25 bp, Homo sapien
atcttacctcaggagctgcgctgcg

SEQ ID NO: 160056 - DNA, 25 bp, Homo sapien
ggcgggttgccagctaatatttttc

SEQ ID NO: 160057 - DNA, 25 bp, Homo sapien
tggccgagaccaactacctatcgtg

SEQ ID NO: 160058 - DNA, 25 bp, Homo sapien
tggctaccgctcgtatgacaggatg

SEQ ID NO: 160059 - DNA, 25 bp, Homo sapien
cgcggacagtttccaaaggacatgc

SEQ ID NO: 160060 - DNA, 25 bp, Homo sapien
tcggaagcctatgcgagcgccattt

SEQ ID NO: 160061 - DNA, 25 bp, Homo sapien
agcgccattttgtcctacggctcca

SEQ ID NO: 160062 - DNA, 25 bp, Homo sapien
gagactgactctgacactgctttga

SEQ ID NO: 160063 - DNA, 25 bp, Homo sapien
cccgtagccgagttaacagccaata

SEQ ID NO: 160064 - DNA, 25 bp, Homo sapien
gggcaactgcgacttgacgaacttc

SEQ ID NO: 160065 - DNA, 25 bp, Homo sapien
tccagctgttctcgagtgaaatacc

SEQ ID NO: 160066 - DNA, 25 bp, Homo sapien
gaaagttctttatctgggtccacgc

SEQ ID NO: 160067 - DNA, 25 bp, Homo sapien
cgcctgctggcgataagaaagttct

SEQ ID NO: 160068 - DNA, 25 bp, Homo sapien
tgtcctgaagcagattggccgcctg

SEQ ID NO: 160069 - DNA, 25 bp, Homo sapien
gcctaggccacaaggatacacgtta

SEQ ID NO: 160070 - DNA, 25 bp, Homo sapien
gcttccctagcgctaactgagtttc

SEQ ID NO: 160071 - DNA, 25 bp, Homo sapien
ggctgctctggttcatctggaagaa

SEQ ID NO: 160072 - DNA, 25 bp, Homo sapien
gttgtcacctcggtatcctcgaagc

SEQ ID NO: 160073 - DNA, 25 bp, Homo sapien
ggaactgcttcgactggaacacctg

SEQ ID NO: 160074 - DNA, 25 bp, Homo sapien
catctggaagaagtaccgctggtac

SEQ ID NO: 160075 - DNA, 25 bp, Homo sapien
ctgcatcccggaggcagctcatata

SEQ ID NO: 160076 - DNA, 25 bp, Homo sapien
tggcggaagctatgccggttacaca

SEQ ID NO: 160077 - DNA, 25 bp, Homo sapien
acgtagctcaccacccacatggagt

SEQ ID NO: 160078 - DNA, 25 bp, Homo sapien
cagcttggccgaacggaactgcttc

SEQ ID NO: 160079 - DNA, 25 bp, Homo sapien
aactccctcgggcaacactgccgag

SEQ ID NO: 160080 - DNA, 25 bp, Homo sapien
actgcctccatgacttccctttgcc

SEQ ID NO: 160081 - DNA, 25 bp, Homo sapien
gacctaggagtcctcgatcccactg

SEQ ID NO: 160082 - DNA, 25 bp, Homo sapien
ggacctaggagtcctcgatcccact

SEQ ID NO: 160083 - DNA, 25 bp, Homo sapien
gcgccggacctaggagtcctcgatc

SEQ ID NO: 160084 - DNA, 25 bp, Homo sapien
gagcgccggacctaggagtcctcga

SEQ ID NO: 160085 - DNA, 25 bp, Homo sapien
gcgagcgccggacctaggagtcctc

SEQ ID NO: 160086 - DNA, 25 bp, Homo sapien
cagcctggaactcgccccgtggagg

SEQ ID NO: 160087 - DNA, 25 bp, Homo sapien
cgttccaatcctggcgcaccgggag

SEQ ID NO: 160088 - DNA, 25 bp, Homo sapien
ccacaaactcttgtcgagagccgct

SEQ ID NO: 160089 - DNA, 25 bp, Homo sapien
agccgctcgggtgcgttccaatcct

SEQ ID NO: 160090 - DNA, 25 bp, Homo sapien
tcgggtgcgttccaatcctggcgca

SEQ ID NO: 160091 - DNA, 25 bp, Homo sapien
agacgacccgtccaaggcttcggcg

SEQ ID NO: 160092 - DNA, 25 bp, Homo sapien
cgagacgacccgtccaaggcttcgg

SEQ ID NO: 160093 - DNA, 25 bp, Homo sapien
tgcgttccaatcctggcgcaccggg

SEQ ID NO: 160094 - DNA, 25 bp, Homo sapien
acccacaaactcttgtcgagagccg

SEQ ID NO: 160095 - DNA, 25 bp, Homo sapien
cccagcccgtttcttgcagatttta

SEQ ID NO: 160096 - DNA, 25 bp, Homo sapien
gccatttgctctccatcaggtgctg

SEQ ID NO: 160097 - DNA, 25 bp, Homo sapien
ctccacgtgtggaaacagccatttg

SEQ ID NO: 160098 - DNA, 25 bp, Homo sapien
gtagtttttccacagacattgcccg

SEQ ID NO: 160099 - DNA, 25 bp, Homo sapien
tactgtaaacaagctgtcgccctgg

SEQ ID NO: 160100 - DNA, 25 bp, Homo sapien
gggacggagaccttcagaaatactg

SEQ ID NO: 160101 - DNA, 25 bp, Homo sapien
cagttttcctacagcgtgcgcgtca

SEQ ID NO: 160102 - DNA, 25 bp, Homo sapien
tgcaggaatcctcgtaaacttacag

SEQ ID NO: 160103 - DNA, 25 bp, Homo sapien
agctactgttctgggatcaagaccc

SEQ ID NO: 160104 - DNA, 25 bp, Homo sapien
agcagctactgttctgggatcaaga

SEQ ID NO: 160105 - DNA, 25 bp, Homo sapien
caagcagctactgttctgggatcaa

SEQ ID NO: 160106 - DNA, 25 bp, Homo sapien
gacaagcagctactgttctgggatc

SEQ ID NO: 160107 - DNA, 25 bp, Homo sapien
gtcctgggaagacaagcagctactg

SEQ ID NO: 160108 - DNA, 25 bp, Homo sapien
ctgggaagacaagcagctactgttc

SEQ ID NO: 160109 - DNA, 25 bp, Homo sapien
ttctgggatcaagaccccgcgggga

SEQ ID NO: 160110 - DNA, 25 bp, Homo sapien
ggaagacaagcagctactgttctgg

SEQ ID NO: 160111 - DNA, 25 bp, Homo sapien
agcactcttgcttttcggtcctttc

SEQ ID NO: 160112 - DNA, 25 bp, Homo sapien
gtctcgagctgggactgcagttcct

SEQ ID NO: 160113 - DNA, 25 bp, Homo sapien
agctgggctctctccacagggatgc

SEQ ID NO: 160114 - DNA, 25 bp, Homo sapien
ggatgccgatccctctggagacaca

SEQ ID NO: 160115 - DNA, 25 bp, Homo sapien
ggcgagcagagcaccagcactcttg

SEQ ID NO: 160116 - DNA, 25 bp, Homo sapien
gggagcagaagcttccgccaagagc

SEQ ID NO: 160117 - DNA, 25 bp, Homo sapien
gcggcggaaactccagagtccctac

SEQ ID NO: 160118 - DNA, 25 bp, Homo sapien
gagtccctactctttctcgggagga

SEQ ID NO: 160119 - DNA, 25 bp, Homo sapien
tgagctccgagcagctggtcttcgc

SEQ ID NO: 160120 - DNA, 25 bp, Homo sapien
agcggtgatctgagctccgagcagc

SEQ ID NO: 160121 - DNA, 25 bp, Homo sapien
cgccgcagccctttgtttcccggcg

SEQ ID NO: 160122 - DNA, 25 bp, Homo sapien
ggagccggcgccagattcctcagcc

SEQ ID NO: 160123 - DNA, 25 bp, Homo sapien
agtagttcctgggttgccgagcgtc

SEQ ID NO: 160124 - DNA, 25 bp, Homo sapien
ggcgggcactattgttgtaggagcc

SEQ ID NO: 160125 - DNA, 25 bp, Homo sapien
agcagctggtcttcgcggctcgctc

SEQ ID NO: 160126 - DNA, 25 bp, Homo sapien
ttgccgagcgtctctgtctccgcat

SEQ ID NO: 160127 - DNA, 25 bp, Homo sapien
ccgtttcctggtcgcggagatgaac

SEQ ID NO: 160128 - DNA, 25 bp, Homo sapien
tgtggtttgccagacgttagcgtcc

SEQ ID NO: 160129 - DNA, 25 bp, Homo sapien
tcccagaatgcatgacttgagcgcc

SEQ ID NO: 160130 - DNA, 25 bp, Homo sapien
aggaagagtttttcgccaataggct

SEQ ID NO: 160131 - DNA, 25 bp, Homo sapien
tttctgtaagctcgtgggaaccgcc

SEQ ID NO: 160132 - DNA, 25 bp, Homo sapien
tgccctgactctagccctttctgta

SEQ ID NO: 160133 - DNA, 25 bp, Homo sapien
taggctttcggcattaggttctccc

SEQ ID NO: 160134 - DNA, 25 bp, Homo sapien
gtctgccgggcaatgtggtttgcca

SEQ ID NO: 160135 - DNA, 25 bp, Homo sapien
cgcaggttctgacgcatccgttaga

SEQ ID NO: 160136 - DNA, 25 bp, Homo sapien
tcgggactatctcctcaccagggtc

SEQ ID NO: 160137 - DNA, 25 bp, Homo sapien
tgccacgtgtccaagccaaagctga

SEQ ID NO: 160138 - DNA, 25 bp, Homo sapien
agtattaccacccaacaaggctcgg

SEQ ID NO: 160139 - DNA, 25 bp, Homo sapien
ggggtcacggatgctcttccaaaga

SEQ ID NO: 160140 - DNA, 25 bp, Homo sapien
actttcggtttcgagcccagcctca

SEQ ID NO: 160141 - DNA, 25 bp, Homo sapien
ggggctccacctacgatcggactac

SEQ ID NO: 160142 - DNA, 25 bp, Homo sapien
tatgtgaagcgtgtctccaaaagca

SEQ ID NO: 160143 - DNA, 25 bp, Homo sapien
caagaagcagggcagcaccacggcc

SEQ ID NO: 160144 - DNA, 25 bp, Homo sapien
atatgggaaacccaagaagcagggc

SEQ ID NO: 160145 - DNA, 25 bp, Homo sapien
cggaagcggcagcaatatgggaaac

SEQ ID NO: 160146 - DNA, 25 bp, Homo sapien
gcagcgctggcaatgcgaccatctc

SEQ ID NO: 160147 - DNA, 25 bp, Homo sapien
cgcagcccggcaggctaagctgatg

SEQ ID NO: 160148 - DNA, 25 bp, Homo sapien
ctgccctgtcgtggcaggcggccat

SEQ ID NO: 160149 - DNA, 25 bp, Homo sapien
acatgaatgccaatgcggcagcggg

SEQ ID NO: 160150 - DNA, 25 bp, Homo sapien
gcccatgccaacatgaatgccaatg

SEQ ID NO: 160151 - DNA, 25 bp, Homo sapien
ctagcggcagttctcgcgagaccca

SEQ ID NO: 160152 - DNA, 25 bp, Homo sapien
ctgcgcggtagctagcggcagttct

SEQ ID NO: 160153 - DNA, 25 bp, Homo sapien
ctagcaccggaagccgcgacggcga

SEQ ID NO: 160154 - DNA, 25 bp, Homo sapien
tcacctgttcctgctatcagctgcg

SEQ ID NO: 160155 - DNA, 25 bp, Homo sapien
tctcgggtgggaagaatcccaccgc

SEQ ID NO: 160156 - DNA, 25 bp, Homo sapien
ccgatcgcgcgatagctgcgcggta

SEQ ID NO: 160157 - DNA, 25 bp, Homo sapien
tctctgagctctcgggtgggaagaa

SEQ ID NO: 160158 - DNA, 25 bp, Homo sapien
agctctgcgtccttcaaatgcgggg

SEQ ID NO: 160159 - DNA, 25 bp, Homo sapien
gccaggcaacttcaggcccagaatc

SEQ ID NO: 160160 - DNA, 25 bp, Homo sapien
tgctgacactcgtggaccgcgatgt

SEQ ID NO: 160161 - DNA, 25 bp, Homo sapien
cggacagcgtcaagcacacggtgtt

SEQ ID NO: 160162 - DNA, 25 bp, Homo sapien
acaggcctagctgccgcttgctcag

SEQ ID NO: 160163 - DNA, 25 bp, Homo sapien
gaccgcgatgtgcagaccctgaagc

SEQ ID NO: 160164 - DNA, 25 bp, Homo sapien
ctcattgcttagagccctgggaacc

SEQ ID NO: 160165 - DNA, 25 bp, Homo sapien
aggggaactgctcaccgactgcaca

SEQ ID NO: 160166 - DNA, 25 bp, Homo sapien
tccagcatgtcgaagcccggaggct

SEQ ID NO: 160167 - DNA, 25 bp, Homo sapien
gggtattgtgaacgtagcctcctcc

SEQ ID NO: 160168 - DNA, 25 bp, Homo sapien
cgtctgatacgccaaaatccgggga

SEQ ID NO: 160169 - DNA, 25 bp, Homo sapien
tggagggtcacacaatcaaccttgc

SEQ ID NO: 160170 - DNA, 25 bp, Homo sapien
ggccagacttctaccaggcgttttc

SEQ ID NO: 160171 - DNA, 25 bp, Homo sapien
ccgtgcaccctggaaacgaagctta

SEQ ID NO: 160172 - DNA, 25 bp, Homo sapien
ctcaaaagcgcctgggaagctgctc

SEQ ID NO: 160173 - DNA, 25 bp, Homo sapien
tgcgccctagaatctcccagtaagg

SEQ ID NO: 160174 - DNA, 25 bp, Homo sapien
tgagctatcatacgtcccaccaggg

SEQ ID NO: 160175 - DNA, 25 bp, Homo sapien
acgcacgtggcgtcaatgacaaaga

SEQ ID NO: 160176 - DNA, 25 bp, Homo sapien
tccagcatttgggaaaccagatctg

SEQ ID NO: 160177 - DNA, 25 bp, Homo sapien
ctgcgctccctgtagctttggcttg

SEQ ID NO: 160178 - DNA, 25 bp, Homo sapien
ggatggctgtcgctaccactgttca

SEQ ID NO: 160179 - DNA, 25 bp, Homo sapien
acgtcccggtagatccgaggatcca

SEQ ID NO: 160180 - DNA, 25 bp, Homo sapien
gcgactgctcgacagccgcttttga

SEQ ID NO: 160181 - DNA, 25 bp, Homo sapien
ttgggatcgtatcactacgcacgtg

SEQ ID NO: 160182 - DNA, 25 bp, Homo sapien
cttcgtaagaaggtggagccacgta

SEQ ID NO: 160183 - DNA, 25 bp, Homo sapien
tgccggcagcttgagagaaaagtct

SEQ ID NO: 160184 - DNA, 25 bp, Homo sapien
accttccgggactgctgtcaatctc

SEQ ID NO: 160185 - DNA, 25 bp, Homo sapien
agaaatcgttgaggcgctgaccttc

SEQ ID NO: 160186 - DNA, 25 bp, Homo sapien
ttcggagaaattagaaccagcgttc

SEQ ID NO: 160187 - DNA, 25 bp, Homo sapien
ccagcgttctaaattaaggggagca

SEQ ID NO: 160188 - DNA, 25 bp, Homo sapien
cagatgtccttgttttgctcgcgag

SEQ ID NO: 160189 - DNA, 25 bp, Homo sapien
tggcctgctgttcagacagaaatcg

SEQ ID NO: 160190 - DNA, 25 bp, Homo sapien
caatctccgcgtgcagatggccagc

SEQ ID NO: 160191 - DNA, 25 bp, Homo sapien
atgtgacaccgcgcggactgctccg

SEQ ID NO: 160192 - DNA, 25 bp, Homo sapien
atatatacccgggcacacgtgtgtg

SEQ ID NO: 160193 - DNA, 25 bp, Homo sapien
gaactatatatacccgggcacacgt

SEQ ID NO: 160194 - DNA, 25 bp, Homo sapien
tgggaactatatatacccgggcaca

SEQ ID NO: 160195 - DNA, 25 bp, Homo sapien
cccaagcctgatgggatcgcacgag

SEQ ID NO: 160196 - DNA, 25 bp, Homo sapien
gctgttgtcccccaagcctgatggg

SEQ ID NO: 160197 - DNA, 25 bp, Homo sapien
gactgggaactatatatacccgggc

SEQ ID NO: 160198 - DNA, 25 bp, Homo sapien
caagcctgatgggatcgcacgagtg

SEQ ID NO: 160199 - DNA, 25 bp, Homo sapien
cagttccaggagatgcgcccaacga

SEQ ID NO: 160200 - DNA, 25 bp, Homo sapien
ttgtttgctagacaccagcgccagc

SEQ ID NO: 160201 - DNA, 25 bp, Homo sapien
gggtgtcttaggctccacagcgccc

SEQ ID NO: 160202 - DNA, 25 bp, Homo sapien
tctccattgcaagaggcgcccggct

SEQ ID NO: 160203 - DNA, 25 bp, Homo sapien
taggaaactctcttggggcaggccc

SEQ ID NO: 160204 - DNA, 25 bp, Homo sapien
ccacgtcatggcagtcgccagactg

SEQ ID NO: 160205 - DNA, 25 bp, Homo sapien
cgcccaacgaagaagcggaggaaca

SEQ ID NO: 160206 - DNA, 25 bp, Homo sapien
acccggctgctttttgtttgctaga

SEQ ID NO: 160207 - DNA, 25 bp, Homo sapien
tccgatggcgtggaacacaaggccc

SEQ ID NO: 160208 - DNA, 25 bp, Homo sapien
ccacacggaacatgtgcagccgttc

SEQ ID NO: 160209 - DNA, 25 bp, Homo sapien
cccgctgaatgatgctagcgatttg

SEQ ID NO: 160210 - DNA, 25 bp, Homo sapien
tagcgatttgcttcacctcgtcccg

SEQ ID NO: 160211 - DNA, 25 bp, Homo sapien
acagcgatagcagcagcgacgattg

SEQ ID NO: 160212 - DNA, 25 bp, Homo sapien
gccgcccgttgttctcaccaataga

SEQ ID NO: 160213 - DNA, 25 bp, Homo sapien
ggcactatgaaagtcagccatctgg

SEQ ID NO: 160214 - DNA, 25 bp, Homo sapien
gctccaatagatgcgcgtggcctcg

SEQ ID NO: 160215 - DNA, 25 bp, Homo sapien
gaaaggctgtgactctgcagttcta

SEQ ID NO: 160216 - DNA, 25 bp, Homo sapien
cggccctattttgtgttggagcgga

SEQ ID NO: 160217 - DNA, 25 bp, Homo sapien
tcgtgaagccttcggcgctagatcc

SEQ ID NO: 160218 - DNA, 25 bp, Homo sapien
gaaggggctatttcctggcccaaga

SEQ ID NO: 160219 - DNA, 25 bp, Homo sapien
tctacgcacacgctgcgggatcctt

SEQ ID NO: 160220 - DNA, 25 bp, Homo sapien
cgaggcagccatttgcaaccggaga

SEQ ID NO: 160221 - DNA, 25 bp, Homo sapien
tctccagatggaacgtcgaggcgcc

SEQ ID NO: 160222 - DNA, 25 bp, Homo sapien
cagcggtcgtgaagattcgtgaagc

SEQ ID NO: 160223 - DNA, 25 bp, Homo sapien
acagcacgtctaacgccagggagcc

SEQ ID NO: 160224 - DNA, 25 bp, Homo sapien
ggccgctcgccattggtccattaga

SEQ ID NO: 160225 - DNA, 25 bp, Homo sapien
actggagccggttcattcataaaga

SEQ ID NO: 160226 - DNA, 25 bp, Homo sapien
gcagcgcgcctcttctggctacaaa

SEQ ID NO: 160227 - DNA, 25 bp, Homo sapien
tctggctacaaagctgctgcgcgtc

SEQ ID NO: 160228 - DNA, 25 bp, Homo sapien
cctacacagcggtatccgaggatga

SEQ ID NO: 160229 - DNA, 25 bp, Homo sapien
gaccaccttcctgtagcggactagc

SEQ ID NO: 160230 - DNA, 25 bp, Homo sapien
gagctgcccacgtgatcacaacaca

SEQ ID NO: 160231 - DNA, 25 bp, Homo sapien
ccagtagctcctccgctaagcggta

SEQ ID NO: 160232 - DNA, 25 bp, Homo sapien
ccgagagtaccaatgcatgccagtc

SEQ ID NO: 160233 - DNA, 25 bp, Homo sapien
tggtgactctccagaaccgcgtagc

SEQ ID NO: 160234 - DNA, 25 bp, Homo sapien
gaggccaggacatcgttcaccagca

SEQ ID NO: 160235 - DNA, 25 bp, Homo sapien
gaacaccggtgcaaagtcgcctggc

SEQ ID NO: 160236 - DNA, 25 bp, Homo sapien
gcaacagtttgcgtggaggccactc

SEQ ID NO: 160237 - DNA, 25 bp, Homo sapien
cgcacagttgcatttcccggaaagc

SEQ ID NO: 160238 - DNA, 25 bp, Homo sapien
ttcgaggtttctatgcctgggacgc

SEQ ID NO: 160239 - DNA, 25 bp, Homo sapien
cgcagtagctctgagaactgcctta

SEQ ID NO: 160240 - DNA, 25 bp, Homo sapien
cctctgccggcgaggaactctcagt

SEQ ID NO: 160241 - DNA, 25 bp, Homo sapien
cgcaaggtgccttgtgaggagcaat

SEQ ID NO: 160242 - DNA, 25 bp, Homo sapien
gcctctcgccttggtggcgcgcaag

SEQ ID NO: 160243 - DNA, 25 bp, Homo sapien
ctggcgcgtctagctcgcggtcaga

SEQ ID NO: 160244 - DNA, 25 bp, Homo sapien
tcgctgactgtgctcaggatgtccc

SEQ ID NO: 160245 - DNA, 25 bp, Homo sapien
tccggcagcgattccctcaggttag

SEQ ID NO: 160246 - DNA, 25 bp, Homo sapien
gaactgccttaagctccggcagcga

SEQ ID NO: 160247 - DNA, 25 bp, Homo sapien
tagtgatgtccaaagcacggccttc

SEQ ID NO: 160248 - DNA, 25 bp, Homo sapien
ggttgcgggactcgtagtagaccca

SEQ ID NO: 160249 - DNA, 25 bp, Homo sapien
tcagtcactcgtaggcgcactccgg

SEQ ID NO: 160250 - DNA, 25 bp, Homo sapien
aatcctgagcgtggtggccgtcctc

SEQ ID NO: 160251 - DNA, 25 bp, Homo sapien
gggccacatgttcatcacggcaatg

SEQ ID NO: 160252 - DNA, 25 bp, Homo sapien
catcacggcaatggccaaagcgttc

SEQ ID NO: 160253 - DNA, 25 bp, Homo sapien
cacggccttcgtagtggagtgaatc

SEQ ID NO: 160254 - DNA, 25 bp, Homo sapien
ggcgcgccagcaacccatacttgtt

SEQ ID NO: 160255 - DNA, 25 bp, Homo sapien
caatccctgctccgtccgggtaggt

SEQ ID NO: 160256 - DNA, 25 bp, Homo sapien
tgcgcgaagtacaatggccattatc

SEQ ID NO: 160257 - DNA, 25 bp, Homo sapien
tccggccacaaaggcgcttttcagc

SEQ ID NO: 160258 - DNA, 25 bp, Homo sapien
gcagctccggccacaaaggcgcttt

SEQ ID NO: 160259 - DNA, 25 bp, Homo sapien
tgggagaagcggactcagcagctcc

SEQ ID NO: 160260 - DNA, 25 bp, Homo sapien
accgagcgagaatcctgagcccagg

SEQ ID NO: 160261 - DNA, 25 bp, Homo sapien
aatggccattatccgggatgactta

SEQ ID NO: 160262 - DNA, 25 bp, Homo sapien
gggatgacttaaccgagcgagaatc

SEQ ID NO: 160263 - DNA, 25 bp, Homo sapien
ggagaggccctccttacctcggtca

SEQ ID NO: 160264 - DNA, 25 bp, Homo sapien
tccttacctcggtcatcaggcggtc

SEQ ID NO: 160265 - DNA, 25 bp, Homo sapien
tcatcaggcggtcggctccactgtt

SEQ ID NO: 160266 - DNA, 25 bp, Homo sapien
gcacgccgggcacaaattgcttgta

SEQ ID NO: 160267 - DNA, 25 bp, Homo sapien
ccgggcacaaattgcttgtagagta

SEQ ID NO: 160268 - DNA, 25 bp, Homo sapien
ttgcttgtagagtagcggcacgagc

SEQ ID NO: 160269 - DNA, 25 bp, Homo sapien
tagagtagcggcacgagctgcttgc

SEQ ID NO: 160270 - DNA, 25 bp, Homo sapien
agctgcttgcgcgcatagcggcgcc

SEQ ID NO: 160271 - DNA, 25 bp, Homo sapien
gctcgctctccctgaaccgttatgt

SEQ ID NO: 160272 - DNA, 25 bp, Homo sapien
ggacgcactggccacttttctggtc

SEQ ID NO: 160273 - DNA, 25 bp, Homo sapien
ctgaccgtgcaaagtggcttccgcg

SEQ ID NO: 160274 - DNA, 25 bp, Homo sapien
acccgcggcgcaataacggtgagtg

SEQ ID NO: 160275 - DNA, 25 bp, Homo sapien
cgttatgtctcttacctggtctctc

SEQ ID NO: 160276 - DNA, 25 bp, Homo sapien
ggagcggctgttgcttctttccgca

SEQ ID NO: 160277 - DNA, 25 bp, Homo sapien
gaacaaacttgtgcccggcgctgac

SEQ ID NO: 160278 - DNA, 25 bp, Homo sapien
aagtagaaagtagtgctctctgccc

SEQ ID NO: 160279 - DNA, 25 bp, Homo sapien
acggcctttgtttatcgctcaggga

SEQ ID NO: 160280 - DNA, 25 bp, Homo sapien
gtctggggctcagatacagtcgtcc

SEQ ID NO: 160281 - DNA, 25 bp, Homo sapien
cacttcgtagtcaggtgcttccata

SEQ ID NO: 160282 - DNA, 25 bp, Homo sapien
gttctcgcacggatagcacttcgta

SEQ ID NO: 160283 - DNA, 25 bp, Homo sapien
cactcgcggatcctctcgtggaata

SEQ ID NO: 160284 - DNA, 25 bp, Homo sapien
gcccaggcatggtttgacggcactc

SEQ ID NO: 160285 - DNA, 25 bp, Homo sapien
ccactctttaaggtcgggtcgcgct

SEQ ID NO: 160286 - DNA, 25 bp, Homo sapien
ggtcgcgctcacgtttcaatgcaaa

SEQ ID NO: 160287 - DNA, 25 bp, Homo sapien
caggtggcctctacagactgttgtg

SEQ ID NO: 160288 - DNA, 25 bp, Homo sapien
ccgcttttcgcgctcaagaggaagt

SEQ ID NO: 160289 - DNA, 25 bp, Homo sapien
agggaccgcacccaggacacagtta

SEQ ID NO: 160290 - DNA, 25 bp, Homo sapien
gttacgcgacaaaagagagctccgg

SEQ ID NO: 160291 - DNA, 25 bp, Homo sapien
cgctatttacacacaccgaggtctc

SEQ ID NO: 160292 - DNA, 25 bp, Homo sapien
ggagccgcacggcttactcaccata

SEQ ID NO: 160293 - DNA, 25 bp, Homo sapien
gcggtacattgacagggagctcttc

SEQ ID NO: 160294 - DNA, 25 bp, Homo sapien
ggagacacgccctgtagccctagtc

SEQ ID NO: 160295 - DNA, 25 bp, Homo sapien
gcatcagcgaaaccgtgcgcacaga

SEQ ID NO: 160296 - DNA, 25 bp, Homo sapien
tctcggataacacaggcgcctaggc

SEQ ID NO: 160297 - DNA, 25 bp, Homo sapien
tggggctaagctaaacctcacaaaa

SEQ ID NO: 160298 - DNA, 25 bp, Homo sapien
cctcgcccagagagcttacgaaaga

SEQ ID NO: 160299 - DNA, 25 bp, Homo sapien
gcccagtggctccaacgccatagaa

SEQ ID NO: 160300 - DNA, 25 bp, Homo sapien
gggctccggcagaaactcaccatgt

SEQ ID NO: 160301 - DNA, 25 bp, Homo sapien
tcccgggaatgtgtgggtatctttc

SEQ ID NO: 160302 - DNA, 25 bp, Homo sapien
gctaaccctaggctgcgctttgttc

SEQ ID NO: 160303 - DNA, 25 bp, Homo sapien
cgccacgccctgctgtttagaagcg

SEQ ID NO: 160304 - DNA, 25 bp, Homo sapien
aggcggcgctatctccaggccgcag

SEQ ID NO: 160305 - DNA, 25 bp, Homo sapien
cgcccgccacgaaggccacttccgc

SEQ ID NO: 160306 - DNA, 25 bp, Homo sapien
agcaggcggcgctatctccaggccg

SEQ ID NO: 160307 - DNA, 25 bp, Homo sapien
ctttcttcacatatcgctgtccgcg

SEQ ID NO: 160308 - DNA, 25 bp, Homo sapien
cggcctttcttcacatatcgctgtc

SEQ ID NO: 160309 - DNA, 25 bp, Homo sapien
ccctgctgtttagaagcggcctttc

SEQ ID NO: 160310 - DNA, 25 bp, Homo sapien
agaagcggcctttcttcacatatcg

SEQ ID NO: 160311 - DNA, 25 bp, Homo sapien
ggtcgagttcacttggcagacacca

SEQ ID NO: 160312 - DNA, 25 bp, Homo sapien
gctccttccgacgagtttggtttga

SEQ ID NO: 160313 - DNA, 25 bp, Homo sapien
gcagacaccagttcgggccggaaaa

SEQ ID NO: 160314 - DNA, 25 bp, Homo sapien
tgaacttttgaatccgccaatcagc

SEQ ID NO: 160315 - DNA, 25 bp, Homo sapien
cccggactccttggtagtctgttag

SEQ ID NO: 160316 - DNA, 25 bp, Homo sapien
ctgttagtgggagatccttgttgcc

SEQ ID NO: 160317 - DNA, 25 bp, Homo sapien
cccttcaagttctagtcatggtgag

SEQ ID NO: 160318 - DNA, 25 bp, Homo sapien
cctccggttaacctggcttgtggcg

SEQ ID NO: 160319 - DNA, 25 bp, Homo sapien
aacctcgtgctcttccgcaaggtga

SEQ ID NO: 160320 - DNA, 25 bp, Homo sapien
tgcggggcaattccattagacagcc

SEQ ID NO: 160321 - DNA, 25 bp, Homo sapien
gaacagcctctaaccggatcctggg

SEQ ID NO: 160322 - DNA, 25 bp, Homo sapien
cccgatctcagtatccagaggtggc

SEQ ID NO: 160323 - DNA, 25 bp, Homo sapien
gcctggaactagagcgcaagattga

SEQ ID NO: 160324 - DNA, 25 bp, Homo sapien
ggcgcccacttctgttcgttcaagc

SEQ ID NO: 160325 - DNA, 25 bp, Homo sapien
tcagccctccatttagagtcctggg

SEQ ID NO: 160326 - DNA, 25 bp, Homo sapien
agctcccagtccgttagagacaatg

SEQ ID NO: 160327 - DNA, 25 bp, Homo sapien
aagcttggcgccgtgctatggtcaa

SEQ ID NO: 160328 - DNA, 25 bp, Homo sapien
ggaacgatcaactgtaccctcagta

SEQ ID NO: 160329 - DNA, 25 bp, Homo sapien
gctccactctcggattggctgattg

SEQ ID NO: 160330 - DNA, 25 bp, Homo sapien
tggctgattgatccgagtcagtttt

SEQ ID NO: 160331 - DNA, 25 bp, Homo sapien
ttttcctcgccagaaagcggttcga

SEQ ID NO: 160332 - DNA, 25 bp, Homo sapien
agcggttcgacaattggtccttctt

SEQ ID NO: 160333 - DNA, 25 bp, Homo sapien
gggccagccttcaacaccgttggca

SEQ ID NO: 160334 - DNA, 25 bp, Homo sapien
ccgttggcagcaatcggaacgatca

SEQ ID NO: 160335 - DNA, 25 bp, Homo sapien
ctgcacatcaacaaggcgggcagca

SEQ ID NO: 160336 - DNA, 25 bp, Homo sapien
cggtggcctgttcggcaaccacgtc

SEQ ID NO: 160337 - DNA, 25 bp, Homo sapien
tactaccaaagcgacggccggagcg

SEQ ID NO: 160338 - DNA, 25 bp, Homo sapien
gaagctggtggactccaccttcacc

SEQ ID NO: 160339 - DNA, 25 bp, Homo sapien
agcagccagggcgacactgagtcgc

SEQ ID NO: 160340 - DNA, 25 bp, Homo sapien
actgagtcgccatcccacgagaagc

SEQ ID NO: 160341 - DNA, 25 bp, Homo sapien
cgccatcccacgagaagctggtgga

SEQ ID NO: 160342 - DNA, 25 bp, Homo sapien
ggcaaccacgtcagctactaccaaa

SEQ ID NO: 160343 - DNA, 25 bp, Homo sapien
tgagcaccaagagttcgcccattta

SEQ ID NO: 160344 - DNA, 25 bp, Homo sapien
caccgccaggctctcaaagggtggg

SEQ ID NO: 160345 - DNA, 25 bp, Homo sapien
tttcccgccgtccagcttgatgaag

SEQ ID NO: 160346 - DNA, 25 bp, Homo sapien
cgtcgcccacgtccaggtgcagaat

SEQ ID NO: 160347 - DNA, 25 bp, Homo sapien
ctggcccggacctatcgagggagaa

SEQ ID NO: 160348 - DNA, 25 bp, Homo sapien
tcgagggagaagaacctgctcatgc

SEQ ID NO: 160349 - DNA, 25 bp, Homo sapien
gccacttatacccttgagcaccaag

SEQ ID NO: 160350 - DNA, 25 bp, Homo sapien
tgatccctccggaagtcgctctgct

SEQ ID NO: 160351 - DNA, 25 bp, Homo sapien
cggctggtttcttagggatctgaga

SEQ ID NO: 160352 - DNA, 25 bp, Homo sapien
tgccagggccagcaaatcttcctca

SEQ ID NO: 160353 - DNA, 25 bp, Homo sapien
gagccagtggtcctctagtaccctc

SEQ ID NO: 160354 - DNA, 25 bp, Homo sapien
tgcccagatagaccactccctgatg

SEQ ID NO: 160355 - DNA, 25 bp, Homo sapien
cgggcgcgatctcctagtaggtttt

SEQ ID NO: 160356 - DNA, 25 bp, Homo sapien
aggttttgcgctctgcctcttggca

SEQ ID NO: 160357 - DNA, 25 bp, Homo sapien
tcttggcaagcaccgactcaccttg

SEQ ID NO: 160358 - DNA, 25 bp, Homo sapien
ttcctcactcttgggcgcaatggct

SEQ ID NO: 160359 - DNA, 25 bp, Homo sapien
cgggtagccgagttagtgcaaccaa

SEQ ID NO: 160360 - DNA, 25 bp, Homo sapien
tcgaagggcccgtgtcagaaacaca

SEQ ID NO: 160361 - DNA, 25 bp, Homo sapien
ttcatcggcgatgctgggaaaagca

SEQ ID NO: 160362 - DNA, 25 bp, Homo sapien
gacgccgcacggacgaacagtatct

SEQ ID NO: 160363 - DNA, 25 bp, Homo sapien
cggggaccagacactgcgattcaga

SEQ ID NO: 160364 - DNA, 25 bp, Homo sapien
acagagtgcacagcgagcccgagat

SEQ ID NO: 160365 - DNA, 25 bp, Homo sapien
accggacgctgtgattcagagattg

SEQ ID NO: 160366 - DNA, 25 bp, Homo sapien
cagtatctggggctattcatcggcg

SEQ ID NO: 160367 - DNA, 25 bp, Homo sapien
gccgtgtcacgccatgtgctcatgt

SEQ ID NO: 160368 - DNA, 25 bp, Homo sapien
caggtctagggtgatggcgctccca

SEQ ID NO: 160369 - DNA, 25 bp, Homo sapien
ttggcgcagaagtggtttcccagcg

SEQ ID NO: 160370 - DNA, 25 bp, Homo sapien
ggacaccacttctggggcaggtcta

SEQ ID NO: 160371 - DNA, 25 bp, Homo sapien
tggaagccaccagtcgtcctgggtg

SEQ ID NO: 160372 - DNA, 25 bp, Homo sapien
tccgaggatgtggaagccaccagtc

SEQ ID NO: 160373 - DNA, 25 bp, Homo sapien
gtgctcatgtgaccgaggacgcttc

SEQ ID NO: 160374 - DNA, 25 bp, Homo sapien
gagcctgcagcccttggccgtgtca

SEQ ID NO: 160375 - DNA, 25 bp, Homo sapien
gtaagtgatccaggcttccagcgcc

SEQ ID NO: 160376 - DNA, 25 bp, Homo sapien
tcggcgtaagtgatccaggcttcca

SEQ ID NO: 160377 - DNA, 25 bp, Homo sapien
ccgttcggcgtaagtgatccaggct

SEQ ID NO: 160378 - DNA, 25 bp, Homo sapien
ggactcccagacctcggcaccaacc

SEQ ID NO: 160379 - DNA, 25 bp, Homo sapien
ggcaccaaccgtatctcctgttact

SEQ ID NO: 160380 - DNA, 25 bp, Homo sapien
ccgctgccgcactggactcccagac

SEQ ID NO: 160381 - DNA, 25 bp, Homo sapien
gggcggccatgtacaacccctggca

SEQ ID NO: 160382 - DNA, 25 bp, Homo sapien
cacgcccggcaggagactgcgcgca

SEQ ID NO: 160383 - DNA, 25 bp, Homo sapien
ctgcagattctttggcgctagctcc

SEQ ID NO: 160384 - DNA, 25 bp, Homo sapien
gcatccgctcaaaaaaggctccaag

SEQ ID NO: 160385 - DNA, 25 bp, Homo sapien
ccaagccttagaggtccggcaggta

SEQ ID NO: 160386 - DNA, 25 bp, Homo sapien
aaccaagggtttctagcctggcgcg

SEQ ID NO: 160387 - DNA, 25 bp, Homo sapien
ctcctgccggctttgaatgacactg

SEQ ID NO: 160388 - DNA, 25 bp, Homo sapien
aggcggccagacaaagagcagcttc

SEQ ID NO: 160389 - DNA, 25 bp, Homo sapien
tatgcccgctccgttcagtgaaatc

SEQ ID NO: 160390 - DNA, 25 bp, Homo sapien
aggctccaagtcctggcgaacccga

SEQ ID NO: 160391 - DNA, 25 bp, Homo sapien
tcctcgcgcttacattgcccttggg

SEQ ID NO: 160392 - DNA, 25 bp, Homo sapien
ctgggctgggatagaccacccatcc

SEQ ID NO: 160393 - DNA, 25 bp, Homo sapien
tccgatccttgtcacgctctgctgg

SEQ ID NO: 160394 - DNA, 25 bp, Homo sapien
cagccgatgctgagaatagccaaaa

SEQ ID NO: 160395 - DNA, 25 bp, Homo sapien
ccagtttgcgggtaaatgcaccacc

SEQ ID NO: 160396 - DNA, 25 bp, Homo sapien
gaccctttcctctcgctgcagtttg

SEQ ID NO: 160397 - DNA, 25 bp, Homo sapien
ggtgcgctttttcctcgctcacttc

SEQ ID NO: 160398 - DNA, 25 bp, Homo sapien
gcgcaacgtatgtttgccgaattga

SEQ ID NO: 160399 - DNA, 25 bp, Homo sapien
cgtttcccgtcgttggcgactctga

SEQ ID NO: 160400 - DNA, 25 bp, Homo sapien
gcgactctgaaattgccttttggaa

SEQ ID NO: 160401 - DNA, 25 bp, Homo sapien
tcccaacccggacattgagcaaaag

SEQ ID NO: 160402 - DNA, 25 bp, Homo sapien
tttcggctctttccgtcagttcagc

SEQ ID NO: 160403 - DNA, 25 bp, Homo sapien
ggtaattcccagtctccggtggcgc

SEQ ID NO: 160404 - DNA, 25 bp, Homo sapien
cccgactgacgatcccgaggtcatt

SEQ ID NO: 160405 - DNA, 25 bp, Homo sapien
tgacagctgggtagatcagaaaccc

SEQ ID NO: 160406 - DNA, 25 bp, Homo sapien
gttggctgccacagcctcgagcttg

SEQ ID NO: 160407 - DNA, 25 bp, Homo sapien
caaggctggagtccttttggcgccc

SEQ ID NO: 160408 - DNA, 25 bp, Homo sapien
tcagcgtctgctaactgaggaggca

SEQ ID NO: 160409 - DNA, 25 bp, Homo sapien
ctccgtctggttcagcgtctgctaa

SEQ ID NO: 160410 - DNA, 25 bp, Homo sapien
tggggctaaacgctactggcttcac

SEQ ID NO: 160411 - DNA, 25 bp, Homo sapien
ctcgcaaggctggagtccttttggc

SEQ ID NO: 160412 - DNA, 25 bp, Homo sapien
aagcttcaagtgttcggccctgccc

SEQ ID NO: 160413 - DNA, 25 bp, Homo sapien
gccttctcacgcaaagcttcaagtg

SEQ ID NO: 160414 - DNA, 25 bp, Homo sapien
aaacgctactggcttcacggccaca

SEQ ID NO: 160415 - DNA, 25 bp, Homo sapien
ctcctgcttgcggagacacctcata

SEQ ID NO: 160416 - DNA, 25 bp, Homo sapien
gagagcatcttccacagcatgcgtc

SEQ ID NO: 160417 - DNA, 25 bp, Homo sapien
ttttcctcggggagagcatcttcca

SEQ ID NO: 160418 - DNA, 25 bp, Homo sapien
tgcttttagatttcccgggtgcggc

SEQ ID NO: 160419 - DNA, 25 bp, Homo sapien
cataggagcagctggatccattttc

SEQ ID NO: 160420 - DNA, 25 bp, Homo sapien
cgtctgacccttactcctagggcta

SEQ ID NO: 160421 - DNA, 25 bp, Homo sapien
tcacacggaggacgtctgaccctta

SEQ ID NO: 160422 - DNA, 25 bp, Homo sapien
atccattttccagagcgtcaagttg

SEQ ID NO: 160423 - DNA, 25 bp, Homo sapien
ccacctgggcggtgaacaatggcat

SEQ ID NO: 160424 - DNA, 25 bp, Homo sapien
ggcttcggcaacgtgtccgccaaca

SEQ ID NO: 160425 - DNA, 25 bp, Homo sapien
caatggcatcgacaccaccgaggtg

SEQ ID NO: 160426 - DNA, 25 bp, Homo sapien
ctcttccgctttaggtggccgcgga

SEQ ID NO: 160427 - DNA, 25 bp, Homo sapien
agcagcgcatgctggagtacttcca

SEQ ID NO: 160428 - DNA, 25 bp, Homo sapien
agccctgatgcacgcggtggtgttt

SEQ ID NO: 160429 - DNA, 25 bp, Homo sapien
ccttcaggccttgcctaggagcgtg

SEQ ID NO: 160430 - DNA, 25 bp, Homo sapien
acacggacaccgagaagatcttctc

SEQ ID NO: 160431 - DNA, 25 bp, Homo sapien
accgcggactggatttcgacttcca

SEQ ID NO: 160432 - DNA, 25 bp, Homo sapien
tccaacaatttctccgcggcgacgg

SEQ ID NO: 160433 - DNA, 25 bp, Homo sapien
accgcgaggtctcaccattcctaga

SEQ ID NO: 160434 - DNA, 25 bp, Homo sapien
ggcttccgtgaggtacgtctacttc

SEQ ID NO: 160435 - DNA, 25 bp, Homo sapien
tggcaatctcttccggttcgtcttg

SEQ ID NO: 160436 - DNA, 25 bp, Homo sapien
gctttcctagttgggacagcatata

SEQ ID NO: 160437 - DNA, 25 bp, Homo sapien
gcgtaacacttcgagccagattcta

SEQ ID NO: 160438 - DNA, 25 bp, Homo sapien
gcggcactctgcaaaactccatttc

SEQ ID NO: 160439 - DNA, 25 bp, Homo sapien
ctcggaggctctggcatggtaacat

SEQ ID NO: 160440 - DNA, 25 bp, Homo sapien
ggaggctctggcatggtaacatccc

SEQ ID NO: 160441 - DNA, 25 bp, Homo sapien
caatcagagcggctcttactggcgg

SEQ ID NO: 160442 - DNA, 25 bp, Homo sapien
ccggcgactgcgaagccaggacgca

SEQ ID NO: 160443 - DNA, 25 bp, Homo sapien
gcgtgaacgcttcggctcctggagc

SEQ ID NO: 160444 - DNA, 25 bp, Homo sapien
cctacacactgcgtgaacgcttcgg

SEQ ID NO: 160445 - DNA, 25 bp, Homo sapien
cgctgtgcagcgcaaaggcacccta

SEQ ID NO: 160446 - DNA, 25 bp, Homo sapien
gtgcagcgcaaaggcaccctacaca

SEQ ID NO: 160447 - DNA, 25 bp, Homo sapien
cccaaccaggtggtgctgagcttcc

SEQ ID NO: 160448 - DNA, 25 bp, Homo sapien
ggttcgtttcagaagtgcctcactg

SEQ ID NO: 160449 - DNA, 25 bp, Homo sapien
cgacgcctgcgacatgaccatagag

SEQ ID NO: 160450 - DNA, 25 bp, Homo sapien
atggcgccctcttaccctttgtgaa

SEQ ID NO: 160451 - DNA, 25 bp, Homo sapien
gcagggtctacgtcagcagcctgta

SEQ ID NO: 160452 - DNA, 25 bp, Homo sapien
tggagttaaccggaacagcgtcttc

SEQ ID NO: 160453 - DNA, 25 bp, Homo sapien
ggtgtctttcgactctgcttgtaga

SEQ ID NO: 160454 - DNA, 25 bp, Homo sapien
ttgcacatattctgtacgagcctcg

SEQ ID NO: 160455 - DNA, 25 bp, Homo sapien
ctgctcagaggttcctgggaagaca

SEQ ID NO: 160456 - DNA, 25 bp, Homo sapien
cagctcacagggctcaggcatcggc

SEQ ID NO: 160457 - DNA, 25 bp, Homo sapien
tcaggcatcggcatcttgccgggcg

SEQ ID NO: 160458 - DNA, 25 bp, Homo sapien
tgacggccgcgtctgccaatcacag

SEQ ID NO: 160459 - DNA, 25 bp, Homo sapien
tggggacttctcctaagggtccagc

SEQ ID NO: 160460 - DNA, 25 bp, Homo sapien
gagaagcctggttcctaggacggtc

SEQ ID NO: 160461 - DNA, 25 bp, Homo sapien
agcggacagccgcaccgaagcaagg

SEQ ID NO: 160462 - DNA, 25 bp, Homo sapien
cttctcctaagggtccagcggtgga

SEQ ID NO: 160463 - DNA, 25 bp, Homo sapien
agaagccacgcctcgcaccaggaag

SEQ ID NO: 160464 - DNA, 25 bp, Homo sapien
ggcgactaagagtcctcacccagga

SEQ ID NO: 160465 - DNA, 25 bp, Homo sapien
ctaggcctctgtagtgtgaccagga

SEQ ID NO: 160466 - DNA, 25 bp, Homo sapien
gcaaatcatgccaagcttcggggtg

SEQ ID NO: 160467 - DNA, 25 bp, Homo sapien
ccggctgacggcttaattgagatta

SEQ ID NO: 160468 - DNA, 25 bp, Homo sapien
gcggacaggattacctaatcgtata

SEQ ID NO: 160469 - DNA, 25 bp, Homo sapien
gggtagaaagacaccgcctggcaga

SEQ ID NO: 160470 - DNA, 25 bp, Homo sapien
accgaccgcatctccttacaaaggg

SEQ ID NO: 160471 - DNA, 25 bp, Homo sapien
cgttcgaattcagagcacgtccttc

SEQ ID NO: 160472 - DNA, 25 bp, Homo sapien
ttgatcgacaagctcaggcctctga

SEQ ID NO: 160473 - DNA, 25 bp, Homo sapien
agcagccgctgtttatgcacgtaca

SEQ ID NO: 160474 - DNA, 25 bp, Homo sapien
gcgagtcagagcacatccggtgtta

SEQ ID NO: 160475 - DNA, 25 bp, Homo sapien
tctgaacctagtactgggcgaactg

SEQ ID NO: 160476 - DNA, 25 bp, Homo sapien
accctgaaggaacgaggccctgctc

SEQ ID NO: 160477 - DNA, 25 bp, Homo sapien
ccttggcctagcttcgatcgttcga

SEQ ID NO: 160478 - DNA, 25 bp, Homo sapien
tccgaggtgaaggaacgcgaaactc

SEQ ID NO: 160479 - DNA, 25 bp, Homo sapien
tagagtgagtcactgagagactccg

SEQ ID NO: 160480 - DNA, 25 bp, Homo sapien
cctgactcccacaagaggacagcga

SEQ ID NO: 160481 - DNA, 25 bp, Homo sapien
cgtagagtgagtcactgagagactc

SEQ ID NO: 160482 - DNA, 25 bp, Homo sapien
agcgagtcgtagagtgagtcactga

SEQ ID NO: 160483 - DNA, 25 bp, Homo sapien
acagcgagtcgtagagtgagtcact

SEQ ID NO: 160484 - DNA, 25 bp, Homo sapien
ccacaagaggacagcgagtcgtaga

SEQ ID NO: 160485 - DNA, 25 bp, Homo sapien
tcccacaagaggacagcgagtcgta

SEQ ID NO: 160486 - DNA, 25 bp, Homo sapien
agccctgactcccacaagaggacag

SEQ ID NO: 160487 - DNA, 25 bp, Homo sapien
gttcagcgctggcagcttgctcttc

SEQ ID NO: 160488 - DNA, 25 bp, Homo sapien
gacgcaggtcttccgccttggccat

SEQ ID NO: 160489 - DNA, 25 bp, Homo sapien
aggtaggccttctcctcttccagtg

SEQ ID NO: 160490 - DNA, 25 bp, Homo sapien
ttgctcttcttaaggccgaaccagc

SEQ ID NO: 160491 - DNA, 25 bp, Homo sapien
cctccttgttcttggtggcctctgt

SEQ ID NO: 160492 - DNA, 25 bp, Homo sapien
gcttccgggcttccatcttgacttc

SEQ ID NO: 160493 - DNA, 25 bp, Homo sapien
ccttggccatcagcttggagatgtt

SEQ ID NO: 160494 - DNA, 25 bp, Homo sapien
cttggagatgttgaggctctcggcc

SEQ ID NO: 160495 - DNA, 25 bp, Homo sapien
tctgtactgccacgagagccttacc

SEQ ID NO: 160496 - DNA, 25 bp, Homo sapien
gcccacaggcatgcgcgtttgcttc

SEQ ID NO: 160497 - DNA, 25 bp, Homo sapien
ttggtaaacctcagccgtgcctggg

SEQ ID NO: 160498 - DNA, 25 bp, Homo sapien
ccagatgttcccaggacgcgagcta

SEQ ID NO: 160499 - DNA, 25 bp, Homo sapien
tagcagccaatccacgttcagcctg

SEQ ID NO: 160500 - DNA, 25 bp, Homo sapien
gccgcctcctgatgtcaaggcttta

SEQ ID NO: 160501 - DNA, 25 bp, Homo sapien
cgaaatcaggtgttgagctgggcca

SEQ ID NO: 160502 - DNA, 25 bp, Homo sapien
gtagacccagaactcaccgaaatca

SEQ ID NO: 160503 - DNA, 25 bp, Homo sapien
gcgagaataatgaggaaaatttccg

SEQ ID NO: 160504 - DNA, 25 bp, Homo sapien
cattagcctcaacacagcctctggg

SEQ ID NO: 160505 - DNA, 25 bp, Homo sapien
aatcggcccgttctcgggactctca

SEQ ID NO: 160506 - DNA, 25 bp, Homo sapien
ctcaggaaagagctgtcgaagcagc

SEQ ID NO: 160507 - DNA, 25 bp, Homo sapien
cgccaggtgccagaactcgcgattc

SEQ ID NO: 160508 - DNA, 25 bp, Homo sapien
gctgcggtctccttaacactccctc

SEQ ID NO: 160509 - DNA, 25 bp, Homo sapien
accggaagccgggaacctgctgtcg

SEQ ID NO: 160510 - DNA, 25 bp, Homo sapien
agaactcgcgattcctcttccgctg

SEQ ID NO: 160511 - DNA, 25 bp, Homo sapien
cgcagcctgcctgcgtctcttcctt

SEQ ID NO: 160512 - DNA, 25 bp, Homo sapien
gtggccgcttgggtaaccgcagcct

SEQ ID NO: 160513 - DNA, 25 bp, Homo sapien
tccttcctccgcgtgggttctagca

SEQ ID NO: 160514 - DNA, 25 bp, Homo sapien
gacgctgcccgcgtgaaaccagagc

SEQ ID NO: 160515 - DNA, 25 bp, Homo sapien
gaactccgtgacaccgaccagctga

SEQ ID NO: 160516 - DNA, 25 bp, Homo sapien
gacgcgggaactccgtgacaccgac

SEQ ID NO: 160517 - DNA, 25 bp, Homo sapien
gttctagcaacatccactgcagccg

SEQ ID NO: 160518 - DNA, 25 bp, Homo sapien
tccgcgtgggttctagcaacatcca

SEQ ID NO: 160519 - DNA, 25 bp, Homo sapien
cctcctctacaactacgtgctgttt

SEQ ID NO: 160520 - DNA, 25 bp, Homo sapien
tacgtgctgtttccgccagccaaga

SEQ ID NO: 160521 - DNA, 25 bp, Homo sapien
gtggagctgcactcgccgcagagcc

SEQ ID NO: 160522 - DNA, 25 bp, Homo sapien
ctctcccgcaggtctgaagttggcc

SEQ ID NO: 160523 - DNA, 25 bp, Homo sapien
cctgccacggggtaccaaggcctga

SEQ ID NO: 160524 - DNA, 25 bp, Homo sapien
cccgacggacgcttgtgaggcccga

SEQ ID NO: 160525 - DNA, 25 bp, Homo sapien
cccagcgcagagtagctgcttcctg

SEQ ID NO: 160526 - DNA, 25 bp, Homo sapien
cagccaagagcctgtcggagcgcct

SEQ ID NO: 160527 - DNA, 25 bp, Homo sapien
tggccataggcacgctggcccaggc

SEQ ID NO: 160528 - DNA, 25 bp, Homo sapien
acctgcgggacgagcatcactccga

SEQ ID NO: 160529 - DNA, 25 bp, Homo sapien
taccatcctgcagatcgcgctggcg

SEQ ID NO: 160530 - DNA, 25 bp, Homo sapien
caccatgaagaaggaggtgtgctcc

SEQ ID NO: 160531 - DNA, 25 bp, Homo sapien
ctcaaggccgtgttcgcagagttct

SEQ ID NO: 160532 - DNA, 25 bp, Homo sapien
agttcttggccaccctcatcttcgt

SEQ ID NO: 160533 - DNA, 25 bp, Homo sapien
catcttcgtcttctttggcctgggc

SEQ ID NO: 160534 - DNA, 25 bp, Homo sapien
gggagccaacctgggcgcatcatgc

SEQ ID NO: 160535 - DNA, 25 bp, Homo sapien
cacgttcattcgaatgtgcagagcc

SEQ ID NO: 160536 - DNA, 25 bp, Homo sapien
tctgcgtgtcggatcttgcaggagc

SEQ ID NO: 160537 - DNA, 25 bp, Homo sapien
tttcctccgcacgttcattcgaatg

SEQ ID NO: 160538 - DNA, 25 bp, Homo sapien
atgttccgggtgtgtgcgtctcctt

SEQ ID NO: 160539 - DNA, 25 bp, Homo sapien
agtcgtgcccgagggctgcatgttc

SEQ ID NO: 160540 - DNA, 25 bp, Homo sapien
tcgaatgtgcagagccacatcagcc

SEQ ID NO: 160541 - DNA, 25 bp, Homo sapien
acactgacctcagtcgtgcccgagg

SEQ ID NO: 160542 - DNA, 25 bp, Homo sapien
gggctcacaaagtcccgtgcacacg

SEQ ID NO: 160543 - DNA, 25 bp, Homo sapien
ccgggttttccagcaggctctcgat

SEQ ID NO: 160544 - DNA, 25 bp, Homo sapien
tctgcacgatggatggcccagagcc

SEQ ID NO: 160545 - DNA, 25 bp, Homo sapien
cagaaggccagtaccgggaacgacg

SEQ ID NO: 160546 - DNA, 25 bp, Homo sapien
tgtccgtggtgcttaagcggcgtct

SEQ ID NO: 160547 - DNA, 25 bp, Homo sapien
ttgggctgtatgagcccggccgcca

SEQ ID NO: 160548 - DNA, 25 bp, Homo sapien
tccttctacttgtatgtagcggccc

SEQ ID NO: 160549 - DNA, 25 bp, Homo sapien
gcatttgtactgaagaagggctgca

SEQ ID NO: 160550 - DNA, 25 bp, Homo sapien
cccagagcccttgaggtacagcacg

SEQ ID NO: 160551 - DNA, 25 bp, Homo sapien
ccaccgcgattagggagtgggccca

SEQ ID NO: 160552 - DNA, 25 bp, Homo sapien
tgggtggaggcctgcaagccccacc

SEQ ID NO: 160553 - DNA, 25 bp, Homo sapien
aggtcaacagtcctcgagggacgcc

SEQ ID NO: 160554 - DNA, 25 bp, Homo sapien
cggtttaaggtcaacagtcctcgag

SEQ ID NO: 160555 - DNA, 25 bp, Homo sapien
agaccgcaaagaagaaagtgtccgg

SEQ ID NO: 160556 - DNA, 25 bp, Homo sapien
gcaccgggaaagaccgcaaagaaga

SEQ ID NO: 160557 - DNA, 25 bp, Homo sapien
gcagggcaccgggaaagaccgcaaa

SEQ ID NO: 160558 - DNA, 25 bp, Homo sapien
cgaatgcacgtccatccagcagggg

SEQ ID NO: 160559 - DNA, 25 bp, Homo sapien
cctctacggtgtgacgtacgcgtca

SEQ ID NO: 160560 - DNA, 25 bp, Homo sapien
ggaacgggaatgagcatgcgcattc

SEQ ID NO: 160561 - DNA, 25 bp, Homo sapien
cgccgtccctctacggtgtgacgta

SEQ ID NO: 160562 - DNA, 25 bp, Homo sapien
cacagagaaatttattcctcccgcg

SEQ ID NO: 160563 - DNA, 25 bp, Homo sapien
gaaaaccttcaccaaccaatcacag

SEQ ID NO: 160564 - DNA, 25 bp, Homo sapien
agcggcagacgcacctggtctggca

SEQ ID NO: 160565 - DNA, 25 bp, Homo sapien
acgaacactctgcttcctatcacaa

SEQ ID NO: 160566 - DNA, 25 bp, Homo sapien
tcctatcacaatccagcggcagacg

SEQ ID NO: 160567 - DNA, 25 bp, Homo sapien
tgtcttcattctctcgccttcgctg

SEQ ID NO: 160568 - DNA, 25 bp, Homo sapien
ctgatccgatgtcccgacaggcgaa

SEQ ID NO: 160569 - DNA, 25 bp, Homo sapien
cgagacgcgcgctctgagtgcttcc

SEQ ID NO: 160570 - DNA, 25 bp, Homo sapien
aggtcaggctggaacgcgcctgtta

SEQ ID NO: 160571 - DNA, 25 bp, Homo sapien
gcgcccaggcaccaatgatggggtt

SEQ ID NO: 160572 - DNA, 25 bp, Homo sapien
acaggcgaactgtcatcgacgatcc

SEQ ID NO: 160573 - DNA, 25 bp, Homo sapien
tgtcatcgacgatccctggacgcgg

SEQ ID NO: 160574 - DNA, 25 bp, Homo sapien
ccacagcccgatgcgtgtcttcatt

SEQ ID NO: 160575 - DNA, 25 bp, Homo sapien
ctctggatttcccttgctgctgggg

SEQ ID NO: 160576 - DNA, 25 bp, Homo sapien
gctcgctgtcatagggaaccgcgcc

SEQ ID NO: 160577 - DNA, 25 bp, Homo sapien
tctgactgcgacgagaagctggact

SEQ ID NO: 160578 - DNA, 25 bp, Homo sapien
ctttggccgcgaggctcctcggtac

SEQ ID NO: 160579 - DNA, 25 bp, Homo sapien
tcgcagacactcgtaggcgcgcacg

SEQ ID NO: 160580 - DNA, 25 bp, Homo sapien
cagagacagcctcgcagacactcgt

SEQ ID NO: 160581 - DNA, 25 bp, Homo sapien
acagctcgctgtcatagggaaccgc

SEQ ID NO: 160582 - DNA, 25 bp, Homo sapien
gccggacgatggatccctgcagatc

SEQ ID NO: 160583 - DNA, 25 bp, Homo sapien
catcctcacggtgctggagctcttt

SEQ ID NO: 160584 - DNA, 25 bp, Homo sapien
aggcacgttcgaggactttacctgc

SEQ ID NO: 160585 - DNA, 25 bp, Homo sapien
gccgggatgacatacgctgccaaca

SEQ ID NO: 160586 - DNA, 25 bp, Homo sapien
cctggacgacgtcaaaagacacgtg

SEQ ID NO: 160587 - DNA, 25 bp, Homo sapien
ccagaaggaggccaaaaggagcagt

SEQ ID NO: 160588 - DNA, 25 bp, Homo sapien
caagctgtgccgacgaggaaaatgc

SEQ ID NO: 160589 - DNA, 25 bp, Homo sapien
ccgtcctaggtcattaagcacaagc

SEQ ID NO: 160590 - DNA, 25 bp, Homo sapien
tggagctctttgactacgcctacga

SEQ ID NO: 160591 - DNA, 25 bp, Homo sapien
acgcggcctctctattgcagagctc

SEQ ID NO: 160592 - DNA, 25 bp, Homo sapien
gctcacgcggcctctctattgcaga

SEQ ID NO: 160593 - DNA, 25 bp, Homo sapien
gcctctctattgcagagctcttctc

SEQ ID NO: 160594 - DNA, 25 bp, Homo sapien
gagggcgtggccagcacgccttttc

SEQ ID NO: 160595 - DNA, 25 bp, Homo sapien
tatcccatagtctcgctgccctgag

SEQ ID NO: 160596 - DNA, 25 bp, Homo sapien
ttctttgtgcggctgcatcggcggc

SEQ ID NO: 160597 - DNA, 25 bp, Homo sapien
gcctcctgtgcgaatgggcccggct

SEQ ID NO: 160598 - DNA, 25 bp, Homo sapien
gctccgggtcaagggctgtaccgct

SEQ ID NO: 160599 - DNA, 25 bp, Homo sapien
cgtctgatgcgcagttccctttata

SEQ ID NO: 160600 - DNA, 25 bp, Homo sapien
tccctcgagggagagaaaccacagc

SEQ ID NO: 160601 - DNA, 25 bp, Homo sapien
aaggccggctgcgaaaatctaccca

SEQ ID NO: 160602 - DNA, 25 bp, Homo sapien
gggctttatcatgcctcctgcaaga

SEQ ID NO: 160603 - DNA, 25 bp, Homo sapien
taatcgcagctactccaggggtcag

SEQ ID NO: 160604 - DNA, 25 bp, Homo sapien
gttagactctcatcccttgtgccca

SEQ ID NO: 160605 - DNA, 25 bp, Homo sapien
gctaccctcacgtgtctggttccga

SEQ ID NO: 160606 - DNA, 25 bp, Homo sapien
aacttccggttccagagcttggctc

SEQ ID NO: 160607 - DNA, 25 bp, Homo sapien
ccacagcaagcttaggggtccctgc

SEQ ID NO: 160608 - DNA, 25 bp, Homo sapien
cacgttctcgggtagccagaagcgc

SEQ ID NO: 160609 - DNA, 25 bp, Homo sapien
agatcagcccagctcacgttctcgg

SEQ ID NO: 160610 - DNA, 25 bp, Homo sapien
aacaccgagaggatgtgccggccgc

SEQ ID NO: 160611 - DNA, 25 bp, Homo sapien
tcacgaagaagatgcccgccgccag

SEQ ID NO: 160612 - DNA, 25 bp, Homo sapien
tgcttccgggctttccttgcagttc

SEQ ID NO: 160613 - DNA, 25 bp, Homo sapien
ttgcagttctgcttccggccctcgg

SEQ ID NO: 160614 - DNA, 25 bp, Homo sapien
cgctcgaagagcagcctcacgaaga

SEQ ID NO: 160615 - DNA, 25 bp, Homo sapien
aagcagttgttgtttcaagggaggt

SEQ ID NO: 160616 - DNA, 25 bp, Homo sapien
gcgagtgtgtgtccttatcctagca

SEQ ID NO: 160617 - DNA, 25 bp, Homo sapien
ttatcctagcaattggggcgcgggc

SEQ ID NO: 160618 - DNA, 25 bp, Homo sapien
agcagaggacgacatgttgcttttc

SEQ ID NO: 160619 - DNA, 25 bp, Homo sapien
cttttcgtggaggtgagtgcattat

SEQ ID NO: 160620 - DNA, 25 bp, Homo sapien
agtgcattatgctagtctcgtcctg

SEQ ID NO: 160621 - DNA, 25 bp, Homo sapien
ctagtctcgtcctgctcttaggaga

SEQ ID NO: 160622 - DNA, 25 bp, Homo sapien
ccgccatgtgactttccgggccgta

SEQ ID NO: 160623 - DNA, 25 bp, Homo sapien
gcgtcttcagcctgactgggctgga

SEQ ID NO: 160624 - DNA, 25 bp, Homo sapien
ggcgccgtaagcatatgcgtcttca

SEQ ID NO: 160625 - DNA, 25 bp, Homo sapien
agcatatgcgtcttcagcctgactg

SEQ ID NO: 160626 - DNA, 25 bp, Homo sapien
cctctcttgtcttccggagtgtggc

SEQ ID NO: 160627 - DNA, 25 bp, Homo sapien
cacgtgacctttgctcatggcggcg

SEQ ID NO: 160628 - DNA, 25 bp, Homo sapien
gtcgcgctcacgtgacctttgctca

SEQ ID NO: 160629 - DNA, 25 bp, Homo sapien
agcttcccagtagagggcgccgtaa

SEQ ID NO: 160630 - DNA, 25 bp, Homo sapien
gcccgtcgttctggtagcttcccag

SEQ ID NO: 160631 - DNA, 25 bp, Homo sapien
gcaaccgacgcacgggcattgcgca

SEQ ID NO: 160632 - DNA, 25 bp, Homo sapien
accctcctggagcttgcagtctagc

SEQ ID NO: 160633 - DNA, 25 bp, Homo sapien
cagaagccgccctttgcagtcgcag

SEQ ID NO: 160634 - DNA, 25 bp, Homo sapien
gttggctgttaagtgacactgattc

SEQ ID NO: 160635 - DNA, 25 bp, Homo sapien
tgactgccgaggaaacggtagctta

SEQ ID NO: 160636 - DNA, 25 bp, Homo sapien
cgcacactagtgctcagttttgccc

SEQ ID NO: 160637 - DNA, 25 bp, Homo sapien
cctagccacaagtcaggaccgcgta

SEQ ID NO: 160638 - DNA, 25 bp, Homo sapien
gcttgtgtagatcatgccgccagta

SEQ ID NO: 160639 - DNA, 25 bp, Homo sapien
gcccgaagagcgttcacacggctac

SEQ ID NO: 160640 - DNA, 25 bp, Homo sapien
ggcagaaccagtccgtcagcattta

SEQ ID NO: 160641 - DNA, 25 bp, Homo sapien
cgtcagcatttagccttccacgggc

SEQ ID NO: 160642 - DNA, 25 bp, Homo sapien
actgggacacccgaaaaagtgctgc

SEQ ID NO: 160643 - DNA, 25 bp, Homo sapien
gacccggggcactgagtccattgct

SEQ ID NO: 160644 - DNA, 25 bp, Homo sapien
caggacccgctgtgcacactcggga

SEQ ID NO: 160645 - DNA, 25 bp, Homo sapien
tgcacactcgggactgaggagaccc

SEQ ID NO: 160646 - DNA, 25 bp, Homo sapien
gcagcaggcggctcccttcttagtc

SEQ ID NO: 160647 - DNA, 25 bp, Homo sapien
cagtcccgccgtctctagaaagttc

SEQ ID NO: 160648 - DNA, 25 bp, Homo sapien
atctggaagaatccggttagacagg

SEQ ID NO: 160649 - DNA, 25 bp, Homo sapien
ctgcgtcgtttaaggcaccgaggcc

SEQ ID NO: 160650 - DNA, 25 bp, Homo sapien
cccaaacaggacgaaggcgtgctga

SEQ ID NO: 160651 - DNA, 25 bp, Homo sapien
agaggtgctcaagcctcctcgcggt

SEQ ID NO: 160652 - DNA, 25 bp, Homo sapien
gatcccgagtccgagggtcccagga

SEQ ID NO: 160653 - DNA, 25 bp, Homo sapien
gtcgggagatcgatcgagaagaatc

SEQ ID NO: 160654 - DNA, 25 bp, Homo sapien
ccatggagggagtggacatcagccc

SEQ ID NO: 160655 - DNA, 25 bp, Homo sapien
agaccactactcgccctctggaagg

SEQ ID NO: 160656 - DNA, 25 bp, Homo sapien
aaccggcggctagttcccagcaggc

SEQ ID NO: 160657 - DNA, 25 bp, Homo sapien
atcttgctcaccagcctccaaaatg

SEQ ID NO: 160658 - DNA, 25 bp, Homo sapien
gctcctgagcgtggcgctgttgttt

SEQ ID NO: 160659 - DNA, 25 bp, Homo sapien
tgtttgtggggagctctcacttata

SEQ ID NO: 160660 - DNA, 25 bp, Homo sapien
tcacttatactcagaccactactcg

SEQ ID NO: 160661 - DNA, 25 bp, Homo sapien
tggggagctctcacttatactcaga

SEQ ID NO: 160662 - DNA, 25 bp, Homo sapien
tgggaagtacctgccgccatcttgc

SEQ ID NO: 160663 - DNA, 25 bp, Homo sapien
cggcgccgacgaagaggccacgaaa

SEQ ID NO: 160664 - DNA, 25 bp, Homo sapien
ggcgcgactccatcagtcctggact

SEQ ID NO: 160665 - DNA, 25 bp, Homo sapien
ccgcacatccctattggctggagtc

SEQ ID NO: 160666 - DNA, 25 bp, Homo sapien
tccctgccagcgagcggaatgccgt

SEQ ID NO: 160667 - DNA, 25 bp, Homo sapien
ggtctttctctgaatggcgcgactc

SEQ ID NO: 160668 - DNA, 25 bp, Homo sapien
agctgggccatgtgtcctaggccgc

SEQ ID NO: 160669 - DNA, 25 bp, Homo sapien
tttcgaggcgtcgaagcaggtcagc

SEQ ID NO: 160670 - DNA, 25 bp, Homo sapien
aggccacgaaagaccttgccctgtg

SEQ ID NO: 160671 - DNA, 25 bp, Homo sapien
ggctatggctaccaatcagcgctca

SEQ ID NO: 160672 - DNA, 25 bp, Homo sapien
gaagtactgctgtgtccaatcctgg

SEQ ID NO: 160673 - DNA, 25 bp, Homo sapien
gtggcataagaactcgctccctctg

SEQ ID NO: 160674 - DNA, 25 bp, Homo sapien
tgctacctaacagtcgaggctccga

SEQ ID NO: 160675 - DNA, 25 bp, Homo sapien
ggcactggcaaactgacatctgcta

SEQ ID NO: 160676 - DNA, 25 bp, Homo sapien
gaaagtggacagttcccggcctatc

SEQ ID NO: 160677 - DNA, 25 bp, Homo sapien
tcgccgccagactgactggaaagtg

SEQ ID NO: 160678 - DNA, 25 bp, Homo sapien
tccgcacttagtctttgagtccttc

SEQ ID NO: 160679 - DNA, 25 bp, Homo sapien
cccggctccggctaacaataggatc

SEQ ID NO: 160680 - DNA, 25 bp, Homo sapien
ggctaacaataggatccggccgcag

SEQ ID NO: 160681 - DNA, 25 bp, Homo sapien
gcactggctcttataggcgccggca

SEQ ID NO: 160682 - DNA, 25 bp, Homo sapien
ataggcgccggcacgtcctgaccga

SEQ ID NO: 160683 - DNA, 25 bp, Homo sapien
ttgtaggcggtaactgctgcaaagc

SEQ ID NO: 160684 - DNA, 25 bp, Homo sapien
aactgctgcaaagccgaagccggcg

SEQ ID NO: 160685 - DNA, 25 bp, Homo sapien
tgcaaagccgaagccggcgcgcaaa

SEQ ID NO: 160686 - DNA, 25 bp, Homo sapien
ccgagaaaggacgaggcggcaccct

SEQ ID NO: 160687 - DNA, 25 bp, Homo sapien
cccacggcttagaaccaaatccagg

SEQ ID NO: 160688 - DNA, 25 bp, Homo sapien
caaatccaggtttccgctgagccga

SEQ ID NO: 160689 - DNA, 25 bp, Homo sapien
cgtcagtctcggcagcgatgatagg

SEQ ID NO: 160690 - DNA, 25 bp, Homo sapien
cctataaagaagagaccgcgtcagt

SEQ ID NO: 160691 - DNA, 25 bp, Homo sapien
tcacgctgtcgttcgcctataaaga

SEQ ID NO: 160692 - DNA, 25 bp, Homo sapien
cccacggcctggaaacatggaagga

SEQ ID NO: 160693 - DNA, 25 bp, Homo sapien
ccggcgaacatgacgtcacgctgtc

SEQ ID NO: 160694 - DNA, 25 bp, Homo sapien
ggagaaagtccagcacaggcgtaaa

SEQ ID NO: 160695 - DNA, 25 bp, Homo sapien
ggcattgcatattaaccaaacccga

SEQ ID NO: 160696 - DNA, 25 bp, Homo sapien
tcattcgggagaaccgtgacaggtc

SEQ ID NO: 160697 - DNA, 25 bp, Homo sapien
ggaacccaggcgtccgtgttctcca

SEQ ID NO: 160698 - DNA, 25 bp, Homo sapien
ctccagagaggcaaggatccgcttc

SEQ ID NO: 160699 - DNA, 25 bp, Homo sapien
tcgccactggttctgtgtacagagc

SEQ ID NO: 160700 - DNA, 25 bp, Homo sapien
gagattcatctcacagcccgggcca

SEQ ID NO: 160701 - DNA, 25 bp, Homo sapien
ggcggccaccgattagagattcatc

SEQ ID NO: 160702 - DNA, 25 bp, Homo sapien
ccgcccgcagacaaagaagccagtg

SEQ ID NO: 160703 - DNA, 25 bp, Homo sapien
ccagcggggccgaacttaactactg

SEQ ID NO: 160704 - DNA, 25 bp, Homo sapien
ccagggtcaccaaacgccaggtttg

SEQ ID NO: 160705 - DNA, 25 bp, Homo sapien
tgacgccttcgtcatacccaaatta

SEQ ID NO: 160706 - DNA, 25 bp, Homo sapien
atacccaaattacggcagcttgctg

SEQ ID NO: 160707 - DNA, 25 bp, Homo sapien
tttcctccgtaaactctgtggcgca

SEQ ID NO: 160708 - DNA, 25 bp, Homo sapien
atccgcaggagcaaatagagcgcta

SEQ ID NO: 160709 - DNA, 25 bp, Homo sapien
gcaggcattcgcgtaggccaatgga

SEQ ID NO: 160710 - DNA, 25 bp, Homo sapien
cggaccatcatgtgacacggaagta

SEQ ID NO: 160711 - DNA, 25 bp, Homo sapien
atccaccaggtgtcaggagagggcc

SEQ ID NO: 160712 - DNA, 25 bp, Homo sapien
attgtcactttactctccatccgga

SEQ ID NO: 160713 - DNA, 25 bp, Homo sapien
aggagttctggtgacgccatccacc

SEQ ID NO: 160714 - DNA, 25 bp, Homo sapien
ccagtttcgccaaagcgcggtaaca

SEQ ID NO: 160715 - DNA, 25 bp, Homo sapien
tcacctttccagtcggacgggctgc

SEQ ID NO: 160716 - DNA, 25 bp, Homo sapien
gctccgcgcgtccttttgaactcaa

SEQ ID NO: 160717 - DNA, 25 bp, Homo sapien
agcggagagaaaccgccctctgcag

SEQ ID NO: 160718 - DNA, 25 bp, Homo sapien
tagggttccacagctaggagttctg

SEQ ID NO: 160719 - DNA, 25 bp, Homo sapien
ggtcgcgggctccttctgccgctta

SEQ ID NO: 160720 - DNA, 25 bp, Homo sapien
agaggacaggcattagcagagccgc

SEQ ID NO: 160721 - DNA, 25 bp, Homo sapien
cccaaagaggacaggcattagcaga

SEQ ID NO: 160722 - DNA, 25 bp, Homo sapien
tttcagcgcggaaaaagattggagg

SEQ ID NO: 160723 - DNA, 25 bp, Homo sapien
ctgtcgcgccgaggcaaagccgcag

SEQ ID NO: 160724 - DNA, 25 bp, Homo sapien
tccgccgaagggaagtccgagcagt

SEQ ID NO: 160725 - DNA, 25 bp, Homo sapien
tcggcagaagcgagatccgccgaag

SEQ ID NO: 160726 - DNA, 25 bp, Homo sapien
cggccaggctttcagcgcggaaaaa

SEQ ID NO: 160727 - DNA, 25 bp, Homo sapien
ccgcggttcacttcagactcgttga

SEQ ID NO: 160728 - DNA, 25 bp, Homo sapien
gcgatgtacttgtcgccgcggttca

SEQ ID NO: 160729 - DNA, 25 bp, Homo sapien
cgaccgtgtcttctccctgaaactt

SEQ ID NO: 160730 - DNA, 25 bp, Homo sapien
agtctccctccactgggttatctga

SEQ ID NO: 160731 - DNA, 25 bp, Homo sapien
ggtctgaagcgacacatcactttga

SEQ ID NO: 160732 - DNA, 25 bp, Homo sapien
ctttgatgttgcactcggccaggtc

SEQ ID NO: 160733 - DNA, 25 bp, Homo sapien
cggggtcgcagattcaaattttact

SEQ ID NO: 160734 - DNA, 25 bp, Homo sapien
gcgccggcagccgttaaccctaatg

SEQ ID NO: 160735 - DNA, 25 bp, Homo sapien
tggcctcgcgttgtcctgccagaac

SEQ ID NO: 160736 - DNA, 25 bp, Homo sapien
tgatctgctcagacccgaccagagg

SEQ ID NO: 160737 - DNA, 25 bp, Homo sapien
ggagacctagttcggctccgccatg

SEQ ID NO: 160738 - DNA, 25 bp, Homo sapien
acggcgtcctcagctatcaggtagg

SEQ ID NO: 160739 - DNA, 25 bp, Homo sapien
aacctgggatctggcccatctctgc

SEQ ID NO: 160740 - DNA, 25 bp, Homo sapien
tcgccgttcgagtgatctgctcaga

SEQ ID NO: 160741 - DNA, 25 bp, Homo sapien
gcaggcctctcgctgattggttgcg

SEQ ID NO: 160742 - DNA, 25 bp, Homo sapien
tcctcgcgtctttctgttggaaggg

SEQ ID NO: 160743 - DNA, 25 bp, Homo sapien
ccctctgctcttggaggtgccatga

SEQ ID NO: 160744 - DNA, 25 bp, Homo sapien
tgccatgaggtcagttagctacgtg

SEQ ID NO: 160745 - DNA, 25 bp, Homo sapien
tcagttagctacgtgcagcgcgtgg

SEQ ID NO: 160746 - DNA, 25 bp, Homo sapien
acgcaatctgcctcggagacgttga

SEQ ID NO: 160747 - DNA, 25 bp, Homo sapien
cctcggagacgttgataacgatacg

SEQ ID NO: 160748 - DNA, 25 bp, Homo sapien
aacgatacggtaggtgcatgcgcac

SEQ ID NO: 160749 - DNA, 25 bp, Homo sapien
catgcgcaccgcaagagacagcctg

SEQ ID NO: 160750 - DNA, 25 bp, Homo sapien
tcagggaatatttactgggcctctc

SEQ ID NO: 160751 - DNA, 25 bp, Homo sapien
ccagtcaggggctttgccgcagagt

SEQ ID NO: 160752 - DNA, 25 bp, Homo sapien
gcgggcgcgagtcatcaattatgca

SEQ ID NO: 160753 - DNA, 25 bp, Homo sapien
tcatcaattatgcaaggactcgggc

SEQ ID NO: 160754 - DNA, 25 bp, Homo sapien
aattatgcaaggactcgggcggtgc

SEQ ID NO: 160755 - DNA, 25 bp, Homo sapien
ttctcgcctcgggacccttgagcgg

SEQ ID NO: 160756 - DNA, 25 bp, Homo sapien
tcgcccatctccagtcaggggcttt

SEQ ID NO: 160757 - DNA, 25 bp, Homo sapien
tcaccacgacagctttcgggtctcg

SEQ ID NO: 160758 - DNA, 25 bp, Homo sapien
cagagcacgcgggtcaccacgacag

SEQ ID NO: 160759 - DNA, 25 bp, Homo sapien
actgcaacggcgtggtgtccctcat

SEQ ID NO: 160760 - DNA, 25 bp, Homo sapien
caacggcgtggtgtccctcatcggc

SEQ ID NO: 160761 - DNA, 25 bp, Homo sapien
caacagcacggtggactgcaacggc

SEQ ID NO: 160762 - DNA, 25 bp, Homo sapien
tgaagcgcaacagcacggtggactg

SEQ ID NO: 160763 - DNA, 25 bp, Homo sapien
tcgcggatgacgagcacagcacggt

SEQ ID NO: 160764 - DNA, 25 bp, Homo sapien
ccgagaatgagttcgcggatgacga

SEQ ID NO: 160765 - DNA, 25 bp, Homo sapien
gacccgggctccgagaatgagttcg

SEQ ID NO: 160766 - DNA, 25 bp, Homo sapien
ctgcggcgcagcgtgaagcgcaaca

SEQ ID NO: 160767 - DNA, 25 bp, Homo sapien
ccgaacagtcgggaagcctagtgga

SEQ ID NO: 160768 - DNA, 25 bp, Homo sapien
caaacccagagcgtgaggaccaagg

SEQ ID NO: 160769 - DNA, 25 bp, Homo sapien
tgccaacacccagcgacggagacgg

SEQ ID NO: 160770 - DNA, 25 bp, Homo sapien
ccatagcgtgagcaggacgaccagc

SEQ ID NO: 160771 - DNA, 25 bp, Homo sapien
agcgaccggaaatggccgcactcct

SEQ ID NO: 160772 - DNA, 25 bp, Homo sapien
gtcgccgccagtgatccatagcgtg

SEQ ID NO: 160773 - DNA, 25 bp, Homo sapien
gcgccagccggtcttcagaaagccg

SEQ ID NO: 160774 - DNA, 25 bp, Homo sapien
cgctccacgatcagctgcagggcgt

SEQ ID NO: 160775 - DNA, 25 bp, Homo sapien
atcttgctcgtcaccagctccaggg

SEQ ID NO: 160776 - DNA, 25 bp, Homo sapien
ccgcggcccaaagagcaggacggtc

SEQ ID NO: 160777 - DNA, 25 bp, Homo sapien
cagggtccacgcctttgggagtctc

SEQ ID NO: 160778 - DNA, 25 bp, Homo sapien
tcaaagggctccagttgcgggccgt

SEQ ID NO: 160779 - DNA, 25 bp, Homo sapien
tcgtacgcgtacttgcggtagcggc

SEQ ID NO: 160780 - DNA, 25 bp, Homo sapien
ttgcgcttcagcgacagcccggatt

SEQ ID NO: 160781 - DNA, 25 bp, Homo sapien
agcgcctctagctcgctgatgagga

SEQ ID NO: 160782 - DNA, 25 bp, Homo sapien
ccctgcgggatagttgtacagcggc

SEQ ID NO: 160783 - DNA, 25 bp, Homo sapien
agcaatctgcgaaggaccctctgca

SEQ ID NO: 160784 - DNA, 25 bp, Homo sapien
gctggatccttctgggacccgaacc

SEQ ID NO: 160785 - DNA, 25 bp, Homo sapien
gcccgtgcggacaacacaaacattc

SEQ ID NO: 160786 - DNA, 25 bp, Homo sapien
agcatgcgaatctctgtgtagaaca

SEQ ID NO: 160787 - DNA, 25 bp, Homo sapien
agccctacggcctaatcctgattta

SEQ ID NO: 160788 - DNA, 25 bp, Homo sapien
tagtgaccgtccctttaacagccca

SEQ ID NO: 160789 - DNA, 25 bp, Homo sapien
cgtcaccatgctggggaatctccgg

SEQ ID NO: 160790 - DNA, 25 bp, Homo sapien
cagcatttgctgatcacctacaggg

SEQ ID NO: 160791 - DNA, 25 bp, Homo sapien
ggaattccacgtgcaaaccgagaga

SEQ ID NO: 160792 - DNA, 25 bp, Homo sapien
aatttgccctcagacctggacccta

SEQ ID NO: 160793 - DNA, 25 bp, Homo sapien
agccgcaaagattggctgccgcaga

SEQ ID NO: 160794 - DNA, 25 bp, Homo sapien
ccgagagaggttttgccataaattc

SEQ ID NO: 160795 - DNA, 25 bp, Homo sapien
agcgggattgtctgatggaattcca

SEQ ID NO: 160796 - DNA, 25 bp, Homo sapien
gccctttgttaggtcccgagacgca

SEQ ID NO: 160797 - DNA, 25 bp, Homo sapien
accctaccagggaacagcgggattg

SEQ ID NO: 160798 - DNA, 25 bp, Homo sapien
ccgttgcctttggaatttgccctca

SEQ ID NO: 160799 - DNA, 25 bp, Homo sapien
gagggagcagatggcagcaattacc

SEQ ID NO: 160800 - DNA, 25 bp, Homo sapien
tggcagcaattaccgctcggaccct

SEQ ID NO: 160801 - DNA, 25 bp, Homo sapien
attctgtcgcgcaatgctgtgtggc

SEQ ID NO: 160802 - DNA, 25 bp, Homo sapien
ggcgtgaactatccacccgtgtgca

SEQ ID NO: 160803 - DNA, 25 bp, Homo sapien
tccgtatcccgaggcgggcgtgaac

SEQ ID NO: 160804 - DNA, 25 bp, Homo sapien
cgaaatccagatccacacgtccgta

SEQ ID NO: 160805 - DNA, 25 bp, Homo sapien
gacgcgtctgtccaggtccgaaatc

SEQ ID NO: 160806 - DNA, 25 bp, Homo sapien
cggaagatcggctcggcagctcgct

SEQ ID NO: 160807 - DNA, 25 bp, Homo sapien
agacgttcacaagctggtgccacga

SEQ ID NO: 160808 - DNA, 25 bp, Homo sapien
ccatttcctggcagttcgttgcgca

SEQ ID NO: 160809 - DNA, 25 bp, Homo sapien
acaaacggcattggcgctgacctga

SEQ ID NO: 160810 - DNA, 25 bp, Homo sapien
gtgcgtgaacaaacggcattggcgc

SEQ ID NO: 160811 - DNA, 25 bp, Homo sapien
cagtgaccaagaaggatctggcgga

SEQ ID NO: 160812 - DNA, 25 bp, Homo sapien
ttcctggcagttcgttgcgcattgc

SEQ ID NO: 160813 - DNA, 25 bp, Homo sapien
tgagcgacgggctgccgcccattgc

SEQ ID NO: 160814 - DNA, 25 bp, Homo sapien
ccaccaggatgccagtgaccaagaa

SEQ ID NO: 160815 - DNA, 25 bp, Homo sapien
gcgcctcgcttttggcggtcttcca

SEQ ID NO: 160816 - DNA, 25 bp, Homo sapien
cttctcggcttccaggatgagcacc

SEQ ID NO: 160817 - DNA, 25 bp, Homo sapien
gatgagcaccgaggccaattgcgcc

SEQ ID NO: 160818 - DNA, 25 bp, Homo sapien
ccgaggccaattgcgcctcgctttt

SEQ ID NO: 160819 - DNA, 25 bp, Homo sapien
gctggacccggccatctttgcagaa

SEQ ID NO: 160820 - DNA, 25 bp, Homo sapien
acccggccatctttgcagaagtcag

SEQ ID NO: 160821 - DNA, 25 bp, Homo sapien
cctacgtcttctcggcttccaggat

SEQ ID NO: 160822 - DNA, 25 bp, Homo sapien
tggcggtcttccacagcgactcact

SEQ ID NO: 160823 - DNA, 25 bp, Homo sapien
caggaagacgctggaataagaaaca

SEQ ID NO: 160824 - DNA, 25 bp, Homo sapien
ttgcctacagtctcggctctgtctc

SEQ ID NO: 160825 - DNA, 25 bp, Homo sapien
tgtctcccacggctgtgggtccgga

SEQ ID NO: 160826 - DNA, 25 bp, Homo sapien
cgagctgggcaataaggaaacggtt

SEQ ID NO: 160827 - DNA, 25 bp, Homo sapien
gccgtccagcgctggcggtgcaact

SEQ ID NO: 160828 - DNA, 25 bp, Homo sapien
ccagagtcaccgcagagtggtcgcg

SEQ ID NO: 160829 - DNA, 25 bp, Homo sapien
ggccgccagacgttgcctacagtct

SEQ ID NO: 160830 - DNA, 25 bp, Homo sapien
ataagaaacatttttgctccagccc

SEQ ID NO: 160831 - DNA, 25 bp, Homo sapien
ccgcgacttcaagagccgcaatgtg

SEQ ID NO: 160832 - DNA, 25 bp, Homo sapien
ggtacacagggcaaaccagccattg

SEQ ID NO: 160833 - DNA, 25 bp, Homo sapien
tgcacgtggagatcttcggtacaca

SEQ ID NO: 160834 - DNA, 25 bp, Homo sapien
cccatctggctctgaggctagctgt

SEQ ID NO: 160835 - DNA, 25 bp, Homo sapien
ggctccctctacgactttctgcaga

SEQ ID NO: 160836 - DNA, 25 bp, Homo sapien
aacctgcagtgttgcatcgccgacc

SEQ ID NO: 160837 - DNA, 25 bp, Homo sapien
atgtgctggtcaagagcaacctgca

SEQ ID NO: 160838 - DNA, 25 bp, Homo sapien
agctgtggctcatcacgcactacca

SEQ ID NO: 160839 - DNA, 25 bp, Homo sapien
ggtctggcaccggagctttcagttt

SEQ ID NO: 160840 - DNA, 25 bp, Homo sapien
aggcctgggactccattgctgcatc

SEQ ID NO: 160841 - DNA, 25 bp, Homo sapien
cttgtctcggcattccgggctcgaa

SEQ ID NO: 160842 - DNA, 25 bp, Homo sapien
atcggcgccggccttgtctcggcat

SEQ ID NO: 160843 - DNA, 25 bp, Homo sapien
acgtgacggaacgtcgccaatcggc

SEQ ID NO: 160844 - DNA, 25 bp, Homo sapien
gagcgttaaggtcacgtgacggaac

SEQ ID NO: 160845 - DNA, 25 bp, Homo sapien
tccgctgtttgaaattggcgccggc

SEQ ID NO: 160846 - DNA, 25 bp, Homo sapien
ggagctttcagtttgttccgctgtt

SEQ ID NO: 160847 - DNA, 25 bp, Homo sapien
gacccgagccctgttccaggcggaa

SEQ ID NO: 160848 - DNA, 25 bp, Homo sapien
gggcagttctcaggggtcgcgctcc

SEQ ID NO: 160849 - DNA, 25 bp, Homo sapien
ccgagccctgttccaggcggaactg

SEQ ID NO: 160850 - DNA, 25 bp, Homo sapien
ctggggacccgagccctgttccagg

SEQ ID NO: 160851 - DNA, 25 bp, Homo sapien
gagtcggggtgacccccagtcagct

SEQ ID NO: 160852 - DNA, 25 bp, Homo sapien
cccacgagcacaatatggccgggtg

SEQ ID NO: 160853 - DNA, 25 bp, Homo sapien
gcggccgctggactacagcgcgccc

SEQ ID NO: 160854 - DNA, 25 bp, Homo sapien
cggaactggattcgggcagttctca

SEQ ID NO: 160855 - DNA, 25 bp, Homo sapien
atagcacacccttccgaggggactc

SEQ ID NO: 160856 - DNA, 25 bp, Homo sapien
cgctctcggagcctataaagggagg

SEQ ID NO: 160857 - DNA, 25 bp, Homo sapien
aggactatcaccctgccgagctgta

SEQ ID NO: 160858 - DNA, 25 bp, Homo sapien
ctacagggcctgctgactccgcagt

SEQ ID NO: 160859 - DNA, 25 bp, Homo sapien
caggctcggtggctcttaactccgc

SEQ ID NO: 160860 - DNA, 25 bp, Homo sapien
ccaggcaagttgaaggtccgagagc

SEQ ID NO: 160861 - DNA, 25 bp, Homo sapien
ggagccgctgactccggatagcaca

SEQ ID NO: 160862 - DNA, 25 bp, Homo sapien
cgttctcactctgaggaagtgcgtg

SEQ ID NO: 160863 - DNA, 25 bp, Homo sapien
gccaccacggtccaggcctgacccg

SEQ ID NO: 160864 - DNA, 25 bp, Homo sapien
ctacctctcccgtctctgcgcaggc

SEQ ID NO: 160865 - DNA, 25 bp, Homo sapien
ccagcatctacgacacgctggagtc

SEQ ID NO: 160866 - DNA, 25 bp, Homo sapien
ctacgacacgctggagtcggtgcgc

SEQ ID NO: 160867 - DNA, 25 bp, Homo sapien
acgctggagtcggtgcgctcctgcc

SEQ ID NO: 160868 - DNA, 25 bp, Homo sapien
tgcccttcgggcctctgctcgccgt

SEQ ID NO: 160869 - DNA, 25 bp, Homo sapien
cgtctaccacacgtgcttcttcggg

SEQ ID NO: 160870 - DNA, 25 bp, Homo sapien
cctggtggtgaaggaccccagcatc

SEQ ID NO: 160871 - DNA, 25 bp, Homo sapien
ggcctgcgcaaaaccaagtaccgca

SEQ ID NO: 160872 - DNA, 25 bp, Homo sapien
cggactcaaccgctccctggaggag

SEQ ID NO: 160873 - DNA, 25 bp, Homo sapien
gcaaaaccaagtaccgcagcttccg

SEQ ID NO: 160874 - DNA, 25 bp, Homo sapien
gcgcaaaaccaagtaccgcagcttc

SEQ ID NO: 160875 - DNA, 25 bp, Homo sapien
ggctgctcaagttcatccccggact

SEQ ID NO: 160876 - DNA, 25 bp, Homo sapien
atttattcgcaacagccagcgctaa

SEQ ID NO: 160877 - DNA, 25 bp, Homo sapien
tcgcaacagccagcgctaaaagagg

SEQ ID NO: 160878 - DNA, 25 bp, Homo sapien
agcttccgccggcggctgctcaagt

SEQ ID NO: 160879 - DNA, 25 bp, Homo sapien
cgagccgctcctcacagggtgctgt

SEQ ID NO: 160880 - DNA, 25 bp, Homo sapien
cctcaggaagtcctggcgccgtagc

SEQ ID NO: 160881 - DNA, 25 bp, Homo sapien
gagtaaccgcctcccgaggcagcta

SEQ ID NO: 160882 - DNA, 25 bp, Homo sapien
tcggggttatgctttgctgggatct

SEQ ID NO: 160883 - DNA, 25 bp, Homo sapien
acacgggcgcctctgcactctcaac

SEQ ID NO: 160884 - DNA, 25 bp, Homo sapien
cagactcgggaacggccacactcgt

SEQ ID NO: 160885 - DNA, 25 bp, Homo sapien
agcgccggagtgagtaaccgcctcc

SEQ ID NO: 160886 - DNA, 25 bp, Homo sapien
gctcctcacagggtgctgtggctcc

SEQ ID NO: 160887 - DNA, 25 bp, Homo sapien
tcgcctgcagcagacccgaaggaag

SEQ ID NO: 160888 - DNA, 25 bp, Homo sapien
cctcgctcctctgggagtgcgatta

SEQ ID NO: 160889 - DNA, 25 bp, Homo sapien
ggttcatttgcatgcgcccgtgcta

SEQ ID NO: 160890 - DNA, 25 bp, Homo sapien
cctccggactggctagtgacgtagc

SEQ ID NO: 160891 - DNA, 25 bp, Homo sapien
cccatctctggcgacgcggagaaaa

SEQ ID NO: 160892 - DNA, 25 bp, Homo sapien
aagcttcggctcaatggttcatttg

SEQ ID NO: 160893 - DNA, 25 bp, Homo sapien
gcgattacgggcctctcacttcgta

SEQ ID NO: 160894 - DNA, 25 bp, Homo sapien
agccgtcgtcggaggatgaccaaat

SEQ ID NO: 160895 - DNA, 25 bp, Homo sapien
attccggagacgtcaatgggcacgc

SEQ ID NO: 160896 - DNA, 25 bp, Homo sapien
tggccaggccagagaaattccttcc

SEQ ID NO: 160897 - DNA, 25 bp, Homo sapien
aagggcgacggccaaggctttctct

SEQ ID NO: 160898 - DNA, 25 bp, Homo sapien
aatctcgggtcttcggtggatgcct

SEQ ID NO: 160899 - DNA, 25 bp, Homo sapien
tgtgagcgagacctcggcaccctca

SEQ ID NO: 160900 - DNA, 25 bp, Homo sapien
tttggaccgccaccgagtctctctg

SEQ ID NO: 160901 - DNA, 25 bp, Homo sapien
gaatcgctgtgactttggaccgcca

SEQ ID NO: 160902 - DNA, 25 bp, Homo sapien
gactggattcccagcggaaccgctg

SEQ ID NO: 160903 - DNA, 25 bp, Homo sapien
agcagatacctctccgctctgggga

SEQ ID NO: 160904 - DNA, 25 bp, Homo sapien
cggccctgtttatcgaggcgtattc

SEQ ID NO: 160905 - DNA, 25 bp, Homo sapien
ggcagatcctcacagcggaaaaccg

SEQ ID NO: 160906 - DNA, 25 bp, Homo sapien
cgcgcccgaaacgacagtttactca

SEQ ID NO: 160907 - DNA, 25 bp, Homo sapien
gtttactcatctcaggcgcagcaga

SEQ ID NO: 160908 - DNA, 25 bp, Homo sapien
gctcgctctcttcaatacgccatgg

SEQ ID NO: 160909 - DNA, 25 bp, Homo sapien
acaaggtgcgggaaaactctctcca

SEQ ID NO: 160910 - DNA, 25 bp, Homo sapien
tggcggacattaaaactccactgtg

SEQ ID NO: 160911 - DNA, 25 bp, Homo sapien
ggcctgggagctgctatttttagcg

SEQ ID NO: 160912 - DNA, 25 bp, Homo sapien
atctgtttttaggagcggtgcatga

SEQ ID NO: 160913 - DNA, 25 bp, Homo sapien
cgtcctgtgcactagctgcgcctag

SEQ ID NO: 160914 - DNA, 25 bp, Homo sapien
tgaggagatcctcatccggggaagc

SEQ ID NO: 160915 - DNA, 25 bp, Homo sapien
ctcccgctggttattctggacctgg

SEQ ID NO: 160916 - DNA, 25 bp, Homo sapien
ggcgcgaggagcctatttatagatc

SEQ ID NO: 160917 - DNA, 25 bp, Homo sapien
gcgcccttgtatggccaaagctcga

SEQ ID NO: 160918 - DNA, 25 bp, Homo sapien
ccttcggggaacgtgcatctgtttt

SEQ ID NO: 160919 - DNA, 25 bp, Homo sapien
cctccagtctctatggcggaagtga

SEQ ID NO: 160920 - DNA, 25 bp, Homo sapien
gcgggaattccttcctgcgtccgtc

SEQ ID NO: 160921 - DNA, 25 bp, Homo sapien
cctccctggttacgtggactgtgga

SEQ ID NO: 160922 - DNA, 25 bp, Homo sapien
tgcttctgtgactacgcggatgttg

SEQ ID NO: 160923 - DNA, 25 bp, Homo sapien
gcatgactatctgcgtgtgcttctg

SEQ ID NO: 160924 - DNA, 25 bp, Homo sapien
cccagatcagagagcaacgcatgac

SEQ ID NO: 160925 - DNA, 25 bp, Homo sapien
tacgggccgaaacaccacagcgttc

SEQ ID NO: 160926 - DNA, 25 bp, Homo sapien
cgtccgtcccgagtctcttgatatg

SEQ ID NO: 160927 - DNA, 25 bp, Homo sapien
cttccttactgaggaggcttcttgg

SEQ ID NO: 160928 - DNA, 25 bp, Homo sapien
gcaaggcacctgtctttggagaatg

SEQ ID NO: 160929 - DNA, 25 bp, Homo sapien
ttggagaatgagtcgctcttcagcg

SEQ ID NO: 160930 - DNA, 25 bp, Homo sapien
tcagcgactcaggttcccagctctg

SEQ ID NO: 160931 - DNA, 25 bp, Homo sapien
ggggctacagtagcttccttactga

SEQ ID NO: 160932 - DNA, 25 bp, Homo sapien
ccagctctgtaagtccacggccggt

SEQ ID NO: 160933 - DNA, 25 bp, Homo sapien
cctatggagaaagggccgtagccac

SEQ ID NO: 160934 - DNA, 25 bp, Homo sapien
tggcgatcccgccacatctgggcag

SEQ ID NO: 160935 - DNA, 25 bp, Homo sapien
cgaggcccaggcaaaaacaaagtct

SEQ ID NO: 160936 - DNA, 25 bp, Homo sapien
ggcgctccagaggaccaagccttag

SEQ ID NO: 160937 - DNA, 25 bp, Homo sapien
ggagccacgagaacacggaccaatc

SEQ ID NO: 160938 - DNA, 25 bp, Homo sapien
ccgtgggcagagacctttggttcag

SEQ ID NO: 160939 - DNA, 25 bp, Homo sapien
cttctggagttttcgtgacgggctc

SEQ ID NO: 160940 - DNA, 25 bp, Homo sapien
tagtagcttgttctgacgccgctgc

SEQ ID NO: 160941 - DNA, 25 bp, Homo sapien
cttcggacgggtaaagctgaattct

SEQ ID NO: 160942 - DNA, 25 bp, Homo sapien
taggagactcctctgaccggactcg

SEQ ID NO: 160943 - DNA, 25 bp, Homo sapien
gctcagttgtggcggcgcctccagt

SEQ ID NO: 160944 - DNA, 25 bp, Homo sapien
gcgccgccttcacccgtggcctgct

SEQ ID NO: 160945 - DNA, 25 bp, Homo sapien
tgcccgaccggctttgggagactcc

SEQ ID NO: 160946 - DNA, 25 bp, Homo sapien
gttgtggcggcgcctccagtgtcct

SEQ ID NO: 160947 - DNA, 25 bp, Homo sapien
tgcccggacacgttggcctgcgggc

SEQ ID NO: 160948 - DNA, 25 bp, Homo sapien
cggacaccaggtgtcggcgctgcgg

SEQ ID NO: 160949 - DNA, 25 bp, Homo sapien
gtgcccgaccggctttgggagactc

SEQ ID NO: 160950 - DNA, 25 bp, Homo sapien
gagtggctccctagggttggcggct

SEQ ID NO: 160951 - DNA, 25 bp, Homo sapien
gaggtcaccattaaccagagcctgc

SEQ ID NO: 160952 - DNA, 25 bp, Homo sapien
tccgccagtgttggggacacgatct

SEQ ID NO: 160953 - DNA, 25 bp, Homo sapien
ggagagcgagcagatcaagaccctc

SEQ ID NO: 160954 - DNA, 25 bp, Homo sapien
cggcatccgcgaggtcaccattaac

SEQ ID NO: 160955 - DNA, 25 bp, Homo sapien
tgcttggactgaaagcctgggcttc

SEQ ID NO: 160956 - DNA, 25 bp, Homo sapien
ctagggatggcgctcctgcctactc

SEQ ID NO: 160957 - DNA, 25 bp, Homo sapien
ccgctgttctctgcggccgtctagg

SEQ ID NO: 160958 - DNA, 25 bp, Homo sapien
gcccttctgtctttccgccagtgtt

SEQ ID NO: 160959 - DNA, 25 bp, Homo sapien
cgtgccaagttggaggccgccattg

SEQ ID NO: 160960 - DNA, 25 bp, Homo sapien
aactcatgagcgtgaagctggccct

SEQ ID NO: 160961 - DNA, 25 bp, Homo sapien
taccaggaactcatgagcgtgaagc

SEQ ID NO: 160962 - DNA, 25 bp, Homo sapien
gcgtgagtaccaggaactcatgagc

SEQ ID NO: 160963 - DNA, 25 bp, Homo sapien
gcaagcaggatatggcacggcagct

SEQ ID NO: 160964 - DNA, 25 bp, Homo sapien
caaggatgctcgtgccaagcaggag

SEQ ID NO: 160965 - DNA, 25 bp, Homo sapien
cgctcaaggatgctcgtgccaagca

SEQ ID NO: 160966 - DNA, 25 bp, Homo sapien
ctggcgctcaaggatgctcgtgcca

SEQ ID NO: 160967 - DNA, 25 bp, Homo sapien
ggtctttacctagggctgcgaggac

SEQ ID NO: 160968 - DNA, 25 bp, Homo sapien
gctgcgaggacagtcctttagattc

SEQ ID NO: 160969 - DNA, 25 bp, Homo sapien
cgaggacagtcctttagattcgggg

SEQ ID NO: 160970 - DNA, 25 bp, Homo sapien
ggagccctgtgctctcggaagcagt

SEQ ID NO: 160971 - DNA, 25 bp, Homo sapien
gcgtcggtacaaagtggggcgctca

SEQ ID NO: 160972 - DNA, 25 bp, Homo sapien
cctgtgctctcggaagcagtgaagg

SEQ ID NO: 160973 - DNA, 25 bp, Homo sapien
ggtgctcaccgccacgttcccgctg

SEQ ID NO: 160974 - DNA, 25 bp, Homo sapien
cgggagcccgacacgcacaggtccc

SEQ ID NO: 160975 - DNA, 25 bp, Homo sapien
tttacgagcttggagggctcggccc

SEQ ID NO: 160976 - DNA, 25 bp, Homo sapien
agctcgcggccaaggcgtttacgag

SEQ ID NO: 160977 - DNA, 25 bp, Homo sapien
tgcgccttatatgacggcccgcggg

SEQ ID NO: 160978 - DNA, 25 bp, Homo sapien
ccaagccggcgctgcgccttatatg

SEQ ID NO: 160979 - DNA, 25 bp, Homo sapien
ccggccgcctgcataaaacggcgtt

SEQ ID NO: 160980 - DNA, 25 bp, Homo sapien
gcctgcataaaacggcgttcgcctc

SEQ ID NO: 160981 - DNA, 25 bp, Homo sapien
ggactccgagctttgccttgttgga

SEQ ID NO: 160982 - DNA, 25 bp, Homo sapien
gccttgttggatccggcctccactt

SEQ ID NO: 160983 - DNA, 25 bp, Homo sapien
ccgaagctgcgtccgcaggagccgg

SEQ ID NO: 160984 - DNA, 25 bp, Homo sapien
agccgaagctgcgtccgcaggagcc

SEQ ID NO: 160985 - DNA, 25 bp, Homo sapien
agcggtagccgaagctgcgtccgca

SEQ ID NO: 160986 - DNA, 25 bp, Homo sapien
ggaggctctcgttgaccgacacggt

SEQ ID NO: 160987 - DNA, 25 bp, Homo sapien
aggaggctctcgttgaccgacacgg

SEQ ID NO: 160988 - DNA, 25 bp, Homo sapien
gaggaggctctcgttgaccgacacg

SEQ ID NO: 160989 - DNA, 25 bp, Homo sapien
cgtgaggaggctctcgttgaccgac

SEQ ID NO: 160990 - DNA, 25 bp, Homo sapien
tgaggaggctctcgttgaccgacac

SEQ ID NO: 160991 - DNA, 25 bp, Homo sapien
cacggaggcagcaccagatggatgt

SEQ ID NO: 160992 - DNA, 25 bp, Homo sapien
caggaacgggcgcaggcatctccct

SEQ ID NO: 160993 - DNA, 25 bp, Homo sapien
ctccagccgcacttgacaggagggg

SEQ ID NO: 160994 - DNA, 25 bp, Homo sapien
cacagaggcagcaccagacggatgc

SEQ ID NO: 160995 - DNA, 25 bp, Homo sapien
agcaccagacggatgcctgccaagg

SEQ ID NO: 160996 - DNA, 25 bp, Homo sapien
cctgccaaggggacgctgcagccgt

SEQ ID NO: 160997 - DNA, 25 bp, Homo sapien
ggaatgggcacaggcgtctccctcc

SEQ ID NO: 160998 - DNA, 25 bp, Homo sapien
gtgaagattcaggagcacgagcatc

SEQ ID NO: 160999 - DNA, 25 bp, Homo sapien
accgtgtcggtcaacgagagcctcc

SEQ ID NO: 161000 - DNA, 25 bp, Homo sapien
tgcggacgcagcttcggctaccgct

SEQ ID NO: 161001 - DNA, 25 bp, Homo sapien
ccgtgtcggtcaacgagagcctcct

SEQ ID NO: 161002 - DNA, 25 bp, Homo sapien
gtgtcggtcaacgagagcctcctca

SEQ ID NO: 161003 - DNA, 25 bp, Homo sapien
tgtcggtcaacgagagcctcctcac

SEQ ID NO: 161004 - DNA, 25 bp, Homo sapien
gtcggtcaacgagagcctcctcacg

SEQ ID NO: 161005 - DNA, 25 bp, Homo sapien
cggtcaacgagagcctcctcacgcc

SEQ ID NO: 161006 - DNA, 25 bp, Homo sapien
ggctcctgcggacgcagcttcggct

SEQ ID NO: 161007 - DNA, 25 bp, Homo sapien
cctgttgtctccaccagagtcagta

SEQ ID NO: 161008 - DNA, 25 bp, Homo sapien
cccagcaacagcaacgtggtggtgg

SEQ ID NO: 161009 - DNA, 25 bp, Homo sapien
atgtctgtaagtagtggggtccgtc

SEQ ID NO: 161010 - DNA, 25 bp, Homo sapien
gtctccaccagagtcagtagcgtcc

SEQ ID NO: 161011 - DNA, 25 bp, Homo sapien
caacgtggtggtgggcactactaac

SEQ ID NO: 161012 - DNA, 25 bp, Homo sapien
tcggctcggtgaatgtctgtaagta

SEQ ID NO: 161013 - DNA, 25 bp, Homo sapien
ggtgggcactactaacgcctgcgcc

SEQ ID NO: 161014 - DNA, 25 bp, Homo sapien
cagccagtacctcgcgccaccagaa

SEQ ID NO: 161015 - DNA, 25 bp, Homo sapien
gtcagccctcggtagcaggacaccc

SEQ ID NO: 161016 - DNA, 25 bp, Homo sapien
aagccacctacagctatccggggcc

SEQ ID NO: 161017 - DNA, 25 bp, Homo sapien
acctacagctatccggggcccgcag

SEQ ID NO: 161018 - DNA, 25 bp, Homo sapien
tgcggctgccgaagcccgtcagccc

SEQ ID NO: 161019 - DNA, 25 bp, Homo sapien
cgtcagccctcggtagcaggacacc

SEQ ID NO: 161020 - DNA, 25 bp, Homo sapien
ccacctacagctatccggggcccgc

SEQ ID NO: 161021 - DNA, 25 bp, Homo sapien
gccctcggtagcaggacacccctcg

SEQ ID NO: 161022 - DNA, 25 bp, Homo sapien
cccgtcagccctcggtagcaggaca

SEQ ID NO: 161023 - DNA, 25 bp, Homo sapien
gcttgggagcccgacccaaagcgtg

SEQ ID NO: 161024 - DNA, 25 bp, Homo sapien
ttgggagcccgacccaaagcgtgcc

SEQ ID NO: 161025 - DNA, 25 bp, Homo sapien
gcccgacccaaagcgtgccctccag

SEQ ID NO: 161026 - DNA, 25 bp, Homo sapien
cagggtgcagcaccgacgggtgccg

SEQ ID NO: 161027 - DNA, 25 bp, Homo sapien
aagtactggactagctgcgggcagg

SEQ ID NO: 161028 - DNA, 25 bp, Homo sapien
cggcgggaagtactggactagctgc

SEQ ID NO: 161029 - DNA, 25 bp, Homo sapien
gacgcggcgctactcccctctgcca

SEQ ID NO: 161030 - DNA, 25 bp, Homo sapien
agcaccgacgggtgccgcggcgttt

SEQ ID NO: 161031 - DNA, 25 bp, Homo sapien
tcactcctccaggaatagggatccc

SEQ ID NO: 161032 - DNA, 25 bp, Homo sapien
cggttgactcactcctccaggaata

SEQ ID NO: 161033 - DNA, 25 bp, Homo sapien
gtgctcggctgctcttttctttccg

SEQ ID NO: 161034 - DNA, 25 bp, Homo sapien
gcgcgcaacgagcagccaaacagtc

SEQ ID NO: 161035 - DNA, 25 bp, Homo sapien
cgaagaggaaggctctcggctcctg

SEQ ID NO: 161036 - DNA, 25 bp, Homo sapien
gactccttggaactggcttagcgca

SEQ ID NO: 161037 - DNA, 25 bp, Homo sapien
cagtcccattctgggaaaactcctc

SEQ ID NO: 161038 - DNA, 25 bp, Homo sapien
cgtgttttcccgtcagtcccattct

SEQ ID NO: 161039 - DNA, 25 bp, Homo sapien
tccatctccacgttgagcggggcca

SEQ ID NO: 161040 - DNA, 25 bp, Homo sapien
gaacttgttgtttagcgccttgatc

SEQ ID NO: 161041 - DNA, 25 bp, Homo sapien
tgcccgaggactcaccttgtcgatg

SEQ ID NO: 161042 - DNA, 25 bp, Homo sapien
agaggctcttgctgccaaaggaggc

SEQ ID NO: 161043 - DNA, 25 bp, Homo sapien
caaaggaggccgagcccttgacccg

SEQ ID NO: 161044 - DNA, 25 bp, Homo sapien
cgatcccgccagagaggaccgcgga

SEQ ID NO: 161045 - DNA, 25 bp, Homo sapien
ctcatggctcgcaagtaccggtgct

SEQ ID NO: 161046 - DNA, 25 bp, Homo sapien
gaggctcttgttgacggtgacctga

SEQ ID NO: 161047 - DNA, 25 bp, Homo sapien
catccttcgcggcaactttcgggct

SEQ ID NO: 161048 - DNA, 25 bp, Homo sapien
caactttcgggctgctgcgatgcca

SEQ ID NO: 161049 - DNA, 25 bp, Homo sapien
ctccggggcacaggtcagaagcagc

SEQ ID NO: 161050 - DNA, 25 bp, Homo sapien
gttgagggtttaccgcctactcatc

SEQ ID NO: 161051 - DNA, 25 bp, Homo sapien
ttcagaatttgtggcgggaccgcca

SEQ ID NO: 161052 - DNA, 25 bp, Homo sapien
accgccagctctaggaggagctttg

SEQ ID NO: 161053 - DNA, 25 bp, Homo sapien
gtggccagtctctgcaaagacggtc

SEQ ID NO: 161054 - DNA, 25 bp, Homo sapien
tgctgcgatgccagcagtctgggaa

SEQ ID NO: 161055 - DNA, 25 bp, Homo sapien
tgctgatgcgtgctctttatctgga

SEQ ID NO: 161056 - DNA, 25 bp, Homo sapien
ctgcgatgctgatgcgtgctcttta

SEQ ID NO: 161057 - DNA, 25 bp, Homo sapien
cccgccactgactccatagcgggcg

SEQ ID NO: 161058 - DNA, 25 bp, Homo sapien
cgccccggttgctggccgagctgaa

SEQ ID NO: 161059 - DNA, 25 bp, Homo sapien
agaacttgatgctgccgccccggtt

SEQ ID NO: 161060 - DNA, 25 bp, Homo sapien
tctttatctggagtagcgctgggag

SEQ ID NO: 161061 - DNA, 25 bp, Homo sapien
ctgatgcgtgctctttatctggagt

SEQ ID NO: 161062 - DNA, 25 bp, Homo sapien
cgatgctgatgcgtgctctttatct

SEQ ID NO: 161063 - DNA, 25 bp, Homo sapien
gattggctgggcccgagcgctccca

SEQ ID NO: 161064 - DNA, 25 bp, Homo sapien
ccgctccgcggtgactcatccagca

SEQ ID NO: 161065 - DNA, 25 bp, Homo sapien
aagtagagaccatggagtctggctg

SEQ ID NO: 161066 - DNA, 25 bp, Homo sapien
tctctccagaagtagagaccatgga

SEQ ID NO: 161067 - DNA, 25 bp, Homo sapien
agcctctctccagaagtagagacca

SEQ ID NO: 161068 - DNA, 25 bp, Homo sapien
tgagagccctgtgctccgtcaccga

SEQ ID NO: 161069 - DNA, 25 bp, Homo sapien
gagctgagacgtctccgctcggttc

SEQ ID NO: 161070 - DNA, 25 bp, Homo sapien
agacccgcccgctaagccgggagag

SEQ ID NO: 161071 - DNA, 25 bp, Homo sapien
gagagacaaaggcaccggacccgtc

SEQ ID NO: 161072 - DNA, 25 bp, Homo sapien
ggagcgccgagtcccaaacgccgag

SEQ ID NO: 161073 - DNA, 25 bp, Homo sapien
gcggcgtgcggacttcctcctggac

SEQ ID NO: 161074 - DNA, 25 bp, Homo sapien
cctcctggactagcctggaatcctg

SEQ ID NO: 161075 - DNA, 25 bp, Homo sapien
gctttaagtgctgccgcgcacagga

SEQ ID NO: 161076 - DNA, 25 bp, Homo sapien
ccgggactgcgttgagacagtcgcc

SEQ ID NO: 161077 - DNA, 25 bp, Homo sapien
gaccctcacgttcggaacgcggctg

SEQ ID NO: 161078 - DNA, 25 bp, Homo sapien
gctcgacgctgctccaaggacagca

SEQ ID NO: 161079 - DNA, 25 bp, Homo sapien
tgtctgctgccggcttgcctgtcct

SEQ ID NO: 161080 - DNA, 25 bp, Homo sapien
acctgctggaaaggccggagccggc

SEQ ID NO: 161081 - DNA, 25 bp, Homo sapien
agcgcggggcaatgtggcgccctct

SEQ ID NO: 161082 - DNA, 25 bp, Homo sapien
ctcggagccgctggctcacaggcgg

SEQ ID NO: 161083 - DNA, 25 bp, Homo sapien
gcgagggcctcagcagtctccagga

SEQ ID NO: 161084 - DNA, 25 bp, Homo sapien
aggacagagagtggaacccgccacc

SEQ ID NO: 161085 - DNA, 25 bp, Homo sapien
tctccaggacagagagtggaacccg

SEQ ID NO: 161086 - DNA, 25 bp, Homo sapien
cccaggcccgtgcaggcgtggacct

SEQ ID NO: 161087 - DNA, 25 bp, Homo sapien
ccggggtatgactcattctgtgacc

SEQ ID NO: 161088 - DNA, 25 bp, Homo sapien
atcctgcatgggctttccgaggcca

SEQ ID NO: 161089 - DNA, 25 bp, Homo sapien
ggcgaccgcgttatctgaagccata

SEQ ID NO: 161090 - DNA, 25 bp, Homo sapien
gactttgaatcctgcatgggctttc

SEQ ID NO: 161091 - DNA, 25 bp, Homo sapien
acgcccgcagactttgaatcctgca

SEQ ID NO: 161092 - DNA, 25 bp, Homo sapien
gaagccataaacttaacaggacgta

SEQ ID NO: 161093 - DNA, 25 bp, Homo sapien
cgcgttatctgaagccataaactta

SEQ ID NO: 161094 - DNA, 25 bp, Homo sapien
gagagcgtcccgagactgctgcccg

SEQ ID NO: 161095 - DNA, 25 bp, Homo sapien
gctccggcttccgaagcggctccgg

SEQ ID NO: 161096 - DNA, 25 bp, Homo sapien
cggggcctcactctgcgatataact

SEQ ID NO: 161097 - DNA, 25 bp, Homo sapien
gggcctcactctgcgatataactcg

SEQ ID NO: 161098 - DNA, 25 bp, Homo sapien
ctcactctgcgatataactcgggtc

SEQ ID NO: 161099 - DNA, 25 bp, Homo sapien
tgcgatataactcgggtcgcgcggc

SEQ ID NO: 161100 - DNA, 25 bp, Homo sapien
tccacctgtggctccggcttccgaa

SEQ ID NO: 161101 - DNA, 25 bp, Homo sapien
caccgtcgtccgcaaagcctgagtc

SEQ ID NO: 161102 - DNA, 25 bp, Homo sapien
ctctgcgatataactcgggtcgcgc

SEQ ID NO: 161103 - DNA, 25 bp, Homo sapien
tgggaagccgctatcctgcccatac

SEQ ID NO: 161104 - DNA, 25 bp, Homo sapien
ccggctctgggaagccgctatcctg

SEQ ID NO: 161105 - DNA, 25 bp, Homo sapien
taaagatctcgcagtgaggttaggg

SEQ ID NO: 161106 - DNA, 25 bp, Homo sapien
gactctactcgagggaggatccgag

SEQ ID NO: 161107 - DNA, 25 bp, Homo sapien
cgcgcgctcccattgggtggtgcct

SEQ ID NO: 161108 - DNA, 25 bp, Homo sapien
ctcctccttaaagatctcgcagtga

SEQ ID NO: 161109 - DNA, 25 bp, Homo sapien
gtggactctactcgagggaggatcc

SEQ ID NO: 161110 - DNA, 25 bp, Homo sapien
ccttaaagatctcgcagtgaggtta

SEQ ID NO: 161111 - DNA, 25 bp, Homo sapien
cctccgagcgtgatccactgatttc

SEQ ID NO: 161112 - DNA, 25 bp, Homo sapien
gcgcggacgagtgcacattagacta

SEQ ID NO: 161113 - DNA, 25 bp, Homo sapien
gcgctcgcgtgtagccctacgtaaa

SEQ ID NO: 161114 - DNA, 25 bp, Homo sapien
cgcgcccgctataatcacgtgattg

SEQ ID NO: 161115 - DNA, 25 bp, Homo sapien
gctggcactggttcctttctgaatt

SEQ ID NO: 161116 - DNA, 25 bp, Homo sapien
ttcaccctttctgcgcgagattgga

SEQ ID NO: 161117 - DNA, 25 bp, Homo sapien
cgaggccttttcgtagacgtgaatc

SEQ ID NO: 161118 - DNA, 25 bp, Homo sapien
cgccgcgcagctttacgaacctaga

SEQ ID NO: 161119 - DNA, 25 bp, Homo sapien
tgcctgtgtcccgccgggtcaggct

SEQ ID NO: 161120 - DNA, 25 bp, Homo sapien
acttcctgtctccagtatgtccctg

SEQ ID NO: 161121 - DNA, 25 bp, Homo sapien
gtctccagtatgtccctggcgcggc

SEQ ID NO: 161122 - DNA, 25 bp, Homo sapien
ccaccgtttcttctgcgtctgtctg

SEQ ID NO: 161123 - DNA, 25 bp, Homo sapien
ctggctcgcgtgtttctttctgcct

SEQ ID NO: 161124 - DNA, 25 bp, Homo sapien
cttgttcctagtcccttctagacct

SEQ ID NO: 161125 - DNA, 25 bp, Homo sapien
cgtttcttctgcgtctgtctggctc

SEQ ID NO: 161126 - DNA, 25 bp, Homo sapien
gtctgtctggctcgcgtgtttcttt

SEQ ID NO: 161127 - DNA, 25 bp, Homo sapien
caccgagcgaagtggggtcctccag

SEQ ID NO: 161128 - DNA, 25 bp, Homo sapien
cggcaagggtttccgactgtgtgac

SEQ ID NO: 161129 - DNA, 25 bp, Homo sapien
agcatctcgcacagtccgcccgaaa

SEQ ID NO: 161130 - DNA, 25 bp, Homo sapien
gaaggcgggatcatagcacctcgga

SEQ ID NO: 161131 - DNA, 25 bp, Homo sapien
cttcctctaacgcaggggacccagc

SEQ ID NO: 161132 - DNA, 25 bp, Homo sapien
ccgctcagccctgcgatccttctcc

SEQ ID NO: 161133 - DNA, 25 bp, Homo sapien
gatggctccgaggaagaccgtttca

SEQ ID NO: 161134 - DNA, 25 bp, Homo sapien
ctccgaggaagaccgtttcagaaag

SEQ ID NO: 161135 - DNA, 25 bp, Homo sapien
cacgccttccagcacccggggcgca

SEQ ID NO: 161136 - DNA, 25 bp, Homo sapien
cctttcctgcttcacatgtgggaca

SEQ ID NO: 161137 - DNA, 25 bp, Homo sapien
ggccgcacgccgtgccacacacgca

SEQ ID NO: 161138 - DNA, 25 bp, Homo sapien
aagcgggcacagatgaggctgattc

SEQ ID NO: 161139 - DNA, 25 bp, Homo sapien
cagatgaggctgattcgactcgcca

SEQ ID NO: 161140 - DNA, 25 bp, Homo sapien
atgaggctgattcgactcgccagcc

SEQ ID NO: 161141 - DNA, 25 bp, Homo sapien
atcctccagacccttctgggaacac

SEQ ID NO: 161142 - DNA, 25 bp, Homo sapien
tcacatgtgggacagaggccgtaag

SEQ ID NO: 161143 - DNA, 25 bp, Homo sapien
ctgggacttagacctcacctacgtg

SEQ ID NO: 161144 - DNA, 25 bp, Homo sapien
gtccagatgggcgaggctaatcact

SEQ ID NO: 161145 - DNA, 25 bp, Homo sapien
ctgcgttcatgcgtaggctcctcct

SEQ ID NO: 161146 - DNA, 25 bp, Homo sapien
gcgaggctaatcactgacgtcacca

SEQ ID NO: 161147 - DNA, 25 bp, Homo sapien
tcacctacgtgacggagcgcatctt

SEQ ID NO: 161148 - DNA, 25 bp, Homo sapien
agctggcccatgtgctgcaatccaa

SEQ ID NO: 161149 - DNA, 25 bp, Homo sapien
tccaagcaccgggacaagtacctgg

SEQ ID NO: 161150 - DNA, 25 bp, Homo sapien
ggccatcaggagtccgccaatgaga

SEQ ID NO: 161151 - DNA, 25 bp, Homo sapien
gtgcagcaacagaagaagcccagtg

SEQ ID NO: 161152 - DNA, 25 bp, Homo sapien
gcacggcctgatcactgagatgaga

SEQ ID NO: 161153 - DNA, 25 bp, Homo sapien
agaaggtggccacgctcgcacaaac

SEQ ID NO: 161154 - DNA, 25 bp, Homo sapien
cggtctggtcaacccggctgttgct

SEQ ID NO: 161155 - DNA, 25 bp, Homo sapien
gggcacctgcaggagccaatcggaa

SEQ ID NO: 161156 - DNA, 25 bp, Homo sapien
ccttccgcttcaggctccggggaga

SEQ ID NO: 161157 - DNA, 25 bp, Homo sapien
atcactgagatgagacccgggagca

SEQ ID NO: 161158 - DNA, 25 bp, Homo sapien
agcaacggcctctgacgacgggcac

SEQ ID NO: 161159 - DNA, 25 bp, Homo sapien
gagctctgtgcggaaccgcgtccag

SEQ ID NO: 161160 - DNA, 25 bp, Homo sapien
gccgactcactgacacatcacaatg

SEQ ID NO: 161161 - DNA, 25 bp, Homo sapien
atgagtcacgtgctctgtgcaccgg

SEQ ID NO: 161162 - DNA, 25 bp, Homo sapien
tgcaccgggcggatttgtcagatcc

SEQ ID NO: 161163 - DNA, 25 bp, Homo sapien
ttgtcagatccgctgctgcatcacg

SEQ ID NO: 161164 - DNA, 25 bp, Homo sapien
ctgcatcacggctcggcagggctct

SEQ ID NO: 161165 - DNA, 25 bp, Homo sapien
agtgccctcctaggtctgcaatgca

SEQ ID NO: 161166 - DNA, 25 bp, Homo sapien
tgacgctgctcagataaaccctggc

SEQ ID NO: 161167 - DNA, 25 bp, Homo sapien
tgggtggcccggcaagcctttccgc

SEQ ID NO: 161168 - DNA, 25 bp, Homo sapien
aagctgagggctgtctcaggaggga

SEQ ID NO: 161169 - DNA, 25 bp, Homo sapien
ccaaggacgacgaggcgcctttgcg

SEQ ID NO: 161170 - DNA, 25 bp, Homo sapien
cgcccaaggacgacgaggcgccttt

SEQ ID NO: 161171 - DNA, 25 bp, Homo sapien
gactgcagtgccatccgcccaagga

SEQ ID NO: 161172 - DNA, 25 bp, Homo sapien
tgcggggtctacacccctaactgcg

SEQ ID NO: 161173 - DNA, 25 bp, Homo sapien
caggagtgcggggtctacaccccta

SEQ ID NO: 161174 - DNA, 25 bp, Homo sapien
cgcgcctgctggtgagtccgcgccc

SEQ ID NO: 161175 - DNA, 25 bp, Homo sapien
tcgtccgtacagacggcagcgcttc

SEQ ID NO: 161176 - DNA, 25 bp, Homo sapien
ttcaaggagtctgaaccagctcacc

SEQ ID NO: 161177 - DNA, 25 bp, Homo sapien
tggtgtttgtaaacttgcctcggtc

SEQ ID NO: 161178 - DNA, 25 bp, Homo sapien
gctagtctagctgccgagcccggaa

SEQ ID NO: 161179 - DNA, 25 bp, Homo sapien
tacaatcatcgaagggccgagggtc

SEQ ID NO: 161180 - DNA, 25 bp, Homo sapien
atcgagcacccagcgtacaatcatc

SEQ ID NO: 161181 - DNA, 25 bp, Homo sapien
gcgcttcagtagctcgcaagccgtg

SEQ ID NO: 161182 - DNA, 25 bp, Homo sapien
tgggcactgccagtcccgtttctgc

SEQ ID NO: 161183 - DNA, 25 bp, Homo sapien
tctgctcagcaagaaaaggcgcgtc

SEQ ID NO: 161184 - DNA, 25 bp, Homo sapien
acgcgttccaggtcgtccttcatgg

SEQ ID NO: 161185 - DNA, 25 bp, Homo sapien
tcaggtccataaggtagtacaggtc

SEQ ID NO: 161186 - DNA, 25 bp, Homo sapien
accgggtatccctcagcacgaagga

SEQ ID NO: 161187 - DNA, 25 bp, Homo sapien
tctcccgacgcggtgaagttctgct

SEQ ID NO: 161188 - DNA, 25 bp, Homo sapien
tcggctcaccaatgcgcacagaatg

SEQ ID NO: 161189 - DNA, 25 bp, Homo sapien
gtcagcagagcgcattggaacgcca

SEQ ID NO: 161190 - DNA, 25 bp, Homo sapien
tccttcatggagtagctcaggtcca

SEQ ID NO: 161191 - DNA, 25 bp, Homo sapien
aaaagtgcattcctgcggctcggcg

SEQ ID NO: 161192 - DNA, 25 bp, Homo sapien
gctcccgccgtgaactctctgggaa

SEQ ID NO: 161193 - DNA, 25 bp, Homo sapien
cagctcttatctgggtgcttcggca

SEQ ID NO: 161194 - DNA, 25 bp, Homo sapien
gctagcactggggagacctttttta

SEQ ID NO: 161195 - DNA, 25 bp, Homo sapien
cgcgcgcgcttgcttagacacacat

SEQ ID NO: 161196 - DNA, 25 bp, Homo sapien
caccttgctcgggagaatgcttgca

SEQ ID NO: 161197 - DNA, 25 bp, Homo sapien
cgcttcagggccgaaaagtgcattc

SEQ ID NO: 161198 - DNA, 25 bp, Homo sapien
gcaggcatactctccacagctcata

SEQ ID NO: 161199 - DNA, 25 bp, Homo sapien
aaaccgcacactgactctgcaggcg

SEQ ID NO: 161200 - DNA, 25 bp, Homo sapien
cgcacactgactctgcaggcgggga

SEQ ID NO: 161201 - DNA, 25 bp, Homo sapien
atatccgacacattttctcccaaac

SEQ ID NO: 161202 - DNA, 25 bp, Homo sapien
agcgtcgcaatgtccggggctcgcc

SEQ ID NO: 161203 - DNA, 25 bp, Homo sapien
ctcttggatggagcgtcgcaatgtc

SEQ ID NO: 161204 - DNA, 25 bp, Homo sapien
gcagtctcttggatggagcgtcgca

SEQ ID NO: 161205 - DNA, 25 bp, Homo sapien
aggtcccggcgtcgggcagtctctt

SEQ ID NO: 161206 - DNA, 25 bp, Homo sapien
ccgcctgactcacctggagtgggag

SEQ ID NO: 161207 - DNA, 25 bp, Homo sapien
aacccttggctctaccggactgcgg

SEQ ID NO: 161208 - DNA, 25 bp, Homo sapien
cttaggaagctccaacccttggctc

SEQ ID NO: 161209 - DNA, 25 bp, Homo sapien
cagcggtgctgttccttaggaagct

SEQ ID NO: 161210 - DNA, 25 bp, Homo sapien
cccgagcactgcacggaagaaaaga

SEQ ID NO: 161211 - DNA, 25 bp, Homo sapien
attggcacttatttcagggtggccc

SEQ ID NO: 161212 - DNA, 25 bp, Homo sapien
tgcgggcatctttcccgagcactgc

SEQ ID NO: 161213 - DNA, 25 bp, Homo sapien
gggcctctgagatgcacacgcatga

SEQ ID NO: 161214 - DNA, 25 bp, Homo sapien
cgcatgaccctgaagcaactcgaga

SEQ ID NO: 161215 - DNA, 25 bp, Homo sapien
agagcggaatcgtccttttataacg

SEQ ID NO: 161216 - DNA, 25 bp, Homo sapien
tacgtgctgaagtgaaggggatccc

SEQ ID NO: 161217 - DNA, 25 bp, Homo sapien
tgtacctaggaaagagggcgagctc

SEQ ID NO: 161218 - DNA, 25 bp, Homo sapien
gtcaggcggttaagtcctgtaccta

SEQ ID NO: 161219 - DNA, 25 bp, Homo sapien
ggttacattttggatcctcgcggag

SEQ ID NO: 161220 - DNA, 25 bp, Homo sapien
tggcagccgcggatatttgaaagga

SEQ ID NO: 161221 - DNA, 25 bp, Homo sapien
cagcgcggcgggtaaactacaactc

SEQ ID NO: 161222 - DNA, 25 bp, Homo sapien
tttataacgggagcacggcgtcctg

SEQ ID NO: 161223 - DNA, 25 bp, Homo sapien
ccaggcgatttcagagtcgcgagtc

SEQ ID NO: 161224 - DNA, 25 bp, Homo sapien
ctcgcgcccattggtcgaatgcaaa

SEQ ID NO: 161225 - DNA, 25 bp, Homo sapien
tcccattaaagatagtgtgtcattg

SEQ ID NO: 161226 - DNA, 25 bp, Homo sapien
cgcggcgcacttgtttaggcacaca

SEQ ID NO: 161227 - DNA, 25 bp, Homo sapien
ctgcagagcccttgacatttagcga

SEQ ID NO: 161228 - DNA, 25 bp, Homo sapien
agacctttcctctggcttgcttggg

SEQ ID NO: 161229 - DNA, 25 bp, Homo sapien
ccagcgctttccgttgaaggttctg

SEQ ID NO: 161230 - DNA, 25 bp, Homo sapien
ctcgggtaaaagagaccagcgcttt

SEQ ID NO: 161231 - DNA, 25 bp, Homo sapien
cccaacatggcgcagtctattaaca

SEQ ID NO: 161232 - DNA, 25 bp, Homo sapien
ggcgaaacctctatccgatcccagg

SEQ ID NO: 161233 - DNA, 25 bp, Homo sapien
cgcccggttccaagttggcagccta

SEQ ID NO: 161234 - DNA, 25 bp, Homo sapien
ttaacatcacggagctgaatctgcc

SEQ ID NO: 161235 - DNA, 25 bp, Homo sapien
ggcagcctacctttcccaggcgaaa

SEQ ID NO: 161236 - DNA, 25 bp, Homo sapien
cgttaagtcggccttcccaacatgg

SEQ ID NO: 161237 - DNA, 25 bp, Homo sapien
ctgccgcagctagaaatgctcaaga

SEQ ID NO: 161238 - DNA, 25 bp, Homo sapien
ttgctcgccgagagacttcctcttc

SEQ ID NO: 161239 - DNA, 25 bp, Homo sapien
ggagctgcttatgggacaccaattc

SEQ ID NO: 161240 - DNA, 25 bp, Homo sapien
aatcgggacgcacaatggcaccttc

SEQ ID NO: 161241 - DNA, 25 bp, Homo sapien
tccgcgaaaagtgaccctgggactg

SEQ ID NO: 161242 - DNA, 25 bp, Homo sapien
tggcattccgccaacagggtcactc

SEQ ID NO: 161243 - DNA, 25 bp, Homo sapien
gcctccctgaagtccagcattaatc

SEQ ID NO: 161244 - DNA, 25 bp, Homo sapien
gatcccgaaaaactcgcttcctgtg

SEQ ID NO: 161245 - DNA, 25 bp, Homo sapien
ggcaccgcatgctcggtccagagtc

SEQ ID NO: 161246 - DNA, 25 bp, Homo sapien
acgatcccgcagcaaactcatggca

SEQ ID NO: 161247 - DNA, 25 bp, Homo sapien
cgtcaggtgttctcggcggcctctc

SEQ ID NO: 161248 - DNA, 25 bp, Homo sapien
tgaatataaccgggagggagtgccc

SEQ ID NO: 161249 - DNA, 25 bp, Homo sapien
gctgccgtggtgaatataaccggga

SEQ ID NO: 161250 - DNA, 25 bp, Homo sapien
ccagctgccgtggtgaatataaccg

SEQ ID NO: 161251 - DNA, 25 bp, Homo sapien
ggcccagctgccgtggtgaatataa

SEQ ID NO: 161252 - DNA, 25 bp, Homo sapien
gcactcggctgcctaggtggtgtga

SEQ ID NO: 161253 - DNA, 25 bp, Homo sapien
cggtaacagcctggcctttgcttct

SEQ ID NO: 161254 - DNA, 25 bp, Homo sapien
ctctcggtaacagcctggcctttgc

SEQ ID NO: 161255 - DNA, 25 bp, Homo sapien
tcatcgcgccatcctgagacctgtg

SEQ ID NO: 161256 - DNA, 25 bp, Homo sapien
ggcggctgcttctcgcaacttcaaa

SEQ ID NO: 161257 - DNA, 25 bp, Homo sapien
aaggtcacacgcctcctggggattg

SEQ ID NO: 161258 - DNA, 25 bp, Homo sapien
aggcttcattgtttcccgagatttg

SEQ ID NO: 161259 - DNA, 25 bp, Homo sapien
cgagggttttccgagaagtgctgca

SEQ ID NO: 161260 - DNA, 25 bp, Homo sapien
ccgtttctctgtgcatcccgaggga

SEQ ID NO: 161261 - DNA, 25 bp, Homo sapien
ggggattggcgtctacacacacagc

SEQ ID NO: 161262 - DNA, 25 bp, Homo sapien
agtacagcctgattcctacctggca

SEQ ID NO: 161263 - DNA, 25 bp, Homo sapien
cgcaactcggttcccgggctagatt

SEQ ID NO: 161264 - DNA, 25 bp, Homo sapien
tgcccgtcaccagctcgttattgtg

SEQ ID NO: 161265 - DNA, 25 bp, Homo sapien
gggctctcatagctactgcccgtca

SEQ ID NO: 161266 - DNA, 25 bp, Homo sapien
agagcacatcttgccggttcgcagg

SEQ ID NO: 161267 - DNA, 25 bp, Homo sapien
caggacgtctgcagtcggcaaactc

SEQ ID NO: 161268 - DNA, 25 bp, Homo sapien
cgggacagacctccaaagcttcttc

SEQ ID NO: 161269 - DNA, 25 bp, Homo sapien
ctagattcgtatgcggacgggtacc

SEQ ID NO: 161270 - DNA, 25 bp, Homo sapien
tgtgctcatatagggtgacttgacc

SEQ ID NO: 161271 - DNA, 25 bp, Homo sapien
cgccgccgctatttgaagcggtttt

SEQ ID NO: 161272 - DNA, 25 bp, Homo sapien
cacgactgattgcagacccagggca

SEQ ID NO: 161273 - DNA, 25 bp, Homo sapien
ctcggatttcttcaaagcgcctttg

SEQ ID NO: 161274 - DNA, 25 bp, Homo sapien
cccagcccactaaagaagtcttcgg

SEQ ID NO: 161275 - DNA, 25 bp, Homo sapien
cctactttgggagtcgtcaccggag

SEQ ID NO: 161276 - DNA, 25 bp, Homo sapien
tgttcttcggctaactccgtggcgg

SEQ ID NO: 161277 - DNA, 25 bp, Homo sapien
tgccacagagtggtttttgttcttc

SEQ ID NO: 161278 - DNA, 25 bp, Homo sapien
cgcgcaggccgcttctaaaaggggc

SEQ ID NO: 161279 - DNA, 25 bp, Homo sapien
tgcggtcccgaccacaattgctggg

SEQ ID NO: 161280 - DNA, 25 bp, Homo sapien
ggcagctgcatatctgcggtcccga

SEQ ID NO: 161281 - DNA, 25 bp, Homo sapien
gaccacaattgctgggagtcgcgtc

SEQ ID NO: 161282 - DNA, 25 bp, Homo sapien
ctcttccgccgtagctttctcgagg

SEQ ID NO: 161283 - DNA, 25 bp, Homo sapien
gccgtagctttctcgaggctgcatc

SEQ ID NO: 161284 - DNA, 25 bp, Homo sapien
tcgaggctgcatccaagcttcttcc

SEQ ID NO: 161285 - DNA, 25 bp, Homo sapien
ttcctccggatcttgcagtgcccga

SEQ ID NO: 161286 - DNA, 25 bp, Homo sapien
cgccgcgccgattagagcccgagag

SEQ ID NO: 161287 - DNA, 25 bp, Homo sapien
tggtcgccgcctgctccaaggccct

SEQ ID NO: 161288 - DNA, 25 bp, Homo sapien
ccgaaaccttctgactactaacctg

SEQ ID NO: 161289 - DNA, 25 bp, Homo sapien
gactactaacctgtagatcccttta

SEQ ID NO: 161290 - DNA, 25 bp, Homo sapien
agatccctttagttccttagcagta

SEQ ID NO: 161291 - DNA, 25 bp, Homo sapien
gttccttagcagtattcacaaatgt

SEQ ID NO: 161292 - DNA, 25 bp, Homo sapien
cacaaatgtttttctactcacactt

SEQ ID NO: 161293 - DNA, 25 bp, Homo sapien
ccctctcgttacttttcacacttgg

SEQ ID NO: 161294 - DNA, 25 bp, Homo sapien
ctcgttacttttcacacttggattt

SEQ ID NO: 161295 - DNA, 25 bp, Homo sapien
gcttctcggtactggcctagccgta

SEQ ID NO: 161296 - DNA, 25 bp, Homo sapien
cccaggagatttccggcttctcggt

SEQ ID NO: 161297 - DNA, 25 bp, Homo sapien
cggaccagagtgattgattagtttg

SEQ ID NO: 161298 - DNA, 25 bp, Homo sapien
tttcctcctcagtcggaccagagtg

SEQ ID NO: 161299 - DNA, 25 bp, Homo sapien
tgtctaatcatcagtcgagcggcca

SEQ ID NO: 161300 - DNA, 25 bp, Homo sapien
cgagcggccacataattaccaatta

SEQ ID NO: 161301 - DNA, 25 bp, Homo sapien
ttaccaattaggcagtagcagaggc

SEQ ID NO: 161302 - DNA, 25 bp, Homo sapien
tgactaggaagagccgagactgcga

SEQ ID NO: 161303 - DNA, 25 bp, Homo sapien
ttgtcttcttcttagccggctcggg

SEQ ID NO: 161304 - DNA, 25 bp, Homo sapien
ttcgtcgcttgctagcagccgttgt

SEQ ID NO: 161305 - DNA, 25 bp, Homo sapien
cagccgttgtctcgctggtgcctac

SEQ ID NO: 161306 - DNA, 25 bp, Homo sapien
cgcctgcaggtaagcctaaaaattt

SEQ ID NO: 161307 - DNA, 25 bp, Homo sapien
cctctctatcgcaattcgtcgcttg

SEQ ID NO: 161308 - DNA, 25 bp, Homo sapien
ctacgctgtcaaaggagccgctcta

SEQ ID NO: 161309 - DNA, 25 bp, Homo sapien
agccgctctaggcttttgggaggcc

SEQ ID NO: 161310 - DNA, 25 bp, Homo sapien
ggaaggcttggacgacgcaatcgcc

SEQ ID NO: 161311 - DNA, 25 bp, Homo sapien
ggacagcttggtcaccagcaatgga

SEQ ID NO: 161312 - DNA, 25 bp, Homo sapien
caccagcaatggaaggacgaagccc

SEQ ID NO: 161313 - DNA, 25 bp, Homo sapien
acgaagcccaagtcaggaccgctga

SEQ ID NO: 161314 - DNA, 25 bp, Homo sapien
gcgctgcggcgtaaccatgacgact

SEQ ID NO: 161315 - DNA, 25 bp, Homo sapien
ggcccaagactctgggacgctctcg

SEQ ID NO: 161316 - DNA, 25 bp, Homo sapien
gaccacccagaaacaaggcccaaga

SEQ ID NO: 161317 - DNA, 25 bp, Homo sapien
taaccatgacgactgggcctgaggc

SEQ ID NO: 161318 - DNA, 25 bp, Homo sapien
cgcgtgaagtcaccaggacaagatt

SEQ ID NO: 161319 - DNA, 25 bp, Homo sapien
cccgtccctgctcggcttgaactcc

SEQ ID NO: 161320 - DNA, 25 bp, Homo sapien
cgcagcacaaaaggcggcgctgctg

SEQ ID NO: 161321 - DNA, 25 bp, Homo sapien
ctgtcacaggcgatgctcgtgcggt

SEQ ID NO: 161322 - DNA, 25 bp, Homo sapien
tgtccggatgcacgggtgtcagctt

SEQ ID NO: 161323 - DNA, 25 bp, Homo sapien
cgggtgtcagcttcagctttctgcc

SEQ ID NO: 161324 - DNA, 25 bp, Homo sapien
tcggcttgaactcccgctccttcca

SEQ ID NO: 161325 - DNA, 25 bp, Homo sapien
tccaggctcgtacctggcccgcctg

SEQ ID NO: 161326 - DNA, 25 bp, Homo sapien
atgcacgggtgtcagcttcagcttt

SEQ ID NO: 161327 - DNA, 25 bp, Homo sapien
gtgcgactgtctgcgggaaacctgc

SEQ ID NO: 161328 - DNA, 25 bp, Homo sapien
tccgccacgcggtgatggaagctga

SEQ ID NO: 161329 - DNA, 25 bp, Homo sapien
tactgtgcgactgtctgcgggaaac

SEQ ID NO: 161330 - DNA, 25 bp, Homo sapien
acgcggagcgaattaagtggagtga

SEQ ID NO: 161331 - DNA, 25 bp, Homo sapien
ctctttgttagcaagtttgcctttc

SEQ ID NO: 161332 - DNA, 25 bp, Homo sapien
cgggccgcctctttgttagcaagtt

SEQ ID NO: 161333 - DNA, 25 bp, Homo sapien
cagggccacccagcggcacacggcc

SEQ ID NO: 161334 - DNA, 25 bp, Homo sapien
cggcgcagcggctttcaaacctccc

SEQ ID NO: 161335 - DNA, 25 bp, Homo sapien
ttctcgcgatccaaaaggctccgtg

SEQ ID NO: 161336 - DNA, 25 bp, Homo sapien
aaccaatctcagtgcacctagggga

SEQ ID NO: 161337 - DNA, 25 bp, Homo sapien
gtacgcatgtccacagcttcacgga

SEQ ID NO: 161338 - DNA, 25 bp, Homo sapien
taccgattccttcagggcgaaaagc

SEQ ID NO: 161339 - DNA, 25 bp, Homo sapien
ctaggtgagccgtctcgtaccgatt

SEQ ID NO: 161340 - DNA, 25 bp, Homo sapien
gcctctccagctgcgacacagatgg

SEQ ID NO: 161341 - DNA, 25 bp, Homo sapien
tcccagaccgcaaagagccaggatc

SEQ ID NO: 161342 - DNA, 25 bp, Homo sapien
ggctccgtgcccaagtgagtcctta

SEQ ID NO: 161343 - DNA, 25 bp, Homo sapien
taatcccattcctcgaactggaggg

SEQ ID NO: 161344 - DNA, 25 bp, Homo sapien
tccaggaagcgccatattgatcccg

SEQ ID NO: 161345 - DNA, 25 bp, Homo sapien
tcaccttggcgatggccttccggta

SEQ ID NO: 161346 - DNA, 25 bp, Homo sapien
ttccggtagcgggtcaccgcctgct

SEQ ID NO: 161347 - DNA, 25 bp, Homo sapien
cctgctggatgaggctgaaaacttt

SEQ ID NO: 161348 - DNA, 25 bp, Homo sapien
ctgaaaactttcatgtggccgtccc

SEQ ID NO: 161349 - DNA, 25 bp, Homo sapien
agggcagggcacacaacaccgcgca

SEQ ID NO: 161350 - DNA, 25 bp, Homo sapien
ttgtcacttttaatcccattcctcg

SEQ ID NO: 161351 - DNA, 25 bp, Homo sapien
tctcccattggtcggctttggccta

SEQ ID NO: 161352 - DNA, 25 bp, Homo sapien
aactctcgcgagaagtcatgggtcc

SEQ ID NO: 161353 - DNA, 25 bp, Homo sapien
gctcggtcctacaatctgtctccag

SEQ ID NO: 161354 - DNA, 25 bp, Homo sapien
ccgtccaacacagactgggagggga

SEQ ID NO: 161355 - DNA, 25 bp, Homo sapien
agcgatctcccattagcgctcatcg

SEQ ID NO: 161356 - DNA, 25 bp, Homo sapien
cgctcggcaacgtaaaagcgatctc

SEQ ID NO: 161357 - DNA, 25 bp, Homo sapien
acttaccggctggtagctccgttgc

SEQ ID NO: 161358 - DNA, 25 bp, Homo sapien
ctcccgtcagatcatggactagcta

SEQ ID NO: 161359 - DNA, 25 bp, Homo sapien
cgatccgtaacgtggactgcggttt

SEQ ID NO: 161360 - DNA, 25 bp, Homo sapien
cggcacgcggaagagccaactctaa

SEQ ID NO: 161361 - DNA, 25 bp, Homo sapien
cacgcaaggtaagcgcctcaaagca

SEQ ID NO: 161362 - DNA, 25 bp, Homo sapien
ccaacgagtcgctcagccacggata

SEQ ID NO: 161363 - DNA, 25 bp, Homo sapien
ccacggatagagtgattgcaacata

SEQ ID NO: 161364 - DNA, 25 bp, Homo sapien
actccgcggagtaagccgatccgta

SEQ ID NO: 161365 - DNA, 25 bp, Homo sapien
taccgcgtttgggatctcggacttg

SEQ ID NO: 161366 - DNA, 25 bp, Homo sapien
cctggcgttcgagaggagaaactac

SEQ ID NO: 161367 - DNA, 25 bp, Homo sapien
ggccaatccatcttgcaggcgggcg

SEQ ID NO: 161368 - DNA, 25 bp, Homo sapien
cggaggaatttcaatgcggccaatc

SEQ ID NO: 161369 - DNA, 25 bp, Homo sapien
cgagtttaattatcctcgcggagga

SEQ ID NO: 161370 - DNA, 25 bp, Homo sapien
caggaatgtaattttgcccggatga

SEQ ID NO: 161371 - DNA, 25 bp, Homo sapien
cccgagcgacgccattacaggaatg

SEQ ID NO: 161372 - DNA, 25 bp, Homo sapien
ggccggcgataaaaaccgccgctga

SEQ ID NO: 161373 - DNA, 25 bp, Homo sapien
gcagcagctttacggtcccggagga

SEQ ID NO: 161374 - DNA, 25 bp, Homo sapien
caatgcggccaatccatcttgcagg

SEQ ID NO: 161375 - DNA, 25 bp, Homo sapien
tggcatattgttcgcggacggtcta

SEQ ID NO: 161376 - DNA, 25 bp, Homo sapien
gaattaacatcacatcggcggctgg

SEQ ID NO: 161377 - DNA, 25 bp, Homo sapien
ttaacatcacatcggcggctggcgc

SEQ ID NO: 161378 - DNA, 25 bp, Homo sapien
cggctggcgcgtgttcagatttaaa

SEQ ID NO: 161379 - DNA, 25 bp, Homo sapien
aaatggtggcatattgttcgcggac

SEQ ID NO: 161380 - DNA, 25 bp, Homo sapien
tcgcggacggtctagctcagaaccg

SEQ ID NO: 161381 - DNA, 25 bp, Homo sapien
tctagctcagaaccgcgagctcgca

SEQ ID NO: 161382 - DNA, 25 bp, Homo sapien
cgcgtgttcagatttaaatggtggc

SEQ ID NO: 161383 - DNA, 25 bp, Homo sapien
gcagaggctgcgcactttccttcct

SEQ ID NO: 161384 - DNA, 25 bp, Homo sapien
attacctgcgaggaggaaagacgca

SEQ ID NO: 161385 - DNA, 25 bp, Homo sapien
cagacataaattacctgcgaggagg

SEQ ID NO: 161386 - DNA, 25 bp, Homo sapien
catctgctccgctctcagacataaa

SEQ ID NO: 161387 - DNA, 25 bp, Homo sapien
attgctaaattacccgccatctgct

SEQ ID NO: 161388 - DNA, 25 bp, Homo sapien
cccgcacacggtaattgctaaatta

SEQ ID NO: 161389 - DNA, 25 bp, Homo sapien
gcttccatgtggaggcgcgagtccc

SEQ ID NO: 161390 - DNA, 25 bp, Homo sapien
gcggggaatctttggcttccatgtg

SEQ ID NO: 161391 - DNA, 25 bp, Homo sapien
ggagccctggctacccaagcattgc

SEQ ID NO: 161392 - DNA, 25 bp, Homo sapien
ctacggcgggagaaacaagaacatt

SEQ ID NO: 161393 - DNA, 25 bp, Homo sapien
ctcggagccaatcgccagagatcta

SEQ ID NO: 161394 - DNA, 25 bp, Homo sapien
cagagatctaatggctcctttggca

SEQ ID NO: 161395 - DNA, 25 bp, Homo sapien
gcagcgcggtggaacgttttaatta

SEQ ID NO: 161396 - DNA, 25 bp, Homo sapien
gcggactcattacggctgcagccaa

SEQ ID NO: 161397 - DNA, 25 bp, Homo sapien
agccaatttcatgccagcgccgagc

SEQ ID NO: 161398 - DNA, 25 bp, Homo sapien
gcagccaaagggacggacactcaca

SEQ ID NO: 161399 - DNA, 25 bp, Homo sapien
caggtccgagggcttcgaagatctg

SEQ ID NO: 161400 - DNA, 25 bp, Homo sapien
acgttggtgcgggacccaactcctg

SEQ ID NO: 161401 - DNA, 25 bp, Homo sapien
gcccgctgctttggcctccggagaa

SEQ ID NO: 161402 - DNA, 25 bp, Homo sapien
cagtctgcgcgaaagccaggtccga

SEQ ID NO: 161403 - DNA, 25 bp, Homo sapien
gcgtgtgcagctcgagcgttacaac

SEQ ID NO: 161404 - DNA, 25 bp, Homo sapien
ttccttctctccagtctgcgcgaaa

SEQ ID NO: 161405 - DNA, 25 bp, Homo sapien
cgttacaacgatgcaaagtgcggtc

SEQ ID NO: 161406 - DNA, 25 bp, Homo sapien
acttgccgcggcttcgagtagagac

SEQ ID NO: 161407 - DNA, 25 bp, Homo sapien
gcctgtcgcacaacgtgaacctgca

SEQ ID NO: 161408 - DNA, 25 bp, Homo sapien
tcagggcgccgtctatacggacatc

SEQ ID NO: 161409 - DNA, 25 bp, Homo sapien
cgtcgaaggctaccagcactgggct

SEQ ID NO: 161410 - DNA, 25 bp, Homo sapien
tgggctctctccaatggctgggaca

SEQ ID NO: 161411 - DNA, 25 bp, Homo sapien
agtcaggtgtactgctccaaggagc

SEQ ID NO: 161412 - DNA, 25 bp, Homo sapien
atctgctccgacacgttctctgtag

SEQ ID NO: 161413 - DNA, 25 bp, Homo sapien
ctgcccggccgagaatgaagcaatc

SEQ ID NO: 161414 - DNA, 25 bp, Homo sapien
ctctagggccaaggagttcgccttc

SEQ ID NO: 161415 - DNA, 25 bp, Homo sapien
tctctgagcgccaggtaaccatctg

SEQ ID NO: 161416 - DNA, 25 bp, Homo sapien
ccctacactaaggtgcagctgaagg

SEQ ID NO: 161417 - DNA, 25 bp, Homo sapien
cgcaagaaacgcgtgccctacacta

SEQ ID NO: 161418 - DNA, 25 bp, Homo sapien
tcatcaccaaagagaagcgccggcg

SEQ ID NO: 161419 - DNA, 25 bp, Homo sapien
gtcagcaaatcgaaagcgcctcatc

SEQ ID NO: 161420 - DNA, 25 bp, Homo sapien
tgtctccgctttgtaccataaccga

SEQ ID NO: 161421 - DNA, 25 bp, Homo sapien
ctgcgcgggtgcagaagagtattta

SEQ ID NO: 161422 - DNA, 25 bp, Homo sapien
atacgcggctagcaagttcatcacc

SEQ ID NO: 161423 - DNA, 25 bp, Homo sapien
taccttcctggagaaacggtgcgcc

SEQ ID NO: 161424 - DNA, 25 bp, Homo sapien
gctctgggcacctgtagtcacgaag

SEQ ID NO: 161425 - DNA, 25 bp, Homo sapien
cggactattccgtaggctctgggca

SEQ ID NO: 161426 - DNA, 25 bp, Homo sapien
ggtcgctctagctccgcaaattgtg

SEQ ID NO: 161427 - DNA, 25 bp, Homo sapien
cacccgtcccgcaagggcttttgag

SEQ ID NO: 161428 - DNA, 25 bp, Homo sapien
ttacccttcaagctcgagtcggttc

SEQ ID NO: 161429 - DNA, 25 bp, Homo sapien
gcatgtgtgtgaagatcatccctta

SEQ ID NO: 161430 - DNA, 25 bp, Homo sapien
tcctcagatatcagagccgcctctg

SEQ ID NO: 161431 - DNA, 25 bp, Homo sapien
ccgccacccggaaagcaatggtaca

SEQ ID NO: 161432 - DNA, 25 bp, Homo sapien
ctcagcggggttaccttctgcagaa

SEQ ID NO: 161433 - DNA, 25 bp, Homo sapien
tgctcacagcgctgccattactgtg

SEQ ID NO: 161434 - DNA, 25 bp, Homo sapien
ggagccgaggtcacttacaggatac

SEQ ID NO: 161435 - DNA, 25 bp, Homo sapien
actcacctgtctccgcgaggaaaga

SEQ ID NO: 161436 - DNA, 25 bp, Homo sapien
tcacgggatccgtaaaacaatcgtc

SEQ ID NO: 161437 - DNA, 25 bp, Homo sapien
agggagccaagcttcgtgtgattgc

SEQ ID NO: 161438 - DNA, 25 bp, Homo sapien
ttacaggataccatcttcccgggcc

SEQ ID NO: 161439 - DNA, 25 bp, Homo sapien
cagagatgctctggcaactccgctc

SEQ ID NO: 161440 - DNA, 25 bp, Homo sapien
taacgcccataaaaggcggcctctc

SEQ ID NO: 161441 - DNA, 25 bp, Homo sapien
gacaagggcgctaataacgcccata

SEQ ID NO: 161442 - DNA, 25 bp, Homo sapien
tccagtctagacaagggcgctaata

SEQ ID NO: 161443 - DNA, 25 bp, Homo sapien
ggaggtgtcgtctccagtctagaca

SEQ ID NO: 161444 - DNA, 25 bp, Homo sapien
gtttacacacagaggaggtgtcgtc

SEQ ID NO: 161445 - DNA, 25 bp, Homo sapien
cgccgcctctgtttacacacagagg

SEQ ID NO: 161446 - DNA, 25 bp, Homo sapien
gcccttctctgataccttggcgagg

SEQ ID NO: 161447 - DNA, 25 bp, Homo sapien
ctcggcctgaccacctatagttttg

SEQ ID NO: 161448 - DNA, 25 bp, Homo sapien
ctgcatttttgtccgagcccggtta

SEQ ID NO: 161449 - DNA, 25 bp, Homo sapien
actccttgggatgcgagtccctcgc

SEQ ID NO: 161450 - DNA, 25 bp, Homo sapien
gacccagactgggagctgcattttt

SEQ ID NO: 161451 - DNA, 25 bp, Homo sapien
tagattttaagcgtctcacccgagc

SEQ ID NO: 161452 - DNA, 25 bp, Homo sapien
tcgccgaggctggatttagatttta

SEQ ID NO: 161453 - DNA, 25 bp, Homo sapien
ttttgcgcatggtcagcgaagtgcc

SEQ ID NO: 161454 - DNA, 25 bp, Homo sapien
aatcgctccacggtttgggtgcctc

SEQ ID NO: 161455 - DNA, 25 bp, Homo sapien
cggctctaactgaaggtggcggctt

SEQ ID NO: 161456 - DNA, 25 bp, Homo sapien
ccatggcttgccctaagttccgaca

SEQ ID NO: 161457 - DNA, 25 bp, Homo sapien
agttccgacaagtgcgcctaacgcg

SEQ ID NO: 161458 - DNA, 25 bp, Homo sapien
aggcaccgagctgcgagcttcgaac

SEQ ID NO: 161459 - DNA, 25 bp, Homo sapien
cccgcggggacacatttctgtcgga

SEQ ID NO: 161460 - DNA, 25 bp, Homo sapien
ttctgtcggagtgagcagctacggt

SEQ ID NO: 161461 - DNA, 25 bp, Homo sapien
cagctacggtttgggatatgaaatc

SEQ ID NO: 161462 - DNA, 25 bp, Homo sapien
aaccggccaagcagggcaagggaca

SEQ ID NO: 161463 - DNA, 25 bp, Homo sapien
ggcagcttggtatcgccgttgaacc

SEQ ID NO: 161464 - DNA, 25 bp, Homo sapien
ccggccactcaagcggcggattcaa

SEQ ID NO: 161465 - DNA, 25 bp, Homo sapien
tccctgctcaacgagggcaacaagg

SEQ ID NO: 161466 - DNA, 25 bp, Homo sapien
ggaatccgactccagttcgtccctg

SEQ ID NO: 161467 - DNA, 25 bp, Homo sapien
ctgcgctcggcttcaagtacgacta

SEQ ID NO: 161468 - DNA, 25 bp, Homo sapien
cgacaacgtgtgctccctgtcctgg

SEQ ID NO: 161469 - DNA, 25 bp, Homo sapien
cgctggtaaacatccacacgggaga

SEQ ID NO: 161470 - DNA, 25 bp, Homo sapien
taatctcctgaatcccgggtttgtg

SEQ ID NO: 161471 - DNA, 25 bp, Homo sapien
agcgcgcctatgctcagcctttggt

SEQ ID NO: 161472 - DNA, 25 bp, Homo sapien
ccctgtgagtgtgagagacctccaa

SEQ ID NO: 161473 - DNA, 25 bp, Homo sapien
gttgccactctagccgaggcctcga

SEQ ID NO: 161474 - DNA, 25 bp, Homo sapien
gacggcgctgccgattttccaagga

SEQ ID NO: 161475 - DNA, 25 bp, Homo sapien
ccctgtggcgaaggttgtgagacct

SEQ ID NO: 161476 - DNA, 25 bp, Homo sapien
tggagccgccaatcctctctgcatg

SEQ ID NO: 161477 - DNA, 25 bp, Homo sapien
tccaggaaagcagaagcggtttttc

SEQ ID NO: 161478 - DNA, 25 bp, Homo sapien
ccgcgcgagaaacgcactctggagc

SEQ ID NO: 161479 - DNA, 25 bp, Homo sapien
ggccgtggcatttctggtcttgtaa

SEQ ID NO: 161480 - DNA, 25 bp, Homo sapien
catcagactctttggggccttaaaa

SEQ ID NO: 161481 - DNA, 25 bp, Homo sapien
acaaagtgaaggtcaagttagcatc

SEQ ID NO: 161482 - DNA, 25 bp, Homo sapien
ggcatttctggtcttgtaaacatca

SEQ ID NO: 161483 - DNA, 25 bp, Homo sapien
ggtcaagttagcatcgtaccttata

SEQ ID NO: 161484 - DNA, 25 bp, Homo sapien
atcgtaccttataaggaaggcgccg

SEQ ID NO: 161485 - DNA, 25 bp, Homo sapien
tgtaaacatcagactctttggggcc

SEQ ID NO: 161486 - DNA, 25 bp, Homo sapien
gaaggcgccggtcctccatttcagc

SEQ ID NO: 161487 - DNA, 25 bp, Homo sapien
gtatccgccgcgacagcctttggcg

SEQ ID NO: 161488 - DNA, 25 bp, Homo sapien
attggatatttgctggtctagggga

SEQ ID NO: 161489 - DNA, 25 bp, Homo sapien
cgtgcggagaaacaaatatattgga

SEQ ID NO: 161490 - DNA, 25 bp, Homo sapien
cctggcgtgcggagaaacaaatata

SEQ ID NO: 161491 - DNA, 25 bp, Homo sapien
aagcaaagcgcataagggcccagtg

SEQ ID NO: 161492 - DNA, 25 bp, Homo sapien
ccgggcagctagcaaagaaagatgc

SEQ ID NO: 161493 - DNA, 25 bp, Homo sapien
gaaagatgctgcagtcggtggaact

SEQ ID NO: 161494 - DNA, 25 bp, Homo sapien
cggtggaactggaagcaaagcgcat

SEQ ID NO: 161495 - DNA, 25 bp, Homo sapien
gtttcttcgacaacgcctactgcgg

SEQ ID NO: 161496 - DNA, 25 bp, Homo sapien
acgactcgactttttacgatggaga

SEQ ID NO: 161497 - DNA, 25 bp, Homo sapien
gttcagcccactccgtggccaagga

SEQ ID NO: 161498 - DNA, 25 bp, Homo sapien
ccattgcgggcgatattaactttga

SEQ ID NO: 161499 - DNA, 25 bp, Homo sapien
ccgcggccttagtgcttgcctagaa

SEQ ID NO: 161500 - DNA, 25 bp, Homo sapien
tctccctcggtctgtgaaattttta

SEQ ID NO: 161501 - DNA, 25 bp, Homo sapien
tcaaactatgtgttcgcgggtcctc

SEQ ID NO: 161502 - DNA, 25 bp, Homo sapien
ccaggaccgctatgatccttcttaa

SEQ ID NO: 161503 - DNA, 25 bp, Homo sapien
ccgctgtagtattgctccttaaaaa

SEQ ID NO: 161504 - DNA, 25 bp, Homo sapien
agatgtcagctcctccgctgtagta

SEQ ID NO: 161505 - DNA, 25 bp, Homo sapien
tccgaactcgtacgcggagcccttg

SEQ ID NO: 161506 - DNA, 25 bp, Homo sapien
tagccggagcgcaggcatgtatatg

SEQ ID NO: 161507 - DNA, 25 bp, Homo sapien
gcctatcgcctggaacaacctgttg

SEQ ID NO: 161508 - DNA, 25 bp, Homo sapien
cctacccacctagtgtcaaggagga

SEQ ID NO: 161509 - DNA, 25 bp, Homo sapien
ctgttctggggccaacgacttcgaa

SEQ ID NO: 161510 - DNA, 25 bp, Homo sapien
gcgccgaacatctggaatcgcctca

SEQ ID NO: 161511 - DNA, 25 bp, Homo sapien
ctctgagatctctcgtcggctgctg

SEQ ID NO: 161512 - DNA, 25 bp, Homo sapien
acttcggctcggagatgcagccctt

SEQ ID NO: 161513 - DNA, 25 bp, Homo sapien
cgggcaaccgcatgttgagtctata

SEQ ID NO: 161514 - DNA, 25 bp, Homo sapien
ccgaccaatggtcacagcatgaaaa

SEQ ID NO: 161515 - DNA, 25 bp, Homo sapien
agcccttcccgagaacaggtgaaga

SEQ ID NO: 161516 - DNA, 25 bp, Homo sapien
atttggtccagaccaggttgcccgc

SEQ ID NO: 161517 - DNA, 25 bp, Homo sapien
aaggcgagccttggtctctgagatc

SEQ ID NO: 161518 - DNA, 25 bp, Homo sapien
acgtctgaactgaggccgaccaatg

SEQ ID NO: 161519 - DNA, 25 bp, Homo sapien
ctgcctcctcgcgaacttgggacga

SEQ ID NO: 161520 - DNA, 25 bp, Homo sapien
ggcctcgcagctgagtcattcggtc

SEQ ID NO: 161521 - DNA, 25 bp, Homo sapien
cggctaccgcatcacagctgacgtg

SEQ ID NO: 161522 - DNA, 25 bp, Homo sapien
acctcctcgcgtccgtaatcagtga

SEQ ID NO: 161523 - DNA, 25 bp, Homo sapien
tgacgaggtccgctacgtaaatccc

SEQ ID NO: 161524 - DNA, 25 bp, Homo sapien
ggacgagttggaaaatcctccctga

SEQ ID NO: 161525 - DNA, 25 bp, Homo sapien
cagtttagacgaaagcggacgcagc

SEQ ID NO: 161526 - DNA, 25 bp, Homo sapien
cccactttacgagcgcagtttagac

SEQ ID NO: 161527 - DNA, 25 bp, Homo sapien
tcacacttcgcagccggaggagcag

SEQ ID NO: 161528 - DNA, 25 bp, Homo sapien
gcgctcacacttcgcagccggagga

SEQ ID NO: 161529 - DNA, 25 bp, Homo sapien
tcctccacgttaccttgggcgtgta

SEQ ID NO: 161530 - DNA, 25 bp, Homo sapien
gcgtgtaggcttcccgtggacctgc

SEQ ID NO: 161531 - DNA, 25 bp, Homo sapien
ctctcagctgtcaagcagccgcctg

SEQ ID NO: 161532 - DNA, 25 bp, Homo sapien
cttagccggcctgactggtcgggct

SEQ ID NO: 161533 - DNA, 25 bp, Homo sapien
cccgattcaggctcccaaggtgggg

SEQ ID NO: 161534 - DNA, 25 bp, Homo sapien
cgagttccatgtgcggcagacacgc

SEQ ID NO: 161535 - DNA, 25 bp, Homo sapien
tcacacaaaagatcaggtaacaagg

SEQ ID NO: 161536 - DNA, 25 bp, Homo sapien
ccttaattgtacttcgggctcgtat

SEQ ID NO: 161537 - DNA, 25 bp, Homo sapien
tacttcgggctcgtattgtctctcc

SEQ ID NO: 161538 - DNA, 25 bp, Homo sapien
gctcgtattgtctctcctttcgcca

SEQ ID NO: 161539 - DNA, 25 bp, Homo sapien
tttccttgcgacacatacatcacac

SEQ ID NO: 161540 - DNA, 25 bp, Homo sapien
aggctggaaaaccagaccgcgttgg

SEQ ID NO: 161541 - DNA, 25 bp, Homo sapien
ggtaacaaggcgctcagggccactg

SEQ ID NO: 161542 - DNA, 25 bp, Homo sapien
agtcactgcaaatttccttgcgaca

SEQ ID NO: 161543 - DNA, 25 bp, Homo sapien
ttctcagatgagctaggagccgtcc

SEQ ID NO: 161544 - DNA, 25 bp, Homo sapien
ttgatccgcgccgtatttttgggta

SEQ ID NO: 161545 - DNA, 25 bp, Homo sapien
ggggcccatcagtaactattacgtg

SEQ ID NO: 161546 - DNA, 25 bp, Homo sapien
gtggactcgctcatctctcacgaca

SEQ ID NO: 161547 - DNA, 25 bp, Homo sapien
ctgtagcgattttccgtcctgtagc

SEQ ID NO: 161548 - DNA, 25 bp, Homo sapien
cctctcagtcgtccgtggtatatca

SEQ ID NO: 161549 - DNA, 25 bp, Homo sapien
ccgacacgcgctacatgcggacttg

SEQ ID NO: 161550 - DNA, 25 bp, Homo sapien
gcttcggggactggcattttcaccc

SEQ ID NO: 161551 - DNA, 25 bp, Homo sapien
cgttcgcggagatgttccaagccca

SEQ ID NO: 161552 - DNA, 25 bp, Homo sapien
tgggctacaaaccaggggtcaaaca

SEQ ID NO: 161553 - DNA, 25 bp, Homo sapien
ccaagcccagaaatgcgcctgaatg

SEQ ID NO: 161554 - DNA, 25 bp, Homo sapien
cgcggagatgttccaagcccagaaa

SEQ ID NO: 161555 - DNA, 25 bp, Homo sapien
aggggtcaaacagcctggagaagtc

SEQ ID NO: 161556 - DNA, 25 bp, Homo sapien
acagcctggagaagtccgagtccca

SEQ ID NO: 161557 - DNA, 25 bp, Homo sapien
agcctcggagcgtgcatccgcgttc

SEQ ID NO: 161558 - DNA, 25 bp, Homo sapien
cgcgagagggatgggctacaaacca

SEQ ID NO: 161559 - DNA, 25 bp, Homo sapien
caaatgaaagaacggtgagggatcc

SEQ ID NO: 161560 - DNA, 25 bp, Homo sapien
ctcggggagcgaaataaaccagata

SEQ ID NO: 161561 - DNA, 25 bp, Homo sapien
tcctttatttccaggctcggggagc

SEQ ID NO: 161562 - DNA, 25 bp, Homo sapien
aggatggctgctttcggttccttta

SEQ ID NO: 161563 - DNA, 25 bp, Homo sapien
taaatccgtggtacctatgagggcg

SEQ ID NO: 161564 - DNA, 25 bp, Homo sapien
tgacccggacaaacgaacataaatc

SEQ ID NO: 161565 - DNA, 25 bp, Homo sapien
gcaggcagcgcgtaattaacacaaa

SEQ ID NO: 161566 - DNA, 25 bp, Homo sapien
ggcaggcattaaaaataatcgcttt

SEQ ID NO: 161567 - DNA, 25 bp, Homo sapien
agcacgcttcgcaccacgttcaaga

SEQ ID NO: 161568 - DNA, 25 bp, Homo sapien
cggagacgcctccaaattctatggc

SEQ ID NO: 161569 - DNA, 25 bp, Homo sapien
cgcgagctctacctaccgacagtga

SEQ ID NO: 161570 - DNA, 25 bp, Homo sapien
gccgcgggttttcatgtacccagca

SEQ ID NO: 161571 - DNA, 25 bp, Homo sapien
agaacccgtgctcgcttagctgcca

SEQ ID NO: 161572 - DNA, 25 bp, Homo sapien
tacaaagccggcgagtccctggaac

SEQ ID NO: 161573 - DNA, 25 bp, Homo sapien
cctggaaccggcctattacgactgc

SEQ ID NO: 161574 - DNA, 25 bp, Homo sapien
ttacgactgccggttccctcagagc

SEQ ID NO: 161575 - DNA, 25 bp, Homo sapien
tctctttagaatcgcgtcctcccaa

SEQ ID NO: 161576 - DNA, 25 bp, Homo sapien
tactcgagatgccaggcatggagag

SEQ ID NO: 161577 - DNA, 25 bp, Homo sapien
gatgcgctctctttagaatcgcgtc

SEQ ID NO: 161578 - DNA, 25 bp, Homo sapien
agcgggatgcgctctctttagaatc

SEQ ID NO: 161579 - DNA, 25 bp, Homo sapien
ccggctttactcgagatgccaggca

SEQ ID NO: 161580 - DNA, 25 bp, Homo sapien
gctttactcgagatgccaggcatgg

SEQ ID NO: 161581 - DNA, 25 bp, Homo sapien
aacgtaattgtgagcgggatgcgct

SEQ ID NO: 161582 - DNA, 25 bp, Homo sapien
tagaatcgcgtcctcccaaatgctc

SEQ ID NO: 161583 - DNA, 25 bp, Homo sapien
tcagagaaaagaggcctaccggctt

SEQ ID NO: 161584 - DNA, 25 bp, Homo sapien
tgtgctcagagaaaagaggcctacc

SEQ ID NO: 161585 - DNA, 25 bp, Homo sapien
tcaaaagccatcttgtgctcagaga

SEQ ID NO: 161586 - DNA, 25 bp, Homo sapien
ggggatgctgtactcaaaagccatc

SEQ ID NO: 161587 - DNA, 25 bp, Homo sapien
agccgagaggagagcgtctgcccac

SEQ ID NO: 161588 - DNA, 25 bp, Homo sapien
cgcgactgctagagctcacacatgc

SEQ ID NO: 161589 - DNA, 25 bp, Homo sapien
gctgctctgggctaggacctgcctc

SEQ ID NO: 161590 - DNA, 25 bp, Homo sapien
ggcggggcctgttaattggcaatta

SEQ ID NO: 161591 - DNA, 25 bp, Homo sapien
cctggagtaatgtgggaatcgccga

SEQ ID NO: 161592 - DNA, 25 bp, Homo sapien
tcgctttccttgtttacgatcgaga

SEQ ID NO: 161593 - DNA, 25 bp, Homo sapien
tacgatcgagaaaagcgcttggctc

SEQ ID NO: 161594 - DNA, 25 bp, Homo sapien
ctctctttcgcctgcattttgtccg

SEQ ID NO: 161595 - DNA, 25 bp, Homo sapien
agggagcctttctcctggagtaatg

SEQ ID NO: 161596 - DNA, 25 bp, Homo sapien
gccgaccggtgaggcctctatttct

SEQ ID NO: 161597 - DNA, 25 bp, Homo sapien
tctgacgaggggctaatttcgcttt

SEQ ID NO: 161598 - DNA, 25 bp, Homo sapien
agtctgtgggacctgaaaagggcaa

SEQ ID NO: 161599 - DNA, 25 bp, Homo sapien
cgcggtaccagaccctggaactgga

SEQ ID NO: 161600 - DNA, 25 bp, Homo sapien
taatctcacatccactctctcgggg

SEQ ID NO: 161601 - DNA, 25 bp, Homo sapien
gaagtggaaaaaagaatctaatctc

SEQ ID NO: 161602 - DNA, 25 bp, Homo sapien
tgaccgagcgacagatcaaaatctg

SEQ ID NO: 161603 - DNA, 25 bp, Homo sapien
gcggccgccagatctactcgcggta

SEQ ID NO: 161604 - DNA, 25 bp, Homo sapien
acgcgctttgcctgaccgagcgaca

SEQ ID NO: 161605 - DNA, 25 bp, Homo sapien
actcgcggtaccagaccctggaact

SEQ ID NO: 161606 - DNA, 25 bp, Homo sapien
ctttgcctgaccgagcgacagatca

SEQ ID NO: 161607 - DNA, 25 bp, Homo sapien
gtgcgtgtgggatcgagttctcact

SEQ ID NO: 161608 - DNA, 25 bp, Homo sapien
cgttgcacatctcgcacacccttgc

SEQ ID NO: 161609 - DNA, 25 bp, Homo sapien
cacctgtgcgtgtgggatcgagttc

SEQ ID NO: 161610 - DNA, 25 bp, Homo sapien
cccgcgcacctgtgcgtgtgggatc

SEQ ID NO: 161611 - DNA, 25 bp, Homo sapien
ccacacccgggcgtgtgggatccac

SEQ ID NO: 161612 - DNA, 25 bp, Homo sapien
cgtgtgggatcgagttctcactgcg

SEQ ID NO: 161613 - DNA, 25 bp, Homo sapien
acacccttgcgcgtgggatccacag

SEQ ID NO: 161614 - DNA, 25 bp, Homo sapien
atctcgcacacccttgcgcgtggga

SEQ ID NO: 161615 - DNA, 25 bp, Homo sapien
gatcagtcggtttgggcaccaaccc

SEQ ID NO: 161616 - DNA, 25 bp, Homo sapien
gccaagctggctgttgcgaaacgta

SEQ ID NO: 161617 - DNA, 25 bp, Homo sapien
caggcctttcttcctgcctgtggca

SEQ ID NO: 161618 - DNA, 25 bp, Homo sapien
tgtcggcagggattgagcgattcaa

SEQ ID NO: 161619 - DNA, 25 bp, Homo sapien
aaaagccgcgtaggattttgttgcg

SEQ ID NO: 161620 - DNA, 25 bp, Homo sapien
cggccttctgttcgttctcgcgatc

SEQ ID NO: 161621 - DNA, 25 bp, Homo sapien
aattctgttaattcgctcgcccgcc

SEQ ID NO: 161622 - DNA, 25 bp, Homo sapien
gaagcactatccaggcaccagggtc

SEQ ID NO: 161623 - DNA, 25 bp, Homo sapien
aggccgtcgggaagtgactactcac

SEQ ID NO: 161624 - DNA, 25 bp, Homo sapien
tatcggaaactggtcgccaaggacg

SEQ ID NO: 161625 - DNA, 25 bp, Homo sapien
actgggcttgtatcggaaactggtc

SEQ ID NO: 161626 - DNA, 25 bp, Homo sapien
cctatctgcggaaactgggcttgta

SEQ ID NO: 161627 - DNA, 25 bp, Homo sapien
gcccatggacgcctatctgcggaaa

SEQ ID NO: 161628 - DNA, 25 bp, Homo sapien
tgcagcaggaccagcaacatggagg

SEQ ID NO: 161629 - DNA, 25 bp, Homo sapien
cggacagccatgcattaggcagggc

SEQ ID NO: 161630 - DNA, 25 bp, Homo sapien
gtgactactcactctcggggttttc

SEQ ID NO: 161631 - DNA, 25 bp, Homo sapien
tcgcctttcctctctatatttcggg

SEQ ID NO: 161632 - DNA, 25 bp, Homo sapien
ctgtgtgcgcccaaatttacgacga

SEQ ID NO: 161633 - DNA, 25 bp, Homo sapien
atagagatcgccaacaacttgtgtc

SEQ ID NO: 161634 - DNA, 25 bp, Homo sapien
aggacttcattttgcgctctcgggt

SEQ ID NO: 161635 - DNA, 25 bp, Homo sapien
gtccgcctgggttttataggccatg

SEQ ID NO: 161636 - DNA, 25 bp, Homo sapien
ggcatcaatggctcgtaaaactgtc

SEQ ID NO: 161637 - DNA, 25 bp, Homo sapien
ggtcccgaaccagttacacgcgcta

SEQ ID NO: 161638 - DNA, 25 bp, Homo sapien
cggatctcgagggtgcttattgttc

SEQ ID NO: 161639 - DNA, 25 bp, Homo sapien
gcttcggggaagtttataacacatc

SEQ ID NO: 161640 - DNA, 25 bp, Homo sapien
cgaggggccgcctgtaaattacagc

SEQ ID NO: 161641 - DNA, 25 bp, Homo sapien
accgcggcaggaccatttcgttgga

SEQ ID NO: 161642 - DNA, 25 bp, Homo sapien
gggaacgttttcctatcagagaata

SEQ ID NO: 161643 - DNA, 25 bp, Homo sapien
gccaggcctgaagggataacccaca

SEQ ID NO: 161644 - DNA, 25 bp, Homo sapien
ctccgggcttaatccagacctttca

SEQ ID NO: 161645 - DNA, 25 bp, Homo sapien
tctcgcgctgactggcgtaaagttg

SEQ ID NO: 161646 - DNA, 25 bp, Homo sapien
tgtggccgaattcgcatctcttctg

SEQ ID NO: 161647 - DNA, 25 bp, Homo sapien
agccctataaaagctgtagcgacga

SEQ ID NO: 161648 - DNA, 25 bp, Homo sapien
tagcgacgaggcaagcgctcctacc

SEQ ID NO: 161649 - DNA, 25 bp, Homo sapien
tgatttatgacgttttacagcccta

SEQ ID NO: 161650 - DNA, 25 bp, Homo sapien
ggcgattccgcgagactgatttatg

SEQ ID NO: 161651 - DNA, 25 bp, Homo sapien
ccgacacaaagagtgcgggcgattc

SEQ ID NO: 161652 - DNA, 25 bp, Homo sapien
tcacggcggcgatcataataataaa

SEQ ID NO: 161653 - DNA, 25 bp, Homo sapien
agattgactaatcacggcggcgatc

SEQ ID NO: 161654 - DNA, 25 bp, Homo sapien
cggcgaattaaaggtagattgacta

SEQ ID NO: 161655 - DNA, 25 bp, Homo sapien
cctagctaccctgagcgccagtata

SEQ ID NO: 161656 - DNA, 25 bp, Homo sapien
ccgagaaatcacagtcgctctgcga

SEQ ID NO: 161657 - DNA, 25 bp, Homo sapien
agtatagctgcaccagtctccaggg

SEQ ID NO: 161658 - DNA, 25 bp, Homo sapien
gaatcgggattccagcatcaccacc

SEQ ID NO: 161659 - DNA, 25 bp, Homo sapien
gccggaccagggaatcgggattcca

SEQ ID NO: 161660 - DNA, 25 bp, Homo sapien
tccctgaacacagtccggaatatta

SEQ ID NO: 161661 - DNA, 25 bp, Homo sapien
atccgaaatttcctccatgcgaaga

SEQ ID NO: 161662 - DNA, 25 bp, Homo sapien
attcgcaaaatagctacatccctga

SEQ ID NO: 161663 - DNA, 25 bp, Homo sapien
gacgaagtttcaagggccagcggca

SEQ ID NO: 161664 - DNA, 25 bp, Homo sapien
agtttcaagggccagcggcagccag

SEQ ID NO: 161665 - DNA, 25 bp, Homo sapien
aagggccagcggcagccaggctcct

SEQ ID NO: 161666 - DNA, 25 bp, Homo sapien
ttccacgccacgtccgccctgggcg

SEQ ID NO: 161667 - DNA, 25 bp, Homo sapien
cctgggcgcggtgtcgccttcagct

SEQ ID NO: 161668 - DNA, 25 bp, Homo sapien
ggtgtcgccttcagctgggtcacga

SEQ ID NO: 161669 - DNA, 25 bp, Homo sapien
cagccggggcaaagacgaagtttca

SEQ ID NO: 161670 - DNA, 25 bp, Homo sapien
agcgggttcactgcgcggtgaactc

SEQ ID NO: 161671 - DNA, 25 bp, Homo sapien
tgtccgattaggtatcgcagcgtcc

SEQ ID NO: 161672 - DNA, 25 bp, Homo sapien
attaggtatcgcagcgtcctccacc

SEQ ID NO: 161673 - DNA, 25 bp, Homo sapien
ttgctgttttgtccgattaggtatc

SEQ ID NO: 161674 - DNA, 25 bp, Homo sapien
cttattttattgctgttttgtccga

SEQ ID NO: 161675 - DNA, 25 bp, Homo sapien
cgcttccaccggtcttattttattg

SEQ ID NO: 161676 - DNA, 25 bp, Homo sapien
gcggcctggaacacaaaacctgggc

SEQ ID NO: 161677 - DNA, 25 bp, Homo sapien
cggcggcctggaacacaaaacctgg

SEQ ID NO: 161678 - DNA, 25 bp, Homo sapien
ccagccggtgcctgatcgcccggcg

SEQ ID NO: 161679 - DNA, 25 bp, Homo sapien
gccgctgggtcgtctggtttccgct

SEQ ID NO: 161680 - DNA, 25 bp, Homo sapien
ggctgcacacctgcgagatggcgga

SEQ ID NO: 161681 - DNA, 25 bp, Homo sapien
aggcaagtggagtcgctgaacttta

SEQ ID NO: 161682 - DNA, 25 bp, Homo sapien
gctttccgaaagaaatgagaggaga

SEQ ID NO: 161683 - DNA, 25 bp, Homo sapien
tggagtcgctgaactttaattaaac

SEQ ID NO: 161684 - DNA, 25 bp, Homo sapien
attaaaccgtagagaagacagtggg

SEQ ID NO: 161685 - DNA, 25 bp, Homo sapien
tttccgctttccgaaagaaatgaga

SEQ ID NO: 161686 - DNA, 25 bp, Homo sapien
taattaaaccgtagagaagacagtg

SEQ ID NO: 161687 - DNA, 25 bp, Homo sapien
agcagcgtggatccaagaagggatc

SEQ ID NO: 161688 - DNA, 25 bp, Homo sapien
aacagaaaccagtgtcttgggagag

SEQ ID NO: 161689 - DNA, 25 bp, Homo sapien
gagcagaggaagcccgcacctctgc

SEQ ID NO: 161690 - DNA, 25 bp, Homo sapien
acctctgccctaacctgaggctttg

SEQ ID NO: 161691 - DNA, 25 bp, Homo sapien
cagcgtggatccaagaagggatctg

SEQ ID NO: 161692 - DNA, 25 bp, Homo sapien
cagaagcagcgtggatccaagaagg

SEQ ID NO: 161693 - DNA, 25 bp, Homo sapien
ccaaacagaaaccagtgtcttggga

SEQ ID NO: 161694 - DNA, 25 bp, Homo sapien
tcccaaacagaaaccagtgtcttgg

SEQ ID NO: 161695 - DNA, 25 bp, Homo sapien
tcgtccagtcccaagctccggagga

SEQ ID NO: 161696 - DNA, 25 bp, Homo sapien
ggggaacactacctcgtgctgcgtg

SEQ ID NO: 161697 - DNA, 25 bp, Homo sapien
ggcttgaaccggaacctcttgccga

SEQ ID NO: 161698 - DNA, 25 bp, Homo sapien
ggctggagtcctaccggccagacac

SEQ ID NO: 161699 - DNA, 25 bp, Homo sapien
gcacatcagcgaccgggagaacata

SEQ ID NO: 161700 - DNA, 25 bp, Homo sapien
ggaatgcccactcccggctggagtc

SEQ ID NO: 161701 - DNA, 25 bp, Homo sapien
aacagtcgcacagccaacgtcgggg

SEQ ID NO: 161702 - DNA, 25 bp, Homo sapien
tctcggcgacccgtgcataaccggg

SEQ ID NO: 161703 - DNA, 25 bp, Homo sapien
tgaatgctctccctccggatcgctg

SEQ ID NO: 161704 - DNA, 25 bp, Homo sapien
gtggtccctcgtaccaatcgatcga

SEQ ID NO: 161705 - DNA, 25 bp, Homo sapien
tctgtccctcggctctggggagaaa

SEQ ID NO: 161706 - DNA, 25 bp, Homo sapien
gccctgatggccactcacgctatag

SEQ ID NO: 161707 - DNA, 25 bp, Homo sapien
gcgctcctcccggaatcgtttgaga

SEQ ID NO: 161708 - DNA, 25 bp, Homo sapien
aaatctagatgagcctgtccggagc

SEQ ID NO: 161709 - DNA, 25 bp, Homo sapien
gggtgcgattcagcccgagaacaat

SEQ ID NO: 161710 - DNA, 25 bp, Homo sapien
ggggcacaccagcacggcagaaact

SEQ ID NO: 161711 - DNA, 25 bp, Homo sapien
cccgacgttggccagtcagatctgt

SEQ ID NO: 161712 - DNA, 25 bp, Homo sapien
gcccggctactcactggattcgctt

SEQ ID NO: 161713 - DNA, 25 bp, Homo sapien
tgcacgcttatccatacgcgcgcgg

SEQ ID NO: 161714 - DNA, 25 bp, Homo sapien
gggacggagatgcaacctttacgaa

SEQ ID NO: 161715 - DNA, 25 bp, Homo sapien
ggattcgcttcccacataacggtga

SEQ ID NO: 161716 - DNA, 25 bp, Homo sapien
caaaatcgagcggagagagcctgtg

SEQ ID NO: 161717 - DNA, 25 bp, Homo sapien
ccggaactcaacacccagactgaag

SEQ ID NO: 161718 - DNA, 25 bp, Homo sapien
tccctgtcacaagccagcgtttaca

SEQ ID NO: 161719 - DNA, 25 bp, Homo sapien
gctgcattcggctttgggccataaa

SEQ ID NO: 161720 - DNA, 25 bp, Homo sapien
ctcgtcccgatagattgtcacggtc

SEQ ID NO: 161721 - DNA, 25 bp, Homo sapien
ggtcaggacagggaagatgtatttc

SEQ ID NO: 161722 - DNA, 25 bp, Homo sapien
cctctgggagcgcaagaacagtaac

SEQ ID NO: 161723 - DNA, 25 bp, Homo sapien
atttgcatacccagctgcgcacagc

SEQ ID NO: 161724 - DNA, 25 bp, Homo sapien
ccataaattcgtggctggcggctct

SEQ ID NO: 161725 - DNA, 25 bp, Homo sapien
tgagtaaccgctggatcagtcctgc

SEQ ID NO: 161726 - DNA, 25 bp, Homo sapien
cgggcagcgcgaatttgcatacatt

SEQ ID NO: 161727 - DNA, 25 bp, Homo sapien
gcgctttccttaggctgtccgtcta

SEQ ID NO: 161728 - DNA, 25 bp, Homo sapien
gacgctgctcagaaggggaaaaccc

SEQ ID NO: 161729 - DNA, 25 bp, Homo sapien
cactggctcagtgagacgctgctca

SEQ ID NO: 161730 - DNA, 25 bp, Homo sapien
gcgcttcctgctcactggctcagtg

SEQ ID NO: 161731 - DNA, 25 bp, Homo sapien
gagtcaaaccgctgcctcctggaga

SEQ ID NO: 161732 - DNA, 25 bp, Homo sapien
aggctgtccgtctactggttccaga

SEQ ID NO: 161733 - DNA, 25 bp, Homo sapien
attggacgactggtcccagcgcttt

SEQ ID NO: 161734 - DNA, 25 bp, Homo sapien
gttccagattcgttccatccgttta

SEQ ID NO: 161735 - DNA, 25 bp, Homo sapien
accttgccttggtgagcgagttttc

SEQ ID NO: 161736 - DNA, 25 bp, Homo sapien
gcgggactcgttactcgtagcaaaa

SEQ ID NO: 161737 - DNA, 25 bp, Homo sapien
agttaggcgcgctttcccacttgaa

SEQ ID NO: 161738 - DNA, 25 bp, Homo sapien
cagcttgctcctttctgcccgtgga

SEQ ID NO: 161739 - DNA, 25 bp, Homo sapien
acctcctggctgcttgtctaataca

SEQ ID NO: 161740 - DNA, 25 bp, Homo sapien
ctacacgtgcggtcaacaagagttc

SEQ ID NO: 161741 - DNA, 25 bp, Homo sapien
gcgcctgcgcaaaactcgccatttt

SEQ ID NO: 161742 - DNA, 25 bp, Homo sapien
tctcagaggcaggtggaacttctta

SEQ ID NO: 161743 - DNA, 25 bp, Homo sapien
ttgctcacagttttgcggaaggcga

SEQ ID NO: 161744 - DNA, 25 bp, Homo sapien
ttgacgatacggaaaccacggagtc

SEQ ID NO: 161745 - DNA, 25 bp, Homo sapien
ccatgaggtctaggaacttggatcg

SEQ ID NO: 161746 - DNA, 25 bp, Homo sapien
acttggatcggggaggctacagact

SEQ ID NO: 161747 - DNA, 25 bp, Homo sapien
gaggctacagactcggcgaatcctg

SEQ ID NO: 161748 - DNA, 25 bp, Homo sapien
gggcgaggcttctattgctttttgc

SEQ ID NO: 161749 - DNA, 25 bp, Homo sapien
gctgaagggttgacgatacggaaac

SEQ ID NO: 161750 - DNA, 25 bp, Homo sapien
actcggcgaatcctgcgaaggggaa

SEQ ID NO: 161751 - DNA, 25 bp, Homo sapien
tcttgtgacggctcagtagtgggtt

SEQ ID NO: 161752 - DNA, 25 bp, Homo sapien
agcggcgagcctgctgccgctgcca

SEQ ID NO: 161753 - DNA, 25 bp, Homo sapien
tggagaaagtcagcgtgccctgaag

SEQ ID NO: 161754 - DNA, 25 bp, Homo sapien
tcagcgtgccctgaagcgggcgaaa

SEQ ID NO: 161755 - DNA, 25 bp, Homo sapien
gaagagaagtcacccggcggtcctg

SEQ ID NO: 161756 - DNA, 25 bp, Homo sapien
ctccctgggcaaagcccgcgtccct

SEQ ID NO: 161757 - DNA, 25 bp, Homo sapien
ccctagacttcttgtgacggctcag

SEQ ID NO: 161758 - DNA, 25 bp, Homo sapien
cgcgccctcccactgctgaattccc

SEQ ID NO: 161759 - DNA, 25 bp, Homo sapien
cactcctaggaaagagcttgttctg

SEQ ID NO: 161760 - DNA, 25 bp, Homo sapien
agggatctgatcagtgtggtcattg

SEQ ID NO: 161761 - DNA, 25 bp, Homo sapien
tgtccattatccagacactcctagg

SEQ ID NO: 161762 - DNA, 25 bp, Homo sapien
gtggcttaccctgcgagaccctggg

SEQ ID NO: 161763 - DNA, 25 bp, Homo sapien
atcccgagattggttagggccgcgc

SEQ ID NO: 161764 - DNA, 25 bp, Homo sapien
tatccagtgtggtggcagtagtctg

SEQ ID NO: 161765 - DNA, 25 bp, Homo sapien
ccaagaatgtgggaagcagaggtca

SEQ ID NO: 161766 - DNA, 25 bp, Homo sapien
acctgacaggaagtctgaagatttg

SEQ ID NO: 161767 - DNA, 25 bp, Homo sapien
acccgggcactcagggctccgcgag

SEQ ID NO: 161768 - DNA, 25 bp, Homo sapien
ccctcagcaggtgaagacgggagga

SEQ ID NO: 161769 - DNA, 25 bp, Homo sapien
acccacagagaggaacccaggagcc

SEQ ID NO: 161770 - DNA, 25 bp, Homo sapien
accgaggatcatgctggggacccag

SEQ ID NO: 161771 - DNA, 25 bp, Homo sapien
cactcaccgaggatcatgctgggga

SEQ ID NO: 161772 - DNA, 25 bp, Homo sapien
agcctggagtcgcagagaccactca

SEQ ID NO: 161773 - DNA, 25 bp, Homo sapien
gtgacccacagagaggaacccagga

SEQ ID NO: 161774 - DNA, 25 bp, Homo sapien
tcgcagagaccactcaccgaggatc

SEQ ID NO: 161775 - DNA, 25 bp, Homo sapien
gtgcccgacttttcggccggctaca

SEQ ID NO: 161776 - DNA, 25 bp, Homo sapien
cccaggcgtacatccagggtgtcag

SEQ ID NO: 161777 - DNA, 25 bp, Homo sapien
ttcggggccttgcactactttctct

SEQ ID NO: 161778 - DNA, 25 bp, Homo sapien
cagcgtctatgtcctgcaccgagga

SEQ ID NO: 161779 - DNA, 25 bp, Homo sapien
cgccaatgtttgctacgacgtcttc

SEQ ID NO: 161780 - DNA, 25 bp, Homo sapien
caggagaggtttgtctgcaacacgc

SEQ ID NO: 161781 - DNA, 25 bp, Homo sapien
tgtcagggcacacgaagattccgga

SEQ ID NO: 161782 - DNA, 25 bp, Homo sapien
cggcccacagagaagtccctgctga

SEQ ID NO: 161783 - DNA, 25 bp, Homo sapien
agccgaccagctacaggaaaccagc

SEQ ID NO: 161784 - DNA, 25 bp, Homo sapien
ccctcgcctgaacagagattggggg

SEQ ID NO: 161785 - DNA, 25 bp, Homo sapien
cagcacccgcccttggctgagttcg

SEQ ID NO: 161786 - DNA, 25 bp, Homo sapien
gaccagctacaggaaaccagctttt

SEQ ID NO: 161787 - DNA, 25 bp, Homo sapien
attctgacgttcttggccccacgga

SEQ ID NO: 161788 - DNA, 25 bp, Homo sapien
ccagaagtcccggtctcagcacagc

SEQ ID NO: 161789 - DNA, 25 bp, Homo sapien
gctccagccgaccagctacaggaaa

SEQ ID NO: 161790 - DNA, 25 bp, Homo sapien
agccgccgtcctctctcgggtcttt

SEQ ID NO: 161791 - DNA, 25 bp, Homo sapien
tcactcacccgtctgttcccggccg

SEQ ID NO: 161792 - DNA, 25 bp, Homo sapien
ggccggtaaaactccactgagaatc

SEQ ID NO: 161793 - DNA, 25 bp, Homo sapien
cactgagaatccgaagaaggagccc

SEQ ID NO: 161794 - DNA, 25 bp, Homo sapien
gggcctccgcgtctaagttgaagcc

SEQ ID NO: 161795 - DNA, 25 bp, Homo sapien
catagcgcccgctcttccctgtcct

SEQ ID NO: 161796 - DNA, 25 bp, Homo sapien
ctaaacctcccagaggcgaatgact

SEQ ID NO: 161797 - DNA, 25 bp, Homo sapien
gagtttgccaaactcccggctgagc

SEQ ID NO: 161798 - DNA, 25 bp, Homo sapien
ggtccctggaactctgagcccgcgt

SEQ ID NO: 161799 - DNA, 25 bp, Homo sapien
agcagcgggaccgtgaactggatct

SEQ ID NO: 161800 - DNA, 25 bp, Homo sapien
aggcgctcttccttcggtcagtctc

SEQ ID NO: 161801 - DNA, 25 bp, Homo sapien
ggtcagtctcaaagaagcacagatt

SEQ ID NO: 161802 - DNA, 25 bp, Homo sapien
gcacagattcgagatgtggctccga

SEQ ID NO: 161803 - DNA, 25 bp, Homo sapien
cgcaaactgagcgttcgtcctcaaa

SEQ ID NO: 161804 - DNA, 25 bp, Homo sapien
ctcgtccttggctgggcgagtgccc

SEQ ID NO: 161805 - DNA, 25 bp, Homo sapien
ggctgttgtcttgctccatggctgg

SEQ ID NO: 161806 - DNA, 25 bp, Homo sapien
tcgtcctcaaaagggcgcactgcta

SEQ ID NO: 161807 - DNA, 25 bp, Homo sapien
gcatgaccacttcgggcaagccttt

SEQ ID NO: 161808 - DNA, 25 bp, Homo sapien
tatttgctcagaggggcatgaccac

SEQ ID NO: 161809 - DNA, 25 bp, Homo sapien
ttccttcggtgttgtcaggcagggt

SEQ ID NO: 161810 - DNA, 25 bp, Homo sapien
atgtgagtcagctttcggccgatcc

SEQ ID NO: 161811 - DNA, 25 bp, Homo sapien
atcccgctgaatggggaaaggcatt

SEQ ID NO: 161812 - DNA, 25 bp, Homo sapien
cagggttcgctagctgcagcttttt

SEQ ID NO: 161813 - DNA, 25 bp, Homo sapien
ctcgcatgcctgtggtatttgctca

SEQ ID NO: 161814 - DNA, 25 bp, Homo sapien
cgggcaagcctttaaatgtgagtca

SEQ ID NO: 161815 - DNA, 25 bp, Homo sapien
cgcaagcgcattcggcgatgccagg

SEQ ID NO: 161816 - DNA, 25 bp, Homo sapien
aagggaatcggcctgcatccgagac

SEQ ID NO: 161817 - DNA, 25 bp, Homo sapien
cagcagcgggaagccgcctaccggt

SEQ ID NO: 161818 - DNA, 25 bp, Homo sapien
gcgaagaaacccagcagcgggaagc

SEQ ID NO: 161819 - DNA, 25 bp, Homo sapien
ggctcggaagactagggctcctcag

SEQ ID NO: 161820 - DNA, 25 bp, Homo sapien
agggctcctcaggtagtagaatgca

SEQ ID NO: 161821 - DNA, 25 bp, Homo sapien
tagtagaatgcagcggccggcagat

SEQ ID NO: 161822 - DNA, 25 bp, Homo sapien
catggccctgcgcaagcgcattcgg

SEQ ID NO: 161823 - DNA, 25 bp, Homo sapien
gttggtctttcagacgtctcccaga

SEQ ID NO: 161824 - DNA, 25 bp, Homo sapien
ctggtctccaaagtctcgttggtct

SEQ ID NO: 161825 - DNA, 25 bp, Homo sapien
tgcgcgagctcccagcgaatgcaag

SEQ ID NO: 161826 - DNA, 25 bp, Homo sapien
cagttcgacgagcagggagccaaaa

SEQ ID NO: 161827 - DNA, 25 bp, Homo sapien
gcgacagcccgtgagaagagcagtt

SEQ ID NO: 161828 - DNA, 25 bp, Homo sapien
cgtccagattgaaggcgacagcccg

SEQ ID NO: 161829 - DNA, 25 bp, Homo sapien
gcaaggcacccatcacgtccagatt

SEQ ID NO: 161830 - DNA, 25 bp, Homo sapien
ctgcaactgccggtgcagggccaca

SEQ ID NO: 161831 - DNA, 25 bp, Homo sapien
tggctccggtcccttgggcaatact

SEQ ID NO: 161832 - DNA, 25 bp, Homo sapien
tgacacagcggtcacgtgacatggc

SEQ ID NO: 161833 - DNA, 25 bp, Homo sapien
agcgttccagcttccggagccggag

SEQ ID NO: 161834 - DNA, 25 bp, Homo sapien
gagctgcagggtgagccaaatatcc

SEQ ID NO: 161835 - DNA, 25 bp, Homo sapien
gccaaatatcctgtcggccgttttc

SEQ ID NO: 161836 - DNA, 25 bp, Homo sapien
ccggagcctggatctcgagtaacta

SEQ ID NO: 161837 - DNA, 25 bp, Homo sapien
tatccagggaaagacgccagctagc

SEQ ID NO: 161838 - DNA, 25 bp, Homo sapien
ctcgagtaactaaccatatccaggg

SEQ ID NO: 161839 - DNA, 25 bp, Homo sapien
tccctcatgtgacgcggtaacagct

SEQ ID NO: 161840 - DNA, 25 bp, Homo sapien
ccgcaaagggaaagccgcaagggca

SEQ ID NO: 161841 - DNA, 25 bp, Homo sapien
aagggactgcgggtggtctctccca

SEQ ID NO: 161842 - DNA, 25 bp, Homo sapien
ttcgaagcaaagttgctccagggcg

SEQ ID NO: 161843 - DNA, 25 bp, Homo sapien
ccagcctggagaaacggtcttcagc

SEQ ID NO: 161844 - DNA, 25 bp, Homo sapien
caggacagatccaagggcgccggca

SEQ ID NO: 161845 - DNA, 25 bp, Homo sapien
cctctttacccgcaggagaggggtg

SEQ ID NO: 161846 - DNA, 25 bp, Homo sapien
gctatacctccgtgccaactcgggg

SEQ ID NO: 161847 - DNA, 25 bp, Homo sapien
cctagagagcatcaagtcgcagatc

SEQ ID NO: 161848 - DNA, 25 bp, Homo sapien
aggcgcccaacatcagccgcgaggt

SEQ ID NO: 161849 - DNA, 25 bp, Homo sapien
cgctgcagcagatcctggacctaca

SEQ ID NO: 161850 - DNA, 25 bp, Homo sapien
gacctacacgacttccagggcgacg

SEQ ID NO: 161851 - DNA, 25 bp, Homo sapien
accgtcattagcatggcccaggaga

SEQ ID NO: 161852 - DNA, 25 bp, Homo sapien
cttcatagaagttttccgagcggtg

SEQ ID NO: 161853 - DNA, 25 bp, Homo sapien
tatgcacgcctagttcccggaggtt

SEQ ID NO: 161854 - DNA, 25 bp, Homo sapien
acagcgctgcctcttttgttggctc

SEQ ID NO: 161855 - DNA, 25 bp, Homo sapien
ttcagttcctagaaaagtccaactc

SEQ ID NO: 161856 - DNA, 25 bp, Homo sapien
aggagaaggcgcaagctaccctgta

SEQ ID NO: 161857 - DNA, 25 bp, Homo sapien
ctttagcttatggagctccaccgtc

SEQ ID NO: 161858 - DNA, 25 bp, Homo sapien
gctaccctgtagaattcagttccta

SEQ ID NO: 161859 - DNA, 25 bp, Homo sapien
cgattcacggtacctttagcttatg

SEQ ID NO: 161860 - DNA, 25 bp, Homo sapien
tatggagctccaccgtctcggtcgc

SEQ ID NO: 161861 - DNA, 25 bp, Homo sapien
ccgagaaacgaagtggaaaaggctg

SEQ ID NO: 161862 - DNA, 25 bp, Homo sapien
tagaaaagtccaactcagcccttcc

SEQ ID NO: 161863 - DNA, 25 bp, Homo sapien
gcagcgaggtcacttccaacaggta

SEQ ID NO: 161864 - DNA, 25 bp, Homo sapien
cttggcatgccagctccttggccga

SEQ ID NO: 161865 - DNA, 25 bp, Homo sapien
gtagttgtagccgatgcccttacac

SEQ ID NO: 161866 - DNA, 25 bp, Homo sapien
tgtacatgctgcacaggaagaactt

SEQ ID NO: 161867 - DNA, 25 bp, Homo sapien
gcggcttcttgtagtcctctaggca

SEQ ID NO: 161868 - DNA, 25 bp, Homo sapien
tccatgcacagcgtgtcagggttgc

SEQ ID NO: 161869 - DNA, 25 bp, Homo sapien
tcggtgcggttgtagtccatgcaca

SEQ ID NO: 161870 - DNA, 25 bp, Homo sapien
ggtctcccttatgcttcgcccggga

SEQ ID NO: 161871 - DNA, 25 bp, Homo sapien
cacttccggggtcaccagggaagag

SEQ ID NO: 161872 - DNA, 25 bp, Homo sapien
ctccgcgtgtgggaatgggattccc

SEQ ID NO: 161873 - DNA, 25 bp, Homo sapien
gaatgggattcccgcaggttgcacc

SEQ ID NO: 161874 - DNA, 25 bp, Homo sapien
ctagggctgcgtcgactccaaggag

SEQ ID NO: 161875 - DNA, 25 bp, Homo sapien
gccaatccagctagggctgcgtcga

SEQ ID NO: 161876 - DNA, 25 bp, Homo sapien
aaggaaaagaaatagcggttggctg

SEQ ID NO: 161877 - DNA, 25 bp, Homo sapien
tcctaaggaagtactggccccgcca

SEQ ID NO: 161878 - DNA, 25 bp, Homo sapien
agaggcaagccaatccagctagggc

SEQ ID NO: 161879 - DNA, 25 bp, Homo sapien
gctgcttgacatctcatctgcatac

SEQ ID NO: 161880 - DNA, 25 bp, Homo sapien
tctcatctgcataccaagctatttg

SEQ ID NO: 161881 - DNA, 25 bp, Homo sapien
ccaagctatttggtggacgtccaca

SEQ ID NO: 161882 - DNA, 25 bp, Homo sapien
atttggtggacgtccacaagcgccc

SEQ ID NO: 161883 - DNA, 25 bp, Homo sapien
ctctgcacacgcctctagccttata

SEQ ID NO: 161884 - DNA, 25 bp, Homo sapien
gccttataccccgtcttgatccgaa

SEQ ID NO: 161885 - DNA, 25 bp, Homo sapien
cttccctggtccacgatcccgacca

SEQ ID NO: 161886 - DNA, 25 bp, Homo sapien
gatccgaaagtttttccacccatga

SEQ ID NO: 161887 - DNA, 25 bp, Homo sapien
gctcggctcagaactttgcccgtga

SEQ ID NO: 161888 - DNA, 25 bp, Homo sapien
ttgcccgtgagccaaagaacactga

SEQ ID NO: 161889 - DNA, 25 bp, Homo sapien
gcgtaacttggctcggctcagaact

SEQ ID NO: 161890 - DNA, 25 bp, Homo sapien
taggaactgggagcgtaacttggct

SEQ ID NO: 161891 - DNA, 25 bp, Homo sapien
atcaccgagcggtgcctaggaactg

SEQ ID NO: 161892 - DNA, 25 bp, Homo sapien
cgcgcttgacccagctggcgagctg

SEQ ID NO: 161893 - DNA, 25 bp, Homo sapien
cctttgtatcctgcggtgcggaggt

SEQ ID NO: 161894 - DNA, 25 bp, Homo sapien
actgaactcatctacctgctgcttg

SEQ ID NO: 161895 - DNA, 25 bp, Homo sapien
caccgccggtctcgtcagtaacata

SEQ ID NO: 161896 - DNA, 25 bp, Homo sapien
tgccaccgataccattactgagcgc

SEQ ID NO: 161897 - DNA, 25 bp, Homo sapien
tagggagtcgccatcttgaaaacgc

SEQ ID NO: 161898 - DNA, 25 bp, Homo sapien
ccaagagaagttccgaggcacagtc

SEQ ID NO: 161899 - DNA, 25 bp, Homo sapien
ttggtgacgtggagcagacaaactc

SEQ ID NO: 161900 - DNA, 25 bp, Homo sapien
cgcacaagtgtttctagggacggtt

SEQ ID NO: 161901 - DNA, 25 bp, Homo sapien
ctgagcgcttgctgcctgtaaaaca

SEQ ID NO: 161902 - DNA, 25 bp, Homo sapien
ggagtcccgatcgtagcaagccacc

SEQ ID NO: 161903 - DNA, 25 bp, Homo sapien
ctcccgctcattcggagggatggtg

SEQ ID NO: 161904 - DNA, 25 bp, Homo sapien
gcagctatgtcgtcaggaacggggc

SEQ ID NO: 161905 - DNA, 25 bp, Homo sapien
accgcgagccctctcaagcaaggta

SEQ ID NO: 161906 - DNA, 25 bp, Homo sapien
cccacgggctgcgttcgtgctgctg

SEQ ID NO: 161907 - DNA, 25 bp, Homo sapien
ggaagtcctcttcggaacctccaca

SEQ ID NO: 161908 - DNA, 25 bp, Homo sapien
ctcattcggagggatggtgaagccc

SEQ ID NO: 161909 - DNA, 25 bp, Homo sapien
gccctctcaagcaaggtagagaccc

SEQ ID NO: 161910 - DNA, 25 bp, Homo sapien
agtcctcttcggaacctccacagtg

SEQ ID NO: 161911 - DNA, 25 bp, Homo sapien
tactcgctccacatgcatttcagtc

SEQ ID NO: 161912 - DNA, 25 bp, Homo sapien
tctcgtccacagagctgcacacata

SEQ ID NO: 161913 - DNA, 25 bp, Homo sapien
cgtggctaaacgctcactttatgta

SEQ ID NO: 161914 - DNA, 25 bp, Homo sapien
aagctgcaattctgggacaggggca

SEQ ID NO: 161915 - DNA, 25 bp, Homo sapien
ccaggagagacgcattggacagcca

SEQ ID NO: 161916 - DNA, 25 bp, Homo sapien
gtgacctcatctgcgcggcatctga

SEQ ID NO: 161917 - DNA, 25 bp, Homo sapien
tttcagtctcctctcgcctttcatg

SEQ ID NO: 161918 - DNA, 25 bp, Homo sapien
aggtgggcccggatctcccacatca

SEQ ID NO: 161919 - DNA, 25 bp, Homo sapien
cgcgctaacgcagtaagagtcactc

SEQ ID NO: 161920 - DNA, 25 bp, Homo sapien
gagctccgcggaacgcagtccaggc

SEQ ID NO: 161921 - DNA, 25 bp, Homo sapien
gtcatggccaggaagacgcgctaac

SEQ ID NO: 161922 - DNA, 25 bp, Homo sapien
gaacaaaatggggtcatggccagga

SEQ ID NO: 161923 - DNA, 25 bp, Homo sapien
cgtcagaagcgctagaggtcgttgc

SEQ ID NO: 161924 - DNA, 25 bp, Homo sapien
tctgtgtcgcgcgtcagaagcgcta

SEQ ID NO: 161925 - DNA, 25 bp, Homo sapien
accttgccagagctggttctgtgtc

SEQ ID NO: 161926 - DNA, 25 bp, Homo sapien
agagtcactcagagggccggaactg

SEQ ID NO: 161927 - DNA, 25 bp, Homo sapien
gccaaattgacaagagcgagaggta

SEQ ID NO: 161928 - DNA, 25 bp, Homo sapien
cccggctctgacgttgaccaataga

SEQ ID NO: 161929 - DNA, 25 bp, Homo sapien
cggcaacattgtttcaagttggcca

SEQ ID NO: 161930 - DNA, 25 bp, Homo sapien
gcgagaggtatactgcgttccatcc

SEQ ID NO: 161931 - DNA, 25 bp, Homo sapien
ggtccgccttctgcagggttcccag

SEQ ID NO: 161932 - DNA, 25 bp, Homo sapien
ttcatggagaacttccaaaaggtgg

SEQ ID NO: 161933 - DNA, 25 bp, Homo sapien
cacgtacggagttgtgtacaaagcc

SEQ ID NO: 161934 - DNA, 25 bp, Homo sapien
gcgcttaagaaaatccgcctggaca

SEQ ID NO: 161935 - DNA, 25 bp, Homo sapien
gtaccgagctgatggagcccaaagg

SEQ ID NO: 161936 - DNA, 25 bp, Homo sapien
tttgtctgttcgacacaggcttggg

SEQ ID NO: 161937 - DNA, 25 bp, Homo sapien
gtaatcgagctattggctggagccc

SEQ ID NO: 161938 - DNA, 25 bp, Homo sapien
tgagtgcacatatagcccaccctcg

SEQ ID NO: 161939 - DNA, 25 bp, Homo sapien
ctcgcctttctccagaggattggtg

SEQ ID NO: 161940 - DNA, 25 bp, Homo sapien
ggtgacagcgcccaaagagactcgc

SEQ ID NO: 161941 - DNA, 25 bp, Homo sapien
cccttgctcgtacttgttggtgaca

SEQ ID NO: 161942 - DNA, 25 bp, Homo sapien
aggtttctccctcgctattggcttg

SEQ ID NO: 161943 - DNA, 25 bp, Homo sapien
ggcaagtcccttctcaggtgaagct

SEQ ID NO: 161944 - DNA, 25 bp, Homo sapien
tcggatttgaatctttcggcgctcg

SEQ ID NO: 161945 - DNA, 25 bp, Homo sapien
atttgaatctttcggcgctcggcta

SEQ ID NO: 161946 - DNA, 25 bp, Homo sapien
aatctttcggcgctcggctactctc

SEQ ID NO: 161947 - DNA, 25 bp, Homo sapien
ccgcctgtcgcctggtagtgggacc

SEQ ID NO: 161948 - DNA, 25 bp, Homo sapien
agtcccttctcaggtgaagctgctg

SEQ ID NO: 161949 - DNA, 25 bp, Homo sapien
cgatggtgcctttcggatttgaatc

SEQ ID NO: 161950 - DNA, 25 bp, Homo sapien
gcagacgatggtgcctttcggattt

SEQ ID NO: 161951 - DNA, 25 bp, Homo sapien
gtggaccgagtgtacatttcatttg

SEQ ID NO: 161952 - DNA, 25 bp, Homo sapien
cgtgcctccaagatggtgagtcttc

SEQ ID NO: 161953 - DNA, 25 bp, Homo sapien
tcatgctatataggagggccctgcc

SEQ ID NO: 161954 - DNA, 25 bp, Homo sapien
gtccgcgtagggatctcatgctata

SEQ ID NO: 161955 - DNA, 25 bp, Homo sapien
tgccgttcttgaagcccgtctccta

SEQ ID NO: 161956 - DNA, 25 bp, Homo sapien
ggcttgctgggagacacataacctc

SEQ ID NO: 161957 - DNA, 25 bp, Homo sapien
gcctagcgtcgcgtataccggaaaa

SEQ ID NO: 161958 - DNA, 25 bp, Homo sapien
cgtccagaattgcttccgagtcggc

SEQ ID NO: 161959 - DNA, 25 bp, Homo sapien
tccacggccagcaccgtaactggag

SEQ ID NO: 161960 - DNA, 25 bp, Homo sapien
cgacggccagcaccgtaactggaga

SEQ ID NO: 161961 - DNA, 25 bp, Homo sapien
cgtaactggagaccatgcgggcacc

SEQ ID NO: 161962 - DNA, 25 bp, Homo sapien
cgggcaccggtgtgaacccagactc

SEQ ID NO: 161963 - DNA, 25 bp, Homo sapien
ccacggccagcaccgtaactggaga

SEQ ID NO: 161964 - DNA, 25 bp, Homo sapien
gggcaccggtgtgaacccagactcc

SEQ ID NO: 161965 - DNA, 25 bp, Homo sapien
ggcaccggtgtgaactcagacccga

SEQ ID NO: 161966 - DNA, 25 bp, Homo sapien
ggcaccggtgtgaacccagactcca

SEQ ID NO: 161967 - DNA, 25 bp, Homo sapien
aggcaccggtgtgaactcagacgca

SEQ ID NO: 161968 - DNA, 25 bp, Homo sapien
atgaccaggatttcagcagcttcta

SEQ ID NO: 161969 - DNA, 25 bp, Homo sapien
tgtcaatcaaagcttaggcacgtgg

SEQ ID NO: 161970 - DNA, 25 bp, Homo sapien
aggcacgtgggttacttcactgttc

SEQ ID NO: 161971 - DNA, 25 bp, Homo sapien
cgtccagggcaacagcgttcacatt

SEQ ID NO: 161972 - DNA, 25 bp, Homo sapien
cacattccggcggtgccatagagca

SEQ ID NO: 161973 - DNA, 25 bp, Homo sapien
gaacccgttctgcagctgaactcga

SEQ ID NO: 161974 - DNA, 25 bp, Homo sapien
cgagatccttctacctcaaccggga

SEQ ID NO: 161975 - DNA, 25 bp, Homo sapien
atcctcgatctgctccgccaagttg

SEQ ID NO: 161976 - DNA, 25 bp, Homo sapien
tgcctcgatgtcctagcctaggggc

SEQ ID NO: 161977 - DNA, 25 bp, Homo sapien
gctccggctccgattgcaatttgca

SEQ ID NO: 161978 - DNA, 25 bp, Homo sapien
tggcctatctcctgcagaaaaatta

SEQ ID NO: 161979 - DNA, 25 bp, Homo sapien
cagggctttggagagctttccactc

SEQ ID NO: 161980 - DNA, 25 bp, Homo sapien
agtgcaatttcacgcggtctctgtg

SEQ ID NO: 161981 - DNA, 25 bp, Homo sapien
agcggccagagacagtgcaatttca

SEQ ID NO: 161982 - DNA, 25 bp, Homo sapien
agcagccaccaattcgccagcggtt

SEQ ID NO: 161983 - DNA, 25 bp, Homo sapien
gcaaactatcgctgaggacctggtc

SEQ ID NO: 161984 - DNA, 25 bp, Homo sapien
atcgaggggactctgaccacagcct

SEQ ID NO: 161985 - DNA, 25 bp, Homo sapien
cctggtcgtgaccaagtataagatg

SEQ ID NO: 161986 - DNA, 25 bp, Homo sapien
gggcgacatcgccaacagtgagtgc

SEQ ID NO: 161987 - DNA, 25 bp, Homo sapien
gacgtgttttctcttgttcctatcc

SEQ ID NO: 161988 - DNA, 25 bp, Homo sapien
cattcccgattattgcttcctctga

SEQ ID NO: 161989 - DNA, 25 bp, Homo sapien
cttcctctgattctggcagcggcga

SEQ ID NO: 161990 - DNA, 25 bp, Homo sapien
ctgcccgctcgactttaaacctatt

SEQ ID NO: 161991 - DNA, 25 bp, Homo sapien
atcgcgagcaaacgccagcttcgtg

SEQ ID NO: 161992 - DNA, 25 bp, Homo sapien
ccgcttagaccatgtcgtgcctttg

SEQ ID NO: 161993 - DNA, 25 bp, Homo sapien
ttgccatagtgacacgcaaagcgtg

SEQ ID NO: 161994 - DNA, 25 bp, Homo sapien
cggcatgtcgcacgcgtacttcata

SEQ ID NO: 161995 - DNA, 25 bp, Homo sapien
gcgcccttagtgtcccattcacgta

SEQ ID NO: 161996 - DNA, 25 bp, Homo sapien
taggcggctctttgtcgaagctaga

SEQ ID NO: 161997 - DNA, 25 bp, Homo sapien
ctgctggctagagcgtcacttcttc

SEQ ID NO: 161998 - DNA, 25 bp, Homo sapien
ccatagagtatggttccgggtctgc

SEQ ID NO: 161999 - DNA, 25 bp, Homo sapien
cagcgaggcagctactggacgacga

SEQ ID NO: 162000 - DNA, 25 bp, Homo sapien
ggccctggcggtgctgacttcattc

SEQ ID NO: 162001 - DNA, 25 bp, Homo sapien
ggttgctggtgctgatacctgtgta

SEQ ID NO: 162002 - DNA, 25 bp, Homo sapien
tacctgtgtatttggccggggcagt

SEQ ID NO: 162003 - DNA, 25 bp, Homo sapien
gactcagcgtgggtttcgtgctctt

SEQ ID NO: 162004 - DNA, 25 bp, Homo sapien
tgctgacttcattcgggaggcggtt

SEQ ID NO: 162005 - DNA, 25 bp, Homo sapien
cgcgacgagaaagaacggagccttc

SEQ ID NO: 162006 - DNA, 25 bp, Homo sapien
aacggagccttcgagcagcgaggca

SEQ ID NO: 162007 - DNA, 25 bp, Homo sapien
ccggactgtgggctgcgcttgttcc

SEQ ID NO: 162008 - DNA, 25 bp, Homo sapien
cggatgccttctctctagtcttgca

SEQ ID NO: 162009 - DNA, 25 bp, Homo sapien
cgttggggcagagacccttatttct

SEQ ID NO: 162010 - DNA, 25 bp, Homo sapien
ggttctctcttttctcgcttttatc

SEQ ID NO: 162011 - DNA, 25 bp, Homo sapien
agacccttatttctgcggcggccgc

SEQ ID NO: 162012 - DNA, 25 bp, Homo sapien
ccgcgtctcctgtgctgaggcggat

SEQ ID NO: 162013 - DNA, 25 bp, Homo sapien
tgctgaggcggatgccttctctcta

SEQ ID NO: 162014 - DNA, 25 bp, Homo sapien
ctctagtcttgcagaggcgaagccg

SEQ ID NO: 162015 - DNA, 25 bp, Homo sapien
cgcattccagtgctccgtttgctca

SEQ ID NO: 162016 - DNA, 25 bp, Homo sapien
tggcacccgcataagccgtctgtgt

SEQ ID NO: 162017 - DNA, 25 bp, Homo sapien
ccgtctgtgtgttccagagaggcca

SEQ ID NO: 162018 - DNA, 25 bp, Homo sapien
ctgtccgtgagcgtgcttggaccta

SEQ ID NO: 162019 - DNA, 25 bp, Homo sapien
tggacctacgcataggacccagctg

SEQ ID NO: 162020 - DNA, 25 bp, Homo sapien
ccagctgagcgggacatttacacga

SEQ ID NO: 162021 - DNA, 25 bp, Homo sapien
gtcagcccggtgaactaagcggacc

SEQ ID NO: 162022 - DNA, 25 bp, Homo sapien
cagccctgcatgtgctgtccgtgag

SEQ ID NO: 162023 - DNA, 25 bp, Homo sapien
gtttccagtccaagcctcctagaga

SEQ ID NO: 162024 - DNA, 25 bp, Homo sapien
aacatgcgttttcccgcgtgctagg

SEQ ID NO: 162025 - DNA, 25 bp, Homo sapien
cttgcctgtcgggttagatttatac

SEQ ID NO: 162026 - DNA, 25 bp, Homo sapien
gctcgcagagctatatcaagtgatg

SEQ ID NO: 162027 - DNA, 25 bp, Homo sapien
ccgaacttgcgggtctccatgaatg

SEQ ID NO: 162028 - DNA, 25 bp, Homo sapien
tcacgctcgggaacagtcagtaatc

SEQ ID NO: 162029 - DNA, 25 bp, Homo sapien
cccacgtgtgagagtctgcaaaacc

SEQ ID NO: 162030 - DNA, 25 bp, Homo sapien
ttgatccgctcaaaggtggcttagg

SEQ ID NO: 162031 - DNA, 25 bp, Homo sapien
catcccgtgagcccgcggggaacta

SEQ ID NO: 162032 - DNA, 25 bp, Homo sapien
ctgcaatctagagcgcggcgcatcc

SEQ ID NO: 162033 - DNA, 25 bp, Homo sapien
actgcaatctagagcgcggcgcatc

SEQ ID NO: 162034 - DNA, 25 bp, Homo sapien
cctcgcgtcaactgcaatctagagc

SEQ ID NO: 162035 - DNA, 25 bp, Homo sapien
gccctcgcgtcaactgcaatctaga

SEQ ID NO: 162036 - DNA, 25 bp, Homo sapien
ctgagtcaccaaccaccgccatggg

SEQ ID NO: 162037 - DNA, 25 bp, Homo sapien
tcaactgcaatctagagcgcggcgc

SEQ ID NO: 162038 - DNA, 25 bp, Homo sapien
cgtcaactgcaatctagagcgcggc

SEQ ID NO: 162039 - DNA, 25 bp, Homo sapien
ttgcgcattcctaacccgacgaagc

SEQ ID NO: 162040 - DNA, 25 bp, Homo sapien
ctttttgcctcagctcgggagtgtc

SEQ ID NO: 162041 - DNA, 25 bp, Homo sapien
ggggcgccattctcctgagatcgct

SEQ ID NO: 162042 - DNA, 25 bp, Homo sapien
gggagtgtcacctcgctatcccact

SEQ ID NO: 162043 - DNA, 25 bp, Homo sapien
gtagacccgagtggtcctcaccttg

SEQ ID NO: 162044 - DNA, 25 bp, Homo sapien
gtggtcctcaccttgcgcattccta

SEQ ID NO: 162045 - DNA, 25 bp, Homo sapien
tcctgagatcgctcttaccagacgc

SEQ ID NO: 162046 - DNA, 25 bp, Homo sapien
gctcttaccagacgcgaagcccttt

SEQ ID NO: 162047 - DNA, 25 bp, Homo sapien
aggcgcagtacgcaccgccctggaa

SEQ ID NO: 162048 - DNA, 25 bp, Homo sapien
acagtactgccctggtgccgggtcc

SEQ ID NO: 162049 - DNA, 25 bp, Homo sapien
cgcaacctgacccagtcggagctga

SEQ ID NO: 162050 - DNA, 25 bp, Homo sapien
gcagcggccacagtactgccctggt

SEQ ID NO: 162051 - DNA, 25 bp, Homo sapien
aaagaagactcctaccactcgtcgc

SEQ ID NO: 162052 - DNA, 25 bp, Homo sapien
gtcgccgcctcagacggatcctttg

SEQ ID NO: 162053 - DNA, 25 bp, Homo sapien
tggagtctccgcaacctgacccagt

SEQ ID NO: 162054 - DNA, 25 bp, Homo sapien
gctgctacgcaacccggcggaagct

SEQ ID NO: 162055 - DNA, 25 bp, Homo sapien
gaagctcaggggttgctcgttgccc

SEQ ID NO: 162056 - DNA, 25 bp, Homo sapien
agcagttccgcctctgtttccagca

SEQ ID NO: 162057 - DNA, 25 bp, Homo sapien
gttccgcctctgtttccagcagctt

SEQ ID NO: 162058 - DNA, 25 bp, Homo sapien
cacctccgtcttcccaccgtgcagc

SEQ ID NO: 162059 - DNA, 25 bp, Homo sapien
tggacgccaggcctgtcgcttgcag

SEQ ID NO: 162060 - DNA, 25 bp, Homo sapien
cgtcagcctcgaggtcggctctcat

SEQ ID NO: 162061 - DNA, 25 bp, Homo sapien
cgaggtcggctctcatcagaagctc

SEQ ID NO: 162062 - DNA, 25 bp, Homo sapien
ctctcatcagaagctcaggggttgc

SEQ ID NO: 162063 - DNA, 25 bp, Homo sapien
gatctggccagtaagattctactcc

SEQ ID NO: 162064 - DNA, 25 bp, Homo sapien
gggttccggaagatctggccagtaa

SEQ ID NO: 162065 - DNA, 25 bp, Homo sapien
accgagtcccggcttgtcgggatga

SEQ ID NO: 162066 - DNA, 25 bp, Homo sapien
ctgctcagcggcgtgcacagtcctg

SEQ ID NO: 162067 - DNA, 25 bp, Homo sapien
gaaacttccgggaatgtccgcactc

SEQ ID NO: 162068 - DNA, 25 bp, Homo sapien
gcacgagtctctgatcccgattggc

SEQ ID NO: 162069 - DNA, 25 bp, Homo sapien
ttcgcggcgcacgagtctctgatcc

SEQ ID NO: 162070 - DNA, 25 bp, Homo sapien
cagtaagattctactccctggctgt

SEQ ID NO: 162071 - DNA, 25 bp, Homo sapien
ccacaagaccctagcggaaacctgg

SEQ ID NO: 162072 - DNA, 25 bp, Homo sapien
cggctgcagagagaaccggcattct

SEQ ID NO: 162073 - DNA, 25 bp, Homo sapien
gattctggctggagcgagctcccgc

SEQ ID NO: 162074 - DNA, 25 bp, Homo sapien
acctgggccttagtcccgcggtgct

SEQ ID NO: 162075 - DNA, 25 bp, Homo sapien
cgcggtgcttcccaaactgaggacc

SEQ ID NO: 162076 - DNA, 25 bp, Homo sapien
cgaacggctggccagatcttaccca

SEQ ID NO: 162077 - DNA, 25 bp, Homo sapien
gagctaactcctcccgtcagcgatt

SEQ ID NO: 162078 - DNA, 25 bp, Homo sapien
gaggggctccactctagggattctg

SEQ ID NO: 162079 - DNA, 25 bp, Homo sapien
ctcgccacaggtgtgaaactacatc

SEQ ID NO: 162080 - DNA, 25 bp, Homo sapien
agtcgcctctgtgcctacctatcgg

SEQ ID NO: 162081 - DNA, 25 bp, Homo sapien
ctacatctcccgacaggcggcgttg

SEQ ID NO: 162082 - DNA, 25 bp, Homo sapien
agcggtcccggcttcagttctagcc

SEQ ID NO: 162083 - DNA, 25 bp, Homo sapien
cgcgtcagaacttagagggccaggc

SEQ ID NO: 162084 - DNA, 25 bp, Homo sapien
caccgccgcgaccaatgaggtgaga

SEQ ID NO: 162085 - DNA, 25 bp, Homo sapien
ctgcggtagacacgcccacgaagtc

SEQ ID NO: 162086 - DNA, 25 bp, Homo sapien
gacgttcagaggatctacagatatc

SEQ ID NO: 162087 - DNA, 25 bp, Homo sapien
aagtaaagccatggcgggcgatctc

SEQ ID NO: 162088 - DNA, 25 bp, Homo sapien
ccggccattggtccggtatggaagc

SEQ ID NO: 162089 - DNA, 25 bp, Homo sapien
gtgacagcagggtcggcctcctcac

SEQ ID NO: 162090 - DNA, 25 bp, Homo sapien
ctcctcacgcgttctggactgcggg

SEQ ID NO: 162091 - DNA, 25 bp, Homo sapien
gcacatggtcctgtagcttcacgca

SEQ ID NO: 162092 - DNA, 25 bp, Homo sapien
ggcggccgcagtaagtaaagccatg

SEQ ID NO: 162093 - DNA, 25 bp, Homo sapien
ggaccttagcccttgacagcagttg

SEQ ID NO: 162094 - DNA, 25 bp, Homo sapien
caccttggttcccaagagccgggcg

SEQ ID NO: 162095 - DNA, 25 bp, Homo sapien
tccagcccgtaagtgattacccgta

SEQ ID NO: 162096 - DNA, 25 bp, Homo sapien
ggactccgccattgctttcgcttca

SEQ ID NO: 162097 - DNA, 25 bp, Homo sapien
ggaagaccgctggactctcactttg

SEQ ID NO: 162098 - DNA, 25 bp, Homo sapien
gctaactggtacctaagcgggactc

SEQ ID NO: 162099 - DNA, 25 bp, Homo sapien
aactctcgcgcgaacaggcagctta

SEQ ID NO: 162100 - DNA, 25 bp, Homo sapien
tcaatcgccgaaggacccagacttg

SEQ ID NO: 162101 - DNA, 25 bp, Homo sapien
cccagacttgcgtggcgaacagatc

SEQ ID NO: 162102 - DNA, 25 bp, Homo sapien
ccaccaggggtcagccgtagaatag

SEQ ID NO: 162103 - DNA, 25 bp, Homo sapien
ttccaatcaagaagggctcggggca

SEQ ID NO: 162104 - DNA, 25 bp, Homo sapien
cagctccgcgggaaattccagtttc

SEQ ID NO: 162105 - DNA, 25 bp, Homo sapien
ccaatcagaaggagccaggtacggc

SEQ ID NO: 162106 - DNA, 25 bp, Homo sapien
gctcggggcatattttagccaatca

SEQ ID NO: 162107 - DNA, 25 bp, Homo sapien
aaacgcagccagacgccggacttgt

SEQ ID NO: 162108 - DNA, 25 bp, Homo sapien
ggtccgaggcgcttcttccaatcaa

SEQ ID NO: 162109 - DNA, 25 bp, Homo sapien
agggctcaacctaaccactacggcg

SEQ ID NO: 162110 - DNA, 25 bp, Homo sapien
gctccgggcgcatctaagccaatca

SEQ ID NO: 162111 - DNA, 25 bp, Homo sapien
cactttctacgaggggaggagtcca

SEQ ID NO: 162112 - DNA, 25 bp, Homo sapien
cggaaccgaaactagcttgaggagc

SEQ ID NO: 162113 - DNA, 25 bp, Homo sapien
ctgattttcgagaacccgcgcgtga

SEQ ID NO: 162114 - DNA, 25 bp, Homo sapien
tgagccgaaaccacacctgcagctt

SEQ ID NO: 162115 - DNA, 25 bp, Homo sapien
tggctgccattcagtcaagcccttc

SEQ ID NO: 162116 - DNA, 25 bp, Homo sapien
tgagctcgggtactagaacctcgcg

SEQ ID NO: 162117 - DNA, 25 bp, Homo sapien
tcgcgacttcccgtccctagtatga

SEQ ID NO: 162118 - DNA, 25 bp, Homo sapien
ctccaatggctctggtcgcgacttc

SEQ ID NO: 162119 - DNA, 25 bp, Homo sapien
gaggagcgctaccttccgcagtgct

SEQ ID NO: 162120 - DNA, 25 bp, Homo sapien
ttcaagtgcgtgcagaaggacatcc

SEQ ID NO: 162121 - DNA, 25 bp, Homo sapien
ctacatgcgcagaatggtggccacc

SEQ ID NO: 162122 - DNA, 25 bp, Homo sapien
acgcgtggctttatttctgttcctc

SEQ ID NO: 162123 - DNA, 25 bp, Homo sapien
agcaaattcgtcttggcctcaggtc

SEQ ID NO: 162124 - DNA, 25 bp, Homo sapien
agtcccattgaagaaacgcgtgttt

SEQ ID NO: 162125 - DNA, 25 bp, Homo sapien
tgttgctttgcaaactccctttgga

SEQ ID NO: 162126 - DNA, 25 bp, Homo sapien
tgcccacgtatgcacagctctggac

SEQ ID NO: 162127 - DNA, 25 bp, Homo sapien
agcagcgtagggctaagcccgcgtc

SEQ ID NO: 162128 - DNA, 25 bp, Homo sapien
cgagccgggctggtccacgtgactc

SEQ ID NO: 162129 - DNA, 25 bp, Homo sapien
ctcagaagcccggaggagccaccgg

SEQ ID NO: 162130 - DNA, 25 bp, Homo sapien
agggactcagcgtttcccgagaatg

SEQ ID NO: 162131 - DNA, 25 bp, Homo sapien
ggctaagcccgcgtccggtgagacc

SEQ ID NO: 162132 - DNA, 25 bp, Homo sapien
gacccaagctgtgcggagcagcgta

SEQ ID NO: 162133 - DNA, 25 bp, Homo sapien
cacgtgactccgagcgaactggggc

SEQ ID NO: 162134 - DNA, 25 bp, Homo sapien
cagagtacagaattgcgcgtgcgcg

SEQ ID NO: 162135 - DNA, 25 bp, Homo sapien
cccaggtccaatcactgaggaagca

SEQ ID NO: 162136 - DNA, 25 bp, Homo sapien
gctaagtaagagtgagcccagttca

SEQ ID NO: 162137 - DNA, 25 bp, Homo sapien
ttgcccaatgagagcaagacggtgg

SEQ ID NO: 162138 - DNA, 25 bp, Homo sapien
ggagccttactgatcctggtgctgc

SEQ ID NO: 162139 - DNA, 25 bp, Homo sapien
cttgcgacagtctgcggatgcttcc

SEQ ID NO: 162140 - DNA, 25 bp, Homo sapien
ctcagagagcctcgacctccgaagg

SEQ ID NO: 162141 - DNA, 25 bp, Homo sapien
agcccagttcaggaggtcactcaga

SEQ ID NO: 162142 - DNA, 25 bp, Homo sapien
ctgcagagccttcatggagcgcatg

SEQ ID NO: 162143 - DNA, 25 bp, Homo sapien
cctgtggtgcgtgttccggggctgt

SEQ ID NO: 162144 - DNA, 25 bp, Homo sapien
tgctacgcgtagtgaccctgggcct

SEQ ID NO: 162145 - DNA, 25 bp, Homo sapien
ctgtgctacgcgtagtgaccctggg

SEQ ID NO: 162146 - DNA, 25 bp, Homo sapien
gctgtgctacgcgtagtgaccctgg

SEQ ID NO: 162147 - DNA, 25 bp, Homo sapien
tgtgctacgtgtagtgaccctgggc

SEQ ID NO: 162148 - DNA, 25 bp, Homo sapien
gctgtgctacgtgtagtgaccctgg

SEQ ID NO: 162149 - DNA, 25 bp, Homo sapien
gtgctacgcgtagtgaccctgggcc

SEQ ID NO: 162150 - DNA, 25 bp, Homo sapien
gctacgtgtagtgaccctgggcctg

SEQ ID NO: 162151 - DNA, 25 bp, Homo sapien
tctgctcagcgcgattctactgaga

SEQ ID NO: 162152 - DNA, 25 bp, Homo sapien
gcatgcgctgctggctaacggctct

SEQ ID NO: 162153 - DNA, 25 bp, Homo sapien
agaggctgcaccgtgcccagcatca

SEQ ID NO: 162154 - DNA, 25 bp, Homo sapien
ccgacactcagtgccacccaagagg

SEQ ID NO: 162155 - DNA, 25 bp, Homo sapien
cgattctactgagagaggcctgagt

SEQ ID NO: 162156 - DNA, 25 bp, Homo sapien
cctgagtgtgcaagagcttggcgaa

SEQ ID NO: 162157 - DNA, 25 bp, Homo sapien
agcttggcgaacacagaacttttta

SEQ ID NO: 162158 - DNA, 25 bp, Homo sapien
cacagaactttttacgggtatcgag

SEQ ID NO: 162159 - DNA, 25 bp, Homo sapien
tcttcacgctcaagagaatgggtgc

SEQ ID NO: 162160 - DNA, 25 bp, Homo sapien
agcaaggagaccctcgcctcgggtt

SEQ ID NO: 162161 - DNA, 25 bp, Homo sapien
tcgggttggatcctcgcaggaaata

SEQ ID NO: 162162 - DNA, 25 bp, Homo sapien
ggctcaagccggctctggagcttct

SEQ ID NO: 162163 - DNA, 25 bp, Homo sapien
caggaaataagctcccgtcggcttc

SEQ ID NO: 162164 - DNA, 25 bp, Homo sapien
cccgagaggagccaacatggccggc

SEQ ID NO: 162165 - DNA, 25 bp, Homo sapien
cccggggtacaagcggttcacatgg

SEQ ID NO: 162166 - DNA, 25 bp, Homo sapien
aggagtcatctccaccagccaggcg

SEQ ID NO: 162167 - DNA, 25 bp, Homo sapien
gaagcctccggattccggtcgcgga

SEQ ID NO: 162168 - DNA, 25 bp, Homo sapien
tgggcccagaataggaaaggtactc

SEQ ID NO: 162169 - DNA, 25 bp, Homo sapien
agaggcgtgagaagcctccggattc

SEQ ID NO: 162170 - DNA, 25 bp, Homo sapien
ccgcgggagatttttctggcgaaga

SEQ ID NO: 162171 - DNA, 25 bp, Homo sapien
aaaatgggcgagtagatagttcagg

SEQ ID NO: 162172 - DNA, 25 bp, Homo sapien
ggagagtcagatcccgaatcccggg

SEQ ID NO: 162173 - DNA, 25 bp, Homo sapien
atcccggggcaggataccgcaggaa

SEQ ID NO: 162174 - DNA, 25 bp, Homo sapien
gataccgcaggaacggcccgccaag

SEQ ID NO: 162175 - DNA, 25 bp, Homo sapien
gggcggcaaaatggaacgttagctc

SEQ ID NO: 162176 - DNA, 25 bp, Homo sapien
agctgggtcgaagaaacctcctatg

SEQ ID NO: 162177 - DNA, 25 bp, Homo sapien
ccgcttgtacggaacgcgtgtccaa

SEQ ID NO: 162178 - DNA, 25 bp, Homo sapien
gggtgtcccattcttgttctccagc

SEQ ID NO: 162179 - DNA, 25 bp, Homo sapien
gcggctccaggcatccttttaacac

SEQ ID NO: 162180 - DNA, 25 bp, Homo sapien
tttgcgccgcatagtccctgactaa

SEQ ID NO: 162181 - DNA, 25 bp, Homo sapien
gccagttaaaggtcatcggaagcca

SEQ ID NO: 162182 - DNA, 25 bp, Homo sapien
actcagccgaagtcaggcctctttc

SEQ ID NO: 162183 - DNA, 25 bp, Homo sapien
gcgacccacgaaggttcacgcttca

SEQ ID NO: 162184 - DNA, 25 bp, Homo sapien
ggaacgactgccaccaccgatgcga

SEQ ID NO: 162185 - DNA, 25 bp, Homo sapien
tgctgctagggagtcgacttctctc

SEQ ID NO: 162186 - DNA, 25 bp, Homo sapien
tgacgcagcaaaatgcccgggcctt

SEQ ID NO: 162187 - DNA, 25 bp, Homo sapien
tgcgcagtccttgtttttgggctcc

SEQ ID NO: 162188 - DNA, 25 bp, Homo sapien
cggcgcggctttctagagatatcta

SEQ ID NO: 162189 - DNA, 25 bp, Homo sapien
tcccgctctgtcttctcgcgttaga

SEQ ID NO: 162190 - DNA, 25 bp, Homo sapien
cgccttcggcgatttctctgagaaa

SEQ ID NO: 162191 - DNA, 25 bp, Homo sapien
cccacgcctgttgcagaaggaagcc

SEQ ID NO: 162192 - DNA, 25 bp, Homo sapien
gtagcggcacagaaagtacttactg

SEQ ID NO: 162193 - DNA, 25 bp, Homo sapien
atccgattccgggtcaagagctgcc

SEQ ID NO: 162194 - DNA, 25 bp, Homo sapien
ggcagccacttcctttgacgagtga

SEQ ID NO: 162195 - DNA, 25 bp, Homo sapien
acgagtgactgtcaggccgttccca

SEQ ID NO: 162196 - DNA, 25 bp, Homo sapien
cgcaggcctagcaggagctctctgc

SEQ ID NO: 162197 - DNA, 25 bp, Homo sapien
actgcggtattaagtcgacctcgcg

SEQ ID NO: 162198 - DNA, 25 bp, Homo sapien
ggacccacgcagtcctcagaactaa

SEQ ID NO: 162199 - DNA, 25 bp, Homo sapien
cagtttgcgatctgcccacgcgttc

SEQ ID NO: 162200 - DNA, 25 bp, Homo sapien
cggtggggtcaaacgtctccattga

SEQ ID NO: 162201 - DNA, 25 bp, Homo sapien
cgcgcggcacaaagcctggtgcaca

SEQ ID NO: 162202 - DNA, 25 bp, Homo sapien
cagaaggcgcttcatattgtcattc

SEQ ID NO: 162203 - DNA, 25 bp, Homo sapien
ctccaccgtagttgagccagcgata

SEQ ID NO: 162204 - DNA, 25 bp, Homo sapien
gcggaactcgccacggtaaggatta

SEQ ID NO: 162205 - DNA, 25 bp, Homo sapien
accacaggaattggcgggaacagca

SEQ ID NO: 162206 - DNA, 25 bp, Homo sapien
ttgtagttcccacttggtgcgcgcg

SEQ ID NO: 162207 - DNA, 25 bp, Homo sapien
ctccggagtcgcatctgggagggaa

SEQ ID NO: 162208 - DNA, 25 bp, Homo sapien
catggggctgaataaggggccaagc

SEQ ID NO: 162209 - DNA, 25 bp, Homo sapien
cccagcaagagcgagataaatgccg

SEQ ID NO: 162210 - DNA, 25 bp, Homo sapien
agagcgagataaatgccgggccgaa

SEQ ID NO: 162211 - DNA, 25 bp, Homo sapien
aacgagcgcctcagtccctccacaa

SEQ ID NO: 162212 - DNA, 25 bp, Homo sapien
tggaggcaacgagcgcctcagtccc

SEQ ID NO: 162213 - DNA, 25 bp, Homo sapien
cgctgcatcggctggggcgctccct

SEQ ID NO: 162214 - DNA, 25 bp, Homo sapien
tctggaggcaacgagcgcctcagtc

SEQ ID NO: 162215 - DNA, 25 bp, Homo sapien
gtagaccaagcagccggagaggatc

SEQ ID NO: 162216 - DNA, 25 bp, Homo sapien
gccaccgcccttctgcagagtaacg

SEQ ID NO: 162217 - DNA, 25 bp, Homo sapien
gaggatcaagagtagccgcactgtc

SEQ ID NO: 162218 - DNA, 25 bp, Homo sapien
actttcattcctcccgccatggttg

SEQ ID NO: 162219 - DNA, 25 bp, Homo sapien
gcaactaactccgaacgggcaacga

SEQ ID NO: 162220 - DNA, 25 bp, Homo sapien
ggcaacgacagcagcctatcctcta

SEQ ID NO: 162221 - DNA, 25 bp, Homo sapien
gacagcagcctatcctctacgaaac

SEQ ID NO: 162222 - DNA, 25 bp, Homo sapien
ggtacctgtgccgtagaccaagcag

SEQ ID NO: 162223 - DNA, 25 bp, Homo sapien
cggctatcgagggaaggaatcctac

SEQ ID NO: 162224 - DNA, 25 bp, Homo sapien
aaccacaaatcagtgcgccggcttc

SEQ ID NO: 162225 - DNA, 25 bp, Homo sapien
aacatggctcgcttcgctctgactg

SEQ ID NO: 162226 - DNA, 25 bp, Homo sapien
cgctctgactgttgtccggcagtga

SEQ ID NO: 162227 - DNA, 25 bp, Homo sapien
ctgtggcaggatgtctttctctctc

SEQ ID NO: 162228 - DNA, 25 bp, Homo sapien
ctctcttccttgagtgtgttggagc

SEQ ID NO: 162229 - DNA, 25 bp, Homo sapien
agatagcttcgttccgtgtttcaga

SEQ ID NO: 162230 - DNA, 25 bp, Homo sapien
ccgtgtttcagataaagtgaggccc

SEQ ID NO: 162231 - DNA, 25 bp, Homo sapien
cttgtgcgtggttgtgaaactcctc

SEQ ID NO: 162232 - DNA, 25 bp, Homo sapien
ggtctcctcgctaggccacattgta

SEQ ID NO: 162233 - DNA, 25 bp, Homo sapien
actctcgggcgaggtccctaataga

SEQ ID NO: 162234 - DNA, 25 bp, Homo sapien
ggcagggcctcatcctcagcaaaca

SEQ ID NO: 162235 - DNA, 25 bp, Homo sapien
ctgcctgacctacgcgctgacaaaa

SEQ ID NO: 162236 - DNA, 25 bp, Homo sapien
cacctaagtggtggcgtgcagcata

SEQ ID NO: 162237 - DNA, 25 bp, Homo sapien
ttcccaaactttccaggctagcatg

SEQ ID NO: 162238 - DNA, 25 bp, Homo sapien
aggcccgccttaagtgcacactata

SEQ ID NO: 162239 - DNA, 25 bp, Homo sapien
ggtgcacacacacggcgcgcatatc

SEQ ID NO: 162240 - DNA, 25 bp, Homo sapien
caggtgcacacacacggcgcgcata

SEQ ID NO: 162241 - DNA, 25 bp, Homo sapien
gcctgtccggttccctgtcacacct

SEQ ID NO: 162242 - DNA, 25 bp, Homo sapien
tgcggactccgcctgtccggttccc

SEQ ID NO: 162243 - DNA, 25 bp, Homo sapien
tgtgaatcacggagggacttaggtc

SEQ ID NO: 162244 - DNA, 25 bp, Homo sapien
gctacaaactgagttgtgaatcacg

SEQ ID NO: 162245 - DNA, 25 bp, Homo sapien
cggagaagcgcccaggctacaaact

SEQ ID NO: 162246 - DNA, 25 bp, Homo sapien
ttgtttccggagaagcgcccaggct

SEQ ID NO: 162247 - DNA, 25 bp, Homo sapien
ctagaaaatcgagcctcggcccaga

SEQ ID NO: 162248 - DNA, 25 bp, Homo sapien
tcggcgcatgcgcactcactggatt

SEQ ID NO: 162249 - DNA, 25 bp, Homo sapien
agtctccaaatcaaagctcagcctt

SEQ ID NO: 162250 - DNA, 25 bp, Homo sapien
tcgggtgtccctgtttactccgagc

SEQ ID NO: 162251 - DNA, 25 bp, Homo sapien
atcccagtccggtcttccaaagtct

SEQ ID NO: 162252 - DNA, 25 bp, Homo sapien
cctgaaatcctagagtatgacactg

SEQ ID NO: 162253 - DNA, 25 bp, Homo sapien
ctgctctctggagcaccagggagga

SEQ ID NO: 162254 - DNA, 25 bp, Homo sapien
acactgagtttcaaaggggagccgc

SEQ ID NO: 162255 - DNA, 25 bp, Homo sapien
tggaggacaagatctaccgcgggaa

SEQ ID NO: 162256 - DNA, 25 bp, Homo sapien
gaaatccggcgcatcgatcttcaca

SEQ ID NO: 162257 - DNA, 25 bp, Homo sapien
ggcgcatcgatcttcacaaaggaga

SEQ ID NO: 162258 - DNA, 25 bp, Homo sapien
tggtgcccggcctgcgcaacaccat

SEQ ID NO: 162259 - DNA, 25 bp, Homo sapien
agctgctggacaacggaggtgacca

SEQ ID NO: 162260 - DNA, 25 bp, Homo sapien
cggaggtgaccaccgattgctgcca

SEQ ID NO: 162261 - DNA, 25 bp, Homo sapien
gtgaccaccgattgctgccaggcag

SEQ ID NO: 162262 - DNA, 25 bp, Homo sapien
aaaggagactacagcgtcctggtgc

SEQ ID NO: 162263 - DNA, 25 bp, Homo sapien
atcgtgccgcgagtatgccggctac

SEQ ID NO: 162264 - DNA, 25 bp, Homo sapien
ctggcctttgactaccgggcaggca

SEQ ID NO: 162265 - DNA, 25 bp, Homo sapien
gaagaacgtcatcgccctggccttt

SEQ ID NO: 162266 - DNA, 25 bp, Homo sapien
gcccttcgaggaccctgagcacatg

SEQ ID NO: 162267 - DNA, 25 bp, Homo sapien
tgagcgcaacctcaatgcgcccgtg

SEQ ID NO: 162268 - DNA, 25 bp, Homo sapien
tccacctgtcggatgagcgcaacct

SEQ ID NO: 162269 - DNA, 25 bp, Homo sapien
agagcgcaccattctcaagagtatc

SEQ ID NO: 162270 - DNA, 25 bp, Homo sapien
tgccggctacctgctctactcagag

SEQ ID NO: 162271 - DNA, 25 bp, Homo sapien
cggccctgctccgagagtgagttct

SEQ ID NO: 162272 - DNA, 25 bp, Homo sapien
ccgactgcatggacggcagcgacga

SEQ ID NO: 162273 - DNA, 25 bp, Homo sapien
ctgtgacgcagacgccgactgcatg

SEQ ID NO: 162274 - DNA, 25 bp, Homo sapien
accagttccagtgcaagagcggcca

SEQ ID NO: 162275 - DNA, 25 bp, Homo sapien
cccgctgtgacatggaccagttcca

SEQ ID NO: 162276 - DNA, 25 bp, Homo sapien
gagaccacgactgcgcggacggctc

SEQ ID NO: 162277 - DNA, 25 bp, Homo sapien
cgctggaaatgcgatggagaccacg

SEQ ID NO: 162278 - DNA, 25 bp, Homo sapien
agtgagttctcctgtgccaacggcc

SEQ ID NO: 162279 - DNA, 25 bp, Homo sapien
agcggacagacagactgcccgattc

SEQ ID NO: 162280 - DNA, 25 bp, Homo sapien
gctccttaggaaggtaagagtggca

SEQ ID NO: 162281 - DNA, 25 bp, Homo sapien
tctttggcccgtggctccttaggaa

SEQ ID NO: 162282 - DNA, 25 bp, Homo sapien
ggaatggttcctcttgctctttggc

SEQ ID NO: 162283 - DNA, 25 bp, Homo sapien
gcgtgccggtgtgaaagtcaccttc

SEQ ID NO: 162284 - DNA, 25 bp, Homo sapien
acgggcactctcctagcgcaagttg

SEQ ID NO: 162285 - DNA, 25 bp, Homo sapien
caatgattctcatctccgggccgaa

SEQ ID NO: 162286 - DNA, 25 bp, Homo sapien
tgcccgattcaggacgggcactctc

SEQ ID NO: 162287 - DNA, 25 bp, Homo sapien
accggcaagatcgtggaccatgtga

SEQ ID NO: 162288 - DNA, 25 bp, Homo sapien
gcgctttcaattgccacgtggagta

SEQ ID NO: 162289 - DNA, 25 bp, Homo sapien
gggcaacctcagtgtcagcatcgtg

SEQ ID NO: 162290 - DNA, 25 bp, Homo sapien
ggtgcataccctcaagttttcgctg

SEQ ID NO: 162291 - DNA, 25 bp, Homo sapien
ggggacttctactttcgggtgcata

SEQ ID NO: 162292 - DNA, 25 bp, Homo sapien
cggcgcgcgccaaaaagatcttcgg

SEQ ID NO: 162293 - DNA, 25 bp, Homo sapien
acccgtcgcaggtgtgcttcaccga

SEQ ID NO: 162294 - DNA, 25 bp, Homo sapien
ggggccaaagagtcacgcgctttca

SEQ ID NO: 162295 - DNA, 25 bp, Homo sapien
tggacctcctgcgacttccgagttg

SEQ ID NO: 162296 - DNA, 25 bp, Homo sapien
gcgtagatccctcccgttagctttg

SEQ ID NO: 162297 - DNA, 25 bp, Homo sapien
cgacagcttgctgccctagaccaga

SEQ ID NO: 162298 - DNA, 25 bp, Homo sapien
tccgagttgcgatgctgtacttctc

SEQ ID NO: 162299 - DNA, 25 bp, Homo sapien
ttcctagtcacaaactctggggttc

SEQ ID NO: 162300 - DNA, 25 bp, Homo sapien
ggagttaactgcgagcctgtcctca

SEQ ID NO: 162301 - DNA, 25 bp, Homo sapien
tgaccgcccatttcacgtggcatta

SEQ ID NO: 162302 - DNA, 25 bp, Homo sapien
tggggctccaaacgctgggtaatca

SEQ ID NO: 162303 - DNA, 25 bp, Homo sapien
gcccaggcagattaagccgatcatc

SEQ ID NO: 162304 - DNA, 25 bp, Homo sapien
tcgtcatggcaacccggccgggaga

SEQ ID NO: 162305 - DNA, 25 bp, Homo sapien
tgcctttaccagacgtcggggctgc

SEQ ID NO: 162306 - DNA, 25 bp, Homo sapien
ttccgcatttcagggcgggccaagc

SEQ ID NO: 162307 - DNA, 25 bp, Homo sapien
tcgcagcaagtaaagcgcagcgctg

SEQ ID NO: 162308 - DNA, 25 bp, Homo sapien
gtgagcatcccaagccgtgccttta

SEQ ID NO: 162309 - DNA, 25 bp, Homo sapien
ggtacagtcgaaggtgcatgcagca

SEQ ID NO: 162310 - DNA, 25 bp, Homo sapien
cagccctgagatgccggtcggtaca

SEQ ID NO: 162311 - DNA, 25 bp, Homo sapien
ctgtctctgggtatgtccatctctc

SEQ ID NO: 162312 - DNA, 25 bp, Homo sapien
tggctttgtccctctgcatcggttt

SEQ ID NO: 162313 - DNA, 25 bp, Homo sapien
ttcgagattgccctaagccctctga

SEQ ID NO: 162314 - DNA, 25 bp, Homo sapien
gggcttcatctctgcttctgggctg

SEQ ID NO: 162315 - DNA, 25 bp, Homo sapien
ggacgcggaagctcctatctctcca

SEQ ID NO: 162316 - DNA, 25 bp, Homo sapien
tgcagcctccactcttctggtgtga

SEQ ID NO: 162317 - DNA, 25 bp, Homo sapien
cgcaggagtcattagccgcagatta

SEQ ID NO: 162318 - DNA, 25 bp, Homo sapien
cctattctctgggttgctgcctctg

SEQ ID NO: 162319 - DNA, 25 bp, Homo sapien
acttgcggccgctggcacgcactgt

SEQ ID NO: 162320 - DNA, 25 bp, Homo sapien
ctggtccaagtctgtgccgcggtag

SEQ ID NO: 162321 - DNA, 25 bp, Homo sapien
ccgcagctggtccaagtctgtgccg

SEQ ID NO: 162322 - DNA, 25 bp, Homo sapien
aggacacgtcccgtcccgcagctgg

SEQ ID NO: 162323 - DNA, 25 bp, Homo sapien
gcgtcagctgctcgcaggacacgtc

SEQ ID NO: 162324 - DNA, 25 bp, Homo sapien
agctgcgtcagctgctcgcaggaca

SEQ ID NO: 162325 - DNA, 25 bp, Homo sapien
tctgtgccgcggtaggtgagtttgc

SEQ ID NO: 162326 - DNA, 25 bp, Homo sapien
tgcggccgctggcacgcactgtaca

SEQ ID NO: 162327 - DNA, 25 bp, Homo sapien
agcgctggagcctctctgactctct

SEQ ID NO: 162328 - DNA, 25 bp, Homo sapien
ccgcctggacatttgttcggagatc

SEQ ID NO: 162329 - DNA, 25 bp, Homo sapien
tttgccaccgccgtttgcatgtggg

SEQ ID NO: 162330 - DNA, 25 bp, Homo sapien
tgggcctttccactaagaagcgggc

SEQ ID NO: 162331 - DNA, 25 bp, Homo sapien
cctgcaagagggcagaatgagccga

SEQ ID NO: 162332 - DNA, 25 bp, Homo sapien
ccttactgaaaggagcgcctgcgga

SEQ ID NO: 162333 - DNA, 25 bp, Homo sapien
tgtctcaagagacgcggcagggcac

SEQ ID NO: 162334 - DNA, 25 bp, Homo sapien
ggggccagggacatctcagagtaat

SEQ ID NO: 162335 - DNA, 25 bp, Homo sapien
cagggcttaagagtcttggtgagta

SEQ ID NO: 162336 - DNA, 25 bp, Homo sapien
agtaccggcccttcctcggatctgt

SEQ ID NO: 162337 - DNA, 25 bp, Homo sapien
cctcggatctgttttcaattcagtc

SEQ ID NO: 162338 - DNA, 25 bp, Homo sapien
agctcacatagggtcgctgtcacgc

SEQ ID NO: 162339 - DNA, 25 bp, Homo sapien
gcatgcggcagtatcatccatcacc

SEQ ID NO: 162340 - DNA, 25 bp, Homo sapien
atgacctttgcagcatgcggcagta

SEQ ID NO: 162341 - DNA, 25 bp, Homo sapien
ccttggcccagacttatgacctttg

SEQ ID NO: 162342 - DNA, 25 bp, Homo sapien
tcaattcagtctgctccttggccca

SEQ ID NO: 162343 - DNA, 25 bp, Homo sapien
ggcgccaagccagattccgaaatgc

SEQ ID NO: 162344 - DNA, 25 bp, Homo sapien
gctgcctgcggctaaatcgccaaga

SEQ ID NO: 162345 - DNA, 25 bp, Homo sapien
tctcactcggtacctgtcggaaagg

SEQ ID NO: 162346 - DNA, 25 bp, Homo sapien
ctagctcggttctcggaggacttga

SEQ ID NO: 162347 - DNA, 25 bp, Homo sapien
ttactgactacagaggcctcacctg

SEQ ID NO: 162348 - DNA, 25 bp, Homo sapien
agcccagatgggtctcaggttaccc

SEQ ID NO: 162349 - DNA, 25 bp, Homo sapien
cagctcttgcaagcggggcctgaaa

SEQ ID NO: 162350 - DNA, 25 bp, Homo sapien
tggctcctcctagtagatacgcgtt

SEQ ID NO: 162351 - DNA, 25 bp, Homo sapien
gcggccatccgaccctgacccatcg

SEQ ID NO: 162352 - DNA, 25 bp, Homo sapien
ttctctccagcagcgcacacttgga

SEQ ID NO: 162353 - DNA, 25 bp, Homo sapien
gaagggcgcaatagtttttaggtca

SEQ ID NO: 162354 - DNA, 25 bp, Homo sapien
acacttggagcagtccttcccgcgg

SEQ ID NO: 162355 - DNA, 25 bp, Homo sapien
cgaagcactggaagggcgcaatagt

SEQ ID NO: 162356 - DNA, 25 bp, Homo sapien
aagaaacacacggagctagccaccc

SEQ ID NO: 162357 - DNA, 25 bp, Homo sapien
ccacccaagaaacacacggagctag

SEQ ID NO: 162358 - DNA, 25 bp, Homo sapien
cagcgcacacttggagcagtccttc

SEQ ID NO: 162359 - DNA, 25 bp, Homo sapien
cccagacccgggacatagaggcaaa

SEQ ID NO: 162360 - DNA, 25 bp, Homo sapien
gcctgaggggatgctcagcttctta

SEQ ID NO: 162361 - DNA, 25 bp, Homo sapien
agcagtatagggtccctcaagggag

SEQ ID NO: 162362 - DNA, 25 bp, Homo sapien
cagcttcttagggactcatcccaga

SEQ ID NO: 162363 - DNA, 25 bp, Homo sapien
aaaaagtttgcgcttctcgcgggtg

SEQ ID NO: 162364 - DNA, 25 bp, Homo sapien
ctcatcctccagaacggcaagaggg

SEQ ID NO: 162365 - DNA, 25 bp, Homo sapien
gcgtaagcagtatagggtccctcaa

SEQ ID NO: 162366 - DNA, 25 bp, Homo sapien
gactcatcccagacccgggacatag

SEQ ID NO: 162367 - DNA, 25 bp, Homo sapien
ctttagtttgttgcgcacgcggttc

SEQ ID NO: 162368 - DNA, 25 bp, Homo sapien
gtatccctagctggactctgaccca

SEQ ID NO: 162369 - DNA, 25 bp, Homo sapien
taaccagccgctcgatgacagtccg

SEQ ID NO: 162370 - DNA, 25 bp, Homo sapien
gctacccgctggtccctgacaatga

SEQ ID NO: 162371 - DNA, 25 bp, Homo sapien
ctgaggccacggtgttgtttccttc

SEQ ID NO: 162372 - DNA, 25 bp, Homo sapien
gtccacgctactttcgggccggcta

SEQ ID NO: 162373 - DNA, 25 bp, Homo sapien
ggtgggaggcttcctcacttcttta

SEQ ID NO: 162374 - DNA, 25 bp, Homo sapien
ccaggcaaggaaacgctcgggtcaa

SEQ ID NO: 162375 - DNA, 25 bp, Homo sapien
tgctcatcagcactgtaggcccgga

SEQ ID NO: 162376 - DNA, 25 bp, Homo sapien
tccggttgcatcagcgagggattca

SEQ ID NO: 162377 - DNA, 25 bp, Homo sapien
ccgctgaactcagaagcgggaggcc

SEQ ID NO: 162378 - DNA, 25 bp, Homo sapien
agggcagtggcctaatacggaactc

SEQ ID NO: 162379 - DNA, 25 bp, Homo sapien
gattcacggcgaaatgagactgttc

SEQ ID NO: 162380 - DNA, 25 bp, Homo sapien
cccggaaggtactcgtgctggtgct

SEQ ID NO: 162381 - DNA, 25 bp, Homo sapien
atcagcactgtaggcccggaaggta

SEQ ID NO: 162382 - DNA, 25 bp, Homo sapien
gactgttcgtgagtgatggcgtccc

SEQ ID NO: 162383 - DNA, 25 bp, Homo sapien
tcacccagtcttagagcgggggtgt

SEQ ID NO: 162384 - DNA, 25 bp, Homo sapien
atggtcacccagtcttagagcgggg

SEQ ID NO: 162385 - DNA, 25 bp, Homo sapien
gatggtcacccagtcttagagcggg

SEQ ID NO: 162386 - DNA, 25 bp, Homo sapien
cgatggtcacccagtcttagagcgg

SEQ ID NO: 162387 - DNA, 25 bp, Homo sapien
gcgatggtcacccagtcttagagcg

SEQ ID NO: 162388 - DNA, 25 bp, Homo sapien
ctgagcgatggtcacccagtcttag

SEQ ID NO: 162389 - DNA, 25 bp, Homo sapien
tgagcgatggtcacccagtcttaga

SEQ ID NO: 162390 - DNA, 25 bp, Homo sapien
gagcgatggtcacccagtcttagag

SEQ ID NO: 162391 - DNA, 25 bp, Homo sapien
ccgcggacaggcctaacgatgaggc

SEQ ID NO: 162392 - DNA, 25 bp, Homo sapien
aggcctaacgatgaggcctgaagtt

SEQ ID NO: 162393 - DNA, 25 bp, Homo sapien
gcctgaagttggctacgggaaagaa

SEQ ID NO: 162394 - DNA, 25 bp, Homo sapien
ttggctacgggaaagaatgaatttc

SEQ ID NO: 162395 - DNA, 25 bp, Homo sapien
gaaagaatgaatttcccaagggcaa

SEQ ID NO: 162396 - DNA, 25 bp, Homo sapien
aaccgaggtccctttgcccagcagc

SEQ ID NO: 162397 - DNA, 25 bp, Homo sapien
agagcagggcccgtgttccggctcc

SEQ ID NO: 162398 - DNA, 25 bp, Homo sapien
caggggtggagagacgccgtcgtcc

SEQ ID NO: 162399 - DNA, 25 bp, Homo sapien
agaagctgctgttccgcccacctag

SEQ ID NO: 162400 - DNA, 25 bp, Homo sapien
cggggatgatgcaatgtttggcaac

SEQ ID NO: 162401 - DNA, 25 bp, Homo sapien
ggcaaccggtgtctgcacgcgcacg

SEQ ID NO: 162402 - DNA, 25 bp, Homo sapien
caacggctatcagccttggtcgccc

SEQ ID NO: 162403 - DNA, 25 bp, Homo sapien
ccctagtcggtcgtgagcctctttg

SEQ ID NO: 162404 - DNA, 25 bp, Homo sapien
tcgtgagcctctttgccgcttgtct

SEQ ID NO: 162405 - DNA, 25 bp, Homo sapien
gtgagcctctttgccgcttgtctcc

SEQ ID NO: 162406 - DNA, 25 bp, Homo sapien
gatgcaatgtttggcaaccggtgtc

SEQ ID NO: 162407 - DNA, 25 bp, Homo sapien
gcgcagtgccttctgggaacggaat

SEQ ID NO: 162408 - DNA, 25 bp, Homo sapien
gtgtttgttctcttggggattaatg

SEQ ID NO: 162409 - DNA, 25 bp, Homo sapien
agcggcgcttcctgctaggaccggc

SEQ ID NO: 162410 - DNA, 25 bp, Homo sapien
aggccgctcggtgatccgcggcggc

SEQ ID NO: 162411 - DNA, 25 bp, Homo sapien
cagcagcctgcgcagtgccttctgg

SEQ ID NO: 162412 - DNA, 25 bp, Homo sapien
ggcgcgctcccgcatgcgcactgca

SEQ ID NO: 162413 - DNA, 25 bp, Homo sapien
agcctgcgcagtgccttctgggaac

SEQ ID NO: 162414 - DNA, 25 bp, Homo sapien
tccagttggctcgtcgctgtccgct

SEQ ID NO: 162415 - DNA, 25 bp, Homo sapien
cgtatttagggtccgccatggcggc

SEQ ID NO: 162416 - DNA, 25 bp, Homo sapien
gagtcgatttctgggccgagctacc

SEQ ID NO: 162417 - DNA, 25 bp, Homo sapien
cgagctaccggcgactgccggaaag

SEQ ID NO: 162418 - DNA, 25 bp, Homo sapien
gggccggtcctgtactcacaatgcc

SEQ ID NO: 162419 - DNA, 25 bp, Homo sapien
ctgtactcacaatgccgggaaggtc

SEQ ID NO: 162420 - DNA, 25 bp, Homo sapien
caatgccgggaaggtcggcgtattt

SEQ ID NO: 162421 - DNA, 25 bp, Homo sapien
gtcggcgtatttagggtccgccatg

SEQ ID NO: 162422 - DNA, 25 bp, Homo sapien
gagcggcagatgagcaggaagtctc

SEQ ID NO: 162423 - DNA, 25 bp, Homo sapien
ctcccggagtggtgtatagagctga

SEQ ID NO: 162424 - DNA, 25 bp, Homo sapien
ttcgggaccattcgggacacgtgaa

SEQ ID NO: 162425 - DNA, 25 bp, Homo sapien
ctcgggctgaatccgctcccggagt

SEQ ID NO: 162426 - DNA, 25 bp, Homo sapien
gttccggggcgtctctgcaaggaac

SEQ ID NO: 162427 - DNA, 25 bp, Homo sapien
tctctgcaaggaacggaagcacagg

SEQ ID NO: 162428 - DNA, 25 bp, Homo sapien
actgcaggagattgcaaaaggcgca

SEQ ID NO: 162429 - DNA, 25 bp, Homo sapien
aaaaggcgcagagcacagttgttgg

SEQ ID NO: 162430 - DNA, 25 bp, Homo sapien
ctgcttgtcacactcgggctgaatc

SEQ ID NO: 162431 - DNA, 25 bp, Homo sapien
tgctggaaggacaagagcgaaccac

SEQ ID NO: 162432 - DNA, 25 bp, Homo sapien
ctggtgttggaacctgcagttctcc

SEQ ID NO: 162433 - DNA, 25 bp, Homo sapien
tccagcgtctggtgttggaacctgc

SEQ ID NO: 162434 - DNA, 25 bp, Homo sapien
cgtcgtacccgttttccagcgtctg

SEQ ID NO: 162435 - DNA, 25 bp, Homo sapien
ggcccagactgaccaggaagtgata

SEQ ID NO: 162436 - DNA, 25 bp, Homo sapien
ctaatgggtcactggccatcgggct

SEQ ID NO: 162437 - DNA, 25 bp, Homo sapien
ggatctcgttcctccgggacaggaa

SEQ ID NO: 162438 - DNA, 25 bp, Homo sapien
ttctccgggtcgaaatagtgctgga

SEQ ID NO: 162439 - DNA, 25 bp, Homo sapien
agaggagcggtgaggttccaccctt

SEQ ID NO: 162440 - DNA, 25 bp, Homo sapien
aggagcggtgaggttccacccttcg

SEQ ID NO: 162441 - DNA, 25 bp, Homo sapien
ggggtcgacgtcgagccagcgtccc

SEQ ID NO: 162442 - DNA, 25 bp, Homo sapien
ggcagagagcccgaaaggaccagac

SEQ ID NO: 162443 - DNA, 25 bp, Homo sapien
agagcccgaaaggaccagacgccca

SEQ ID NO: 162444 - DNA, 25 bp, Homo sapien
cgaaaggaccagacgcccaggtcgc

SEQ ID NO: 162445 - DNA, 25 bp, Homo sapien
agacgcccaggtcgcccgcatcccg

SEQ ID NO: 162446 - DNA, 25 bp, Homo sapien
ccgcatcccgctgccgcaggagaga

SEQ ID NO: 162447 - DNA, 25 bp, Homo sapien
cctagttgacagttcgaggggcctc

SEQ ID NO: 162448 - DNA, 25 bp, Homo sapien
ttcggcttcgcctccaagaccaaga

SEQ ID NO: 162449 - DNA, 25 bp, Homo sapien
accagccacggtatcggcggcgaca

SEQ ID NO: 162450 - DNA, 25 bp, Homo sapien
gcaccacggtctcctagttgacagt

SEQ ID NO: 162451 - DNA, 25 bp, Homo sapien
ggagactatggcgtcctcctcggtc

SEQ ID NO: 162452 - DNA, 25 bp, Homo sapien
gcccacacactgagcggacattggg

SEQ ID NO: 162453 - DNA, 25 bp, Homo sapien
tgcttcgtcagcttacagggatccc

SEQ ID NO: 162454 - DNA, 25 bp, Homo sapien
gtagcccactcggtgagaaccagcc

SEQ ID NO: 162455 - DNA, 25 bp, Homo sapien
gggcagtcgcaggaatacatgaatt

SEQ ID NO: 162456 - DNA, 25 bp, Homo sapien
gggcggattccgcagcagcaactcc

SEQ ID NO: 162457 - DNA, 25 bp, Homo sapien
ccctcgaccctgaaacttggagcag

SEQ ID NO: 162458 - DNA, 25 bp, Homo sapien
agggctgcacccacaactcaactta

SEQ ID NO: 162459 - DNA, 25 bp, Homo sapien
cgaaaacgagttctgcggggcagtc

SEQ ID NO: 162460 - DNA, 25 bp, Homo sapien
atacatgaattctattacgagggcc

SEQ ID NO: 162461 - DNA, 25 bp, Homo sapien
aattctattacgagggccatagccc

SEQ ID NO: 162462 - DNA, 25 bp, Homo sapien
ccacaactcaacttatccgaaaacg

SEQ ID NO: 162463 - DNA, 25 bp, Homo sapien
acgtggagtgggaacgtggtggtgt

SEQ ID NO: 162464 - DNA, 25 bp, Homo sapien
gggcctagagccacccctaaccaga

SEQ ID NO: 162465 - DNA, 25 bp, Homo sapien
cgctgggacccgcacagcgccagtg

SEQ ID NO: 162466 - DNA, 25 bp, Homo sapien
ccgcggccaggcctgttattcagct

SEQ ID NO: 162467 - DNA, 25 bp, Homo sapien
aggcctgttattcagctctccgctc

SEQ ID NO: 162468 - DNA, 25 bp, Homo sapien
gccaggcctgttattcagctctccg

SEQ ID NO: 162469 - DNA, 25 bp, Homo sapien
cctaaccagaggccggagacagctg

SEQ ID NO: 162470 - DNA, 25 bp, Homo sapien
cggccaggcctgttattcagctctc

SEQ ID NO: 162471 - DNA, 25 bp, Homo sapien
cagacccgagaaggtcctcaagcga

SEQ ID NO: 162472 - DNA, 25 bp, Homo sapien
tctcaccgaggctcggttccatcag

SEQ ID NO: 162473 - DNA, 25 bp, Homo sapien
catcagctcttcaggggcgaagagc

SEQ ID NO: 162474 - DNA, 25 bp, Homo sapien
ggaaccggagctacctgaagagcgc

SEQ ID NO: 162475 - DNA, 25 bp, Homo sapien
ttcagggcaccaggacctacccagg

SEQ ID NO: 162476 - DNA, 25 bp, Homo sapien
gcgaagagcaggaaccggagctacc

SEQ ID NO: 162477 - DNA, 25 bp, Homo sapien
aggctcagggaagctctcaccgagg

SEQ ID NO: 162478 - DNA, 25 bp, Homo sapien
ccaagggcagaatgagcgggattca

SEQ ID NO: 162479 - DNA, 25 bp, Homo sapien
gcggcaggaactttcgccatactca

SEQ ID NO: 162480 - DNA, 25 bp, Homo sapien
tgctcgtgccggtcaaggaattgaa

SEQ ID NO: 162481 - DNA, 25 bp, Homo sapien
ttgaacgtgagattccgagaccggc

SEQ ID NO: 162482 - DNA, 25 bp, Homo sapien
gctgcacgtgctcttgtcccagctg

SEQ ID NO: 162483 - DNA, 25 bp, Homo sapien
acctttttgtccgagcctgtggtca

SEQ ID NO: 162484 - DNA, 25 bp, Homo sapien
tcggcgtcttgtccacctttttgtc

SEQ ID NO: 162485 - DNA, 25 bp, Homo sapien
ctctagatggtgacagcgcgtcttc

SEQ ID NO: 162486 - DNA, 25 bp, Homo sapien
ggttggtttgctcctcctctagatg

SEQ ID NO: 162487 - DNA, 25 bp, Homo sapien
ggttacttgagacacggccaggttc

SEQ ID NO: 162488 - DNA, 25 bp, Homo sapien
cgtggttctctctttgtcctagggc

SEQ ID NO: 162489 - DNA, 25 bp, Homo sapien
gcaccttgtcagtccgcgccaggaa

SEQ ID NO: 162490 - DNA, 25 bp, Homo sapien
tccgcgccaggaagaagttaaccac

SEQ ID NO: 162491 - DNA, 25 bp, Homo sapien
cagcacgtacttggtggttacttga

SEQ ID NO: 162492 - DNA, 25 bp, Homo sapien
ggcaaagccggagatctcgcgcacc

SEQ ID NO: 162493 - DNA, 25 bp, Homo sapien
tccgcgccgtgaagacgaagtcgtc

SEQ ID NO: 162494 - DNA, 25 bp, Homo sapien
tcagcagctgccgataagtggtggc

SEQ ID NO: 162495 - DNA, 25 bp, Homo sapien
ccgaggcctggcatcttaatgctga

SEQ ID NO: 162496 - DNA, 25 bp, Homo sapien
acacatcgcgctagggtttgcactg

SEQ ID NO: 162497 - DNA, 25 bp, Homo sapien
agacatttggatgccgcggtttcga

SEQ ID NO: 162498 - DNA, 25 bp, Homo sapien
cccgctctatcagggcagtggcagt

SEQ ID NO: 162499 - DNA, 25 bp, Homo sapien
tcagtctgagcatcacctgggccgg

SEQ ID NO: 162500 - DNA, 25 bp, Homo sapien
aatgcagaatcatgcccgtgctggc

SEQ ID NO: 162501 - DNA, 25 bp, Homo sapien
gggcactgacctgtctaacgctcta

SEQ ID NO: 162502 - DNA, 25 bp, Homo sapien
ctaaggcagcggcaaaatttcggtc

SEQ ID NO: 162503 - DNA, 25 bp, Homo sapien
caccgccccgtgagaggaaaaagcg

SEQ ID NO: 162504 - DNA, 25 bp, Homo sapien
atggccgaggtcacctcctgggctg

SEQ ID NO: 162505 - DNA, 25 bp, Homo sapien
atcgtgcgctgcgagggcatcgaca

SEQ ID NO: 162506 - DNA, 25 bp, Homo sapien
gcgctgcgagggcatcgacatttct

SEQ ID NO: 162507 - DNA, 25 bp, Homo sapien
cccacgtcttctggcagagcttgcg

SEQ ID NO: 162508 - DNA, 25 bp, Homo sapien
cgtcttctggcagagcttgcgagcc

SEQ ID NO: 162509 - DNA, 25 bp, Homo sapien
ccaggtgttcggtggcgtcccaccg

SEQ ID NO: 162510 - DNA, 25 bp, Homo sapien
cgcctaggacctgccgccaggtgtt

SEQ ID NO: 162511 - DNA, 25 bp, Homo sapien
cttcgggccagtgcgcattgcctac

SEQ ID NO: 162512 - DNA, 25 bp, Homo sapien
cggaggcgagggattgtttcccaca

SEQ ID NO: 162513 - DNA, 25 bp, Homo sapien
cgggctcagggcacaaaaagcgcac

SEQ ID NO: 162514 - DNA, 25 bp, Homo sapien
ttgtttcccacaagggactggagtc

SEQ ID NO: 162515 - DNA, 25 bp, Homo sapien
agggcacaaaaagcgcacacgcaca

SEQ ID NO: 162516 - DNA, 25 bp, Homo sapien
gctacaggacttcgctgagcgccag

SEQ ID NO: 162517 - DNA, 25 bp, Homo sapien
gcagggactggacgcatacggaccc

SEQ ID NO: 162518 - DNA, 25 bp, Homo sapien
cccgtgctacaggacttcgctgagc

SEQ ID NO: 162519 - DNA, 25 bp, Homo sapien
tggcttagggcggaaacagattctc

SEQ ID NO: 162520 - DNA, 25 bp, Homo sapien
cttgtcgatgattggctggtctctg

SEQ ID NO: 162521 - DNA, 25 bp, Homo sapien
ccaataaaatcatgtggcgccgatg

SEQ ID NO: 162522 - DNA, 25 bp, Homo sapien
cggcggaaacgctgctgtccagttt

SEQ ID NO: 162523 - DNA, 25 bp, Homo sapien
tccagtttgttaggactgctgcttc

SEQ ID NO: 162524 - DNA, 25 bp, Homo sapien
ctgggactcctgttacccgcaagtc

SEQ ID NO: 162525 - DNA, 25 bp, Homo sapien
gcgcatagaccacgcctctgaaatt

SEQ ID NO: 162526 - DNA, 25 bp, Homo sapien
gaccttggagccacgtttacaaata

SEQ ID NO: 162527 - DNA, 25 bp, Homo sapien
agcccggcgcgagacctggacagca

SEQ ID NO: 162528 - DNA, 25 bp, Homo sapien
cctcgagtccagcagcgtgttgttg

SEQ ID NO: 162529 - DNA, 25 bp, Homo sapien
cgtgttgttggcacgggtgcctgca

SEQ ID NO: 162530 - DNA, 25 bp, Homo sapien
ccctcgagtccagcagcgtgttgtt

SEQ ID NO: 162531 - DNA, 25 bp, Homo sapien
gcaatctctccagctagcccggcgc

SEQ ID NO: 162532 - DNA, 25 bp, Homo sapien
accaaatagccactttcccagttca

SEQ ID NO: 162533 - DNA, 25 bp, Homo sapien
cgtgggtcccgctgatccggccgtc

SEQ ID NO: 162534 - DNA, 25 bp, Homo sapien
ctagcccggcgcgagacctggacag

SEQ ID NO: 162535 - DNA, 25 bp, Homo sapien
gctcacgtacccacagcagcagttg

SEQ ID NO: 162536 - DNA, 25 bp, Homo sapien
actataccagcgcaaccggggcgtc

SEQ ID NO: 162537 - DNA, 25 bp, Homo sapien
cgccaggcgttttccgagatgaagc

SEQ ID NO: 162538 - DNA, 25 bp, Homo sapien
gctgctcgtacttggcgcgaatcca

SEQ ID NO: 162539 - DNA, 25 bp, Homo sapien
accagggatcaacggaaaaggctct

SEQ ID NO: 162540 - DNA, 25 bp, Homo sapien
tgttccctcacgcttaccgcgaaga

SEQ ID NO: 162541 - DNA, 25 bp, Homo sapien
tgtctctcccgctgggcaactatac

SEQ ID NO: 162542 - DNA, 25 bp, Homo sapien
gcgccaggaacagtagctgctcgta

SEQ ID NO: 162543 - DNA, 25 bp, Homo sapien
aggatgctccttccgccagccaggt

SEQ ID NO: 162544 - DNA, 25 bp, Homo sapien
gggaagtgaggcttcctatccgccc

SEQ ID NO: 162545 - DNA, 25 bp, Homo sapien
gtacggattgcctttgcagcagttc

SEQ ID NO: 162546 - DNA, 25 bp, Homo sapien
gcctatctcctccagtaggaaaata

SEQ ID NO: 162547 - DNA, 25 bp, Homo sapien
tgtgagccgaaccaagagtctcctg

SEQ ID NO: 162548 - DNA, 25 bp, Homo sapien
tcctctcccgggagtgtgagccgaa

SEQ ID NO: 162549 - DNA, 25 bp, Homo sapien
ggaactctgggatccggagccatct

SEQ ID NO: 162550 - DNA, 25 bp, Homo sapien
tttaaatattctgcacgttccagcc

SEQ ID NO: 162551 - DNA, 25 bp, Homo sapien
gccgctgataaacttgagcatcttg

SEQ ID NO: 162552 - DNA, 25 bp, Homo sapien
ttgccctcgctttcgggccatgaca

SEQ ID NO: 162553 - DNA, 25 bp, Homo sapien
tgctcgtgctgatccacagcgcatc

SEQ ID NO: 162554 - DNA, 25 bp, Homo sapien
atcttgcggtcacgagtggatgctc

SEQ ID NO: 162555 - DNA, 25 bp, Homo sapien
ctcttggtgaagatgccgctgataa

SEQ ID NO: 162556 - DNA, 25 bp, Homo sapien
tcttactcttgcctttccgagggga

SEQ ID NO: 162557 - DNA, 25 bp, Homo sapien
gtcccggatgcaagtcactgttgtc

SEQ ID NO: 162558 - DNA, 25 bp, Homo sapien
caccagaggtcgaagctgtagagcc

SEQ ID NO: 162559 - DNA, 25 bp, Homo sapien
aaaatccagggctggatttctctcc

SEQ ID NO: 162560 - DNA, 25 bp, Homo sapien
gaggatgctggggatggagatacag

SEQ ID NO: 162561 - DNA, 25 bp, Homo sapien
atgcgcgctgtgtccgggcgctccc

SEQ ID NO: 162562 - DNA, 25 bp, Homo sapien
ccctcacattgaggaggaggcggcc

SEQ ID NO: 162563 - DNA, 25 bp, Homo sapien
tccaccagcaccgatgtctgcgagg

SEQ ID NO: 162564 - DNA, 25 bp, Homo sapien
accagcaccgatgtctgcgagggcg

SEQ ID NO: 162565 - DNA, 25 bp, Homo sapien
gcggtgcaaaatccagggctggatt

SEQ ID NO: 162566 - DNA, 25 bp, Homo sapien
tctgcgagggcggtgcaaaatccag

SEQ ID NO: 162567 - DNA, 25 bp, Homo sapien
gaccatagacacaggccgcaagcta

SEQ ID NO: 162568 - DNA, 25 bp, Homo sapien
ttgagcgacccttccataaccagct

SEQ ID NO: 162569 - DNA, 25 bp, Homo sapien
ttcctgggaagggactgcacttacc

SEQ ID NO: 162570 - DNA, 25 bp, Homo sapien
tgaccgcttgacattgctctgagga

SEQ ID NO: 162571 - DNA, 25 bp, Homo sapien
atacacccgagctcggtccggagca

SEQ ID NO: 162572 - DNA, 25 bp, Homo sapien
ggcagccacgtgatctgttgctatc

SEQ ID NO: 162573 - DNA, 25 bp, Homo sapien
tgttgctatcacacgtgaccgcttg

SEQ ID NO: 162574 - DNA, 25 bp, Homo sapien
tcaccatgtgaccagctgccaaaga

SEQ ID NO: 162575 - DNA, 25 bp, Homo sapien
gggccgagccaagcctgatcccgga

SEQ ID NO: 162576 - DNA, 25 bp, Homo sapien
agcagtgaacggctgtcgcaggccc

SEQ ID NO: 162577 - DNA, 25 bp, Homo sapien
gtgtccggacgatgctcaagtctcg

SEQ ID NO: 162578 - DNA, 25 bp, Homo sapien
ctcaagtctcggctccgcatgtttc

SEQ ID NO: 162579 - DNA, 25 bp, Homo sapien
cgcatgtttctgaacgagctgaagc

SEQ ID NO: 162580 - DNA, 25 bp, Homo sapien
ccctgtcgctcagcagtagcctgga

SEQ ID NO: 162581 - DNA, 25 bp, Homo sapien
gtagcctggacagcggactccgaac

SEQ ID NO: 162582 - DNA, 25 bp, Homo sapien
gccaagcctgatcccggagccggag

SEQ ID NO: 162583 - DNA, 25 bp, Homo sapien
cagttcccaggattcgggcctcaaa

SEQ ID NO: 162584 - DNA, 25 bp, Homo sapien
actgcggagcctttgccattcttcg

SEQ ID NO: 162585 - DNA, 25 bp, Homo sapien
ctcacgcagtgagcagtccgcaagc

SEQ ID NO: 162586 - DNA, 25 bp, Homo sapien
ccagattgatagtttcgggacccgc

SEQ ID NO: 162587 - DNA, 25 bp, Homo sapien
gttcccgggtaacttgagtcacaga

SEQ ID NO: 162588 - DNA, 25 bp, Homo sapien
attcttcgccttccctgcagggttg

SEQ ID NO: 162589 - DNA, 25 bp, Homo sapien
cgcagactacgttgttcagggttcc

SEQ ID NO: 162590 - DNA, 25 bp, Homo sapien
gccgcacaaggtcgcagactacgtt

SEQ ID NO: 162591 - DNA, 25 bp, Homo sapien
agttgcagcacaactgctctcccgg

SEQ ID NO: 162592 - DNA, 25 bp, Homo sapien
cgccaactcctctctcggtcgaatc

SEQ ID NO: 162593 - DNA, 25 bp, Homo sapien
aaaaactgacgtcacccatctgatc

SEQ ID NO: 162594 - DNA, 25 bp, Homo sapien
aaatcctcccagcagttgcagcaca

SEQ ID NO: 162595 - DNA, 25 bp, Homo sapien
tgctctcccggctgctttgagaatc

SEQ ID NO: 162596 - DNA, 25 bp, Homo sapien
tgctttgagaatcccgccctcctct

SEQ ID NO: 162597 - DNA, 25 bp, Homo sapien
tgcccactcctcactagcgcagcgt

SEQ ID NO: 162598 - DNA, 25 bp, Homo sapien
ccatctgatcctcccgggtctaccc

SEQ ID NO: 162599 - DNA, 25 bp, Homo sapien
actagcgcagcgtgtggtccgccat

SEQ ID NO: 162600 - DNA, 25 bp, Homo sapien
agccatgcgcgttggtggcagttcc

SEQ ID NO: 162601 - DNA, 25 bp, Homo sapien
gcgcaggccagaggcgcaagttaat

SEQ ID NO: 162602 - DNA, 25 bp, Homo sapien
ggtttctctaccaaatccacgtgga

SEQ ID NO: 162603 - DNA, 25 bp, Homo sapien
ccatgatcccagtccggggtttctc

SEQ ID NO: 162604 - DNA, 25 bp, Homo sapien
agtctcggctgccatgatcccagtc

SEQ ID NO: 162605 - DNA, 25 bp, Homo sapien
agcacgttgccggtagtagcgcttc

SEQ ID NO: 162606 - DNA, 25 bp, Homo sapien
gcgcaagttaatgacgcagccatgc

SEQ ID NO: 162607 - DNA, 25 bp, Homo sapien
tccatcttggatgacgtcgtgaggc

SEQ ID NO: 162608 - DNA, 25 bp, Homo sapien
actgggaccacctacagacgctgga

SEQ ID NO: 162609 - DNA, 25 bp, Homo sapien
gtcacgtcacacaatgcggctgctc

SEQ ID NO: 162610 - DNA, 25 bp, Homo sapien
agcaggtcgcgcaaacgccattccg

SEQ ID NO: 162611 - DNA, 25 bp, Homo sapien
aagccttcgacacacctgcagggtc

SEQ ID NO: 162612 - DNA, 25 bp, Homo sapien
tgcacatgcgcagaacgtttcccta

SEQ ID NO: 162613 - DNA, 25 bp, Homo sapien
agcccacgtccctgcggctttggag

SEQ ID NO: 162614 - DNA, 25 bp, Homo sapien
tccagcggcctgagtgattgctgtc

SEQ ID NO: 162615 - DNA, 25 bp, Homo sapien
gtgggcatgtgctgaccatcacgca

SEQ ID NO: 162616 - DNA, 25 bp, Homo sapien
ggcccagatcccgaatctgagtcgg

SEQ ID NO: 162617 - DNA, 25 bp, Homo sapien
tctgagtcggaatcggtgttcccgc

SEQ ID NO: 162618 - DNA, 25 bp, Homo sapien
tcgggctctttgcagactcttactc

SEQ ID NO: 162619 - DNA, 25 bp, Homo sapien
cttactcggagaagagccagttctg

SEQ ID NO: 162620 - DNA, 25 bp, Homo sapien
agccagttctgtttctgtgggcatg

SEQ ID NO: 162621 - DNA, 25 bp, Homo sapien
atcacgcagaactttgggtcccgcc

SEQ ID NO: 162622 - DNA, 25 bp, Homo sapien
tgggaggtccagatcccggactccg

SEQ ID NO: 162623 - DNA, 25 bp, Homo sapien
gacagctgcgccgaagacgcccttt

SEQ ID NO: 162624 - DNA, 25 bp, Homo sapien
tcagcgaaactggtcagaggcagcc

SEQ ID NO: 162625 - DNA, 25 bp, Homo sapien
tggagccgtgttccatctaacaatc

SEQ ID NO: 162626 - DNA, 25 bp, Homo sapien
cgctggctctaagccctggaggtca

SEQ ID NO: 162627 - DNA, 25 bp, Homo sapien
tggcccagtgcttcgagagctaccc

SEQ ID NO: 162628 - DNA, 25 bp, Homo sapien
ggcctgcaagtgctggactccagtc

SEQ ID NO: 162629 - DNA, 25 bp, Homo sapien
agctagctgcccgaacgacctcggg

SEQ ID NO: 162630 - DNA, 25 bp, Homo sapien
gtcgggcttgtttgctcagcgaaac

SEQ ID NO: 162631 - DNA, 25 bp, Homo sapien
ggtgatgattggacgactggtaaca

SEQ ID NO: 162632 - DNA, 25 bp, Homo sapien
ccgttgtgacgaaagtgcagggaca

SEQ ID NO: 162633 - DNA, 25 bp, Homo sapien
tgcagggacaaagcacaaactcggc

SEQ ID NO: 162634 - DNA, 25 bp, Homo sapien
tctggtggaccggatacggaaaagc

SEQ ID NO: 162635 - DNA, 25 bp, Homo sapien
gagggcgggagcaaattcgctttcc

SEQ ID NO: 162636 - DNA, 25 bp, Homo sapien
ccgcaagcatggctggtgatgattg

SEQ ID NO: 162637 - DNA, 25 bp, Homo sapien
ccggatacggaaaagcggtgccttg

SEQ ID NO: 162638 - DNA, 25 bp, Homo sapien
gcacaaactcggctctggtggaccg

SEQ ID NO: 162639 - DNA, 25 bp, Homo sapien
cgccggcgggattgccgaaagacca

SEQ ID NO: 162640 - DNA, 25 bp, Homo sapien
ctgcgtctgccgccgtttttaaacg

SEQ ID NO: 162641 - DNA, 25 bp, Homo sapien
agtccgggttgaccgcccactctga

SEQ ID NO: 162642 - DNA, 25 bp, Homo sapien
agcaacagcttttcctccgagggcg

SEQ ID NO: 162643 - DNA, 25 bp, Homo sapien
ttgccgaaagaccaagcgggtgcca

SEQ ID NO: 162644 - DNA, 25 bp, Homo sapien
caggcctcacccgaccttgatgttg

SEQ ID NO: 162645 - DNA, 25 bp, Homo sapien
ccgaccttgatgttggcgttagtcc

SEQ ID NO: 162646 - DNA, 25 bp, Homo sapien
ttcctccgggttgagcaacagcttt

SEQ ID NO: 162647 - DNA, 25 bp, Homo sapien
gctttgtgaaccgaggctcggcgcg

SEQ ID NO: 162648 - DNA, 25 bp, Homo sapien
ctcggaggcacaggaccgcggggcc

SEQ ID NO: 162649 - DNA, 25 bp, Homo sapien
ccctgaacggcagcccgccgcgagg

SEQ ID NO: 162650 - DNA, 25 bp, Homo sapien
agcgtggggaccaaactgccgcgcc

SEQ ID NO: 162651 - DNA, 25 bp, Homo sapien
tccccgcgtctgaggtccgcaagga

SEQ ID NO: 162652 - DNA, 25 bp, Homo sapien
tgcgggaatgcacgcccggggaaga

SEQ ID NO: 162653 - DNA, 25 bp, Homo sapien
aagaggctttgtgaaccgaggctcg

SEQ ID NO: 162654 - DNA, 25 bp, Homo sapien
gaagaggctttgtgaaccgaggctc

SEQ ID NO: 162655 - DNA, 25 bp, Homo sapien
ttatcgcttcacttccgggttcgga

SEQ ID NO: 162656 - DNA, 25 bp, Homo sapien
agagagccctcacgaccctttagcg

SEQ ID NO: 162657 - DNA, 25 bp, Homo sapien
gcgcatcctaaaagacctctgaata

SEQ ID NO: 162658 - DNA, 25 bp, Homo sapien
cgctaacggctccaaaccgcagata

SEQ ID NO: 162659 - DNA, 25 bp, Homo sapien
ggggcacgactggataaccgcttgt

SEQ ID NO: 162660 - DNA, 25 bp, Homo sapien
caatcgcctccggttgtcctggtaa

SEQ ID NO: 162661 - DNA, 25 bp, Homo sapien
gtcctggtaacagccagcaaccaca

SEQ ID NO: 162662 - DNA, 25 bp, Homo sapien
agaacaccgtgcgtcttatcgcttc

SEQ ID NO: 162663 - DNA, 25 bp, Homo sapien
gctagccgcttacgactgcagtcca

SEQ ID NO: 162664 - DNA, 25 bp, Homo sapien
cctgggccagaaggagctatacggc

SEQ ID NO: 162665 - DNA, 25 bp, Homo sapien
ggaagaatacttacagccgagcgac

SEQ ID NO: 162666 - DNA, 25 bp, Homo sapien
aaacttccagccgagggtgcacgcc

SEQ ID NO: 162667 - DNA, 25 bp, Homo sapien
gctgcccggtcaattccttctttta

SEQ ID NO: 162668 - DNA, 25 bp, Homo sapien
gtggccacgtgacaataacaccgct

SEQ ID NO: 162669 - DNA, 25 bp, Homo sapien
ttttctcgaatctccagcggcccgg

SEQ ID NO: 162670 - DNA, 25 bp, Homo sapien
tgaggcccggacagttctttttcca

SEQ ID NO: 162671 - DNA, 25 bp, Homo sapien
ccagcgagcccttatatagacaaaa

SEQ ID NO: 162672 - DNA, 25 bp, Homo sapien
ggcttttacaccgagactcagcgtg

SEQ ID NO: 162673 - DNA, 25 bp, Homo sapien
tgcctatagctttgacagccgcttg

SEQ ID NO: 162674 - DNA, 25 bp, Homo sapien
gaggacacgtcaggggccataaata

SEQ ID NO: 162675 - DNA, 25 bp, Homo sapien
agcatgctcagtcggtctccaggca

SEQ ID NO: 162676 - DNA, 25 bp, Homo sapien
cgccagagaccagataaagtaagta

SEQ ID NO: 162677 - DNA, 25 bp, Homo sapien
ggtgctcacgctctcggcttttaca

SEQ ID NO: 162678 - DNA, 25 bp, Homo sapien
tcacccgttgacagcgaggcgaatc

SEQ ID NO: 162679 - DNA, 25 bp, Homo sapien
ttctctggggaaaggcaattggaca

SEQ ID NO: 162680 - DNA, 25 bp, Homo sapien
agacttggcgccttccactcgaatc

SEQ ID NO: 162681 - DNA, 25 bp, Homo sapien
tggcggcaacacctagcgatgctcc

SEQ ID NO: 162682 - DNA, 25 bp, Homo sapien
tatcgctctcgcatcgcttccaaga

SEQ ID NO: 162683 - DNA, 25 bp, Homo sapien
ctcctccgatggcaaagacggttca

SEQ ID NO: 162684 - DNA, 25 bp, Homo sapien
ccgcttctttattccacagtgtcaa

SEQ ID NO: 162685 - DNA, 25 bp, Homo sapien
agctccctggactgcaagaatcaag

SEQ ID NO: 162686 - DNA, 25 bp, Homo sapien
ggtcttgctgcaattaccgctctta

SEQ ID NO: 162687 - DNA, 25 bp, Homo sapien
gtgccgcggcttatcacgatctcac

SEQ ID NO: 162688 - DNA, 25 bp, Homo sapien
cgagctggttctttcgctagtgaca

SEQ ID NO: 162689 - DNA, 25 bp, Homo sapien
tatatacgccgttttgacaggtccc

SEQ ID NO: 162690 - DNA, 25 bp, Homo sapien
gctgctcaaaacctcgctccggaaa

SEQ ID NO: 162691 - DNA, 25 bp, Homo sapien
gacacccagcggtctgacatcgcga

SEQ ID NO: 162692 - DNA, 25 bp, Homo sapien
ttcccataatgctctggggcgtgcc

SEQ ID NO: 162693 - DNA, 25 bp, Homo sapien
gccgtgggacgccattcccataatg

SEQ ID NO: 162694 - DNA, 25 bp, Homo sapien
tcaggccttcccgaatgataggtta

SEQ ID NO: 162695 - DNA, 25 bp, Homo sapien
aggggcagttctcttgtctagcctg

SEQ ID NO: 162696 - DNA, 25 bp, Homo sapien
cgccagaccggcagactcggttgca

SEQ ID NO: 162697 - DNA, 25 bp, Homo sapien
gacgctaggccggttcctcaaaggc

SEQ ID NO: 162698 - DNA, 25 bp, Homo sapien
tctacgcgcttttctatggcgaatg

SEQ ID NO: 162699 - DNA, 25 bp, Homo sapien
ccgggatttcaagggtctacgcgct

SEQ ID NO: 162700 - DNA, 25 bp, Homo sapien
tcgtccgccggctacgtctgcgttt

SEQ ID NO: 162701 - DNA, 25 bp, Homo sapien
cagcatcaagctgtgcgcgtgggct

SEQ ID NO: 162702 - DNA, 25 bp, Homo sapien
gcctctgtacggagcagggtacgca

SEQ ID NO: 162703 - DNA, 25 bp, Homo sapien
tcttgccaggttggctggtgacacc

SEQ ID NO: 162704 - DNA, 25 bp, Homo sapien
ctgtctagcctacttgattccgggg

SEQ ID NO: 162705 - DNA, 25 bp, Homo sapien
ttgacgccttaaaccctgtctagcc

SEQ ID NO: 162706 - DNA, 25 bp, Homo sapien
tgtgggaatcgctgcccacccggaa

SEQ ID NO: 162707 - DNA, 25 bp, Homo sapien
gagctggcgctgaagcttcttgcca

SEQ ID NO: 162708 - DNA, 25 bp, Homo sapien
cctccgagaaaagccagaggtgttg

SEQ ID NO: 162709 - DNA, 25 bp, Homo sapien
acctgcccgccttgtgggtttctcg

SEQ ID NO: 162710 - DNA, 25 bp, Homo sapien
cagcgctcggaattgtgggcgactc

SEQ ID NO: 162711 - DNA, 25 bp, Homo sapien
ctcagcactctggtgacgtggaatc

SEQ ID NO: 162712 - DNA, 25 bp, Homo sapien
tttctctcttcagagcggtggctga

SEQ ID NO: 162713 - DNA, 25 bp, Homo sapien
ttgccgcccatttcctgctttcgag

SEQ ID NO: 162714 - DNA, 25 bp, Homo sapien
cccggctatgccttggctgctgttt

SEQ ID NO: 162715 - DNA, 25 bp, Homo sapien
cctgtagagctgaacgggaattccc

SEQ ID NO: 162716 - DNA, 25 bp, Homo sapien
gatctctaaggttcgtccggacgca

SEQ ID NO: 162717 - DNA, 25 bp, Homo sapien
agcgcgcgagcctccttaagtgatc

SEQ ID NO: 162718 - DNA, 25 bp, Homo sapien
atttctggtagcacgctgacgcctg

SEQ ID NO: 162719 - DNA, 25 bp, Homo sapien
ccaaggacaccgcagactgagatta

SEQ ID NO: 162720 - DNA, 25 bp, Homo sapien
ccgaggctatttacagctgaggttc

SEQ ID NO: 162721 - DNA, 25 bp, Homo sapien
attgctgggacggaaaactcatttc

SEQ ID NO: 162722 - DNA, 25 bp, Homo sapien
agcctggcttttatttacactctta

SEQ ID NO: 162723 - DNA, 25 bp, Homo sapien
cccgagtgatttcctgccacagtgc

SEQ ID NO: 162724 - DNA, 25 bp, Homo sapien
tgggtcacggctctgcagcagacac

SEQ ID NO: 162725 - DNA, 25 bp, Homo sapien
agcagacacgggacctccacgtttc

SEQ ID NO: 162726 - DNA, 25 bp, Homo sapien
ttattggtagctggttcggctcgcc

SEQ ID NO: 162727 - DNA, 25 bp, Homo sapien
gcaggcgacgaagcttctggtcgac

SEQ ID NO: 162728 - DNA, 25 bp, Homo sapien
acttccatgttaagatgctgtcgca

SEQ ID NO: 162729 - DNA, 25 bp, Homo sapien
cccggaatccgacgtcagtatactt

SEQ ID NO: 162730 - DNA, 25 bp, Homo sapien
aatgcaagagctgaccggggaatgt

SEQ ID NO: 162731 - DNA, 25 bp, Homo sapien
cgcctatccgcaccggaacaaagta

SEQ ID NO: 162732 - DNA, 25 bp, Homo sapien
agccgtttctatagcgacgggagga

SEQ ID NO: 162733 - DNA, 25 bp, Homo sapien
ggtgcgcggacaagaaaatacagtt

SEQ ID NO: 162734 - DNA, 25 bp, Homo sapien
gtacttcacgagcagtcaggcgcga

SEQ ID NO: 162735 - DNA, 25 bp, Homo sapien
acggcggagttcttcaggatgtcca

SEQ ID NO: 162736 - DNA, 25 bp, Homo sapien
ggaccccgcgtgcccgtcaaacagc

SEQ ID NO: 162737 - DNA, 25 bp, Homo sapien
tgctccgtgatgtggtgctgcagca

SEQ ID NO: 162738 - DNA, 25 bp, Homo sapien
ctgctccgtgatgtggtgctgcagc

SEQ ID NO: 162739 - DNA, 25 bp, Homo sapien
taaagaagcgtgtggggggcgtgct

SEQ ID NO: 162740 - DNA, 25 bp, Homo sapien
ctgcccgggtcagagtccggctgtt

SEQ ID NO: 162741 - DNA, 25 bp, Homo sapien
agtccggctgttggcgggcgtgttc

SEQ ID NO: 162742 - DNA, 25 bp, Homo sapien
gacggcggagttcttcaggatgtcc

SEQ ID NO: 162743 - DNA, 25 bp, Homo sapien
tactgccgccgggtcatgtgataat

SEQ ID NO: 162744 - DNA, 25 bp, Homo sapien
cttccgcaacggagctgcatggagc

SEQ ID NO: 162745 - DNA, 25 bp, Homo sapien
gctcccagagcctagtgctgcaggg

SEQ ID NO: 162746 - DNA, 25 bp, Homo sapien
tgagcatattactccggcgcccggc

SEQ ID NO: 162747 - DNA, 25 bp, Homo sapien
tggccacggcagatttcactcgagt

SEQ ID NO: 162748 - DNA, 25 bp, Homo sapien
atgccgcccatgaaattggccacgg

SEQ ID NO: 162749 - DNA, 25 bp, Homo sapien
cgccgagtctccttgaggatgagga

SEQ ID NO: 162750 - DNA, 25 bp, Homo sapien
ggtgtcgctgcactcactctgcgta

SEQ ID NO: 162751 - DNA, 25 bp, Homo sapien
tgcaggtgcttcaccacgcggcaca

SEQ ID NO: 162752 - DNA, 25 bp, Homo sapien
taccagcatgtaggccgacgcaaac

SEQ ID NO: 162753 - DNA, 25 bp, Homo sapien
aagccgtagcaggtacccaagatga

SEQ ID NO: 162754 - DNA, 25 bp, Homo sapien
cgtcatccaggtcacgtaggcacga

SEQ ID NO: 162755 - DNA, 25 bp, Homo sapien
cgccagcacggcgatctccagtttg

SEQ ID NO: 162756 - DNA, 25 bp, Homo sapien
cgcgggccttggtgacattgttcac

SEQ ID NO: 162757 - DNA, 25 bp, Homo sapien
tagcggtcggctgtcatgactacca

SEQ ID NO: 162758 - DNA, 25 bp, Homo sapien
cggacgttgcaccagatgttgtagc

SEQ ID NO: 162759 - DNA, 25 bp, Homo sapien
taatcaaggagtatggtggagctgg

SEQ ID NO: 162760 - DNA, 25 bp, Homo sapien
tttcgctctttcagactttggatcc

SEQ ID NO: 162761 - DNA, 25 bp, Homo sapien
tcgctctttcagactttggatcctc

SEQ ID NO: 162762 - DNA, 25 bp, Homo sapien
gctctttcagactttggatcctccc

SEQ ID NO: 162763 - DNA, 25 bp, Homo sapien
ggacctccaggagccccttggcagt

SEQ ID NO: 162764 - DNA, 25 bp, Homo sapien
ctgcggccggaagattgcagccgct

SEQ ID NO: 162765 - DNA, 25 bp, Homo sapien
cggccggaagattgcagccgctttg

SEQ ID NO: 162766 - DNA, 25 bp, Homo sapien
cggaagattgcagccgctttgagct

SEQ ID NO: 162767 - DNA, 25 bp, Homo sapien
ccagcccttggctcggaattggaga

SEQ ID NO: 162768 - DNA, 25 bp, Homo sapien
gcgcacgcctttcaaacacgtgtta

SEQ ID NO: 162769 - DNA, 25 bp, Homo sapien
cggctctcaagtccgggattacccg

SEQ ID NO: 162770 - DNA, 25 bp, Homo sapien
tgccagagatttgcgggaatgctcc

SEQ ID NO: 162771 - DNA, 25 bp, Homo sapien
aatggtcctcattcttacccagatc

SEQ ID NO: 162772 - DNA, 25 bp, Homo sapien
agcggctctgctcgtttcttatcgc

SEQ ID NO: 162773 - DNA, 25 bp, Homo sapien
tcttatcgccctgtactgcctattc

SEQ ID NO: 162774 - DNA, 25 bp, Homo sapien
gtgttaaaatccaagacgtcgtctc

SEQ ID NO: 162775 - DNA, 25 bp, Homo sapien
tacgtcctcgctgtacgtgggggac

SEQ ID NO: 162776 - DNA, 25 bp, Homo sapien
gtccggactgacacctccaccttcg

SEQ ID NO: 162777 - DNA, 25 bp, Homo sapien
caacaccattctggggcggtgaagt

SEQ ID NO: 162778 - DNA, 25 bp, Homo sapien
cattctggggcggtgaagtagtttt

SEQ ID NO: 162779 - DNA, 25 bp, Homo sapien
gaggccttcccgctgtccggactga

SEQ ID NO: 162780 - DNA, 25 bp, Homo sapien
cggcagcggatcaacaccattctgg

SEQ ID NO: 162781 - DNA, 25 bp, Homo sapien
cagcggcagcggatcaacaccattc

SEQ ID NO: 162782 - DNA, 25 bp, Homo sapien
cagctacgtcctcgctgtacgtggg

SEQ ID NO: 162783 - DNA, 25 bp, Homo sapien
aatcctgcctcggttcttgtgctcc

SEQ ID NO: 162784 - DNA, 25 bp, Homo sapien
cattgcctgatgtcttcgggaagta

SEQ ID NO: 162785 - DNA, 25 bp, Homo sapien
gccagcgtcactcggcttgctgtgt

SEQ ID NO: 162786 - DNA, 25 bp, Homo sapien
gatgcgcgcttctctcattctttcc

SEQ ID NO: 162787 - DNA, 25 bp, Homo sapien
cttctgcccaatagatgcgcgcttc

SEQ ID NO: 162788 - DNA, 25 bp, Homo sapien
caagtcccgcgcctgtgacaagtga

SEQ ID NO: 162789 - DNA, 25 bp, Homo sapien
gctcccaaagggaatgcgcaagtcc

SEQ ID NO: 162790 - DNA, 25 bp, Homo sapien
tgtctgccatatggctccaggtttg

SEQ ID NO: 162791 - DNA, 25 bp, Homo sapien
cggttggccacaagaggcatccatc

SEQ ID NO: 162792 - DNA, 25 bp, Homo sapien
caatttcgagagtatggtgccagcg

SEQ ID NO: 162793 - DNA, 25 bp, Homo sapien
atcttcccggaccagccaggcgttt

SEQ ID NO: 162794 - DNA, 25 bp, Homo sapien
agccgtgtgcgcaccctcaactttg

SEQ ID NO: 162795 - DNA, 25 bp, Homo sapien
gtgtgcctgtcactagcggcctcct

SEQ ID NO: 162796 - DNA, 25 bp, Homo sapien
gattcctttcgcctgccgagctgta

SEQ ID NO: 162797 - DNA, 25 bp, Homo sapien
tctcgaacaatggtgcggagcgccg

SEQ ID NO: 162798 - DNA, 25 bp, Homo sapien
ctgggattaccgacggagctcaatt

SEQ ID NO: 162799 - DNA, 25 bp, Homo sapien
ccttgtcgtaagagaagatacccag

SEQ ID NO: 162800 - DNA, 25 bp, Homo sapien
tcagcgctggtgacgtcatgcaaac

SEQ ID NO: 162801 - DNA, 25 bp, Homo sapien
ccacattgtccttagccttgtcgta

SEQ ID NO: 162802 - DNA, 25 bp, Homo sapien
cctctctgtgtggttcgtcagcgct

SEQ ID NO: 162803 - DNA, 25 bp, Homo sapien
tacccaggtgagagaagaacgtctc

SEQ ID NO: 162804 - DNA, 25 bp, Homo sapien
tcggctcctgtagctctgactattc

SEQ ID NO: 162805 - DNA, 25 bp, Homo sapien
gctctaagaagttgcctgcgctctg

SEQ ID NO: 162806 - DNA, 25 bp, Homo sapien
ccgctcctgggccttagagaagacg

SEQ ID NO: 162807 - DNA, 25 bp, Homo sapien
tttgtcctaacctcagacggcgatg

SEQ ID NO: 162808 - DNA, 25 bp, Homo sapien
tcaccaggtcaatggccacgacgtc

SEQ ID NO: 162809 - DNA, 25 bp, Homo sapien
cggtcgcttagcaccacatacttga

SEQ ID NO: 162810 - DNA, 25 bp, Homo sapien
gttggacaccacgatgcatggctcg

SEQ ID NO: 162811 - DNA, 25 bp, Homo sapien
atgccgccgcaggaacacatccagg

SEQ ID NO: 162812 - DNA, 25 bp, Homo sapien
gccgcaactgcaggaatcgacgcta

SEQ ID NO: 162813 - DNA, 25 bp, Homo sapien
gtccagcctctcgatctttgtccta

SEQ ID NO: 162814 - DNA, 25 bp, Homo sapien
gctggtccttcaggcccgagttgat

SEQ ID NO: 162815 - DNA, 25 bp, Homo sapien
accacgcagacacagccggggattt

SEQ ID NO: 162816 - DNA, 25 bp, Homo sapien
cgaacctgacgcttgagctctgaca

SEQ ID NO: 162817 - DNA, 25 bp, Homo sapien
ggccagcaccgtctctggcgttgta

SEQ ID NO: 162818 - DNA, 25 bp, Homo sapien
cttgggaccctctatggcggtgcac

SEQ ID NO: 162819 - DNA, 25 bp, Homo sapien
ggcggttgcttggtgtttcatcacc

SEQ ID NO: 162820 - DNA, 25 bp, Homo sapien
ttcatcacccgaattgccacgaggc

SEQ ID NO: 162821 - DNA, 25 bp, Homo sapien
tcggcatcgcctgtggttccgaagc

SEQ ID NO: 162822 - DNA, 25 bp, Homo sapien
ttccgaagcccgttagtcatcgttg

SEQ ID NO: 162823 - DNA, 25 bp, Homo sapien
tccgggtcctgtcaatgtcacgtaa

SEQ ID NO: 162824 - DNA, 25 bp, Homo sapien
caatgtcacgtaagtgttaccggga

SEQ ID NO: 162825 - DNA, 25 bp, Homo sapien
tagcgcttgcgcagacaggcgagaa

SEQ ID NO: 162826 - DNA, 25 bp, Homo sapien
taaggttttggaagtggcaccgtgc

SEQ ID NO: 162827 - DNA, 25 bp, Homo sapien
ggctgccgcacaatcccgggttgtc

SEQ ID NO: 162828 - DNA, 25 bp, Homo sapien
ccgtcgtttcttggttagcgcttgc

SEQ ID NO: 162829 - DNA, 25 bp, Homo sapien
aagttttgacccagcttagcagccg

SEQ ID NO: 162830 - DNA, 25 bp, Homo sapien
ttagcagccgtagtcagccgggagt

SEQ ID NO: 162831 - DNA, 25 bp, Homo sapien
tgcgggaatcccaattactgtgttc

SEQ ID NO: 162832 - DNA, 25 bp, Homo sapien
aattactgtgttcgctgctcagggc

SEQ ID NO: 162833 - DNA, 25 bp, Homo sapien
cgccgcggctgtggtgactaccaga

SEQ ID NO: 162834 - DNA, 25 bp, Homo sapien
ctttgggcataaagaggacgactcc

SEQ ID NO: 162835 - DNA, 25 bp, Homo sapien
gtgactaccagacgggccataggcg

SEQ ID NO: 162836 - DNA, 25 bp, Homo sapien
cgaagccggaagtgtcctgagtctc

SEQ ID NO: 162837 - DNA, 25 bp, Homo sapien
gtcgcgcgggccctgttacctgcat

SEQ ID NO: 162838 - DNA, 25 bp, Homo sapien
tggacggggtgtctccagacatccc

SEQ ID NO: 162839 - DNA, 25 bp, Homo sapien
ttccgcgacgctgtcgggagaaacc

SEQ ID NO: 162840 - DNA, 25 bp, Homo sapien
tccgaaactcgagccagcgaggctg

SEQ ID NO: 162841 - DNA, 25 bp, Homo sapien
cggctcgcagaggaatttgcagttt

SEQ ID NO: 162842 - DNA, 25 bp, Homo sapien
aacgtgcctggagcttgtgcgtgta

SEQ ID NO: 162843 - DNA, 25 bp, Homo sapien
cccgctccggccaacaagtgagtgg

SEQ ID NO: 162844 - DNA, 25 bp, Homo sapien
gaggacgccgaggacttcttcttca

SEQ ID NO: 162845 - DNA, 25 bp, Homo sapien
agctgcataaggactgcccggggct

SEQ ID NO: 162846 - DNA, 25 bp, Homo sapien
gaatttgcagtttccgggaggttga

SEQ ID NO: 162847 - DNA, 25 bp, Homo sapien
tccctaggcgcgatcacgtgagcca

SEQ ID NO: 162848 - DNA, 25 bp, Homo sapien
ggtcaagacctgtacgtacctctcg

SEQ ID NO: 162849 - DNA, 25 bp, Homo sapien
agtcagacgttttctccctaggcgc

SEQ ID NO: 162850 - DNA, 25 bp, Homo sapien
ataaaaagccgtgccttgaaggccg

SEQ ID NO: 162851 - DNA, 25 bp, Homo sapien
agaggccgaccagccgaaggaataa

SEQ ID NO: 162852 - DNA, 25 bp, Homo sapien
cagcaccacgttgggcctccgggtt

SEQ ID NO: 162853 - DNA, 25 bp, Homo sapien
agcacttcgtcctggtcgtccgtga

SEQ ID NO: 162854 - DNA, 25 bp, Homo sapien
tctggtaggacgtacgtgtttctga

SEQ ID NO: 162855 - DNA, 25 bp, Homo sapien
tcagatgctgtacctgcggcagaaa

SEQ ID NO: 162856 - DNA, 25 bp, Homo sapien
cgagccagcggcatcagatgctgta

SEQ ID NO: 162857 - DNA, 25 bp, Homo sapien
agcgggctgctcaacgagctgtaca

SEQ ID NO: 162858 - DNA, 25 bp, Homo sapien
gagagtcaggaggaagaaacgattc

SEQ ID NO: 162859 - DNA, 25 bp, Homo sapien
tagctcagtggcgtggcagtctcct

SEQ ID NO: 162860 - DNA, 25 bp, Homo sapien
gccttctcgcgcacgggagagcgct

SEQ ID NO: 162861 - DNA, 25 bp, Homo sapien
gtgctgctggcttcttcccaacggt

SEQ ID NO: 162862 - DNA, 25 bp, Homo sapien
ttcccaacggtgttctggccacgtc

SEQ ID NO: 162863 - DNA, 25 bp, Homo sapien
aggcgcggagaacccgctgcttcca

SEQ ID NO: 162864 - DNA, 25 bp, Homo sapien
ggctccgcactgcagatgcctgctg

SEQ ID NO: 162865 - DNA, 25 bp, Homo sapien
caggacaagctgaccgggtctctga

SEQ ID NO: 162866 - DNA, 25 bp, Homo sapien
cgtgggcaccatcctgagcaatgtg

SEQ ID NO: 162867 - DNA, 25 bp, Homo sapien
agaagcgcagctgcatttcccggac

SEQ ID NO: 162868 - DNA, 25 bp, Homo sapien
ttctgccttagcctgactccgtcta

SEQ ID NO: 162869 - DNA, 25 bp, Homo sapien
tctggggaaagtccgcgtgccacct

SEQ ID NO: 162870 - DNA, 25 bp, Homo sapien
gctccctgtctctggcgcttctggg

SEQ ID NO: 162871 - DNA, 25 bp, Homo sapien
ctggcgccgtcagatactctgctgc

SEQ ID NO: 162872 - DNA, 25 bp, Homo sapien
tgcgcgctcccaagcagttaaaact

SEQ ID NO: 162873 - DNA, 25 bp, Homo sapien
ccgttctgcgataggctggcacttt

SEQ ID NO: 162874 - DNA, 25 bp, Homo sapien
cgtctccctttcagccagtaggatt

SEQ ID NO: 162875 - DNA, 25 bp, Homo sapien
ccggcgctcactgaaggcgcaaatt

SEQ ID NO: 162876 - DNA, 25 bp, Homo sapien
acaacgctgggcttgactgagtgct

SEQ ID NO: 162877 - DNA, 25 bp, Homo sapien
ctgcattcacagtgcggtgcgccca

SEQ ID NO: 162878 - DNA, 25 bp, Homo sapien
tcagccagggctgttcccgtttaga

SEQ ID NO: 162879 - DNA, 25 bp, Homo sapien
tcggcccagacgaacccatagtaag

SEQ ID NO: 162880 - DNA, 25 bp, Homo sapien
ctgactgctaaatcggccggcggca

SEQ ID NO: 162881 - DNA, 25 bp, Homo sapien
ctctcggatgaggagcttttctctc

SEQ ID NO: 162882 - DNA, 25 bp, Homo sapien
gcccggtctacctcaagaagctgaa

SEQ ID NO: 162883 - DNA, 25 bp, Homo sapien
agagcagcaacagcaccggtcaggg

SEQ ID NO: 162884 - DNA, 25 bp, Homo sapien
taataacaataacacggcagccgcc

SEQ ID NO: 162885 - DNA, 25 bp, Homo sapien
tcgggcgacctctcctacttacgga

SEQ ID NO: 162886 - DNA, 25 bp, Homo sapien
ttcgctccagtaccgcgggctcaaa

SEQ ID NO: 162887 - DNA, 25 bp, Homo sapien
ccgaccctgccacgttagggtgtga

SEQ ID NO: 162888 - DNA, 25 bp, Homo sapien
ccgtgcccaggaatttcccgtcatg

SEQ ID NO: 162889 - DNA, 25 bp, Homo sapien
acaccttatcctgtcccgggagcga

SEQ ID NO: 162890 - DNA, 25 bp, Homo sapien
agcgaacctgaacccgcgggagcct

SEQ ID NO: 162891 - DNA, 25 bp, Homo sapien
gttgccgctcagataacgggcccga

SEQ ID NO: 162892 - DNA, 25 bp, Homo sapien
cgctcgtctcctatgctcatatttg

SEQ ID NO: 162893 - DNA, 25 bp, Homo sapien
ggattccattctgcgcctgctgcgc

SEQ ID NO: 162894 - DNA, 25 bp, Homo sapien
gcgcagtccggtaagttcgggctcc

SEQ ID NO: 162895 - DNA, 25 bp, Homo sapien
ctgggagcactttggcgccgcagac

SEQ ID NO: 162896 - DNA, 25 bp, Homo sapien
gcagactcaggagccgacgccatct

SEQ ID NO: 162897 - DNA, 25 bp, Homo sapien
gccatctccaggacggcctcggtgg

SEQ ID NO: 162898 - DNA, 25 bp, Homo sapien
gaaaagtttgtttctccaacgcgca

SEQ ID NO: 162899 - DNA, 25 bp, Homo sapien
tgtctgggcgcaatactctccggcc

SEQ ID NO: 162900 - DNA, 25 bp, Homo sapien
ttggccaaaaaatcccagagtccta

SEQ ID NO: 162901 - DNA, 25 bp, Homo sapien
cccgccggcatgaggactcgtgcgt

SEQ ID NO: 162902 - DNA, 25 bp, Homo sapien
tcgtgcgtggcgtttcgaccctccg

SEQ ID NO: 162903 - DNA, 25 bp, Homo sapien
cgccgcgctctaaagttaagttgta

SEQ ID NO: 162904 - DNA, 25 bp, Homo sapien
gtcggccagccgagacttcaaaggc

SEQ ID NO: 162905 - DNA, 25 bp, Homo sapien
actccagtttcgtgttgagcggccg

SEQ ID NO: 162906 - DNA, 25 bp, Homo sapien
gcacttaacgcagggcgcacgcacg

SEQ ID NO: 162907 - DNA, 25 bp, Homo sapien
agcggatgcccgtgacaagttaata

SEQ ID NO: 162908 - DNA, 25 bp, Homo sapien
ctcgcccacgctcggggttagagac

SEQ ID NO: 162909 - DNA, 25 bp, Homo sapien
caagttaatagctctcgccgcgctc

SEQ ID NO: 162910 - DNA, 25 bp, Homo sapien
gcttagacctctccacgtcgctgtg

SEQ ID NO: 162911 - DNA, 25 bp, Homo sapien
cacgcgtcttttcgggcagccaatt

SEQ ID NO: 162912 - DNA, 25 bp, Homo sapien
gctgtttccggacacgctgctcgga

SEQ ID NO: 162913 - DNA, 25 bp, Homo sapien
ttgagacacaattgcgcaccctgtc

SEQ ID NO: 162914 - DNA, 25 bp, Homo sapien
gcgagcggctggtgatcaatatctc

SEQ ID NO: 162915 - DNA, 25 bp, Homo sapien
agagcaacaggatgcgggagacttc

SEQ ID NO: 162916 - DNA, 25 bp, Homo sapien
ttagggctcacggacccaacggcca

SEQ ID NO: 162917 - DNA, 25 bp, Homo sapien
taacgggaagcgcagaaccaaatcc

SEQ ID NO: 162918 - DNA, 25 bp, Homo sapien
gcagccaatttcacacgcgcctgtg

SEQ ID NO: 162919 - DNA, 25 bp, Homo sapien
ctcatctcccgaaaggtgctgggca

SEQ ID NO: 162920 - DNA, 25 bp, Homo sapien
ttctctttttggcagccgctggacg

SEQ ID NO: 162921 - DNA, 25 bp, Homo sapien
tttccaagccgcttccgaagtgctc

SEQ ID NO: 162922 - DNA, 25 bp, Homo sapien
agggacacaattcactccaagtctc

SEQ ID NO: 162923 - DNA, 25 bp, Homo sapien
cccgcctaacatttcaagggacaca

SEQ ID NO: 162924 - DNA, 25 bp, Homo sapien
gcccaaggcactttcaatctcaatc

SEQ ID NO: 162925 - DNA, 25 bp, Homo sapien
ctttgctttccgactgcccaaggca

SEQ ID NO: 162926 - DNA, 25 bp, Homo sapien
gcggcggcagcctaagcaacagcag

SEQ ID NO: 162927 - DNA, 25 bp, Homo sapien
cgctcacgccgaccggaagtctttg

SEQ ID NO: 162928 - DNA, 25 bp, Homo sapien
agtctttgcacttccgtcttccggg

SEQ ID NO: 162929 - DNA, 25 bp, Homo sapien
ttgcacgccgggagacaaaatgtct

SEQ ID NO: 162930 - DNA, 25 bp, Homo sapien
tgtgatcgcggacctagaaacttgg

SEQ ID NO: 162931 - DNA, 25 bp, Homo sapien
cttggtccgtcccatacaggtgtag

SEQ ID NO: 162932 - DNA, 25 bp, Homo sapien
taggtccgctttccggacgtgggca

SEQ ID NO: 162933 - DNA, 25 bp, Homo sapien
tgaggaaccgaactcacctgagaaa

SEQ ID NO: 162934 - DNA, 25 bp, Homo sapien
acgagcttccgccattggtgtgatc

SEQ ID NO: 162935 - DNA, 25 bp, Homo sapien
gcttcaaaaattccagctgggcgga

SEQ ID NO: 162936 - DNA, 25 bp, Homo sapien
ccacgctgctgccatagttgaagtc

SEQ ID NO: 162937 - DNA, 25 bp, Homo sapien
tacccattcggatgtgcacggtggc

SEQ ID NO: 162938 - DNA, 25 bp, Homo sapien
ggagctcagtgagcactccctgtga

SEQ ID NO: 162939 - DNA, 25 bp, Homo sapien
gccagtcctctggtacccggagaag

SEQ ID NO: 162940 - DNA, 25 bp, Homo sapien
caaattcaggctgcggcggtttcca

SEQ ID NO: 162941 - DNA, 25 bp, Homo sapien
ggcgaacaccgagcgagtcgatttt

SEQ ID NO: 162942 - DNA, 25 bp, Homo sapien
tccactcgtgtgtacgtcagtcaca

SEQ ID NO: 162943 - DNA, 25 bp, Homo sapien
gagagctctgcgctgttctggacag

SEQ ID NO: 162944 - DNA, 25 bp, Homo sapien
tgtaacggcctgtcgcaggcgtgca

SEQ ID NO: 162945 - DNA, 25 bp, Homo sapien
gaagcaggatttccgcggttgtgta

SEQ ID NO: 162946 - DNA, 25 bp, Homo sapien
gagaacggcgtgttcctagggctct

SEQ ID NO: 162947 - DNA, 25 bp, Homo sapien
gcaaagccagcgaagggagaacccg

SEQ ID NO: 162948 - DNA, 25 bp, Homo sapien
tccagttcgcactctgcttgtctcg

SEQ ID NO: 162949 - DNA, 25 bp, Homo sapien
tctgggctttctccagttcgcactc

SEQ ID NO: 162950 - DNA, 25 bp, Homo sapien
ggagctctgagctctgggctttctc

SEQ ID NO: 162951 - DNA, 25 bp, Homo sapien
atgtggacgcgtcaggccatcaggg

SEQ ID NO: 162952 - DNA, 25 bp, Homo sapien
cgtcaggccatcagggtgctgcccg

SEQ ID NO: 162953 - DNA, 25 bp, Homo sapien
cgcgtcaggccatcagggtgctgcc

SEQ ID NO: 162954 - DNA, 25 bp, Homo sapien
acgcgtcaggccatcagggtgctgc

SEQ ID NO: 162955 - DNA, 25 bp, Homo sapien
tgtggacgcgtcaggccatcagggt

SEQ ID NO: 162956 - DNA, 25 bp, Homo sapien
catgtggacgcgtcaggccatcagg

SEQ ID NO: 162957 - DNA, 25 bp, Homo sapien
acatgtggacgcgtcaggccatcag

SEQ ID NO: 162958 - DNA, 25 bp, Homo sapien
gtggacgcgtcaggccatcagggtg

SEQ ID NO: 162959 - DNA, 25 bp, Homo sapien
gtccacacatggggacgcgtcaggt

SEQ ID NO: 162960 - DNA, 25 bp, Homo sapien
cggctcacggtccacacatggggac

SEQ ID NO: 162961 - DNA, 25 bp, Homo sapien
tcacggtccacacatggggacgcgt

SEQ ID NO: 162962 - DNA, 25 bp, Homo sapien
cggtccacacatggggacgcgtcag

SEQ ID NO: 162963 - DNA, 25 bp, Homo sapien
cggctcacggtccacacatggggat

SEQ ID NO: 162964 - DNA, 25 bp, Homo sapien
gctcacggtccacacatggggatgt

SEQ ID NO: 162965 - DNA, 25 bp, Homo sapien
ggctcacggtccacacatggggacg

SEQ ID NO: 162966 - DNA, 25 bp, Homo sapien
tcacggtccacacatggggatgtgt

SEQ ID NO: 162967 - DNA, 25 bp, Homo sapien
ggcatggtgtcgctccctgcgctcg

SEQ ID NO: 162968 - DNA, 25 bp, Homo sapien
tgctcctctgcctgcaagcagatag

SEQ ID NO: 162969 - DNA, 25 bp, Homo sapien
tgcctgcaagcagatagggatattc

SEQ ID NO: 162970 - DNA, 25 bp, Homo sapien
agggatattcttcttccagccgggc

SEQ ID NO: 162971 - DNA, 25 bp, Homo sapien
atattcttcttccagccgggcatgg

SEQ ID NO: 162972 - DNA, 25 bp, Homo sapien
gctcccgggcacattgaagcggcgc

SEQ ID NO: 162973 - DNA, 25 bp, Homo sapien
ttaggcgacgacctcggtggagtaa

SEQ ID NO: 162974 - DNA, 25 bp, Homo sapien
gggcagtgtccttccctctagtccc

SEQ ID NO: 162975 - DNA, 25 bp, Homo sapien
ccttcggccgtagccggtagcttct

SEQ ID NO: 162976 - DNA, 25 bp, Homo sapien
gaggcctccgtgaactctgacctta

SEQ ID NO: 162977 - DNA, 25 bp, Homo sapien
tgaccttagctttccgtagcgcccg

SEQ ID NO: 162978 - DNA, 25 bp, Homo sapien
tggcgagcgcctcgtaccacatttc

SEQ ID NO: 162979 - DNA, 25 bp, Homo sapien
accaggaggcgattcttgcgtctca

SEQ ID NO: 162980 - DNA, 25 bp, Homo sapien
attcgcttgccatcctgcggcgcta

SEQ ID NO: 162981 - DNA, 25 bp, Homo sapien
tctcacgcgaacagcgccgtcgtta

SEQ ID NO: 162982 - DNA, 25 bp, Homo sapien
attctttctcctaggcagttgcccg

SEQ ID NO: 162983 - DNA, 25 bp, Homo sapien
tctttctttggaagagggttgtcgc

SEQ ID NO: 162984 - DNA, 25 bp, Homo sapien
acggcagccctgaaatgcattttcc

SEQ ID NO: 162985 - DNA, 25 bp, Homo sapien
ctctccagcggccatgttaaccagg

SEQ ID NO: 162986 - DNA, 25 bp, Homo sapien
agcggccatgttaaccaggaaacct

SEQ ID NO: 162987 - DNA, 25 bp, Homo sapien
ctgcctgcgggacctcgaacaaagt

SEQ ID NO: 162988 - DNA, 25 bp, Homo sapien
ggccgtctgcaacgtgggccgccta

SEQ ID NO: 162989 - DNA, 25 bp, Homo sapien
tttggaagagggttgtcgctgccca

SEQ ID NO: 162990 - DNA, 25 bp, Homo sapien
acctcgaacaaagtcggcggcgcgg

SEQ ID NO: 162991 - DNA, 25 bp, Homo sapien
cagcgcagaaaagcagcgtgacctc

SEQ ID NO: 162992 - DNA, 25 bp, Homo sapien
aatccctggggctgatagagatggc

SEQ ID NO: 162993 - DNA, 25 bp, Homo sapien
gcagagtgccttacctccattagga

SEQ ID NO: 162994 - DNA, 25 bp, Homo sapien
gcctagggaccaatagagactcgca

SEQ ID NO: 162995 - DNA, 25 bp, Homo sapien
ttcccgcctagaggcctgtcggtct

SEQ ID NO: 162996 - DNA, 25 bp, Homo sapien
taacagtgttccctagcaaagcctc

SEQ ID NO: 162997 - DNA, 25 bp, Homo sapien
cccgctactccgacagttaactgga

SEQ ID NO: 162998 - DNA, 25 bp, Homo sapien
accttgaagcgcaccggcatgtcgc

SEQ ID NO: 162999 - DNA, 25 bp, Homo sapien
agcgaggctgaacgcctgacgtcaa

SEQ ID NO: 163000 - DNA, 25 bp, Homo sapien
gcctgacgtcaaggcgacatcgcca

SEQ ID NO: 163001 - DNA, 25 bp, Homo sapien
cggcgcagctagagagaagaacctc

SEQ ID NO: 163002 - DNA, 25 bp, Homo sapien
caccagacagcctggggaagcgagc

SEQ ID NO: 163003 - DNA, 25 bp, Homo sapien
gtcaggaacaccgacgcgcggattc

SEQ ID NO: 163004 - DNA, 25 bp, Homo sapien
gttccactggaacccacgagggtca

SEQ ID NO: 163005 - DNA, 25 bp, Homo sapien
acagtttgcattaagaggcggcgcc

SEQ ID NO: 163006 - DNA, 25 bp, Homo sapien
cgctttgcggaaggggtcaaatgtc

SEQ ID NO: 163007 - DNA, 25 bp, Homo sapien
cgcggtagctaaactgcagccaact

SEQ ID NO: 163008 - DNA, 25 bp, Homo sapien
cccatgccgggaaatttggccacaa

SEQ ID NO: 163009 - DNA, 25 bp, Homo sapien
ccacaaatggggaaaaagccgcttg

SEQ ID NO: 163010 - DNA, 25 bp, Homo sapien
ggctaaacgcaaccaggaacacatt

SEQ ID NO: 163011 - DNA, 25 bp, Homo sapien
agcaacactgttcgctcctggggtg

SEQ ID NO: 163012 - DNA, 25 bp, Homo sapien
tctgttttagggacagactgcttcc

SEQ ID NO: 163013 - DNA, 25 bp, Homo sapien
tgcacctgtaggctgaagtcgcgca

SEQ ID NO: 163014 - DNA, 25 bp, Homo sapien
atctattcggcgctttggggcagca

SEQ ID NO: 163015 - DNA, 25 bp, Homo sapien
tgcactcgaaaacacgccgggctta

SEQ ID NO: 163016 - DNA, 25 bp, Homo sapien
tggctgaagcccactaagcccgttc

SEQ ID NO: 163017 - DNA, 25 bp, Homo sapien
agatgccggttttctccgccaaagg

SEQ ID NO: 163018 - DNA, 25 bp, Homo sapien
ttgcaaggcttttccactgaggttc

SEQ ID NO: 163019 - DNA, 25 bp, Homo sapien
cccttttgtgtatcagtgcactcga

SEQ ID NO: 163020 - DNA, 25 bp, Homo sapien
ggggcacaagctcttctttactaga

SEQ ID NO: 163021 - DNA, 25 bp, Homo sapien
ccggaagttaccgtgctgtcaaatc

SEQ ID NO: 163022 - DNA, 25 bp, Homo sapien
aactcggctcaaagacggggcactc

SEQ ID NO: 163023 - DNA, 25 bp, Homo sapien
gcactgcgttaaggcacctgggatc

SEQ ID NO: 163024 - DNA, 25 bp, Homo sapien
ggcgcttttccgatctctagtttaa

SEQ ID NO: 163025 - DNA, 25 bp, Homo sapien
taggtccgtcccatctgaatgcttc

SEQ ID NO: 163026 - DNA, 25 bp, Homo sapien
cgtgtgtgtgtgatagccctagcaa

SEQ ID NO: 163027 - DNA, 25 bp, Homo sapien
agcaatggcccagtccgctagaacg

SEQ ID NO: 163028 - DNA, 25 bp, Homo sapien
acattttcgccgtagctgctccgta

SEQ ID NO: 163029 - DNA, 25 bp, Homo sapien
gctccgtaaagcgattgtccaactg

SEQ ID NO: 163030 - DNA, 25 bp, Homo sapien
ctcaagctagaggtctgtgttcttc

SEQ ID NO: 163031 - DNA, 25 bp, Homo sapien
gtagcggccgttcagccagcggctc

SEQ ID NO: 163032 - DNA, 25 bp, Homo sapien
tcatggcattgctggtggaccgagt

SEQ ID NO: 163033 - DNA, 25 bp, Homo sapien
cagcttcgcggggatcatggcattg

SEQ ID NO: 163034 - DNA, 25 bp, Homo sapien
cgtcctagctggcttacagggcggc

SEQ ID NO: 163035 - DNA, 25 bp, Homo sapien
ggtgtgtgtcctctgttaagagtgc

SEQ ID NO: 163036 - DNA, 25 bp, Homo sapien
ctgttaagagtgctactcgcccggg

SEQ ID NO: 163037 - DNA, 25 bp, Homo sapien
gttgatctgtgcatgccactcctgg

SEQ ID NO: 163038 - DNA, 25 bp, Homo sapien
tactcgcccggggttgatctgtgca

SEQ ID NO: 163039 - DNA, 25 bp, Homo sapien
gtcactagtgtgaacgctgcgcgta

SEQ ID NO: 163040 - DNA, 25 bp, Homo sapien
gtgtcacagcgccaaaccttgctgg

SEQ ID NO: 163041 - DNA, 25 bp, Homo sapien
tgtgcgcgcgcacaaatgcccggat

SEQ ID NO: 163042 - DNA, 25 bp, Homo sapien
cctctgaccgagatcctgctgcttt

SEQ ID NO: 163043 - DNA, 25 bp, Homo sapien
tgctttcgcagccaggagcaccgtc

SEQ ID NO: 163044 - DNA, 25 bp, Homo sapien
ccggattagtgcgtacgagcgccca

SEQ ID NO: 163045 - DNA, 25 bp, Homo sapien
cccgttcgcagcctttgtgcggttc

SEQ ID NO: 163046 - DNA, 25 bp, Homo sapien
gcgcaacggctaaaggagtgtcaca

SEQ ID NO: 163047 - DNA, 25 bp, Homo sapien
ctgctgccatgctctgtgggtcgat

SEQ ID NO: 163048 - DNA, 25 bp, Homo sapien
ctctgtgggttgacgctgctgccat

SEQ ID NO: 163049 - DNA, 25 bp, Homo sapien
atgctctgtgggtcgatgcagccac

SEQ ID NO: 163050 - DNA, 25 bp, Homo sapien
cagccacccggagtcgggacctgtg

SEQ ID NO: 163051 - DNA, 25 bp, Homo sapien
gcagagccgtcgagccctcccggcc

SEQ ID NO: 163052 - DNA, 25 bp, Homo sapien
gtgtgagcgaggcttcaggcgatcc

SEQ ID NO: 163053 - DNA, 25 bp, Homo sapien
ctgctgccacgctctgtgggttgac

SEQ ID NO: 163054 - DNA, 25 bp, Homo sapien
tcgatgcagccacccggagtcggga

SEQ ID NO: 163055 - DNA, 25 bp, Homo sapien
catctcgcccggcaacccataggca

SEQ ID NO: 163056 - DNA, 25 bp, Homo sapien
atctcgcccggcaacccataggcag

SEQ ID NO: 163057 - DNA, 25 bp, Homo sapien
tctcgcccggcaacccataggcagc

SEQ ID NO: 163058 - DNA, 25 bp, Homo sapien
ctcgcccggcaacccataggcagcg

SEQ ID NO: 163059 - DNA, 25 bp, Homo sapien
cggtcccctgtgacgtcgcaagggc

SEQ ID NO: 163060 - DNA, 25 bp, Homo sapien
gggcctttggcgagtcacaggcgcg

SEQ ID NO: 163061 - DNA, 25 bp, Homo sapien
cctttggcgagtcacaggcgcgggt

SEQ ID NO: 163062 - DNA, 25 bp, Homo sapien
tggcgagtcacaggcgcgggtgttc

SEQ ID NO: 163063 - DNA, 25 bp, Homo sapien
ctagcgcagagtctggcccttgctg

SEQ ID NO: 163064 - DNA, 25 bp, Homo sapien
cgacagtgcgatcggttgcaccttc

SEQ ID NO: 163065 - DNA, 25 bp, Homo sapien
agtgcgatcggttgcaccttctgcg

SEQ ID NO: 163066 - DNA, 25 bp, Homo sapien
gcgatcggttgcaccttctgcgaca

SEQ ID NO: 163067 - DNA, 25 bp, Homo sapien
gatcggttgcaccttctgcgacagg

SEQ ID NO: 163068 - DNA, 25 bp, Homo sapien
tgctagcgcagagtctggcccttgc

SEQ ID NO: 163069 - DNA, 25 bp, Homo sapien
gcgcgacagtgcgatcggttgcacc

SEQ ID NO: 163070 - DNA, 25 bp, Homo sapien
acagtgcgatcggttgcaccttctg

SEQ ID NO: 163071 - DNA, 25 bp, Homo sapien
cagccgccttcgcacctaggagaga

SEQ ID NO: 163072 - DNA, 25 bp, Homo sapien
tcgcggacagtctttgctggagccc

SEQ ID NO: 163073 - DNA, 25 bp, Homo sapien
cccaggtcagaagtgtgtcctcgcc

SEQ ID NO: 163074 - DNA, 25 bp, Homo sapien
accgagggacactctctgtcgcaga

SEQ ID NO: 163075 - DNA, 25 bp, Homo sapien
ctctgtcgcagactgcagccgcttg

SEQ ID NO: 163076 - DNA, 25 bp, Homo sapien
gagccaagctcccagcagtgccaag

SEQ ID NO: 163077 - DNA, 25 bp, Homo sapien
tgcccagcgaggctaagcaatcacg

SEQ ID NO: 163078 - DNA, 25 bp, Homo sapien
atcacggggcttcgagaaagaacgc

SEQ ID NO: 163079 - DNA, 25 bp, Homo sapien
gtcgcctcatggaaggccgcgttca

SEQ ID NO: 163080 - DNA, 25 bp, Homo sapien
cggcgtggaccacatagacatttac

SEQ ID NO: 163081 - DNA, 25 bp, Homo sapien
cggatgtcggcgaagagttcaacca

SEQ ID NO: 163082 - DNA, 25 bp, Homo sapien
ttcaaccaggtacgtgagagcccag

SEQ ID NO: 163083 - DNA, 25 bp, Homo sapien
ccgcgagccgaagcgactgcagagt

SEQ ID NO: 163084 - DNA, 25 bp, Homo sapien
gattcctcccatcgctccattttgt

SEQ ID NO: 163085 - DNA, 25 bp, Homo sapien
ggctctccttctcgggtttgcgaca

SEQ ID NO: 163086 - DNA, 25 bp, Homo sapien
gctccctattgttggcggcacccgg

SEQ ID NO: 163087 - DNA, 25 bp, Homo sapien
gtgtacactgcgtgcgcatacgcga

SEQ ID NO: 163088 - DNA, 25 bp, Homo sapien
agtaactcgccctccttcggctaga

SEQ ID NO: 163089 - DNA, 25 bp, Homo sapien
tccgtgggacaatatgttcaagaga

SEQ ID NO: 163090 - DNA, 25 bp, Homo sapien
aatggccgaatttgggcctgactcc

SEQ ID NO: 163091 - DNA, 25 bp, Homo sapien
tcgcgccttttctcctcgggtttga

SEQ ID NO: 163092 - DNA, 25 bp, Homo sapien
ccattgagcgaaaaaccggcgttca

SEQ ID NO: 163093 - DNA, 25 bp, Homo sapien
tggctgccaaggaaacgggcgactc

SEQ ID NO: 163094 - DNA, 25 bp, Homo sapien
cctgaggagttgacggttactcacc

SEQ ID NO: 163095 - DNA, 25 bp, Homo sapien
cccagaggctgatctgtgggcgccc

SEQ ID NO: 163096 - DNA, 25 bp, Homo sapien
gaagtgcttttccaagattcgggcc

SEQ ID NO: 163097 - DNA, 25 bp, Homo sapien
ctgagagcagttccggtgccaaaac

SEQ ID NO: 163098 - DNA, 25 bp, Homo sapien
gccttgtaggcacagcggctgagac

SEQ ID NO: 163099 - DNA, 25 bp, Homo sapien
agcggctgagactcgatctgctcca

SEQ ID NO: 163100 - DNA, 25 bp, Homo sapien
agactcgatctgctccaagtagggg

SEQ ID NO: 163101 - DNA, 25 bp, Homo sapien
ctctcagcacctgggcggacggtga

SEQ ID NO: 163102 - DNA, 25 bp, Homo sapien
gcttttccaagattcgggccggaga

SEQ ID NO: 163103 - DNA, 25 bp, Homo sapien
taggtctttgcatagtcccggcagc

SEQ ID NO: 163104 - DNA, 25 bp, Homo sapien
caaagccagcgtctccttgtgccta

SEQ ID NO: 163105 - DNA, 25 bp, Homo sapien
ctcggaaccatggtgagcctgactc

SEQ ID NO: 163106 - DNA, 25 bp, Homo sapien
cacttgtgtgcggaactcctcggaa

SEQ ID NO: 163107 - DNA, 25 bp, Homo sapien
gaaatttctagtgtgggacccgctc

SEQ ID NO: 163108 - DNA, 25 bp, Homo sapien
gcctcacccggagcgaagaaatttc

SEQ ID NO: 163109 - DNA, 25 bp, Homo sapien
gcacgagctgtgaggggattcactt

SEQ ID NO: 163110 - DNA, 25 bp, Homo sapien
ccgtggggctccaatcaaaatggga

SEQ ID NO: 163111 - DNA, 25 bp, Homo sapien
gtggtttcgtgtcccagtcttagga

SEQ ID NO: 163112 - DNA, 25 bp, Homo sapien
ggaagcagctcacaacaccggacgc

SEQ ID NO: 163113 - DNA, 25 bp, Homo sapien
ttcccgaacaagtcggaagcagctc

SEQ ID NO: 163114 - DNA, 25 bp, Homo sapien
ttacacattaactgcgcggtcccgc

SEQ ID NO: 163115 - DNA, 25 bp, Homo sapien
ggagtcgcgcccaagtaggcagctc

SEQ ID NO: 163116 - DNA, 25 bp, Homo sapien
ggcacgggcgcgttacacattaact

SEQ ID NO: 163117 - DNA, 25 bp, Homo sapien
ctccgtttctcgctgcttcgggacg

SEQ ID NO: 163118 - DNA, 25 bp, Homo sapien
cttaggaaactacgcgcgaggcacc

SEQ ID NO: 163119 - DNA, 25 bp, Homo sapien
ctccaccttgttagaagcgcgctga

SEQ ID NO: 163120 - DNA, 25 bp, Homo sapien
agagccttctgcgaagcaacctagc

SEQ ID NO: 163121 - DNA, 25 bp, Homo sapien
gatccgcgggacaagaaaattcatg

SEQ ID NO: 163122 - DNA, 25 bp, Homo sapien
agcagctccagatcctaggcccggt

SEQ ID NO: 163123 - DNA, 25 bp, Homo sapien
cccgttgcttttgtctcggctccaa

SEQ ID NO: 163124 - DNA, 25 bp, Homo sapien
cagcaagcctccctgtgagtcggtg

SEQ ID NO: 163125 - DNA, 25 bp, Homo sapien
cacgatcagattcgctccaggtggc

SEQ ID NO: 163126 - DNA, 25 bp, Homo sapien
cgctgccgttttgcagtcgtcgctc

SEQ ID NO: 163127 - DNA, 25 bp, Homo sapien
gtgttcgagtgcaccttcacctgtg

SEQ ID NO: 163128 - DNA, 25 bp, Homo sapien
ttggagttcaagattcccgccgctc

SEQ ID NO: 163129 - DNA, 25 bp, Homo sapien
tccctccggttaagctaaattgatc

SEQ ID NO: 163130 - DNA, 25 bp, Homo sapien
ttcatctcggacgtccctctaaggg

SEQ ID NO: 163131 - DNA, 25 bp, Homo sapien
attccgattgcaagtcgccgctgtc

SEQ ID NO: 163132 - DNA, 25 bp, Homo sapien
atccggctcggcttgtttctcatca

SEQ ID NO: 163133 - DNA, 25 bp, Homo sapien
ttctcatcatctccggcgtcgtgtc

SEQ ID NO: 163134 - DNA, 25 bp, Homo sapien
gctcttcatcttcggcttctgctgg

SEQ ID NO: 163135 - DNA, 25 bp, Homo sapien
atcgccatcgtctcggtcttggtta

SEQ ID NO: 163136 - DNA, 25 bp, Homo sapien
ggtcttggttatcctcatctccatc

SEQ ID NO: 163137 - DNA, 25 bp, Homo sapien
atcttcgagtatccggagagctctg

SEQ ID NO: 163138 - DNA, 25 bp, Homo sapien
tccgcgaggatgagggcttcattaa

SEQ ID NO: 163139 - DNA, 25 bp, Homo sapien
acgtctccctggacgtgttcgcgga

SEQ ID NO: 163140 - DNA, 25 bp, Homo sapien
tgttcgcggacgagatacgcttcta

SEQ ID NO: 163141 - DNA, 25 bp, Homo sapien
caggtgtggcttatcttcgagtatc

SEQ ID NO: 163142 - DNA, 25 bp, Homo sapien
atcaccttctgcttggagaccctgc

SEQ ID NO: 163143 - DNA, 25 bp, Homo sapien
cgcgccgataccttcccggccaggg

SEQ ID NO: 163144 - DNA, 25 bp, Homo sapien
gagccaacgcctgagcctgccaagg

SEQ ID NO: 163145 - DNA, 25 bp, Homo sapien
cggcaaaggaacaatgcgccggcga

SEQ ID NO: 163146 - DNA, 25 bp, Homo sapien
tcgtctcccggcaaaggaacaatgc

SEQ ID NO: 163147 - DNA, 25 bp, Homo sapien
ggcaatttcctcgtctcccggcaaa

SEQ ID NO: 163148 - DNA, 25 bp, Homo sapien
cttccgcaatcaaaaggcaatttcc

SEQ ID NO: 163149 - DNA, 25 bp, Homo sapien
cgtccgctgacttccgcaatcaaaa

SEQ ID NO: 163150 - DNA, 25 bp, Homo sapien
acgctgccattctgacccgcgctgc

SEQ ID NO: 163151 - DNA, 25 bp, Homo sapien
ctcccaggctgacagaggtccgcgg

SEQ ID NO: 163152 - DNA, 25 bp, Homo sapien
tcccaggctgacagaggtccgcggg

SEQ ID NO: 163153 - DNA, 25 bp, Homo sapien
aggctgacagaggtccgcgggagcc

SEQ ID NO: 163154 - DNA, 25 bp, Homo sapien
cccaggctgacagaggtccgcggga

SEQ ID NO: 163155 - DNA, 25 bp, Homo sapien
ggctgacagaggtccgcgggagccc

SEQ ID NO: 163156 - DNA, 25 bp, Homo sapien
acagaggtccgcgggagcccctagc

SEQ ID NO: 163157 - DNA, 25 bp, Homo sapien
ccaggctgacagaggtccgcgggag

SEQ ID NO: 163158 - DNA, 25 bp, Homo sapien
agaggtccgcgggagcccctagcct

SEQ ID NO: 163159 - DNA, 25 bp, Homo sapien
tccgacactgacagaggtccgcggg

SEQ ID NO: 163160 - DNA, 25 bp, Homo sapien
ccgacactgacagaggtccgcggga

SEQ ID NO: 163161 - DNA, 25 bp, Homo sapien
gacactgacagaggtccgcgggagc

SEQ ID NO: 163162 - DNA, 25 bp, Homo sapien
tcagctcctagcctcacaccggccc

SEQ ID NO: 163163 - DNA, 25 bp, Homo sapien
caggcttgcacgcgggctgctggga

SEQ ID NO: 163164 - DNA, 25 bp, Homo sapien
ggaggtcacagtggggcgagagctg

SEQ ID NO: 163165 - DNA, 25 bp, Homo sapien
ctccgacactgacagaggtccgcgg

SEQ ID NO: 163166 - DNA, 25 bp, Homo sapien
cacgctgacaggtcagcctcagctc

SEQ ID NO: 163167 - DNA, 25 bp, Homo sapien
cgcaattcgggctggagcgctttaa

SEQ ID NO: 163168 - DNA, 25 bp, Homo sapien
gcggcgttgagcactgaatcttcca

SEQ ID NO: 163169 - DNA, 25 bp, Homo sapien
gagaactcgccagtaccgcgcgctg

SEQ ID NO: 163170 - DNA, 25 bp, Homo sapien
agaaatgcacgtgtctcggggagta

SEQ ID NO: 163171 - DNA, 25 bp, Homo sapien
tctcccaggtctggtgtgttgctga

SEQ ID NO: 163172 - DNA, 25 bp, Homo sapien
cacactgtcattgcgagcccgacgg

SEQ ID NO: 163173 - DNA, 25 bp, Homo sapien
tctggacccgcagagaaatggcttc

SEQ ID NO: 163174 - DNA, 25 bp, Homo sapien
acgcccgctgagttgcagaagccca

SEQ ID NO: 163175 - DNA, 25 bp, Homo sapien
gctcccagttcacgcgataataaga

SEQ ID NO: 163176 - DNA, 25 bp, Homo sapien
gcctgcctcgaaagcggaaacggtc

SEQ ID NO: 163177 - DNA, 25 bp, Homo sapien
tgccgcgagcgtgagaaattcctca

SEQ ID NO: 163178 - DNA, 25 bp, Homo sapien
ccgactccgtatctggctgttatta

SEQ ID NO: 163179 - DNA, 25 bp, Homo sapien
ggatccgcccgacaattgcctcgtt

SEQ ID NO: 163180 - DNA, 25 bp, Homo sapien
ggtgcggtcttaccctactcggaca

SEQ ID NO: 163181 - DNA, 25 bp, Homo sapien
agctctgactgctgctgaacccgga

SEQ ID NO: 163182 - DNA, 25 bp, Homo sapien
gcggctgtacccgaaacgtcacttc

SEQ ID NO: 163183 - DNA, 25 bp, Homo sapien
tgcccacgtgagctaggcgacatcc

SEQ ID NO: 163184 - DNA, 25 bp, Homo sapien
ggacgtgactgcgttcagccgcgtc

SEQ ID NO: 163185 - DNA, 25 bp, Homo sapien
gacctgaccctagggcggcttgcgc

SEQ ID NO: 163186 - DNA, 25 bp, Homo sapien
gcttttgcggtgaggcgttgaccac

SEQ ID NO: 163187 - DNA, 25 bp, Homo sapien
ccgggttgcgctctgcttttgcggt

SEQ ID NO: 163188 - DNA, 25 bp, Homo sapien
tgcttcccagacttgcccaagttcg

SEQ ID NO: 163189 - DNA, 25 bp, Homo sapien
ggctttgctcctggggtctcggcct

SEQ ID NO: 163190 - DNA, 25 bp, Homo sapien
ggattggctgcctcggctttctctt

SEQ ID NO: 163191 - DNA, 25 bp, Homo sapien
cctggatgtaggctggcaaatctca

SEQ ID NO: 163192 - DNA, 25 bp, Homo sapien
ggcctgtcatctccgccttcggttt

SEQ ID NO: 163193 - DNA, 25 bp, Homo sapien
ctgcgctactgcgagaacaagttta

SEQ ID NO: 163194 - DNA, 25 bp, Homo sapien
ctactcgttcaaggtggtgctgctg

SEQ ID NO: 163195 - DNA, 25 bp, Homo sapien
tggggcccttcattctcggactttc

SEQ ID NO: 163196 - DNA, 25 bp, Homo sapien
agagagggatcgttcttcgcttttc

SEQ ID NO: 163197 - DNA, 25 bp, Homo sapien
agattgccagtaggcgctcgactca

SEQ ID NO: 163198 - DNA, 25 bp, Homo sapien
gtccaggcacgttcttctggggcta

SEQ ID NO: 163199 - DNA, 25 bp, Homo sapien
gtagcgttaggcctgagactccacc

SEQ ID NO: 163200 - DNA, 25 bp, Homo sapien
tgagcccagttcagcacgcacgcgt

SEQ ID NO: 163201 - DNA, 25 bp, Homo sapien
acgcacgcgtcaggcggcttttttc

SEQ ID NO: 163202 - DNA, 25 bp, Homo sapien
ccgcccggatgttattctagttttg

SEQ ID NO: 163203 - DNA, 25 bp, Homo sapien
ttttgccggatgttgttgtatgtcc

SEQ ID NO: 163204 - DNA, 25 bp, Homo sapien
tatgtccgagagacacgtgaggttc

SEQ ID NO: 163205 - DNA, 25 bp, Homo sapien
acgtcattaccaggcacgcgcagga

SEQ ID NO: 163206 - DNA, 25 bp, Homo sapien
cgtgaggttctgctacgtcattacc

SEQ ID NO: 163207 - DNA, 25 bp, Homo sapien
gaagccgctgcactacaatctgatg

SEQ ID NO: 163208 - DNA, 25 bp, Homo sapien
cgctttccaagttgggcgcgtccca

SEQ ID NO: 163209 - DNA, 25 bp, Homo sapien
cgcttgtgtccagaacccgtcttaa

SEQ ID NO: 163210 - DNA, 25 bp, Homo sapien
tgagctctccgatgcctgctctggc

SEQ ID NO: 163211 - DNA, 25 bp, Homo sapien
catcgccgtacacaagcggcttgtg

SEQ ID NO: 163212 - DNA, 25 bp, Homo sapien
acaatgctcgctgtgctgctcagcc

SEQ ID NO: 163213 - DNA, 25 bp, Homo sapien
gaacgccacccgctacgtagtgctg

SEQ ID NO: 163214 - DNA, 25 bp, Homo sapien
tcgtggcattgctcgcggtcacaat

SEQ ID NO: 163215 - DNA, 25 bp, Homo sapien
ccatgcaggacatgcagcaccagca

SEQ ID NO: 163216 - DNA, 25 bp, Homo sapien
acagcgagctgggcacctggaagca

SEQ ID NO: 163217 - DNA, 25 bp, Homo sapien
agcgggccatgcaggacatgcagca

SEQ ID NO: 163218 - DNA, 25 bp, Homo sapien
ctgtcggacgcccagaagcagcagc

SEQ ID NO: 163219 - DNA, 25 bp, Homo sapien
gcgtcacggagctgtcggacgccca

SEQ ID NO: 163220 - DNA, 25 bp, Homo sapien
gaccgcaaggggttcggctataaga

SEQ ID NO: 163221 - DNA, 25 bp, Homo sapien
gccagaagagaataaggcagaactc

SEQ ID NO: 163222 - DNA, 25 bp, Homo sapien
cggcagccaccgtgaagaggaagcg

SEQ ID NO: 163223 - DNA, 25 bp, Homo sapien
aggcgcagctgaaaggcccgcaacc

SEQ ID NO: 163224 - DNA, 25 bp, Homo sapien
cgtcaaaacaaacagaaggacttgg

SEQ ID NO: 163225 - DNA, 25 bp, Homo sapien
aggactgggcactgaaaggcctcta

SEQ ID NO: 163226 - DNA, 25 bp, Homo sapien
gcactgaaaggcctctaggcctagg

SEQ ID NO: 163227 - DNA, 25 bp, Homo sapien
ccagacgtgttgctgccgtgagtaa

SEQ ID NO: 163228 - DNA, 25 bp, Homo sapien
ccgtgagtaaaacgagcgccctctc

SEQ ID NO: 163229 - DNA, 25 bp, Homo sapien
cgcggaaccagtgcgcaggcgctct

SEQ ID NO: 163230 - DNA, 25 bp, Homo sapien
aaggacttgggattccggagcagtc

SEQ ID NO: 163231 - DNA, 25 bp, Homo sapien
ccgacattgaggatcaccctctcgt

SEQ ID NO: 163232 - DNA, 25 bp, Homo sapien
ccaggcgtgttccaggcagggtctt

SEQ ID NO: 163233 - DNA, 25 bp, Homo sapien
ccgccgtggtcaagcagtcgcctgg

SEQ ID NO: 163234 - DNA, 25 bp, Homo sapien
ttgtcgcccgccgtggtcaagcagt

SEQ ID NO: 163235 - DNA, 25 bp, Homo sapien
cgaagaagaactcgcggccgccacc

SEQ ID NO: 163236 - DNA, 25 bp, Homo sapien
ccgccgcgtcctcgatgcccagcct

SEQ ID NO: 163237 - DNA, 25 bp, Homo sapien
ctccagcggccagatttgccgtcgg

SEQ ID NO: 163238 - DNA, 25 bp, Homo sapien
gaggatcaccctctcgttgttctcg

SEQ ID NO: 163239 - DNA, 25 bp, Homo sapien
cacctccacatcatccgtaatccga

SEQ ID NO: 163240 - DNA, 25 bp, Homo sapien
tccgtaatccgatcacctccacatc

SEQ ID NO: 163241 - DNA, 25 bp, Homo sapien
cctccacatcatccgtaatccgatc

SEQ ID NO: 163242 - DNA, 25 bp, Homo sapien
tccgatcacctccacatcatccgta

SEQ ID NO: 163243 - DNA, 25 bp, Homo sapien
atcatccgtaatccgatcacctcca

SEQ ID NO: 163244 - DNA, 25 bp, Homo sapien
acatcatccgtaatccgatcacctc

SEQ ID NO: 163245 - DNA, 25 bp, Homo sapien
ccacatcatccgtaatccgatcacc

SEQ ID NO: 163246 - DNA, 25 bp, Homo sapien
ccgtaatccgatcacctccacatca

SEQ ID NO: 163247 - DNA, 25 bp, Homo sapien
tgtcctccgttgacgcggctttttg

SEQ ID NO: 163248 - DNA, 25 bp, Homo sapien
gctttttgtcctccgttgacgcggc

SEQ ID NO: 163249 - DNA, 25 bp, Homo sapien
cggctttttgtcctccgttgacgcg

SEQ ID NO: 163250 - DNA, 25 bp, Homo sapien
gcggctttttgtcctccgttgacgc

SEQ ID NO: 163251 - DNA, 25 bp, Homo sapien
cgcggctttttgtcctccgttgacg

SEQ ID NO: 163252 - DNA, 25 bp, Homo sapien
cgacgcggctttttgtcctccgttg

SEQ ID NO: 163253 - DNA, 25 bp, Homo sapien
gacgcggctttttgtcctccgttga

SEQ ID NO: 163254 - DNA, 25 bp, Homo sapien
gctccagctttttgcacaaccgccg

SEQ ID NO: 163255 - DNA, 25 bp, Homo sapien
gtttccgagtggacgaggttctctg

SEQ ID NO: 163256 - DNA, 25 bp, Homo sapien
tctccgacgagaaactacttgttgg

SEQ ID NO: 163257 - DNA, 25 bp, Homo sapien
tacttgttggcgttttccggattca

SEQ ID NO: 163258 - DNA, 25 bp, Homo sapien
catcgcgcagggttgggcaaaccat

SEQ ID NO: 163259 - DNA, 25 bp, Homo sapien
tgcggatttgccagtcgccaacctc

SEQ ID NO: 163260 - DNA, 25 bp, Homo sapien
gcgttttccggattcaggtggttga

SEQ ID NO: 163261 - DNA, 25 bp, Homo sapien
aagtggttctgctttggtttccgag

SEQ ID NO: 163262 - DNA, 25 bp, Homo sapien
cttcattctgtgatctgcggatttg

SEQ ID NO: 163263 - DNA, 25 bp, Homo sapien
gcacgacgagctcgtgtggtacatg

SEQ ID NO: 163264 - DNA, 25 bp, Homo sapien
ctccagacccgaccactgccccagg

SEQ ID NO: 163265 - DNA, 25 bp, Homo sapien
cccgagcgaccggaaggctcagcag

SEQ ID NO: 163266 - DNA, 25 bp, Homo sapien
cgagcgaccggaaggctcagcagca

SEQ ID NO: 163267 - DNA, 25 bp, Homo sapien
gcgcacgacgagctcgtgtggtaca

SEQ ID NO: 163268 - DNA, 25 bp, Homo sapien
cacgacgagctcgtgtggtacatgc

SEQ ID NO: 163269 - DNA, 25 bp, Homo sapien
acgacgagctcgtgtggtacatgcg

SEQ ID NO: 163270 - DNA, 25 bp, Homo sapien
caccaggcccctagcactgcccagt

SEQ ID NO: 163271 - DNA, 25 bp, Homo sapien
cctggctgaccggaactgagcttgt

SEQ ID NO: 163272 - DNA, 25 bp, Homo sapien
ctctgacctccagggacgaaaaggt

SEQ ID NO: 163273 - DNA, 25 bp, Homo sapien
gccacgctctcagaagtacttgctg

SEQ ID NO: 163274 - DNA, 25 bp, Homo sapien
cgcagcgcagggcttctgattacac

SEQ ID NO: 163275 - DNA, 25 bp, Homo sapien
gggcttctgattacactctgacctc

SEQ ID NO: 163276 - DNA, 25 bp, Homo sapien
caagtcccttgttcgttctacgcca

SEQ ID NO: 163277 - DNA, 25 bp, Homo sapien
cttgctggctggaaaacccaaaggg

SEQ ID NO: 163278 - DNA, 25 bp, Homo sapien
ccaaaggggtgaaacctcagctaca

SEQ ID NO: 163279 - DNA, 25 bp, Homo sapien
ccgagggtctaacttgcgcttcatg

SEQ ID NO: 163280 - DNA, 25 bp, Homo sapien
tcctccgtagattggcaggtcactg

SEQ ID NO: 163281 - DNA, 25 bp, Homo sapien
gcgttttgaagctgcggctctgtga

SEQ ID NO: 163282 - DNA, 25 bp, Homo sapien
agctgtggctactgctactgggttc

SEQ ID NO: 163283 - DNA, 25 bp, Homo sapien
cgaggaggacgtagactttatcaac

SEQ ID NO: 163284 - DNA, 25 bp, Homo sapien
acaacgcctccctggatctcgggta

SEQ ID NO: 163285 - DNA, 25 bp, Homo sapien
acaaggcttgcttgcgtcctccgta

SEQ ID NO: 163286 - DNA, 25 bp, Homo sapien
acgccagatttttgccagacgagga

SEQ ID NO: 163287 - DNA, 25 bp, Homo sapien
tccggcttcggcttctggttacgaa

SEQ ID NO: 163288 - DNA, 25 bp, Homo sapien
cagacgaggagatctgcgcagtctc

SEQ ID NO: 163289 - DNA, 25 bp, Homo sapien
tccgcggaactcagacgaggagatc

SEQ ID NO: 163290 - DNA, 25 bp, Homo sapien
ggctaaaacgcctacactcaaaatg

SEQ ID NO: 163291 - DNA, 25 bp, Homo sapien
cggtggctccggaaatgaaactgtt

SEQ ID NO: 163292 - DNA, 25 bp, Homo sapien
caggcttcggttcccacataacatc

SEQ ID NO: 163293 - DNA, 25 bp, Homo sapien
atcaccttggttctccggcttcggc

SEQ ID NO: 163294 - DNA, 25 bp, Homo sapien
ccagcgagggagacgccatttgcaa

SEQ ID NO: 163295 - DNA, 25 bp, Homo sapien
cgtcctcttgcgagcgctcactgaa

SEQ ID NO: 163296 - DNA, 25 bp, Homo sapien
agagctgcaacaacccgtcgctgcg

SEQ ID NO: 163297 - DNA, 25 bp, Homo sapien
tcggtgaggatgcaacactttttct

SEQ ID NO: 163298 - DNA, 25 bp, Homo sapien
gcacgcctcattaacttggggcctt

SEQ ID NO: 163299 - DNA, 25 bp, Homo sapien
tggctgcctgactactgccgacgct

SEQ ID NO: 163300 - DNA, 25 bp, Homo sapien
cggcgcttttgaatgggccatcttc

SEQ ID NO: 163301 - DNA, 25 bp, Homo sapien
gcgggactctctgctaacagcctca

SEQ ID NO: 163302 - DNA, 25 bp, Homo sapien
gctgcctctcggttcttgggaatta

SEQ ID NO: 163303 - DNA, 25 bp, Homo sapien
ctcgctccggtccacgcggaaaaga

SEQ ID NO: 163304 - DNA, 25 bp, Homo sapien
cgccgctcgcgctcatatacaatta

SEQ ID NO: 163305 - DNA, 25 bp, Homo sapien
attagcgtcagcacgtagggccctt

SEQ ID NO: 163306 - DNA, 25 bp, Homo sapien
ggccttgtagtctcccagcaacgcg

SEQ ID NO: 163307 - DNA, 25 bp, Homo sapien
gttgcctagcaactgaaccgtcctc

SEQ ID NO: 163308 - DNA, 25 bp, Homo sapien
gccggtgtctaacctcctctgttaa

SEQ ID NO: 163309 - DNA, 25 bp, Homo sapien
ttttctccctgctgagccggaaagg

SEQ ID NO: 163310 - DNA, 25 bp, Homo sapien
cggacgctccctgtcaaggcctaat

SEQ ID NO: 163311 - DNA, 25 bp, Homo sapien
tccattccggctgagaagcacctcg

SEQ ID NO: 163312 - DNA, 25 bp, Homo sapien
ggtacctggctatgggatgctctaa

SEQ ID NO: 163313 - DNA, 25 bp, Homo sapien
cgccagtgggcttcgtacacaaaac

SEQ ID NO: 163314 - DNA, 25 bp, Homo sapien
acgcagcagctcacgatggcttcca

SEQ ID NO: 163315 - DNA, 25 bp, Homo sapien
tgctctaagtgtagcgcctccagga

SEQ ID NO: 163316 - DNA, 25 bp, Homo sapien
gaacttaacatatctgggccgcttc

SEQ ID NO: 163317 - DNA, 25 bp, Homo sapien
ttgaccagcttgcagaacacccggg

SEQ ID NO: 163318 - DNA, 25 bp, Homo sapien
cctgcagcggccatagaacttaaca

SEQ ID NO: 163319 - DNA, 25 bp, Homo sapien
atggagcaacactcacccgtgcgga

SEQ ID NO: 163320 - DNA, 25 bp, Homo sapien
gcggtcgaaatgctccaacagcctc

SEQ ID NO: 163321 - DNA, 25 bp, Homo sapien
accttgcttcgccagggtgttatcg

SEQ ID NO: 163322 - DNA, 25 bp, Homo sapien
tgcggcgtccaaagctaacactaca

SEQ ID NO: 163323 - DNA, 25 bp, Homo sapien
cgggagtcactgtccaccttgcttc

SEQ ID NO: 163324 - DNA, 25 bp, Homo sapien
tgggcacccagaaccgcgaagatcc

SEQ ID NO: 163325 - DNA, 25 bp, Homo sapien
gcgtcgcggcctaatgttgtcatcc

SEQ ID NO: 163326 - DNA, 25 bp, Homo sapien
gccgcggcttttgtaaggctgcaga

SEQ ID NO: 163327 - DNA, 25 bp, Homo sapien
gtgaaacgctttctcccagcatgca

SEQ ID NO: 163328 - DNA, 25 bp, Homo sapien
aaccgtgctgagtggattccttgcc

SEQ ID NO: 163329 - DNA, 25 bp, Homo sapien
tttaacaccaagatggcggacggcc

SEQ ID NO: 163330 - DNA, 25 bp, Homo sapien
gggcagccagagcttcacatctacc

SEQ ID NO: 163331 - DNA, 25 bp, Homo sapien
ctaggtttcccaagcgactgtctca

SEQ ID NO: 163332 - DNA, 25 bp, Homo sapien
tcgctcctgagcagctgctaggttt

SEQ ID NO: 163333 - DNA, 25 bp, Homo sapien
tgcccgagttcctgaagaggggtcc

SEQ ID NO: 163334 - DNA, 25 bp, Homo sapien
acggcccggatgagtacgataccga

SEQ ID NO: 163335 - DNA, 25 bp, Homo sapien
ggcggcaggacctggtctgctgcct

SEQ ID NO: 163336 - DNA, 25 bp, Homo sapien
ctgcagagatgcaggcggcagttcg

SEQ ID NO: 163337 - DNA, 25 bp, Homo sapien
agatgcaggcggcagttcggagccg

SEQ ID NO: 163338 - DNA, 25 bp, Homo sapien
aacatggcgcatggaactggtgcac

SEQ ID NO: 163339 - DNA, 25 bp, Homo sapien
catggcgcatggaactggtgcacgc

SEQ ID NO: 163340 - DNA, 25 bp, Homo sapien
cgcatggaactggtgcacgcgccta

SEQ ID NO: 163341 - DNA, 25 bp, Homo sapien
acgcgcctagttggcgggaccatta

SEQ ID NO: 163342 - DNA, 25 bp, Homo sapien
atggaactggtgcacgcgcctagtt

SEQ ID NO: 163343 - DNA, 25 bp, Homo sapien
ctctcgatggcaaatgggcgaaatc

SEQ ID NO: 163344 - DNA, 25 bp, Homo sapien
cgtcattactttcggggcgccacga

SEQ ID NO: 163345 - DNA, 25 bp, Homo sapien
ggtctaacgggcagctaaaattatc

SEQ ID NO: 163346 - DNA, 25 bp, Homo sapien
cgcggaacggcttgcttattagaca

SEQ ID NO: 163347 - DNA, 25 bp, Homo sapien
cgggctctcgatttctcgttgatca

SEQ ID NO: 163348 - DNA, 25 bp, Homo sapien
cagtcgcgcgtgagtcaaaaggtcc

SEQ ID NO: 163349 - DNA, 25 bp, Homo sapien
ggaaacgggatactcgctgcccttc

SEQ ID NO: 163350 - DNA, 25 bp, Homo sapien
tctcctcgaatgtatccaccggtgg

SEQ ID NO: 163351 - DNA, 25 bp, Homo sapien
ctactcacttgagtcggaggcggga

SEQ ID NO: 163352 - DNA, 25 bp, Homo sapien
agcacgtaccgcaggcggagctagc

SEQ ID NO: 163353 - DNA, 25 bp, Homo sapien
agtccgagatcccaggcgaagcgcg

SEQ ID NO: 163354 - DNA, 25 bp, Homo sapien
cgccggtgccttttaaagagcgctc

SEQ ID NO: 163355 - DNA, 25 bp, Homo sapien
ggctagccaccaggagacaaaaggc

SEQ ID NO: 163356 - DNA, 25 bp, Homo sapien
agttccaaaagccactgggacttgg

SEQ ID NO: 163357 - DNA, 25 bp, Homo sapien
actgggacttggagagggacttcct

SEQ ID NO: 163358 - DNA, 25 bp, Homo sapien
cctcttcgcggagacagtcatgggc

SEQ ID NO: 163359 - DNA, 25 bp, Homo sapien
tgaaccatggttaccgctctgctgc

SEQ ID NO: 163360 - DNA, 25 bp, Homo sapien
cctgctttcctaaggaggcttcctg

SEQ ID NO: 163361 - DNA, 25 bp, Homo sapien
gggagtgggccctgtatcccaattc

SEQ ID NO: 163362 - DNA, 25 bp, Homo sapien
tctggcgccttgagaccgaatttga

SEQ ID NO: 163363 - DNA, 25 bp, Homo sapien
tatgcatagaagacccgcgcacgtc

SEQ ID NO: 163364 - DNA, 25 bp, Homo sapien
tggaagaacgatctacaccctctgg

SEQ ID NO: 163365 - DNA, 25 bp, Homo sapien
ttgccggggcaaacttcttaacatc

SEQ ID NO: 163366 - DNA, 25 bp, Homo sapien
catcgcacgctggtgtgacacatga

SEQ ID NO: 163367 - DNA, 25 bp, Homo sapien
aacagcgtgttcatttccaggtgcc

SEQ ID NO: 163368 - DNA, 25 bp, Homo sapien
ccaggacccatgatgagattatttt

SEQ ID NO: 163369 - DNA, 25 bp, Homo sapien
ttccttttgtggaaaatcgcccagc

SEQ ID NO: 163370 - DNA, 25 bp, Homo sapien
gctgcgctccttgcaaagttccttt

SEQ ID NO: 163371 - DNA, 25 bp, Homo sapien
tttctgggtgacaagaatgtgcctc

SEQ ID NO: 163372 - DNA, 25 bp, Homo sapien
ctcagcggcccaagcagtttctttc

SEQ ID NO: 163373 - DNA, 25 bp, Homo sapien
tctctttaaattccagctgcgcggc

SEQ ID NO: 163374 - DNA, 25 bp, Homo sapien
caggaaacttttctcgcagggcccg

SEQ ID NO: 163375 - DNA, 25 bp, Homo sapien
tagcacgtccgggttacccatagat

SEQ ID NO: 163376 - DNA, 25 bp, Homo sapien
tccacgcaccgcacgttcaggcgac

SEQ ID NO: 163377 - DNA, 25 bp, Homo sapien
ttcaggcgacccatagatatccacg

SEQ ID NO: 163378 - DNA, 25 bp, Homo sapien
ccgatgttcaggtgagccatagaca

SEQ ID NO: 163379 - DNA, 25 bp, Homo sapien
gtgagccatagacatccacacaccg

SEQ ID NO: 163380 - DNA, 25 bp, Homo sapien
tgtccatgcaccgtacgtccgggtt

SEQ ID NO: 163381 - DNA, 25 bp, Homo sapien
atgcaccgtacgtccgggttatccg

SEQ ID NO: 163382 - DNA, 25 bp, Homo sapien
gatatccacgcaccgatgttcaggt

SEQ ID NO: 163383 - DNA, 25 bp, Homo sapien
gtccggtagccaccggtcgccatat

SEQ ID NO: 163384 - DNA, 25 bp, Homo sapien
acctgtcggctcgtcgtatcgcctg

SEQ ID NO: 163385 - DNA, 25 bp, Homo sapien
ctcctagccggttcgcagaggaggc

SEQ ID NO: 163386 - DNA, 25 bp, Homo sapien
ctgtcccgccgagcgtggaaaggac

SEQ ID NO: 163387 - DNA, 25 bp, Homo sapien
cgagcgccttaccttggaggagctt

SEQ ID NO: 163388 - DNA, 25 bp, Homo sapien
cttggcgcgcatcttctcgcgtttc

SEQ ID NO: 163389 - DNA, 25 bp, Homo sapien
agctccaggcaatcccaggacagga

SEQ ID NO: 163390 - DNA, 25 bp, Homo sapien
atccggctcccaggtgtgccgaagc

SEQ ID NO: 163391 - DNA, 25 bp, Homo sapien
ttcaccttggtcttctggcgcttca

SEQ ID NO: 163392 - DNA, 25 bp, Homo sapien
ctgtctcagctacgccgagtcgttg

SEQ ID NO: 163393 - DNA, 25 bp, Homo sapien
ccgcaaggctctacagggcagatct

SEQ ID NO: 163394 - DNA, 25 bp, Homo sapien
cggcggccaatctaacgtaacttcg

SEQ ID NO: 163395 - DNA, 25 bp, Homo sapien
tctcggagccgatccagcgtttcag

SEQ ID NO: 163396 - DNA, 25 bp, Homo sapien
ggcgccatcgtcgaacttcaccttg

SEQ ID NO: 163397 - DNA, 25 bp, Homo sapien
cagtgagtccgtccacattggcgta

SEQ ID NO: 163398 - DNA, 25 bp, Homo sapien
gagccgacgctcgagacttccagta

SEQ ID NO: 163399 - DNA, 25 bp, Homo sapien
agtggccaagtgtttccgatcattc

SEQ ID NO: 163400 - DNA, 25 bp, Homo sapien
tgtgttgttttttcgctcaggagga

SEQ ID NO: 163401 - DNA, 25 bp, Homo sapien
atgtttctttcctaatctgccgctg

SEQ ID NO: 163402 - DNA, 25 bp, Homo sapien
gaagaccgggtgcttgcaataggca

SEQ ID NO: 163403 - DNA, 25 bp, Homo sapien
agtagccttcgatgcctttcttcca

SEQ ID NO: 163404 - DNA, 25 bp, Homo sapien
gggccttaacctccagctgcttggt

SEQ ID NO: 163405 - DNA, 25 bp, Homo sapien
ccatcgtggacagtatttcctcgga

SEQ ID NO: 163406 - DNA, 25 bp, Homo sapien
tgattcgtcagcctcgagtagcctt

SEQ ID NO: 163407 - DNA, 25 bp, Homo sapien
ttcggagcgcacaaagcagagctgc

SEQ ID NO: 163408 - DNA, 25 bp, Homo sapien
gcctctcagcaggatggacgtgatg

SEQ ID NO: 163409 - DNA, 25 bp, Homo sapien
caccaccatggatcggcggaaggca

SEQ ID NO: 163410 - DNA, 25 bp, Homo sapien
gtacttctacgacggctcctgcata

SEQ ID NO: 163411 - DNA, 25 bp, Homo sapien
ctcagatgaggacgagcacgtgcga

SEQ ID NO: 163412 - DNA, 25 bp, Homo sapien
actgcctcatgtgggcctgcaaagc

SEQ ID NO: 163413 - DNA, 25 bp, Homo sapien
ctgcaagaggaagtccaccaccatg

SEQ ID NO: 163414 - DNA, 25 bp, Homo sapien
tggatggctgccagttctcaccttc

SEQ ID NO: 163415 - DNA, 25 bp, Homo sapien
tgtcaatgtcgccatgtctgccgtg

SEQ ID NO: 163416 - DNA, 25 bp, Homo sapien
agccgagagttgctatcgaccggga

SEQ ID NO: 163417 - DNA, 25 bp, Homo sapien
ttcgatctcgaagccgcggagagcc

SEQ ID NO: 163418 - DNA, 25 bp, Homo sapien
gcgcagcggctccaacaaagccaga

SEQ ID NO: 163419 - DNA, 25 bp, Homo sapien
gaaagtgttctgttctcggcgcgaa

SEQ ID NO: 163420 - DNA, 25 bp, Homo sapien
gagcggctggaccactgtcaatgtc

SEQ ID NO: 163421 - DNA, 25 bp, Homo sapien
gtgacgctcggcttcagcatcagca

SEQ ID NO: 163422 - DNA, 25 bp, Homo sapien
cgcgtcccatgtcccgttgggaatt

SEQ ID NO: 163423 - DNA, 25 bp, Homo sapien
agccgcggtggtggaataaaactgt

SEQ ID NO: 163424 - DNA, 25 bp, Homo sapien
cagcggcagggttaaaaaccgcagc

SEQ ID NO: 163425 - DNA, 25 bp, Homo sapien
acagcctcaaaaaaccatagtggtg

SEQ ID NO: 163426 - DNA, 25 bp, Homo sapien
aaccacaaaaatccgctgagacagg

SEQ ID NO: 163427 - DNA, 25 bp, Homo sapien
gtggaataaaactgtgactgcaaaa

SEQ ID NO: 163428 - DNA, 25 bp, Homo sapien
cggtggtggaataaaactgtgactg

SEQ ID NO: 163429 - DNA, 25 bp, Homo sapien
gcagggttaaaaaccgcagcggcaa

SEQ ID NO: 163430 - DNA, 25 bp, Homo sapien
ctcaaaaaaccatagtggtggggca

SEQ ID NO: 163431 - DNA, 25 bp, Homo sapien
agtaccatttgtcgcacactcgggg

SEQ ID NO: 163432 - DNA, 25 bp, Homo sapien
ttctggagtttgagcgcgatttttc

SEQ ID NO: 163433 - DNA, 25 bp, Homo sapien
tggcagcgagtacaagacccacttc

SEQ ID NO: 163434 - DNA, 25 bp, Homo sapien
accgtcttggctgcagtgtcgtaaa

SEQ ID NO: 163435 - DNA, 25 bp, Homo sapien
cccaggaagttgcaagagtaccatt

SEQ ID NO: 163436 - DNA, 25 bp, Homo sapien
gctctgggctcacttcggaatttgc

SEQ ID NO: 163437 - DNA, 25 bp, Homo sapien
cggcgactctagtgtggcttccaaa

SEQ ID NO: 163438 - DNA, 25 bp, Homo sapien
taacctgctgcaacggcgctgtgac

SEQ ID NO: 163439 - DNA, 25 bp, Homo sapien
tgctcctccgagaaagctcctagcg

SEQ ID NO: 163440 - DNA, 25 bp, Homo sapien
caaagtttgcgctgggatctgctca

SEQ ID NO: 163441 - DNA, 25 bp, Homo sapien
ctttactcagtggtggatgctcctg

SEQ ID NO: 163442 - DNA, 25 bp, Homo sapien
agccagccaggtcggagtttaaagg

SEQ ID NO: 163443 - DNA, 25 bp, Homo sapien
tccagcctgttctcggactttgagc

SEQ ID NO: 163444 - DNA, 25 bp, Homo sapien
cgcagatgttggagctccgtacgca

SEQ ID NO: 163445 - DNA, 25 bp, Homo sapien
ccctcaatctgggaaagtgatcagg

SEQ ID NO: 163446 - DNA, 25 bp, Homo sapien
gatctccttgcggtatcgtccagcc

SEQ ID NO: 163447 - DNA, 25 bp, Homo sapien
agctcggttcagaccattgtcaaag

SEQ ID NO: 163448 - DNA, 25 bp, Homo sapien
tgctttgggaagcaaagctcggttc

SEQ ID NO: 163449 - DNA, 25 bp, Homo sapien
cgtccatcggaaaaatggcatatta

SEQ ID NO: 163450 - DNA, 25 bp, Homo sapien
aggagaagcgtccatcggaaaaatg

SEQ ID NO: 163451 - DNA, 25 bp, Homo sapien
tccgtcagcagccaaaaggagaagc

SEQ ID NO: 163452 - DNA, 25 bp, Homo sapien
caggagctcggcatcttcccgtggc

SEQ ID NO: 163453 - DNA, 25 bp, Homo sapien
tttcagaaacttaaccacgcggcgc

SEQ ID NO: 163454 - DNA, 25 bp, Homo sapien
tcagaccattgtcaaaggaggagag

SEQ ID NO: 163455 - DNA, 25 bp, Homo sapien
aatccggctcggagctctactgagc

SEQ ID NO: 163456 - DNA, 25 bp, Homo sapien
aggccgccatgtcttctgtctcaca

SEQ ID NO: 163457 - DNA, 25 bp, Homo sapien
cggcgccattgcagccgactaactg

SEQ ID NO: 163458 - DNA, 25 bp, Homo sapien
caatcgctcagaaggaatccggctc

SEQ ID NO: 163459 - DNA, 25 bp, Homo sapien
acggccatgtttgcgccacctacag

SEQ ID NO: 163460 - DNA, 25 bp, Homo sapien
actgctgcagttcctgagggatgcc

SEQ ID NO: 163461 - DNA, 25 bp, Homo sapien
agggatgccctgtccatttccaatg

SEQ ID NO: 163462 - DNA, 25 bp, Homo sapien
cgtcaccaagccgaagcaatcaatc

SEQ ID NO: 163463 - DNA, 25 bp, Homo sapien
cacctgatggtttaggcgacacgta

SEQ ID NO: 163464 - DNA, 25 bp, Homo sapien
ctgggagggagctaataaacattga

SEQ ID NO: 163465 - DNA, 25 bp, Homo sapien
ctcaaagtgcgtcttggaggaactg

SEQ ID NO: 163466 - DNA, 25 bp, Homo sapien
actccgcagtggctctgaagcttcc

SEQ ID NO: 163467 - DNA, 25 bp, Homo sapien
agtgcggatttctgctatgatgaca

SEQ ID NO: 163468 - DNA, 25 bp, Homo sapien
cttccctctttaaggctcaaagtgc

SEQ ID NO: 163469 - DNA, 25 bp, Homo sapien
cttctgttttttgttgccgctgctg

SEQ ID NO: 163470 - DNA, 25 bp, Homo sapien
tggggctcgccttgtatctcaacac

SEQ ID NO: 163471 - DNA, 25 bp, Homo sapien
cctttcccagctagggaggaggatg

SEQ ID NO: 163472 - DNA, 25 bp, Homo sapien
ggggctttgcttcctaaaacgcaca

SEQ ID NO: 163473 - DNA, 25 bp, Homo sapien
taaaacgcacatcaaaggctgcttc

SEQ ID NO: 163474 - DNA, 25 bp, Homo sapien
gctgcttctcagctcaggaaaaata

SEQ ID NO: 163475 - DNA, 25 bp, Homo sapien
aaataattcccgttcccgcagcctg

SEQ ID NO: 163476 - DNA, 25 bp, Homo sapien
cagcctgtgccactgggtgggtcat

SEQ ID NO: 163477 - DNA, 25 bp, Homo sapien
tgggtcatgcctgttcccgaacgcc

SEQ ID NO: 163478 - DNA, 25 bp, Homo sapien
ttactccagcctttcccagctaggg

SEQ ID NO: 163479 - DNA, 25 bp, Homo sapien
ttctgcctttgctaaagcgaacgga

SEQ ID NO: 163480 - DNA, 25 bp, Homo sapien
ccctttcgggccatttatcacagga

SEQ ID NO: 163481 - DNA, 25 bp, Homo sapien
tcgggccatttatcacaggatacct

SEQ ID NO: 163482 - DNA, 25 bp, Homo sapien
tcacaggatacctcaagcaaagggg

SEQ ID NO: 163483 - DNA, 25 bp, Homo sapien
tcaagcaaaggggaactgtggtcac

SEQ ID NO: 163484 - DNA, 25 bp, Homo sapien
tgtggtcacgtgaaaacactctgtc

SEQ ID NO: 163485 - DNA, 25 bp, Homo sapien
aaacactctgtcctcggtagtcgcc

SEQ ID NO: 163486 - DNA, 25 bp, Homo sapien
tgtcctcggtagtcgccttctgcct

SEQ ID NO: 163487 - DNA, 25 bp, Homo sapien
gagaagcagcttcttgcctaggttg

SEQ ID NO: 163488 - DNA, 25 bp, Homo sapien
tgttacggccgcctaccggctgcag

SEQ ID NO: 163489 - DNA, 25 bp, Homo sapien
tgcgcgtgtacatgcgtatgtgtgt

SEQ ID NO: 163490 - DNA, 25 bp, Homo sapien
cagggaaacagcacgggatacaggc

SEQ ID NO: 163491 - DNA, 25 bp, Homo sapien
cgcctgtgtgtctgccagggaaaca

SEQ ID NO: 163492 - DNA, 25 bp, Homo sapien
caaggagagactcgtgagcgcctgt

SEQ ID NO: 163493 - DNA, 25 bp, Homo sapien
cctgcaggctggcaaggagagactc

SEQ ID NO: 163494 - DNA, 25 bp, Homo sapien
aaacccattgatgcagcggccactg

SEQ ID NO: 163495 - DNA, 25 bp, Homo sapien
ctcgttagagtacgtcactgtcgtc

SEQ ID NO: 163496 - DNA, 25 bp, Homo sapien
caggaggtcctctggagcacgttat

SEQ ID NO: 163497 - DNA, 25 bp, Homo sapien
tctcctttcgctgtagggtctggtc

SEQ ID NO: 163498 - DNA, 25 bp, Homo sapien
cctggagtaaactgatagggcgcta

SEQ ID NO: 163499 - DNA, 25 bp, Homo sapien
tttgccctcaagagccctccgagta

SEQ ID NO: 163500 - DNA, 25 bp, Homo sapien
tacgcgacagtcttccaggattatg

SEQ ID NO: 163501 - DNA, 25 bp, Homo sapien
cggatccctgagtccttctgtaata

SEQ ID NO: 163502 - DNA, 25 bp, Homo sapien
cagtgacttttacatgggcgcagga

SEQ ID NO: 163503 - DNA, 25 bp, Homo sapien
cttcagggcttctccgcgactggac

SEQ ID NO: 163504 - DNA, 25 bp, Homo sapien
gaggagccttcctccaaaagggagc

SEQ ID NO: 163505 - DNA, 25 bp, Homo sapien
gcttgggctccgtgcagcggaaaat

SEQ ID NO: 163506 - DNA, 25 bp, Homo sapien
tccgtgcagcggaaaatgccgtgtg

SEQ ID NO: 163507 - DNA, 25 bp, Homo sapien
gctcatcatgaagcgcttgggctcc

SEQ ID NO: 163508 - DNA, 25 bp, Homo sapien
ttcgcactgcttgttgggctcatca

SEQ ID NO: 163509 - DNA, 25 bp, Homo sapien
cgctggctcagtgcgaacccggcga

SEQ ID NO: 163510 - DNA, 25 bp, Homo sapien
cctccaaaagggagcatcaggtacg

SEQ ID NO: 163511 - DNA, 25 bp, Homo sapien
aagccgcatgggcaagaagccatgg

SEQ ID NO: 163512 - DNA, 25 bp, Homo sapien
aaagccgcggcatcgggtgccaaaa

SEQ ID NO: 163513 - DNA, 25 bp, Homo sapien
gcggaggcaaaaggccacgacggcg

SEQ ID NO: 163514 - DNA, 25 bp, Homo sapien
aatcaacgggggcaggtgcaaaaag

SEQ ID NO: 163515 - DNA, 25 bp, Homo sapien
cagcaaaaagcccaggcgtaggggc

SEQ ID NO: 163516 - DNA, 25 bp, Homo sapien
gcaaaaagcccaggcgtaggggcaa

SEQ ID NO: 163517 - DNA, 25 bp, Homo sapien
ccgtggcaggaaaaacctgcggctg

SEQ ID NO: 163518 - DNA, 25 bp, Homo sapien
cgcagcggcagtaaaaagccgcatg

SEQ ID NO: 163519 - DNA, 25 bp, Homo sapien
ctccgccaaggccagaataagatcc

SEQ ID NO: 163520 - DNA, 25 bp, Homo sapien
ggagagcctacagttcacgaccgtg

SEQ ID NO: 163521 - DNA, 25 bp, Homo sapien
ccgtgggtgatgctttacgtttaga

SEQ ID NO: 163522 - DNA, 25 bp, Homo sapien
tacgtttagattctccgccggagtc

SEQ ID NO: 163523 - DNA, 25 bp, Homo sapien
cccagagctcggtgttcaggatgat

SEQ ID NO: 163524 - DNA, 25 bp, Homo sapien
aggcgtggaacgaggacttcaaatc

SEQ ID NO: 163525 - DNA, 25 bp, Homo sapien
tcccggcatgcaacgcgtaagactg

SEQ ID NO: 163526 - DNA, 25 bp, Homo sapien
gacagatccctatcgcggttccacg

SEQ ID NO: 163527 - DNA, 25 bp, Homo sapien
cggcagatagtccacgcattgggta

SEQ ID NO: 163528 - DNA, 25 bp, Homo sapien
ggcgaagcttggtaccctgcagcta

SEQ ID NO: 163529 - DNA, 25 bp, Homo sapien
agccgccggcgcttttatacagttc

SEQ ID NO: 163530 - DNA, 25 bp, Homo sapien
cgtggggtgctgtttcataatctcc

SEQ ID NO: 163531 - DNA, 25 bp, Homo sapien
cctcggggctacacaaataaatctg

SEQ ID NO: 163532 - DNA, 25 bp, Homo sapien
ggagctccagcatattgcacgaaca

SEQ ID NO: 163533 - DNA, 25 bp, Homo sapien
ggcgactccgtttagctgttctgga

SEQ ID NO: 163534 - DNA, 25 bp, Homo sapien
cgggcgcgatttttcctggagagcc

SEQ ID NO: 163535 - DNA, 25 bp, Homo sapien
ggcaactctcccgtcaaacaatatt

SEQ ID NO: 163536 - DNA, 25 bp, Homo sapien
tggacaccgaactgctgcgacaaca

SEQ ID NO: 163537 - DNA, 25 bp, Homo sapien
cgcccttgtatctcatggaggatta

SEQ ID NO: 163538 - DNA, 25 bp, Homo sapien
cccgtggtggcgaacagaacatcac

SEQ ID NO: 163539 - DNA, 25 bp, Homo sapien
acggtacgcggagcataagagtcac

SEQ ID NO: 163540 - DNA, 25 bp, Homo sapien
cggccatcgacattcggggacacca

SEQ ID NO: 163541 - DNA, 25 bp, Homo sapien
agggcccgccaagtcagcattccag

SEQ ID NO: 163542 - DNA, 25 bp, Homo sapien
ttccagccggtgattgcaatggaca

SEQ ID NO: 163543 - DNA, 25 bp, Homo sapien
agcgagcgtctcaatggatacattc

SEQ ID NO: 163544 - DNA, 25 bp, Homo sapien
cagggcacataaaccagggcacttc

SEQ ID NO: 163545 - DNA, 25 bp, Homo sapien
gggcacttcagttgtctcatgtttc

SEQ ID NO: 163546 - DNA, 25 bp, Homo sapien
cgtcggaacttttgcgcaccaatgg

SEQ ID NO: 163547 - DNA, 25 bp, Homo sapien
cccagctctgtttgctctgatgttc

SEQ ID NO: 163548 - DNA, 25 bp, Homo sapien
ctcttaggtcagtccagtgctttta

SEQ ID NO: 163549 - DNA, 25 bp, Homo sapien
aggctgcacctcaaatctacccggg

SEQ ID NO: 163550 - DNA, 25 bp, Homo sapien
cgtggggagttacaagccattgttc

SEQ ID NO: 163551 - DNA, 25 bp, Homo sapien
ctaggtgattctgacgcaggcgctc

SEQ ID NO: 163552 - DNA, 25 bp, Homo sapien
cgagacaccgccagccctgtaaaga

SEQ ID NO: 163553 - DNA, 25 bp, Homo sapien
caacccgtccttaccgtggctgagg

SEQ ID NO: 163554 - DNA, 25 bp, Homo sapien
atgcgcctcggctttggtacttttt

SEQ ID NO: 163555 - DNA, 25 bp, Homo sapien
ttcccagagtccagcgcatcgcagg

SEQ ID NO: 163556 - DNA, 25 bp, Homo sapien
aaacgctctgttcgcgcttcccaga

SEQ ID NO: 163557 - DNA, 25 bp, Homo sapien
cgcagacctcgaattctggcggctg

SEQ ID NO: 163558 - DNA, 25 bp, Homo sapien
ggtcactacaacaacggcggcccag

SEQ ID NO: 163559 - DNA, 25 bp, Homo sapien
ccgccttggctgagcgcggtcacgt

SEQ ID NO: 163560 - DNA, 25 bp, Homo sapien
tctgcaccgggtggcctgcaagatt

SEQ ID NO: 163561 - DNA, 25 bp, Homo sapien
cggcagtgggaaccattttccgagg

SEQ ID NO: 163562 - DNA, 25 bp, Homo sapien
agaacgctcacccgttccggtctgg

SEQ ID NO: 163563 - DNA, 25 bp, Homo sapien
ctcacgccgccgtccgcaacagcag

SEQ ID NO: 163564 - DNA, 25 bp, Homo sapien
gctgcgcacccagctatcaggatcc

SEQ ID NO: 163565 - DNA, 25 bp, Homo sapien
tactcacgctgcactgcgaggaggc

SEQ ID NO: 163566 - DNA, 25 bp, Homo sapien
acctcgcccggcagtgggaaccatt

SEQ ID NO: 163567 - DNA, 25 bp, Homo sapien
catacagcttgaccggccgcggcag

SEQ ID NO: 163568 - DNA, 25 bp, Homo sapien
actcatacagcttgaccggccgcgg

SEQ ID NO: 163569 - DNA, 25 bp, Homo sapien
ggctctctccactcatacagcttga

SEQ ID NO: 163570 - DNA, 25 bp, Homo sapien
gcgctcgcatgccaggctctctcca

SEQ ID NO: 163571 - DNA, 25 bp, Homo sapien
gctgacgctccaccttctcctgctg

SEQ ID NO: 163572 - DNA, 25 bp, Homo sapien
cctcgtagatctggttcatgatgaa

SEQ ID NO: 163573 - DNA, 25 bp, Homo sapien
gctgcctcatgtcctcgtagatctg

SEQ ID NO: 163574 - DNA, 25 bp, Homo sapien
gcggcagcgtgctcacatccgctgg

SEQ ID NO: 163575 - DNA, 25 bp, Homo sapien
tgcgccagtgcatccttctccaaga

SEQ ID NO: 163576 - DNA, 25 bp, Homo sapien
ctggagacccagttgcttgtgtcga

SEQ ID NO: 163577 - DNA, 25 bp, Homo sapien
cggcgatctcgcctatcatggtggc

SEQ ID NO: 163578 - DNA, 25 bp, Homo sapien
gcgccgtgcagcaccctttatagtg

SEQ ID NO: 163579 - DNA, 25 bp, Homo sapien
ggagctgacgtaatccgcttgtaaa

SEQ ID NO: 163580 - DNA, 25 bp, Homo sapien
cgcaccattgtgacgcaagccggtt

SEQ ID NO: 163581 - DNA, 25 bp, Homo sapien
agctccgcagcattcgaagatctca

SEQ ID NO: 163582 - DNA, 25 bp, Homo sapien
tggccgactccagccaatccgaata

SEQ ID NO: 163583 - DNA, 25 bp, Homo sapien
gagcgaacgactaggcagcctgcga

SEQ ID NO: 163584 - DNA, 25 bp, Homo sapien
gccgcagcttcttccggctagctgg

SEQ ID NO: 163585 - DNA, 25 bp, Homo sapien
ccgtaactgacagatgggcgggccc

SEQ ID NO: 163586 - DNA, 25 bp, Homo sapien
ggccactcactactcggggtgcgcg

SEQ ID NO: 163587 - DNA, 25 bp, Homo sapien
gacggtttcactctcttaccctctg

SEQ ID NO: 163588 - DNA, 25 bp, Homo sapien
cacgtgctgccagaaagacggtttc

SEQ ID NO: 163589 - DNA, 25 bp, Homo sapien
tccattttcactcccactcagggtt

SEQ ID NO: 163590 - DNA, 25 bp, Homo sapien
tccaggccagcgaccaatcggaagc

SEQ ID NO: 163591 - DNA, 25 bp, Homo sapien
gtcccaaggcctcgccgaactccag

SEQ ID NO: 163592 - DNA, 25 bp, Homo sapien
cgcatgtgggcttcatttaaacaga

SEQ ID NO: 163593 - DNA, 25 bp, Homo sapien
gcttcatttaaacagagcagagggg

SEQ ID NO: 163594 - DNA, 25 bp, Homo sapien
gtgggcttcatttaaacagagcaga

SEQ ID NO: 163595 - DNA, 25 bp, Homo sapien
ggcgcatgtgggcttcatttaaaca

SEQ ID NO: 163596 - DNA, 25 bp, Homo sapien
cccattgcaatggtctctgcacgca

SEQ ID NO: 163597 - DNA, 25 bp, Homo sapien
gggcacggtcatcccacgctgggct

SEQ ID NO: 163598 - DNA, 25 bp, Homo sapien
ttgcaatggtctctgcacgcaggcg

SEQ ID NO: 163599 - DNA, 25 bp, Homo sapien
gctccatggagagcggcggacaact

SEQ ID NO: 163600 - DNA, 25 bp, Homo sapien
ggagcgggtcttcgcaactgtctcc

SEQ ID NO: 163601 - DNA, 25 bp, Homo sapien
gcctctatgatgaagttcaagccca

SEQ ID NO: 163602 - DNA, 25 bp, Homo sapien
caggagcccgcctctatgatgaagt

SEQ ID NO: 163603 - DNA, 25 bp, Homo sapien
tggttccagtgacccgcgctagcgt

SEQ ID NO: 163604 - DNA, 25 bp, Homo sapien
catctcggcaccctggttccagtga

SEQ ID NO: 163605 - DNA, 25 bp, Homo sapien
agaggcggagctttcatctcggcac

SEQ ID NO: 163606 - DNA, 25 bp, Homo sapien
tcttcgcaactgtctccgcgtggcg

SEQ ID NO: 163607 - DNA, 25 bp, Homo sapien
agtggaacagagtgaagggaaagct

SEQ ID NO: 163608 - DNA, 25 bp, Homo sapien
ataagtgttatttttgctccaagca

SEQ ID NO: 163609 - DNA, 25 bp, Homo sapien
aagtgttatttttgctccaagcaca

SEQ ID NO: 163610 - DNA, 25 bp, Homo sapien
tgctccaagcacacatttgagaaat

SEQ ID NO: 163611 - DNA, 25 bp, Homo sapien
gctccaagcacacatttgagaaatc

SEQ ID NO: 163612 - DNA, 25 bp, Homo sapien
ccaagcacacatttgagaaatcttc

SEQ ID NO: 163613 - DNA, 25 bp, Homo sapien
gcacacatttgagaaatcttccatt

SEQ ID NO: 163614 - DNA, 25 bp, Homo sapien
cacatttgagaaatcttccatttag

SEQ ID NO: 163615 - DNA, 25 bp, Homo sapien
aaatgtagtccctgctcgggcgcgg

SEQ ID NO: 163616 - DNA, 25 bp, Homo sapien
ttcattcattctgcacccgcggttg

SEQ ID NO: 163617 - DNA, 25 bp, Homo sapien
tctcagaagctatggaggcccgcgc

SEQ ID NO: 163618 - DNA, 25 bp, Homo sapien
ctgcccagctgagccgacgagagca

SEQ ID NO: 163619 - DNA, 25 bp, Homo sapien
tgggcggttaccttgatgatcctgc

SEQ ID NO: 163620 - DNA, 25 bp, Homo sapien
ggcagcccggccatcttgtcagaac

SEQ ID NO: 163621 - DNA, 25 bp, Homo sapien
tgtcagaacccgagttcggcctctg

SEQ ID NO: 163622 - DNA, 25 bp, Homo sapien
tcgcctcacgcacgagtggaagtcc

SEQ ID NO: 163623 - DNA, 25 bp, Homo sapien
atgtggctgcgcgtttcttatagcg

SEQ ID NO: 163624 - DNA, 25 bp, Homo sapien
cgctttcccgcggagactacatttc

SEQ ID NO: 163625 - DNA, 25 bp, Homo sapien
tgagaagccgtcaaggtaaccgctt

SEQ ID NO: 163626 - DNA, 25 bp, Homo sapien
gcagttgtagaggtctcccgcctgt

SEQ ID NO: 163627 - DNA, 25 bp, Homo sapien
ctcgaaactgggcagtcccacagtg

SEQ ID NO: 163628 - DNA, 25 bp, Homo sapien
tcccacagtgttggtcggcagttgt

SEQ ID NO: 163629 - DNA, 25 bp, Homo sapien
cttcctgcagaagagccggcatgtg

SEQ ID NO: 163630 - DNA, 25 bp, Homo sapien
cagcgctgtttcgtgggaccaggat

SEQ ID NO: 163631 - DNA, 25 bp, Homo sapien
actatttgctcttcctaggtcgcca

SEQ ID NO: 163632 - DNA, 25 bp, Homo sapien
actggatctgcaggtgactatttgc

SEQ ID NO: 163633 - DNA, 25 bp, Homo sapien
caagggcctattcccactggatctg

SEQ ID NO: 163634 - DNA, 25 bp, Homo sapien
ggtgtgagaccggaatgccaatttg

SEQ ID NO: 163635 - DNA, 25 bp, Homo sapien
ccaagtttgtgtgggtgcttcttcc

SEQ ID NO: 163636 - DNA, 25 bp, Homo sapien
ggtttgcattttccgcagcgctcgc

SEQ ID NO: 163637 - DNA, 25 bp, Homo sapien
gaggcttttgtgtgccctctgcgca

SEQ ID NO: 163638 - DNA, 25 bp, Homo sapien
ccttctcggcgtctggaagtgtctg

SEQ ID NO: 163639 - DNA, 25 bp, Homo sapien
gcctcagcgcccgtcagcaccctgc

SEQ ID NO: 163640 - DNA, 25 bp, Homo sapien
gatctcgtgcacctaaaaggggacg

SEQ ID NO: 163641 - DNA, 25 bp, Homo sapien
tcaggatctcgtgcacctaaaaggg

SEQ ID NO: 163642 - DNA, 25 bp, Homo sapien
tgcgcttcaggatctcgtgcaccta

SEQ ID NO: 163643 - DNA, 25 bp, Homo sapien
caggctgtgcgcttcaggatctcgt

SEQ ID NO: 163644 - DNA, 25 bp, Homo sapien
acccatcgtgttgttggctcgggag

SEQ ID NO: 163645 - DNA, 25 bp, Homo sapien
gtgtgtcaccctcaccactgcctgg

SEQ ID NO: 163646 - DNA, 25 bp, Homo sapien
gctggggtccttacccatcgtgttg

SEQ ID NO: 163647 - DNA, 25 bp, Homo sapien
ccttggtccgctctttagttcattc

SEQ ID NO: 163648 - DNA, 25 bp, Homo sapien
tccgcatttccgatccgggccaagg

SEQ ID NO: 163649 - DNA, 25 bp, Homo sapien
agcactccctctttagcgggtcaag

SEQ ID NO: 163650 - DNA, 25 bp, Homo sapien
ccgcccgtagtcttcctgtttgata

SEQ ID NO: 163651 - DNA, 25 bp, Homo sapien
tttgatacaagggtttcagcggccg

SEQ ID NO: 163652 - DNA, 25 bp, Homo sapien
ccaatgggcgctcacggccaaacgt

SEQ ID NO: 163653 - DNA, 25 bp, Homo sapien
cagcggccgaagcagagccttttta

SEQ ID NO: 163654 - DNA, 25 bp, Homo sapien
ttgccgcagaaaccgcccgtagtct

SEQ ID NO: 163655 - DNA, 25 bp, Homo sapien
ttagacccagacttgtccgcgaagg

SEQ ID NO: 163656 - DNA, 25 bp, Homo sapien
agccttatagcttcgaattctgtga

SEQ ID NO: 163657 - DNA, 25 bp, Homo sapien
ctggtccacaaaatcgggaggctga

SEQ ID NO: 163658 - DNA, 25 bp, Homo sapien
cctcactgctgctcgagggtaggca

SEQ ID NO: 163659 - DNA, 25 bp, Homo sapien
acaatgggtggggatcgtctaacca

SEQ ID NO: 163660 - DNA, 25 bp, Homo sapien
ggcggaaacggctttcgaagcatcc

SEQ ID NO: 163661 - DNA, 25 bp, Homo sapien
aagcatccgcgattctctttattga

SEQ ID NO: 163662 - DNA, 25 bp, Homo sapien
tctttattgaatcttgagtgacacc

SEQ ID NO: 163663 - DNA, 25 bp, Homo sapien
agcactcgcacgacagcatggtccg

SEQ ID NO: 163664 - DNA, 25 bp, Homo sapien
aggagcactcgcacgacagcatggt

SEQ ID NO: 163665 - DNA, 25 bp, Homo sapien
agacggtgcccaaccgcagatagcc

SEQ ID NO: 163666 - DNA, 25 bp, Homo sapien
agcgcgtgtcccacagccgggccaa

SEQ ID NO: 163667 - DNA, 25 bp, Homo sapien
atggagagcgcgtgtcccacagccg

SEQ ID NO: 163668 - DNA, 25 bp, Homo sapien
ccctccgtgatggagagcgcgtgtc

SEQ ID NO: 163669 - DNA, 25 bp, Homo sapien
gtaatgccctccgtgatggagagcg

SEQ ID NO: 163670 - DNA, 25 bp, Homo sapien
gggcactgcactctccaggcagggc

SEQ ID NO: 163671 - DNA, 25 bp, Homo sapien
accaagcgggcaactgcacagagcc

SEQ ID NO: 163672 - DNA, 25 bp, Homo sapien
tggagcacagcctctcgcgcctgta

SEQ ID NO: 163673 - DNA, 25 bp, Homo sapien
gtcggagcaagccatcggagccatc

SEQ ID NO: 163674 - DNA, 25 bp, Homo sapien
tgctcgcctatctgctggcactggc

SEQ ID NO: 163675 - DNA, 25 bp, Homo sapien
cacctacgtgctgcctgagccggag

SEQ ID NO: 163676 - DNA, 25 bp, Homo sapien
gctctccttcctgggcgagctgcgg

SEQ ID NO: 163677 - DNA, 25 bp, Homo sapien
cacacaggaactctccggcgaagga

SEQ ID NO: 163678 - DNA, 25 bp, Homo sapien
ccggaacaaccgctggtacctggcg

SEQ ID NO: 163679 - DNA, 25 bp, Homo sapien
cccggcctggttggattcgccgtcg

SEQ ID NO: 163680 - DNA, 25 bp, Homo sapien
ccatggcagtttcctagcgtcgctg

SEQ ID NO: 163681 - DNA, 25 bp, Homo sapien
cctggtctggaatgacgatgctcac

SEQ ID NO: 163682 - DNA, 25 bp, Homo sapien
acaatctcagtctccgggcagaatc

SEQ ID NO: 163683 - DNA, 25 bp, Homo sapien
gctgtgggcctgatgtacaatctca

SEQ ID NO: 163684 - DNA, 25 bp, Homo sapien
ctcgttattgatggcgccgtctcct

SEQ ID NO: 163685 - DNA, 25 bp, Homo sapien
ccgcagaagcctcgttattgatggc

SEQ ID NO: 163686 - DNA, 25 bp, Homo sapien
tgctcacgacccatctaggctcagg

SEQ ID NO: 163687 - DNA, 25 bp, Homo sapien
tccgcttacggaggcattgggacta

SEQ ID NO: 163688 - DNA, 25 bp, Homo sapien
cgtccctagggaaatgtgaagtatc

SEQ ID NO: 163689 - DNA, 25 bp, Homo sapien
ccacgtgctgacgtatggcccagaa

SEQ ID NO: 163690 - DNA, 25 bp, Homo sapien
ccgacacagcgtctccaggggtttt

SEQ ID NO: 163691 - DNA, 25 bp, Homo sapien
tgagagcctcaaatggtagtcctgc

SEQ ID NO: 163692 - DNA, 25 bp, Homo sapien
tgcagatatgcgctcccgaagccgc

SEQ ID NO: 163693 - DNA, 25 bp, Homo sapien
gctcagcttgccacgagggaacctc

SEQ ID NO: 163694 - DNA, 25 bp, Homo sapien
ttaagtgaccgcagttctggccgcg

SEQ ID NO: 163695 - DNA, 25 bp, Homo sapien
gctgggattgaagccggaccttccg

SEQ ID NO: 163696 - DNA, 25 bp, Homo sapien
agttccgctcgccatgttccagccg

SEQ ID NO: 163697 - DNA, 25 bp, Homo sapien
ctgggattgaagccggaccttccgc

SEQ ID NO: 163698 - DNA, 25 bp, Homo sapien
cggctgggattgaagccggaccttc

SEQ ID NO: 163699 - DNA, 25 bp, Homo sapien
tgggattgaagccggaccttccgcc

SEQ ID NO: 163700 - DNA, 25 bp, Homo sapien
tccggagaggcagcgcaaagattct

SEQ ID NO: 163701 - DNA, 25 bp, Homo sapien
agccaccggctgtgctcgggatcac

SEQ ID NO: 163702 - DNA, 25 bp, Homo sapien
ctcacccggctcttgcagcggtggt

SEQ ID NO: 163703 - DNA, 25 bp, Homo sapien
tgacttttcacttgggcagagcccg

SEQ ID NO: 163704 - DNA, 25 bp, Homo sapien
cgaactttcccgtcttctggggctg

SEQ ID NO: 163705 - DNA, 25 bp, Homo sapien
cggctcggctcgaaactccggagag

SEQ ID NO: 163706 - DNA, 25 bp, Homo sapien
ccacccttttagctcggaggatcgg

SEQ ID NO: 163707 - DNA, 25 bp, Homo sapien
gtgggttagcactgagccgccgccc

SEQ ID NO: 163708 - DNA, 25 bp, Homo sapien
caccaggagcggagcgagtctccga

SEQ ID NO: 163709 - DNA, 25 bp, Homo sapien
actcaccctccgcatggtgtctggg

SEQ ID NO: 163710 - DNA, 25 bp, Homo sapien
accctcactattcccgctgggagga

SEQ ID NO: 163711 - DNA, 25 bp, Homo sapien
tgccggagtgcaggcatccttcctc

SEQ ID NO: 163712 - DNA, 25 bp, Homo sapien
cgcgccttccaaatgccggagtgca

SEQ ID NO: 163713 - DNA, 25 bp, Homo sapien
ctggaggaggctcgcgccttccaaa

SEQ ID NO: 163714 - DNA, 25 bp, Homo sapien
gcggagcgagtctccgatgcctgcc

SEQ ID NO: 163715 - DNA, 25 bp, Homo sapien
tggcacctgccggtaaagcagcagc

SEQ ID NO: 163716 - DNA, 25 bp, Homo sapien
cgtgcgcagagctaggtcttgccta

SEQ ID NO: 163717 - DNA, 25 bp, Homo sapien
ttctcacgcgaacgccagacgtggt

SEQ ID NO: 163718 - DNA, 25 bp, Homo sapien
agcccgcgtttcaggacctgcacta

SEQ ID NO: 163719 - DNA, 25 bp, Homo sapien
aacccaccggatggaagctgccact

SEQ ID NO: 163720 - DNA, 25 bp, Homo sapien
caggacctgcactaactccatcttg

SEQ ID NO: 163721 - DNA, 25 bp, Homo sapien
cacgcccagaaggttctcacgcgaa

SEQ ID NO: 163722 - DNA, 25 bp, Homo sapien
tgcgccgagcaaaacccaccggatg

SEQ ID NO: 163723 - DNA, 25 bp, Homo sapien
gtgatctgctgcagcccgcgtttca

SEQ ID NO: 163724 - DNA, 25 bp, Homo sapien
aagcggcgctcccaaactgaacggc

SEQ ID NO: 163725 - DNA, 25 bp, Homo sapien
ccgcggaagctttccctgcaggtta

SEQ ID NO: 163726 - DNA, 25 bp, Homo sapien
ttgtgtgctccaagccgctcgccgt

SEQ ID NO: 163727 - DNA, 25 bp, Homo sapien
ctgcaggttaaaggtcagaggcgct

SEQ ID NO: 163728 - DNA, 25 bp, Homo sapien
cgcctgcgcattagcaacggggaga

SEQ ID NO: 163729 - DNA, 25 bp, Homo sapien
cacgtctcactcgtgccggcgttag

SEQ ID NO: 163730 - DNA, 25 bp, Homo sapien
gttcgtgacctctttctcggctcgg

SEQ ID NO: 163731 - DNA, 25 bp, Homo sapien
ccagcgtttcttaccggcgcttttg

SEQ ID NO: 163732 - DNA, 25 bp, Homo sapien
cggcacgatggcaggcctcgaatgt

SEQ ID NO: 163733 - DNA, 25 bp, Homo sapien
ccgtccgagcaggagcacacgtcgt

SEQ ID NO: 163734 - DNA, 25 bp, Homo sapien
gagaaagggcttcgaaaagcacacg

SEQ ID NO: 163735 - DNA, 25 bp, Homo sapien
cgtcgtagcggcagttccgcaggta

SEQ ID NO: 163736 - DNA, 25 bp, Homo sapien
aaaagcacacgtggacggatttggg

SEQ ID NO: 163737 - DNA, 25 bp, Homo sapien
gagcacacgtcgtagcggcagttcc

SEQ ID NO: 163738 - DNA, 25 bp, Homo sapien
ttcgaaaagcacacgtggacggatt

SEQ ID NO: 163739 - DNA, 25 bp, Homo sapien
acgcctcctcggagaacctggctgt

SEQ ID NO: 163740 - DNA, 25 bp, Homo sapien
ttaccggctgcagaagtcatgattc

SEQ ID NO: 163741 - DNA, 25 bp, Homo sapien
cagaattcccagacggtgcccggtt

SEQ ID NO: 163742 - DNA, 25 bp, Homo sapien
tccgtcgtcgcctgacaggtgtagc

SEQ ID NO: 163743 - DNA, 25 bp, Homo sapien
cttcatttcccatcgtgctgaggcg

SEQ ID NO: 163744 - DNA, 25 bp, Homo sapien
ctcttctccaataagcgggctcgaa

SEQ ID NO: 163745 - DNA, 25 bp, Homo sapien
cctccaatcggagggctcgagcttc

SEQ ID NO: 163746 - DNA, 25 bp, Homo sapien
tctcgggctccaaaaatcagcagtg

SEQ ID NO: 163747 - DNA, 25 bp, Homo sapien
tcagtccattgttcccacagttcgg

SEQ ID NO: 163748 - DNA, 25 bp, Homo sapien
cctccgggagccacctgaatggcga

SEQ ID NO: 163749 - DNA, 25 bp, Homo sapien
acgccgcttgctacggcgggttgcc

SEQ ID NO: 163750 - DNA, 25 bp, Homo sapien
gccgatttgcttcgggaatgcccga

SEQ ID NO: 163751 - DNA, 25 bp, Homo sapien
ttcaccctgcgcttgccgatttgct

SEQ ID NO: 163752 - DNA, 25 bp, Homo sapien
tccggctgactctagagctcaactt

SEQ ID NO: 163753 - DNA, 25 bp, Homo sapien
cgtctccacaggtatctccggctga

SEQ ID NO: 163754 - DNA, 25 bp, Homo sapien
gcgtccctaccatcgagagcagctt

SEQ ID NO: 163755 - DNA, 25 bp, Homo sapien
cctgaatggcgacctggatccagac

SEQ ID NO: 163756 - DNA, 25 bp, Homo sapien
tcctggaatttctgcgatttacaca

SEQ ID NO: 163757 - DNA, 25 bp, Homo sapien
cctgtgagccgcagaatcatccacg

SEQ ID NO: 163758 - DNA, 25 bp, Homo sapien
cttcgcacctgtagtgccgtcggga

SEQ ID NO: 163759 - DNA, 25 bp, Homo sapien
cgcaagtgggtctgcgcgaacaaca

SEQ ID NO: 163760 - DNA, 25 bp, Homo sapien
caattcaaaattcgccggacgcgtc

SEQ ID NO: 163761 - DNA, 25 bp, Homo sapien
aagcgcattcctcctcaaccgagtg

SEQ ID NO: 163762 - DNA, 25 bp, Homo sapien
catccacggacgtcgttagtccttc

SEQ ID NO: 163763 - DNA, 25 bp, Homo sapien
gggcttcgagcatcacctcgcggta

SEQ ID NO: 163764 - DNA, 25 bp, Homo sapien
tagactccctctagatcaggtcagg

SEQ ID NO: 163765 - DNA, 25 bp, Homo sapien
ccgcgaaacaggctagcgcctactt

SEQ ID NO: 163766 - DNA, 25 bp, Homo sapien
tcagggcatgccaaggggcttaaaa

SEQ ID NO: 163767 - DNA, 25 bp, Homo sapien
tttgcgagacctttcacttcccggc

SEQ ID NO: 163768 - DNA, 25 bp, Homo sapien
gcagttccatgcgatgcatttttat

SEQ ID NO: 163769 - DNA, 25 bp, Homo sapien
catttttattgcaccgacgccgcgg

SEQ ID NO: 163770 - DNA, 25 bp, Homo sapien
ccggaacattcctaagagcagtaga

SEQ ID NO: 163771 - DNA, 25 bp, Homo sapien
gccgctgaactttgcgagacctttc

SEQ ID NO: 163772 - DNA, 25 bp, Homo sapien
ttacatcgaaagttttaatccgtga

SEQ ID NO: 163773 - DNA, 25 bp, Homo sapien
tccgtgacagaggaaatattgctta

SEQ ID NO: 163774 - DNA, 25 bp, Homo sapien
taatccgtgacagaggaaatattgc

SEQ ID NO: 163775 - DNA, 25 bp, Homo sapien
gttttaatccgtgacagaggaaata

SEQ ID NO: 163776 - DNA, 25 bp, Homo sapien
cgaaagttttaatccgtgacagagg

SEQ ID NO: 163777 - DNA, 25 bp, Homo sapien
gacagaggaaatattgcttacgccc

SEQ ID NO: 163778 - DNA, 25 bp, Homo sapien
catcgaaagttttaatccgtgacag

SEQ ID NO: 163779 - DNA, 25 bp, Homo sapien
tgacagaggaaatattgcttacgcc

SEQ ID NO: 163780 - DNA, 25 bp, Homo sapien
ttcaaatgcacgtatgaaggccgtg

SEQ ID NO: 163781 - DNA, 25 bp, Homo sapien
gcccttaggtaatttcaaatgcacg

SEQ ID NO: 163782 - DNA, 25 bp, Homo sapien
gcgggtttctgcaggcgaagcaaaa

SEQ ID NO: 163783 - DNA, 25 bp, Homo sapien
gtggggcatgacaccgtatcccaga

SEQ ID NO: 163784 - DNA, 25 bp, Homo sapien
cagacgcaactcgacctcgtttgca

SEQ ID NO: 163785 - DNA, 25 bp, Homo sapien
gacctcgtttgcaagaaattctgta

SEQ ID NO: 163786 - DNA, 25 bp, Homo sapien
attctgtatccaactctcttcagtg

SEQ ID NO: 163787 - DNA, 25 bp, Homo sapien
ttgcttacgcccttaggtaatttca

SEQ ID NO: 163788 - DNA, 25 bp, Homo sapien
gagcctggcagatcgtctgactctc

SEQ ID NO: 163789 - DNA, 25 bp, Homo sapien
tgatgcacaggcgtctcaggagccc

SEQ ID NO: 163790 - DNA, 25 bp, Homo sapien
ggcgactttggagctgcctcatgca

SEQ ID NO: 163791 - DNA, 25 bp, Homo sapien
gagccctgatcaggacccggtgaga

SEQ ID NO: 163792 - DNA, 25 bp, Homo sapien
gcagcctccgtttcttttgggactg

SEQ ID NO: 163793 - DNA, 25 bp, Homo sapien
tctctcctgcgtggaagccctgcag

SEQ ID NO: 163794 - DNA, 25 bp, Homo sapien
ggcccagtgcggcttgaacctagcc

SEQ ID NO: 163795 - DNA, 25 bp, Homo sapien
caggagcccgtttctttcttgaatc

SEQ ID NO: 163796 - DNA, 25 bp, Homo sapien
tggtcggcagagagtagcctgcaac

SEQ ID NO: 163797 - DNA, 25 bp, Homo sapien
ttcactctgcttttaggtttctgag

SEQ ID NO: 163798 - DNA, 25 bp, Homo sapien
cgtttcccattcatccgcgtgaggc

SEQ ID NO: 163799 - DNA, 25 bp, Homo sapien
tgctggttccttcgcgcgtttccca

SEQ ID NO: 163800 - DNA, 25 bp, Homo sapien
tttctcttgaaactgcggctcggga

SEQ ID NO: 163801 - DNA, 25 bp, Homo sapien
agcctgcaacattcggccgtggtta

SEQ ID NO: 163802 - DNA, 25 bp, Homo sapien
ggacctgcggtacctgctgtagtca

SEQ ID NO: 163803 - DNA, 25 bp, Homo sapien
cattcggccgtggttacgatggtaa

SEQ ID NO: 163804 - DNA, 25 bp, Homo sapien
gatcccggaacgcagctggccaacg

SEQ ID NO: 163805 - DNA, 25 bp, Homo sapien
gccaacggataagtgcggggcaccc

SEQ ID NO: 163806 - DNA, 25 bp, Homo sapien
ctcagggaccgtctggtagctgatc

SEQ ID NO: 163807 - DNA, 25 bp, Homo sapien
tcccggtcatctcagggaccgtctg

SEQ ID NO: 163808 - DNA, 25 bp, Homo sapien
gcccggttcccggtcatctcaggga

SEQ ID NO: 163809 - DNA, 25 bp, Homo sapien
tctggtagctgatcccggaacgcag

SEQ ID NO: 163810 - DNA, 25 bp, Homo sapien
gggcggaggtgccaatcgatcctcc

SEQ ID NO: 163811 - DNA, 25 bp, Homo sapien
ggtgccaatcgatcctccagtctcg

SEQ ID NO: 163812 - DNA, 25 bp, Homo sapien
ccctcggcgcgaggcgacatggcaa

SEQ ID NO: 163813 - DNA, 25 bp, Homo sapien
ctctggagggaaacaacgccgtgaa

SEQ ID NO: 163814 - DNA, 25 bp, Homo sapien
tcactgtgcactctggagggaaaca

SEQ ID NO: 163815 - DNA, 25 bp, Homo sapien
tcttcctctcactgtgcactctgga

SEQ ID NO: 163816 - DNA, 25 bp, Homo sapien
aggcgacatggcaagcggccacagc

SEQ ID NO: 163817 - DNA, 25 bp, Homo sapien
gcggcttttcgtcctccactgagtc

SEQ ID NO: 163818 - DNA, 25 bp, Homo sapien
cctgctggagaacgcgcagcaagtg

SEQ ID NO: 163819 - DNA, 25 bp, Homo sapien
aggctgcggcttttcgtcctccact

SEQ ID NO: 163820 - DNA, 25 bp, Homo sapien
agcgcacgcgccaagccacagagga

SEQ ID NO: 163821 - DNA, 25 bp, Homo sapien
cagtgcatgatgagggctggcacca

SEQ ID NO: 163822 - DNA, 25 bp, Homo sapien
caccacgctggtggagtgcaagagt

SEQ ID NO: 163823 - DNA, 25 bp, Homo sapien
tgcaagagtggatatggcctcgacc

SEQ ID NO: 163824 - DNA, 25 bp, Homo sapien
gctccttgcagcaacggctccagtg

SEQ ID NO: 163825 - DNA, 25 bp, Homo sapien
tggacatcggcatctcggctaccta

SEQ ID NO: 163826 - DNA, 25 bp, Homo sapien
cgagctcaagatgctgcgcgtgatt

SEQ ID NO: 163827 - DNA, 25 bp, Homo sapien
gcctcgacctggagaccgagctcaa

SEQ ID NO: 163828 - DNA, 25 bp, Homo sapien
aaggaagtgcgcgtcatccacggag

SEQ ID NO: 163829 - DNA, 25 bp, Homo sapien
agcccacagtgagctgcgcgtcctg

SEQ ID NO: 163830 - DNA, 25 bp, Homo sapien
attcttgatatagcgcctcacggcc

SEQ ID NO: 163831 - DNA, 25 bp, Homo sapien
ccacggaggtgaagccaccattgtc

SEQ ID NO: 163832 - DNA, 25 bp, Homo sapien
cgagccggtcctcgttgtccagcag

SEQ ID NO: 163833 - DNA, 25 bp, Homo sapien
actcgttgttctctagggccacctc

SEQ ID NO: 163834 - DNA, 25 bp, Homo sapien
accattgtcgggcttattcttgata

SEQ ID NO: 163835 - DNA, 25 bp, Homo sapien
cttgcaccggcgcacaaggaagtgc

SEQ ID NO: 163836 - DNA, 25 bp, Homo sapien
cctcgagattctgcgaggtccctgc

SEQ ID NO: 163837 - DNA, 25 bp, Homo sapien
gagagaccaggccactctggagccg

SEQ ID NO: 163838 - DNA, 25 bp, Homo sapien
gttgccattgtaattcccacacagg

SEQ ID NO: 163839 - DNA, 25 bp, Homo sapien
gtcgtcgccctggttgccattgtaa

SEQ ID NO: 163840 - DNA, 25 bp, Homo sapien
ggttcacatactcatgcgcgggttg

SEQ ID NO: 163841 - DNA, 25 bp, Homo sapien
ctgcactaatgtggagacctcgaga

SEQ ID NO: 163842 - DNA, 25 bp, Homo sapien
gcctccggaacgcactgcactaatg

SEQ ID NO: 163843 - DNA, 25 bp, Homo sapien
cagggatcgctgtgctgcttctgca

SEQ ID NO: 163844 - DNA, 25 bp, Homo sapien
gtttcttaaagtcagacgagcgttg

SEQ ID NO: 163845 - DNA, 25 bp, Homo sapien
tgcgcagattgtcctcctgagactg

SEQ ID NO: 163846 - DNA, 25 bp, Homo sapien
cgagtaaagtcgacgctgcagcgca

SEQ ID NO: 163847 - DNA, 25 bp, Homo sapien
ccggagaggccaacgaacaggtatc

SEQ ID NO: 163848 - DNA, 25 bp, Homo sapien
acaggtatccactatctcgggcatg

SEQ ID NO: 163849 - DNA, 25 bp, Homo sapien
cgctcagctaccagactcgtcgata

SEQ ID NO: 163850 - DNA, 25 bp, Homo sapien
gactcgtcgatagagaacctgagga

SEQ ID NO: 163851 - DNA, 25 bp, Homo sapien
cccactgtaccaggctgcgcagatt

SEQ ID NO: 163852 - DNA, 25 bp, Homo sapien
cccgggccaactgcgcagggcacga

SEQ ID NO: 163853 - DNA, 25 bp, Homo sapien
gaaacagcgagtccagccgcctccc

SEQ ID NO: 163854 - DNA, 25 bp, Homo sapien
gggaaacagcgagtccagccgcctc

SEQ ID NO: 163855 - DNA, 25 bp, Homo sapien
tgggaaacagcgagtccagccgcct

SEQ ID NO: 163856 - DNA, 25 bp, Homo sapien
atgggaaacagcgagtccagccgcc

SEQ ID NO: 163857 - DNA, 25 bp, Homo sapien
cggatgggaaacagcgagtccagcc

SEQ ID NO: 163858 - DNA, 25 bp, Homo sapien
gcttctgcgggttgcgggcggaccc

SEQ ID NO: 163859 - DNA, 25 bp, Homo sapien
ccctcccgggccaactgcgcagggc

SEQ ID NO: 163860 - DNA, 25 bp, Homo sapien
caaagtgcactggtgctcggatcca

SEQ ID NO: 163861 - DNA, 25 bp, Homo sapien
tccactctcgcttggcaggtgaccc

SEQ ID NO: 163862 - DNA, 25 bp, Homo sapien
gcgtgcaaccctgggagctcgccca

SEQ ID NO: 163863 - DNA, 25 bp, Homo sapien
cgccgaccttccagctgggaccgca

SEQ ID NO: 163864 - DNA, 25 bp, Homo sapien
tggaggctggaccaccgccgacctt

SEQ ID NO: 163865 - DNA, 25 bp, Homo sapien
ggcgcacgccccatcggacatttaa

SEQ ID NO: 163866 - DNA, 25 bp, Homo sapien
ccctcgagtgggcaaagtgcactgg

SEQ ID NO: 163867 - DNA, 25 bp, Homo sapien
gtccctgggaagaaccgtggcagga

SEQ ID NO: 163868 - DNA, 25 bp, Homo sapien
cgacaagcacgtcaccaggccggtg

SEQ ID NO: 163869 - DNA, 25 bp, Homo sapien
tttgtgaccaataaaaccgacaagc

SEQ ID NO: 163870 - DNA, 25 bp, Homo sapien
gccttcaaggccatcaagacggaga

SEQ ID NO: 163871 - DNA, 25 bp, Homo sapien
ggcctgtactcgtccttcaccatta

SEQ ID NO: 163872 - DNA, 25 bp, Homo sapien
acgaatacatccactcaggcctgta

SEQ ID NO: 163873 - DNA, 25 bp, Homo sapien
tcagaagcacgagccgcaacgaata

SEQ ID NO: 163874 - DNA, 25 bp, Homo sapien
aggacagcgactgcaaggcgtctcc

SEQ ID NO: 163875 - DNA, 25 bp, Homo sapien
ctgccttccacgtcagaggctgcgg

SEQ ID NO: 163876 - DNA, 25 bp, Homo sapien
tttggagcggcctcatatagcgacc

SEQ ID NO: 163877 - DNA, 25 bp, Homo sapien
tctctgaaaggagaagacggcaacc

SEQ ID NO: 163878 - DNA, 25 bp, Homo sapien
ggcatccatctctgaaaggagaaga

SEQ ID NO: 163879 - DNA, 25 bp, Homo sapien
cctgtggcatccatctctgaaagga

SEQ ID NO: 163880 - DNA, 25 bp, Homo sapien
cggaacctgtggcatccatctctga

SEQ ID NO: 163881 - DNA, 25 bp, Homo sapien
gagcggcctcatatagcgacctcgc

SEQ ID NO: 163882 - DNA, 25 bp, Homo sapien
ggcgactttggagcggcctcatata

SEQ ID NO: 163883 - DNA, 25 bp, Homo sapien
aagcccggaacctgtggcatccatc

SEQ ID NO: 163884 - DNA, 25 bp, Homo sapien
gacccaaggtcctcgctggaccgga

SEQ ID NO: 163885 - DNA, 25 bp, Homo sapien
ctccttgcgtgtgcgtcgctttcac

SEQ ID NO: 163886 - DNA, 25 bp, Homo sapien
ttgccaagtccctcggtcaacatgg

SEQ ID NO: 163887 - DNA, 25 bp, Homo sapien
gccaactcaccagcaagagcgggga

SEQ ID NO: 163888 - DNA, 25 bp, Homo sapien
ctgggaagcagctcgcagacactca

SEQ ID NO: 163889 - DNA, 25 bp, Homo sapien
cggcgtctatatctgtcggcgcctc

SEQ ID NO: 163890 - DNA, 25 bp, Homo sapien
attgaaacgatccaaccagcggcgg

SEQ ID NO: 163891 - DNA, 25 bp, Homo sapien
gtgtctcacgcgttgccaagtccct

SEQ ID NO: 163892 - DNA, 25 bp, Homo sapien
caggcaaccgcgtgtacacatactc

SEQ ID NO: 163893 - DNA, 25 bp, Homo sapien
tcagacgactctaccacctcggggt

SEQ ID NO: 163894 - DNA, 25 bp, Homo sapien
cctagccgtgttttatgggccgctg

SEQ ID NO: 163895 - DNA, 25 bp, Homo sapien
tggacgcgaaaaacccgctcctggc

SEQ ID NO: 163896 - DNA, 25 bp, Homo sapien
cctcttgtgagaaggagatccagga

SEQ ID NO: 163897 - DNA, 25 bp, Homo sapien
atccaggagttgttaggctttatga

SEQ ID NO: 163898 - DNA, 25 bp, Homo sapien
aggctttagccaccacggaggaaga

SEQ ID NO: 163899 - DNA, 25 bp, Homo sapien
agaagcacgaattccgccggcgttg

SEQ ID NO: 163900 - DNA, 25 bp, Homo sapien
cggccgccgaagtttaacagtccag

SEQ ID NO: 163901 - DNA, 25 bp, Homo sapien
tttaacagtccaggcgggagccgga

SEQ ID NO: 163902 - DNA, 25 bp, Homo sapien
aagccacagccgcacgcagcgcctc

SEQ ID NO: 163903 - DNA, 25 bp, Homo sapien
ttctgtccggccagaagccacagcc

SEQ ID NO: 163904 - DNA, 25 bp, Homo sapien
agttcccgccctgacactgggataa

SEQ ID NO: 163905 - DNA, 25 bp, Homo sapien
cgccgccctgaccagaccctctgta

SEQ ID NO: 163906 - DNA, 25 bp, Homo sapien
tcccgccctgacactgggataactt

SEQ ID NO: 163907 - DNA, 25 bp, Homo sapien
ccccctgttgtgttgctgcggagag

SEQ ID NO: 163908 - DNA, 25 bp, Homo sapien
gcgctgctgttctcgaccgccgccc

SEQ ID NO: 163909 - DNA, 25 bp, Homo sapien
agcagcaccgccgacctgcgcgagt

SEQ ID NO: 163910 - DNA, 25 bp, Homo sapien
cccggggaccagcagcaccgccgac

SEQ ID NO: 163911 - DNA, 25 bp, Homo sapien
accaggctccgtggtcccggagccg

SEQ ID NO: 163912 - DNA, 25 bp, Homo sapien
gaggcctcggccgttactcgaagtc

SEQ ID NO: 163913 - DNA, 25 bp, Homo sapien
caccgccgacctgcgcgagtggccg

SEQ ID NO: 163914 - DNA, 25 bp, Homo sapien
atggcgctgctgttctcgaccgccg

SEQ ID NO: 163915 - DNA, 25 bp, Homo sapien
tcgaagtcccctacccagcagcagc

SEQ ID NO: 163916 - DNA, 25 bp, Homo sapien
cgttctcccgcttccgctggttacg

SEQ ID NO: 163917 - DNA, 25 bp, Homo sapien
ttgcgaaggcctgcgccggcttagt

SEQ ID NO: 163918 - DNA, 25 bp, Homo sapien
cccgccagattacaactcgaggtcg

SEQ ID NO: 163919 - DNA, 25 bp, Homo sapien
tacaactcgaggtcgcgaactcagc

SEQ ID NO: 163920 - DNA, 25 bp, Homo sapien
gtcgcgaactcagcgcgcggaacct

SEQ ID NO: 163921 - DNA, 25 bp, Homo sapien
cagggcgggtaagaacggaaatcat

SEQ ID NO: 163922 - DNA, 25 bp, Homo sapien
tgatcctggagacccgactaaacgg

SEQ ID NO: 163923 - DNA, 25 bp, Homo sapien
tcctttgatcctggagacccgacta

SEQ ID NO: 163924 - DNA, 25 bp, Homo sapien
tcgcgttctttgacgtgtgggtctg

SEQ ID NO: 163925 - DNA, 25 bp, Homo sapien
ttctccagtgacgaagagcgcgagc

SEQ ID NO: 163926 - DNA, 25 bp, Homo sapien
acgtgtacgtccagctctacctgca

SEQ ID NO: 163927 - DNA, 25 bp, Homo sapien
ggagcagcgcaaagacgtgtacgtc

SEQ ID NO: 163928 - DNA, 25 bp, Homo sapien
gttggtcgccaacaatgtgacgctg

SEQ ID NO: 163929 - DNA, 25 bp, Homo sapien
ccgcagttggttcgtagttcggctc

SEQ ID NO: 163930 - DNA, 25 bp, Homo sapien
tgtccgcgagtttttgttccgctcc

SEQ ID NO: 163931 - DNA, 25 bp, Homo sapien
agatgccggagttcctggaagaccc

SEQ ID NO: 163932 - DNA, 25 bp, Homo sapien
gagcggctctcacttttacgcagga

SEQ ID NO: 163933 - DNA, 25 bp, Homo sapien
agctcaagtccctccgagtgccaga

SEQ ID NO: 163934 - DNA, 25 bp, Homo sapien
agcactttagctcgcctaggatttg

SEQ ID NO: 163935 - DNA, 25 bp, Homo sapien
agtgcatcaaatacctgctgttcgg

SEQ ID NO: 163936 - DNA, 25 bp, Homo sapien
gcctgcatctgtatccagcgccagg

SEQ ID NO: 163937 - DNA, 25 bp, Homo sapien
ccggtcaaaggaggcaccaagtgca

SEQ ID NO: 163938 - DNA, 25 bp, Homo sapien
gttagccctcaccatgccggtcaaa

SEQ ID NO: 163939 - DNA, 25 bp, Homo sapien
cctgctgttcggatttaacttcatc

SEQ ID NO: 163940 - DNA, 25 bp, Homo sapien
tgtgagccgcaacctttccaaggga

SEQ ID NO: 163941 - DNA, 25 bp, Homo sapien
agaccctgcccaatacagtcgtgtg

SEQ ID NO: 163942 - DNA, 25 bp, Homo sapien
ccttttccaccataggcgggtgtca

SEQ ID NO: 163943 - DNA, 25 bp, Homo sapien
agaaagatgttctcgtccgtggcgc

SEQ ID NO: 163944 - DNA, 25 bp, Homo sapien
ttgctaggagaacgcgatgacgcta

SEQ ID NO: 163945 - DNA, 25 bp, Homo sapien
ggcacacatcttaggacccggagga

SEQ ID NO: 163946 - DNA, 25 bp, Homo sapien
ggcgctcttctccaccaatgggcga

SEQ ID NO: 163947 - DNA, 25 bp, Homo sapien
aggccgtgactagctctttctccgc

SEQ ID NO: 163948 - DNA, 25 bp, Homo sapien
cgtgactgctctatcccgggcaaaa

SEQ ID NO: 163949 - DNA, 25 bp, Homo sapien
agacctcctccctttgtgtccagta

SEQ ID NO: 163950 - DNA, 25 bp, Homo sapien
ggctcttcacctcagacatgtctgg

SEQ ID NO: 163951 - DNA, 25 bp, Homo sapien
tctggagaccctaggacgacaagcc

SEQ ID NO: 163952 - DNA, 25 bp, Homo sapien
ggcatcctcgttgcttcactgagtc

SEQ ID NO: 163953 - DNA, 25 bp, Homo sapien
acagcgccttccactgcgatattgc

SEQ ID NO: 163954 - DNA, 25 bp, Homo sapien
cgggatttgactgctccgctgtcca

SEQ ID NO: 163955 - DNA, 25 bp, Homo sapien
tttatttgcataagcgggcgcgcgc

SEQ ID NO: 163956 - DNA, 25 bp, Homo sapien
gcgaaggaaagcctgctccgggacc

SEQ ID NO: 163957 - DNA, 25 bp, Homo sapien
tgatgcctgttatacggtcgccgcg

SEQ ID NO: 163958 - DNA, 25 bp, Homo sapien
agatgggtcgatctgctttaaaaca

SEQ ID NO: 163959 - DNA, 25 bp, Homo sapien
ccagagtcttttgctcagatgggtc

SEQ ID NO: 163960 - DNA, 25 bp, Homo sapien
ggaggacggcgagtatcagaaaatc

SEQ ID NO: 163961 - DNA, 25 bp, Homo sapien
ccggctccacaatccacggtagatt

SEQ ID NO: 163962 - DNA, 25 bp, Homo sapien
tccacggtagattggccagagtctt

SEQ ID NO: 163963 - DNA, 25 bp, Homo sapien
gtaacaaggccgcacgctcagagca

SEQ ID NO: 163964 - DNA, 25 bp, Homo sapien
acgcagggagctccgagaacacatc

SEQ ID NO: 163965 - DNA, 25 bp, Homo sapien
agaaatcccgtgtcttgtctgccgg

SEQ ID NO: 163966 - DNA, 25 bp, Homo sapien
ccgggctgccaagtgcctattgatc

SEQ ID NO: 163967 - DNA, 25 bp, Homo sapien
cacaggcctcgacactgaagaagtg

SEQ ID NO: 163968 - DNA, 25 bp, Homo sapien
agaaatttcttagccaccgcggtgc

SEQ ID NO: 163969 - DNA, 25 bp, Homo sapien
cacgttggtacccagagaaatttct

SEQ ID NO: 163970 - DNA, 25 bp, Homo sapien
gcagggtaacggctttcctgaactc

SEQ ID NO: 163971 - DNA, 25 bp, Homo sapien
gaacacatcagtcagcgcccagaga

SEQ ID NO: 163972 - DNA, 25 bp, Homo sapien
taccacgcggctaacacacacctcc

SEQ ID NO: 163973 - DNA, 25 bp, Homo sapien
acctcccacaggtggcaagtgcctg

SEQ ID NO: 163974 - DNA, 25 bp, Homo sapien
gcatccgcacctaccacgcggctaa

SEQ ID NO: 163975 - DNA, 25 bp, Homo sapien
gcctgtccctccacgcatccgcacc

SEQ ID NO: 163976 - DNA, 25 bp, Homo sapien
gcatctccacgcggctaaatctccc

SEQ ID NO: 163977 - DNA, 25 bp, Homo sapien
ctttctcccacacccgccacgcctg

SEQ ID NO: 163978 - DNA, 25 bp, Homo sapien
gcactctgcgcgctttctcccacac

SEQ ID NO: 163979 - DNA, 25 bp, Homo sapien
ggcaagtgcctgaacgtccccacgg

SEQ ID NO: 163980 - DNA, 25 bp, Homo sapien
ctcggttactatggatatctcgctc

SEQ ID NO: 163981 - DNA, 25 bp, Homo sapien
ggcaccacttcttggagccacgtct

SEQ ID NO: 163982 - DNA, 25 bp, Homo sapien
cggaccctcactgcgagagcgatgc

SEQ ID NO: 163983 - DNA, 25 bp, Homo sapien
tggctgcgctctccattgttccgcg

SEQ ID NO: 163984 - DNA, 25 bp, Homo sapien
cgttgcctctgtgcatctttctggg

SEQ ID NO: 163985 - DNA, 25 bp, Homo sapien
gacatgtggcttgaacctccgctcc

SEQ ID NO: 163986 - DNA, 25 bp, Homo sapien
aggacgcagacatgtggcttgaacc

SEQ ID NO: 163987 - DNA, 25 bp, Homo sapien
caaggggcagaagcaggtcctgctc

SEQ ID NO: 163988 - DNA, 25 bp, Homo sapien
caatggggatcagaccatgtcttga

SEQ ID NO: 163989 - DNA, 25 bp, Homo sapien
cggcagagagagtcctagctggagc

SEQ ID NO: 163990 - DNA, 25 bp, Homo sapien
aggcagggagcacgactctctcctc

SEQ ID NO: 163991 - DNA, 25 bp, Homo sapien
caccctaaaataatgcaagagcttc

SEQ ID NO: 163992 - DNA, 25 bp, Homo sapien
ataatgcaagagcttcagcacggag

SEQ ID NO: 163993 - DNA, 25 bp, Homo sapien
tcagaccatgtcttgaaagaggggc

SEQ ID NO: 163994 - DNA, 25 bp, Homo sapien
ctgaattcccaaggcctcgttcccg

SEQ ID NO: 163995 - DNA, 25 bp, Homo sapien
ggcgcagcttttacaatggggatca

SEQ ID NO: 163996 - DNA, 25 bp, Homo sapien
ttaaccaggcacttgggtgacgcca

SEQ ID NO: 163997 - DNA, 25 bp, Homo sapien
tgatcgctcacgaccgggagagacc

SEQ ID NO: 163998 - DNA, 25 bp, Homo sapien
ctcggttaacggaaccgctctgctc

SEQ ID NO: 163999 - DNA, 25 bp, Homo sapien
actgcgccagaagccctcggttaac

SEQ ID NO: 164000 - DNA, 25 bp, Homo sapien
ggtctcgtcctgttgctcactgcct

SEQ ID NO: 164001 - DNA, 25 bp, Homo sapien
cgaactcgagttagagcccagcaca

SEQ ID NO: 164002 - DNA, 25 bp, Homo sapien
tttcttgatgatcccggccatggta

SEQ ID NO: 164003 - DNA, 25 bp, Homo sapien
gctcactgacctggagaggtgcttc

SEQ ID NO: 164004 - DNA, 25 bp, Homo sapien
ggttcttgaagtagcagaggcagca

SEQ ID NO: 164005 - DNA, 25 bp, Homo sapien
tccaagcccgttggcagttgtccta

SEQ ID NO: 164006 - DNA, 25 bp, Homo sapien
aagtggcctggaatttgtagaacgc

SEQ ID NO: 164007 - DNA, 25 bp, Homo sapien
ctctctcaggcgctcaaagtggcct

SEQ ID NO: 164008 - DNA, 25 bp, Homo sapien
ccaacacgaaccgacggctgcggta

SEQ ID NO: 164009 - DNA, 25 bp, Homo sapien
caggcttctgctatgtccaggtggc

SEQ ID NO: 164010 - DNA, 25 bp, Homo sapien
agggcgcgagttcccacctcaagca

SEQ ID NO: 164011 - DNA, 25 bp, Homo sapien
gtagccacgcagtcgcgctggttcc

SEQ ID NO: 164012 - DNA, 25 bp, Homo sapien
tctccgagggacaagatatatacgc

SEQ ID NO: 164013 - DNA, 25 bp, Homo sapien
gtgctacgtttcatctccggacatc

SEQ ID NO: 164014 - DNA, 25 bp, Homo sapien
tcggttacagccatgaaaatgtgtc

SEQ ID NO: 164015 - DNA, 25 bp, Homo sapien
tggagcttacaacgccaaaatcggt

SEQ ID NO: 164016 - DNA, 25 bp, Homo sapien
tgacgaccttagtgctggataatgg

SEQ ID NO: 164017 - DNA, 25 bp, Homo sapien
agggaaaacaactacggctgcggtg

SEQ ID NO: 164018 - DNA, 25 bp, Homo sapien
aaggtgaccagaggcgcgtcctaac

SEQ ID NO: 164019 - DNA, 25 bp, Homo sapien
gctccgcccaacaaaccatagagta

SEQ ID NO: 164020 - DNA, 25 bp, Homo sapien
aatccggtagcctgggtcaccagcc

SEQ ID NO: 164021 - DNA, 25 bp, Homo sapien
gaagtactggctccgcctcttccga

SEQ ID NO: 164022 - DNA, 25 bp, Homo sapien
cccggaagctcgttctgactgacaa

SEQ ID NO: 164023 - DNA, 25 bp, Homo sapien
caagtctacggaacctcggagtcaa

SEQ ID NO: 164024 - DNA, 25 bp, Homo sapien
gaaccgccataagctcgcgcgctgg

SEQ ID NO: 164025 - DNA, 25 bp, Homo sapien
gccgagtcctcgaaagaggccttga

SEQ ID NO: 164026 - DNA, 25 bp, Homo sapien
tacctttcggggacattggacacta

SEQ ID NO: 164027 - DNA, 25 bp, Homo sapien
ttggacactactctaggaccgggtg

SEQ ID NO: 164028 - DNA, 25 bp, Homo sapien
ccgccttatgattggtcccttcgaa

SEQ ID NO: 164029 - DNA, 25 bp, Homo sapien
gtcccttcgaaacaggcggcggcca

SEQ ID NO: 164030 - DNA, 25 bp, Homo sapien
cccgcacagattgagccgagttgtc

SEQ ID NO: 164031 - DNA, 25 bp, Homo sapien
cctggtgagtacttccctgtttgtc

SEQ ID NO: 164032 - DNA, 25 bp, Homo sapien
tggcgaacttttacgcgctgtctcg

SEQ ID NO: 164033 - DNA, 25 bp, Homo sapien
cgaagctgaggtttgttgggtctcc

SEQ ID NO: 164034 - DNA, 25 bp, Homo sapien
agccagtacgctctgcgtttgcctg

SEQ ID NO: 164035 - DNA, 25 bp, Homo sapien
acctgtccacccaagtgcggagaga

SEQ ID NO: 164036 - DNA, 25 bp, Homo sapien
aggcccttcccattggtgcgcattc

SEQ ID NO: 164037 - DNA, 25 bp, Homo sapien
attcagggacgctcagtggcgccgc

SEQ ID NO: 164038 - DNA, 25 bp, Homo sapien
gattgcacggattcagggacgctca

SEQ ID NO: 164039 - DNA, 25 bp, Homo sapien
cttcgcgattgcacggattcaggga

SEQ ID NO: 164040 - DNA, 25 bp, Homo sapien
attccaaagggccatgtaaacttct

SEQ ID NO: 164041 - DNA, 25 bp, Homo sapien
gcctctgtgtgaaggcccttcccat

SEQ ID NO: 164042 - DNA, 25 bp, Homo sapien
cgaaagtggtgcgttctgaccccaa

SEQ ID NO: 164043 - DNA, 25 bp, Homo sapien
tgtaaacttcttcgcgattgcacgg

SEQ ID NO: 164044 - DNA, 25 bp, Homo sapien
gccttggcagagctgtccctcgaat

SEQ ID NO: 164045 - DNA, 25 bp, Homo sapien
gcagagctgtccctcgaatccgggc

SEQ ID NO: 164046 - DNA, 25 bp, Homo sapien
agctgtccctcgaatccgggccgag

SEQ ID NO: 164047 - DNA, 25 bp, Homo sapien
taagcccacggagggctgactcatc

SEQ ID NO: 164048 - DNA, 25 bp, Homo sapien
gaaagcgccaatcggcggcaacccg

SEQ ID NO: 164049 - DNA, 25 bp, Homo sapien
gagggctgactcatcctggcgccgc

SEQ ID NO: 164050 - DNA, 25 bp, Homo sapien
gctttgagctctggcgagaaagcgc

SEQ ID NO: 164051 - DNA, 25 bp, Homo sapien
ctctggcgagaaagcgccaatcggc

SEQ ID NO: 164052 - DNA, 25 bp, Homo sapien
ccagctgattctagacggagaccca

SEQ ID NO: 164053 - DNA, 25 bp, Homo sapien
ggtctcaactttacacttgggaatg

SEQ ID NO: 164054 - DNA, 25 bp, Homo sapien
atgggtgccaccgacttattgggtc

SEQ ID NO: 164055 - DNA, 25 bp, Homo sapien
cttattgggtctcgttctcgctctc

SEQ ID NO: 164056 - DNA, 25 bp, Homo sapien
tcggacattccatcactcaaccttg

SEQ ID NO: 164057 - DNA, 25 bp, Homo sapien
gctcgcgccctcatcagatgctggg

SEQ ID NO: 164058 - DNA, 25 bp, Homo sapien
agcgcctcgtggtaagacagaaaca

SEQ ID NO: 164059 - DNA, 25 bp, Homo sapien
tctccagtggagcttccctaggaaa

SEQ ID NO: 164060 - DNA, 25 bp, Homo sapien
ccaggacaggattaggacgcaggcc

SEQ ID NO: 164061 - DNA, 25 bp, Homo sapien
gctcgcctctgcgtcgcagtgacaa

SEQ ID NO: 164062 - DNA, 25 bp, Homo sapien
tcctgaaggcatcaggccatgaagc

SEQ ID NO: 164063 - DNA, 25 bp, Homo sapien
agcagcatcttttgggcagaaggcc

SEQ ID NO: 164064 - DNA, 25 bp, Homo sapien
taccaggctgtaccggagaaaaaca

SEQ ID NO: 164065 - DNA, 25 bp, Homo sapien
gacctacgttcccttcgggagcaga

SEQ ID NO: 164066 - DNA, 25 bp, Homo sapien
ttacttatcacaggcgcgggaccta

SEQ ID NO: 164067 - DNA, 25 bp, Homo sapien
ccgctcctttagaaacggcctgagg

SEQ ID NO: 164068 - DNA, 25 bp, Homo sapien
tgcggccgcccatcaggaagtcctt

SEQ ID NO: 164069 - DNA, 25 bp, Homo sapien
tcggaaaatcgacccgctgccctga

SEQ ID NO: 164070 - DNA, 25 bp, Homo sapien
cagtgacggctgacatgaagctagc

SEQ ID NO: 164071 - DNA, 25 bp, Homo sapien
tcaaacccaggtatgggacctcgga

SEQ ID NO: 164072 - DNA, 25 bp, Homo sapien
cacgtagtcccacaccacgaaggtg

SEQ ID NO: 164073 - DNA, 25 bp, Homo sapien
gagatgaccagcatgcccgcgaaca

SEQ ID NO: 164074 - DNA, 25 bp, Homo sapien
cccagcgaaggcgtagtagatgccg

SEQ ID NO: 164075 - DNA, 25 bp, Homo sapien
ccctgagtgctcaccacgtgaggaa

SEQ ID NO: 164076 - DNA, 25 bp, Homo sapien
ccatgaagacaaagcccgtttccca

SEQ ID NO: 164077 - DNA, 25 bp, Homo sapien
agtatagcctgtgagccgctttccc

SEQ ID NO: 164078 - DNA, 25 bp, Homo sapien
ggctcaagccgcacgtgagaaagtc

SEQ ID NO: 164079 - DNA, 25 bp, Homo sapien
agaaagtctgggcatctgggaatcg

SEQ ID NO: 164080 - DNA, 25 bp, Homo sapien
tctgggaatcggagagtatagcctg

SEQ ID NO: 164081 - DNA, 25 bp, Homo sapien
tccttactgtcggttgcatcccttc

SEQ ID NO: 164082 - DNA, 25 bp, Homo sapien
tgtcggttgcatcccttcgacactc

SEQ ID NO: 164083 - DNA, 25 bp, Homo sapien
tgcagccatgaagacaaagcccgtt

SEQ ID NO: 164084 - DNA, 25 bp, Homo sapien
ataataggaatggtaccgcgctgcc

SEQ ID NO: 164085 - DNA, 25 bp, Homo sapien
gcctcgatgagtcgtcccggtcgaa

SEQ ID NO: 164086 - DNA, 25 bp, Homo sapien
gtggcgaatctgacaactgaaaatg

SEQ ID NO: 164087 - DNA, 25 bp, Homo sapien
cccgctcactggatgtagataccgt

SEQ ID NO: 164088 - DNA, 25 bp, Homo sapien
gtcagccagcaacttccacgtcgga

SEQ ID NO: 164089 - DNA, 25 bp, Homo sapien
ctcgccgatcttcagtgattccttg

SEQ ID NO: 164090 - DNA, 25 bp, Homo sapien
agctggctactctagggtatcctgg

SEQ ID NO: 164091 - DNA, 25 bp, Homo sapien
ctgaggccagtaaccagaggttttt

SEQ ID NO: 164092 - DNA, 25 bp, Homo sapien
gaagatcgccttccagtatggaatc

SEQ ID NO: 164093 - DNA, 25 bp, Homo sapien
tatggaatcaccgacctgcgcggca

SEQ ID NO: 164094 - DNA, 25 bp, Homo sapien
tgcgcggcatgctcaagcgactcaa

SEQ ID NO: 164095 - DNA, 25 bp, Homo sapien
caagcgactcaagcgcatgcgcaga

SEQ ID NO: 164096 - DNA, 25 bp, Homo sapien
cgtggcagcgttcgaaagccttgac

SEQ ID NO: 164097 - DNA, 25 bp, Homo sapien
cagcgttcgaaagccttgaccgtga

SEQ ID NO: 164098 - DNA, 25 bp, Homo sapien
cagtgagtacgagaagatcgccttc

SEQ ID NO: 164099 - DNA, 25 bp, Homo sapien
cgcgaaacccagtgagtacgagaag

SEQ ID NO: 164100 - DNA, 25 bp, Homo sapien
ctgtcccacggccaccgaagaggta

SEQ ID NO: 164101 - DNA, 25 bp, Homo sapien
gcctggagactgtcacgccactatc

SEQ ID NO: 164102 - DNA, 25 bp, Homo sapien
aacgtggtcaccacgctcgtgctca

SEQ ID NO: 164103 - DNA, 25 bp, Homo sapien
ctgctccagtggatcccgctctgga

SEQ ID NO: 164104 - DNA, 25 bp, Homo sapien
gttaagacatcagacctcaggcgca

SEQ ID NO: 164105 - DNA, 25 bp, Homo sapien
atccgacgccgtgggttaagacatc

SEQ ID NO: 164106 - DNA, 25 bp, Homo sapien
tcaaggaccttgatcgccgataaca

SEQ ID NO: 164107 - DNA, 25 bp, Homo sapien
caggtcctatgtccgcgcagatcct

SEQ ID NO: 164108 - DNA, 25 bp, Homo sapien
gcctcatccggacacgtcgctgatt

SEQ ID NO: 164109 - DNA, 25 bp, Homo sapien
ctcctgtaagtggtcccagggtgta

SEQ ID NO: 164110 - DNA, 25 bp, Homo sapien
cccgcaatttaggtctcggaaaatg

SEQ ID NO: 164111 - DNA, 25 bp, Homo sapien
tctccgcgacgcttctgaggcaagc

SEQ ID NO: 164112 - DNA, 25 bp, Homo sapien
acaagcgcgcttcacctgaggtggc

SEQ ID NO: 164113 - DNA, 25 bp, Homo sapien
ttactggtcgtcgacaggcgtcctc

SEQ ID NO: 164114 - DNA, 25 bp, Homo sapien
tacctcactggtcaagggcagcctc

SEQ ID NO: 164115 - DNA, 25 bp, Homo sapien
gcgacgccaggaggtaagatttacc

SEQ ID NO: 164116 - DNA, 25 bp, Homo sapien
tggtgacaacgacgcccaagaagca

SEQ ID NO: 164117 - DNA, 25 bp, Homo sapien
tctgcaggagcttgaacagcatcac

SEQ ID NO: 164118 - DNA, 25 bp, Homo sapien
caggtataggtctgtctctgcagga

SEQ ID NO: 164119 - DNA, 25 bp, Homo sapien
actcacctctccgaactggaaggcg

SEQ ID NO: 164120 - DNA, 25 bp, Homo sapien
ccaagaagcacacgtagagcccata

SEQ ID NO: 164121 - DNA, 25 bp, Homo sapien
cggagacgatggtgacaacgacgcc

SEQ ID NO: 164122 - DNA, 25 bp, Homo sapien
ctcattgcagctccggcgacggacg

SEQ ID NO: 164123 - DNA, 25 bp, Homo sapien
tagagcccatacctgtgggacaggc

SEQ ID NO: 164124 - DNA, 25 bp, Homo sapien
cttcctcttggtgacctggtcgtca

SEQ ID NO: 164125 - DNA, 25 bp, Homo sapien
gttcaccattgaggtgggagccaca

SEQ ID NO: 164126 - DNA, 25 bp, Homo sapien
cttcctgaggggaatggctttcgtc

SEQ ID NO: 164127 - DNA, 25 bp, Homo sapien
ttttctccagagttgcgcaagagcc

SEQ ID NO: 164128 - DNA, 25 bp, Homo sapien
attatctcctacgtggtcgccgtgc

SEQ ID NO: 164129 - DNA, 25 bp, Homo sapien
ccgtgacctggcgaacctcattgaa

SEQ ID NO: 164130 - DNA, 25 bp, Homo sapien
tcctcccgtatatcaggtgagtggc

SEQ ID NO: 164131 - DNA, 25 bp, Homo sapien
gggccgctttgtgacttcactcgtt

SEQ ID NO: 164132 - DNA, 25 bp, Homo sapien
tcatccatctcctcagcgggcggtg

SEQ ID NO: 164133 - DNA, 25 bp, Homo sapien
tagtccagattgtgacgtcaatttc

SEQ ID NO: 164134 - DNA, 25 bp, Homo sapien
ctcctcgctcggcattctgggattg

SEQ ID NO: 164135 - DNA, 25 bp, Homo sapien
cggaagaaagcttctccgctcacta

SEQ ID NO: 164136 - DNA, 25 bp, Homo sapien
gtcgggagtctagcaccgtctttta

SEQ ID NO: 164137 - DNA, 25 bp, Homo sapien
tccttaatcagctcaggagggaccc

SEQ ID NO: 164138 - DNA, 25 bp, Homo sapien
acagttgggagatgcacaccgtctc

SEQ ID NO: 164139 - DNA, 25 bp, Homo sapien
tcactaatcactcggcggcttccgg

SEQ ID NO: 164140 - DNA, 25 bp, Homo sapien
ccgtgtgtggactggattctgttct

SEQ ID NO: 164141 - DNA, 25 bp, Homo sapien
ttcccgttggtgtgtggactagatc

SEQ ID NO: 164142 - DNA, 25 bp, Homo sapien
ccgtccgtgtgtggactggattcta

SEQ ID NO: 164143 - DNA, 25 bp, Homo sapien
tccgtgtgtggactggattctgttc

SEQ ID NO: 164144 - DNA, 25 bp, Homo sapien
cccgtccgtgtgtggactggattct

SEQ ID NO: 164145 - DNA, 25 bp, Homo sapien
gactagatcctcttccgtcggcgcg

SEQ ID NO: 164146 - DNA, 25 bp, Homo sapien
ttggcgtgtggactagatcctcttc

SEQ ID NO: 164147 - DNA, 25 bp, Homo sapien
tccgtcggtgcatggactggattct

SEQ ID NO: 164148 - DNA, 25 bp, Homo sapien
cgcagaacgggcaacagagtccgta

SEQ ID NO: 164149 - DNA, 25 bp, Homo sapien
tcactctctcttcgggttgcattcg

SEQ ID NO: 164150 - DNA, 25 bp, Homo sapien
cgtagcgtcctggtagacatgctgc

SEQ ID NO: 164151 - DNA, 25 bp, Homo sapien
ccttagaggaactggcgtagcgtcc

SEQ ID NO: 164152 - DNA, 25 bp, Homo sapien
cacgctcaaagcctggcgctgttgg

SEQ ID NO: 164153 - DNA, 25 bp, Homo sapien
tagcacatgggcgtaaacacgctca

SEQ ID NO: 164154 - DNA, 25 bp, Homo sapien
cgcagaaacgcagaggtagccagtg

SEQ ID NO: 164155 - DNA, 25 bp, Homo sapien
tcgccataagagagccggtagaccc

SEQ ID NO: 164156 - DNA, 25 bp, Homo sapien
ttgaactgtattcagcggcgacagc

SEQ ID NO: 164157 - DNA, 25 bp, Homo sapien
tgaagagtacgtcttcgggtctacc

SEQ ID NO: 164158 - DNA, 25 bp, Homo sapien
cgcgaggtttgaactgtattcagcg

SEQ ID NO: 164159 - DNA, 25 bp, Homo sapien
ccagaggcaggctggtcttccttgg

SEQ ID NO: 164160 - DNA, 25 bp, Homo sapien
ctgggcggccggcagaaaagcatcc

SEQ ID NO: 164161 - DNA, 25 bp, Homo sapien
ctcctgggaatagagtggcaaggct

SEQ ID NO: 164162 - DNA, 25 bp, Homo sapien
gggccaggcgagttcctcaagaccc

SEQ ID NO: 164163 - DNA, 25 bp, Homo sapien
tgggaaggaagaactcctgggaata

SEQ ID NO: 164164 - DNA, 25 bp, Homo sapien
cgtcagtgccatttctctttgagga

SEQ ID NO: 164165 - DNA, 25 bp, Homo sapien
cttgtcctccgggtgaaactgcaga

SEQ ID NO: 164166 - DNA, 25 bp, Homo sapien
agggacggacctagatcttcatcgg

SEQ ID NO: 164167 - DNA, 25 bp, Homo sapien
gctctgactcctcttggggtgctta

SEQ ID NO: 164168 - DNA, 25 bp, Homo sapien
gcctagaagacacccaccaagtgtg

SEQ ID NO: 164169 - DNA, 25 bp, Homo sapien
ttaattaacccacgcgcaggcaagg

SEQ ID NO: 164170 - DNA, 25 bp, Homo sapien
agccgcgtttctgcgccctttgcag

SEQ ID NO: 164171 - DNA, 25 bp, Homo sapien
ccgctggtgagaatctgaaggtttc

SEQ ID NO: 164172 - DNA, 25 bp, Homo sapien
gtgggcgttgtcctgacgcaggagg

SEQ ID NO: 164173 - DNA, 25 bp, Homo sapien
ggtgcatctccgcacagtaacgccc

SEQ ID NO: 164174 - DNA, 25 bp, Homo sapien
gcagcctgccggatgctccaggtca

SEQ ID NO: 164175 - DNA, 25 bp, Homo sapien
gcctgccggatgctccaggtcacct

SEQ ID NO: 164176 - DNA, 25 bp, Homo sapien
gacgcaggaggcaccacttcgctgc

SEQ ID NO: 164177 - DNA, 25 bp, Homo sapien
ggcaccacttcgctgcccgccctgg

SEQ ID NO: 164178 - DNA, 25 bp, Homo sapien
agccagggagcgacgggccacccaa

SEQ ID NO: 164179 - DNA, 25 bp, Homo sapien
cgtggtgcatctccgcacagtaacg

SEQ ID NO: 164180 - DNA, 25 bp, Homo sapien
ttaaagcccttcctcgcggatgaga

SEQ ID NO: 164181 - DNA, 25 bp, Homo sapien
gatgagacccttggtgcgttccacc

SEQ ID NO: 164182 - DNA, 25 bp, Homo sapien
tcgccaggacgcactcagaatgaac

SEQ ID NO: 164183 - DNA, 25 bp, Homo sapien
cagaggttcctgaccctgagcgtta

SEQ ID NO: 164184 - DNA, 25 bp, Homo sapien
ccctgttgaacgcaagagcatccaa

SEQ ID NO: 164185 - DNA, 25 bp, Homo sapien
ccggtagtctcctagccctgttgaa

SEQ ID NO: 164186 - DNA, 25 bp, Homo sapien
tccaaggctctaggcgcctgcattc

SEQ ID NO: 164187 - DNA, 25 bp, Homo sapien
cggcaggaacgtttcaggagctcca

SEQ ID NO: 164188 - DNA, 25 bp, Homo sapien
tgccctaagcgccatcactcaaccc

SEQ ID NO: 164189 - DNA, 25 bp, Homo sapien
cccagacgtcctgaagctggacggg

SEQ ID NO: 164190 - DNA, 25 bp, Homo sapien
agctggacggggttctggccagaga

SEQ ID NO: 164191 - DNA, 25 bp, Homo sapien
ctgtccaagcggtcgagcgacggct

SEQ ID NO: 164192 - DNA, 25 bp, Homo sapien
gtcgagcgacggctgcaagcgcctc

SEQ ID NO: 164193 - DNA, 25 bp, Homo sapien
ccctctcggcgccagcacgcggccc

SEQ ID NO: 164194 - DNA, 25 bp, Homo sapien
cccaccagtgccctaagcgccatca

SEQ ID NO: 164195 - DNA, 25 bp, Homo sapien
gcggcgccgaagaaccaggaatccc

SEQ ID NO: 164196 - DNA, 25 bp, Homo sapien
ggtcacaagtcagcgcccaagcaag

SEQ ID NO: 164197 - DNA, 25 bp, Homo sapien
agagcgcgttcagcactgacttttg

SEQ ID NO: 164198 - DNA, 25 bp, Homo sapien
cactctaagaagtctcccggggatt

SEQ ID NO: 164199 - DNA, 25 bp, Homo sapien
tccgtcagggctcccgcttcatatt

SEQ ID NO: 164200 - DNA, 25 bp, Homo sapien
tgttcctgcacccaagttctctctg

SEQ ID NO: 164201 - DNA, 25 bp, Homo sapien
ccgctgcgcatggaaagctctgcca

SEQ ID NO: 164202 - DNA, 25 bp, Homo sapien
agcctgtttctttgccacggccgca

SEQ ID NO: 164203 - DNA, 25 bp, Homo sapien
ggcgcggccaacaagaagatgagta

SEQ ID NO: 164204 - DNA, 25 bp, Homo sapien
ggaagcttgcactaccgggctcagc

SEQ ID NO: 164205 - DNA, 25 bp, Homo sapien
cctgccaaatgcgagaccttagaga

SEQ ID NO: 164206 - DNA, 25 bp, Homo sapien
tgtaggggacaaaagctccgcacct

SEQ ID NO: 164207 - DNA, 25 bp, Homo sapien
tctgcaaagtgcgttggagaggact

SEQ ID NO: 164208 - DNA, 25 bp, Homo sapien
tccttggagggagtcactttctgca

SEQ ID NO: 164209 - DNA, 25 bp, Homo sapien
cggccgcttacaaagccgcctttga

SEQ ID NO: 164210 - DNA, 25 bp, Homo sapien
gccgcctttgatgctctggctacca

SEQ ID NO: 164211 - DNA, 25 bp, Homo sapien
gctaccagggctattttggggacga

SEQ ID NO: 164212 - DNA, 25 bp, Homo sapien
atgaggatgcttggggagcatctcc

SEQ ID NO: 164213 - DNA, 25 bp, Homo sapien
atggcaaccgcgccttttccgacgg

SEQ ID NO: 164214 - DNA, 25 bp, Homo sapien
acgcgcccaggagtctgctttggat

SEQ ID NO: 164215 - DNA, 25 bp, Homo sapien
ccaggagtctgctttggatgtcgtc

SEQ ID NO: 164216 - DNA, 25 bp, Homo sapien
gctcgagctctgtgttactcgggcc

SEQ ID NO: 164217 - DNA, 25 bp, Homo sapien
ctctgtgttactcgggccggtgctc

SEQ ID NO: 164218 - DNA, 25 bp, Homo sapien
gaaagcaggacagagatgaggctca

SEQ ID NO: 164219 - DNA, 25 bp, Homo sapien
aggctcaagcgtgcgggaccacacc

SEQ ID NO: 164220 - DNA, 25 bp, Homo sapien
agcgtggttccaagcgctccgcagt

SEQ ID NO: 164221 - DNA, 25 bp, Homo sapien
cttcctgtattagcatgcgggcggc

SEQ ID NO: 164222 - DNA, 25 bp, Homo sapien
gggaccatctgctcgctgtcaatgc

SEQ ID NO: 164223 - DNA, 25 bp, Homo sapien
tcgctgtcaatgcatcacctgctcg

SEQ ID NO: 164224 - DNA, 25 bp, Homo sapien
gctccttggcctttgctgccgtgct

SEQ ID NO: 164225 - DNA, 25 bp, Homo sapien
ggcaaccacaatggggctgccttgc

SEQ ID NO: 164226 - DNA, 25 bp, Homo sapien
cagcagagagcaaacggtccggctc

SEQ ID NO: 164227 - DNA, 25 bp, Homo sapien
gagctggagcactctgctgggtcct

SEQ ID NO: 164228 - DNA, 25 bp, Homo sapien
cgcaggccacatgggatggaatgat

SEQ ID NO: 164229 - DNA, 25 bp, Homo sapien
cccgactcggctgttactattatta

SEQ ID NO: 164230 - DNA, 25 bp, Homo sapien
cagctcctgcgtcggaacacgtggc

SEQ ID NO: 164231 - DNA, 25 bp, Homo sapien
gaagtttctagagcgcatttttccc

SEQ ID NO: 164232 - DNA, 25 bp, Homo sapien
aaaggcgcgagttgtgaagtttcta

SEQ ID NO: 164233 - DNA, 25 bp, Homo sapien
atatacaacagctttcccgaccggg

SEQ ID NO: 164234 - DNA, 25 bp, Homo sapien
ctcagatgcagatttcgggctaaaa

SEQ ID NO: 164235 - DNA, 25 bp, Homo sapien
ctgctgcggtcaatttcagggtggc

SEQ ID NO: 164236 - DNA, 25 bp, Homo sapien
tccgctcagtaaccggatttccgga

SEQ ID NO: 164237 - DNA, 25 bp, Homo sapien
atggtgattacaacccggggcgcta

SEQ ID NO: 164238 - DNA, 25 bp, Homo sapien
cggcgggccagatggtgattacaac

SEQ ID NO: 164239 - DNA, 25 bp, Homo sapien
tggtccacccaatagctccgctgta

SEQ ID NO: 164240 - DNA, 25 bp, Homo sapien
ctccgccactacagggagcagaggc

SEQ ID NO: 164241 - DNA, 25 bp, Homo sapien
gagcctggctctcgcctgacaataa

SEQ ID NO: 164242 - DNA, 25 bp, Homo sapien
gctccgcaggcacaatttttaaacc

SEQ ID NO: 164243 - DNA, 25 bp, Homo sapien
ctgcatccggagcatagcaagcatg

SEQ ID NO: 164244 - DNA, 25 bp, Homo sapien
gcaccgccacgtgagctgtcctctc

SEQ ID NO: 164245 - DNA, 25 bp, Homo sapien
tgtcgagttcaggtgcgaccgaaaa

SEQ ID NO: 164246 - DNA, 25 bp, Homo sapien
gcgggccgctcgatcccagtcccag

SEQ ID NO: 164247 - DNA, 25 bp, Homo sapien
cccgagcggtgctggcggtagggag

SEQ ID NO: 164248 - DNA, 25 bp, Homo sapien
tcgagttcaggtgcgaccgaaaagg

SEQ ID NO: 164249 - DNA, 25 bp, Homo sapien
ggtgcggtgacacctgtgggcacag

SEQ ID NO: 164250 - DNA, 25 bp, Homo sapien
ctcggccggcgggtgtcgagttcag

SEQ ID NO: 164251 - DNA, 25 bp, Homo sapien
agggcaccgccacgtgagctgtcct

SEQ ID NO: 164252 - DNA, 25 bp, Homo sapien
ccgcgaaagtcgtgctggaatcact

SEQ ID NO: 164253 - DNA, 25 bp, Homo sapien
tgaccaatcggaaggagccacgctt

SEQ ID NO: 164254 - DNA, 25 bp, Homo sapien
cctgctgaccttcggtgagtgattc

SEQ ID NO: 164255 - DNA, 25 bp, Homo sapien
ccgccgcgacctctctaaaaggatg

SEQ ID NO: 164256 - DNA, 25 bp, Homo sapien
cgctctctaggatccggaagtagtt

SEQ ID NO: 164257 - DNA, 25 bp, Homo sapien
ccggtcacggaataaacgctctcta

SEQ ID NO: 164258 - DNA, 25 bp, Homo sapien
gcccgcggagccatttgattggaga

SEQ ID NO: 164259 - DNA, 25 bp, Homo sapien
ggggatttgcaacctctctcgtgtg

SEQ ID NO: 164260 - DNA, 25 bp, Homo sapien
tactagagactgtaccgcgaactgc

SEQ ID NO: 164261 - DNA, 25 bp, Homo sapien
tgcctctatacacgcgctctactag

SEQ ID NO: 164262 - DNA, 25 bp, Homo sapien
cgtgcggcattaaagggagctcttg

SEQ ID NO: 164263 - DNA, 25 bp, Homo sapien
ccaatcgtttatcagtgaggggcgc

SEQ ID NO: 164264 - DNA, 25 bp, Homo sapien
tgtcagaagttccagctcacgacta

SEQ ID NO: 164265 - DNA, 25 bp, Homo sapien
agccagcgctggacacgagacacac

SEQ ID NO: 164266 - DNA, 25 bp, Homo sapien
gcgagcaggccggacccaaaataca

SEQ ID NO: 164267 - DNA, 25 bp, Homo sapien
ctcctttacgagctgagggcactga

SEQ ID NO: 164268 - DNA, 25 bp, Homo sapien
ttgtcttaccgcagtgagtaccacg

SEQ ID NO: 164269 - DNA, 25 bp, Homo sapien
actggagacaaaagctgacgtcggc

SEQ ID NO: 164270 - DNA, 25 bp, Homo sapien
gattgggctgtcctacatcacgtga

SEQ ID NO: 164271 - DNA, 25 bp, Homo sapien
gccagtacgcgtgggatttggctcc

SEQ ID NO: 164272 - DNA, 25 bp, Homo sapien
ggagcttgagtccagccactgtctg

SEQ ID NO: 164273 - DNA, 25 bp, Homo sapien
cactgtctgggtactgccagccatc

SEQ ID NO: 164274 - DNA, 25 bp, Homo sapien
gtactacagagaccggctgcccgtg

SEQ ID NO: 164275 - DNA, 25 bp, Homo sapien
tgacgtcggcagagcgctcctagtc

SEQ ID NO: 164276 - DNA, 25 bp, Homo sapien
atgagctgcacgtctacaacacggg

SEQ ID NO: 164277 - DNA, 25 bp, Homo sapien
ccatccgggagctgatgatcatctt

SEQ ID NO: 164278 - DNA, 25 bp, Homo sapien
tcctcaactggaggcgagtttcttc

SEQ ID NO: 164279 - DNA, 25 bp, Homo sapien
gaagcgtccttccaccctaaggtgc

SEQ ID NO: 164280 - DNA, 25 bp, Homo sapien
ctgtggcttcttcccaaaataccga

SEQ ID NO: 164281 - DNA, 25 bp, Homo sapien
cgagcttctctcacgttgcttgtga

SEQ ID NO: 164282 - DNA, 25 bp, Homo sapien
gaagaccatgtccaaccgcctgggc

SEQ ID NO: 164283 - DNA, 25 bp, Homo sapien
ccgaaatctcgcctctgtcaaaaaa

SEQ ID NO: 164284 - DNA, 25 bp, Homo sapien
gtcggtttaggagcgatcattggcc

SEQ ID NO: 164285 - DNA, 25 bp, Homo sapien
ggagacggacatttcattcgagcta

SEQ ID NO: 164286 - DNA, 25 bp, Homo sapien
ttcgagctaaagtggagtcggttta

SEQ ID NO: 164287 - DNA, 25 bp, Homo sapien
atctctcgggcgtccctctctttgt

SEQ ID NO: 164288 - DNA, 25 bp, Homo sapien
cgatcattggccgaagcgagacaca

SEQ ID NO: 164289 - DNA, 25 bp, Homo sapien
aaacctccaatgcagccctggttgg

SEQ ID NO: 164290 - DNA, 25 bp, Homo sapien
ggctcccgtctccaatcggctgttt

SEQ ID NO: 164291 - DNA, 25 bp, Homo sapien
aatggctgcgaaggaaccagtccca

SEQ ID NO: 164292 - DNA, 25 bp, Homo sapien
gcctgatttcgctcagggcccgtta

SEQ ID NO: 164293 - DNA, 25 bp, Homo sapien
gcatcctcctccatcgagaatcttg

SEQ ID NO: 164294 - DNA, 25 bp, Homo sapien
gggaagcgaccaaaccgacagccga

SEQ ID NO: 164295 - DNA, 25 bp, Homo sapien
acgggctatgacttcgctgttgtca

SEQ ID NO: 164296 - DNA, 25 bp, Homo sapien
gtcctcttcctacaagcaccgtgtt

SEQ ID NO: 164297 - DNA, 25 bp, Homo sapien
ctgtcggaaaccgaaccgagatctc

SEQ ID NO: 164298 - DNA, 25 bp, Homo sapien
ccttgaagaagatacacgggctatg

SEQ ID NO: 164299 - DNA, 25 bp, Homo sapien
gcaccgtgtttccaatgaaaggtta

SEQ ID NO: 164300 - DNA, 25 bp, Homo sapien
ggctggacaaactgagccagtccca

SEQ ID NO: 164301 - DNA, 25 bp, Homo sapien
aaaaaagtgatctggctggacaaac

SEQ ID NO: 164302 - DNA, 25 bp, Homo sapien
ctggctggacaaactgagccagtcc

SEQ ID NO: 164303 - DNA, 25 bp, Homo sapien
tctggctggacaaactgagccagtc

SEQ ID NO: 164304 - DNA, 25 bp, Homo sapien
tgatctggctggacaaactgagcca

SEQ ID NO: 164305 - DNA, 25 bp, Homo sapien
gtgatctggctggacaaactgagcc

SEQ ID NO: 164306 - DNA, 25 bp, Homo sapien
agtgatctggctggacaaactgagc

SEQ ID NO: 164307 - DNA, 25 bp, Homo sapien
aaagtgatctggctggacaaactga

SEQ ID NO: 164308 - DNA, 25 bp, Homo sapien
aagatattttaaggcgtgtctgagc

SEQ ID NO: 164309 - DNA, 25 bp, Homo sapien
gtgaaaccagacaaagccgcgagcc

SEQ ID NO: 164310 - DNA, 25 bp, Homo sapien
gtaagctctgcgtcgggtgaaacca

SEQ ID NO: 164311 - DNA, 25 bp, Homo sapien
gaaggagggcctgatgtcttcatca

SEQ ID NO: 164312 - DNA, 25 bp, Homo sapien
atttgcagcagagcgaaaggtggtc

SEQ ID NO: 164313 - DNA, 25 bp, Homo sapien
agttttcttcactccggcatttgca

SEQ ID NO: 164314 - DNA, 25 bp, Homo sapien
tcgtagccattaggaaacagcaacc

SEQ ID NO: 164315 - DNA, 25 bp, Homo sapien
agggcgtggcttctcgtagccatta

SEQ ID NO: 164316 - DNA, 25 bp, Homo sapien
taaagccagcgtggatgtgaccctc

SEQ ID NO: 164317 - DNA, 25 bp, Homo sapien
tgtgaccctccaaacgggacgcagc

SEQ ID NO: 164318 - DNA, 25 bp, Homo sapien
agcgtggtcacagcctgccttttaa

SEQ ID NO: 164319 - DNA, 25 bp, Homo sapien
cggccatggtccaaccttgaaggta

SEQ ID NO: 164320 - DNA, 25 bp, Homo sapien
aattggccgcggaaaccgatctgcc

SEQ ID NO: 164321 - DNA, 25 bp, Homo sapien
ccctggaaggaacgctctcggaatt

SEQ ID NO: 164322 - DNA, 25 bp, Homo sapien
ccgctctgcttttgtgccacacaga

SEQ ID NO: 164323 - DNA, 25 bp, Homo sapien
ctagcgcatgtgttaatcgaagttg

SEQ ID NO: 164324 - DNA, 25 bp, Homo sapien
agctgttcagccctctttcttcagg

SEQ ID NO: 164325 - DNA, 25 bp, Homo sapien
tccggcttttgcaccacactaacta

SEQ ID NO: 164326 - DNA, 25 bp, Homo sapien
aggaatctggaaggacctggacccg

SEQ ID NO: 164327 - DNA, 25 bp, Homo sapien
tggccttcggcgagaactcaggcga

SEQ ID NO: 164328 - DNA, 25 bp, Homo sapien
tccggcgagtcagcgcgactgtgaa

SEQ ID NO: 164329 - DNA, 25 bp, Homo sapien
tgtccatgctgacctgaggagtcgc

SEQ ID NO: 164330 - DNA, 25 bp, Homo sapien
agcggcatatttctcatctggcgga

SEQ ID NO: 164331 - DNA, 25 bp, Homo sapien
atccgtccttggcacggtgactgcc

SEQ ID NO: 164332 - DNA, 25 bp, Homo sapien
cgtgagctcggcgaacaactcctta

SEQ ID NO: 164333 - DNA, 25 bp, Homo sapien
tggccggcatgttggttgaaaaagc

SEQ ID NO: 164334 - DNA, 25 bp, Homo sapien
ggaggccgacgtagacccaaagctc

SEQ ID NO: 164335 - DNA, 25 bp, Homo sapien
ctcatgtactgcgtgcggcagaacc

SEQ ID NO: 164336 - DNA, 25 bp, Homo sapien
cgtcctctttgatggcgtgagccga

SEQ ID NO: 164337 - DNA, 25 bp, Homo sapien
cgtgagccgaaccagagaagcagcc

SEQ ID NO: 164338 - DNA, 25 bp, Homo sapien
ctcaccgctgacgaggagaagtgcc

SEQ ID NO: 164339 - DNA, 25 bp, Homo sapien
ttacctcagagatacccgtggccgg

SEQ ID NO: 164340 - DNA, 25 bp, Homo sapien
gcagctccagccgatcgatctcgtg

SEQ ID NO: 164341 - DNA, 25 bp, Homo sapien
ggacggtccttagagctgcccgcag

SEQ ID NO: 164342 - DNA, 25 bp, Homo sapien
ctatgtacatcgaggggttagcacc

SEQ ID NO: 164343 - DNA, 25 bp, Homo sapien
ccagcaggtccatgtcgcggagcac

SEQ ID NO: 164344 - DNA, 25 bp, Homo sapien
agcatgctgtattgcgcctcgcgca

SEQ ID NO: 164345 - DNA, 25 bp, Homo sapien
acgaattccttccagcgcaacgggg

SEQ ID NO: 164346 - DNA, 25 bp, Homo sapien
atcgatctcgtggtcgctcagccct

SEQ ID NO: 164347 - DNA, 25 bp, Homo sapien
cctccaggtcgccagcatgctgtat

SEQ ID NO: 164348 - DNA, 25 bp, Homo sapien
cccgcagccaggacaaagccatgaa

SEQ ID NO: 164349 - DNA, 25 bp, Homo sapien
gatgaaagagttacccggagccggc

SEQ ID NO: 164350 - DNA, 25 bp, Homo sapien
gaaggtgtgcttcgccctcttcttc

SEQ ID NO: 164351 - DNA, 25 bp, Homo sapien
tggctgcccagatctacccgggtca

SEQ ID NO: 164352 - DNA, 25 bp, Homo sapien
ttggatattttcttctctctcgcgc

SEQ ID NO: 164353 - DNA, 25 bp, Homo sapien
ttccaaagtatgttgcacccaggta

SEQ ID NO: 164354 - DNA, 25 bp, Homo sapien
agaatctgccggatggtgctggcca

SEQ ID NO: 164355 - DNA, 25 bp, Homo sapien
cttgggatcctttatcctggtcatc

SEQ ID NO: 164356 - DNA, 25 bp, Homo sapien
agccaacagcgccacaagccgtaag

SEQ ID NO: 164357 - DNA, 25 bp, Homo sapien
cggctcatgatggtcctgaccgggc

SEQ ID NO: 164358 - DNA, 25 bp, Homo sapien
caccaactggaagcggctcatgatg

SEQ ID NO: 164359 - DNA, 25 bp, Homo sapien
agatcccggccaacgaggcacacgt

SEQ ID NO: 164360 - DNA, 25 bp, Homo sapien
tgacagacacgtgccgagccaacag

SEQ ID NO: 164361 - DNA, 25 bp, Homo sapien
cgggaccaggtgacagacacgtgcc

SEQ ID NO: 164362 - DNA, 25 bp, Homo sapien
tgaggaccacgagctcatctactgc

SEQ ID NO: 164363 - DNA, 25 bp, Homo sapien
ccacaagccgtaagcggagggtgct

SEQ ID NO: 164364 - DNA, 25 bp, Homo sapien
tcagaccagaccgagacaccagggg

SEQ ID NO: 164365 - DNA, 25 bp, Homo sapien
agaccagaccgagacaccaggggcg

SEQ ID NO: 164366 - DNA, 25 bp, Homo sapien
atggaaggggcattcacctggtgcc

SEQ ID NO: 164367 - DNA, 25 bp, Homo sapien
atggtcacctgttccggagcgcggc

SEQ ID NO: 164368 - DNA, 25 bp, Homo sapien
tccatggtcacctgttccggagcgc

SEQ ID NO: 164369 - DNA, 25 bp, Homo sapien
cccgcacctgatgcgcccgaacgcg

SEQ ID NO: 164370 - DNA, 25 bp, Homo sapien
tccctcccgcacctgatgcgcccga

SEQ ID NO: 164371 - DNA, 25 bp, Homo sapien
gtggccgcggaacagcttccctcag

SEQ ID NO: 164372 - DNA, 25 bp, Homo sapien
gcctttttcctgcatccgggcctga

SEQ ID NO: 164373 - DNA, 25 bp, Homo sapien
agagtgcaggcttgagggaagcatg

SEQ ID NO: 164374 - DNA, 25 bp, Homo sapien
agcatggaggtccatggcaagccca

SEQ ID NO: 164375 - DNA, 25 bp, Homo sapien
gaggtccatggcaagcccaaggcta

SEQ ID NO: 164376 - DNA, 25 bp, Homo sapien
agcccaaggctagcccgagttgttc

SEQ ID NO: 164377 - DNA, 25 bp, Homo sapien
gctagcccgagttgttcgtcgccca

SEQ ID NO: 164378 - DNA, 25 bp, Homo sapien
gcagtttcctccaatcgcggccctc

SEQ ID NO: 164379 - DNA, 25 bp, Homo sapien
tctccgctccttactccgcccaccg

SEQ ID NO: 164380 - DNA, 25 bp, Homo sapien
ccgccgcagcatgctggagaggagc

SEQ ID NO: 164381 - DNA, 25 bp, Homo sapien
gctgcgttcggacagccaacctggt

SEQ ID NO: 164382 - DNA, 25 bp, Homo sapien
cgctctcggcctctgctagtccgca

SEQ ID NO: 164383 - DNA, 25 bp, Homo sapien
ccgccagctggctgcgttcggacag

SEQ ID NO: 164384 - DNA, 25 bp, Homo sapien
actcacccggccagtggagaagcgc

SEQ ID NO: 164385 - DNA, 25 bp, Homo sapien
tggaaaccaggacagggtgacagcc

SEQ ID NO: 164386 - DNA, 25 bp, Homo sapien
cccggagtctggaaaccaggacagg

SEQ ID NO: 164387 - DNA, 25 bp, Homo sapien
ggacagccaacctggtgcgacccgg

SEQ ID NO: 164388 - DNA, 25 bp, Homo sapien
ctgggagtttgaccgcgttgacgac

SEQ ID NO: 164389 - DNA, 25 bp, Homo sapien
ctctccagcgttactttcggggttg

SEQ ID NO: 164390 - DNA, 25 bp, Homo sapien
gggacgcgctctccagcgttacttt

SEQ ID NO: 164391 - DNA, 25 bp, Homo sapien
acttcagagcccttggggtgtgcga

SEQ ID NO: 164392 - DNA, 25 bp, Homo sapien
cgttgacgacggctcgcagagtaag

SEQ ID NO: 164393 - DNA, 25 bp, Homo sapien
aagtcacgtgctgtgacagtagctg

SEQ ID NO: 164394 - DNA, 25 bp, Homo sapien
cacggcggaggactcgctttcccag

SEQ ID NO: 164395 - DNA, 25 bp, Homo sapien
cagccgtctggtgcgggacacttca

SEQ ID NO: 164396 - DNA, 25 bp, Homo sapien
gtgtggtgagctccggtcccgacac

SEQ ID NO: 164397 - DNA, 25 bp, Homo sapien
tgcaacgcctcctctagcaggagct

SEQ ID NO: 164398 - DNA, 25 bp, Homo sapien
ctctagcaggagcttgtccacggcg

SEQ ID NO: 164399 - DNA, 25 bp, Homo sapien
tccacgcctggccagtggccgccgc

SEQ ID NO: 164400 - DNA, 25 bp, Homo sapien
ccggccgagccggatcaacaggaag

SEQ ID NO: 164401 - DNA, 25 bp, Homo sapien
gatcaacaggaagtgtggcgcgccc

SEQ ID NO: 164402 - DNA, 25 bp, Homo sapien
acaccggaaatgtggcgcccgcgct

SEQ ID NO: 164403 - DNA, 25 bp, Homo sapien
ccgagccggatcaacaggaagtgtg

SEQ ID NO: 164404 - DNA, 25 bp, Homo sapien
gaaagaccgaaagcgtggcaagtcc

SEQ ID NO: 164405 - DNA, 25 bp, Homo sapien
ttgcgcctggagcagtcgagcctgc

SEQ ID NO: 164406 - DNA, 25 bp, Homo sapien
gacaggagcagaccgcccgtttctg

SEQ ID NO: 164407 - DNA, 25 bp, Homo sapien
cccattttcgggacaggagcagacc

SEQ ID NO: 164408 - DNA, 25 bp, Homo sapien
atgggctgcgggaactccaccgcca

SEQ ID NO: 164409 - DNA, 25 bp, Homo sapien
gaccaatggccgaccgcgaagcgcg

SEQ ID NO: 164410 - DNA, 25 bp, Homo sapien
cctcgtaataacgaccaatggccga

SEQ ID NO: 164411 - DNA, 25 bp, Homo sapien
cgtttctggaaagaccgaaagcgtg

SEQ ID NO: 164412 - DNA, 25 bp, Homo sapien
tcagcctcggtcctgtttaggcacg

SEQ ID NO: 164413 - DNA, 25 bp, Homo sapien
agcctcggtcctgtttaggcacgga

SEQ ID NO: 164414 - DNA, 25 bp, Homo sapien
ctcggtcctgtttaggcacggaaag

SEQ ID NO: 164415 - DNA, 25 bp, Homo sapien
agggctggagaaccgcgtccttccg

SEQ ID NO: 164416 - DNA, 25 bp, Homo sapien
ctggagaaccgcgtccttccgaggc

SEQ ID NO: 164417 - DNA, 25 bp, Homo sapien
ggagaaccgcgtccttccgaggcgc

SEQ ID NO: 164418 - DNA, 25 bp, Homo sapien
ggaaagttaaagaacgcgctgcagc

SEQ ID NO: 164419 - DNA, 25 bp, Homo sapien
tctgggaaagttaaagaacgcgctg

SEQ ID NO: 164420 - DNA, 25 bp, Homo sapien
ccctcaaagtcctggatctggagga

SEQ ID NO: 164421 - DNA, 25 bp, Homo sapien
tcatcgctgatgacactggaagggc

SEQ ID NO: 164422 - DNA, 25 bp, Homo sapien
gacagcacgctgtcatcgctgatga

SEQ ID NO: 164423 - DNA, 25 bp, Homo sapien
tcaaaagagtcgctggacagcacgc

SEQ ID NO: 164424 - DNA, 25 bp, Homo sapien
gcaaatccagcaagtcaaaagagtc

SEQ ID NO: 164425 - DNA, 25 bp, Homo sapien
agggcgattctcctgcaaatccagc

SEQ ID NO: 164426 - DNA, 25 bp, Homo sapien
gaagttttctgcagagacgcagctg

SEQ ID NO: 164427 - DNA, 25 bp, Homo sapien
cctggatctggaggaagttttctgc

SEQ ID NO: 164428 - DNA, 25 bp, Homo sapien
ccaggagtgctttgtcctcgctggg

SEQ ID NO: 164429 - DNA, 25 bp, Homo sapien
gagcgtgtcgcgactcgccctttgt

SEQ ID NO: 164430 - DNA, 25 bp, Homo sapien
gataccgctcggactgcggctcggt

SEQ ID NO: 164431 - DNA, 25 bp, Homo sapien
gaagccgctgtacgctcaaggtcgc

SEQ ID NO: 164432 - DNA, 25 bp, Homo sapien
cttccatgtccaagcgcggggcgag

SEQ ID NO: 164433 - DNA, 25 bp, Homo sapien
tcattttcttgtaggtgtcgccgca

SEQ ID NO: 164434 - DNA, 25 bp, Homo sapien
aggcggtgactcacggaccttgccc

SEQ ID NO: 164435 - DNA, 25 bp, Homo sapien
tgttcggttacaggcggtgactcac

SEQ ID NO: 164436 - DNA, 25 bp, Homo sapien
gcgtgaccgcggtacccaggtcatc

SEQ ID NO: 164437 - DNA, 25 bp, Homo sapien
ctggaggccacgctacgggctcgac

SEQ ID NO: 164438 - DNA, 25 bp, Homo sapien
gtggtgaaggagctgtatttgtaca

SEQ ID NO: 164439 - DNA, 25 bp, Homo sapien
tgtacaggtcaaagagcgtctgctc

SEQ ID NO: 164440 - DNA, 25 bp, Homo sapien
gtctgctctgtgatgcggtccagct

SEQ ID NO: 164441 - DNA, 25 bp, Homo sapien
tgtctgccctttcccaaagagggga

SEQ ID NO: 164442 - DNA, 25 bp, Homo sapien
ctttcggcttgagtgccgcttggca

SEQ ID NO: 164443 - DNA, 25 bp, Homo sapien
ccgggacactgtggactgtttattg

SEQ ID NO: 164444 - DNA, 25 bp, Homo sapien
tgaagcctccgtcctccttcggccc

SEQ ID NO: 164445 - DNA, 25 bp, Homo sapien
tcctcagacctgagaagcttctccg

SEQ ID NO: 164446 - DNA, 25 bp, Homo sapien
ctgagaagcttctccgtgagggcct

SEQ ID NO: 164447 - DNA, 25 bp, Homo sapien
ggccgcctccttgaaagcctgctgc

SEQ ID NO: 164448 - DNA, 25 bp, Homo sapien
ttcggcccgtgggaatcggacttca

SEQ ID NO: 164449 - DNA, 25 bp, Homo sapien
aatcggacttcagctggcggagctc

SEQ ID NO: 164450 - DNA, 25 bp, Homo sapien
cggagctcttcctccagtctccgga

SEQ ID NO: 164451 - DNA, 25 bp, Homo sapien
aggcgggagacggactcctcagacc

SEQ ID NO: 164452 - DNA, 25 bp, Homo sapien
caggacgtggtggacgcaccagccc

SEQ ID NO: 164453 - DNA, 25 bp, Homo sapien
cgagccgggagagcttgccacgcac

SEQ ID NO: 164454 - DNA, 25 bp, Homo sapien
gtgggcacccttctccgaggggctc

SEQ ID NO: 164455 - DNA, 25 bp, Homo sapien
cggcggcttcttcgccacgtcatcc

SEQ ID NO: 164456 - DNA, 25 bp, Homo sapien
aagagaaagttgagcgccctgccga

SEQ ID NO: 164457 - DNA, 25 bp, Homo sapien
ccaccagggcgaggtagaagagaaa

SEQ ID NO: 164458 - DNA, 25 bp, Homo sapien
acctcctccaggacgtggtggacgc

SEQ ID NO: 164459 - DNA, 25 bp, Homo sapien
tccctctgccgggagaagtcctggt

SEQ ID NO: 164460 - DNA, 25 bp, Homo sapien
cccgctatccggttttgtgatggcc

SEQ ID NO: 164461 - DNA, 25 bp, Homo sapien
ctcggcggcctcagttccgtaaaca

SEQ ID NO: 164462 - DNA, 25 bp, Homo sapien
tcgccgctgtttaaatcctgctgga

SEQ ID NO: 164463 - DNA, 25 bp, Homo sapien
tgtttgacctcgaactgccgtcccg

SEQ ID NO: 164464 - DNA, 25 bp, Homo sapien
agctcggctcctagttcatgtcttc

SEQ ID NO: 164465 - DNA, 25 bp, Homo sapien
tctcggaactccatcctgggaaggc

SEQ ID NO: 164466 - DNA, 25 bp, Homo sapien
agcgctcggctttcggagactgaag

SEQ ID NO: 164467 - DNA, 25 bp, Homo sapien
cggcctctctggttcaaactgacga

SEQ ID NO: 164468 - DNA, 25 bp, Homo sapien
gcgccgatcccgactgtagaggtca

SEQ ID NO: 164469 - DNA, 25 bp, Homo sapien
cgagctacaccagagggcgtacttt

SEQ ID NO: 164470 - DNA, 25 bp, Homo sapien
ggaacctttctaccgcgtctctagc

SEQ ID NO: 164471 - DNA, 25 bp, Homo sapien
tctctagctaacacgcacggcgggg

SEQ ID NO: 164472 - DNA, 25 bp, Homo sapien
gcgcggaggttctatctgtttcttc

SEQ ID NO: 164473 - DNA, 25 bp, Homo sapien
cttcctccttcgtgagcagcatgga

SEQ ID NO: 164474 - DNA, 25 bp, Homo sapien
agtttgggaacctgactccggagca

SEQ ID NO: 164475 - DNA, 25 bp, Homo sapien
cgcgcttgcgagtcttttttccaga

SEQ ID NO: 164476 - DNA, 25 bp, Homo sapien
cttcagcctattccagtggcagaga

SEQ ID NO: 164477 - DNA, 25 bp, Homo sapien
ggtgaccgccaccatggcattcggc

SEQ ID NO: 164478 - DNA, 25 bp, Homo sapien
gctgtcattgctgccaggcgcacca

SEQ ID NO: 164479 - DNA, 25 bp, Homo sapien
aggcgaacgcgaacagtcagatctg

SEQ ID NO: 164480 - DNA, 25 bp, Homo sapien
tcccgccgtctgaagaaggctttta

SEQ ID NO: 164481 - DNA, 25 bp, Homo sapien
caggctccatctacgcgctgtcaga

SEQ ID NO: 164482 - DNA, 25 bp, Homo sapien
atccctcaaggactctccgggcggt

SEQ ID NO: 164483 - DNA, 25 bp, Homo sapien
agatctgacttcgaattccgctgtc

SEQ ID NO: 164484 - DNA, 25 bp, Homo sapien
cggccactttatcggggcccgcagg

SEQ ID NO: 164485 - DNA, 25 bp, Homo sapien
catattctaatcacagcgcggccga

SEQ ID NO: 164486 - DNA, 25 bp, Homo sapien
catggtcaaagcacccggggtaatc

SEQ ID NO: 164487 - DNA, 25 bp, Homo sapien
ggctctgcctctgtccatggtcaaa

SEQ ID NO: 164488 - DNA, 25 bp, Homo sapien
tttccgaaggatcgcggaaagccgc

SEQ ID NO: 164489 - DNA, 25 bp, Homo sapien
ccactcagctctgattgtggggagg

SEQ ID NO: 164490 - DNA, 25 bp, Homo sapien
agtctccgtacattgtcccactcag

SEQ ID NO: 164491 - DNA, 25 bp, Homo sapien
tctgcactttcaactccgccgagga

SEQ ID NO: 164492 - DNA, 25 bp, Homo sapien
tcgaggtgccacttgcagaaacttt

SEQ ID NO: 164493 - DNA, 25 bp, Homo sapien
gcgctttcgcttgccctggacacaa

SEQ ID NO: 164494 - DNA, 25 bp, Homo sapien
ctggacacaaagttacgtaaagatg

SEQ ID NO: 164495 - DNA, 25 bp, Homo sapien
ttacgtaaagatgcgctggctcgcg

SEQ ID NO: 164496 - DNA, 25 bp, Homo sapien
ctccggctggtagagacgcgcagct

SEQ ID NO: 164497 - DNA, 25 bp, Homo sapien
tgcagaaactttgccagccgaccgc

SEQ ID NO: 164498 - DNA, 25 bp, Homo sapien
cggacccaggtcctcctagggtatg

SEQ ID NO: 164499 - DNA, 25 bp, Homo sapien
tgacggcttcgcactgcgcctggga

SEQ ID NO: 164500 - DNA, 25 bp, Homo sapien
aggagttccacgcagtagccacgag

SEQ ID NO: 164501 - DNA, 25 bp, Homo sapien
ggctccacaggaccctcaggcactg

SEQ ID NO: 164502 - DNA, 25 bp, Homo sapien
cgatcagcagagtcgttggacaggt

SEQ ID NO: 164503 - DNA, 25 bp, Homo sapien
gagtcgttggacaggtttggacacc

SEQ ID NO: 164504 - DNA, 25 bp, Homo sapien
tcgttggacaggtttggacaccggc

SEQ ID NO: 164505 - DNA, 25 bp, Homo sapien
acgaggagttccacgcagtagccac

SEQ ID NO: 164506 - DNA, 25 bp, Homo sapien
agtagccacgaggtggcaccgcaga

SEQ ID NO: 164507 - DNA, 25 bp, Homo sapien
accacgaggagttccacgcagtagc

SEQ ID NO: 164508 - DNA, 25 bp, Homo sapien
gctgaggcggccaaagtacttcctg

SEQ ID NO: 164509 - DNA, 25 bp, Homo sapien
gtcggtcgcctacgcaacagaagga

SEQ ID NO: 164510 - DNA, 25 bp, Homo sapien
caccggcagctacgtgtttgtggcc

SEQ ID NO: 164511 - DNA, 25 bp, Homo sapien
cccgggtgatcgttgctcagttact

SEQ ID NO: 164512 - DNA, 25 bp, Homo sapien
tgcccacaaggcaaagtgcgtcctg

SEQ ID NO: 164513 - DNA, 25 bp, Homo sapien
ttttaggccaccgagaacttgtgca

SEQ ID NO: 164514 - DNA, 25 bp, Homo sapien
tggagctaagacaatggcccggtcg

SEQ ID NO: 164515 - DNA, 25 bp, Homo sapien
ttcctggagccggatttgagttccc

SEQ ID NO: 164516 - DNA, 25 bp, Homo sapien
tcccagcatgcccttggcgggaatt

SEQ ID NO: 164517 - DNA, 25 bp, Homo sapien
ttgcagtccatttagcggctggttc

SEQ ID NO: 164518 - DNA, 25 bp, Homo sapien
attcggcacgccagtaaattagatg

SEQ ID NO: 164519 - DNA, 25 bp, Homo sapien
ctttccggctggatgactaccaatc

SEQ ID NO: 164520 - DNA, 25 bp, Homo sapien
agcaggacagtcagcgacataacga

SEQ ID NO: 164521 - DNA, 25 bp, Homo sapien
tcgcggtaccacagttcccagcatg

SEQ ID NO: 164522 - DNA, 25 bp, Homo sapien
cgggtcctgagggattacagcgaca

SEQ ID NO: 164523 - DNA, 25 bp, Homo sapien
gccgggttgctctagtcctttgaga

SEQ ID NO: 164524 - DNA, 25 bp, Homo sapien
ccctggacgaagaaagtgctggaga

SEQ ID NO: 164525 - DNA, 25 bp, Homo sapien
gctggagaaactggcgaccgtccca

SEQ ID NO: 164526 - DNA, 25 bp, Homo sapien
tccctaaggcgaaggctctgaattc

SEQ ID NO: 164527 - DNA, 25 bp, Homo sapien
ctctgaattccgaagaccgttactc

SEQ ID NO: 164528 - DNA, 25 bp, Homo sapien
cctcgcccgatttgattggatggtg

SEQ ID NO: 164529 - DNA, 25 bp, Homo sapien
tcgcgcgtgcgcaattgggacacag

SEQ ID NO: 164530 - DNA, 25 bp, Homo sapien
tggggctactcctccttatacgtcg

SEQ ID NO: 164531 - DNA, 25 bp, Homo sapien
tccacatcctgagaggacgcctctg

SEQ ID NO: 164532 - DNA, 25 bp, Homo sapien
tccctgggctgcgattgcgacaggc

SEQ ID NO: 164533 - DNA, 25 bp, Homo sapien
ctcccgatcgggcttccgaagaagg

SEQ ID NO: 164534 - DNA, 25 bp, Homo sapien
cacttcctgagctccgccatgggag

SEQ ID NO: 164535 - DNA, 25 bp, Homo sapien
ttctcctcggtctcagagctgcttc

SEQ ID NO: 164536 - DNA, 25 bp, Homo sapien
tgctctccctgcgaggcttgtccaa

SEQ ID NO: 164537 - DNA, 25 bp, Homo sapien
gaacccgggcatctgccagccggtt

SEQ ID NO: 164538 - DNA, 25 bp, Homo sapien
cagctgtcccttgcgctctctggaa

SEQ ID NO: 164539 - DNA, 25 bp, Homo sapien
tcggtctcagagctgcttctgcggc

SEQ ID NO: 164540 - DNA, 25 bp, Homo sapien
acagttctcagcagcgccaaccagg

SEQ ID NO: 164541 - DNA, 25 bp, Homo sapien
ggtctcaagaagctcccgacagttc

SEQ ID NO: 164542 - DNA, 25 bp, Homo sapien
gggatttcggtcctcggtctcaaga

SEQ ID NO: 164543 - DNA, 25 bp, Homo sapien
tttccagagaaacccggcaggctga

SEQ ID NO: 164544 - DNA, 25 bp, Homo sapien
ggccgcacattcactgtggggcctc

SEQ ID NO: 164545 - DNA, 25 bp, Homo sapien
ggaccgatcaaaaggccgcacattc

SEQ ID NO: 164546 - DNA, 25 bp, Homo sapien
ccacggaagatctccaggaccgatc

SEQ ID NO: 164547 - DNA, 25 bp, Homo sapien
gtcagagcgcgggacacaactacgc

SEQ ID NO: 164548 - DNA, 25 bp, Homo sapien
actacactggctcggaggggtaatc

SEQ ID NO: 164549 - DNA, 25 bp, Homo sapien
agccgacaccttcgcttccaagaga

SEQ ID NO: 164550 - DNA, 25 bp, Homo sapien
tccaagagaattgcctcacccgggg

SEQ ID NO: 164551 - DNA, 25 bp, Homo sapien
gcctggaggcgacgcataacttcga

SEQ ID NO: 164552 - DNA, 25 bp, Homo sapien
accggcacctcacgtttctgaagtg

SEQ ID NO: 164553 - DNA, 25 bp, Homo sapien
cggcagccgcttgatcccaaacttg

SEQ ID NO: 164554 - DNA, 25 bp, Homo sapien
cccttggaagcaaatcgcgttgacc

SEQ ID NO: 164555 - DNA, 25 bp, Homo sapien
ccaggagattcgtcacggaaacctc

SEQ ID NO: 164556 - DNA, 25 bp, Homo sapien
caagtacgagatccagagcgccatg

SEQ ID NO: 164557 - DNA, 25 bp, Homo sapien
tgcgcttcgccaagtgcaccaagta

SEQ ID NO: 164558 - DNA, 25 bp, Homo sapien
tgacactgtcaacactgccctggtg

SEQ ID NO: 164559 - DNA, 25 bp, Homo sapien
tgcacagccggcacaacagctttga

SEQ ID NO: 164560 - DNA, 25 bp, Homo sapien
ggtgcgctcctccaacttgtctttg

SEQ ID NO: 164561 - DNA, 25 bp, Homo sapien
aggcagccgaaagtactaacagttg

SEQ ID NO: 164562 - DNA, 25 bp, Homo sapien
cagggtctgctctgtatattccagc

SEQ ID NO: 164563 - DNA, 25 bp, Homo sapien
tctacaacatgagcagcgccggcgg

SEQ ID NO: 164564 - DNA, 25 bp, Homo sapien
ggcagacgcgggctgaacaataagc

SEQ ID NO: 164565 - DNA, 25 bp, Homo sapien
cctggagttgcagggttgaaagaac

SEQ ID NO: 164566 - DNA, 25 bp, Homo sapien
ataagcaggtccctggagttgcagg

SEQ ID NO: 164567 - DNA, 25 bp, Homo sapien
gctgaacaataagcaggtccctgga

SEQ ID NO: 164568 - DNA, 25 bp, Homo sapien
ctgccgccgctgatggagtggatcc

SEQ ID NO: 164569 - DNA, 25 bp, Homo sapien
gcagcttctccatggacagcgacga

SEQ ID NO: 164570 - DNA, 25 bp, Homo sapien
tggacagcgacgacgtccgccaggc

SEQ ID NO: 164571 - DNA, 25 bp, Homo sapien
gctccctggttgaagtggcagacgc

SEQ ID NO: 164572 - DNA, 25 bp, Homo sapien
ggcgtggccaaagagacaccagaca

SEQ ID NO: 164573 - DNA, 25 bp, Homo sapien
cacgcccttgacttgaggaccatga

SEQ ID NO: 164574 - DNA, 25 bp, Homo sapien
agcctggtttctagcgtgacacgcc

SEQ ID NO: 164575 - DNA, 25 bp, Homo sapien
ggtccctccctatgcagcctggttt

SEQ ID NO: 164576 - DNA, 25 bp, Homo sapien
gccctgtgcagatccctgagcgtgt

SEQ ID NO: 164577 - DNA, 25 bp, Homo sapien
cgtctgaaatgagcgccgacgctgc

SEQ ID NO: 164578 - DNA, 25 bp, Homo sapien
attcggcgcctcagaatgacgtctg

SEQ ID NO: 164579 - DNA, 25 bp, Homo sapien
cggctgcttccgcttccattttgtc

SEQ ID NO: 164580 - DNA, 25 bp, Homo sapien
aagggctgtggattagcccgcccgc

SEQ ID NO: 164581 - DNA, 25 bp, Homo sapien
gacaccgccacccaagggctgtgga

SEQ ID NO: 164582 - DNA, 25 bp, Homo sapien
gggacaagagcggtcaccaaaacca

SEQ ID NO: 164583 - DNA, 25 bp, Homo sapien
catctcggggaacacctggggcctt

SEQ ID NO: 164584 - DNA, 25 bp, Homo sapien
atccggccgggtagaatcgagcgcc

SEQ ID NO: 164585 - DNA, 25 bp, Homo sapien
tcggccgggagttccgcgtctccat

SEQ ID NO: 164586 - DNA, 25 bp, Homo sapien
ctcatccgggcagagttcgcctcgg

SEQ ID NO: 164587 - DNA, 25 bp, Homo sapien
cactgctttgttcctcatccgggca

SEQ ID NO: 164588 - DNA, 25 bp, Homo sapien
gagacgacgtctgtatttgtaggga

SEQ ID NO: 164589 - DNA, 25 bp, Homo sapien
cacgtttcatcgcagggtcttcggg

SEQ ID NO: 164590 - DNA, 25 bp, Homo sapien
ctacgccggagctgcggtttgcaaa

SEQ ID NO: 164591 - DNA, 25 bp, Homo sapien
cccggtgagagctccttaccaagaa

SEQ ID NO: 164592 - DNA, 25 bp, Homo sapien
ttccctctccaaggtagcagcgttg

SEQ ID NO: 164593 - DNA, 25 bp, Homo sapien
agcagcgttgaaaggcttctccaca

SEQ ID NO: 164594 - DNA, 25 bp, Homo sapien
agtcgccagtgaccctgactcaggc

SEQ ID NO: 164595 - DNA, 25 bp, Homo sapien
ttcggggcagaattcggagacacct

SEQ ID NO: 164596 - DNA, 25 bp, Homo sapien
atgcaacagcgacggggagtccaag

SEQ ID NO: 164597 - DNA, 25 bp, Homo sapien
agcgagcgcccgaactggccaggac

SEQ ID NO: 164598 - DNA, 25 bp, Homo sapien
gcgctgccatcgactacatcaagca

SEQ ID NO: 164599 - DNA, 25 bp, Homo sapien
agctggcagacaagcgcctcagcaa

SEQ ID NO: 164600 - DNA, 25 bp, Homo sapien
atggcagtacttgcccgtgccgctg

SEQ ID NO: 164601 - DNA, 25 bp, Homo sapien
ggaacggctggccttgccatactcg

SEQ ID NO: 164602 - DNA, 25 bp, Homo sapien
cctcagcaaagtggagacgctccgc

SEQ ID NO: 164603 - DNA, 25 bp, Homo sapien
gcaaatgatggagacgcgtaaaccg

SEQ ID NO: 164604 - DNA, 25 bp, Homo sapien
caccagagatctggccgagtgggtc

SEQ ID NO: 164605 - DNA, 25 bp, Homo sapien
cttccagtgccggactgccagaaca

SEQ ID NO: 164606 - DNA, 25 bp, Homo sapien
ccggcagatcgcctagcttggctgc

SEQ ID NO: 164607 - DNA, 25 bp, Homo sapien
tgttgctgtccactccggatcctga

SEQ ID NO: 164608 - DNA, 25 bp, Homo sapien
catcagagacgctgggtggacaacg

SEQ ID NO: 164609 - DNA, 25 bp, Homo sapien
ggccaatccaggtggtccgccagac

SEQ ID NO: 164610 - DNA, 25 bp, Homo sapien
cggtgtccacccaacgactctaatg

SEQ ID NO: 164611 - DNA, 25 bp, Homo sapien
ggcagagcctttaggcccacgcctg

SEQ ID NO: 164612 - DNA, 25 bp, Homo sapien
atggccagctacacaggtccggcgg

SEQ ID NO: 164613 - DNA, 25 bp, Homo sapien
acctgccgccggaagaagagcgacg

SEQ ID NO: 164614 - DNA, 25 bp, Homo sapien
acgcgtacacctgccgccggaagaa

SEQ ID NO: 164615 - DNA, 25 bp, Homo sapien
gacggtcgcacagctctcaggccgg

SEQ ID NO: 164616 - DNA, 25 bp, Homo sapien
cgcgcccatccacgcccagccacgc

SEQ ID NO: 164617 - DNA, 25 bp, Homo sapien
cgccgacttggcgatggccagctac

SEQ ID NO: 164618 - DNA, 25 bp, Homo sapien
aagagcgacggtcgcacagctctca

SEQ ID NO: 164619 - DNA, 25 bp, Homo sapien
cgacttggcgatggccagctacaca

SEQ ID NO: 164620 - DNA, 25 bp, Homo sapien
ctgctgcaattcaaggcgcacacta

SEQ ID NO: 164621 - DNA, 25 bp, Homo sapien
cggagacccttcaggtaaggactca

SEQ ID NO: 164622 - DNA, 25 bp, Homo sapien
gagctggtgcgaaatgtcttctgcc

SEQ ID NO: 164623 - DNA, 25 bp, Homo sapien
ctgggcttcgctttccagacgcttc

SEQ ID NO: 164624 - DNA, 25 bp, Homo sapien
cagagtttgcaagtggcggagaccc

SEQ ID NO: 164625 - DNA, 25 bp, Homo sapien
ccaggtggcatgcaaggagttaagc

SEQ ID NO: 164626 - DNA, 25 bp, Homo sapien
ccttggtggcgagaaaggaaatcca

SEQ ID NO: 164627 - DNA, 25 bp, Homo sapien
gcgcctgctgagctcagctggcaga

SEQ ID NO: 164628 - DNA, 25 bp, Homo sapien
agccacaagctcctggtgccagata

SEQ ID NO: 164629 - DNA, 25 bp, Homo sapien
tgtggtgcctcccaaccaatcgcta

SEQ ID NO: 164630 - DNA, 25 bp, Homo sapien
cgaccatagtttgcgctccagtctg

SEQ ID NO: 164631 - DNA, 25 bp, Homo sapien
tccttcagtgatcaatgcgaccata

SEQ ID NO: 164632 - DNA, 25 bp, Homo sapien
ccggcctccgcctttattagtgctg

SEQ ID NO: 164633 - DNA, 25 bp, Homo sapien
gcagctgctgcattgcgccattttc

SEQ ID NO: 164634 - DNA, 25 bp, Homo sapien
ggtctagctgcgctggaacttactg

SEQ ID NO: 164635 - DNA, 25 bp, Homo sapien
ggagcctcgagacacagccacaagc

SEQ ID NO: 164636 - DNA, 25 bp, Homo sapien
ctcccgctgcttattggctgctacg

SEQ ID NO: 164637 - DNA, 25 bp, Homo sapien
agagattcgcgcctcccagaacgca

SEQ ID NO: 164638 - DNA, 25 bp, Homo sapien
cagcggctccgggacgaagagaccc

SEQ ID NO: 164639 - DNA, 25 bp, Homo sapien
agttctccctttctagggaagtgtg

SEQ ID NO: 164640 - DNA, 25 bp, Homo sapien
tcttggaggggactcagaccggtcc

SEQ ID NO: 164641 - DNA, 25 bp, Homo sapien
gacaagtggggaaagccaatccgcc

SEQ ID NO: 164642 - DNA, 25 bp, Homo sapien
acgcaagcaacaaccaatgggagtg

SEQ ID NO: 164643 - DNA, 25 bp, Homo sapien
tggctgctacgtgaacgagacaaac

SEQ ID NO: 164644 - DNA, 25 bp, Homo sapien
tgaagccgaggtttcggccgcagtc

SEQ ID NO: 164645 - DNA, 25 bp, Homo sapien
aagactggaagatgcccgctgccca

SEQ ID NO: 164646 - DNA, 25 bp, Homo sapien
agtcgccatcttgcgcttctaatga

SEQ ID NO: 164647 - DNA, 25 bp, Homo sapien
ttgggcccagccttggactcagcct

SEQ ID NO: 164648 - DNA, 25 bp, Homo sapien
ggtttgcagccttggcggctttatc

SEQ ID NO: 164649 - DNA, 25 bp, Homo sapien
cgcttctaatgactctcgggtcttc

SEQ ID NO: 164650 - DNA, 25 bp, Homo sapien
ggacccgaggacctgaaagactgga

SEQ ID NO: 164651 - DNA, 25 bp, Homo sapien
ggtcttgtatgtcgcagcggccaca

SEQ ID NO: 164652 - DNA, 25 bp, Homo sapien
ggcccgactctatcacaagaaggta

SEQ ID NO: 164653 - DNA, 25 bp, Homo sapien
cggaatgccgactcagcggaggcct

SEQ ID NO: 164654 - DNA, 25 bp, Homo sapien
gcgacttcgtgcgtcccaattttaa

SEQ ID NO: 164655 - DNA, 25 bp, Homo sapien
taaacaacagttaccgctcatcggg

SEQ ID NO: 164656 - DNA, 25 bp, Homo sapien
gtgaggctcactgcaactgataaac

SEQ ID NO: 164657 - DNA, 25 bp, Homo sapien
ctcgctttcccttgctgcgcagtga

SEQ ID NO: 164658 - DNA, 25 bp, Homo sapien
acaaaagagggacgcgcggaatgcc

SEQ ID NO: 164659 - DNA, 25 bp, Homo sapien
aggcgcaaagcttcggtgacgtcag

SEQ ID NO: 164660 - DNA, 25 bp, Homo sapien
gccaggagcgttccggacctcgaaa

SEQ ID NO: 164661 - DNA, 25 bp, Homo sapien
caaagccaggaaacccgcaggccag

SEQ ID NO: 164662 - DNA, 25 bp, Homo sapien
ggcgcaggcacatgctcagaggaca

SEQ ID NO: 164663 - DNA, 25 bp, Homo sapien
cacatgctcagaggacaggtccgcc

SEQ ID NO: 164664 - DNA, 25 bp, Homo sapien
ccgctctccagtcatctgagtggta

SEQ ID NO: 164665 - DNA, 25 bp, Homo sapien
tcatctgagtggtagagggccacgc

SEQ ID NO: 164666 - DNA, 25 bp, Homo sapien
tggtctcgcacccaaagccaggaaa

SEQ ID NO: 164667 - DNA, 25 bp, Homo sapien
ccctctggtcgcaccgagggatgca

SEQ ID NO: 164668 - DNA, 25 bp, Homo sapien
cccgaaggcacttgcgcagaggtcc

SEQ ID NO: 164669 - DNA, 25 bp, Homo sapien
ctcctccagacggtacacgacgggg

SEQ ID NO: 164670 - DNA, 25 bp, Homo sapien
tccagacggtacacgacggggcgtc

SEQ ID NO: 164671 - DNA, 25 bp, Homo sapien
ctgcatcggcccgaaggcacttgcg

SEQ ID NO: 164672 - DNA, 25 bp, Homo sapien
cacttgcgcagaggtccggcaggca

SEQ ID NO: 164673 - DNA, 25 bp, Homo sapien
aggcagcagagcaccttgtgggcgt

SEQ ID NO: 164674 - DNA, 25 bp, Homo sapien
ccggcagacactccgggcctgcagc

SEQ ID NO: 164675 - DNA, 25 bp, Homo sapien
cagtgggcgtctgcatcggcccgaa

SEQ ID NO: 164676 - DNA, 25 bp, Homo sapien
agggcacaggcgtccgcagaacccg

SEQ ID NO: 164677 - DNA, 25 bp, Homo sapien
cagtctcagcgggttccggcttagt

SEQ ID NO: 164678 - DNA, 25 bp, Homo sapien
gcccagtcctgtctgtccgaagcga

SEQ ID NO: 164679 - DNA, 25 bp, Homo sapien
acatctcaggggaatagggtctcgg

SEQ ID NO: 164680 - DNA, 25 bp, Homo sapien
ggcccagggacatctcaggggaata

SEQ ID NO: 164681 - DNA, 25 bp, Homo sapien
cattaagaatcacgcgctccgggca

SEQ ID NO: 164682 - DNA, 25 bp, Homo sapien
tgggcctttccattaagaatcacgc

SEQ ID NO: 164683 - DNA, 25 bp, Homo sapien
ctgccaccaccgtttgcatatgggc

SEQ ID NO: 164684 - DNA, 25 bp, Homo sapien
agacgtctcgagctagagccgccac

SEQ ID NO: 164685 - DNA, 25 bp, Homo sapien
ggtcgatcacgtccctcgcgcgccc

SEQ ID NO: 164686 - DNA, 25 bp, Homo sapien
agggcgccacagacgtctcgagcta

SEQ ID NO: 164687 - DNA, 25 bp, Homo sapien
cacagacgtctcgagctagagccgc

SEQ ID NO: 164688 - DNA, 25 bp, Homo sapien
aggcctcggctggtcgatcacgtcc

SEQ ID NO: 164689 - DNA, 25 bp, Homo sapien
tctcgagctagagccgccaccgcca

SEQ ID NO: 164690 - DNA, 25 bp, Homo sapien
gcgcgcaggcctcagtgcgcggagt

SEQ ID NO: 164691 - DNA, 25 bp, Homo sapien
gcgccacagacgtctcgagctagag

SEQ ID NO: 164692 - DNA, 25 bp, Homo sapien
gactgcggccgcaggttccgctgtc

SEQ ID NO: 164693 - DNA, 25 bp, Homo sapien
cccgtgacggctttttcatgcccta

SEQ ID NO: 164694 - DNA, 25 bp, Homo sapien
gcctgttgctaagggaaaagaaaga

SEQ ID NO: 164695 - DNA, 25 bp, Homo sapien
ccctgggagctgtcctgcggtctac

SEQ ID NO: 164696 - DNA, 25 bp, Homo sapien
gctgtctcgggaaccgtcgtatccc

SEQ ID NO: 164697 - DNA, 25 bp, Homo sapien
ttcaggcctccggtgcggctgcaat

SEQ ID NO: 164698 - DNA, 25 bp, Homo sapien
tcatgccctagttggggtctccagg

SEQ ID NO: 164699 - DNA, 25 bp, Homo sapien
acgtggtccgtcagctattgctctc

SEQ ID NO: 164700 - DNA, 25 bp, Homo sapien
cgggtaaaccgcacgcaaaattctg

SEQ ID NO: 164701 - DNA, 25 bp, Homo sapien
cgattcagaagcgagacgcaaagag

SEQ ID NO: 164702 - DNA, 25 bp, Homo sapien
tgatatcactgcaacacgtccgtgg

SEQ ID NO: 164703 - DNA, 25 bp, Homo sapien
agtgctctagcatcgcagctccggc

SEQ ID NO: 164704 - DNA, 25 bp, Homo sapien
ggcgcagatcggaatcccgcagtca

SEQ ID NO: 164705 - DNA, 25 bp, Homo sapien
gcagtcaccctggtggcctcgtggt

SEQ ID NO: 164706 - DNA, 25 bp, Homo sapien
aatcggtcgcgtcacttccggagca

SEQ ID NO: 164707 - DNA, 25 bp, Homo sapien
agcacgctgggaactacggcaggct

SEQ ID NO: 164708 - DNA, 25 bp, Homo sapien
aggatcgcgcctctgactcggtaaa

SEQ ID NO: 164709 - DNA, 25 bp, Homo sapien
tgcaggccatcccagccaagaaggc

SEQ ID NO: 164710 - DNA, 25 bp, Homo sapien
ctgttccacaaatgggcgtcttctg

SEQ ID NO: 164711 - DNA, 25 bp, Homo sapien
tccgcttttgctgggacctgttcca

SEQ ID NO: 164712 - DNA, 25 bp, Homo sapien
ttgccgcgaaaagaccacgtgggga

SEQ ID NO: 164713 - DNA, 25 bp, Homo sapien
tgatcggccagaagacgctctactc

SEQ ID NO: 164714 - DNA, 25 bp, Homo sapien
cgccatgctaaagggccagccaatg

SEQ ID NO: 164715 - DNA, 25 bp, Homo sapien
cgtgttcaaaatagccgccgctgtc

SEQ ID NO: 164716 - DNA, 25 bp, Homo sapien
gcccgtcgtggctacgttctgccaa

SEQ ID NO: 164717 - DNA, 25 bp, Homo sapien
atttcttcggggaacatggcgtgcc

SEQ ID NO: 164718 - DNA, 25 bp, Homo sapien
gaggaaggcatttcttcggggaaca

SEQ ID NO: 164719 - DNA, 25 bp, Homo sapien
ccagaggggtaactaacggcctgag

SEQ ID NO: 164720 - DNA, 25 bp, Homo sapien
ggagcaccggctgccagctgagacc

SEQ ID NO: 164721 - DNA, 25 bp, Homo sapien
tccgagcaccgtggagcaccggctg

SEQ ID NO: 164722 - DNA, 25 bp, Homo sapien
ccgctcagtggaacggcccaaccct

SEQ ID NO: 164723 - DNA, 25 bp, Homo sapien
ttctgccaagccctgtgacgttgga

SEQ ID NO: 164724 - DNA, 25 bp, Homo sapien
cggcggcttcacccgcgagtcccaa

SEQ ID NO: 164725 - DNA, 25 bp, Homo sapien
aaggcaagcgagcggctgggtcgcc

SEQ ID NO: 164726 - DNA, 25 bp, Homo sapien
caagcgagcggctgggtcgccccca

SEQ ID NO: 164727 - DNA, 25 bp, Homo sapien
ccgcggcagccagtcaagagcctgc

SEQ ID NO: 164728 - DNA, 25 bp, Homo sapien
ccgtgggcaacggaaatcttcaccg

SEQ ID NO: 164729 - DNA, 25 bp, Homo sapien
gcggcttcacccgcgagtcccaagg

SEQ ID NO: 164730 - DNA, 25 bp, Homo sapien
cggcttcacccgcgagtcccaaggc

SEQ ID NO: 164731 - DNA, 25 bp, Homo sapien
ggcggcttcacccgcgagtcccaag

SEQ ID NO: 164732 - DNA, 25 bp, Homo sapien
atcctgggacaactggacagctcca

SEQ ID NO: 164733 - DNA, 25 bp, Homo sapien
gcagatcctgggacaactggacagc

SEQ ID NO: 164734 - DNA, 25 bp, Homo sapien
tgggccagcagatcctgggacaact

SEQ ID NO: 164735 - DNA, 25 bp, Homo sapien
agctgagtacggctacatccggacc

SEQ ID NO: 164736 - DNA, 25 bp, Homo sapien
cccagctgagtacggctacatccgg

SEQ ID NO: 164737 - DNA, 25 bp, Homo sapien
caagagcctgcggatccaggagcag

SEQ ID NO: 164738 - DNA, 25 bp, Homo sapien
tgggacaactggacagctccagcct

SEQ ID NO: 164739 - DNA, 25 bp, Homo sapien
cagtcaagagcctgcggatccagga

SEQ ID NO: 164740 - DNA, 25 bp, Homo sapien
tccgggtcgcgacctggctgtcctg

SEQ ID NO: 164741 - DNA, 25 bp, Homo sapien
ggcgctctaggactgcatctcggcc

SEQ ID NO: 164742 - DNA, 25 bp, Homo sapien
ctcatttcggctgccgaagctcagc

SEQ ID NO: 164743 - DNA, 25 bp, Homo sapien
tgcatttcgggatggagcaagcgca

SEQ ID NO: 164744 - DNA, 25 bp, Homo sapien
caagcgcagcgcgaagttgggcgcc

SEQ ID NO: 164745 - DNA, 25 bp, Homo sapien
aggactgcatctcggcctccgggtc

SEQ ID NO: 164746 - DNA, 25 bp, Homo sapien
tcgcgacctggctgtcctgctgggt

SEQ ID NO: 164747 - DNA, 25 bp, Homo sapien
cgcagctcatttcggctgccgaagc

SEQ ID NO: 164748 - DNA, 25 bp, Homo sapien
aactcatctggccaagtgacagcca

SEQ ID NO: 164749 - DNA, 25 bp, Homo sapien
tccggcctgctcgtaactcatctgg

SEQ ID NO: 164750 - DNA, 25 bp, Homo sapien
ccgtgtcagtggcagcagttggtcc

SEQ ID NO: 164751 - DNA, 25 bp, Homo sapien
cccggcatcccattgtgtgacaaac

SEQ ID NO: 164752 - DNA, 25 bp, Homo sapien
cattgtgtgacaaacgactgttgcc

SEQ ID NO: 164753 - DNA, 25 bp, Homo sapien
cccattgtcccagggtctcagtgca

SEQ ID NO: 164754 - DNA, 25 bp, Homo sapien
cccagggtctcagtgcaattgtttc

SEQ ID NO: 164755 - DNA, 25 bp, Homo sapien
ctcagtgcaattgtttctgcagccc

SEQ ID NO: 164756 - DNA, 25 bp, Homo sapien
ctcaagcctccgttgcagtaattgc

SEQ ID NO: 164757 - DNA, 25 bp, Homo sapien
tgacaacaactgcatgcccgagagc

SEQ ID NO: 164758 - DNA, 25 bp, Homo sapien
tttcggccaagggaattaagttgca

SEQ ID NO: 164759 - DNA, 25 bp, Homo sapien
aggaggctgggtgcattaaaacttg

SEQ ID NO: 164760 - DNA, 25 bp, Homo sapien
taaaacttgcaatcccgcctggggc

SEQ ID NO: 164761 - DNA, 25 bp, Homo sapien
cgggcggagagatctgttgcaaccc

SEQ ID NO: 164762 - DNA, 25 bp, Homo sapien
gaaagtttgcgtttctggcgcccta

SEQ ID NO: 164763 - DNA, 25 bp, Homo sapien
ccacggcagcaacgatattaggcac

SEQ ID NO: 164764 - DNA, 25 bp, Homo sapien
cccgcagagggcaacgtcttaagcc

SEQ ID NO: 164765 - DNA, 25 bp, Homo sapien
ctccggcgaataaaggtcggcctgc

SEQ ID NO: 164766 - DNA, 25 bp, Homo sapien
gtcttaagccgtccgttgtgcgcct

SEQ ID NO: 164767 - DNA, 25 bp, Homo sapien
ggcatttatcccacctccgctattt

SEQ ID NO: 164768 - DNA, 25 bp, Homo sapien
gcgaagaagctctgcggaactgtca

SEQ ID NO: 164769 - DNA, 25 bp, Homo sapien
ttttccggaactggatgcttgcttc

SEQ ID NO: 164770 - DNA, 25 bp, Homo sapien
tggcggggttctgaaagcgaacacc

SEQ ID NO: 164771 - DNA, 25 bp, Homo sapien
aactcgggtgttttgggctgagaca

SEQ ID NO: 164772 - DNA, 25 bp, Homo sapien
gccaaagccgcgtcctggagcaaac

SEQ ID NO: 164773 - DNA, 25 bp, Homo sapien
cgaaagcccgcgattcgtgcggaga

SEQ ID NO: 164774 - DNA, 25 bp, Homo sapien
agccatagccgcaggtctcaatctg

SEQ ID NO: 164775 - DNA, 25 bp, Homo sapien
gtcggtgctcagaaccctagccata

SEQ ID NO: 164776 - DNA, 25 bp, Homo sapien
agcgcctttctgtttgccgtgggca

SEQ ID NO: 164777 - DNA, 25 bp, Homo sapien
agcgggcgcgttcagaagcgccttt

SEQ ID NO: 164778 - DNA, 25 bp, Homo sapien
ccgctgctaggcaaaggtgagttct

SEQ ID NO: 164779 - DNA, 25 bp, Homo sapien
cttcagtcccgcgaccgaagcaggg

SEQ ID NO: 164780 - DNA, 25 bp, Homo sapien
tcggcttggctgcaacacctattga

SEQ ID NO: 164781 - DNA, 25 bp, Homo sapien
cgcgccaccgctcaggtttcaattt

SEQ ID NO: 164782 - DNA, 25 bp, Homo sapien
tggctggcctgaagtacaacgcctc

SEQ ID NO: 164783 - DNA, 25 bp, Homo sapien
acggcaggtgttcgagttgcccttc

SEQ ID NO: 164784 - DNA, 25 bp, Homo sapien
atggcgacgacaccacgattcacgg

SEQ ID NO: 164785 - DNA, 25 bp, Homo sapien
cctcacggcggtgtgacgtacccat

SEQ ID NO: 164786 - DNA, 25 bp, Homo sapien
tcagaacagcgtggagacgtcacct

SEQ ID NO: 164787 - DNA, 25 bp, Homo sapien
cccacgttgccatggtgacgtcaga

SEQ ID NO: 164788 - DNA, 25 bp, Homo sapien
ctcctggaagtaggctagggcccgt

SEQ ID NO: 164789 - DNA, 25 bp, Homo sapien
aaatagagcggagctgctgggaaca

SEQ ID NO: 164790 - DNA, 25 bp, Homo sapien
cagccgcttagaggcctgaaacagg

SEQ ID NO: 164791 - DNA, 25 bp, Homo sapien
aggctagggcccgtctataatcagc

SEQ ID NO: 164792 - DNA, 25 bp, Homo sapien
tcctgtcctagataaggcggcgggt

SEQ ID NO: 164793 - DNA, 25 bp, Homo sapien
ataatcagcccgtccgctggatacg

SEQ ID NO: 164794 - DNA, 25 bp, Homo sapien
gccgagcagccgcttagaggcctga

SEQ ID NO: 164795 - DNA, 25 bp, Homo sapien
ggccagctcctgtcctagataaggc

SEQ ID NO: 164796 - DNA, 25 bp, Homo sapien
gcgagcgagaggaagcaacaaagac

SEQ ID NO: 164797 - DNA, 25 bp, Homo sapien
ccggtgcattctcgccgctgttctt

SEQ ID NO: 164798 - DNA, 25 bp, Homo sapien
aggagacaatccctccacctcgggg

SEQ ID NO: 164799 - DNA, 25 bp, Homo sapien
gccgctgttctttgcaacctgcagg

SEQ ID NO: 164800 - DNA, 25 bp, Homo sapien
aggctgcatccgagcttgcgtcgcc

SEQ ID NO: 164801 - DNA, 25 bp, Homo sapien
ggcttgcgagctcgcacacccggtg

SEQ ID NO: 164802 - DNA, 25 bp, Homo sapien
cccggcgaagatgcgtcgcctgagc

SEQ ID NO: 164803 - DNA, 25 bp, Homo sapien
cgccactgggatcggctgtttctca

SEQ ID NO: 164804 - DNA, 25 bp, Homo sapien
gcgcgcacaaaagggccgctttatt

SEQ ID NO: 164805 - DNA, 25 bp, Homo sapien
gttaacccatttgcgtgtcaagagc

SEQ ID NO: 164806 - DNA, 25 bp, Homo sapien
cgtaattcaatcaggcggcgattcc

SEQ ID NO: 164807 - DNA, 25 bp, Homo sapien
tgagaacgaggaggcgcgcacaaaa

SEQ ID NO: 164808 - DNA, 25 bp, Homo sapien
gtcaagagctattgggcgctttctc

SEQ ID NO: 164809 - DNA, 25 bp, Homo sapien
cgctttctctgcctgtgcgttgcgg

SEQ ID NO: 164810 - DNA, 25 bp, Homo sapien
ggccgggaattgctgctctctccca

SEQ ID NO: 164811 - DNA, 25 bp, Homo sapien
gccggagccgctttattgtgttaac

SEQ ID NO: 164812 - DNA, 25 bp, Homo sapien
ggctccgattcgatcttgctccgtg

SEQ ID NO: 164813 - DNA, 25 bp, Homo sapien
ggagatccgcgcttcctgaatcccg

SEQ ID NO: 164814 - DNA, 25 bp, Homo sapien
cctggaaaatgggtgtcgcgatccc

SEQ ID NO: 164815 - DNA, 25 bp, Homo sapien
gctctagttggaatcggctccgatt

SEQ ID NO: 164816 - DNA, 25 bp, Homo sapien
atcttgctccgtgacttcgggccgc

SEQ ID NO: 164817 - DNA, 25 bp, Homo sapien
cgccctgggactgtgtcctagtctc

SEQ ID NO: 164818 - DNA, 25 bp, Homo sapien
ctagtctctaaatgggcgtcccggc

SEQ ID NO: 164819 - DNA, 25 bp, Homo sapien
acggtctttggagagggctctagtt

SEQ ID NO: 164820 - DNA, 25 bp, Homo sapien
gattacgcagataagcgcctgcccg

SEQ ID NO: 164821 - DNA, 25 bp, Homo sapien
ggtcaacattgaacgattacgcaga

SEQ ID NO: 164822 - DNA, 25 bp, Homo sapien
cggcacaatggggacagcgccacct

SEQ ID NO: 164823 - DNA, 25 bp, Homo sapien
gggctcaagcgcaggcgctcaatgc

SEQ ID NO: 164824 - DNA, 25 bp, Homo sapien
aagcgcaggcgctcaatgcgcaggc

SEQ ID NO: 164825 - DNA, 25 bp, Homo sapien
actgaagggtcgtgtccccatataa

SEQ ID NO: 164826 - DNA, 25 bp, Homo sapien
aacctcctgcaaacgacggtaattg

SEQ ID NO: 164827 - DNA, 25 bp, Homo sapien
acgacggtaattgggtcaacattga

SEQ ID NO: 164828 - DNA, 25 bp, Homo sapien
agacagccatcttgggccttaccca

SEQ ID NO: 164829 - DNA, 25 bp, Homo sapien
atcttgggccttacccaggcagctg

SEQ ID NO: 164830 - DNA, 25 bp, Homo sapien
ccgccaacttcacacgagtactaag

SEQ ID NO: 164831 - DNA, 25 bp, Homo sapien
tcacacgagtactaaggcgaagaca

SEQ ID NO: 164832 - DNA, 25 bp, Homo sapien
cacgagtactaaggcgaagacagcc

SEQ ID NO: 164833 - DNA, 25 bp, Homo sapien
tactaaggcgaagacagccatcttg

SEQ ID NO: 164834 - DNA, 25 bp, Homo sapien
gcgaagacagccatcttgggcctta

SEQ ID NO: 164835 - DNA, 25 bp, Homo sapien
ttgggccttacccaggcagctgtgg

SEQ ID NO: 164836 - DNA, 25 bp, Homo sapien
ctccattccggctcaccgaagaagg

SEQ ID NO: 164837 - DNA, 25 bp, Homo sapien
ttcgctacaaccgacgaggacgctc

SEQ ID NO: 164838 - DNA, 25 bp, Homo sapien
tggtcacggttctctttcgctacaa

SEQ ID NO: 164839 - DNA, 25 bp, Homo sapien
ctcctgttggtcacggttctctttc

SEQ ID NO: 164840 - DNA, 25 bp, Homo sapien
gtggacactgctctcctgttggtca

SEQ ID NO: 164841 - DNA, 25 bp, Homo sapien
agggcccaagtgagccgctcccagg

SEQ ID NO: 164842 - DNA, 25 bp, Homo sapien
ccagcagcgccatttcggggtcgag

SEQ ID NO: 164843 - DNA, 25 bp, Homo sapien
cttcagcaagtgttcggccagcagc

SEQ ID NO: 164844 - DNA, 25 bp, Homo sapien
gtctcgagaccgaggtcacacgtta

SEQ ID NO: 164845 - DNA, 25 bp, Homo sapien
aaagtatgtgaagcttgccacggtc

SEQ ID NO: 164846 - DNA, 25 bp, Homo sapien
tgcaaagactgatccactggcggct

SEQ ID NO: 164847 - DNA, 25 bp, Homo sapien
cccatttgttgcacgtgcatgttca

SEQ ID NO: 164848 - DNA, 25 bp, Homo sapien
ctgtagcgcgtctgggaattacacc

SEQ ID NO: 164849 - DNA, 25 bp, Homo sapien
acacaggctccctacgcgctgaagg

SEQ ID NO: 164850 - DNA, 25 bp, Homo sapien
cgacggggcaccagagaaaaacaca

SEQ ID NO: 164851 - DNA, 25 bp, Homo sapien
tgctatttatctcccgctggccacg

SEQ ID NO: 164852 - DNA, 25 bp, Homo sapien
ttgcagccttggcacagcacgcacg

SEQ ID NO: 164853 - DNA, 25 bp, Homo sapien
aggccgcccagggacctcttcgttg

SEQ ID NO: 164854 - DNA, 25 bp, Homo sapien
ttcgttgcgaccctagccgcgggat

SEQ ID NO: 164855 - DNA, 25 bp, Homo sapien
cgctgctccggagccgtttcgacat

SEQ ID NO: 164856 - DNA, 25 bp, Homo sapien
gcttccgctctaacgggtcccagct

SEQ ID NO: 164857 - DNA, 25 bp, Homo sapien
gggacctcttcgttgcgaccctagc

SEQ ID NO: 164858 - DNA, 25 bp, Homo sapien
cggagccgtttcgacatggctccca

SEQ ID NO: 164859 - DNA, 25 bp, Homo sapien
agccgcgggatgcagcctgacctga

SEQ ID NO: 164860 - DNA, 25 bp, Homo sapien
gcgtgatcgagtgccgtgtcacacg

SEQ ID NO: 164861 - DNA, 25 bp, Homo sapien
acacgcagcccaggaaacaaacacg

SEQ ID NO: 164862 - DNA, 25 bp, Homo sapien
agccgatccatcaggcggccgacag

SEQ ID NO: 164863 - DNA, 25 bp, Homo sapien
caaaggctgggccaaggtgcctcgt

SEQ ID NO: 164864 - DNA, 25 bp, Homo sapien
cgtaacaggctctgtggcaaaggct

SEQ ID NO: 164865 - DNA, 25 bp, Homo sapien
ggtgggaaatccgtaacaggctctg

SEQ ID NO: 164866 - DNA, 25 bp, Homo sapien
ctcctcttctgagccgtgagctggg

SEQ ID NO: 164867 - DNA, 25 bp, Homo sapien
acgccgcgcgaaaggtattggtgaa

SEQ ID NO: 164868 - DNA, 25 bp, Homo sapien
tctggggcatacttgtgccgctgca

SEQ ID NO: 164869 - DNA, 25 bp, Homo sapien
gtggccgaccattcgcgctttcatt

SEQ ID NO: 164870 - DNA, 25 bp, Homo sapien
tgtccgtgtagccacccaaccgtgt

SEQ ID NO: 164871 - DNA, 25 bp, Homo sapien
cggccacagttcgtttctcggtcgg

SEQ ID NO: 164872 - DNA, 25 bp, Homo sapien
ctgtggtctacccagtgtctgtctc

SEQ ID NO: 164873 - DNA, 25 bp, Homo sapien
tgaccgtgtacgacgaggacgactc

SEQ ID NO: 164874 - DNA, 25 bp, Homo sapien
tgcaaactcgtaagcacagtcatcg

SEQ ID NO: 164875 - DNA, 25 bp, Homo sapien
gcagctgcagcaggacgtaagcaca

SEQ ID NO: 164876 - DNA, 25 bp, Homo sapien
tgcggtggttcgctctccgcacttc

SEQ ID NO: 164877 - DNA, 25 bp, Homo sapien
ttgctcgccggcctcagggcaggca

SEQ ID NO: 164878 - DNA, 25 bp, Homo sapien
gcgacgaggaccaggttacggcctc

SEQ ID NO: 164879 - DNA, 25 bp, Homo sapien
ccctgcacctcctagtctggaaaaa

SEQ ID NO: 164880 - DNA, 25 bp, Homo sapien
ctggaaaaacgactaccggcagctc

SEQ ID NO: 164881 - DNA, 25 bp, Homo sapien
cgcacttccctgtttggggcagtta

SEQ ID NO: 164882 - DNA, 25 bp, Homo sapien
cagttaggtccgcagaagtctgtcc

SEQ ID NO: 164883 - DNA, 25 bp, Homo sapien
aagtctgtccgcgagctgtcagcgc

SEQ ID NO: 164884 - DNA, 25 bp, Homo sapien
gcttctgcctaagatttgttccgga

SEQ ID NO: 164885 - DNA, 25 bp, Homo sapien
gatcaactttccgtctgtgccaacg

SEQ ID NO: 164886 - DNA, 25 bp, Homo sapien
cgtcctggtctaagttccgcttctg

SEQ ID NO: 164887 - DNA, 25 bp, Homo sapien
gcgcgcgtcattgccatggtaactg

SEQ ID NO: 164888 - DNA, 25 bp, Homo sapien
agagaggccacttccgtcgcaagcc

SEQ ID NO: 164889 - DNA, 25 bp, Homo sapien
cggtaacgctggacgcagcatcttc

SEQ ID NO: 164890 - DNA, 25 bp, Homo sapien
cagaggccaaggtacagccacggta

SEQ ID NO: 164891 - DNA, 25 bp, Homo sapien
cgcgattaccgttctgctgtggtta

SEQ ID NO: 164892 - DNA, 25 bp, Homo sapien
acgcacgtcctggttttcattgttc

SEQ ID NO: 164893 - DNA, 25 bp, Homo sapien
agtgacgtaactctacggcctagca

SEQ ID NO: 164894 - DNA, 25 bp, Homo sapien
gcaaccgttgccaaggagctcgact

SEQ ID NO: 164895 - DNA, 25 bp, Homo sapien
tttgaggtaacctcgccaactcgcg

SEQ ID NO: 164896 - DNA, 25 bp, Homo sapien
gtcctctctcggtcctgatgcagca

SEQ ID NO: 164897 - DNA, 25 bp, Homo sapien
ctgatgcagcacctcgcaagtggaa

SEQ ID NO: 164898 - DNA, 25 bp, Homo sapien
ggacactatttctggtactcccagg

SEQ ID NO: 164899 - DNA, 25 bp, Homo sapien
gcagcacggtttctctcccaaattg

SEQ ID NO: 164900 - DNA, 25 bp, Homo sapien
cctctgatcgcctcaagagagcggg

SEQ ID NO: 164901 - DNA, 25 bp, Homo sapien
ctgagcctggaacaggtcaagaagc

SEQ ID NO: 164902 - DNA, 25 bp, Homo sapien
cacttcggcgtcaacgagagtacgg

SEQ ID NO: 164903 - DNA, 25 bp, Homo sapien
ggagaacgcgcacaccaagacggtg

SEQ ID NO: 164904 - DNA, 25 bp, Homo sapien
tgggtcagagaaccgcaggcacaga

SEQ ID NO: 164905 - DNA, 25 bp, Homo sapien
cccgaagccatggagaacgcgcaca

SEQ ID NO: 164906 - DNA, 25 bp, Homo sapien
aggcagcggccgataaatgctatta

SEQ ID NO: 164907 - DNA, 25 bp, Homo sapien
ccgcaggcacagaagagggtaccca

SEQ ID NO: 164908 - DNA, 25 bp, Homo sapien
gcagcactgactcgaaaagccggta

SEQ ID NO: 164909 - DNA, 25 bp, Homo sapien
gccatgtcccgcacgtggtctatca

SEQ ID NO: 164910 - DNA, 25 bp, Homo sapien
cgcctcaactcacgggttgttatta

SEQ ID NO: 164911 - DNA, 25 bp, Homo sapien
tgaacccaacttgcgctccgaagtc

SEQ ID NO: 164912 - DNA, 25 bp, Homo sapien
ggtctatcacattcatcctgctctg

SEQ ID NO: 164913 - DNA, 25 bp, Homo sapien
ggtgcctcaggaaaccctcgcctgg

SEQ ID NO: 164914 - DNA, 25 bp, Homo sapien
ttagggaagactccaaaatggcggc

SEQ ID NO: 164915 - DNA, 25 bp, Homo sapien
agcctctgccttctatgtctccaag

SEQ ID NO: 164916 - DNA, 25 bp, Homo sapien
cggccttgcagttccgcttctggtt

SEQ ID NO: 164917 - DNA, 25 bp, Homo sapien
gatccaggtacagcggagcgcttcc

SEQ ID NO: 164918 - DNA, 25 bp, Homo sapien
cccagaggagcaggatccaggtaca

SEQ ID NO: 164919 - DNA, 25 bp, Homo sapien
acacacacggtttctctctgctctt

SEQ ID NO: 164920 - DNA, 25 bp, Homo sapien
ttctctcggcacacacacggtttct

SEQ ID NO: 164921 - DNA, 25 bp, Homo sapien
acagcggagcgcttccggtctggca

SEQ ID NO: 164922 - DNA, 25 bp, Homo sapien
cggacgtggagcttccggccttgca

SEQ ID NO: 164923 - DNA, 25 bp, Homo sapien
gcccgggtttcaacccagaggagca

SEQ ID NO: 164924 - DNA, 25 bp, Homo sapien
ctgtctaagcttggatacctgagta

SEQ ID NO: 164925 - DNA, 25 bp, Homo sapien
tttgcgtgcagacgtttgacctgta

SEQ ID NO: 164926 - DNA, 25 bp, Homo sapien
gtgaccctcgcgatttgcaaatgtg

SEQ ID NO: 164927 - DNA, 25 bp, Homo sapien
aaggcacctcttgttttggggagca

SEQ ID NO: 164928 - DNA, 25 bp, Homo sapien
ctccgggaaagtgaagtgcgaacca

SEQ ID NO: 164929 - DNA, 25 bp, Homo sapien
atgtatatttccctcctgtgacgca

SEQ ID NO: 164930 - DNA, 25 bp, Homo sapien
cttccacagagaggtgcaaacgtgc

SEQ ID NO: 164931 - DNA, 25 bp, Homo sapien
atcccgtgagaaacgcgtcctgaga

SEQ ID NO: 164932 - DNA, 25 bp, Homo sapien
tggccggattctccgccgacttgaa

SEQ ID NO: 164933 - DNA, 25 bp, Homo sapien
cctgcagccgttgagatttgaactc

SEQ ID NO: 164934 - DNA, 25 bp, Homo sapien
gaactcggtatttgtggctttgccc

SEQ ID NO: 164935 - DNA, 25 bp, Homo sapien
ttgcccgcgcgttgccagactcaga

SEQ ID NO: 164936 - DNA, 25 bp, Homo sapien
cgccgacttgaaaactgccttgcta

SEQ ID NO: 164937 - DNA, 25 bp, Homo sapien
tgttgtgcacgcgtgttttttcctt

SEQ ID NO: 164938 - DNA, 25 bp, Homo sapien
tttcagcctgactgccggaatcaga

SEQ ID NO: 164939 - DNA, 25 bp, Homo sapien
ccttgctaattggtgcgtgttgtgc

SEQ ID NO: 164940 - DNA, 25 bp, Homo sapien
tgcagagacgagatcgcgaagcttt

SEQ ID NO: 164941 - DNA, 25 bp, Homo sapien
tataggaccaaaggccttccctggc

SEQ ID NO: 164942 - DNA, 25 bp, Homo sapien
gcagccatgctgaagtgcgtgatga

SEQ ID NO: 164943 - DNA, 25 bp, Homo sapien
ccgagcctgctttttagggcggatg

SEQ ID NO: 164944 - DNA, 25 bp, Homo sapien
ccggaacattcgaggtataggacca

SEQ ID NO: 164945 - DNA, 25 bp, Homo sapien
ggatacgagacctaggccagccgca

SEQ ID NO: 164946 - DNA, 25 bp, Homo sapien
cttaaccgcaaccaatgagagcaga

SEQ ID NO: 164947 - DNA, 25 bp, Homo sapien
agaaattgccgtacggaggcccgca

SEQ ID NO: 164948 - DNA, 25 bp, Homo sapien
acactctcgggttgtgaccttgagc

SEQ ID NO: 164949 - DNA, 25 bp, Homo sapien
tgaccttgagcacacgacttgaccg

SEQ ID NO: 164950 - DNA, 25 bp, Homo sapien
gtcgttcaagcggaaaacgcgcctc

SEQ ID NO: 164951 - DNA, 25 bp, Homo sapien
atagtaagcgctccctccatgtgag

SEQ ID NO: 164952 - DNA, 25 bp, Homo sapien
cgcccttcttgaggaggcccttacg

SEQ ID NO: 164953 - DNA, 25 bp, Homo sapien
cccgtacgagaggaccgagaacatc

SEQ ID NO: 164954 - DNA, 25 bp, Homo sapien
gctctggactcggacagaccggtca

SEQ ID NO: 164955 - DNA, 25 bp, Homo sapien
accagaacgaggttaggagcctgca

SEQ ID NO: 164956 - DNA, 25 bp, Homo sapien
tgttttctccgaactggccttatta

SEQ ID NO: 164957 - DNA, 25 bp, Homo sapien
taacaccgcgcgtggggaatccact

SEQ ID NO: 164958 - DNA, 25 bp, Homo sapien
acgaaagactcacaacatccctgga

SEQ ID NO: 164959 - DNA, 25 bp, Homo sapien
cgagtccgggtgacatatgtaattg

SEQ ID NO: 164960 - DNA, 25 bp, Homo sapien
agggctatctggaataatacgagtc

SEQ ID NO: 164961 - DNA, 25 bp, Homo sapien
ggggtgctctaacttctcagcgctg

SEQ ID NO: 164962 - DNA, 25 bp, Homo sapien
cgccgaagtctttgccgtggcactt

SEQ ID NO: 164963 - DNA, 25 bp, Homo sapien
ccgcactgatgtgaacacgggagta

SEQ ID NO: 164964 - DNA, 25 bp, Homo sapien
cagccctggccaccttcggaacttt

SEQ ID NO: 164965 - DNA, 25 bp, Homo sapien
gaaaccacagccgggatttacacgc

SEQ ID NO: 164966 - DNA, 25 bp, Homo sapien
tgccatcgctgcctcacccaggcgc

SEQ ID NO: 164967 - DNA, 25 bp, Homo sapien
cccagtcagtctccggcagcttctc

SEQ ID NO: 164968 - DNA, 25 bp, Homo sapien
aacgcgctgtccatgtcgcgggcct

SEQ ID NO: 164969 - DNA, 25 bp, Homo sapien
agatgaggccgcgaggtctcccgcc

SEQ ID NO: 164970 - DNA, 25 bp, Homo sapien
agagggcctcaactccaccgaggca

SEQ ID NO: 164971 - DNA, 25 bp, Homo sapien
cggtgacgacagagggcctcaactc

SEQ ID NO: 164972 - DNA, 25 bp, Homo sapien
ggctgcacgccaaacggggtacgcc

SEQ ID NO: 164973 - DNA, 25 bp, Homo sapien
caccgctgcgactgggagcctcaga

SEQ ID NO: 164974 - DNA, 25 bp, Homo sapien
gcctgtggtcagtccacccgttcgt

SEQ ID NO: 164975 - DNA, 25 bp, Homo sapien
tgggcctcccgcagttacaaaggtc

SEQ ID NO: 164976 - DNA, 25 bp, Homo sapien
cgcagttacaaaggtcccgcccgtg

SEQ ID NO: 164977 - DNA, 25 bp, Homo sapien
gagcgaatcgcggatcacaaaaatc

SEQ ID NO: 164978 - DNA, 25 bp, Homo sapien
cctcttctcggaaggatcgggcact

SEQ ID NO: 164979 - DNA, 25 bp, Homo sapien
gtcttgtagaaagggctgcacgcca

SEQ ID NO: 164980 - DNA, 25 bp, Homo sapien
aaatggccgccgactccttagacag

SEQ ID NO: 164981 - DNA, 25 bp, Homo sapien
aggaagcctgcatcctcgtgcaatg

SEQ ID NO: 164982 - DNA, 25 bp, Homo sapien
tcgtgcaatgaatgagcggagcctg

SEQ ID NO: 164983 - DNA, 25 bp, Homo sapien
cagctggcgacaagttgggaatccc

SEQ ID NO: 164984 - DNA, 25 bp, Homo sapien
tgggccaactcgaggagctcactcc

SEQ ID NO: 164985 - DNA, 25 bp, Homo sapien
ccgggacttctttatgggccatagg

SEQ ID NO: 164986 - DNA, 25 bp, Homo sapien
cccgagcgagagttgcaaagttgca

SEQ ID NO: 164987 - DNA, 25 bp, Homo sapien
gcatgggatccttccgccaaacggg

SEQ ID NO: 164988 - DNA, 25 bp, Homo sapien
tgcgaccctcggatcccaagcatat

SEQ ID NO: 164989 - DNA, 25 bp, Homo sapien
tttttaagcgtgcaatgccgggagc

SEQ ID NO: 164990 - DNA, 25 bp, Homo sapien
cgtgttgtgtgtgctccgattgcaa

SEQ ID NO: 164991 - DNA, 25 bp, Homo sapien
tcccaagcatatctggcgatggagc

SEQ ID NO: 164992 - DNA, 25 bp, Homo sapien
ggtgacatttcccacgactcagtgg

SEQ ID NO: 164993 - DNA, 25 bp, Homo sapien
gcggtggtggtgacatttcccacga

SEQ ID NO: 164994 - DNA, 25 bp, Homo sapien
ctgagctactactcagacgaagccc

SEQ ID NO: 164995 - DNA, 25 bp, Homo sapien
gcccgtaaagaaccctgagctacta

SEQ ID NO: 164996 - DNA, 25 bp, Homo sapien
gcaagtttgcgctcctgcctccagg

SEQ ID NO: 164997 - DNA, 25 bp, Homo sapien
ccggcctctgttctttcccggagtg

SEQ ID NO: 164998 - DNA, 25 bp, Homo sapien
ggaatctcagagaacgcaccgtgga

SEQ ID NO: 164999 - DNA, 25 bp, Homo sapien
ttccttgcttgttctgcctcctgcg

SEQ ID NO: 165000 - DNA, 25 bp, Homo sapien
cccttcccaagtctagatgcagacg

SEQ ID NO: 165001 - DNA, 25 bp, Homo sapien
gggttcgtcttgcttcttgccttta

SEQ ID NO: 165002 - DNA, 25 bp, Homo sapien
tgccgcgaccatggagaagcgctag

SEQ ID NO: 165003 - DNA, 25 bp, Homo sapien
ccctagatttggaggtgttctctgc

SEQ ID NO: 165004 - DNA, 25 bp, Homo sapien
ttcaggttgaatggtttctcgcagc

SEQ ID NO: 165005 - DNA, 25 bp, Homo sapien
gtcgctgacgccataccgatcctgg

SEQ ID NO: 165006 - DNA, 25 bp, Homo sapien
tcctggcaagaaaggtgaccttgta

SEQ ID NO: 165007 - DNA, 25 bp, Homo sapien
gagcattaaagtggccgaggcaaca

SEQ ID NO: 165008 - DNA, 25 bp, Homo sapien
tgaccttgtaccagcccggtgtcca

SEQ ID NO: 165009 - DNA, 25 bp, Homo sapien
gtgtccagccctccggaaacgtata

SEQ ID NO: 165010 - DNA, 25 bp, Homo sapien
ccagttattattccttccagcgccg

SEQ ID NO: 165011 - DNA, 25 bp, Homo sapien
cgtggctttcattcctggctgttca

SEQ ID NO: 165012 - DNA, 25 bp, Homo sapien
ggcccaagccctggcgcaagctcac

SEQ ID NO: 165013 - DNA, 25 bp, Homo sapien
ggcagagatcgccttccaggtgaag

SEQ ID NO: 165014 - DNA, 25 bp, Homo sapien
ggagcagctgctgaaacacaacatc

SEQ ID NO: 165015 - DNA, 25 bp, Homo sapien
tgaaacacaacatcgggcagcgggt

SEQ ID NO: 165016 - DNA, 25 bp, Homo sapien
cacaacatcgggcagcgggtgtttg

SEQ ID NO: 165017 - DNA, 25 bp, Homo sapien
tcgcagggctcggtcagcgagatcc

SEQ ID NO: 165018 - DNA, 25 bp, Homo sapien
tcggtcagcgagatcctagcccggc

SEQ ID NO: 165019 - DNA, 25 bp, Homo sapien
agcagctggacacggcagagatcgc

SEQ ID NO: 165020 - DNA, 25 bp, Homo sapien
ccgagcagtacgagctgtacatgta

SEQ ID NO: 165021 - DNA, 25 bp, Homo sapien
agcacctcggaggacgccatcaaga

SEQ ID NO: 165022 - DNA, 25 bp, Homo sapien
cacgccgtgagatgcaggcgcaaca

SEQ ID NO: 165023 - DNA, 25 bp, Homo sapien
gccttcgtgcagagcatcatccgca

SEQ ID NO: 165024 - DNA, 25 bp, Homo sapien
ccgagatcggcgacgccggctactt

SEQ ID NO: 165025 - DNA, 25 bp, Homo sapien
ccgtgaggtagacacgctggagctc

SEQ ID NO: 165026 - DNA, 25 bp, Homo sapien
atcatccgcaaggtcaagtccgaga

SEQ ID NO: 165027 - DNA, 25 bp, Homo sapien
caggcgagcccaagacctcggtggc

SEQ ID NO: 165028 - DNA, 25 bp, Homo sapien
ttctcgcggcagagttcacaggcct

SEQ ID NO: 165029 - DNA, 25 bp, Homo sapien
aggcctggacctaggaactgagaca

SEQ ID NO: 165030 - DNA, 25 bp, Homo sapien
cacgtaccggctttgggaccattgt

SEQ ID NO: 165031 - DNA, 25 bp, Homo sapien
ggaccattgttcttcccaagccaag

SEQ ID NO: 165032 - DNA, 25 bp, Homo sapien
ccaagccaagccgtgagctaggtta

SEQ ID NO: 165033 - DNA, 25 bp, Homo sapien
gctaggttaatacggccgtgcgctc

SEQ ID NO: 165034 - DNA, 25 bp, Homo sapien
ctctccagggccgagttaaattcca

SEQ ID NO: 165035 - DNA, 25 bp, Homo sapien
cggtccttagataacacggctgaga

SEQ ID NO: 165036 - DNA, 25 bp, Homo sapien
catcgctcagacaccatggggaagg

SEQ ID NO: 165037 - DNA, 25 bp, Homo sapien
cttcttttgcgtcgccaggtgaaga

SEQ ID NO: 165038 - DNA, 25 bp, Homo sapien
cctgttcgacagtcagccgcatctt

SEQ ID NO: 165039 - DNA, 25 bp, Homo sapien
ggtttctataaattgagcccgcagc

SEQ ID NO: 165040 - DNA, 25 bp, Homo sapien
ggcgcacgtagctcaggcctcaaga

SEQ ID NO: 165041 - DNA, 25 bp, Homo sapien
ctactagcggttttacgggcgcacg

SEQ ID NO: 165042 - DNA, 25 bp, Homo sapien
gcgtgcccagttgaaccaggcggct

SEQ ID NO: 165043 - DNA, 25 bp, Homo sapien
cccgcaaggagagctcaaggtcagc

SEQ ID NO: 165044 - DNA, 25 bp, Homo sapien
acccagcgtttgtagggctaggaga

SEQ ID NO: 165045 - DNA, 25 bp, Homo sapien
ggcggctcctctttctggagagctt

SEQ ID NO: 165046 - DNA, 25 bp, Homo sapien
catgcagtggtatggaagacgccta

SEQ ID NO: 165047 - DNA, 25 bp, Homo sapien
agacgcctaagaaagggcttctctt

SEQ ID NO: 165048 - DNA, 25 bp, Homo sapien
cagtgtgtgagctcgaagccatttc

SEQ ID NO: 165049 - DNA, 25 bp, Homo sapien
ttcctccagggaaatgcagtgatgc

SEQ ID NO: 165050 - DNA, 25 bp, Homo sapien
caaacggtttttggaggcacacaca

SEQ ID NO: 165051 - DNA, 25 bp, Homo sapien
cacgtcggtgatgaatcggtaccca

SEQ ID NO: 165052 - DNA, 25 bp, Homo sapien
atggcatcctgactctcagcggcca

SEQ ID NO: 165053 - DNA, 25 bp, Homo sapien
agcgcacagcgaaggcgaactcctc

SEQ ID NO: 165054 - DNA, 25 bp, Homo sapien
tgcagccctccaggatgatgacgcc

SEQ ID NO: 165055 - DNA, 25 bp, Homo sapien
cgctcgttcagcttcatggtggcaa

SEQ ID NO: 165056 - DNA, 25 bp, Homo sapien
aggaagcctgcattgtccaccgggg

SEQ ID NO: 165057 - DNA, 25 bp, Homo sapien
tagaagagcatgttcccgcgcagca

SEQ ID NO: 165058 - DNA, 25 bp, Homo sapien
agccgcaggtagtcgaagctggcac

SEQ ID NO: 165059 - DNA, 25 bp, Homo sapien
ccacccttcttgtacaggaagcctg

SEQ ID NO: 165060 - DNA, 25 bp, Homo sapien
tttaacccttcccagcctgctcgcg

SEQ ID NO: 165061 - DNA, 25 bp, Homo sapien
ccgccctcgaaatcactcttaaagg

SEQ ID NO: 165062 - DNA, 25 bp, Homo sapien
ttcccacctcccgattggcaggccc

SEQ ID NO: 165063 - DNA, 25 bp, Homo sapien
ctggagaagtcaccactggtgcgga

SEQ ID NO: 165064 - DNA, 25 bp, Homo sapien
gtcaccactggtgcggagtcccagc

SEQ ID NO: 165065 - DNA, 25 bp, Homo sapien
gggtcccatgtcctcgtgcatgtcc

SEQ ID NO: 165066 - DNA, 25 bp, Homo sapien
gggagcaaccggacagtccgcgacc

SEQ ID NO: 165067 - DNA, 25 bp, Homo sapien
cactcttaaagggtccgctcctggc

SEQ ID NO: 165068 - DNA, 25 bp, Homo sapien
ggtaactgggttgtacgtcctctgc

SEQ ID NO: 165069 - DNA, 25 bp, Homo sapien
cgcgcaaagcggctgccaccaagtg

SEQ ID NO: 165070 - DNA, 25 bp, Homo sapien
agcggctgccaccaagtggctgcca

SEQ ID NO: 165071 - DNA, 25 bp, Homo sapien
tgccaccgcgcgttaccaccctcag

SEQ ID NO: 165072 - DNA, 25 bp, Homo sapien
gtaactgggttgtacgtcctctgcg

SEQ ID NO: 165073 - DNA, 25 bp, Homo sapien
ccacgttgatcccgggtcacgggtg

SEQ ID NO: 165074 - DNA, 25 bp, Homo sapien
caggagctcgcgtgccccacgttga

SEQ ID NO: 165075 - DNA, 25 bp, Homo sapien
ccgcgcgttaccaccctcagggcct

SEQ ID NO: 165076 - DNA, 25 bp, Homo sapien
gatcctcacttctatcttcagactg

SEQ ID NO: 165077 - DNA, 25 bp, Homo sapien
ccctgcgggcactgataaggccctg

SEQ ID NO: 165078 - DNA, 25 bp, Homo sapien
tgaaagccgtggtcgctattgcacc

SEQ ID NO: 165079 - DNA, 25 bp, Homo sapien
tcctctttacataacggcgcggggc

SEQ ID NO: 165080 - DNA, 25 bp, Homo sapien
cgctggccattttccgagcccgggt

SEQ ID NO: 165081 - DNA, 25 bp, Homo sapien
cagagctcctgtctctcaggtgagc

SEQ ID NO: 165082 - DNA, 25 bp, Homo sapien
tcttcagactgtgggacgcgaaatc

SEQ ID NO: 165083 - DNA, 25 bp, Homo sapien
cggaaatgatgaggcgctggccatt

SEQ ID NO: 165084 - DNA, 25 bp, Homo sapien
ctggccaagaagttcctgccctgga

SEQ ID NO: 165085 - DNA, 25 bp, Homo sapien
cgagttctgtgagttgcacgccgta

SEQ ID NO: 165086 - DNA, 25 bp, Homo sapien
gctggcccgccagtactggctgttc

SEQ ID NO: 165087 - DNA, 25 bp, Homo sapien
tgtcgctgcagttcaccgacctctt

SEQ ID NO: 165088 - DNA, 25 bp, Homo sapien
ctgggtctccgccatgaacgggcct

SEQ ID NO: 165089 - DNA, 25 bp, Homo sapien
tgctgcgctacagcctggccgacga

SEQ ID NO: 165090 - DNA, 25 bp, Homo sapien
ggagctcttcgacccacccaaggta

SEQ ID NO: 165091 - DNA, 25 bp, Homo sapien
caaggtaagtaagccctgcccgcgg

SEQ ID NO: 165092 - DNA, 25 bp, Homo sapien
gagccggggctgaccatcgccgcta

SEQ ID NO: 165093 - DNA, 25 bp, Homo sapien
tcacacctaaaccgggagtggagga

SEQ ID NO: 165094 - DNA, 25 bp, Homo sapien
ggaaaacgccaccacagcctccaga

SEQ ID NO: 165095 - DNA, 25 bp, Homo sapien
gctccctccatcttgaccgccgggg

SEQ ID NO: 165096 - DNA, 25 bp, Homo sapien
ctggggtgccgacacccacctgccc

SEQ ID NO: 165097 - DNA, 25 bp, Homo sapien
tgaccatcgccgctacccgagaacc

SEQ ID NO: 165098 - DNA, 25 bp, Homo sapien
ttcagcgacatggtgaggggcccat

SEQ ID NO: 165099 - DNA, 25 bp, Homo sapien
tgaggggcccatacaccggctcgca

SEQ ID NO: 165100 - DNA, 25 bp, Homo sapien
cccagacccggctacagggaatgcg

SEQ ID NO: 165101 - DNA, 25 bp, Homo sapien
gtgttccgcgagctccaatcggata

SEQ ID NO: 165102 - DNA, 25 bp, Homo sapien
tgacacactcatagggcaggcgctg

SEQ ID NO: 165103 - DNA, 25 bp, Homo sapien
gacctgcggtttacgcatgcgcgca

SEQ ID NO: 165104 - DNA, 25 bp, Homo sapien
ggtgccacacttaggctgagctgca

SEQ ID NO: 165105 - DNA, 25 bp, Homo sapien
agctgcaggttttcgcacagtcgcg

SEQ ID NO: 165106 - DNA, 25 bp, Homo sapien
acagtcgcgagttaacctctgcttg

SEQ ID NO: 165107 - DNA, 25 bp, Homo sapien
gcttgctccagaggcctcgtcctaa

SEQ ID NO: 165108 - DNA, 25 bp, Homo sapien
gcgccacccgcttcgcttgcatcag

SEQ ID NO: 165109 - DNA, 25 bp, Homo sapien
tgagaccctagctctgctctcggtc

SEQ ID NO: 165110 - DNA, 25 bp, Homo sapien
tccgctagcccgctgcgatgttgcg

SEQ ID NO: 165111 - DNA, 25 bp, Homo sapien
agcagcccgaggtcttctgcaacca

SEQ ID NO: 165112 - DNA, 25 bp, Homo sapien
ttctgcaaccaggtgagcccaccgg

SEQ ID NO: 165113 - DNA, 25 bp, Homo sapien
tcgcggggccgggtctttccgcaca

SEQ ID NO: 165114 - DNA, 25 bp, Homo sapien
agtggccctgagaccctagctctgc

SEQ ID NO: 165115 - DNA, 25 bp, Homo sapien
atcccgaggaatggtagaggcagcc

SEQ ID NO: 165116 - DNA, 25 bp, Homo sapien
tgtggcgttcttctcggctctagcc

SEQ ID NO: 165117 - DNA, 25 bp, Homo sapien
cccactgagtatgtcggaggagagc

SEQ ID NO: 165118 - DNA, 25 bp, Homo sapien
tcttctttaggacctggcgagccca

SEQ ID NO: 165119 - DNA, 25 bp, Homo sapien
gcctgtcctgtatgcggcgtgtctt

SEQ ID NO: 165120 - DNA, 25 bp, Homo sapien
ctatgacgtcattagcgcagcgcca

SEQ ID NO: 165121 - DNA, 25 bp, Homo sapien
tccgcagagtggagataaaggctga

SEQ ID NO: 165122 - DNA, 25 bp, Homo sapien
ttgcagtgagaggttccatcgacta

SEQ ID NO: 165123 - DNA, 25 bp, Homo sapien
actcacgcgagtccgggcctatgac

SEQ ID NO: 165124 - DNA, 25 bp, Homo sapien
tccacccttgcaaagatgcagccga

SEQ ID NO: 165125 - DNA, 25 bp, Homo sapien
acaggcctagtggactctgagcgga

SEQ ID NO: 165126 - DNA, 25 bp, Homo sapien
tctgtagcaacggtcccagagcttc

SEQ ID NO: 165127 - DNA, 25 bp, Homo sapien
ccctggatacggtcactttctacaa

SEQ ID NO: 165128 - DNA, 25 bp, Homo sapien
ttggcgcttctcctcaagcggagca

SEQ ID NO: 165129 - DNA, 25 bp, Homo sapien
agatccaaccctcgagtcccaagtg

SEQ ID NO: 165130 - DNA, 25 bp, Homo sapien
cggggcgttctccactatcgcttac

SEQ ID NO: 165131 - DNA, 25 bp, Homo sapien
gagaatgttatgaccaccgggcatg

SEQ ID NO: 165132 - DNA, 25 bp, Homo sapien
ggactggccctcttggctgaaacga

SEQ ID NO: 165133 - DNA, 25 bp, Homo sapien
gccctcttggctgaaacgactccga

SEQ ID NO: 165134 - DNA, 25 bp, Homo sapien
ccgcgccctagtccacaggcatgca

SEQ ID NO: 165135 - DNA, 25 bp, Homo sapien
acgactccgaccctctcggaagatg

SEQ ID NO: 165136 - DNA, 25 bp, Homo sapien
ggactgtgcccgatgctcaggcgcc

SEQ ID NO: 165137 - DNA, 25 bp, Homo sapien
agcccgcaactctgcagctttcttc

SEQ ID NO: 165138 - DNA, 25 bp, Homo sapien
cgcacagcctccaaaccagcggatt

SEQ ID NO: 165139 - DNA, 25 bp, Homo sapien
ttggctgaaacgactccgaccctct

SEQ ID NO: 165140 - DNA, 25 bp, Homo sapien
caaccttggggcaggcaggaatcct

SEQ ID NO: 165141 - DNA, 25 bp, Homo sapien
caggaatcctgaagacggacggcac

SEQ ID NO: 165142 - DNA, 25 bp, Homo sapien
aacaccagttgtcaaccttggggca

SEQ ID NO: 165143 - DNA, 25 bp, Homo sapien
accgcagtgaaagcaggagactttc

SEQ ID NO: 165144 - DNA, 25 bp, Homo sapien
gtcgctaagcgggaccgcagtgaaa

SEQ ID NO: 165145 - DNA, 25 bp, Homo sapien
gcgatcggagtcctcagcctcgctt

SEQ ID NO: 165146 - DNA, 25 bp, Homo sapien
tggcagcccgtgagaagtaccggaa

SEQ ID NO: 165147 - DNA, 25 bp, Homo sapien
atcctgaagacggacggcactcctc

SEQ ID NO: 165148 - DNA, 25 bp, Homo sapien
ggcttccaccttcggggagatctcc

SEQ ID NO: 165149 - DNA, 25 bp, Homo sapien
ctattaaagggccagcgtcgatctc

SEQ ID NO: 165150 - DNA, 25 bp, Homo sapien
tgatgacaagcgcagaaccacagtg

SEQ ID NO: 165151 - DNA, 25 bp, Homo sapien
cgcctgtcgttagggtcctgcacat

SEQ ID NO: 165152 - DNA, 25 bp, Homo sapien
ctcaccgtaaatgggccggaggcgc

SEQ ID NO: 165153 - DNA, 25 bp, Homo sapien
gggctggtccaagacactcaccgta

SEQ ID NO: 165154 - DNA, 25 bp, Homo sapien
tctatcacgatagtcgcggtgctgc

SEQ ID NO: 165155 - DNA, 25 bp, Homo sapien
cgtcgatctcgcttgtctatcacga

SEQ ID NO: 165156 - DNA, 25 bp, Homo sapien
cctccagtttaggaagggtccagca

SEQ ID NO: 165157 - DNA, 25 bp, Homo sapien
ccagggagccaatcgacgcgcagaa

SEQ ID NO: 165158 - DNA, 25 bp, Homo sapien
ctgggagcgacaacggtgttatcca

SEQ ID NO: 165159 - DNA, 25 bp, Homo sapien
gtgttatccaatgggccgacagctg

SEQ ID NO: 165160 - DNA, 25 bp, Homo sapien
ctccgtgtctgcagctagtgtgtca

SEQ ID NO: 165161 - DNA, 25 bp, Homo sapien
ctagtgtgtcaactcagcgtttctc

SEQ ID NO: 165162 - DNA, 25 bp, Homo sapien
cgtttctcctctcgtccctggtgag

SEQ ID NO: 165163 - DNA, 25 bp, Homo sapien
ggcctagagtccgagcctcgagctg

SEQ ID NO: 165164 - DNA, 25 bp, Homo sapien
cgcggtggaaccacagcatgtcctc

SEQ ID NO: 165165 - DNA, 25 bp, Homo sapien
ttcctgcagcgggatgtagatctcg

SEQ ID NO: 165166 - DNA, 25 bp, Homo sapien
ggcttcttggtgtcttcttcctgca

SEQ ID NO: 165167 - DNA, 25 bp, Homo sapien
ccctcggccttgtcttttggcttct

SEQ ID NO: 165168 - DNA, 25 bp, Homo sapien
gccagtgtcttctcgggctcaactt

SEQ ID NO: 165169 - DNA, 25 bp, Homo sapien
tccacagagaggtcgctgacggttt

SEQ ID NO: 165170 - DNA, 25 bp, Homo sapien
tgactacgccctcgtccaggtgggt

SEQ ID NO: 165171 - DNA, 25 bp, Homo sapien
tggacgtgctgacctccatgctgtc

SEQ ID NO: 165172 - DNA, 25 bp, Homo sapien
ggagcatccctctcgctgtccacag

SEQ ID NO: 165173 - DNA, 25 bp, Homo sapien
ccgtgtcaatccatccgagacacaa

SEQ ID NO: 165174 - DNA, 25 bp, Homo sapien
tccgagacacaacacagagaagttg

SEQ ID NO: 165175 - DNA, 25 bp, Homo sapien
cagagaagttgctggattgcccatc

SEQ ID NO: 165176 - DNA, 25 bp, Homo sapien
tgctggattgcccatcgcggacccg

SEQ ID NO: 165177 - DNA, 25 bp, Homo sapien
ccggggcacacaaaaaggccctgcg

SEQ ID NO: 165178 - DNA, 25 bp, Homo sapien
ctctgaacccgggatgcttggcgac

SEQ ID NO: 165179 - DNA, 25 bp, Homo sapien
caaaaaggccctgcggcctaacgcg

SEQ ID NO: 165180 - DNA, 25 bp, Homo sapien
gccattcagggtagccctggctttg

SEQ ID NO: 165181 - DNA, 25 bp, Homo sapien
catgcctcgcggagcggacaataca

SEQ ID NO: 165182 - DNA, 25 bp, Homo sapien
actgtcagtgagacgccatgttggg

SEQ ID NO: 165183 - DNA, 25 bp, Homo sapien
gccgctcggcaaccaactgtcagtg

SEQ ID NO: 165184 - DNA, 25 bp, Homo sapien
gccctaggcggtccgagtcgccata

SEQ ID NO: 165185 - DNA, 25 bp, Homo sapien
gcgatcaccagtccatggcagcggc

SEQ ID NO: 165186 - DNA, 25 bp, Homo sapien
tggtctcttccttcaccgagagcca

SEQ ID NO: 165187 - DNA, 25 bp, Homo sapien
tgacccggatcagcccgtcgtgcag

SEQ ID NO: 165188 - DNA, 25 bp, Homo sapien
gtggctgcgacaggctcagtgtcat

SEQ ID NO: 165189 - DNA, 25 bp, Homo sapien
gcaaagaccaagaggcgacttccgg

SEQ ID NO: 165190 - DNA, 25 bp, Homo sapien
cagcccaagagagtggcgaagaacc

SEQ ID NO: 165191 - DNA, 25 bp, Homo sapien
cccaacgtggctgcgacaggctcag

SEQ ID NO: 165192 - DNA, 25 bp, Homo sapien
tcagtgtcatcctctggaacccagg

SEQ ID NO: 165193 - DNA, 25 bp, Homo sapien
gtcatcctctggaacccaggaccag

SEQ ID NO: 165194 - DNA, 25 bp, Homo sapien
caggaacacagtgcacgcgccgtct

SEQ ID NO: 165195 - DNA, 25 bp, Homo sapien
ctgggagacgcgaaaccttttggct

SEQ ID NO: 165196 - DNA, 25 bp, Homo sapien
gccgcggtttccaggaggaagcaag

SEQ ID NO: 165197 - DNA, 25 bp, Homo sapien
agcccgatgtgaccgagcccagcgg

SEQ ID NO: 165198 - DNA, 25 bp, Homo sapien
gggcagctgcacagtctccgggatc

SEQ ID NO: 165199 - DNA, 25 bp, Homo sapien
gtcgctcggtcctccgctgacggga

SEQ ID NO: 165200 - DNA, 25 bp, Homo sapien
cgatgtgaccgagcccagcggagcc

SEQ ID NO: 165201 - DNA, 25 bp, Homo sapien
agcaaggatgctttggacactgtgc

SEQ ID NO: 165202 - DNA, 25 bp, Homo sapien
atgaaatcgatgtggcagcgggccc

SEQ ID NO: 165203 - DNA, 25 bp, Homo sapien
tttggacactgtgcgtggcgcctcc

SEQ ID NO: 165204 - DNA, 25 bp, Homo sapien
gaaggtagctcctctccggtagcca

SEQ ID NO: 165205 - DNA, 25 bp, Homo sapien
tcggatgtgcgcttttacccaggct

SEQ ID NO: 165206 - DNA, 25 bp, Homo sapien
ccaaagtggctgctcctgcgagtct

SEQ ID NO: 165207 - DNA, 25 bp, Homo sapien
cccgtgctatcctttgggattttga

SEQ ID NO: 165208 - DNA, 25 bp, Homo sapien
gagacccgcgcaggacccgtgctat

SEQ ID NO: 165209 - DNA, 25 bp, Homo sapien
ccaccaacgctgcaggccggtaagg

SEQ ID NO: 165210 - DNA, 25 bp, Homo sapien
ctcgatatgtgcctctcctggagcc

SEQ ID NO: 165211 - DNA, 25 bp, Homo sapien
tgcgcttttacccaggctcgatatg

SEQ ID NO: 165212 - DNA, 25 bp, Homo sapien
cgccgggcggccatggacttgtaca

SEQ ID NO: 165213 - DNA, 25 bp, Homo sapien
aaccagaaatccgaaggccgcgcca

SEQ ID NO: 165214 - DNA, 25 bp, Homo sapien
cgaaaccagaaatccgaaggccgcg

SEQ ID NO: 165215 - DNA, 25 bp, Homo sapien
ctgcgctggacaggttcgtggccag

SEQ ID NO: 165216 - DNA, 25 bp, Homo sapien
gcggccatggacttgtacagcaccc

SEQ ID NO: 165217 - DNA, 25 bp, Homo sapien
agccgcggaaggagttcgtagagaa

SEQ ID NO: 165218 - DNA, 25 bp, Homo sapien
cgtttcacgccacgcgcgggaccga

SEQ ID NO: 165219 - DNA, 25 bp, Homo sapien
accgaggacctaggacctggccagc

SEQ ID NO: 165220 - DNA, 25 bp, Homo sapien
gcccaccgggcagtaggtgctccag

SEQ ID NO: 165221 - DNA, 25 bp, Homo sapien
tcagagcaacaggtggttctgcgcc

SEQ ID NO: 165222 - DNA, 25 bp, Homo sapien
ggcacatcctcctcagagcaacagg

SEQ ID NO: 165223 - DNA, 25 bp, Homo sapien
ccatgtgccgtgaataagcgcgccc

SEQ ID NO: 165224 - DNA, 25 bp, Homo sapien
gctccctcccatgtgccgtgaataa

SEQ ID NO: 165225 - DNA, 25 bp, Homo sapien
gctcacaaggcacaggcacggctgc

SEQ ID NO: 165226 - DNA, 25 bp, Homo sapien
gtgggctccactctccctaaacgca

SEQ ID NO: 165227 - DNA, 25 bp, Homo sapien
caggctcgcaggagccactgtgctc

SEQ ID NO: 165228 - DNA, 25 bp, Homo sapien
tgtccacgcgcggaaagctcggcgc

SEQ ID NO: 165229 - DNA, 25 bp, Homo sapien
gcagtctgtccacgcgcggaaagct

SEQ ID NO: 165230 - DNA, 25 bp, Homo sapien
cccattgttctcagccgaatgctct

SEQ ID NO: 165231 - DNA, 25 bp, Homo sapien
ctcagccgaatgctctcctgggaag

SEQ ID NO: 165232 - DNA, 25 bp, Homo sapien
tgagaacgcgggtgcttagggaccc

SEQ ID NO: 165233 - DNA, 25 bp, Homo sapien
cccgtgcgttctgcggccacccagg

SEQ ID NO: 165234 - DNA, 25 bp, Homo sapien
ctctccctcccggagcacggccgag

SEQ ID NO: 165235 - DNA, 25 bp, Homo sapien
cctcttgtctcctggcaggtcgcga

SEQ ID NO: 165236 - DNA, 25 bp, Homo sapien
gcgctgcatctcctcgttgatgctg

SEQ ID NO: 165237 - DNA, 25 bp, Homo sapien
aggtgtcctcctcgacggcagcctt

SEQ ID NO: 165238 - DNA, 25 bp, Homo sapien
ctctccgacagggaggtgtcctcct

SEQ ID NO: 165239 - DNA, 25 bp, Homo sapien
cctcactctccgacagggaggtgtc

SEQ ID NO: 165240 - DNA, 25 bp, Homo sapien
tcctcgttgatgctgagggctgtgc

SEQ ID NO: 165241 - DNA, 25 bp, Homo sapien
agcatgcgctgcatctcctcgttga

SEQ ID NO: 165242 - DNA, 25 bp, Homo sapien
cagctggttgagcatgcgctgcatc

SEQ ID NO: 165243 - DNA, 25 bp, Homo sapien
tgagggctgtgctctcctcctcatc

SEQ ID NO: 165244 - DNA, 25 bp, Homo sapien
gctccatccctaagtcgcagtcgtg

SEQ ID NO: 165245 - DNA, 25 bp, Homo sapien
atttcgagtacaggcaccatgcggc

SEQ ID NO: 165246 - DNA, 25 bp, Homo sapien
gtgcggcgcaacttctacgacccgt

SEQ ID NO: 165247 - DNA, 25 bp, Homo sapien
ggacggcctacgatatggacatctg

SEQ ID NO: 165248 - DNA, 25 bp, Homo sapien
ctacgagaagcagcacccgtggctc

SEQ ID NO: 165249 - DNA, 25 bp, Homo sapien
gtggctcgacctctcatcgctaggc

SEQ ID NO: 165250 - DNA, 25 bp, Homo sapien
cgctaggcttctgctacctcatcta

SEQ ID NO: 165251 - DNA, 25 bp, Homo sapien
acagcatgtcgcagatgaaccgcca

SEQ ID NO: 165252 - DNA, 25 bp, Homo sapien
aagagcgacgtgaagcccgtgcctg

SEQ ID NO: 165253 - DNA, 25 bp, Homo sapien
ctcccggtgaagaacttgaatggta

SEQ ID NO: 165254 - DNA, 25 bp, Homo sapien
acttgaatggtactgggccggtcca

SEQ ID NO: 165255 - DNA, 25 bp, Homo sapien
gtggcccgcagaaaggcccttcagg

SEQ ID NO: 165256 - DNA, 25 bp, Homo sapien
ggtggggcccaagagcgcaaccctc

SEQ ID NO: 165257 - DNA, 25 bp, Homo sapien
ccagggatgaccgggatactgctgt

SEQ ID NO: 165258 - DNA, 25 bp, Homo sapien
tgagcaagagcgacgtgaagcccgt

SEQ ID NO: 165259 - DNA, 25 bp, Homo sapien
cccgcactcccggtgaagaacttga

SEQ ID NO: 165260 - DNA, 25 bp, Homo sapien
ccacctgcatcacgtggggcagttg

SEQ ID NO: 165261 - DNA, 25 bp, Homo sapien
aggccgagagccactggttgagctc

SEQ ID NO: 165262 - DNA, 25 bp, Homo sapien
gccactggttgagctcattcacatt

SEQ ID NO: 165263 - DNA, 25 bp, Homo sapien
cattcacattctgcagcgggtggga

SEQ ID NO: 165264 - DNA, 25 bp, Homo sapien
tctcaccttgcactggaggtaggtg

SEQ ID NO: 165265 - DNA, 25 bp, Homo sapien
tggaaggcgccctcgtctacgcgct

SEQ ID NO: 165266 - DNA, 25 bp, Homo sapien
ctccacggcgcggatgtgagacacg

SEQ ID NO: 165267 - DNA, 25 bp, Homo sapien
catcgcggtggggtctcaccttgca

SEQ ID NO: 165268 - DNA, 25 bp, Homo sapien
cggagcccacgatggcgtccacgat

SEQ ID NO: 165269 - DNA, 25 bp, Homo sapien
ctgcttgaaggcgaggcgcatggcg

SEQ ID NO: 165270 - DNA, 25 bp, Homo sapien
cgagagtgcgcctttgaaggagatc

SEQ ID NO: 165271 - DNA, 25 bp, Homo sapien
tgcgcctttgaaggagatcctcctg

SEQ ID NO: 165272 - DNA, 25 bp, Homo sapien
ctttgaaggagatcctcctggaggg

SEQ ID NO: 165273 - DNA, 25 bp, Homo sapien
ctcggggcacaacatctgcctgctc

SEQ ID NO: 165274 - DNA, 25 bp, Homo sapien
tggcgtccacgatgggccccaggta

SEQ ID NO: 165275 - DNA, 25 bp, Homo sapien
ggtctcccgcatctgctcctccgag

SEQ ID NO: 165276 - DNA, 25 bp, Homo sapien
cagaagcgcccgaggagtactcaca

SEQ ID NO: 165277 - DNA, 25 bp, Homo sapien
tacatgtcacctgcttcaagcctgg

SEQ ID NO: 165278 - DNA, 25 bp, Homo sapien
tggaccaggggacgtctacatgtca

SEQ ID NO: 165279 - DNA, 25 bp, Homo sapien
gccatggcgcctagccacaaacttt

SEQ ID NO: 165280 - DNA, 25 bp, Homo sapien
cgcgaacattcagggagctgctctt

SEQ ID NO: 165281 - DNA, 25 bp, Homo sapien
agtactcacacgtccttggcaggca

SEQ ID NO: 165282 - DNA, 25 bp, Homo sapien
gcccgtccggactctacaggtagga

SEQ ID NO: 165283 - DNA, 25 bp, Homo sapien
cggggcatctgctaactctaggcgc

SEQ ID NO: 165284 - DNA, 25 bp, Homo sapien
tgaagagccagcttccgagccaggc

SEQ ID NO: 165285 - DNA, 25 bp, Homo sapien
acgcactgcctgaagcaaccgatta

SEQ ID NO: 165286 - DNA, 25 bp, Homo sapien
cgtcatgcaaaaggaaacggcggga

SEQ ID NO: 165287 - DNA, 25 bp, Homo sapien
cagcgccggcttaagcgcctggagc

SEQ ID NO: 165288 - DNA, 25 bp, Homo sapien
tgagtcctgaaggtcgtcttctccc

SEQ ID NO: 165289 - DNA, 25 bp, Homo sapien
cgccagctcctgagtcctgaaggtc

SEQ ID NO: 165290 - DNA, 25 bp, Homo sapien
cagctccaggagctacggcgggaac

SEQ ID NO: 165291 - DNA, 25 bp, Homo sapien
ccctggttttgcgagcgaatgtcag

SEQ ID NO: 165292 - DNA, 25 bp, Homo sapien
ccgctgcactaaggaggggaatctc

SEQ ID NO: 165293 - DNA, 25 bp, Homo sapien
atgaggaccgatggggcaatgctta

SEQ ID NO: 165294 - DNA, 25 bp, Homo sapien
aacgccagggctgatgaggaccgat

SEQ ID NO: 165295 - DNA, 25 bp, Homo sapien
cagtgggtacgacccgccctaggtg

SEQ ID NO: 165296 - DNA, 25 bp, Homo sapien
agcgtacgctgcagtgggtacgacc

SEQ ID NO: 165297 - DNA, 25 bp, Homo sapien
ctctagttccaagaggttccggagc

SEQ ID NO: 165298 - DNA, 25 bp, Homo sapien
gaatctcaggcatcaccgagccgtt

SEQ ID NO: 165299 - DNA, 25 bp, Homo sapien
cctggccggacgaggtgctcgcaca

SEQ ID NO: 165300 - DNA, 25 bp, Homo sapien
tcccgatgcctacgagccaagatgc

SEQ ID NO: 165301 - DNA, 25 bp, Homo sapien
cctctccatgtttagggacctcctg

SEQ ID NO: 165302 - DNA, 25 bp, Homo sapien
acgcacctgagtgagtggcaccaga

SEQ ID NO: 165303 - DNA, 25 bp, Homo sapien
ggcggcctagtacacacgcacctga

SEQ ID NO: 165304 - DNA, 25 bp, Homo sapien
gccaagatgctcaggtaggagaaca

SEQ ID NO: 165305 - DNA, 25 bp, Homo sapien
ctgctccctggttgctgggtgcaaa

SEQ ID NO: 165306 - DNA, 25 bp, Homo sapien
gggccgttcacacgtagcctgtgcc

SEQ ID NO: 165307 - DNA, 25 bp, Homo sapien
cgggcgtcatcttccgcctggatct

SEQ ID NO: 165308 - DNA, 25 bp, Homo sapien
cagcgttaccgcttgcaaaggcgcc

SEQ ID NO: 165309 - DNA, 25 bp, Homo sapien
tgctggcttcggtttcgcgaacttc

SEQ ID NO: 165310 - DNA, 25 bp, Homo sapien
gttcccgggagcacttgctggcttc

SEQ ID NO: 165311 - DNA, 25 bp, Homo sapien
cgccctcggtgcagagttcccggga

SEQ ID NO: 165312 - DNA, 25 bp, Homo sapien
ctaacaggctaacttttccgcgccg

SEQ ID NO: 165313 - DNA, 25 bp, Homo sapien
gctagtcagactttcccgcgtgcct

SEQ ID NO: 165314 - DNA, 25 bp, Homo sapien
gcgccgctggctagtcagactttcc

SEQ ID NO: 165315 - DNA, 25 bp, Homo sapien
gctgattttcgcctgtgagacttcc

SEQ ID NO: 165316 - DNA, 25 bp, Homo sapien
aagaatccgagggatgcgacggctt

SEQ ID NO: 165317 - DNA, 25 bp, Homo sapien
agacctgcggaaggacgtgatagtt

SEQ ID NO: 165318 - DNA, 25 bp, Homo sapien
ctgcaacagcttcgggctcggggtt

SEQ ID NO: 165319 - DNA, 25 bp, Homo sapien
ccagttagccagtaggacgctgtga

SEQ ID NO: 165320 - DNA, 25 bp, Homo sapien
gttcatcacggtagcccagttagcc

SEQ ID NO: 165321 - DNA, 25 bp, Homo sapien
aggacgtgatagttggccaatcaga

SEQ ID NO: 165322 - DNA, 25 bp, Homo sapien
gcagggaagtctccaccgcgcttct

SEQ ID NO: 165323 - DNA, 25 bp, Homo sapien
tggccaatcagagttcatcacggta

SEQ ID NO: 165324 - DNA, 25 bp, Homo sapien
gctgccgatttattttactgattca

SEQ ID NO: 165325 - DNA, 25 bp, Homo sapien
cgacgcggtatacaataagagctca

SEQ ID NO: 165326 - DNA, 25 bp, Homo sapien
tcagcatgcgtctcgtctctctttg

SEQ ID NO: 165327 - DNA, 25 bp, Homo sapien
taaatgttcgcgtccctgatgtccc

SEQ ID NO: 165328 - DNA, 25 bp, Homo sapien
tgggaccagcaaactccgaacctcg

SEQ ID NO: 165329 - DNA, 25 bp, Homo sapien
gaggcggctctttcttacctcgggc

SEQ ID NO: 165330 - DNA, 25 bp, Homo sapien
tcaggaacatctccgtgctccgttt

SEQ ID NO: 165331 - DNA, 25 bp, Homo sapien
ctgcgcttcccaggaaagagacctc

SEQ ID NO: 165332 - DNA, 25 bp, Homo sapien
cttgagcacgttgatgttggagccc

SEQ ID NO: 165333 - DNA, 25 bp, Homo sapien
aagccaggcccttgcaccagagtgg

SEQ ID NO: 165334 - DNA, 25 bp, Homo sapien
ttgcttctccaacagccggttccgg

SEQ ID NO: 165335 - DNA, 25 bp, Homo sapien
aaccggaggttcagggtcttgagca

SEQ ID NO: 165336 - DNA, 25 bp, Homo sapien
ctgacgaagccggtctgcactgcct

SEQ ID NO: 165337 - DNA, 25 bp, Homo sapien
ccggcgggacagagccgaccaatca

SEQ ID NO: 165338 - DNA, 25 bp, Homo sapien
ataacggattcatggctgcgccttc

SEQ ID NO: 165339 - DNA, 25 bp, Homo sapien
cgtgcgagaacgaccagatggtgcc

SEQ ID NO: 165340 - DNA, 25 bp, Homo sapien
atggtggacggacgccaccctgacg

SEQ ID NO: 165341 - DNA, 25 bp, Homo sapien
acgccatccgcgagactgggtaagg

SEQ ID NO: 165342 - DNA, 25 bp, Homo sapien
acgcccgtttctctgggggtcagct

SEQ ID NO: 165343 - DNA, 25 bp, Homo sapien
tctcggcgggccagctgcttatggt

SEQ ID NO: 165344 - DNA, 25 bp, Homo sapien
cgctcggtgctcctggacgtctcgg

SEQ ID NO: 165345 - DNA, 25 bp, Homo sapien
tggccctgctggtcgggccgttcct

SEQ ID NO: 165346 - DNA, 25 bp, Homo sapien
tcatggtgggccagatgtactgcta

SEQ ID NO: 165347 - DNA, 25 bp, Homo sapien
ctgcttatggtggacggacgccacc

SEQ ID NO: 165348 - DNA, 25 bp, Homo sapien
cccaaatcgcaataccaggaggaca

SEQ ID NO: 165349 - DNA, 25 bp, Homo sapien
cccgcggcctgacggctctataaag

SEQ ID NO: 165350 - DNA, 25 bp, Homo sapien
tcataaagacttgggcttcctggtc

SEQ ID NO: 165351 - DNA, 25 bp, Homo sapien
ctgcggtccgtacaggatgacactg

SEQ ID NO: 165352 - DNA, 25 bp, Homo sapien
acagcagggctagatggaatctttc

SEQ ID NO: 165353 - DNA, 25 bp, Homo sapien
ccagagaggcttacaaccttccata

SEQ ID NO: 165354 - DNA, 25 bp, Homo sapien
cctgtttctctgctcgaaaggtgga

SEQ ID NO: 165355 - DNA, 25 bp, Homo sapien
tgttggccgtctccttgtccgacga

SEQ ID NO: 165356 - DNA, 25 bp, Homo sapien
cgcgcgacaccgacccaaggttaga

SEQ ID NO: 165357 - DNA, 25 bp, Homo sapien
tgcgagatcatgtcggtgaacctgg

SEQ ID NO: 165358 - DNA, 25 bp, Homo sapien
cgtagtagtcgccttggtagtctgc

SEQ ID NO: 165359 - DNA, 25 bp, Homo sapien
gagactcagactgccagagaccaca

SEQ ID NO: 165360 - DNA, 25 bp, Homo sapien
cacgcggcaaaaactcggagacttc

SEQ ID NO: 165361 - DNA, 25 bp, Homo sapien
ggagacttcagtcacaggttccctg

SEQ ID NO: 165362 - DNA, 25 bp, Homo sapien
ccgctgaatacctcgccgggcatgg

SEQ ID NO: 165363 - DNA, 25 bp, Homo sapien
agaagtcgtagttgcttcccggcgc

SEQ ID NO: 165364 - DNA, 25 bp, Homo sapien
acagtcctggggtctctccaaattc

SEQ ID NO: 165365 - DNA, 25 bp, Homo sapien
tgcctctcagacatagacagtcctg

SEQ ID NO: 165366 - DNA, 25 bp, Homo sapien
aattgcctcttcctaacctgcgtta

SEQ ID NO: 165367 - DNA, 25 bp, Homo sapien
ctgccttgctaacactgccactgaa

SEQ ID NO: 165368 - DNA, 25 bp, Homo sapien
cttccggatgtgctgaggttagtga

SEQ ID NO: 165369 - DNA, 25 bp, Homo sapien
tctctgccctgaaaagcacagcctg

SEQ ID NO: 165370 - DNA, 25 bp, Homo sapien
tgctccgggcccagattttgtaggg

SEQ ID NO: 165371 - DNA, 25 bp, Homo sapien
ggtaattggaacaaacgccgtctga

SEQ ID NO: 165372 - DNA, 25 bp, Homo sapien
gccggtccagtccttgggcaatctc

SEQ ID NO: 165373 - DNA, 25 bp, Homo sapien
ttcgcctcttgtctcagcagctgca

SEQ ID NO: 165374 - DNA, 25 bp, Homo sapien
ggcgttcacaacctcatgccacggg

SEQ ID NO: 165375 - DNA, 25 bp, Homo sapien
ctcatctttgtctggtcgccgcgta

SEQ ID NO: 165376 - DNA, 25 bp, Homo sapien
cgccatccctggaacttgcagaagt

SEQ ID NO: 165377 - DNA, 25 bp, Homo sapien
tctttttgtcatacacggggctggg

SEQ ID NO: 165378 - DNA, 25 bp, Homo sapien
cgggcctttctcatggagagagcta

SEQ ID NO: 165379 - DNA, 25 bp, Homo sapien
tcaagcggtccggatcctcatcttt

SEQ ID NO: 165380 - DNA, 25 bp, Homo sapien
gctttattgggaaacgcgcgctctg

SEQ ID NO: 165381 - DNA, 25 bp, Homo sapien
aattgctcgccggattcattacctc

SEQ ID NO: 165382 - DNA, 25 bp, Homo sapien
taaatttaaattgctcgccggattc

SEQ ID NO: 165383 - DNA, 25 bp, Homo sapien
ttaaacaaacgcagcgagcgcctcc

SEQ ID NO: 165384 - DNA, 25 bp, Homo sapien
gccagcgcggctttaacattaaaca

SEQ ID NO: 165385 - DNA, 25 bp, Homo sapien
gtggcatcttgtgcgacccagcccg

SEQ ID NO: 165386 - DNA, 25 bp, Homo sapien
ctcttggtggcatcttgtgcgaccc

SEQ ID NO: 165387 - DNA, 25 bp, Homo sapien
agaggcgcgcgctttgcccacttct

SEQ ID NO: 165388 - DNA, 25 bp, Homo sapien
cgtggattgcttggtttccagaaca

SEQ ID NO: 165389 - DNA, 25 bp, Homo sapien
gtctcgttaactgggcaggcccgac

SEQ ID NO: 165390 - DNA, 25 bp, Homo sapien
ccactggcgctaggccgtggattgc

SEQ ID NO: 165391 - DNA, 25 bp, Homo sapien
ggtttccagaacatctctgcggggc

SEQ ID NO: 165392 - DNA, 25 bp, Homo sapien
gcgcagggccttcctgtcagttgaa

SEQ ID NO: 165393 - DNA, 25 bp, Homo sapien
gtcagttgaatcgtgctcggcttaa

SEQ ID NO: 165394 - DNA, 25 bp, Homo sapien
tgctcggcttaattaacggtctcgt

SEQ ID NO: 165395 - DNA, 25 bp, Homo sapien
taacggtctcgttaactgggcaggc

SEQ ID NO: 165396 - DNA, 25 bp, Homo sapien
ggatcgcgctctctaaaactcctct

SEQ ID NO: 165397 - DNA, 25 bp, Homo sapien
agcagcccggctgaacaccgcgagc

SEQ ID NO: 165398 - DNA, 25 bp, Homo sapien
tgcgggatcgcgctctctaaaactc

SEQ ID NO: 165399 - DNA, 25 bp, Homo sapien
accactgcgggatcgcgctctctaa

SEQ ID NO: 165400 - DNA, 25 bp, Homo sapien
taccctgctgggcacccttccgctc

SEQ ID NO: 165401 - DNA, 25 bp, Homo sapien
ccaaggcgagtatgtttaccctgct

SEQ ID NO: 165402 - DNA, 25 bp, Homo sapien
ccttcctcccaaggcgagtatgttt

SEQ ID NO: 165403 - DNA, 25 bp, Homo sapien
aaagcggcggtttacgcagcagccc

SEQ ID NO: 165404 - DNA, 25 bp, Homo sapien
gacgctttttctggcgaaacggaga

SEQ ID NO: 165405 - DNA, 25 bp, Homo sapien
tagctccctggatttgaagttgcgg

SEQ ID NO: 165406 - DNA, 25 bp, Homo sapien
atacgcacccgcgaaacgttcgaca

SEQ ID NO: 165407 - DNA, 25 bp, Homo sapien
aacgttcgacatcgccgcttttttg

SEQ ID NO: 165408 - DNA, 25 bp, Homo sapien
cgggcagtgacagtgaaacgaattc

SEQ ID NO: 165409 - DNA, 25 bp, Homo sapien
caccgtgtaggcagaagcgaggttc

SEQ ID NO: 165410 - DNA, 25 bp, Homo sapien
tcctctaagcaggtttgccggagaa

SEQ ID NO: 165411 - DNA, 25 bp, Homo sapien
gcgccggagtttggaccaagacaaa

SEQ ID NO: 165412 - DNA, 25 bp, Homo sapien
cgactttgttttcgcggtcaaggag

SEQ ID NO: 165413 - DNA, 25 bp, Homo sapien
agggcctcttttctcgcaaccgtgg

SEQ ID NO: 165414 - DNA, 25 bp, Homo sapien
tctcacacgcgagcttggctactca

SEQ ID NO: 165415 - DNA, 25 bp, Homo sapien
tggctactcagaccaagccggttta

SEQ ID NO: 165416 - DNA, 25 bp, Homo sapien
ctgccagtgcctttgtggcgcatta

SEQ ID NO: 165417 - DNA, 25 bp, Homo sapien
cagcggcttcaaacgcactgtttcc

SEQ ID NO: 165418 - DNA, 25 bp, Homo sapien
ttcactaaccaacaaggagggctgc

SEQ ID NO: 165419 - DNA, 25 bp, Homo sapien
tgatggatgccgcttcttgccactc

SEQ ID NO: 165420 - DNA, 25 bp, Homo sapien
tcaacccgcctaggagaggcgctcg

SEQ ID NO: 165421 - DNA, 25 bp, Homo sapien
ggggcttccagtataccttccagcg

SEQ ID NO: 165422 - DNA, 25 bp, Homo sapien
gagctcgattctccgggtgccataa

SEQ ID NO: 165423 - DNA, 25 bp, Homo sapien
taattacattgtcctcacctgcagc

SEQ ID NO: 165424 - DNA, 25 bp, Homo sapien
cggcagcgtgtgtggaaattacctt

SEQ ID NO: 165425 - DNA, 25 bp, Homo sapien
caccatcaattaagcgaccgcgggg

SEQ ID NO: 165426 - DNA, 25 bp, Homo sapien
tgccataaattaggacgccagtcgc

SEQ ID NO: 165427 - DNA, 25 bp, Homo sapien
tagagtgtccctagcgtcacgccct

SEQ ID NO: 165428 - DNA, 25 bp, Homo sapien
cgggagattcttcacgatcagtcgc

SEQ ID NO: 165429 - DNA, 25 bp, Homo sapien
atgcgccggtttagctcggtgttaa

SEQ ID NO: 165430 - DNA, 25 bp, Homo sapien
gcggattctgtgagacgccaatgca

SEQ ID NO: 165431 - DNA, 25 bp, Homo sapien
ggcgtggctaatccaaaactactca

SEQ ID NO: 165432 - DNA, 25 bp, Homo sapien
cttggcctgacctgtccggaagtag

SEQ ID NO: 165433 - DNA, 25 bp, Homo sapien
acagtcacgtggctgagaccttggc

SEQ ID NO: 165434 - DNA, 25 bp, Homo sapien
ggtcagcgtcttccaccaagtttca

SEQ ID NO: 165435 - DNA, 25 bp, Homo sapien
taccgagccggaacacagtcacgtg

SEQ ID NO: 165436 - DNA, 25 bp, Homo sapien
cggcgtggcgacagagagacgcagc

SEQ ID NO: 165437 - DNA, 25 bp, Homo sapien
ccgggccgcgcgtctctaatctccg

SEQ ID NO: 165438 - DNA, 25 bp, Homo sapien
gcgtctctaatctccggccgccgtg

SEQ ID NO: 165439 - DNA, 25 bp, Homo sapien
gacagtgtggagacatcagcgcgag

SEQ ID NO: 165440 - DNA, 25 bp, Homo sapien
caaattgctttgacggctggggaca

SEQ ID NO: 165441 - DNA, 25 bp, Homo sapien
gcccggcttagccaaattgctttga

SEQ ID NO: 165442 - DNA, 25 bp, Homo sapien
ccatcggcccggcttagccaaattg

SEQ ID NO: 165443 - DNA, 25 bp, Homo sapien
cggccgatagcgacgccgaccgggg

SEQ ID NO: 165444 - DNA, 25 bp, Homo sapien
cccatggtactgtggcaggcagaaa

SEQ ID NO: 165445 - DNA, 25 bp, Homo sapien
ttcctctagacccaccagaatgcgg

SEQ ID NO: 165446 - DNA, 25 bp, Homo sapien
acgtgcaatccggacctagctttcg

SEQ ID NO: 165447 - DNA, 25 bp, Homo sapien
cacagaatcgttccacgcaggcgca

SEQ ID NO: 165448 - DNA, 25 bp, Homo sapien
caattcgaaggagacgcgcagctta

SEQ ID NO: 165449 - DNA, 25 bp, Homo sapien
tccctcatggagttggcttttagcc

SEQ ID NO: 165450 - DNA, 25 bp, Homo sapien
tctgttgggtgaaagccgcaccttc

SEQ ID NO: 165451 - DNA, 25 bp, Homo sapien
ctccttcgtagggtccaacttgcgc

SEQ ID NO: 165452 - DNA, 25 bp, Homo sapien
cggggcatcctctggctttttgctt

SEQ ID NO: 165453 - DNA, 25 bp, Homo sapien
ggactgcagttcgttgatataaaca

SEQ ID NO: 165454 - DNA, 25 bp, Homo sapien
ctagttcactcaggccttgggccga

SEQ ID NO: 165455 - DNA, 25 bp, Homo sapien
agcggggagcagactttgtttaatt

SEQ ID NO: 165456 - DNA, 25 bp, Homo sapien
tcagtttattgagggaggcttcggc

SEQ ID NO: 165457 - DNA, 25 bp, Homo sapien
cacacactcggtggcttgggcctac

SEQ ID NO: 165458 - DNA, 25 bp, Homo sapien
cggagccaaagcctcgcagtgttta

SEQ ID NO: 165459 - DNA, 25 bp, Homo sapien
agacaagttggcagatctcggctca

SEQ ID NO: 165460 - DNA, 25 bp, Homo sapien
tgatctctgcaaagggacccgaagc

SEQ ID NO: 165461 - DNA, 25 bp, Homo sapien
gggccgattctacacatagtgcaga

SEQ ID NO: 165462 - DNA, 25 bp, Homo sapien
gctgacctggcccttattaagatgc

SEQ ID NO: 165463 - DNA, 25 bp, Homo sapien
aagccatcgctcatgccggcctgaa

SEQ ID NO: 165464 - DNA, 25 bp, Homo sapien
caggtcttttgcgtcaggctccaga

SEQ ID NO: 165465 - DNA, 25 bp, Homo sapien
tttggccgtaaagataaccgtcaca

SEQ ID NO: 165466 - DNA, 25 bp, Homo sapien
tttcgaatcgcagggcaggtctttt

SEQ ID NO: 165467 - DNA, 25 bp, Homo sapien
aacggccggataattgagatttctc

SEQ ID NO: 165468 - DNA, 25 bp, Homo sapien
ggtgcattcaccacatcctctgctg

SEQ ID NO: 165469 - DNA, 25 bp, Homo sapien
tgcttacccagaatagcggctactg

SEQ ID NO: 165470 - DNA, 25 bp, Homo sapien
tccgagccgcgcaaaatctctgcaa

SEQ ID NO: 165471 - DNA, 25 bp, Homo sapien
ccagactccatttgccggggagctc

SEQ ID NO: 165472 - DNA, 25 bp, Homo sapien
gtttgacagaaccaggccgtgcttc

SEQ ID NO: 165473 - DNA, 25 bp, Homo sapien
caagctgtgctctgcagaatgcaaa

SEQ ID NO: 165474 - DNA, 25 bp, Homo sapien
ggctactgctgcctactagggcgca

SEQ ID NO: 165475 - DNA, 25 bp, Homo sapien
gtgcttctgcaaacctcaatgccgc

SEQ ID NO: 165476 - DNA, 25 bp, Homo sapien
taattattgtaccagggcccgccga

SEQ ID NO: 165477 - DNA, 25 bp, Homo sapien
agaatgcaattcgtcccagagtggc

SEQ ID NO: 165478 - DNA, 25 bp, Homo sapien
gggagttctccgtaatgtgccttgc

SEQ ID NO: 165479 - DNA, 25 bp, Homo sapien
cagtgccctcttgcagacttgcata

SEQ ID NO: 165480 - DNA, 25 bp, Homo sapien
gccgaggcacgaggcactctatttt

SEQ ID NO: 165481 - DNA, 25 bp, Homo sapien
gggcacaatttctaagcagcgcagt

SEQ ID NO: 165482 - DNA, 25 bp, Homo sapien
tttgcgcaccgctggaaacccacta

SEQ ID NO: 165483 - DNA, 25 bp, Homo sapien
gctcgtgtttgctcccagatgccaa

SEQ ID NO: 165484 - DNA, 25 bp, Homo sapien
tcgcttcccggtgtttcaggctctt

SEQ ID NO: 165485 - DNA, 25 bp, Homo sapien
tatctttgctctgtggctctccctg

SEQ ID NO: 165486 - DNA, 25 bp, Homo sapien
ggcccttctcctatctttgctctgt

SEQ ID NO: 165487 - DNA, 25 bp, Homo sapien
ttcccgagtacacgtggaggctgct

SEQ ID NO: 165488 - DNA, 25 bp, Homo sapien
ccagcagttcccgagtacacgtgga

SEQ ID NO: 165489 - DNA, 25 bp, Homo sapien
gcgtttaagggattcccagcagttc

SEQ ID NO: 165490 - DNA, 25 bp, Homo sapien
cgcgccttcaggtagagcgtttaag

SEQ ID NO: 165491 - DNA, 25 bp, Homo sapien
caccgcctgtttgctctgggcgcag

SEQ ID NO: 165492 - DNA, 25 bp, Homo sapien
tccaagcttcgtgctcggtgaggta

SEQ ID NO: 165493 - DNA, 25 bp, Homo sapien
ctcacgtgcgcctagaattataata

SEQ ID NO: 165494 - DNA, 25 bp, Homo sapien
gggaattgccacagacgcccgattt

SEQ ID NO: 165495 - DNA, 25 bp, Homo sapien
gcgcatctgcggcactggctaaatc

SEQ ID NO: 165496 - DNA, 25 bp, Homo sapien
ccacgagccgacagatttgcaattc

SEQ ID NO: 165497 - DNA, 25 bp, Homo sapien
ctaacgcgcctgcaaataatgtgtg

SEQ ID NO: 165498 - DNA, 25 bp, Homo sapien
taatgaagtgtctgcgcgctaacgc

SEQ ID NO: 165499 - DNA, 25 bp, Homo sapien
gcccgggtacctgcaagaatcttcc

SEQ ID NO: 165500 - DNA, 25 bp, Homo sapien
agagtggctgacgcaagccagcaga

SEQ ID NO: 165501 - DNA, 25 bp, Homo sapien
agacgcgcaggaaggacatcctgga

SEQ ID NO: 165502 - DNA, 25 bp, Homo sapien
gcgagcagctcaccgcgtggtgcac

SEQ ID NO: 165503 - DNA, 25 bp, Homo sapien
gagcgctcctgatggctgctctcag

SEQ ID NO: 165504 - DNA, 25 bp, Homo sapien
aaaccaaggccgagtgtgcagagtc

SEQ ID NO: 165505 - DNA, 25 bp, Homo sapien
tgcagagtcgggcaggaaaacgcct

SEQ ID NO: 165506 - DNA, 25 bp, Homo sapien
aacgccttgagagagtggctgacgc

SEQ ID NO: 165507 - DNA, 25 bp, Homo sapien
tcgggcaggaaaacgccttgagaga

SEQ ID NO: 165508 - DNA, 25 bp, Homo sapien
ttgggcccagacacatttagaaatg

SEQ ID NO: 165509 - DNA, 25 bp, Homo sapien
cgactacataaagggtccgccggca

SEQ ID NO: 165510 - DNA, 25 bp, Homo sapien
ggccggagggattgcttcacactcc

SEQ ID NO: 165511 - DNA, 25 bp, Homo sapien
tgcgcggctgaaacgcgactacata

SEQ ID NO: 165512 - DNA, 25 bp, Homo sapien
acgatgacataagtggcgctgatga

SEQ ID NO: 165513 - DNA, 25 bp, Homo sapien
gcgcacccagaaacgatgacataag

SEQ ID NO: 165514 - DNA, 25 bp, Homo sapien
gaaatgttttgctggacgtgtgccc

SEQ ID NO: 165515 - DNA, 25 bp, Homo sapien
ttcacactccggaattgggcccaga

SEQ ID NO: 165516 - DNA, 25 bp, Homo sapien
ggacgcttctcctttgattcgcaga

SEQ ID NO: 165517 - DNA, 25 bp, Homo sapien
gccaagcgctggaagaaacgaactg

SEQ ID NO: 165518 - DNA, 25 bp, Homo sapien
gagtgaactctaggcgcagctggac

SEQ ID NO: 165519 - DNA, 25 bp, Homo sapien
cccgagtgaactctaggcgcagctg

SEQ ID NO: 165520 - DNA, 25 bp, Homo sapien
tctcctttgattcgcagacccgggc

SEQ ID NO: 165521 - DNA, 25 bp, Homo sapien
ggtgagagaaggacgcttctccttt

SEQ ID NO: 165522 - DNA, 25 bp, Homo sapien
ttccgtgcttggctagccagcggag

SEQ ID NO: 165523 - DNA, 25 bp, Homo sapien
ccatgtgagccggttggccagagcc

SEQ ID NO: 165524 - DNA, 25 bp, Homo sapien
acggcgcgaactgctccatcaagca

SEQ ID NO: 165525 - DNA, 25 bp, Homo sapien
aactgctccatcaagcatccactgg

SEQ ID NO: 165526 - DNA, 25 bp, Homo sapien
tccagccgcgtttccggttgtagca

SEQ ID NO: 165527 - DNA, 25 bp, Homo sapien
tttccggttgtagcactgggcgccc

SEQ ID NO: 165528 - DNA, 25 bp, Homo sapien
cgagtcagggcacctcggaccggct

SEQ ID NO: 165529 - DNA, 25 bp, Homo sapien
ccgataagctatcggcgcggcccag

SEQ ID NO: 165530 - DNA, 25 bp, Homo sapien
cgctcaggacagaagcgagatgcct

SEQ ID NO: 165531 - DNA, 25 bp, Homo sapien
cagagtggacccgataagctatcgg

SEQ ID NO: 165532 - DNA, 25 bp, Homo sapien
gttcttgacgctttggggacatttg

SEQ ID NO: 165533 - DNA, 25 bp, Homo sapien
cgcggggatcgcatttcaaaagctc

SEQ ID NO: 165534 - DNA, 25 bp, Homo sapien
gcccggacagtagccgtacagattc

SEQ ID NO: 165535 - DNA, 25 bp, Homo sapien
cgcgggacagaagcgccttacgttt

SEQ ID NO: 165536 - DNA, 25 bp, Homo sapien
tgccgggtaaccaggcagcgctttt

SEQ ID NO: 165537 - DNA, 25 bp, Homo sapien
cgcctgagtctcattcactgctttg

SEQ ID NO: 165538 - DNA, 25 bp, Homo sapien
ccttcgccggcttctctgtagaatc

SEQ ID NO: 165539 - DNA, 25 bp, Homo sapien
ctgggcttctagctggggccaaaac

SEQ ID NO: 165540 - DNA, 25 bp, Homo sapien
accgctcaggctgaacttagttcca

SEQ ID NO: 165541 - DNA, 25 bp, Homo sapien
ccgaaccgctcaggctgaacttagt

SEQ ID NO: 165542 - DNA, 25 bp, Homo sapien
cagccaccctagcagggcacccgaa

SEQ ID NO: 165543 - DNA, 25 bp, Homo sapien
aaacacagaacagtcagtgacgcgc

SEQ ID NO: 165544 - DNA, 25 bp, Homo sapien
ctctacactggcccgagtcactgtg

SEQ ID NO: 165545 - DNA, 25 bp, Homo sapien
cggcggcctgaggacctctacactg

SEQ ID NO: 165546 - DNA, 25 bp, Homo sapien
tgaacttagttccacactcctcggg

SEQ ID NO: 165547 - DNA, 25 bp, Homo sapien
aacagtcagtgacgcgcactgtccc

SEQ ID NO: 165548 - DNA, 25 bp, Homo sapien
gcgagtcatggcctttgtccttgta

SEQ ID NO: 165549 - DNA, 25 bp, Homo sapien
ctgtcgtgaagcgttgcaagcctct

SEQ ID NO: 165550 - DNA, 25 bp, Homo sapien
caagcctctcgtagcggcctgaagg

SEQ ID NO: 165551 - DNA, 25 bp, Homo sapien
ttaagggcctacacgtcaggaactg

SEQ ID NO: 165552 - DNA, 25 bp, Homo sapien
gcgcagatctagagagaggccctaa

SEQ ID NO: 165553 - DNA, 25 bp, Homo sapien
cggcacccgcatttgtcaccttaaa

SEQ ID NO: 165554 - DNA, 25 bp, Homo sapien
ccgtgaggtcacattggaaaccagc

SEQ ID NO: 165555 - DNA, 25 bp, Homo sapien
ctgaccctcgtagggactgctgctc

SEQ ID NO: 165556 - DNA, 25 bp, Homo sapien
caagccgctaaccaaccgctggatg

SEQ ID NO: 165557 - DNA, 25 bp, Homo sapien
cttcccagacgcaactgcaaaagga

SEQ ID NO: 165558 - DNA, 25 bp, Homo sapien
tctccgcgcagagtttgggcgacaa

SEQ ID NO: 165559 - DNA, 25 bp, Homo sapien
gacctgtccggcttggcttccaagc

SEQ ID NO: 165560 - DNA, 25 bp, Homo sapien
ctggactggaatgaaaagacgtgtc

SEQ ID NO: 165561 - DNA, 25 bp, Homo sapien
tccgacaaagtgcacggcagcctga

SEQ ID NO: 165562 - DNA, 25 bp, Homo sapien
ctgcaaaaggaagggctaacgccat

SEQ ID NO: 165563 - DNA, 25 bp, Homo sapien
cggcagcctgaactggactggaatg

SEQ ID NO: 165564 - DNA, 25 bp, Homo sapien
gccgtggaatccaggcccgagacac

SEQ ID NO: 165565 - DNA, 25 bp, Homo sapien
cccatggcaaactggctggggtgca

SEQ ID NO: 165566 - DNA, 25 bp, Homo sapien
ttgaagaactgttggcccgccaggc

SEQ ID NO: 165567 - DNA, 25 bp, Homo sapien
ctcagcagcgaaaaggtgagccttg

SEQ ID NO: 165568 - DNA, 25 bp, Homo sapien
tgagtcgggcgacgctttgtccagc

SEQ ID NO: 165569 - DNA, 25 bp, Homo sapien
gggccatgctcctctttgctctcgg

SEQ ID NO: 165570 - DNA, 25 bp, Homo sapien
ccgtctgcaccgtgagcggcgcgaa

SEQ ID NO: 165571 - DNA, 25 bp, Homo sapien
tcctccgacgtggtggtggagatct

SEQ ID NO: 165572 - DNA, 25 bp, Homo sapien
gtcgcctctaggtggcttatcgaga

SEQ ID NO: 165573 - DNA, 25 bp, Homo sapien
ctactgcctgtcctgtgaatatgtc

SEQ ID NO: 165574 - DNA, 25 bp, Homo sapien
gctctttgacgctttcggaccaatt

SEQ ID NO: 165575 - DNA, 25 bp, Homo sapien
gcctctagaattcaccgggcgtctg

SEQ ID NO: 165576 - DNA, 25 bp, Homo sapien
cttccttgtcctaaaacgtgagcga

SEQ ID NO: 165577 - DNA, 25 bp, Homo sapien
gggtgtctcggtttcaatccaaatc

SEQ ID NO: 165578 - DNA, 25 bp, Homo sapien
gcagctgtgctagacccggctttaa

SEQ ID NO: 165579 - DNA, 25 bp, Homo sapien
tgccgctgagctcgaaatagacact

SEQ ID NO: 165580 - DNA, 25 bp, Homo sapien
gccatgcgctgggtgattaatttgc

SEQ ID NO: 165581 - DNA, 25 bp, Homo sapien
ggtctgcaaacttccgccaattatg

SEQ ID NO: 165582 - DNA, 25 bp, Homo sapien
ttatgactgacctcccagactcggc

SEQ ID NO: 165583 - DNA, 25 bp, Homo sapien
gggaaggtgcgaactcctctttgtc

SEQ ID NO: 165584 - DNA, 25 bp, Homo sapien
tgcgaacaaacaaaagcggcctggt

SEQ ID NO: 165585 - DNA, 25 bp, Homo sapien
gtggccactgcattcgggttaaaca

SEQ ID NO: 165586 - DNA, 25 bp, Homo sapien
ttcgggttaaacattggccagcgtg

SEQ ID NO: 165587 - DNA, 25 bp, Homo sapien
ggccgccgtaattctgggatcaaaa

SEQ ID NO: 165588 - DNA, 25 bp, Homo sapien
gtgcctgggtcaccgcgaattccat

SEQ ID NO: 165589 - DNA, 25 bp, Homo sapien
gtctgcttctccaaacggccgctgt

SEQ ID NO: 165590 - DNA, 25 bp, Homo sapien
ggtgctcagcgcatctcaactcgcg

SEQ ID NO: 165591 - DNA, 25 bp, Homo sapien
ccagcgtgaaccgtgtgcttgtttt

SEQ ID NO: 165592 - DNA, 25 bp, Homo sapien
tcattgtctccatctcggggcttcc

SEQ ID NO: 165593 - DNA, 25 bp, Homo sapien
ttccttgtagagtttggagctccgc

SEQ ID NO: 165594 - DNA, 25 bp, Homo sapien
agctccgcgtgaacagcgctctacg

SEQ ID NO: 165595 - DNA, 25 bp, Homo sapien
gcgctctacgcgctagttccatcgg

SEQ ID NO: 165596 - DNA, 25 bp, Homo sapien
ctggacgcgcctcggtgcggatcca

SEQ ID NO: 165597 - DNA, 25 bp, Homo sapien
agaggtctcggacaggctgtccttc

SEQ ID NO: 165598 - DNA, 25 bp, Homo sapien
caggagagcaaagaggtctcggaca

SEQ ID NO: 165599 - DNA, 25 bp, Homo sapien
aaacgctgcacaggcccgcaggaga

SEQ ID NO: 165600 - DNA, 25 bp, Homo sapien
ctcggattctactctcacccaaggg

SEQ ID NO: 165601 - DNA, 25 bp, Homo sapien
gcagctcacggcctcggattctact

SEQ ID NO: 165602 - DNA, 25 bp, Homo sapien
cacggaaccggagaagcagctcacg

SEQ ID NO: 165603 - DNA, 25 bp, Homo sapien
tctcggtcgcgacaaggtcccgaca

SEQ ID NO: 165604 - DNA, 25 bp, Homo sapien
gtgtctagaatcaatacggcccaga

SEQ ID NO: 165605 - DNA, 25 bp, Homo sapien
tttgtgcaagccacaatggtccgtg

SEQ ID NO: 165606 - DNA, 25 bp, Homo sapien
ccgcggcgaattaattgggccctga

SEQ ID NO: 165607 - DNA, 25 bp, Homo sapien
gggcgacatagcttccagttaatta

SEQ ID NO: 165608 - DNA, 25 bp, Homo sapien
agaaatgaatcaagtcccagcggcc

SEQ ID NO: 165609 - DNA, 25 bp, Homo sapien
aggcgctctcgcgagctctagcgtc

SEQ ID NO: 165610 - DNA, 25 bp, Homo sapien
tggggaacacagcttggacgcctag

SEQ ID NO: 165611 - DNA, 25 bp, Homo sapien
tgcgcacgcatgtgtgtctagaatc

SEQ ID NO: 165612 - DNA, 25 bp, Homo sapien
tcctttgcccgcttgaccaactttg

SEQ ID NO: 165613 - DNA, 25 bp, Homo sapien
tcctagtatttctctggcgtctgtc

SEQ ID NO: 165614 - DNA, 25 bp, Homo sapien
ggcgcgaatctcgatcctcctagta

SEQ ID NO: 165615 - DNA, 25 bp, Homo sapien
tttcttccagttatccgcgccgctg

SEQ ID NO: 165616 - DNA, 25 bp, Homo sapien
cgcgcgcttacagtcaactactttg

SEQ ID NO: 165617 - DNA, 25 bp, Homo sapien
gttcaagtagcgactccagcggatg

SEQ ID NO: 165618 - DNA, 25 bp, Homo sapien
atcccagcctggtgcgcacacaaga

SEQ ID NO: 165619 - DNA, 25 bp, Homo sapien
agcggcttggatctgcatagacatc

SEQ ID NO: 165620 - DNA, 25 bp, Homo sapien
ttctctaaagcgtccgggaatgatc

SEQ ID NO: 165621 - DNA, 25 bp, Homo sapien
cgcaccgcgtgagcttcatcgatct

SEQ ID NO: 165622 - DNA, 25 bp, Homo sapien
ccgtgaggttaatgcccaggctttt

SEQ ID NO: 165623 - DNA, 25 bp, Homo sapien
tgcccgatgtccaacgaacgaatga

SEQ ID NO: 165624 - DNA, 25 bp, Homo sapien
gcctcggcctacttctcaggactta

SEQ ID NO: 165625 - DNA, 25 bp, Homo sapien
gacttagctttgtccctgcccgcga

SEQ ID NO: 165626 - DNA, 25 bp, Homo sapien
accaccggctctgcttaggttcgaa

SEQ ID NO: 165627 - DNA, 25 bp, Homo sapien
taggttcgaactctgggccactctt

SEQ ID NO: 165628 - DNA, 25 bp, Homo sapien
cgccggcgcacctgcaatcaggccc

SEQ ID NO: 165629 - DNA, 25 bp, Homo sapien
cgcgctcgccgctgataagaggcgg

SEQ ID NO: 165630 - DNA, 25 bp, Homo sapien
cctcgagcccaaggccgccgcgcgc

SEQ ID NO: 165631 - DNA, 25 bp, Homo sapien
gcgcaggatgctggcgttgcggaag

SEQ ID NO: 165632 - DNA, 25 bp, Homo sapien
accgccctgcgtgcgaaggggaggc

SEQ ID NO: 165633 - DNA, 25 bp, Homo sapien
gcggctcattctaccgccctgcgtg

SEQ ID NO: 165634 - DNA, 25 bp, Homo sapien
gcgcgcggccgtgcggctcattcta

SEQ ID NO: 165635 - DNA, 25 bp, Homo sapien
gccgcctcctcgagcccaaggccgc

SEQ ID NO: 165636 - DNA, 25 bp, Homo sapien
tcgcctcttaaagggcctgaaacac

SEQ ID NO: 165637 - DNA, 25 bp, Homo sapien
ctcggtgtcactcccgctccggctc

SEQ ID NO: 165638 - DNA, 25 bp, Homo sapien
agcgtcgcctcttaaagggcctgaa

SEQ ID NO: 165639 - DNA, 25 bp, Homo sapien
gccgggaaatcccaccgcacaggcc

SEQ ID NO: 165640 - DNA, 25 bp, Homo sapien
cacggacagcccataataacctcaa

SEQ ID NO: 165641 - DNA, 25 bp, Homo sapien
tcgtcgctcaggcaaccactggcca

SEQ ID NO: 165642 - DNA, 25 bp, Homo sapien
cggctccagcgtcgcctcttaaagg

SEQ ID NO: 165643 - DNA, 25 bp, Homo sapien
ggacagcccataataacctcaacca

SEQ ID NO: 165644 - DNA, 25 bp, Homo sapien
atacacggcgtgatgagtgaaggcc

SEQ ID NO: 165645 - DNA, 25 bp, Homo sapien
tgaaggccgctgtgactctgggccc

SEQ ID NO: 165646 - DNA, 25 bp, Homo sapien
ctgggcccgcgggaaatcatctcgg

SEQ ID NO: 165647 - DNA, 25 bp, Homo sapien
cgcgggaaatcatctcgggagtttt

SEQ ID NO: 165648 - DNA, 25 bp, Homo sapien
catctcgggagttttgtggggacca

SEQ ID NO: 165649 - DNA, 25 bp, Homo sapien
gggcactgctttcccaattgcccgg

SEQ ID NO: 165650 - DNA, 25 bp, Homo sapien
caattgcccggaccacgccagcgcc

SEQ ID NO: 165651 - DNA, 25 bp, Homo sapien
tcttcccggtctgtggcgacacctg

SEQ ID NO: 165652 - DNA, 25 bp, Homo sapien
cctgcatgccaattaggccctaatt

SEQ ID NO: 165653 - DNA, 25 bp, Homo sapien
agctttcttgcaacgcgacgcctct

SEQ ID NO: 165654 - DNA, 25 bp, Homo sapien
ttaccaacagctttcttgcaacgcg

SEQ ID NO: 165655 - DNA, 25 bp, Homo sapien
acccaattccgcttattaccaacag

SEQ ID NO: 165656 - DNA, 25 bp, Homo sapien
cgcctcggttctccagggcgaaacg

SEQ ID NO: 165657 - DNA, 25 bp, Homo sapien
aggccctaatttgatttctgttcta

SEQ ID NO: 165658 - DNA, 25 bp, Homo sapien
ctcggttctccagggcgaaacgcag

SEQ ID NO: 165659 - DNA, 25 bp, Homo sapien
atttctgttctatctgtgcgaaccc

SEQ ID NO: 165660 - DNA, 25 bp, Homo sapien
atcggaagtcacatgctgcccaggc

SEQ ID NO: 165661 - DNA, 25 bp, Homo sapien
ctcccatcatggtctgtgtagtctc

SEQ ID NO: 165662 - DNA, 25 bp, Homo sapien
cacccaataggaggccggaagcatc

SEQ ID NO: 165663 - DNA, 25 bp, Homo sapien
gtcgcgcaagatcttctcaccattg

SEQ ID NO: 165664 - DNA, 25 bp, Homo sapien
ctcgcgacgttgttcccgaagtgca

SEQ ID NO: 165665 - DNA, 25 bp, Homo sapien
ctgcccttgcagtcccagagcgttt

SEQ ID NO: 165666 - DNA, 25 bp, Homo sapien
tgccggcttccagtccaagtgatgc

SEQ ID NO: 165667 - DNA, 25 bp, Homo sapien
cctctgagtgcatttcggtgcagtc

SEQ ID NO: 165668 - DNA, 25 bp, Homo sapien
cggggacgtgttcatccagatgccc

SEQ ID NO: 165669 - DNA, 25 bp, Homo sapien
ggacgtgttcatccagatgcccgcg

SEQ ID NO: 165670 - DNA, 25 bp, Homo sapien
gttcatccagatgcccgcgtccagg

SEQ ID NO: 165671 - DNA, 25 bp, Homo sapien
accaccatttccaccatggcggcca

SEQ ID NO: 165672 - DNA, 25 bp, Homo sapien
catttccaccatggcggccaccgcg

SEQ ID NO: 165673 - DNA, 25 bp, Homo sapien
ccctgctgcagcacgtgggtgggga

SEQ ID NO: 165674 - DNA, 25 bp, Homo sapien
gacgagcagcctgggacgcccgccc

SEQ ID NO: 165675 - DNA, 25 bp, Homo sapien
gtgttcatccagatgcccgcgtcca

SEQ ID NO: 165676 - DNA, 25 bp, Homo sapien
gaagaccgccaccatcacgacatag

SEQ ID NO: 165677 - DNA, 25 bp, Homo sapien
atctctgccctacacgcgggagtca

SEQ ID NO: 165678 - DNA, 25 bp, Homo sapien
ctggcggcctaagtgggcctaactt

SEQ ID NO: 165679 - DNA, 25 bp, Homo sapien
gagccagcctcatagacattccttg

SEQ ID NO: 165680 - DNA, 25 bp, Homo sapien
tgggagcagccaatccacgcgaagg

SEQ ID NO: 165681 - DNA, 25 bp, Homo sapien
ttacacggaaaacgactgcgcaagc

SEQ ID NO: 165682 - DNA, 25 bp, Homo sapien
atagcgcagcacatatgggtaaaca

SEQ ID NO: 165683 - DNA, 25 bp, Homo sapien
cagcctaaggcggagccctaggaca

SEQ ID NO: 165684 - DNA, 25 bp, Homo sapien
tttgtccgcgaagggctaagagcct

SEQ ID NO: 165685 - DNA, 25 bp, Homo sapien
atgagatcatgagatgccggcgctc

SEQ ID NO: 165686 - DNA, 25 bp, Homo sapien
cgctcgccgaggagtcgatttgttg

SEQ ID NO: 165687 - DNA, 25 bp, Homo sapien
cgcaaagatgcgtcaaaaggatgga

SEQ ID NO: 165688 - DNA, 25 bp, Homo sapien
tggaaaaggcagctttgcccttcgc

SEQ ID NO: 165689 - DNA, 25 bp, Homo sapien
ttgcccttcgcaaactgagatctcc

SEQ ID NO: 165690 - DNA, 25 bp, Homo sapien
aactgagatctcctttgtccgcgaa

SEQ ID NO: 165691 - DNA, 25 bp, Homo sapien
gcccgacgcggtgatctcatccggg

SEQ ID NO: 165692 - DNA, 25 bp, Homo sapien
cccgcgatccatccaaaatgttctt

SEQ ID NO: 165693 - DNA, 25 bp, Homo sapien
cgcgtctgtcgctcaacttcctttt

SEQ ID NO: 165694 - DNA, 25 bp, Homo sapien
cagggcgcagcacggaagtaactct

SEQ ID NO: 165695 - DNA, 25 bp, Homo sapien
gacactcacacaccggcaaacagga

SEQ ID NO: 165696 - DNA, 25 bp, Homo sapien
gagagcgtttccaatctcctggacg

SEQ ID NO: 165697 - DNA, 25 bp, Homo sapien
agccctctctccacagttctatttg

SEQ ID NO: 165698 - DNA, 25 bp, Homo sapien
tcgtcgcttgttttttctcttcctc

SEQ ID NO: 165699 - DNA, 25 bp, Homo sapien
caaattccacgctttgggcttcgcg

SEQ ID NO: 165700 - DNA, 25 bp, Homo sapien
tattaattaaagtgtcacatggtgg

SEQ ID NO: 165701 - DNA, 25 bp, Homo sapien
ttgttgtgctgacggcgctattatt

SEQ ID NO: 165702 - DNA, 25 bp, Homo sapien
ctccttgtgttgtgcgtttgttgtg

SEQ ID NO: 165703 - DNA, 25 bp, Homo sapien
ggcacgggcacatgaccgctggcct

SEQ ID NO: 165704 - DNA, 25 bp, Homo sapien
gcagctcgtcgcctagcgccttgag

SEQ ID NO: 165705 - DNA, 25 bp, Homo sapien
ccacatggtgcgctggtgcagctcg

SEQ ID NO: 165706 - DNA, 25 bp, Homo sapien
gcgtacctgttgctcgctccggctg

SEQ ID NO: 165707 - DNA, 25 bp, Homo sapien
cccgcgttcctacaagttccgcctg

SEQ ID NO: 165708 - DNA, 25 bp, Homo sapien
gcagtggagaccctaaggggtcggc

SEQ ID NO: 165709 - DNA, 25 bp, Homo sapien
ttaatgcgcagtggagaccctaagg

SEQ ID NO: 165710 - DNA, 25 bp, Homo sapien
taatgcgcagtggagaccctaaggg

SEQ ID NO: 165711 - DNA, 25 bp, Homo sapien
aatgcgcagtggagaccctaagggg

SEQ ID NO: 165712 - DNA, 25 bp, Homo sapien
atgcgcagtggagaccctaaggggt

SEQ ID NO: 165713 - DNA, 25 bp, Homo sapien
gcgcagtggagaccctaaggggtcg

SEQ ID NO: 165714 - DNA, 25 bp, Homo sapien
tggagaccctaaggggtcggcgaga

SEQ ID NO: 165715 - DNA, 25 bp, Homo sapien
tgcgcagtggagaccctaaggggtc

SEQ ID NO: 165716 - DNA, 25 bp, Homo sapien
gctttctttgtgaacattattttcc

SEQ ID NO: 165717 - DNA, 25 bp, Homo sapien
tcctgatggcgttacagttttctgc

SEQ ID NO: 165718 - DNA, 25 bp, Homo sapien
aacttcttgtctgctttctttgtga

SEQ ID NO: 165719 - DNA, 25 bp, Homo sapien
ccgcacccaaaagaccctcgcaagg

SEQ ID NO: 165720 - DNA, 25 bp, Homo sapien
acggaggcattctcgctgcccggca

SEQ ID NO: 165721 - DNA, 25 bp, Homo sapien
gaacattattttcctgatggcgtta

SEQ ID NO: 165722 - DNA, 25 bp, Homo sapien
gcgttacagttttctgcgatgaccc

SEQ ID NO: 165723 - DNA, 25 bp, Homo sapien
ttctaaagggaaacttcttgtctgc

SEQ ID NO: 165724 - DNA, 25 bp, Homo sapien
accaccacgtgcgtacaggggcagc

SEQ ID NO: 165725 - DNA, 25 bp, Homo sapien
tggcacccggtggaaccgaggagaa

SEQ ID NO: 165726 - DNA, 25 bp, Homo sapien
ggagcggcgaatatggacgactaca

SEQ ID NO: 165727 - DNA, 25 bp, Homo sapien
cgaatatggacgactacagcctgga

SEQ ID NO: 165728 - DNA, 25 bp, Homo sapien
tacagcctggatgagttccgtcggc

SEQ ID NO: 165729 - DNA, 25 bp, Homo sapien
aggacgtagcgagccgctcacgttc

SEQ ID NO: 165730 - DNA, 25 bp, Homo sapien
ggagcagctggtggaccagctcatc

SEQ ID NO: 165731 - DNA, 25 bp, Homo sapien
aagccggaccaccacgtgcgtacag

SEQ ID NO: 165732 - DNA, 25 bp, Homo sapien
gcatcttggtctcaatgtcgatccc

SEQ ID NO: 165733 - DNA, 25 bp, Homo sapien
agccttggctatgtaccggcgctgc

SEQ ID NO: 165734 - DNA, 25 bp, Homo sapien
catgttaaggaagcggacgtgcatc

SEQ ID NO: 165735 - DNA, 25 bp, Homo sapien
agggccatggtttccatgttaagga

SEQ ID NO: 165736 - DNA, 25 bp, Homo sapien
cgcagacgagccttggctatgtacc

SEQ ID NO: 165737 - DNA, 25 bp, Homo sapien
cggccccattgcaaagtgcagtttc

SEQ ID NO: 165738 - DNA, 25 bp, Homo sapien
ccctgccagatctggaagggacgga

SEQ ID NO: 165739 - DNA, 25 bp, Homo sapien
gcggacgtgcatcttggtctcaatg

SEQ ID NO: 165740 - DNA, 25 bp, Homo sapien
tacaccagcgggtccagcacgcagt

SEQ ID NO: 165741 - DNA, 25 bp, Homo sapien
gccctcggcgctaaagtagtacacc

SEQ ID NO: 165742 - DNA, 25 bp, Homo sapien
ctggccgccaggttacacatgtaca

SEQ ID NO: 165743 - DNA, 25 bp, Homo sapien
cagctgccgtacatgttcatctgga

SEQ ID NO: 165744 - DNA, 25 bp, Homo sapien
cggtccacgttgatgagcatcagga

SEQ ID NO: 165745 - DNA, 25 bp, Homo sapien
tcgtcgctgaagctctcgaagcata

SEQ ID NO: 165746 - DNA, 25 bp, Homo sapien
cgtagaccgccagcgtgctgttgta

SEQ ID NO: 165747 - DNA, 25 bp, Homo sapien
tgcctttccacagctcgtcgctgaa

SEQ ID NO: 165748 - DNA, 25 bp, Homo sapien
ggccagaggagcatactttacattt

SEQ ID NO: 165749 - DNA, 25 bp, Homo sapien
attcttccagagtgatgcggccgtc

SEQ ID NO: 165750 - DNA, 25 bp, Homo sapien
gggtttcccgacagcagctcctcga

SEQ ID NO: 165751 - DNA, 25 bp, Homo sapien
tacatttcgatattcttccagagtg

SEQ ID NO: 165752 - DNA, 25 bp, Homo sapien
ataagcgggaaaggcactgcgcgtc

SEQ ID NO: 165753 - DNA, 25 bp, Homo sapien
tcgatgtgagggtttcccgacagca

SEQ ID NO: 165754 - DNA, 25 bp, Homo sapien
gcgagcggactccttctcgatgtga

SEQ ID NO: 165755 - DNA, 25 bp, Homo sapien
tgaccttgggcctccatcagggtcg

SEQ ID NO: 165756 - DNA, 25 bp, Homo sapien
gctctcgcgctcacgaatgcaaacg

SEQ ID NO: 165757 - DNA, 25 bp, Homo sapien
tgcaaacgactctcaggtgtggggc

SEQ ID NO: 165758 - DNA, 25 bp, Homo sapien
agttcccgggccagtccgaagctga

SEQ ID NO: 165759 - DNA, 25 bp, Homo sapien
cagcggggacccatttgaaagagga

SEQ ID NO: 165760 - DNA, 25 bp, Homo sapien
gacttcaaaactttccgctctcgcg

SEQ ID NO: 165761 - DNA, 25 bp, Homo sapien
gtcccgggagactcagcgaactcag

SEQ ID NO: 165762 - DNA, 25 bp, Homo sapien
tgaggctgcctgaacccattttaca

SEQ ID NO: 165763 - DNA, 25 bp, Homo sapien
gcgggtactcacagccggtcttgcc

SEQ ID NO: 165764 - DNA, 25 bp, Homo sapien
cctctgaaggaaccgatggcccacg

SEQ ID NO: 165765 - DNA, 25 bp, Homo sapien
cgagggctcaaacgtgcgctgaaaa

SEQ ID NO: 165766 - DNA, 25 bp, Homo sapien
gcttaccttgggctgcgtatcgaca

SEQ ID NO: 165767 - DNA, 25 bp, Homo sapien
tgtgcagacccagccacgtttagct

SEQ ID NO: 165768 - DNA, 25 bp, Homo sapien
tgcgtatcgacaggagccgtcctcc

SEQ ID NO: 165769 - DNA, 25 bp, Homo sapien
ctccaccagcacgttatagaaaggc

SEQ ID NO: 165770 - DNA, 25 bp, Homo sapien
ggacgttcatgttccggatccactc

SEQ ID NO: 165771 - DNA, 25 bp, Homo sapien
acgtttagctgactgtgggcccgaa

SEQ ID NO: 165772 - DNA, 25 bp, Homo sapien
tgacatccatgtgaagtgccctgca

SEQ ID NO: 165773 - DNA, 25 bp, Homo sapien
cgctatcgtttcctgctgtgtgtga

SEQ ID NO: 165774 - DNA, 25 bp, Homo sapien
tgccctgcacgtcgtagtaactgtg

SEQ ID NO: 165775 - DNA, 25 bp, Homo sapien
tgtggagccacaaacgatgtcgttt

SEQ ID NO: 165776 - DNA, 25 bp, Homo sapien
cgcggtagtcttatctcagttgctt

SEQ ID NO: 165777 - DNA, 25 bp, Homo sapien
aagcccttctatgaggcccgtggca

SEQ ID NO: 165778 - DNA, 25 bp, Homo sapien
gcctggtgaacctacagtgtattta

SEQ ID NO: 165779 - DNA, 25 bp, Homo sapien
gcatgcggatgctgacgatattctc

SEQ ID NO: 165780 - DNA, 25 bp, Homo sapien
cggagtcctaccagttcggctatct

SEQ ID NO: 165781 - DNA, 25 bp, Homo sapien
cccgagacaaggtgacggcgacgtt

SEQ ID NO: 165782 - DNA, 25 bp, Homo sapien
tccggggaaactccaggtgcatgtt

SEQ ID NO: 165783 - DNA, 25 bp, Homo sapien
tggtttctgttgctaccaggcaagc

SEQ ID NO: 165784 - DNA, 25 bp, Homo sapien
tctagacttaccacggaggcgagca

SEQ ID NO: 165785 - DNA, 25 bp, Homo sapien
cgcggactttcatgctctagactta

SEQ ID NO: 165786 - DNA, 25 bp, Homo sapien
tctgcagagtaaacagggccgttca

SEQ ID NO: 165787 - DNA, 25 bp, Homo sapien
ttcttttgttcaggacaggactcga

SEQ ID NO: 165788 - DNA, 25 bp, Homo sapien
cgatcgatgcatcactgggtccatg

SEQ ID NO: 165789 - DNA, 25 bp, Homo sapien
cgccgcaaaagggaggacataattg

SEQ ID NO: 165790 - DNA, 25 bp, Homo sapien
cctcacccggcaggttgacgaggca

SEQ ID NO: 165791 - DNA, 25 bp, Homo sapien
ccgcagcacaggatgtactccagca

SEQ ID NO: 165792 - DNA, 25 bp, Homo sapien
tcctagatgcgccatttggggaccc

SEQ ID NO: 165793 - DNA, 25 bp, Homo sapien
tcacccttgacggaggacccggctg

SEQ ID NO: 165794 - DNA, 25 bp, Homo sapien
ccgaagtcgggcacaaaagaagcgc

SEQ ID NO: 165795 - DNA, 25 bp, Homo sapien
tgtaaacatttcagcccgaagtcgg

SEQ ID NO: 165796 - DNA, 25 bp, Homo sapien
gaaccaagttgggacgcgcagcaaa

SEQ ID NO: 165797 - DNA, 25 bp, Homo sapien
ccgctaggaggaaaatgaggccgcc

SEQ ID NO: 165798 - DNA, 25 bp, Homo sapien
tcttgcaaagttggagcctgggcgc

SEQ ID NO: 165799 - DNA, 25 bp, Homo sapien
gtgccaaagactccgccattacctg

SEQ ID NO: 165800 - DNA, 25 bp, Homo sapien
ccaatctcgcccagacggaagaagt

SEQ ID NO: 165801 - DNA, 25 bp, Homo sapien
gcacaactttcccaggttttggaga

SEQ ID NO: 165802 - DNA, 25 bp, Homo sapien
cctttgcgggagaagcacaactttc

SEQ ID NO: 165803 - DNA, 25 bp, Homo sapien
tcagcctcagcgaacccaagttcgg

SEQ ID NO: 165804 - DNA, 25 bp, Homo sapien
ctggtgtgacaatagtgctggacgc

SEQ ID NO: 165805 - DNA, 25 bp, Homo sapien
ggggcacacgggattgttctccttc

SEQ ID NO: 165806 - DNA, 25 bp, Homo sapien
aagcctgtccacgtgggtgtacaca

SEQ ID NO: 165807 - DNA, 25 bp, Homo sapien
taggcgtccacggtaagcctgtcca

SEQ ID NO: 165808 - DNA, 25 bp, Homo sapien
cccgggatcaagtgtatcagttttc

SEQ ID NO: 165809 - DNA, 25 bp, Homo sapien
atttgctccgatgcagcgcggtgaa

SEQ ID NO: 165810 - DNA, 25 bp, Homo sapien
cagctggaactcgtgggatttgctc

SEQ ID NO: 165811 - DNA, 25 bp, Homo sapien
caccgatcgcactcacttgggcgtg

SEQ ID NO: 165812 - DNA, 25 bp, Homo sapien
taaaaccctcggtgcgcgccggaga

SEQ ID NO: 165813 - DNA, 25 bp, Homo sapien
tgacggttgctgcaatcgctcctgc

SEQ ID NO: 165814 - DNA, 25 bp, Homo sapien
tcttgcctgtcaatcaaagggcggg

SEQ ID NO: 165815 - DNA, 25 bp, Homo sapien
agctcgcgtggcaaagtgaaattac

SEQ ID NO: 165816 - DNA, 25 bp, Homo sapien
gtgaaattactaccgggagtgcgtg

SEQ ID NO: 165817 - DNA, 25 bp, Homo sapien
cgcgttctcaaggtgctgtctgcat

SEQ ID NO: 165818 - DNA, 25 bp, Homo sapien
tgggcacatcccgtctgtctttagc

SEQ ID NO: 165819 - DNA, 25 bp, Homo sapien
tccacggtttggagtgctttagcgc

SEQ ID NO: 165820 - DNA, 25 bp, Homo sapien
cagactcgtccgttctgtttagggc

SEQ ID NO: 165821 - DNA, 25 bp, Homo sapien
agaagaaggcggctttcgcacctgg

SEQ ID NO: 165822 - DNA, 25 bp, Homo sapien
cgcgaactgtaagtgccagggtctc

SEQ ID NO: 165823 - DNA, 25 bp, Homo sapien
cgcgacgatctcagcggatctggtc

SEQ ID NO: 165824 - DNA, 25 bp, Homo sapien
cgcggcgaccaagatcaggaacctg

SEQ ID NO: 165825 - DNA, 25 bp, Homo sapien
ggcttttgccagttctcaccctttc

SEQ ID NO: 165826 - DNA, 25 bp, Homo sapien
cccagctccatttgccgaagaagaa

SEQ ID NO: 165827 - DNA, 25 bp, Homo sapien
tggagacctcagcactcaagcagca

SEQ ID NO: 165828 - DNA, 25 bp, Homo sapien
gcggtacgctgacgggataaaagct

SEQ ID NO: 165829 - DNA, 25 bp, Homo sapien
cgggataaaagctgaggggttgctc

SEQ ID NO: 165830 - DNA, 25 bp, Homo sapien
gggaagacgcgcgaaccagataaaa

SEQ ID NO: 165831 - DNA, 25 bp, Homo sapien
gaagacgcgcgaaccagataaaaat

SEQ ID NO: 165832 - DNA, 25 bp, Homo sapien
tgaggggaaccagcgccggataaaa

SEQ ID NO: 165833 - DNA, 25 bp, Homo sapien
gagcgatagaaaccggagtagggga

SEQ ID NO: 165834 - DNA, 25 bp, Homo sapien
agccgggctgagagaaaaaccaagc

SEQ ID NO: 165835 - DNA, 25 bp, Homo sapien
gtagagccgggctgagagaaaaacc

SEQ ID NO: 165836 - DNA, 25 bp, Homo sapien
tccgcccgggacagcagtaccgagt

SEQ ID NO: 165837 - DNA, 25 bp, Homo sapien
cggcacacgtgcctctttactttgc

SEQ ID NO: 165838 - DNA, 25 bp, Homo sapien
gaaaacaacaggagcgggatccctc

SEQ ID NO: 165839 - DNA, 25 bp, Homo sapien
cccaggaaggatgcttggctgagcc

SEQ ID NO: 165840 - DNA, 25 bp, Homo sapien
accgctgactgggaaaactcaactt

SEQ ID NO: 165841 - DNA, 25 bp, Homo sapien
agggaattgggtctctcgctgtccc

SEQ ID NO: 165842 - DNA, 25 bp, Homo sapien
cttcctgcaaagacggccgagctgc

SEQ ID NO: 165843 - DNA, 25 bp, Homo sapien
agcggttgccaagctgcagaacgca

SEQ ID NO: 165844 - DNA, 25 bp, Homo sapien
acccagactggcaaattaggaacgg

SEQ ID NO: 165845 - DNA, 25 bp, Homo sapien
aggcctgagtcgaatcctgggctgc

SEQ ID NO: 165846 - DNA, 25 bp, Homo sapien
gcgcgaccaccatgaggaagcgatc

SEQ ID NO: 165847 - DNA, 25 bp, Homo sapien
tcctcatggccggagaagatccgcc

SEQ ID NO: 165848 - DNA, 25 bp, Homo sapien
ctgttggagcaggtgtaaacctctc

SEQ ID NO: 165849 - DNA, 25 bp, Homo sapien
ccgctccgagaccaggacagacaga

SEQ ID NO: 165850 - DNA, 25 bp, Homo sapien
tcagcagtgcgaagaagcgttcgta

SEQ ID NO: 165851 - DNA, 25 bp, Homo sapien
atgggagtatcccaggacctaggga

SEQ ID NO: 165852 - DNA, 25 bp, Homo sapien
ccgagagcctgtgacgcattatgta

SEQ ID NO: 165853 - DNA, 25 bp, Homo sapien
ttttggagggctgaagcctcacccg

SEQ ID NO: 165854 - DNA, 25 bp, Homo sapien
ttaaatgggtcgagagcgtccagcc

SEQ ID NO: 165855 - DNA, 25 bp, Homo sapien
ccgggcccttgagcctgcaagaagt

SEQ ID NO: 165856 - DNA, 25 bp, Homo sapien
attcattcacttttcccgggcttca

SEQ ID NO: 165857 - DNA, 25 bp, Homo sapien
cggccgatttctcctttgttaaatg

SEQ ID NO: 165858 - DNA, 25 bp, Homo sapien
ttcggcctgcggcagaaattcattc

SEQ ID NO: 165859 - DNA, 25 bp, Homo sapien
tcagacccaagagggacctaggttc

SEQ ID NO: 165860 - DNA, 25 bp, Homo sapien
ttctgggacctggtccttcagggga

SEQ ID NO: 165861 - DNA, 25 bp, Homo sapien
ggtgctctcacctcagacctgctgt

SEQ ID NO: 165862 - DNA, 25 bp, Homo sapien
ccctatcctagtgcctcatgaggca

SEQ ID NO: 165863 - DNA, 25 bp, Homo sapien
cttgttcctgagtcgctctcctgtg

SEQ ID NO: 165864 - DNA, 25 bp, Homo sapien
cactctgttctaagccctctgggga

SEQ ID NO: 165865 - DNA, 25 bp, Homo sapien
ctggggtcttctcacactctgttct

SEQ ID NO: 165866 - DNA, 25 bp, Homo sapien
tctctctaggtgtcctgctctcagc

SEQ ID NO: 165867 - DNA, 25 bp, Homo sapien
ttcagtcttggaccctctcggagtc

SEQ ID NO: 165868 - DNA, 25 bp, Homo sapien
cagttcttgccggtcccacgtacgg

SEQ ID NO: 165869 - DNA, 25 bp, Homo sapien
tgcggcgcttaaactcagatcgctc

SEQ ID NO: 165870 - DNA, 25 bp, Homo sapien
gggccctggacttcggatagtctcc

SEQ ID NO: 165871 - DNA, 25 bp, Homo sapien
cattatgtgcagtcctcgctcggtc

SEQ ID NO: 165872 - DNA, 25 bp, Homo sapien
tgcagcctcgacctcagagcaagcg

SEQ ID NO: 165873 - DNA, 25 bp, Homo sapien
acaaggtctcatttccgtcgcccgg

SEQ ID NO: 165874 - DNA, 25 bp, Homo sapien
gtcttgtgcaactctcaggcgcctg

SEQ ID NO: 165875 - DNA, 25 bp, Homo sapien
agcgcgcggctttcattttactcag

SEQ ID NO: 165876 - DNA, 25 bp, Homo sapien
ggcagctctcgacccggaagtcgct

SEQ ID NO: 165877 - DNA, 25 bp, Homo sapien
taggtcgctaacgatcaccgcttta

SEQ ID NO: 165878 - DNA, 25 bp, Homo sapien
ctttagttctagctccaggcgccgc

SEQ ID NO: 165879 - DNA, 25 bp, Homo sapien
gcctgcccgtagatttgcctgactc

SEQ ID NO: 165880 - DNA, 25 bp, Homo sapien
cccactatacgttgaggattttaag

SEQ ID NO: 165881 - DNA, 25 bp, Homo sapien
tgccgcggacactgctaggcagacg

SEQ ID NO: 165882 - DNA, 25 bp, Homo sapien
gaagccctgggtgcgttacactcga

SEQ ID NO: 165883 - DNA, 25 bp, Homo sapien
tgcctgactctagcgaacctggctc

SEQ ID NO: 165884 - DNA, 25 bp, Homo sapien
tttgtccttgaacgcggcagggagt

SEQ ID NO: 165885 - DNA, 25 bp, Homo sapien
aggaatggccgcatcttccggctgc

SEQ ID NO: 165886 - DNA, 25 bp, Homo sapien
ttgaacacgaatttggaggtccttg

SEQ ID NO: 165887 - DNA, 25 bp, Homo sapien
gaggtccttgtttgtccttgaacgc

SEQ ID NO: 165888 - DNA, 25 bp, Homo sapien
cgggaggaggcacaaaatcgctttg

SEQ ID NO: 165889 - DNA, 25 bp, Homo sapien
aaatcgctttgtgcgacagcgcccg

SEQ ID NO: 165890 - DNA, 25 bp, Homo sapien
caagtacctgtaattggagcgtcca

SEQ ID NO: 165891 - DNA, 25 bp, Homo sapien
tccgccgtgaatgggccgcggacaa

SEQ ID NO: 165892 - DNA, 25 bp, Homo sapien
agggcaccctctgtaccggcctagg

SEQ ID NO: 165893 - DNA, 25 bp, Homo sapien
tgtctatcaaatggcactttctggg

SEQ ID NO: 165894 - DNA, 25 bp, Homo sapien
ccgaattggtgagggattgtctatc

SEQ ID NO: 165895 - DNA, 25 bp, Homo sapien
ccctgctcggcagatggcgagaagc

SEQ ID NO: 165896 - DNA, 25 bp, Homo sapien
catgcacagatgtaacgctgcgccc

SEQ ID NO: 165897 - DNA, 25 bp, Homo sapien
tgacagctccgcatgcacagatgta

SEQ ID NO: 165898 - DNA, 25 bp, Homo sapien
gagatacccttgacagctccgcatg

SEQ ID NO: 165899 - DNA, 25 bp, Homo sapien
caggccggctgtgagacacaaaaga

SEQ ID NO: 165900 - DNA, 25 bp, Homo sapien
tgtcgccagtatcacggcccgcaag

SEQ ID NO: 165901 - DNA, 25 bp, Homo sapien
aaagcccagcggacgagcctccttt

SEQ ID NO: 165902 - DNA, 25 bp, Homo sapien
cctctctgggtttcacccggacaga

SEQ ID NO: 165903 - DNA, 25 bp, Homo sapien
cccgtttggaatccacgtttcagca

SEQ ID NO: 165904 - DNA, 25 bp, Homo sapien
cacgtttcagcactttggacagcgc

SEQ ID NO: 165905 - DNA, 25 bp, Homo sapien
cgaggaaccttcaaagcggtggcca

SEQ ID NO: 165906 - DNA, 25 bp, Homo sapien
cccgagagcatcattgtcgccagta

SEQ ID NO: 165907 - DNA, 25 bp, Homo sapien
tggtgctgcccagaaagccagccct

SEQ ID NO: 165908 - DNA, 25 bp, Homo sapien
ggtctcccttgcggcaacgtgcaga

SEQ ID NO: 165909 - DNA, 25 bp, Homo sapien
gcctatgagaaagcgccggagagac

SEQ ID NO: 165910 - DNA, 25 bp, Homo sapien
tacagtgagaaggactcgcagcagc

SEQ ID NO: 165911 - DNA, 25 bp, Homo sapien
agcgcgtcggagacgtcggtcctac

SEQ ID NO: 165912 - DNA, 25 bp, Homo sapien
gagcgggatcccaaatacagtgaga

SEQ ID NO: 165913 - DNA, 25 bp, Homo sapien
cccatcccgtgacccagtggggtgg

SEQ ID NO: 165914 - DNA, 25 bp, Homo sapien
gtactaacaaccctcgcagactctt

SEQ ID NO: 165915 - DNA, 25 bp, Homo sapien
cgtcggtcctactcgcctatgagaa

SEQ ID NO: 165916 - DNA, 25 bp, Homo sapien
ggcccaagggttagcagttgcctac

SEQ ID NO: 165917 - DNA, 25 bp, Homo sapien
cccacgaattccagccaatgaggaa

SEQ ID NO: 165918 - DNA, 25 bp, Homo sapien
ttccagccaatgaggaagccctcct

SEQ ID NO: 165919 - DNA, 25 bp, Homo sapien
aatgaggaagccctcctcggcgtcc

SEQ ID NO: 165920 - DNA, 25 bp, Homo sapien
cacccggcccaagggttagcagttg

SEQ ID NO: 165921 - DNA, 25 bp, Homo sapien
ccgcagtgcgataaacccctcgttg

SEQ ID NO: 165922 - DNA, 25 bp, Homo sapien
tggggccgccttagttctcggccgc

SEQ ID NO: 165923 - DNA, 25 bp, Homo sapien
cgtcccgttgccaagcaactgggtt

SEQ ID NO: 165924 - DNA, 25 bp, Homo sapien
ccctagcgagcgcagtaagctcata

SEQ ID NO: 165925 - DNA, 25 bp, Homo sapien
ttactctttctacccagcgcgtcgt

SEQ ID NO: 165926 - DNA, 25 bp, Homo sapien
caccagcaaagtgggtgcgcctctc

SEQ ID NO: 165927 - DNA, 25 bp, Homo sapien
agcgcccaggactgtctctatctca

SEQ ID NO: 165928 - DNA, 25 bp, Homo sapien
ccgtggactttgctgactcctctga

SEQ ID NO: 165929 - DNA, 25 bp, Homo sapien
ctcctcgtggtactcagagccctga

SEQ ID NO: 165930 - DNA, 25 bp, Homo sapien
cccgcgctaggtgttctttgtcctc

SEQ ID NO: 165931 - DNA, 25 bp, Homo sapien
ggcacgctctgtccaggcaacagtt

SEQ ID NO: 165932 - DNA, 25 bp, Homo sapien
atgaacggctcagattgcccgcgcg

SEQ ID NO: 165933 - DNA, 25 bp, Homo sapien
ttaccgcaccgctcaagaccggaag

SEQ ID NO: 165934 - DNA, 25 bp, Homo sapien
atagcctcgcgcgtttagctggccg

SEQ ID NO: 165935 - DNA, 25 bp, Homo sapien
gaaagtgtcggtttatcttcgcgcc

SEQ ID NO: 165936 - DNA, 25 bp, Homo sapien
taaagcgcgattgcgagagctcggc

SEQ ID NO: 165937 - DNA, 25 bp, Homo sapien
cagggtccctttcctgcagtgaggc

SEQ ID NO: 165938 - DNA, 25 bp, Homo sapien
cccatcatgggcaataccagcagtg

SEQ ID NO: 165939 - DNA, 25 bp, Homo sapien
aggcccaagatcctgatggacagcc

SEQ ID NO: 165940 - DNA, 25 bp, Homo sapien
ttttccttttgcatggtagccacga

SEQ ID NO: 165941 - DNA, 25 bp, Homo sapien
tggtagccacgaccgcccacagtga

SEQ ID NO: 165942 - DNA, 25 bp, Homo sapien
cccaggacgcgaccgagacaggtat

SEQ ID NO: 165943 - DNA, 25 bp, Homo sapien
gcagccatctcgaagcaaaacaaag

SEQ ID NO: 165944 - DNA, 25 bp, Homo sapien
tgactgtaacgcgacaggggccgaa

SEQ ID NO: 165945 - DNA, 25 bp, Homo sapien
gccgaagccattttgcggctaaagc

SEQ ID NO: 165946 - DNA, 25 bp, Homo sapien
acatccgcccgacactgaaactttt

SEQ ID NO: 165947 - DNA, 25 bp, Homo sapien
ccgagacaggtatgacgtcactgga

SEQ ID NO: 165948 - DNA, 25 bp, Homo sapien
gctgtcttcaaacagcctcccgggg

SEQ ID NO: 165949 - DNA, 25 bp, Homo sapien
acacaagaggaacgtagggagctgc

SEQ ID NO: 165950 - DNA, 25 bp, Homo sapien
ctgctggcgacacaagaggaacgta

SEQ ID NO: 165951 - DNA, 25 bp, Homo sapien
gcttggtgatgtgctcgttgtacgt

SEQ ID NO: 165952 - DNA, 25 bp, Homo sapien
aggccacgcgcttggtgatgtgctc

SEQ ID NO: 165953 - DNA, 25 bp, Homo sapien
agacttgtccctgcgcagctcggtc

SEQ ID NO: 165954 - DNA, 25 bp, Homo sapien
cggccaggagacttgtccctgcgca

SEQ ID NO: 165955 - DNA, 25 bp, Homo sapien
gggaccgctctctccgcgtgctgag

SEQ ID NO: 165956 - DNA, 25 bp, Homo sapien
gaggttgacgattccgcccagccct

SEQ ID NO: 165957 - DNA, 25 bp, Homo sapien
tgagccaccagagatcgaacccggg

SEQ ID NO: 165958 - DNA, 25 bp, Homo sapien
tgccacaaaccctcctacgagagga

SEQ ID NO: 165959 - DNA, 25 bp, Homo sapien
cctctttgttcgcaggcggaggtct

SEQ ID NO: 165960 - DNA, 25 bp, Homo sapien
tcgcattgaaatctggccgggcgtt

SEQ ID NO: 165961 - DNA, 25 bp, Homo sapien
cggggtccaacgacaagtttcgcat

SEQ ID NO: 165962 - DNA, 25 bp, Homo sapien
cctcctacgagaggaccaggacggc

SEQ ID NO: 165963 - DNA, 25 bp, Homo sapien
caccagagatcgaacccggggtcca

SEQ ID NO: 165964 - DNA, 25 bp, Homo sapien
atcagtcaccaggaggctgcccatc

SEQ ID NO: 165965 - DNA, 25 bp, Homo sapien
ggacactcgtccatcagtcaccagg

SEQ ID NO: 165966 - DNA, 25 bp, Homo sapien
ccaggcgagttagagccgagcatca

SEQ ID NO: 165967 - DNA, 25 bp, Homo sapien
accatggttgcaagctgaggcgtcc

SEQ ID NO: 165968 - DNA, 25 bp, Homo sapien
tgggaatgcacggatggacatatgc

SEQ ID NO: 165969 - DNA, 25 bp, Homo sapien
cggatggacatatgcggctcctacc

SEQ ID NO: 165970 - DNA, 25 bp, Homo sapien
gggcgtgttacatcctctccacttc

SEQ ID NO: 165971 - DNA, 25 bp, Homo sapien
cccgccagaaacgttaccatggttg

SEQ ID NO: 165972 - DNA, 25 bp, Homo sapien
agccgtgtttggaccaatcagcgtc

SEQ ID NO: 165973 - DNA, 25 bp, Homo sapien
ccgtgtttggaccaatcagcgtctc

SEQ ID NO: 165974 - DNA, 25 bp, Homo sapien
tctcagccgtgtttggaccaatcag

SEQ ID NO: 165975 - DNA, 25 bp, Homo sapien
cccaggtctgcgatctgttccgccc

SEQ ID NO: 165976 - DNA, 25 bp, Homo sapien
ggatcagactcacgctctgcgaacc

SEQ ID NO: 165977 - DNA, 25 bp, Homo sapien
ggggatcagactcacgctctgcgaa

SEQ ID NO: 165978 - DNA, 25 bp, Homo sapien
cccgggacttgtatgggtggaggcg

SEQ ID NO: 165979 - DNA, 25 bp, Homo sapien
agccgggtgcggtagaattgggtct

SEQ ID NO: 165980 - DNA, 25 bp, Homo sapien
ccgcgcttcagcacccgccgagccg

SEQ ID NO: 165981 - DNA, 25 bp, Homo sapien
agtctctgttcctgagtcctccctt

SEQ ID NO: 165982 - DNA, 25 bp, Homo sapien
gcaacagggcggctgagaacccggc

SEQ ID NO: 165983 - DNA, 25 bp, Homo sapien
gcggcggcgttcctcctcgcttcct

SEQ ID NO: 165984 - DNA, 25 bp, Homo sapien
cgaccctcagtctctgttcctgagt

SEQ ID NO: 165985 - DNA, 25 bp, Homo sapien
gcgcgcgggccatgtccgctttctg

SEQ ID NO: 165986 - DNA, 25 bp, Homo sapien
ccatgtccgctttctgcctgggctt

SEQ ID NO: 165987 - DNA, 25 bp, Homo sapien
cctgggcttggtcggccgcgcttca

SEQ ID NO: 165988 - DNA, 25 bp, Homo sapien
gcatccattagacgggctcgggtcc

SEQ ID NO: 165989 - DNA, 25 bp, Homo sapien
tgtccatggcaaccgatgccgcgtg

SEQ ID NO: 165990 - DNA, 25 bp, Homo sapien
caccacgggttctgacgctactgga

SEQ ID NO: 165991 - DNA, 25 bp, Homo sapien
cgccggcaacgttagtcagcacatt

SEQ ID NO: 165992 - DNA, 25 bp, Homo sapien
gcctcagggcgttttttggcaagga

SEQ ID NO: 165993 - DNA, 25 bp, Homo sapien
tgaggatttccgctgtttgctgcca

SEQ ID NO: 165994 - DNA, 25 bp, Homo sapien
ccagccaatagcagtgggtgtgacg

SEQ ID NO: 165995 - DNA, 25 bp, Homo sapien
ctgagccctcagcatccattagacg

SEQ ID NO: 165996 - DNA, 25 bp, Homo sapien
tgccgatggcacctcccgatacaaa

SEQ ID NO: 165997 - DNA, 25 bp, Homo sapien
accttcttggcactcgaggagggcg

SEQ ID NO: 165998 - DNA, 25 bp, Homo sapien
cgggctggtccaacaccttcttggc

SEQ ID NO: 165999 - DNA, 25 bp, Homo sapien
actctgcgaatcagtccgctcggcg

SEQ ID NO: 166000 - DNA, 25 bp, Homo sapien
cggccgggtagagcaatatacacta

SEQ ID NO: 166001 - DNA, 25 bp, Homo sapien
cagcaggctggcatcaagaaggcaa

SEQ ID NO: 166002 - DNA, 25 bp, Homo sapien
ataacggcacgaaactgagactgtc

SEQ ID NO: 166003 - DNA, 25 bp, Homo sapien
tagaacgtgccgctgtctcctcagg

SEQ ID NO: 166004 - DNA, 25 bp, Homo sapien
ccgctcagggtcgtcattcttatta

SEQ ID NO: 166005 - DNA, 25 bp, Homo sapien
cccggcgaatttgtaggcatcttcc

SEQ ID NO: 166006 - DNA, 25 bp, Homo sapien
ggtctcgaacaactggatgcccatc

SEQ ID NO: 166007 - DNA, 25 bp, Homo sapien
agtgcagcctcacctaatattcggc

SEQ ID NO: 166008 - DNA, 25 bp, Homo sapien
gttgatttcgtgaagccaccgcttg

SEQ ID NO: 166009 - DNA, 25 bp, Homo sapien
tgacgttgacaaaggactcggcact

SEQ ID NO: 166010 - DNA, 25 bp, Homo sapien
ctcggcactggtgacgtcgtaaacc

SEQ ID NO: 166011 - DNA, 25 bp, Homo sapien
ttcaaacgaaggcagagtcagcgca

SEQ ID NO: 166012 - DNA, 25 bp, Homo sapien
cggtcgctcaactgtgtccacaggt

SEQ ID NO: 166013 - DNA, 25 bp, Homo sapien
cagggcagttaacgaggcccagcgc

SEQ ID NO: 166014 - DNA, 25 bp, Homo sapien
gcacacacagggcagttaacgaggc

SEQ ID NO: 166015 - DNA, 25 bp, Homo sapien
gatgtagctgcctgcacacacaggg

SEQ ID NO: 166016 - DNA, 25 bp, Homo sapien
gtggtgatgtagctgcctgcacaca

SEQ ID NO: 166017 - DNA, 25 bp, Homo sapien
actccgatcgtggtgatgtagctgc

SEQ ID NO: 166018 - DNA, 25 bp, Homo sapien
ctccacggtccggatcttgaaatcc

SEQ ID NO: 166019 - DNA, 25 bp, Homo sapien
gatcttgaaatccactccgatcgtg

SEQ ID NO: 166020 - DNA, 25 bp, Homo sapien
ggctcgcacgagctccgggtttcca

SEQ ID NO: 166021 - DNA, 25 bp, Homo sapien
aaatgacaggcacgccgcgaccgtg

SEQ ID NO: 166022 - DNA, 25 bp, Homo sapien
gtcgtggacgttgttgctccctcat

SEQ ID NO: 166023 - DNA, 25 bp, Homo sapien
aagaagcccaaggtgccggagaagc

SEQ ID NO: 166024 - DNA, 25 bp, Homo sapien
tgtcgagtcccagcggaaagaagcc

SEQ ID NO: 166025 - DNA, 25 bp, Homo sapien
ctgtcgccgatgatgagcagcttga

SEQ ID NO: 166026 - DNA, 25 bp, Homo sapien
ggcggatccacttcccgaacaaaca

SEQ ID NO: 166027 - DNA, 25 bp, Homo sapien
cagccggaactgacagaaacacctc

SEQ ID NO: 166028 - DNA, 25 bp, Homo sapien
gagctccagctgctgaagtcgaggc

SEQ ID NO: 166029 - DNA, 25 bp, Homo sapien
gcagccctgagagtccagcctgaga

SEQ ID NO: 166030 - DNA, 25 bp, Homo sapien
ggctgactccggaaccgcttccgga

SEQ ID NO: 166031 - DNA, 25 bp, Homo sapien
ttccggaacgcttccgggtcacagc

SEQ ID NO: 166032 - DNA, 25 bp, Homo sapien
gcagccggatcacgggcttaaagtt

SEQ ID NO: 166033 - DNA, 25 bp, Homo sapien
cctcgtgggagactagcgcttgtaa

SEQ ID NO: 166034 - DNA, 25 bp, Homo sapien
agcgcttgtaacgtggtgagcccgc

SEQ ID NO: 166035 - DNA, 25 bp, Homo sapien
agcccgcggtgtaacgctatgggcc

SEQ ID NO: 166036 - DNA, 25 bp, Homo sapien
gggctctggactctgtatctggaac

SEQ ID NO: 166037 - DNA, 25 bp, Homo sapien
ctctgtatctggaactggtggcgtc

SEQ ID NO: 166038 - DNA, 25 bp, Homo sapien
atctggaactggtggcgtcggccca

SEQ ID NO: 166039 - DNA, 25 bp, Homo sapien
ccggagtaagtagcacccaggggag

SEQ ID NO: 166040 - DNA, 25 bp, Homo sapien
ggacccgcctctcatcccatcctca

SEQ ID NO: 166041 - DNA, 25 bp, Homo sapien
cctcagacccgatttcccacccatt

SEQ ID NO: 166042 - DNA, 25 bp, Homo sapien
gggccgagcgcagaattcccgagcc

SEQ ID NO: 166043 - DNA, 25 bp, Homo sapien
aagcctccttctgggcagcgagtga

SEQ ID NO: 166044 - DNA, 25 bp, Homo sapien
tggtcaacaagcctgtaagttcctc

SEQ ID NO: 166045 - DNA, 25 bp, Homo sapien
gactgcgccgtgtcttcctgaagaa

SEQ ID NO: 166046 - DNA, 25 bp, Homo sapien
cagcgaccttcgctttcgtggggaa

SEQ ID NO: 166047 - DNA, 25 bp, Homo sapien
ttttttcctcttgcgccagtcttga

SEQ ID NO: 166048 - DNA, 25 bp, Homo sapien
tggcccgcagttctcgttctcctaa

SEQ ID NO: 166049 - DNA, 25 bp, Homo sapien
gctgcctgcgctccttaagctaggt

SEQ ID NO: 166050 - DNA, 25 bp, Homo sapien
agctaggtcagttctctggcccgca

SEQ ID NO: 166051 - DNA, 25 bp, Homo sapien
gttcctcagctacgactaccaggta

SEQ ID NO: 166052 - DNA, 25 bp, Homo sapien
ttcagggcagaagttacgataactc

SEQ ID NO: 166053 - DNA, 25 bp, Homo sapien
taactcggggcggaaatagcttctg

SEQ ID NO: 166054 - DNA, 25 bp, Homo sapien
cgccgctagcgctgcgagatattca

SEQ ID NO: 166055 - DNA, 25 bp, Homo sapien
tcacttccgggagtggctggaacac

SEQ ID NO: 166056 - DNA, 25 bp, Homo sapien
tcacccggaagtggtgctgcagctc

SEQ ID NO: 166057 - DNA, 25 bp, Homo sapien
tcacacgcacggaacgcgcgcgaga

SEQ ID NO: 166058 - DNA, 25 bp, Homo sapien
tggagcgagacagacccacacactc

SEQ ID NO: 166059 - DNA, 25 bp, Homo sapien
ggcaaaagctgaaaccggaggactc

SEQ ID NO: 166060 - DNA, 25 bp, Homo sapien
tccagccaacggaaagccgccttta

SEQ ID NO: 166061 - DNA, 25 bp, Homo sapien
cccaggcggaacagaataggactcc

SEQ ID NO: 166062 - DNA, 25 bp, Homo sapien
tggcgcccatctaactagcacacga

SEQ ID NO: 166063 - DNA, 25 bp, Homo sapien
cccgcgcgtgccttttataatgcga

SEQ ID NO: 166064 - DNA, 25 bp, Homo sapien
aaaccgcggatagcgctcctgtcta

SEQ ID NO: 166065 - DNA, 25 bp, Homo sapien
gctcctgtctattggctgcgccatc

SEQ ID NO: 166066 - DNA, 25 bp, Homo sapien
gccatcgcccgtcagacaaagctga

SEQ ID NO: 166067 - DNA, 25 bp, Homo sapien
ccacgcagggtttaaagacgatgtc

SEQ ID NO: 166068 - DNA, 25 bp, Homo sapien
tctggcagccagaacacagcgagcc

SEQ ID NO: 166069 - DNA, 25 bp, Homo sapien
gctcgtggtagtgcacctcacagta

SEQ ID NO: 166070 - DNA, 25 bp, Homo sapien
tcgtgctcgaagaagctgccgttca

SEQ ID NO: 166071 - DNA, 25 bp, Homo sapien
gtgaagcattcctgccaggcggaga

SEQ ID NO: 166072 - DNA, 25 bp, Homo sapien
gcatagtcggcacgctcggagtgac

SEQ ID NO: 166073 - DNA, 25 bp, Homo sapien
tcggagtgactcctacttgctaggc

SEQ ID NO: 166074 - DNA, 25 bp, Homo sapien
acttgctaggcgtttcccatgtgcc

SEQ ID NO: 166075 - DNA, 25 bp, Homo sapien
cccatgtgccgtgttgtcctaaacg

SEQ ID NO: 166076 - DNA, 25 bp, Homo sapien
ccggcttccagaagtggagccactc

SEQ ID NO: 166077 - DNA, 25 bp, Homo sapien
tccttctcgtggaaccctggggagc

SEQ ID NO: 166078 - DNA, 25 bp, Homo sapien
gtagtccttgcgacagtaggccttg

SEQ ID NO: 166079 - DNA, 25 bp, Homo sapien
tcgaagtagtccttgcgacagtagg

SEQ ID NO: 166080 - DNA, 25 bp, Homo sapien
tgggtgcgaacatgtcgaagtagtc

SEQ ID NO: 166081 - DNA, 25 bp, Homo sapien
cagccgccacacttgggtgcgaaca

SEQ ID NO: 166082 - DNA, 25 bp, Homo sapien
gggttttggaggcacagttcattcc

SEQ ID NO: 166083 - DNA, 25 bp, Homo sapien
ggcacagttcattccggcttccaga

SEQ ID NO: 166084 - DNA, 25 bp, Homo sapien
tcaccgaggtcgtccatggccggac

SEQ ID NO: 166085 - DNA, 25 bp, Homo sapien
gtccagaggtgaagccgtcccagac

SEQ ID NO: 166086 - DNA, 25 bp, Homo sapien
aagtctcgtccctgcagcggacggg

SEQ ID NO: 166087 - DNA, 25 bp, Homo sapien
caggaagtctcgtccctgcagcgga

SEQ ID NO: 166088 - DNA, 25 bp, Homo sapien
cccgcaacttttccgccgcgagcct

SEQ ID NO: 166089 - DNA, 25 bp, Homo sapien
tcccgtagctgacgaggtggtctgc

SEQ ID NO: 166090 - DNA, 25 bp, Homo sapien
cgaggtcgtccatggccggaccacg

SEQ ID NO: 166091 - DNA, 25 bp, Homo sapien
gctccccgagttgggcggtcgatct

SEQ ID NO: 166092 - DNA, 25 bp, Homo sapien
cacgtggctttttctccttggcttc

SEQ ID NO: 166093 - DNA, 25 bp, Homo sapien
cggacgccacctagtgtgaccatta

SEQ ID NO: 166094 - DNA, 25 bp, Homo sapien
gtgtgaccattaccagccactgcgc

SEQ ID NO: 166095 - DNA, 25 bp, Homo sapien
gctgggccgccattcaccaatagaa

SEQ ID NO: 166096 - DNA, 25 bp, Homo sapien
agccacgtgctcataagatatccaa

SEQ ID NO: 166097 - DNA, 25 bp, Homo sapien
gttgggcacacagcatcacgtgaca

SEQ ID NO: 166098 - DNA, 25 bp, Homo sapien
ggcttcggcgaaacattacgtcaca

SEQ ID NO: 166099 - DNA, 25 bp, Homo sapien
cacaatcacatcctgtggcggcgga

SEQ ID NO: 166100 - DNA, 25 bp, Homo sapien
cgagctctaatgctcggcgctcaga

SEQ ID NO: 166101 - DNA, 25 bp, Homo sapien
gccaacgccgatttaggcccgaaca

SEQ ID NO: 166102 - DNA, 25 bp, Homo sapien
cccgaacaaaagacgcggccgctga

SEQ ID NO: 166103 - DNA, 25 bp, Homo sapien
ccgctaagcctgagtggcagccatg

SEQ ID NO: 166104 - DNA, 25 bp, Homo sapien
ggcggcctccaatcacagctgctgg

SEQ ID NO: 166105 - DNA, 25 bp, Homo sapien
ggccggtttcacatgccaacgccga

SEQ ID NO: 166106 - DNA, 25 bp, Homo sapien
gccatggcggctgaccattgttccc

SEQ ID NO: 166107 - DNA, 25 bp, Homo sapien
ctggatcagattagtgcgagctcta

SEQ ID NO: 166108 - DNA, 25 bp, Homo sapien
ccgggagcagcctcacaaaagtttg

SEQ ID NO: 166109 - DNA, 25 bp, Homo sapien
ccggacccggatcggccatgttggc

SEQ ID NO: 166110 - DNA, 25 bp, Homo sapien
agacacaaagggcccgcgtgagcgc

SEQ ID NO: 166111 - DNA, 25 bp, Homo sapien
atgaacatcttgctgcgggaggagg

SEQ ID NO: 166112 - DNA, 25 bp, Homo sapien
cctgcgtagtctgccaactgagtcc

SEQ ID NO: 166113 - DNA, 25 bp, Homo sapien
tcaccctgcgtagtctgccaactga

SEQ ID NO: 166114 - DNA, 25 bp, Homo sapien
acaaaagtttgagccgcaggtgcga

SEQ ID NO: 166115 - DNA, 25 bp, Homo sapien
gcgcgtcagtctccatcgggagccg

SEQ ID NO: 166116 - DNA, 25 bp, Homo sapien
ggtgcagtcactccgggcgcagcct

SEQ ID NO: 166117 - DNA, 25 bp, Homo sapien
tggccgtttctcattagagggagaa

SEQ ID NO: 166118 - DNA, 25 bp, Homo sapien
ggggacttggccgtttctcattaga

SEQ ID NO: 166119 - DNA, 25 bp, Homo sapien
cctggtcctttgtggctcggacaac

SEQ ID NO: 166120 - DNA, 25 bp, Homo sapien
ctgagacagccgcacaaagaggagg

SEQ ID NO: 166121 - DNA, 25 bp, Homo sapien
ccgggaggcggaatctttccacatg

SEQ ID NO: 166122 - DNA, 25 bp, Homo sapien
gcaacgcggccacaaagggagcccg

SEQ ID NO: 166123 - DNA, 25 bp, Homo sapien
cgggtacaccctgcgcggtgcagtc

SEQ ID NO: 166124 - DNA, 25 bp, Homo sapien
agcgcatgctctctcttgcccgaga

SEQ ID NO: 166125 - DNA, 25 bp, Homo sapien
cccgagatgccgaggattttgacaa

SEQ ID NO: 166126 - DNA, 25 bp, Homo sapien
ccgtcgtcccggatgatagtgctca

SEQ ID NO: 166127 - DNA, 25 bp, Homo sapien
cggcgcccaatagtaacttcctttg

SEQ ID NO: 166128 - DNA, 25 bp, Homo sapien
cccatggcgaagagggctcaggtac

SEQ ID NO: 166129 - DNA, 25 bp, Homo sapien
ataccggcgctgaacgtttgtggct

SEQ ID NO: 166130 - DNA, 25 bp, Homo sapien
cgcatcaggaccaaggtacgccctt

SEQ ID NO: 166131 - DNA, 25 bp, Homo sapien
cgcatgcgcacgaaggaaacggtaa

SEQ ID NO: 166132 - DNA, 25 bp, Homo sapien
tcctttgcggtcttttgtccacgtc

SEQ ID NO: 166133 - DNA, 25 bp, Homo sapien
atgcctgccgtgcaggcgtcctttg

SEQ ID NO: 166134 - DNA, 25 bp, Homo sapien
gcatgcgcggcccatttccgagagt

SEQ ID NO: 166135 - DNA, 25 bp, Homo sapien
ccctttggcgcgtaggagacagcgc

SEQ ID NO: 166136 - DNA, 25 bp, Homo sapien
ccttagcggcgtttgctgctcttgt

SEQ ID NO: 166137 - DNA, 25 bp, Homo sapien
ccactgcgcgccctagtggggacta

SEQ ID NO: 166138 - DNA, 25 bp, Homo sapien
ccgctctagcacagtccgggagctg

SEQ ID NO: 166139 - DNA, 25 bp, Homo sapien
gcttgcccactaaaagcccattcgg

SEQ ID NO: 166140 - DNA, 25 bp, Homo sapien
tggcccgttcgcagccgtttaatgt

SEQ ID NO: 166141 - DNA, 25 bp, Homo sapien
attgaagcactggtcgtactcgcgc

SEQ ID NO: 166142 - DNA, 25 bp, Homo sapien
tactcgcgcttcatgtccgtgcatg

SEQ ID NO: 166143 - DNA, 25 bp, Homo sapien
acgacggcgcactctgatgtcatca

SEQ ID NO: 166144 - DNA, 25 bp, Homo sapien
atgtcatcactctcaggcgcgtcgc

SEQ ID NO: 166145 - DNA, 25 bp, Homo sapien
tccaaggcggatcctcaggtaaagg

SEQ ID NO: 166146 - DNA, 25 bp, Homo sapien
gactggagaaagctatcgccttcgc

SEQ ID NO: 166147 - DNA, 25 bp, Homo sapien
ttctcggcgaaccagcgattgaagc

SEQ ID NO: 166148 - DNA, 25 bp, Homo sapien
tcactcacctgcatgcttggcgcgg

SEQ ID NO: 166149 - DNA, 25 bp, Homo sapien
gacccgaagcaggagactgcgcgga

SEQ ID NO: 166150 - DNA, 25 bp, Homo sapien
catcccacccatcccgcaggcccgc

SEQ ID NO: 166151 - DNA, 25 bp, Homo sapien
caccgacctgttgtgcgcaggagac

SEQ ID NO: 166152 - DNA, 25 bp, Homo sapien
acctgttgtgcgcaggagacgagct

SEQ ID NO: 166153 - DNA, 25 bp, Homo sapien
ccgagagcggactggggacccgaag

SEQ ID NO: 166154 - DNA, 25 bp, Homo sapien
tcacctgcatgcttggcgcggcggc

SEQ ID NO: 166155 - DNA, 25 bp, Homo sapien
cagcttctcaccgacctgttgtgcg

SEQ ID NO: 166156 - DNA, 25 bp, Homo sapien
aggcggacaaggctcatttggaccc

SEQ ID NO: 166157 - DNA, 25 bp, Homo sapien
aacgcggctgcgaccattgcgcgtg

SEQ ID NO: 166158 - DNA, 25 bp, Homo sapien
gtcctcttaaagagaacgcggctgc

SEQ ID NO: 166159 - DNA, 25 bp, Homo sapien
ctcagccgcactgcattgtgggaac

SEQ ID NO: 166160 - DNA, 25 bp, Homo sapien
gtagaacaggtcctccaagtccttc

SEQ ID NO: 166161 - DNA, 25 bp, Homo sapien
cctgcgaggagaggctgcctcatcc

SEQ ID NO: 166162 - DNA, 25 bp, Homo sapien
ataaaggaagtgacgacggcgcgaa

SEQ ID NO: 166163 - DNA, 25 bp, Homo sapien
gggccctccaaaggctcagcttttg

SEQ ID NO: 166164 - DNA, 25 bp, Homo sapien
cacggtttcggtagcgacggtatct

SEQ ID NO: 166165 - DNA, 25 bp, Homo sapien
cctgctttcctaagggcgcctgaca

SEQ ID NO: 166166 - DNA, 25 bp, Homo sapien
gggaaagcgccacctagcaacggta

SEQ ID NO: 166167 - DNA, 25 bp, Homo sapien
cgctcctgtggagaagaccagaccc

SEQ ID NO: 166168 - DNA, 25 bp, Homo sapien
tcaggcgctggagaaatacaacata

SEQ ID NO: 166169 - DNA, 25 bp, Homo sapien
gccttgcccactaggtaaccatgtg

SEQ ID NO: 166170 - DNA, 25 bp, Homo sapien
ggctgcttagatgcgccacggtttc

SEQ ID NO: 166171 - DNA, 25 bp, Homo sapien
tcctgagggaaccatggagtcaatg

SEQ ID NO: 166172 - DNA, 25 bp, Homo sapien
gtcactccacgaacgacggcggctg

SEQ ID NO: 166173 - DNA, 25 bp, Homo sapien
gctgcccgcttctcttgggacaaga

SEQ ID NO: 166174 - DNA, 25 bp, Homo sapien
tcttgggacaagagccgagcactta

SEQ ID NO: 166175 - DNA, 25 bp, Homo sapien
acggccgcaatagctccatagagca

SEQ ID NO: 166176 - DNA, 25 bp, Homo sapien
ccgccatcttggtagtcgagtgaca

SEQ ID NO: 166177 - DNA, 25 bp, Homo sapien
gcggctggccggcaacattattagc

SEQ ID NO: 166178 - DNA, 25 bp, Homo sapien
gtacgccttgttgcgtcactccacg

SEQ ID NO: 166179 - DNA, 25 bp, Homo sapien
tgacaacggccagagagtacgcctt

SEQ ID NO: 166180 - DNA, 25 bp, Homo sapien
atccgttgctgtgtcggagacacta

SEQ ID NO: 166181 - DNA, 25 bp, Homo sapien
ggagacactagtccccgacaccgag

SEQ ID NO: 166182 - DNA, 25 bp, Homo sapien
gcggggctcgcgcaacctccctcgc

SEQ ID NO: 166183 - DNA, 25 bp, Homo sapien
ttgctgtgtcggagacactagtccc

SEQ ID NO: 166184 - DNA, 25 bp, Homo sapien
agtatccgttgctgtgtcggagaca

SEQ ID NO: 166185 - DNA, 25 bp, Homo sapien
cgagtatccgttgctgtgtcggaga

SEQ ID NO: 166186 - DNA, 25 bp, Homo sapien
cccaggggcgagtatccgttgctgt

SEQ ID NO: 166187 - DNA, 25 bp, Homo sapien
cattcccggagcaggtcggcctcgg

SEQ ID NO: 166188 - DNA, 25 bp, Homo sapien
cagacaccagttcgcagagcaggta

SEQ ID NO: 166189 - DNA, 25 bp, Homo sapien
tgtgaattctgtccgctgccaatgg

SEQ ID NO: 166190 - DNA, 25 bp, Homo sapien
ccggcgtgcaaaccggatgtgaatt

SEQ ID NO: 166191 - DNA, 25 bp, Homo sapien
gcgctctgctaatttcggactctcg

SEQ ID NO: 166192 - DNA, 25 bp, Homo sapien
cccaggcgcttaaagagatacctta

SEQ ID NO: 166193 - DNA, 25 bp, Homo sapien
tgcgccgaaagttccgtgcaccctg

SEQ ID NO: 166194 - DNA, 25 bp, Homo sapien
aggctgctcagaactcggtcatcga

SEQ ID NO: 166195 - DNA, 25 bp, Homo sapien
ccgcagcctttcagccattcagaga

SEQ ID NO: 166196 - DNA, 25 bp, Homo sapien
cgccagccgctaattataagtctcc

SEQ ID NO: 166197 - DNA, 25 bp, Homo sapien
cccggagatccgctggacggcgacg

SEQ ID NO: 166198 - DNA, 25 bp, Homo sapien
ggctgtttgcaatcacccgggtccc

SEQ ID NO: 166199 - DNA, 25 bp, Homo sapien
aggccggcggctgtttgcaatcacc

SEQ ID NO: 166200 - DNA, 25 bp, Homo sapien
taagtctcctaatgaggccggcggc

SEQ ID NO: 166201 - DNA, 25 bp, Homo sapien
gccgctaattataagtctcctaatg

SEQ ID NO: 166202 - DNA, 25 bp, Homo sapien
ttataagtctcctaatgaggccggc

SEQ ID NO: 166203 - DNA, 25 bp, Homo sapien
ctgcgccagccgctaattataagtc

SEQ ID NO: 166204 - DNA, 25 bp, Homo sapien
atgagctcgcacatcgccaaaagcg

SEQ ID NO: 166205 - DNA, 25 bp, Homo sapien
tcgccaaaagcgagtccaagacgtc

SEQ ID NO: 166206 - DNA, 25 bp, Homo sapien
aaagcgagtccaagacgtcgctgct

SEQ ID NO: 166207 - DNA, 25 bp, Homo sapien
gggactccgttccagccgccgcgtc

SEQ ID NO: 166208 - DNA, 25 bp, Homo sapien
ctcagctccgcctttggccaggtaa

SEQ ID NO: 166209 - DNA, 25 bp, Homo sapien
agctccgcctttggccaggtaaggg

SEQ ID NO: 166210 - DNA, 25 bp, Homo sapien
tttggccaggtaagggccgcgcctc

SEQ ID NO: 166211 - DNA, 25 bp, Homo sapien
acggatcacgcctcggctcacctcg

SEQ ID NO: 166212 - DNA, 25 bp, Homo sapien
aaggactgcgtctcttaggtctgga

SEQ ID NO: 166213 - DNA, 25 bp, Homo sapien
ccgagagcgtcatttgggcggtcaa

SEQ ID NO: 166214 - DNA, 25 bp, Homo sapien
agccttctcattggacggccgtctg

SEQ ID NO: 166215 - DNA, 25 bp, Homo sapien
gcggggccttattctcatgggattc

SEQ ID NO: 166216 - DNA, 25 bp, Homo sapien
ctctctgggaaagcatgggtcctct

SEQ ID NO: 166217 - DNA, 25 bp, Homo sapien
ctccagagcctatttggtctcagga

SEQ ID NO: 166218 - DNA, 25 bp, Homo sapien
tttcccgcgcctgacagccaatgag

SEQ ID NO: 166219 - DNA, 25 bp, Homo sapien
attcgttccctggagacctgtgtcc

SEQ ID NO: 166220 - DNA, 25 bp, Homo sapien
ctcttttcagcgaaggcagtgctgc

SEQ ID NO: 166221 - DNA, 25 bp, Homo sapien
cccgatctctgtcctaaagttctag

SEQ ID NO: 166222 - DNA, 25 bp, Homo sapien
ggggctcagatgcaagctcttttca

SEQ ID NO: 166223 - DNA, 25 bp, Homo sapien
tgctgcggacagaaacctcagtctc

SEQ ID NO: 166224 - DNA, 25 bp, Homo sapien
agattccggatgctgaccgctcgcg

SEQ ID NO: 166225 - DNA, 25 bp, Homo sapien
gggaccatctttgagtcagcgacgc

SEQ ID NO: 166226 - DNA, 25 bp, Homo sapien
agccgtgcccatttcctctgacttt

SEQ ID NO: 166227 - DNA, 25 bp, Homo sapien
atggatttcggttgcccaagacgcc

SEQ ID NO: 166228 - DNA, 25 bp, Homo sapien
cacgctcacgtagctctggtgggga

SEQ ID NO: 166229 - DNA, 25 bp, Homo sapien
gaccgcattcctgtgagtccggcca

SEQ ID NO: 166230 - DNA, 25 bp, Homo sapien
agtccggccacgctaggatgccctt

SEQ ID NO: 166231 - DNA, 25 bp, Homo sapien
taggatgcccttcggccggtcggct

SEQ ID NO: 166232 - DNA, 25 bp, Homo sapien
cagctctgccggacctgtttgggta

SEQ ID NO: 166233 - DNA, 25 bp, Homo sapien
gaactggatcctcctgagccggccg

SEQ ID NO: 166234 - DNA, 25 bp, Homo sapien
tgagcgggtctaacccgaaggctgc

SEQ ID NO: 166235 - DNA, 25 bp, Homo sapien
gctgctggcgctggacaccatccgg

SEQ ID NO: 166236 - DNA, 25 bp, Homo sapien
gaacagccagctgaccgaccgcgcg

SEQ ID NO: 166237 - DNA, 25 bp, Homo sapien
aggccctacgggcgtggcctctgtc

SEQ ID NO: 166238 - DNA, 25 bp, Homo sapien
ccagttctgctgctccttgcgccga

SEQ ID NO: 166239 - DNA, 25 bp, Homo sapien
gccggctctgtcagagccgctggca

SEQ ID NO: 166240 - DNA, 25 bp, Homo sapien
agcactccggaacagcgcgctcgca

SEQ ID NO: 166241 - DNA, 25 bp, Homo sapien
aggtcgcgaagcctgggactgtgtc

SEQ ID NO: 166242 - DNA, 25 bp, Homo sapien
cgcgcgcagtcgagcgtcggttcct

SEQ ID NO: 166243 - DNA, 25 bp, Homo sapien
cgagcgtcggttcctcgccttggga

SEQ ID NO: 166244 - DNA, 25 bp, Homo sapien
gcggagccacgtgtaagcttcaatg

SEQ ID NO: 166245 - DNA, 25 bp, Homo sapien
tcgaagagtagaatgcctgcgtccc

SEQ ID NO: 166246 - DNA, 25 bp, Homo sapien
ccgaaatttgcgtccttagagcgga

SEQ ID NO: 166247 - DNA, 25 bp, Homo sapien
ccggaagcccgccatagagtttagt

SEQ ID NO: 166248 - DNA, 25 bp, Homo sapien
catagagtttagtggccagagcgac

SEQ ID NO: 166249 - DNA, 25 bp, Homo sapien
aggtcgaagcttccaggtagcggcc

SEQ ID NO: 166250 - DNA, 25 bp, Homo sapien
tgacccagggtacgacgaagcagtc

SEQ ID NO: 166251 - DNA, 25 bp, Homo sapien
gtggggcatgtcctgccgaaatttg

SEQ ID NO: 166252 - DNA, 25 bp, Homo sapien
gccgggcatctgctcaggagctacc

SEQ ID NO: 166253 - DNA, 25 bp, Homo sapien
tacgtgacagagatgccggcagagc

SEQ ID NO: 166254 - DNA, 25 bp, Homo sapien
gcgacgcccgcatcactgagatcta

SEQ ID NO: 166255 - DNA, 25 bp, Homo sapien
catcactgagatctacgagggcacc

SEQ ID NO: 166256 - DNA, 25 bp, Homo sapien
gcatgggctacgtgacagagatgcc

SEQ ID NO: 166257 - DNA, 25 bp, Homo sapien
tctacgagggcaccagcgaaatcca

SEQ ID NO: 166258 - DNA, 25 bp, Homo sapien
cagcgaaatccagcggctggtgatc

SEQ ID NO: 166259 - DNA, 25 bp, Homo sapien
tctgctcaggagctaccggagctga

SEQ ID NO: 166260 - DNA, 25 bp, Homo sapien
acgtgcccaaaacacgctcacgtga

SEQ ID NO: 166261 - DNA, 25 bp, Homo sapien
actcaccacgagtaggtctgctccg

SEQ ID NO: 166262 - DNA, 25 bp, Homo sapien
tgcagctccaaacccaacatggcgg

SEQ ID NO: 166263 - DNA, 25 bp, Homo sapien
tgaggcgaggccactcgatcacacc

SEQ ID NO: 166264 - DNA, 25 bp, Homo sapien
ccatgcgcagagacgtcggctcctg

SEQ ID NO: 166265 - DNA, 25 bp, Homo sapien
gagatgtcgcctcgggtaccctctt

SEQ ID NO: 166266 - DNA, 25 bp, Homo sapien
gctgctgcaccagccaatcgggaac

SEQ ID NO: 166267 - DNA, 25 bp, Homo sapien
acagccagagcagttgggccgcctc

SEQ ID NO: 166268 - DNA, 25 bp, Homo sapien
agctggctgagctgcccaatgggct

SEQ ID NO: 166269 - DNA, 25 bp, Homo sapien
acggacgacgatggggaagacttca

SEQ ID NO: 166270 - DNA, 25 bp, Homo sapien
cactgatccaggcactgggtgagcc

SEQ ID NO: 166271 - DNA, 25 bp, Homo sapien
gcaaagaggcactgatccaggcact

SEQ ID NO: 166272 - DNA, 25 bp, Homo sapien
tcctggcggccctgctcgagtcagg

SEQ ID NO: 166273 - DNA, 25 bp, Homo sapien
actgagccagctgcagacggagctc

SEQ ID NO: 166274 - DNA, 25 bp, Homo sapien
tctaaactgagccagctgcagacgg

SEQ ID NO: 166275 - DNA, 25 bp, Homo sapien
ggcaggcaaacgcaacccacgcggt

SEQ ID NO: 166276 - DNA, 25 bp, Homo sapien
gcctccttcatgacgtcacgtgaga

SEQ ID NO: 166277 - DNA, 25 bp, Homo sapien
attgtggagaacaccgccgttatca

SEQ ID NO: 166278 - DNA, 25 bp, Homo sapien
accgcaaaggattgtggagaacacc

SEQ ID NO: 166279 - DNA, 25 bp, Homo sapien
cgccatcttgaaccaccgcaaagga

SEQ ID NO: 166280 - DNA, 25 bp, Homo sapien
cgaatcgctcactgtgccactgggc

SEQ ID NO: 166281 - DNA, 25 bp, Homo sapien
ctgctgttactactttccgaatcgc

SEQ ID NO: 166282 - DNA, 25 bp, Homo sapien
ctccgcatcgctactgctgttacta

SEQ ID NO: 166283 - DNA, 25 bp, Homo sapien
cgccgttatcaagcctccttcatga

SEQ ID NO: 166284 - DNA, 25 bp, Homo sapien
cgaggctggaaaaacgcgcacgtgt

SEQ ID NO: 166285 - DNA, 25 bp, Homo sapien
tgtgcacatttgcacgaaccgtggg

SEQ ID NO: 166286 - DNA, 25 bp, Homo sapien
tcctggatcacacatctgagagagg

SEQ ID NO: 166287 - DNA, 25 bp, Homo sapien
gacttgtgtgtgcaactgtgcgtcc

SEQ ID NO: 166288 - DNA, 25 bp, Homo sapien
tctgctgcaccgagtgtgcacattt

SEQ ID NO: 166289 - DNA, 25 bp, Homo sapien
tcaaccagaaagacccgcacgcggg

SEQ ID NO: 166290 - DNA, 25 bp, Homo sapien
gtctcggactgaggaactgcgttca

SEQ ID NO: 166291 - DNA, 25 bp, Homo sapien
caactgtgcgtcctgcgagagtgag

SEQ ID NO: 166292 - DNA, 25 bp, Homo sapien
gcggccttcctgttcgagtacgaca

SEQ ID NO: 166293 - DNA, 25 bp, Homo sapien
ccctagagggtcatcgttcccgacg

SEQ ID NO: 166294 - DNA, 25 bp, Homo sapien
aggagcctttcgtcctcaagggcga

SEQ ID NO: 166295 - DNA, 25 bp, Homo sapien
atcctggcctacgtcatcgggtgag

SEQ ID NO: 166296 - DNA, 25 bp, Homo sapien
gtgctcatccgcagccgcaaagtgg

SEQ ID NO: 166297 - DNA, 25 bp, Homo sapien
cgcaaagtggggctcatgaaccgcg

SEQ ID NO: 166298 - DNA, 25 bp, Homo sapien
atgaaccgcgccgtgcaactgctca

SEQ ID NO: 166299 - DNA, 25 bp, Homo sapien
tcgagtacgacacgccgcgcatcgt

SEQ ID NO: 166300 - DNA, 25 bp, Homo sapien
gggaccgctcttgcagagacagctt

SEQ ID NO: 166301 - DNA, 25 bp, Homo sapien
accctgggaccgctcttgcagagac

SEQ ID NO: 166302 - DNA, 25 bp, Homo sapien
tgcagcgtccgttcatgtccaggct

SEQ ID NO: 166303 - DNA, 25 bp, Homo sapien
gcagatgcagcgtccgttcatgtcc

SEQ ID NO: 166304 - DNA, 25 bp, Homo sapien
acgtggtgagactccactgtcggcc

SEQ ID NO: 166305 - DNA, 25 bp, Homo sapien
catacccgtgatggagacgtggtga

SEQ ID NO: 166306 - DNA, 25 bp, Homo sapien
cgcacctgcatacccgtgatggaga

SEQ ID NO: 166307 - DNA, 25 bp, Homo sapien
gcgccaagccgaggtccacagcaca

SEQ ID NO: 166308 - DNA, 25 bp, Homo sapien
tccgcgtggtgcgagcgctgcacca

SEQ ID NO: 166309 - DNA, 25 bp, Homo sapien
attgggccactgacaaggccgtccc

SEQ ID NO: 166310 - DNA, 25 bp, Homo sapien
cccggccgacagattgggccactga

SEQ ID NO: 166311 - DNA, 25 bp, Homo sapien
cctggctggtggttactgtccgaac

SEQ ID NO: 166312 - DNA, 25 bp, Homo sapien
gtgcatcacagagcgctccagcctt

SEQ ID NO: 166313 - DNA, 25 bp, Homo sapien
accgctcgaggctggtgcatcacag

SEQ ID NO: 166314 - DNA, 25 bp, Homo sapien
gagcgtacccacctggacctgtctg

SEQ ID NO: 166315 - DNA, 25 bp, Homo sapien
tggtcgctgactctctgggcgtgca

SEQ ID NO: 166316 - DNA, 25 bp, Homo sapien
ccagcctccgggctttgtgtgccat

SEQ ID NO: 166317 - DNA, 25 bp, Homo sapien
gcgggagcctgcaaagacgaaagta

SEQ ID NO: 166318 - DNA, 25 bp, Homo sapien
cctgcaaagacgaaagtagcgaaga

SEQ ID NO: 166319 - DNA, 25 bp, Homo sapien
gtggcgccgcaactttgtacccgct

SEQ ID NO: 166320 - DNA, 25 bp, Homo sapien
cgccggcagcgcttgctttgtttag

SEQ ID NO: 166321 - DNA, 25 bp, Homo sapien
ttgctttgtttagccaaatgccggg

SEQ ID NO: 166322 - DNA, 25 bp, Homo sapien
cgcctccgggctgaccctgggaaag

SEQ ID NO: 166323 - DNA, 25 bp, Homo sapien
ggctgtcggggaccgtgtccctcca

SEQ ID NO: 166324 - DNA, 25 bp, Homo sapien
gcgtcacccagtccttgatgccgaa

SEQ ID NO: 166325 - DNA, 25 bp, Homo sapien
gccgaacacattggcgtgcacaacc

SEQ ID NO: 166326 - DNA, 25 bp, Homo sapien
tcatgggattgaagtagaggctctc

SEQ ID NO: 166327 - DNA, 25 bp, Homo sapien
catggcggcccgagactaagtctcg

SEQ ID NO: 166328 - DNA, 25 bp, Homo sapien
ccaggaaacagacatccgcgtgctc

SEQ ID NO: 166329 - DNA, 25 bp, Homo sapien
acaaggcacaacactaccgggtcta

SEQ ID NO: 166330 - DNA, 25 bp, Homo sapien
gtgcggctcatctcgttcagcagca

SEQ ID NO: 166331 - DNA, 25 bp, Homo sapien
agcaccgcgatcttgtacggcgtca

SEQ ID NO: 166332 - DNA, 25 bp, Homo sapien
gccttcgagccaaccggcgtgttca

SEQ ID NO: 166333 - DNA, 25 bp, Homo sapien
gtgttcaaattcaccacggcccttc

SEQ ID NO: 166334 - DNA, 25 bp, Homo sapien
cagcagcttcctcagggacgctatc

SEQ ID NO: 166335 - DNA, 25 bp, Homo sapien
caccgagcatgaacgcgggaacgtc

SEQ ID NO: 166336 - DNA, 25 bp, Homo sapien
gcggttacctagtcgtcatctcgga

SEQ ID NO: 166337 - DNA, 25 bp, Homo sapien
cctgtcgcttcattggctctggtga

SEQ ID NO: 166338 - DNA, 25 bp, Homo sapien
agtcggcttcctattggtcgtcgtg

SEQ ID NO: 166339 - DNA, 25 bp, Homo sapien
tctgacggtcataacaaaggccttc

SEQ ID NO: 166340 - DNA, 25 bp, Homo sapien
cctggaaaggacagagcggacatga

SEQ ID NO: 166341 - DNA, 25 bp, Homo sapien
aaactccaggggacgctgctgccgg

SEQ ID NO: 166342 - DNA, 25 bp, Homo sapien
ctcaagccgccgaaactccagggga

SEQ ID NO: 166343 - DNA, 25 bp, Homo sapien
gagtcctcaggtccctggatggcca

SEQ ID NO: 166344 - DNA, 25 bp, Homo sapien
agcgagccacagcttttcgggccaa

SEQ ID NO: 166345 - DNA, 25 bp, Homo sapien
agcttttcgggccaaagcggcgaag

SEQ ID NO: 166346 - DNA, 25 bp, Homo sapien
cctgaggactcaagccgccgaaact

SEQ ID NO: 166347 - DNA, 25 bp, Homo sapien
tgctgccggaatcgggaggtctccc

SEQ ID NO: 166348 - DNA, 25 bp, Homo sapien
ctccatctggatacacttgggcggg

SEQ ID NO: 166349 - DNA, 25 bp, Homo sapien
tcgctctcaggctccgacttgatgg

SEQ ID NO: 166350 - DNA, 25 bp, Homo sapien
gctgctggttctcgttggccaggct

SEQ ID NO: 166351 - DNA, 25 bp, Homo sapien
ctcagctccttgttgggaagccgcc

SEQ ID NO: 166352 - DNA, 25 bp, Homo sapien
gggagtggtcgctctccctggtctt

SEQ ID NO: 166353 - DNA, 25 bp, Homo sapien
gttcgtcctcgggttcctgcttgaa

SEQ ID NO: 166354 - DNA, 25 bp, Homo sapien
agcgccatgcggtcctcggcgttct

SEQ ID NO: 166355 - DNA, 25 bp, Homo sapien
ggccggatcacatggcgctccatct

SEQ ID NO: 166356 - DNA, 25 bp, Homo sapien
cctctgactccttaatctgcgggga

SEQ ID NO: 166357 - DNA, 25 bp, Homo sapien
ggaagctcgtcgttgaccacaccct

SEQ ID NO: 166358 - DNA, 25 bp, Homo sapien
ccagcagtttggaagctcgtcgttg

SEQ ID NO: 166359 - DNA, 25 bp, Homo sapien
acttcggacactcccagcagtttgg

SEQ ID NO: 166360 - DNA, 25 bp, Homo sapien
agaagatggcccacgggcacaaggc

SEQ ID NO: 166361 - DNA, 25 bp, Homo sapien
ccggcactcactttcccggtcttgc

SEQ ID NO: 166362 - DNA, 25 bp, Homo sapien
atctgcggggaacaccaggactcag

SEQ ID NO: 166363 - DNA, 25 bp, Homo sapien
cggcgtggttacacttcggacactc

SEQ ID NO: 166364 - DNA, 25 bp, Homo sapien
tccatgtccactgccctgtctgggg

SEQ ID NO: 166365 - DNA, 25 bp, Homo sapien
ctgggagatgactcctccacaggga

SEQ ID NO: 166366 - DNA, 25 bp, Homo sapien
atgactcctccacagggaggaccgc

SEQ ID NO: 166367 - DNA, 25 bp, Homo sapien
tgtgggtgtgtacaagggaattcaa

SEQ ID NO: 166368 - DNA, 25 bp, Homo sapien
gtgtgtacaagggaattcaagggca

SEQ ID NO: 166369 - DNA, 25 bp, Homo sapien
cccgttgcgaagtccatgtccactg

SEQ ID NO: 166370 - DNA, 25 bp, Homo sapien
tgcgaagtccatgtccactgccctg

SEQ ID NO: 166371 - DNA, 25 bp, Homo sapien
ttttccacggggactgggagatgac

SEQ ID NO: 166372 - DNA, 25 bp, Homo sapien
ccggttggcggccaacttcaccgcg

SEQ ID NO: 166373 - DNA, 25 bp, Homo sapien
ttgcggcatcgcgtccggcgccgcc

SEQ ID NO: 166374 - DNA, 25 bp, Homo sapien
aagtggcactctccgcactcggtcc

SEQ ID NO: 166375 - DNA, 25 bp, Homo sapien
gcaggcaggcctcgcacttgcggca

SEQ ID NO: 166376 - DNA, 25 bp, Homo sapien
aggcaggcctcgcacttgcggcatc

SEQ ID NO: 166377 - DNA, 25 bp, Homo sapien
aggcctcgcacttgcggcatcgcgt

SEQ ID NO: 166378 - DNA, 25 bp, Homo sapien
tgccgttgtccggttggcggccaac

SEQ ID NO: 166379 - DNA, 25 bp, Homo sapien
cgagctcctgccgttgtccggttgg

SEQ ID NO: 166380 - DNA, 25 bp, Homo sapien
tgcactgccgcatgatgcagctctg

SEQ ID NO: 166381 - DNA, 25 bp, Homo sapien
tccacaggaagagctctcggggagt

SEQ ID NO: 166382 - DNA, 25 bp, Homo sapien
gccagagcgagcagcggtcagacac

SEQ ID NO: 166383 - DNA, 25 bp, Homo sapien
acgcaggggcctgaatcgagcgcag

SEQ ID NO: 166384 - DNA, 25 bp, Homo sapien
tgccgcatgatgcagctctgcttca

SEQ ID NO: 166385 - DNA, 25 bp, Homo sapien
caccgcgatgcactgccgcatgatg

SEQ ID NO: 166386 - DNA, 25 bp, Homo sapien
atgcagctctgcttcatgcgcccgg

SEQ ID NO: 166387 - DNA, 25 bp, Homo sapien
ttcccgtccacaggaagagctctcg

SEQ ID NO: 166388 - DNA, 25 bp, Homo sapien
ttcgcctttgcagggtcaagtagtg

SEQ ID NO: 166389 - DNA, 25 bp, Homo sapien
ggagttccactcgagtcgcctgacg

SEQ ID NO: 166390 - DNA, 25 bp, Homo sapien
ccgccttctgagttgacctccgaaa

SEQ ID NO: 166391 - DNA, 25 bp, Homo sapien
cccttggacaggtaccgccttctga

SEQ ID NO: 166392 - DNA, 25 bp, Homo sapien
aacgccctgactctaccctgaggtg

SEQ ID NO: 166393 - DNA, 25 bp, Homo sapien
gtttgcactcgctgcaggaccagga

SEQ ID NO: 166394 - DNA, 25 bp, Homo sapien
gacctgaagcgcacgaacccgggaa

SEQ ID NO: 166395 - DNA, 25 bp, Homo sapien
aggaccgctggcctggataagctct

SEQ ID NO: 166396 - DNA, 25 bp, Homo sapien
tgaaactgaacacccgcggcgcggg

SEQ ID NO: 166397 - DNA, 25 bp, Homo sapien
ctcatgcccgcgctgaaactgaaca

SEQ ID NO: 166398 - DNA, 25 bp, Homo sapien
gaggtgccaagagcgcgccgcacac

SEQ ID NO: 166399 - DNA, 25 bp, Homo sapien
tgcacctgcagcaccaactttgggg

SEQ ID NO: 166400 - DNA, 25 bp, Homo sapien
caccctccaagttggcggcagatca

SEQ ID NO: 166401 - DNA, 25 bp, Homo sapien
gtgcagcaaggcaccctccaagttg

SEQ ID NO: 166402 - DNA, 25 bp, Homo sapien
caagcacaccgcagtcacatgggca

SEQ ID NO: 166403 - DNA, 25 bp, Homo sapien
ctggcgtgacgcctttgcactgacc

SEQ ID NO: 166404 - DNA, 25 bp, Homo sapien
cacggccgctcagattagcaggatc

SEQ ID NO: 166405 - DNA, 25 bp, Homo sapien
cggagactcacagcggtgacctgtc

SEQ ID NO: 166406 - DNA, 25 bp, Homo sapien
gtttggactggtaatccggagactc

SEQ ID NO: 166407 - DNA, 25 bp, Homo sapien
acctcaagccgtcccgtttggactg

SEQ ID NO: 166408 - DNA, 25 bp, Homo sapien
caggcctgctcatttccttggcggc

SEQ ID NO: 166409 - DNA, 25 bp, Homo sapien
atctgattgacagcatcggggtagc

SEQ ID NO: 166410 - DNA, 25 bp, Homo sapien
gaaatccgtttgataaagccttggc

SEQ ID NO: 166411 - DNA, 25 bp, Homo sapien
ccagggactcaggaatacagggttc

SEQ ID NO: 166412 - DNA, 25 bp, Homo sapien
tttgccctccatggcgtgcacgaag

SEQ ID NO: 166413 - DNA, 25 bp, Homo sapien
ctgcgaagcttctcctccaggctga

SEQ ID NO: 166414 - DNA, 25 bp, Homo sapien
gacgcgggcgcgaaatacgaaccca

SEQ ID NO: 166415 - DNA, 25 bp, Homo sapien
cccgaaatgtgctgggcttcgccca

SEQ ID NO: 166416 - DNA, 25 bp, Homo sapien
ttcggaagcactgaagggacatctg

SEQ ID NO: 166417 - DNA, 25 bp, Homo sapien
cctgggcccagcactaacaggtgca

SEQ ID NO: 166418 - DNA, 25 bp, Homo sapien
ttctcgtcgtatcgctggcggtcaa

SEQ ID NO: 166419 - DNA, 25 bp, Homo sapien
ccggcggcatttctaaagctggagc

SEQ ID NO: 166420 - DNA, 25 bp, Homo sapien
cattgttgccgatcgcgctcggagc

SEQ ID NO: 166421 - DNA, 25 bp, Homo sapien
ttgttgggtcacgagtgcgcctctg

SEQ ID NO: 166422 - DNA, 25 bp, Homo sapien
tgttttgttgttgggtcacgagtgc

SEQ ID NO: 166423 - DNA, 25 bp, Homo sapien
ccgttagcgccgtggcatcgctgtt

SEQ ID NO: 166424 - DNA, 25 bp, Homo sapien
gttgtgtgcagagctgacttttgga

SEQ ID NO: 166425 - DNA, 25 bp, Homo sapien
gtaaacattgttgccgatcgcgctc

SEQ ID NO: 166426 - DNA, 25 bp, Homo sapien
cggaacgtaaacattgttgccgatc

SEQ ID NO: 166427 - DNA, 25 bp, Homo sapien
ccgtggcatcgctgttttgttgttg

SEQ ID NO: 166428 - DNA, 25 bp, Homo sapien
tgagccgcgccaagcttaaagcctc

SEQ ID NO: 166429 - DNA, 25 bp, Homo sapien
ctgtcctggcgcaagctctacttga

SEQ ID NO: 166430 - DNA, 25 bp, Homo sapien
acccggactggatcggccagagtta

SEQ ID NO: 166431 - DNA, 25 bp, Homo sapien
gcagcgggcacttcttcgacctcgt

SEQ ID NO: 166432 - DNA, 25 bp, Homo sapien
tctgctctccggcttcgccatggtg

SEQ ID NO: 166433 - DNA, 25 bp, Homo sapien
gcactccatgcaggcgctgtcctgg

SEQ ID NO: 166434 - DNA, 25 bp, Homo sapien
gatgagcctcaacgagcactccatg

SEQ ID NO: 166435 - DNA, 25 bp, Homo sapien
ggccagagttactccgaggtgatga

SEQ ID NO: 166436 - DNA, 25 bp, Homo sapien
cacatgcgcatacgtcagcagttga

SEQ ID NO: 166437 - DNA, 25 bp, Homo sapien
cggtgcctgagtcacgttcctgtac

SEQ ID NO: 166438 - DNA, 25 bp, Homo sapien
gctccgcccgcctatttaagtgggc

SEQ ID NO: 166439 - DNA, 25 bp, Homo sapien
cagtcgcgtgagttcagtggaccca

SEQ ID NO: 166440 - DNA, 25 bp, Homo sapien
tgcgcttcctgaagccagactgggc

SEQ ID NO: 166441 - DNA, 25 bp, Homo sapien
cgttcctgtactcaatgcgcctgcg

SEQ ID NO: 166442 - DNA, 25 bp, Homo sapien
gcagttgacagttgctgaaggaccc

SEQ ID NO: 166443 - DNA, 25 bp, Homo sapien
tgctccgcagcaaggttactcgacc

SEQ ID NO: 166444 - DNA, 25 bp, Homo sapien
cagtgcccgattcgggctcagcggc

SEQ ID NO: 166445 - DNA, 25 bp, Homo sapien
cgacaccgttctagatgagaatgcc

SEQ ID NO: 166446 - DNA, 25 bp, Homo sapien
ccaggcgagcaggagaggtaggcct

SEQ ID NO: 166447 - DNA, 25 bp, Homo sapien
gccgacgacaccgttctagatgaga

SEQ ID NO: 166448 - DNA, 25 bp, Homo sapien
cggtttcgcttcccggtacgctgca

SEQ ID NO: 166449 - DNA, 25 bp, Homo sapien
tcaccagtgcccgattcgggctcag

SEQ ID NO: 166450 - DNA, 25 bp, Homo sapien
gaatgccaagtgcaggtcctccgcc

SEQ ID NO: 166451 - DNA, 25 bp, Homo sapien
cgttctagatgagaatgccaagtgc

SEQ ID NO: 166452 - DNA, 25 bp, Homo sapien
accatcgcatcatgtccgggcagct

SEQ ID NO: 166453 - DNA, 25 bp, Homo sapien
gcacgagctggagggagaatttcaa

SEQ ID NO: 166454 - DNA, 25 bp, Homo sapien
cttcagctcttcgtccacgtggggc

SEQ ID NO: 166455 - DNA, 25 bp, Homo sapien
aatttcaagaactgcaggtagggcc

SEQ ID NO: 166456 - DNA, 25 bp, Homo sapien
gagcctgccatgtcccggtccggaa

SEQ ID NO: 166457 - DNA, 25 bp, Homo sapien
ctggagggagaatttcaagaactgc

SEQ ID NO: 166458 - DNA, 25 bp, Homo sapien
cttgcaccatcgcatcatgtccggg

SEQ ID NO: 166459 - DNA, 25 bp, Homo sapien
ccgaaagaccttgcgagcctgccat

SEQ ID NO: 166460 - DNA, 25 bp, Homo sapien
gcaccggaaaaacggggctcagctg

SEQ ID NO: 166461 - DNA, 25 bp, Homo sapien
cccagggatactgcagcaccggaaa

SEQ ID NO: 166462 - DNA, 25 bp, Homo sapien
ggtattcagctctcagtcccaggga

SEQ ID NO: 166463 - DNA, 25 bp, Homo sapien
ctttctgctaaggtctcagccctgg

SEQ ID NO: 166464 - DNA, 25 bp, Homo sapien
gccaaagttccagctgaatccactg

SEQ ID NO: 166465 - DNA, 25 bp, Homo sapien
gagccctggctgtacaccatgagca

SEQ ID NO: 166466 - DNA, 25 bp, Homo sapien
caccagggaagatgctgacgcgaga

SEQ ID NO: 166467 - DNA, 25 bp, Homo sapien
tgtggcttggcacatgtccgcctct

SEQ ID NO: 166468 - DNA, 25 bp, Homo sapien
taaggcaagtcctgccacctcctgg

SEQ ID NO: 166469 - DNA, 25 bp, Homo sapien
gtagtaaggcaagtcctgccacctc

SEQ ID NO: 166470 - DNA, 25 bp, Homo sapien
actcagtagtaaggcaagtcctgcc

SEQ ID NO: 166471 - DNA, 25 bp, Homo sapien
ccggcgactcagtagtaaggcaagt

SEQ ID NO: 166472 - DNA, 25 bp, Homo sapien
gatgccggcgactcagtagtaaggc

SEQ ID NO: 166473 - DNA, 25 bp, Homo sapien
catgttccacgctagggctccgggc

SEQ ID NO: 166474 - DNA, 25 bp, Homo sapien
aggtcatgttccacgctagggctcc

SEQ ID NO: 166475 - DNA, 25 bp, Homo sapien
cgaaaggtcatgttccacgctaggg

SEQ ID NO: 166476 - DNA, 25 bp, Homo sapien
ggctcgaagcctgtaaagaaaactg

SEQ ID NO: 166477 - DNA, 25 bp, Homo sapien
gagagccgccgccattagcaaagca

SEQ ID NO: 166478 - DNA, 25 bp, Homo sapien
ctcccgccctgagtgaggacaaagg

SEQ ID NO: 166479 - DNA, 25 bp, Homo sapien
gagatgctgcgtcatggtgccaaca

SEQ ID NO: 166480 - DNA, 25 bp, Homo sapien
gtgccaacatggacgccggcctttt

SEQ ID NO: 166481 - DNA, 25 bp, Homo sapien
gggtgcggaatcctcacgatcgaaa

SEQ ID NO: 166482 - DNA, 25 bp, Homo sapien
ggcgatgaggctccctagtgtttta

SEQ ID NO: 166483 - DNA, 25 bp, Homo sapien
ctgactcggctctcagagggcgact

SEQ ID NO: 166484 - DNA, 25 bp, Homo sapien
agccagcgagacagctcctttcggg

SEQ ID NO: 166485 - DNA, 25 bp, Homo sapien
gacaccatgtactggctggcggcgc

SEQ ID NO: 166486 - DNA, 25 bp, Homo sapien
gtcgggctccttagcggtgtattgt

SEQ ID NO: 166487 - DNA, 25 bp, Homo sapien
cggcggagacgacaacaacttgctg

SEQ ID NO: 166488 - DNA, 25 bp, Homo sapien
gggcctgccgattggattctttcgc

SEQ ID NO: 166489 - DNA, 25 bp, Homo sapien
gggttattctctcgctccattcttg

SEQ ID NO: 166490 - DNA, 25 bp, Homo sapien
tctcccggaagggttattctctcgc

SEQ ID NO: 166491 - DNA, 25 bp, Homo sapien
ctttcgcgtgtgtgtagaagcggcc

SEQ ID NO: 166492 - DNA, 25 bp, Homo sapien
tgcagagttcccagtaggacgccca

SEQ ID NO: 166493 - DNA, 25 bp, Homo sapien
ccagggtcccgcacttagcgatttc

SEQ ID NO: 166494 - DNA, 25 bp, Homo sapien
ccaagcgcgacttagacgtggccta

SEQ ID NO: 166495 - DNA, 25 bp, Homo sapien
ttttcgctgatggaaacgctggccg

SEQ ID NO: 166496 - DNA, 25 bp, Homo sapien
ccactgcggggcttcatcatacgaa

SEQ ID NO: 166497 - DNA, 25 bp, Homo sapien
cctggagagctttggcctttgtttc

SEQ ID NO: 166498 - DNA, 25 bp, Homo sapien
tcagcagcacagattacacctaagg

SEQ ID NO: 166499 - DNA, 25 bp, Homo sapien
gttgtcagaagactcgcacgcggca

SEQ ID NO: 166500 - DNA, 25 bp, Homo sapien
cctggactcgcgcatcgagatgctg

SEQ ID NO: 166501 - DNA, 25 bp, Homo sapien
acgagagcaagttcacggacgccta

SEQ ID NO: 166502 - DNA, 25 bp, Homo sapien
ccgccgccacgaacatcattatgta

SEQ ID NO: 166503 - DNA, 25 bp, Homo sapien
gtacacaattctcccgcggtcactg

SEQ ID NO: 166504 - DNA, 25 bp, Homo sapien
cgttcaaggctcaaccacaggattc

SEQ ID NO: 166505 - DNA, 25 bp, Homo sapien
tgctcctggattcaagtctgctttc

SEQ ID NO: 166506 - DNA, 25 bp, Homo sapien
aagtctgctttctctccgtatcaga

SEQ ID NO: 166507 - DNA, 25 bp, Homo sapien
gagtcctgagccctgtgacagccct

SEQ ID NO: 166508 - DNA, 25 bp, Homo sapien
gaatagcgcctgggctttctgcggc

SEQ ID NO: 166509 - DNA, 25 bp, Homo sapien
cgccggccctggcacccgtctcctc

SEQ ID NO: 166510 - DNA, 25 bp, Homo sapien
ccgctccgtctaggctgcctggggt

SEQ ID NO: 166511 - DNA, 25 bp, Homo sapien
gtgaggagtgtttaccatgctgacc

SEQ ID NO: 166512 - DNA, 25 bp, Homo sapien
agtgtttaccatgctgaccacggtc

SEQ ID NO: 166513 - DNA, 25 bp, Homo sapien
ttaccatgctgaccacggtccaggg

SEQ ID NO: 166514 - DNA, 25 bp, Homo sapien
cccgcagtggctggagcgaaaggca

SEQ ID NO: 166515 - DNA, 25 bp, Homo sapien
tgctgaccacggtccagggctgaga

SEQ ID NO: 166516 - DNA, 25 bp, Homo sapien
tcatccgcgtcatcatcctcggggt

SEQ ID NO: 166517 - DNA, 25 bp, Homo sapien
aggagtcattgtcggcgtcctcgtc

SEQ ID NO: 166518 - DNA, 25 bp, Homo sapien
agcacaaggacgaggacaggccgaa

SEQ ID NO: 166519 - DNA, 25 bp, Homo sapien
cgagaccgggatatggcagacaccc

SEQ ID NO: 166520 - DNA, 25 bp, Homo sapien
tgaggaagatgaaggttcgtgctct

SEQ ID NO: 166521 - DNA, 25 bp, Homo sapien
gacaccacctcatctggcgaccaga

SEQ ID NO: 166522 - DNA, 25 bp, Homo sapien
aggccgaagcccaaggaccgcatcg

SEQ ID NO: 166523 - DNA, 25 bp, Homo sapien
ttcaaggtcaagaggaaggagccac

SEQ ID NO: 166524 - DNA, 25 bp, Homo sapien
gccggccacctaagaagcgccatga

SEQ ID NO: 166525 - DNA, 25 bp, Homo sapien
aatacatggagttggccaagagccg

SEQ ID NO: 166526 - DNA, 25 bp, Homo sapien
ctaagaagcgccatgaggacctggt

SEQ ID NO: 166527 - DNA, 25 bp, Homo sapien
cctgtatgacatctggaacggtggc

SEQ ID NO: 166528 - DNA, 25 bp, Homo sapien
ggaggacatccgcttcctgtgtgtc

SEQ ID NO: 166529 - DNA, 25 bp, Homo sapien
gcttcctgtgtgtcacctacgagcg

SEQ ID NO: 166530 - DNA, 25 bp, Homo sapien
acatctggaacggtggcatcgatga

SEQ ID NO: 166531 - DNA, 25 bp, Homo sapien
cgcgatgaggtcactgaggaataca

SEQ ID NO: 166532 - DNA, 25 bp, Homo sapien
tgtcctccttcactggcagctgtga

SEQ ID NO: 166533 - DNA, 25 bp, Homo sapien
ccacattcacgactggggcttgttc

SEQ ID NO: 166534 - DNA, 25 bp, Homo sapien
caccgtccactgcagggcatgagca

SEQ ID NO: 166535 - DNA, 25 bp, Homo sapien
tcgacgccaccaagtgcggcaactt

SEQ ID NO: 166536 - DNA, 25 bp, Homo sapien
agcagctacatgttccgggtggacc

SEQ ID NO: 166537 - DNA, 25 bp, Homo sapien
cccttttgtggccaggtgatcgcag

SEQ ID NO: 166538 - DNA, 25 bp, Homo sapien
cgtgggccagaatatccgtcaggta

SEQ ID NO: 166539 - DNA, 25 bp, Homo sapien
ggcttgttcgccatggagcccatcg

SEQ ID NO: 166540 - DNA, 25 bp, Homo sapien
ttcagaaagtcggatggggcagagg

SEQ ID NO: 166541 - DNA, 25 bp, Homo sapien
ggctggaaccggaggcccttgagaa

SEQ ID NO: 166542 - DNA, 25 bp, Homo sapien
ccaggctggaaccggaggcccttga

SEQ ID NO: 166543 - DNA, 25 bp, Homo sapien
cagatggcgctcctcggccaggctg

SEQ ID NO: 166544 - DNA, 25 bp, Homo sapien
atggcgctcctcggccaggctggaa

SEQ ID NO: 166545 - DNA, 25 bp, Homo sapien
gcgctcctcggccaggctggaaccg

SEQ ID NO: 166546 - DNA, 25 bp, Homo sapien
tcctcggccaggctggaaccggagg

SEQ ID NO: 166547 - DNA, 25 bp, Homo sapien
agaaagtcggatggggcagaggatc

SEQ ID NO: 166548 - DNA, 25 bp, Homo sapien
agctttaagccgactctactggaga

SEQ ID NO: 166549 - DNA, 25 bp, Homo sapien
ctagttcgggcttcagaaagtcgga

SEQ ID NO: 166550 - DNA, 25 bp, Homo sapien
cccagatctagttcgggcttcagaa

SEQ ID NO: 166551 - DNA, 25 bp, Homo sapien
ggaggtgaaactctccagcccagat

SEQ ID NO: 166552 - DNA, 25 bp, Homo sapien
cgcagaggaggtgaaactctccagc

SEQ ID NO: 166553 - DNA, 25 bp, Homo sapien
agcagtctaccctagagggaggatg

SEQ ID NO: 166554 - DNA, 25 bp, Homo sapien
ctggagaagcagtctaccctagagg

SEQ ID NO: 166555 - DNA, 25 bp, Homo sapien
ccgactctactggagaagcagtcta

SEQ ID NO: 166556 - DNA, 25 bp, Homo sapien
aggcactactgccttatgcgcaaca

SEQ ID NO: 166557 - DNA, 25 bp, Homo sapien
ctactgccttatgcgcaacacaaac

SEQ ID NO: 166558 - DNA, 25 bp, Homo sapien
aacacagacacagtattggaccggg

SEQ ID NO: 166559 - DNA, 25 bp, Homo sapien
acacagtattggaccggggcacgct

SEQ ID NO: 166560 - DNA, 25 bp, Homo sapien
attggaccggggcacgctttaatcg

SEQ ID NO: 166561 - DNA, 25 bp, Homo sapien
cgctttaatcgggagggctggagca

SEQ ID NO: 166562 - DNA, 25 bp, Homo sapien
tggcaaagcgctggcacccgcagct

SEQ ID NO: 166563 - DNA, 25 bp, Homo sapien
ccctggctgccataaggcactactg

SEQ ID NO: 166564 - DNA, 25 bp, Homo sapien
tggggatccattgcttccgacgcta

SEQ ID NO: 166565 - DNA, 25 bp, Homo sapien
tccgcaacggatctccctgggaggc

SEQ ID NO: 166566 - DNA, 25 bp, Homo sapien
ccaactatgacgtgctggaaagcgt

SEQ ID NO: 166567 - DNA, 25 bp, Homo sapien
gaagcgcagatcaaggccaactatg

SEQ ID NO: 166568 - DNA, 25 bp, Homo sapien
tgactgtcagcgacgtccaggagct

SEQ ID NO: 166569 - DNA, 25 bp, Homo sapien
ccctagcgttggtgtgcaattgcgt

SEQ ID NO: 166570 - DNA, 25 bp, Homo sapien
cttgactgttctcgcgttcgcggac

SEQ ID NO: 166571 - DNA, 25 bp, Homo sapien
ttcacgatgtccgacgaggaagcga

SEQ ID NO: 166572 - DNA, 25 bp, Homo sapien
ctgccctgtcgctttagggcctgtc

SEQ ID NO: 166573 - DNA, 25 bp, Homo sapien
cgaggaaagtctatgccgccagcga

SEQ ID NO: 166574 - DNA, 25 bp, Homo sapien
tctatgccgccagcgaccggcagga

SEQ ID NO: 166575 - DNA, 25 bp, Homo sapien
acgtcgggcacgctcgtcaccgttt

SEQ ID NO: 166576 - DNA, 25 bp, Homo sapien
gctcgtcaccgtttcctggcacgtg

SEQ ID NO: 166577 - DNA, 25 bp, Homo sapien
tggcaaccagaactagggagctggt

SEQ ID NO: 166578 - DNA, 25 bp, Homo sapien
ctctggccttttgaagaccggggtg

SEQ ID NO: 166579 - DNA, 25 bp, Homo sapien
acggagcttgggtggcaaccagaac

SEQ ID NO: 166580 - DNA, 25 bp, Homo sapien
tggggcccgagtcgcgggcactgcg

SEQ ID NO: 166581 - DNA, 25 bp, Homo sapien
atctgcgcattctgggggccgccga

SEQ ID NO: 166582 - DNA, 25 bp, Homo sapien
agttcccgtgcggtgccggcagctg

SEQ ID NO: 166583 - DNA, 25 bp, Homo sapien
ggaagctgtgtctgcgcgagttccc

SEQ ID NO: 166584 - DNA, 25 bp, Homo sapien
cgagcacttgcggaagctgtgtctg

SEQ ID NO: 166585 - DNA, 25 bp, Homo sapien
gagtccgagtctgaggccgggcctg

SEQ ID NO: 166586 - DNA, 25 bp, Homo sapien
aggcgtcgtacgagtccgagtccga

SEQ ID NO: 166587 - DNA, 25 bp, Homo sapien
ccatggaggcgtcgtacgagtccga

SEQ ID NO: 166588 - DNA, 25 bp, Homo sapien
gccgtgagtgtcttggtgaccactg

SEQ ID NO: 166589 - DNA, 25 bp, Homo sapien
ttccgccgtggtcagtgactcgttt

SEQ ID NO: 166590 - DNA, 25 bp, Homo sapien
caggagtagcggcagaatttcgata

SEQ ID NO: 166591 - DNA, 25 bp, Homo sapien
gactcgtttgcacaaggacttttta

SEQ ID NO: 166592 - DNA, 25 bp, Homo sapien
gccgggctcactctttcgcattttg

SEQ ID NO: 166593 - DNA, 25 bp, Homo sapien
cactggtcgattcagagggacacta

SEQ ID NO: 166594 - DNA, 25 bp, Homo sapien
ctcacgttcgcttctgtcaggagta

SEQ ID NO: 166595 - DNA, 25 bp, Homo sapien
ggacactagaaacgcgatgcccata

SEQ ID NO: 166596 - DNA, 25 bp, Homo sapien
aggctctgcgcatgttcgccgtgta

SEQ ID NO: 166597 - DNA, 25 bp, Homo sapien
tcagcccttcggagactgtcgcgtt

SEQ ID NO: 166598 - DNA, 25 bp, Homo sapien
tgggtctctgctgccgtcagccctt

SEQ ID NO: 166599 - DNA, 25 bp, Homo sapien
gcttcggttctccaggctggggaca

SEQ ID NO: 166600 - DNA, 25 bp, Homo sapien
cccggcgtcacgctcaggtaggttg

SEQ ID NO: 166601 - DNA, 25 bp, Homo sapien
gcagtaaaggctgttcccagcactc

SEQ ID NO: 166602 - DNA, 25 bp, Homo sapien
gactgtcgcgttgaaagaatgaacc

SEQ ID NO: 166603 - DNA, 25 bp, Homo sapien
gtcaccgagtcctgtggggatccga

SEQ ID NO: 166604 - DNA, 25 bp, Homo sapien
ctcggggactcgtttctagaagatg

SEQ ID NO: 166605 - DNA, 25 bp, Homo sapien
cgccagacgcacacgccggaagtga

SEQ ID NO: 166606 - DNA, 25 bp, Homo sapien
gaggtcctggccctcgaaacagcaa

SEQ ID NO: 166607 - DNA, 25 bp, Homo sapien
ccacccaaggaagcagtcgggattg

SEQ ID NO: 166608 - DNA, 25 bp, Homo sapien
cgaggcttagggcaaaggctgtaac

SEQ ID NO: 166609 - DNA, 25 bp, Homo sapien
tgcgcgacagccaactcttcagagc

SEQ ID NO: 166610 - DNA, 25 bp, Homo sapien
cttcagagccgccattgtgcagcgc

SEQ ID NO: 166611 - DNA, 25 bp, Homo sapien
tacctgaagaatgaagttacgctgc

SEQ ID NO: 166612 - DNA, 25 bp, Homo sapien
cccggtggttattcagattctcgcc

SEQ ID NO: 166613 - DNA, 25 bp, Homo sapien
gccaagacccagagcgcgtttcaga

SEQ ID NO: 166614 - DNA, 25 bp, Homo sapien
ggttctacctagtctggccctagtg

SEQ ID NO: 166615 - DNA, 25 bp, Homo sapien
cgcgtttcagagtctggtcactcca

SEQ ID NO: 166616 - DNA, 25 bp, Homo sapien
gaatctgctgggttcgggttctacc

SEQ ID NO: 166617 - DNA, 25 bp, Homo sapien
tttaggttcactcggccgtaggaca

SEQ ID NO: 166618 - DNA, 25 bp, Homo sapien
ccgcctcgcgcaacacgtttaggtt

SEQ ID NO: 166619 - DNA, 25 bp, Homo sapien
gcacttgtccaggaactcgcgcagc

SEQ ID NO: 166620 - DNA, 25 bp, Homo sapien
tccaagctccatcttgaggcgggcg

SEQ ID NO: 166621 - DNA, 25 bp, Homo sapien
cctgaggaatgctcaggtgacaggc

SEQ ID NO: 166622 - DNA, 25 bp, Homo sapien
ggccagggtgccctccatgccggat

SEQ ID NO: 166623 - DNA, 25 bp, Homo sapien
ttcggaaacccgagagcgatctggc

SEQ ID NO: 166624 - DNA, 25 bp, Homo sapien
ggcagcggtgtgatttcggaaaccc

SEQ ID NO: 166625 - DNA, 25 bp, Homo sapien
gccacttttccagctccggaggagc

SEQ ID NO: 166626 - DNA, 25 bp, Homo sapien
tgccgcggtagaaggttcggattac

SEQ ID NO: 166627 - DNA, 25 bp, Homo sapien
tgacagggccgccacttttccagct

SEQ ID NO: 166628 - DNA, 25 bp, Homo sapien
cggggccagtcgctagagactacaa

SEQ ID NO: 166629 - DNA, 25 bp, Homo sapien
tgtgaacgggcttcggaatcgactc

SEQ ID NO: 166630 - DNA, 25 bp, Homo sapien
cccgctagggttttctccagacgca

SEQ ID NO: 166631 - DNA, 25 bp, Homo sapien
aaggcggcaccactctctagagctc

SEQ ID NO: 166632 - DNA, 25 bp, Homo sapien
ccattttgggctgtggaaaagattc

SEQ ID NO: 166633 - DNA, 25 bp, Homo sapien
cggctcgaagagctctagatcgcca

SEQ ID NO: 166634 - DNA, 25 bp, Homo sapien
gcacttggaattctggccctcctgg

SEQ ID NO: 166635 - DNA, 25 bp, Homo sapien
gcccagcgagaggaaaggatattct

SEQ ID NO: 166636 - DNA, 25 bp, Homo sapien
ttgtcgctttcaacagtaccggccg

SEQ ID NO: 166637 - DNA, 25 bp, Homo sapien
ggcgccattttgtctacacacatac

SEQ ID NO: 166638 - DNA, 25 bp, Homo sapien
ccgaagcttcgcctcagactaaatc

SEQ ID NO: 166639 - DNA, 25 bp, Homo sapien
ggggcaacttcctatttcgagtcta

SEQ ID NO: 166640 - DNA, 25 bp, Homo sapien
ccatagttcagagtcccggccgcta

SEQ ID NO: 166641 - DNA, 25 bp, Homo sapien
cctggctttaaactcagattcggta

SEQ ID NO: 166642 - DNA, 25 bp, Homo sapien
gggagccgttcacccactgttggaa

SEQ ID NO: 166643 - DNA, 25 bp, Homo sapien
agtaatcttggtctcttccggccgc

SEQ ID NO: 166644 - DNA, 25 bp, Homo sapien
ttgcatggcattgcgtcgagctgtc

SEQ ID NO: 166645 - DNA, 25 bp, Homo sapien
ggcaggactagccttcgaaaaagcc

SEQ ID NO: 166646 - DNA, 25 bp, Homo sapien
ggctttcagctttcttttctcttca

SEQ ID NO: 166647 - DNA, 25 bp, Homo sapien
cctcaagtgtaaacaggactctccc

SEQ ID NO: 166648 - DNA, 25 bp, Homo sapien
cctcgctaagcggtttgagatcctc

SEQ ID NO: 166649 - DNA, 25 bp, Homo sapien
tgccgcgtctttgcttgcaacctga

SEQ ID NO: 166650 - DNA, 25 bp, Homo sapien
cccggcaccatgtcggagaaaagcg

SEQ ID NO: 166651 - DNA, 25 bp, Homo sapien
ttccagagacccagcttgccgagcg

SEQ ID NO: 166652 - DNA, 25 bp, Homo sapien
cccgctcccgagaagctcgtagaga

SEQ ID NO: 166653 - DNA, 25 bp, Homo sapien
gaggcgatgatcctcggactcatta

SEQ ID NO: 166654 - DNA, 25 bp, Homo sapien
ggcacgcccatctcgaggattcatc

SEQ ID NO: 166655 - DNA, 25 bp, Homo sapien
aggattcatcctctccaacgggtga

SEQ ID NO: 166656 - DNA, 25 bp, Homo sapien
tctcgcgataaaggctcattgtctc

SEQ ID NO: 166657 - DNA, 25 bp, Homo sapien
tcaggactccaggatgcaccgcaga

SEQ ID NO: 166658 - DNA, 25 bp, Homo sapien
gcaaggcgcacgctccgcaattttt

SEQ ID NO: 166659 - DNA, 25 bp, Homo sapien
tctctgcgtctgcaagtcacgttcc

SEQ ID NO: 166660 - DNA, 25 bp, Homo sapien
gggctgcacagtctcctattatttg

SEQ ID NO: 166661 - DNA, 25 bp, Homo sapien
acagcatcaagaacgtgccggcgcg

SEQ ID NO: 166662 - DNA, 25 bp, Homo sapien
tccttctctcgtgagcggtttccca

SEQ ID NO: 166663 - DNA, 25 bp, Homo sapien
ctgggtgaaaagcttctcgtatgtc

SEQ ID NO: 166664 - DNA, 25 bp, Homo sapien
tcgtatgtcgccagacttgtttgcc

SEQ ID NO: 166665 - DNA, 25 bp, Homo sapien
ccgagcgctgcccacgtataaatag

SEQ ID NO: 166666 - DNA, 25 bp, Homo sapien
accggcgcccgacagacagaaactt

SEQ ID NO: 166667 - DNA, 25 bp, Homo sapien
agcgcgagcagttcgacaagaccca

SEQ ID NO: 166668 - DNA, 25 bp, Homo sapien
ccggcgctcactggaggatgaaacc

SEQ ID NO: 166669 - DNA, 25 bp, Homo sapien
actcatggccgcagtaaacggggtg

SEQ ID NO: 166670 - DNA, 25 bp, Homo sapien
ggcacggcctgtcccgaactcatgg

SEQ ID NO: 166671 - DNA, 25 bp, Homo sapien
tgtaatcctgggtacggcacggcct

SEQ ID NO: 166672 - DNA, 25 bp, Homo sapien
ctgcgaagagaatccttgctgagtg

SEQ ID NO: 166673 - DNA, 25 bp, Homo sapien
cacgaactgcgaagagaatccttgc

SEQ ID NO: 166674 - DNA, 25 bp, Homo sapien
cggatatggggacacgaactgcgaa

SEQ ID NO: 166675 - DNA, 25 bp, Homo sapien
cactggaggatgaaacccggctggt

SEQ ID NO: 166676 - DNA, 25 bp, Homo sapien
ggctgccatcggtactctgagctct

SEQ ID NO: 166677 - DNA, 25 bp, Homo sapien
actccaggtcgttgttgagggtctc

SEQ ID NO: 166678 - DNA, 25 bp, Homo sapien
actctagtcatccttcgggtgcctc

SEQ ID NO: 166679 - DNA, 25 bp, Homo sapien
gcgatcccgaggaatcgttccgctc

SEQ ID NO: 166680 - DNA, 25 bp, Homo sapien
ccgcgctcggcattcggcttatgct

SEQ ID NO: 166681 - DNA, 25 bp, Homo sapien
ccgcggaagccctagaggatgaatc

SEQ ID NO: 166682 - DNA, 25 bp, Homo sapien
cccggcaagtcaagggtgacacctt

SEQ ID NO: 166683 - DNA, 25 bp, Homo sapien
gggtgcctcttccttatccgctaac

SEQ ID NO: 166684 - DNA, 25 bp, Homo sapien
taatgacccgggcacttattctagc

SEQ ID NO: 166685 - DNA, 25 bp, Homo sapien
tacgctctgcaataggaggacggta

SEQ ID NO: 166686 - DNA, 25 bp, Homo sapien
ggtccttggccatgctggctcgcct

SEQ ID NO: 166687 - DNA, 25 bp, Homo sapien
tggccatgctggctcgcctggtcac

SEQ ID NO: 166688 - DNA, 25 bp, Homo sapien
cgcgtcactacgctctgcaatagga

SEQ ID NO: 166689 - DNA, 25 bp, Homo sapien
ggcacttattctagcccagctctgg

SEQ ID NO: 166690 - DNA, 25 bp, Homo sapien
cttctgagctgggtgggctcgcctt

SEQ ID NO: 166691 - DNA, 25 bp, Homo sapien
gactcccacgcacgcccggactcct

SEQ ID NO: 166692 - DNA, 25 bp, Homo sapien
agcgcattaatgacgtcactgcggc

SEQ ID NO: 166693 - DNA, 25 bp, Homo sapien
atgtgtcagggacagtcgggacttc

SEQ ID NO: 166694 - DNA, 25 bp, Homo sapien
acgtgacgtaagtgtcgcggctcgc

SEQ ID NO: 166695 - DNA, 25 bp, Homo sapien
agccctgggtcgtgacgtcatcacc

SEQ ID NO: 166696 - DNA, 25 bp, Homo sapien
ctgtgacgcgtgagcgcattaatga

SEQ ID NO: 166697 - DNA, 25 bp, Homo sapien
tcgttgagctgcaccagcgacagcc

SEQ ID NO: 166698 - DNA, 25 bp, Homo sapien
tccggccaccgttcgaggagcgaac

SEQ ID NO: 166699 - DNA, 25 bp, Homo sapien
aagggccctatgattgggctgtgac

SEQ ID NO: 166700 - DNA, 25 bp, Homo sapien
gcacacgagggtgatgaccagccac

SEQ ID NO: 166701 - DNA, 25 bp, Homo sapien
tagatgcccacgaagaggcacacga

SEQ ID NO: 166702 - DNA, 25 bp, Homo sapien
gcagcagcttcaccatggcatagat

SEQ ID NO: 166703 - DNA, 25 bp, Homo sapien
tgtacgtccacacgaacagggccca

SEQ ID NO: 166704 - DNA, 25 bp, Homo sapien
atgcgccgagtgaaatgtacgtcca

SEQ ID NO: 166705 - DNA, 25 bp, Homo sapien
agcagccaccagagcaggaaggatg

SEQ ID NO: 166706 - DNA, 25 bp, Homo sapien
tggccgcacggtggacagcagccac

SEQ ID NO: 166707 - DNA, 25 bp, Homo sapien
ttggtgtaggagagcagcttctgca

SEQ ID NO: 166708 - DNA, 25 bp, Homo sapien
ctgagactggcgtgcgttgagacag

SEQ ID NO: 166709 - DNA, 25 bp, Homo sapien
cagtttccgcgctgctcattgaaga

SEQ ID NO: 166710 - DNA, 25 bp, Homo sapien
ttccgcgctgctcattgaagactgc

SEQ ID NO: 166711 - DNA, 25 bp, Homo sapien
gctgctcattgaagactgcgccgga

SEQ ID NO: 166712 - DNA, 25 bp, Homo sapien
tgctcattgaagactgcgccggacg

SEQ ID NO: 166713 - DNA, 25 bp, Homo sapien
gtcctcgctccgctcttcccgctgc

SEQ ID NO: 166714 - DNA, 25 bp, Homo sapien
ccgctgcaaggtcggagctgagact

SEQ ID NO: 166715 - DNA, 25 bp, Homo sapien
tctggggtgcagtttccgcgctgct

SEQ ID NO: 166716 - DNA, 25 bp, Homo sapien
cctgcttctgcaccgataacttgta

SEQ ID NO: 166717 - DNA, 25 bp, Homo sapien
tcactggggcaatctgaggtaatcc

SEQ ID NO: 166718 - DNA, 25 bp, Homo sapien
ttgggaacgccaccggaagtaatgc

SEQ ID NO: 166719 - DNA, 25 bp, Homo sapien
ggacccggggtagatgctaaatcca

SEQ ID NO: 166720 - DNA, 25 bp, Homo sapien
cggacctccgagctctttaaactgt

SEQ ID NO: 166721 - DNA, 25 bp, Homo sapien
tcctgtgaaggcacgacccagttca

SEQ ID NO: 166722 - DNA, 25 bp, Homo sapien
cgaagtctctctacggaagctggta

SEQ ID NO: 166723 - DNA, 25 bp, Homo sapien
agccattagtccctgcctcgtagtg

SEQ ID NO: 166724 - DNA, 25 bp, Homo sapien
acctggggcgtcagaacgaaaggca

SEQ ID NO: 166725 - DNA, 25 bp, Homo sapien
acatcccaaggtcgcaaggccagca

SEQ ID NO: 166726 - DNA, 25 bp, Homo sapien
caggaaagacacctcgaggaactgc

SEQ ID NO: 166727 - DNA, 25 bp, Homo sapien
gcttcggctcaagcgcgtcttcttc

SEQ ID NO: 166728 - DNA, 25 bp, Homo sapien
gcgcagcttcggcagacacaggcgt

SEQ ID NO: 166729 - DNA, 25 bp, Homo sapien
cagccttggaagtgggcgcagcttc

SEQ ID NO: 166730 - DNA, 25 bp, Homo sapien
ctcagtctggagctcgcagtcgtat

SEQ ID NO: 166731 - DNA, 25 bp, Homo sapien
tcccgcaagcgctcgaggagtcgca

SEQ ID NO: 166732 - DNA, 25 bp, Homo sapien
cggtggctgtacttcagctgcgcca

SEQ ID NO: 166733 - DNA, 25 bp, Homo sapien
ccggcccacgatgtagatctgcatg

SEQ ID NO: 166734 - DNA, 25 bp, Homo sapien
ccgcgtagccatccgtgatgaactg

SEQ ID NO: 166735 - DNA, 25 bp, Homo sapien
gctgcactcacggtgccctacttgg

SEQ ID NO: 166736 - DNA, 25 bp, Homo sapien
ggacaggctaatggcgctgtacacc

SEQ ID NO: 166737 - DNA, 25 bp, Homo sapien
cagcttcttggtgggccggcccacg

SEQ ID NO: 166738 - DNA, 25 bp, Homo sapien
ccatccgtgatgaactgcggggtca

SEQ ID NO: 166739 - DNA, 25 bp, Homo sapien
ccgccacgtccttggtggagccata

SEQ ID NO: 166740 - DNA, 25 bp, Homo sapien
gcacgcgcatgacggtgtcgaacac

SEQ ID NO: 166741 - DNA, 25 bp, Homo sapien
tggtgttagcatcgcccttcttgga

SEQ ID NO: 166742 - DNA, 25 bp, Homo sapien
atcgcccttcttggagctggggtcc

SEQ ID NO: 166743 - DNA, 25 bp, Homo sapien
gtgcctccgtgcagcaccagtagca

SEQ ID NO: 166744 - DNA, 25 bp, Homo sapien
ccagtagcagcacgtggatcttgga

SEQ ID NO: 166745 - DNA, 25 bp, Homo sapien
catgacggtgtcgaacacgttggcg

SEQ ID NO: 166746 - DNA, 25 bp, Homo sapien
acacgttggcgatggtgttagcatc

SEQ ID NO: 166747 - DNA, 25 bp, Homo sapien
tgcagccagcggctggctaacctcg

SEQ ID NO: 166748 - DNA, 25 bp, Homo sapien
gcgccgcggtgcacctcagggaccg

SEQ ID NO: 166749 - DNA, 25 bp, Homo sapien
aggccccgccgctacacggtgctga

SEQ ID NO: 166750 - DNA, 25 bp, Homo sapien
cgcggggacttctcgctatggctgc

SEQ ID NO: 166751 - DNA, 25 bp, Homo sapien
gggacttctcgctatggctgcgccc

SEQ ID NO: 166752 - DNA, 25 bp, Homo sapien
ggacttctcgctatggctgcgccca

SEQ ID NO: 166753 - DNA, 25 bp, Homo sapien
gacttctcgctatggctgcgcccag

SEQ ID NO: 166754 - DNA, 25 bp, Homo sapien
cctgggccaggcctcgagtatgtgg

SEQ ID NO: 166755 - DNA, 25 bp, Homo sapien
aggcctcgagtatgtggggcgggac

SEQ ID NO: 166756 - DNA, 25 bp, Homo sapien
ggaaccggccgacttgcggccactg

SEQ ID NO: 166757 - DNA, 25 bp, Homo sapien
tgcggccactgtgactcttaaaaca

SEQ ID NO: 166758 - DNA, 25 bp, Homo sapien
gctcgcattccctcagtggcggcgg

SEQ ID NO: 166759 - DNA, 25 bp, Homo sapien
ggcattgctcccgagcgtcgcaggc

SEQ ID NO: 166760 - DNA, 25 bp, Homo sapien
cagggccggcgactcactgaggcca

SEQ ID NO: 166761 - DNA, 25 bp, Homo sapien
aaatcagcgtttcgggcacggatcc

SEQ ID NO: 166762 - DNA, 25 bp, Homo sapien
cacgcggtcgcgaccgacggaaatt

SEQ ID NO: 166763 - DNA, 25 bp, Homo sapien
ccgacggaaattcggaaatcagcgt

SEQ ID NO: 166764 - DNA, 25 bp, Homo sapien
gccgtgacacccgagctcagttttc

SEQ ID NO: 166765 - DNA, 25 bp, Homo sapien
aagcttcagtttctcgcatgcgcag

SEQ ID NO: 166766 - DNA, 25 bp, Homo sapien
agtgtctcctaagtctcgtctcctg

SEQ ID NO: 166767 - DNA, 25 bp, Homo sapien
tctctccagtgattggctgcccgga

SEQ ID NO: 166768 - DNA, 25 bp, Homo sapien
gcgggattgctgtgaaactctcttc

SEQ ID NO: 166769 - DNA, 25 bp, Homo sapien
cctccgctgaggtgatttggatatc

SEQ ID NO: 166770 - DNA, 25 bp, Homo sapien
catctgcggagaagccaggtaaccc

SEQ ID NO: 166771 - DNA, 25 bp, Homo sapien
tacggctgccgacgactgtcaaagg

SEQ ID NO: 166772 - DNA, 25 bp, Homo sapien
cagacacaatttctcccggagcgct

SEQ ID NO: 166773 - DNA, 25 bp, Homo sapien
gctgcgtttgggagagaaagtattt

SEQ ID NO: 166774 - DNA, 25 bp, Homo sapien
cggtcaagtcaacgtccctagcata

SEQ ID NO: 166775 - DNA, 25 bp, Homo sapien
caacactgccgcaaaggctgctggc

SEQ ID NO: 166776 - DNA, 25 bp, Homo sapien
gagcgcttctaaccgcgcagcggtg

SEQ ID NO: 166777 - DNA, 25 bp, Homo sapien
cctcacgggtgaactaggctgcgtt

SEQ ID NO: 166778 - DNA, 25 bp, Homo sapien
gtccctagcataaagcaacactgcc

SEQ ID NO: 166779 - DNA, 25 bp, Homo sapien
aggcgcatggctgcggtcaagtcaa

SEQ ID NO: 166780 - DNA, 25 bp, Homo sapien
caacccgtgaacaggaggcagggct

SEQ ID NO: 166781 - DNA, 25 bp, Homo sapien
cgtgagggatgatgacaaggaagcc

SEQ ID NO: 166782 - DNA, 25 bp, Homo sapien
gcggcttggcaacccgtgaacagga

SEQ ID NO: 166783 - DNA, 25 bp, Homo sapien
ggggctttgtctaactccgccactg

SEQ ID NO: 166784 - DNA, 25 bp, Homo sapien
tctcagacaatgagcgcagtgtgca

SEQ ID NO: 166785 - DNA, 25 bp, Homo sapien
cgtctcggcgcatctcagacaatga

SEQ ID NO: 166786 - DNA, 25 bp, Homo sapien
tcagcgaaggccgtctcggcgcatc

SEQ ID NO: 166787 - DNA, 25 bp, Homo sapien
ccacgccagacaaagagcgcggggc

SEQ ID NO: 166788 - DNA, 25 bp, Homo sapien
ccagatggggcgtccacgtgaccca

SEQ ID NO: 166789 - DNA, 25 bp, Homo sapien
ggccaagttcggtttgtaagacatc

SEQ ID NO: 166790 - DNA, 25 bp, Homo sapien
gagcgcccgcgcactttttgttgtc

SEQ ID NO: 166791 - DNA, 25 bp, Homo sapien
cgcactttttgttgtcggcggctcg

SEQ ID NO: 166792 - DNA, 25 bp, Homo sapien
ccagagaactttcgcggcgcgggct

SEQ ID NO: 166793 - DNA, 25 bp, Homo sapien
cagagctgcgccaacttcgttcact

SEQ ID NO: 166794 - DNA, 25 bp, Homo sapien
acgcggctcactcaccggcgttgag

SEQ ID NO: 166795 - DNA, 25 bp, Homo sapien
cgtgcggggcgcaccagagaacttt

SEQ ID NO: 166796 - DNA, 25 bp, Homo sapien
ttggatccaagagaattccggaacc

SEQ ID NO: 166797 - DNA, 25 bp, Homo sapien
gcccggtaccagttgttggatccaa

SEQ ID NO: 166798 - DNA, 25 bp, Homo sapien
aagcgagtacaacggagccgccgtc

SEQ ID NO: 166799 - DNA, 25 bp, Homo sapien
tcctcccgggaggtgtgagtttgaa

SEQ ID NO: 166800 - DNA, 25 bp, Homo sapien
ctgacgaacagaggaagcgagtaca

SEQ ID NO: 166801 - DNA, 25 bp, Homo sapien
caatgctggggcacgaaagaggact

SEQ ID NO: 166802 - DNA, 25 bp, Homo sapien
aaacggtccattaccgcggctctgg

SEQ ID NO: 166803 - DNA, 25 bp, Homo sapien
ccgcctccctcctaggtgaaggaag

SEQ ID NO: 166804 - DNA, 25 bp, Homo sapien
tcccaatggcagctcgggtgtcttc

SEQ ID NO: 166805 - DNA, 25 bp, Homo sapien
tccacggcagcagatccatatgtca

SEQ ID NO: 166806 - DNA, 25 bp, Homo sapien
ccgtgcttctgtttcccttctatga

SEQ ID NO: 166807 - DNA, 25 bp, Homo sapien
agccatggctagaggtatttgccca

SEQ ID NO: 166808 - DNA, 25 bp, Homo sapien
tttggaaactaaagcgcagggcacc

SEQ ID NO: 166809 - DNA, 25 bp, Homo sapien
tggcctatcactacgggcagcctgc

SEQ ID NO: 166810 - DNA, 25 bp, Homo sapien
cctgtcgggaaagcgtttgcagtta

SEQ ID NO: 166811 - DNA, 25 bp, Homo sapien
ggtgtcttccatcgcagccattcaa

SEQ ID NO: 166812 - DNA, 25 bp, Homo sapien
tctccaggcaggaagatgtccaagc

SEQ ID NO: 166813 - DNA, 25 bp, Homo sapien
caccgacggggtaagcaggcaccct

SEQ ID NO: 166814 - DNA, 25 bp, Homo sapien
ctggcggtgtttgacctcggaaaag

SEQ ID NO: 166815 - DNA, 25 bp, Homo sapien
ctcggaaaagtttgactgcgccttc

SEQ ID NO: 166816 - DNA, 25 bp, Homo sapien
tctgtacttactcagaggaggggcc

SEQ ID NO: 166817 - DNA, 25 bp, Homo sapien
gcccaggtgcggcttgcgacaaagt

SEQ ID NO: 166818 - DNA, 25 bp, Homo sapien
agccggggcctcgaaatatggctgc

SEQ ID NO: 166819 - DNA, 25 bp, Homo sapien
caccgcctcggtgttgaatggtccc

SEQ ID NO: 166820 - DNA, 25 bp, Homo sapien
aggacgcggacgactttgaactgca

SEQ ID NO: 166821 - DNA, 25 bp, Homo sapien
gacggagtttccaccgtgcaatcca

SEQ ID NO: 166822 - DNA, 25 bp, Homo sapien
caggtaggagatgtcatacacgtcc

SEQ ID NO: 166823 - DNA, 25 bp, Homo sapien
cgtgcaatccagagcggggtaaaaa

SEQ ID NO: 166824 - DNA, 25 bp, Homo sapien
caaaactttccgctgggcagagtcc

SEQ ID NO: 166825 - DNA, 25 bp, Homo sapien
agctgctgtcttggagtctcccaaa

SEQ ID NO: 166826 - DNA, 25 bp, Homo sapien
agggccataagctcgcggcccaaca

SEQ ID NO: 166827 - DNA, 25 bp, Homo sapien
tcgtgctttccagccgtagaatttg

SEQ ID NO: 166828 - DNA, 25 bp, Homo sapien
ctggattggaaggatggcgccttac

SEQ ID NO: 166829 - DNA, 25 bp, Homo sapien
gggcgccatgttgaaacctggcaaa

SEQ ID NO: 166830 - DNA, 25 bp, Homo sapien
cccaagctttgcagaggtgagtgga

SEQ ID NO: 166831 - DNA, 25 bp, Homo sapien
cggaagggagcccaagctttgcaga

SEQ ID NO: 166832 - DNA, 25 bp, Homo sapien
cggcgaatctgctgctaccaatgta

SEQ ID NO: 166833 - DNA, 25 bp, Homo sapien
ccaatgtaaaggtcaggccgaggcc

SEQ ID NO: 166834 - DNA, 25 bp, Homo sapien
caaaggggacgacattctgggttgc

SEQ ID NO: 166835 - DNA, 25 bp, Homo sapien
cgcggagaatctgctgtcgcctgca

SEQ ID NO: 166836 - DNA, 25 bp, Homo sapien
atccgagttgcgctcaatggagccg

SEQ ID NO: 166837 - DNA, 25 bp, Homo sapien
ggatctccaggacgcgcacgacctt

SEQ ID NO: 166838 - DNA, 25 bp, Homo sapien
gcaaactcgtgcaactcccaaactt

SEQ ID NO: 166839 - DNA, 25 bp, Homo sapien
actcccaaacttgccgctgtcgagg

SEQ ID NO: 166840 - DNA, 25 bp, Homo sapien
cgatgtcgtacacgtccatgacggt

SEQ ID NO: 166841 - DNA, 25 bp, Homo sapien
gtcaatgacccgctcgaactcgtgg

SEQ ID NO: 166842 - DNA, 25 bp, Homo sapien
tcccaagttgggatccgagttgcgc

SEQ ID NO: 166843 - DNA, 25 bp, Homo sapien
ggcccacaagcgacgcgatgtcgta

SEQ ID NO: 166844 - DNA, 25 bp, Homo sapien
gcaaggtcttcgtgtccacctacta

SEQ ID NO: 166845 - DNA, 25 bp, Homo sapien
ctggaacgagagtatctgcaaggtc

SEQ ID NO: 166846 - DNA, 25 bp, Homo sapien
gggcatctggatggtcagcttcatc

SEQ ID NO: 166847 - DNA, 25 bp, Homo sapien
caggcactgcatgccgtcatgggca

SEQ ID NO: 166848 - DNA, 25 bp, Homo sapien
caggcttcctccgactatgactgga

SEQ ID NO: 166849 - DNA, 25 bp, Homo sapien
agtctccaagatcggcctcggcttt

SEQ ID NO: 166850 - DNA, 25 bp, Homo sapien
gctggcacaacaacggcgagcgcta

SEQ ID NO: 166851 - DNA, 25 bp, Homo sapien
ggctgccagttcatagtctccaaga

SEQ ID NO: 166852 - DNA, 25 bp, Homo sapien
tggaacctctcgctgagctttgtga

SEQ ID NO: 166853 - DNA, 25 bp, Homo sapien
ttcctggacatcgacgtggaggtgc

SEQ ID NO: 166854 - DNA, 25 bp, Homo sapien
tccttcggcatgcttggttgctttg

SEQ ID NO: 166855 - DNA, 25 bp, Homo sapien
acgcttgctgaactgctggtgcttc

SEQ ID NO: 166856 - DNA, 25 bp, Homo sapien
ctcgggcaccaagatgggcctcatc

SEQ ID NO: 166857 - DNA, 25 bp, Homo sapien
agtgcttctttgagcgggtcacctc

SEQ ID NO: 166858 - DNA, 25 bp, Homo sapien
cgacgcccatgctgaagagtgcttc

SEQ ID NO: 166859 - DNA, 25 bp, Homo sapien
acggtctcgggctatttcgttagca

SEQ ID NO: 166860 - DNA, 25 bp, Homo sapien
ccattagcattacaggggccaccta

SEQ ID NO: 166861 - DNA, 25 bp, Homo sapien
tgaacatgcgccgagtttatgaagc

SEQ ID NO: 166862 - DNA, 25 bp, Homo sapien
gcctgagtgccctggtgtttctctt

SEQ ID NO: 166863 - DNA, 25 bp, Homo sapien
ggtgactgtgcaaagcgtgaacatg

SEQ ID NO: 166864 - DNA, 25 bp, Homo sapien
cgccggcattacaccattagcatta

SEQ ID NO: 166865 - DNA, 25 bp, Homo sapien
ggccacctacacctcgtatttcgat

SEQ ID NO: 166866 - DNA, 25 bp, Homo sapien
gcagagccacgtttatcaagaagtc

SEQ ID NO: 166867 - DNA, 25 bp, Homo sapien
tatttcgattccacagctccggaga

SEQ ID NO: 166868 - DNA, 25 bp, Homo sapien
agcgcgccatggagcatgtgacaga

SEQ ID NO: 166869 - DNA, 25 bp, Homo sapien
tctgctgctccagcgaagttcccgg

SEQ ID NO: 166870 - DNA, 25 bp, Homo sapien
tgcatcggacccacaggaggtgatc

SEQ ID NO: 166871 - DNA, 25 bp, Homo sapien
ttttgcagggctgctaacccgggtc

SEQ ID NO: 166872 - DNA, 25 bp, Homo sapien
ttcccgtacatgacgccggtgcagg

SEQ ID NO: 166873 - DNA, 25 bp, Homo sapien
atcggaccgcaacattcaggacgta

SEQ ID NO: 166874 - DNA, 25 bp, Homo sapien
gacacgtttctctgcccacggtagc

SEQ ID NO: 166875 - DNA, 25 bp, Homo sapien
ccatcagcgggtgcctgttttgcag

SEQ ID NO: 166876 - DNA, 25 bp, Homo sapien
aggtgctgggacagccatggtttca

SEQ ID NO: 166877 - DNA, 25 bp, Homo sapien
tgaccaccacttgctctgcgctgag

SEQ ID NO: 166878 - DNA, 25 bp, Homo sapien
gctgcgcaggatttgagacgctccc

SEQ ID NO: 166879 - DNA, 25 bp, Homo sapien
tcacagcacctcgtgcgtcacttgg

SEQ ID NO: 166880 - DNA, 25 bp, Homo sapien
gggctggcacgagtcacagcacctc

SEQ ID NO: 166881 - DNA, 25 bp, Homo sapien
cgcactccacttccgcagattaggg

SEQ ID NO: 166882 - DNA, 25 bp, Homo sapien
agccagtctgacagcgcgctgcaca

SEQ ID NO: 166883 - DNA, 25 bp, Homo sapien
gccatggtttcagacggtgaggacc

SEQ ID NO: 166884 - DNA, 25 bp, Homo sapien
ttcgggagtcgacaacgccaaagca

SEQ ID NO: 166885 - DNA, 25 bp, Homo sapien
ctgctgcgttttcgtgtctgagtcc

SEQ ID NO: 166886 - DNA, 25 bp, Homo sapien
ttttatccgaatgtccggccctgcg

SEQ ID NO: 166887 - DNA, 25 bp, Homo sapien
cggccgctcttcttttgaggctttt

SEQ ID NO: 166888 - DNA, 25 bp, Homo sapien
ggcggtgattcttccactgctaacc

SEQ ID NO: 166889 - DNA, 25 bp, Homo sapien
ccgccgattggtggttgccatagct

SEQ ID NO: 166890 - DNA, 25 bp, Homo sapien
ttgccactggtccaatcacagcgcg

SEQ ID NO: 166891 - DNA, 25 bp, Homo sapien
cttctgcagggcatcctgaggcttc

SEQ ID NO: 166892 - DNA, 25 bp, Homo sapien
ctcggcgagactcctccaggaaagc

SEQ ID NO: 166893 - DNA, 25 bp, Homo sapien
gtggtcttcatcagctccgggcacc

SEQ ID NO: 166894 - DNA, 25 bp, Homo sapien
cgtgcactaggaacgggtgagcttc

SEQ ID NO: 166895 - DNA, 25 bp, Homo sapien
ccagttagttaggatcgcccgtgtg

SEQ ID NO: 166896 - DNA, 25 bp, Homo sapien
tccagttccgagacgtgagtgtcgc

SEQ ID NO: 166897 - DNA, 25 bp, Homo sapien
agaccatgtgcctggcgcagctctt

SEQ ID NO: 166898 - DNA, 25 bp, Homo sapien
acaacctcgggcgtccattggtcgg

SEQ ID NO: 166899 - DNA, 25 bp, Homo sapien
gcgggatttagctctgcgtccagtc

SEQ ID NO: 166900 - DNA, 25 bp, Homo sapien
acttcctcaaccaggcgagcgagga

SEQ ID NO: 166901 - DNA, 25 bp, Homo sapien
ggcgctcttcatctaccgcactatg

SEQ ID NO: 166902 - DNA, 25 bp, Homo sapien
ggggctgctagagcctgcccatcgt

SEQ ID NO: 166903 - DNA, 25 bp, Homo sapien
cggcctcaggtgctgtccacaaacg

SEQ ID NO: 166904 - DNA, 25 bp, Homo sapien
cccagcttttcgaggacctgctcaa

SEQ ID NO: 166905 - DNA, 25 bp, Homo sapien
aggacctgctcaaccgcgacgacgg

SEQ ID NO: 166906 - DNA, 25 bp, Homo sapien
gggcgaggacctcatcttgcacttc

SEQ ID NO: 166907 - DNA, 25 bp, Homo sapien
tgtatgcggctttcggcatcaccga

SEQ ID NO: 166908 - DNA, 25 bp, Homo sapien
acggaaacctcgcagcttgggactc

SEQ ID NO: 166909 - DNA, 25 bp, Homo sapien
tgcccgctctgccttttccgatgag

SEQ ID NO: 166910 - DNA, 25 bp, Homo sapien
ggtcagagcttcacgggacactggc

SEQ ID NO: 166911 - DNA, 25 bp, Homo sapien
ttggcttcgcagagaaaatcgagcg

SEQ ID NO: 166912 - DNA, 25 bp, Homo sapien
ggacggattatatggccaccatctg

SEQ ID NO: 166913 - DNA, 25 bp, Homo sapien
acacccgggccaagatagaggcttc

SEQ ID NO: 166914 - DNA, 25 bp, Homo sapien
ccctcaggctgtggaaaaaggccta

SEQ ID NO: 166915 - DNA, 25 bp, Homo sapien
agcgagtgcccaaagcaaaaccttg

SEQ ID NO: 166916 - DNA, 25 bp, Homo sapien
cctctctttgatgaggtggacctcg

SEQ ID NO: 166917 - DNA, 25 bp, Homo sapien
cgcaaaaggagtttcctgctctctg

SEQ ID NO: 166918 - DNA, 25 bp, Homo sapien
tgtagacctcttcaaattccgggtg

SEQ ID NO: 166919 - DNA, 25 bp, Homo sapien
agaggctctttttcatgcggcggcg

SEQ ID NO: 166920 - DNA, 25 bp, Homo sapien
tcatgagcttcttcttggcggcgtg

SEQ ID NO: 166921 - DNA, 25 bp, Homo sapien
gcggactccctagccagcagaaatg

SEQ ID NO: 166922 - DNA, 25 bp, Homo sapien
acacagttctgtccgtccctgagtg

SEQ ID NO: 166923 - DNA, 25 bp, Homo sapien
agcatccactggttcccgcaaaagg

SEQ ID NO: 166924 - DNA, 25 bp, Homo sapien
tattcacttggcgaggcggggctac

SEQ ID NO: 166925 - DNA, 25 bp, Homo sapien
cgggccgatattcacttggcgaggc

SEQ ID NO: 166926 - DNA, 25 bp, Homo sapien
gcccggcgcatctcgcccgctccca

SEQ ID NO: 166927 - DNA, 25 bp, Homo sapien
cgcacctgtgaggtgtccctgagga

SEQ ID NO: 166928 - DNA, 25 bp, Homo sapien
tcacttggagtgagttctcggcggc

SEQ ID NO: 166929 - DNA, 25 bp, Homo sapien
gccgcactgcggttgccctgggtaa

SEQ ID NO: 166930 - DNA, 25 bp, Homo sapien
ggccgggctgcagtctttctttctt

SEQ ID NO: 166931 - DNA, 25 bp, Homo sapien
aacccatcccggaggatgggcctcg

SEQ ID NO: 166932 - DNA, 25 bp, Homo sapien
cgcccggcatcctcgacgcgcgcgc

SEQ ID NO: 166933 - DNA, 25 bp, Homo sapien
ccagagcggtaaggaggcgctctct

SEQ ID NO: 166934 - DNA, 25 bp, Homo sapien
gtaaggaggcgctctctctcccaaa

SEQ ID NO: 166935 - DNA, 25 bp, Homo sapien
aggaggcgctctctctcccaaacgg

SEQ ID NO: 166936 - DNA, 25 bp, Homo sapien
gaggcgctctctctcccaaacgggg

SEQ ID NO: 166937 - DNA, 25 bp, Homo sapien
gccactgcagcagcaggacgtgcct

SEQ ID NO: 166938 - DNA, 25 bp, Homo sapien
actgcagcagcaggacgtgcctcct

SEQ ID NO: 166939 - DNA, 25 bp, Homo sapien
cagcagcaggacgtgcctcctcctc

SEQ ID NO: 166940 - DNA, 25 bp, Homo sapien
actacctgcagagggcctattacca

SEQ ID NO: 166941 - DNA, 25 bp, Homo sapien
tgcctgacccagtgcgcagcacgga

SEQ ID NO: 166942 - DNA, 25 bp, Homo sapien
acttgctctacgctgacgggctgcg

SEQ ID NO: 166943 - DNA, 25 bp, Homo sapien
tcctactttgcgttgcccaggagta

SEQ ID NO: 166944 - DNA, 25 bp, Homo sapien
aagcgaccgcgaggacctcttgaga

SEQ ID NO: 166945 - DNA, 25 bp, Homo sapien
ctcttgagatcgcagaggagcagcc

SEQ ID NO: 166946 - DNA, 25 bp, Homo sapien
agggccgcctcttcctaggaatgaa

SEQ ID NO: 166947 - DNA, 25 bp, Homo sapien
ctctgcgtaggagctggctaagcga

SEQ ID NO: 166948 - DNA, 25 bp, Homo sapien
gcgccaggggaagacgcgagtaagt

SEQ ID NO: 166949 - DNA, 25 bp, Homo sapien
cgcgcgcatcgccatgtgagcggct

SEQ ID NO: 166950 - DNA, 25 bp, Homo sapien
catcgccatgtgagcggctgccgcg

SEQ ID NO: 166951 - DNA, 25 bp, Homo sapien
cctagcctccctcgctcaggcgcga

SEQ ID NO: 166952 - DNA, 25 bp, Homo sapien
cggcgttctctgaggtggagtatta

SEQ ID NO: 166953 - DNA, 25 bp, Homo sapien
cggagcataatggtggggaaagctc

SEQ ID NO: 166954 - DNA, 25 bp, Homo sapien
tctctgaggtggagtattacaaaca

SEQ ID NO: 166955 - DNA, 25 bp, Homo sapien
gtggagtattacaaacatggcgccc

SEQ ID NO: 166956 - DNA, 25 bp, Homo sapien
ggcagtatctcgctcccgcgtggct

SEQ ID NO: 166957 - DNA, 25 bp, Homo sapien
ccacgggacgccagcctatatcggt

SEQ ID NO: 166958 - DNA, 25 bp, Homo sapien
ccagaaagacgaagctgcgagcctc

SEQ ID NO: 166959 - DNA, 25 bp, Homo sapien
tcgatgttcgaatagccctgcagcc

SEQ ID NO: 166960 - DNA, 25 bp, Homo sapien
ggcgccacgaccgtttcgatgttcg

SEQ ID NO: 166961 - DNA, 25 bp, Homo sapien
cagtctgccttcttggccgcgagag

SEQ ID NO: 166962 - DNA, 25 bp, Homo sapien
gcctatatcggtctgggctttcacg

SEQ ID NO: 166963 - DNA, 25 bp, Homo sapien
cgcgtggctggaaagtcggacttca

SEQ ID NO: 166964 - DNA, 25 bp, Homo sapien
agggaggctgccagaccaaggaccc

SEQ ID NO: 166965 - DNA, 25 bp, Homo sapien
gacacgatgagctcggcctggcact

SEQ ID NO: 166966 - DNA, 25 bp, Homo sapien
gcactttccggaccaccctgcactg

SEQ ID NO: 166967 - DNA, 25 bp, Homo sapien
gtggcgcaactaccgcagccagctg

SEQ ID NO: 166968 - DNA, 25 bp, Homo sapien
gtggcagcacccaactgcacgtggc

SEQ ID NO: 166969 - DNA, 25 bp, Homo sapien
tacagcgagaccatcgtggcagcac

SEQ ID NO: 166970 - DNA, 25 bp, Homo sapien
gtcacggcctacagcgagaccatcg

SEQ ID NO: 166971 - DNA, 25 bp, Homo sapien
ccagaccaaggacccgtgtggaagg

SEQ ID NO: 166972 - DNA, 25 bp, Homo sapien
gggtcaccgactgtcggcctgcaca

SEQ ID NO: 166973 - DNA, 25 bp, Homo sapien
cgctttttaattagaacgacgtgtg

SEQ ID NO: 166974 - DNA, 25 bp, Homo sapien
cgacgtgtgtaaatgacagaatacc

SEQ ID NO: 166975 - DNA, 25 bp, Homo sapien
agaataccaccaccctgcgcagatg

SEQ ID NO: 166976 - DNA, 25 bp, Homo sapien
accctgcgcagatggcggccacaga

SEQ ID NO: 166977 - DNA, 25 bp, Homo sapien
gcggccacagaatacgcatcgaatt

SEQ ID NO: 166978 - DNA, 25 bp, Homo sapien
tcctgcgagtgatggggtcaccgac

SEQ ID NO: 166979 - DNA, 25 bp, Homo sapien
gcatcgaattcattctgcccaagga

SEQ ID NO: 166980 - DNA, 25 bp, Homo sapien
actcgctgtcggagagtgtctcgta

SEQ ID NO: 166981 - DNA, 25 bp, Homo sapien
agtgtctcgtactgcgagcagagca

SEQ ID NO: 166982 - DNA, 25 bp, Homo sapien
ccttcccgagcaccaggtaaacatc

SEQ ID NO: 166983 - DNA, 25 bp, Homo sapien
tgagtaaggtctgcacagggccagc

SEQ ID NO: 166984 - DNA, 25 bp, Homo sapien
ggagtcttagttaaggctttagaca

SEQ ID NO: 166985 - DNA, 25 bp, Homo sapien
tttagacaggcaaggatgccggctc

SEQ ID NO: 166986 - DNA, 25 bp, Homo sapien
cgccctgttctgagtcactcgctgt

SEQ ID NO: 166987 - DNA, 25 bp, Homo sapien
ggtggggaagccatgacacccgcct

SEQ ID NO: 166988 - DNA, 25 bp, Homo sapien
ggtctgccagagaccttggccttcc

SEQ ID NO: 166989 - DNA, 25 bp, Homo sapien
ggcgtccggcggttgcagtctccct

SEQ ID NO: 166990 - DNA, 25 bp, Homo sapien
tgcagtctccctccgagtgcactga

SEQ ID NO: 166991 - DNA, 25 bp, Homo sapien
cctccgagtgcactgaggagacaga

SEQ ID NO: 166992 - DNA, 25 bp, Homo sapien
gcagtgaagacagcaccgacgctac

SEQ ID NO: 166993 - DNA, 25 bp, Homo sapien
ggctgctgggtctgccagagacctt

SEQ ID NO: 166994 - DNA, 25 bp, Homo sapien
ctgcgttgggcagtgaagacagcac

SEQ ID NO: 166995 - DNA, 25 bp, Homo sapien
ccggggacttggcttttcggctgct

SEQ ID NO: 166996 - DNA, 25 bp, Homo sapien
cgctgtcagggtggtcttacccaga

SEQ ID NO: 166997 - DNA, 25 bp, Homo sapien
taatcgcgtctatgaaggtggccgc

SEQ ID NO: 166998 - DNA, 25 bp, Homo sapien
ccctttatcgtgagcaatttgacgc

SEQ ID NO: 166999 - DNA, 25 bp, Homo sapien
cggaagtcttaccatcgcgagggga

SEQ ID NO: 167000 - DNA, 25 bp, Homo sapien
tatctttggaccacgagacggggtg

SEQ ID NO: 167001 - DNA, 25 bp, Homo sapien
gccaaagtaaaaagcagagatctga

SEQ ID NO: 167002 - DNA, 25 bp, Homo sapien
gagtagtcgtcagcgcgtgcaaacc

SEQ ID NO: 167003 - DNA, 25 bp, Homo sapien
ccagagaacggagttccagttcctg

SEQ ID NO: 167004 - DNA, 25 bp, Homo sapien
ctcctcgtagcaggcacgttccagt

SEQ ID NO: 167005 - DNA, 25 bp, Homo sapien
tcaggcacaatgaccggggcgccgc

SEQ ID NO: 167006 - DNA, 25 bp, Homo sapien
cttcaggctctcctcgtagcaggca

SEQ ID NO: 167007 - DNA, 25 bp, Homo sapien
gggcgtcggccatcacatccagcgg

SEQ ID NO: 167008 - DNA, 25 bp, Homo sapien
atgagggagcgtacgtcgtgctttt

SEQ ID NO: 167009 - DNA, 25 bp, Homo sapien
cgtcgtgctttttggagccagtggt

SEQ ID NO: 167010 - DNA, 25 bp, Homo sapien
ggcttacccagctcaggcacaatga

SEQ ID NO: 167011 - DNA, 25 bp, Homo sapien
aggcacgttccagtgcccgggcgtc

SEQ ID NO: 167012 - DNA, 25 bp, Homo sapien
ctccacgtaggaccgagggatccct

SEQ ID NO: 167013 - DNA, 25 bp, Homo sapien
ccagggcctgcgtcttgtaggcctc

SEQ ID NO: 167014 - DNA, 25 bp, Homo sapien
ctcctcgcgcgggatctcatggatg

SEQ ID NO: 167015 - DNA, 25 bp, Homo sapien
ctcatgggccggcttcagcttcagg

SEQ ID NO: 167016 - DNA, 25 bp, Homo sapien
tgtaggcctcggtcaggtcccgtga

SEQ ID NO: 167017 - DNA, 25 bp, Homo sapien
tgccctcccgctttaggagcttggc

SEQ ID NO: 167018 - DNA, 25 bp, Homo sapien
ttggcctcccgacgcaggtagtcct

SEQ ID NO: 167019 - DNA, 25 bp, Homo sapien
aggtagtcctcctgtgcctccacgt

SEQ ID NO: 167020 - DNA, 25 bp, Homo sapien
gcccactcaccggttcttgtcgccg

SEQ ID NO: 167021 - DNA, 25 bp, Homo sapien
aggtagcactggagtcgctgtcctg

SEQ ID NO: 167022 - DNA, 25 bp, Homo sapien
tgcaggtagcactggagtcgctgtc

SEQ ID NO: 167023 - DNA, 25 bp, Homo sapien
gtgcactcgctcttgacgggctcct

SEQ ID NO: 167024 - DNA, 25 bp, Homo sapien
ctcgtctgcactgcaggtagcactg

SEQ ID NO: 167025 - DNA, 25 bp, Homo sapien
cacctcgtctgcactgcaggtagca

SEQ ID NO: 167026 - DNA, 25 bp, Homo sapien
atccacctcgtctgcactgcaggta

SEQ ID NO: 167027 - DNA, 25 bp, Homo sapien
tccgtgcactcgctcttgacgggct

SEQ ID NO: 167028 - DNA, 25 bp, Homo sapien
caagttttccggaaacatagggctg

SEQ ID NO: 167029 - DNA, 25 bp, Homo sapien
acgcggcaggactgaatgtgacctc

SEQ ID NO: 167030 - DNA, 25 bp, Homo sapien
ggcaaaatccaaggacccaggccca

SEQ ID NO: 167031 - DNA, 25 bp, Homo sapien
ccagtgcggacgctcagcgagcaat

SEQ ID NO: 167032 - DNA, 25 bp, Homo sapien
ccagcaccaatgtgcccagtgcgga

SEQ ID NO: 167033 - DNA, 25 bp, Homo sapien
gccgggctcagctctgatcttcttg

SEQ ID NO: 167034 - DNA, 25 bp, Homo sapien
cttctccgtcccacggtgagggagg

SEQ ID NO: 167035 - DNA, 25 bp, Homo sapien
tcacaagtccgcctgcctgtggtgg

SEQ ID NO: 167036 - DNA, 25 bp, Homo sapien
acgcggcttccgtgagcctgaccag

SEQ ID NO: 167037 - DNA, 25 bp, Homo sapien
cggggccttcatgcaacgccaaagc

SEQ ID NO: 167038 - DNA, 25 bp, Homo sapien
tctggatgctcactgaggacatttc

SEQ ID NO: 167039 - DNA, 25 bp, Homo sapien
tcctggaacgcctctctggatgctc

SEQ ID NO: 167040 - DNA, 25 bp, Homo sapien
agcctgaccaggctccggtttcctt

SEQ ID NO: 167041 - DNA, 25 bp, Homo sapien
gttgtcacgctctgcacgcggcttc

SEQ ID NO: 167042 - DNA, 25 bp, Homo sapien
aagccaaggtttccgcacgcacagg

SEQ ID NO: 167043 - DNA, 25 bp, Homo sapien
cctggctcagagagaaacgggcaca

SEQ ID NO: 167044 - DNA, 25 bp, Homo sapien
cggtgatcctcaacatccgattgca

SEQ ID NO: 167045 - DNA, 25 bp, Homo sapien
ggagccgctttgcttaccgtcctgc

SEQ ID NO: 167046 - DNA, 25 bp, Homo sapien
ccgattgcaggtacatatttagagc

SEQ ID NO: 167047 - DNA, 25 bp, Homo sapien
ccgtacttctacgtcgcgggctcgg

SEQ ID NO: 167048 - DNA, 25 bp, Homo sapien
tcgccttcttcgagctggcctggca

SEQ ID NO: 167049 - DNA, 25 bp, Homo sapien
acctcgtacggcgtcttctgcaagg

SEQ ID NO: 167050 - DNA, 25 bp, Homo sapien
ggcaaccctcgctacagacgctggg

SEQ ID NO: 167051 - DNA, 25 bp, Homo sapien
tcttagctgctagcggagctcctca

SEQ ID NO: 167052 - DNA, 25 bp, Homo sapien
ccgccgccacgcatcgccgagctcc

SEQ ID NO: 167053 - DNA, 25 bp, Homo sapien
ctgttgtgacgtcgcctcacgcgcg

SEQ ID NO: 167054 - DNA, 25 bp, Homo sapien
cgcgcgtcacgcacccgcgacgtgc

SEQ ID NO: 167055 - DNA, 25 bp, Homo sapien
aatctcgccctccttcgcgcgcgcc

SEQ ID NO: 167056 - DNA, 25 bp, Homo sapien
aaggaagaccacgaggcgcgaccgc

SEQ ID NO: 167057 - DNA, 25 bp, Homo sapien
cctcccgacgaaggaagaccacgag

SEQ ID NO: 167058 - DNA, 25 bp, Homo sapien
aggcgccggtacatgccgccgccct

SEQ ID NO: 167059 - DNA, 25 bp, Homo sapien
ccgacgaaggaagaccacgaggcgc

SEQ ID NO: 167060 - DNA, 25 bp, Homo sapien
ctgcggcgctgactgcctgaattag

SEQ ID NO: 167061 - DNA, 25 bp, Homo sapien
agggtctactcttccttggcccgag

SEQ ID NO: 167062 - DNA, 25 bp, Homo sapien
aaagcgtgaggatcgccgagtgcac

SEQ ID NO: 167063 - DNA, 25 bp, Homo sapien
gctgagttctcagtagacgccggca

SEQ ID NO: 167064 - DNA, 25 bp, Homo sapien
tgcatgcaaagtgcccggttgctct

SEQ ID NO: 167065 - DNA, 25 bp, Homo sapien
gggcataggtttctgccctgctgca

SEQ ID NO: 167066 - DNA, 25 bp, Homo sapien
tgtgcggctgcccagaataggctga

SEQ ID NO: 167067 - DNA, 25 bp, Homo sapien
cgcccttgtacaggtggcagctgta

SEQ ID NO: 167068 - DNA, 25 bp, Homo sapien
agctgcgtggcctaaggtcttaggc

SEQ ID NO: 167069 - DNA, 25 bp, Homo sapien
gttcccgtcttcctgagatgcgggg

SEQ ID NO: 167070 - DNA, 25 bp, Homo sapien
tgcaggttcccgtcttcctgagatg

SEQ ID NO: 167071 - DNA, 25 bp, Homo sapien
tgagtgcaggttcccgtcttcctga

SEQ ID NO: 167072 - DNA, 25 bp, Homo sapien
atggtgctgagtgcaggttcccgtc

SEQ ID NO: 167073 - DNA, 25 bp, Homo sapien
cgtggcctaaggtcttaggcgccgc

SEQ ID NO: 167074 - DNA, 25 bp, Homo sapien
tcagggtcaccaagttcaccgtcct

SEQ ID NO: 167075 - DNA, 25 bp, Homo sapien
ggtcaccaagttcaccgtcctttca

SEQ ID NO: 167076 - DNA, 25 bp, Homo sapien
gacatccgggtctgtttggtccttc

SEQ ID NO: 167077 - DNA, 25 bp, Homo sapien
agccagccgcaatagagcccggaca

SEQ ID NO: 167078 - DNA, 25 bp, Homo sapien
ctcaggaaggacagcgctcagtgct

SEQ ID NO: 167079 - DNA, 25 bp, Homo sapien
tccagggagcgcaacaccttttctg

SEQ ID NO: 167080 - DNA, 25 bp, Homo sapien
tgtgaaatgagaccctccagggagc

SEQ ID NO: 167081 - DNA, 25 bp, Homo sapien
tcgctgaagcttggggcatttcctt

SEQ ID NO: 167082 - DNA, 25 bp, Homo sapien
ttggtccttcccgactcgctgaagc

SEQ ID NO: 167083 - DNA, 25 bp, Homo sapien
cgcacggagtcattccactgaattc

SEQ ID NO: 167084 - DNA, 25 bp, Homo sapien
ggaagatgagcccaaggaatctgca

SEQ ID NO: 167085 - DNA, 25 bp, Homo sapien
ctggagtctagacgccgccgcgcag

SEQ ID NO: 167086 - DNA, 25 bp, Homo sapien
gcccaaggaatctgcagctggagca

SEQ ID NO: 167087 - DNA, 25 bp, Homo sapien
cacgcgtccctgctgattgcttgca

SEQ ID NO: 167088 - DNA, 25 bp, Homo sapien
ccctgctgattgcttgcagtggagg

SEQ ID NO: 167089 - DNA, 25 bp, Homo sapien
tcggcagtaagcgtgaggccgcaac

SEQ ID NO: 167090 - DNA, 25 bp, Homo sapien
caacccatgggagataacagcgaga

SEQ ID NO: 167091 - DNA, 25 bp, Homo sapien
ggactccgccactttgccggcaagg

SEQ ID NO: 167092 - DNA, 25 bp, Homo sapien
agacacggtctgctttccaggcttg

SEQ ID NO: 167093 - DNA, 25 bp, Homo sapien
ttcgccctcctgtccggagaacgtg

SEQ ID NO: 167094 - DNA, 25 bp, Homo sapien
agctcgcccgtgcaactgaaaactg

SEQ ID NO: 167095 - DNA, 25 bp, Homo sapien
gtaacgcttcccttagagacctaga

SEQ ID NO: 167096 - DNA, 25 bp, Homo sapien
tgggaagtcccagcacttaactctg

SEQ ID NO: 167097 - DNA, 25 bp, Homo sapien
tcgctcgtttgccagccagactata

SEQ ID NO: 167098 - DNA, 25 bp, Homo sapien
acccaacggtgtatgcgtctcttta

SEQ ID NO: 167099 - DNA, 25 bp, Homo sapien
gctgtgccctcgaattggccactga

SEQ ID NO: 167100 - DNA, 25 bp, Homo sapien
gccgaggcacttatggtcacgtcta

SEQ ID NO: 167101 - DNA, 25 bp, Homo sapien
agcgggtcgaggacctgtttgaata

SEQ ID NO: 167102 - DNA, 25 bp, Homo sapien
ctggttccacgtggtgcatttggcg

SEQ ID NO: 167103 - DNA, 25 bp, Homo sapien
ttcgcgacgtttttgcgacagccgc

SEQ ID NO: 167104 - DNA, 25 bp, Homo sapien
ggctctgcccttctgtttgagtgta

SEQ ID NO: 167105 - DNA, 25 bp, Homo sapien
ctgctcttgccgcatcagtcgggct

SEQ ID NO: 167106 - DNA, 25 bp, Homo sapien
cctcagaggctgtgacaatggacta

SEQ ID NO: 167107 - DNA, 25 bp, Homo sapien
tggtcacgtctacaaagccaagagg

SEQ ID NO: 167108 - DNA, 25 bp, Homo sapien
gcctcggagaccaggccggactctt

SEQ ID NO: 167109 - DNA, 25 bp, Homo sapien
actcgccaatcctggtgaagcggcc

SEQ ID NO: 167110 - DNA, 25 bp, Homo sapien
ctctccgctgtaggctgctgtggcc

SEQ ID NO: 167111 - DNA, 25 bp, Homo sapien
cccacggcgaactgaagttgctgca

SEQ ID NO: 167112 - DNA, 25 bp, Homo sapien
aactgaagttgctgcatcgccgcgc

SEQ ID NO: 167113 - DNA, 25 bp, Homo sapien
accaggccggactcttggagtgcag

SEQ ID NO: 167114 - DNA, 25 bp, Homo sapien
tggttctggtccagctccgcgtgcc

SEQ ID NO: 167115 - DNA, 25 bp, Homo sapien
ttggccgaggcactcgccaatcctg

SEQ ID NO: 167116 - DNA, 25 bp, Homo sapien
cttgcatgctgaaaacgaacaactg

SEQ ID NO: 167117 - DNA, 25 bp, Homo sapien
ctactcgtgtcgcatgtcggcgcag

SEQ ID NO: 167118 - DNA, 25 bp, Homo sapien
ctgagaactgcatggtagccctgcc

SEQ ID NO: 167119 - DNA, 25 bp, Homo sapien
aacaactgtttgacatctgggctgc

SEQ ID NO: 167120 - DNA, 25 bp, Homo sapien
ctgtttgcaacagcgctgggaatgc

SEQ ID NO: 167121 - DNA, 25 bp, Homo sapien
gatgcccatgcactgctgccgattc

SEQ ID NO: 167122 - DNA, 25 bp, Homo sapien
tgcaatggaagtaccgagacagaca

SEQ ID NO: 167123 - DNA, 25 bp, Homo sapien
ccggaacaaagaggggctccagact

SEQ ID NO: 167124 - DNA, 25 bp, Homo sapien
ggccggttgcctttctttcgcaaga

SEQ ID NO: 167125 - DNA, 25 bp, Homo sapien
cttcgttttatgttcccgtggctgc

SEQ ID NO: 167126 - DNA, 25 bp, Homo sapien
tggggagactctctaacctgtttga

SEQ ID NO: 167127 - DNA, 25 bp, Homo sapien
tcgacagacttgaaccgcgaccttg

SEQ ID NO: 167128 - DNA, 25 bp, Homo sapien
ggccggaaccgccatcttccaggta

SEQ ID NO: 167129 - DNA, 25 bp, Homo sapien
tcgcttacggttggcgtttccctca

SEQ ID NO: 167130 - DNA, 25 bp, Homo sapien
ttttccctgcggagacgcggataca

SEQ ID NO: 167131 - DNA, 25 bp, Homo sapien
gcgtcctcttgatcgcccttgaagg

SEQ ID NO: 167132 - DNA, 25 bp, Homo sapien
atgtccgggcactttctgctcgcac

SEQ ID NO: 167133 - DNA, 25 bp, Homo sapien
tcggactacctactgcccaaggaca

SEQ ID NO: 167134 - DNA, 25 bp, Homo sapien
caaggacatcaaactggcggtgctg

SEQ ID NO: 167135 - DNA, 25 bp, Homo sapien
tggcgtttcctggtgcatctactcc

SEQ ID NO: 167136 - DNA, 25 bp, Homo sapien
atctactcctgggatctcggcggga

SEQ ID NO: 167137 - DNA, 25 bp, Homo sapien
tggccgtatctccagggtctgagcc

SEQ ID NO: 167138 - DNA, 25 bp, Homo sapien
aggagactcgcagaatgcctgacta

SEQ ID NO: 167139 - DNA, 25 bp, Homo sapien
aagcgcacagcctcggcgatagtca

SEQ ID NO: 167140 - DNA, 25 bp, Homo sapien
tctcatccagggctgacagggcacg

SEQ ID NO: 167141 - DNA, 25 bp, Homo sapien
ctgcagcgccaattacagcaaagcc

SEQ ID NO: 167142 - DNA, 25 bp, Homo sapien
ttgaccatcgccgacgcgttcattg

SEQ ID NO: 167143 - DNA, 25 bp, Homo sapien
cgcatgcgcgatctcccggagcatg

SEQ ID NO: 167144 - DNA, 25 bp, Homo sapien
gcagcagccttctgccgaggacgca

SEQ ID NO: 167145 - DNA, 25 bp, Homo sapien
cgcttcccaggaggttcatctgctc

SEQ ID NO: 167146 - DNA, 25 bp, Homo sapien
ccgagtcggtgtcgtccttgaccat

SEQ ID NO: 167147 - DNA, 25 bp, Homo sapien
aaagcctggaagcttgacgcgcacc

SEQ ID NO: 167148 - DNA, 25 bp, Homo sapien
ctcggtctcccactagggctttata

SEQ ID NO: 167149 - DNA, 25 bp, Homo sapien
ttgggattcagttccgccgacagaa

SEQ ID NO: 167150 - DNA, 25 bp, Homo sapien
gcggagccacgtttttctactgttg

SEQ ID NO: 167151 - DNA, 25 bp, Homo sapien
agcggcctcgctgaaaatggcttta

SEQ ID NO: 167152 - DNA, 25 bp, Homo sapien
acatccctcggaagttcgtgcagcg

SEQ ID NO: 167153 - DNA, 25 bp, Homo sapien
gctggcggcaactctaggtctaaca

SEQ ID NO: 167154 - DNA, 25 bp, Homo sapien
tgtcgggacggaactagaaaagctc

SEQ ID NO: 167155 - DNA, 25 bp, Homo sapien
ggctcccggaggcaaaacaaagctg

SEQ ID NO: 167156 - DNA, 25 bp, Homo sapien
agggcggctccacctatccgagagc

SEQ ID NO: 167157 - DNA, 25 bp, Homo sapien
ctcccgggttagagtgagaccactc

SEQ ID NO: 167158 - DNA, 25 bp, Homo sapien
cacagctggggaaggagtgaacatc

SEQ ID NO: 167159 - DNA, 25 bp, Homo sapien
ccgattcgagaggaagcgcacctga

SEQ ID NO: 167160 - DNA, 25 bp, Homo sapien
tcttgccctattttgacccagttga

SEQ ID NO: 167161 - DNA, 25 bp, Homo sapien
ctcttcaaggtgtgttgaccgacta

SEQ ID NO: 167162 - DNA, 25 bp, Homo sapien
ccttcgtattctgtggtgactcatc

SEQ ID NO: 167163 - DNA, 25 bp, Homo sapien
aagggccatcctgggtcaacaccgc

SEQ ID NO: 167164 - DNA, 25 bp, Homo sapien
gctcgggtgactaaagttcaaactc

SEQ ID NO: 167165 - DNA, 25 bp, Homo sapien
cgccttggttctctcagggatgcta

SEQ ID NO: 167166 - DNA, 25 bp, Homo sapien
ccacagattaagtgcgccttggttc

SEQ ID NO: 167167 - DNA, 25 bp, Homo sapien
ggagctttctctgcggaaatggcca

SEQ ID NO: 167168 - DNA, 25 bp, Homo sapien
tctctcagaggcacggagctttctc

SEQ ID NO: 167169 - DNA, 25 bp, Homo sapien
ttaaacaggaaagtggcgcggccgc

SEQ ID NO: 167170 - DNA, 25 bp, Homo sapien
agggatgctattttgctccggcccg

SEQ ID NO: 167171 - DNA, 25 bp, Homo sapien
caagccctgggaggcgctttaaaca

SEQ ID NO: 167172 - DNA, 25 bp, Homo sapien
ctgctcactgcgaggtcgcgcaccg

SEQ ID NO: 167173 - DNA, 25 bp, Homo sapien
cagccctgagaggacgaggggacgc

SEQ ID NO: 167174 - DNA, 25 bp, Homo sapien
ctgcagagaaaggtcccgaggacgc

SEQ ID NO: 167175 - DNA, 25 bp, Homo sapien
gcagagaaaggtcccgaggacgcaa

SEQ ID NO: 167176 - DNA, 25 bp, Homo sapien
ggagcctggagtctcagggttgcgg

SEQ ID NO: 167177 - DNA, 25 bp, Homo sapien
gcgttctgggtggtgaacgtcccca

SEQ ID NO: 167178 - DNA, 25 bp, Homo sapien
gggtggtgaacgtccccagcctgcc

SEQ ID NO: 167179 - DNA, 25 bp, Homo sapien
tccctgctcactgcgaggtcgcgca

SEQ ID NO: 167180 - DNA, 25 bp, Homo sapien
gcctcgtgcggagcttctggcagct

SEQ ID NO: 167181 - DNA, 25 bp, Homo sapien
gagcttctggcagctgctccacagc

SEQ ID NO: 167182 - DNA, 25 bp, Homo sapien
agcctcggcatcttcgatgggcaca

SEQ ID NO: 167183 - DNA, 25 bp, Homo sapien
ttcgatgggcacagagtctgaattg

SEQ ID NO: 167184 - DNA, 25 bp, Homo sapien
cacagagtctgaattggcaagggcc

SEQ ID NO: 167185 - DNA, 25 bp, Homo sapien
gcaagggccagggccttcagtagaa

SEQ ID NO: 167186 - DNA, 25 bp, Homo sapien
cggtagcgtgaacagcagcctgcct

SEQ ID NO: 167187 - DNA, 25 bp, Homo sapien
ccacagcctcggcatcttcgatggg

SEQ ID NO: 167188 - DNA, 25 bp, Homo sapien
atgccaggaatacaaccgcccttcg

SEQ ID NO: 167189 - DNA, 25 bp, Homo sapien
gcaaaggcagccgatgccaggaata

SEQ ID NO: 167190 - DNA, 25 bp, Homo sapien
tcgcgccgttccaaactaagagatg

SEQ ID NO: 167191 - DNA, 25 bp, Homo sapien
taagagatggcagcggtttcccagc

SEQ ID NO: 167192 - DNA, 25 bp, Homo sapien
agcgcactgctggaagtgtgctcca

SEQ ID NO: 167193 - DNA, 25 bp, Homo sapien
agacagtccgcactcgccacatgtg

SEQ ID NO: 167194 - DNA, 25 bp, Homo sapien
gcgagatctagatctgcgccatctc

SEQ ID NO: 167195 - DNA, 25 bp, Homo sapien
actcgccacatgtgctggggtgcga

SEQ ID NO: 167196 - DNA, 25 bp, Homo sapien
gcgcgagttcgcttctaatatgtac

SEQ ID NO: 167197 - DNA, 25 bp, Homo sapien
gcgacctacctgaatctgtccgaga

SEQ ID NO: 167198 - DNA, 25 bp, Homo sapien
tctggcgaccgcctaccaagggatt

SEQ ID NO: 167199 - DNA, 25 bp, Homo sapien
caagggattgggtccacagcacaga

SEQ ID NO: 167200 - DNA, 25 bp, Homo sapien
ggctttcaccagcacgcagctgcta

SEQ ID NO: 167201 - DNA, 25 bp, Homo sapien
gcgctcactgtagctctgctgtgga

SEQ ID NO: 167202 - DNA, 25 bp, Homo sapien
tgtcccgcctacgtcgcatcgagat

SEQ ID NO: 167203 - DNA, 25 bp, Homo sapien
ctgcccagcagcaagaggatgcgca

SEQ ID NO: 167204 - DNA, 25 bp, Homo sapien
aagtcccagcacactttcgctcaaa

SEQ ID NO: 167205 - DNA, 25 bp, Homo sapien
gaggcctccgctcgtgtcaaagcct

SEQ ID NO: 167206 - DNA, 25 bp, Homo sapien
gcggcgcaccagagctctcaagcat

SEQ ID NO: 167207 - DNA, 25 bp, Homo sapien
cagagactgcgttcaagtcccagca

SEQ ID NO: 167208 - DNA, 25 bp, Homo sapien
gcaacctctgacctgaatgcagaaa

SEQ ID NO: 167209 - DNA, 25 bp, Homo sapien
ctgacctgaatgcagaaacagtttg

SEQ ID NO: 167210 - DNA, 25 bp, Homo sapien
aaacagtttgcgtcttgtgctgagc

SEQ ID NO: 167211 - DNA, 25 bp, Homo sapien
cgccgccagcagagactgcgttcaa

SEQ ID NO: 167212 - DNA, 25 bp, Homo sapien
ggtggcacttttccctgaagaaatc

SEQ ID NO: 167213 - DNA, 25 bp, Homo sapien
ccctcggcgactcggcagattatct

SEQ ID NO: 167214 - DNA, 25 bp, Homo sapien
aaccggcggatttgctttctgctga

SEQ ID NO: 167215 - DNA, 25 bp, Homo sapien
tgagaacgcgcctccatggaatacc

SEQ ID NO: 167216 - DNA, 25 bp, Homo sapien
ccttctataggtcgcaggcagcaga

SEQ ID NO: 167217 - DNA, 25 bp, Homo sapien
gcctgtaatggactcggcgatttta

SEQ ID NO: 167218 - DNA, 25 bp, Homo sapien
ggcgattttacgataccaggagcta

SEQ ID NO: 167219 - DNA, 25 bp, Homo sapien
gccctcctgatcgatgtggtcactc

SEQ ID NO: 167220 - DNA, 25 bp, Homo sapien
cctggcagctaggagagcaatctga

SEQ ID NO: 167221 - DNA, 25 bp, Homo sapien
tgaagtctaccaaagctcacgcgtg

SEQ ID NO: 167222 - DNA, 25 bp, Homo sapien
cccgggtcggactaaactacatcag

SEQ ID NO: 167223 - DNA, 25 bp, Homo sapien
gcagtgcttctctagtccagtttga

SEQ ID NO: 167224 - DNA, 25 bp, Homo sapien
tcagggcttcggacactacagatcc

SEQ ID NO: 167225 - DNA, 25 bp, Homo sapien
cgccggcagagaacagaaggtcttt

SEQ ID NO: 167226 - DNA, 25 bp, Homo sapien
tgaaagccggcctctcaacgtcaga

SEQ ID NO: 167227 - DNA, 25 bp, Homo sapien
ccaggactccttggtagtgcacatc

SEQ ID NO: 167228 - DNA, 25 bp, Homo sapien
aggggcttcaaccactcgccgagga

SEQ ID NO: 167229 - DNA, 25 bp, Homo sapien
tgaccgagagacacatcaagatctg

SEQ ID NO: 167230 - DNA, 25 bp, Homo sapien
cgaaggggaaaacccgctctctcag

SEQ ID NO: 167231 - DNA, 25 bp, Homo sapien
ctctctcaggcgcatgtgccagttg

SEQ ID NO: 167232 - DNA, 25 bp, Homo sapien
ccgcaggaaccacgatgagaggcag

SEQ ID NO: 167233 - DNA, 25 bp, Homo sapien
ttcaacaagtacatctcacggccgc

SEQ ID NO: 167234 - DNA, 25 bp, Homo sapien
tacactaggcgctgaaatgggatgc

SEQ ID NO: 167235 - DNA, 25 bp, Homo sapien
gaccacccgccctggcagttgaatg

SEQ ID NO: 167236 - DNA, 25 bp, Homo sapien
cttcgctctgcgaattgggccagcc

SEQ ID NO: 167237 - DNA, 25 bp, Homo sapien
cccgacttcgctctgcgaattgggc

SEQ ID NO: 167238 - DNA, 25 bp, Homo sapien
ggcgcagaaacttgtcctcggaccc

SEQ ID NO: 167239 - DNA, 25 bp, Homo sapien
ggtggaggcgcagaaacttgtcctc

SEQ ID NO: 167240 - DNA, 25 bp, Homo sapien
ttagttggtggaggcgcagaaactt

SEQ ID NO: 167241 - DNA, 25 bp, Homo sapien
tccgcgagacccgagggttcgccaa

SEQ ID NO: 167242 - DNA, 25 bp, Homo sapien
tgcctgagactggtcttcgggcagc

SEQ ID NO: 167243 - DNA, 25 bp, Homo sapien
tgcgaattgggccagccgctgcttt

SEQ ID NO: 167244 - DNA, 25 bp, Homo sapien
gcgctcggaactgcatgcctgtgca

SEQ ID NO: 167245 - DNA, 25 bp, Homo sapien
ccagtggatgcgaatcgtgggccct

SEQ ID NO: 167246 - DNA, 25 bp, Homo sapien
tgagcggccaccctcagccaactgg

SEQ ID NO: 167247 - DNA, 25 bp, Homo sapien
gtgtacttcaaactctgagcggcca

SEQ ID NO: 167248 - DNA, 25 bp, Homo sapien
aactgcatgcctgtgcacggtgccg

SEQ ID NO: 167249 - DNA, 25 bp, Homo sapien
tggggcccgatatgtgtacttcaaa

SEQ ID NO: 167250 - DNA, 25 bp, Homo sapien
ccacaggaagactcgcgtggggccc

SEQ ID NO: 167251 - DNA, 25 bp, Homo sapien
cagctggaccgatacctcctggatc

SEQ ID NO: 167252 - DNA, 25 bp, Homo sapien
tctctcggatcgtgttcctggctct

SEQ ID NO: 167253 - DNA, 25 bp, Homo sapien
cccatctctcggatcgtgttcctgg

SEQ ID NO: 167254 - DNA, 25 bp, Homo sapien
cgaccctaccgagcgctccgtgcgc

SEQ ID NO: 167255 - DNA, 25 bp, Homo sapien
ccgagcaccgcccagcgatgcgcag

SEQ ID NO: 167256 - DNA, 25 bp, Homo sapien
tgagtcccgcgattcgggaaatccg

SEQ ID NO: 167257 - DNA, 25 bp, Homo sapien
ctctgtcgaagctgctgagtcccgc

SEQ ID NO: 167258 - DNA, 25 bp, Homo sapien
cgaagctgctgagtcccgcgattcg

SEQ ID NO: 167259 - DNA, 25 bp, Homo sapien
ttcctggctctgtcgaagctgctga

SEQ ID NO: 167260 - DNA, 25 bp, Homo sapien
tgctgaccgcacgcccacgtgatat

SEQ ID NO: 167261 - DNA, 25 bp, Homo sapien
ccctgcctgcatcacccgctgcccg

SEQ ID NO: 167262 - DNA, 25 bp, Homo sapien
ggcctgcgctgtatgcttcctgcct

SEQ ID NO: 167263 - DNA, 25 bp, Homo sapien
gcaccgccatgtccttcgctcagct

SEQ ID NO: 167264 - DNA, 25 bp, Homo sapien
gcccgccagaaaggtgcaagggaaa

SEQ ID NO: 167265 - DNA, 25 bp, Homo sapien
tccatcctaggtcgaggatgagcgg

SEQ ID NO: 167266 - DNA, 25 bp, Homo sapien
gcggcccattcctgagggcggattc

SEQ ID NO: 167267 - DNA, 25 bp, Homo sapien
ccatctctccatcctaggtcgagga

SEQ ID NO: 167268 - DNA, 25 bp, Homo sapien
ggagtagattagctcgcgcctgcta

SEQ ID NO: 167269 - DNA, 25 bp, Homo sapien
ctgcagctttgacgggccgaacaca

SEQ ID NO: 167270 - DNA, 25 bp, Homo sapien
atcgctcagcccaggtcttcgacga

SEQ ID NO: 167271 - DNA, 25 bp, Homo sapien
tgctccaggccttcttcaccgagtg

SEQ ID NO: 167272 - DNA, 25 bp, Homo sapien
tagttgcgcgcaccttttgaaaagc

SEQ ID NO: 167273 - DNA, 25 bp, Homo sapien
cttggcgtcttcaggtataaggaca

SEQ ID NO: 167274 - DNA, 25 bp, Homo sapien
acgccgcgaatctctccagggaatc

SEQ ID NO: 167275 - DNA, 25 bp, Homo sapien
cgcggacatcacaccattccaaaga

SEQ ID NO: 167276 - DNA, 25 bp, Homo sapien
ccgacatagagacttccccgtcttc

SEQ ID NO: 167277 - DNA, 25 bp, Homo sapien
taatattcccgctgtcgcagacgcc

SEQ ID NO: 167278 - DNA, 25 bp, Homo sapien
ctaatattcccgctgtcgcagacgc

SEQ ID NO: 167279 - DNA, 25 bp, Homo sapien
gaccagtccggacctcgactgggcc

SEQ ID NO: 167280 - DNA, 25 bp, Homo sapien
aatattcccgctgtcgcagacgccg

SEQ ID NO: 167281 - DNA, 25 bp, Homo sapien
ttcccgacatagagacttccccgtc

SEQ ID NO: 167282 - DNA, 25 bp, Homo sapien
tgaccagtccggacctcgactgggc

SEQ ID NO: 167283 - DNA, 25 bp, Homo sapien
cagtccggacctcgactgggccccg

SEQ ID NO: 167284 - DNA, 25 bp, Homo sapien
tgccacatcccttgttccgtaggta

SEQ ID NO: 167285 - DNA, 25 bp, Homo sapien
gcgggacaatgtcgacttttgaacc

SEQ ID NO: 167286 - DNA, 25 bp, Homo sapien
atgtgctcttgctccactgtccaaa

SEQ ID NO: 167287 - DNA, 25 bp, Homo sapien
cagggtttattgacaggcgtttcac

SEQ ID NO: 167288 - DNA, 25 bp, Homo sapien
ctggagctgtatacgccacccggaa

SEQ ID NO: 167289 - DNA, 25 bp, Homo sapien
agggtctatacctcttgctgtttcc

SEQ ID NO: 167290 - DNA, 25 bp, Homo sapien
aactgcccttaaggcgcctccgtgg

SEQ ID NO: 167291 - DNA, 25 bp, Homo sapien
ggtcatccggtctcaacctcaggcg

SEQ ID NO: 167292 - DNA, 25 bp, Homo sapien
tgcctgctcgctgtaccttgaattg

SEQ ID NO: 167293 - DNA, 25 bp, Homo sapien
aaaggggcactcaactaggactctc

SEQ ID NO: 167294 - DNA, 25 bp, Homo sapien
cccaggctcagtaggtcagagaagc

SEQ ID NO: 167295 - DNA, 25 bp, Homo sapien
ggggctagcaccttcttcccagcga

SEQ ID NO: 167296 - DNA, 25 bp, Homo sapien
cccaggtcacttctcttcttagatg

SEQ ID NO: 167297 - DNA, 25 bp, Homo sapien
aagtgcccataaccagcgtgcctgc

SEQ ID NO: 167298 - DNA, 25 bp, Homo sapien
tccggcaaacctaggatctttttca

SEQ ID NO: 167299 - DNA, 25 bp, Homo sapien
gtccagcagtgctcacgccgacatt

SEQ ID NO: 167300 - DNA, 25 bp, Homo sapien
gttctcattgtcaagcgtttcgctc

SEQ ID NO: 167301 - DNA, 25 bp, Homo sapien
gacctgcacttgtctgttctcattg

SEQ ID NO: 167302 - DNA, 25 bp, Homo sapien
attcgggaatgaggatcactgcggc

SEQ ID NO: 167303 - DNA, 25 bp, Homo sapien
ctttgagcgctctcagaacccgcgg

SEQ ID NO: 167304 - DNA, 25 bp, Homo sapien
cgtttcgctcggatatttgtcacca

SEQ ID NO: 167305 - DNA, 25 bp, Homo sapien
gttcacctcctaatacaagcctttg

SEQ ID NO: 167306 - DNA, 25 bp, Homo sapien
tcggtttcagcaaccgcgtggagtg

SEQ ID NO: 167307 - DNA, 25 bp, Homo sapien
tttgacagcgctgccagattcggga

SEQ ID NO: 167308 - DNA, 25 bp, Homo sapien
ggcctagagtcaaggcgcgatgatt

SEQ ID NO: 167309 - DNA, 25 bp, Homo sapien
tatgctcaggtgtttcggaagaggc

SEQ ID NO: 167310 - DNA, 25 bp, Homo sapien
tatttgccggagagaactgccctgc

SEQ ID NO: 167311 - DNA, 25 bp, Homo sapien
accgagagcatgtcgctatttgccg

SEQ ID NO: 167312 - DNA, 25 bp, Homo sapien
aaggccgacagaaaccgagagcatg

SEQ ID NO: 167313 - DNA, 25 bp, Homo sapien
ccagaaagcggaaagcggctctgcc

SEQ ID NO: 167314 - DNA, 25 bp, Homo sapien
tgattgccgcgcaagctagggtcca

SEQ ID NO: 167315 - DNA, 25 bp, Homo sapien
cccttgcggctgcttatgctcaggt

SEQ ID NO: 167316 - DNA, 25 bp, Homo sapien
tcacatgtaaaggtcgggcgcagca

SEQ ID NO: 167317 - DNA, 25 bp, Homo sapien
cgttttgctttgcagttcgggctta

SEQ ID NO: 167318 - DNA, 25 bp, Homo sapien
ccggggcaaagcactaaacaatatg

SEQ ID NO: 167319 - DNA, 25 bp, Homo sapien
tggggagaactggataaacgctttg

SEQ ID NO: 167320 - DNA, 25 bp, Homo sapien
gggcggacaaaaggactcattactc

SEQ ID NO: 167321 - DNA, 25 bp, Homo sapien
tctccacttcctttgtgcacgtgtg

SEQ ID NO: 167322 - DNA, 25 bp, Homo sapien
agaacaccgcttccgctcacatgta

SEQ ID NO: 167323 - DNA, 25 bp, Homo sapien
cctagtgcccaagagcgagaacacc

SEQ ID NO: 167324 - DNA, 25 bp, Homo sapien
ctagagtttgtctcccgcttggaaa

SEQ ID NO: 167325 - DNA, 25 bp, Homo sapien
agtttcagagcagccgctaggtccc

SEQ ID NO: 167326 - DNA, 25 bp, Homo sapien
ccaccgttgcatgctgtctggagga

SEQ ID NO: 167327 - DNA, 25 bp, Homo sapien
tctggaggatcagcccaagctgcga

SEQ ID NO: 167328 - DNA, 25 bp, Homo sapien
tgcctagaactgagcacgagttttc

SEQ ID NO: 167329 - DNA, 25 bp, Homo sapien
ctcttcaggtgttcggagtttcaga

SEQ ID NO: 167330 - DNA, 25 bp, Homo sapien
ctccgtcagggtagtgcgaaaatgt

SEQ ID NO: 167331 - DNA, 25 bp, Homo sapien
ttccactcttgcagcgcgagaagag

SEQ ID NO: 167332 - DNA, 25 bp, Homo sapien
aaaggcgctgaatccgctcggcacg

SEQ ID NO: 167333 - DNA, 25 bp, Homo sapien
cctcctagtgcgctgggatctttga

SEQ ID NO: 167334 - DNA, 25 bp, Homo sapien
ggactgcagggagccacaaaccacc

SEQ ID NO: 167335 - DNA, 25 bp, Homo sapien
cgaactctgtcgtttggatccgggg

SEQ ID NO: 167336 - DNA, 25 bp, Homo sapien
ccctcggactggtgcaaagtggaag

SEQ ID NO: 167337 - DNA, 25 bp, Homo sapien
cgaccgcaaattccctcggactggt

SEQ ID NO: 167338 - DNA, 25 bp, Homo sapien
gctctcttaaggatgcgcgtcaccg

SEQ ID NO: 167339 - DNA, 25 bp, Homo sapien
cgctgcaggtggctctcttaaggat

SEQ ID NO: 167340 - DNA, 25 bp, Homo sapien
ctgcggcgttgccatgaacagtggc

SEQ ID NO: 167341 - DNA, 25 bp, Homo sapien
cgacggccgtctcaggaagaggaaa

SEQ ID NO: 167342 - DNA, 25 bp, Homo sapien
ccaggcttttatccggcaccggcag

SEQ ID NO: 167343 - DNA, 25 bp, Homo sapien
gagtgaagctgaagtactgccgcta

SEQ ID NO: 167344 - DNA, 25 bp, Homo sapien
ctgccgctactacgctaaggataag

SEQ ID NO: 167345 - DNA, 25 bp, Homo sapien
ataagacttgcttctacggggagga

SEQ ID NO: 167346 - DNA, 25 bp, Homo sapien
gagtgtcagttcctgcatgaggacc

SEQ ID NO: 167347 - DNA, 25 bp, Homo sapien
tgagtgagagaatcccaactctccc

SEQ ID NO: 167348 - DNA, 25 bp, Homo sapien
atgagacccgtctttgcagtcagcg

SEQ ID NO: 167349 - DNA, 25 bp, Homo sapien
cgccggcggctctcagtaaaagcga

SEQ ID NO: 167350 - DNA, 25 bp, Homo sapien
tccgactcctaggacagtactactg

SEQ ID NO: 167351 - DNA, 25 bp, Homo sapien
ctccgtgcgacccaaagagctgaga

SEQ ID NO: 167352 - DNA, 25 bp, Homo sapien
tgccttacccaagaaaagctccgtg

SEQ ID NO: 167353 - DNA, 25 bp, Homo sapien
cgcgaaattctctgcatcgtgtctg

SEQ ID NO: 167354 - DNA, 25 bp, Homo sapien
tgtacttccgacctctcaatggtga

SEQ ID NO: 167355 - DNA, 25 bp, Homo sapien
agggccgcttattgtccctgtgaca

SEQ ID NO: 167356 - DNA, 25 bp, Homo sapien
ggccagtgcccaatatcaccaaagt

SEQ ID NO: 167357 - DNA, 25 bp, Homo sapien
cggcacctccttctggtgacgtcaa

SEQ ID NO: 167358 - DNA, 25 bp, Homo sapien
ctcccgcggacctcgatgaagagca

SEQ ID NO: 167359 - DNA, 25 bp, Homo sapien
cggtgtcccagtagctgaccatggt

SEQ ID NO: 167360 - DNA, 25 bp, Homo sapien
cctcacctgtgagaagcagacagct

SEQ ID NO: 167361 - DNA, 25 bp, Homo sapien
tgcccgctgcaactagtgtcccagg

SEQ ID NO: 167362 - DNA, 25 bp, Homo sapien
cccgacagctggataagggatcagc

SEQ ID NO: 167363 - DNA, 25 bp, Homo sapien
tcagcgatcctgtcgcaaacggaca

SEQ ID NO: 167364 - DNA, 25 bp, Homo sapien
gcacgatccaagttaattttccagc

SEQ ID NO: 167365 - DNA, 25 bp, Homo sapien
agccttcgggatgtctattgctgcc

SEQ ID NO: 167366 - DNA, 25 bp, Homo sapien
ggaaggacgcctgagaaaacagacc

SEQ ID NO: 167367 - DNA, 25 bp, Homo sapien
ggtgtgtgcggattctcaataaaaa

SEQ ID NO: 167368 - DNA, 25 bp, Homo sapien
cagcgccgacaggaaatgctgtttc

SEQ ID NO: 167369 - DNA, 25 bp, Homo sapien
tggtgccaacaagactgacacagga

SEQ ID NO: 167370 - DNA, 25 bp, Homo sapien
ttgtcccgcgaacaatgtggcgatg

SEQ ID NO: 167371 - DNA, 25 bp, Homo sapien
tgtttcctgcatcgtacaacgctgg

SEQ ID NO: 167372 - DNA, 25 bp, Homo sapien
acgtggcaagaagagatgctccagc

SEQ ID NO: 167373 - DNA, 25 bp, Homo sapien
ggcaagaagagatgctccagcagtt

SEQ ID NO: 167374 - DNA, 25 bp, Homo sapien
aagaagagatgctccagcagttgaa

SEQ ID NO: 167375 - DNA, 25 bp, Homo sapien
ttgaaggtgaggacgacggtcacta

SEQ ID NO: 167376 - DNA, 25 bp, Homo sapien
tgaggacgacggtcactaccagcag

SEQ ID NO: 167377 - DNA, 25 bp, Homo sapien
ggagcaggcgggcttatcggtctgc

SEQ ID NO: 167378 - DNA, 25 bp, Homo sapien
gcttatcggtctgcggcgagccgga

SEQ ID NO: 167379 - DNA, 25 bp, Homo sapien
ccctcgaccgtgcacctgcccaagg

SEQ ID NO: 167380 - DNA, 25 bp, Homo sapien
aacaacagaaccgaagaattgccgc

SEQ ID NO: 167381 - DNA, 25 bp, Homo sapien
aaccgaagaattgccgcacggagcc

SEQ ID NO: 167382 - DNA, 25 bp, Homo sapien
taaataacatctgaggcgctgcggc

SEQ ID NO: 167383 - DNA, 25 bp, Homo sapien
ccctcgcaggaaaagataaataaca

SEQ ID NO: 167384 - DNA, 25 bp, Homo sapien
ggatacacaacaccctggactgtca

SEQ ID NO: 167385 - DNA, 25 bp, Homo sapien
taaacaatcgcacaggatacacaac

SEQ ID NO: 167386 - DNA, 25 bp, Homo sapien
catgggccgggcgataaacaatcgc

SEQ ID NO: 167387 - DNA, 25 bp, Homo sapien
accggatacgagtaacgcgtgcgcc

SEQ ID NO: 167388 - DNA, 25 bp, Homo sapien
ggcgccataatctgtcgagtcacgg

SEQ ID NO: 167389 - DNA, 25 bp, Homo sapien
tacaaaccgtagatgtttattaata

SEQ ID NO: 167390 - DNA, 25 bp, Homo sapien
agcccacacccttactgcgcccttg

SEQ ID NO: 167391 - DNA, 25 bp, Homo sapien
ccctgggtcccttgggattgcaagc

SEQ ID NO: 167392 - DNA, 25 bp, Homo sapien
ccagccctcggaaacggaagtgagc

SEQ ID NO: 167393 - DNA, 25 bp, Homo sapien
gcctcaggcgccataatctgtcgag

SEQ ID NO: 167394 - DNA, 25 bp, Homo sapien
taatctgtcgagtcacggggtttgg

SEQ ID NO: 167395 - DNA, 25 bp, Homo sapien
ctcggcagaaacaggcagtcgcctc

SEQ ID NO: 167396 - DNA, 25 bp, Homo sapien
caaattacgcttgtcggggagtctc

SEQ ID NO: 167397 - DNA, 25 bp, Homo sapien
ctgcgcagtggacaatcggccaatc

SEQ ID NO: 167398 - DNA, 25 bp, Homo sapien
tagtggatcgtgcacccaccctcgg

SEQ ID NO: 167399 - DNA, 25 bp, Homo sapien
ggacagtaacctcggactacgcggc

SEQ ID NO: 167400 - DNA, 25 bp, Homo sapien
gcgattggtccacccggacgtcact

SEQ ID NO: 167401 - DNA, 25 bp, Homo sapien
cggggagtctcaagcgtattgtaaa

SEQ ID NO: 167402 - DNA, 25 bp, Homo sapien
agcagccactcagcaccgctgttga

SEQ ID NO: 167403 - DNA, 25 bp, Homo sapien
ttgtaaagcaaacctcggcaagcgc

SEQ ID NO: 167404 - DNA, 25 bp, Homo sapien
ggtgcgggcatagtcccaatcgaga

SEQ ID NO: 167405 - DNA, 25 bp, Homo sapien
aaaacatcgcgcgttgggcaccctc

SEQ ID NO: 167406 - DNA, 25 bp, Homo sapien
gctggcctcaggacgctacaaagcg

SEQ ID NO: 167407 - DNA, 25 bp, Homo sapien
ccttctgttagaaattcggcttcca

SEQ ID NO: 167408 - DNA, 25 bp, Homo sapien
tgacagcagtgcaatggtcgggacc

SEQ ID NO: 167409 - DNA, 25 bp, Homo sapien
gtagacaactttgcagcagtcctgg

SEQ ID NO: 167410 - DNA, 25 bp, Homo sapien
cccgagcttcccatggacgtagaca

SEQ ID NO: 167411 - DNA, 25 bp, Homo sapien
cacctcgtggaatcggggacgtcac

SEQ ID NO: 167412 - DNA, 25 bp, Homo sapien
cggctctcagggcaagtttatctcc

SEQ ID NO: 167413 - DNA, 25 bp, Homo sapien
gtggtggcctcttggacattacatc

SEQ ID NO: 167414 - DNA, 25 bp, Homo sapien
tgcggaaacccttgaccgcttagcg

SEQ ID NO: 167415 - DNA, 25 bp, Homo sapien
ccgcttagcggagtacagacctgtc

SEQ ID NO: 167416 - DNA, 25 bp, Homo sapien
cggtaaatagaaaactcgagctgga

SEQ ID NO: 167417 - DNA, 25 bp, Homo sapien
gaacccggcccgagatgagcgtctc

SEQ ID NO: 167418 - DNA, 25 bp, Homo sapien
ttgacccaggtgagcgaatcctctg

SEQ ID NO: 167419 - DNA, 25 bp, Homo sapien
ccgcggcttctctttgtccaggcga

SEQ ID NO: 167420 - DNA, 25 bp, Homo sapien
agcatcgcaagctggcaccctctgg

SEQ ID NO: 167421 - DNA, 25 bp, Homo sapien
tgaccgttggaatcaggacgccaga

SEQ ID NO: 167422 - DNA, 25 bp, Homo sapien
cgggacgttctcttagaaattcagc

SEQ ID NO: 167423 - DNA, 25 bp, Homo sapien
ccgcaaggcccggtgtttctgggat

SEQ ID NO: 167424 - DNA, 25 bp, Homo sapien
tgcctcgcggaattcgggacatcac

SEQ ID NO: 167425 - DNA, 25 bp, Homo sapien
cagcaatgcagtagtcgggacgttc

SEQ ID NO: 167426 - DNA, 25 bp, Homo sapien
cagcgcttcccattgacgtagacga

SEQ ID NO: 167427 - DNA, 25 bp, Homo sapien
gtagacgactttgcagccatccttg

SEQ ID NO: 167428 - DNA, 25 bp, Homo sapien
tcgagctctgctgttgggtgatgca

SEQ ID NO: 167429 - DNA, 25 bp, Homo sapien
tctgcagtgcggctcgagctctgct

SEQ ID NO: 167430 - DNA, 25 bp, Homo sapien
caattcgaggcggaaatggcgcgcc

SEQ ID NO: 167431 - DNA, 25 bp, Homo sapien
tgcagctgcaattcgaggcggaaat

SEQ ID NO: 167432 - DNA, 25 bp, Homo sapien
agctgctgagcatccggtgtcaaca

SEQ ID NO: 167433 - DNA, 25 bp, Homo sapien
ccaggagcaggtcagtctgcagtgc

SEQ ID NO: 167434 - DNA, 25 bp, Homo sapien
gagcacggtgaccagctgctgagca

SEQ ID NO: 167435 - DNA, 25 bp, Homo sapien
cggtgtcaacaccaggagcaggtca

SEQ ID NO: 167436 - DNA, 25 bp, Homo sapien
gaggcgagtccggagcaaacatacc

SEQ ID NO: 167437 - DNA, 25 bp, Homo sapien
gcgctctgagcgaagccgactccat

SEQ ID NO: 167438 - DNA, 25 bp, Homo sapien
ttgtgcaaactatcccgggcctctg

SEQ ID NO: 167439 - DNA, 25 bp, Homo sapien
tcccgagaacgaagccacgagtgca

SEQ ID NO: 167440 - DNA, 25 bp, Homo sapien
tagagctaagcagtcaccaggagtg

SEQ ID NO: 167441 - DNA, 25 bp, Homo sapien
tgtgcggcaaccaagcctagagcta

SEQ ID NO: 167442 - DNA, 25 bp, Homo sapien
tcacaaagcatccagacgcgtctcg

SEQ ID NO: 167443 - DNA, 25 bp, Homo sapien
gctgctcttggctgactcgtcacaa

SEQ ID NO: 167444 - DNA, 25 bp, Homo sapien
gaatgcatcctaggcgcgtcctcct

SEQ ID NO: 167445 - DNA, 25 bp, Homo sapien
tccaccctgagggagcaccgacccg

SEQ ID NO: 167446 - DNA, 25 bp, Homo sapien
agctggccctgtgcgcatgctcagt

SEQ ID NO: 167447 - DNA, 25 bp, Homo sapien
agatgacgccactacacggcctgcg

SEQ ID NO: 167448 - DNA, 25 bp, Homo sapien
gagtcagcacaacacccagatgacg

SEQ ID NO: 167449 - DNA, 25 bp, Homo sapien
tgctcagtagctgcgaatgcatcct

SEQ ID NO: 167450 - DNA, 25 bp, Homo sapien
agtccgattaaactctcgcccacat

SEQ ID NO: 167451 - DNA, 25 bp, Homo sapien
ggccagagtcagcacaacacccaga

SEQ ID NO: 167452 - DNA, 25 bp, Homo sapien
cgctgtgccacaggccatagccaaa

SEQ ID NO: 167453 - DNA, 25 bp, Homo sapien
ggcgtgaacagaccgccggttgcac

SEQ ID NO: 167454 - DNA, 25 bp, Homo sapien
caggccatagccaaagtagatgatg

SEQ ID NO: 167455 - DNA, 25 bp, Homo sapien
gagtccttgcttggtcggcatccag

SEQ ID NO: 167456 - DNA, 25 bp, Homo sapien
agttgccgtcaggagtccttgcttg

SEQ ID NO: 167457 - DNA, 25 bp, Homo sapien
gctgtgcgtcacttgcactggtcca

SEQ ID NO: 167458 - DNA, 25 bp, Homo sapien
gcactggtccaagttgccgtcagga

SEQ ID NO: 167459 - DNA, 25 bp, Homo sapien
agatgatgaagcctgcgggccgaca

SEQ ID NO: 167460 - DNA, 25 bp, Homo sapien
tcacacctgcctgcgcggactgaat

SEQ ID NO: 167461 - DNA, 25 bp, Homo sapien
ccaggtttcatcagcagtgcgcccg

SEQ ID NO: 167462 - DNA, 25 bp, Homo sapien
cggcaggatcgcgaacagacagact

SEQ ID NO: 167463 - DNA, 25 bp, Homo sapien
cggtttcagggagccaaaatggact

SEQ ID NO: 167464 - DNA, 25 bp, Homo sapien
ttgcatcatgcaccacgccgcggtt

SEQ ID NO: 167465 - DNA, 25 bp, Homo sapien
ccaggtagttgacccgctgctcaca

SEQ ID NO: 167466 - DNA, 25 bp, Homo sapien
gcccacgcttactcactcggtgttg

SEQ ID NO: 167467 - DNA, 25 bp, Homo sapien
accgcgccatgtaagggaaggtctc

SEQ ID NO: 167468 - DNA, 25 bp, Homo sapien
caggtacctgcctgagcgtggcact

SEQ ID NO: 167469 - DNA, 25 bp, Homo sapien
tcctttgccctcaagtcctatcatt

SEQ ID NO: 167470 - DNA, 25 bp, Homo sapien
gtcctatcatttggccgggctccgc

SEQ ID NO: 167471 - DNA, 25 bp, Homo sapien
taagcgcagaccgacccggcgcctc

SEQ ID NO: 167472 - DNA, 25 bp, Homo sapien
cctgagcgtggcactgcgcagtctg

SEQ ID NO: 167473 - DNA, 25 bp, Homo sapien
gacacgccagctcgcgggctaggct

SEQ ID NO: 167474 - DNA, 25 bp, Homo sapien
caagtcctatcatttggccgggctc

SEQ ID NO: 167475 - DNA, 25 bp, Homo sapien
ccacgctggcgaggcggtaagcgca

SEQ ID NO: 167476 - DNA, 25 bp, Homo sapien
agcccgggaatggtttcctctcaga

SEQ ID NO: 167477 - DNA, 25 bp, Homo sapien
gctacacatcgacgcgtgagccttg

SEQ ID NO: 167478 - DNA, 25 bp, Homo sapien
cccagcgtggatgtacacagataac

SEQ ID NO: 167479 - DNA, 25 bp, Homo sapien
cgcgctcaagggcatttaactagtt

SEQ ID NO: 167480 - DNA, 25 bp, Homo sapien
ctgcctgagtgcgactaagggaaac

SEQ ID NO: 167481 - DNA, 25 bp, Homo sapien
agtgcgtcaccacggagaccattcc

SEQ ID NO: 167482 - DNA, 25 bp, Homo sapien
tccctcgagcatcacgggaagtgta

SEQ ID NO: 167483 - DNA, 25 bp, Homo sapien
tgctcccgagtcaagtcctcattaa

SEQ ID NO: 167484 - DNA, 25 bp, Homo sapien
ggagccattagtgactctgtgaccc

SEQ ID NO: 167485 - DNA, 25 bp, Homo sapien
tgcaacctgcaagcctgagtcagct

SEQ ID NO: 167486 - DNA, 25 bp, Homo sapien
ggcgagcgccgctgcaacctgcaag

SEQ ID NO: 167487 - DNA, 25 bp, Homo sapien
aatcctctggcaggtccatttcctc

SEQ ID NO: 167488 - DNA, 25 bp, Homo sapien
gcggggcccaagctggttcaagccc

SEQ ID NO: 167489 - DNA, 25 bp, Homo sapien
gccgacgcagccatttcccagggag

SEQ ID NO: 167490 - DNA, 25 bp, Homo sapien
tggcgggagccattagtgactctgt

SEQ ID NO: 167491 - DNA, 25 bp, Homo sapien
ttcccagggagatcaatcctctggc

SEQ ID NO: 167492 - DNA, 25 bp, Homo sapien
actgagctctggtcgtgcttgatga

SEQ ID NO: 167493 - DNA, 25 bp, Homo sapien
tgcttgatgagcctgcctccactgc

SEQ ID NO: 167494 - DNA, 25 bp, Homo sapien
ggctgctcatccctgagactgtgca

SEQ ID NO: 167495 - DNA, 25 bp, Homo sapien
cgttagctcgcgacgtgcgtgaaaa

SEQ ID NO: 167496 - DNA, 25 bp, Homo sapien
cgggcacattcagcgatgcggtcca

SEQ ID NO: 167497 - DNA, 25 bp, Homo sapien
tcggattcattacccagaaggcgca

SEQ ID NO: 167498 - DNA, 25 bp, Homo sapien
cccgaggagtcgctgaactacaatt

SEQ ID NO: 167499 - DNA, 25 bp, Homo sapien
cgggctttgtagttcgccagtccga

SEQ ID NO: 167500 - DNA, 25 bp, Homo sapien
aacgctcttgtgttctgcgggccca

SEQ ID NO: 167501 - DNA, 25 bp, Homo sapien
acgtggacctatgcctgttgtaaga

SEQ ID NO: 167502 - DNA, 25 bp, Homo sapien
ttgtgagttcaccaaatggaggcgc

SEQ ID NO: 167503 - DNA, 25 bp, Homo sapien
cctggcttgggaacctattgtgagt

SEQ ID NO: 167504 - DNA, 25 bp, Homo sapien
catgccaccggcaggtgtctctttc

SEQ ID NO: 167505 - DNA, 25 bp, Homo sapien
tccttggaagctgaatgaagaaccg

SEQ ID NO: 167506 - DNA, 25 bp, Homo sapien
gagatcatgttgtgtccttggaagc

SEQ ID NO: 167507 - DNA, 25 bp, Homo sapien
tcacctttgaaacgccggcagctgc

SEQ ID NO: 167508 - DNA, 25 bp, Homo sapien
tccgaattcttgaccgagagccttg

SEQ ID NO: 167509 - DNA, 25 bp, Homo sapien
tttcctcctccgaattcttgaccga

SEQ ID NO: 167510 - DNA, 25 bp, Homo sapien
attcttgaccgagagccttggaacc

SEQ ID NO: 167511 - DNA, 25 bp, Homo sapien
tgaccgagagccttggaaccacatt

SEQ ID NO: 167512 - DNA, 25 bp, Homo sapien
tgcccaaatctgtacacgccggagc

SEQ ID NO: 167513 - DNA, 25 bp, Homo sapien
caaatctgtacacgccggagccagg

SEQ ID NO: 167514 - DNA, 25 bp, Homo sapien
ggcgcacgggcccttatgtaaggcc

SEQ ID NO: 167515 - DNA, 25 bp, Homo sapien
gagagccttggaaccacattctgcc

SEQ ID NO: 167516 - DNA, 25 bp, Homo sapien
atttgcagctctccacatcctgaga

SEQ ID NO: 167517 - DNA, 25 bp, Homo sapien
cgtaatttgcactggcgagtcggcc

SEQ ID NO: 167518 - DNA, 25 bp, Homo sapien
gagggttccgctgagctgctcacaa

SEQ ID NO: 167519 - DNA, 25 bp, Homo sapien
ccctggagggcgtgcgtaaaatgca

SEQ ID NO: 167520 - DNA, 25 bp, Homo sapien
tcggtgctatttgcagctctccaca

SEQ ID NO: 167521 - DNA, 25 bp, Homo sapien
tggacgccgaggaccgctccctgga

SEQ ID NO: 167522 - DNA, 25 bp, Homo sapien
cgtgcgtaaaatgcagcagcggagc

SEQ ID NO: 167523 - DNA, 25 bp, Homo sapien
ccagctgcagctgtcggtgctattt

SEQ ID NO: 167524 - DNA, 25 bp, Homo sapien
accgcggctgctaacctcttggcag

SEQ ID NO: 167525 - DNA, 25 bp, Homo sapien
cctgcagcctcttcctggtttaatc

SEQ ID NO: 167526 - DNA, 25 bp, Homo sapien
ggaaccgggcgcacattgtctgccc

SEQ ID NO: 167527 - DNA, 25 bp, Homo sapien
cggctctgtcggagtctggaacaat

SEQ ID NO: 167528 - DNA, 25 bp, Homo sapien
cacattctgctgtgcggatcgggca

SEQ ID NO: 167529 - DNA, 25 bp, Homo sapien
tggaacaatgggtcgccctttcacc

SEQ ID NO: 167530 - DNA, 25 bp, Homo sapien
ttcccaggtccatgtcccgtatcag

SEQ ID NO: 167531 - DNA, 25 bp, Homo sapien
tctgaatggacgctgccaccaacgg

SEQ ID NO: 167532 - DNA, 25 bp, Homo sapien
acaccgaacctctcggggctgagtc

SEQ ID NO: 167533 - DNA, 25 bp, Homo sapien
gcagcggcccttgttggaagtccag

SEQ ID NO: 167534 - DNA, 25 bp, Homo sapien
ggaagtccaggagtccgcgctaccc

SEQ ID NO: 167535 - DNA, 25 bp, Homo sapien
ctgagtcgggctgctttctcctcgc

SEQ ID NO: 167536 - DNA, 25 bp, Homo sapien
cgcgcggcgagctgaacaatggcct

SEQ ID NO: 167537 - DNA, 25 bp, Homo sapien
gagctgaacaatggcctggggacac

SEQ ID NO: 167538 - DNA, 25 bp, Homo sapien
ctggcaggtcgcaggccccaaatct

SEQ ID NO: 167539 - DNA, 25 bp, Homo sapien
cccttgttggaagtccaggagtccg

SEQ ID NO: 167540 - DNA, 25 bp, Homo sapien
gaggactcttttgccgcggactcaa

SEQ ID NO: 167541 - DNA, 25 bp, Homo sapien
agaaagccgcgcactagttttaatc

SEQ ID NO: 167542 - DNA, 25 bp, Homo sapien
aacgttgcaactagggtggagatca

SEQ ID NO: 167543 - DNA, 25 bp, Homo sapien
agccgccttcctagtggagacgcga

SEQ ID NO: 167544 - DNA, 25 bp, Homo sapien
caagcaggtctctttcgtcagcgta

SEQ ID NO: 167545 - DNA, 25 bp, Homo sapien
gcgaccggaagtgctcacgtcttca

SEQ ID NO: 167546 - DNA, 25 bp, Homo sapien
cgtcagcgtaatccctccgcagaaa

SEQ ID NO: 167547 - DNA, 25 bp, Homo sapien
cggaccacggaacagcgacgcgcaa

SEQ ID NO: 167548 - DNA, 25 bp, Homo sapien
agatcctctcagcaatggctgcgcg

SEQ ID NO: 167549 - DNA, 25 bp, Homo sapien
tcggggtaggaaagatcctctcagc

SEQ ID NO: 167550 - DNA, 25 bp, Homo sapien
cagtggtccgcagtcggcccggact

SEQ ID NO: 167551 - DNA, 25 bp, Homo sapien
ggccgcgtgactccgggcttctctg

SEQ ID NO: 167552 - DNA, 25 bp, Homo sapien
tgtgtacagatttccgcggcgccgg

SEQ ID NO: 167553 - DNA, 25 bp, Homo sapien
gcgctgcggtgtgtacagatttccg

SEQ ID NO: 167554 - DNA, 25 bp, Homo sapien
taggtcgcacggagagaatacgaca

SEQ ID NO: 167555 - DNA, 25 bp, Homo sapien
atggctgcgcgccatgcgtgctctg

SEQ ID NO: 167556 - DNA, 25 bp, Homo sapien
caggcaccggcatgctagaggttaa

SEQ ID NO: 167557 - DNA, 25 bp, Homo sapien
accctacttggaaccttgcgccatg

SEQ ID NO: 167558 - DNA, 25 bp, Homo sapien
atctagtggcagctctcaggacgtc

SEQ ID NO: 167559 - DNA, 25 bp, Homo sapien
tgctagaggttaacgaggaggttcc

SEQ ID NO: 167560 - DNA, 25 bp, Homo sapien
tccttccagcgtggatgagcctttc

SEQ ID NO: 167561 - DNA, 25 bp, Homo sapien
cggtgtcaagtgtaggcaagaaata

SEQ ID NO: 167562 - DNA, 25 bp, Homo sapien
tacggctgatcaagaagcgacttca

SEQ ID NO: 167563 - DNA, 25 bp, Homo sapien
aacactgagtccctttgcggcaggg

SEQ ID NO: 167564 - DNA, 25 bp, Homo sapien
acatcaagaggtgggtggcctcgcc

SEQ ID NO: 167565 - DNA, 25 bp, Homo sapien
gagcagactcgagcatgccaagtta

SEQ ID NO: 167566 - DNA, 25 bp, Homo sapien
ttatgagacgatgataactctgccc

SEQ ID NO: 167567 - DNA, 25 bp, Homo sapien
ggtcagactggcacctgagcggcca

SEQ ID NO: 167568 - DNA, 25 bp, Homo sapien
taccgcctcagcagctacatcaaga

SEQ ID NO: 167569 - DNA, 25 bp, Homo sapien
gctccgtgcgcttctagactttcct

SEQ ID NO: 167570 - DNA, 25 bp, Homo sapien
ttctgcttctatcacccggagcctg

SEQ ID NO: 167571 - DNA, 25 bp, Homo sapien
gagcctgacctccatctcgtctggg

SEQ ID NO: 167572 - DNA, 25 bp, Homo sapien
gggatcaggcactgtcagctcctcg

SEQ ID NO: 167573 - DNA, 25 bp, Homo sapien
gccgcgcccgccttaatatgattgg

SEQ ID NO: 167574 - DNA, 25 bp, Homo sapien
gaccttttccgccacagctacagaa

SEQ ID NO: 167575 - DNA, 25 bp, Homo sapien
tgtgagagttcaatgcaagcacgcg

SEQ ID NO: 167576 - DNA, 25 bp, Homo sapien
aagggtgaccgcagtccctgtgtca

SEQ ID NO: 167577 - DNA, 25 bp, Homo sapien
acgcgagctggaaacagcacgggca

SEQ ID NO: 167578 - DNA, 25 bp, Homo sapien
acgggcagacccaaaacaggagcgg

SEQ ID NO: 167579 - DNA, 25 bp, Homo sapien
agcacgcgaaatcgtgggaaaagcg

SEQ ID NO: 167580 - DNA, 25 bp, Homo sapien
gtctggccgttcctctgacactcag

SEQ ID NO: 167581 - DNA, 25 bp, Homo sapien
cggcggctggctgataagaaaccct

SEQ ID NO: 167582 - DNA, 25 bp, Homo sapien
ggtcccacttcctcagccttatgta

SEQ ID NO: 167583 - DNA, 25 bp, Homo sapien
tctcgagccttctggaaagattcta

SEQ ID NO: 167584 - DNA, 25 bp, Homo sapien
ccacaggcgttttgctgccctaata

SEQ ID NO: 167585 - DNA, 25 bp, Homo sapien
ctcgcagactcccacttacggggtg

SEQ ID NO: 167586 - DNA, 25 bp, Homo sapien
gtcgctggtccctagttccacggag

SEQ ID NO: 167587 - DNA, 25 bp, Homo sapien
cgtgaatccctgagacaatcccttc

SEQ ID NO: 167588 - DNA, 25 bp, Homo sapien
aactttgcaacagcgcgagtggcgg

SEQ ID NO: 167589 - DNA, 25 bp, Homo sapien
agcctccgccgccaggatgcggccg

SEQ ID NO: 167590 - DNA, 25 bp, Homo sapien
ccgaagaaactttgcaacagcgcga

SEQ ID NO: 167591 - DNA, 25 bp, Homo sapien
aactgtgccaccgaagaaactttgc

SEQ ID NO: 167592 - DNA, 25 bp, Homo sapien
aggaactgtgccaccgaagaaactt

SEQ ID NO: 167593 - DNA, 25 bp, Homo sapien
ttcgcgggcacagtcgcccgtgccc

SEQ ID NO: 167594 - DNA, 25 bp, Homo sapien
cctgctccctgggtaagtagcgggc

SEQ ID NO: 167595 - DNA, 25 bp, Homo sapien
tcctcacctgctccctgggtaagta

SEQ ID NO: 167596 - DNA, 25 bp, Homo sapien
actcccgcagccaatcggggtggcg

SEQ ID NO: 167597 - DNA, 25 bp, Homo sapien
tggagaagccgccagtctctgggcc

SEQ ID NO: 167598 - DNA, 25 bp, Homo sapien
ctccgcttgaccgtggcggtcgccg

SEQ ID NO: 167599 - DNA, 25 bp, Homo sapien
agcgctcggcgcagcgaagtagcct

SEQ ID NO: 167600 - DNA, 25 bp, Homo sapien
tcggcgcagcgaagtagcctccggc

SEQ ID NO: 167601 - DNA, 25 bp, Homo sapien
gcctccggcggtggcaactacggcg

SEQ ID NO: 167602 - DNA, 25 bp, Homo sapien
cagcgcccgggaggtagctttgtga

SEQ ID NO: 167603 - DNA, 25 bp, Homo sapien
agcgcggaccgcaccctcccgcgac

SEQ ID NO: 167604 - DNA, 25 bp, Homo sapien
gcattaccaatgaggagcggctgca

SEQ ID NO: 167605 - DNA, 25 bp, Homo sapien
ctgcggcattaccaatgaggagcgg

SEQ ID NO: 167606 - DNA, 25 bp, Homo sapien
gcagcgacaatgaggcaacacagct

SEQ ID NO: 167607 - DNA, 25 bp, Homo sapien
ctggagaagagcttgcccggccact

SEQ ID NO: 167608 - DNA, 25 bp, Homo sapien
agagagacctggctgaacgtgctgg

SEQ ID NO: 167609 - DNA, 25 bp, Homo sapien
tggaagtggacaaccagagagacct

SEQ ID NO: 167610 - DNA, 25 bp, Homo sapien
atccctggccggaagcttaggccca

SEQ ID NO: 167611 - DNA, 25 bp, Homo sapien
ggcctgtgtgcgcttcatccagccg

SEQ ID NO: 167612 - DNA, 25 bp, Homo sapien
cgatcccagttcaggtggggtcttc

SEQ ID NO: 167613 - DNA, 25 bp, Homo sapien
tccgcagaagctgggaaattcctcc

SEQ ID NO: 167614 - DNA, 25 bp, Homo sapien
cagccggcgtttctggtgatgacag

SEQ ID NO: 167615 - DNA, 25 bp, Homo sapien
ctttagatgagcactcccggccgga

SEQ ID NO: 167616 - DNA, 25 bp, Homo sapien
tgctccgccgtgtcctttagatgag

SEQ ID NO: 167617 - DNA, 25 bp, Homo sapien
tcccagaagaaagccgatcccagtt

SEQ ID NO: 167618 - DNA, 25 bp, Homo sapien
cgctcacgggaagccttgctgaaga

SEQ ID NO: 167619 - DNA, 25 bp, Homo sapien
gtcttcctcggttgcgtacctggct

SEQ ID NO: 167620 - DNA, 25 bp, Homo sapien
agcctgggcacttgtgcccttcggc

SEQ ID NO: 167621 - DNA, 25 bp, Homo sapien
acgctgaagcctgggcacttgtgcc

SEQ ID NO: 167622 - DNA, 25 bp, Homo sapien
cctccgacccaggactgccaccagg

SEQ ID NO: 167623 - DNA, 25 bp, Homo sapien
tgcttgggcgtccatggagcatccc

SEQ ID NO: 167624 - DNA, 25 bp, Homo sapien
actggacggtgagtgatgaacgagc

SEQ ID NO: 167625 - DNA, 25 bp, Homo sapien
cgacacatgcagtggcttctggact

SEQ ID NO: 167626 - DNA, 25 bp, Homo sapien
gtgcaagcgaggacacgacacatgc

SEQ ID NO: 167627 - DNA, 25 bp, Homo sapien
tggcttctggactgcgcgatgactg

SEQ ID NO: 167628 - DNA, 25 bp, Homo sapien
ctgagggcacggggcgtctttctcc

SEQ ID NO: 167629 - DNA, 25 bp, Homo sapien
tctccgcaggcggatcaagcccctg

SEQ ID NO: 167630 - DNA, 25 bp, Homo sapien
cagggcccgggagcgccttgctctc

SEQ ID NO: 167631 - DNA, 25 bp, Homo sapien
gcggcgtctccaggcacctgcttgc

SEQ ID NO: 167632 - DNA, 25 bp, Homo sapien
tgcctgtcagctcctgacctccgtg

SEQ ID NO: 167633 - DNA, 25 bp, Homo sapien
tcttcgtctcctgagggcacggggc

SEQ ID NO: 167634 - DNA, 25 bp, Homo sapien
ttgctcttcgtctcctgagggcacg

SEQ ID NO: 167635 - DNA, 25 bp, Homo sapien
cctgacctccgtgatggtggctgcg

SEQ ID NO: 167636 - DNA, 25 bp, Homo sapien
gacagatttgtgaccggcgcggttt

SEQ ID NO: 167637 - DNA, 25 bp, Homo sapien
tccggccaaaaaagaactgcacctc

SEQ ID NO: 167638 - DNA, 25 bp, Homo sapien
ggcgcggtttttgtcagcttactcc

SEQ ID NO: 167639 - DNA, 25 bp, Homo sapien
aactgcacctctggagcgggttagt

SEQ ID NO: 167640 - DNA, 25 bp, Homo sapien
ctctgctgcgcctcgggtgtctttt

SEQ ID NO: 167641 - DNA, 25 bp, Homo sapien
cttctgaaactaggcggcagaggcg

SEQ ID NO: 167642 - DNA, 25 bp, Homo sapien
ttgtggcgcgagcttctgaaactag

SEQ ID NO: 167643 - DNA, 25 bp, Homo sapien
tgtcagcttactccggccaaaaaag

SEQ ID NO: 167644 - DNA, 25 bp, Homo sapien
cccgacttcgccagattttcaaagc

SEQ ID NO: 167645 - DNA, 25 bp, Homo sapien
aagtgaacgaatttgggcgcccatg

SEQ ID NO: 167646 - DNA, 25 bp, Homo sapien
cagattttcaaagcgggctgccagc

SEQ ID NO: 167647 - DNA, 25 bp, Homo sapien
ctggccagtgtagttttcccggagc

SEQ ID NO: 167648 - DNA, 25 bp, Homo sapien
ctcgtttatgcgctcggattacagc

SEQ ID NO: 167649 - DNA, 25 bp, Homo sapien
gaccgctgtcattacctggccagtg

SEQ ID NO: 167650 - DNA, 25 bp, Homo sapien
cagcgcctgttgacgcactgtagcg

SEQ ID NO: 167651 - DNA, 25 bp, Homo sapien
gggccgcttacgcaattcgcaagtg

SEQ ID NO: 167652 - DNA, 25 bp, Homo sapien
caatcggtgtggtttttgtcggtag

SEQ ID NO: 167653 - DNA, 25 bp, Homo sapien
gcttggcgccattttgaagcggaga

SEQ ID NO: 167654 - DNA, 25 bp, Homo sapien
cgccgaagagcgcttggcgccattt

SEQ ID NO: 167655 - DNA, 25 bp, Homo sapien
cggttcgattggagcagccgccgaa

SEQ ID NO: 167656 - DNA, 25 bp, Homo sapien
gtagtggacgccttgacagctgccc

SEQ ID NO: 167657 - DNA, 25 bp, Homo sapien
gccgcaagagtagtggacgccttga

SEQ ID NO: 167658 - DNA, 25 bp, Homo sapien
agaggtctaggaagccgcaagagta

SEQ ID NO: 167659 - DNA, 25 bp, Homo sapien
tttgtcggtagaggtctaggaagcc

SEQ ID NO: 167660 - DNA, 25 bp, Homo sapien
actgggttctagctttcctttcaga

SEQ ID NO: 167661 - DNA, 25 bp, Homo sapien
agctgcaggctgctgcgttccttgc

SEQ ID NO: 167662 - DNA, 25 bp, Homo sapien
gctcgacagttattttggacgaatg

SEQ ID NO: 167663 - DNA, 25 bp, Homo sapien
gctaactcttaagtagctcgacagt

SEQ ID NO: 167664 - DNA, 25 bp, Homo sapien
ttggtagagacgtgaaagctaactc

SEQ ID NO: 167665 - DNA, 25 bp, Homo sapien
aatggtgtgcaattgtgactcgtta

SEQ ID NO: 167666 - DNA, 25 bp, Homo sapien
ggttggtagagcagctacccaccca

SEQ ID NO: 167667 - DNA, 25 bp, Homo sapien
gctactgctgttggtttttggtaga

SEQ ID NO: 167668 - DNA, 25 bp, Homo sapien
agcctcttgaagtcctcctccgtga

SEQ ID NO: 167669 - DNA, 25 bp, Homo sapien
cgccatagcgttcgaagagcctctt

SEQ ID NO: 167670 - DNA, 25 bp, Homo sapien
tcgcccggcttgaggaaactcttga

SEQ ID NO: 167671 - DNA, 25 bp, Homo sapien
gacagtccttttgttccctcgcgcg

SEQ ID NO: 167672 - DNA, 25 bp, Homo sapien
gccgggtttttctcaatgcgcactt

SEQ ID NO: 167673 - DNA, 25 bp, Homo sapien
cggacaccggatacaggcctagatt

SEQ ID NO: 167674 - DNA, 25 bp, Homo sapien
gccacggttgccacaggttgagaca

SEQ ID NO: 167675 - DNA, 25 bp, Homo sapien
atgcgcacttgcttcaggtttcctc

SEQ ID NO: 167676 - DNA, 25 bp, Homo sapien
ggtgcgtccatctgggatacgttca

SEQ ID NO: 167677 - DNA, 25 bp, Homo sapien
acaacaacgtcttccgcgacacgga

SEQ ID NO: 167678 - DNA, 25 bp, Homo sapien
ggagactcccggaacgccagtctgc

SEQ ID NO: 167679 - DNA, 25 bp, Homo sapien
agctcggggtcactcactaccgctt

SEQ ID NO: 167680 - DNA, 25 bp, Homo sapien
gtaattattgccagcggagcccgcc

SEQ ID NO: 167681 - DNA, 25 bp, Homo sapien
tgaacctgagcgtccacgaaacgtc

SEQ ID NO: 167682 - DNA, 25 bp, Homo sapien
gcgcggcaggcaaagagaatgaacc

SEQ ID NO: 167683 - DNA, 25 bp, Homo sapien
agccagcgacagctacaacaacgtc

SEQ ID NO: 167684 - DNA, 25 bp, Homo sapien
ggacgtgctccttgccttgcattca

SEQ ID NO: 167685 - DNA, 25 bp, Homo sapien
ctcccgcgcattcagtggatgtgtc

SEQ ID NO: 167686 - DNA, 25 bp, Homo sapien
ggccacttggtctgggcacttattc

SEQ ID NO: 167687 - DNA, 25 bp, Homo sapien
cccggccttgggctctgaaactcat

SEQ ID NO: 167688 - DNA, 25 bp, Homo sapien
ggagtcccgcaactgctcactgatg

SEQ ID NO: 167689 - DNA, 25 bp, Homo sapien
gtcctcataacgaccggcgggctct

SEQ ID NO: 167690 - DNA, 25 bp, Homo sapien
gctggtcattttagatccgtcctca

SEQ ID NO: 167691 - DNA, 25 bp, Homo sapien
ggatctcctgagctgcgtttggcaa

SEQ ID NO: 167692 - DNA, 25 bp, Homo sapien
gcaacgagcgcaaaggaagggatcc

SEQ ID NO: 167693 - DNA, 25 bp, Homo sapien
agaagtcttaatatccgggaccaga

SEQ ID NO: 167694 - DNA, 25 bp, Homo sapien
gcagcgcacatttccggcaacgagc

SEQ ID NO: 167695 - DNA, 25 bp, Homo sapien
ccagaggctggttgcagcgcacatt

SEQ ID NO: 167696 - DNA, 25 bp, Homo sapien
tgcctgcctagcaaacgtgcaaaca

SEQ ID NO: 167697 - DNA, 25 bp, Homo sapien
ttgaaaaagacgcacacgcagaccg

SEQ ID NO: 167698 - DNA, 25 bp, Homo sapien
cacgcgggaaccctccagaagtctt

SEQ ID NO: 167699 - DNA, 25 bp, Homo sapien
gaagggatccggtgacgcctcttcc

SEQ ID NO: 167700 - DNA, 25 bp, Homo sapien
gacggctggactatcacaaggagca

SEQ ID NO: 167701 - DNA, 25 bp, Homo sapien
cgcggcagctgattttgtctgcaca

SEQ ID NO: 167702 - DNA, 25 bp, Homo sapien
cgtagcctttccgtccaaaatcatt

SEQ ID NO: 167703 - DNA, 25 bp, Homo sapien
ccaaaatcatttacgcggccgcgac

SEQ ID NO: 167704 - DNA, 25 bp, Homo sapien
agctcgcgggaaaacttgtctctgc

SEQ ID NO: 167705 - DNA, 25 bp, Homo sapien
cgctcgcgcgggattttcaagcgta

SEQ ID NO: 167706 - DNA, 25 bp, Homo sapien
gtggacaagtatcggccctgctcct

SEQ ID NO: 167707 - DNA, 25 bp, Homo sapien
aactcgagctgccatgagcctctgg

SEQ ID NO: 167708 - DNA, 25 bp, Homo sapien
ccacttctccgaaggtgggcagggc

SEQ ID NO: 167709 - DNA, 25 bp, Homo sapien
gaccagcggctccttgtgagccttc

SEQ ID NO: 167710 - DNA, 25 bp, Homo sapien
gggccagcgtcacgccctgggacca

SEQ ID NO: 167711 - DNA, 25 bp, Homo sapien
gtctcatcccacttctccgaaggtg

SEQ ID NO: 167712 - DNA, 25 bp, Homo sapien
agcagtacggtttggggtgccttct

SEQ ID NO: 167713 - DNA, 25 bp, Homo sapien
aggagggacgccatctctggaggct

SEQ ID NO: 167714 - DNA, 25 bp, Homo sapien
agcaccggcagccttagcagtacgg

SEQ ID NO: 167715 - DNA, 25 bp, Homo sapien
ccggcagccttagcagtacggtttg

SEQ ID NO: 167716 - DNA, 25 bp, Homo sapien
cgtacaagagattcgggcgtaatta

SEQ ID NO: 167717 - DNA, 25 bp, Homo sapien
cgggcgtaattacttgagcaatcta

SEQ ID NO: 167718 - DNA, 25 bp, Homo sapien
tggtgcttcagatcgactgcctctc

SEQ ID NO: 167719 - DNA, 25 bp, Homo sapien
gtcccgacagggctgaaagctgaca

SEQ ID NO: 167720 - DNA, 25 bp, Homo sapien
cactgtcacagtttgctccttagcc

SEQ ID NO: 167721 - DNA, 25 bp, Homo sapien
tgctgcgccagggaaagccaacttg

SEQ ID NO: 167722 - DNA, 25 bp, Homo sapien
taatcgcgacagaagccagcccagc

SEQ ID NO: 167723 - DNA, 25 bp, Homo sapien
gcattgtgcaggacggtcgcagatt

SEQ ID NO: 167724 - DNA, 25 bp, Homo sapien
tcctgcaagaggcaaaccgctctga

SEQ ID NO: 167725 - DNA, 25 bp, Homo sapien
cgcgccttaggagaccgatattaga

SEQ ID NO: 167726 - DNA, 25 bp, Homo sapien
ttagattaatcttcctgcaagaggc

SEQ ID NO: 167727 - DNA, 25 bp, Homo sapien
accgctctgaacagcggaatttatc

SEQ ID NO: 167728 - DNA, 25 bp, Homo sapien
gcggaatttatcatttagatccttg

SEQ ID NO: 167729 - DNA, 25 bp, Homo sapien
ccgctgctgagtggaacggcttcgc

SEQ ID NO: 167730 - DNA, 25 bp, Homo sapien
gtgtagcgcgccttaggagaccgat

SEQ ID NO: 167731 - DNA, 25 bp, Homo sapien
ggagaccgatattagattaatcttc

SEQ ID NO: 167732 - DNA, 25 bp, Homo sapien
gatctgcaccacgtacctatctcgg

SEQ ID NO: 167733 - DNA, 25 bp, Homo sapien
ggtgcatttaaaggccggcgtgatc

SEQ ID NO: 167734 - DNA, 25 bp, Homo sapien
ctacatttgtctaccgcttgagcca

SEQ ID NO: 167735 - DNA, 25 bp, Homo sapien
gagattgaaaccttccgccttgacc

SEQ ID NO: 167736 - DNA, 25 bp, Homo sapien
ggagtggcactccttggacaagaga

SEQ ID NO: 167737 - DNA, 25 bp, Homo sapien
gccggaggcggtaatgaattccacc

SEQ ID NO: 167738 - DNA, 25 bp, Homo sapien
gaggccctcgtagcgattgtccatc

SEQ ID NO: 167739 - DNA, 25 bp, Homo sapien
cagcgtctgaaacctggaccggatt

SEQ ID NO: 167740 - DNA, 25 bp, Homo sapien
cttacttggtgtcccggcttactct

SEQ ID NO: 167741 - DNA, 25 bp, Homo sapien
gtgccctcttactttcctctctggg

SEQ ID NO: 167742 - DNA, 25 bp, Homo sapien
ctgcgtgagcttatttgaaaacctt

SEQ ID NO: 167743 - DNA, 25 bp, Homo sapien
tgcgctctctcccttgggttcaggc

SEQ ID NO: 167744 - DNA, 25 bp, Homo sapien
tgggttcaggccagagatgcttgcc

SEQ ID NO: 167745 - DNA, 25 bp, Homo sapien
tgggccacctgcagaacacccttgg

SEQ ID NO: 167746 - DNA, 25 bp, Homo sapien
acacccttggttgtcaaggacgtga

SEQ ID NO: 167747 - DNA, 25 bp, Homo sapien
ctgggctcaagatcgctacgcttta

SEQ ID NO: 167748 - DNA, 25 bp, Homo sapien
cgccctcttcccaccgcagcaacct

SEQ ID NO: 167749 - DNA, 25 bp, Homo sapien
aaccacgcaccggtccgcggagaga

SEQ ID NO: 167750 - DNA, 25 bp, Homo sapien
ccagggaaggcaaaccacgcaccgg

SEQ ID NO: 167751 - DNA, 25 bp, Homo sapien
ggccactagtgcagggatgtgcctc

SEQ ID NO: 167752 - DNA, 25 bp, Homo sapien
gtgcctcggcccgtcctcattgaaa

SEQ ID NO: 167753 - DNA, 25 bp, Homo sapien
tcctcattgaaatgcggcgcttcgc

SEQ ID NO: 167754 - DNA, 25 bp, Homo sapien
cccttcttggcagggcgcacccacc

SEQ ID NO: 167755 - DNA, 25 bp, Homo sapien
cagggcggccgcctttcgaggaact

SEQ ID NO: 167756 - DNA, 25 bp, Homo sapien
tggaggatggagacgattactaatc

SEQ ID NO: 167757 - DNA, 25 bp, Homo sapien
tggagacgattactaatcaccagcc

SEQ ID NO: 167758 - DNA, 25 bp, Homo sapien
gacgattactaatcaccagccacct

SEQ ID NO: 167759 - DNA, 25 bp, Homo sapien
tgcaatgaccctgcggcggcgcctt

SEQ ID NO: 167760 - DNA, 25 bp, Homo sapien
aacgcccggtcacgcctcccgcgtg

SEQ ID NO: 167761 - DNA, 25 bp, Homo sapien
ctggctcacaggctgcgtgtaaacg

SEQ ID NO: 167762 - DNA, 25 bp, Homo sapien
caggctgcgtgtaaacgcccggtca

SEQ ID NO: 167763 - DNA, 25 bp, Homo sapien
gctgcgtgtaaacgcccggtcacgc

SEQ ID NO: 167764 - DNA, 25 bp, Homo sapien
cggctgtcgcttaccatcctgtaga

SEQ ID NO: 167765 - DNA, 25 bp, Homo sapien
ttaccatcctgtagaccgtgacctc

SEQ ID NO: 167766 - DNA, 25 bp, Homo sapien
gccagcaggtgactgcgatcctgga

SEQ ID NO: 167767 - DNA, 25 bp, Homo sapien
agcaggccatcctgcacgcggtgga

SEQ ID NO: 167768 - DNA, 25 bp, Homo sapien
ccagcttctggacgcactgtgagcg

SEQ ID NO: 167769 - DNA, 25 bp, Homo sapien
cactgtgagcggttatgcagcagca

SEQ ID NO: 167770 - DNA, 25 bp, Homo sapien
tgcagcagcacgctcatatgagatg

SEQ ID NO: 167771 - DNA, 25 bp, Homo sapien
agggtgctatgcaggcccacgtccc

SEQ ID NO: 167772 - DNA, 25 bp, Homo sapien
cttaaagtggccctgtcgccagttc

SEQ ID NO: 167773 - DNA, 25 bp, Homo sapien
gcccgcccgcgaggttataaacgca

SEQ ID NO: 167774 - DNA, 25 bp, Homo sapien
agcctcttacctggcccgagatctg

SEQ ID NO: 167775 - DNA, 25 bp, Homo sapien
ctggcagtgctcctggcagataatt

SEQ ID NO: 167776 - DNA, 25 bp, Homo sapien
ggcccttaggagaccgcgtcactag

SEQ ID NO: 167777 - DNA, 25 bp, Homo sapien
cagggcagctctcacgacactaagc

SEQ ID NO: 167778 - DNA, 25 bp, Homo sapien
aaggggcccttcctgctattcgctc

SEQ ID NO: 167779 - DNA, 25 bp, Homo sapien
tcactagctgactgcgcactccaag

SEQ ID NO: 167780 - DNA, 25 bp, Homo sapien
gcggcttcagccctgagactctgca

SEQ ID NO: 167781 - DNA, 25 bp, Homo sapien
taagggccacccagaagccagtacg

SEQ ID NO: 167782 - DNA, 25 bp, Homo sapien
tcttccttcatagtgtcaggccaga

SEQ ID NO: 167783 - DNA, 25 bp, Homo sapien
cacaccgtcgaagttgtagtttctc

SEQ ID NO: 167784 - DNA, 25 bp, Homo sapien
ttcaggcggttggtgctcacaccgt

SEQ ID NO: 167785 - DNA, 25 bp, Homo sapien
tgcggacttcttccagcaactgctg

SEQ ID NO: 167786 - DNA, 25 bp, Homo sapien
gtgacgtcataaagcgatgcccgca

SEQ ID NO: 167787 - DNA, 25 bp, Homo sapien
gccgactcacttcttgcggacttct

SEQ ID NO: 167788 - DNA, 25 bp, Homo sapien
tgcagagaaaggctgcccaaccttg

SEQ ID NO: 167789 - DNA, 25 bp, Homo sapien
gtcaccgtaacactctagaagggga

SEQ ID NO: 167790 - DNA, 25 bp, Homo sapien
agactaggttctgcccactctgacc

SEQ ID NO: 167791 - DNA, 25 bp, Homo sapien
gcgcgtcttgccagcggattcatca

SEQ ID NO: 167792 - DNA, 25 bp, Homo sapien
ccgcagcctaggtcacgtgagtacc

SEQ ID NO: 167793 - DNA, 25 bp, Homo sapien
ttgccgtggcaaccaagacgttcca

SEQ ID NO: 167794 - DNA, 25 bp, Homo sapien
ccatgggttaagaggccgaagcttc

SEQ ID NO: 167795 - DNA, 25 bp, Homo sapien
atataaccgcagttgttcgtgggcc

SEQ ID NO: 167796 - DNA, 25 bp, Homo sapien
tgcgtcggatactcgggtccgctcg

SEQ ID NO: 167797 - DNA, 25 bp, Homo sapien
gcgatggcgtggcttgcgtctcccg

SEQ ID NO: 167798 - DNA, 25 bp, Homo sapien
cctgcgtcggatactcgggtccgct

SEQ ID NO: 167799 - DNA, 25 bp, Homo sapien
gaggcgcccagcgagccagagtggt

SEQ ID NO: 167800 - DNA, 25 bp, Homo sapien
gcccgggaccatagagggtcgctcc

SEQ ID NO: 167801 - DNA, 25 bp, Homo sapien
gaccatagagggtcgctccgccact

SEQ ID NO: 167802 - DNA, 25 bp, Homo sapien
gggtcgctccgccactttcctagag

SEQ ID NO: 167803 - DNA, 25 bp, Homo sapien
ccactttcctagagcgaccgcggcg

SEQ ID NO: 167804 - DNA, 25 bp, Homo sapien
tcacggaaacagtcccttccaaagc

SEQ ID NO: 167805 - DNA, 25 bp, Homo sapien
ttcctgggccacaatcttggctttc

SEQ ID NO: 167806 - DNA, 25 bp, Homo sapien
aagacctctcgtggggacctcgagc

SEQ ID NO: 167807 - DNA, 25 bp, Homo sapien
tggagacgcaacactgccgcgactg

SEQ ID NO: 167808 - DNA, 25 bp, Homo sapien
tcggcatggaaacgctcccgctagg

SEQ ID NO: 167809 - DNA, 25 bp, Homo sapien
ttggccgattcaacagacgcgggtg

SEQ ID NO: 167810 - DNA, 25 bp, Homo sapien
cttcacgcagttgcgcaggagcccg

SEQ ID NO: 167811 - DNA, 25 bp, Homo sapien
cgagcacgacgtgcgaccctaaatc

SEQ ID NO: 167812 - DNA, 25 bp, Homo sapien
gaaacttgcagggtcccgagctctg

SEQ ID NO: 167813 - DNA, 25 bp, Homo sapien
cgtcctccgagattttccaatggtg

SEQ ID NO: 167814 - DNA, 25 bp, Homo sapien
gtcctagagccaagcgcccgctaga

SEQ ID NO: 167815 - DNA, 25 bp, Homo sapien
tgcaggtcagtgagggaaacttgca

SEQ ID NO: 167816 - DNA, 25 bp, Homo sapien
gaacttgccctacgcggagagcgcc

SEQ ID NO: 167817 - DNA, 25 bp, Homo sapien
caacattcccgaggacggcttcgcg

SEQ ID NO: 167818 - DNA, 25 bp, Homo sapien
gcgcgtatcgtccagaccggagcac

SEQ ID NO: 167819 - DNA, 25 bp, Homo sapien
ttttccaatggtggcgcaagctcct

SEQ ID NO: 167820 - DNA, 25 bp, Homo sapien
tgctagtgatgcaaccctgtgctgg

SEQ ID NO: 167821 - DNA, 25 bp, Homo sapien
ggccaagcagcgcaaaccgtggatg

SEQ ID NO: 167822 - DNA, 25 bp, Homo sapien
atctagaggacgaggagactcactc

SEQ ID NO: 167823 - DNA, 25 bp, Homo sapien
caagcccgttaggtacctgtgcgaa

SEQ ID NO: 167824 - DNA, 25 bp, Homo sapien
ggcctctcaattcaccctgctagtg

SEQ ID NO: 167825 - DNA, 25 bp, Homo sapien
ccagcgtgtcctgagtctttggttc

SEQ ID NO: 167826 - DNA, 25 bp, Homo sapien
cacatgcgcagtcagtcccgttggt

SEQ ID NO: 167827 - DNA, 25 bp, Homo sapien
aggcggacctgttagacacttcgga

SEQ ID NO: 167828 - DNA, 25 bp, Homo sapien
cggggtagtactcctcgcagcggcc

SEQ ID NO: 167829 - DNA, 25 bp, Homo sapien
aaagccaagcctcacgccgaggagc

SEQ ID NO: 167830 - DNA, 25 bp, Homo sapien
cctttgtctgcgtgggtcgcctcgc

SEQ ID NO: 167831 - DNA, 25 bp, Homo sapien
tcgcccgtattagtgcgccgacctg

SEQ ID NO: 167832 - DNA, 25 bp, Homo sapien
cgcgaagcctcatcgcccgtattag

SEQ ID NO: 167833 - DNA, 25 bp, Homo sapien
gtcagtcagactggagccgcgaagc

SEQ ID NO: 167834 - DNA, 25 bp, Homo sapien
cccagccggcgtcagtcagactgga

SEQ ID NO: 167835 - DNA, 25 bp, Homo sapien
gaggagggcacgtcttacctgtccc

SEQ ID NO: 167836 - DNA, 25 bp, Homo sapien
cacctccacacaggcggaagcgcgc

SEQ ID NO: 167837 - DNA, 25 bp, Homo sapien
aggcggagaaaacgccgctctcgtg

SEQ ID NO: 167838 - DNA, 25 bp, Homo sapien
gccgcagtctccaggagagcggtaa

SEQ ID NO: 167839 - DNA, 25 bp, Homo sapien
cctgttctcaccagtacgagggctg

SEQ ID NO: 167840 - DNA, 25 bp, Homo sapien
ttctcaccagtacgagggctgcggc

SEQ ID NO: 167841 - DNA, 25 bp, Homo sapien
gcaacagaagcggagccattctcca

SEQ ID NO: 167842 - DNA, 25 bp, Homo sapien
gcagcccgcccaatcccgcacctcc

SEQ ID NO: 167843 - DNA, 25 bp, Homo sapien
gagccattctccatgccgtggcagc

SEQ ID NO: 167844 - DNA, 25 bp, Homo sapien
ctgtagagttccatacccgctgcga

SEQ ID NO: 167845 - DNA, 25 bp, Homo sapien
tgtcacagtgaaaagaaagggcttc

SEQ ID NO: 167846 - DNA, 25 bp, Homo sapien
gggtgccatttccttcctcgtcgag

SEQ ID NO: 167847 - DNA, 25 bp, Homo sapien
ttaactcttagctgggattctctca

SEQ ID NO: 167848 - DNA, 25 bp, Homo sapien
ggacggcagcttcctttaactctta

SEQ ID NO: 167849 - DNA, 25 bp, Homo sapien
agttctgtaccctggcggacggcag

SEQ ID NO: 167850 - DNA, 25 bp, Homo sapien
caccttggcatttcccgtggcgtga

SEQ ID NO: 167851 - DNA, 25 bp, Homo sapien
cttcctcagtgagacgggagatgaa

SEQ ID NO: 167852 - DNA, 25 bp, Homo sapien
ggccgcacttccgattggcaggctg

SEQ ID NO: 167853 - DNA, 25 bp, Homo sapien
cctggagtttagctgcctcaacctc

SEQ ID NO: 167854 - DNA, 25 bp, Homo sapien
gatgtaggcgtccacctggagttta

SEQ ID NO: 167855 - DNA, 25 bp, Homo sapien
ccgcgaaaggcgatgtaggcgtcca

SEQ ID NO: 167856 - DNA, 25 bp, Homo sapien
tcggcttagcaacaccgcgaaaggc

SEQ ID NO: 167857 - DNA, 25 bp, Homo sapien
gtgtccggaaatacccgtctctgga

SEQ ID NO: 167858 - DNA, 25 bp, Homo sapien
caaaattcttgccagtgtccggaaa

SEQ ID NO: 167859 - DNA, 25 bp, Homo sapien
tctctggaacccaaaagtcaaacta

SEQ ID NO: 167860 - DNA, 25 bp, Homo sapien
tgaactggagtcttgagtgcgctgc

SEQ ID NO: 167861 - DNA, 25 bp, Homo sapien
ccgcggttgaactggagtcttgagt

SEQ ID NO: 167862 - DNA, 25 bp, Homo sapien
cagccctcaactcccggtcgggttg

SEQ ID NO: 167863 - DNA, 25 bp, Homo sapien
cctccgtgcgctcgttggctggcga

SEQ ID NO: 167864 - DNA, 25 bp, Homo sapien
acaagcacaactccgcgaggtccag

SEQ ID NO: 167865 - DNA, 25 bp, Homo sapien
ggcgacaagcacaactccgcgaggt

SEQ ID NO: 167866 - DNA, 25 bp, Homo sapien
cggctgcgcggaacgaacaagccca

SEQ ID NO: 167867 - DNA, 25 bp, Homo sapien
cagctaccgggtccgccagggtcag

SEQ ID NO: 167868 - DNA, 25 bp, Homo sapien
atggaattcccttagtcgctgctga

SEQ ID NO: 167869 - DNA, 25 bp, Homo sapien
ttaagagttcccacggctgacagcg

SEQ ID NO: 167870 - DNA, 25 bp, Homo sapien
gcctgcacagatccctctggataaa

SEQ ID NO: 167871 - DNA, 25 bp, Homo sapien
agaccgcgctggaaagggatagtcc

SEQ ID NO: 167872 - DNA, 25 bp, Homo sapien
cgctgctgagttttggagcattcca

SEQ ID NO: 167873 - DNA, 25 bp, Homo sapien
agcacgcccggcaaattccaatgga

SEQ ID NO: 167874 - DNA, 25 bp, Homo sapien
tgcaaagttgcaatcttcgggctga

SEQ ID NO: 167875 - DNA, 25 bp, Homo sapien
atagtccgggaagatgcgcgtccca

SEQ ID NO: 167876 - DNA, 25 bp, Homo sapien
tttcctttaagatcacgctgacgtc

SEQ ID NO: 167877 - DNA, 25 bp, Homo sapien
tccggcaccaccatgtaagtgtttg

SEQ ID NO: 167878 - DNA, 25 bp, Homo sapien
cacactagaggaagtcgtgctaccc

SEQ ID NO: 167879 - DNA, 25 bp, Homo sapien
cccgctcttttcctcaggtcgaagg

SEQ ID NO: 167880 - DNA, 25 bp, Homo sapien
acggctgccgtacaaagtgtgagta

SEQ ID NO: 167881 - DNA, 25 bp, Homo sapien
ggggatgatccgagcttttccaaca

SEQ ID NO: 167882 - DNA, 25 bp, Homo sapien
gagaggtccgtacttgctcgctaag

SEQ ID NO: 167883 - DNA, 25 bp, Homo sapien
tgcttaccgactgccataattcctg

SEQ ID NO: 167884 - DNA, 25 bp, Homo sapien
tcttggacactacggcttctcctgg

SEQ ID NO: 167885 - DNA, 25 bp, Homo sapien
aacttgctgtctggccaagctcttg

SEQ ID NO: 167886 - DNA, 25 bp, Homo sapien
ttctcctgggagaaattcgctgagc

SEQ ID NO: 167887 - DNA, 25 bp, Homo sapien
agaacgtgggagacaccctgccaca

SEQ ID NO: 167888 - DNA, 25 bp, Homo sapien
ctgacttagaatccctggacgcttc

SEQ ID NO: 167889 - DNA, 25 bp, Homo sapien
ggcagctcaggctcacgacctctga

SEQ ID NO: 167890 - DNA, 25 bp, Homo sapien
cacgttcgaataccagctgcagctg

SEQ ID NO: 167891 - DNA, 25 bp, Homo sapien
atgaggcactgaggcagattcccgc

SEQ ID NO: 167892 - DNA, 25 bp, Homo sapien
agttcgccttccagcccgagacaga

SEQ ID NO: 167893 - DNA, 25 bp, Homo sapien
ccgacttcgcatgctctcaggctga

SEQ ID NO: 167894 - DNA, 25 bp, Homo sapien
tctcctgtcactggtaagccgcgtc

SEQ ID NO: 167895 - DNA, 25 bp, Homo sapien
tgcgcggtttcggtactagacaacg

SEQ ID NO: 167896 - DNA, 25 bp, Homo sapien
ggttgtgactcggaacttgcctctg

SEQ ID NO: 167897 - DNA, 25 bp, Homo sapien
gctgcctcgctatggagaactcctc

SEQ ID NO: 167898 - DNA, 25 bp, Homo sapien
ccggagactctcctgatggactgca

SEQ ID NO: 167899 - DNA, 25 bp, Homo sapien
ggacaggcaactccaccagctttca

SEQ ID NO: 167900 - DNA, 25 bp, Homo sapien
cgccggtctctcgacccgcacctgc

SEQ ID NO: 167901 - DNA, 25 bp, Homo sapien
gaacccggacgcatggtccggctcg

SEQ ID NO: 167902 - DNA, 25 bp, Homo sapien
acctgcgctcagagtccacgggcgg

SEQ ID NO: 167903 - DNA, 25 bp, Homo sapien
agtagaaacacctgcgctcagagtc

SEQ ID NO: 167904 - DNA, 25 bp, Homo sapien
gaggtagctcttgaaggcgctttcc

SEQ ID NO: 167905 - DNA, 25 bp, Homo sapien
ggtgccgccagaggtagctcttgaa

SEQ ID NO: 167906 - DNA, 25 bp, Homo sapien
cggcaggtttgagtgcggtttccct

SEQ ID NO: 167907 - DNA, 25 bp, Homo sapien
agcggccggcagagtagaaacacct

SEQ ID NO: 167908 - DNA, 25 bp, Homo sapien
tgttccctttcgtactcaaagctcg

SEQ ID NO: 167909 - DNA, 25 bp, Homo sapien
gcattcgcgtttttgtggctctcca

SEQ ID NO: 167910 - DNA, 25 bp, Homo sapien
cttgcatttttggttttgcattcgc

SEQ ID NO: 167911 - DNA, 25 bp, Homo sapien
agccggtgctggcttctttcttgca

SEQ ID NO: 167912 - DNA, 25 bp, Homo sapien
tcccgtctggtcatggcgagattct

SEQ ID NO: 167913 - DNA, 25 bp, Homo sapien
tgcagcctgaggctgtcaggtcctc

SEQ ID NO: 167914 - DNA, 25 bp, Homo sapien
tcaaagctcgtgcatccagggaggg

SEQ ID NO: 167915 - DNA, 25 bp, Homo sapien
ctctgtgccgctgcaaaccgttgca

SEQ ID NO: 167916 - DNA, 25 bp, Homo sapien
cacggggcagccgagtgatttactt

SEQ ID NO: 167917 - DNA, 25 bp, Homo sapien
tttggcaggcgaggcacgcaccgcc

SEQ ID NO: 167918 - DNA, 25 bp, Homo sapien
aggagcggatctccctttggcaggc

SEQ ID NO: 167919 - DNA, 25 bp, Homo sapien
atcgcacgcagaggagcggatctcc

SEQ ID NO: 167920 - DNA, 25 bp, Homo sapien
tctcgggcgggaacatccacgggaa

SEQ ID NO: 167921 - DNA, 25 bp, Homo sapien
tgatttacttacatggctggcgggc

SEQ ID NO: 167922 - DNA, 25 bp, Homo sapien
agagccgacggatccgccgagctca

SEQ ID NO: 167923 - DNA, 25 bp, Homo sapien
acaacttgctgtctttctcgggcgg

SEQ ID NO: 167924 - DNA, 25 bp, Homo sapien
gctgccaacggcctcaacaatgggg

SEQ ID NO: 167925 - DNA, 25 bp, Homo sapien
taagatcctggagacgcggctggac

SEQ ID NO: 167926 - DNA, 25 bp, Homo sapien
ccgctgtcgcgcaagctgcataaga

SEQ ID NO: 167927 - DNA, 25 bp, Homo sapien
cgcggctggacaacgacaaggtaac

SEQ ID NO: 167928 - DNA, 25 bp, Homo sapien
gcaatactcgcgctgcctccgtggt

SEQ ID NO: 167929 - DNA, 25 bp, Homo sapien
gcggccgatttgcacatgcgcaata

SEQ ID NO: 167930 - DNA, 25 bp, Homo sapien
acttccggggccgatgcgcatgcgc

SEQ ID NO: 167931 - DNA, 25 bp, Homo sapien
cgcgcaagctgcataagatcctgga

SEQ ID NO: 167932 - DNA, 25 bp, Homo sapien
tggcgtgcccttcgctccgaaaaac

SEQ ID NO: 167933 - DNA, 25 bp, Homo sapien
gggaggctccctcactgcttagcaa

SEQ ID NO: 167934 - DNA, 25 bp, Homo sapien
gcaaacaagccttggcgtgcccttc

SEQ ID NO: 167935 - DNA, 25 bp, Homo sapien
cactcaagacagaggcaaacaagcc

SEQ ID NO: 167936 - DNA, 25 bp, Homo sapien
tgtgacctgggcgacactcaagaca

SEQ ID NO: 167937 - DNA, 25 bp, Homo sapien
ttagcaactcctccttgtgacctgg

SEQ ID NO: 167938 - DNA, 25 bp, Homo sapien
tccgtccgtgtagggagcgcagccc

SEQ ID NO: 167939 - DNA, 25 bp, Homo sapien
agggcggtcatagtccgtccgtgta

SEQ ID NO: 167940 - DNA, 25 bp, Homo sapien
gtgtctcgagcccacacagaccggt

SEQ ID NO: 167941 - DNA, 25 bp, Homo sapien
cagaaccggcctggcaccatggaaa

SEQ ID NO: 167942 - DNA, 25 bp, Homo sapien
aagggctgccaaagccgtcctcgcg

SEQ ID NO: 167943 - DNA, 25 bp, Homo sapien
gaagaccctaagatctccttcgagg

SEQ ID NO: 167944 - DNA, 25 bp, Homo sapien
tccttcgaggagatgagcagaaagc

SEQ ID NO: 167945 - DNA, 25 bp, Homo sapien
gagcagaaagcccagccgcagagct

SEQ ID NO: 167946 - DNA, 25 bp, Homo sapien
cgcagagctgcggacgctaacgcca

SEQ ID NO: 167947 - DNA, 25 bp, Homo sapien
ggacgctaacgccagcgccaagcgg

SEQ ID NO: 167948 - DNA, 25 bp, Homo sapien
aggccgagcaaacctgcacagctgc

SEQ ID NO: 167949 - DNA, 25 bp, Homo sapien
cagaacttaacttcgcggggccatc

SEQ ID NO: 167950 - DNA, 25 bp, Homo sapien
tcgaagtccgggtcgatctccacca

SEQ ID NO: 167951 - DNA, 25 bp, Homo sapien
gactggctaaactccggcctgggca

SEQ ID NO: 167952 - DNA, 25 bp, Homo sapien
tggccgagttggactggctaaactc

SEQ ID NO: 167953 - DNA, 25 bp, Homo sapien
ccgccgagctctcgatggccttggt

SEQ ID NO: 167954 - DNA, 25 bp, Homo sapien
tcctccagcaagctcaggttgctca

SEQ ID NO: 167955 - DNA, 25 bp, Homo sapien
tcgcggggccatccacatcgaggct

SEQ ID NO: 167956 - DNA, 25 bp, Homo sapien
tccagttggggcttcccgaggacaa

SEQ ID NO: 167957 - DNA, 25 bp, Homo sapien
caatgggcgtgcccgaagcgctccg

SEQ ID NO: 167958 - DNA, 25 bp, Homo sapien
cctcgcaggggccttcaagcaactg

SEQ ID NO: 167959 - DNA, 25 bp, Homo sapien
tcgcaggggccttcaagcaactgga

SEQ ID NO: 167960 - DNA, 25 bp, Homo sapien
ttcggtacggcgggcagcgaatctc

SEQ ID NO: 167961 - DNA, 25 bp, Homo sapien
gattccagttcacccgcggtcccga

SEQ ID NO: 167962 - DNA, 25 bp, Homo sapien
cagcgcggtcgggattccagttcac

SEQ ID NO: 167963 - DNA, 25 bp, Homo sapien
acctgacggacagcccttcggacca

SEQ ID NO: 167964 - DNA, 25 bp, Homo sapien
cgccgagacacgaaatgaaccaaga

SEQ ID NO: 167965 - DNA, 25 bp, Homo sapien
gaacacaactgaaatggtgcgtccc

SEQ ID NO: 167966 - DNA, 25 bp, Homo sapien
tccgtgccgaacagtgagtagcata

SEQ ID NO: 167967 - DNA, 25 bp, Homo sapien
tgagtagcataatcgcagccgctga

SEQ ID NO: 167968 - DNA, 25 bp, Homo sapien
cggtacctgactgttccgtgccgaa

SEQ ID NO: 167969 - DNA, 25 bp, Homo sapien
gccagagttcagcaaaggttcgctg

SEQ ID NO: 167970 - DNA, 25 bp, Homo sapien
gcggagccagttgcctccaagcgac

SEQ ID NO: 167971 - DNA, 25 bp, Homo sapien
tgcctgaggacctaccgggccaaca

SEQ ID NO: 167972 - DNA, 25 bp, Homo sapien
gttcacgcacccgtcggctcacccg

SEQ ID NO: 167973 - DNA, 25 bp, Homo sapien
gtccactcacaagcaccgtatcgtt

SEQ ID NO: 167974 - DNA, 25 bp, Homo sapien
gtatcgttcacgcacccgtcggctc

SEQ ID NO: 167975 - DNA, 25 bp, Homo sapien
tcacaagcaccgtatcgttcacgca

SEQ ID NO: 167976 - DNA, 25 bp, Homo sapien
acaagcaccgtatggttcacgcacc

SEQ ID NO: 167977 - DNA, 25 bp, Homo sapien
cgtccactcacaagcaccgtatggt

SEQ ID NO: 167978 - DNA, 25 bp, Homo sapien
tatcgttcacgcacccgtcggctca

SEQ ID NO: 167979 - DNA, 25 bp, Homo sapien
cactcacaagcaccgtatcgttcac

SEQ ID NO: 167980 - DNA, 25 bp, Homo sapien
ccgttgccgacgtgggtgttaagtg

SEQ ID NO: 167981 - DNA, 25 bp, Homo sapien
caagtcctgtcatttggctgcgggg

SEQ ID NO: 167982 - DNA, 25 bp, Homo sapien
cgctctccaccttcaccagggtcgg

SEQ ID NO: 167983 - DNA, 25 bp, Homo sapien
gcagcccggtctggcgcctgcagct

SEQ ID NO: 167984 - DNA, 25 bp, Homo sapien
cctgtcatttggctgcggggctccg

SEQ ID NO: 167985 - DNA, 25 bp, Homo sapien
ccgcgggactcggagaatctcgggg

SEQ ID NO: 167986 - DNA, 25 bp, Homo sapien
cggtccttggcggcgaaactgattt

SEQ ID NO: 167987 - DNA, 25 bp, Homo sapien
tgaatggagacttgctggctgccca

SEQ ID NO: 167988 - DNA, 25 bp, Homo sapien
ccgcccatcgtagccatgtttacgg

SEQ ID NO: 167989 - DNA, 25 bp, Homo sapien
cgccgccattcctcgtagtcaatgt

SEQ ID NO: 167990 - DNA, 25 bp, Homo sapien
ttcctcgtagtcaatgttgctgccg

SEQ ID NO: 167991 - DNA, 25 bp, Homo sapien
gctactatcgcgctcagcagctccg

SEQ ID NO: 167992 - DNA, 25 bp, Homo sapien
catcgtagccatgtttacggaggcc

SEQ ID NO: 167993 - DNA, 25 bp, Homo sapien
tagccatgtttacggaggcctgggc

SEQ ID NO: 167994 - DNA, 25 bp, Homo sapien
gaggcctgggcctacaggttctccc

SEQ ID NO: 167995 - DNA, 25 bp, Homo sapien
ggagctgctactatcgcgctcagca

SEQ ID NO: 167996 - DNA, 25 bp, Homo sapien
gcagcggctaaaagccttctggtgc

SEQ ID NO: 167997 - DNA, 25 bp, Homo sapien
aatggaaaagggctgggactcgcta

SEQ ID NO: 167998 - DNA, 25 bp, Homo sapien
ggctgggactcgctagaagtcgttc

SEQ ID NO: 167999 - DNA, 25 bp, Homo sapien
actcgctagaagtcgttctgaccta

SEQ ID NO: 168000 - DNA, 25 bp, Homo sapien
tagaagtcgttctgacctagcagcg

SEQ ID NO: 168001 - DNA, 25 bp, Homo sapien
gtcgttctgacctagcagcggctaa

SEQ ID NO: 168002 - DNA, 25 bp, Homo sapien
gatcattgcgctgggaatggaaaag

SEQ ID NO: 168003 - DNA, 25 bp, Homo sapien
tctgacctagcagcggctaaaagcc

SEQ ID NO: 168004 - DNA, 25 bp, Homo sapien
gctcctggcgccactaactacagta

SEQ ID NO: 168005 - DNA, 25 bp, Homo sapien
ccgctagaccatatgggaagtgcta

SEQ ID NO: 168006 - DNA, 25 bp, Homo sapien
gtgacccacctgacaagcataagtg

SEQ ID NO: 168007 - DNA, 25 bp, Homo sapien
cgctccgctgcaacagcaaagtttg

SEQ ID NO: 168008 - DNA, 25 bp, Homo sapien
tggccttgagccagcgagcctagaa

SEQ ID NO: 168009 - DNA, 25 bp, Homo sapien
cttgaggcttgagatcccgtccttc

SEQ ID NO: 168010 - DNA, 25 bp, Homo sapien
agcgcattcgcttctccagcaggca

SEQ ID NO: 168011 - DNA, 25 bp, Homo sapien
tgctatgagaaactgccgtgaccca

SEQ ID NO: 168012 - DNA, 25 bp, Homo sapien
agagacagcagcacgagcccattta

SEQ ID NO: 168013 - DNA, 25 bp, Homo sapien
cgagaccgagggaaagaatccgctt

SEQ ID NO: 168014 - DNA, 25 bp, Homo sapien
ccttgttttagctgacgacactcga

SEQ ID NO: 168015 - DNA, 25 bp, Homo sapien
gcctcccgttatcgtttagacagtg

SEQ ID NO: 168016 - DNA, 25 bp, Homo sapien
atatcgcgatccttctctggtgttc

SEQ ID NO: 168017 - DNA, 25 bp, Homo sapien
tttgtgaatcttcttgggccgcttc

SEQ ID NO: 168018 - DNA, 25 bp, Homo sapien
agcacattgcggttgcaggggaaca

SEQ ID NO: 168019 - DNA, 25 bp, Homo sapien
gctaagatagcagcgtctccgaaga

SEQ ID NO: 168020 - DNA, 25 bp, Homo sapien
ttggaaatcctcttgggccgcctcc

SEQ ID NO: 168021 - DNA, 25 bp, Homo sapien
atggtcgaaggcgtctgcaaacttg

SEQ ID NO: 168022 - DNA, 25 bp, Homo sapien
cagctgctagcacgttgcgattgca

SEQ ID NO: 168023 - DNA, 25 bp, Homo sapien
acaagccgcgtcctggaacagactg

SEQ ID NO: 168024 - DNA, 25 bp, Homo sapien
cacgggccgcacttctgaattcagc

SEQ ID NO: 168025 - DNA, 25 bp, Homo sapien
tgaattcagccctatcccgcggtga

SEQ ID NO: 168026 - DNA, 25 bp, Homo sapien
gtgaggcctccctttattgcataga

SEQ ID NO: 168027 - DNA, 25 bp, Homo sapien
ttgaagtagggacacgcagctgcta

SEQ ID NO: 168028 - DNA, 25 bp, Homo sapien
gcgtttagttagattgcacagcaca

SEQ ID NO: 168029 - DNA, 25 bp, Homo sapien
ctgccatcttgcagtgcgcgggaac

SEQ ID NO: 168030 - DNA, 25 bp, Homo sapien
ttcaaacgcatcttggtgagtggcc

SEQ ID NO: 168031 - DNA, 25 bp, Homo sapien
tgccgcccaaggagagcaacctctt

SEQ ID NO: 168032 - DNA, 25 bp, Homo sapien
agcacaaggcaaatccacgcggttg

SEQ ID NO: 168033 - DNA, 25 bp, Homo sapien
ctcctcggctaggtgttttgcgttc

SEQ ID NO: 168034 - DNA, 25 bp, Homo sapien
gccaggctgcccaattgcaactgta

SEQ ID NO: 168035 - DNA, 25 bp, Homo sapien
caccgctctttgtttacctcggagg

SEQ ID NO: 168036 - DNA, 25 bp, Homo sapien
agccagggaggctctgcatgcccac

SEQ ID NO: 168037 - DNA, 25 bp, Homo sapien
tataagatctaggaacccgagccgg

SEQ ID NO: 168038 - DNA, 25 bp, Homo sapien
ttaaagtctcggctctgcagatggc

SEQ ID NO: 168039 - DNA, 25 bp, Homo sapien
gcctggcgaaggctcagttttcttg

SEQ ID NO: 168040 - DNA, 25 bp, Homo sapien
tcttgtctgtaaaacggacttggta

SEQ ID NO: 168041 - DNA, 25 bp, Homo sapien
cggacttggtaatagaacgcacttc

SEQ ID NO: 168042 - DNA, 25 bp, Homo sapien
tccggccgccgaaggctataagatc

SEQ ID NO: 168043 - DNA, 25 bp, Homo sapien
cgcgcccagcagtcagctctggtga

SEQ ID NO: 168044 - DNA, 25 bp, Homo sapien
ggcggaaagagcctgcggagctcca

SEQ ID NO: 168045 - DNA, 25 bp, Homo sapien
ggcgtgcaacagtctgacctccggc

SEQ ID NO: 168046 - DNA, 25 bp, Homo sapien
gggctctggcaagcgcctcgcagtc

SEQ ID NO: 168047 - DNA, 25 bp, Homo sapien
ggcacctagccgagtccgccggaaa

SEQ ID NO: 168048 - DNA, 25 bp, Homo sapien
agtagaagccgggattgcatggcgc

SEQ ID NO: 168049 - DNA, 25 bp, Homo sapien
cgagttacctgtgtcggcccccgag

SEQ ID NO: 168050 - DNA, 25 bp, Homo sapien
ccgagccggcgtgcaacagtctgac

SEQ ID NO: 168051 - DNA, 25 bp, Homo sapien
ggccggctcagtagactcagcccgg

SEQ ID NO: 168052 - DNA, 25 bp, Homo sapien
tggaactctgattgggccgagcttg

SEQ ID NO: 168053 - DNA, 25 bp, Homo sapien
gtccggccacgcagagagaagcaac

SEQ ID NO: 168054 - DNA, 25 bp, Homo sapien
gacgcactccggctgcgacagatgc

SEQ ID NO: 168055 - DNA, 25 bp, Homo sapien
aacactccgcggtttggaactctga

SEQ ID NO: 168056 - DNA, 25 bp, Homo sapien
agaacagctcgctaggcgtggctcc

SEQ ID NO: 168057 - DNA, 25 bp, Homo sapien
cagagaagtttatggcgcgactgcg

SEQ ID NO: 168058 - DNA, 25 bp, Homo sapien
caggttccgcccttaaaagaatatg

SEQ ID NO: 168059 - DNA, 25 bp, Homo sapien
cgcgccacgctgaggttaatttatc

SEQ ID NO: 168060 - DNA, 25 bp, Homo sapien
gctgcgtcctgagcacccggcctgc

SEQ ID NO: 168061 - DNA, 25 bp, Homo sapien
tcgagctgcgcttccagggacttcg

SEQ ID NO: 168062 - DNA, 25 bp, Homo sapien
acttcgcgtttgtgcctggcgggct

SEQ ID NO: 168063 - DNA, 25 bp, Homo sapien
ttccagggacttcgcgtttgtgcct

SEQ ID NO: 168064 - DNA, 25 bp, Homo sapien
aggtgggcgagctgtcaccttcgat

SEQ ID NO: 168065 - DNA, 25 bp, Homo sapien
cgcttccagggacttcgcgtttgtg

SEQ ID NO: 168066 - DNA, 25 bp, Homo sapien
gcgagctgtcaccttcgatgggaca

SEQ ID NO: 168067 - DNA, 25 bp, Homo sapien
caccttcgatgggacagcccgggct

SEQ ID NO: 168068 - DNA, 25 bp, Homo sapien
tgctttgagaccgtggaatgtaggc

SEQ ID NO: 168069 - DNA, 25 bp, Homo sapien
caacttttcacttgctttgagaccg

SEQ ID NO: 168070 - DNA, 25 bp, Homo sapien
tgcgaggaccgtttcccggcttcac

SEQ ID NO: 168071 - DNA, 25 bp, Homo sapien
aaccgctggcaaaccgctggcgacg

SEQ ID NO: 168072 - DNA, 25 bp, Homo sapien
gcctttgtccggctgatcgaggctc

SEQ ID NO: 168073 - DNA, 25 bp, Homo sapien
cgcgatggagcctcagcacgtgcgc

SEQ ID NO: 168074 - DNA, 25 bp, Homo sapien
ccgcgccttataaggcctgacaggg

SEQ ID NO: 168075 - DNA, 25 bp, Homo sapien
gccgctttcggttccgcgccttata

SEQ ID NO: 168076 - DNA, 25 bp, Homo sapien
ttttattcagctggaaccgcgcggc

SEQ ID NO: 168077 - DNA, 25 bp, Homo sapien
aaaatgctcttctcttccgtgtgcg

SEQ ID NO: 168078 - DNA, 25 bp, Homo sapien
gcggagctgaacctcccggaaaatg

SEQ ID NO: 168079 - DNA, 25 bp, Homo sapien
aggggatcgctctttctgaacgaaa

SEQ ID NO: 168080 - DNA, 25 bp, Homo sapien
agcgcttcagcttagacacttcttg

SEQ ID NO: 168081 - DNA, 25 bp, Homo sapien
tccaggcaatctcggttagcgcttc

SEQ ID NO: 168082 - DNA, 25 bp, Homo sapien
ccaaggctttttgtctcgggtactg

SEQ ID NO: 168083 - DNA, 25 bp, Homo sapien
cgcatggctcgagtgtattgttttc

SEQ ID NO: 168084 - DNA, 25 bp, Homo sapien
agttcgactggcagaggcgggtgca

SEQ ID NO: 168085 - DNA, 25 bp, Homo sapien
gctgcgggacggattcccggcggct

SEQ ID NO: 168086 - DNA, 25 bp, Homo sapien
tgggaaaaagctgacgcgcagtcgc

SEQ ID NO: 168087 - DNA, 25 bp, Homo sapien
ggaaaaagctgacgcgcagtcgcga

SEQ ID NO: 168088 - DNA, 25 bp, Homo sapien
acgcgcagtcgcgagttcctactta

SEQ ID NO: 168089 - DNA, 25 bp, Homo sapien
gcgcagtcgcgagttcctacttagg

SEQ ID NO: 168090 - DNA, 25 bp, Homo sapien
gcagtcgcgagttcctacttaggga

SEQ ID NO: 168091 - DNA, 25 bp, Homo sapien
cagtcgcgagttcctacttagggaa

SEQ ID NO: 168092 - DNA, 25 bp, Homo sapien
ttgggaggacgttgcactttgttcc

SEQ ID NO: 168093 - DNA, 25 bp, Homo sapien
tccaaggcaacggaccaggaagcgc

SEQ ID NO: 168094 - DNA, 25 bp, Homo sapien
caggttcgtaggtcgccctcgaatt

SEQ ID NO: 168095 - DNA, 25 bp, Homo sapien
ctcgaatttaaagctcccaaggctg

SEQ ID NO: 168096 - DNA, 25 bp, Homo sapien
ctttaagtcatgtgaccagcggggc

SEQ ID NO: 168097 - DNA, 25 bp, Homo sapien
atttttctcgcgagaggcgcgctgc

SEQ ID NO: 168098 - DNA, 25 bp, Homo sapien
cgcggccgaaggaggaaactcaccg

SEQ ID NO: 168099 - DNA, 25 bp, Homo sapien
tggtgtgcgcacaggaacatttgca

SEQ ID NO: 168100 - DNA, 25 bp, Homo sapien
caccttttctggtagtgattgcata

SEQ ID NO: 168101 - DNA, 25 bp, Homo sapien
ttcgctgggaaacaacactggcctc

SEQ ID NO: 168102 - DNA, 25 bp, Homo sapien
ccggacgatgggtttgaatctcacc

SEQ ID NO: 168103 - DNA, 25 bp, Homo sapien
tgggccacccagagcttgcatattc

SEQ ID NO: 168104 - DNA, 25 bp, Homo sapien
agcgtcgccctgttcttctatttca

SEQ ID NO: 168105 - DNA, 25 bp, Homo sapien
acaccaagtacctgcgtggctcgga

SEQ ID NO: 168106 - DNA, 25 bp, Homo sapien
gcgccagcagagactacaccaagta

SEQ ID NO: 168107 - DNA, 25 bp, Homo sapien
atgagcgccttcacttgggcatcta

SEQ ID NO: 168108 - DNA, 25 bp, Homo sapien
gcagcggttttaacagctgagtttc

SEQ ID NO: 168109 - DNA, 25 bp, Homo sapien
gattccaaagtgcagaggcagcggt

SEQ ID NO: 168110 - DNA, 25 bp, Homo sapien
cttagcgagtctcaagatgggattc

SEQ ID NO: 168111 - DNA, 25 bp, Homo sapien
ctctattgcgggtgttcatggttca

SEQ ID NO: 168112 - DNA, 25 bp, Homo sapien
gagcccggagttcaccactctattg

SEQ ID NO: 168113 - DNA, 25 bp, Homo sapien
tctctctggtcttccacggggctca

SEQ ID NO: 168114 - DNA, 25 bp, Homo sapien
ttgttaaaatactcaccgcctctgg

SEQ ID NO: 168115 - DNA, 25 bp, Homo sapien
gtgcacgacgctctcccgcgaaggg

SEQ ID NO: 168116 - DNA, 25 bp, Homo sapien
cgggaacctcgcctttaatagcaca

SEQ ID NO: 168117 - DNA, 25 bp, Homo sapien
gtgcttgcacgggacacgttaccca

SEQ ID NO: 168118 - DNA, 25 bp, Homo sapien
taatagcacaacgagcgcagagtcc

SEQ ID NO: 168119 - DNA, 25 bp, Homo sapien
tccactggatctgcgagaagaaacc

SEQ ID NO: 168120 - DNA, 25 bp, Homo sapien
ccgcgctaactagtttgtccctacg

SEQ ID NO: 168121 - DNA, 25 bp, Homo sapien
ctccagttggcgagagtttgcgcta

SEQ ID NO: 168122 - DNA, 25 bp, Homo sapien
cctgtgagtgtgattcaagaacgtc

SEQ ID NO: 168123 - DNA, 25 bp, Homo sapien
gcccttggctcctttcggagtgtga

SEQ ID NO: 168124 - DNA, 25 bp, Homo sapien
acgcgtgtctcgcttggagaagctg

SEQ ID NO: 168125 - DNA, 25 bp, Homo sapien
cagcagagcggagtccgccaaggct

SEQ ID NO: 168126 - DNA, 25 bp, Homo sapien
tgaaaacctgaaagaagagggcagc

SEQ ID NO: 168127 - DNA, 25 bp, Homo sapien
tctcagtctagatccaggtgccgtg

SEQ ID NO: 168128 - DNA, 25 bp, Homo sapien
ctgcagtcgccgttccctctgctgc

SEQ ID NO: 168129 - DNA, 25 bp, Homo sapien
tgctcgtagggaccgaggcaaaatt

SEQ ID NO: 168130 - DNA, 25 bp, Homo sapien
tagggaccgaggcaaaattctacga

SEQ ID NO: 168131 - DNA, 25 bp, Homo sapien
aaggaggatcgaacgcgtgtctcgc

SEQ ID NO: 168132 - DNA, 25 bp, Homo sapien
actgcggtttagtcccgaggtcgct

SEQ ID NO: 168133 - DNA, 25 bp, Homo sapien
gttgtccgacaggaagtcccgaatg

SEQ ID NO: 168134 - DNA, 25 bp, Homo sapien
cgccgtagaccggtgtgcaaccgaa

SEQ ID NO: 168135 - DNA, 25 bp, Homo sapien
gcaaattgtcacagaggtcgccgta

SEQ ID NO: 168136 - DNA, 25 bp, Homo sapien
tgcccaatttcgttgaggctcagga

SEQ ID NO: 168137 - DNA, 25 bp, Homo sapien
gggccgagcttacgactccagctga

SEQ ID NO: 168138 - DNA, 25 bp, Homo sapien
ggctctggttcctgttcctctaacg

SEQ ID NO: 168139 - DNA, 25 bp, Homo sapien
gaccgaatcgcctctggtgtgcgtt

SEQ ID NO: 168140 - DNA, 25 bp, Homo sapien
tccatcctcagtatcagcgctgggg

SEQ ID NO: 168141 - DNA, 25 bp, Homo sapien
ctgattctctcatgggtcgctcttc

SEQ ID NO: 168142 - DNA, 25 bp, Homo sapien
cctgctccaagtaccgcaagtggca

SEQ ID NO: 168143 - DNA, 25 bp, Homo sapien
cctggctgcaggaacagacacctcg

SEQ ID NO: 168144 - DNA, 25 bp, Homo sapien
cacctcgctgaggagagacccagga

SEQ ID NO: 168145 - DNA, 25 bp, Homo sapien
tcgccggcactgacgactacatcta

SEQ ID NO: 168146 - DNA, 25 bp, Homo sapien
actacatctacctcagcctcgtggg

SEQ ID NO: 168147 - DNA, 25 bp, Homo sapien
agcccttctacaacgacttcgagcg

SEQ ID NO: 168148 - DNA, 25 bp, Homo sapien
actggagcgagtcggcgacatatgg

SEQ ID NO: 168149 - DNA, 25 bp, Homo sapien
gagcgagtcggcgacatatggggag

SEQ ID NO: 168150 - DNA, 25 bp, Homo sapien
ctcttcgggcacaggaaagccatca

SEQ ID NO: 168151 - DNA, 25 bp, Homo sapien
tcttcgggcacaggaaagccatcac

SEQ ID NO: 168152 - DNA, 25 bp, Homo sapien
cttcgggcacaggaaagccatcacc

SEQ ID NO: 168153 - DNA, 25 bp, Homo sapien
tggagcgagtcggcgacatatgggg

SEQ ID NO: 168154 - DNA, 25 bp, Homo sapien
ggagcgagtcggcgacatatgggga

SEQ ID NO: 168155 - DNA, 25 bp, Homo sapien
ctggagcgagtcggcgacatatggg

SEQ ID NO: 168156 - DNA, 25 bp, Homo sapien
gcgacatatggggagcacatctggt

SEQ ID NO: 168157 - DNA, 25 bp, Homo sapien
gacatatggggagcacatctggttc

SEQ ID NO: 168158 - DNA, 25 bp, Homo sapien
catatggggagcacatctggttcga

SEQ ID NO: 168159 - DNA, 25 bp, Homo sapien
atggggagcacatctggttcgagac

SEQ ID NO: 168160 - DNA, 25 bp, Homo sapien
ggggagcacatctggttcgagacca

SEQ ID NO: 168161 - DNA, 25 bp, Homo sapien
ggagcacatctggttcgagaccaac

SEQ ID NO: 168162 - DNA, 25 bp, Homo sapien
agcacatctggttcgagaccaacgt

SEQ ID NO: 168163 - DNA, 25 bp, Homo sapien
agaccaacgtgtccggggacttctg

SEQ ID NO: 168164 - DNA, 25 bp, Homo sapien
caggcacaagaaggccgtctcctca

SEQ ID NO: 168165 - DNA, 25 bp, Homo sapien
aggtgcccagcgtgcgcgtccgcat

SEQ ID NO: 168166 - DNA, 25 bp, Homo sapien
cggaacaggagcttcccggcaccgg

SEQ ID NO: 168167 - DNA, 25 bp, Homo sapien
gcagccgctaagtcagcatcgccta

SEQ ID NO: 168168 - DNA, 25 bp, Homo sapien
tgcccggcagctgggtgtcccatgt

SEQ ID NO: 168169 - DNA, 25 bp, Homo sapien
ctcagggtcaatgctggggccctga

SEQ ID NO: 168170 - DNA, 25 bp, Homo sapien
cagcgtttgaatcgcgcaggcacaa

SEQ ID NO: 168171 - DNA, 25 bp, Homo sapien
ccaggccttgtttagagtagctcca

SEQ ID NO: 168172 - DNA, 25 bp, Homo sapien
cagccgctttcggaataagatgttc

SEQ ID NO: 168173 - DNA, 25 bp, Homo sapien
acgagtctcgagaggccaacccaga

SEQ ID NO: 168174 - DNA, 25 bp, Homo sapien
ccctggagttccacgagtctcgaga

SEQ ID NO: 168175 - DNA, 25 bp, Homo sapien
agcctgggctttgacgcccacgtca

SEQ ID NO: 168176 - DNA, 25 bp, Homo sapien
gtcttcaacaactacttcagcctgg

SEQ ID NO: 168177 - DNA, 25 bp, Homo sapien
gaccgagatgaaggcgccaccgacc

SEQ ID NO: 168178 - DNA, 25 bp, Homo sapien
cccagagaaattcaacagccgcttt

SEQ ID NO: 168179 - DNA, 25 bp, Homo sapien
tggtacagctggaccgctgggacct

SEQ ID NO: 168180 - DNA, 25 bp, Homo sapien
tgccagagcagttgcgcatccaggt

SEQ ID NO: 168181 - DNA, 25 bp, Homo sapien
tacctcgaggtcattggcttcacca

SEQ ID NO: 168182 - DNA, 25 bp, Homo sapien
gtcgcgaggtggtgctcaccacatc

SEQ ID NO: 168183 - DNA, 25 bp, Homo sapien
acatccaaggccatcccggtgcagg

SEQ ID NO: 168184 - DNA, 25 bp, Homo sapien
atggcgagccctgcaagcttgcagc

SEQ ID NO: 168185 - DNA, 25 bp, Homo sapien
accatggtgcagaaggccaagcggc

SEQ ID NO: 168186 - DNA, 25 bp, Homo sapien
ccagcagccggtgccagagcagttg

SEQ ID NO: 168187 - DNA, 25 bp, Homo sapien
gcatgacgacggctacctcgaggtc

SEQ ID NO: 168188 - DNA, 25 bp, Homo sapien
cccagagatccttgatgcggtggag

SEQ ID NO: 168189 - DNA, 25 bp, Homo sapien
ggcagcactaccagatgatccagcg

SEQ ID NO: 168190 - DNA, 25 bp, Homo sapien
ctacctggagaaccggcagcactac

SEQ ID NO: 168191 - DNA, 25 bp, Homo sapien
aggacaccgagctggcggcctacct

SEQ ID NO: 168192 - DNA, 25 bp, Homo sapien
accagatgatccagcgggaggacca

SEQ ID NO: 168193 - DNA, 25 bp, Homo sapien
gggagacctgtttgcaccaagcagc

SEQ ID NO: 168194 - DNA, 25 bp, Homo sapien
gcaaggatgtggtccgctacctgct

SEQ ID NO: 168195 - DNA, 25 bp, Homo sapien
ctgtttgcaccaagcagcggccctg

SEQ ID NO: 168196 - DNA, 25 bp, Homo sapien
gtcgtgacttcaccaacagcctgca

SEQ ID NO: 168197 - DNA, 25 bp, Homo sapien
ggccactggcactacgtcgtgactt

SEQ ID NO: 168198 - DNA, 25 bp, Homo sapien
acgcccggattccacagcctgtgag

SEQ ID NO: 168199 - DNA, 25 bp, Homo sapien
acagcctgcagtactcgttaacgag

SEQ ID NO: 168200 - DNA, 25 bp, Homo sapien
tcgttaacgagatttcgccaggccc

SEQ ID NO: 168201 - DNA, 25 bp, Homo sapien
tggactaacgccaggattctcggtg

SEQ ID NO: 168202 - DNA, 25 bp, Homo sapien
gcagtcagcgctctgggattagaca

SEQ ID NO: 168203 - DNA, 25 bp, Homo sapien
cagctctattggctagtgcacctgc

SEQ ID NO: 168204 - DNA, 25 bp, Homo sapien
tccttgcagccctcacgaaaagttc

SEQ ID NO: 168205 - DNA, 25 bp, Homo sapien
tgggagcatttcagagcgcacaagc

SEQ ID NO: 168206 - DNA, 25 bp, Homo sapien
tgagagattacttccgtccgggctg

SEQ ID NO: 168207 - DNA, 25 bp, Homo sapien
agcattcggctacaggaccgcgaca

SEQ ID NO: 168208 - DNA, 25 bp, Homo sapien
tcaccggccgacaaacacaggaggg

SEQ ID NO: 168209 - DNA, 25 bp, Homo sapien
cctggactggttctacttgtgttct

SEQ ID NO: 168210 - DNA, 25 bp, Homo sapien
agccatggtggccaaacagcggatc

SEQ ID NO: 168211 - DNA, 25 bp, Homo sapien
agaaggctcgtttggtggaccatac

SEQ ID NO: 168212 - DNA, 25 bp, Homo sapien
gtcccgcggctgcttaacggcgaaa

SEQ ID NO: 168213 - DNA, 25 bp, Homo sapien
gggccattgcttcggcagaaaatgt

SEQ ID NO: 168214 - DNA, 25 bp, Homo sapien
tcggcagaaaatgtgaagggtccct

SEQ ID NO: 168215 - DNA, 25 bp, Homo sapien
tgaagggtccctgaaaaatactatg

SEQ ID NO: 168216 - DNA, 25 bp, Homo sapien
cacgtgcttacgtttaagggagtca

SEQ ID NO: 168217 - DNA, 25 bp, Homo sapien
taacggcgaaagcttcctatttgta

SEQ ID NO: 168218 - DNA, 25 bp, Homo sapien
tcggaggtttccacggcggcctcaa

SEQ ID NO: 168219 - DNA, 25 bp, Homo sapien
ggcggcctcaaaacactgggccatt

SEQ ID NO: 168220 - DNA, 25 bp, Homo sapien
ggcagcgccaagcaaatgtcgcctt

SEQ ID NO: 168221 - DNA, 25 bp, Homo sapien
ggcgccgcagacataaagccgggtc

SEQ ID NO: 168222 - DNA, 25 bp, Homo sapien
ttactagtgctcttcttcggctccc

SEQ ID NO: 168223 - DNA, 25 bp, Homo sapien
ctgtggtggttgttactagtgctct

SEQ ID NO: 168224 - DNA, 25 bp, Homo sapien
gcgactgcagccgacgccgttcaaa

SEQ ID NO: 168225 - DNA, 25 bp, Homo sapien
gggtgcgaccctctcttatcctctt

SEQ ID NO: 168226 - DNA, 25 bp, Homo sapien
ctcggcacacgtcctcggggaggaa

SEQ ID NO: 168227 - DNA, 25 bp, Homo sapien
cccggtacggtgagcccagcaacga

SEQ ID NO: 168228 - DNA, 25 bp, Homo sapien
tggagcaagcattaggcgtcacttc

SEQ ID NO: 168229 - DNA, 25 bp, Homo sapien
tttaccgtgaactacaaggctcagc

SEQ ID NO: 168230 - DNA, 25 bp, Homo sapien
ttacgtcatttctcggcgccgggaa

SEQ ID NO: 168231 - DNA, 25 bp, Homo sapien
gaaacctgccattcttcgctgctga

SEQ ID NO: 168232 - DNA, 25 bp, Homo sapien
ttcgctgctgatcgcgggattcttt

SEQ ID NO: 168233 - DNA, 25 bp, Homo sapien
tgacgttcgtggatagactcatatc

SEQ ID NO: 168234 - DNA, 25 bp, Homo sapien
caccgcggatggcaagagacctgat

SEQ ID NO: 168235 - DNA, 25 bp, Homo sapien
gccctgctcgctgaagaaagtcgga

SEQ ID NO: 168236 - DNA, 25 bp, Homo sapien
ccacgtccagggacaaactgggagc

SEQ ID NO: 168237 - DNA, 25 bp, Homo sapien
gcgccgtaggaaacgccagtctgtg

SEQ ID NO: 168238 - DNA, 25 bp, Homo sapien
cagtctgtgccgcagtgtacgtaga

SEQ ID NO: 168239 - DNA, 25 bp, Homo sapien
tagaggcgctatgagcccgagtttc

SEQ ID NO: 168240 - DNA, 25 bp, Homo sapien
aaactgggagccgtgactgtcaggc

SEQ ID NO: 168241 - DNA, 25 bp, Homo sapien
agaagctgacgagtgactcccgaca

SEQ ID NO: 168242 - DNA, 25 bp, Homo sapien
accacaggggcgctttccagtgaag

SEQ ID NO: 168243 - DNA, 25 bp, Homo sapien
tcatttacaagggacgctgggcacg

SEQ ID NO: 168244 - DNA, 25 bp, Homo sapien
cacgcccactcaagaaatttccgaa

SEQ ID NO: 168245 - DNA, 25 bp, Homo sapien
agtttgtctgcaacagcgcgccgta

SEQ ID NO: 168246 - DNA, 25 bp, Homo sapien
cgagcgcggggaactcgacttgacc

SEQ ID NO: 168247 - DNA, 25 bp, Homo sapien
cgcggcttgtcctttgttccggacg

SEQ ID NO: 168248 - DNA, 25 bp, Homo sapien
ttctggcaggtaaggaacgccggct

SEQ ID NO: 168249 - DNA, 25 bp, Homo sapien
tggcggcgtgttcctcttttcctcg

SEQ ID NO: 168250 - DNA, 25 bp, Homo sapien
cgccgtactgacgtagcagtgcgca

SEQ ID NO: 168251 - DNA, 25 bp, Homo sapien
tcggttcccagtgttctggcaggta

SEQ ID NO: 168252 - DNA, 25 bp, Homo sapien
ggagcgctcgctgtctttgagttcc

SEQ ID NO: 168253 - DNA, 25 bp, Homo sapien
cgctgtctttgagttcctgctgcca

SEQ ID NO: 168254 - DNA, 25 bp, Homo sapien
ctttgagttcctgctgccagagccg

SEQ ID NO: 168255 - DNA, 25 bp, Homo sapien
gccgcgcccgccagagagacaaagg

SEQ ID NO: 168256 - DNA, 25 bp, Homo sapien
gcccgccagagagacaaaggccagg

SEQ ID NO: 168257 - DNA, 25 bp, Homo sapien
tctggccgcagcactttccagcgcc

SEQ ID NO: 168258 - DNA, 25 bp, Homo sapien
aaactcttctagctctgcgggtgcg

SEQ ID NO: 168259 - DNA, 25 bp, Homo sapien
cggtcctcacacagaaaactcttct

SEQ ID NO: 168260 - DNA, 25 bp, Homo sapien
ccgcatctgtgggattttgttaaag

SEQ ID NO: 168261 - DNA, 25 bp, Homo sapien
gtactgtgcggcgtgtaaaccaccg

SEQ ID NO: 168262 - DNA, 25 bp, Homo sapien
cagctgtactgtgcggcgtgtaaac

SEQ ID NO: 168263 - DNA, 25 bp, Homo sapien
gcccagaactctgtgggaatgcagc

SEQ ID NO: 168264 - DNA, 25 bp, Homo sapien
ggacgcccagaactctgtgggaatg

SEQ ID NO: 168265 - DNA, 25 bp, Homo sapien
aggtggcgccgattccggacgccca

SEQ ID NO: 168266 - DNA, 25 bp, Homo sapien
cggcgtgtaaaccaccgcatctgtg

SEQ ID NO: 168267 - DNA, 25 bp, Homo sapien
tccagctgtggtcctttacccggcg

SEQ ID NO: 168268 - DNA, 25 bp, Homo sapien
gcgggcctatttccaggatcagctc

SEQ ID NO: 168269 - DNA, 25 bp, Homo sapien
gctccgcctccagttttctagaaaa

SEQ ID NO: 168270 - DNA, 25 bp, Homo sapien
ctccgtagcacaccagagctgggcg

SEQ ID NO: 168271 - DNA, 25 bp, Homo sapien
agaacatctcatcgtctgccggata

SEQ ID NO: 168272 - DNA, 25 bp, Homo sapien
actcacggctgatgaggtcccggta

SEQ ID NO: 168273 - DNA, 25 bp, Homo sapien
cgcgatctcccggatcttgtagatg

SEQ ID NO: 168274 - DNA, 25 bp, Homo sapien
gcgctagcttagcacgagcctgaaa

SEQ ID NO: 168275 - DNA, 25 bp, Homo sapien
ggtcccggtagataatcatgatggc

SEQ ID NO: 168276 - DNA, 25 bp, Homo sapien
cgctgagcgagcgacaacagcggca

SEQ ID NO: 168277 - DNA, 25 bp, Homo sapien
gagacgctgagcgagcgacaacagc

SEQ ID NO: 168278 - DNA, 25 bp, Homo sapien
tggaagctctggttgtcctcagggg

SEQ ID NO: 168279 - DNA, 25 bp, Homo sapien
cgtggtcgtactggaagctctggtt

SEQ ID NO: 168280 - DNA, 25 bp, Homo sapien
cctcgtggtcgtactggaagctctg

SEQ ID NO: 168281 - DNA, 25 bp, Homo sapien
gcctcgtggtcgtactggaagctct

SEQ ID NO: 168282 - DNA, 25 bp, Homo sapien
aaggcctcgtggtcgtactggaagc

SEQ ID NO: 168283 - DNA, 25 bp, Homo sapien
tgagcgagcgacaacagcggcagct

SEQ ID NO: 168284 - DNA, 25 bp, Homo sapien
ctcggatctgaatgaccctggaaca

SEQ ID NO: 168285 - DNA, 25 bp, Homo sapien
tgtaacaagaacctgaggccgctgg

SEQ ID NO: 168286 - DNA, 25 bp, Homo sapien
gcgattccgaatgtggtgtgccctc

SEQ ID NO: 168287 - DNA, 25 bp, Homo sapien
ggtgtgccctctcccacagtgcgaa

SEQ ID NO: 168288 - DNA, 25 bp, Homo sapien
ctcaggctgccgtttgaatgaacgc

SEQ ID NO: 168289 - DNA, 25 bp, Homo sapien
ctcgttagcagacgcggagatgcca

SEQ ID NO: 168290 - DNA, 25 bp, Homo sapien
caacccggactcagttgtaacaaga

SEQ ID NO: 168291 - DNA, 25 bp, Homo sapien
aaggaggctcctcggaaatcgcagc

SEQ ID NO: 168292 - DNA, 25 bp, Homo sapien
ccggagccttgcaccgaacgttttg

SEQ ID NO: 168293 - DNA, 25 bp, Homo sapien
ccagacgaggcgtcctgtcagccga

SEQ ID NO: 168294 - DNA, 25 bp, Homo sapien
caggctgtcaggcttcgctctgcct

SEQ ID NO: 168295 - DNA, 25 bp, Homo sapien
ggcagagaacttgccggtgccagct

SEQ ID NO: 168296 - DNA, 25 bp, Homo sapien
cagacggactcggtattggagctga

SEQ ID NO: 168297 - DNA, 25 bp, Homo sapien
aaagctggctctctgggatcggaga

SEQ ID NO: 168298 - DNA, 25 bp, Homo sapien
atagtcgtacccatttaaagccacg

SEQ ID NO: 168299 - DNA, 25 bp, Homo sapien
cccgactctaattctgcctggggac

SEQ ID NO: 168300 - DNA, 25 bp, Homo sapien
gatggcgagccagcactcctatcca

SEQ ID NO: 168301 - DNA, 25 bp, Homo sapien
ctcagcgacgagatgttcgtgttcc

SEQ ID NO: 168302 - DNA, 25 bp, Homo sapien
cgacctggagctggactacaacccg

SEQ ID NO: 168303 - DNA, 25 bp, Homo sapien
tgggtaaatgagaactgccgcctgc

SEQ ID NO: 168304 - DNA, 25 bp, Homo sapien
gtgaagaaggaccacgtcgccctgc

SEQ ID NO: 168305 - DNA, 25 bp, Homo sapien
gccctgcggaagatggtcagcaaca

SEQ ID NO: 168306 - DNA, 25 bp, Homo sapien
tcccgaggctccacaacttgtacag

SEQ ID NO: 168307 - DNA, 25 bp, Homo sapien
ctgcacaaagacagcgcgtccctgg

SEQ ID NO: 168308 - DNA, 25 bp, Homo sapien
gctcccttcgcaagtgcagtccgga

SEQ ID NO: 168309 - DNA, 25 bp, Homo sapien
ggccgctaggaggaccgcctcaaaa

SEQ ID NO: 168310 - DNA, 25 bp, Homo sapien
cgccctctaggcgtaaggttccatg

SEQ ID NO: 168311 - DNA, 25 bp, Homo sapien
ccggaagtcagaggtttgccctgtt

SEQ ID NO: 168312 - DNA, 25 bp, Homo sapien
ttcctctgtagacccaggcagcttc

SEQ ID NO: 168313 - DNA, 25 bp, Homo sapien
cttccggccgtcagattagtcgtca

SEQ ID NO: 168314 - DNA, 25 bp, Homo sapien
agtgcgcagacaccacccttcgtgg

SEQ ID NO: 168315 - DNA, 25 bp, Homo sapien
gcctctccagggtcaagcgaaactg

SEQ ID NO: 168316 - DNA, 25 bp, Homo sapien
cgtcgcccagatggaagaaactctg

SEQ ID NO: 168317 - DNA, 25 bp, Homo sapien
ggggccaccgtagctctctagaagc

SEQ ID NO: 168318 - DNA, 25 bp, Homo sapien
cgcgctcccggtaacagcagaaagg

SEQ ID NO: 168319 - DNA, 25 bp, Homo sapien
tctctgctgggcacaaacctctctg

SEQ ID NO: 168320 - DNA, 25 bp, Homo sapien
ctgctctgagcgaccctaagatacc

SEQ ID NO: 168321 - DNA, 25 bp, Homo sapien
tagtctctgagaatcgccctgcgta

SEQ ID NO: 168322 - DNA, 25 bp, Homo sapien
ctgcgtaaaagtgtcctgaggtccc

SEQ ID NO: 168323 - DNA, 25 bp, Homo sapien
acgactttggctgtgttgaggacga

SEQ ID NO: 168324 - DNA, 25 bp, Homo sapien
tcactcaggaaacagaaaaggcttc

SEQ ID NO: 168325 - DNA, 25 bp, Homo sapien
gaatttacaccaatgacccgccgtg

SEQ ID NO: 168326 - DNA, 25 bp, Homo sapien
gcgggtcagcaagcccgacgaattt

SEQ ID NO: 168327 - DNA, 25 bp, Homo sapien
tcgaggtgtgttgactcctacagca

SEQ ID NO: 168328 - DNA, 25 bp, Homo sapien
tctccaggcagagtagatactgacc

SEQ ID NO: 168329 - DNA, 25 bp, Homo sapien
tggtgtcacaccacataaaggagga

SEQ ID NO: 168330 - DNA, 25 bp, Homo sapien
atgctcagagctcatccctggtgtc

SEQ ID NO: 168331 - DNA, 25 bp, Homo sapien
tcctacagcaaagggcacggatccg

SEQ ID NO: 168332 - DNA, 25 bp, Homo sapien
tctttgcatcgaggcgtagcccatc

SEQ ID NO: 168333 - DNA, 25 bp, Homo sapien
cggccctttcggtagctactctgca

SEQ ID NO: 168334 - DNA, 25 bp, Homo sapien
ggctgaacctgagcgccaggaaatt

SEQ ID NO: 168335 - DNA, 25 bp, Homo sapien
cacgacctctcggacacggtgcagg

SEQ ID NO: 168336 - DNA, 25 bp, Homo sapien
ttccctaacgcggtggacagtcgga

SEQ ID NO: 168337 - DNA, 25 bp, Homo sapien
atcggcccgttgtctcccgaagaag

SEQ ID NO: 168338 - DNA, 25 bp, Homo sapien
ctccaaccagttcaagccgtctttg

SEQ ID NO: 168339 - DNA, 25 bp, Homo sapien
ggcactcagcccgagctgccgtttt

SEQ ID NO: 168340 - DNA, 25 bp, Homo sapien
cgggttacactaggttggaggctca

SEQ ID NO: 168341 - DNA, 25 bp, Homo sapien
tcttacctacggtggcggagtgacc

SEQ ID NO: 168342 - DNA, 25 bp, Homo sapien
gccgcaggaaggctgacaacgtcca

SEQ ID NO: 168343 - DNA, 25 bp, Homo sapien
gctgcgggtctaggaaagtctttct

SEQ ID NO: 168344 - DNA, 25 bp, Homo sapien
ctacttcacattttcgcgcggtggc

SEQ ID NO: 168345 - DNA, 25 bp, Homo sapien
gccagctccctccttaaaatgcgta

SEQ ID NO: 168346 - DNA, 25 bp, Homo sapien
ctagtaacgcgttgaggccagctcc

SEQ ID NO: 168347 - DNA, 25 bp, Homo sapien
tgcctagagcagcaggtccacactc

SEQ ID NO: 168348 - DNA, 25 bp, Homo sapien
agcgcacttgttcccaggtgtgcca

SEQ ID NO: 168349 - DNA, 25 bp, Homo sapien
tcagactcaggtctgcgccgtttcc

SEQ ID NO: 168350 - DNA, 25 bp, Homo sapien
cccttctaatggataggaccgtgca

SEQ ID NO: 168351 - DNA, 25 bp, Homo sapien
tcctggtgaggagactcccttctaa

SEQ ID NO: 168352 - DNA, 25 bp, Homo sapien
gaccgtgcagacgataaagcccaca

SEQ ID NO: 168353 - DNA, 25 bp, Homo sapien
cgggcgtggaactgtccaccgtaca

SEQ ID NO: 168354 - DNA, 25 bp, Homo sapien
ccgcgatttgcggagcgcacttgtt

SEQ ID NO: 168355 - DNA, 25 bp, Homo sapien
aagcgtctctttctacgctcggcca

SEQ ID NO: 168356 - DNA, 25 bp, Homo sapien
cctcgggttaacactgcagccgcta

SEQ ID NO: 168357 - DNA, 25 bp, Homo sapien
cactagcctgccgtagaacatggag

SEQ ID NO: 168358 - DNA, 25 bp, Homo sapien
cagaaaaatgtcactgccggcgaag

SEQ ID NO: 168359 - DNA, 25 bp, Homo sapien
gccttgcagggcacccagaaaaatg

SEQ ID NO: 168360 - DNA, 25 bp, Homo sapien
gctcgtagtcctggcgagcagcact

SEQ ID NO: 168361 - DNA, 25 bp, Homo sapien
cgcaaacatgggctcgctcgtagtc

SEQ ID NO: 168362 - DNA, 25 bp, Homo sapien
gaggccgccatttctgagtcggacc

SEQ ID NO: 168363 - DNA, 25 bp, Homo sapien
aggcattacctgagcagcagcccgc

SEQ ID NO: 168364 - DNA, 25 bp, Homo sapien
aggcacgctgcccttcggaaggaaa

SEQ ID NO: 168365 - DNA, 25 bp, Homo sapien
aggtctttgctagctgggtctttcc

SEQ ID NO: 168366 - DNA, 25 bp, Homo sapien
acgcattacgcaccgcggacagctg

SEQ ID NO: 168367 - DNA, 25 bp, Homo sapien
tctcgctttgatttcggcgcctccg

SEQ ID NO: 168368 - DNA, 25 bp, Homo sapien
tgaccagctgcaagcatccgcgttg

SEQ ID NO: 168369 - DNA, 25 bp, Homo sapien
ggcagtttccaactccctggaggtc

SEQ ID NO: 168370 - DNA, 25 bp, Homo sapien
agagggacgaactcacgccgtgctt

SEQ ID NO: 168371 - DNA, 25 bp, Homo sapien
ctgacgctgcgtcctttcttgcgcg

SEQ ID NO: 168372 - DNA, 25 bp, Homo sapien
ggacaccggcgccatctgttgggcc

SEQ ID NO: 168373 - DNA, 25 bp, Homo sapien
cagaccgcgcgagttcttatcatta

SEQ ID NO: 168374 - DNA, 25 bp, Homo sapien
ccgagaacgagcacaaacgcagggc

SEQ ID NO: 168375 - DNA, 25 bp, Homo sapien
ctcggaaggcggaagagtcacccag

SEQ ID NO: 168376 - DNA, 25 bp, Homo sapien
tcaccactcgaagacgcagccattt

SEQ ID NO: 168377 - DNA, 25 bp, Homo sapien
agccgctctcgtgtgctgttaccac

SEQ ID NO: 168378 - DNA, 25 bp, Homo sapien
tccaagtcctcaagcgcagacagca

SEQ ID NO: 168379 - DNA, 25 bp, Homo sapien
cgcattacctagacaggacctccaa

SEQ ID NO: 168380 - DNA, 25 bp, Homo sapien
acttggcttgttcgatctggggacc

SEQ ID NO: 168381 - DNA, 25 bp, Homo sapien
gaattcccggtcgtttgtgcagtcc

SEQ ID NO: 168382 - DNA, 25 bp, Homo sapien
ttggctaattgtgccgaattcccgg

SEQ ID NO: 168383 - DNA, 25 bp, Homo sapien
tgggtccgcagctcctttgtaagga

SEQ ID NO: 168384 - DNA, 25 bp, Homo sapien
gttcaactccgctctggcccagaag

SEQ ID NO: 168385 - DNA, 25 bp, Homo sapien
ccatggtgaaggtgacgttcaactc

SEQ ID NO: 168386 - DNA, 25 bp, Homo sapien
acctggttgggagcgaattcagaac

SEQ ID NO: 168387 - DNA, 25 bp, Homo sapien
tagtcccttgtacccggcgaactca

SEQ ID NO: 168388 - DNA, 25 bp, Homo sapien
gaggggtctcggcttcaacttgaca

SEQ ID NO: 168389 - DNA, 25 bp, Homo sapien
gcagttccctcttgtgaggctcgga

SEQ ID NO: 168390 - DNA, 25 bp, Homo sapien
cgtctgcagaatggtgacaggattc

SEQ ID NO: 168391 - DNA, 25 bp, Homo sapien
ctgcctctcgtcaggtgagcgagca

SEQ ID NO: 168392 - DNA, 25 bp, Homo sapien
cggaaaggcgtcatgccgcccaaaa

SEQ ID NO: 168393 - DNA, 25 bp, Homo sapien
ggtttcccagtttaattcctcatga

SEQ ID NO: 168394 - DNA, 25 bp, Homo sapien
actagccagatattccctgcggggc

SEQ ID NO: 168395 - DNA, 25 bp, Homo sapien
gggcccgagagtcttccctatcaga

SEQ ID NO: 168396 - DNA, 25 bp, Homo sapien
gcatctctactttccgagcgcagcg

SEQ ID NO: 168397 - DNA, 25 bp, Homo sapien
gtcgtccctatcgatgacccttcgt

SEQ ID NO: 168398 - DNA, 25 bp, Homo sapien
cactgtcctccgtgcgcggagtgtc

SEQ ID NO: 168399 - DNA, 25 bp, Homo sapien
ctggcgtcactaaccaaggcgtgcc

SEQ ID NO: 168400 - DNA, 25 bp, Homo sapien
gtgccctggtcctggtcgtccctat

SEQ ID NO: 168401 - DNA, 25 bp, Homo sapien
ccgagttcctcctgtcgggcaaact

SEQ ID NO: 168402 - DNA, 25 bp, Homo sapien
tgtcgggcaaactccgccctgtctg

SEQ ID NO: 168403 - DNA, 25 bp, Homo sapien
ctgtctgtgccttgctgcttggcca

SEQ ID NO: 168404 - DNA, 25 bp, Homo sapien
ttgtcctggagacacgctgacgagc

SEQ ID NO: 168405 - DNA, 25 bp, Homo sapien
ccactgctgtgttagggaagcgccc

SEQ ID NO: 168406 - DNA, 25 bp, Homo sapien
gcgcccgctgttggaaatgtaattc

SEQ ID NO: 168407 - DNA, 25 bp, Homo sapien
tcggaacgttcaacccgtgactctc

SEQ ID NO: 168408 - DNA, 25 bp, Homo sapien
cgtgactctccctaagtctttaatc

SEQ ID NO: 168409 - DNA, 25 bp, Homo sapien
ctttaatctgcggtgtcgtgaggtc

SEQ ID NO: 168410 - DNA, 25 bp, Homo sapien
tgaggtcgcagttgtcctggagaca

SEQ ID NO: 168411 - DNA, 25 bp, Homo sapien
cgcccggttcccactgctgtgttag

SEQ ID NO: 168412 - DNA, 25 bp, Homo sapien
cgccgcggtcaacttcggccaggta

SEQ ID NO: 168413 - DNA, 25 bp, Homo sapien
gtacctgaccgtggtgatcttcacc

SEQ ID NO: 168414 - DNA, 25 bp, Homo sapien
gccgcaagtcctcaggtagggcctc

SEQ ID NO: 168415 - DNA, 25 bp, Homo sapien
aacgatgtctacgtgtacggcatgc

SEQ ID NO: 168416 - DNA, 25 bp, Homo sapien
cggccgaggtggtagacatctacta

SEQ ID NO: 168417 - DNA, 25 bp, Homo sapien
gcacgggacttgcaggatggattct

SEQ ID NO: 168418 - DNA, 25 bp, Homo sapien
ctccgcagtacgactggtgctcctg

SEQ ID NO: 168419 - DNA, 25 bp, Homo sapien
gacatctactacgagggcgaccagg

SEQ ID NO: 168420 - DNA, 25 bp, Homo sapien
ttgccgcagctagtacacctggatg

SEQ ID NO: 168421 - DNA, 25 bp, Homo sapien
tgcacgttcgtctttgctaaccggg

SEQ ID NO: 168422 - DNA, 25 bp, Homo sapien
cccttgttctcctgcttggtcgtga

SEQ ID NO: 168423 - DNA, 25 bp, Homo sapien
cctgcgccgcacttgtgacttgctt

SEQ ID NO: 168424 - DNA, 25 bp, Homo sapien
ggtctcgcgcaaggcacttttttgt

SEQ ID NO: 168425 - DNA, 25 bp, Homo sapien
aagggacctgttgctgccttacatg

SEQ ID NO: 168426 - DNA, 25 bp, Homo sapien
acgtttccttttgcagctcagcagc

SEQ ID NO: 168427 - DNA, 25 bp, Homo sapien
cccgactatgccttgagggtcaaaa

SEQ ID NO: 168428 - DNA, 25 bp, Homo sapien
cgggacctggggtactagatttatg

SEQ ID NO: 168429 - DNA, 25 bp, Homo sapien
gatgatcaccctggaacgacgccaa

SEQ ID NO: 168430 - DNA, 25 bp, Homo sapien
agtcaaacttttcgcgctattcctg

SEQ ID NO: 168431 - DNA, 25 bp, Homo sapien
gaaacttcaggcaggacgctccctc

SEQ ID NO: 168432 - DNA, 25 bp, Homo sapien
cagccacaccagacgtgggagctta

SEQ ID NO: 168433 - DNA, 25 bp, Homo sapien
agcggcctccgagcagatgatcacc

SEQ ID NO: 168434 - DNA, 25 bp, Homo sapien
actcccgccagcagttttacgcatg

SEQ ID NO: 168435 - DNA, 25 bp, Homo sapien
cgcagttccaaaacggcttcgccta

SEQ ID NO: 168436 - DNA, 25 bp, Homo sapien
ctcccggctccgtagtaagcatggc

SEQ ID NO: 168437 - DNA, 25 bp, Homo sapien
tggtccctcgggtgaaacagaaagc

SEQ ID NO: 168438 - DNA, 25 bp, Homo sapien
cttctgcctcagaacggcgtgactc

SEQ ID NO: 168439 - DNA, 25 bp, Homo sapien
gaccggtctactagtcgggcacctg

SEQ ID NO: 168440 - DNA, 25 bp, Homo sapien
cgagcctagccaggacacgcttgcg

SEQ ID NO: 168441 - DNA, 25 bp, Homo sapien
gccgccgaacttgaacgcttttctg

SEQ ID NO: 168442 - DNA, 25 bp, Homo sapien
ccctctgtttgatcctgcgtggctg

SEQ ID NO: 168443 - DNA, 25 bp, Homo sapien
gtggctgcttccagtacctggcagt

SEQ ID NO: 168444 - DNA, 25 bp, Homo sapien
tgctgcacatgaccgcgctcagcgt

SEQ ID NO: 168445 - DNA, 25 bp, Homo sapien
ggacatgcggaccaccaccaacttg

SEQ ID NO: 168446 - DNA, 25 bp, Homo sapien
gcatggccgtgtccgacctactcat

SEQ ID NO: 168447 - DNA, 25 bp, Homo sapien
ctgccggtcccttcttgttcctggt

SEQ ID NO: 168448 - DNA, 25 bp, Homo sapien
tgtgggtcaccaccgcctacttctt

SEQ ID NO: 168449 - DNA, 25 bp, Homo sapien
tcagcatcctctacgggctcatcgg

SEQ ID NO: 168450 - DNA, 25 bp, Homo sapien
aacgtggtgaccgtgatgctgatcg

SEQ ID NO: 168451 - DNA, 25 bp, Homo sapien
caccaacttgtacctgggcagcatg

SEQ ID NO: 168452 - DNA, 25 bp, Homo sapien
ctggggctctctctcttcagctgct

SEQ ID NO: 168453 - DNA, 25 bp, Homo sapien
ttggcccagttctgctcagtcatca

SEQ ID NO: 168454 - DNA, 25 bp, Homo sapien
gctagcagtttgaagtccgcggctg

SEQ ID NO: 168455 - DNA, 25 bp, Homo sapien
ggtcacgccctgcttgagcttcttc

SEQ ID NO: 168456 - DNA, 25 bp, Homo sapien
gcccaggtggtagatctccagcatg

SEQ ID NO: 168457 - DNA, 25 bp, Homo sapien
cccacctcgaacagcgtcttgaaga

SEQ ID NO: 168458 - DNA, 25 bp, Homo sapien
tcttctcttccatgcgcacgatgtg

SEQ ID NO: 168459 - DNA, 25 bp, Homo sapien
gagatgaagcagtccaccgtgttgg

SEQ ID NO: 168460 - DNA, 25 bp, Homo sapien
ttacagctcggtgcttaactcggtc

SEQ ID NO: 168461 - DNA, 25 bp, Homo sapien
tatgacgtcacacgaggagccctga

SEQ ID NO: 168462 - DNA, 25 bp, Homo sapien
cgcacgtgacgctttcctgtatttc

SEQ ID NO: 168463 - DNA, 25 bp, Homo sapien
accgtcgaaggtcagcgcatttttc

SEQ ID NO: 168464 - DNA, 25 bp, Homo sapien
tcatgtctgactgggagaggtttcc

SEQ ID NO: 168465 - DNA, 25 bp, Homo sapien
tgtgcgtctcccgtcattgaactcc

SEQ ID NO: 168466 - DNA, 25 bp, Homo sapien
ggccgttgccttacagttgctgaga

SEQ ID NO: 168467 - DNA, 25 bp, Homo sapien
cctgaacatttccaaacggcgcttt

SEQ ID NO: 168468 - DNA, 25 bp, Homo sapien
cgccgagtctctgaggcgtgaacca

SEQ ID NO: 168469 - DNA, 25 bp, Homo sapien
ccgacagttcctctagccgggaggt

SEQ ID NO: 168470 - DNA, 25 bp, Homo sapien
tgaaaccaaggcaccgccgtggctg

SEQ ID NO: 168471 - DNA, 25 bp, Homo sapien
gtgcgaccaatcaatgggctcctgg

SEQ ID NO: 168472 - DNA, 25 bp, Homo sapien
aagccgagagcgctagcagtcaatc

SEQ ID NO: 168473 - DNA, 25 bp, Homo sapien
ctcagctacagtgcgcgagacaagc

SEQ ID NO: 168474 - DNA, 25 bp, Homo sapien
gatgccggcctctcgactacgagta

SEQ ID NO: 168475 - DNA, 25 bp, Homo sapien
ctcctcccatgtagtgatcggttta

SEQ ID NO: 168476 - DNA, 25 bp, Homo sapien
ggcacttccgggatctcgctatccg

SEQ ID NO: 168477 - DNA, 25 bp, Homo sapien
ggccggctagtgactcaaagcgaca

SEQ ID NO: 168478 - DNA, 25 bp, Homo sapien
gcagctgcagcacagtcatggccca

SEQ ID NO: 168479 - DNA, 25 bp, Homo sapien
ttccacaggtggctctgactgccca

SEQ ID NO: 168480 - DNA, 25 bp, Homo sapien
gtgcttccaccacaaccgatgtcaa

SEQ ID NO: 168481 - DNA, 25 bp, Homo sapien
cgctcaccggtaaaccaggacagtg

SEQ ID NO: 168482 - DNA, 25 bp, Homo sapien
aagagctgggtctcacgttcacgga

SEQ ID NO: 168483 - DNA, 25 bp, Homo sapien
gctggacgaacttggctcaccactc

SEQ ID NO: 168484 - DNA, 25 bp, Homo sapien
agcgaccgagaaacttggctccctg

SEQ ID NO: 168485 - DNA, 25 bp, Homo sapien
agaggcttttgtgtctgaggaacca

SEQ ID NO: 168486 - DNA, 25 bp, Homo sapien
acgctacctgcgaggtcagctgctg

SEQ ID NO: 168487 - DNA, 25 bp, Homo sapien
acccgacttctttagaagccgattg

SEQ ID NO: 168488 - DNA, 25 bp, Homo sapien
tagaagccgattggccgtctcaggc

SEQ ID NO: 168489 - DNA, 25 bp, Homo sapien
ccatgaaatccggtggctgctgccg

SEQ ID NO: 168490 - DNA, 25 bp, Homo sapien
ctgctgccgggacttagaggctttt

SEQ ID NO: 168491 - DNA, 25 bp, Homo sapien
ctccaatgggcgcagaagtgcgagc

SEQ ID NO: 168492 - DNA, 25 bp, Homo sapien
tcgtagcagagccagatgagcgccc

SEQ ID NO: 168493 - DNA, 25 bp, Homo sapien
cttaccagcgcgaagtgcaccagcg

SEQ ID NO: 168494 - DNA, 25 bp, Homo sapien
tgcaccagcgcgtcgtagcagagcc

SEQ ID NO: 168495 - DNA, 25 bp, Homo sapien
agggtctaggcgatggcacttacca

SEQ ID NO: 168496 - DNA, 25 bp, Homo sapien
cccactctctgggatggggagtgca

SEQ ID NO: 168497 - DNA, 25 bp, Homo sapien
ggccagctcgctgcaaaaagccgca

SEQ ID NO: 168498 - DNA, 25 bp, Homo sapien
ctcagctaacagacttcctgcagca

SEQ ID NO: 168499 - DNA, 25 bp, Homo sapien
aggcgcctctcagctaacagacttc

SEQ ID NO: 168500 - DNA, 25 bp, Homo sapien
cccgagacgtggacgcagcaaggcc

SEQ ID NO: 168501 - DNA, 25 bp, Homo sapien
gggcgctgaccgtttctgcgattcc

SEQ ID NO: 168502 - DNA, 25 bp, Homo sapien
ttctgcgattcctggttccgctcgg

SEQ ID NO: 168503 - DNA, 25 bp, Homo sapien
gcagagagacccactgcctggagtc

SEQ ID NO: 168504 - DNA, 25 bp, Homo sapien
gggactccgatcctagaggccgcag

SEQ ID NO: 168505 - DNA, 25 bp, Homo sapien
tcctagaggccgcaggagttacctc

SEQ ID NO: 168506 - DNA, 25 bp, Homo sapien
aggagttacctcaggtgggctctga

SEQ ID NO: 168507 - DNA, 25 bp, Homo sapien
cgcctcgagcatgcccgagacgtgg

SEQ ID NO: 168508 - DNA, 25 bp, Homo sapien
atcgcggcccttgttcttgaagctc

SEQ ID NO: 168509 - DNA, 25 bp, Homo sapien
ggagtaattctccacgcctagtgag

SEQ ID NO: 168510 - DNA, 25 bp, Homo sapien
gcggcggtcgtcaactacagttccc

SEQ ID NO: 168511 - DNA, 25 bp, Homo sapien
gccggacctggcgacttttactgcc

SEQ ID NO: 168512 - DNA, 25 bp, Homo sapien
tgcccgttggttctcgggatgaccc

SEQ ID NO: 168513 - DNA, 25 bp, Homo sapien
agagcacgttctgtgacgcctccga

SEQ ID NO: 168514 - DNA, 25 bp, Homo sapien
gaagctcttgatgcggtggttctcc

SEQ ID NO: 168515 - DNA, 25 bp, Homo sapien
atcatgccacgatccgcctggagta

SEQ ID NO: 168516 - DNA, 25 bp, Homo sapien
tgtggagactgtccgccctctagtg

SEQ ID NO: 168517 - DNA, 25 bp, Homo sapien
gccgcgccggcacgcagagaacctc

SEQ ID NO: 168518 - DNA, 25 bp, Homo sapien
agagaacctcgcccgctcggcatta

SEQ ID NO: 168519 - DNA, 25 bp, Homo sapien
cccgctcggcattactgtctggaaa

SEQ ID NO: 168520 - DNA, 25 bp, Homo sapien
ctcggcattactgtctggaaacggc

SEQ ID NO: 168521 - DNA, 25 bp, Homo sapien
cgcccgcagccggagtagccctcgc

SEQ ID NO: 168522 - DNA, 25 bp, Homo sapien
gttttttccttgacagcgcggccga

SEQ ID NO: 168523 - DNA, 25 bp, Homo sapien
ggttgtggagactgtccgccctcta

SEQ ID NO: 168524 - DNA, 25 bp, Homo sapien
ggctggtttccctcacatgctaaat

SEQ ID NO: 168525 - DNA, 25 bp, Homo sapien
ggtcccggcctcgacattatttcta

SEQ ID NO: 168526 - DNA, 25 bp, Homo sapien
gcccgaggtccggacttgtctatgt

SEQ ID NO: 168527 - DNA, 25 bp, Homo sapien
cggccggcatctccttcagagggat

SEQ ID NO: 168528 - DNA, 25 bp, Homo sapien
agggcccttacccatgtgctgcgtg

SEQ ID NO: 168529 - DNA, 25 bp, Homo sapien
tggggaccctctgaccctgaaggtc

SEQ ID NO: 168530 - DNA, 25 bp, Homo sapien
ttgaacacagaaccgggcccaggtg

SEQ ID NO: 168531 - DNA, 25 bp, Homo sapien
ccaggggttttcctatgcagaattt

SEQ ID NO: 168532 - DNA, 25 bp, Homo sapien
gcttctggtcttgagatgcggatga

SEQ ID NO: 168533 - DNA, 25 bp, Homo sapien
accatcttaattgcacggcagctta

SEQ ID NO: 168534 - DNA, 25 bp, Homo sapien
acggcagcttaactgggagactttc

SEQ ID NO: 168535 - DNA, 25 bp, Homo sapien
ccgtctgggcaaacggcgtccactt

SEQ ID NO: 168536 - DNA, 25 bp, Homo sapien
agccgcgagtccattttggggctgt

SEQ ID NO: 168537 - DNA, 25 bp, Homo sapien
ctagccggaggtcggagataagtac

SEQ ID NO: 168538 - DNA, 25 bp, Homo sapien
gggtggtcctcgaaccttcagcgag

SEQ ID NO: 168539 - DNA, 25 bp, Homo sapien
tgtgtctgtggtccagaaaacctgc

SEQ ID NO: 168540 - DNA, 25 bp, Homo sapien
ggaaactctttcctggggcacctca

SEQ ID NO: 168541 - DNA, 25 bp, Homo sapien
tggcgctatactctcggacaggtta

SEQ ID NO: 168542 - DNA, 25 bp, Homo sapien
tgaggctcctcattcaaattcgtta

SEQ ID NO: 168543 - DNA, 25 bp, Homo sapien
gccgactgccctttgctccaagtaa

SEQ ID NO: 168544 - DNA, 25 bp, Homo sapien
agtcccgctctgctacttcttcagg

SEQ ID NO: 168545 - DNA, 25 bp, Homo sapien
aggttatcctgtctctcccgctaga

SEQ ID NO: 168546 - DNA, 25 bp, Homo sapien
ccatgactccgggtcctgaattttc

SEQ ID NO: 168547 - DNA, 25 bp, Homo sapien
ttcgcgattaagtgagagtagaccc

SEQ ID NO: 168548 - DNA, 25 bp, Homo sapien
ggtcactcgctccatctggtcctgg

SEQ ID NO: 168549 - DNA, 25 bp, Homo sapien
agaacttgttttattgcgctcgagg

SEQ ID NO: 168550 - DNA, 25 bp, Homo sapien
gcaggcacacggatgcttattttta

SEQ ID NO: 168551 - DNA, 25 bp, Homo sapien
acacacttaatttagccggcaggca

SEQ ID NO: 168552 - DNA, 25 bp, Homo sapien
ttcacacgtgcggtgctgcttcacg

SEQ ID NO: 168553 - DNA, 25 bp, Homo sapien
ttaccacgcttgagagggacgccta

SEQ ID NO: 168554 - DNA, 25 bp, Homo sapien
atctggtcctggagacgagatgcca

SEQ ID NO: 168555 - DNA, 25 bp, Homo sapien
gctggcgcccaacgaagattttaac

SEQ ID NO: 168556 - DNA, 25 bp, Homo sapien
ggcccacagaatttttgctccagtg

SEQ ID NO: 168557 - DNA, 25 bp, Homo sapien
cctcctgggattctaggcccacaga

SEQ ID NO: 168558 - DNA, 25 bp, Homo sapien
cccgggtcttgagctgaaattccag

SEQ ID NO: 168559 - DNA, 25 bp, Homo sapien
ccggggcgcatcagttgcaatagct

SEQ ID NO: 168560 - DNA, 25 bp, Homo sapien
actgtcaggacacgcgcttttcgcc

SEQ ID NO: 168561 - DNA, 25 bp, Homo sapien
cccacacctgcgagaggcagagata

SEQ ID NO: 168562 - DNA, 25 bp, Homo sapien
cggcgaattcgtttctgcgccaatt

SEQ ID NO: 168563 - DNA, 25 bp, Homo sapien
gctcgctcctggtttccttccaatt

SEQ ID NO: 168564 - DNA, 25 bp, Homo sapien
ctcggggctctgtgacagactccaa

SEQ ID NO: 168565 - DNA, 25 bp, Homo sapien
gtgtctgtacatcacatgacccggc

SEQ ID NO: 168566 - DNA, 25 bp, Homo sapien
acggattcgagcgaagcttatttcc

SEQ ID NO: 168567 - DNA, 25 bp, Homo sapien
tacctataaatagcgctcaccgcgc

SEQ ID NO: 168568 - DNA, 25 bp, Homo sapien
gtaacgactgctgggatcgcgtccc

SEQ ID NO: 168569 - DNA, 25 bp, Homo sapien
accgagtcgacagcgtcggacttcc

SEQ ID NO: 168570 - DNA, 25 bp, Homo sapien
ccctgcagtcaagggtggtgacgtc

SEQ ID NO: 168571 - DNA, 25 bp, Homo sapien
cgctcacacaatgggacgcgtcggg

SEQ ID NO: 168572 - DNA, 25 bp, Homo sapien
cgctcttccaggcattgcggtgcta

SEQ ID NO: 168573 - DNA, 25 bp, Homo sapien
gcacacgacctaagtacacagcgcg

SEQ ID NO: 168574 - DNA, 25 bp, Homo sapien
tttcagcaaagctccgaggaagttg

SEQ ID NO: 168575 - DNA, 25 bp, Homo sapien
ctcgattttttgtgcagtttcagca

SEQ ID NO: 168576 - DNA, 25 bp, Homo sapien
aaagccgctgttcctgagcttcatg

SEQ ID NO: 168577 - DNA, 25 bp, Homo sapien
tgacgaaatgataggccttgccata

SEQ ID NO: 168578 - DNA, 25 bp, Homo sapien
tgaaactgagctccctaccggccta

SEQ ID NO: 168579 - DNA, 25 bp, Homo sapien
ccggagctacagttggaagaatata

SEQ ID NO: 168580 - DNA, 25 bp, Homo sapien
gctccttcggcagtggaaacctcta

SEQ ID NO: 168581 - DNA, 25 bp, Homo sapien
cgccgcgaggcgaaaagaactatcc

SEQ ID NO: 168582 - DNA, 25 bp, Homo sapien
ggtctgcagccctttaacactggta

SEQ ID NO: 168583 - DNA, 25 bp, Homo sapien
tcggcaagtcgtcttcggaactggc

SEQ ID NO: 168584 - DNA, 25 bp, Homo sapien
gctctggccgctggataagatactc

SEQ ID NO: 168585 - DNA, 25 bp, Homo sapien
aatgttgccagtgttcggtcccgac

SEQ ID NO: 168586 - DNA, 25 bp, Homo sapien
tgaggctgcagatcacatgtcctta

SEQ ID NO: 168587 - DNA, 25 bp, Homo sapien
cgtcccagagtttccaagtttgtca

SEQ ID NO: 168588 - DNA, 25 bp, Homo sapien
gggtgcgggacacaatctggcccaa

SEQ ID NO: 168589 - DNA, 25 bp, Homo sapien
cgcgcaggggaaaccgcttctagag

SEQ ID NO: 168590 - DNA, 25 bp, Homo sapien
ccgcttctagagcttcgcggggaag

SEQ ID NO: 168591 - DNA, 25 bp, Homo sapien
tctgtattctagttgtggatctttc

SEQ ID NO: 168592 - DNA, 25 bp, Homo sapien
ggatctttcgggtctctgtcagtta

SEQ ID NO: 168593 - DNA, 25 bp, Homo sapien
gctcggagccgtaaaaccttgcctg

SEQ ID NO: 168594 - DNA, 25 bp, Homo sapien
tctggcccaaggtcgttcaaatcgg

SEQ ID NO: 168595 - DNA, 25 bp, Homo sapien
tgtcagttaacagaagcctttgggg

SEQ ID NO: 168596 - DNA, 25 bp, Homo sapien
tgcaaggtctgcagagccaccattt

SEQ ID NO: 168597 - DNA, 25 bp, Homo sapien
gcgctgctcggtgtgcacttgaaaa

SEQ ID NO: 168598 - DNA, 25 bp, Homo sapien
cgctgaccagctccgaagtcgagtc

SEQ ID NO: 168599 - DNA, 25 bp, Homo sapien
aatgctgagcgttgcttcttccctc

SEQ ID NO: 168600 - DNA, 25 bp, Homo sapien
cgtgttctgacccaaagctgcctga

SEQ ID NO: 168601 - DNA, 25 bp, Homo sapien
tctgccttcgcctgaagtccgaatc

SEQ ID NO: 168602 - DNA, 25 bp, Homo sapien
ggggtcgccaaggtcacattttcta

SEQ ID NO: 168603 - DNA, 25 bp, Homo sapien
ccagggctttgatgagaaaacgtgc

SEQ ID NO: 168604 - DNA, 25 bp, Homo sapien
gttgctcctccaagaccaatccggg

SEQ ID NO: 168605 - DNA, 25 bp, Homo sapien
ccaggcgcctgatttgctggagata

SEQ ID NO: 168606 - DNA, 25 bp, Homo sapien
acgaggcccggatgttgatctttta

SEQ ID NO: 168607 - DNA, 25 bp, Homo sapien
tgtgacaccacctaccaatcgctgg

SEQ ID NO: 168608 - DNA, 25 bp, Homo sapien
acgacccggcgagcaacttcacgga

SEQ ID NO: 168609 - DNA, 25 bp, Homo sapien
tggcgtcacgcccaaaggaacaaac

SEQ ID NO: 168610 - DNA, 25 bp, Homo sapien
gaaagccgcgtacccgttgaagctg

SEQ ID NO: 168611 - DNA, 25 bp, Homo sapien
accggcctgaatctggaggacagca

SEQ ID NO: 168612 - DNA, 25 bp, Homo sapien
gcgcgcgatgagcacctaccactag

SEQ ID NO: 168613 - DNA, 25 bp, Homo sapien
cacgtcatagcaagccgcggttttc

SEQ ID NO: 168614 - DNA, 25 bp, Homo sapien
ggcagcacgtgttcctggtttcagg

SEQ ID NO: 168615 - DNA, 25 bp, Homo sapien
gcaggctggtctcggaaacgaaacg

SEQ ID NO: 168616 - DNA, 25 bp, Homo sapien
tggtttcaggtaaacacgcgcgccc

SEQ ID NO: 168617 - DNA, 25 bp, Homo sapien
cccgcattttggtcacacgtcatag

SEQ ID NO: 168618 - DNA, 25 bp, Homo sapien
acgtaacacgagcagcaggctggtc

SEQ ID NO: 168619 - DNA, 25 bp, Homo sapien
atgggattctctctgggacagctgg

SEQ ID NO: 168620 - DNA, 25 bp, Homo sapien
acggggaccctcctgatccgtgcga

SEQ ID NO: 168621 - DNA, 25 bp, Homo sapien
gaccctcctgatccgtgcgacggga

SEQ ID NO: 168622 - DNA, 25 bp, Homo sapien
cgaggaggacgactgcgtggactcg

SEQ ID NO: 168623 - DNA, 25 bp, Homo sapien
ctcctgatccgtgcgacgggaccgg

SEQ ID NO: 168624 - DNA, 25 bp, Homo sapien
gtgcaccatggacccaaaggcgggc

SEQ ID NO: 168625 - DNA, 25 bp, Homo sapien
ccgggacgtgcaccatggacccaaa

SEQ ID NO: 168626 - DNA, 25 bp, Homo sapien
cccgggtcacgacggcgcccgcaag

SEQ ID NO: 168627 - DNA, 25 bp, Homo sapien
ctggcgcttgagttgtttgccggct

SEQ ID NO: 168628 - DNA, 25 bp, Homo sapien
cggcaaggaaatcgtgcgcttcacc

SEQ ID NO: 168629 - DNA, 25 bp, Homo sapien
cgacaacgtcctggcgtggatccac

SEQ ID NO: 168630 - DNA, 25 bp, Homo sapien
caagggcgctcagccagcgctggct

SEQ ID NO: 168631 - DNA, 25 bp, Homo sapien
cagcgctggctgtggtgctgttcct

SEQ ID NO: 168632 - DNA, 25 bp, Homo sapien
gagcagatcctgcagctgcaccgca

SEQ ID NO: 168633 - DNA, 25 bp, Homo sapien
tgcagccaggacttcttcacgctgg

SEQ ID NO: 168634 - DNA, 25 bp, Homo sapien
cggcccgtgcactacggcaaggaaa

SEQ ID NO: 168635 - DNA, 25 bp, Homo sapien
tgcgcttcaccgtctactgtcgcta

SEQ ID NO: 168636 - DNA, 25 bp, Homo sapien
tcacactccggttttaactcgggca

SEQ ID NO: 168637 - DNA, 25 bp, Homo sapien
ctcggtcagtcggtaccttcatgaa

SEQ ID NO: 168638 - DNA, 25 bp, Homo sapien
ggtcaggccctatcctttcattagc

SEQ ID NO: 168639 - DNA, 25 bp, Homo sapien
tcgccgttctactggtcaggcccta

SEQ ID NO: 168640 - DNA, 25 bp, Homo sapien
aacactgtctgggtctttcctccgg

SEQ ID NO: 168641 - DNA, 25 bp, Homo sapien
gcagacgtgtctatcaggaacagta

SEQ ID NO: 168642 - DNA, 25 bp, Homo sapien
gcccagatggctgcgctggttcata

SEQ ID NO: 168643 - DNA, 25 bp, Homo sapien
tgaaggtctctaccgcgcctttggc

SEQ ID NO: 168644 - DNA, 25 bp, Homo sapien
tatacgcgcgttcacgggaggttaa

SEQ ID NO: 168645 - DNA, 25 bp, Homo sapien
aggcctcttctctttccggtcttgc

SEQ ID NO: 168646 - DNA, 25 bp, Homo sapien
cgcacgcgcattgggataccagatc

SEQ ID NO: 168647 - DNA, 25 bp, Homo sapien
gactactgccattcggccgcgagga

SEQ ID NO: 168648 - DNA, 25 bp, Homo sapien
tccgaggacaggtatggactactgc

SEQ ID NO: 168649 - DNA, 25 bp, Homo sapien
ggcgtcatcagcgtctccgaggaca

SEQ ID NO: 168650 - DNA, 25 bp, Homo sapien
atatggccgtgatcgtgcccaaaga

SEQ ID NO: 168651 - DNA, 25 bp, Homo sapien
gtctctgtctcaacctgtgtccgtg

SEQ ID NO: 168652 - DNA, 25 bp, Homo sapien
ccggttatgtaagagccgcggcttc

SEQ ID NO: 168653 - DNA, 25 bp, Homo sapien
ccttacttggtgtactcgcgcagcc

SEQ ID NO: 168654 - DNA, 25 bp, Homo sapien
cttggcgaaccacacgacgctgcgg

SEQ ID NO: 168655 - DNA, 25 bp, Homo sapien
cgccctgacatcatcccggttatgt

SEQ ID NO: 168656 - DNA, 25 bp, Homo sapien
gcacccgtcgttctggacacgctta

SEQ ID NO: 168657 - DNA, 25 bp, Homo sapien
tcagcgccgtttagagaacaccgtc

SEQ ID NO: 168658 - DNA, 25 bp, Homo sapien
tctcctcggggtcgaaatcgggcat

SEQ ID NO: 168659 - DNA, 25 bp, Homo sapien
ttccttgctccaccggtaaggcaag

SEQ ID NO: 168660 - DNA, 25 bp, Homo sapien
cgtgccggaagcagagacacatctt

SEQ ID NO: 168661 - DNA, 25 bp, Homo sapien
agacacatcttggagccgtggagga

SEQ ID NO: 168662 - DNA, 25 bp, Homo sapien
tgatttcatcccttgtgcggcagaa

SEQ ID NO: 168663 - DNA, 25 bp, Homo sapien
cgattctacggcacctccctggtga

SEQ ID NO: 168664 - DNA, 25 bp, Homo sapien
atcccaggtcctaacagggcggctg

SEQ ID NO: 168665 - DNA, 25 bp, Homo sapien
aagctgccaagctctgtccgaaaca

SEQ ID NO: 168666 - DNA, 25 bp, Homo sapien
tccgtcttacttgccacctggttgc

SEQ ID NO: 168667 - DNA, 25 bp, Homo sapien
cctcagctgcacttttgatttcatc

SEQ ID NO: 168668 - DNA, 25 bp, Homo sapien
gtgcgccacgccgaacactagtcta

SEQ ID NO: 168669 - DNA, 25 bp, Homo sapien
cctcggcatattctattggctggaa

SEQ ID NO: 168670 - DNA, 25 bp, Homo sapien
cgcagccctcttcacacggatgatt

SEQ ID NO: 168671 - DNA, 25 bp, Homo sapien
gcgcggctcggctctaaagcaaaca

SEQ ID NO: 168672 - DNA, 25 bp, Homo sapien
ccgaattcttctctgatctggctca

SEQ ID NO: 168673 - DNA, 25 bp, Homo sapien
cctggaaaatcgatccgctgtgcgc

SEQ ID NO: 168674 - DNA, 25 bp, Homo sapien
ccgacactgtactgggatctcacgc

SEQ ID NO: 168675 - DNA, 25 bp, Homo sapien
acagtgttctctgccgtgccagtgc

SEQ ID NO: 168676 - DNA, 25 bp, Homo sapien
agcccaggacgctaggccttttctg

SEQ ID NO: 168677 - DNA, 25 bp, Homo sapien
gttgccatagagaccgacgcgccct

SEQ ID NO: 168678 - DNA, 25 bp, Homo sapien
acctccgcgtgtggagcgttgccat

SEQ ID NO: 168679 - DNA, 25 bp, Homo sapien
gccaacgaagcgtcccggaaggatc

SEQ ID NO: 168680 - DNA, 25 bp, Homo sapien
accagtccacctcgaggcagggtca

SEQ ID NO: 168681 - DNA, 25 bp, Homo sapien
ttctgagagagacgcatacggactt

SEQ ID NO: 168682 - DNA, 25 bp, Homo sapien
ccgcccaagtggcaccaaagggtgg

SEQ ID NO: 168683 - DNA, 25 bp, Homo sapien
gtgagtggcaagacgcttacccgta

SEQ ID NO: 168684 - DNA, 25 bp, Homo sapien
cactgttcttggagtagccgggcct

SEQ ID NO: 168685 - DNA, 25 bp, Homo sapien
tttaaagctgttgttccacgttgcg

SEQ ID NO: 168686 - DNA, 25 bp, Homo sapien
agccgggcctacgaagagcacgttt

SEQ ID NO: 168687 - DNA, 25 bp, Homo sapien
tccttggcctggcaaccggcggctt

SEQ ID NO: 168688 - DNA, 25 bp, Homo sapien
cggcgaccctagtccactccttggc

SEQ ID NO: 168689 - DNA, 25 bp, Homo sapien
tcgttctagaggcagcccgccaggg

SEQ ID NO: 168690 - DNA, 25 bp, Homo sapien
ttctcctggaaaagccgctccgccc

SEQ ID NO: 168691 - DNA, 25 bp, Homo sapien
gcacgttttaaagctgttgttccac

SEQ ID NO: 168692 - DNA, 25 bp, Homo sapien
ctgctggcacatggctcccgtgagg

SEQ ID NO: 168693 - DNA, 25 bp, Homo sapien
ttcaaaaggaaatcacaaattcagc

SEQ ID NO: 168694 - DNA, 25 bp, Homo sapien
aaataaggataactcagaatttcaa

SEQ ID NO: 168695 - DNA, 25 bp, Homo sapien
aaaataaggataactcagaatttca

SEQ ID NO: 168696 - DNA, 25 bp, Homo sapien
tgggaaaaataaggataactcagaa

SEQ ID NO: 168697 - DNA, 25 bp, Homo sapien
atgggaaaaataaggataactcaga

SEQ ID NO: 168698 - DNA, 25 bp, Homo sapien
ctggcacatggctcccgtgaggagg

SEQ ID NO: 168699 - DNA, 25 bp, Homo sapien
tcaaaaggaaatcacaaattcagct

SEQ ID NO: 168700 - DNA, 25 bp, Homo sapien
gaggtagaaacaccgagactctacc

SEQ ID NO: 168701 - DNA, 25 bp, Homo sapien
tctcctccgtttccggtctggcttg

SEQ ID NO: 168702 - DNA, 25 bp, Homo sapien
accaggagcgcaactgtaacagtgc

SEQ ID NO: 168703 - DNA, 25 bp, Homo sapien
gagcgcaactgtaacagtgcgtccc

SEQ ID NO: 168704 - DNA, 25 bp, Homo sapien
gaaacacaaagccaaccaggagcgc

SEQ ID NO: 168705 - DNA, 25 bp, Homo sapien
cgagactctaccaacaccgcggaaa

SEQ ID NO: 168706 - DNA, 25 bp, Homo sapien
gaggatcctaaaccgccgagaccgc

SEQ ID NO: 168707 - DNA, 25 bp, Homo sapien
ctggcctaggaggatcctaaaccgc

SEQ ID NO: 168708 - DNA, 25 bp, Homo sapien
gctctcgcgagttcccacttaggga

SEQ ID NO: 168709 - DNA, 25 bp, Homo sapien
cttagacccaatcagagggtgagtg

SEQ ID NO: 168710 - DNA, 25 bp, Homo sapien
gctgcccgcttagacccaatcagag

SEQ ID NO: 168711 - DNA, 25 bp, Homo sapien
gagagttttaatttgtcctccctgc

SEQ ID NO: 168712 - DNA, 25 bp, Homo sapien
ggtaaaagctgacgcgctctcgcga

SEQ ID NO: 168713 - DNA, 25 bp, Homo sapien
cgtgggtaaaagctgacgcgctctc

SEQ ID NO: 168714 - DNA, 25 bp, Homo sapien
tctcctgctgccgtcgggaaggcag

SEQ ID NO: 168715 - DNA, 25 bp, Homo sapien
cgactagcccaggatgtagtgagcc

SEQ ID NO: 168716 - DNA, 25 bp, Homo sapien
caggccgaaaggtccctcgagcatc

SEQ ID NO: 168717 - DNA, 25 bp, Homo sapien
gctggttccttcattccgctggttc

SEQ ID NO: 168718 - DNA, 25 bp, Homo sapien
cccgccatgttgaagcctgagcaga

SEQ ID NO: 168719 - DNA, 25 bp, Homo sapien
tccacaggcgaagtcaaccgaaacg

SEQ ID NO: 168720 - DNA, 25 bp, Homo sapien
agaaagctcgcctgacccttatagg

SEQ ID NO: 168721 - DNA, 25 bp, Homo sapien
gcagggcattgggacaagctgctcc

SEQ ID NO: 168722 - DNA, 25 bp, Homo sapien
tccgagcaccctcttgaggcagtga

SEQ ID NO: 168723 - DNA, 25 bp, Homo sapien
caactcatatcctggggaaaccatg

SEQ ID NO: 168724 - DNA, 25 bp, Homo sapien
tcttacctttcgagactgacgggca

SEQ ID NO: 168725 - DNA, 25 bp, Homo sapien
gagggcgcttcttacctttcgagac

SEQ ID NO: 168726 - DNA, 25 bp, Homo sapien
gcacacagccggaccaggggtttaa

SEQ ID NO: 168727 - DNA, 25 bp, Homo sapien
gaaacgcgcggccagccaaggtcct

SEQ ID NO: 168728 - DNA, 25 bp, Homo sapien
acaggaaacaggcaggaaacgcgcg

SEQ ID NO: 168729 - DNA, 25 bp, Homo sapien
cgccagctgctggacaggaaacagg

SEQ ID NO: 168730 - DNA, 25 bp, Homo sapien
cggcgaggtagagcgccaagcatcc

SEQ ID NO: 168731 - DNA, 25 bp, Homo sapien
aggagcctccaagagtctcgcggca

SEQ ID NO: 168732 - DNA, 25 bp, Homo sapien
ttctcctcgccatcgtagattcgca

SEQ ID NO: 168733 - DNA, 25 bp, Homo sapien
ctggaaccacgccaaggaagtcgac

SEQ ID NO: 168734 - DNA, 25 bp, Homo sapien
caaggaagtcgactgccggatcgcc

SEQ ID NO: 168735 - DNA, 25 bp, Homo sapien
ttctcccgggcactgcagctgtgcg

SEQ ID NO: 168736 - DNA, 25 bp, Homo sapien
aaggttggcagacgccctaccttct

SEQ ID NO: 168737 - DNA, 25 bp, Homo sapien
gctggtccaaacgaagcggtccatg

SEQ ID NO: 168738 - DNA, 25 bp, Homo sapien
caccagggtctcgttgatctccagg

SEQ ID NO: 168739 - DNA, 25 bp, Homo sapien
gcctgctgggaaccgtgccaaagtt

SEQ ID NO: 168740 - DNA, 25 bp, Homo sapien
cagatcggtgtttacgtcctcgtca

SEQ ID NO: 168741 - DNA, 25 bp, Homo sapien
acacacgctcgtggtacgccagatc

SEQ ID NO: 168742 - DNA, 25 bp, Homo sapien
tcttggccttgtggaacggatcata

SEQ ID NO: 168743 - DNA, 25 bp, Homo sapien
ggcgcagtccgcattcaaaggtgaa

SEQ ID NO: 168744 - DNA, 25 bp, Homo sapien
ccgacccgaggctacgatgagcaca

SEQ ID NO: 168745 - DNA, 25 bp, Homo sapien
tgtgtcccatctcggttgtttgtca

SEQ ID NO: 168746 - DNA, 25 bp, Homo sapien
gtctgccttcctccaaggactgtga

SEQ ID NO: 168747 - DNA, 25 bp, Homo sapien
cctcgtcagtgaacgcgtcgatgtt

SEQ ID NO: 168748 - DNA, 25 bp, Homo sapien
tgccctgccatttctgtgagggccc

SEQ ID NO: 168749 - DNA, 25 bp, Homo sapien
agccggagcagcttgtcccaatgcc

SEQ ID NO: 168750 - DNA, 25 bp, Homo sapien
cctataagggtcaggcgagctttct

SEQ ID NO: 168751 - DNA, 25 bp, Homo sapien
ttcggttgacttcgcctgtggaaac

SEQ ID NO: 168752 - DNA, 25 bp, Homo sapien
aggcttcaacatggcgggccgtttc

SEQ ID NO: 168753 - DNA, 25 bp, Homo sapien
ggagctctgctcaggcttcaacatg

SEQ ID NO: 168754 - DNA, 25 bp, Homo sapien
tcactgcctcaagagggtgctcgga

SEQ ID NO: 168755 - DNA, 25 bp, Homo sapien
gaaccagcggaatgaaggaaccagc

SEQ ID NO: 168756 - DNA, 25 bp, Homo sapien
tgcttcaccggcgaaacggagcttt

SEQ ID NO: 168757 - DNA, 25 bp, Homo sapien
acggagctttgcttcgaagctaagc

SEQ ID NO: 168758 - DNA, 25 bp, Homo sapien
cgaagctaagctttcggtgaattta

SEQ ID NO: 168759 - DNA, 25 bp, Homo sapien
taaaacgtttggtggcagtgggtca

SEQ ID NO: 168760 - DNA, 25 bp, Homo sapien
gggacatcggcgacaccacaaacct

SEQ ID NO: 168761 - DNA, 25 bp, Homo sapien
ccaaggacgtgtgttggtccagccc

SEQ ID NO: 168762 - DNA, 25 bp, Homo sapien
atggctgtggtcgttgtcctctgta

SEQ ID NO: 168763 - DNA, 25 bp, Homo sapien
aggtcccgatctcctagttcctttg

SEQ ID NO: 168764 - DNA, 25 bp, Homo sapien
agttcccaccaggtaggcactgggg

SEQ ID NO: 168765 - DNA, 25 bp, Homo sapien
ggaggacaacagttcccaccaggta

SEQ ID NO: 168766 - DNA, 25 bp, Homo sapien
gcccgcggccaaatgacacgacttg

SEQ ID NO: 168767 - DNA, 25 bp, Homo sapien
caggttaaggagacatttcccactt

SEQ ID NO: 168768 - DNA, 25 bp, Homo sapien
tcgcaaggaacaggttaaggagaca

SEQ ID NO: 168769 - DNA, 25 bp, Homo sapien
ttgccgccaaggaacccggacaggc

SEQ ID NO: 168770 - DNA, 25 bp, Homo sapien
agggcgcccggatgcaaaccagttt

SEQ ID NO: 168771 - DNA, 25 bp, Homo sapien
aggccgatgaccctgagattctcca

SEQ ID NO: 168772 - DNA, 25 bp, Homo sapien
gctctcctggatggctttatgtctc

SEQ ID NO: 168773 - DNA, 25 bp, Homo sapien
cggtctcggcggtctggaatcctcc

SEQ ID NO: 168774 - DNA, 25 bp, Homo sapien
ggaatacagttacccacctcagttg

SEQ ID NO: 168775 - DNA, 25 bp, Homo sapien
cgcactgttcagttgctctcctgga

SEQ ID NO: 168776 - DNA, 25 bp, Homo sapien
agcacttttggctccgcaggtcctc

SEQ ID NO: 168777 - DNA, 25 bp, Homo sapien
tatgtctccgcggtgtttcctagag

SEQ ID NO: 168778 - DNA, 25 bp, Homo sapien
gtaccgcagttcagcacttttggct

SEQ ID NO: 168779 - DNA, 25 bp, Homo sapien
agaggaacccgccagaccagaaacg

SEQ ID NO: 168780 - DNA, 25 bp, Homo sapien
acactgagggattgctcgggcacta

SEQ ID NO: 168781 - DNA, 25 bp, Homo sapien
gtgcgggttctgtcacgtgacatca

SEQ ID NO: 168782 - DNA, 25 bp, Homo sapien
catcaggtcacgtgaggccggtcac

SEQ ID NO: 168783 - DNA, 25 bp, Homo sapien
gggagatccgtttccgccacactga

SEQ ID NO: 168784 - DNA, 25 bp, Homo sapien
tttttcgctgcagatgaaccggacg

SEQ ID NO: 168785 - DNA, 25 bp, Homo sapien
gtcccgttgcctgccctcttaggaa

SEQ ID NO: 168786 - DNA, 25 bp, Homo sapien
agacgcgacgttcccttcatggggt

SEQ ID NO: 168787 - DNA, 25 bp, Homo sapien
ggtttctggctcagctccatccgga

SEQ ID NO: 168788 - DNA, 25 bp, Homo sapien
accagaaggctttttgccgctatta

SEQ ID NO: 168789 - DNA, 25 bp, Homo sapien
aggcctccgtaaccatggctgcgag

SEQ ID NO: 168790 - DNA, 25 bp, Homo sapien
aagtactactgaaagctccgtggga

SEQ ID NO: 168791 - DNA, 25 bp, Homo sapien
cgccacacgttccttagggatgaca

SEQ ID NO: 168792 - DNA, 25 bp, Homo sapien
gaagagaccacgcagccgctaaaga

SEQ ID NO: 168793 - DNA, 25 bp, Homo sapien
ccagcccaaagatcgcggggatcca

SEQ ID NO: 168794 - DNA, 25 bp, Homo sapien
gccgctattagtgcagaatgacttc

SEQ ID NO: 168795 - DNA, 25 bp, Homo sapien
cggcaagtcccagtcgtttagaatc

SEQ ID NO: 168796 - DNA, 25 bp, Homo sapien
ccgccctctggacttacgtgactgt

SEQ ID NO: 168797 - DNA, 25 bp, Homo sapien
ggggctgcagaattccacgtcatca

SEQ ID NO: 168798 - DNA, 25 bp, Homo sapien
agggcatttcaacgccgcgcgcaca

SEQ ID NO: 168799 - DNA, 25 bp, Homo sapien
tgtggaatccctggcggtactcacc

SEQ ID NO: 168800 - DNA, 25 bp, Homo sapien
cggagttctctgtcatgtttgcggc

SEQ ID NO: 168801 - DNA, 25 bp, Homo sapien
gtccgaactgtggaacctgatactc

SEQ ID NO: 168802 - DNA, 25 bp, Homo sapien
acactcatacgcgtggggcgacatc

SEQ ID NO: 168803 - DNA, 25 bp, Homo sapien
ccaccagggcaatgggaactttgtc

SEQ ID NO: 168804 - DNA, 25 bp, Homo sapien
cctgatcgcgggtcaagccgaaaga

SEQ ID NO: 168805 - DNA, 25 bp, Homo sapien
ggtagctgggtccaccgagacataa

SEQ ID NO: 168806 - DNA, 25 bp, Homo sapien
agcgtcaagttgtactcggcgatgc

SEQ ID NO: 168807 - DNA, 25 bp, Homo sapien
agccggaagtgctcgtgcccataga

SEQ ID NO: 168808 - DNA, 25 bp, Homo sapien
tgtggtcattcgcatccaggacgcg

SEQ ID NO: 168809 - DNA, 25 bp, Homo sapien
tccggcaccagcgaagtggcaccag

SEQ ID NO: 168810 - DNA, 25 bp, Homo sapien
taggtgtcctgacgctcgtagtcca

SEQ ID NO: 168811 - DNA, 25 bp, Homo sapien
atccaggacgcgcacgctgagggca

SEQ ID NO: 168812 - DNA, 25 bp, Homo sapien
atgccggcattgtgaaactcgcgtg

SEQ ID NO: 168813 - DNA, 25 bp, Homo sapien
tcgcttggccagagattcggaacta

SEQ ID NO: 168814 - DNA, 25 bp, Homo sapien
cagcggacagccactcgattatgga

SEQ ID NO: 168815 - DNA, 25 bp, Homo sapien
gctccgcaaagctgggtttctgtta

SEQ ID NO: 168816 - DNA, 25 bp, Homo sapien
ccggcgttttctcggaatgcaaatg

SEQ ID NO: 168817 - DNA, 25 bp, Homo sapien
gccggcaactgtctcgcaatcttga

SEQ ID NO: 168818 - DNA, 25 bp, Homo sapien
agccgctcgaatcgccttgttatca

SEQ ID NO: 168819 - DNA, 25 bp, Homo sapien
cgggtgctgatcaggcctcacaaaa

SEQ ID NO: 168820 - DNA, 25 bp, Homo sapien
ccggtctatgaggtatctgtgagtg

SEQ ID NO: 168821 - DNA, 25 bp, Homo sapien
cccgtggattaccagagtcaggaca

SEQ ID NO: 168822 - DNA, 25 bp, Homo sapien
tgcgccctctactggcaggtgcact

SEQ ID NO: 168823 - DNA, 25 bp, Homo sapien
gagcccatcgcctagtacaacctga

SEQ ID NO: 168824 - DNA, 25 bp, Homo sapien
acaacctgacgctggtgaccgcgga

SEQ ID NO: 168825 - DNA, 25 bp, Homo sapien
tgggctacgagaaagacaatgctcc

SEQ ID NO: 168826 - DNA, 25 bp, Homo sapien
cggctgtcttcaacgtgtgtgtcct

SEQ ID NO: 168827 - DNA, 25 bp, Homo sapien
tgtgtgtcctggacgccaatgacca

SEQ ID NO: 168828 - DNA, 25 bp, Homo sapien
tcgtcgaagagtctcctaattttca

SEQ ID NO: 168829 - DNA, 25 bp, Homo sapien
tcggcctccagcagtcggctttctg

SEQ ID NO: 168830 - DNA, 25 bp, Homo sapien
gtgaacctgtggacacctccgactc

SEQ ID NO: 168831 - DNA, 25 bp, Homo sapien
cctcgggcctctcttcgtcgaagag

SEQ ID NO: 168832 - DNA, 25 bp, Homo sapien
taattttcagatctccggagccagc

SEQ ID NO: 168833 - DNA, 25 bp, Homo sapien
ctcagagctacagcggtgaacctgt

SEQ ID NO: 168834 - DNA, 25 bp, Homo sapien
tacgcgactgccttgctgccatata

SEQ ID NO: 168835 - DNA, 25 bp, Homo sapien
ctgccatataagagggacggcgctc

SEQ ID NO: 168836 - DNA, 25 bp, Homo sapien
acgtgaaacccttcagacggcagcc

SEQ ID NO: 168837 - DNA, 25 bp, Homo sapien
accctgaaggctccgtggaagcaga

SEQ ID NO: 168838 - DNA, 25 bp, Homo sapien
cctgaaggctccgtggaagcagatg

SEQ ID NO: 168839 - DNA, 25 bp, Homo sapien
gaagcagatgggcccgcacagccag

SEQ ID NO: 168840 - DNA, 25 bp, Homo sapien
gcacagccagcccaacccgcaaaac

SEQ ID NO: 168841 - DNA, 25 bp, Homo sapien
ccgcaaaacccatcgcttacgtgaa

SEQ ID NO: 168842 - DNA, 25 bp, Homo sapien
ccatcgcttacgtgaaacccttcag

SEQ ID NO: 168843 - DNA, 25 bp, Homo sapien
cgcttacgtgaaacccttcagacgg

SEQ ID NO: 168844 - DNA, 25 bp, Homo sapien
tgcgcagagcggggacctttttccc

SEQ ID NO: 168845 - DNA, 25 bp, Homo sapien
acgtgcggccagacacccatcccgg

SEQ ID NO: 168846 - DNA, 25 bp, Homo sapien
ccctaagaagtgcacagtgcgcggg

SEQ ID NO: 168847 - DNA, 25 bp, Homo sapien
aggcgagcgctgtcactcgacgagc

SEQ ID NO: 168848 - DNA, 25 bp, Homo sapien
ttcttggaggaaattcctccgctgg

SEQ ID NO: 168849 - DNA, 25 bp, Homo sapien
gaccagccgccgacctcacctgttt

SEQ ID NO: 168850 - DNA, 25 bp, Homo sapien
tgccggctctgatccggtgccagac

SEQ ID NO: 168851 - DNA, 25 bp, Homo sapien
tctgcgtacagagagagggtccagc

SEQ ID NO: 168852 - DNA, 25 bp, Homo sapien
gctgaatttgtgatttccttttgaa

SEQ ID NO: 168853 - DNA, 25 bp, Homo sapien
ctgagttatccttatttttcccatt

SEQ ID NO: 168854 - DNA, 25 bp, Homo sapien
tctgagttatccttatttttcccat

SEQ ID NO: 168855 - DNA, 25 bp, Homo sapien
agctgaatttgtgatttccttttga

SEQ ID NO: 168856 - DNA, 25 bp, Homo sapien
ttctgagttatccttatttttccca

SEQ ID NO: 168857 - DNA, 25 bp, Homo sapien
cctcacgggagccatgtgccagcag

SEQ ID NO: 168858 - DNA, 25 bp, Homo sapien
ttgaaattctgagttatccttattt

SEQ ID NO: 168859 - DNA, 25 bp, Homo sapien
ctgaatttgtgatttccttttgaaa

SEQ ID NO: 168860 - DNA, 25 bp, Homo sapien
cctcattcagatgggtccacgcgga

SEQ ID NO: 168861 - DNA, 25 bp, Homo sapien
taggcagaccgcagctacgttattc

SEQ ID NO: 168862 - DNA, 25 bp, Homo sapien
actgcgattcccgattccgtgtatg

SEQ ID NO: 168863 - DNA, 25 bp, Homo sapien
ctggaagagctactcccggtggtta

SEQ ID NO: 168864 - DNA, 25 bp, Homo sapien
ttgctcctcgctcggattggctgac

SEQ ID NO: 168865 - DNA, 25 bp, Homo sapien
cagtatcaatgtttaagcggcggcg

SEQ ID NO: 168866 - DNA, 25 bp, Homo sapien
atctcagcccgtggaagcgcattca

SEQ ID NO: 168867 - DNA, 25 bp, Homo sapien
tgtgtgtagagaaaccctttaggca

SEQ ID NO: 168868 - DNA, 25 bp, Homo sapien
gtcccaatggtgaagtgctctactc

SEQ ID NO: 168869 - DNA, 25 bp, Homo sapien
tcctacttggtggaactgcccgaga

SEQ ID NO: 168870 - DNA, 25 bp, Homo sapien
tgcaaagtcacggtcaagctcatcg

SEQ ID NO: 168871 - DNA, 25 bp, Homo sapien
tcactgaccgggactctggcaagaa

SEQ ID NO: 168872 - DNA, 25 bp, Homo sapien
ccgtgtgaagggcaatctggactat

SEQ ID NO: 168873 - DNA, 25 bp, Homo sapien
gcttcaggtgcacgagaacaacatc

SEQ ID NO: 168874 - DNA, 25 bp, Homo sapien
ttccgccaccgtacagatcaacgtg

SEQ ID NO: 168875 - DNA, 25 bp, Homo sapien
tcggttcaccaaagggctctacgtg

SEQ ID NO: 168876 - DNA, 25 bp, Homo sapien
gctgagggatcgacaacaggtttta

SEQ ID NO: 168877 - DNA, 25 bp, Homo sapien
aggtggccactcagcaagccgcaag

SEQ ID NO: 168878 - DNA, 25 bp, Homo sapien
ggggccgcagccaacacatctgaaa

SEQ ID NO: 168879 - DNA, 25 bp, Homo sapien
cgccgccggatcaatgacacgctga

SEQ ID NO: 168880 - DNA, 25 bp, Homo sapien
tccgggcactgcgaaacatgattgg

SEQ ID NO: 168881 - DNA, 25 bp, Homo sapien
aggccgctcaccttaaggacgcaga

SEQ ID NO: 168882 - DNA, 25 bp, Homo sapien
gctccaggcgatactcacaaacttg

SEQ ID NO: 168883 - DNA, 25 bp, Homo sapien
agcctagcccaaccgctgaagtcgg

SEQ ID NO: 168884 - DNA, 25 bp, Homo sapien
aatctgcctgaatcgccgtgaatgc

SEQ ID NO: 168885 - DNA, 25 bp, Homo sapien
gcttcccagaaaccgcgcttggtga

SEQ ID NO: 168886 - DNA, 25 bp, Homo sapien
ctctggtggagggtgtttaccacca

SEQ ID NO: 168887 - DNA, 25 bp, Homo sapien
gcgctcccggcgaatctgcctgaat

SEQ ID NO: 168888 - DNA, 25 bp, Homo sapien
ttctcagccggtcttggcttttctc

SEQ ID NO: 168889 - DNA, 25 bp, Homo sapien
gcgctcagaacagcccggaaccagg

SEQ ID NO: 168890 - DNA, 25 bp, Homo sapien
gctcagacgctgcaaagggccttct

SEQ ID NO: 168891 - DNA, 25 bp, Homo sapien
gggtcttgccctctggaacggcagc

SEQ ID NO: 168892 - DNA, 25 bp, Homo sapien
cccaatgtcggtcctacgcaatgtc

SEQ ID NO: 168893 - DNA, 25 bp, Homo sapien
atgtcggtcctacgcaatgtcagtc

SEQ ID NO: 168894 - DNA, 25 bp, Homo sapien
atgtcggtcctacgcaatgtcggtc

SEQ ID NO: 168895 - DNA, 25 bp, Homo sapien
tacgcaatgtcggtcctaggcaatg

SEQ ID NO: 168896 - DNA, 25 bp, Homo sapien
atgtcggtcctacccaatgtcggtc

SEQ ID NO: 168897 - DNA, 25 bp, Homo sapien
gtcggtcctacgcaatgtcagtcct

SEQ ID NO: 168898 - DNA, 25 bp, Homo sapien
tcggtcctacgcaatgtcggtccta

SEQ ID NO: 168899 - DNA, 25 bp, Homo sapien
tcggtcctacgcaatgtcagtccta

SEQ ID NO: 168900 - DNA, 25 bp, Homo sapien
aaagcaggttttcttgggctgacca

SEQ ID NO: 168901 - DNA, 25 bp, Homo sapien
tgctgcccgcaacgtgaccttttta

SEQ ID NO: 168902 - DNA, 25 bp, Homo sapien
atgcccagttgcagagccgaccaga

SEQ ID NO: 168903 - DNA, 25 bp, Homo sapien
aggcaaagtccctgaaccgtcctga

SEQ ID NO: 168904 - DNA, 25 bp, Homo sapien
tcctcgcgactttccaaggtgtgca

SEQ ID NO: 168905 - DNA, 25 bp, Homo sapien
gggcgctgcaaacgccacacttttg

SEQ ID NO: 168906 - DNA, 25 bp, Homo sapien
tctgcccgcggggactcaaaaaagc

SEQ ID NO: 168907 - DNA, 25 bp, Homo sapien
acacctctgagttttgctgcccgca

SEQ ID NO: 168908 - DNA, 25 bp, Homo sapien
caggccgccatttctgggcgctctg

SEQ ID NO: 168909 - DNA, 25 bp, Homo sapien
gaagagaagagtcgggcactggcag

SEQ ID NO: 168910 - DNA, 25 bp, Homo sapien
taaagcggccgcatctgccgtctca

SEQ ID NO: 168911 - DNA, 25 bp, Homo sapien
gccgcatctgccgtctcagaaacgg

SEQ ID NO: 168912 - DNA, 25 bp, Homo sapien
acgccaagcctagcgggcccgccct

SEQ ID NO: 168913 - DNA, 25 bp, Homo sapien
ctgccgtctcagaaacggctacctg

SEQ ID NO: 168914 - DNA, 25 bp, Homo sapien
cgcaagagccaacgccgaaggagtg

SEQ ID NO: 168915 - DNA, 25 bp, Homo sapien
gagacgccggcaagagctccagctc

SEQ ID NO: 168916 - DNA, 25 bp, Homo sapien
cttaggatcaccatcgcagaggcga

SEQ ID NO: 168917 - DNA, 25 bp, Homo sapien
gcgccgaggactgagatccagcctc

SEQ ID NO: 168918 - DNA, 25 bp, Homo sapien
aggggctggctcctaagaccagtta

SEQ ID NO: 168919 - DNA, 25 bp, Homo sapien
ggctcctaagaccagttagaatggc

SEQ ID NO: 168920 - DNA, 25 bp, Homo sapien
aagtcagtaaacagcggatgctgga

SEQ ID NO: 168921 - DNA, 25 bp, Homo sapien
ggagaaataggaatgctttcacatt

SEQ ID NO: 168922 - DNA, 25 bp, Homo sapien
gaatgctttcacattgttggtggga

SEQ ID NO: 168923 - DNA, 25 bp, Homo sapien
ggctcataggacctccatcacagtg

SEQ ID NO: 168924 - DNA, 25 bp, Homo sapien
gcgctgaaagcgagcgaccctctga

SEQ ID NO: 168925 - DNA, 25 bp, Homo sapien
cgcacatctctttgctaagtgaagg

SEQ ID NO: 168926 - DNA, 25 bp, Homo sapien
cccggtgctgcaaatagaggctttt

SEQ ID NO: 168927 - DNA, 25 bp, Homo sapien
tggggaccgcagaatttggaatctc

SEQ ID NO: 168928 - DNA, 25 bp, Homo sapien
tcggagcacttcctacatgcagagc

SEQ ID NO: 168929 - DNA, 25 bp, Homo sapien
cgcgtgcgaagtctcctctagcgga

SEQ ID NO: 168930 - DNA, 25 bp, Homo sapien
ggcagcagcgaaaacccggaaatct

SEQ ID NO: 168931 - DNA, 25 bp, Homo sapien
ggaacaaggcgctgactgtctccca

SEQ ID NO: 168932 - DNA, 25 bp, Homo sapien
gcagcccagagcgtctgagttgccg

SEQ ID NO: 168933 - DNA, 25 bp, Homo sapien
agaccaggggcgacacgcggcccag

SEQ ID NO: 168934 - DNA, 25 bp, Homo sapien
agcccagagcgtctgagttgccgcc

SEQ ID NO: 168935 - DNA, 25 bp, Homo sapien
agcgtctgagttgccgcccagccag

SEQ ID NO: 168936 - DNA, 25 bp, Homo sapien
tggacgctgtctcgctgctgccact

SEQ ID NO: 168937 - DNA, 25 bp, Homo sapien
gctgctgccactgcgtcatgggctg

SEQ ID NO: 168938 - DNA, 25 bp, Homo sapien
ccctgcctcgaaggcggggaagctg

SEQ ID NO: 168939 - DNA, 25 bp, Homo sapien
gcccagggctggcaagttcagggcg

SEQ ID NO: 168940 - DNA, 25 bp, Homo sapien
gtgcttcacatcgaagtcttttcgc

SEQ ID NO: 168941 - DNA, 25 bp, Homo sapien
gtcttttcgcccagagcctgacatg

SEQ ID NO: 168942 - DNA, 25 bp, Homo sapien
ctgacatgctttacgcacagaaggc

SEQ ID NO: 168943 - DNA, 25 bp, Homo sapien
cgccaaaagctgagaatcctcgatg

SEQ ID NO: 168944 - DNA, 25 bp, Homo sapien
ctgaagagtttccagcggagtcgca

SEQ ID NO: 168945 - DNA, 25 bp, Homo sapien
cgcagacggcaaagccgcgcgtttc

SEQ ID NO: 168946 - DNA, 25 bp, Homo sapien
caacccttaggctggagatgcgcga

SEQ ID NO: 168947 - DNA, 25 bp, Homo sapien
agctcacgcaggagtaggctggtca

SEQ ID NO: 168948 - DNA, 25 bp, Homo sapien
gcagggtgaggtgccaacttctcag

SEQ ID NO: 168949 - DNA, 25 bp, Homo sapien
gtggctccagcaaaggcgccgtcct

SEQ ID NO: 168950 - DNA, 25 bp, Homo sapien
acagcagcgctgagaggggtctcca

SEQ ID NO: 168951 - DNA, 25 bp, Homo sapien
gcacgaacgcggacagcagcgctga

SEQ ID NO: 168952 - DNA, 25 bp, Homo sapien
gcgccacagatcagccctgtcggtg

SEQ ID NO: 168953 - DNA, 25 bp, Homo sapien
cgagccctgcggagcaggtcacgac

SEQ ID NO: 168954 - DNA, 25 bp, Homo sapien
ggtctctcagcttcgcgggtcattt

SEQ ID NO: 168955 - DNA, 25 bp, Homo sapien
ggatggacccggtctctcagcttcg

SEQ ID NO: 168956 - DNA, 25 bp, Homo sapien
gcgaggagttgccattcgaatttcc

SEQ ID NO: 168957 - DNA, 25 bp, Homo sapien
atttggagccacgttcctctgcgcg

SEQ ID NO: 168958 - DNA, 25 bp, Homo sapien
tgctactcgccatggctaaggccga

SEQ ID NO: 168959 - DNA, 25 bp, Homo sapien
tggtctcccgcaccgcattcagatt

SEQ ID NO: 168960 - DNA, 25 bp, Homo sapien
tggcaggtccctaccaaagatcttg

SEQ ID NO: 168961 - DNA, 25 bp, Homo sapien
caactctcaagggatagggccatca

SEQ ID NO: 168962 - DNA, 25 bp, Homo sapien
cacgattggctagtcgctcacaagc

SEQ ID NO: 168963 - DNA, 25 bp, Homo sapien
tcgaatttcctacgcggcctccgtg

SEQ ID NO: 168964 - DNA, 25 bp, Homo sapien
cccgagctgccaagtttggggctta

SEQ ID NO: 168965 - DNA, 25 bp, Homo sapien
acgtcttggacttgagcatcttgcc

SEQ ID NO: 168966 - DNA, 25 bp, Homo sapien
gggcttaattttcacgccgagtgta

SEQ ID NO: 168967 - DNA, 25 bp, Homo sapien
agggcctgcaaccttgtgcttccga

SEQ ID NO: 168968 - DNA, 25 bp, Homo sapien
tctggacgccacctcacaacgtgtg

SEQ ID NO: 168969 - DNA, 25 bp, Homo sapien
aacattggttggctctctgacggcc

SEQ ID NO: 168970 - DNA, 25 bp, Homo sapien
gctcttccagcaaaaggcgtcaatc

SEQ ID NO: 168971 - DNA, 25 bp, Homo sapien
acgcacctggtgcagtaacacatta

SEQ ID NO: 168972 - DNA, 25 bp, Homo sapien
gtcaacggcatcttccttcttcacg

SEQ ID NO: 168973 - DNA, 25 bp, Homo sapien
agcagcctcgccagttgggtccacg

SEQ ID NO: 168974 - DNA, 25 bp, Homo sapien
gagacagaacctgcctctaccggtc

SEQ ID NO: 168975 - DNA, 25 bp, Homo sapien
tctaccggtcttccaaggcactgag

SEQ ID NO: 168976 - DNA, 25 bp, Homo sapien
tggctgcagcgacactacttcacag

SEQ ID NO: 168977 - DNA, 25 bp, Homo sapien
atcacacggccagaatcacgtcctg

SEQ ID NO: 168978 - DNA, 25 bp, Homo sapien
acgcgtcacagtgcagctggcatca

SEQ ID NO: 168979 - DNA, 25 bp, Homo sapien
gcggacgccgctgtaaattccctgc

SEQ ID NO: 168980 - DNA, 25 bp, Homo sapien
gtgtcagaggccacatgcaacccac

SEQ ID NO: 168981 - DNA, 25 bp, Homo sapien
ggtgtcagaggccacatgcaaccca

SEQ ID NO: 168982 - DNA, 25 bp, Homo sapien
ccacatgcaacccactggttttgtc

SEQ ID NO: 168983 - DNA, 25 bp, Homo sapien
ggccacatgcaacccactggttttg

SEQ ID NO: 168984 - DNA, 25 bp, Homo sapien
tgtcagaggccacatgcaacccact

SEQ ID NO: 168985 - DNA, 25 bp, Homo sapien
gtcagaggccacatgcaacccactg

SEQ ID NO: 168986 - DNA, 25 bp, Homo sapien
tcagaggccacatgcaacccactgg

SEQ ID NO: 168987 - DNA, 25 bp, Homo sapien
aggccacatgcaacccactggtttt

SEQ ID NO: 168988 - DNA, 25 bp, Homo sapien
cccgaggcctccttggctgaacgag

SEQ ID NO: 168989 - DNA, 25 bp, Homo sapien
ccgcgcaaaggcaggggcagtccaa

SEQ ID NO: 168990 - DNA, 25 bp, Homo sapien
aaaggcctctcaagtcccgctgggc

SEQ ID NO: 168991 - DNA, 25 bp, Homo sapien
aggctgcccagtcctagagctgccc

SEQ ID NO: 168992 - DNA, 25 bp, Homo sapien
tgctgaccggtgcatgggctgctcc

SEQ ID NO: 168993 - DNA, 25 bp, Homo sapien
ctccttggctgaacgagggtctcgt

SEQ ID NO: 168994 - DNA, 25 bp, Homo sapien
aacgagggtctcgttcagccgcgtc

SEQ ID NO: 168995 - DNA, 25 bp, Homo sapien
gcagtccaagcaccggcgggacacg

SEQ ID NO: 168996 - DNA, 25 bp, Homo sapien
cccatggctacaagggtgctgagca

SEQ ID NO: 168997 - DNA, 25 bp, Homo sapien
cccgcgtttcgctgagagtaaatgg

SEQ ID NO: 168998 - DNA, 25 bp, Homo sapien
tgtaccgctctccaatgccaaggca

SEQ ID NO: 168999 - DNA, 25 bp, Homo sapien
tgctcacgcgcaccttagttgtttt

SEQ ID NO: 169000 - DNA, 25 bp, Homo sapien
ttcgtgcgcgccttcgaaaactgcc

SEQ ID NO: 169001 - DNA, 25 bp, Homo sapien
cgctgtctgaggagtccacccgaaa

SEQ ID NO: 169002 - DNA, 25 bp, Homo sapien
acctggtccaggtaggaagagccgc

SEQ ID NO: 169003 - DNA, 25 bp, Homo sapien
tcgaaaactgcctgccgctgtctga

SEQ ID NO: 169004 - DNA, 25 bp, Homo sapien
cgcccgccagcgaacttggaaaggt

SEQ ID NO: 169005 - DNA, 25 bp, Homo sapien
attcggggacccaaaaagcgtgcag

SEQ ID NO: 169006 - DNA, 25 bp, Homo sapien
cgccagacaggcttaggagaattcg

SEQ ID NO: 169007 - DNA, 25 bp, Homo sapien
ctcttttgtgtcagagcgcgccaga

SEQ ID NO: 169008 - DNA, 25 bp, Homo sapien
agccgcgagaaagtctcctcttttg

SEQ ID NO: 169009 - DNA, 25 bp, Homo sapien
ccgctcgcagaggtagaaggcaaca

SEQ ID NO: 169010 - DNA, 25 bp, Homo sapien
ctctgagtgtgatggttgaaatccc

SEQ ID NO: 169011 - DNA, 25 bp, Homo sapien
gctcagcaggcgctaagtcgcttta

SEQ ID NO: 169012 - DNA, 25 bp, Homo sapien
ggcgggttaaatgggcatcctcctc

SEQ ID NO: 169013 - DNA, 25 bp, Homo sapien
gctgcgccttgatcaggtaggcaaa

SEQ ID NO: 169014 - DNA, 25 bp, Homo sapien
tgcgccttgtgctcgaagatgaata

SEQ ID NO: 169015 - DNA, 25 bp, Homo sapien
ctcgaagatgaataccgccgggttg

SEQ ID NO: 169016 - DNA, 25 bp, Homo sapien
tgactcctaccagggtgaccggctg

SEQ ID NO: 169017 - DNA, 25 bp, Homo sapien
ccggaaccgcttatcgcttggcttc

SEQ ID NO: 169018 - DNA, 25 bp, Homo sapien
gcgggaacggctcatcctgaatgca

SEQ ID NO: 169019 - DNA, 25 bp, Homo sapien
gaaggcgccgccgaaactgtgccaa

SEQ ID NO: 169020 - DNA, 25 bp, Homo sapien
catcggacttagcatccagcggcgg

SEQ ID NO: 169021 - DNA, 25 bp, Homo sapien
gaaggtcaccggctcgcggacacag

SEQ ID NO: 169022 - DNA, 25 bp, Homo sapien
tggaactcacatcggacttagcatc

SEQ ID NO: 169023 - DNA, 25 bp, Homo sapien
ccaggttggaactcacatcggactt

SEQ ID NO: 169024 - DNA, 25 bp, Homo sapien
gctgcccactctccttccaggttgg

SEQ ID NO: 169025 - DNA, 25 bp, Homo sapien
tgaaacggaagcagaaacacaattt

SEQ ID NO: 169026 - DNA, 25 bp, Homo sapien
gttggtgacctgaaacggaagcaga

SEQ ID NO: 169027 - DNA, 25 bp, Homo sapien
acttgcggcccggactcgagagaac

SEQ ID NO: 169028 - DNA, 25 bp, Homo sapien
acctccacgcttccagggattctgg

SEQ ID NO: 169029 - DNA, 25 bp, Homo sapien
agtcttttctgtctgctcggtccgc

SEQ ID NO: 169030 - DNA, 25 bp, Homo sapien
gccacctggcgtctgtctcagaata

SEQ ID NO: 169031 - DNA, 25 bp, Homo sapien
gtccacggtggtttgtctctaaagc

SEQ ID NO: 169032 - DNA, 25 bp, Homo sapien
tgagaggcccgtcaaactctttttg

SEQ ID NO: 169033 - DNA, 25 bp, Homo sapien
tatgacacttgacctacggccctgc

SEQ ID NO: 169034 - DNA, 25 bp, Homo sapien
gcctcctagcgcagtcggttgacac

SEQ ID NO: 169035 - DNA, 25 bp, Homo sapien
tcagaataggactccgcggcacgcc

SEQ ID NO: 169036 - DNA, 25 bp, Homo sapien
ctatttctggtatgtcaagcgggcc

SEQ ID NO: 169037 - DNA, 25 bp, Homo sapien
gcggcgctgcgacttttgaagtcca

SEQ ID NO: 169038 - DNA, 25 bp, Homo sapien
ttgaagtccaaactgtcgtcggggc

SEQ ID NO: 169039 - DNA, 25 bp, Homo sapien
gccttgggtcgctttcaggagttta

SEQ ID NO: 169040 - DNA, 25 bp, Homo sapien
aaagccaggtcttcacgttcgtgta

SEQ ID NO: 169041 - DNA, 25 bp, Homo sapien
ctgcagagcgcaacaaagggaacta

SEQ ID NO: 169042 - DNA, 25 bp, Homo sapien
cctcccttgtcctagccatggaagg

SEQ ID NO: 169043 - DNA, 25 bp, Homo sapien
cttggccgggaaaggtacaattgtg

SEQ ID NO: 169044 - DNA, 25 bp, Homo sapien
gctgcttaagtagagccgcctgctc

SEQ ID NO: 169045 - DNA, 25 bp, Homo sapien
taatccacgtgtgctgtccgccaga

SEQ ID NO: 169046 - DNA, 25 bp, Homo sapien
gagcggggactcgatttgcatctta

SEQ ID NO: 169047 - DNA, 25 bp, Homo sapien
ttgcatcttaaacgcggacgccacg

SEQ ID NO: 169048 - DNA, 25 bp, Homo sapien
ccggtccagaaagaagcggcctttg

SEQ ID NO: 169049 - DNA, 25 bp, Homo sapien
cgagctgcaagtcccgcaggtaatc

SEQ ID NO: 169050 - DNA, 25 bp, Homo sapien
acgttcagctccacgatgtcgggga

SEQ ID NO: 169051 - DNA, 25 bp, Homo sapien
ctggcagctcgaagtactcggcctc

SEQ ID NO: 169052 - DNA, 25 bp, Homo sapien
tcccacctccggctgcacccgcgcg

SEQ ID NO: 169053 - DNA, 25 bp, Homo sapien
gatctgtccgctgaacctgcgcatc

SEQ ID NO: 169054 - DNA, 25 bp, Homo sapien
ttgcggcggattccgctctggcgca

SEQ ID NO: 169055 - DNA, 25 bp, Homo sapien
gcggattccgctctggcgcatagcc

SEQ ID NO: 169056 - DNA, 25 bp, Homo sapien
ggcgcatagccccactggagcgctg

SEQ ID NO: 169057 - DNA, 25 bp, Homo sapien
cagcacctccgaagctgcgtgcaga

SEQ ID NO: 169058 - DNA, 25 bp, Homo sapien
caggtgggagagagatctgtccgct

SEQ ID NO: 169059 - DNA, 25 bp, Homo sapien
gcacctccgaagctgcgtgcagagc

SEQ ID NO: 169060 - DNA, 25 bp, Homo sapien
ccctgctcaccgtggtttgtgtcgg

SEQ ID NO: 169061 - DNA, 25 bp, Homo sapien
cggaacctgcgcttggggccaagct

SEQ ID NO: 169062 - DNA, 25 bp, Homo sapien
ggcctcgagaggctccggaagtact

SEQ ID NO: 169063 - DNA, 25 bp, Homo sapien
gctccggaagtactgggtgcagcct

SEQ ID NO: 169064 - DNA, 25 bp, Homo sapien
tcggagcgcacttgagagcaaagtt

SEQ ID NO: 169065 - DNA, 25 bp, Homo sapien
ccactggccggtgccctacaagtga

SEQ ID NO: 169066 - DNA, 25 bp, Homo sapien
ccctggcgctgctttggctcgcggt

SEQ ID NO: 169067 - DNA, 25 bp, Homo sapien
ccaagctctggagctgacgcgcagg

SEQ ID NO: 169068 - DNA, 25 bp, Homo sapien
agaagctttccttctcagtcccgcg

SEQ ID NO: 169069 - DNA, 25 bp, Homo sapien
ccaagggtcataaagcctggcagga

SEQ ID NO: 169070 - DNA, 25 bp, Homo sapien
agcccacagagtgcgagctccatgg

SEQ ID NO: 169071 - DNA, 25 bp, Homo sapien
tgacatgtttggaagcaggcacggc

SEQ ID NO: 169072 - DNA, 25 bp, Homo sapien
gcgccgcgagagactacctcagcga

SEQ ID NO: 169073 - DNA, 25 bp, Homo sapien
gtaagcttcctgcacctgggccaca

SEQ ID NO: 169074 - DNA, 25 bp, Homo sapien
tgggccacaaacagcgagtctaaaa

SEQ ID NO: 169075 - DNA, 25 bp, Homo sapien
cgcaccacgccttgttgacatgttt

SEQ ID NO: 169076 - DNA, 25 bp, Homo sapien
cccatggcgtgagaagcagttctct

SEQ ID NO: 169077 - DNA, 25 bp, Homo sapien
cctcatgccgttctcactgtggttc

SEQ ID NO: 169078 - DNA, 25 bp, Homo sapien
tcaaaggccatagggaggtgtctgc

SEQ ID NO: 169079 - DNA, 25 bp, Homo sapien
cgtttacttagctgagagggactca

SEQ ID NO: 169080 - DNA, 25 bp, Homo sapien
gaagagcactctccagcatcgttta

SEQ ID NO: 169081 - DNA, 25 bp, Homo sapien
gtgcagagacctcgtggcacccttc

SEQ ID NO: 169082 - DNA, 25 bp, Homo sapien
tcctgttccattccctttgtccgga

SEQ ID NO: 169083 - DNA, 25 bp, Homo sapien
tgtggttcatccactgtccacggcg

SEQ ID NO: 169084 - DNA, 25 bp, Homo sapien
gactacaaagacagcgacctccttc

SEQ ID NO: 169085 - DNA, 25 bp, Homo sapien
ccacggagccgtcgggaaccggcat

SEQ ID NO: 169086 - DNA, 25 bp, Homo sapien
taaatcctccggtagcggtcggcca

SEQ ID NO: 169087 - DNA, 25 bp, Homo sapien
ttgagcgcagcggtataaatcctcc

SEQ ID NO: 169088 - DNA, 25 bp, Homo sapien
cctggtccctgtcattgagcgcagc

SEQ ID NO: 169089 - DNA, 25 bp, Homo sapien
gtcgctgcgcacatcatcatcctcg

SEQ ID NO: 169090 - DNA, 25 bp, Homo sapien
ccgcagcagggagactacaaagaca

SEQ ID NO: 169091 - DNA, 25 bp, Homo sapien
tcgggaaccggcatgaacagcgccc

SEQ ID NO: 169092 - DNA, 25 bp, Homo sapien
cgatgtcattgagctgcgcaactag

SEQ ID NO: 169093 - DNA, 25 bp, Homo sapien
tctggcagtatgcaaagcaagcgtc

SEQ ID NO: 169094 - DNA, 25 bp, Homo sapien
tcgcctgaaccgtcgctgcagatcg

SEQ ID NO: 169095 - DNA, 25 bp, Homo sapien
aggcatttggagtcacccttacttc

SEQ ID NO: 169096 - DNA, 25 bp, Homo sapien
atagccagtgcagcgttttttctcc

SEQ ID NO: 169097 - DNA, 25 bp, Homo sapien
tcgcacacatgctcacttaggtatc

SEQ ID NO: 169098 - DNA, 25 bp, Homo sapien
gcgagctctactaccgaatgcctta

SEQ ID NO: 169099 - DNA, 25 bp, Homo sapien
ggtcgctctcctcaaaattgatagc

SEQ ID NO: 169100 - DNA, 25 bp, Homo sapien
gccaggcggtgacacttcccacgat

SEQ ID NO: 169101 - DNA, 25 bp, Homo sapien
ttcaagccggcagcaggcttcttcg

SEQ ID NO: 169102 - DNA, 25 bp, Homo sapien
tcgtctacttcaagccggcagcagg

SEQ ID NO: 169103 - DNA, 25 bp, Homo sapien
gaggcgcccttcgtctacttcaagc

SEQ ID NO: 169104 - DNA, 25 bp, Homo sapien
aagcagaacgagcagctgcggagtc

SEQ ID NO: 169105 - DNA, 25 bp, Homo sapien
cggtgctgatgcgaaccgccggctc

SEQ ID NO: 169106 - DNA, 25 bp, Homo sapien
attgctggatctggagagcgtagcc

SEQ ID NO: 169107 - DNA, 25 bp, Homo sapien
acgaggacgactacacctggtactg

SEQ ID NO: 169108 - DNA, 25 bp, Homo sapien
gaaccgcggaattaaggcacctaga

SEQ ID NO: 169109 - DNA, 25 bp, Homo sapien
tgcccgagccaagtcgctgcaaacg

SEQ ID NO: 169110 - DNA, 25 bp, Homo sapien
tcgccagtatccacgctcaaaagta

SEQ ID NO: 169111 - DNA, 25 bp, Homo sapien
agtaactcaagtttgcgcgccagtg

SEQ ID NO: 169112 - DNA, 25 bp, Homo sapien
gggtcccaggcaaagctccgaactc

SEQ ID NO: 169113 - DNA, 25 bp, Homo sapien
tcccggcggatgaaagccgctactc

SEQ ID NO: 169114 - DNA, 25 bp, Homo sapien
ggcgtcattatctctgcggtttgca

SEQ ID NO: 169115 - DNA, 25 bp, Homo sapien
tccgcagtttcagagcctagagaca

SEQ ID NO: 169116 - DNA, 25 bp, Homo sapien
ggaggcctccagaataactcccgga

SEQ ID NO: 169117 - DNA, 25 bp, Homo sapien
gccaatacgcatgtgcgggctctga

SEQ ID NO: 169118 - DNA, 25 bp, Homo sapien
cccgaagtctgaaagttatgccctg

SEQ ID NO: 169119 - DNA, 25 bp, Homo sapien
ccgtcctcccgtaaagctgacttga

SEQ ID NO: 169120 - DNA, 25 bp, Homo sapien
tgcgacaaggcttatctcacaagtg

SEQ ID NO: 169121 - DNA, 25 bp, Homo sapien
tcacaagtggaaaagaggacctcgc

SEQ ID NO: 169122 - DNA, 25 bp, Homo sapien
aggacctcgcgagaattagaattcg

SEQ ID NO: 169123 - DNA, 25 bp, Homo sapien
agctctgccgatggtttgaaactgc

SEQ ID NO: 169124 - DNA, 25 bp, Homo sapien
actgcctttctgaggcgtgaaatta

SEQ ID NO: 169125 - DNA, 25 bp, Homo sapien
cgagcacgcacagagactgcctttc

SEQ ID NO: 169126 - DNA, 25 bp, Homo sapien
acacgacattaagggccgccggaca

SEQ ID NO: 169127 - DNA, 25 bp, Homo sapien
gacaaaacgtgcctcgctgcgggac

SEQ ID NO: 169128 - DNA, 25 bp, Homo sapien
gcgaagaggttgctctgcagctgca

SEQ ID NO: 169129 - DNA, 25 bp, Homo sapien
acggcacgctgttcatcgtgtggta

SEQ ID NO: 169130 - DNA, 25 bp, Homo sapien
tccggcttgaaaggatggctcttgc

SEQ ID NO: 169131 - DNA, 25 bp, Homo sapien
gcacagcatgcgaagggcaaacaca

SEQ ID NO: 169132 - DNA, 25 bp, Homo sapien
tatttgactccgcagccactactcg

SEQ ID NO: 169133 - DNA, 25 bp, Homo sapien
gaaagttagtatttgactccgcagc

SEQ ID NO: 169134 - DNA, 25 bp, Homo sapien
ttgtctgttggggtttagggactca

SEQ ID NO: 169135 - DNA, 25 bp, Homo sapien
aagttagtatttgactccgcagcca

SEQ ID NO: 169136 - DNA, 25 bp, Homo sapien
gttagtatttgactccgcagccact

SEQ ID NO: 169137 - DNA, 25 bp, Homo sapien
tagtatttgactccgcagccactac

SEQ ID NO: 169138 - DNA, 25 bp, Homo sapien
tttgactccgcagccactactcgcc

SEQ ID NO: 169139 - DNA, 25 bp, Homo sapien
tgcggagaaagttagtatttgactc

SEQ ID NO: 169140 - DNA, 25 bp, Homo sapien
cggagctgtgtttctcgcagactcg

SEQ ID NO: 169141 - DNA, 25 bp, Homo sapien
aagccggagctgtgtttctcgcaga

SEQ ID NO: 169142 - DNA, 25 bp, Homo sapien
ccaccttgggttctggtggccgaag

SEQ ID NO: 169143 - DNA, 25 bp, Homo sapien
ctgagggacttcgacataagtgcgt

SEQ ID NO: 169144 - DNA, 25 bp, Homo sapien
cagactcggggagctacattgtgcg

SEQ ID NO: 169145 - DNA, 25 bp, Homo sapien
tggccgaagccggagctgtgtttct

SEQ ID NO: 169146 - DNA, 25 bp, Homo sapien
agggacttcgacataagtgcgtggc

SEQ ID NO: 169147 - DNA, 25 bp, Homo sapien
ttcgacataagtgcgtggcggtagt

SEQ ID NO: 169148 - DNA, 25 bp, Homo sapien
ggcactgcggagctccctcggcctc

SEQ ID NO: 169149 - DNA, 25 bp, Homo sapien
aggctcggagatttcccggagaccg

SEQ ID NO: 169150 - DNA, 25 bp, Homo sapien
cttggcactgcggagctccctcggc

SEQ ID NO: 169151 - DNA, 25 bp, Homo sapien
gagaccgtcgtcctccctttctgct

SEQ ID NO: 169152 - DNA, 25 bp, Homo sapien
cggagaccgtcgtcctccctttctg

SEQ ID NO: 169153 - DNA, 25 bp, Homo sapien
ctcggagatttcccggagaccgtcg

SEQ ID NO: 169154 - DNA, 25 bp, Homo sapien
tgcttggcactgcggagctccctcg

SEQ ID NO: 169155 - DNA, 25 bp, Homo sapien
gctcggagatttcccggagaccgtc

SEQ ID NO: 169156 - DNA, 25 bp, Homo sapien
tacctcccaggcgatagctactggg

SEQ ID NO: 169157 - DNA, 25 bp, Homo sapien
tggtccgctacctcccaggcgatag

SEQ ID NO: 169158 - DNA, 25 bp, Homo sapien
gccacgttccgggtcgcttaggctc

SEQ ID NO: 169159 - DNA, 25 bp, Homo sapien
ccgggtcgcttaggctcggagattt

SEQ ID NO: 169160 - DNA, 25 bp, Homo sapien
ccatcccgggcagtggcctgccctc

SEQ ID NO: 169161 - DNA, 25 bp, Homo sapien
ccaggcgatagctactgggctcctc

SEQ ID NO: 169162 - DNA, 25 bp, Homo sapien
ctgaggttggagttctccgggccac

SEQ ID NO: 169163 - DNA, 25 bp, Homo sapien
gcgatagctactgggctcctcgctg

SEQ ID NO: 169164 - DNA, 25 bp, Homo sapien
tttcgcgtcttaatcgccaggtttc

SEQ ID NO: 169165 - DNA, 25 bp, Homo sapien
tctggaagctgtggagaaaaccgca

SEQ ID NO: 169166 - DNA, 25 bp, Homo sapien
cgagttcgctgtaatcccagggaca

SEQ ID NO: 169167 - DNA, 25 bp, Homo sapien
gtctgctgccaccagaacgcacgga

SEQ ID NO: 169168 - DNA, 25 bp, Homo sapien
agttgccttgtcatgtaacacattg

SEQ ID NO: 169169 - DNA, 25 bp, Homo sapien
cgccaggtttcacgagtaataataa

SEQ ID NO: 169170 - DNA, 25 bp, Homo sapien
tgccctcaaaaggtcaagtctcgtc

SEQ ID NO: 169171 - DNA, 25 bp, Homo sapien
cctaaacgttccagcgcccagggag

SEQ ID NO: 169172 - DNA, 25 bp, Homo sapien
ggcctcccatcaagaacgcgggtta

SEQ ID NO: 169173 - DNA, 25 bp, Homo sapien
gcgggttagcgttttctcccatctc

SEQ ID NO: 169174 - DNA, 25 bp, Homo sapien
atatccctgcgatgcgtttctgatg

SEQ ID NO: 169175 - DNA, 25 bp, Homo sapien
ccgttttgtagctgtgcccacaatc

SEQ ID NO: 169176 - DNA, 25 bp, Homo sapien
atgtaacattctgcacggtctgagc

SEQ ID NO: 169177 - DNA, 25 bp, Homo sapien
agccatggcagcgttcagaatcccg

SEQ ID NO: 169178 - DNA, 25 bp, Homo sapien
gcgctttcgaaacgcgcgatctcca

SEQ ID NO: 169179 - DNA, 25 bp, Homo sapien
aggcgcccagatgaatccattaatc

SEQ ID NO: 169180 - DNA, 25 bp, Homo sapien
cccttttagagagccactttgcgtt

SEQ ID NO: 169181 - DNA, 25 bp, Homo sapien
ggtctcatctgagcgctgtctttca

SEQ ID NO: 169182 - DNA, 25 bp, Homo sapien
cgctgtctttcaccagagctctgta

SEQ ID NO: 169183 - DNA, 25 bp, Homo sapien
cgggacacaagcatatcgaggctga

SEQ ID NO: 169184 - DNA, 25 bp, Homo sapien
gtgacccgcgactcccttttagaga

SEQ ID NO: 169185 - DNA, 25 bp, Homo sapien
gttttgtttgcgcacacgggacaca

SEQ ID NO: 169186 - DNA, 25 bp, Homo sapien
ggctgaacaagccacagtccacgtt

SEQ ID NO: 169187 - DNA, 25 bp, Homo sapien
gtagagcctgtctttgcccagaagg

SEQ ID NO: 169188 - DNA, 25 bp, Homo sapien
cccgggctgaaacagcaacggtttg

SEQ ID NO: 169189 - DNA, 25 bp, Homo sapien
gtcggcgaacagctctgcaaggacc

SEQ ID NO: 169190 - DNA, 25 bp, Homo sapien
tgcttgcggcctttgtgccttttta

SEQ ID NO: 169191 - DNA, 25 bp, Homo sapien
aattgatgaagtctcgcggtggctc

SEQ ID NO: 169192 - DNA, 25 bp, Homo sapien
gctgccggtaaatctcgcgagaatt

SEQ ID NO: 169193 - DNA, 25 bp, Homo sapien
agggcagctcaatgggaacgattca

SEQ ID NO: 169194 - DNA, 25 bp, Homo sapien
tggctacgtcgaaaaggcaaaagta

SEQ ID NO: 169195 - DNA, 25 bp, Homo sapien
tttgagagcgtacactcccgcgtgc

SEQ ID NO: 169196 - DNA, 25 bp, Homo sapien
gcctctgtctctgtgtggtgagaag

SEQ ID NO: 169197 - DNA, 25 bp, Homo sapien
accaatcaaggacgggtcattcccg

SEQ ID NO: 169198 - DNA, 25 bp, Homo sapien
ctcgcgcacacagaaaagaccaatc

SEQ ID NO: 169199 - DNA, 25 bp, Homo sapien
gcccactcgacaggttgacaaccta

SEQ ID NO: 169200 - DNA, 25 bp, Homo sapien
gagaagactccctctctcggaagcc

SEQ ID NO: 169201 - DNA, 25 bp, Homo sapien
tggatcaccaccagccggggactgg

SEQ ID NO: 169202 - DNA, 25 bp, Homo sapien
tgtcctcaggtgttctaggaacgcg

SEQ ID NO: 169203 - DNA, 25 bp, Homo sapien
gcgagcggtccgagcatgctcaata

SEQ ID NO: 169204 - DNA, 25 bp, Homo sapien
tcacgaaatgcaggagcacacttcc

SEQ ID NO: 169205 - DNA, 25 bp, Homo sapien
gacgcacaagtccaacccacgcaca

SEQ ID NO: 169206 - DNA, 25 bp, Homo sapien
gtacgtgtcacgaaatgcaggagca

SEQ ID NO: 169207 - DNA, 25 bp, Homo sapien
caactcaagagaactgccttccagc

SEQ ID NO: 169208 - DNA, 25 bp, Homo sapien
acacggcgactccacgctgcactga

SEQ ID NO: 169209 - DNA, 25 bp, Homo sapien
cgacactgcgagcacgaaagccctg

SEQ ID NO: 169210 - DNA, 25 bp, Homo sapien
tcggacatccggcacaggtttccca

SEQ ID NO: 169211 - DNA, 25 bp, Homo sapien
gcctccgaagggtacgtgtcacgaa

SEQ ID NO: 169212 - DNA, 25 bp, Homo sapien
gcctcaccgtgatcgcggctttgca

SEQ ID NO: 169213 - DNA, 25 bp, Homo sapien
gattctcttctttctgcgatgtgca

SEQ ID NO: 169214 - DNA, 25 bp, Homo sapien
ctcgcgaagaccctgcgggatttga

SEQ ID NO: 169215 - DNA, 25 bp, Homo sapien
gcgcacgcggagtatttcctctttt

SEQ ID NO: 169216 - DNA, 25 bp, Homo sapien
ggcaagtcccttttcctggcagatg

SEQ ID NO: 169217 - DNA, 25 bp, Homo sapien
tacggagaacctaaagccagatcgc

SEQ ID NO: 169218 - DNA, 25 bp, Homo sapien
gcctgcaaaggcaacctggaaaata

SEQ ID NO: 169219 - DNA, 25 bp, Homo sapien
tggactttgccttccaccaagagga

SEQ ID NO: 169220 - DNA, 25 bp, Homo sapien
ctccgtcgggtagaagctcttctcc

SEQ ID NO: 169221 - DNA, 25 bp, Homo sapien
gacgcccaggagaacgctcctcagg

SEQ ID NO: 169222 - DNA, 25 bp, Homo sapien
tgtgcttatcttgtcgtcctccgtc

SEQ ID NO: 169223 - DNA, 25 bp, Homo sapien
agcgctaggagacgccgtttgcctc

SEQ ID NO: 169224 - DNA, 25 bp, Homo sapien
gactccttggtgtggcagctgaccc

SEQ ID NO: 169225 - DNA, 25 bp, Homo sapien
agaacgctcctcaggccgtgctgct

SEQ ID NO: 169226 - DNA, 25 bp, Homo sapien
acgctgcattgaggatgtgcttatc

SEQ ID NO: 169227 - DNA, 25 bp, Homo sapien
tcggaggtgcaggtcacgctgcatt

SEQ ID NO: 169228 - DNA, 25 bp, Homo sapien
ggcatctcgtctcttggaccgcttt

SEQ ID NO: 169229 - DNA, 25 bp, Homo sapien
ccctgctggtgtctaggtaggagtt

SEQ ID NO: 169230 - DNA, 25 bp, Homo sapien
ggtctccgccaacccagtgctgttt

SEQ ID NO: 169231 - DNA, 25 bp, Homo sapien
aacaccgagatggacaccctgctgg

SEQ ID NO: 169232 - DNA, 25 bp, Homo sapien
agcagtcccgggaccaacaccgaga

SEQ ID NO: 169233 - DNA, 25 bp, Homo sapien
tcaggataaacacgagcatgcccac

SEQ ID NO: 169234 - DNA, 25 bp, Homo sapien
gaccgctttcggttcctcaggataa

SEQ ID NO: 169235 - DNA, 25 bp, Homo sapien
cgaagttaacgtgggcgagatccta

SEQ ID NO: 169236 - DNA, 25 bp, Homo sapien
aagcggtagctcacagccagggcct

SEQ ID NO: 169237 - DNA, 25 bp, Homo sapien
ctggctggcacaggtgcctcgtacc

SEQ ID NO: 169238 - DNA, 25 bp, Homo sapien
tggcacaggtgcctcgtacctggct

SEQ ID NO: 169239 - DNA, 25 bp, Homo sapien
gttcgggtcccatggcagccgacat

SEQ ID NO: 169240 - DNA, 25 bp, Homo sapien
atggcagccgacatgccgtgggcct

SEQ ID NO: 169241 - DNA, 25 bp, Homo sapien
tcctccaggccatccatgcgtggga

SEQ ID NO: 169242 - DNA, 25 bp, Homo sapien
agtgaggaagcggtagctcacagcc

SEQ ID NO: 169243 - DNA, 25 bp, Homo sapien
caggccatccatgcgtgggaccggc

SEQ ID NO: 169244 - DNA, 25 bp, Homo sapien
ttcctgagctctgcggtggattatt

SEQ ID NO: 169245 - DNA, 25 bp, Homo sapien
ctttcccgttctcggggcagccgtg

SEQ ID NO: 169246 - DNA, 25 bp, Homo sapien
ggttttccatgcgtgaggctctcac

SEQ ID NO: 169247 - DNA, 25 bp, Homo sapien
ttattcaggcatccttgtccggccc

SEQ ID NO: 169248 - DNA, 25 bp, Homo sapien
ggtggattattcaggcatccttgtc

SEQ ID NO: 169249 - DNA, 25 bp, Homo sapien
ttatttggtttgtggtggattattc

SEQ ID NO: 169250 - DNA, 25 bp, Homo sapien
tgagctctgcggtggattatttggt

SEQ ID NO: 169251 - DNA, 25 bp, Homo sapien
gcagccgtggttttccatgcgtgag

SEQ ID NO: 169252 - DNA, 25 bp, Homo sapien
cgcagcgagtttcagtcgtgacttt

SEQ ID NO: 169253 - DNA, 25 bp, Homo sapien
catgacgcagcgagtttcagtcgtg

SEQ ID NO: 169254 - DNA, 25 bp, Homo sapien
ttttctgggggcatcgcggcgtccc

SEQ ID NO: 169255 - DNA, 25 bp, Homo sapien
cagcgagtttcagtcgtgacttttc

SEQ ID NO: 169256 - DNA, 25 bp, Homo sapien
agtttcagtcgtgacttttctgggg

SEQ ID NO: 169257 - DNA, 25 bp, Homo sapien
cagtcgtgacttttctgggggcatc

SEQ ID NO: 169258 - DNA, 25 bp, Homo sapien
ggtcatgacgcagcgagtttcagtc

SEQ ID NO: 169259 - DNA, 25 bp, Homo sapien
tgacgccggccggtcacgtgggcgt

SEQ ID NO: 169260 - DNA, 25 bp, Homo sapien
tcaaatactaattaggggccgcggc

SEQ ID NO: 169261 - DNA, 25 bp, Homo sapien
cgcgatcgcgccttaacacgtattg

SEQ ID NO: 169262 - DNA, 25 bp, Homo sapien
accatgtacagtgtgcgctgcaaga

SEQ ID NO: 169263 - DNA, 25 bp, Homo sapien
gggcccatcatgtctgctgcagctt

SEQ ID NO: 169264 - DNA, 25 bp, Homo sapien
ggcgcgacaataaacaagtgcactg

SEQ ID NO: 169265 - DNA, 25 bp, Homo sapien
gccacaggcatagaacgacgcggtt

SEQ ID NO: 169266 - DNA, 25 bp, Homo sapien
actaatgacgattgtgcgccgcatc

SEQ ID NO: 169267 - DNA, 25 bp, Homo sapien
actgccaaagggatgcaagagcctc

SEQ ID NO: 169268 - DNA, 25 bp, Homo sapien
ggataccttcgctgagttctttgta

SEQ ID NO: 169269 - DNA, 25 bp, Homo sapien
tggtagttccgtgcaaaccttgcta

SEQ ID NO: 169270 - DNA, 25 bp, Homo sapien
ccgttgcaaatagacgcggagccca

SEQ ID NO: 169271 - DNA, 25 bp, Homo sapien
ggctttcgtgctgatccttggtgta

SEQ ID NO: 169272 - DNA, 25 bp, Homo sapien
tattcggagattgcggataccttcg

SEQ ID NO: 169273 - DNA, 25 bp, Homo sapien
cgctctccgggaagcgctgctaagt

SEQ ID NO: 169274 - DNA, 25 bp, Homo sapien
cttggtgtactgattcccggtaagc

SEQ ID NO: 169275 - DNA, 25 bp, Homo sapien
ctaagtggtaccgtgcatgcaatta

SEQ ID NO: 169276 - DNA, 25 bp, Homo sapien
gctgagaccgacatgcgctccatta

SEQ ID NO: 169277 - DNA, 25 bp, Homo sapien
tcggtgcccttgtctgtgttaattc

SEQ ID NO: 169278 - DNA, 25 bp, Homo sapien
gtgactcctgcggtccggttgaata

SEQ ID NO: 169279 - DNA, 25 bp, Homo sapien
gcctcctgctggttttcatcatgtc

SEQ ID NO: 169280 - DNA, 25 bp, Homo sapien
ctccgacgtgagctcctttaacatg

SEQ ID NO: 169281 - DNA, 25 bp, Homo sapien
agctgctgtgccctgactattcaga

SEQ ID NO: 169282 - DNA, 25 bp, Homo sapien
acgaggtgatctgtaaggcgcccaa

SEQ ID NO: 169283 - DNA, 25 bp, Homo sapien
agatgtagtagtttccacgcccaca

SEQ ID NO: 169284 - DNA, 25 bp, Homo sapien
catacaggaagtgcgactgggtccc

SEQ ID NO: 169285 - DNA, 25 bp, Homo sapien
ctgggccgccgctcatacaggaagt

SEQ ID NO: 169286 - DNA, 25 bp, Homo sapien
ggccgccgctcatacaggaagtgcg

SEQ ID NO: 169287 - DNA, 25 bp, Homo sapien
ccgccgctcatacaggaagtgcgac

SEQ ID NO: 169288 - DNA, 25 bp, Homo sapien
gccgctcatacaggaagtgcgactg

SEQ ID NO: 169289 - DNA, 25 bp, Homo sapien
ctcatacaggaagtgcgactgggtc

SEQ ID NO: 169290 - DNA, 25 bp, Homo sapien
aagtgcgactgggtccccgtcggct

SEQ ID NO: 169291 - DNA, 25 bp, Homo sapien
agacaaggggatgagtggcggttag

SEQ ID NO: 169292 - DNA, 25 bp, Homo sapien
cagatgacttcggtgtgagacgtga

SEQ ID NO: 169293 - DNA, 25 bp, Homo sapien
ccgaaagggttcgacagatacaacg

SEQ ID NO: 169294 - DNA, 25 bp, Homo sapien
cggagcacaagggacgcattcttcc

SEQ ID NO: 169295 - DNA, 25 bp, Homo sapien
gctccgggagcaaccaaaacggcga

SEQ ID NO: 169296 - DNA, 25 bp, Homo sapien
agccctcggtgttcgatgcttcatg

SEQ ID NO: 169297 - DNA, 25 bp, Homo sapien
tttaccaccaataccagggcagatg

SEQ ID NO: 169298 - DNA, 25 bp, Homo sapien
tgagttcgaaaaggccacgcacaag

SEQ ID NO: 169299 - DNA, 25 bp, Homo sapien
cacgggcgctttgcagacagcaagc

SEQ ID NO: 169300 - DNA, 25 bp, Homo sapien
tcacccagctcagcgcaatcttgtg

SEQ ID NO: 169301 - DNA, 25 bp, Homo sapien
gcgccttgacaagggagaccagctc

SEQ ID NO: 169302 - DNA, 25 bp, Homo sapien
tcacaactgagtctggggcctccca

SEQ ID NO: 169303 - DNA, 25 bp, Homo sapien
cggacaatctgcgttcacaactgag

SEQ ID NO: 169304 - DNA, 25 bp, Homo sapien
agcgcaatcttgtgcgccgggagcc

SEQ ID NO: 169305 - DNA, 25 bp, Homo sapien
gagcgcctctatgtccgccgctggg

SEQ ID NO: 169306 - DNA, 25 bp, Homo sapien
gcgaaagggccgatcttctgttgtt

SEQ ID NO: 169307 - DNA, 25 bp, Homo sapien
cttctgttgttttccacgtccggtg

SEQ ID NO: 169308 - DNA, 25 bp, Homo sapien
cccaaactttgtacgcgcgagggtg

SEQ ID NO: 169309 - DNA, 25 bp, Homo sapien
ttaaagcgcctccagaacaaagcgg

SEQ ID NO: 169310 - DNA, 25 bp, Homo sapien
tcccgagggcgagagttaaagcgcc

SEQ ID NO: 169311 - DNA, 25 bp, Homo sapien
gtgtggcagccgcatctggctgccc

SEQ ID NO: 169312 - DNA, 25 bp, Homo sapien
cggctactcctcctggtgagtctgc

SEQ ID NO: 169313 - DNA, 25 bp, Homo sapien
agatggtggcggctactcctcctgg

SEQ ID NO: 169314 - DNA, 25 bp, Homo sapien
ggcctccggtcgtagtaaagcgcag

SEQ ID NO: 169315 - DNA, 25 bp, Homo sapien
ctttgttagcccgcgtgggcagcct

SEQ ID NO: 169316 - DNA, 25 bp, Homo sapien
tccttctggccctggttgggtccgc

SEQ ID NO: 169317 - DNA, 25 bp, Homo sapien
ttccacgtctgcagctcagccaggg

SEQ ID NO: 169318 - DNA, 25 bp, Homo sapien
ggcactcgtgggaagatgacctttc

SEQ ID NO: 169319 - DNA, 25 bp, Homo sapien
ctgcagccgcgcagggtgaatcccg

SEQ ID NO: 169320 - DNA, 25 bp, Homo sapien
aagatgacctttcgggccctgcagc

SEQ ID NO: 169321 - DNA, 25 bp, Homo sapien
cgaggatggacgcacagacctggcc

SEQ ID NO: 169322 - DNA, 25 bp, Homo sapien
gccgctgtgtcttccacgtctgcag

SEQ ID NO: 169323 - DNA, 25 bp, Homo sapien
ggcgtgcagacctgcgaagaagttc

SEQ ID NO: 169324 - DNA, 25 bp, Homo sapien
ttcaaggctggtttggggacttcac

SEQ ID NO: 169325 - DNA, 25 bp, Homo sapien
ccgagctggatttgtatgttgcacc

SEQ ID NO: 169326 - DNA, 25 bp, Homo sapien
tcccgttagggttcctcagtgcttc

SEQ ID NO: 169327 - DNA, 25 bp, Homo sapien
tcacgggctgcctgtttcagatgtg

SEQ ID NO: 169328 - DNA, 25 bp, Homo sapien
tttctgccaccgctatgggactccg

SEQ ID NO: 169329 - DNA, 25 bp, Homo sapien
ccctgttgctgagttggtgctcact

SEQ ID NO: 169330 - DNA, 25 bp, Homo sapien
atgttgcaccatgccttcttggatc

SEQ ID NO: 169331 - DNA, 25 bp, Homo sapien
caaacttggaagaactgcgaccgca

SEQ ID NO: 169332 - DNA, 25 bp, Homo sapien
tgggttgtctcctgagtaaactatc

SEQ ID NO: 169333 - DNA, 25 bp, Homo sapien
cttgtcctgttaaacggtgtcgtcg

SEQ ID NO: 169334 - DNA, 25 bp, Homo sapien
tttcttagattgctctcggcgcgcg

SEQ ID NO: 169335 - DNA, 25 bp, Homo sapien
tcctggtgatcatgtacagcatttc

SEQ ID NO: 169336 - DNA, 25 bp, Homo sapien
tgcacacgcgccttactttcttaga

SEQ ID NO: 169337 - DNA, 25 bp, Homo sapien
ctatttcggcacgttctgggttgtc

SEQ ID NO: 169338 - DNA, 25 bp, Homo sapien
aactatcactgagcgctttgcgtcc

SEQ ID NO: 169339 - DNA, 25 bp, Homo sapien
gtccaactggcttgcttgtcttttc

SEQ ID NO: 169340 - DNA, 25 bp, Homo sapien
tcgctctcagcggacaaaccggtcg

SEQ ID NO: 169341 - DNA, 25 bp, Homo sapien
cttctcaattgggttaatgtccgtg

SEQ ID NO: 169342 - DNA, 25 bp, Homo sapien
agctgggttcagtcttctcaattgg

SEQ ID NO: 169343 - DNA, 25 bp, Homo sapien
cagccctgcgatttgggacaactta

SEQ ID NO: 169344 - DNA, 25 bp, Homo sapien
aaccggtcgagagcgcaattctgga

SEQ ID NO: 169345 - DNA, 25 bp, Homo sapien
ggctgccaggccgtctcttaaagcg

SEQ ID NO: 169346 - DNA, 25 bp, Homo sapien
ctggcctgccggtaacttaagaagc

SEQ ID NO: 169347 - DNA, 25 bp, Homo sapien
tgggttccaattcaggctcctcact

SEQ ID NO: 169348 - DNA, 25 bp, Homo sapien
ccgcttcgcaaagccgccgggaaga

SEQ ID NO: 169349 - DNA, 25 bp, Homo sapien
tctgaaaagcgcagggaagttccgc

SEQ ID NO: 169350 - DNA, 25 bp, Homo sapien
gctcagcagtgcctagtaccgtaaa

SEQ ID NO: 169351 - DNA, 25 bp, Homo sapien
cggcgccattacctacatgaaacca

SEQ ID NO: 169352 - DNA, 25 bp, Homo sapien
ggcagcttccggagactgctctgtg

SEQ ID NO: 169353 - DNA, 25 bp, Homo sapien
ctgctctgtggccagtttctgcccg

SEQ ID NO: 169354 - DNA, 25 bp, Homo sapien
ccgtaaagagtatggtctgaaaagc

SEQ ID NO: 169355 - DNA, 25 bp, Homo sapien
tcgcgggacacgttaacagagcagc

SEQ ID NO: 169356 - DNA, 25 bp, Homo sapien
cggcctctgactggtgaatgtcttc

SEQ ID NO: 169357 - DNA, 25 bp, Homo sapien
cgcatgctcagtagcaagacgtgct

SEQ ID NO: 169358 - DNA, 25 bp, Homo sapien
cgtaacctgaagcaacatcctcctg

SEQ ID NO: 169359 - DNA, 25 bp, Homo sapien
tcttcggcttatggcagaggagccc

SEQ ID NO: 169360 - DNA, 25 bp, Homo sapien
agcgcatcggccacttcgagttcca

SEQ ID NO: 169361 - DNA, 25 bp, Homo sapien
tggacctccagcgttgcagcagctg

SEQ ID NO: 169362 - DNA, 25 bp, Homo sapien
cggcctctcgccactagtgatcgtg

SEQ ID NO: 169363 - DNA, 25 bp, Homo sapien
gggagatgagttttccgtaacctga

SEQ ID NO: 169364 - DNA, 25 bp, Homo sapien
tgggtaacccttgctcaacacttgg

SEQ ID NO: 169365 - DNA, 25 bp, Homo sapien
atccggacaagcagttggcgccttt

SEQ ID NO: 169366 - DNA, 25 bp, Homo sapien
agcagccgagctccaatccatatta

SEQ ID NO: 169367 - DNA, 25 bp, Homo sapien
gcccgcatctggaacgagctgcttc

SEQ ID NO: 169368 - DNA, 25 bp, Homo sapien
cgcctttgttttgcgcagtgattca

SEQ ID NO: 169369 - DNA, 25 bp, Homo sapien
ccgcgcatccgtggacacacttagg

SEQ ID NO: 169370 - DNA, 25 bp, Homo sapien
gtaggcccgcagacttcagaaaaca

SEQ ID NO: 169371 - DNA, 25 bp, Homo sapien
cgccgcgcgctcatgtttattcacg

SEQ ID NO: 169372 - DNA, 25 bp, Homo sapien
cgcattcgcagggacgtgtcagctg

SEQ ID NO: 169373 - DNA, 25 bp, Homo sapien
ttaggagcagcgctgataacgactg

SEQ ID NO: 169374 - DNA, 25 bp, Homo sapien
gctgggcaggctataatttgcatta

SEQ ID NO: 169375 - DNA, 25 bp, Homo sapien
taacgactggaaagttcgacggctg

SEQ ID NO: 169376 - DNA, 25 bp, Homo sapien
gcctggcgagcaaccatcgaaaata

SEQ ID NO: 169377 - DNA, 25 bp, Homo sapien
taaaacaattgctgtccttggcggc

SEQ ID NO: 169378 - DNA, 25 bp, Homo sapien
aaaggcctctatggacgcctccagg

SEQ ID NO: 169379 - DNA, 25 bp, Homo sapien
cagcgcagggaaccaaagggcaccc

SEQ ID NO: 169380 - DNA, 25 bp, Homo sapien
gggcgcaagaaagacgcggaccctc

SEQ ID NO: 169381 - DNA, 25 bp, Homo sapien
agtggaatcttctctccatcttctg

SEQ ID NO: 169382 - DNA, 25 bp, Homo sapien
ctccggggagagtggaatcttctct

SEQ ID NO: 169383 - DNA, 25 bp, Homo sapien
accgtccctatctgctccggggaga

SEQ ID NO: 169384 - DNA, 25 bp, Homo sapien
attggctggcgcgaccgtccctatc

SEQ ID NO: 169385 - DNA, 25 bp, Homo sapien
acttcgcttgcctggaggacacggc

SEQ ID NO: 169386 - DNA, 25 bp, Homo sapien
ttgcgggaacttcgcttgcctggag

SEQ ID NO: 169387 - DNA, 25 bp, Homo sapien
aagaaagacgcggaccctcgaggcg

SEQ ID NO: 169388 - DNA, 25 bp, Homo sapien
gaccacgcgcttgtgactgtcagca

SEQ ID NO: 169389 - DNA, 25 bp, Homo sapien
agcaccctagagaaactgtcagaga

SEQ ID NO: 169390 - DNA, 25 bp, Homo sapien
gtctctgaaagacgcctgccgctgc

SEQ ID NO: 169391 - DNA, 25 bp, Homo sapien
cgttcatctgcgctacggaaggaca

SEQ ID NO: 169392 - DNA, 25 bp, Homo sapien
tcaccgtgaagtccgtgtctatagg

SEQ ID NO: 169393 - DNA, 25 bp, Homo sapien
cgggctctagcgctaaagcacccta

SEQ ID NO: 169394 - DNA, 25 bp, Homo sapien
cagacgcggcgacattcaacagagt

SEQ ID NO: 169395 - DNA, 25 bp, Homo sapien
ggagccctttacctgccaacgatca

SEQ ID NO: 169396 - DNA, 25 bp, Homo sapien
ctcggtgactttctcatttgacaga

SEQ ID NO: 169397 - DNA, 25 bp, Homo sapien
cccaaaagttgcgtcgcggagactc

SEQ ID NO: 169398 - DNA, 25 bp, Homo sapien
tcctcggtcgttctctcttaaatgc

SEQ ID NO: 169399 - DNA, 25 bp, Homo sapien
acgttctttgggtccttcgtctgca

SEQ ID NO: 169400 - DNA, 25 bp, Homo sapien
tgggacactctaacttctcggcggt

SEQ ID NO: 169401 - DNA, 25 bp, Homo sapien
tcggcccggaggaaatcaatgttgg

SEQ ID NO: 169402 - DNA, 25 bp, Homo sapien
tctccgactctgtgagcagtttcca

SEQ ID NO: 169403 - DNA, 25 bp, Homo sapien
cgcagagcgcagcaatggatataaa

SEQ ID NO: 169404 - DNA, 25 bp, Homo sapien
ctaggagcgggcaacgaattgaatc

SEQ ID NO: 169405 - DNA, 25 bp, Homo sapien
agctctgtcatttggcaactccctg

SEQ ID NO: 169406 - DNA, 25 bp, Homo sapien
ctgcagactgatgacacggcgcttt

SEQ ID NO: 169407 - DNA, 25 bp, Homo sapien
acacggcgctttccatggtcgagcc

SEQ ID NO: 169408 - DNA, 25 bp, Homo sapien
acctggctgggctcctaattacccg

SEQ ID NO: 169409 - DNA, 25 bp, Homo sapien
agctcccggtgatgttaaggcgtcc

SEQ ID NO: 169410 - DNA, 25 bp, Homo sapien
gtaacccggctccaggcatttctta

SEQ ID NO: 169411 - DNA, 25 bp, Homo sapien
agacttgggttatttgcttcgcgta

SEQ ID NO: 169412 - DNA, 25 bp, Homo sapien
cgcctgtgatccgtggccagggagc

SEQ ID NO: 169413 - DNA, 25 bp, Homo sapien
gcctgtgatcgctttccagggggca

SEQ ID NO: 169414 - DNA, 25 bp, Homo sapien
gcgccctcctgtgatcccccgccag

SEQ ID NO: 169415 - DNA, 25 bp, Homo sapien
gtggcagaggccgtacactcggcct

SEQ ID NO: 169416 - DNA, 25 bp, Homo sapien
cagaggatcggggaaccgggctcag

SEQ ID NO: 169417 - DNA, 25 bp, Homo sapien
gaaccgggctcagcccggtgactgt

SEQ ID NO: 169418 - DNA, 25 bp, Homo sapien
ggctcagcccggtgactgtggcccg

SEQ ID NO: 169419 - DNA, 25 bp, Homo sapien
ccagtgggaacgagccagccagcga

SEQ ID NO: 169420 - DNA, 25 bp, Homo sapien
ttcactatccgagtctaggcgccga

SEQ ID NO: 169421 - DNA, 25 bp, Homo sapien
tggtacacgggcagcatcttgccgg

SEQ ID NO: 169422 - DNA, 25 bp, Homo sapien
ttgggcttcacctcctggtacacgg

SEQ ID NO: 169423 - DNA, 25 bp, Homo sapien
cggggacactcaccagaagaacacg

SEQ ID NO: 169424 - DNA, 25 bp, Homo sapien
ctggcgacgccaaagggagcccaga

SEQ ID NO: 169425 - DNA, 25 bp, Homo sapien
agcccagagctacgcccaggggtga

SEQ ID NO: 169426 - DNA, 25 bp, Homo sapien
gtgcacgaacccgagtgaaactttc

SEQ ID NO: 169427 - DNA, 25 bp, Homo sapien
gagacagctgcctcgtgctctagca

SEQ ID NO: 169428 - DNA, 25 bp, Homo sapien
tctggctccatcttgggccgcggca

SEQ ID NO: 169429 - DNA, 25 bp, Homo sapien
tgcgcctatacacccgggacggtgg

SEQ ID NO: 169430 - DNA, 25 bp, Homo sapien
ggagctgcgcctatacacccgggac

SEQ ID NO: 169431 - DNA, 25 bp, Homo sapien
cacctggcacctgtggcggccgcag

SEQ ID NO: 169432 - DNA, 25 bp, Homo sapien
agaatcgtggggagctgcgcctata

SEQ ID NO: 169433 - DNA, 25 bp, Homo sapien
atctggagccagagaattgtgagag

SEQ ID NO: 169434 - DNA, 25 bp, Homo sapien
cgcccaggccaggtcggctctggct

SEQ ID NO: 169435 - DNA, 25 bp, Homo sapien
caggctccagagtggcacgggccca

SEQ ID NO: 169436 - DNA, 25 bp, Homo sapien
cgttctgaccggacagtgtcactgg

SEQ ID NO: 169437 - DNA, 25 bp, Homo sapien
tttggagctctcgttgctgctacca

SEQ ID NO: 169438 - DNA, 25 bp, Homo sapien
cgcgttgggttctttccattgccga

SEQ ID NO: 169439 - DNA, 25 bp, Homo sapien
ttaccagggtctgtggatgaactgc

SEQ ID NO: 169440 - DNA, 25 bp, Homo sapien
cgcgacatgtccagggcgcagatct

SEQ ID NO: 169441 - DNA, 25 bp, Homo sapien
ttgctgctaccacgtccaatgagtg

SEQ ID NO: 169442 - DNA, 25 bp, Homo sapien
cgagcctcctcggtgataacagcca

SEQ ID NO: 169443 - DNA, 25 bp, Homo sapien
ataacagccacttgggtttaccagg

SEQ ID NO: 169444 - DNA, 25 bp, Homo sapien
ttcatggtctccatctcaggctggg

SEQ ID NO: 169445 - DNA, 25 bp, Homo sapien
cgtctctcccaacagggccttaggg

SEQ ID NO: 169446 - DNA, 25 bp, Homo sapien
ccaacctgtggaaggcgtgcgttac

SEQ ID NO: 169447 - DNA, 25 bp, Homo sapien
acgctgcccaccgactactggaagg

SEQ ID NO: 169448 - DNA, 25 bp, Homo sapien
ttcggagatcatcgccttcatggtc

SEQ ID NO: 169449 - DNA, 25 bp, Homo sapien
ggtgtctaccatcgacggcacggtc

SEQ ID NO: 169450 - DNA, 25 bp, Homo sapien
cgggcgtctccaactgcaaggactt

SEQ ID NO: 169451 - DNA, 25 bp, Homo sapien
tgcgttaccgactccacgggcgtct

SEQ ID NO: 169452 - DNA, 25 bp, Homo sapien
tcccgcctcttaccatgcttgaaaa

SEQ ID NO: 169453 - DNA, 25 bp, Homo sapien
aactgcgccagacggatgagcttca

SEQ ID NO: 169454 - DNA, 25 bp, Homo sapien
cggcgtttgcactcttccttgagcg

SEQ ID NO: 169455 - DNA, 25 bp, Homo sapien
tgggcacttctcgtcttccagcttg

SEQ ID NO: 169456 - DNA, 25 bp, Homo sapien
gttcatgatgttctcctgcagcgtc

SEQ ID NO: 169457 - DNA, 25 bp, Homo sapien
cctgcgggaccagagaagacctctt

SEQ ID NO: 169458 - DNA, 25 bp, Homo sapien
gcgtccaggacgttgctatagcagc

SEQ ID NO: 169459 - DNA, 25 bp, Homo sapien
ttccagcttgcagaaggtgatgttc

SEQ ID NO: 169460 - DNA, 25 bp, Homo sapien
gttggccgccacactccatcgtggg

SEQ ID NO: 169461 - DNA, 25 bp, Homo sapien
ccggaccacggacgactcaggatac

SEQ ID NO: 169462 - DNA, 25 bp, Homo sapien
tgaaacgtgtctggtctgggcaagt

SEQ ID NO: 169463 - DNA, 25 bp, Homo sapien
ggcggctactccagctggatctgca

SEQ ID NO: 169464 - DNA, 25 bp, Homo sapien
caaaagccgagagacgcgggttcca

SEQ ID NO: 169465 - DNA, 25 bp, Homo sapien
cgggcagccgaaccagcagacaaaa

SEQ ID NO: 169466 - DNA, 25 bp, Homo sapien
ccttgcgtggatctcggtcacaaga

SEQ ID NO: 169467 - DNA, 25 bp, Homo sapien
gcgagcgtctagaccgcagcgctaa

SEQ ID NO: 169468 - DNA, 25 bp, Homo sapien
tggatctgcagtacgaaggtgagtc

SEQ ID NO: 169469 - DNA, 25 bp, Homo sapien
cccttcctgctagtcctggtggatc

SEQ ID NO: 169470 - DNA, 25 bp, Homo sapien
tgctggtgggccacacacctttcct

SEQ ID NO: 169471 - DNA, 25 bp, Homo sapien
agcctcgtctcgtgcttccacgtta

SEQ ID NO: 169472 - DNA, 25 bp, Homo sapien
cacgctggcgaacctggaaaggatc

SEQ ID NO: 169473 - DNA, 25 bp, Homo sapien
gtttggccttcccattcgtacgctg

SEQ ID NO: 169474 - DNA, 25 bp, Homo sapien
gcaccgggctacgacttcaggaagt

SEQ ID NO: 169475 - DNA, 25 bp, Homo sapien
ttccacgttatcctatcagggacgg

SEQ ID NO: 169476 - DNA, 25 bp, Homo sapien
ccgcgggtccattcccaggactttg

SEQ ID NO: 169477 - DNA, 25 bp, Homo sapien
gttctcggacagaggccttaggaca

SEQ ID NO: 169478 - DNA, 25 bp, Homo sapien
agcctagtagcagccgcaccacgtt

SEQ ID NO: 169479 - DNA, 25 bp, Homo sapien
cacttcgcggccaagtgggcagtca

SEQ ID NO: 169480 - DNA, 25 bp, Homo sapien
cagacacccgctgcgagcacgaaga

SEQ ID NO: 169481 - DNA, 25 bp, Homo sapien
ttgctgagcggcgtcacagatgctc

SEQ ID NO: 169482 - DNA, 25 bp, Homo sapien
tcggacccggtacccacagtctgtg

SEQ ID NO: 169483 - DNA, 25 bp, Homo sapien
ctggcgccatggcacggagagaaaa

SEQ ID NO: 169484 - DNA, 25 bp, Homo sapien
aggctcccgagttgtctactcagaa

SEQ ID NO: 169485 - DNA, 25 bp, Homo sapien
gggcgttgtttctcacatcggtgtc

SEQ ID NO: 169486 - DNA, 25 bp, Homo sapien
tgtctactcagaaacgcgggcgttg

SEQ ID NO: 169487 - DNA, 25 bp, Homo sapien
ccgcttccctcagcgtgaggtagga

SEQ ID NO: 169488 - DNA, 25 bp, Homo sapien
gtccctgggcccgaataactgtcgc

SEQ ID NO: 169489 - DNA, 25 bp, Homo sapien
ttggattccgcgcttggcaacggct

SEQ ID NO: 169490 - DNA, 25 bp, Homo sapien
tgggagcggcttccttggattccgc

SEQ ID NO: 169491 - DNA, 25 bp, Homo sapien
tgaccgcttggcgatgtcccaagtc

SEQ ID NO: 169492 - DNA, 25 bp, Homo sapien
ctggtgaagaacatccggctggagc

SEQ ID NO: 169493 - DNA, 25 bp, Homo sapien
tgaaaggttcaacaagtggctgctg

SEQ ID NO: 169494 - DNA, 25 bp, Homo sapien
tggtcatcatgtaccagtacgtgtc

SEQ ID NO: 169495 - DNA, 25 bp, Homo sapien
gtgccgcgcttcaacttcagcctga

SEQ ID NO: 169496 - DNA, 25 bp, Homo sapien
gacccgcttcgtggatttcaacatc

SEQ ID NO: 169497 - DNA, 25 bp, Homo sapien
tttcaacatcaaagggcgcgacgtg

SEQ ID NO: 169498 - DNA, 25 bp, Homo sapien
cgcgacgtgatcgtgttcctccaca

SEQ ID NO: 169499 - DNA, 25 bp, Homo sapien
tcagcctgaaggacctgacccgctt

SEQ ID NO: 169500 - DNA, 25 bp, Homo sapien
ccagcgtgcctgtgcagcctagttg

SEQ ID NO: 169501 - DNA, 25 bp, Homo sapien
agcctagttggtcccggaccgcaga

SEQ ID NO: 169502 - DNA, 25 bp, Homo sapien
agtgcgtgttctcgggtcctcgccc

SEQ ID NO: 169503 - DNA, 25 bp, Homo sapien
gagcaagtgcgtgttctcgggtcct

SEQ ID NO: 169504 - DNA, 25 bp, Homo sapien
aggcccagcgagcaagtgcgtgttc

SEQ ID NO: 169505 - DNA, 25 bp, Homo sapien
cggaccgcagacctgtcccggggag

SEQ ID NO: 169506 - DNA, 25 bp, Homo sapien
ctgtgcagcctagttggtcccggac

SEQ ID NO: 169507 - DNA, 25 bp, Homo sapien
tccgtccgaccctgcctgctgcagg

SEQ ID NO: 169508 - DNA, 25 bp, Homo sapien
cacagtcatggtaagtgcggccgcc

SEQ ID NO: 169509 - DNA, 25 bp, Homo sapien
accaagccaaccaagctgcggtggc

SEQ ID NO: 169510 - DNA, 25 bp, Homo sapien
cacttgcaggccaaaatcaaagctg

SEQ ID NO: 169511 - DNA, 25 bp, Homo sapien
tatggattacataaaggggcgttgc

SEQ ID NO: 169512 - DNA, 25 bp, Homo sapien
caagtgacaacaccgtaaccgtttg

SEQ ID NO: 169513 - DNA, 25 bp, Homo sapien
gagagaccgactgccgctttgcaca

SEQ ID NO: 169514 - DNA, 25 bp, Homo sapien
ttccagcgaggaaactgtgcccggg

SEQ ID NO: 169515 - DNA, 25 bp, Homo sapien
tgtcttaggtatgcagggagttcca

SEQ ID NO: 169516 - DNA, 25 bp, Homo sapien
cccacccttcttcatcttcgggcgc

SEQ ID NO: 169517 - DNA, 25 bp, Homo sapien
atcccgcggtctggtttgcggctag

SEQ ID NO: 169518 - DNA, 25 bp, Homo sapien
gtgacaggacccgacgcctcctggt

SEQ ID NO: 169519 - DNA, 25 bp, Homo sapien
acccgacgcctcctggtgggcattt

SEQ ID NO: 169520 - DNA, 25 bp, Homo sapien
ctcctggtgggcatttcgctccaag

SEQ ID NO: 169521 - DNA, 25 bp, Homo sapien
gacagtcccaccctcaccgacagga

SEQ ID NO: 169522 - DNA, 25 bp, Homo sapien
tgggcatttcgctccaagccgggac

SEQ ID NO: 169523 - DNA, 25 bp, Homo sapien
tggcttgcggctgatcccgcggtct

SEQ ID NO: 169524 - DNA, 25 bp, Homo sapien
gaattcttaatgtctcgggagtctc

SEQ ID NO: 169525 - DNA, 25 bp, Homo sapien
agcttcattttgttgcgtttacaca

SEQ ID NO: 169526 - DNA, 25 bp, Homo sapien
cttcagtcagaagcctgtaggtgcc

SEQ ID NO: 169527 - DNA, 25 bp, Homo sapien
cccgcctcaggataaagcttggagg

SEQ ID NO: 169528 - DNA, 25 bp, Homo sapien
agtctcaggttgacgctgctcctgg

SEQ ID NO: 169529 - DNA, 25 bp, Homo sapien
aactgcgcatgctcggtacacaggc

SEQ ID NO: 169530 - DNA, 25 bp, Homo sapien
gtgcttgtttatctccgcgcgggca

SEQ ID NO: 169531 - DNA, 25 bp, Homo sapien
aaccaaagctctaggagtgctgaca

SEQ ID NO: 169532 - DNA, 25 bp, Homo sapien
cgagaagtccgtgagtagaaggtac

SEQ ID NO: 169533 - DNA, 25 bp, Homo sapien
cccgacaatgtggtccggaaacagg

SEQ ID NO: 169534 - DNA, 25 bp, Homo sapien
cagttctacctgctcctgggaaacc

SEQ ID NO: 169535 - DNA, 25 bp, Homo sapien
cggcggagcagcaacagttctacct

SEQ ID NO: 169536 - DNA, 25 bp, Homo sapien
tctctcacgcctagcgcaatggcgg

SEQ ID NO: 169537 - DNA, 25 bp, Homo sapien
gcaccgcagggtgcgtggccaatca

SEQ ID NO: 169538 - DNA, 25 bp, Homo sapien
tgggtctaaagggactgccttcctg

SEQ ID NO: 169539 - DNA, 25 bp, Homo sapien
tccggaaacaggcagaggtaaccga

SEQ ID NO: 169540 - DNA, 25 bp, Homo sapien
ccctggccggaagcccaagagaggc

SEQ ID NO: 169541 - DNA, 25 bp, Homo sapien
cgggtattaatagccggcgccgccg

SEQ ID NO: 169542 - DNA, 25 bp, Homo sapien
cgccgcccgcgggtattaatagccg

SEQ ID NO: 169543 - DNA, 25 bp, Homo sapien
cgcgctgcattaggtagcgccgcgc

SEQ ID NO: 169544 - DNA, 25 bp, Homo sapien
cggttcgtttttcgccacagctgct

SEQ ID NO: 169545 - DNA, 25 bp, Homo sapien
ctcaaaaagcgacctgcagagtccg

SEQ ID NO: 169546 - DNA, 25 bp, Homo sapien
cccaggcaggacctcaaaaagcgac

SEQ ID NO: 169547 - DNA, 25 bp, Homo sapien
ccacagctgctggattcgcgtctcg

SEQ ID NO: 169548 - DNA, 25 bp, Homo sapien
tgtacaccacgtcgaggctctcagg

SEQ ID NO: 169549 - DNA, 25 bp, Homo sapien
gctccttctcggtgtcctgctcgaa

SEQ ID NO: 169550 - DNA, 25 bp, Homo sapien
ctccttgtagtccttgcagatgtca

SEQ ID NO: 169551 - DNA, 25 bp, Homo sapien
ggttttcgtcctcgcagatacagta

SEQ ID NO: 169552 - DNA, 25 bp, Homo sapien
taatgcctgcacttggtgacgactg

SEQ ID NO: 169553 - DNA, 25 bp, Homo sapien
tgagtctcaggctcccaacggccgt

SEQ ID NO: 169554 - DNA, 25 bp, Homo sapien
gcgcagctctcgcagaaataatgcc

SEQ ID NO: 169555 - DNA, 25 bp, Homo sapien
ggcctggcgacatatgaaacacctg

SEQ ID NO: 169556 - DNA, 25 bp, Homo sapien
gtgcactgccacaagcgcgtcttct

SEQ ID NO: 169557 - DNA, 25 bp, Homo sapien
ccttcgagtcataggccgactgttt

SEQ ID NO: 169558 - DNA, 25 bp, Homo sapien
atgacctcgggtgccatccagaatg

SEQ ID NO: 169559 - DNA, 25 bp, Homo sapien
ttccttttgatctgggtgtctgtca

SEQ ID NO: 169560 - DNA, 25 bp, Homo sapien
gtcagctggccagccacgccaaagt

SEQ ID NO: 169561 - DNA, 25 bp, Homo sapien
gtggcgaacccaccgagcacaggca

SEQ ID NO: 169562 - DNA, 25 bp, Homo sapien
cggtgcggacttacaactccgtgca

SEQ ID NO: 169563 - DNA, 25 bp, Homo sapien
cagcaggacgttggccgctgcaaaa

SEQ ID NO: 169564 - DNA, 25 bp, Homo sapien
ggttcctacggctcctgcacgcaca

SEQ ID NO: 169565 - DNA, 25 bp, Homo sapien
tcgcggttaccttcctccactccac

SEQ ID NO: 169566 - DNA, 25 bp, Homo sapien
ccacctcacttctcccggggacagg

SEQ ID NO: 169567 - DNA, 25 bp, Homo sapien
gcgtctccatgcacggcgccaggga

SEQ ID NO: 169568 - DNA, 25 bp, Homo sapien
tcctgcacgcacacgccggagacct

SEQ ID NO: 169569 - DNA, 25 bp, Homo sapien
gacgccgtgtggataccgccaagtt

SEQ ID NO: 169570 - DNA, 25 bp, Homo sapien
gataccgccaagttgctgcttccgc

SEQ ID NO: 169571 - DNA, 25 bp, Homo sapien
gggggcctccaagggcatcactcca

SEQ ID NO: 169572 - DNA, 25 bp, Homo sapien
cgcgtagctccgagtctttagcccg

SEQ ID NO: 169573 - DNA, 25 bp, Homo sapien
ggcaggtgctactcctccgacctga

SEQ ID NO: 169574 - DNA, 25 bp, Homo sapien
agctccgagtctttagcccggccgg

SEQ ID NO: 169575 - DNA, 25 bp, Homo sapien
ccaggatcgcaacctcggcggagtc

SEQ ID NO: 169576 - DNA, 25 bp, Homo sapien
gtgggaatacgaggattacagtgcc

SEQ ID NO: 169577 - DNA, 25 bp, Homo sapien
ggtcccgtcccgctccaagcgcact

SEQ ID NO: 169578 - DNA, 25 bp, Homo sapien
cagttagacggtgtttctgccgccc

SEQ ID NO: 169579 - DNA, 25 bp, Homo sapien
cccacccgccgagcgtacccatggc

SEQ ID NO: 169580 - DNA, 25 bp, Homo sapien
tgtccctcaggtctggatgctggta

SEQ ID NO: 169581 - DNA, 25 bp, Homo sapien
aaatgttttcagctcctggaggcga

SEQ ID NO: 169582 - DNA, 25 bp, Homo sapien
actgcacaagtgacaaaatgttttc

SEQ ID NO: 169583 - DNA, 25 bp, Homo sapien
tcggcgcgaatctgaaagcgctttc

SEQ ID NO: 169584 - DNA, 25 bp, Homo sapien
ggggcactggtgagtacactgcaca

SEQ ID NO: 169585 - DNA, 25 bp, Homo sapien
gcccttcgggttattccgctcaaga

SEQ ID NO: 169586 - DNA, 25 bp, Homo sapien
gacctcgctcagtcggcttctcggt

SEQ ID NO: 169587 - DNA, 25 bp, Homo sapien
gtgcagagtcgctctgtgtccgtga

SEQ ID NO: 169588 - DNA, 25 bp, Homo sapien
ttatgtggcaccgatcggaacccgc

SEQ ID NO: 169589 - DNA, 25 bp, Homo sapien
gagcctcggttatgtcgcctgtaac

SEQ ID NO: 169590 - DNA, 25 bp, Homo sapien
cagaggtctcaggaaagtagccttt

SEQ ID NO: 169591 - DNA, 25 bp, Homo sapien
tgtaacctgaggacaacggcctgga

SEQ ID NO: 169592 - DNA, 25 bp, Homo sapien
gtaccagggaaactgcgatgcgccg

SEQ ID NO: 169593 - DNA, 25 bp, Homo sapien
gcttgcgagcccaccgtgacgcaga

SEQ ID NO: 169594 - DNA, 25 bp, Homo sapien
tgggcaatacttcggagcctcggtt

SEQ ID NO: 169595 - DNA, 25 bp, Homo sapien
tcaccttggacgtgggcaatacttc

SEQ ID NO: 169596 - DNA, 25 bp, Homo sapien
cgaaccctgctagttcccggtcttg

SEQ ID NO: 169597 - DNA, 25 bp, Homo sapien
agagattagaagtggcgctcctgcc

SEQ ID NO: 169598 - DNA, 25 bp, Homo sapien
cagtgccacccgtttttacctcagg

SEQ ID NO: 169599 - DNA, 25 bp, Homo sapien
tctgaccgccatcgtttcaacctgg

SEQ ID NO: 169600 - DNA, 25 bp, Homo sapien
ttcaacctggagaggtgagccctcc

SEQ ID NO: 169601 - DNA, 25 bp, Homo sapien
cggattcgtcgctccgccaagagtg

SEQ ID NO: 169602 - DNA, 25 bp, Homo sapien
cccggaaagacacaacgcgcgtgga

SEQ ID NO: 169603 - DNA, 25 bp, Homo sapien
accctaggcacctctttgaggaggc

SEQ ID NO: 169604 - DNA, 25 bp, Homo sapien
tctgggcgctatgggcattaggata

SEQ ID NO: 169605 - DNA, 25 bp, Homo sapien
agaaagacagcgcagctccagcctg

SEQ ID NO: 169606 - DNA, 25 bp, Homo sapien
ctccagcctgcctgtatccagggtt

SEQ ID NO: 169607 - DNA, 25 bp, Homo sapien
gcgggagcgtagcagccgctccact

SEQ ID NO: 169608 - DNA, 25 bp, Homo sapien
tccgcacgcaggcagcatcggggca

SEQ ID NO: 169609 - DNA, 25 bp, Homo sapien
ggcgcagagcgtcacactggatctg

SEQ ID NO: 169610 - DNA, 25 bp, Homo sapien
tctcctcacctgagacatgggcggc

SEQ ID NO: 169611 - DNA, 25 bp, Homo sapien
tgcatctgaggtgtctgggcgctat

SEQ ID NO: 169612 - DNA, 25 bp, Homo sapien
cagggcctccattttgtggcctgcg

SEQ ID NO: 169613 - DNA, 25 bp, Homo sapien
accgggtagacaccgcagccacgta

SEQ ID NO: 169614 - DNA, 25 bp, Homo sapien
gacccaggccgacctagatgacgtg

SEQ ID NO: 169615 - DNA, 25 bp, Homo sapien
ctagatgacgtgtccgagtaggagt

SEQ ID NO: 169616 - DNA, 25 bp, Homo sapien
ggccctgcgcatgcgtgatacttgc

SEQ ID NO: 169617 - DNA, 25 bp, Homo sapien
cgcatgcgtgatacttgcaccggtc

SEQ ID NO: 169618 - DNA, 25 bp, Homo sapien
gtctttcggcacgacagcgcccagg

SEQ ID NO: 169619 - DNA, 25 bp, Homo sapien
agacaccgcagccacgtaaccaagg

SEQ ID NO: 169620 - DNA, 25 bp, Homo sapien
aacaactatcatgagcgcgaggctg

SEQ ID NO: 169621 - DNA, 25 bp, Homo sapien
tgagaacttcgtaagacccagcagc

SEQ ID NO: 169622 - DNA, 25 bp, Homo sapien
aaccacctcagctggcgcgcggaaa

SEQ ID NO: 169623 - DNA, 25 bp, Homo sapien
cctgcgaccgttctcactgagcatg

SEQ ID NO: 169624 - DNA, 25 bp, Homo sapien
ggccttgtagtcgtctccgagactc

SEQ ID NO: 169625 - DNA, 25 bp, Homo sapien
cgcccgtcaacttctgcgacgaaga

SEQ ID NO: 169626 - DNA, 25 bp, Homo sapien
cgagccctctgatgcactgttggaa

SEQ ID NO: 169627 - DNA, 25 bp, Homo sapien
tagcgcaaccggaactagccttctg

SEQ ID NO: 169628 - DNA, 25 bp, Homo sapien
atgcgcctcccacgcgctggctcga

SEQ ID NO: 169629 - DNA, 25 bp, Homo sapien
acctcgtccaaggtcgctgccgccc

SEQ ID NO: 169630 - DNA, 25 bp, Homo sapien
agccggacggaagcaccatgcgcct

SEQ ID NO: 169631 - DNA, 25 bp, Homo sapien
aacccagccggacggaagcaccatg

SEQ ID NO: 169632 - DNA, 25 bp, Homo sapien
cgctgctgaggctgtgagtgcaggt

SEQ ID NO: 169633 - DNA, 25 bp, Homo sapien
aagatggcgctacgtctgctgcgga

SEQ ID NO: 169634 - DNA, 25 bp, Homo sapien
ggcagttgacctcgggactcgccgc

SEQ ID NO: 169635 - DNA, 25 bp, Homo sapien
tccctttgggagggccctcgttgca

SEQ ID NO: 169636 - DNA, 25 bp, Homo sapien
ggacaaaagacgaggatgccagttc

SEQ ID NO: 169637 - DNA, 25 bp, Homo sapien
gggcagaacccaagcccgtgccttc

SEQ ID NO: 169638 - DNA, 25 bp, Homo sapien
cctgccttcggagtttcctgctatt

SEQ ID NO: 169639 - DNA, 25 bp, Homo sapien
cggagtttcctgctattgacctggc

SEQ ID NO: 169640 - DNA, 25 bp, Homo sapien
tttcctgctattgacctggcggggc

SEQ ID NO: 169641 - DNA, 25 bp, Homo sapien
gcacagggacgtcatggacaaaaga

SEQ ID NO: 169642 - DNA, 25 bp, Homo sapien
gatgccagttcgatgtgcgagcaga

SEQ ID NO: 169643 - DNA, 25 bp, Homo sapien
ttcgatgtgcgagcagaaggccgcc

SEQ ID NO: 169644 - DNA, 25 bp, Homo sapien
agcgttcccgtctgatgtcccagtg

SEQ ID NO: 169645 - DNA, 25 bp, Homo sapien
gatgtcccagtgttagtcctcccgg

SEQ ID NO: 169646 - DNA, 25 bp, Homo sapien
agtcctgcgggatgaagacttcacc

SEQ ID NO: 169647 - DNA, 25 bp, Homo sapien
tgaaagtaactccttccgtggcata

SEQ ID NO: 169648 - DNA, 25 bp, Homo sapien
cgtggcatatttcgctgggcagata

SEQ ID NO: 169649 - DNA, 25 bp, Homo sapien
caccgcctccgatttgaatttgaaa

SEQ ID NO: 169650 - DNA, 25 bp, Homo sapien
ctgggcagatagaacaaaccatgtc

SEQ ID NO: 169651 - DNA, 25 bp, Homo sapien
attcacacttttgcacccggtcgtt

SEQ ID NO: 169652 - DNA, 25 bp, Homo sapien
tgcccacgacgtaaagagcgacttg

SEQ ID NO: 169653 - DNA, 25 bp, Homo sapien
ataacgtctctctcgggtctcccag

SEQ ID NO: 169654 - DNA, 25 bp, Homo sapien
ctgttgctaggagcccgagaaacta

SEQ ID NO: 169655 - DNA, 25 bp, Homo sapien
cccggctgtaatggtggcagatcaa

SEQ ID NO: 169656 - DNA, 25 bp, Homo sapien
ttggcagcatatcgccttccgagtc

SEQ ID NO: 169657 - DNA, 25 bp, Homo sapien
ccactgtaagtgaccggctgggttt

SEQ ID NO: 169658 - DNA, 25 bp, Homo sapien
tccgagtcagtaagaattgcccacg

SEQ ID NO: 169659 - DNA, 25 bp, Homo sapien
tttgacttttgcttcttccgacgga

SEQ ID NO: 169660 - DNA, 25 bp, Homo sapien
cttttgtgctcgttttgcaggccca

SEQ ID NO: 169661 - DNA, 25 bp, Homo sapien
cgcgctcctcgctgctaattacaaa

SEQ ID NO: 169662 - DNA, 25 bp, Homo sapien
gcccattgtgggctgtttaactcca

SEQ ID NO: 169663 - DNA, 25 bp, Homo sapien
caccaggctcctcggaaagacatcg

SEQ ID NO: 169664 - DNA, 25 bp, Homo sapien
catcggggctaataggtgaagtcac

SEQ ID NO: 169665 - DNA, 25 bp, Homo sapien
cacttttgcagctcggacacccaga

SEQ ID NO: 169666 - DNA, 25 bp, Homo sapien
gccctcttcttgtagcgcccttgtg

SEQ ID NO: 169667 - DNA, 25 bp, Homo sapien
ctctccaaagggatcccgggtctcg

SEQ ID NO: 169668 - DNA, 25 bp, Homo sapien
gcgacccttcaaagcgcctcggtga

SEQ ID NO: 169669 - DNA, 25 bp, Homo sapien
cctcggtgatgaacgacccttatta

SEQ ID NO: 169670 - DNA, 25 bp, Homo sapien
cccttattaaatatggcccgagctg

SEQ ID NO: 169671 - DNA, 25 bp, Homo sapien
cctgactctttttgtccgcagccga

SEQ ID NO: 169672 - DNA, 25 bp, Homo sapien
aatacaacttcttatctgccgaccc

SEQ ID NO: 169673 - DNA, 25 bp, Homo sapien
ctccgcctttctaatgggcacaggg

SEQ ID NO: 169674 - DNA, 25 bp, Homo sapien
tttaaatgtcacctccgcctttcta

SEQ ID NO: 169675 - DNA, 25 bp, Homo sapien
ctttttgtccgcagccgagtggcgt

SEQ ID NO: 169676 - DNA, 25 bp, Homo sapien
ccggtgactctaaccagggatttca

SEQ ID NO: 169677 - DNA, 25 bp, Homo sapien
gcttcatctgacacgggcatccctg

SEQ ID NO: 169678 - DNA, 25 bp, Homo sapien
cgccgcctttccatggagactcgta

SEQ ID NO: 169679 - DNA, 25 bp, Homo sapien
ctgaagagagtgcaccgagcaaacc

SEQ ID NO: 169680 - DNA, 25 bp, Homo sapien
tccagcatcgacaaacagggcgcca

SEQ ID NO: 169681 - DNA, 25 bp, Homo sapien
gtacctgcctgaagcctactgcctg

SEQ ID NO: 169682 - DNA, 25 bp, Homo sapien
tgcagaatctcctacgacccggcga

SEQ ID NO: 169683 - DNA, 25 bp, Homo sapien
tggaaaagttcacggaggctccctg

SEQ ID NO: 169684 - DNA, 25 bp, Homo sapien
tggacctgagccgttgccaaatccg

SEQ ID NO: 169685 - DNA, 25 bp, Homo sapien
ccggggatgcccaagttgcacttgc

SEQ ID NO: 169686 - DNA, 25 bp, Homo sapien
ctgcacagtgggaccgagattttgg

SEQ ID NO: 169687 - DNA, 25 bp, Homo sapien
tccagcgattggcagagtgaacacc

SEQ ID NO: 169688 - DNA, 25 bp, Homo sapien
tgtcctggcctcttaactctgctta

SEQ ID NO: 169689 - DNA, 25 bp, Homo sapien
gcccgccttcaaaaacatgtatgta

SEQ ID NO: 169690 - DNA, 25 bp, Homo sapien
cgccgggaagcctgtcatattctga

SEQ ID NO: 169691 - DNA, 25 bp, Homo sapien
tgggcgctctttaacttcttttgtc

SEQ ID NO: 169692 - DNA, 25 bp, Homo sapien
tccgcgagacgcagagccaaaaacc

SEQ ID NO: 169693 - DNA, 25 bp, Homo sapien
gcaggaaatgcaaccgtccgcgaga

SEQ ID NO: 169694 - DNA, 25 bp, Homo sapien
cgccagaaacaccaagcgcgggttg

SEQ ID NO: 169695 - DNA, 25 bp, Homo sapien
acaatgtccaatagctgagcggccc

SEQ ID NO: 169696 - DNA, 25 bp, Homo sapien
gcccggggattagtccctttgatca

SEQ ID NO: 169697 - DNA, 25 bp, Homo sapien
ggatgggccctctcagaacacaatg

SEQ ID NO: 169698 - DNA, 25 bp, Homo sapien
cattaaggcggactgatcccgatta

SEQ ID NO: 169699 - DNA, 25 bp, Homo sapien
gcgtttttacgagagcctcctggga

SEQ ID NO: 169700 - DNA, 25 bp, Homo sapien
atgagctcctgcttgattggctgcc

SEQ ID NO: 169701 - DNA, 25 bp, Homo sapien
acctgtatgagtacgcttgtggatc

SEQ ID NO: 169702 - DNA, 25 bp, Homo sapien
cggggacagacacccacctgtatga

SEQ ID NO: 169703 - DNA, 25 bp, Homo sapien
acatgtccgggttatacgtatgcga

SEQ ID NO: 169704 - DNA, 25 bp, Homo sapien
gggcctgtgtgtgctatcgaattac

SEQ ID NO: 169705 - DNA, 25 bp, Homo sapien
agcgcattcctgtcttcccggaggg

SEQ ID NO: 169706 - DNA, 25 bp, Homo sapien
ctgccgcatgtagcgcaggaaggcc

SEQ ID NO: 169707 - DNA, 25 bp, Homo sapien
acgtgctccaccgtgacgtgattca

SEQ ID NO: 169708 - DNA, 25 bp, Homo sapien
tcctgactgccggttggaggctaca

SEQ ID NO: 169709 - DNA, 25 bp, Homo sapien
agatctgtctgcaagggacccttcc

SEQ ID NO: 169710 - DNA, 25 bp, Homo sapien
ccgatgtgaacacagcccggggaaa

SEQ ID NO: 169711 - DNA, 25 bp, Homo sapien
gcctggcgccactaagcggcgctga

SEQ ID NO: 169712 - DNA, 25 bp, Homo sapien
gcttttaggagtttgctggtcacga

SEQ ID NO: 169713 - DNA, 25 bp, Homo sapien
ggggacgcgacctcgtccaagatct

SEQ ID NO: 169714 - DNA, 25 bp, Homo sapien
cgacctcgtccaagatctgtctgca

SEQ ID NO: 169715 - DNA, 25 bp, Homo sapien
gaaagcggatttccaggcacgcctg

SEQ ID NO: 169716 - DNA, 25 bp, Homo sapien
tttactacgcgaggcgcagccaatg

SEQ ID NO: 169717 - DNA, 25 bp, Homo sapien
taatacactttggttctccgcctgg

SEQ ID NO: 169718 - DNA, 25 bp, Homo sapien
tgtgactgcattctaccggcgctgc

SEQ ID NO: 169719 - DNA, 25 bp, Homo sapien
tcgtggccactgcaagtttactacg

SEQ ID NO: 169720 - DNA, 25 bp, Homo sapien
ctgccttcatctggggaaattcgtg

SEQ ID NO: 169721 - DNA, 25 bp, Homo sapien
tcctcctccggcacaacttaaagaa

SEQ ID NO: 169722 - DNA, 25 bp, Homo sapien
tgttattgtttttcagcccagcctc

SEQ ID NO: 169723 - DNA, 25 bp, Homo sapien
cgccgcagctcctttaatacacttt

SEQ ID NO: 169724 - DNA, 25 bp, Homo sapien
agccagcgccgatgtttgccgtcca

SEQ ID NO: 169725 - DNA, 25 bp, Homo sapien
cgctgcggaagcacatgaaggtacc

SEQ ID NO: 169726 - DNA, 25 bp, Homo sapien
tccgataagccctatctctgcaaga

SEQ ID NO: 169727 - DNA, 25 bp, Homo sapien
catgcacgtccacacctccgataag

SEQ ID NO: 169728 - DNA, 25 bp, Homo sapien
ccgttccagtgtgagtttgagggct

SEQ ID NO: 169729 - DNA, 25 bp, Homo sapien
acatgaaggtaccaccgcggcggcc

SEQ ID NO: 169730 - DNA, 25 bp, Homo sapien
gtttgccgtccacaggggagaagcc

SEQ ID NO: 169731 - DNA, 25 bp, Homo sapien
gaagccgttccagtgtgagtttgag

SEQ ID NO: 169732 - DNA, 25 bp, Homo sapien
ccctggactctgtgctgttctgcgt

SEQ ID NO: 169733 - DNA, 25 bp, Homo sapien
gcgcccactagagactcgggtccta

SEQ ID NO: 169734 - DNA, 25 bp, Homo sapien
ttgaacttcagtgagcctaggccgg

SEQ ID NO: 169735 - DNA, 25 bp, Homo sapien
atcacagactgtaccggaggctcgg

SEQ ID NO: 169736 - DNA, 25 bp, Homo sapien
tcactccaggatcagaggccgcgtc

SEQ ID NO: 169737 - DNA, 25 bp, Homo sapien
ccggcatcggtatcagctttccctg

SEQ ID NO: 169738 - DNA, 25 bp, Homo sapien
ctcgggaggcccgtcattattatta

SEQ ID NO: 169739 - DNA, 25 bp, Homo sapien
tagccgccgccgtcaacttgaactt

SEQ ID NO: 169740 - DNA, 25 bp, Homo sapien
atcttcggcagggaattcgagacca

SEQ ID NO: 169741 - DNA, 25 bp, Homo sapien
gaggtcccttgcctttgcgcgcgcg

SEQ ID NO: 169742 - DNA, 25 bp, Homo sapien
cccacgaagcgagaggatgctcagc

SEQ ID NO: 169743 - DNA, 25 bp, Homo sapien
cgagcttttgaagaggtgacacctc

SEQ ID NO: 169744 - DNA, 25 bp, Homo sapien
caggagccgacgagcttttgaagag

SEQ ID NO: 169745 - DNA, 25 bp, Homo sapien
cccgacagtccgagaactctcggtg

SEQ ID NO: 169746 - DNA, 25 bp, Homo sapien
aattcgagaccagggtcctcccact

SEQ ID NO: 169747 - DNA, 25 bp, Homo sapien
agccaagatcttcggcagggaattc

SEQ ID NO: 169748 - DNA, 25 bp, Homo sapien
ctcctgatcctttcctgcggtcata

SEQ ID NO: 169749 - DNA, 25 bp, Homo sapien
tgcggtcatacaagttcctagggtg

SEQ ID NO: 169750 - DNA, 25 bp, Homo sapien
cttaagtcagagaacccggcctagg

SEQ ID NO: 169751 - DNA, 25 bp, Homo sapien
ccacagccaagagggccttaagtca

SEQ ID NO: 169752 - DNA, 25 bp, Homo sapien
ggacttgagtgaatgcagctccctc

SEQ ID NO: 169753 - DNA, 25 bp, Homo sapien
ggaacgtcgaactctctctgccttg

SEQ ID NO: 169754 - DNA, 25 bp, Homo sapien
tgctcctctttgcagaaccgacggg

SEQ ID NO: 169755 - DNA, 25 bp, Homo sapien
ccgacgggctttcaactctggaagt

SEQ ID NO: 169756 - DNA, 25 bp, Homo sapien
ggttccgcatcagctacaccgcttg

SEQ ID NO: 169757 - DNA, 25 bp, Homo sapien
ttcactgggcttctagccgtgccgc

SEQ ID NO: 169758 - DNA, 25 bp, Homo sapien
gaggcatccctcgttgcagctgttc

SEQ ID NO: 169759 - DNA, 25 bp, Homo sapien
atattgctcgaggtctgcttccagg

SEQ ID NO: 169760 - DNA, 25 bp, Homo sapien
ggcgcggaggtgactcaatgacatt

SEQ ID NO: 169761 - DNA, 25 bp, Homo sapien
caatgacattgaccggcctggatgc

SEQ ID NO: 169762 - DNA, 25 bp, Homo sapien
gcatcgggtttctggctcgtgattt

SEQ ID NO: 169763 - DNA, 25 bp, Homo sapien
gctgatggctttgggcaggcatatt

SEQ ID NO: 169764 - DNA, 25 bp, Homo sapien
ggccgggcaactctcgaagtcatcc

SEQ ID NO: 169765 - DNA, 25 bp, Homo sapien
tggccctgctgtacacgaagcactg

SEQ ID NO: 169766 - DNA, 25 bp, Homo sapien
ccgtacacgaagactagggccatcc

SEQ ID NO: 169767 - DNA, 25 bp, Homo sapien
agcatccgctcgtctaccgcgtaga

SEQ ID NO: 169768 - DNA, 25 bp, Homo sapien
cccgcttcagggtgccgtacacgaa

SEQ ID NO: 169769 - DNA, 25 bp, Homo sapien
cagcagccacgggatgttgtgctcc

SEQ ID NO: 169770 - DNA, 25 bp, Homo sapien
ctcgaagtcatccagaaagcgcagc

SEQ ID NO: 169771 - DNA, 25 bp, Homo sapien
atcaccaacgggtagggctccagcg

SEQ ID NO: 169772 - DNA, 25 bp, Homo sapien
cgccctctgcccgttctggcaatcg

SEQ ID NO: 169773 - DNA, 25 bp, Homo sapien
cgttctggcaatcgcgcccgtggcc

SEQ ID NO: 169774 - DNA, 25 bp, Homo sapien
acgccgagtgctgcggcctcgaccc

SEQ ID NO: 169775 - DNA, 25 bp, Homo sapien
cctcgcacacacgtggccgctcgca

SEQ ID NO: 169776 - DNA, 25 bp, Homo sapien
gccgctcgcacaactggccgcctaa

SEQ ID NO: 169777 - DNA, 25 bp, Homo sapien
cgcctaacagccagacccacccacg

SEQ ID NO: 169778 - DNA, 25 bp, Homo sapien
gttcctggcttttaccgccctctgc

SEQ ID NO: 169779 - DNA, 25 bp, Homo sapien
ccacccacgccgatgcccgccggag

SEQ ID NO: 169780 - DNA, 25 bp, Homo sapien
agtgagccctcgcttttcctccggg

SEQ ID NO: 169781 - DNA, 25 bp, Homo sapien
ctttgtcccatgtgcggctcacaca

SEQ ID NO: 169782 - DNA, 25 bp, Homo sapien
cgcgttacctgcaaggagcctgagc

SEQ ID NO: 169783 - DNA, 25 bp, Homo sapien
tgcggaaactctggcggctccaggc

SEQ ID NO: 169784 - DNA, 25 bp, Homo sapien
cattggctgctgctcccgtcacttt

SEQ ID NO: 169785 - DNA, 25 bp, Homo sapien
aagtccctcctcagctcattggcgg

SEQ ID NO: 169786 - DNA, 25 bp, Homo sapien
gaccctatttctggcctgtctcgcg

SEQ ID NO: 169787 - DNA, 25 bp, Homo sapien
tgtctcgcgcttcgcctgcgcggtg

SEQ ID NO: 169788 - DNA, 25 bp, Homo sapien
gtttcgcagtaaagccgcccgcgtc

SEQ ID NO: 169789 - DNA, 25 bp, Homo sapien
ctgcaagggacctgcctcagaagcc

SEQ ID NO: 169790 - DNA, 25 bp, Homo sapien
aggcctgggcatttcgcaaactcca

SEQ ID NO: 169791 - DNA, 25 bp, Homo sapien
agtcctgtttctactcggagggaag

SEQ ID NO: 169792 - DNA, 25 bp, Homo sapien
agcgcctaacacagcaaccaggatc

SEQ ID NO: 169793 - DNA, 25 bp, Homo sapien
gcagcgtctcaatcccgcgtttaca

SEQ ID NO: 169794 - DNA, 25 bp, Homo sapien
gtcgttccttcgcttgtctcatcag

SEQ ID NO: 169795 - DNA, 25 bp, Homo sapien
cgtttacaacactgagggccgtctc

SEQ ID NO: 169796 - DNA, 25 bp, Homo sapien
cgcgggttacttgatgccgtgcaaa

SEQ ID NO: 169797 - DNA, 25 bp, Homo sapien
gctcgcggagtccttgctgaaggcc

SEQ ID NO: 169798 - DNA, 25 bp, Homo sapien
ttgcacctcgctcgcggagtccttg

SEQ ID NO: 169799 - DNA, 25 bp, Homo sapien
agcagcttgcacctcgctcgcggag

SEQ ID NO: 169800 - DNA, 25 bp, Homo sapien
tcgtcaacggccgagtgctggcgcc

SEQ ID NO: 169801 - DNA, 25 bp, Homo sapien
aagactcgtcaacggccgagtgctg

SEQ ID NO: 169802 - DNA, 25 bp, Homo sapien
aactgcgactccttaggtccgcttg

SEQ ID NO: 169803 - DNA, 25 bp, Homo sapien
tgatgccgtgcaaaagccaggagac

SEQ ID NO: 169804 - DNA, 25 bp, Homo sapien
ctttcgtactcaacagcacggcggc

SEQ ID NO: 169805 - DNA, 25 bp, Homo sapien
gcaacagctaggctctcatctgcga

SEQ ID NO: 169806 - DNA, 25 bp, Homo sapien
gcagtcagtctcacagcaacagcta

SEQ ID NO: 169807 - DNA, 25 bp, Homo sapien
ccagggtcggtactggcagttcctt

SEQ ID NO: 169808 - DNA, 25 bp, Homo sapien
ttgctacagggactgcagtgatgcc

SEQ ID NO: 169809 - DNA, 25 bp, Homo sapien
gccaaggaactaacgagcgcgcatc

SEQ ID NO: 169810 - DNA, 25 bp, Homo sapien
aacacctgctagatgcccaggcggg

SEQ ID NO: 169811 - DNA, 25 bp, Homo sapien
gtgcagcgctgtagtgatgcccagt

SEQ ID NO: 169812 - DNA, 25 bp, Homo sapien
ccggttgcttgtcgcccgcgcagga

SEQ ID NO: 169813 - DNA, 25 bp, Homo sapien
ccatgagtgggtgtgcgagacctac

SEQ ID NO: 169814 - DNA, 25 bp, Homo sapien
tgagccgggcatgttcttcgggccc

SEQ ID NO: 169815 - DNA, 25 bp, Homo sapien
acgacgggagcacctgtgcaggtaa

SEQ ID NO: 169816 - DNA, 25 bp, Homo sapien
catctgccacgtgactgagccgggc

SEQ ID NO: 169817 - DNA, 25 bp, Homo sapien
actgcggcgtctgcatctgccacgt

SEQ ID NO: 169818 - DNA, 25 bp, Homo sapien
ctgacccggcctgccggttgcttgt

SEQ ID NO: 169819 - DNA, 25 bp, Homo sapien
tgcgagacctacgacgggagcacct

SEQ ID NO: 169820 - DNA, 25 bp, Homo sapien
gcaacctgcgcttcttgaggccgaa

SEQ ID NO: 169821 - DNA, 25 bp, Homo sapien
gcgaggagcagccaacttgccatct

SEQ ID NO: 169822 - DNA, 25 bp, Homo sapien
cttgccatctctggcggctgcactt

SEQ ID NO: 169823 - DNA, 25 bp, Homo sapien
cgcgacggcacccagagtgctcaga

SEQ ID NO: 169824 - DNA, 25 bp, Homo sapien
ccgaagatgcgcactttggagaaga

SEQ ID NO: 169825 - DNA, 25 bp, Homo sapien
gaagatatccaccaggttgccgttg

SEQ ID NO: 169826 - DNA, 25 bp, Homo sapien
acaggttgcccgacagcggactcca

SEQ ID NO: 169827 - DNA, 25 bp, Homo sapien
ccgcttctggcggatcaagccgcta

SEQ ID NO: 169828 - DNA, 25 bp, Homo sapien
gactctgggccaatgggtaaagcca

SEQ ID NO: 169829 - DNA, 25 bp, Homo sapien
gtggcaacggaaacttcccgcgcta

SEQ ID NO: 169830 - DNA, 25 bp, Homo sapien
gggtcagaggtcatctccgtggcaa

SEQ ID NO: 169831 - DNA, 25 bp, Homo sapien
acagcacaagctgccgggtcccaga

SEQ ID NO: 169832 - DNA, 25 bp, Homo sapien
tcagagccgaagcagtccacactcg

SEQ ID NO: 169833 - DNA, 25 bp, Homo sapien
ccggccgccatggtttccatagcaa

SEQ ID NO: 169834 - DNA, 25 bp, Homo sapien
tcggaacccagcttcacccggatta

SEQ ID NO: 169835 - DNA, 25 bp, Homo sapien
aggagtgaccttgcaaacccgcgcc

SEQ ID NO: 169836 - DNA, 25 bp, Homo sapien
cagctacgttgcattggcaaggttc

SEQ ID NO: 169837 - DNA, 25 bp, Homo sapien
aggccgtggagagccatgatctact

SEQ ID NO: 169838 - DNA, 25 bp, Homo sapien
agccatgatctactgcaccgcagtg

SEQ ID NO: 169839 - DNA, 25 bp, Homo sapien
tctccaccctgaacggagctagggg

SEQ ID NO: 169840 - DNA, 25 bp, Homo sapien
ggagctaggggacgccacacactcc

SEQ ID NO: 169841 - DNA, 25 bp, Homo sapien
accgcagtgccagcgtcaggagctt

SEQ ID NO: 169842 - DNA, 25 bp, Homo sapien
ccaatcgcctcggactgagacgcgg

SEQ ID NO: 169843 - DNA, 25 bp, Homo sapien
cagcgtcaggagcttccagagcccg

SEQ ID NO: 169844 - DNA, 25 bp, Homo sapien
gcagcagccgcaccaaaaagtttca

SEQ ID NO: 169845 - DNA, 25 bp, Homo sapien
tcgagatccgaaccctccagtaatg

SEQ ID NO: 169846 - DNA, 25 bp, Homo sapien
tttcacggtctcctgccgaagaagg

SEQ ID NO: 169847 - DNA, 25 bp, Homo sapien
tggaggcctgctgttgcctaaaaac

SEQ ID NO: 169848 - DNA, 25 bp, Homo sapien
ttcctctgccgctacccggagtatg

SEQ ID NO: 169849 - DNA, 25 bp, Homo sapien
ccgggacaccaggactctgcttgga

SEQ ID NO: 169850 - DNA, 25 bp, Homo sapien
tttgccaagcgaagggttcccatta

SEQ ID NO: 169851 - DNA, 25 bp, Homo sapien
ttcccattattcctggctggcggtc

SEQ ID NO: 169852 - DNA, 25 bp, Homo sapien
ctcccgttaaggtcaaacgctgaca

SEQ ID NO: 169853 - DNA, 25 bp, Homo sapien
cttcgcacacttctacatggggtca

SEQ ID NO: 169854 - DNA, 25 bp, Homo sapien
gtcttcctcacacccatagtcgatt

SEQ ID NO: 169855 - DNA, 25 bp, Homo sapien
attccgaggcgcgatcagctctgac

SEQ ID NO: 169856 - DNA, 25 bp, Homo sapien
tcctacccggcaaagcggacgaagc

SEQ ID NO: 169857 - DNA, 25 bp, Homo sapien
gctacttcgagccagtcacccggga

SEQ ID NO: 169858 - DNA, 25 bp, Homo sapien
gggatccgttctctccgcaaatgcg

SEQ ID NO: 169859 - DNA, 25 bp, Homo sapien
ctttgcggggatgattgtaacaatc

SEQ ID NO: 169860 - DNA, 25 bp, Homo sapien
tacttaattcgataccggcctgggc

SEQ ID NO: 169861 - DNA, 25 bp, Homo sapien
cagctcaggtttttgcgttggtcac

SEQ ID NO: 169862 - DNA, 25 bp, Homo sapien
gagggcaggcataaagcaccttgaa

SEQ ID NO: 169863 - DNA, 25 bp, Homo sapien
tgtcaatgctatccgacgacctgtc

SEQ ID NO: 169864 - DNA, 25 bp, Homo sapien
agcatcctcgctcgctccgatggga

SEQ ID NO: 169865 - DNA, 25 bp, Homo sapien
gccacctgggcattcaaaattttta

SEQ ID NO: 169866 - DNA, 25 bp, Homo sapien
ccctctggtgaacaaagctcgatta

SEQ ID NO: 169867 - DNA, 25 bp, Homo sapien
tcaccgccctggtcagcttggcagt

SEQ ID NO: 169868 - DNA, 25 bp, Homo sapien
cccgaagcgctggaagggaagatcc

SEQ ID NO: 169869 - DNA, 25 bp, Homo sapien
cggtgcagtccgtcgtagaagaatt

SEQ ID NO: 169870 - DNA, 25 bp, Homo sapien
gccagagtctctccgctttaatgcg

SEQ ID NO: 169871 - DNA, 25 bp, Homo sapien
ctggacctgtctttcttccgggagg

SEQ ID NO: 169872 - DNA, 25 bp, Homo sapien
gccaacggccattctctggacctgt

SEQ ID NO: 169873 - DNA, 25 bp, Homo sapien
tccgccctgcgcgtcgtattagacg

SEQ ID NO: 169874 - DNA, 25 bp, Homo sapien
atcctggctgttggtatccttaacg

SEQ ID NO: 169875 - DNA, 25 bp, Homo sapien
cgcagggacatcttctggctgtttc

SEQ ID NO: 169876 - DNA, 25 bp, Homo sapien
ttcagcaagaggaccaccagcgtga

SEQ ID NO: 169877 - DNA, 25 bp, Homo sapien
gtgtctcctccggtacttcagcaag

SEQ ID NO: 169878 - DNA, 25 bp, Homo sapien
cagaagacgctgtccgcagtcctta

SEQ ID NO: 169879 - DNA, 25 bp, Homo sapien
tagtcgccgctgaccttctcgtagt

SEQ ID NO: 169880 - DNA, 25 bp, Homo sapien
agtccttagcgggatgataatgtca

SEQ ID NO: 169881 - DNA, 25 bp, Homo sapien
tgttgccgtctgtgctagaacctgc

SEQ ID NO: 169882 - DNA, 25 bp, Homo sapien
tccctgcaaataaggccacttcgga

SEQ ID NO: 169883 - DNA, 25 bp, Homo sapien
tgatgcatcctgaagcaatccctgc

SEQ ID NO: 169884 - DNA, 25 bp, Homo sapien
tgtccacagcgtctggacaccgggc

SEQ ID NO: 169885 - DNA, 25 bp, Homo sapien
ctggattctggtctctgctctgagc

SEQ ID NO: 169886 - DNA, 25 bp, Homo sapien
ctggtctctgctctgagcgaggtgc

SEQ ID NO: 169887 - DNA, 25 bp, Homo sapien
ctccctgcttttgagcggggatgca

SEQ ID NO: 169888 - DNA, 25 bp, Homo sapien
gggacttgaacctgcactggctgag

SEQ ID NO: 169889 - DNA, 25 bp, Homo sapien
aacctgcactggctgagctgtggac

SEQ ID NO: 169890 - DNA, 25 bp, Homo sapien
ctctgcggagctgcctctggcacct

SEQ ID NO: 169891 - DNA, 25 bp, Homo sapien
ctggcacctgtccacagcgtctgga

SEQ ID NO: 169892 - DNA, 25 bp, Homo sapien
ccagcgccgtgcaggatttcctaaa

SEQ ID NO: 169893 - DNA, 25 bp, Homo sapien
tttagccgcgttctccagctgagcg

SEQ ID NO: 169894 - DNA, 25 bp, Homo sapien
ttcctaaacttggaatcgctcttcc

SEQ ID NO: 169895 - DNA, 25 bp, Homo sapien
cggcgtcctcaccatcagaacttta

SEQ ID NO: 169896 - DNA, 25 bp, Homo sapien
aggcggtctgcccagactgctgcag

SEQ ID NO: 169897 - DNA, 25 bp, Homo sapien
ccgccatcatggtctctcttcaatg

SEQ ID NO: 169898 - DNA, 25 bp, Homo sapien
atgacgcgccatgcgctgcattctg

SEQ ID NO: 169899 - DNA, 25 bp, Homo sapien
tccagctgagcgatcacttctgggg

SEQ ID NO: 169900 - DNA, 25 bp, Homo sapien
ggcgcggttccatgtcccggagcac

SEQ ID NO: 169901 - DNA, 25 bp, Homo sapien
ttctgcataaaaccatcaaaacacc

SEQ ID NO: 169902 - DNA, 25 bp, Homo sapien
gagtcccttctcacagccatggcga

SEQ ID NO: 169903 - DNA, 25 bp, Homo sapien
gggccgcctgtgactatagatccag

SEQ ID NO: 169904 - DNA, 25 bp, Homo sapien
tatagatccagtgcagcgggcagcg

SEQ ID NO: 169905 - DNA, 25 bp, Homo sapien
cctcccgacattgggtgccgcgagg

SEQ ID NO: 169906 - DNA, 25 bp, Homo sapien
tcagagcgctataaacgcggggccc

SEQ ID NO: 169907 - DNA, 25 bp, Homo sapien
ccgccgcgctgtcagagcgctataa

SEQ ID NO: 169908 - DNA, 25 bp, Homo sapien
cttggcggaagcctgagacgcaata

SEQ ID NO: 169909 - DNA, 25 bp, Homo sapien
cgcctcctgacgatttttgccgaag

SEQ ID NO: 169910 - DNA, 25 bp, Homo sapien
cggcgtctacagctgccacgaaggc

SEQ ID NO: 169911 - DNA, 25 bp, Homo sapien
tgtcggccaacggactttatgcctt

SEQ ID NO: 169912 - DNA, 25 bp, Homo sapien
atccttccgggagacgctctaaccg

SEQ ID NO: 169913 - DNA, 25 bp, Homo sapien
gcgcttcttgttgtgcttgctgctc

SEQ ID NO: 169914 - DNA, 25 bp, Homo sapien
tcccgagatttggaacgcttccgca

SEQ ID NO: 169915 - DNA, 25 bp, Homo sapien
tggagactctccttttcgccttggc

SEQ ID NO: 169916 - DNA, 25 bp, Homo sapien
gcggctttttggctcggagacaaaa

SEQ ID NO: 169917 - DNA, 25 bp, Homo sapien
cgggtggttcagtgaactcggatta

SEQ ID NO: 169918 - DNA, 25 bp, Homo sapien
ctagaggaagaagtcggcggctttt

SEQ ID NO: 169919 - DNA, 25 bp, Homo sapien
gacttgaagtcctcccgtgcgtctc

SEQ ID NO: 169920 - DNA, 25 bp, Homo sapien
gcgtctcgatgccaccagtttttgt

SEQ ID NO: 169921 - DNA, 25 bp, Homo sapien
gtttctttggtgaggaatcggttca

SEQ ID NO: 169922 - DNA, 25 bp, Homo sapien
gaaacttcattcctcagccggtggg

SEQ ID NO: 169923 - DNA, 25 bp, Homo sapien
cgctgggaccgaacctacaggaagc

SEQ ID NO: 169924 - DNA, 25 bp, Homo sapien
gtctccaggcgccacacgggcttgg

SEQ ID NO: 169925 - DNA, 25 bp, Homo sapien
tcgtctttgcctcggttgcccttgc

SEQ ID NO: 169926 - DNA, 25 bp, Homo sapien
gagtttcctagaaaaagagccttgc

SEQ ID NO: 169927 - DNA, 25 bp, Homo sapien
cgccacacgggcttggcagagtttc

SEQ ID NO: 169928 - DNA, 25 bp, Homo sapien
caccgtgaagcactggcccgaggac

SEQ ID NO: 169929 - DNA, 25 bp, Homo sapien
gcattctccaccgtgaagcactggc

SEQ ID NO: 169930 - DNA, 25 bp, Homo sapien
cgactccagttcctggcgcacaccg

SEQ ID NO: 169931 - DNA, 25 bp, Homo sapien
cgggcttggcagagtttcctagaaa

SEQ ID NO: 169932 - DNA, 25 bp, Homo sapien
tgtgcacctgcatcgaccgtgtagc

SEQ ID NO: 169933 - DNA, 25 bp, Homo sapien
ttattccgtcctgctgtgtgacacg

SEQ ID NO: 169934 - DNA, 25 bp, Homo sapien
tcccagtgcgtgcagttattccgtc

SEQ ID NO: 169935 - DNA, 25 bp, Homo sapien
ttggtctctgaatgcgtctcggatc

SEQ ID NO: 169936 - DNA, 25 bp, Homo sapien
tctcaactaaggaccgagccacttc

SEQ ID NO: 169937 - DNA, 25 bp, Homo sapien
gcgctggcttttgcgtcatctcctc

SEQ ID NO: 169938 - DNA, 25 bp, Homo sapien
aagttgccgccatcttcgtcctgga

SEQ ID NO: 169939 - DNA, 25 bp, Homo sapien
acagtcatcttcagtccgcgggcta

SEQ ID NO: 169940 - DNA, 25 bp, Homo sapien
tggactcggcaactcccatcacctg

SEQ ID NO: 169941 - DNA, 25 bp, Homo sapien
tgcacaaacaccctgcttgctgccc

SEQ ID NO: 169942 - DNA, 25 bp, Homo sapien
gcgcagtctacagcgctgtggactc

SEQ ID NO: 169943 - DNA, 25 bp, Homo sapien
gtctacagcgctgtggactcggcaa

SEQ ID NO: 169944 - DNA, 25 bp, Homo sapien
tacagcgctgtggactcggcaactc

SEQ ID NO: 169945 - DNA, 25 bp, Homo sapien
gcgctgtggactcggcaactcccat

SEQ ID NO: 169946 - DNA, 25 bp, Homo sapien
catcacctgccgctgcacaaacacc

SEQ ID NO: 169947 - DNA, 25 bp, Homo sapien
cggcgcagtctacagcgctgtggac

SEQ ID NO: 169948 - DNA, 25 bp, Homo sapien
gagctcatcgggtccggcacctctt

SEQ ID NO: 169949 - DNA, 25 bp, Homo sapien
ccgcgagtctgagtaagtgcggctc

SEQ ID NO: 169950 - DNA, 25 bp, Homo sapien
gcttgcagagcgatggtggactccc

SEQ ID NO: 169951 - DNA, 25 bp, Homo sapien
gccaagatccctaggtcctggagca

SEQ ID NO: 169952 - DNA, 25 bp, Homo sapien
cacgccgccgaggtatcttttccgt

SEQ ID NO: 169953 - DNA, 25 bp, Homo sapien
cagcctgtccgcgagtctgagtaag

SEQ ID NO: 169954 - DNA, 25 bp, Homo sapien
agcgccggtccgctccttctaggag

SEQ ID NO: 169955 - DNA, 25 bp, Homo sapien
gcatttgccggcgacacccgagcgg

SEQ ID NO: 169956 - DNA, 25 bp, Homo sapien
gcggccaagtgagggaccagtctca

SEQ ID NO: 169957 - DNA, 25 bp, Homo sapien
agctccattgtctcagaggccggcg

SEQ ID NO: 169958 - DNA, 25 bp, Homo sapien
tgggcagtgtcagctccattgtctc

SEQ ID NO: 169959 - DNA, 25 bp, Homo sapien
agctgttgcctcttgcgcggattct

SEQ ID NO: 169960 - DNA, 25 bp, Homo sapien
aaactggccatttcgagggacgcgg

SEQ ID NO: 169961 - DNA, 25 bp, Homo sapien
aagccttctgaactctggacctacc

SEQ ID NO: 169962 - DNA, 25 bp, Homo sapien
agaggaggcttgtcggtcccttcct

SEQ ID NO: 169963 - DNA, 25 bp, Homo sapien
atcgcggggacttcccaaccgctag

SEQ ID NO: 169964 - DNA, 25 bp, Homo sapien
gttggcccgtccatctggtctcctt

SEQ ID NO: 169965 - DNA, 25 bp, Homo sapien
tctccttcgctgcactcggtgttca

SEQ ID NO: 169966 - DNA, 25 bp, Homo sapien
ctcggtgttcagcatggatgacagc

SEQ ID NO: 169967 - DNA, 25 bp, Homo sapien
acacccggctgagtgcttcctatga

SEQ ID NO: 169968 - DNA, 25 bp, Homo sapien
cttcctatgaggctgtgagcgcctg

SEQ ID NO: 169969 - DNA, 25 bp, Homo sapien
aagcggccaacgaaggtcagccctg

SEQ ID NO: 169970 - DNA, 25 bp, Homo sapien
tgggccagtgcctcgttggcccgtc

SEQ ID NO: 169971 - DNA, 25 bp, Homo sapien
tcgcgcatgctctgacttcgccttg

SEQ ID NO: 169972 - DNA, 25 bp, Homo sapien
ctgaacttcggctacgcggctgccg

SEQ ID NO: 169973 - DNA, 25 bp, Homo sapien
ggcatctcctgctgtgccactatcg

SEQ ID NO: 169974 - DNA, 25 bp, Homo sapien
ctccgaagacgcctacaggtttgtg

SEQ ID NO: 169975 - DNA, 25 bp, Homo sapien
aagctctctgaaagctggacagcca

SEQ ID NO: 169976 - DNA, 25 bp, Homo sapien
ggaacccaacggctgcagcgacctg

SEQ ID NO: 169977 - DNA, 25 bp, Homo sapien
acgcgcggaccagctggtcagacga

SEQ ID NO: 169978 - DNA, 25 bp, Homo sapien
ccggattcgcacttcaagtgctgca

SEQ ID NO: 169979 - DNA, 25 bp, Homo sapien
acaggtttgtgaaggaccagcgccc

SEQ ID NO: 169980 - DNA, 25 bp, Homo sapien
tcagcggctcctacgaggagatatc

SEQ ID NO: 169981 - DNA, 25 bp, Homo sapien
agaggcgcccaaggttcacccaaag

SEQ ID NO: 169982 - DNA, 25 bp, Homo sapien
aggtgaagaagctgccagtcctgga

SEQ ID NO: 169983 - DNA, 25 bp, Homo sapien
agcgagcctgtgtacatcgagatgc

SEQ ID NO: 169984 - DNA, 25 bp, Homo sapien
gtcctggagaccaacctcaagtacc

SEQ ID NO: 169985 - DNA, 25 bp, Homo sapien
agattcctcctcgaaagcccaagcg

SEQ ID NO: 169986 - DNA, 25 bp, Homo sapien
gcgacgactacagcaccatgaagaa

SEQ ID NO: 169987 - DNA, 25 bp, Homo sapien
agatgaagtgttgcctgcccgacga

SEQ ID NO: 169988 - DNA, 25 bp, Homo sapien
ggccaatgctgccagtgttgttgtg

SEQ ID NO: 169989 - DNA, 25 bp, Homo sapien
ccaatgctgccagtgttgttgtggc

SEQ ID NO: 169990 - DNA, 25 bp, Homo sapien
gtggccaatgctgccagtgttgttg

SEQ ID NO: 169991 - DNA, 25 bp, Homo sapien
tgtggccaatgctgccagtgttgtt

SEQ ID NO: 169992 - DNA, 25 bp, Homo sapien
cgtgtggccaatgctgccagtgttg

SEQ ID NO: 169993 - DNA, 25 bp, Homo sapien
ccgtgtggccaatgctgccagtgtt

SEQ ID NO: 169994 - DNA, 25 bp, Homo sapien
ctccgtgtggccaatgctgccagtg

SEQ ID NO: 169995 - DNA, 25 bp, Homo sapien
gctccgtgtggccaatgctgccagt

SEQ ID NO: 169996 - DNA, 25 bp, Homo sapien
cggcgcctaagaggctagtgcgccc

SEQ ID NO: 169997 - DNA, 25 bp, Homo sapien
gcggtccgcagctcctgaagggcct

SEQ ID NO: 169998 - DNA, 25 bp, Homo sapien
ccgcagttagcggtcaacagaaagg

SEQ ID NO: 169999 - DNA, 25 bp, Homo sapien
tcaacagaaagggcgacacggaacg

SEQ ID NO: 170000 - DNA, 25 bp, Homo sapien
ttcctggcacccgagctcgccgcac

SEQ ID NO: 170001 - DNA, 25 bp, Homo sapien
tcgccgcaccgaagtctcctggtaa

SEQ ID NO: 170002 - DNA, 25 bp, Homo sapien
ccgaagtctcctggtaacagcgaca

SEQ ID NO: 170003 - DNA, 25 bp, Homo sapien
ggcaggacgggcgaaatcccccgca

SEQ ID NO: 170004 - DNA, 25 bp, Homo sapien
tgcgccattcacttgtcagcttgtc

SEQ ID NO: 170005 - DNA, 25 bp, Homo sapien
agaaagtgcggtttccatagcgccg

SEQ ID NO: 170006 - DNA, 25 bp, Homo sapien
cagcttgtcgggaagttgaaatcgc

SEQ ID NO: 170007 - DNA, 25 bp, Homo sapien
gcaccgcgctccagatcgagagcgg

SEQ ID NO: 170008 - DNA, 25 bp, Homo sapien
ttaattgggcttgagcttccgccgg

SEQ ID NO: 170009 - DNA, 25 bp, Homo sapien
tcccgcctcggactcaattaattgg

SEQ ID NO: 170010 - DNA, 25 bp, Homo sapien
ttgaaatcgcgtttgggaggtaata

SEQ ID NO: 170011 - DNA, 25 bp, Homo sapien
cgtccactacctgtgtgcgcggtgc

SEQ ID NO: 170012 - DNA, 25 bp, Homo sapien
gttgagaccattctggaagccggca

SEQ ID NO: 170013 - DNA, 25 bp, Homo sapien
gagctcttgtctcccggctgaggaa

SEQ ID NO: 170014 - DNA, 25 bp, Homo sapien
cctccctcacgtcgatggcgatgta

SEQ ID NO: 170015 - DNA, 25 bp, Homo sapien
ttcctgagagagacattttccacgg

SEQ ID NO: 170016 - DNA, 25 bp, Homo sapien
ggtggcggccacaccaaaagccatc

SEQ ID NO: 170017 - DNA, 25 bp, Homo sapien
caaaagccatctcggtgtagtcacc

SEQ ID NO: 170018 - DNA, 25 bp, Homo sapien
gccgacgcccacagcgctgatgaga

SEQ ID NO: 170019 - DNA, 25 bp, Homo sapien
cgccctcgctgcttttcctgagaga

SEQ ID NO: 170020 - DNA, 25 bp, Homo sapien
cccgacgattggctcttactgcgcg

SEQ ID NO: 170021 - DNA, 25 bp, Homo sapien
cttcacgaagccgatggtgcgcgca

SEQ ID NO: 170022 - DNA, 25 bp, Homo sapien
gacggctgctcgcagttgagcttca

SEQ ID NO: 170023 - DNA, 25 bp, Homo sapien
cggatgttcatgagctgcagcgtca

SEQ ID NO: 170024 - DNA, 25 bp, Homo sapien
ccgtcaggttcttgctctggcccag

SEQ ID NO: 170025 - DNA, 25 bp, Homo sapien
ggccggaactcgaagagctccttga

SEQ ID NO: 170026 - DNA, 25 bp, Homo sapien
tggagccgtactcgtccagggacat

SEQ ID NO: 170027 - DNA, 25 bp, Homo sapien
atgttctgcgccaccaccgagtcgt

SEQ ID NO: 170028 - DNA, 25 bp, Homo sapien
tgagtacacacgtgacaccgagaga

SEQ ID NO: 170029 - DNA, 25 bp, Homo sapien
gagggcagcgccattcgctcacaga

SEQ ID NO: 170030 - DNA, 25 bp, Homo sapien
tccggcttccagagggcagcgccat

SEQ ID NO: 170031 - DNA, 25 bp, Homo sapien
cagcctcgcagggaacgtgggctcc

SEQ ID NO: 170032 - DNA, 25 bp, Homo sapien
ccgactgggctcagcggacacacag

SEQ ID NO: 170033 - DNA, 25 bp, Homo sapien
gtttcccaggttggcggcaccagca

SEQ ID NO: 170034 - DNA, 25 bp, Homo sapien
cgtgtcatctttctgggtgagtaca

SEQ ID NO: 170035 - DNA, 25 bp, Homo sapien
accgagggctcagacaaaagacaga

SEQ ID NO: 170036 - DNA, 25 bp, Homo sapien
tgttccagcctaaagcaaactcatc

SEQ ID NO: 170037 - DNA, 25 bp, Homo sapien
ttacccaaaggcaaggcttgttcca

SEQ ID NO: 170038 - DNA, 25 bp, Homo sapien
gtgggaaagtgattcagcgctgcta

SEQ ID NO: 170039 - DNA, 25 bp, Homo sapien
ctcaggaagtacaaatagggcgtgc

SEQ ID NO: 170040 - DNA, 25 bp, Homo sapien
gcagtccacgcgcactcaggaagta

SEQ ID NO: 170041 - DNA, 25 bp, Homo sapien
cgcgctgctatttcgggcaagtctg

SEQ ID NO: 170042 - DNA, 25 bp, Homo sapien
cgctggcgagtgactcagtgtcacc

SEQ ID NO: 170043 - DNA, 25 bp, Homo sapien
tccacacaacgtcgctagcgagttc

SEQ ID NO: 170044 - DNA, 25 bp, Homo sapien
acggacgtgtcacaacccgcctgga

SEQ ID NO: 170045 - DNA, 25 bp, Homo sapien
tcgtcactgagagtcctggatggcc

SEQ ID NO: 170046 - DNA, 25 bp, Homo sapien
cccgcctggagtagttccaactctg

SEQ ID NO: 170047 - DNA, 25 bp, Homo sapien
aactggcaagccaccgttctccatg

SEQ ID NO: 170048 - DNA, 25 bp, Homo sapien
tgcggtctcacaatgggctcacaga

SEQ ID NO: 170049 - DNA, 25 bp, Homo sapien
tcagctgtttcagccgtgcggtctc

SEQ ID NO: 170050 - DNA, 25 bp, Homo sapien
tgcacacagcgaaagatcgccactg

SEQ ID NO: 170051 - DNA, 25 bp, Homo sapien
ggggtgccgcataacctaaagaatg

SEQ ID NO: 170052 - DNA, 25 bp, Homo sapien
aactcgctttgtctgtcgcctctag

SEQ ID NO: 170053 - DNA, 25 bp, Homo sapien
ctcatcctgcgctaaactcgctttg

SEQ ID NO: 170054 - DNA, 25 bp, Homo sapien
aggctctccttctttccgggtcgtg

SEQ ID NO: 170055 - DNA, 25 bp, Homo sapien
gcctctaggctaagtgggactgacc

SEQ ID NO: 170056 - DNA, 25 bp, Homo sapien
agctggccgggaactcaccttcgca

SEQ ID NO: 170057 - DNA, 25 bp, Homo sapien
cggacagctagctctcggaaggccg

SEQ ID NO: 170058 - DNA, 25 bp, Homo sapien
agagcaccgacttggagcgccttgt

SEQ ID NO: 170059 - DNA, 25 bp, Homo sapien
aaggccggacttccagcgctacgca

SEQ ID NO: 170060 - DNA, 25 bp, Homo sapien
acagccctgccgataccgtgggtgc

SEQ ID NO: 170061 - DNA, 25 bp, Homo sapien
gtgggtgcagctggcgactgcactg

SEQ ID NO: 170062 - DNA, 25 bp, Homo sapien
gggtgcagctggcgactgcactgcg

SEQ ID NO: 170063 - DNA, 25 bp, Homo sapien
gccctgccgataccgtgggtgcagc

SEQ ID NO: 170064 - DNA, 25 bp, Homo sapien
cacagccctgccgataccgtgggtg

SEQ ID NO: 170065 - DNA, 25 bp, Homo sapien
agccctgccgataccgtgggtgcag

SEQ ID NO: 170066 - DNA, 25 bp, Homo sapien
cagccctgccgataccgtgggtgca

SEQ ID NO: 170067 - DNA, 25 bp, Homo sapien
cctgccgataccgtgggtgcagctg

SEQ ID NO: 170068 - DNA, 25 bp, Homo sapien
caatggcagaaaaaccgcgttttct

SEQ ID NO: 170069 - DNA, 25 bp, Homo sapien
ccaagtcctgttccggccctggaag

SEQ ID NO: 170070 - DNA, 25 bp, Homo sapien
ccacactgggatcctgttcgccgag

SEQ ID NO: 170071 - DNA, 25 bp, Homo sapien
gcgagggaacaatggcagaaaaacc

SEQ ID NO: 170072 - DNA, 25 bp, Homo sapien
tgaattgaagcattgcgagggaaca

SEQ ID NO: 170073 - DNA, 25 bp, Homo sapien
ccttagtattgtttgaattgaagca

SEQ ID NO: 170074 - DNA, 25 bp, Homo sapien
ggcgaacgagacaaccttagtattg

SEQ ID NO: 170075 - DNA, 25 bp, Homo sapien
cgaggaggcgaacgagacaacctta

SEQ ID NO: 170076 - DNA, 25 bp, Homo sapien
gcggcatctaattctagggagactt

SEQ ID NO: 170077 - DNA, 25 bp, Homo sapien
aaaaccggctcctttgaagtgcagc

SEQ ID NO: 170078 - DNA, 25 bp, Homo sapien
ttgccttggatgaagctgccttttg

SEQ ID NO: 170079 - DNA, 25 bp, Homo sapien
cttcactgtcttctgttgccttgga

SEQ ID NO: 170080 - DNA, 25 bp, Homo sapien
ggctcctgagtactctgcttcactg

SEQ ID NO: 170081 - DNA, 25 bp, Homo sapien
ccagtcctgttgatgtggccagaga

SEQ ID NO: 170082 - DNA, 25 bp, Homo sapien
tcttgatttcattggtggctccgga

SEQ ID NO: 170083 - DNA, 25 bp, Homo sapien
aatttcaaaggacgtgcgagcagcc

SEQ ID NO: 170084 - DNA, 25 bp, Homo sapien
cgtggttgcagtgcgtggataggcc

SEQ ID NO: 170085 - DNA, 25 bp, Homo sapien
tggttacagcgtgtggatgggccgt

SEQ ID NO: 170086 - DNA, 25 bp, Homo sapien
cgtggttacagtgtgtggataggcc

SEQ ID NO: 170087 - DNA, 25 bp, Homo sapien
agtgtgtggataggccgtggttaca

SEQ ID NO: 170088 - DNA, 25 bp, Homo sapien
aggccgtggttacagtgtgtggata

SEQ ID NO: 170089 - DNA, 25 bp, Homo sapien
cagtgtgtggataggccgtggttac

SEQ ID NO: 170090 - DNA, 25 bp, Homo sapien
cgtggttacagcgtgtggatgggcc

SEQ ID NO: 170091 - DNA, 25 bp, Homo sapien
ccgtggttgcagtgcgtggataggc

SEQ ID NO: 170092 - DNA, 25 bp, Homo sapien
tgagttgagcatcgccaggcggtct

SEQ ID NO: 170093 - DNA, 25 bp, Homo sapien
cgtgacatgacacatgcagtcctgg

SEQ ID NO: 170094 - DNA, 25 bp, Homo sapien
atgcagtcctggatgggtgacagcc

SEQ ID NO: 170095 - DNA, 25 bp, Homo sapien
gggtctcctaggaccgtgccctgca

SEQ ID NO: 170096 - DNA, 25 bp, Homo sapien
tgcactgcgcctgagttgagcatcg

SEQ ID NO: 170097 - DNA, 25 bp, Homo sapien
atcgccaggcggtctggacaccatc

SEQ ID NO: 170098 - DNA, 25 bp, Homo sapien
tctgtcactgcctgtcctcagagct

SEQ ID NO: 170099 - DNA, 25 bp, Homo sapien
cgcggtcgcttaccacgtgacatga

SEQ ID NO: 170100 - DNA, 25 bp, Homo sapien
tccgtggggctgatgccctgcgtct

SEQ ID NO: 170101 - DNA, 25 bp, Homo sapien
tgatgccctgcgtctgcgtgggacc

SEQ ID NO: 170102 - DNA, 25 bp, Homo sapien
ctgatgccgtgcgtctgcgtgggac

SEQ ID NO: 170103 - DNA, 25 bp, Homo sapien
caggcgtccgtggggctcatgccct

SEQ ID NO: 170104 - DNA, 25 bp, Homo sapien
gatgccctgcgtctgcgtgggaccc

SEQ ID NO: 170105 - DNA, 25 bp, Homo sapien
cgtccgtggggctgatgccctgcgt

SEQ ID NO: 170106 - DNA, 25 bp, Homo sapien
gatgccgtgcgtctgcgtgggaccc

SEQ ID NO: 170107 - DNA, 25 bp, Homo sapien
ctgatgccctgcgtctgcgtgggac

SEQ ID NO: 170108 - DNA, 25 bp, Homo sapien
tacaggtccacgttgaggctgttcc

SEQ ID NO: 170109 - DNA, 25 bp, Homo sapien
cgctgcactccgtagcccaggggtt

SEQ ID NO: 170110 - DNA, 25 bp, Homo sapien
ggaggtgctgcccaattcatacagg

SEQ ID NO: 170111 - DNA, 25 bp, Homo sapien
cgcacgctcttcaccgggtgcaaga

SEQ ID NO: 170112 - DNA, 25 bp, Homo sapien
tccgtactccacgtccagcgggaag

SEQ ID NO: 170113 - DNA, 25 bp, Homo sapien
tactgctccgacttgctgcgcagca

SEQ ID NO: 170114 - DNA, 25 bp, Homo sapien
acaggctgtccaggtcgtactgctc

SEQ ID NO: 170115 - DNA, 25 bp, Homo sapien
acggaggctctgctccatgcctgcg

SEQ ID NO: 170116 - DNA, 25 bp, Homo sapien
tggccaatcactggtgtcaccgggc

SEQ ID NO: 170117 - DNA, 25 bp, Homo sapien
caccgggcagctgtctagaggactt

SEQ ID NO: 170118 - DNA, 25 bp, Homo sapien
tgtctagaggacttccgcgccacac

SEQ ID NO: 170119 - DNA, 25 bp, Homo sapien
ttcatcgaatgcaatggaggccgcg

SEQ ID NO: 170120 - DNA, 25 bp, Homo sapien
actacgccaacaagtacagcttctg

SEQ ID NO: 170121 - DNA, 25 bp, Homo sapien
aagtacagcttctggctgaccacca

SEQ ID NO: 170122 - DNA, 25 bp, Homo sapien
gccgctgccaggtgtgcatgaagaa

SEQ ID NO: 170123 - DNA, 25 bp, Homo sapien
tgcatgaagaacctgtgagccggcg

SEQ ID NO: 170124 - DNA, 25 bp, Homo sapien
cggtgtcccagatggagatgttgta

SEQ ID NO: 170125 - DNA, 25 bp, Homo sapien
aaagttctgagagcaccttccgccc

SEQ ID NO: 170126 - DNA, 25 bp, Homo sapien
cgccgtttcgcaagcatccgagttc

SEQ ID NO: 170127 - DNA, 25 bp, Homo sapien
cgcctttccagctgcggtcgatttg

SEQ ID NO: 170128 - DNA, 25 bp, Homo sapien
atccgagttctccagccgaggctcg

SEQ ID NO: 170129 - DNA, 25 bp, Homo sapien
gattctcgtgaacgctccgggacct

SEQ ID NO: 170130 - DNA, 25 bp, Homo sapien
caggagcacgatcttgctgtcgggc

SEQ ID NO: 170131 - DNA, 25 bp, Homo sapien
taggagcgccactgcttcaggtaga

SEQ ID NO: 170132 - DNA, 25 bp, Homo sapien
tgattgagcgagttgggatcccact

SEQ ID NO: 170133 - DNA, 25 bp, Homo sapien
cttccaatggctgtgtttccggcga

SEQ ID NO: 170134 - DNA, 25 bp, Homo sapien
tctgggaaagatgctcgccaactgc

SEQ ID NO: 170135 - DNA, 25 bp, Homo sapien
ccttggacgagagggactggatatt

SEQ ID NO: 170136 - DNA, 25 bp, Homo sapien
caatccgggcttgcagacgaggtaa

SEQ ID NO: 170137 - DNA, 25 bp, Homo sapien
acagaccctgcacgtccttggacga

SEQ ID NO: 170138 - DNA, 25 bp, Homo sapien
tgcgactgggcaagtacagaccctg

SEQ ID NO: 170139 - DNA, 25 bp, Homo sapien
tgtcaatcatctagaaccgggtgtg

SEQ ID NO: 170140 - DNA, 25 bp, Homo sapien
cgagctagtacgtttctcatgcacg

SEQ ID NO: 170141 - DNA, 25 bp, Homo sapien
acccagttctgtgagtcgctctgcg

SEQ ID NO: 170142 - DNA, 25 bp, Homo sapien
acctgtgattaaggcctacagcccg

SEQ ID NO: 170143 - DNA, 25 bp, Homo sapien
cggagctgatcgtccacccagttct

SEQ ID NO: 170144 - DNA, 25 bp, Homo sapien
ttgtcccacgtgttctgtgccagtg

SEQ ID NO: 170145 - DNA, 25 bp, Homo sapien
gctccttcatcagggcgcagacttg

SEQ ID NO: 170146 - DNA, 25 bp, Homo sapien
cctgagtcggcctcttgtgctcctt

SEQ ID NO: 170147 - DNA, 25 bp, Homo sapien
ttctcatgcacgtcaccagggctga

SEQ ID NO: 170148 - DNA, 25 bp, Homo sapien
aagccttccagaagcacggtcgctc

SEQ ID NO: 170149 - DNA, 25 bp, Homo sapien
cctccgacatgatcgccgaggtggg

SEQ ID NO: 170150 - DNA, 25 bp, Homo sapien
gggccgccttcagcaagctctttga

SEQ ID NO: 170151 - DNA, 25 bp, Homo sapien
gctctttgaaacctgagcccgcgca

SEQ ID NO: 170152 - DNA, 25 bp, Homo sapien
agcccgcgcagaccagaagtaaaca

SEQ ID NO: 170153 - DNA, 25 bp, Homo sapien
tgtgtgtgatgggaaaatccggacc

SEQ ID NO: 170154 - DNA, 25 bp, Homo sapien
aatccggacccacgcgtgtgctgaa

SEQ ID NO: 170155 - DNA, 25 bp, Homo sapien
gtgcaaccaccaagccttccagaag

SEQ ID NO: 170156 - DNA, 25 bp, Homo sapien
tcgtccaccacaccatgcaaggtag

SEQ ID NO: 170157 - DNA, 25 bp, Homo sapien
gtgtcgcatgcttccagcaggggct

SEQ ID NO: 170158 - DNA, 25 bp, Homo sapien
actgaagccagcagggcgcggttac

SEQ ID NO: 170159 - DNA, 25 bp, Homo sapien
caaactgccggaccttctgccggaa

SEQ ID NO: 170160 - DNA, 25 bp, Homo sapien
tgcaaggtagcctcgctgccgtctc

SEQ ID NO: 170161 - DNA, 25 bp, Homo sapien
ctgccgtctcctgaaacgtactgaa

SEQ ID NO: 170162 - DNA, 25 bp, Homo sapien
tgaaacgtactgaagccagcagggc

SEQ ID NO: 170163 - DNA, 25 bp, Homo sapien
tcgggcatggccagcgcaaactgcc

SEQ ID NO: 170164 - DNA, 25 bp, Homo sapien
cgccagtcgtgtgccatctgagagg

SEQ ID NO: 170165 - DNA, 25 bp, Homo sapien
ggccgtgcgtcctcacacgagtcag

SEQ ID NO: 170166 - DNA, 25 bp, Homo sapien
acacgagtcagtgatgcagcctgcg

SEQ ID NO: 170167 - DNA, 25 bp, Homo sapien
atgttcagagggtgtgtttcctgcc

SEQ ID NO: 170168 - DNA, 25 bp, Homo sapien
cacgtctgacagtgacggtgatgga

SEQ ID NO: 170169 - DNA, 25 bp, Homo sapien
tccagctgctgctgggatgttcaga

SEQ ID NO: 170170 - DNA, 25 bp, Homo sapien
ctgccgtccatcacgtctgacagtg

SEQ ID NO: 170171 - DNA, 25 bp, Homo sapien
gccgtggtgacaaagagtgacagca

SEQ ID NO: 170172 - DNA, 25 bp, Homo sapien
gctttctcccggattgcgagttctc

SEQ ID NO: 170173 - DNA, 25 bp, Homo sapien
gattgcgagttctctggcccgcggc

SEQ ID NO: 170174 - DNA, 25 bp, Homo sapien
ttctcccggattgcgagttctctgg

SEQ ID NO: 170175 - DNA, 25 bp, Homo sapien
cagaggctttctcccggattgcgag

SEQ ID NO: 170176 - DNA, 25 bp, Homo sapien
atcagaggctttctcccggattgcg

SEQ ID NO: 170177 - DNA, 25 bp, Homo sapien
gctgatcagaggctttctcccggat

SEQ ID NO: 170178 - DNA, 25 bp, Homo sapien
ccctggcgcaggagtgagaggtcgg

SEQ ID NO: 170179 - DNA, 25 bp, Homo sapien
tcccggattgcgagttctctggccc

SEQ ID NO: 170180 - DNA, 25 bp, Homo sapien
gagcacgaggctggccacacttctt

SEQ ID NO: 170181 - DNA, 25 bp, Homo sapien
acacttctttctcaagctcgtgcgc

SEQ ID NO: 170182 - DNA, 25 bp, Homo sapien
gaagagagctctgcgctcgcacacg

SEQ ID NO: 170183 - DNA, 25 bp, Homo sapien
cggagccaggcggaaacagtttctc

SEQ ID NO: 170184 - DNA, 25 bp, Homo sapien
ttcctctcacggcacggctgggctg

SEQ ID NO: 170185 - DNA, 25 bp, Homo sapien
gctgggctgctttcatcacgcgtaa

SEQ ID NO: 170186 - DNA, 25 bp, Homo sapien
atcacgcgtaagtgcacaccacaca

SEQ ID NO: 170187 - DNA, 25 bp, Homo sapien
acagatgctgcacgaggccaggcga

SEQ ID NO: 170188 - DNA, 25 bp, Homo sapien
catgggaaccttctaaccgtggtca

SEQ ID NO: 170189 - DNA, 25 bp, Homo sapien
gatgcccactggtcatccggtcacg

SEQ ID NO: 170190 - DNA, 25 bp, Homo sapien
tctaaccgtggtcaagcctcgggca

SEQ ID NO: 170191 - DNA, 25 bp, Homo sapien
gaggcacgtgcatgggaaccttcta

SEQ ID NO: 170192 - DNA, 25 bp, Homo sapien
tccaacatatggacacgcggggcgg

SEQ ID NO: 170193 - DNA, 25 bp, Homo sapien
ggctgggcactccaacatatggaca

SEQ ID NO: 170194 - DNA, 25 bp, Homo sapien
tggtccgtgatggactaaagcaggt

SEQ ID NO: 170195 - DNA, 25 bp, Homo sapien
cagggctggtccgtgatggactaaa

SEQ ID NO: 170196 - DNA, 25 bp, Homo sapien
tgcgccacgattaggggttccttcc

SEQ ID NO: 170197 - DNA, 25 bp, Homo sapien
tgaggctgttgtacacctgcacacc

SEQ ID NO: 170198 - DNA, 25 bp, Homo sapien
ccgcgcgtagtcctcaacatgtcag

SEQ ID NO: 170199 - DNA, 25 bp, Homo sapien
cactcccggaagcagtcctcaggta

SEQ ID NO: 170200 - DNA, 25 bp, Homo sapien
gtgccgatctcctctccttattagc

SEQ ID NO: 170201 - DNA, 25 bp, Homo sapien
gtgcaagcttctgttgccgggccct

SEQ ID NO: 170202 - DNA, 25 bp, Homo sapien
cctgttagcgaagcacgtgtgcatc

SEQ ID NO: 170203 - DNA, 25 bp, Homo sapien
tcccgttcagccgtgggaagtctcc

SEQ ID NO: 170204 - DNA, 25 bp, Homo sapien
ctccggggtgaaccatgttgagtcc

SEQ ID NO: 170205 - DNA, 25 bp, Homo sapien
ttgagtcctgccaacggggagcagc

SEQ ID NO: 170206 - DNA, 25 bp, Homo sapien
actatgtggaggactacctggactc

SEQ ID NO: 170207 - DNA, 25 bp, Homo sapien
gagtccctgcctttcgacttgcaga

SEQ ID NO: 170208 - DNA, 25 bp, Homo sapien
tgcgggagatcgacgcgaaatacca

SEQ ID NO: 170209 - DNA, 25 bp, Homo sapien
ccaaggtccttgtgtgcaaagcccg

SEQ ID NO: 170210 - DNA, 25 bp, Homo sapien
ctgcgcgaccaaagcgctctttgta

SEQ ID NO: 170211 - DNA, 25 bp, Homo sapien
ctggagcgcctttgattcgccaagg

SEQ ID NO: 170212 - DNA, 25 bp, Homo sapien
tagtggcctttggagtttaaatgtc

SEQ ID NO: 170213 - DNA, 25 bp, Homo sapien
ctgcgacattgtccacgaccttgtg

SEQ ID NO: 170214 - DNA, 25 bp, Homo sapien
gttgtccacgcagggtaggagtccc

SEQ ID NO: 170215 - DNA, 25 bp, Homo sapien
gcaagggccctggtgaccttttcca

SEQ ID NO: 170216 - DNA, 25 bp, Homo sapien
tttccacgaccttgtccacgcagga

SEQ ID NO: 170217 - DNA, 25 bp, Homo sapien
tgccgtgtgcgagccaattatgact

SEQ ID NO: 170218 - DNA, 25 bp, Homo sapien
tgcttgaagaaaatgagtcgccacc

SEQ ID NO: 170219 - DNA, 25 bp, Homo sapien
cacaaccttgtccacgcgaggcagg

SEQ ID NO: 170220 - DNA, 25 bp, Homo sapien
agaagcgctccaaggccaaggcgga

SEQ ID NO: 170221 - DNA, 25 bp, Homo sapien
cgagcgcttcagtcgcgagacagac

SEQ ID NO: 170222 - DNA, 25 bp, Homo sapien
ccaacgaacccacgtactgtctgtg

SEQ ID NO: 170223 - DNA, 25 bp, Homo sapien
ccaggtctcctatggggagatgatc

SEQ ID NO: 170224 - DNA, 25 bp, Homo sapien
atcggctgcgacaacgacgagtgcc

SEQ ID NO: 170225 - DNA, 25 bp, Homo sapien
actgtctgtgcaaccaggtctccta

SEQ ID NO: 170226 - DNA, 25 bp, Homo sapien
gcagcgcaggctgacaagcccaaca

SEQ ID NO: 170227 - DNA, 25 bp, Homo sapien
gctagacgagtgctacgagcgcttc

SEQ ID NO: 170228 - DNA, 25 bp, Homo sapien
cagggcccatgaggcactgacagga

SEQ ID NO: 170229 - DNA, 25 bp, Homo sapien
cctcctgccgtcttctcggtgttta

SEQ ID NO: 170230 - DNA, 25 bp, Homo sapien
accgggactgtctttcctgcagtgg

SEQ ID NO: 170231 - DNA, 25 bp, Homo sapien
tcctcggcttactaaggggcctctg

SEQ ID NO: 170232 - DNA, 25 bp, Homo sapien
ggcggtttcagacagatccactgga

SEQ ID NO: 170233 - DNA, 25 bp, Homo sapien
tcctctgttctgtttcgttccgctc

SEQ ID NO: 170234 - DNA, 25 bp, Homo sapien
cgtcacgatgcacctccttcaggaa

SEQ ID NO: 170235 - DNA, 25 bp, Homo sapien
ctgcttcgggcttgtctcaattaca

SEQ ID NO: 170236 - DNA, 25 bp, Homo sapien
gactcccactggacagccggggaaa

SEQ ID NO: 170237 - DNA, 25 bp, Homo sapien
aatggcgccttaaagcgttcgcacc

SEQ ID NO: 170238 - DNA, 25 bp, Homo sapien
ccttgccgaaatgcgcggcccagtg

SEQ ID NO: 170239 - DNA, 25 bp, Homo sapien
cgtccagccatagaaggagtcctca

SEQ ID NO: 170240 - DNA, 25 bp, Homo sapien
cgccgacatggtccgtcaccggaga

SEQ ID NO: 170241 - DNA, 25 bp, Homo sapien
cgccgccgcagcacaaaggaacgag

SEQ ID NO: 170242 - DNA, 25 bp, Homo sapien
aaggaacgagactagcgccgcggtc

SEQ ID NO: 170243 - DNA, 25 bp, Homo sapien
gcctggaccagaggacgccagcagc

SEQ ID NO: 170244 - DNA, 25 bp, Homo sapien
gaactgcatgctgcaggtgtcctgc

SEQ ID NO: 170245 - DNA, 25 bp, Homo sapien
agctcccacacgtgaagctcgcggt

SEQ ID NO: 170246 - DNA, 25 bp, Homo sapien
agctgcgggtgatgttcgttgcact

SEQ ID NO: 170247 - DNA, 25 bp, Homo sapien
cgttgcactgctagacacgaaattc

SEQ ID NO: 170248 - DNA, 25 bp, Homo sapien
tcccattgacgtcctgcaggaactg

SEQ ID NO: 170249 - DNA, 25 bp, Homo sapien
ttccgcccacgagtgcgccatgttt

SEQ ID NO: 170250 - DNA, 25 bp, Homo sapien
cgagtgcgccatgtttcagcggagc

SEQ ID NO: 170251 - DNA, 25 bp, Homo sapien
gctagacacgaaattcccattgacg

SEQ ID NO: 170252 - DNA, 25 bp, Homo sapien
gtgggttgattccggagctctctga

SEQ ID NO: 170253 - DNA, 25 bp, Homo sapien
cgcttcatctcgcagggcacacgag

SEQ ID NO: 170254 - DNA, 25 bp, Homo sapien
ctgctgggacagattaggacccttg

SEQ ID NO: 170255 - DNA, 25 bp, Homo sapien
ctctctgctgggacagattaggacc

SEQ ID NO: 170256 - DNA, 25 bp, Homo sapien
tggtcctctctgctgggacagatta

SEQ ID NO: 170257 - DNA, 25 bp, Homo sapien
agcaggttctggtcctctctgctgg

SEQ ID NO: 170258 - DNA, 25 bp, Homo sapien
gggacagattaggacccttgcaggc

SEQ ID NO: 170259 - DNA, 25 bp, Homo sapien
cttcatctcgcagggcacacgagca

SEQ ID NO: 170260 - DNA, 25 bp, Homo sapien
cgcttgttctcggtcttggccgacc

SEQ ID NO: 170261 - DNA, 25 bp, Homo sapien
tttggaggcggttccctctcacgcc

SEQ ID NO: 170262 - DNA, 25 bp, Homo sapien
actggcgcctgcgactatgcctgcg

SEQ ID NO: 170263 - DNA, 25 bp, Homo sapien
cagagaaacggcaacctgggagaaa

SEQ ID NO: 170264 - DNA, 25 bp, Homo sapien
tcgtgcaagtgagatgggctccgct

SEQ ID NO: 170265 - DNA, 25 bp, Homo sapien
agaacgctgcctttcgtgcaagtga

SEQ ID NO: 170266 - DNA, 25 bp, Homo sapien
gcaggactcaagaacgctgcctttc

SEQ ID NO: 170267 - DNA, 25 bp, Homo sapien
ccctattgatccgttgggcggcccg

SEQ ID NO: 170268 - DNA, 25 bp, Homo sapien
ggaggaaactctccgcgatgcaagc

SEQ ID NO: 170269 - DNA, 25 bp, Homo sapien
gaggtcgccctacctggcagagtca

SEQ ID NO: 170270 - DNA, 25 bp, Homo sapien
ccggacgtcctaggtatcccaggtg

SEQ ID NO: 170271 - DNA, 25 bp, Homo sapien
tatcccaggtgggagtccacgcagg

SEQ ID NO: 170272 - DNA, 25 bp, Homo sapien
cttccacgcgcacggtggtgacatc

SEQ ID NO: 170273 - DNA, 25 bp, Homo sapien
gaagctaagcgctcaggccctcttt

SEQ ID NO: 170274 - DNA, 25 bp, Homo sapien
cactccattacccaaatggcgcaga

SEQ ID NO: 170275 - DNA, 25 bp, Homo sapien
gtaagggcacactctccgggacacc

SEQ ID NO: 170276 - DNA, 25 bp, Homo sapien
acccaggttcacagcgcaggtgcgc

SEQ ID NO: 170277 - DNA, 25 bp, Homo sapien
gctctgccgtcctagctcacgcggt

SEQ ID NO: 170278 - DNA, 25 bp, Homo sapien
caggggacccaggttcacagcgcag

SEQ ID NO: 170279 - DNA, 25 bp, Homo sapien
accctgggaacgcagcacggagcct

SEQ ID NO: 170280 - DNA, 25 bp, Homo sapien
ggctgatcacgaccgccagagctgc

SEQ ID NO: 170281 - DNA, 25 bp, Homo sapien
aggtgccgggctgatcacgaccgcc

SEQ ID NO: 170282 - DNA, 25 bp, Homo sapien
gagatcggggttcacaggctgaccc

SEQ ID NO: 170283 - DNA, 25 bp, Homo sapien
cacaggctgacccagcgttaggagg

SEQ ID NO: 170284 - DNA, 25 bp, Homo sapien
tgaaaccgcccagtcacccgatgtg

SEQ ID NO: 170285 - DNA, 25 bp, Homo sapien
ttggccttcctggtcgctgtcaggt

SEQ ID NO: 170286 - DNA, 25 bp, Homo sapien
aggcgtcccagaaacgctcggaaca

SEQ ID NO: 170287 - DNA, 25 bp, Homo sapien
acgctcggaacagatctagggcaca

SEQ ID NO: 170288 - DNA, 25 bp, Homo sapien
tctagggcacaagccttggccttcc

SEQ ID NO: 170289 - DNA, 25 bp, Homo sapien
gtcgctgtcaggtatgcgccaagca

SEQ ID NO: 170290 - DNA, 25 bp, Homo sapien
tatgcgccaagcatcacagcgtttg

SEQ ID NO: 170291 - DNA, 25 bp, Homo sapien
cacagcgtttgggtatgaaaccgcc

SEQ ID NO: 170292 - DNA, 25 bp, Homo sapien
tgggtgcttcgctccagccggacct

SEQ ID NO: 170293 - DNA, 25 bp, Homo sapien
ctagggtagagaccgaagactggac

SEQ ID NO: 170294 - DNA, 25 bp, Homo sapien
gggcgaacacccgacgctatccgaa

SEQ ID NO: 170295 - DNA, 25 bp, Homo sapien
gctatccgaagacgtcccgcgcggg

SEQ ID NO: 170296 - DNA, 25 bp, Homo sapien
gcgctcagcgcttgtgctctgtatt

SEQ ID NO: 170297 - DNA, 25 bp, Homo sapien
tgtgctctgtattgcaggtctaccc

SEQ ID NO: 170298 - DNA, 25 bp, Homo sapien
gagagcgagtgcctgagcaacatcc

SEQ ID NO: 170299 - DNA, 25 bp, Homo sapien
cctgagcaacatccgcgagttcctg

SEQ ID NO: 170300 - DNA, 25 bp, Homo sapien
gcgctgagtcgctaacgtgaaggcc

SEQ ID NO: 170301 - DNA, 25 bp, Homo sapien
cgggctaaggcgctgagtcactaac

SEQ ID NO: 170302 - DNA, 25 bp, Homo sapien
gcgctgagtcgctaacatgaaggcc

SEQ ID NO: 170303 - DNA, 25 bp, Homo sapien
cgctgagtcgctaacatgaaggccg

SEQ ID NO: 170304 - DNA, 25 bp, Homo sapien
ctcagaagaggattcgggctaaggc

SEQ ID NO: 170305 - DNA, 25 bp, Homo sapien
cccagaagaggattcgggctaaggc

SEQ ID NO: 170306 - DNA, 25 bp, Homo sapien
ctaaggcgctgagtcgctaacgtga

SEQ ID NO: 170307 - DNA, 25 bp, Homo sapien
cgctgagtcgctaacgtgaaggccg

SEQ ID NO: 170308 - DNA, 25 bp, Homo sapien
ccgggcgtctagtgaaaagccgatc

SEQ ID NO: 170309 - DNA, 25 bp, Homo sapien
cccaagtgggacattcgctacattg

SEQ ID NO: 170310 - DNA, 25 bp, Homo sapien
ggttccaaagcgcagacccaagtgg

SEQ ID NO: 170311 - DNA, 25 bp, Homo sapien
gggctcgaccgcttcgcggaaactc

SEQ ID NO: 170312 - DNA, 25 bp, Homo sapien
gctctgaaggactgattggcccgtg

SEQ ID NO: 170313 - DNA, 25 bp, Homo sapien
ccggagcctcggcaccacagtaggt

SEQ ID NO: 170314 - DNA, 25 bp, Homo sapien
gcagggctccgtccggacaaacttc

SEQ ID NO: 170315 - DNA, 25 bp, Homo sapien
gctacggcctttcgggtctaggaca

SEQ ID NO: 170316 - DNA, 25 bp, Homo sapien
tccgaaaacacccaagccctggagc

SEQ ID NO: 170317 - DNA, 25 bp, Homo sapien
cgcacaccaccatcaactggggacc

SEQ ID NO: 170318 - DNA, 25 bp, Homo sapien
agcaagcacgcagacagcaagcccg

SEQ ID NO: 170319 - DNA, 25 bp, Homo sapien
gtccagcaagcacgcagacagcaag

SEQ ID NO: 170320 - DNA, 25 bp, Homo sapien
cacccggtcactccgtccagcaagc

SEQ ID NO: 170321 - DNA, 25 bp, Homo sapien
gcgagtctcatgttctctgcccttc

SEQ ID NO: 170322 - DNA, 25 bp, Homo sapien
gataagtgccctttcgcggtgagca

SEQ ID NO: 170323 - DNA, 25 bp, Homo sapien
cggtgagcacgcgagtctcatgttc

SEQ ID NO: 170324 - DNA, 25 bp, Homo sapien
gaagttctggcgctgtgtccaccct

SEQ ID NO: 170325 - DNA, 25 bp, Homo sapien
ccaagctggtgggatcttgggtttc

SEQ ID NO: 170326 - DNA, 25 bp, Homo sapien
ttcgtctggatcttcccagatgggg

SEQ ID NO: 170327 - DNA, 25 bp, Homo sapien
tctgtgggtagtgtttgtgaagttc

SEQ ID NO: 170328 - DNA, 25 bp, Homo sapien
aattgcactccaggaaaaaggccgt

SEQ ID NO: 170329 - DNA, 25 bp, Homo sapien
aaaaaggccgtggtgcctggatgcc

SEQ ID NO: 170330 - DNA, 25 bp, Homo sapien
gtgtccaccctggaattgcactcca

SEQ ID NO: 170331 - DNA, 25 bp, Homo sapien
agctgctgtcatcacctgcgtcaga

SEQ ID NO: 170332 - DNA, 25 bp, Homo sapien
ggaagactctgtgtgcacacgccag

SEQ ID NO: 170333 - DNA, 25 bp, Homo sapien
cctgggaagactctgtgtgcacacg

SEQ ID NO: 170334 - DNA, 25 bp, Homo sapien
cggatcctgggaagactctgtgtgc

SEQ ID NO: 170335 - DNA, 25 bp, Homo sapien
acgctggtcccggatcctggggaga

SEQ ID NO: 170336 - DNA, 25 bp, Homo sapien
cccggatcctgggaagactctgtgt

SEQ ID NO: 170337 - DNA, 25 bp, Homo sapien
ctgggaagactctgtgtgcacacgc

SEQ ID NO: 170338 - DNA, 25 bp, Homo sapien
atcctgggaagactctgtgtgcaca

SEQ ID NO: 170339 - DNA, 25 bp, Homo sapien
ccggatcctgggaagactctgtgtg

SEQ ID NO: 170340 - DNA, 25 bp, Homo sapien
ccctgggctattgtttgctggtaca

SEQ ID NO: 170341 - DNA, 25 bp, Homo sapien
tgaactttgtccctgggcgtgtggt

SEQ ID NO: 170342 - DNA, 25 bp, Homo sapien
gagcccgagtcaagtccaacgacga

SEQ ID NO: 170343 - DNA, 25 bp, Homo sapien
tccacagagcccgagtcaagtccaa

SEQ ID NO: 170344 - DNA, 25 bp, Homo sapien
tggggtaaagattctccacagagcc

SEQ ID NO: 170345 - DNA, 25 bp, Homo sapien
cctattctggcgtggggtaaagatt

SEQ ID NO: 170346 - DNA, 25 bp, Homo sapien
attgtgaagatgaaaacctattctg

SEQ ID NO: 170347 - DNA, 25 bp, Homo sapien
ctattgtttgctggtacagactttt

SEQ ID NO: 170348 - DNA, 25 bp, Homo sapien
aacggcagccggctttatttgcgcg

SEQ ID NO: 170349 - DNA, 25 bp, Homo sapien
attcggttaattgtggacgggctca

SEQ ID NO: 170350 - DNA, 25 bp, Homo sapien
caagctgtgctcatccctgcgaagg

SEQ ID NO: 170351 - DNA, 25 bp, Homo sapien
aggagcaggctcgtttctccgggac

SEQ ID NO: 170352 - DNA, 25 bp, Homo sapien
ctcagctgggaccaggtaaagtgtt

SEQ ID NO: 170353 - DNA, 25 bp, Homo sapien
acaacttgctgtggattttctgcta

SEQ ID NO: 170354 - DNA, 25 bp, Homo sapien
cgccggtttcgttgttgatttgttg

SEQ ID NO: 170355 - DNA, 25 bp, Homo sapien
gttgccgctatacaatattcggtta

SEQ ID NO: 170356 - DNA, 25 bp, Homo sapien
ctctgcgtgtcacccatgtgcatca

SEQ ID NO: 170357 - DNA, 25 bp, Homo sapien
gtggcatccagcacgcctctgcgtg

SEQ ID NO: 170358 - DNA, 25 bp, Homo sapien
atggaggaacgtctgccggccagtt

SEQ ID NO: 170359 - DNA, 25 bp, Homo sapien
cacttagacgagtactgaacgtttc

SEQ ID NO: 170360 - DNA, 25 bp, Homo sapien
tgacctctcgtgtttcacttagacg

SEQ ID NO: 170361 - DNA, 25 bp, Homo sapien
tgtgagcaaatgatgacctctcgtg

SEQ ID NO: 170362 - DNA, 25 bp, Homo sapien
cggcgtgtccactgtgagcaaatga

SEQ ID NO: 170363 - DNA, 25 bp, Homo sapien
tcagccgcacagtcaaccgcgtgtt

SEQ ID NO: 170364 - DNA, 25 bp, Homo sapien
tccggcttccttgcacacgtcaggg

SEQ ID NO: 170365 - DNA, 25 bp, Homo sapien
cgttcaggcaacactgcgggaattc

SEQ ID NO: 170366 - DNA, 25 bp, Homo sapien
ctgttcgcagcaaggcagtctcttc

SEQ ID NO: 170367 - DNA, 25 bp, Homo sapien
tggacgtcaaactcgctgccggcca

SEQ ID NO: 170368 - DNA, 25 bp, Homo sapien
ccgaaatgtaatggggcacgcagtg

SEQ ID NO: 170369 - DNA, 25 bp, Homo sapien
ttgttcccggagagatgtatttcga

SEQ ID NO: 170370 - DNA, 25 bp, Homo sapien
gtccggagtcgattctcagacgtga

SEQ ID NO: 170371 - DNA, 25 bp, Homo sapien
ttaaaccggacagcaggcgactgcg

SEQ ID NO: 170372 - DNA, 25 bp, Homo sapien
ttcagacggctcttacacacgcggc

SEQ ID NO: 170373 - DNA, 25 bp, Homo sapien
cccgggcagtcgagccctgcgttcc

SEQ ID NO: 170374 - DNA, 25 bp, Homo sapien
gtgctaagcagtgttcagacggctc

SEQ ID NO: 170375 - DNA, 25 bp, Homo sapien
ctcctagagtgctaagcagtgttca

SEQ ID NO: 170376 - DNA, 25 bp, Homo sapien
gcggctgactttcactcctagagtg

SEQ ID NO: 170377 - DNA, 25 bp, Homo sapien
taatgtgggcggctgactttcactc

SEQ ID NO: 170378 - DNA, 25 bp, Homo sapien
atcaccacggtgggttaatgtgggc

SEQ ID NO: 170379 - DNA, 25 bp, Homo sapien
tcaccacctcctctaacccgagccg

SEQ ID NO: 170380 - DNA, 25 bp, Homo sapien
agccggtcacttgcacacgccgatg

SEQ ID NO: 170381 - DNA, 25 bp, Homo sapien
ttgcgctccgccgaaaccattcggg

SEQ ID NO: 170382 - DNA, 25 bp, Homo sapien
ttgcacacgccgatgccctggggat

SEQ ID NO: 170383 - DNA, 25 bp, Homo sapien
gcattacgttcttcctcgtgccctg

SEQ ID NO: 170384 - DNA, 25 bp, Homo sapien
cgcgtccctccttgaagtcggagtt

SEQ ID NO: 170385 - DNA, 25 bp, Homo sapien
gagtttctctcgtgcacgtttgcac

SEQ ID NO: 170386 - DNA, 25 bp, Homo sapien
acgtttgcactttgcaggctccagc

SEQ ID NO: 170387 - DNA, 25 bp, Homo sapien
tgcactgcgccggaaccattcggtt

SEQ ID NO: 170388 - DNA, 25 bp, Homo sapien
cgcacgttagaaggcgccacgctag

SEQ ID NO: 170389 - DNA, 25 bp, Homo sapien
tgttccctaagttacgatgagtttg

SEQ ID NO: 170390 - DNA, 25 bp, Homo sapien
gatgagtttgttcctgcccgcagaa

SEQ ID NO: 170391 - DNA, 25 bp, Homo sapien
accggcacagctgagtcaaggtaca

SEQ ID NO: 170392 - DNA, 25 bp, Homo sapien
gcccagcaacgctttccagcaggga

SEQ ID NO: 170393 - DNA, 25 bp, Homo sapien
ggaacgttgccctgaacagctctga

SEQ ID NO: 170394 - DNA, 25 bp, Homo sapien
ctctgactgttgagcgcacgttaga

SEQ ID NO: 170395 - DNA, 25 bp, Homo sapien
ggttgcagagactccgtgttcccta

SEQ ID NO: 170396 - DNA, 25 bp, Homo sapien
gcaggagtgatttagggccacaatt

SEQ ID NO: 170397 - DNA, 25 bp, Homo sapien
gccagcttcacaaaagcggtgtgga

SEQ ID NO: 170398 - DNA, 25 bp, Homo sapien
tgtggacgcctgagccagtccgctc

SEQ ID NO: 170399 - DNA, 25 bp, Homo sapien
tgagccagtccgctcttgctggacg

SEQ ID NO: 170400 - DNA, 25 bp, Homo sapien
ctctggcaggagtgatttagggcca

SEQ ID NO: 170401 - DNA, 25 bp, Homo sapien
cggagcctgcgccagcttcacaaaa

SEQ ID NO: 170402 - DNA, 25 bp, Homo sapien
cgagctgcctttgcagacccggcgg

SEQ ID NO: 170403 - DNA, 25 bp, Homo sapien
ccacaattaggttggacgaggagtg

SEQ ID NO: 170404 - DNA, 25 bp, Homo sapien
atccgctgaggggtaaagcgcctgc

SEQ ID NO: 170405 - DNA, 25 bp, Homo sapien
tcctgtgagcgggtgcctcagctct

SEQ ID NO: 170406 - DNA, 25 bp, Homo sapien
cccatcagattttgtgcttcctgtg

SEQ ID NO: 170407 - DNA, 25 bp, Homo sapien
gcctgcggacgctatttcccatcag

SEQ ID NO: 170408 - DNA, 25 bp, Homo sapien
agacccttgaccgagcatccgctga

SEQ ID NO: 170409 - DNA, 25 bp, Homo sapien
ggcacgccacctcgccgatgagatt

SEQ ID NO: 170410 - DNA, 25 bp, Homo sapien
ccgatgagattcacccagacccttg

SEQ ID NO: 170411 - DNA, 25 bp, Homo sapien
ttctccgtggaagggcacgccacct

SEQ ID NO: 170412 - DNA, 25 bp, Homo sapien
ccggagccgttcactgagacaggaa

SEQ ID NO: 170413 - DNA, 25 bp, Homo sapien
gcgtgtttaagaattcccatggagt

SEQ ID NO: 170414 - DNA, 25 bp, Homo sapien
cgctgagctgccaacgtggttgtca

SEQ ID NO: 170415 - DNA, 25 bp, Homo sapien
gccgctgttttcaatgcgctaacga

SEQ ID NO: 170416 - DNA, 25 bp, Homo sapien
gcacgttattcttagccgcgtccgg

SEQ ID NO: 170417 - DNA, 25 bp, Homo sapien
ggggatcacattcctgcgcagttgc

SEQ ID NO: 170418 - DNA, 25 bp, Homo sapien
gcaggcaaaccagaagcctcttttg

SEQ ID NO: 170419 - DNA, 25 bp, Homo sapien
ctgctggcggaagtgacttgttttc

SEQ ID NO: 170420 - DNA, 25 bp, Homo sapien
gcagagaacacgctgggaaggcttt

SEQ ID NO: 170421 - DNA, 25 bp, Homo sapien
tcaccgtgcgttcctgcttccttta

SEQ ID NO: 170422 - DNA, 25 bp, Homo sapien
cctttagggtcaccgtgcgttcctg

SEQ ID NO: 170423 - DNA, 25 bp, Homo sapien
ctctgaggagggtgaatagagttcc

SEQ ID NO: 170424 - DNA, 25 bp, Homo sapien
cccgaacctgccagtggagagccag

SEQ ID NO: 170425 - DNA, 25 bp, Homo sapien
tagtttcggcgccagacaccgaggc

SEQ ID NO: 170426 - DNA, 25 bp, Homo sapien
ctgggaaggctttgttgggacaaca

SEQ ID NO: 170427 - DNA, 25 bp, Homo sapien
gcgcgttccctgcagagaacacgct

SEQ ID NO: 170428 - DNA, 25 bp, Homo sapien
cagatcttggacgaggtcgcgtccc

SEQ ID NO: 170429 - DNA, 25 bp, Homo sapien
ttgcagacagatcttggacgaggtc

SEQ ID NO: 170430 - DNA, 25 bp, Homo sapien
tcgtgaccagcaaactcctaaaagc

SEQ ID NO: 170431 - DNA, 25 bp, Homo sapien
cccgggctgtgttcacatcggctgg

SEQ ID NO: 170432 - DNA, 25 bp, Homo sapien
caggcgtgcctggaaatccgctttc

SEQ ID NO: 170433 - DNA, 25 bp, Homo sapien
gggaagggtcccttgcagacagatc

SEQ ID NO: 170434 - DNA, 25 bp, Homo sapien
tgtagcctccaaccggcagtcagga

SEQ ID NO: 170435 - DNA, 25 bp, Homo sapien
tcagcgccgcttagtggcgccaggc

SEQ ID NO: 170436 - DNA, 25 bp, Homo sapien
ccacagaaggttggggcttcttcca

SEQ ID NO: 170437 - DNA, 25 bp, Homo sapien
accactcgcgaaagtagcgtctgtg

SEQ ID NO: 170438 - DNA, 25 bp, Homo sapien
tgctctccgctgtgcctaattcaga

SEQ ID NO: 170439 - DNA, 25 bp, Homo sapien
ttgttccaaaaaccgtggctcctga

SEQ ID NO: 170440 - DNA, 25 bp, Homo sapien
taccgttcaacccatgggccgtggc

SEQ ID NO: 170441 - DNA, 25 bp, Homo sapien
gcattgctggtagacctcgtcctca

SEQ ID NO: 170442 - DNA, 25 bp, Homo sapien
cctggtcaggctttgtccaacgtga

SEQ ID NO: 170443 - DNA, 25 bp, Homo sapien
aacgtgaaccgtttgctgccgcaga

SEQ ID NO: 170444 - DNA, 25 bp, Homo sapien
accctctcttagcagaacaggtgga

SEQ ID NO: 170445 - DNA, 25 bp, Homo sapien
aaatcgtctcccatcggctgtgccg

SEQ ID NO: 170446 - DNA, 25 bp, Homo sapien
tgtgaaaatcgtctcccatcggctg

SEQ ID NO: 170447 - DNA, 25 bp, Homo sapien
tcctcctgactgttgtgaaaatcgt

SEQ ID NO: 170448 - DNA, 25 bp, Homo sapien
tttggagaaatcctcctgactgttg

SEQ ID NO: 170449 - DNA, 25 bp, Homo sapien
gtagctccgtctggatttggagaaa

SEQ ID NO: 170450 - DNA, 25 bp, Homo sapien
ctctgagagtagctccgtctggatt

SEQ ID NO: 170451 - DNA, 25 bp, Homo sapien
tggggtagccgtttctctgagagta

SEQ ID NO: 170452 - DNA, 25 bp, Homo sapien
cggctgattgatgagcagggatcgc

SEQ ID NO: 170453 - DNA, 25 bp, Homo sapien
cagaggaccactgcgtggctggatc

SEQ ID NO: 170454 - DNA, 25 bp, Homo sapien
cccagaggaccactgcgtggctgga

SEQ ID NO: 170455 - DNA, 25 bp, Homo sapien
agatagcgcggctgattgatgagca

SEQ ID NO: 170456 - DNA, 25 bp, Homo sapien
gctcgctggggtcttacagccacct

SEQ ID NO: 170457 - DNA, 25 bp, Homo sapien
cgctggcaccaaagcgggtgggtgg

SEQ ID NO: 170458 - DNA, 25 bp, Homo sapien
ggaccactgcgtggctggatcccgc

SEQ ID NO: 170459 - DNA, 25 bp, Homo sapien
agggatcgcgctgcgctggcaccaa

SEQ ID NO: 170460 - DNA, 25 bp, Homo sapien
cggaagtgcccactgggagtaatgc

SEQ ID NO: 170461 - DNA, 25 bp, Homo sapien
agcgcccactgggagtaacgctgcg

SEQ ID NO: 170462 - DNA, 25 bp, Homo sapien
cacggaagcgcccactgggagtaac

SEQ ID NO: 170463 - DNA, 25 bp, Homo sapien
cggaagcgcccactgggagtaacgc

SEQ ID NO: 170464 - DNA, 25 bp, Homo sapien
gaagtacctactgggagtaacgctg

SEQ ID NO: 170465 - DNA, 25 bp, Homo sapien
ggaagcgcccactgggagtaacgct

SEQ ID NO: 170466 - DNA, 25 bp, Homo sapien
acggaagcgcccactgggagtaacg

SEQ ID NO: 170467 - DNA, 25 bp, Homo sapien
cacggaagtgcccactgggagtaat

SEQ ID NO: 170468 - DNA, 25 bp, Homo sapien
tttcttagacgcaactctctcagcg

SEQ ID NO: 170469 - DNA, 25 bp, Homo sapien
ctgaggggagacaacggtgcccacc

SEQ ID NO: 170470 - DNA, 25 bp, Homo sapien
gggagacaacggtgcccacccgctg

SEQ ID NO: 170471 - DNA, 25 bp, Homo sapien
ttagacgcaactctctcagcgtctc

SEQ ID NO: 170472 - DNA, 25 bp, Homo sapien
gctgcatatcagcagctccgcgtct

SEQ ID NO: 170473 - DNA, 25 bp, Homo sapien
ctggggctgcatatcagcagctccg

SEQ ID NO: 170474 - DNA, 25 bp, Homo sapien
atctcctagtctctcctggggctgc

SEQ ID NO: 170475 - DNA, 25 bp, Homo sapien
agccctttcttagacgcaactctct

SEQ ID NO: 170476 - DNA, 25 bp, Homo sapien
tcgctgcgctgtgtaccgtgtacac

SEQ ID NO: 170477 - DNA, 25 bp, Homo sapien
aggccactacgtttaggagcgctcg

SEQ ID NO: 170478 - DNA, 25 bp, Homo sapien
atgccgccgcccttaagagttccag

SEQ ID NO: 170479 - DNA, 25 bp, Homo sapien
tccttcaggcgaaaggggcagatca

SEQ ID NO: 170480 - DNA, 25 bp, Homo sapien
gcctgggcaaagagctgccaccttc

SEQ ID NO: 170481 - DNA, 25 bp, Homo sapien
agcagcctcggttttacagaatttc

SEQ ID NO: 170482 - DNA, 25 bp, Homo sapien
tacagaatttcagggtcgcgtctcc

SEQ ID NO: 170483 - DNA, 25 bp, Homo sapien
gcgcgggcgtaaatcgttctcagca

SEQ ID NO: 170484 - DNA, 25 bp, Homo sapien
aaacggcgtcccagctgctcgcaaa

SEQ ID NO: 170485 - DNA, 25 bp, Homo sapien
acttgtttggtattgttccgcgcca

SEQ ID NO: 170486 - DNA, 25 bp, Homo sapien
cagactgtttctctctgggtcgcca

SEQ ID NO: 170487 - DNA, 25 bp, Homo sapien
cgccgcggggcacatttgtcatttt

SEQ ID NO: 170488 - DNA, 25 bp, Homo sapien
tttcttgtctctctcgcctgcagtg

SEQ ID NO: 170489 - DNA, 25 bp, Homo sapien
cgtttcattatgtggagggatctcc

SEQ ID NO: 170490 - DNA, 25 bp, Homo sapien
ttccgcgccacacaaaaggcgtttc

SEQ ID NO: 170491 - DNA, 25 bp, Homo sapien
gagaggttcttgtccgccacagctc

SEQ ID NO: 170492 - DNA, 25 bp, Homo sapien
gtaggtaccctcattaattcgcgtc

SEQ ID NO: 170493 - DNA, 25 bp, Homo sapien
cgagacacagcgctgcacgtgtggt

SEQ ID NO: 170494 - DNA, 25 bp, Homo sapien
ccctcattaattcgcgtccattagc

SEQ ID NO: 170495 - DNA, 25 bp, Homo sapien
tgcccgcctcgctgggcaccagcca

SEQ ID NO: 170496 - DNA, 25 bp, Homo sapien
gcaccagccactgccatcgggagag

SEQ ID NO: 170497 - DNA, 25 bp, Homo sapien
tgccgccacccactcgaccctgccg

SEQ ID NO: 170498 - DNA, 25 bp, Homo sapien
acagcgctgcacgtgtggtaggtac

SEQ ID NO: 170499 - DNA, 25 bp, Homo sapien
gcacgtgtggtaggtaccctcatta

SEQ ID NO: 170500 - DNA, 25 bp, Homo sapien
gcacaatagacttcccgcaggcgag

SEQ ID NO: 170501 - DNA, 25 bp, Homo sapien
gtggctcaggccctacttggcaaga

SEQ ID NO: 170502 - DNA, 25 bp, Homo sapien
agtgcgaacggccttttgcttcctc

SEQ ID NO: 170503 - DNA, 25 bp, Homo sapien
ttccaggacccttagcgacaggaga

SEQ ID NO: 170504 - DNA, 25 bp, Homo sapien
cgggtccaggcctctaggcaatagg

SEQ ID NO: 170505 - DNA, 25 bp, Homo sapien
cacagcgctgaggaccaactagggc

SEQ ID NO: 170506 - DNA, 25 bp, Homo sapien
gcccaggtagagctcgcgtctttaa

SEQ ID NO: 170507 - DNA, 25 bp, Homo sapien
gcgtctttaagagccacccgacaga

SEQ ID NO: 170508 - DNA, 25 bp, Homo sapien
ccagcgcagacacgccgcggggtct

SEQ ID NO: 170509 - DNA, 25 bp, Homo sapien
gcacggccagcgcagacacgccgcg

SEQ ID NO: 170510 - DNA, 25 bp, Homo sapien
agacggcgatcgaggcgcgcgccac

SEQ ID NO: 170511 - DNA, 25 bp, Homo sapien
cggcggccagcagacggcgatcgag

SEQ ID NO: 170512 - DNA, 25 bp, Homo sapien
ctcgaacaaggcctctggctgccag

SEQ ID NO: 170513 - DNA, 25 bp, Homo sapien
ggccctcgaacaaggcctctggctg

SEQ ID NO: 170514 - DNA, 25 bp, Homo sapien
tggagcgccatcacccgaacgcgcg

SEQ ID NO: 170515 - DNA, 25 bp, Homo sapien
cgagcgccctggagcgccatcaccc

SEQ ID NO: 170516 - DNA, 25 bp, Homo sapien
gcggcctccaagaagctcctgggcg

SEQ ID NO: 170517 - DNA, 25 bp, Homo sapien
agctgcggcctccaagaagctcctg

SEQ ID NO: 170518 - DNA, 25 bp, Homo sapien
aatggaatcgctgccagggaaacca

SEQ ID NO: 170519 - DNA, 25 bp, Homo sapien
ctgtgaacacctgccaggccggaaa

SEQ ID NO: 170520 - DNA, 25 bp, Homo sapien
cctgccaggccggaaatgccggctt

SEQ ID NO: 170521 - DNA, 25 bp, Homo sapien
ccgcacctagggagaactcccaaag

SEQ ID NO: 170522 - DNA, 25 bp, Homo sapien
tgaacacctgccaggccggaaatgc

SEQ ID NO: 170523 - DNA, 25 bp, Homo sapien
cggaaatgccggcttgaagctggct

SEQ ID NO: 170524 - DNA, 25 bp, Homo sapien
tgatgatggagaccgacctgcactc

SEQ ID NO: 170525 - DNA, 25 bp, Homo sapien
gccaaggccaaccaggaccgggtca

SEQ ID NO: 170526 - DNA, 25 bp, Homo sapien
ttggccacgactgcacctgtttgca

SEQ ID NO: 170527 - DNA, 25 bp, Homo sapien
ccgaccgtcggcctctttggcaagt

SEQ ID NO: 170528 - DNA, 25 bp, Homo sapien
ctctttggcaagtggtttgtgcatc

SEQ ID NO: 170529 - DNA, 25 bp, Homo sapien
caaaagcggagctgcaacttggcca

SEQ ID NO: 170530 - DNA, 25 bp, Homo sapien
gagaaactttccacctgcgagccga

SEQ ID NO: 170531 - DNA, 25 bp, Homo sapien
tcaagaaggacaagtactcgctggc

SEQ ID NO: 170532 - DNA, 25 bp, Homo sapien
ttgcctgagggcgagctctcctcct

SEQ ID NO: 170533 - DNA, 25 bp, Homo sapien
cttttacactcagccggcggaacga

SEQ ID NO: 170534 - DNA, 25 bp, Homo sapien
ttagtggagagaaagtgctgacccg

SEQ ID NO: 170535 - DNA, 25 bp, Homo sapien
tttgtctttgaagctcccccgccga

SEQ ID NO: 170536 - DNA, 25 bp, Homo sapien
gtcagccgcaagtcaaaccctttta

SEQ ID NO: 170537 - DNA, 25 bp, Homo sapien
ctgcgcctctccaagtcgccctttc

SEQ ID NO: 170538 - DNA, 25 bp, Homo sapien
tttgtgtagaaggagagcaggatta

SEQ ID NO: 170539 - DNA, 25 bp, Homo sapien
ctgacccggggtcagccgcaagtca

SEQ ID NO: 170540 - DNA, 25 bp, Homo sapien
ccaggatttgcttgacttgcttttc

SEQ ID NO: 170541 - DNA, 25 bp, Homo sapien
acctgcggttggattaatcgttata

SEQ ID NO: 170542 - DNA, 25 bp, Homo sapien
atattcccgagatgagcgtcgctgc

SEQ ID NO: 170543 - DNA, 25 bp, Homo sapien
agtctaagagtgttcgcatggccga

SEQ ID NO: 170544 - DNA, 25 bp, Homo sapien
gggcagttccctcccggagtcatta

SEQ ID NO: 170545 - DNA, 25 bp, Homo sapien
aacttcgtctcctcgtgctcaggga

SEQ ID NO: 170546 - DNA, 25 bp, Homo sapien
cgacgctcttttgtctgataactaa

SEQ ID NO: 170547 - DNA, 25 bp, Homo sapien
tcacttatctggaaacctgcggttg

SEQ ID NO: 170548 - DNA, 25 bp, Homo sapien
ttgtcccgggcgctcaaagcgccga

SEQ ID NO: 170549 - DNA, 25 bp, Homo sapien
ccgccggtcactcaggcagaacggg

SEQ ID NO: 170550 - DNA, 25 bp, Homo sapien
cgggcgctcaaagcgccgagcagct

SEQ ID NO: 170551 - DNA, 25 bp, Homo sapien
gccgaggccgaacactgcgcccatt

SEQ ID NO: 170552 - DNA, 25 bp, Homo sapien
gctgcgcagactttctgggctcgga

SEQ ID NO: 170553 - DNA, 25 bp, Homo sapien
tcactcaggcagaacggggtatgca

SEQ ID NO: 170554 - DNA, 25 bp, Homo sapien
cagaacggggtatgcaaatggcctg

SEQ ID NO: 170555 - DNA, 25 bp, Homo sapien
gagcagctgcgcagactttctgggc

SEQ ID NO: 170556 - DNA, 25 bp, Homo sapien
gtccacctccgagcctggagacgtt

SEQ ID NO: 170557 - DNA, 25 bp, Homo sapien
ctgagcccacctccgagcgtggaga

SEQ ID NO: 170558 - DNA, 25 bp, Homo sapien
tcactgagtccacctgcgagcctgg

SEQ ID NO: 170559 - DNA, 25 bp, Homo sapien
ctgagtccacctccgagcgtggaca

SEQ ID NO: 170560 - DNA, 25 bp, Homo sapien
ttcactgagtccacctgcgagcctg

SEQ ID NO: 170561 - DNA, 25 bp, Homo sapien
gagtccacctccgagcctggagacg

SEQ ID NO: 170562 - DNA, 25 bp, Homo sapien
gagcccacctccgagcgtggagacg

SEQ ID NO: 170563 - DNA, 25 bp, Homo sapien
ctgagtccacctccgagcctggaga

SEQ ID NO: 170564 - DNA, 25 bp, Homo sapien
tgcggcctctatcacgttctgcgtg

SEQ ID NO: 170565 - DNA, 25 bp, Homo sapien
tgtggcctctatcacgttctgcatg

SEQ ID NO: 170566 - DNA, 25 bp, Homo sapien
tctatcacgttctgcgtgtggcctc

SEQ ID NO: 170567 - DNA, 25 bp, Homo sapien
tggcctctatcacactctgcatgtg

SEQ ID NO: 170568 - DNA, 25 bp, Homo sapien
tctatcacgtgctgcgtgcggcctc

SEQ ID NO: 170569 - DNA, 25 bp, Homo sapien
tggcctctatcacgtgctgcgtgcg

SEQ ID NO: 170570 - DNA, 25 bp, Homo sapien
tgcgtgcggcctctatcacgttctg

SEQ ID NO: 170571 - DNA, 25 bp, Homo sapien
cacgttctgcatgtggcctctatca

SEQ ID NO: 170572 - DNA, 25 bp, Homo sapien
tgcgcgccgaaaaggccgaattccg

SEQ ID NO: 170573 - DNA, 25 bp, Homo sapien
agtccgggctctacacatctgcagg

SEQ ID NO: 170574 - DNA, 25 bp, Homo sapien
caggtggcttgcacatcaggaaaac

SEQ ID NO: 170575 - DNA, 25 bp, Homo sapien
ggaagcctttcctagctgcgcgtgc

SEQ ID NO: 170576 - DNA, 25 bp, Homo sapien
tgccggttggatacagcccgaatta

SEQ ID NO: 170577 - DNA, 25 bp, Homo sapien
tgagactcgtgtccttcctcgttgg

SEQ ID NO: 170578 - DNA, 25 bp, Homo sapien
acagcgcatctgtgtggccagcaca

SEQ ID NO: 170579 - DNA, 25 bp, Homo sapien
ccgctgtccgagagacgacatctca

SEQ ID NO: 170580 - DNA, 25 bp, Homo sapien
atcaacacgcaagccgctgctgaga

SEQ ID NO: 170581 - DNA, 25 bp, Homo sapien
agaagcgggcacacaccgtccgtgc

SEQ ID NO: 170582 - DNA, 25 bp, Homo sapien
gtccttcatcctggaaagcctttcc

SEQ ID NO: 170583 - DNA, 25 bp, Homo sapien
tcctaaccggagacttccaaattga

SEQ ID NO: 170584 - DNA, 25 bp, Homo sapien
aattgaaaatcgcaacgctctgttg

SEQ ID NO: 170585 - DNA, 25 bp, Homo sapien
acagagcccgttcttaggcattaca

SEQ ID NO: 170586 - DNA, 25 bp, Homo sapien
actcagcgaaccagcccagaaacga

SEQ ID NO: 170587 - DNA, 25 bp, Homo sapien
ccagaaacgaagtaggcagccgaga

SEQ ID NO: 170588 - DNA, 25 bp, Homo sapien
ccactgttgctacgggtcttcacca

SEQ ID NO: 170589 - DNA, 25 bp, Homo sapien
ctcctcgcgagagacttagtgctca

SEQ ID NO: 170590 - DNA, 25 bp, Homo sapien
gtctctaagccacccgaactgtgtg

SEQ ID NO: 170591 - DNA, 25 bp, Homo sapien
ggaaggatcgctccatgaccacgta

SEQ ID NO: 170592 - DNA, 25 bp, Homo sapien
cttaagcttatgtcgcctgtgaata

SEQ ID NO: 170593 - DNA, 25 bp, Homo sapien
tcgcgcgttacccaggaggaaatta

SEQ ID NO: 170594 - DNA, 25 bp, Homo sapien
gccaccaccgaatggacgagttctc

SEQ ID NO: 170595 - DNA, 25 bp, Homo sapien
cgcgggcctgttctttcatcagaaa

SEQ ID NO: 170596 - DNA, 25 bp, Homo sapien
gagcagtaacaactcttcacgggga

SEQ ID NO: 170597 - DNA, 25 bp, Homo sapien
gggcacaggtgtcctgaacaccgcg

SEQ ID NO: 170598 - DNA, 25 bp, Homo sapien
ctgcttggtgacctcgccacacgaa

SEQ ID NO: 170599 - DNA, 25 bp, Homo sapien
tcgccacacgaaaggaccatgattc

SEQ ID NO: 170600 - DNA, 25 bp, Homo sapien
accatgattcctgcagggcggaagc

SEQ ID NO: 170601 - DNA, 25 bp, Homo sapien
cggaagcaaccgatgagcagtaaca

SEQ ID NO: 170602 - DNA, 25 bp, Homo sapien
gacacagacaggtaaccggggcaca

SEQ ID NO: 170603 - DNA, 25 bp, Homo sapien
aacaactcttcacggggacacagac

SEQ ID NO: 170604 - DNA, 25 bp, Homo sapien
cggcagccgcgtagccgaagttcag

SEQ ID NO: 170605 - DNA, 25 bp, Homo sapien
tctggcagctgcagcacttgaagtg

SEQ ID NO: 170606 - DNA, 25 bp, Homo sapien
agctcgtctgaccagctggtccgcg

SEQ ID NO: 170607 - DNA, 25 bp, Homo sapien
ctggctgtccagctttcagagagct

SEQ ID NO: 170608 - DNA, 25 bp, Homo sapien
ggcgctggtccttcacaaacctgta

SEQ ID NO: 170609 - DNA, 25 bp, Homo sapien
cacaaacctgtaggcgtcttcggag

SEQ ID NO: 170610 - DNA, 25 bp, Homo sapien
cacttgaagtgcgaatccggggcca

SEQ ID NO: 170611 - DNA, 25 bp, Homo sapien
cgatagtggcacagcaggagatgcc

SEQ ID NO: 170612 - DNA, 25 bp, Homo sapien
cttctgcatctctagacggagtctg

SEQ ID NO: 170613 - DNA, 25 bp, Homo sapien
ggcacccggcagagaaaacacgttc

SEQ ID NO: 170614 - DNA, 25 bp, Homo sapien
cctaagagtcagtgcgcggaacaga

SEQ ID NO: 170615 - DNA, 25 bp, Homo sapien
acgctggttttctgctcgctgtgac

SEQ ID NO: 170616 - DNA, 25 bp, Homo sapien
cacacgcctgtgtccgtgaggagtc

SEQ ID NO: 170617 - DNA, 25 bp, Homo sapien
ggggacatcgatccgtttcaaacac

SEQ ID NO: 170618 - DNA, 25 bp, Homo sapien
tcttcttgcacttactcggagcctg

SEQ ID NO: 170619 - DNA, 25 bp, Homo sapien
ttccgcagccacagaagaacacgca

SEQ ID NO: 170620 - DNA, 25 bp, Homo sapien
cagcgatgcccgagagcccaaggtc

SEQ ID NO: 170621 - DNA, 25 bp, Homo sapien
ctcccgggaatccagggacgtcgcg

SEQ ID NO: 170622 - DNA, 25 bp, Homo sapien
gcgtgagaagcagccttcgagccta

SEQ ID NO: 170623 - DNA, 25 bp, Homo sapien
ttcgagcctaggttgggactaatga

SEQ ID NO: 170624 - DNA, 25 bp, Homo sapien
ttgggactaatgaaaacgcagatta

SEQ ID NO: 170625 - DNA, 25 bp, Homo sapien
agattaaacagcgtcctccctccgg

SEQ ID NO: 170626 - DNA, 25 bp, Homo sapien
acctggtgcaggaagagccgcctgc

SEQ ID NO: 170627 - DNA, 25 bp, Homo sapien
ccggacgctcagtcggggccttact

SEQ ID NO: 170628 - DNA, 25 bp, Homo sapien
ccgcccgtttctcagatggcacagc

SEQ ID NO: 170629 - DNA, 25 bp, Homo sapien
gcccatgcttctctccgtggagacc

SEQ ID NO: 170630 - DNA, 25 bp, Homo sapien
catgcttctctccgtggagaccacg

SEQ ID NO: 170631 - DNA, 25 bp, Homo sapien
tcagatggcacagcccacgcccatg

SEQ ID NO: 170632 - DNA, 25 bp, Homo sapien
tggcacagcccacgcccatgcttct

SEQ ID NO: 170633 - DNA, 25 bp, Homo sapien
tccgcccgtttctcagatggcacag

SEQ ID NO: 170634 - DNA, 25 bp, Homo sapien
acgcccatgcttctctccgtggaga

SEQ ID NO: 170635 - DNA, 25 bp, Homo sapien
gatggcacagcccacgcccatgctt

SEQ ID NO: 170636 - DNA, 25 bp, Homo sapien
ctgttcacggtgttccatccctggc

SEQ ID NO: 170637 - DNA, 25 bp, Homo sapien
ccgtggtcctatcaaatctgtcgga

SEQ ID NO: 170638 - DNA, 25 bp, Homo sapien
cggccatcagccgtggtcctatcaa

SEQ ID NO: 170639 - DNA, 25 bp, Homo sapien
tcatgggagccctgccggccatcag

SEQ ID NO: 170640 - DNA, 25 bp, Homo sapien
gcacatcagcgtcatgggagccctg

SEQ ID NO: 170641 - DNA, 25 bp, Homo sapien
tgggtgaaaataccggcacatcagc

SEQ ID NO: 170642 - DNA, 25 bp, Homo sapien
ggagccgctccactgggtgaaaata

SEQ ID NO: 170643 - DNA, 25 bp, Homo sapien
tcaccctgatgcttcctgttcacgg

SEQ ID NO: 170644 - DNA, 25 bp, Homo sapien
ttgacttcacaatcacaggagcgtg

SEQ ID NO: 170645 - DNA, 25 bp, Homo sapien
gcgtgacgcctacagcctaatgttg

SEQ ID NO: 170646 - DNA, 25 bp, Homo sapien
tgtcgcatccatccaccgcttaatt

SEQ ID NO: 170647 - DNA, 25 bp, Homo sapien
tgttgccgtgtagggcacagacttc

SEQ ID NO: 170648 - DNA, 25 bp, Homo sapien
aaagaatcttcaggggatgtcgcca

SEQ ID NO: 170649 - DNA, 25 bp, Homo sapien
tcgccaggtgatggcgggaatcctc

SEQ ID NO: 170650 - DNA, 25 bp, Homo sapien
agtgcgccgacgaccgccacagaaa

SEQ ID NO: 170651 - DNA, 25 bp, Homo sapien
ggaccgtcctgcaccacaatcagga

SEQ ID NO: 170652 - DNA, 25 bp, Homo sapien
aagctgccaggccctacgtgggcca

SEQ ID NO: 170653 - DNA, 25 bp, Homo sapien
cctcgcttccggaacagggttcatg

SEQ ID NO: 170654 - DNA, 25 bp, Homo sapien
gcttccggaacagggttcatgctta

SEQ ID NO: 170655 - DNA, 25 bp, Homo sapien
gaacagggttcatgcttaggcaacc

SEQ ID NO: 170656 - DNA, 25 bp, Homo sapien
ggaggggccgagacctccagcagag

SEQ ID NO: 170657 - DNA, 25 bp, Homo sapien
gtggggtccagacagctccgtgcag

SEQ ID NO: 170658 - DNA, 25 bp, Homo sapien
gacaccatgccggcaagaggagctg

SEQ ID NO: 170659 - DNA, 25 bp, Homo sapien
ttcatgcttaggcaacccaactcct

SEQ ID NO: 170660 - DNA, 25 bp, Homo sapien
atgggaatttcgtgtctagcagtgc

SEQ ID NO: 170661 - DNA, 25 bp, Homo sapien
accgcgagcttcacgtgtgggagct

SEQ ID NO: 170662 - DNA, 25 bp, Homo sapien
gctccgctgaaacatggcgcactcg

SEQ ID NO: 170663 - DNA, 25 bp, Homo sapien
aaacatggcgcactcgtgggcggaa

SEQ ID NO: 170664 - DNA, 25 bp, Homo sapien
gcaggacacctgcagcatgcagttc

SEQ ID NO: 170665 - DNA, 25 bp, Homo sapien
cctgcaggacgtcaatgggaatttc

SEQ ID NO: 170666 - DNA, 25 bp, Homo sapien
agtgcaacgaacatcacccgcagct

SEQ ID NO: 170667 - DNA, 25 bp, Homo sapien
cgtgtctagcagtgcaacgaacatc

SEQ ID NO: 170668 - DNA, 25 bp, Homo sapien
aacaaagcgagtgccagacgcgcgt

SEQ ID NO: 170669 - DNA, 25 bp, Homo sapien
aacgagttctgaaacaaagcgagtg

SEQ ID NO: 170670 - DNA, 25 bp, Homo sapien
ggcgcaccctacaaacgagttctga

SEQ ID NO: 170671 - DNA, 25 bp, Homo sapien
aagcaagcctggatggcgcacccta

SEQ ID NO: 170672 - DNA, 25 bp, Homo sapien
cgggcaggacacaaaagcaagcctg

SEQ ID NO: 170673 - DNA, 25 bp, Homo sapien
taaggacaaaaacgggcaggacaca

SEQ ID NO: 170674 - DNA, 25 bp, Homo sapien
tcaacacggccattaaggacaaaaa

SEQ ID NO: 170675 - DNA, 25 bp, Homo sapien
tcctatcgaatcaacacggccatta

SEQ ID NO: 170676 - DNA, 25 bp, Homo sapien
agggacgatgatgtgacactccagc

SEQ ID NO: 170677 - DNA, 25 bp, Homo sapien
ggcattcctcccgtcctcactgacg

SEQ ID NO: 170678 - DNA, 25 bp, Homo sapien
ggataaattggcgagctggcattcc

SEQ ID NO: 170679 - DNA, 25 bp, Homo sapien
cgaaaagggacgatgatgtgacact

SEQ ID NO: 170680 - DNA, 25 bp, Homo sapien
gacaccagagaagggggataaattg

SEQ ID NO: 170681 - DNA, 25 bp, Homo sapien
cccacaggatgaacccaaaggcgcg

SEQ ID NO: 170682 - DNA, 25 bp, Homo sapien
gacgatgatgtgacactccagcacc

SEQ ID NO: 170683 - DNA, 25 bp, Homo sapien
cctcactgacggacccgcgagcgga

SEQ ID NO: 170684 - DNA, 25 bp, Homo sapien
ttactggctgagcatgccctacatg

SEQ ID NO: 170685 - DNA, 25 bp, Homo sapien
atcgaggcggagaaccattactggc

SEQ ID NO: 170686 - DNA, 25 bp, Homo sapien
agcagaacatgatccgccgcctgga

SEQ ID NO: 170687 - DNA, 25 bp, Homo sapien
ggttctctagggagctccttcttcg

SEQ ID NO: 170688 - DNA, 25 bp, Homo sapien
ctctctcgcgagagccgaagtctct

SEQ ID NO: 170689 - DNA, 25 bp, Homo sapien
cactagtttgaatctcggcgccgga

SEQ ID NO: 170690 - DNA, 25 bp, Homo sapien
tcccgcagaagctccggatagggtc

SEQ ID NO: 170691 - DNA, 25 bp, Homo sapien
gcccgggagctacgctaacgccaaa

SEQ ID NO: 170692 - DNA, 25 bp, Homo sapien
ggcgccagcactcggccgttgacga

SEQ ID NO: 170693 - DNA, 25 bp, Homo sapien
tgtctcctggcttttgcacggcatc

SEQ ID NO: 170694 - DNA, 25 bp, Homo sapien
tttgcacggcatcaagtaacccgcg

SEQ ID NO: 170695 - DNA, 25 bp, Homo sapien
gccttcagcaaggactccgcgagcg

SEQ ID NO: 170696 - DNA, 25 bp, Homo sapien
caagctgctggggagtgccacagca

SEQ ID NO: 170697 - DNA, 25 bp, Homo sapien
agcactcggccgttgacgagtcttt

SEQ ID NO: 170698 - DNA, 25 bp, Homo sapien
ccaagcggacctaaggagtcgcagt

SEQ ID NO: 170699 - DNA, 25 bp, Homo sapien
ctccgcgagcgaggtgcaagctgct

SEQ ID NO: 170700 - DNA, 25 bp, Homo sapien
gcgcgtgcggctgcctaagcgttcc

SEQ ID NO: 170701 - DNA, 25 bp, Homo sapien
agttccgggcgacaggtggcccgag

SEQ ID NO: 170702 - DNA, 25 bp, Homo sapien
ctgctgcccggtcggccgagaaagt

SEQ ID NO: 170703 - DNA, 25 bp, Homo sapien
aggccctcgagctgcgcggacagag

SEQ ID NO: 170704 - DNA, 25 bp, Homo sapien
tgcctaagcgttcccggccctgtct

SEQ ID NO: 170705 - DNA, 25 bp, Homo sapien
aaagcgcgggcgcttcccacaatgc

SEQ ID NO: 170706 - DNA, 25 bp, Homo sapien
gccaccagggcgccattttaacgga

SEQ ID NO: 170707 - DNA, 25 bp, Homo sapien
gtctggtgcattccccctgctgctg

SEQ ID NO: 170708 - DNA, 25 bp, Homo sapien
gccactctaccttcgctcctgccca

SEQ ID NO: 170709 - DNA, 25 bp, Homo sapien
agaacgttcggcgacttctggtccg

SEQ ID NO: 170710 - DNA, 25 bp, Homo sapien
ctgcagcagaacgttcggcgacttc

SEQ ID NO: 170711 - DNA, 25 bp, Homo sapien
cccaggatcctgcagcacaggttct

SEQ ID NO: 170712 - DNA, 25 bp, Homo sapien
aacgtattagggctgcacgcgcagg

SEQ ID NO: 170713 - DNA, 25 bp, Homo sapien
cccggaacgtattagggctgcacgc

SEQ ID NO: 170714 - DNA, 25 bp, Homo sapien
ggtcgccatcctcgcccggagccgt

SEQ ID NO: 170715 - DNA, 25 bp, Homo sapien
tgcagcacaggttctgcagcagaac

SEQ ID NO: 170716 - DNA, 25 bp, Homo sapien
ggaatcgcaaccgatttcagagacg

SEQ ID NO: 170717 - DNA, 25 bp, Homo sapien
tgaggctcttgcccgccaggccctt

SEQ ID NO: 170718 - DNA, 25 bp, Homo sapien
tgccccacccacaccggccgcctga

SEQ ID NO: 170719 - DNA, 25 bp, Homo sapien
tccagcgggaatcgcaaccgatttc

SEQ ID NO: 170720 - DNA, 25 bp, Homo sapien
cagcgggaatcgcaaccgatttcag

SEQ ID NO: 170721 - DNA, 25 bp, Homo sapien
agcgggaatcgcaaccgatttcaga

SEQ ID NO: 170722 - DNA, 25 bp, Homo sapien
gcgggaatcgcaaccgatttcagag

SEQ ID NO: 170723 - DNA, 25 bp, Homo sapien
cgggaatcgcaaccgatttcagaga

SEQ ID NO: 170724 - DNA, 25 bp, Homo sapien
gacattgataactcgcgtaggcacc

SEQ ID NO: 170725 - DNA, 25 bp, Homo sapien
agtgctgcctcccacgcgatgctgt

SEQ ID NO: 170726 - DNA, 25 bp, Homo sapien
atgctgtctcatcggcgtacctccg

SEQ ID NO: 170727 - DNA, 25 bp, Homo sapien
gctgggagtcccgtcatttgataac

SEQ ID NO: 170728 - DNA, 25 bp, Homo sapien
cccgagactctacttcactggctga

SEQ ID NO: 170729 - DNA, 25 bp, Homo sapien
cactggctgacatcgctgatctaaa

SEQ ID NO: 170730 - DNA, 25 bp, Homo sapien
ctgatctaaaattgggcgcgcgccc

SEQ ID NO: 170731 - DNA, 25 bp, Homo sapien
cgtacctccgagaacacactgggtt

SEQ ID NO: 170732 - DNA, 25 bp, Homo sapien
agttgacaccctggggcttccgacg

SEQ ID NO: 170733 - DNA, 25 bp, Homo sapien
cagccttgccgccagtggagcagct

SEQ ID NO: 170734 - DNA, 25 bp, Homo sapien
atggactgcagcctcgtgcggacgc

SEQ ID NO: 170735 - DNA, 25 bp, Homo sapien
cggacgctcgtgcacagatacgtga

SEQ ID NO: 170736 - DNA, 25 bp, Homo sapien
acagatacgtgagtgctcccggcgc

SEQ ID NO: 170737 - DNA, 25 bp, Homo sapien
tccgatgtctgggactcggaccgcc

SEQ ID NO: 170738 - DNA, 25 bp, Homo sapien
cgcatgctcacttgcgccggtgacg

SEQ ID NO: 170739 - DNA, 25 bp, Homo sapien
ctgggaccctggctgaaactccggg

SEQ ID NO: 170740 - DNA, 25 bp, Homo sapien
actccgtggggcttttgtgatccca

SEQ ID NO: 170741 - DNA, 25 bp, Homo sapien
tggcttccagctaccgtttttctta

SEQ ID NO: 170742 - DNA, 25 bp, Homo sapien
ggttcccttaccaaggtctccatca

SEQ ID NO: 170743 - DNA, 25 bp, Homo sapien
tctgccgaagtccagtcccgtgtgt

SEQ ID NO: 170744 - DNA, 25 bp, Homo sapien
gcctctcaccttgggctttccggaa

SEQ ID NO: 170745 - DNA, 25 bp, Homo sapien
ctccctctctgagtgacactgtctg

SEQ ID NO: 170746 - DNA, 25 bp, Homo sapien
tgcggctgcatcaccgtccatgctt

SEQ ID NO: 170747 - DNA, 25 bp, Homo sapien
ggcttcttaaggagaccgcctctca

SEQ ID NO: 170748 - DNA, 25 bp, Homo sapien
cctccctgtgttacctgtatgtacc

SEQ ID NO: 170749 - DNA, 25 bp, Homo sapien
ctgtgttacctgtatgtaccgcgtt

SEQ ID NO: 170750 - DNA, 25 bp, Homo sapien
cctgtgttacctgtatgtaccgcgt

SEQ ID NO: 170751 - DNA, 25 bp, Homo sapien
acctgtatgtaccacgttgtcagta

SEQ ID NO: 170752 - DNA, 25 bp, Homo sapien
tgtgttacctgtatgtaccacgttg

SEQ ID NO: 170753 - DNA, 25 bp, Homo sapien
ttacctgtatgtaccacgttgtcag

SEQ ID NO: 170754 - DNA, 25 bp, Homo sapien
ctccctgtgttacctgtatgtacca

SEQ ID NO: 170755 - DNA, 25 bp, Homo sapien
tatgtaccacgttgtcagtatccac

SEQ ID NO: 170756 - DNA, 25 bp, Homo sapien
tcccagaaccatttccggtcacgga

SEQ ID NO: 170757 - DNA, 25 bp, Homo sapien
tcccgtcacggaagcggcactcaga

SEQ ID NO: 170758 - DNA, 25 bp, Homo sapien
accatttcccgtcacggaagcggca

SEQ ID NO: 170759 - DNA, 25 bp, Homo sapien
accatttccggtcacggaagcggca

SEQ ID NO: 170760 - DNA, 25 bp, Homo sapien
tttcccgtcacggaagcggcactca

SEQ ID NO: 170761 - DNA, 25 bp, Homo sapien
tttccggtcacggaagcggcactca

SEQ ID NO: 170762 - DNA, 25 bp, Homo sapien
ccagaaccatttccggtcacggaag

SEQ ID NO: 170763 - DNA, 25 bp, Homo sapien
tccggtcacggaagcggcactcaga

SEQ ID NO: 170764 - DNA, 25 bp, Homo sapien
ccctgtcacgggttgtagaaattga

SEQ ID NO: 170765 - DNA, 25 bp, Homo sapien
tcacgagtgtggattcttgggatac

SEQ ID NO: 170766 - DNA, 25 bp, Homo sapien
gaccatgggcagttttagttcacga

SEQ ID NO: 170767 - DNA, 25 bp, Homo sapien
tgtccggcgttgatcctttaactga

SEQ ID NO: 170768 - DNA, 25 bp, Homo sapien
tgaagccgcggcttccttgcaggcc

SEQ ID NO: 170769 - DNA, 25 bp, Homo sapien
tcacagcgctgagcaggcgtaaccg

SEQ ID NO: 170770 - DNA, 25 bp, Homo sapien
ttgtagaaattgacgcagcgttttc

SEQ ID NO: 170771 - DNA, 25 bp, Homo sapien
ttctgtaacgacctcccgtaaagca

SEQ ID NO: 170772 - DNA, 25 bp, Homo sapien
aaggtgggagagaaccgtgcatctc

SEQ ID NO: 170773 - DNA, 25 bp, Homo sapien
tgcatctcagcacggcggtggaaac

SEQ ID NO: 170774 - DNA, 25 bp, Homo sapien
aacgtggtccacctgcggagggcct

SEQ ID NO: 170775 - DNA, 25 bp, Homo sapien
ggagggcctgtttgcgtttattaca

SEQ ID NO: 170776 - DNA, 25 bp, Homo sapien
tgcgtttattacacccgagcaaggc

SEQ ID NO: 170777 - DNA, 25 bp, Homo sapien
ttattacacccgagcaaggcccgca

SEQ ID NO: 170778 - DNA, 25 bp, Homo sapien
ccgcttccctggactgctaggaggc

SEQ ID NO: 170779 - DNA, 25 bp, Homo sapien
tgggagagaaccgtgcatctcagca

SEQ ID NO: 170780 - DNA, 25 bp, Homo sapien
cagagttgcaagaccctggggaatg

SEQ ID NO: 170781 - DNA, 25 bp, Homo sapien
catcggtgaagagcgtcgttggcgt

SEQ ID NO: 170782 - DNA, 25 bp, Homo sapien
gagccgcagagttgcaagaccctgg

SEQ ID NO: 170783 - DNA, 25 bp, Homo sapien
gtcccacttcatcggggtaggcggc

SEQ ID NO: 170784 - DNA, 25 bp, Homo sapien
cctggggaatggaggctttgttgtt

SEQ ID NO: 170785 - DNA, 25 bp, Homo sapien
tgggtcccacttcatcggggtaggc

SEQ ID NO: 170786 - DNA, 25 bp, Homo sapien
ttgttgttcggtgggtcccacttca

SEQ ID NO: 170787 - DNA, 25 bp, Homo sapien
cccgtcacgggagccgcagagttgc

SEQ ID NO: 170788 - DNA, 25 bp, Homo sapien
ttgaaattgtcgaatgcggcggcag

SEQ ID NO: 170789 - DNA, 25 bp, Homo sapien
agttcttgaaattgtcgaatgcggc

SEQ ID NO: 170790 - DNA, 25 bp, Homo sapien
tcttgaaattgtcgaatgcggcggc

SEQ ID NO: 170791 - DNA, 25 bp, Homo sapien
ccgcgcccgaccacttagttcttga

SEQ ID NO: 170792 - DNA, 25 bp, Homo sapien
aaattgtcgaatgcggcggcaggga

SEQ ID NO: 170793 - DNA, 25 bp, Homo sapien
aagggtgcaagacgcggagggctct

SEQ ID NO: 170794 - DNA, 25 bp, Homo sapien
acgcggagggctctatgtcgggaaa

SEQ ID NO: 170795 - DNA, 25 bp, Homo sapien
ccctggggctggcaagggtgcaaga

SEQ ID NO: 170796 - DNA, 25 bp, Homo sapien
acgtgcctgcgttcagactccgttt

SEQ ID NO: 170797 - DNA, 25 bp, Homo sapien
cgtgcctgcgttcagactccattta

SEQ ID NO: 170798 - DNA, 25 bp, Homo sapien
acgggctgcacatggggtaaactgt

SEQ ID NO: 170799 - DNA, 25 bp, Homo sapien
tgcctgcgttcagactccgtttatc

SEQ ID NO: 170800 - DNA, 25 bp, Homo sapien
tgagctaaacccaggcacacgcgtg

SEQ ID NO: 170801 - DNA, 25 bp, Homo sapien
aacgcacgtgcctgcattcagactc

SEQ ID NO: 170802 - DNA, 25 bp, Homo sapien
cggaacgcacgtgcctgcattcaga

SEQ ID NO: 170803 - DNA, 25 bp, Homo sapien
acgtgcctgcgttcagactccattt

SEQ ID NO: 170804 - DNA, 25 bp, Homo sapien
acgggagtcacgatgggatgtttcc

SEQ ID NO: 170805 - DNA, 25 bp, Homo sapien
gtgtcacagagtgagccggcgtttc

SEQ ID NO: 170806 - DNA, 25 bp, Homo sapien
tagttggaatcggagtgcacgtgtc

SEQ ID NO: 170807 - DNA, 25 bp, Homo sapien
ccagtggaaggcatccaggtccgtc

SEQ ID NO: 170808 - DNA, 25 bp, Homo sapien
tcagggttagctcaggctgcttttc

SEQ ID NO: 170809 - DNA, 25 bp, Homo sapien
tttcccgcgtgggttactcagatgc

SEQ ID NO: 170810 - DNA, 25 bp, Homo sapien
agccttaaggctgctgcgggtgtca

SEQ ID NO: 170811 - DNA, 25 bp, Homo sapien
tgcggaaacgcacagagagccttaa

SEQ ID NO: 170812 - DNA, 25 bp, Homo sapien
ctctcaggggctcttgtgaggataa

SEQ ID NO: 170813 - DNA, 25 bp, Homo sapien
tctcccatttgttctgactcctgtg

SEQ ID NO: 170814 - DNA, 25 bp, Homo sapien
cctgatttgtgcacttggtgatgat

SEQ ID NO: 170815 - DNA, 25 bp, Homo sapien
gatcatttgtgtgcttggtgacgga

SEQ ID NO: 170816 - DNA, 25 bp, Homo sapien
tgtccaatactcttccactagaaag

SEQ ID NO: 170817 - DNA, 25 bp, Homo sapien
ggaacagtgaccgtttgtgcgcttg

SEQ ID NO: 170818 - DNA, 25 bp, Homo sapien
atggggacaaccctatctctcaggg

SEQ ID NO: 170819 - DNA, 25 bp, Homo sapien
cttggtgacggaacggtgatcattt

SEQ ID NO: 170820 - DNA, 25 bp, Homo sapien
acgtttacagtgacctgaatgaccc

SEQ ID NO: 170821 - DNA, 25 bp, Homo sapien
cgcgtccggtcagtaacgtggcttt

SEQ ID NO: 170822 - DNA, 25 bp, Homo sapien
ttttctgtcgccaggttcgtgggtc

SEQ ID NO: 170823 - DNA, 25 bp, Homo sapien
ttcgtgggtcgcatcaacgtttaca

SEQ ID NO: 170824 - DNA, 25 bp, Homo sapien
agtgcctctgcggatgccttggcca

SEQ ID NO: 170825 - DNA, 25 bp, Homo sapien
gccaggtgaagacgtgtggctcaca

SEQ ID NO: 170826 - DNA, 25 bp, Homo sapien
tgcattctttgacggacaagggttt

SEQ ID NO: 170827 - DNA, 25 bp, Homo sapien
acctcccttgttgcgttagaaatgc

SEQ ID NO: 170828 - DNA, 25 bp, Homo sapien
gtgtgtacatctcatcctcgcccga

SEQ ID NO: 170829 - DNA, 25 bp, Homo sapien
tttctgagcgcacgtgaagcctctg

SEQ ID NO: 170830 - DNA, 25 bp, Homo sapien
agcctctgtggtttctagaagtgtc

SEQ ID NO: 170831 - DNA, 25 bp, Homo sapien
cggtgctgaacgcacgcccgtttag

SEQ ID NO: 170832 - DNA, 25 bp, Homo sapien
agctgtaattccatcccactgtata

SEQ ID NO: 170833 - DNA, 25 bp, Homo sapien
ctctatcttcagtggacgcaccgtg

SEQ ID NO: 170834 - DNA, 25 bp, Homo sapien
tgtctctgccacaccgtccaggtga

SEQ ID NO: 170835 - DNA, 25 bp, Homo sapien
cgctagcggtcacttgccatttctg

SEQ ID NO: 170836 - DNA, 25 bp, Homo sapien
cagccactcggagttatctgggata

SEQ ID NO: 170837 - DNA, 25 bp, Homo sapien
atctgggataaacgcatcctgggtg

SEQ ID NO: 170838 - DNA, 25 bp, Homo sapien
tgggaagttcctggtccatcccgtc

SEQ ID NO: 170839 - DNA, 25 bp, Homo sapien
tggtccatcccgtcacgtggttttc

SEQ ID NO: 170840 - DNA, 25 bp, Homo sapien
cacggtgcccaagaaggcaagcatc

SEQ ID NO: 170841 - DNA, 25 bp, Homo sapien
aggcgcagtcctgagagtctcagcc

SEQ ID NO: 170842 - DNA, 25 bp, Homo sapien
gcggggctgactcacgtggttttcc

SEQ ID NO: 170843 - DNA, 25 bp, Homo sapien
gacttctgtgtgtcagaacccttcc

SEQ ID NO: 170844 - DNA, 25 bp, Homo sapien
agcacctgcgcccaggcacaaacca

SEQ ID NO: 170845 - DNA, 25 bp, Homo sapien
ctggcagagtgccacgtggcttcgc

SEQ ID NO: 170846 - DNA, 25 bp, Homo sapien
gcacaaaccagccgcctggcagagt

SEQ ID NO: 170847 - DNA, 25 bp, Homo sapien
gcttcgcggaccagggatgcttcag

SEQ ID NO: 170848 - DNA, 25 bp, Homo sapien
cagagtgccacgtggcttcgcggac

SEQ ID NO: 170849 - DNA, 25 bp, Homo sapien
aggcacaaaccagccgcctggcaga

SEQ ID NO: 170850 - DNA, 25 bp, Homo sapien
cttcgcggaccagggatgcttcagg

SEQ ID NO: 170851 - DNA, 25 bp, Homo sapien
agagtgccacgtggcttcgcggacc

SEQ ID NO: 170852 - DNA, 25 bp, Homo sapien
tcctaaagctgggtgacgcatggcc

SEQ ID NO: 170853 - DNA, 25 bp, Homo sapien
tcagacgcgctaaagccgggcaaca

SEQ ID NO: 170854 - DNA, 25 bp, Homo sapien
tcagacaccttaactccgggtgatg

SEQ ID NO: 170855 - DNA, 25 bp, Homo sapien
ctcctgtgagaggtcctaacgccga

SEQ ID NO: 170856 - DNA, 25 bp, Homo sapien
tggacgtgctctctcccgtcagatg

SEQ ID NO: 170857 - DNA, 25 bp, Homo sapien
cgtcagatgtcctaacgccgagtga

SEQ ID NO: 170858 - DNA, 25 bp, Homo sapien
cctcctgtgagatgccctaaagcta

SEQ ID NO: 170859 - DNA, 25 bp, Homo sapien
ccatcagatgccctaacgttgggtg

SEQ ID NO: 170860 - DNA, 25 bp, Homo sapien
ttggctgtgatgagcagacatcctc

SEQ ID NO: 170861 - DNA, 25 bp, Homo sapien
cacaggacacgggtggatcccaaca

SEQ ID NO: 170862 - DNA, 25 bp, Homo sapien
acaccaaggtggtgttcgtgcacca

SEQ ID NO: 170863 - DNA, 25 bp, Homo sapien
gtcagtccactgttacgggagaatg

SEQ ID NO: 170864 - DNA, 25 bp, Homo sapien
ggatgtccatcagccactcgccagg

SEQ ID NO: 170865 - DNA, 25 bp, Homo sapien
accagaacctgtctcgggctgacgg

SEQ ID NO: 170866 - DNA, 25 bp, Homo sapien
accctgctcatctgggagtggtttc

SEQ ID NO: 170867 - DNA, 25 bp, Homo sapien
tcggataccatcatccctgcggatg

SEQ ID NO: 170868 - DNA, 25 bp, Homo sapien
ccgtcgcccggatacactgaactgg

SEQ ID NO: 170869 - DNA, 25 bp, Homo sapien
gcaacgcaggacgtttacggccacc

SEQ ID NO: 170870 - DNA, 25 bp, Homo sapien
cctgaactgcagagatcctaatata

SEQ ID NO: 170871 - DNA, 25 bp, Homo sapien
gcgaggcacgcaagccgcaactaca

SEQ ID NO: 170872 - DNA, 25 bp, Homo sapien
gcctcgattgtctgcagccctgtag

SEQ ID NO: 170873 - DNA, 25 bp, Homo sapien
gaaaccctcgaggagcgaccacatg

SEQ ID NO: 170874 - DNA, 25 bp, Homo sapien
acactgaactggttttgaagcctga

SEQ ID NO: 170875 - DNA, 25 bp, Homo sapien
gcaactacagctcgccagcggggca

SEQ ID NO: 170876 - DNA, 25 bp, Homo sapien
acaagcaggccacaccgtctcgagg

SEQ ID NO: 170877 - DNA, 25 bp, Homo sapien
gtctccaacagggtgaccatccgct

SEQ ID NO: 170878 - DNA, 25 bp, Homo sapien
gggcgaacaagcaggccacaccgtc

SEQ ID NO: 170879 - DNA, 25 bp, Homo sapien
cacaccgtctcgagggaggaggcca

SEQ ID NO: 170880 - DNA, 25 bp, Homo sapien
atccgtgcacgcgtcggagcacggc

SEQ ID NO: 170881 - DNA, 25 bp, Homo sapien
gccagcgtctccaacagggtgacca

SEQ ID NO: 170882 - DNA, 25 bp, Homo sapien
tgaccatccgctcggcttgctgagc

SEQ ID NO: 170883 - DNA, 25 bp, Homo sapien
cttccgccacgagccagctgggaag

SEQ ID NO: 170884 - DNA, 25 bp, Homo sapien
ccaggcaggctgctgttcacgctac

SEQ ID NO: 170885 - DNA, 25 bp, Homo sapien
gctgtggagcagctgccagaagctc

SEQ ID NO: 170886 - DNA, 25 bp, Homo sapien
gcccatcgaagatgccgaggctgtg

SEQ ID NO: 170887 - DNA, 25 bp, Homo sapien
caattcagactctgtgcccatcgaa

SEQ ID NO: 170888 - DNA, 25 bp, Homo sapien
ggcccttgccaattcagactctgtg

SEQ ID NO: 170889 - DNA, 25 bp, Homo sapien
ttctactgaaggccctggcccttgc

SEQ ID NO: 170890 - DNA, 25 bp, Homo sapien
agctgccagaagctccgcacgaggc

SEQ ID NO: 170891 - DNA, 25 bp, Homo sapien
agcgaggggagtacgttctactgaa

SEQ ID NO: 170892 - DNA, 25 bp, Homo sapien
gcttctgccgacgatcccttgggca

SEQ ID NO: 170893 - DNA, 25 bp, Homo sapien
cagcgtcctgcgctgggaacttcga

SEQ ID NO: 170894 - DNA, 25 bp, Homo sapien
ctgcgctgggaacttcgaggcgcct

SEQ ID NO: 170895 - DNA, 25 bp, Homo sapien
gctcgaaatggcagtggaggagacc

SEQ ID NO: 170896 - DNA, 25 bp, Homo sapien
cctggacgggcttctgccgacgatc

SEQ ID NO: 170897 - DNA, 25 bp, Homo sapien
atcccttgggcacctcgtaggacca

SEQ ID NO: 170898 - DNA, 25 bp, Homo sapien
gaggcgtcaggacgcgcggacacct

SEQ ID NO: 170899 - DNA, 25 bp, Homo sapien
gaagcgtcgcggtcgctcccggagc

SEQ ID NO: 170900 - DNA, 25 bp, Homo sapien
ctgctgctgggtaaaggcaccatcc

SEQ ID NO: 170901 - DNA, 25 bp, Homo sapien
ctggcgatttacagtggatgacacg

SEQ ID NO: 170902 - DNA, 25 bp, Homo sapien
tcctatctttagtgcccagtgcctg

SEQ ID NO: 170903 - DNA, 25 bp, Homo sapien
cccagtgcctgggatgagacacact

SEQ ID NO: 170904 - DNA, 25 bp, Homo sapien
gacacactgtgtgaccgccagctca

SEQ ID NO: 170905 - DNA, 25 bp, Homo sapien
tggccgacgtaaagtccacccagtc

SEQ ID NO: 170906 - DNA, 25 bp, Homo sapien
tttgttcgcttggaacctgtgtgcg

SEQ ID NO: 170907 - DNA, 25 bp, Homo sapien
acggacaggtgctccacggcctctg

SEQ ID NO: 170908 - DNA, 25 bp, Homo sapien
ggctttgagagacgggccgctcttc

SEQ ID NO: 170909 - DNA, 25 bp, Homo sapien
ggagcgctcgcagttccctcctgga

SEQ ID NO: 170910 - DNA, 25 bp, Homo sapien
ctccacagacttcaggcggaccgga

SEQ ID NO: 170911 - DNA, 25 bp, Homo sapien
agcattttctggaagcctccacaga

SEQ ID NO: 170912 - DNA, 25 bp, Homo sapien
gggcctctcagaccagcattgagga

SEQ ID NO: 170913 - DNA, 25 bp, Homo sapien
gagactccgcgcctttcaaggagga

SEQ ID NO: 170914 - DNA, 25 bp, Homo sapien
cggagatctgggagcattttctgga

SEQ ID NO: 170915 - DNA, 25 bp, Homo sapien
gccgcaggcgtgaacgcccaacgga

SEQ ID NO: 170916 - DNA, 25 bp, Homo sapien
accttggcggtgacacgaatttcta

SEQ ID NO: 170917 - DNA, 25 bp, Homo sapien
ggtgcactcacaggactcccaggtg

SEQ ID NO: 170918 - DNA, 25 bp, Homo sapien
ctcccaggtgacctcgttggtgagc

SEQ ID NO: 170919 - DNA, 25 bp, Homo sapien
tgcacagtgtggcttggtgccaacc

SEQ ID NO: 170920 - DNA, 25 bp, Homo sapien
cctgtgtgatacactaggtgaccta

SEQ ID NO: 170921 - DNA, 25 bp, Homo sapien
acctcggcggtgacacgaatttcta

SEQ ID NO: 170922 - DNA, 25 bp, Homo sapien
tgcagcttctacacctgccacgggg

SEQ ID NO: 170923 - DNA, 25 bp, Homo sapien
gtgacacaggtgacacttccaggtg

SEQ ID NO: 170924 - DNA, 25 bp, Homo sapien
ctgcggcggctgtggtcactgccca

SEQ ID NO: 170925 - DNA, 25 bp, Homo sapien
tttagctgtcgcagcagagacccga

SEQ ID NO: 170926 - DNA, 25 bp, Homo sapien
cctgtggtccctgcgtgaagaacca

SEQ ID NO: 170927 - DNA, 25 bp, Homo sapien
ctgcgtgaagaaccagagctgcctc

SEQ ID NO: 170928 - DNA, 25 bp, Homo sapien
agctgcctccgctttgtagcagcct

SEQ ID NO: 170929 - DNA, 25 bp, Homo sapien
agcagcctttgtgacagggcggttc

SEQ ID NO: 170930 - DNA, 25 bp, Homo sapien
ttcgatggccgagaagggagcatcc

SEQ ID NO: 170931 - DNA, 25 bp, Homo sapien
acccgaaggctgtggctctagcatc

SEQ ID NO: 170932 - DNA, 25 bp, Homo sapien
tgtaaggaagtgtgcaccgagccct

SEQ ID NO: 170933 - DNA, 25 bp, Homo sapien
gagtgtcatccgctgtgagttctgc

SEQ ID NO: 170934 - DNA, 25 bp, Homo sapien
gtgagttctgcggtgctctggtccc

SEQ ID NO: 170935 - DNA, 25 bp, Homo sapien
ccgtgaagacatcgtccacgacatt

SEQ ID NO: 170936 - DNA, 25 bp, Homo sapien
cccatcctgtaaggaagtgtgcacc

SEQ ID NO: 170937 - DNA, 25 bp, Homo sapien
gagacgcgatgagagtgtcatccgc

SEQ ID NO: 170938 - DNA, 25 bp, Homo sapien
tgcaccgagcccgtggcatctgggt

SEQ ID NO: 170939 - DNA, 25 bp, Homo sapien
ttcacactcactgagccacgtcctg

SEQ ID NO: 170940 - DNA, 25 bp, Homo sapien
tggggcagttcctcatgaatctctg

SEQ ID NO: 170941 - DNA, 25 bp, Homo sapien
catcactatgcaggtgtctcgggca

SEQ ID NO: 170942 - DNA, 25 bp, Homo sapien
gagctgtctcgtttcttcccgctgg

SEQ ID NO: 170943 - DNA, 25 bp, Homo sapien
gcgatgtccttcatcccgggcagta

SEQ ID NO: 170944 - DNA, 25 bp, Homo sapien
aagcggtcccatctacacaggtcgg

SEQ ID NO: 170945 - DNA, 25 bp, Homo sapien
tgtggctcggttttatcgcccaaaa

SEQ ID NO: 170946 - DNA, 25 bp, Homo sapien
ctgcacacggtgtcgcatcctctga

SEQ ID NO: 170947 - DNA, 25 bp, Homo sapien
tgcgtgggatgccaagctgacatca

SEQ ID NO: 170948 - DNA, 25 bp, Homo sapien
catcctttgtgtgcccgggaagggc

SEQ ID NO: 170949 - DNA, 25 bp, Homo sapien
gctcctgactcgcactgggcagcat

SEQ ID NO: 170950 - DNA, 25 bp, Homo sapien
tcctgactcgcactgggcagcatga

SEQ ID NO: 170951 - DNA, 25 bp, Homo sapien
ctgactcgcactgggcagcatgacg

SEQ ID NO: 170952 - DNA, 25 bp, Homo sapien
ctcgcctccccggaaggtgttgtgg

SEQ ID NO: 170953 - DNA, 25 bp, Homo sapien
gccggctgtcactgctgtgccggga

SEQ ID NO: 170954 - DNA, 25 bp, Homo sapien
cagcatgacggtgcgccggctgtca

SEQ ID NO: 170955 - DNA, 25 bp, Homo sapien
ctcgcactgggcagcatgacggtgc

SEQ ID NO: 170956 - DNA, 25 bp, Homo sapien
cccggccctgaccaagccagctggg

SEQ ID NO: 170957 - DNA, 25 bp, Homo sapien
gcacctcttgctccacatctccaga

SEQ ID NO: 170958 - DNA, 25 bp, Homo sapien
ccacgcgcagtgctcttggccggga

SEQ ID NO: 170959 - DNA, 25 bp, Homo sapien
ttgtgagttctttggccagcggcac

SEQ ID NO: 170960 - DNA, 25 bp, Homo sapien
cgttgcgtggtcacagctgaggtct

SEQ ID NO: 170961 - DNA, 25 bp, Homo sapien
ccgccttcctggcagagcgttgcgt

SEQ ID NO: 170962 - DNA, 25 bp, Homo sapien
gagtcgcggagtccgccttcctggc

SEQ ID NO: 170963 - DNA, 25 bp, Homo sapien
gccaagttcagagccacgcgcagtg

SEQ ID NO: 170964 - DNA, 25 bp, Homo sapien
cctgcatcagagaacccaggtcttg

SEQ ID NO: 170965 - DNA, 25 bp, Homo sapien
gggcggctgtgcactgacacctgcc

SEQ ID NO: 170966 - DNA, 25 bp, Homo sapien
ctgtctcactccaaagggcgtccgg

SEQ ID NO: 170967 - DNA, 25 bp, Homo sapien
tgcccgaggcgcaaactgtctcact

SEQ ID NO: 170968 - DNA, 25 bp, Homo sapien
atgtgcgagtcctccctgcccgagg

SEQ ID NO: 170969 - DNA, 25 bp, Homo sapien
ccaagtgcggatgtgcgagtcctcc

SEQ ID NO: 170970 - DNA, 25 bp, Homo sapien
ctcctggcccttgccggttggtgtt

SEQ ID NO: 170971 - DNA, 25 bp, Homo sapien
gtgttgcgcgtctgagatgacgccc

SEQ ID NO: 170972 - DNA, 25 bp, Homo sapien
acggtggacactgcgatgaggacag

SEQ ID NO: 170973 - DNA, 25 bp, Homo sapien
cactgcgatgaggacggtggacact

SEQ ID NO: 170974 - DNA, 25 bp, Homo sapien
tggacactgtgatgcggacggtgga

SEQ ID NO: 170975 - DNA, 25 bp, Homo sapien
acactgcgatgaggacggtggacac

SEQ ID NO: 170976 - DNA, 25 bp, Homo sapien
ggacactgtgatgcggacggtggac

SEQ ID NO: 170977 - DNA, 25 bp, Homo sapien
acaggcagtgtggacggtggacact

SEQ ID NO: 170978 - DNA, 25 bp, Homo sapien
gacaggcagtgtggacggtggacac

SEQ ID NO: 170979 - DNA, 25 bp, Homo sapien
gacggtggacactgcgatgaggaca

SEQ ID NO: 170980 - DNA, 25 bp, Homo sapien
acggccctgcacaactgtgccgaga

SEQ ID NO: 170981 - DNA, 25 bp, Homo sapien
tggagacgaaatggtttctcaggtc

SEQ ID NO: 170982 - DNA, 25 bp, Homo sapien
atctgcatatttaaaagtctctagg

SEQ ID NO: 170983 - DNA, 25 bp, Homo sapien
agtctctaggacaccctaagatggc

SEQ ID NO: 170984 - DNA, 25 bp, Homo sapien
gacagcctgcaaatgttcctttgga

SEQ ID NO: 170985 - DNA, 25 bp, Homo sapien
caactgtgccgagaccagcagcctg

SEQ ID NO: 170986 - DNA, 25 bp, Homo sapien
cataatgtgaaagttgctcaagtgc

SEQ ID NO: 170987 - DNA, 25 bp, Homo sapien
ccatctggtcaagaattcactaaga

SEQ ID NO: 170988 - DNA, 25 bp, Homo sapien
cgggataccacgctgtgcgccaaaa

SEQ ID NO: 170989 - DNA, 25 bp, Homo sapien
cagtcgcttggacccgtttggcgag

SEQ ID NO: 170990 - DNA, 25 bp, Homo sapien
caatgtcaagttccagggcagtcgc

SEQ ID NO: 170991 - DNA, 25 bp, Homo sapien
tgtgcgccaaaaagccgggcggctt

SEQ ID NO: 170992 - DNA, 25 bp, Homo sapien
gaaaggacttctgcgggataccacg

SEQ ID NO: 170993 - DNA, 25 bp, Homo sapien
ttctcacggtggaggaaaggacttc

SEQ ID NO: 170994 - DNA, 25 bp, Homo sapien
taaaggctgctacgcccaggacagg

SEQ ID NO: 170995 - DNA, 25 bp, Homo sapien
gtgagcaccagctcgtctccggtgg

SEQ ID NO: 170996 - DNA, 25 bp, Homo sapien
cacgccctcgtacatgccctctccc

SEQ ID NO: 170997 - DNA, 25 bp, Homo sapien
ttgctcagaggcacgccctcgtaca

SEQ ID NO: 170998 - DNA, 25 bp, Homo sapien
agcgaatttcttccgcggggcttgt

SEQ ID NO: 170999 - DNA, 25 bp, Homo sapien
atgcagcgaatttcttccgcggggc

SEQ ID NO: 171000 - DNA, 25 bp, Homo sapien
tctccatgcagcgaatttcttccgc

SEQ ID NO: 171001 - DNA, 25 bp, Homo sapien
gccctctccatgcagcgaatttctt

SEQ ID NO: 171002 - DNA, 25 bp, Homo sapien
ggccctctccatgcagcgaatttct

SEQ ID NO: 171003 - DNA, 25 bp, Homo sapien
cttcgttacaccacctcacgtcctc

SEQ ID NO: 171004 - DNA, 25 bp, Homo sapien
ggcgactgaaaagttgccacgagtt

SEQ ID NO: 171005 - DNA, 25 bp, Homo sapien
gtcggcgtcactccacacacatagg

SEQ ID NO: 171006 - DNA, 25 bp, Homo sapien
tcctgatcattgtggtaggtgctgc

SEQ ID NO: 171007 - DNA, 25 bp, Homo sapien
tgtcccggcagaacactcttacctt

SEQ ID NO: 171008 - DNA, 25 bp, Homo sapien
gtttccacaatccacctcgtagctg

SEQ ID NO: 171009 - DNA, 25 bp, Homo sapien
gagacgtgcgtgagccacatcccag

SEQ ID NO: 171010 - DNA, 25 bp, Homo sapien
agttgccacgagttcctgatcattg

SEQ ID NO: 171011 - DNA, 25 bp, Homo sapien
actcttacctttaatggcgactgaa

SEQ ID NO: 171012 - DNA, 25 bp, Homo sapien
acccagaagcagaagttccggaagc

SEQ ID NO: 171013 - DNA, 25 bp, Homo sapien
ccacggagccctgtactgaggagac

SEQ ID NO: 171014 - DNA, 25 bp, Homo sapien
ctggatggtaaagccgccctgcctg

SEQ ID NO: 171015 - DNA, 25 bp, Homo sapien
tcactggatggtaaagccgccctgc

SEQ ID NO: 171016 - DNA, 25 bp, Homo sapien
tgggcttggccaagacccagaagca

SEQ ID NO: 171017 - DNA, 25 bp, Homo sapien
cgtcccgggatcactggatggtaaa

SEQ ID NO: 171018 - DNA, 25 bp, Homo sapien
gcagaagttccggaagctggagaca

SEQ ID NO: 171019 - DNA, 25 bp, Homo sapien
agccctgtactgaggagacgcccac

SEQ ID NO: 171020 - DNA, 25 bp, Homo sapien
tgccgacgcccggtgtggactctca

SEQ ID NO: 171021 - DNA, 25 bp, Homo sapien
ggactctcaggtgtccgctgatgca

SEQ ID NO: 171022 - DNA, 25 bp, Homo sapien
tggactctcaggtgtccgctgatgc

SEQ ID NO: 171023 - DNA, 25 bp, Homo sapien
gccgacgcccggtgtggactctcag

SEQ ID NO: 171024 - DNA, 25 bp, Homo sapien
actctcaggtgtccgctgacgcagg

SEQ ID NO: 171025 - DNA, 25 bp, Homo sapien
cgacgcccggtgtggactctcaggt

SEQ ID NO: 171026 - DNA, 25 bp, Homo sapien
tggactctcaggtgtccgctgacgc

SEQ ID NO: 171027 - DNA, 25 bp, Homo sapien
gactctcaggtgtccgctgacgcag

SEQ ID NO: 171028 - DNA, 25 bp, Homo sapien
cccgtgacgtgagtggcccccgtga

SEQ ID NO: 171029 - DNA, 25 bp, Homo sapien
cccgtgacattagtggaccccgtgg

SEQ ID NO: 171030 - DNA, 25 bp, Homo sapien
ccgtgacgtgagtggcccccgtgac

SEQ ID NO: 171031 - DNA, 25 bp, Homo sapien
ccgtgacattagtggaccccgtggc

SEQ ID NO: 171032 - DNA, 25 bp, Homo sapien
gtggcccccgtgacattagtggacc

SEQ ID NO: 171033 - DNA, 25 bp, Homo sapien
ccccgtgatgtgagtggcccccgtg

SEQ ID NO: 171034 - DNA, 25 bp, Homo sapien
ccgtgatgtgagtggcccccgtgac

SEQ ID NO: 171035 - DNA, 25 bp, Homo sapien
ccctgtgacattagtggaccccgtg

SEQ ID NO: 171036 - DNA, 25 bp, Homo sapien
cccgtgtgctcacttgggcctgttc

SEQ ID NO: 171037 - DNA, 25 bp, Homo sapien
cttgggcctgttcgcgggcatttcg

SEQ ID NO: 171038 - DNA, 25 bp, Homo sapien
acttgggcctgttcgcgggcatttc

SEQ ID NO: 171039 - DNA, 25 bp, Homo sapien
cacttgggcctgttcgcgggcattt

SEQ ID NO: 171040 - DNA, 25 bp, Homo sapien
tcacttgggcctgttcgcgggcatt

SEQ ID NO: 171041 - DNA, 25 bp, Homo sapien
cccccgtggcgtgagtgaccccgtg

SEQ ID NO: 171042 - DNA, 25 bp, Homo sapien
cgtgtgctcacttgggcctgttcgc

SEQ ID NO: 171043 - DNA, 25 bp, Homo sapien
ctcacttgggcctgttcgcgggcat

SEQ ID NO: 171044 - DNA, 25 bp, Homo sapien
agccgcatcttttatgcttacctgc

SEQ ID NO: 171045 - DNA, 25 bp, Homo sapien
gcttacctgccgctgatataaacca

SEQ ID NO: 171046 - DNA, 25 bp, Homo sapien
gacaacaccgttacagccgcatctt

SEQ ID NO: 171047 - DNA, 25 bp, Homo sapien
cgactcttagcaacacgtgggtgta

SEQ ID NO: 171048 - DNA, 25 bp, Homo sapien
gcacttgcggtgtcaggacgcacct

SEQ ID NO: 171049 - DNA, 25 bp, Homo sapien
ctttcatgcccgtggggtccaggca

SEQ ID NO: 171050 - DNA, 25 bp, Homo sapien
cacggctcatgcctcactacatgtg

SEQ ID NO: 171051 - DNA, 25 bp, Homo sapien
ccagccatcaggacgactcttagca

SEQ ID NO: 171052 - DNA, 25 bp, Homo sapien
agccgacgtaaactgaggtggacgt

SEQ ID NO: 171053 - DNA, 25 bp, Homo sapien
tcaatagccgacgtaaactgaggtg

SEQ ID NO: 171054 - DNA, 25 bp, Homo sapien
cttgctttactcaatagccgacgta

SEQ ID NO: 171055 - DNA, 25 bp, Homo sapien
gtccgcttgctttactcaatagccg

SEQ ID NO: 171056 - DNA, 25 bp, Homo sapien
tccgcttgctttactcaatagccga

SEQ ID NO: 171057 - DNA, 25 bp, Homo sapien
tagccgacgtaaactgaggtggacg

SEQ ID NO: 171058 - DNA, 25 bp, Homo sapien
caatagccgacgtaaactgaggtgg

SEQ ID NO: 171059 - DNA, 25 bp, Homo sapien
ttgctttactcaatagccgacgtaa

SEQ ID NO: 171060 - DNA, 25 bp, Homo sapien
gaggtggacgtcagtatctgtgtcc

SEQ ID NO: 171061 - DNA, 25 bp, Homo sapien
tggacgtcagtgtccgcgtccgctt

SEQ ID NO: 171062 - DNA, 25 bp, Homo sapien
atctgtgtccgcttgctttactcaa

SEQ ID NO: 171063 - DNA, 25 bp, Homo sapien
tcagtatctgtgtccgcttgcttta

SEQ ID NO: 171064 - DNA, 25 bp, Homo sapien
tctcaatagccaatgtaaactgagg

SEQ ID NO: 171065 - DNA, 25 bp, Homo sapien
cgcttgcttttctcaatagccaatg

SEQ ID NO: 171066 - DNA, 25 bp, Homo sapien
aatgaaggtggacgttggtatccgc

SEQ ID NO: 171067 - DNA, 25 bp, Homo sapien
ggacgttggtatccgcgtccgcttg

SEQ ID NO: 171068 - DNA, 25 bp, Homo sapien
tgagcccatcggctgaaaacagatg

SEQ ID NO: 171069 - DNA, 25 bp, Homo sapien
tggcactgttggtagccccaggcaa

SEQ ID NO: 171070 - DNA, 25 bp, Homo sapien
tcggctgaaaacagatggcgactta

SEQ ID NO: 171071 - DNA, 25 bp, Homo sapien
acagatggcgacttagcgaacctga

SEQ ID NO: 171072 - DNA, 25 bp, Homo sapien
cgacttagcgaacctgagctgggcc

SEQ ID NO: 171073 - DNA, 25 bp, Homo sapien
tgcaagccagtgctgctcgagaaga

SEQ ID NO: 171074 - DNA, 25 bp, Homo sapien
gctgctcgagaagacgaaccgcctg

SEQ ID NO: 171075 - DNA, 25 bp, Homo sapien
cgagaagacgaaccgcctgggccct

SEQ ID NO: 171076 - DNA, 25 bp, Homo sapien
caaccgccgattacaggggaggagc

SEQ ID NO: 171077 - DNA, 25 bp, Homo sapien
atttaaacgactgtccttcatccga

SEQ ID NO: 171078 - DNA, 25 bp, Homo sapien
ggcctgggcctttctgtctctgaag

SEQ ID NO: 171079 - DNA, 25 bp, Homo sapien
ttctgtctctgaagcccgagctctc

SEQ ID NO: 171080 - DNA, 25 bp, Homo sapien
cggtgccggtcatgcagaatattgc

SEQ ID NO: 171081 - DNA, 25 bp, Homo sapien
gaggcagcccgtgaggcttccacga

SEQ ID NO: 171082 - DNA, 25 bp, Homo sapien
ccgtgaggcttccacgacgctgaga

SEQ ID NO: 171083 - DNA, 25 bp, Homo sapien
acgctgagagcgtctatttaaacga

SEQ ID NO: 171084 - DNA, 25 bp, Homo sapien
tcgaaatcctcgaggagctgacttc

SEQ ID NO: 171085 - DNA, 25 bp, Homo sapien
tgacttcagggccacacggtcaaca

SEQ ID NO: 171086 - DNA, 25 bp, Homo sapien
agagcacgctgcaggcccttgtctc

SEQ ID NO: 171087 - DNA, 25 bp, Homo sapien
ggcaaacctgcagctcgtcctcgtg

SEQ ID NO: 171088 - DNA, 25 bp, Homo sapien
ggactctctccgacatcgctttcaa

SEQ ID NO: 171089 - DNA, 25 bp, Homo sapien
ttaagatgaaggtgccggtaagtgc

SEQ ID NO: 171090 - DNA, 25 bp, Homo sapien
ggcccatctgtgatcatcgaaatcc

SEQ ID NO: 171091 - DNA, 25 bp, Homo sapien
ctgcggtagcagaacggaactcatt

SEQ ID NO: 171092 - DNA, 25 bp, Homo sapien
tgacgctgatccgtgcacacgcctg

SEQ ID NO: 171093 - DNA, 25 bp, Homo sapien
cctgccctggcctgtgtcaggcacc

SEQ ID NO: 171094 - DNA, 25 bp, Homo sapien
aaagtgacgctgatccgtgcacacg

SEQ ID NO: 171095 - DNA, 25 bp, Homo sapien
catctgtaaagtgacgctgatccgt

SEQ ID NO: 171096 - DNA, 25 bp, Homo sapien
aggcaccttgtcagcttcccaaaga

SEQ ID NO: 171097 - DNA, 25 bp, Homo sapien
tgtcagcttcccaaagactcagttt

SEQ ID NO: 171098 - DNA, 25 bp, Homo sapien
ctgatccgtgcacacgcctggcagg

SEQ ID NO: 171099 - DNA, 25 bp, Homo sapien
gatccgtgcacacgcctggcagggt

SEQ ID NO: 171100 - DNA, 25 bp, Homo sapien
gcgagcagctcattgggaacaagca

SEQ ID NO: 171101 - DNA, 25 bp, Homo sapien
cattgggaacaagcactacgcggta

SEQ ID NO: 171102 - DNA, 25 bp, Homo sapien
agcactacgcggtagactccatccg

SEQ ID NO: 171103 - DNA, 25 bp, Homo sapien
ggtagactccatccgcccaaagtgc

SEQ ID NO: 171104 - DNA, 25 bp, Homo sapien
cggcacctctgtgaccagttctctg

SEQ ID NO: 171105 - DNA, 25 bp, Homo sapien
ctgtgaccagttctctgcggagatc

SEQ ID NO: 171106 - DNA, 25 bp, Homo sapien
ttctctgcggagatcgcaaggagga

SEQ ID NO: 171107 - DNA, 25 bp, Homo sapien
ctctggacggcgagcagctcattgg

SEQ ID NO: 171108 - DNA, 25 bp, Homo sapien
agctgagccgttgcatcgccttcca

SEQ ID NO: 171109 - DNA, 25 bp, Homo sapien
tctgagagttctgtgccaccaggcc

SEQ ID NO: 171110 - DNA, 25 bp, Homo sapien
cgcctgctgttctgagagttctgtg

SEQ ID NO: 171111 - DNA, 25 bp, Homo sapien
tatcacagcctgtgcgagcggcagc

SEQ ID NO: 171112 - DNA, 25 bp, Homo sapien
tgcggctcagtctcgaacgtgacta

SEQ ID NO: 171113 - DNA, 25 bp, Homo sapien
aatggcggcagatgctccagttccc

SEQ ID NO: 171114 - DNA, 25 bp, Homo sapien
cttccaggatgggatggccgagtat

SEQ ID NO: 171115 - DNA, 25 bp, Homo sapien
cccacatcagccagtgcgaagagct

SEQ ID NO: 171116 - DNA, 25 bp, Homo sapien
cgttctgcgcctgactgtgtatttt

SEQ ID NO: 171117 - DNA, 25 bp, Homo sapien
tttagtgatgacaccaacatgtgca

SEQ ID NO: 171118 - DNA, 25 bp, Homo sapien
tgtgcaaggcaccttactgagcatg

SEQ ID NO: 171119 - DNA, 25 bp, Homo sapien
actgagcatgcggtttcaggagcac

SEQ ID NO: 171120 - DNA, 25 bp, Homo sapien
tcaggagcacgtgcgaaaggtcttc

SEQ ID NO: 171121 - DNA, 25 bp, Homo sapien
gcaagcatggaggaggtgttccacc

SEQ ID NO: 171122 - DNA, 25 bp, Homo sapien
agacccgaggcactggcaaagtcgc

SEQ ID NO: 171123 - DNA, 25 bp, Homo sapien
cccgcatggagaacatttaaagcgg

SEQ ID NO: 171124 - DNA, 25 bp, Homo sapien
tttacctatgttcagagcaaccgca

SEQ ID NO: 171125 - DNA, 25 bp, Homo sapien
aggccatttgcacgccagggtcctc

SEQ ID NO: 171126 - DNA, 25 bp, Homo sapien
tttcccgtagcttccgctccaggtg

SEQ ID NO: 171127 - DNA, 25 bp, Homo sapien
cgctccaggtgcatttttacctatg

SEQ ID NO: 171128 - DNA, 25 bp, Homo sapien
aggtgcctcggcgttgaagtaaaga

SEQ ID NO: 171129 - DNA, 25 bp, Homo sapien
caccaggtgagaatggacacgctgc

SEQ ID NO: 171130 - DNA, 25 bp, Homo sapien
acgctcgttcacgtggtttgtctgc

SEQ ID NO: 171131 - DNA, 25 bp, Homo sapien
agcagtcccgagcaggccatttgca

SEQ ID NO: 171132 - DNA, 25 bp, Homo sapien
agcggcatgaagtaaagagcgaccc

SEQ ID NO: 171133 - DNA, 25 bp, Homo sapien
cagaagctcctttttcatcggtgga

SEQ ID NO: 171134 - DNA, 25 bp, Homo sapien
actctctctccggttgtatttctgc

SEQ ID NO: 171135 - DNA, 25 bp, Homo sapien
gtcctgacaaaaaagccaagcggca

SEQ ID NO: 171136 - DNA, 25 bp, Homo sapien
atgctctcgtgggtctttatgctgc

SEQ ID NO: 171137 - DNA, 25 bp, Homo sapien
ccgactccctttggtgtgcgaggta

SEQ ID NO: 171138 - DNA, 25 bp, Homo sapien
cggcacccactctgcgttggcagga

SEQ ID NO: 171139 - DNA, 25 bp, Homo sapien
ccctgtgttttgctcacagaagctc

SEQ ID NO: 171140 - DNA, 25 bp, Homo sapien
gcagaggcaggttccacggaagacc

SEQ ID NO: 171141 - DNA, 25 bp, Homo sapien
gtgctgagcaactcgtccagctgca

SEQ ID NO: 171142 - DNA, 25 bp, Homo sapien
tgagcagctcaggtaaggcccacgt

SEQ ID NO: 171143 - DNA, 25 bp, Homo sapien
tcagggacccgaccactggcaagga

SEQ ID NO: 171144 - DNA, 25 bp, Homo sapien
gcgacgagggcctctggtaagaccc

SEQ ID NO: 171145 - DNA, 25 bp, Homo sapien
aaatacacggtcgtggcggaccacg

SEQ ID NO: 171146 - DNA, 25 bp, Homo sapien
tctcccaccaggttccaggtaaata

SEQ ID NO: 171147 - DNA, 25 bp, Homo sapien
cggagactccagagcccacagagga

SEQ ID NO: 171148 - DNA, 25 bp, Homo sapien
tgggtatcccagaagtgtgagtgtc

SEQ ID NO: 171149 - DNA, 25 bp, Homo sapien
gtaaccaatttaggccgctcctgca

SEQ ID NO: 171150 - DNA, 25 bp, Homo sapien
ggcgtcgacgtgtgaaactgatttt

SEQ ID NO: 171151 - DNA, 25 bp, Homo sapien
accagaccagttctctaggggcgtc

SEQ ID NO: 171152 - DNA, 25 bp, Homo sapien
tccttgagcccgattctttggtgtc

SEQ ID NO: 171153 - DNA, 25 bp, Homo sapien
ttccgcgctcagtaaccaatttagg

SEQ ID NO: 171154 - DNA, 25 bp, Homo sapien
agggcacctcctgtgaggactcgga

SEQ ID NO: 171155 - DNA, 25 bp, Homo sapien
agtccgtgagttcccacctccttga

SEQ ID NO: 171156 - DNA, 25 bp, Homo sapien
aggttgcccgcggtgatctcaccta

SEQ ID NO: 171157 - DNA, 25 bp, Homo sapien
tgaagtgctcctgcgtgatgttggt

SEQ ID NO: 171158 - DNA, 25 bp, Homo sapien
cccgggagctccatgtggctgaagt

SEQ ID NO: 171159 - DNA, 25 bp, Homo sapien
aggcctcgccgtgattgtcgatgaa

SEQ ID NO: 171160 - DNA, 25 bp, Homo sapien
gatctcacctaccagtgtggcccag

SEQ ID NO: 171161 - DNA, 25 bp, Homo sapien
tggcccagcccagcgactgcataag

SEQ ID NO: 171162 - DNA, 25 bp, Homo sapien
gcgactgcataaggaaggcgaactc

SEQ ID NO: 171163 - DNA, 25 bp, Homo sapien
agcacgatggcatcgggcaccactc

SEQ ID NO: 171164 - DNA, 25 bp, Homo sapien
ctgtttcgacaaaatcaagaactgg

SEQ ID NO: 171165 - DNA, 25 bp, Homo sapien
cgcggcccactgtttcgacaaaatc

SEQ ID NO: 171166 - DNA, 25 bp, Homo sapien
actggaggaacctgatcgcggtgct

SEQ ID NO: 171167 - DNA, 25 bp, Homo sapien
caaaatcaagaactggaggaacctg

SEQ ID NO: 171168 - DNA, 25 bp, Homo sapien
tttcgacaaaatcaagaactggagg

SEQ ID NO: 171169 - DNA, 25 bp, Homo sapien
tcaagaactggaggaacctgatcgc

SEQ ID NO: 171170 - DNA, 25 bp, Homo sapien
gcccactgtttcgacaaaatcaaga

SEQ ID NO: 171171 - DNA, 25 bp, Homo sapien
gcggcccactgtttcgacaaaatca

SEQ ID NO: 171172 - DNA, 25 bp, Homo sapien
cgtggtcctcactgaccatgtggtg

SEQ ID NO: 171173 - DNA, 25 bp, Homo sapien
gagcacgacctcagcgagcacgacg

SEQ ID NO: 171174 - DNA, 25 bp, Homo sapien
acctcagcgagcacgacggggatga

SEQ ID NO: 171175 - DNA, 25 bp, Homo sapien
tgcctgcccgaacggacgttctctg

SEQ ID NO: 171176 - DNA, 25 bp, Homo sapien
acgttctctgagaggacgctggcct

SEQ ID NO: 171177 - DNA, 25 bp, Homo sapien
acgctggccttcgtgcgcttctcat

SEQ ID NO: 171178 - DNA, 25 bp, Homo sapien
ccttcgtgcgcttctcattggtcag

SEQ ID NO: 171179 - DNA, 25 bp, Homo sapien
ggccctggagctcatggtcctcaac

SEQ ID NO: 171180 - DNA, 25 bp, Homo sapien
gagcaatgccaccaggccgcgattg

SEQ ID NO: 171181 - DNA, 25 bp, Homo sapien
ccgcgaggtctttgaggacagcgac

SEQ ID NO: 171182 - DNA, 25 bp, Homo sapien
gcgcccaagtcccttgagggtcaca

SEQ ID NO: 171183 - DNA, 25 bp, Homo sapien
cagggcttctgccagagttaagttc

SEQ ID NO: 171184 - DNA, 25 bp, Homo sapien
cttcgaacgaacctggaaatggccg

SEQ ID NO: 171185 - DNA, 25 bp, Homo sapien
aatagtcatggtctcggccagcgcc

SEQ ID NO: 171186 - DNA, 25 bp, Homo sapien
cgtagtcgctgagagccacagccta

SEQ ID NO: 171187 - DNA, 25 bp, Homo sapien
ctgcacagcagaagcactagcactg

SEQ ID NO: 171188 - DNA, 25 bp, Homo sapien
cgtccattgttcacaggcggtcacc

SEQ ID NO: 171189 - DNA, 25 bp, Homo sapien
tctgtccatccgtcaagctttcttg

SEQ ID NO: 171190 - DNA, 25 bp, Homo sapien
cttgacttcttggtgcattttcagg

SEQ ID NO: 171191 - DNA, 25 bp, Homo sapien
ggtgcattttcaggcaaaccgcaga

SEQ ID NO: 171192 - DNA, 25 bp, Homo sapien
tgcctgggttgctgcctggcgtcca

SEQ ID NO: 171193 - DNA, 25 bp, Homo sapien
ggcccgtttgtctctgtccatccgt

SEQ ID NO: 171194 - DNA, 25 bp, Homo sapien
tcacctgaggggaggccaacgctcg

SEQ ID NO: 171195 - DNA, 25 bp, Homo sapien
ttttcaggcaaaccgcagacgccaa

SEQ ID NO: 171196 - DNA, 25 bp, Homo sapien
gtggtcatcaagcacaaccggttca

SEQ ID NO: 171197 - DNA, 25 bp, Homo sapien
accggttcacaaaggagacctatga

SEQ ID NO: 171198 - DNA, 25 bp, Homo sapien
aggagacctatgacttcgacatcgc

SEQ ID NO: 171199 - DNA, 25 bp, Homo sapien
tgacttcgacatcgccgtgctccgg

SEQ ID NO: 171200 - DNA, 25 bp, Homo sapien
atcaccttccgcatgaacgtggcgc

SEQ ID NO: 171201 - DNA, 25 bp, Homo sapien
ttccgcatgaacgtggcgcctgcct

SEQ ID NO: 171202 - DNA, 25 bp, Homo sapien
ccgagcgtgactgggccgagtccac

SEQ ID NO: 171203 - DNA, 25 bp, Homo sapien
ttcgggcgcacccacgagaagggcc

SEQ ID NO: 171204 - DNA, 25 bp, Homo sapien
gaagcgcaggccgtcttctacgtcc

SEQ ID NO: 171205 - DNA, 25 bp, Homo sapien
atttccacatctgccacatgggccg

SEQ ID NO: 171206 - DNA, 25 bp, Homo sapien
ttctacgtcccgagatctgcttgcg

SEQ ID NO: 171207 - DNA, 25 bp, Homo sapien
atcttgctggatgaccacggccaca

SEQ ID NO: 171208 - DNA, 25 bp, Homo sapien
ccatcaaaggccgtgtgggcaccgt

SEQ ID NO: 171209 - DNA, 25 bp, Homo sapien
gcaccgtgagctacatggctccaga

SEQ ID NO: 171210 - DNA, 25 bp, Homo sapien
tttcagctctgactgttgggcgcta

SEQ ID NO: 171211 - DNA, 25 bp, Homo sapien
cgcaggagatgattgcaggccagtc

SEQ ID NO: 171212 - DNA, 25 bp, Homo sapien
ggttcacggtcgcagtttgtcctta

SEQ ID NO: 171213 - DNA, 25 bp, Homo sapien
tagggaggacctacctggctgtgcc

SEQ ID NO: 171214 - DNA, 25 bp, Homo sapien
gacgagtccgcagacagcgttcaga

SEQ ID NO: 171215 - DNA, 25 bp, Homo sapien
acctgtggtgcttagggaggaccta

SEQ ID NO: 171216 - DNA, 25 bp, Homo sapien
tctccgctgggttccgacaggcctt

SEQ ID NO: 171217 - DNA, 25 bp, Homo sapien
cagtttgtccttacaaaacgcccag

SEQ ID NO: 171218 - DNA, 25 bp, Homo sapien
caccggcatggctggaggccagtac

SEQ ID NO: 171219 - DNA, 25 bp, Homo sapien
cttgggtcgtccatcctgacaggac

SEQ ID NO: 171220 - DNA, 25 bp, Homo sapien
gcgcgttcctaagccctcaggagta

SEQ ID NO: 171221 - DNA, 25 bp, Homo sapien
tcaagcgggccagctggcgtcactt

SEQ ID NO: 171222 - DNA, 25 bp, Homo sapien
tttcactgcgctgacccttcgtctg

SEQ ID NO: 171223 - DNA, 25 bp, Homo sapien
ttgtgaaaaccaggccgcggaggac

SEQ ID NO: 171224 - DNA, 25 bp, Homo sapien
cgcgctcccgagctctcataaggtg

SEQ ID NO: 171225 - DNA, 25 bp, Homo sapien
ctcccgagcctgcaggagttagggc

SEQ ID NO: 171226 - DNA, 25 bp, Homo sapien
tgagccctcgaggtggtctcacgcc

SEQ ID NO: 171227 - DNA, 25 bp, Homo sapien
acgccagcggctctgattgtgtgtt

SEQ ID NO: 171228 - DNA, 25 bp, Homo sapien
ctatggaggtctcgtctgtgtggct

SEQ ID NO: 171229 - DNA, 25 bp, Homo sapien
gctgtgtgactatggaggtctcgtc

SEQ ID NO: 171230 - DNA, 25 bp, Homo sapien
gtgactatggaggtcgcgtcccatg

SEQ ID NO: 171231 - DNA, 25 bp, Homo sapien
tatggaggtcgcgtcccatgtggct

SEQ ID NO: 171232 - DNA, 25 bp, Homo sapien
ctgtgtgactatggaggtcgcgtcc

SEQ ID NO: 171233 - DNA, 25 bp, Homo sapien
cgctgtgtgactatggaggtctcgt

SEQ ID NO: 171234 - DNA, 25 bp, Homo sapien
gtcgctgtgtgactatggaggtctc

SEQ ID NO: 171235 - DNA, 25 bp, Homo sapien
tgtgactatggaggtctcgtctgtg

SEQ ID NO: 171236 - DNA, 25 bp, Homo sapien
cctcgcttatacgtgcccttgctga

SEQ ID NO: 171237 - DNA, 25 bp, Homo sapien
gcagatgtcgggtctgcctcgctta

SEQ ID NO: 171238 - DNA, 25 bp, Homo sapien
gcctcgcttatacgtgcccttgctg

SEQ ID NO: 171239 - DNA, 25 bp, Homo sapien
gtcggatctgcctcgcttatacgtg

SEQ ID NO: 171240 - DNA, 25 bp, Homo sapien
tctgcctcgcttatacgtgcccttg

SEQ ID NO: 171241 - DNA, 25 bp, Homo sapien
agatgtcggatctgcctcgcttata

SEQ ID NO: 171242 - DNA, 25 bp, Homo sapien
gcctcacttatacgtgcccttgctg

SEQ ID NO: 171243 - DNA, 25 bp, Homo sapien
tcgggtctgcctcacttatacgtgc

SEQ ID NO: 171244 - DNA, 25 bp, Homo sapien
ggtgcaatgatccagctgtcccagc

SEQ ID NO: 171245 - DNA, 25 bp, Homo sapien
aagcagccgcccttacactcgtagg

SEQ ID NO: 171246 - DNA, 25 bp, Homo sapien
gatagcgtgtttcgtcggcgtcaca

SEQ ID NO: 171247 - DNA, 25 bp, Homo sapien
gcgtcacatcgtcagccaaggggaa

SEQ ID NO: 171248 - DNA, 25 bp, Homo sapien
ttacccgcagggaggtcttttgaca

SEQ ID NO: 171249 - DNA, 25 bp, Homo sapien
ggcgctccttttccgcctggctaaa

SEQ ID NO: 171250 - DNA, 25 bp, Homo sapien
ccgatgtcctcgaagtttacccgca

SEQ ID NO: 171251 - DNA, 25 bp, Homo sapien
gtaggcttcatactccttgggtgca

SEQ ID NO: 171252 - DNA, 25 bp, Homo sapien
tcttgcgtctggtaacgccgctgtc

SEQ ID NO: 171253 - DNA, 25 bp, Homo sapien
cctgtccataaagagcccgcgtttg

SEQ ID NO: 171254 - DNA, 25 bp, Homo sapien
agctcacgtgacaagcgctgccggc

SEQ ID NO: 171255 - DNA, 25 bp, Homo sapien
gtgtcttcttcgtgccggcgtcgca

SEQ ID NO: 171256 - DNA, 25 bp, Homo sapien
cgagacccgcgggatcacgtgacgc

SEQ ID NO: 171257 - DNA, 25 bp, Homo sapien
tcacgtgtcggcctgcatcacgcgt

SEQ ID NO: 171258 - DNA, 25 bp, Homo sapien
tcacgtgggtccagggtcacgtgcc

SEQ ID NO: 171259 - DNA, 25 bp, Homo sapien
cgtttgggacgcctcgcaggctgaa

SEQ ID NO: 171260 - DNA, 25 bp, Homo sapien
aggcgttttcagtcaatatattcaa

SEQ ID NO: 171261 - DNA, 25 bp, Homo sapien
atatattcaaagtgtgggtccaggc

SEQ ID NO: 171262 - DNA, 25 bp, Homo sapien
cagtttggctctggtgagtgtcacc

SEQ ID NO: 171263 - DNA, 25 bp, Homo sapien
acgtgcttcagactccgcctgtgga

SEQ ID NO: 171264 - DNA, 25 bp, Homo sapien
cgcctgtggacgtttagtcgcttcc

SEQ ID NO: 171265 - DNA, 25 bp, Homo sapien
aattcctacaagtgcaacgcggagg

SEQ ID NO: 171266 - DNA, 25 bp, Homo sapien
tgcaggccacagtcggcaattccta

SEQ ID NO: 171267 - DNA, 25 bp, Homo sapien
cacgtccgtgtcacgaaggcgtttt

SEQ ID NO: 171268 - DNA, 25 bp, Homo sapien
cagcagccgggaccatttgatcgcc

SEQ ID NO: 171269 - DNA, 25 bp, Homo sapien
gccggcccatctcaaagcgggaaaa

SEQ ID NO: 171270 - DNA, 25 bp, Homo sapien
ggaccatttgatcgccctgcgggtg

SEQ ID NO: 171271 - DNA, 25 bp, Homo sapien
tggagaaaaacttctcgtaggcggc

SEQ ID NO: 171272 - DNA, 25 bp, Homo sapien
gcgtcgtcgaagtcctcaggccgct

SEQ ID NO: 171273 - DNA, 25 bp, Homo sapien
tcaggccgctcgaatccgtacgggt

SEQ ID NO: 171274 - DNA, 25 bp, Homo sapien
tccgtacgggtcgatcctgcaaaac

SEQ ID NO: 171275 - DNA, 25 bp, Homo sapien
tcctgcaaaaccgagagaaggaggc

SEQ ID NO: 171276 - DNA, 25 bp, Homo sapien
tcccatgggtgtttccggaatgttc

SEQ ID NO: 171277 - DNA, 25 bp, Homo sapien
ggactccagacgcactttcctgtga

SEQ ID NO: 171278 - DNA, 25 bp, Homo sapien
tcggtccgcatccaatgacattgtc

SEQ ID NO: 171279 - DNA, 25 bp, Homo sapien
tttcagctgcttttcgtgtccggga

SEQ ID NO: 171280 - DNA, 25 bp, Homo sapien
ttgaattttgctctggcgacgtggc

SEQ ID NO: 171281 - DNA, 25 bp, Homo sapien
ccgctgcatttcaaggccgagacca

SEQ ID NO: 171282 - DNA, 25 bp, Homo sapien
cggaatgttccatgcgagcgccacc

SEQ ID NO: 171283 - DNA, 25 bp, Homo sapien
agctctggttccgaacggcttcttc

SEQ ID NO: 171284 - DNA, 25 bp, Homo sapien
cagagcgtgcggacctgatcttgct

SEQ ID NO: 171285 - DNA, 25 bp, Homo sapien
cggaggacacgtgactcctggctgt

SEQ ID NO: 171286 - DNA, 25 bp, Homo sapien
ccctctgtccgtgggagtgacggag

SEQ ID NO: 171287 - DNA, 25 bp, Homo sapien
gagctcagccgcaccgtcgctaggc

SEQ ID NO: 171288 - DNA, 25 bp, Homo sapien
cccagacgtcgagtgggcctgggca

SEQ ID NO: 171289 - DNA, 25 bp, Homo sapien
tgatgagcggctgtccaggagaagc

SEQ ID NO: 171290 - DNA, 25 bp, Homo sapien
tctgggccgtccctttgcgcctccc

SEQ ID NO: 171291 - DNA, 25 bp, Homo sapien
tgcggacctgatcttgctgggacga

SEQ ID NO: 171292 - DNA, 25 bp, Homo sapien
cctggcggactcaggcaggaggcgt

SEQ ID NO: 171293 - DNA, 25 bp, Homo sapien
ccagtgactcgtgcggtccccaaag

SEQ ID NO: 171294 - DNA, 25 bp, Homo sapien
ggcgacaacccctcccagagacctg

SEQ ID NO: 171295 - DNA, 25 bp, Homo sapien
cagcccgaggcctgtccctgcaggt

SEQ ID NO: 171296 - DNA, 25 bp, Homo sapien
gaggtccccgcacgtacgcctgtgt

SEQ ID NO: 171297 - DNA, 25 bp, Homo sapien
cggggcttcctcttgcagcagccgc

SEQ ID NO: 171298 - DNA, 25 bp, Homo sapien
gcgtccggatgtggcagcagctcgc

SEQ ID NO: 171299 - DNA, 25 bp, Homo sapien
tgactcgtgcggtccccaaaggaga

SEQ ID NO: 171300 - DNA, 25 bp, Homo sapien
ggctactccgcccaattacgagaac

SEQ ID NO: 171301 - DNA, 25 bp, Homo sapien
caacagcagcggagccgagaatggc

SEQ ID NO: 171302 - DNA, 25 bp, Homo sapien
ccacaggcgcgcaggcaacagcagc

SEQ ID NO: 171303 - DNA, 25 bp, Homo sapien
tctgcccaggatcccggcagtgagg

SEQ ID NO: 171304 - DNA, 25 bp, Homo sapien
tatcacgtgggaggtctgcccagga

SEQ ID NO: 171305 - DNA, 25 bp, Homo sapien
acggttatcacgtgggaggtctgcc

SEQ ID NO: 171306 - DNA, 25 bp, Homo sapien
ctccgcccaattacgagaacacgtg

SEQ ID NO: 171307 - DNA, 25 bp, Homo sapien
cccaattacgagaacacgtgagcac

SEQ ID NO: 171308 - DNA, 25 bp, Homo sapien
ctgccgggatggaccttccctggaa

SEQ ID NO: 171309 - DNA, 25 bp, Homo sapien
gcctccttggcgctgcagagccaaa

SEQ ID NO: 171310 - DNA, 25 bp, Homo sapien
tcgcagcaggcaccaaagcgccttt

SEQ ID NO: 171311 - DNA, 25 bp, Homo sapien
gctgcatcggttcacgctgaaaatc

SEQ ID NO: 171312 - DNA, 25 bp, Homo sapien
ctctcagggccgacactggaaaaca

SEQ ID NO: 171313 - DNA, 25 bp, Homo sapien
ctgtttcaggaaaccgctcagtagc

SEQ ID NO: 171314 - DNA, 25 bp, Homo sapien
ggcagaagatgccaagacaccttca

SEQ ID NO: 171315 - DNA, 25 bp, Homo sapien
agtcagaaaacaggtgctcgcagca

SEQ ID NO: 171316 - DNA, 25 bp, Homo sapien
gcagaagacccgtgggtggcgaaca

SEQ ID NO: 171317 - DNA, 25 bp, Homo sapien
acagcccccgtggaggctcggttca

SEQ ID NO: 171318 - DNA, 25 bp, Homo sapien
aacagtgccccggaggctcagttca

SEQ ID NO: 171319 - DNA, 25 bp, Homo sapien
cccggaggctcagttcacccaccgc

SEQ ID NO: 171320 - DNA, 25 bp, Homo sapien
ccggaggctcagttcacccaccgcc

SEQ ID NO: 171321 - DNA, 25 bp, Homo sapien
gaagacccgtgggtggcgaacagcc

SEQ ID NO: 171322 - DNA, 25 bp, Homo sapien
cgaacagcccccgtggaggctcggt

SEQ ID NO: 171323 - DNA, 25 bp, Homo sapien
gcgggctggcagaagacccgtgggt

SEQ ID NO: 171324 - DNA, 25 bp, Homo sapien
tcggttcacccaccgccaacagcgc

SEQ ID NO: 171325 - DNA, 25 bp, Homo sapien
gcagagctcggttcacccaccgcca

SEQ ID NO: 171326 - DNA, 25 bp, Homo sapien
gctcggttcacccaccgccaacagc

SEQ ID NO: 171327 - DNA, 25 bp, Homo sapien
gagctcggttcacccaccgccaaca

SEQ ID NO: 171328 - DNA, 25 bp, Homo sapien
ctcggttcacccaccgccaacagcg

SEQ ID NO: 171329 - DNA, 25 bp, Homo sapien
cagagctcggttcacccaccgccaa

SEQ ID NO: 171330 - DNA, 25 bp, Homo sapien
cggttcacccaccgccaacagcgcc

SEQ ID NO: 171331 - DNA, 25 bp, Homo sapien
agagctcggttcacccaccgccaac

SEQ ID NO: 171332 - DNA, 25 bp, Homo sapien
cggggcgagaccgggcctccctcag

SEQ ID NO: 171333 - DNA, 25 bp, Homo sapien
gcggagtctgggctgccctgtgtga

SEQ ID NO: 171334 - DNA, 25 bp, Homo sapien
ggcggagtctgggctgccctgtgtg

SEQ ID NO: 171335 - DNA, 25 bp, Homo sapien
tgaaaaggcccccggtcagagctgc

SEQ ID NO: 171336 - DNA, 25 bp, Homo sapien
ctgaaaaggcccccggtcagagctg

SEQ ID NO: 171337 - DNA, 25 bp, Homo sapien
cctgaaaaggcccccggtcagagct

SEQ ID NO: 171338 - DNA, 25 bp, Homo sapien
tcctgaaaaggcccccggtcagagc

SEQ ID NO: 171339 - DNA, 25 bp, Homo sapien
ctcctgaaaaggcccccggtcagag

SEQ ID NO: 171340 - DNA, 25 bp, Homo sapien
acttgctgtgaaggtgggcctctcg

SEQ ID NO: 171341 - DNA, 25 bp, Homo sapien
gcgccctgtgatcggggccttcact

SEQ ID NO: 171342 - DNA, 25 bp, Homo sapien
tgtgatcggggccttcacttgctgt

SEQ ID NO: 171343 - DNA, 25 bp, Homo sapien
ttcacttgctgtgaaggtgggcctc

SEQ ID NO: 171344 - DNA, 25 bp, Homo sapien
ctgctgagtgaacgcgtcctcatgc

SEQ ID NO: 171345 - DNA, 25 bp, Homo sapien
tcatgcgctggagccagtgctgccc

SEQ ID NO: 171346 - DNA, 25 bp, Homo sapien
cgtgtctcccgaggcgccctgtgat

SEQ ID NO: 171347 - DNA, 25 bp, Homo sapien
tgaacgcgtcctcatgcgctggagc

SEQ ID NO: 171348 - DNA, 25 bp, Homo sapien
gccgatgtctgcgaagtccaccttc

SEQ ID NO: 171349 - DNA, 25 bp, Homo sapien
gggctttctgcatcgtcttctcgtc

SEQ ID NO: 171350 - DNA, 25 bp, Homo sapien
cttgcatagcacctcgagcgctcga

SEQ ID NO: 171351 - DNA, 25 bp, Homo sapien
ggtcgtatctctgcagcgtcactgc

SEQ ID NO: 171352 - DNA, 25 bp, Homo sapien
ccgagatggccagatcgttggcata

SEQ ID NO: 171353 - DNA, 25 bp, Homo sapien
tctcctcagaatccagctgggcgga

SEQ ID NO: 171354 - DNA, 25 bp, Homo sapien
cgcagtagtaggcatcaaaagattt

SEQ ID NO: 171355 - DNA, 25 bp, Homo sapien
accttcaggtacctccgggagcaca

SEQ ID NO: 171356 - DNA, 25 bp, Homo sapien
acaggccgcagagacaggctgcaga

SEQ ID NO: 171357 - DNA, 25 bp, Homo sapien
acttctctgtacaccggggctgtga

SEQ ID NO: 171358 - DNA, 25 bp, Homo sapien
ctgtcgtggggaaaagatgacccta

SEQ ID NO: 171359 - DNA, 25 bp, Homo sapien
gggcccacggtgaacggccactcaa

SEQ ID NO: 171360 - DNA, 25 bp, Homo sapien
caacacggccgctacatggagcatg

SEQ ID NO: 171361 - DNA, 25 bp, Homo sapien
catggagcatggttgcccgtgacac

SEQ ID NO: 171362 - DNA, 25 bp, Homo sapien
tgcgttctgacatcccacttctctg

SEQ ID NO: 171363 - DNA, 25 bp, Homo sapien
cccgtgacacgccatgcggagacag

SEQ ID NO: 171364 - DNA, 25 bp, Homo sapien
acttgggtccgtgtctctatcatgc

SEQ ID NO: 171365 - DNA, 25 bp, Homo sapien
gggtctgtgtctctatcacgcttta

SEQ ID NO: 171366 - DNA, 25 bp, Homo sapien
cacacgggtccgtgtctctgtcacg

SEQ ID NO: 171367 - DNA, 25 bp, Homo sapien
gtgggtccgtgtcactatcacactc

SEQ ID NO: 171368 - DNA, 25 bp, Homo sapien
gagtctgtgtctctatcacgcttta

SEQ ID NO: 171369 - DNA, 25 bp, Homo sapien
ctatcacgctgtgtcctgtggcgcg

SEQ ID NO: 171370 - DNA, 25 bp, Homo sapien
tactccaccgtgctggtccgtgtct

SEQ ID NO: 171371 - DNA, 25 bp, Homo sapien
cgtccgcgtctctatcacgctgtgt

SEQ ID NO: 171372 - DNA, 25 bp, Homo sapien
gctcggcctcccacatccagcgcgc

SEQ ID NO: 171373 - DNA, 25 bp, Homo sapien
cggattccttccttgcgctgttttg

SEQ ID NO: 171374 - DNA, 25 bp, Homo sapien
tgggaagggatgcaaggaagccctc

SEQ ID NO: 171375 - DNA, 25 bp, Homo sapien
cctccctcggatccacgcggaacgc

SEQ ID NO: 171376 - DNA, 25 bp, Homo sapien
tgcccgtttcgaagccgccctggga

SEQ ID NO: 171377 - DNA, 25 bp, Homo sapien
gcccgcctcgactgcccgtttcgaa

SEQ ID NO: 171378 - DNA, 25 bp, Homo sapien
gttttggtcaacagcctcagcatct

SEQ ID NO: 171379 - DNA, 25 bp, Homo sapien
cttccttgcgctgttttggtcaaca

SEQ ID NO: 171380 - DNA, 25 bp, Homo sapien
acggtgtccatgacccagggtgtgg

SEQ ID NO: 171381 - DNA, 25 bp, Homo sapien
cacggtgtccatgacccagggtgtg

SEQ ID NO: 171382 - DNA, 25 bp, Homo sapien
acccagggtgtggacgcctgcgcgg

SEQ ID NO: 171383 - DNA, 25 bp, Homo sapien
cggtgtccatgacccagggtgtgga

SEQ ID NO: 171384 - DNA, 25 bp, Homo sapien
atgacccagggtgtggacgcctgcg

SEQ ID NO: 171385 - DNA, 25 bp, Homo sapien
ggggaagcaagaccgctgcgtatcg

SEQ ID NO: 171386 - DNA, 25 bp, Homo sapien
tgacccagggtgtggacgcctgcgc

SEQ ID NO: 171387 - DNA, 25 bp, Homo sapien
cctgcgcgggggaagcaagaccgct

SEQ ID NO: 171388 - DNA, 25 bp, Homo sapien
gctgaggcccacgttctaacctgga

SEQ ID NO: 171389 - DNA, 25 bp, Homo sapien
tggaatggaacctgcgttcccaccc

SEQ ID NO: 171390 - DNA, 25 bp, Homo sapien
gctcttcgctgaggcccacgttcta

SEQ ID NO: 171391 - DNA, 25 bp, Homo sapien
gccggccgcagagatgcagccctgt

SEQ ID NO: 171392 - DNA, 25 bp, Homo sapien
tgtgactcctaacggctcctcacgg

SEQ ID NO: 171393 - DNA, 25 bp, Homo sapien
aacggctcctcacggtgtccatgac

SEQ ID NO: 171394 - DNA, 25 bp, Homo sapien
ctaacctggaatggaacctgcgttc

SEQ ID NO: 171395 - DNA, 25 bp, Homo sapien
ggcccacgttctaacctggaatgga

SEQ ID NO: 171396 - DNA, 25 bp, Homo sapien
acagtggaagccgactcactcggaa

SEQ ID NO: 171397 - DNA, 25 bp, Homo sapien
agtggaagccgacttgctcggagcc

SEQ ID NO: 171398 - DNA, 25 bp, Homo sapien
agcctaggcaggaccgtgtccctgt

SEQ ID NO: 171399 - DNA, 25 bp, Homo sapien
aggacagtggaagccgactcactcg

SEQ ID NO: 171400 - DNA, 25 bp, Homo sapien
ttgctcggagcctaggcaggaccgt

SEQ ID NO: 171401 - DNA, 25 bp, Homo sapien
tggaagccgacttgctcggagccta

SEQ ID NO: 171402 - DNA, 25 bp, Homo sapien
ctaggcaggaccgtgtccctgtgcg

SEQ ID NO: 171403 - DNA, 25 bp, Homo sapien
cggagcctaggcaggaccgtgtccc

SEQ ID NO: 171404 - DNA, 25 bp, Homo sapien
ctcggaaacctaggcaggaccgtgt

SEQ ID NO: 171405 - DNA, 25 bp, Homo sapien
cgcttctaagtcgtgactgtttagt

SEQ ID NO: 171406 - DNA, 25 bp, Homo sapien
cagtggaagccgacttgctcggagc

SEQ ID NO: 171407 - DNA, 25 bp, Homo sapien
gaagcctaggcaggaccgtgtccct

SEQ ID NO: 171408 - DNA, 25 bp, Homo sapien
ctcggaagcctaggcaggaccgtgt

SEQ ID NO: 171409 - DNA, 25 bp, Homo sapien
tagtggaagccgacttgctcggagc

SEQ ID NO: 171410 - DNA, 25 bp, Homo sapien
ctgtttagtggaagccgacttgctc

SEQ ID NO: 171411 - DNA, 25 bp, Homo sapien
aagtcgtgactgtttagtggaagcc

SEQ ID NO: 171412 - DNA, 25 bp, Homo sapien
tcaagagcagcacacgcgtggacct

SEQ ID NO: 171413 - DNA, 25 bp, Homo sapien
ccgtacgtgcagatcaagagcagca

SEQ ID NO: 171414 - DNA, 25 bp, Homo sapien
gcagatcaagagcagcacacgcgtg

SEQ ID NO: 171415 - DNA, 25 bp, Homo sapien
cccgtacatgcagatcaagagcagc

SEQ ID NO: 171416 - DNA, 25 bp, Homo sapien
cccgtacgtgcagatcaagagcagc

SEQ ID NO: 171417 - DNA, 25 bp, Homo sapien
cgtacatgcagatcaagagcagcac

SEQ ID NO: 171418 - DNA, 25 bp, Homo sapien
caagagcagcacacgcgtggacctg

SEQ ID NO: 171419 - DNA, 25 bp, Homo sapien
cagatcaagagcagcacacgcgtgg

SEQ ID NO: 171420 - DNA, 25 bp, Homo sapien
gcgagctctgaaggacgctgcctcc

SEQ ID NO: 171421 - DNA, 25 bp, Homo sapien
ctactgaagtcgcagacgtgggccc

SEQ ID NO: 171422 - DNA, 25 bp, Homo sapien
gagctctgaaggacgctgcctccct

SEQ ID NO: 171423 - DNA, 25 bp, Homo sapien
agcgagctctgaaggacgctgcctc

SEQ ID NO: 171424 - DNA, 25 bp, Homo sapien
tcctgaagtcgcagacgtgggccct

SEQ ID NO: 171425 - DNA, 25 bp, Homo sapien
ccctcctactgaagtcgcagacgtg

SEQ ID NO: 171426 - DNA, 25 bp, Homo sapien
tgcagcgagctctgaaggacgctgc

SEQ ID NO: 171427 - DNA, 25 bp, Homo sapien
cagcgagctctgaaggacgctgcct

SEQ ID NO: 171428 - DNA, 25 bp, Homo sapien
tagtgcctgcgatctgactgcccga

SEQ ID NO: 171429 - DNA, 25 bp, Homo sapien
agtgcctgcgatctgactgcccgac

SEQ ID NO: 171430 - DNA, 25 bp, Homo sapien
tagtgcctgcgatctgactctgccc

SEQ ID NO: 171431 - DNA, 25 bp, Homo sapien
ccctagtgcctgtgatctgactctg

SEQ ID NO: 171432 - DNA, 25 bp, Homo sapien
cctagtgcctgcgatctgactctgc

SEQ ID NO: 171433 - DNA, 25 bp, Homo sapien
ctagtgcctgcgatctgactctgcc

SEQ ID NO: 171434 - DNA, 25 bp, Homo sapien
tgcgatctgactctgcccgacgtga

SEQ ID NO: 171435 - DNA, 25 bp, Homo sapien
gtgatctgactctgcccgacgtgac

SEQ ID NO: 171436 - DNA, 25 bp, Homo sapien
gatcgctgatcactgccatgcttta

SEQ ID NO: 171437 - DNA, 25 bp, Homo sapien
tggatgatacgcacacggtcgctga

SEQ ID NO: 171438 - DNA, 25 bp, Homo sapien
cacacggtcgctgatcactgccatg

SEQ ID NO: 171439 - DNA, 25 bp, Homo sapien
ccgccgagatgtgtggatgatacgc

SEQ ID NO: 171440 - DNA, 25 bp, Homo sapien
ctgccatgctttattaccgccgaga

SEQ ID NO: 171441 - DNA, 25 bp, Homo sapien
gattgctgatcactgccatgcttta

SEQ ID NO: 171442 - DNA, 25 bp, Homo sapien
gccatgctttattaccgctgagttg

SEQ ID NO: 171443 - DNA, 25 bp, Homo sapien
ggtcgctgatcactgccatgcttta

SEQ ID NO: 171444 - DNA, 25 bp, Homo sapien
tgcgtgggacccgatatccacttca

SEQ ID NO: 171445 - DNA, 25 bp, Homo sapien
gcttcagacggcacctttgcctctg

SEQ ID NO: 171446 - DNA, 25 bp, Homo sapien
tggcaggcgtcgctctcaggttccc

SEQ ID NO: 171447 - DNA, 25 bp, Homo sapien
tccaacagatgtgtccgggctgcct

SEQ ID NO: 171448 - DNA, 25 bp, Homo sapien
ggagctcccagttccaacagatgtg

SEQ ID NO: 171449 - DNA, 25 bp, Homo sapien
atatccacttcagggcggcagaaac

SEQ ID NO: 171450 - DNA, 25 bp, Homo sapien
cacctttgcctctgtgcgtgggacc

SEQ ID NO: 171451 - DNA, 25 bp, Homo sapien
cagaaacccgggtggagctcccagt

SEQ ID NO: 171452 - DNA, 25 bp, Homo sapien
ctgcagctgacagggtcgtccctgg

SEQ ID NO: 171453 - DNA, 25 bp, Homo sapien
tgtgcatgtggacagcgaccatgtc

SEQ ID NO: 171454 - DNA, 25 bp, Homo sapien
acttctcatagagcctgtgcatgtg

SEQ ID NO: 171455 - DNA, 25 bp, Homo sapien
ctgcggactgacctcgcggcagtag

SEQ ID NO: 171456 - DNA, 25 bp, Homo sapien
ggtcacagccgtccggagcagcgca

SEQ ID NO: 171457 - DNA, 25 bp, Homo sapien
tcgcgccgcgaaagtttgtagccca

SEQ ID NO: 171458 - DNA, 25 bp, Homo sapien
cctgccggctgtacttctcatagag

SEQ ID NO: 171459 - DNA, 25 bp, Homo sapien
ggccacatcccggagcaacagcaga

SEQ ID NO: 171460 - DNA, 25 bp, Homo sapien
cacgggctgcactctgggtttgagt

SEQ ID NO: 171461 - DNA, 25 bp, Homo sapien
cgtaatgaaccgctcttgcagtttc

SEQ ID NO: 171462 - DNA, 25 bp, Homo sapien
cggcgctggtcctgtctctcattct

SEQ ID NO: 171463 - DNA, 25 bp, Homo sapien
gcttgcccaggtcagcgagttttcc

SEQ ID NO: 171464 - DNA, 25 bp, Homo sapien
cctgtctctcattctgccgaggagc

SEQ ID NO: 171465 - DNA, 25 bp, Homo sapien
tgccgaggagcagccagtacatcaa

SEQ ID NO: 171466 - DNA, 25 bp, Homo sapien
tacatcaagtggatcgtctctgcgg

SEQ ID NO: 171467 - DNA, 25 bp, Homo sapien
ccaggtcagcgagttttcctttgtc

SEQ ID NO: 171468 - DNA, 25 bp, Homo sapien
tctggatggggtcacgggtctggac

SEQ ID NO: 171469 - DNA, 25 bp, Homo sapien
tctggacggggtcgcaggtctggac

SEQ ID NO: 171470 - DNA, 25 bp, Homo sapien
cacagctttggaccgggtcgagggt

SEQ ID NO: 171471 - DNA, 25 bp, Homo sapien
ggacggggtcgcacagctttggacc

SEQ ID NO: 171472 - DNA, 25 bp, Homo sapien
tcgcacagctttggaccgggtcgag

SEQ ID NO: 171473 - DNA, 25 bp, Homo sapien
gtcgcacagctttggaccgggtcga

SEQ ID NO: 171474 - DNA, 25 bp, Homo sapien
gtctggacagggtcgtgggtctgga

SEQ ID NO: 171475 - DNA, 25 bp, Homo sapien
ggtcgcacagctttggaccgggtcg

SEQ ID NO: 171476 - DNA, 25 bp, Homo sapien
cctgagcacacgcaggtctggacgg

SEQ ID NO: 171477 - DNA, 25 bp, Homo sapien
tggacggggttgcacaggtctggat

SEQ ID NO: 171478 - DNA, 25 bp, Homo sapien
tggggtcgcacagctttggaccggg

SEQ ID NO: 171479 - DNA, 25 bp, Homo sapien
agcacacgcaggtctggacggggtc

SEQ ID NO: 171480 - DNA, 25 bp, Homo sapien
tggggtcgcacaggtctggacgggg

SEQ ID NO: 171481 - DNA, 25 bp, Homo sapien
acggggttgcacaggtctggatggg

SEQ ID NO: 171482 - DNA, 25 bp, Homo sapien
gtcgcgaaggtctggacagggtcgt

SEQ ID NO: 171483 - DNA, 25 bp, Homo sapien
gatggggtcgcacagctttggaccg

SEQ ID NO: 171484 - DNA, 25 bp, Homo sapien
agctggcgtggacatttgctctctg

SEQ ID NO: 171485 - DNA, 25 bp, Homo sapien
actgctgtcgtcctggtcttccgag

SEQ ID NO: 171486 - DNA, 25 bp, Homo sapien
tctttctgtccgtggctttccggca

SEQ ID NO: 171487 - DNA, 25 bp, Homo sapien
cgctcagaagccagcgtgaggttct

SEQ ID NO: 171488 - DNA, 25 bp, Homo sapien
cttcgcggctcaggcctgactgaaa

SEQ ID NO: 171489 - DNA, 25 bp, Homo sapien
tgttttgtcctcagtctgtctggtc

SEQ ID NO: 171490 - DNA, 25 bp, Homo sapien
gcttgtcagcagagcctgttttgtc

SEQ ID NO: 171491 - DNA, 25 bp, Homo sapien
ctgactgaaagcacccgtggtccct

SEQ ID NO: 171492 - DNA, 25 bp, Homo sapien
tgtccgcaggggatcctgtgggaag

SEQ ID NO: 171493 - DNA, 25 bp, Homo sapien
gatgagtgtccataggggatcctgt

SEQ ID NO: 171494 - DNA, 25 bp, Homo sapien
gtgatgagtgtccataggggatcct

SEQ ID NO: 171495 - DNA, 25 bp, Homo sapien
atgagtgtccataggggatcctgtg

SEQ ID NO: 171496 - DNA, 25 bp, Homo sapien
tccataggggatcctgtgggaaggc

SEQ ID NO: 171497 - DNA, 25 bp, Homo sapien
tgatgagtgtccataggggatcctg

SEQ ID NO: 171498 - DNA, 25 bp, Homo sapien
gtgtccgcaggggatcctgtgggaa

SEQ ID NO: 171499 - DNA, 25 bp, Homo sapien
tgtccataggggatcctgtgggaag

SEQ ID NO: 171500 - DNA, 25 bp, Homo sapien
ttcaggcgtctctcacgtgtcctca

SEQ ID NO: 171501 - DNA, 25 bp, Homo sapien
aggcgtctctcacgtgtcctcaggt

SEQ ID NO: 171502 - DNA, 25 bp, Homo sapien
tgtcttcaggcgtctctcacgtgtc

SEQ ID NO: 171503 - DNA, 25 bp, Homo sapien
gtgtctcacgcgtcctcaggtgtct

SEQ ID NO: 171504 - DNA, 25 bp, Homo sapien
tgtctctcacgcgtcctcaggtgtc

SEQ ID NO: 171505 - DNA, 25 bp, Homo sapien
tctcacgtgtcctcaggtgtttctc

SEQ ID NO: 171506 - DNA, 25 bp, Homo sapien
gtttctcaggcgtctctcacgtgtc

SEQ ID NO: 171507 - DNA, 25 bp, Homo sapien
ggtgtctctcacgtgtcctcaggtg

SEQ ID NO: 171508 - DNA, 25 bp, Homo sapien
ccagcggtgtggtacgtttcgctct

SEQ ID NO: 171509 - DNA, 25 bp, Homo sapien
agcggtgtggtacgtttcgctcttt

SEQ ID NO: 171510 - DNA, 25 bp, Homo sapien
tggtacgtttcgctcttttaatatc

SEQ ID NO: 171511 - DNA, 25 bp, Homo sapien
ccaaacgagtcagtaagtgtgtgcc

SEQ ID NO: 171512 - DNA, 25 bp, Homo sapien
tcgctcttttaatatcgggaacagt

SEQ ID NO: 171513 - DNA, 25 bp, Homo sapien
tcgggaacagttaaaaccatacaga

SEQ ID NO: 171514 - DNA, 25 bp, Homo sapien
gccaagtacagcataaaagaatttt

SEQ ID NO: 171515 - DNA, 25 bp, Homo sapien
ttaccaaacgagtcagtaagtgtgt

SEQ ID NO: 171516 - DNA, 25 bp, Homo sapien
aactcctcgctgtcacgtggacgca

SEQ ID NO: 171517 - DNA, 25 bp, Homo sapien
cggcgctggcatttcagatgtccag

SEQ ID NO: 171518 - DNA, 25 bp, Homo sapien
agatgtccaggccaactcctcgctg

SEQ ID NO: 171519 - DNA, 25 bp, Homo sapien
ggatcccgtttcctgagcgcttttc

SEQ ID NO: 171520 - DNA, 25 bp, Homo sapien
tgtgcgcccgctttcccttagttct

SEQ ID NO: 171521 - DNA, 25 bp, Homo sapien
acacttttatcagggcacggatggc

SEQ ID NO: 171522 - DNA, 25 bp, Homo sapien
cgttgccgtggaggacacttttatc

SEQ ID NO: 171523 - DNA, 25 bp, Homo sapien
cctgggctgcagaggtcagcaccca

SEQ ID NO: 171524 - DNA, 25 bp, Homo sapien
gcgcaagtagttttcagaacgtgtc

SEQ ID NO: 171525 - DNA, 25 bp, Homo sapien
aacgcatctgcggtcatggtgcatg

SEQ ID NO: 171526 - DNA, 25 bp, Homo sapien
ttttcagaacgtctgccatcacggc

SEQ ID NO: 171527 - DNA, 25 bp, Homo sapien
catcacggcgcacgtgtttttcaga

SEQ ID NO: 171528 - DNA, 25 bp, Homo sapien
acgtgctgcgatcacagtgcatgta

SEQ ID NO: 171529 - DNA, 25 bp, Homo sapien
cgaacgcgtctgtgattatggtaca

SEQ ID NO: 171530 - DNA, 25 bp, Homo sapien
tggtacacgtatttttcagaacgcg

SEQ ID NO: 171531 - DNA, 25 bp, Homo sapien
tctgcgatcacagcacacatttttc

SEQ ID NO: 171532 - DNA, 25 bp, Homo sapien
gactcggacgctccaggcggctgct

SEQ ID NO: 171533 - DNA, 25 bp, Homo sapien
cacacacgcagagctccaccacgta

SEQ ID NO: 171534 - DNA, 25 bp, Homo sapien
gcgcagaggcctatctcgcgcccta

SEQ ID NO: 171535 - DNA, 25 bp, Homo sapien
gtgcagcaacctcggcgcttccgag

SEQ ID NO: 171536 - DNA, 25 bp, Homo sapien
gttctgcacgttccttcccagaagg

SEQ ID NO: 171537 - DNA, 25 bp, Homo sapien
aagccgccgcaaggcttcaggagcc

SEQ ID NO: 171538 - DNA, 25 bp, Homo sapien
gccgcgccgcaggattgaacaaagc

SEQ ID NO: 171539 - DNA, 25 bp, Homo sapien
acaaagcggcgggtgcagcaacctc

SEQ ID NO: 171540 - DNA, 25 bp, Homo sapien
agcacagactatgagtgtggccacg

SEQ ID NO: 171541 - DNA, 25 bp, Homo sapien
acgtctgcgccgagacctttgccgg

SEQ ID NO: 171542 - DNA, 25 bp, Homo sapien
ggccacgcgtcccatgacgtgaact

SEQ ID NO: 171543 - DNA, 25 bp, Homo sapien
ccctccattcgagaagcacagacta

SEQ ID NO: 171544 - DNA, 25 bp, Homo sapien
atctccagcttgagtggcagccagc

SEQ ID NO: 171545 - DNA, 25 bp, Homo sapien
gtgtttccacctcatctccagcttg

SEQ ID NO: 171546 - DNA, 25 bp, Homo sapien
acgtcccgccgcagctgtgtttcca

SEQ ID NO: 171547 - DNA, 25 bp, Homo sapien
tgacgtgaactcacgtctgcgccga

SEQ ID NO: 171548 - DNA, 25 bp, Homo sapien
gaatctctcctgatcaatgcctcct

SEQ ID NO: 171549 - DNA, 25 bp, Homo sapien
gtgtgaatctctcctgatcaatgcc

SEQ ID NO: 171550 - DNA, 25 bp, Homo sapien
ggctcacgtgtgaatcatctcccga

SEQ ID NO: 171551 - DNA, 25 bp, Homo sapien
gtgtgaatcatctcccgatcaatgc

SEQ ID NO: 171552 - DNA, 25 bp, Homo sapien
tcggctcacgtgtgaatcatctccc

SEQ ID NO: 171553 - DNA, 25 bp, Homo sapien
ctcacgtgtgaatcatctcccgatc

SEQ ID NO: 171554 - DNA, 25 bp, Homo sapien
ggctcacgtgtgattcatctcccga

SEQ ID NO: 171555 - DNA, 25 bp, Homo sapien
tcggctcacgtgtgattcatctccc

SEQ ID NO: 171556 - DNA, 25 bp, Homo sapien
ggactcgagtgacgtgagcacgcac

SEQ ID NO: 171557 - DNA, 25 bp, Homo sapien
gacgtgggagtgttgaggtaacgca

SEQ ID NO: 171558 - DNA, 25 bp, Homo sapien
acgacggggcactgaggggacgcac

SEQ ID NO: 171559 - DNA, 25 bp, Homo sapien
cacgtaggacctgttagtgacgtgg

SEQ ID NO: 171560 - DNA, 25 bp, Homo sapien
cacgcacgtaggacctgttagtgac

SEQ ID NO: 171561 - DNA, 25 bp, Homo sapien
ctcgagtgacgtgagcacgcacgta

SEQ ID NO: 171562 - DNA, 25 bp, Homo sapien
gttgctgagggatgcacgcagggcc

SEQ ID NO: 171563 - DNA, 25 bp, Homo sapien
gtgagcacgcacgtaggacctgtta

SEQ ID NO: 171564 - DNA, 25 bp, Homo sapien
attccaggaatcgagcggggccgca

SEQ ID NO: 171565 - DNA, 25 bp, Homo sapien
cgcgatgtgaccttcagggccgcca

SEQ ID NO: 171566 - DNA, 25 bp, Homo sapien
ccgcgcctttcaggtcttcgaggag

SEQ ID NO: 171567 - DNA, 25 bp, Homo sapien
ggaaacgctcgctgtcagacgcctc

SEQ ID NO: 171568 - DNA, 25 bp, Homo sapien
gagtccgtttccaaagtgcgagaga

SEQ ID NO: 171569 - DNA, 25 bp, Homo sapien
gtgcgagagaaacacaatggttaaa

SEQ ID NO: 171570 - DNA, 25 bp, Homo sapien
gcttgcggcagcaggtccaaaaata

SEQ ID NO: 171571 - DNA, 25 bp, Homo sapien
cgcgcctcgtcctcctgagaggggt

SEQ ID NO: 171572 - DNA, 25 bp, Homo sapien
tgcttggatttctcggctcctttga

SEQ ID NO: 171573 - DNA, 25 bp, Homo sapien
ctcgggcagacagggctctggtcct

SEQ ID NO: 171574 - DNA, 25 bp, Homo sapien
tggcccaggcagcggtcactgagcc

SEQ ID NO: 171575 - DNA, 25 bp, Homo sapien
ggctctggtcctcgctcgtcaccac

SEQ ID NO: 171576 - DNA, 25 bp, Homo sapien
gatttctcggctcctttgacccatg

SEQ ID NO: 171577 - DNA, 25 bp, Homo sapien
agcggccacttggtgcttggatttc

SEQ ID NO: 171578 - DNA, 25 bp, Homo sapien
cgtcctgccatagcggccacttggt

SEQ ID NO: 171579 - DNA, 25 bp, Homo sapien
tcggctcctttgacccatgggtttc

SEQ ID NO: 171580 - DNA, 25 bp, Homo sapien
aaggcttgccgaggtacccacgcca

SEQ ID NO: 171581 - DNA, 25 bp, Homo sapien
agtcactgcccgagccggttgctaa

SEQ ID NO: 171582 - DNA, 25 bp, Homo sapien
ttttgcttgcagacatagacgagtg

SEQ ID NO: 171583 - DNA, 25 bp, Homo sapien
aggcgcgctgcaagaacctgcccgg

SEQ ID NO: 171584 - DNA, 25 bp, Homo sapien
gcctctgtgacgagggctttgcgta

SEQ ID NO: 171585 - DNA, 25 bp, Homo sapien
gctttgcgtacagctcccaggagaa

SEQ ID NO: 171586 - DNA, 25 bp, Homo sapien
tgacgcccaagtctagacacgggtg

SEQ ID NO: 171587 - DNA, 25 bp, Homo sapien
tcgctttctctgacgcccaagtcta

SEQ ID NO: 171588 - DNA, 25 bp, Homo sapien
cccgttagaatctgcatgtaattcc

SEQ ID NO: 171589 - DNA, 25 bp, Homo sapien
gggcctcaagctgtcccaggacatg

SEQ ID NO: 171590 - DNA, 25 bp, Homo sapien
cagggagctacacctgccactgtga

SEQ ID NO: 171591 - DNA, 25 bp, Homo sapien
tgtgagcaggtctgcgtgaactccc

SEQ ID NO: 171592 - DNA, 25 bp, Homo sapien
tgagcaatcgcggtgtgatcccacg

SEQ ID NO: 171593 - DNA, 25 bp, Homo sapien
tgagcgcaccttgcgtgtggtttga

SEQ ID NO: 171594 - DNA, 25 bp, Homo sapien
catgtaattccttgagcgcaccttg

SEQ ID NO: 171595 - DNA, 25 bp, Homo sapien
ccaggacatggacacctgtgaggta

SEQ ID NO: 171596 - DNA, 25 bp, Homo sapien
ctgcagctgcgctacaacggtgtcg

SEQ ID NO: 171597 - DNA, 25 bp, Homo sapien
gtcactcgcttatgcaaccgttagg

SEQ ID NO: 171598 - DNA, 25 bp, Homo sapien
cagactcagctgtcactcgcttatg

SEQ ID NO: 171599 - DNA, 25 bp, Homo sapien
gacagtgagtgtgcggcagccaccc

SEQ ID NO: 171600 - DNA, 25 bp, Homo sapien
agcggcccggtcatcaaccatggca

SEQ ID NO: 171601 - DNA, 25 bp, Homo sapien
tgcaaccgttaggagatgagctctg

SEQ ID NO: 171602 - DNA, 25 bp, Homo sapien
cgctacaacggtgtcggccgtgtca

SEQ ID NO: 171603 - DNA, 25 bp, Homo sapien
cggtgtcggccgtgtcaccagcagc

SEQ ID NO: 171604 - DNA, 25 bp, Homo sapien
ccacctctcaggatggccatgcagg

SEQ ID NO: 171605 - DNA, 25 bp, Homo sapien
tgacccggtgagacagctacaatgg

SEQ ID NO: 171606 - DNA, 25 bp, Homo sapien
gtggacaccgtggtcaccgatgacc

SEQ ID NO: 171607 - DNA, 25 bp, Homo sapien
agctctcggtaacatggtggacacc

SEQ ID NO: 171608 - DNA, 25 bp, Homo sapien
agtccggagacagcacagccttagg

SEQ ID NO: 171609 - DNA, 25 bp, Homo sapien
ggccatgcaggtcactcagttcaga

SEQ ID NO: 171610 - DNA, 25 bp, Homo sapien
gacaagctgaggctcctccggttcc

SEQ ID NO: 171611 - DNA, 25 bp, Homo sapien
gggtcctttgcagaaagtccggaga

SEQ ID NO: 171612 - DNA, 25 bp, Homo sapien
cagaccgcgcgtgctcccgacagct

SEQ ID NO: 171613 - DNA, 25 bp, Homo sapien
gcgtgctcccgacagctcagacccc

SEQ ID NO: 171614 - DNA, 25 bp, Homo sapien
ctcagaccccagaccgcgcgtgctc

SEQ ID NO: 171615 - DNA, 25 bp, Homo sapien
ccagaccgcgggtgctcctgacagc

SEQ ID NO: 171616 - DNA, 25 bp, Homo sapien
cgcgtgctcccgacagctcagaccc

SEQ ID NO: 171617 - DNA, 25 bp, Homo sapien
agaccgcgcgtgctcccgacagctc

SEQ ID NO: 171618 - DNA, 25 bp, Homo sapien
cagaccgcgggtgctcctgacagct

SEQ ID NO: 171619 - DNA, 25 bp, Homo sapien
accgcgcgtgctcccgacagctcag

SEQ ID NO: 171620 - DNA, 25 bp, Homo sapien
cctgcttcagcagagtagctctcct

SEQ ID NO: 171621 - DNA, 25 bp, Homo sapien
gacctgcttcagcagagtagctctc

SEQ ID NO: 171622 - DNA, 25 bp, Homo sapien
tcattaacgaatggccttggaagag

SEQ ID NO: 171623 - DNA, 25 bp, Homo sapien
cgatgtcattaacgaatggccttgg

SEQ ID NO: 171624 - DNA, 25 bp, Homo sapien
ccctcaacgatgtcattaacgaatg

SEQ ID NO: 171625 - DNA, 25 bp, Homo sapien
gatgccctcaacgatgtcattaacg

SEQ ID NO: 171626 - DNA, 25 bp, Homo sapien
cgcgatgccctcaacgatgtcatta

SEQ ID NO: 171627 - DNA, 25 bp, Homo sapien
aggccggaagactcgcccgcgatgc

SEQ ID NO: 171628 - DNA, 25 bp, Homo sapien
acccacgggtacgtgggctgcactc

SEQ ID NO: 171629 - DNA, 25 bp, Homo sapien
tgtggcactggtagactatcactcc

SEQ ID NO: 171630 - DNA, 25 bp, Homo sapien
acacaggcgtgctgtttgcgctctg

SEQ ID NO: 171631 - DNA, 25 bp, Homo sapien
agaagtcgtggctcacatccgccca

SEQ ID NO: 171632 - DNA, 25 bp, Homo sapien
acctgggaagtagaagtcgtggctc

SEQ ID NO: 171633 - DNA, 25 bp, Homo sapien
cgggactgaatcaacctgggaagta

SEQ ID NO: 171634 - DNA, 25 bp, Homo sapien
ccctctggacgtcgggactgaatca

SEQ ID NO: 171635 - DNA, 25 bp, Homo sapien
accagaggtctgatgagccaagccc

SEQ ID NO: 171636 - DNA, 25 bp, Homo sapien
agctttgtaacaccgcgtggccgtc

SEQ ID NO: 171637 - DNA, 25 bp, Homo sapien
ccggccacgtggtgagctaagatat

SEQ ID NO: 171638 - DNA, 25 bp, Homo sapien
gatatgttgttctctccctgcggcc

SEQ ID NO: 171639 - DNA, 25 bp, Homo sapien
cggcccagatgtgccggtgacttca

SEQ ID NO: 171640 - DNA, 25 bp, Homo sapien
gcggcgtacaagcacagcgacatca

SEQ ID NO: 171641 - DNA, 25 bp, Homo sapien
ccggcctgtaacatatctgtaaata

SEQ ID NO: 171642 - DNA, 25 bp, Homo sapien
ccaagcgcttctttctgactctaaa

SEQ ID NO: 171643 - DNA, 25 bp, Homo sapien
agagcgggctcgaagaaaataattc

SEQ ID NO: 171644 - DNA, 25 bp, Homo sapien
gcttcggtaccgtgagaaaatagtg

SEQ ID NO: 171645 - DNA, 25 bp, Homo sapien
gcacgtggaccttccgcaggcagat

SEQ ID NO: 171646 - DNA, 25 bp, Homo sapien
ggctcccttcggaaacgtccatctg

SEQ ID NO: 171647 - DNA, 25 bp, Homo sapien
aggcagatgcgctttctccactcgg

SEQ ID NO: 171648 - DNA, 25 bp, Homo sapien
ctcggatctggccatcagcacagaa

SEQ ID NO: 171649 - DNA, 25 bp, Homo sapien
ggctcgctaagcaggccaactcgtc

SEQ ID NO: 171650 - DNA, 25 bp, Homo sapien
cgacgatgccagagccagctgagca

SEQ ID NO: 171651 - DNA, 25 bp, Homo sapien
tgagcagagctccaagaagcccgtg

SEQ ID NO: 171652 - DNA, 25 bp, Homo sapien
gggagaagagcggtacttgtttatc

SEQ ID NO: 171653 - DNA, 25 bp, Homo sapien
gagcaatgggatcacctctcgcccg

SEQ ID NO: 171654 - DNA, 25 bp, Homo sapien
tctggggagcaatgggatcacctct

SEQ ID NO: 171655 - DNA, 25 bp, Homo sapien
acttggtgtcttgtggcacgtctgg

SEQ ID NO: 171656 - DNA, 25 bp, Homo sapien
agcagagacggcgacttggtgtctt

SEQ ID NO: 171657 - DNA, 25 bp, Homo sapien
cggtacttgtttatcgtaggcacgg

SEQ ID NO: 171658 - DNA, 25 bp, Homo sapien
cgtgagcggcccacagagcagagac

SEQ ID NO: 171659 - DNA, 25 bp, Homo sapien
actggggaaccgtgagcggcccaca

SEQ ID NO: 171660 - DNA, 25 bp, Homo sapien
ccacgtgtgacagggaggaccaccc

SEQ ID NO: 171661 - DNA, 25 bp, Homo sapien
ccacatcccgtaagcctgcgtgtga

SEQ ID NO: 171662 - DNA, 25 bp, Homo sapien
tcccgtaagcccacgtgtgacaggg

SEQ ID NO: 171663 - DNA, 25 bp, Homo sapien
atcccgtaagcccacgtgtgacagg

SEQ ID NO: 171664 - DNA, 25 bp, Homo sapien
atcccgtaagcctgcgtgtgacagg

SEQ ID NO: 171665 - DNA, 25 bp, Homo sapien
cacatcccgtaagcctgcgtgtgac

SEQ ID NO: 171666 - DNA, 25 bp, Homo sapien
catcccgtaagcctgcgtgtgacag

SEQ ID NO: 171667 - DNA, 25 bp, Homo sapien
catcccgtaagcctgcgtgtgacgg

SEQ ID NO: 171668 - DNA, 25 bp, Homo sapien
cggcgtgcgtttatacccaggctgg

SEQ ID NO: 171669 - DNA, 25 bp, Homo sapien
ggcgtgcgtttatacccaggctgga

SEQ ID NO: 171670 - DNA, 25 bp, Homo sapien
gcgtgcgtttatacccaggctggag

SEQ ID NO: 171671 - DNA, 25 bp, Homo sapien
ctggagctaaccccggcccggcgtg

SEQ ID NO: 171672 - DNA, 25 bp, Homo sapien
gcccggcgtgcgtttatacccaggc

SEQ ID NO: 171673 - DNA, 25 bp, Homo sapien
caggctggagctaaccccggcccgg

SEQ ID NO: 171674 - DNA, 25 bp, Homo sapien
cccggcgtgcgtttatacccaggct

SEQ ID NO: 171675 - DNA, 25 bp, Homo sapien
ccggcgtgcgtttatacccaggctg

SEQ ID NO: 171676 - DNA, 25 bp, Homo sapien
actctcaggctggaactaaccccgg

SEQ ID NO: 171677 - DNA, 25 bp, Homo sapien
ctagaaagcccagcaccctcgaccc

SEQ ID NO: 171678 - DNA, 25 bp, Homo sapien
cggaagcctgcgtaggccaggatct

SEQ ID NO: 171679 - DNA, 25 bp, Homo sapien
tgggccataggccagctgggacaga

SEQ ID NO: 171680 - DNA, 25 bp, Homo sapien
agaggcacctgccatggagaggaga

SEQ ID NO: 171681 - DNA, 25 bp, Homo sapien
agggaagggctgtccagccttccta

SEQ ID NO: 171682 - DNA, 25 bp, Homo sapien
gggctgtccagccttcctagaaagc

SEQ ID NO: 171683 - DNA, 25 bp, Homo sapien
tgtccagccttcctagaaagcccag

SEQ ID NO: 171684 - DNA, 25 bp, Homo sapien
tggcgcctgcaccagacaagcgttt

SEQ ID NO: 171685 - DNA, 25 bp, Homo sapien
caagcgtttctgtgtcctgtctaca

SEQ ID NO: 171686 - DNA, 25 bp, Homo sapien
gtgtcctgtctacaatccggctgca

SEQ ID NO: 171687 - DNA, 25 bp, Homo sapien
acaatccggctgcagttcctcctgg

SEQ ID NO: 171688 - DNA, 25 bp, Homo sapien
cactgagctgccgaggcagagaagc

SEQ ID NO: 171689 - DNA, 25 bp, Homo sapien
cagagaagcttgcaccgaggagacg

SEQ ID NO: 171690 - DNA, 25 bp, Homo sapien
agatcccggcagagacccttcccga

SEQ ID NO: 171691 - DNA, 25 bp, Homo sapien
agcttgcaccgaggagacgccaaag

SEQ ID NO: 171692 - DNA, 25 bp, Homo sapien
ggccaccacgccaaaactgataaac

SEQ ID NO: 171693 - DNA, 25 bp, Homo sapien
gataaacacgatcgctgccaccagc

SEQ ID NO: 171694 - DNA, 25 bp, Homo sapien
tgtgggtgcccagcttttaccaacc

SEQ ID NO: 171695 - DNA, 25 bp, Homo sapien
attcaaagtcccagctcgaggtcgg

SEQ ID NO: 171696 - DNA, 25 bp, Homo sapien
ttcgtcctatgacttccagccctgg

SEQ ID NO: 171697 - DNA, 25 bp, Homo sapien
gtcctcacgcgtctattccgcaaga

SEQ ID NO: 171698 - DNA, 25 bp, Homo sapien
ctcggcacgcgcctctgagaagcaa

SEQ ID NO: 171699 - DNA, 25 bp, Homo sapien
gccgtccacgatggcgcagcagaag

SEQ ID NO: 171700 - DNA, 25 bp, Homo sapien
acaggaaaaggctacctcgctcttc

SEQ ID NO: 171701 - DNA, 25 bp, Homo sapien
ggctacctcgctcttccaaacgaag

SEQ ID NO: 171702 - DNA, 25 bp, Homo sapien
agcccggcttgcgaactggtgaaca

SEQ ID NO: 171703 - DNA, 25 bp, Homo sapien
tggtgaacacgcaacaggtttcctg

SEQ ID NO: 171704 - DNA, 25 bp, Homo sapien
ttggagattccgtgaacacaccggg

SEQ ID NO: 171705 - DNA, 25 bp, Homo sapien
ggcgagccgaaaccaagcaacactg

SEQ ID NO: 171706 - DNA, 25 bp, Homo sapien
cgcctctgcacgttcaaacaggaaa

SEQ ID NO: 171707 - DNA, 25 bp, Homo sapien
acacaccggggagaaacacgagaga

SEQ ID NO: 171708 - DNA, 25 bp, Homo sapien
ggcgccacgctcagcccttggcggt

SEQ ID NO: 171709 - DNA, 25 bp, Homo sapien
cgtccttcctcgctctactctccct

SEQ ID NO: 171710 - DNA, 25 bp, Homo sapien
gagtgggtcaccacgggttcgcctc

SEQ ID NO: 171711 - DNA, 25 bp, Homo sapien
ccgctgagtgggtcaccacgggttc

SEQ ID NO: 171712 - DNA, 25 bp, Homo sapien
ccagatggaaggtgcctggagagga

SEQ ID NO: 171713 - DNA, 25 bp, Homo sapien
tttctggaaatcaggacgccgcggc

SEQ ID NO: 171714 - DNA, 25 bp, Homo sapien
tccagcggccgcctggtttctggaa

SEQ ID NO: 171715 - DNA, 25 bp, Homo sapien
cggccgcctggtttctggaaatcag

SEQ ID NO: 171716 - DNA, 25 bp, Homo sapien
caggaaggagcgagtcccaccagtc

SEQ ID NO: 171717 - DNA, 25 bp, Homo sapien
gcttgggaactctcgcgacatccga

SEQ ID NO: 171718 - DNA, 25 bp, Homo sapien
gccatctttgcggaagcgcagctag

SEQ ID NO: 171719 - DNA, 25 bp, Homo sapien
gagactgtaaaactgccatcccgcg

SEQ ID NO: 171720 - DNA, 25 bp, Homo sapien
cccaagggaggcagaatctccggtc

SEQ ID NO: 171721 - DNA, 25 bp, Homo sapien
gggagagccgcccagagccaaacca

SEQ ID NO: 171722 - DNA, 25 bp, Homo sapien
aatctccggtcaccagcctcgaagg

SEQ ID NO: 171723 - DNA, 25 bp, Homo sapien
tcctgtacctgtgcggagactgtaa

SEQ ID NO: 171724 - DNA, 25 bp, Homo sapien
gtgtgcagatacacggacgtgagtc

SEQ ID NO: 171725 - DNA, 25 bp, Homo sapien
acggacaccgtgagtcctgtgtgca

SEQ ID NO: 171726 - DNA, 25 bp, Homo sapien
tcatgtgtgcagatacacggacgtg

SEQ ID NO: 171727 - DNA, 25 bp, Homo sapien
gacgtgagtctcgtgtgcagataca

SEQ ID NO: 171728 - DNA, 25 bp, Homo sapien
cctgtgtgcagatacacggacaccg

SEQ ID NO: 171729 - DNA, 25 bp, Homo sapien
gagtcatgtgtgcagatacacggac

SEQ ID NO: 171730 - DNA, 25 bp, Homo sapien
tgtgtgcagatacacggacaccgtg

SEQ ID NO: 171731 - DNA, 25 bp, Homo sapien
tgtgtgcagatacatggacaccgtg

SEQ ID NO: 171732 - DNA, 25 bp, Homo sapien
ttgccatgggtctgctgtgacatca

SEQ ID NO: 171733 - DNA, 25 bp, Homo sapien
gcgggttctgcgttttcacatctct

SEQ ID NO: 171734 - DNA, 25 bp, Homo sapien
tcagaggccaaagatcagccgatcc

SEQ ID NO: 171735 - DNA, 25 bp, Homo sapien
ctctgtgacagggtatttgaatctt

SEQ ID NO: 171736 - DNA, 25 bp, Homo sapien
ttgaatctttctctccctatcaggg

SEQ ID NO: 171737 - DNA, 25 bp, Homo sapien
cctatcagggcaaatgggacacaga

SEQ ID NO: 171738 - DNA, 25 bp, Homo sapien
ggcagcacagcgtggctttcctgca

SEQ ID NO: 171739 - DNA, 25 bp, Homo sapien
atgagacgccggtctccctctgtga

SEQ ID NO: 171740 - DNA, 25 bp, Homo sapien
caaaggctgcggctttgcatgggca

SEQ ID NO: 171741 - DNA, 25 bp, Homo sapien
ccgggacggcgtgcatctcactttg

SEQ ID NO: 171742 - DNA, 25 bp, Homo sapien
agcgccacttgtctatgggccggga

SEQ ID NO: 171743 - DNA, 25 bp, Homo sapien
ctcccaaaggctgcggctttgcatg

SEQ ID NO: 171744 - DNA, 25 bp, Homo sapien
tgcggctttgcatgggcagcttgct

SEQ ID NO: 171745 - DNA, 25 bp, Homo sapien
ccacttgtctatgggccgggacggc

SEQ ID NO: 171746 - DNA, 25 bp, Homo sapien
acacgttccacagggccaggtgggc

SEQ ID NO: 171747 - DNA, 25 bp, Homo sapien
gcgtgcatctcactttgccggctct

SEQ ID NO: 171748 - DNA, 25 bp, Homo sapien
gactggacagcggcaaactcgaatg

SEQ ID NO: 171749 - DNA, 25 bp, Homo sapien
caaactcgaatgtggtcgcgccggc

SEQ ID NO: 171750 - DNA, 25 bp, Homo sapien
actcgaatgtggtcgcgccggcgac

SEQ ID NO: 171751 - DNA, 25 bp, Homo sapien
gggactgcacggtgggaaacacact

SEQ ID NO: 171752 - DNA, 25 bp, Homo sapien
ctgcacggtgggaaacacacttgga

SEQ ID NO: 171753 - DNA, 25 bp, Homo sapien
cacacttggaagtgttgatacattc

SEQ ID NO: 171754 - DNA, 25 bp, Homo sapien
ttgatacattcagaaaagcacgggc

SEQ ID NO: 171755 - DNA, 25 bp, Homo sapien
cattcagaaaagcacgggcgggacc

SEQ ID NO: 171756 - DNA, 25 bp, Homo sapien
caacatggaggacctacaggcgcgg

SEQ ID NO: 171757 - DNA, 25 bp, Homo sapien
tgggcagtggacgcccacacaacat

SEQ ID NO: 171758 - DNA, 25 bp, Homo sapien
cggacgctcacacacggaggacctg

SEQ ID NO: 171759 - DNA, 25 bp, Homo sapien
acacaacacagaggacctacggcca

SEQ ID NO: 171760 - DNA, 25 bp, Homo sapien
tcacgcaacatggaggacctacagg

SEQ ID NO: 171761 - DNA, 25 bp, Homo sapien
gtgggcagtggacactcacgcaaca

SEQ ID NO: 171762 - DNA, 25 bp, Homo sapien
agtggacactcacgcaacatggagg

SEQ ID NO: 171763 - DNA, 25 bp, Homo sapien
aacacagaggacctacggccacagg

SEQ ID NO: 171764 - DNA, 25 bp, Homo sapien
ggggcctggatattccccccacgca

SEQ ID NO: 171765 - DNA, 25 bp, Homo sapien
ctggatattccccccacgcaccgcg

SEQ ID NO: 171766 - DNA, 25 bp, Homo sapien
tggggcctggatattccccccacgc

SEQ ID NO: 171767 - DNA, 25 bp, Homo sapien
gggcctggatattccccccacgcac

SEQ ID NO: 171768 - DNA, 25 bp, Homo sapien
ggcctggatattccccccacgcacc

SEQ ID NO: 171769 - DNA, 25 bp, Homo sapien
gcctggatattccccccacgcaccg

SEQ ID NO: 171770 - DNA, 25 bp, Homo sapien
cctggaggttgcccccacgcaccgc

SEQ ID NO: 171771 - DNA, 25 bp, Homo sapien
tggaggttgcccccacgcaccgcgt

SEQ ID NO: 171772 - DNA, 25 bp, Homo sapien
cacgcaccgcgttcctgactgtggg

SEQ ID NO: 171773 - DNA, 25 bp, Homo sapien
ccacgcaccgcgttcctgactgtgg

SEQ ID NO: 171774 - DNA, 25 bp, Homo sapien
gcagagccctgcggtctggatgttc

SEQ ID NO: 171775 - DNA, 25 bp, Homo sapien
acgcaccgcgttcctgactgtgggg

SEQ ID NO: 171776 - DNA, 25 bp, Homo sapien
caccgcgttcctgactgtggggagg

SEQ ID NO: 171777 - DNA, 25 bp, Homo sapien
agcagagccctgcggtctggatgtt

SEQ ID NO: 171778 - DNA, 25 bp, Homo sapien
accgcgttcctgactgtggggagga

SEQ ID NO: 171779 - DNA, 25 bp, Homo sapien
cgcaccgcgttcctgactgtgggga

SEQ ID NO: 171780 - DNA, 25 bp, Homo sapien
gcaagaactgtccaagcctaaatga

SEQ ID NO: 171781 - DNA, 25 bp, Homo sapien
cgataaacaggcaaagaacccggtg

SEQ ID NO: 171782 - DNA, 25 bp, Homo sapien
gctgcccggaggacgaatcacataa

SEQ ID NO: 171783 - DNA, 25 bp, Homo sapien
ctgaaaaagctagaggcaagaactg

SEQ ID NO: 171784 - DNA, 25 bp, Homo sapien
cacataaatcgctcaggcgccaacg

SEQ ID NO: 171785 - DNA, 25 bp, Homo sapien
gtccaagcctaaatgacgataaaca

SEQ ID NO: 171786 - DNA, 25 bp, Homo sapien
gcccggaggacgaatcacataaatc

SEQ ID NO: 171787 - DNA, 25 bp, Homo sapien
gttaccgggcaagtgagagcccgca

SEQ ID NO: 171788 - DNA, 25 bp, Homo sapien
agaaagcctcggtccctcagccggt

SEQ ID NO: 171789 - DNA, 25 bp, Homo sapien
gtgaccgttttcctcgggcacaatg

SEQ ID NO: 171790 - DNA, 25 bp, Homo sapien
acaatggcctcgtggggacaccatg

SEQ ID NO: 171791 - DNA, 25 bp, Homo sapien
aagctgctcactgcagtgtacctga

SEQ ID NO: 171792 - DNA, 25 bp, Homo sapien
ggcgcaaagaacctcaggaagatga

SEQ ID NO: 171793 - DNA, 25 bp, Homo sapien
gtcgcaggacagctcagaaagcctc

SEQ ID NO: 171794 - DNA, 25 bp, Homo sapien
tgtacctgacgtccgggtcatctgc

SEQ ID NO: 171795 - DNA, 25 bp, Homo sapien
cagccggtcactcaccgtgtggtgc

SEQ ID NO: 171796 - DNA, 25 bp, Homo sapien
aatcactacacaggcaccacgtcgg

SEQ ID NO: 171797 - DNA, 25 bp, Homo sapien
ctgtggcaattcacgcgtgaaaatc

SEQ ID NO: 171798 - DNA, 25 bp, Homo sapien
gacacgtgtgaacagccactccctg

SEQ ID NO: 171799 - DNA, 25 bp, Homo sapien
ctgcccacaggtgcgtgtagcacca

SEQ ID NO: 171800 - DNA, 25 bp, Homo sapien
ggttctcctgcaacgggacacggca

SEQ ID NO: 171801 - DNA, 25 bp, Homo sapien
acatactgccgtaggttctcctgca

SEQ ID NO: 171802 - DNA, 25 bp, Homo sapien
tcacacatgacggtcgggcagctca

SEQ ID NO: 171803 - DNA, 25 bp, Homo sapien
tggaagacgcggtccacatactgcc

SEQ ID NO: 171804 - DNA, 25 bp, Homo sapien
caaccctgggcctgtgtcactggct

SEQ ID NO: 171805 - DNA, 25 bp, Homo sapien
gctctctcagggagcgatgtgcgcc

SEQ ID NO: 171806 - DNA, 25 bp, Homo sapien
cgcgatcagacgagccgggctctct

SEQ ID NO: 171807 - DNA, 25 bp, Homo sapien
ggcccagtccatggccgcgatcaga

SEQ ID NO: 171808 - DNA, 25 bp, Homo sapien
atgtgcgcccgcgatcagacgaatc

SEQ ID NO: 171809 - DNA, 25 bp, Homo sapien
gcaaacactaggcacggggcccagt

SEQ ID NO: 171810 - DNA, 25 bp, Homo sapien
agtgagaggtcaggcgcaaacacta

SEQ ID NO: 171811 - DNA, 25 bp, Homo sapien
agcctcagctgcaagggggcaaccc

SEQ ID NO: 171812 - DNA, 25 bp, Homo sapien
ccgcaggggttcagtctctgctttc

SEQ ID NO: 171813 - DNA, 25 bp, Homo sapien
tgctttcgactttgcttctcagttg

SEQ ID NO: 171814 - DNA, 25 bp, Homo sapien
ttcaccatcttgacccgagagtcgg

SEQ ID NO: 171815 - DNA, 25 bp, Homo sapien
gaaacatagtttgcgcttctgtgtg

SEQ ID NO: 171816 - DNA, 25 bp, Homo sapien
gctgcgctcaagtctcggcaacttt

SEQ ID NO: 171817 - DNA, 25 bp, Homo sapien
tggaagagaaactgccatggccatc

SEQ ID NO: 171818 - DNA, 25 bp, Homo sapien
gctcgtcctaagcagcgtggtttga

SEQ ID NO: 171819 - DNA, 25 bp, Homo sapien
gagtcgggccgtttctaagacaatg

SEQ ID NO: 171820 - DNA, 25 bp, Homo sapien
cgtcgatgcacttggacgccagtga

SEQ ID NO: 171821 - DNA, 25 bp, Homo sapien
catggtctcgtcgatgcacttggac

SEQ ID NO: 171822 - DNA, 25 bp, Homo sapien
cgccagcttcatggtctcgtcgatg

SEQ ID NO: 171823 - DNA, 25 bp, Homo sapien
ctcgtgaggctgaggactctcggcc

SEQ ID NO: 171824 - DNA, 25 bp, Homo sapien
cacctcctcgatggcgggcttcagg

SEQ ID NO: 171825 - DNA, 25 bp, Homo sapien
cttcagggtgacatgcaggtaatgc

SEQ ID NO: 171826 - DNA, 25 bp, Homo sapien
tggacgccagtgagtttcctcggaa

SEQ ID NO: 171827 - DNA, 25 bp, Homo sapien
gacagcgtttgtctcctggggacgc

SEQ ID NO: 171828 - DNA, 25 bp, Homo sapien
ggcactgatgaatggcaccaccctg

SEQ ID NO: 171829 - DNA, 25 bp, Homo sapien
cccggcaaacctcgcccaggatgtg

SEQ ID NO: 171830 - DNA, 25 bp, Homo sapien
cctgccatagtgtaggaagagccgc

SEQ ID NO: 171831 - DNA, 25 bp, Homo sapien
tggttctcggcgacgaccttgccat

SEQ ID NO: 171832 - DNA, 25 bp, Homo sapien
gacgaccttgccatccctgtagcgg

SEQ ID NO: 171833 - DNA, 25 bp, Homo sapien
tgccatccctgtagcgggtccaggc

SEQ ID NO: 171834 - DNA, 25 bp, Homo sapien
gcaccaccctgccatagtgtaggaa

SEQ ID NO: 171835 - DNA, 25 bp, Homo sapien
cgcgctggcgatggcactgatgaat

SEQ ID NO: 171836 - DNA, 25 bp, Homo sapien
tttcgcccaggatcagaccctgcga

SEQ ID NO: 171837 - DNA, 25 bp, Homo sapien
ccacgagctgctcacagctcagggt

SEQ ID NO: 171838 - DNA, 25 bp, Homo sapien
tgtcagacctcacgagctgctcgcg

SEQ ID NO: 171839 - DNA, 25 bp, Homo sapien
tggtgtcagacctcacgagctgctc

SEQ ID NO: 171840 - DNA, 25 bp, Homo sapien
tgctgatgccctcccctactggtgt

SEQ ID NO: 171841 - DNA, 25 bp, Homo sapien
ctgctgtgtgcgcattctgggctcc

SEQ ID NO: 171842 - DNA, 25 bp, Homo sapien
ggatcagaccctgcgagctgctcgc

SEQ ID NO: 171843 - DNA, 25 bp, Homo sapien
tgtgcgcattctgggctcctgcacc

SEQ ID NO: 171844 - DNA, 25 bp, Homo sapien
acgccaaggtccgtgggagcagcac

SEQ ID NO: 171845 - DNA, 25 bp, Homo sapien
tctcccgggcagcacgtgggaaacc

SEQ ID NO: 171846 - DNA, 25 bp, Homo sapien
agctggggaactcgccgacacgcag

SEQ ID NO: 171847 - DNA, 25 bp, Homo sapien
cgggtatcccagaatagaagagctg

SEQ ID NO: 171848 - DNA, 25 bp, Homo sapien
cagcgacggcgggtatcccagaata

SEQ ID NO: 171849 - DNA, 25 bp, Homo sapien
ctcagaggccgttgtgacggagacc

SEQ ID NO: 171850 - DNA, 25 bp, Homo sapien
tctgccagctgctcagaggccgttg

SEQ ID NO: 171851 - DNA, 25 bp, Homo sapien
aggcaaacgacgaggccgcactctg

SEQ ID NO: 171852 - DNA, 25 bp, Homo sapien
cactccgagcacaagcgggcgaaca

SEQ ID NO: 171853 - DNA, 25 bp, Homo sapien
ctccgagcacaagcgggcgaacacg

SEQ ID NO: 171854 - DNA, 25 bp, Homo sapien
agcgggcgaacacgcacaacccaaa

SEQ ID NO: 171855 - DNA, 25 bp, Homo sapien
ctcactccgagcacaagcgggcgaa

SEQ ID NO: 171856 - DNA, 25 bp, Homo sapien
gggcgaacacgcacaacccaaaatc

SEQ ID NO: 171857 - DNA, 25 bp, Homo sapien
tcactccgagcacaagcgggcgaac

SEQ ID NO: 171858 - DNA, 25 bp, Homo sapien
tgcgctcactccgagcacaagcagg

SEQ ID NO: 171859 - DNA, 25 bp, Homo sapien
cactccgagcacaagtgggcgaaca

SEQ ID NO: 171860 - DNA, 25 bp, Homo sapien
tgctcatcgttattcccagtcaagg

SEQ ID NO: 171861 - DNA, 25 bp, Homo sapien
gaccacaagcgggtgaacacgccca

SEQ ID NO: 171862 - DNA, 25 bp, Homo sapien
cgaacatgcacaacccaaaatccat

SEQ ID NO: 171863 - DNA, 25 bp, Homo sapien
acaagtgggcgaacacgcaatctgc

SEQ ID NO: 171864 - DNA, 25 bp, Homo sapien
cgaacacgcaatctgctcatcgtta

SEQ ID NO: 171865 - DNA, 25 bp, Homo sapien
tacgtctttagccacagtcggagcc

SEQ ID NO: 171866 - DNA, 25 bp, Homo sapien
tattcccagtcaaggccgaagcccg

SEQ ID NO: 171867 - DNA, 25 bp, Homo sapien
ggccgaagcccgatctacgtcttta

SEQ ID NO: 171868 - DNA, 25 bp, Homo sapien
aagagacacgtgtgcacccgtgcga

SEQ ID NO: 171869 - DNA, 25 bp, Homo sapien
gcagcatcacgccacaagagacacg

SEQ ID NO: 171870 - DNA, 25 bp, Homo sapien
gctctgatctcacaaatgaacaccc

SEQ ID NO: 171871 - DNA, 25 bp, Homo sapien
gctgcaccagagctctgatctcaca

SEQ ID NO: 171872 - DNA, 25 bp, Homo sapien
gtgcctcggagctggctgcaccaga

SEQ ID NO: 171873 - DNA, 25 bp, Homo sapien
ttctcacagcaggaggtgcctcgga

SEQ ID NO: 171874 - DNA, 25 bp, Homo sapien
cgtggccagttctcacagcaggagg

SEQ ID NO: 171875 - DNA, 25 bp, Homo sapien
cgtgcgagcgacagcctgaaacaca

SEQ ID NO: 171876 - DNA, 25 bp, Homo sapien
acggtgagcacccacggcagcacat

SEQ ID NO: 171877 - DNA, 25 bp, Homo sapien
atgcacctctgttgaccgatgcacg

SEQ ID NO: 171878 - DNA, 25 bp, Homo sapien
gggcaccgagccatctcccatcctg

SEQ ID NO: 171879 - DNA, 25 bp, Homo sapien
tcccatcctgcgtcccttcatggca

SEQ ID NO: 171880 - DNA, 25 bp, Homo sapien
caccaccatgtcaaccctgccagtg

SEQ ID NO: 171881 - DNA, 25 bp, Homo sapien
tgcggaccacgccacccaccacggt

SEQ ID NO: 171882 - DNA, 25 bp, Homo sapien
gcacatgcacctctgttgaccgatg

SEQ ID NO: 171883 - DNA, 25 bp, Homo sapien
agtggcctccgcacactgcggacca

SEQ ID NO: 171884 - DNA, 25 bp, Homo sapien
atgctcctgacagcaccgagccggg

SEQ ID NO: 171885 - DNA, 25 bp, Homo sapien
ggcacggcttcagctgcctttctcg

SEQ ID NO: 171886 - DNA, 25 bp, Homo sapien
acagaggaggctacggtcacgccgc

SEQ ID NO: 171887 - DNA, 25 bp, Homo sapien
gcttgactgacagttcccgccggca

SEQ ID NO: 171888 - DNA, 25 bp, Homo sapien
tgcgcctggaatcccgaaggagcct

SEQ ID NO: 171889 - DNA, 25 bp, Homo sapien
atagtttccggtctgtgctctgtga

SEQ ID NO: 171890 - DNA, 25 bp, Homo sapien
tcgcgcatttccgtggttcccgcat

SEQ ID NO: 171891 - DNA, 25 bp, Homo sapien
ctgcctttctcggtttctgtcgcca

SEQ ID NO: 171892 - DNA, 25 bp, Homo sapien
tgaactcgcgcactcacccgccggt

SEQ ID NO: 171893 - DNA, 25 bp, Homo sapien
ggagagcctcacgtcatggtgttgc

SEQ ID NO: 171894 - DNA, 25 bp, Homo sapien
acgctccttcccgttcgcatgagaa

SEQ ID NO: 171895 - DNA, 25 bp, Homo sapien
tgcgattggcgcgtgcgcgcacatc

SEQ ID NO: 171896 - DNA, 25 bp, Homo sapien
cttcttggcctctccgcgcgtacac

SEQ ID NO: 171897 - DNA, 25 bp, Homo sapien
ttcgcatgagaacacacagctccca

SEQ ID NO: 171898 - DNA, 25 bp, Homo sapien
gctgattgggcgcacccgacgctcg

SEQ ID NO: 171899 - DNA, 25 bp, Homo sapien
tcacgtcatggtgttgcggcgcgct

SEQ ID NO: 171900 - DNA, 25 bp, Homo sapien
acggcgccacagttttacacgtggg

SEQ ID NO: 171901 - DNA, 25 bp, Homo sapien
aaacggcgccacagtgttacacgtg

SEQ ID NO: 171902 - DNA, 25 bp, Homo sapien
aaacggcgccacagttttacacgtg

SEQ ID NO: 171903 - DNA, 25 bp, Homo sapien
aacggcgccacagtcttacacgtgg

SEQ ID NO: 171904 - DNA, 25 bp, Homo sapien
cacgctaaacggctccacagtctta

SEQ ID NO: 171905 - DNA, 25 bp, Homo sapien
aaacggcgccacagtcttacacgtg

SEQ ID NO: 171906 - DNA, 25 bp, Homo sapien
cgctaaacggctccacagtcttaca

SEQ ID NO: 171907 - DNA, 25 bp, Homo sapien
gtccacgctaaacggcgccacagtg

SEQ ID NO: 171908 - DNA, 25 bp, Homo sapien
ctcgggacattgtctacgcacagaa

SEQ ID NO: 171909 - DNA, 25 bp, Homo sapien
tgatgtacatgcttgggacactgtc

SEQ ID NO: 171910 - DNA, 25 bp, Homo sapien
gacgtacacgctcgggacattgtct

SEQ ID NO: 171911 - DNA, 25 bp, Homo sapien
gtacatgcttgggacactgtctaca

SEQ ID NO: 171912 - DNA, 25 bp, Homo sapien
cggtgacgtacacgctcgggacatt

SEQ ID NO: 171913 - DNA, 25 bp, Homo sapien
tcgggacattgtctacgcacagaaa

SEQ ID NO: 171914 - DNA, 25 bp, Homo sapien
cgggacattgtctacgcacagaaaa

SEQ ID NO: 171915 - DNA, 25 bp, Homo sapien
tgacgtacacgctcgggacattgtc

SEQ ID NO: 171916 - DNA, 25 bp, Homo sapien
gggatattctagttggcgcttcttc

SEQ ID NO: 171917 - DNA, 25 bp, Homo sapien
ggcgggctacagtggctcaatagaa

SEQ ID NO: 171918 - DNA, 25 bp, Homo sapien
ctccttagacgctctcggtacagtg

SEQ ID NO: 171919 - DNA, 25 bp, Homo sapien
tgccacatgcagtcgagtcattaga

SEQ ID NO: 171920 - DNA, 25 bp, Homo sapien
cgagccggttttattgtgtggatca

SEQ ID NO: 171921 - DNA, 25 bp, Homo sapien
ttcttctgaagcacgcagccgggtt

SEQ ID NO: 171922 - DNA, 25 bp, Homo sapien
gtgctattgttaaccgctttccgag

SEQ ID NO: 171923 - DNA, 25 bp, Homo sapien
cagccgagcctgtctttgagagacc

SEQ ID NO: 171924 - DNA, 25 bp, Homo sapien
gtccgcgccgcgtatctctgcgtgt

SEQ ID NO: 171925 - DNA, 25 bp, Homo sapien
caggacgaagcctcccgtgtcggcg

SEQ ID NO: 171926 - DNA, 25 bp, Homo sapien
aggacgaagcctcccgtgtcggcgc

SEQ ID NO: 171927 - DNA, 25 bp, Homo sapien
tccgcgccgcgtatctctgcgtgtg

SEQ ID NO: 171928 - DNA, 25 bp, Homo sapien
ccgcaccgcgtatctctgcgtgtgg

SEQ ID NO: 171929 - DNA, 25 bp, Homo sapien
tgtccgcaccgcgtatctctgcgtg

SEQ ID NO: 171930 - DNA, 25 bp, Homo sapien
ccgcgccgcgtatctctgcgtgtgg

SEQ ID NO: 171931 - DNA, 25 bp, Homo sapien
gcaggacgaagcctcccgtgtcggc

SEQ ID NO: 171932 - DNA, 25 bp, Homo sapien
gtctggagtatcgactcccttcgtc

SEQ ID NO: 171933 - DNA, 25 bp, Homo sapien
tctggagtatcgactcccttcgtcc

SEQ ID NO: 171934 - DNA, 25 bp, Homo sapien
gtctggagtatcgactcccttcctc

SEQ ID NO: 171935 - DNA, 25 bp, Homo sapien
tgagtctggagtatcgactcccttc

SEQ ID NO: 171936 - DNA, 25 bp, Homo sapien
ggagtatcgactcccttcgtcctcg

SEQ ID NO: 171937 - DNA, 25 bp, Homo sapien
ctgagtctggagtatcgactccctt

SEQ ID NO: 171938 - DNA, 25 bp, Homo sapien
tggagtatcgactcccttcgtcctc

SEQ ID NO: 171939 - DNA, 25 bp, Homo sapien
tgctgagtctggagtatcgactccc

SEQ ID NO: 171940 - DNA, 25 bp, Homo sapien
atcgggtctgagagctgctcaccga

SEQ ID NO: 171941 - DNA, 25 bp, Homo sapien
gggagtccacgttctcgaaaatgca

SEQ ID NO: 171942 - DNA, 25 bp, Homo sapien
ctgggtgattctgcacgcccggctc

SEQ ID NO: 171943 - DNA, 25 bp, Homo sapien
gacccatgcctcctctagcaaatcg

SEQ ID NO: 171944 - DNA, 25 bp, Homo sapien
aacagcatctcagccgttgtccgac

SEQ ID NO: 171945 - DNA, 25 bp, Homo sapien
ccgttgtccgacactgggtgattct

SEQ ID NO: 171946 - DNA, 25 bp, Homo sapien
ttctcgaaaatgcagggtgaccctg

SEQ ID NO: 171947 - DNA, 25 bp, Homo sapien
tgcctgggagtccacgttctcgaaa

SEQ ID NO: 171948 - DNA, 25 bp, Homo sapien
cgagtctcggctcagcaccaccacc

SEQ ID NO: 171949 - DNA, 25 bp, Homo sapien
cgatgcgtccacactgccacggcca

SEQ ID NO: 171950 - DNA, 25 bp, Homo sapien
gatgcgtccacactgccgccgacca

SEQ ID NO: 171951 - DNA, 25 bp, Homo sapien
tgcgtccacactgccacggccacag

SEQ ID NO: 171952 - DNA, 25 bp, Homo sapien
tgcgtccatgctgccacagccacgg

SEQ ID NO: 171953 - DNA, 25 bp, Homo sapien
tgatgcgtccacactgccacggcca

SEQ ID NO: 171954 - DNA, 25 bp, Homo sapien
atgcgtccacactgccacggccacg

SEQ ID NO: 171955 - DNA, 25 bp, Homo sapien
cgatgcgtccatgctgccacagcca

SEQ ID NO: 171956 - DNA, 25 bp, Homo sapien
tcagcatcgtgtgggtctagctctg

SEQ ID NO: 171957 - DNA, 25 bp, Homo sapien
tctagctctgggaatcgaggcagcc

SEQ ID NO: 171958 - DNA, 25 bp, Homo sapien
ccagaacacccttggggcgcaactt

SEQ ID NO: 171959 - DNA, 25 bp, Homo sapien
ctcgcggcggcacgagactcagcat

SEQ ID NO: 171960 - DNA, 25 bp, Homo sapien
tcctgctgtggcttccaaagagacg

SEQ ID NO: 171961 - DNA, 25 bp, Homo sapien
ttccaaagagacgtcaccagaggcg

SEQ ID NO: 171962 - DNA, 25 bp, Homo sapien
cgagactcagcatcgtgtgggtcta

SEQ ID NO: 171963 - DNA, 25 bp, Homo sapien
gcaggcgactgggtctctttgaccg

SEQ ID NO: 171964 - DNA, 25 bp, Homo sapien
gccgagttctaacgggctgagcctc

SEQ ID NO: 171965 - DNA, 25 bp, Homo sapien
accagctgcagaccgagttctaacg

SEQ ID NO: 171966 - DNA, 25 bp, Homo sapien
ctcaaaccagctgcaggccgagttc

SEQ ID NO: 171967 - DNA, 25 bp, Homo sapien
gccgagttctaacgggctgagccac

SEQ ID NO: 171968 - DNA, 25 bp, Homo sapien
cggagttctaaggagctgagcctca

SEQ ID NO: 171969 - DNA, 25 bp, Homo sapien
acgggctgagccacaaacgagctgc

SEQ ID NO: 171970 - DNA, 25 bp, Homo sapien
cgggctgagccacaaacgagctgca

SEQ ID NO: 171971 - DNA, 25 bp, Homo sapien
caaaccagctgcaggccgagttcta

SEQ ID NO: 171972 - DNA, 25 bp, Homo sapien
ccaccatggcgagtgatgtccgtac

SEQ ID NO: 171973 - DNA, 25 bp, Homo sapien
cccaccacggcgagtgatgtccgta

SEQ ID NO: 171974 - DNA, 25 bp, Homo sapien
gtccacccaccatggcgagtgatgt

SEQ ID NO: 171975 - DNA, 25 bp, Homo sapien
tccacccaccatggcgagtgatgtc

SEQ ID NO: 171976 - DNA, 25 bp, Homo sapien
tcagtccacccaccatggcgagtga

SEQ ID NO: 171977 - DNA, 25 bp, Homo sapien
caccatggcgagtgatgtccgtaca

SEQ ID NO: 171978 - DNA, 25 bp, Homo sapien
accatggcgagtgatgtccgtacag

SEQ ID NO: 171979 - DNA, 25 bp, Homo sapien
agtccacccaccatggcgagtgatg

SEQ ID NO: 171980 - DNA, 25 bp, Homo sapien
gacgctctgcacaaaagccaccatg

SEQ ID NO: 171981 - DNA, 25 bp, Homo sapien
tgctgtctttctgcagacgctctgc

SEQ ID NO: 171982 - DNA, 25 bp, Homo sapien
cctgggacttatctccgttgctgtc

SEQ ID NO: 171983 - DNA, 25 bp, Homo sapien
tctgggtgtgacaccagctgctgtc

SEQ ID NO: 171984 - DNA, 25 bp, Homo sapien
ctcacggttgcagccacgctttgtt

SEQ ID NO: 171985 - DNA, 25 bp, Homo sapien
ttctcagtgctgctgtgccttccga

SEQ ID NO: 171986 - DNA, 25 bp, Homo sapien
ttgcccgttgtcacagtcgaacagc

SEQ ID NO: 171987 - DNA, 25 bp, Homo sapien
tgcgcaggactctgcagcttccttc

SEQ ID NO: 171988 - DNA, 25 bp, Homo sapien
caagagaagttcacgtacaacgatc

SEQ ID NO: 171989 - DNA, 25 bp, Homo sapien
ccgacgtcagtggatttgacacctg

SEQ ID NO: 171990 - DNA, 25 bp, Homo sapien
gcggacgaactttgccaagagaagt

SEQ ID NO: 171991 - DNA, 25 bp, Homo sapien
ctgagcgattgactcgcggacgaac

SEQ ID NO: 171992 - DNA, 25 bp, Homo sapien
ttcacgctctggaagacccggagcc

SEQ ID NO: 171993 - DNA, 25 bp, Homo sapien
cggcggacactcaccgatcttgatc

SEQ ID NO: 171994 - DNA, 25 bp, Homo sapien
cacctgaagtgcaggcgcccagaca

SEQ ID NO: 171995 - DNA, 25 bp, Homo sapien
caacgatctggcaggggaggaatcc

SEQ ID NO: 171996 - DNA, 25 bp, Homo sapien
ccacttgctgggcatgcatcaccgt

SEQ ID NO: 171997 - DNA, 25 bp, Homo sapien
caaaatggttgaatagtatttggtt

SEQ ID NO: 171998 - DNA, 25 bp, Homo sapien
ttgctgggcatgcatcaccgtcatc

SEQ ID NO: 171999 - DNA, 25 bp, Homo sapien
gggcatgcatcaccgtcatctgcag

SEQ ID NO: 172000 - DNA, 25 bp, Homo sapien
tcaccgtcatctgcagccactttcc

SEQ ID NO: 172001 - DNA, 25 bp, Homo sapien
cccaatgccagaatcagaaattttc

SEQ ID NO: 172002 - DNA, 25 bp, Homo sapien
ggttattttttgataggatataatg

SEQ ID NO: 172003 - DNA, 25 bp, Homo sapien
ccagcacctgggcaacattctgccc

SEQ ID NO: 172004 - DNA, 25 bp, Homo sapien
tcgtctcaaattttctccttaagaa

SEQ ID NO: 172005 - DNA, 25 bp, Homo sapien
cacacaaatttaggtggccattgtc

SEQ ID NO: 172006 - DNA, 25 bp, Homo sapien
cagggtatcacacaaatttaggtgg

SEQ ID NO: 172007 - DNA, 25 bp, Homo sapien
ggccattgtcttcgtctcaaatttt

SEQ ID NO: 172008 - DNA, 25 bp, Homo sapien
tcgattaaaaaacaaggagatcctg

SEQ ID NO: 172009 - DNA, 25 bp, Homo sapien
aaaaacaaggagatcctgggatctc

SEQ ID NO: 172010 - DNA, 25 bp, Homo sapien
gggtggatcctggattctcctcgga

SEQ ID NO: 172011 - DNA, 25 bp, Homo sapien
ggtggccattgtcttcgtctcaaat

SEQ ID NO: 172012 - DNA, 25 bp, Homo sapien
ggcaactacagctagatgcattttc

SEQ ID NO: 172013 - DNA, 25 bp, Homo sapien
cacaggcaactacagctagatgcat

SEQ ID NO: 172014 - DNA, 25 bp, Homo sapien
acaggcaactacagctagatgcatt

SEQ ID NO: 172015 - DNA, 25 bp, Homo sapien
aggcaactacagctagatgcatttt

SEQ ID NO: 172016 - DNA, 25 bp, Homo sapien
gcaactacagctagatgcattttct

SEQ ID NO: 172017 - DNA, 25 bp, Homo sapien
tgtcccacccaccaggatgcacagc

SEQ ID NO: 172018 - DNA, 25 bp, Homo sapien
accacgtgcgggtagcgccgcatcg

SEQ ID NO: 172019 - DNA, 25 bp, Homo sapien
caggcaactacagctagatgcattt

SEQ ID NO: 172020 - DNA, 25 bp, Homo sapien
tctccgcgaagaacgtctctctctg

SEQ ID NO: 172021 - DNA, 25 bp, Homo sapien
gggtgactcttagaatgaccttgta

SEQ ID NO: 172022 - DNA, 25 bp, Homo sapien
aaggagggtgactcttagaatgacc

SEQ ID NO: 172023 - DNA, 25 bp, Homo sapien
ttgtggaccaattaaaaaatgccca

SEQ ID NO: 172024 - DNA, 25 bp, Homo sapien
accttggcttctaatttgtggacca

SEQ ID NO: 172025 - DNA, 25 bp, Homo sapien
tctccacttaaaaccttggcttcta

SEQ ID NO: 172026 - DNA, 25 bp, Homo sapien
ctctgcttcttatttgtatttctcc

SEQ ID NO: 172027 - DNA, 25 bp, Homo sapien
atgaccttgtaagtttctgagtttt

SEQ ID NO: 172028 - DNA, 25 bp, Homo sapien
gtgccctctcgcctctaactagaga

SEQ ID NO: 172029 - DNA, 25 bp, Homo sapien
gtcgtccagttcaccggcatgtttt

SEQ ID NO: 172030 - DNA, 25 bp, Homo sapien
gccatcacgagcgaagtgctgcttc

SEQ ID NO: 172031 - DNA, 25 bp, Homo sapien
gccagcagaagccacgttaaacgca

SEQ ID NO: 172032 - DNA, 25 bp, Homo sapien
gaacgcctcgcggtgtgagtgaaac

SEQ ID NO: 172033 - DNA, 25 bp, Homo sapien
gagtgaaactctggcggcctcgcta

SEQ ID NO: 172034 - DNA, 25 bp, Homo sapien
aaagtgtgtcccactcacgcgcagg

SEQ ID NO: 172035 - DNA, 25 bp, Homo sapien
gaaacccgtttcatgcggagccagc

SEQ ID NO: 172036 - DNA, 25 bp, Homo sapien
cccgtgcttacggtccccgatgagg

SEQ ID NO: 172037 - DNA, 25 bp, Homo sapien
cttacggtccccgatgaggcgtgac

SEQ ID NO: 172038 - DNA, 25 bp, Homo sapien
ttacggtccccgctgaggcgtgacg

SEQ ID NO: 172039 - DNA, 25 bp, Homo sapien
cccactgaggcgtgacggcgcgtcc

SEQ ID NO: 172040 - DNA, 25 bp, Homo sapien
cccactgaggcgtgacggcgcttcc

SEQ ID NO: 172041 - DNA, 25 bp, Homo sapien
ggtacggtccccactgaggcgtgac

SEQ ID NO: 172042 - DNA, 25 bp, Homo sapien
ccactgaggcgtgacggcgcttccc

SEQ ID NO: 172043 - DNA, 25 bp, Homo sapien
cgtgcttacggtccccgatgaggcg

SEQ ID NO: 172044 - DNA, 25 bp, Homo sapien
tgactctctcgccaatgcccagagg

SEQ ID NO: 172045 - DNA, 25 bp, Homo sapien
cgtccggcagtacctcgaccaggtg

SEQ ID NO: 172046 - DNA, 25 bp, Homo sapien
ccatgaacctagagcggctgcggaa

SEQ ID NO: 172047 - DNA, 25 bp, Homo sapien
atgggattcgtttgctgtggacttc

SEQ ID NO: 172048 - DNA, 25 bp, Homo sapien
tttcccgcgccagatgggattcgtt

SEQ ID NO: 172049 - DNA, 25 bp, Homo sapien
ccacgtgccaggagaggcatcggaa

SEQ ID NO: 172050 - DNA, 25 bp, Homo sapien
gtctgagcctcgttctgcacctggc

SEQ ID NO: 172051 - DNA, 25 bp, Homo sapien
ggcatcggaaccaacaactcgggtc

SEQ ID NO: 172052 - DNA, 25 bp, Homo sapien
aagtgcagttccaccgcgactcgca

SEQ ID NO: 172053 - DNA, 25 bp, Homo sapien
cggatgattttcagacggctaacgc

SEQ ID NO: 172054 - DNA, 25 bp, Homo sapien
acgcttaggaaagcgggtgcctttg

SEQ ID NO: 172055 - DNA, 25 bp, Homo sapien
tcagtaaaacgtgtccgttccgtca

SEQ ID NO: 172056 - DNA, 25 bp, Homo sapien
cctatatgggagtcgtgtgagcttt

SEQ ID NO: 172057 - DNA, 25 bp, Homo sapien
ctgtcggccctagaagtgcagttcc

SEQ ID NO: 172058 - DNA, 25 bp, Homo sapien
tggccgtctcgttgccttacgttcc

SEQ ID NO: 172059 - DNA, 25 bp, Homo sapien
tgccagcacacgactacttcgagtt

SEQ ID NO: 172060 - DNA, 25 bp, Homo sapien
acgcgatcggcgatctgattggccc

SEQ ID NO: 172061 - DNA, 25 bp, Homo sapien
tccagtcgccattcgggaggccgct

SEQ ID NO: 172062 - DNA, 25 bp, Homo sapien
tcctgcatccagtcgccattcggga

SEQ ID NO: 172063 - DNA, 25 bp, Homo sapien
gcgccacgcgatcggcgatctgatt

SEQ ID NO: 172064 - DNA, 25 bp, Homo sapien
gttttgcccacgcacttttggcaca

SEQ ID NO: 172065 - DNA, 25 bp, Homo sapien
gcgagccgctagttttgcccacgca

SEQ ID NO: 172066 - DNA, 25 bp, Homo sapien
cccggtgtcagtcgctgccgaggct

SEQ ID NO: 172067 - DNA, 25 bp, Homo sapien
tcgctgccgaggctggaaacattgc

SEQ ID NO: 172068 - DNA, 25 bp, Homo sapien
ccgacgaggcccgaaggcttaagct

SEQ ID NO: 172069 - DNA, 25 bp, Homo sapien
ggcttaagctctgacctggctaccg

SEQ ID NO: 172070 - DNA, 25 bp, Homo sapien
ctctgttactcagccgagcggccga

SEQ ID NO: 172071 - DNA, 25 bp, Homo sapien
tttatgttattgtgccgctgccgcc

SEQ ID NO: 172072 - DNA, 25 bp, Homo sapien
gttctgaaacacttcggcaagggtc

SEQ ID NO: 172073 - DNA, 25 bp, Homo sapien
gagagcgcttctgccggcaggtccc

SEQ ID NO: 172074 - DNA, 25 bp, Homo sapien
cgcgcccatagggaccgtattttgc

SEQ ID NO: 172075 - DNA, 25 bp, Homo sapien
gggaccgtattttgcttctcgatgc

SEQ ID NO: 172076 - DNA, 25 bp, Homo sapien
cgttcatgtgtccggccacctgata

SEQ ID NO: 172077 - DNA, 25 bp, Homo sapien
cacttagccgttgaggaggcggagt

SEQ ID NO: 172078 - DNA, 25 bp, Homo sapien
tgcccggtgccctcagggatggcct

SEQ ID NO: 172079 - DNA, 25 bp, Homo sapien
ccggtgccctcagggatggcctcga

SEQ ID NO: 172080 - DNA, 25 bp, Homo sapien
tagcggtagcgagagcaggaaaaaa

SEQ ID NO: 172081 - DNA, 25 bp, Homo sapien
gggcgtctgcccaactcttggcgga

SEQ ID NO: 172082 - DNA, 25 bp, Homo sapien
cgtctgcccaactcttggcggagcg

SEQ ID NO: 172083 - DNA, 25 bp, Homo sapien
cctgatacgagaggggcacttagcc

SEQ ID NO: 172084 - DNA, 25 bp, Homo sapien
cgaggattcagggacagtaagctct

SEQ ID NO: 172085 - DNA, 25 bp, Homo sapien
ccttagtgtcatgcggaggcgtagc

SEQ ID NO: 172086 - DNA, 25 bp, Homo sapien
ctctggctggctgccttagtgtcat

SEQ ID NO: 172087 - DNA, 25 bp, Homo sapien
ctggctgccttagtgtcatgcggag

SEQ ID NO: 172088 - DNA, 25 bp, Homo sapien
cgtagcgaggattcagggacagtaa

SEQ ID NO: 172089 - DNA, 25 bp, Homo sapien
ttcagggacagtaagctctgttctc

SEQ ID NO: 172090 - DNA, 25 bp, Homo sapien
cgggctcgcgagatcagctgcttct

SEQ ID NO: 172091 - DNA, 25 bp, Homo sapien
ggccgtcgacctgcggcctttgttc

SEQ ID NO: 172092 - DNA, 25 bp, Homo sapien
tggcagccgtggcatccttcttgcc

SEQ ID NO: 172093 - DNA, 25 bp, Homo sapien
tgcgcgctctctgtcttctcgggct

SEQ ID NO: 172094 - DNA, 25 bp, Homo sapien
gccgtggtgacttcggcagctttgg

SEQ ID NO: 172095 - DNA, 25 bp, Homo sapien
tctgcgcgctctctgtcttctcggg

SEQ ID NO: 172096 - DNA, 25 bp, Homo sapien
tccttggcagccgtggcatccttct

SEQ ID NO: 172097 - DNA, 25 bp, Homo sapien
gggcctcgccgccattagcagggac

SEQ ID NO: 172098 - DNA, 25 bp, Homo sapien
ctcttggcccgggccgtggtgactt

SEQ ID NO: 172099 - DNA, 25 bp, Homo sapien
cctcgccgccattagcagggacggg

SEQ ID NO: 172100 - DNA, 25 bp, Homo sapien
atctggcgactgtgccggcgcgccg

SEQ ID NO: 172101 - DNA, 25 bp, Homo sapien
aggcgtctgcaggaaccgccatcac

SEQ ID NO: 172102 - DNA, 25 bp, Homo sapien
caagtcccaggcgtctgcaggaacc

SEQ ID NO: 172103 - DNA, 25 bp, Homo sapien
tccgcaagtcccaggcgtctgcagg

SEQ ID NO: 172104 - DNA, 25 bp, Homo sapien
agccgtagcgccacgggagtgggcg

SEQ ID NO: 172105 - DNA, 25 bp, Homo sapien
agtcccaggcgtctgcaggaaccgc

SEQ ID NO: 172106 - DNA, 25 bp, Homo sapien
aactggatctggcgactgtgccggc

SEQ ID NO: 172107 - DNA, 25 bp, Homo sapien
cgtctgcaggaaccgccatcaccac

SEQ ID NO: 172108 - DNA, 25 bp, Homo sapien
tgtgcggatagccaagctcctgccg

SEQ ID NO: 172109 - DNA, 25 bp, Homo sapien
tcccgtcctcgtgaagaggagcgtt

SEQ ID NO: 172110 - DNA, 25 bp, Homo sapien
ctccctcaaggagtggagttagcga

SEQ ID NO: 172111 - DNA, 25 bp, Homo sapien
ggccttcggcctacaggctgagcaa

SEQ ID NO: 172112 - DNA, 25 bp, Homo sapien
tacaggctgagcaacgcggacaaca

SEQ ID NO: 172113 - DNA, 25 bp, Homo sapien
actcagcagccatcgctcggggcta

SEQ ID NO: 172114 - DNA, 25 bp, Homo sapien
tgcggctgtcccgtcctcgtgaaga

SEQ ID NO: 172115 - DNA, 25 bp, Homo sapien
ccctgccgtgagagggaagtagacc

SEQ ID NO: 172116 - DNA, 25 bp, Homo sapien
gcgcgcctcgatagaactggagaaa

SEQ ID NO: 172117 - DNA, 25 bp, Homo sapien
aacctctgaagcgacgcggggaata

SEQ ID NO: 172118 - DNA, 25 bp, Homo sapien
cacggtgatggacatggaaggaccc

SEQ ID NO: 172119 - DNA, 25 bp, Homo sapien
gagaagactgtggtgtcatcccgtc

SEQ ID NO: 172120 - DNA, 25 bp, Homo sapien
gggactccaagaagtacagcaggta

SEQ ID NO: 172121 - DNA, 25 bp, Homo sapien
cccgtcgggaatgaagggaaatgca

SEQ ID NO: 172122 - DNA, 25 bp, Homo sapien
tcgcgtgggagcgagaaatgtccct

SEQ ID NO: 172123 - DNA, 25 bp, Homo sapien
ggtaaagagaatagccacggcccgc

SEQ ID NO: 172124 - DNA, 25 bp, Homo sapien
tcaccgggacccacctgtggaaagc

SEQ ID NO: 172125 - DNA, 25 bp, Homo sapien
gcccagtcaagttctgtcttgccca

SEQ ID NO: 172126 - DNA, 25 bp, Homo sapien
cccgcgccgaggaggaaacgctaga

SEQ ID NO: 172127 - DNA, 25 bp, Homo sapien
tacgttccttcacatcgcgcacggt

SEQ ID NO: 172128 - DNA, 25 bp, Homo sapien
gctgctccgacaccgggaagccagt

SEQ ID NO: 172129 - DNA, 25 bp, Homo sapien
gccagtctccgcgaagatacgttcc

SEQ ID NO: 172130 - DNA, 25 bp, Homo sapien
tgcccaatccggacagttagcgaag

SEQ ID NO: 172131 - DNA, 25 bp, Homo sapien
acctgtggaaagcagagggacgctc

SEQ ID NO: 172132 - DNA, 25 bp, Homo sapien
cttctcggagtactgggtccactgg

SEQ ID NO: 172133 - DNA, 25 bp, Homo sapien
gtgcctttcccgatagccaagcaga

SEQ ID NO: 172134 - DNA, 25 bp, Homo sapien
acttgaagcaccgaggctgggatgc

SEQ ID NO: 172135 - DNA, 25 bp, Homo sapien
atgcccatgctggtgacgccttggg

SEQ ID NO: 172136 - DNA, 25 bp, Homo sapien
cttggggctcgcagttatacttggt

SEQ ID NO: 172137 - DNA, 25 bp, Homo sapien
tatacttggtgaccggtctacacgg

SEQ ID NO: 172138 - DNA, 25 bp, Homo sapien
tctacacggcgattcggtgctttcc

SEQ ID NO: 172139 - DNA, 25 bp, Homo sapien
ctttccggagtagcagattcatcta

SEQ ID NO: 172140 - DNA, 25 bp, Homo sapien
caagtgcaggaacggaggcaccgca

SEQ ID NO: 172141 - DNA, 25 bp, Homo sapien
ggacagcgagcaaggcgtatggaaa

SEQ ID NO: 172142 - DNA, 25 bp, Homo sapien
gcctggcgctcagcaagtgcaggaa

SEQ ID NO: 172143 - DNA, 25 bp, Homo sapien
cagaaaagtcaaccgggacagggcg

SEQ ID NO: 172144 - DNA, 25 bp, Homo sapien
gggctcggaggctctgcctctttga

SEQ ID NO: 172145 - DNA, 25 bp, Homo sapien
tgcctctttgagttccagaaaagtc

SEQ ID NO: 172146 - DNA, 25 bp, Homo sapien
tgagttccagaaaagtcaaccggga

SEQ ID NO: 172147 - DNA, 25 bp, Homo sapien
ggctgcctggcgctcagcaagtgca

SEQ ID NO: 172148 - DNA, 25 bp, Homo sapien
cagaccttattaggtgtattacatc

SEQ ID NO: 172149 - DNA, 25 bp, Homo sapien
gttgctcaagctgaactcaaactca

SEQ ID NO: 172150 - DNA, 25 bp, Homo sapien
tgtgcctagcttcaagaaaacgttt

SEQ ID NO: 172151 - DNA, 25 bp, Homo sapien
gtcactgtgcctagcttcaagaaaa

SEQ ID NO: 172152 - DNA, 25 bp, Homo sapien
ctacaggaacatgtcactgtgccta

SEQ ID NO: 172153 - DNA, 25 bp, Homo sapien
ttacatcaaaatccctgtcaccttt

SEQ ID NO: 172154 - DNA, 25 bp, Homo sapien
ggtgtattacatcaaaatccctgtc

SEQ ID NO: 172155 - DNA, 25 bp, Homo sapien
ggaacatgtcactgtgcctagcttc

SEQ ID NO: 172156 - DNA, 25 bp, Homo sapien
ctgccggaaggaggacttccaactg

SEQ ID NO: 172157 - DNA, 25 bp, Homo sapien
ggacagcccgttcataagccagttc

SEQ ID NO: 172158 - DNA, 25 bp, Homo sapien
cacattgtcgtaggtggagagtctc

SEQ ID NO: 172159 - DNA, 25 bp, Homo sapien
cgccatactggccacgctgggtatg

SEQ ID NO: 172160 - DNA, 25 bp, Homo sapien
gcctcgtccatgctgtggtccaggt

SEQ ID NO: 172161 - DNA, 25 bp, Homo sapien
gctccacggggcagcaagttacctt

SEQ ID NO: 172162 - DNA, 25 bp, Homo sapien
tgtgccaagagcacggctctccctg

SEQ ID NO: 172163 - DNA, 25 bp, Homo sapien
ggcagggtctgcaccttcttcccag

SEQ ID NO: 172164 - DNA, 25 bp, Homo sapien
acagccatgttcttggtggtctccg

SEQ ID NO: 172165 - DNA, 25 bp, Homo sapien
ggcctccaaagaacccagctgcaga

SEQ ID NO: 172166 - DNA, 25 bp, Homo sapien
agctgcagagcaagtccggctgacg

SEQ ID NO: 172167 - DNA, 25 bp, Homo sapien
ggaaagtttcccaacacagccatgt

SEQ ID NO: 172168 - DNA, 25 bp, Homo sapien
cctctctgctctgaaggaaagtttc

SEQ ID NO: 172169 - DNA, 25 bp, Homo sapien
atagatctgcttgtgaggctcacga

SEQ ID NO: 172170 - DNA, 25 bp, Homo sapien
ggtctgcgacctctgccgacctgag

SEQ ID NO: 172171 - DNA, 25 bp, Homo sapien
acctggactcctatccgggatattg

SEQ ID NO: 172172 - DNA, 25 bp, Homo sapien
tttaatccggattcagtccaggccg

SEQ ID NO: 172173 - DNA, 25 bp, Homo sapien
cttcgcctcggaaatggcccggatt

SEQ ID NO: 172174 - DNA, 25 bp, Homo sapien
cgcgattagactgggcattgggttt

SEQ ID NO: 172175 - DNA, 25 bp, Homo sapien
ggctgtcggccgatattcccgtgaa

SEQ ID NO: 172176 - DNA, 25 bp, Homo sapien
tattcccgtgaagtccctgccagct

SEQ ID NO: 172177 - DNA, 25 bp, Homo sapien
gctgcttcctcattcaaacccagag

SEQ ID NO: 172178 - DNA, 25 bp, Homo sapien
ctgtgctgcagagcgcaatttaatc

SEQ ID NO: 172179 - DNA, 25 bp, Homo sapien
cgcccgctctcgaagtgcatatcag

SEQ ID NO: 172180 - DNA, 25 bp, Homo sapien
cgccactgtaaaaggtgggttcgct

SEQ ID NO: 172181 - DNA, 25 bp, Homo sapien
aatctcgccctgattgttgctggcc

SEQ ID NO: 172182 - DNA, 25 bp, Homo sapien
acgttgtcgtccagagagcaagagc

SEQ ID NO: 172183 - DNA, 25 bp, Homo sapien
tcaggacgtgggcacgttgtcgtcc

SEQ ID NO: 172184 - DNA, 25 bp, Homo sapien
cctgccctgctgctttcgctgggag

SEQ ID NO: 172185 - DNA, 25 bp, Homo sapien
attctagcaccagagcagtcccttc

SEQ ID NO: 172186 - DNA, 25 bp, Homo sapien
agccttccgacgcacagcattctag

SEQ ID NO: 172187 - DNA, 25 bp, Homo sapien
cgaacaggtccaagcggctgccctg

SEQ ID NO: 172188 - DNA, 25 bp, Homo sapien
cggcaggatccaattagtccgtgta

SEQ ID NO: 172189 - DNA, 25 bp, Homo sapien
tagtccgtgtaaaatgagaggcatc

SEQ ID NO: 172190 - DNA, 25 bp, Homo sapien
tgtaaaatgagaggcatctggcttc

SEQ ID NO: 172191 - DNA, 25 bp, Homo sapien
cccgcctcttagtggctaaaggcag

SEQ ID NO: 172192 - DNA, 25 bp, Homo sapien
tcttagtggctaaaggcagggagcc

SEQ ID NO: 172193 - DNA, 25 bp, Homo sapien
cagtctcgggcctccaaccggacac

SEQ ID NO: 172194 - DNA, 25 bp, Homo sapien
ccagatgccgcggtgcaccgagcag

SEQ ID NO: 172195 - DNA, 25 bp, Homo sapien
cgggcggcaggatccaattagtccg

SEQ ID NO: 172196 - DNA, 25 bp, Homo sapien
gtcctacccacgaagaacagcaaac

SEQ ID NO: 172197 - DNA, 25 bp, Homo sapien
ccgtccagagcctgtctgagttctg

SEQ ID NO: 172198 - DNA, 25 bp, Homo sapien
ggtgatgcggaactgctcatcgcca

SEQ ID NO: 172199 - DNA, 25 bp, Homo sapien
tcatcgccagggaaacgcggcattc

SEQ ID NO: 172200 - DNA, 25 bp, Homo sapien
cgcggcattcggacagccgtccaga

SEQ ID NO: 172201 - DNA, 25 bp, Homo sapien
agagcctgtctgagttctgctgggc

SEQ ID NO: 172202 - DNA, 25 bp, Homo sapien
agccagagactgattcgctgcggtc

SEQ ID NO: 172203 - DNA, 25 bp, Homo sapien
cacccgggacagtttccagtcggct

SEQ ID NO: 172204 - DNA, 25 bp, Homo sapien
tggtgttctcgcaaaaggccgtttc

SEQ ID NO: 172205 - DNA, 25 bp, Homo sapien
acgctgactttgtaggctccgccaa

SEQ ID NO: 172206 - DNA, 25 bp, Homo sapien
ggcatgggctgttaggtagaatatc

SEQ ID NO: 172207 - DNA, 25 bp, Homo sapien
gggatgtccagctcccagctgcttg

SEQ ID NO: 172208 - DNA, 25 bp, Homo sapien
taccgggtgctcacctgttaggtcc

SEQ ID NO: 172209 - DNA, 25 bp, Homo sapien
aggacatgcacgtggtgttctcgca

SEQ ID NO: 172210 - DNA, 25 bp, Homo sapien
accatcgcttttgggaggacatgca

SEQ ID NO: 172211 - DNA, 25 bp, Homo sapien
cagggaggtcgccttgtaacttcac

SEQ ID NO: 172212 - DNA, 25 bp, Homo sapien
gatctcactcattttacaccgacta

SEQ ID NO: 172213 - DNA, 25 bp, Homo sapien
cgtgcactgcggcatctcgggaaac

SEQ ID NO: 172214 - DNA, 25 bp, Homo sapien
cacctgggaccacggcattgtcatg

SEQ ID NO: 172215 - DNA, 25 bp, Homo sapien
tacaccgactaattagatcccgccg

SEQ ID NO: 172216 - DNA, 25 bp, Homo sapien
tcgctggctctgaggcagaggtcca

SEQ ID NO: 172217 - DNA, 25 bp, Homo sapien
accagccacgcgagcaagagggagc

SEQ ID NO: 172218 - DNA, 25 bp, Homo sapien
ggctccttgcgtttagccaccaaga

SEQ ID NO: 172219 - DNA, 25 bp, Homo sapien
ccggggagaagccagatctcactca

SEQ ID NO: 172220 - DNA, 25 bp, Homo sapien
cagccctcaccacacgcacccgcgc

SEQ ID NO: 172221 - DNA, 25 bp, Homo sapien
catggaacagccctcaccacacgca

SEQ ID NO: 172222 - DNA, 25 bp, Homo sapien
tcacgctccgcaagcatggaacagc

SEQ ID NO: 172223 - DNA, 25 bp, Homo sapien
ctgtgacgggtgctgcatgcgctgc

SEQ ID NO: 172224 - DNA, 25 bp, Homo sapien
ccgcagcccaccaccgaatgcgctg

SEQ ID NO: 172225 - DNA, 25 bp, Homo sapien
tggaacagccctcaccacacgcacc

SEQ ID NO: 172226 - DNA, 25 bp, Homo sapien
cgagctgctgtgacgggtgctgcat

SEQ ID NO: 172227 - DNA, 25 bp, Homo sapien
cgctccgcaagcatggaacagccct

SEQ ID NO: 172228 - DNA, 25 bp, Homo sapien
aatggaccgcacttggtttacgccg

SEQ ID NO: 172229 - DNA, 25 bp, Homo sapien
ctgggagaggtaaatggaccgcact

SEQ ID NO: 172230 - DNA, 25 bp, Homo sapien
caggtggcatccacagccggtggcc

SEQ ID NO: 172231 - DNA, 25 bp, Homo sapien
acctacatagaagggtgagctgtgg

SEQ ID NO: 172232 - DNA, 25 bp, Homo sapien
ggctcccgagccacctacatagaag

SEQ ID NO: 172233 - DNA, 25 bp, Homo sapien
cgcatgcctactcgctgtggagcct

SEQ ID NO: 172234 - DNA, 25 bp, Homo sapien
ttggcggggtcaccgcgcatgccta

SEQ ID NO: 172235 - DNA, 25 bp, Homo sapien
aggcagcgccgttctcgctgggcct

SEQ ID NO: 172236 - DNA, 25 bp, Homo sapien
cgcacctgcctagaggatccagcta

SEQ ID NO: 172237 - DNA, 25 bp, Homo sapien
ggcagagcggaacgaccgcaatatc

SEQ ID NO: 172238 - DNA, 25 bp, Homo sapien
gctggctgcactagctagtccactc

SEQ ID NO: 172239 - DNA, 25 bp, Homo sapien
taggactacagggacctttgcagcc

SEQ ID NO: 172240 - DNA, 25 bp, Homo sapien
ccttgctcgcggtacttccgtaatc

SEQ ID NO: 172241 - DNA, 25 bp, Homo sapien
cccaagcagggacgatagccggaac

SEQ ID NO: 172242 - DNA, 25 bp, Homo sapien
acccggtttctcgtcaccagggctg

SEQ ID NO: 172243 - DNA, 25 bp, Homo sapien
acttccgtaatctaggctctccctg

SEQ ID NO: 172244 - DNA, 25 bp, Homo sapien
ctctatggcccggagacgcagcttc

SEQ ID NO: 172245 - DNA, 25 bp, Homo sapien
gtcccagcttcgagcgcctctatgg

SEQ ID NO: 172246 - DNA, 25 bp, Homo sapien
tgtttcttccctcggacacgcacga

SEQ ID NO: 172247 - DNA, 25 bp, Homo sapien
attgaaggacgcctccggtccctgt

SEQ ID NO: 172248 - DNA, 25 bp, Homo sapien
ctaagtcctcgtctctacatgcggg

SEQ ID NO: 172249 - DNA, 25 bp, Homo sapien
gggatcctttgcaagtccctgcgcc

SEQ ID NO: 172250 - DNA, 25 bp, Homo sapien
caagcgctgcatcccggagtaggcc

SEQ ID NO: 172251 - DNA, 25 bp, Homo sapien
agacgcagcttctctggcgggcccg

SEQ ID NO: 172252 - DNA, 25 bp, Homo sapien
ggacgctcgatgtccaggttgcgcc

SEQ ID NO: 172253 - DNA, 25 bp, Homo sapien
aggccttctcggctgagatgaccgg

SEQ ID NO: 172254 - DNA, 25 bp, Homo sapien
acggcactaggttggtctggaattc

SEQ ID NO: 172255 - DNA, 25 bp, Homo sapien
ctggaattccgtcaagtccacattc

SEQ ID NO: 172256 - DNA, 25 bp, Homo sapien
cccgtcaaatcgcagggaggccgtg

SEQ ID NO: 172257 - DNA, 25 bp, Homo sapien
gccgtgatggaggacacgatctgcc

SEQ ID NO: 172258 - DNA, 25 bp, Homo sapien
acagctgctcgtggtaggccttctc

SEQ ID NO: 172259 - DNA, 25 bp, Homo sapien
cacgatctgcccaatcaggcgattg

SEQ ID NO: 172260 - DNA, 25 bp, Homo sapien
gtccagtctgtttcccgcggtcttc

SEQ ID NO: 172261 - DNA, 25 bp, Homo sapien
tgcacgtccagtctgtttcccgcgg

SEQ ID NO: 172262 - DNA, 25 bp, Homo sapien
gggtgggactggacctttccctgca

SEQ ID NO: 172263 - DNA, 25 bp, Homo sapien
ccaggcccgtcgtcagtgtcctgag

SEQ ID NO: 172264 - DNA, 25 bp, Homo sapien
ggcatctagggctcctgggactcag

SEQ ID NO: 172265 - DNA, 25 bp, Homo sapien
gtgacaagctgtcgctggcatctag

SEQ ID NO: 172266 - DNA, 25 bp, Homo sapien
caggcctggtgacaagctgtcgctg

SEQ ID NO: 172267 - DNA, 25 bp, Homo sapien
gactcaggcacatggagctccctcg

SEQ ID NO: 172268 - DNA, 25 bp, Homo sapien
ctgcctgcgcccctggaaagccact

SEQ ID NO: 172269 - DNA, 25 bp, Homo sapien
ccactgggcctgcgacagccaggga

SEQ ID NO: 172270 - DNA, 25 bp, Homo sapien
ttcccgagcgccatctgcctgcgcc

SEQ ID NO: 172271 - DNA, 25 bp, Homo sapien
cctggcgtgagcctccttcccgagc

SEQ ID NO: 172272 - DNA, 25 bp, Homo sapien
ggggcacacagagcggacttccctc

SEQ ID NO: 172273 - DNA, 25 bp, Homo sapien
gagcggacttccctcagccacacgc

SEQ ID NO: 172274 - DNA, 25 bp, Homo sapien
acagagcggacttccctcagccaca

SEQ ID NO: 172275 - DNA, 25 bp, Homo sapien
cagctcgctggtatccttcgggggc

SEQ ID NO: 172276 - DNA, 25 bp, Homo sapien
gctgtactcacctggatgccggacc

SEQ ID NO: 172277 - DNA, 25 bp, Homo sapien
cccagcggaaccagggctgtactca

SEQ ID NO: 172278 - DNA, 25 bp, Homo sapien
ctggcgttcggctactaaagggaag

SEQ ID NO: 172279 - DNA, 25 bp, Homo sapien
agggggtcctcaatcctggactctc

SEQ ID NO: 172280 - DNA, 25 bp, Homo sapien
ttcctaccctccgaggcgtccgctg

SEQ ID NO: 172281 - DNA, 25 bp, Homo sapien
cggcatttaaggctggtgccacctc

SEQ ID NO: 172282 - DNA, 25 bp, Homo sapien
cagcccagcatgcaccaggtgcgtg

SEQ ID NO: 172283 - DNA, 25 bp, Homo sapien
agcatgcaccaggtgcgtgcagccc

SEQ ID NO: 172284 - DNA, 25 bp, Homo sapien
cgttgagtgccttggaagagtcccg

SEQ ID NO: 172285 - DNA, 25 bp, Homo sapien
tgagtcaggaccacgttcccgggca

SEQ ID NO: 172286 - DNA, 25 bp, Homo sapien
ccaagaggctcggaaggtgttcgca

SEQ ID NO: 172287 - DNA, 25 bp, Homo sapien
aacaagcgtggacgcgttgagtgcc

SEQ ID NO: 172288 - DNA, 25 bp, Homo sapien
cttgtgaggattgaacaagcgtgga

SEQ ID NO: 172289 - DNA, 25 bp, Homo sapien
agcggaggacacaaagcgccagctc

SEQ ID NO: 172290 - DNA, 25 bp, Homo sapien
ttcgcagcgtcctcacattggcgct

SEQ ID NO: 172291 - DNA, 25 bp, Homo sapien
ggtgttcgcagcgtcctcacattgg

SEQ ID NO: 172292 - DNA, 25 bp, Homo sapien
atggatgctcctccgggtcaatctc

SEQ ID NO: 172293 - DNA, 25 bp, Homo sapien
gggtcttctccttcctgaatttgca

SEQ ID NO: 172294 - DNA, 25 bp, Homo sapien
tttgcaaagccaggcgaaggccctc

SEQ ID NO: 172295 - DNA, 25 bp, Homo sapien
gacctcttcagattccttgccgaga

SEQ ID NO: 172296 - DNA, 25 bp, Homo sapien
cagtgcgcgtttatgctgcggtaaa

SEQ ID NO: 172297 - DNA, 25 bp, Homo sapien
tgtggtttgcccaattctgatcctg

SEQ ID NO: 172298 - DNA, 25 bp, Homo sapien
ttgacgccagaacatcctagggatc

SEQ ID NO: 172299 - DNA, 25 bp, Homo sapien
gtgtcgctgctgaaaaggcctccgt

SEQ ID NO: 172300 - DNA, 25 bp, Homo sapien
ggactccgcacctgcggaaggcgca

SEQ ID NO: 172301 - DNA, 25 bp, Homo sapien
agccggctctgtcaacctccacagg

SEQ ID NO: 172302 - DNA, 25 bp, Homo sapien
agccagcgccgtgaaaacgggaaga

SEQ ID NO: 172303 - DNA, 25 bp, Homo sapien
cggctgagagccagcgccgtgaaaa

SEQ ID NO: 172304 - DNA, 25 bp, Homo sapien
agctcagaggcaaggcctccacgtc

SEQ ID NO: 172305 - DNA, 25 bp, Homo sapien
gcgcagcgcgaaagctcagaggcaa

SEQ ID NO: 172306 - DNA, 25 bp, Homo sapien
cgcagacttccagcgcagcgcgaaa

SEQ ID NO: 172307 - DNA, 25 bp, Homo sapien
tccacaggctctacgctcagagcag

SEQ ID NO: 172308 - DNA, 25 bp, Homo sapien
aacgcctaacggagcgatggatctc

SEQ ID NO: 172309 - DNA, 25 bp, Homo sapien
gcgctgcccacaggaactcaagttc

SEQ ID NO: 172310 - DNA, 25 bp, Homo sapien
tgcgctaaagcgcaggcaccgctga

SEQ ID NO: 172311 - DNA, 25 bp, Homo sapien
tcctgtgggaagtgaggatctcacc

SEQ ID NO: 172312 - DNA, 25 bp, Homo sapien
attaccgctccgtgaagcctgggca

SEQ ID NO: 172313 - DNA, 25 bp, Homo sapien
caagttccgccacagccaggtcaga

SEQ ID NO: 172314 - DNA, 25 bp, Homo sapien
gacacctcaatctccgcagcattta

SEQ ID NO: 172315 - DNA, 25 bp, Homo sapien
cgcgaatgaacgaagccactgaact

SEQ ID NO: 172316 - DNA, 25 bp, Homo sapien
cgctctccgagtgcgagttttcgcc

SEQ ID NO: 172317 - DNA, 25 bp, Homo sapien
aattctgggcgccttctggcgacgg

SEQ ID NO: 172318 - DNA, 25 bp, Homo sapien
gccttctggcgacggtccctgctag

SEQ ID NO: 172319 - DNA, 25 bp, Homo sapien
cgacggtccctgctagggacgctgc

SEQ ID NO: 172320 - DNA, 25 bp, Homo sapien
caaactgacaagggacccggaacag

SEQ ID NO: 172321 - DNA, 25 bp, Homo sapien
tgataaagcacgcagaaccgcaatc

SEQ ID NO: 172322 - DNA, 25 bp, Homo sapien
tttcgccaaactgataaagcacgca

SEQ ID NO: 172323 - DNA, 25 bp, Homo sapien
cgagtgcgagttttcgccaaactga

SEQ ID NO: 172324 - DNA, 25 bp, Homo sapien
ggcaacaacaagcaattcagtcagt

SEQ ID NO: 172325 - DNA, 25 bp, Homo sapien
acaagcaattcagtcagtccgtgga

SEQ ID NO: 172326 - DNA, 25 bp, Homo sapien
ccatgggctgatgtggcttaccgga

SEQ ID NO: 172327 - DNA, 25 bp, Homo sapien
tgccaccgctgcagtcagcccaccg

SEQ ID NO: 172328 - DNA, 25 bp, Homo sapien
tccaacggctcccgatgctcagaga

SEQ ID NO: 172329 - DNA, 25 bp, Homo sapien
gtggaccttggcacagactctcagc

SEQ ID NO: 172330 - DNA, 25 bp, Homo sapien
tcagtccgtggaccttggcacagac

SEQ ID NO: 172331 - DNA, 25 bp, Homo sapien
cgcccatgggctgatgtggcttacc

SEQ ID NO: 172332 - DNA, 25 bp, Homo sapien
agacacaggcttacgcagggtccct

SEQ ID NO: 172333 - DNA, 25 bp, Homo sapien
ccatgagcaggagcgcctcggggtt

SEQ ID NO: 172334 - DNA, 25 bp, Homo sapien
tcacgctgggagctggccatgagca

SEQ ID NO: 172335 - DNA, 25 bp, Homo sapien
ctccatgtcacgctgggagctggcc

SEQ ID NO: 172336 - DNA, 25 bp, Homo sapien
ccagtcctccatgtcacgctgggag

SEQ ID NO: 172337 - DNA, 25 bp, Homo sapien
gatgactcggcggatggcctgcacc

SEQ ID NO: 172338 - DNA, 25 bp, Homo sapien
gatctacgggcagtacctccgccca

SEQ ID NO: 172339 - DNA, 25 bp, Homo sapien
gcccagatgactcggcggatggcct

SEQ ID NO: 172340 - DNA, 25 bp, Homo sapien
cccttcttttatctggagacgctga

SEQ ID NO: 172341 - DNA, 25 bp, Homo sapien
tggagacgctgagcctcatcaactc

SEQ ID NO: 172342 - DNA, 25 bp, Homo sapien
tcgggatgtcgcctttccctggaga

SEQ ID NO: 172343 - DNA, 25 bp, Homo sapien
gaccgcggcgaatcagtctccgctt

SEQ ID NO: 172344 - DNA, 25 bp, Homo sapien
tcctcatttgctcggccagcgcggg

SEQ ID NO: 172345 - DNA, 25 bp, Homo sapien
atcccgctccgagatggaagtggta

SEQ ID NO: 172346 - DNA, 25 bp, Homo sapien
ttgcggggatccgagcatcccgctc

SEQ ID NO: 172347 - DNA, 25 bp, Homo sapien
ccctggagatgagcagttctgcgtc

SEQ ID NO: 172348 - DNA, 25 bp, Homo sapien
tgtgctcagcctcagagccgtaggc

SEQ ID NO: 172349 - DNA, 25 bp, Homo sapien
agcctcagagccgtaggcgagagcg

SEQ ID NO: 172350 - DNA, 25 bp, Homo sapien
ctcagcctcagagccgtaggcgaga

SEQ ID NO: 172351 - DNA, 25 bp, Homo sapien
gtgctcagcctcagagccgtaggcg

SEQ ID NO: 172352 - DNA, 25 bp, Homo sapien
gtgtgctcagcctcagagccgtagg

SEQ ID NO: 172353 - DNA, 25 bp, Homo sapien
cgtgtgctcagcctcagagccgtag

SEQ ID NO: 172354 - DNA, 25 bp, Homo sapien
tccgtgtgctcagcctcagagccgt

SEQ ID NO: 172355 - DNA, 25 bp, Homo sapien
tgctcagcctcagagccgtaggcga

SEQ ID NO: 172356 - DNA, 25 bp, Homo sapien
acctgttcttctcgtctctgtcatc

SEQ ID NO: 172357 - DNA, 25 bp, Homo sapien
tgtccctgcgcgtgacacaaatttg

SEQ ID NO: 172358 - DNA, 25 bp, Homo sapien
gcgccaagcaaagccgttacacgga

SEQ ID NO: 172359 - DNA, 25 bp, Homo sapien
ccgcctccggaaccctatatgagga

SEQ ID NO: 172360 - DNA, 25 bp, Homo sapien
catggctccgtctaccggcttcgga

SEQ ID NO: 172361 - DNA, 25 bp, Homo sapien
cacgccactcttcggcagagaaagg

SEQ ID NO: 172362 - DNA, 25 bp, Homo sapien
gggctccagttcctattacctgttc

SEQ ID NO: 172363 - DNA, 25 bp, Homo sapien
cagagaaaggatccgccgcatcgtc

SEQ ID NO: 172364 - DNA, 25 bp, Homo sapien
gcagcggcacacgtttgtactttga

SEQ ID NO: 172365 - DNA, 25 bp, Homo sapien
tccgtgtctgcatgagagtccattc

SEQ ID NO: 172366 - DNA, 25 bp, Homo sapien
ggagcggacagaacatccgtgtctg

SEQ ID NO: 172367 - DNA, 25 bp, Homo sapien
tgagagtccattcggatgcaggccg

SEQ ID NO: 172368 - DNA, 25 bp, Homo sapien
ggaactctttgaaggggacgcattc

SEQ ID NO: 172369 - DNA, 25 bp, Homo sapien
gcctctcagctcaggaactctttga

SEQ ID NO: 172370 - DNA, 25 bp, Homo sapien
ctgcgaagacaactccaggagcgga

SEQ ID NO: 172371 - DNA, 25 bp, Homo sapien
cccacacaaagaggggccactactt

SEQ ID NO: 172372 - DNA, 25 bp, Homo sapien
gctcctccaactacgcgtatgtgaa

SEQ ID NO: 172373 - DNA, 25 bp, Homo sapien
agcggctcctccaactacgcgtatg

SEQ ID NO: 172374 - DNA, 25 bp, Homo sapien
cggatctgcagggacttgatcacca

SEQ ID NO: 172375 - DNA, 25 bp, Homo sapien
ctactcctgtaacggaaaggtcgcg

SEQ ID NO: 172376 - DNA, 25 bp, Homo sapien
ggcacgcgctctactcctgtaacgg

SEQ ID NO: 172377 - DNA, 25 bp, Homo sapien
ctaagagaccaaggccttcctgctg

SEQ ID NO: 172378 - DNA, 25 bp, Homo sapien
gaactaagagaccaaggccttcctg

SEQ ID NO: 172379 - DNA, 25 bp, Homo sapien
tgaacttccagcatacgaaggacgc

SEQ ID NO: 172380 - DNA, 25 bp, Homo sapien
ggtgccacccgatttcctcttcttg

SEQ ID NO: 172381 - DNA, 25 bp, Homo sapien
ccacagcctgtaagagagtcaaagc

SEQ ID NO: 172382 - DNA, 25 bp, Homo sapien
caaatacgatctgccgacgggtctg

SEQ ID NO: 172383 - DNA, 25 bp, Homo sapien
cttgtctttcctgtgccagcgcatg

SEQ ID NO: 172384 - DNA, 25 bp, Homo sapien
agcgcccgttcttcttcagcagcga

SEQ ID NO: 172385 - DNA, 25 bp, Homo sapien
aagaagctgtgcgacttggccaccg

SEQ ID NO: 172386 - DNA, 25 bp, Homo sapien
cagcacctcggcaagtccgtcgtgg

SEQ ID NO: 172387 - DNA, 25 bp, Homo sapien
tgcctcttcctcttggtctgcaata

SEQ ID NO: 172388 - DNA, 25 bp, Homo sapien
tgagcgccgtctcctagaaacactt

SEQ ID NO: 172389 - DNA, 25 bp, Homo sapien
acccgaggcggtctttgtcatcccg

SEQ ID NO: 172390 - DNA, 25 bp, Homo sapien
gccggtctcacaggcgtaccatacg

SEQ ID NO: 172391 - DNA, 25 bp, Homo sapien
tccatcgcaaggagacgtcagccgg

SEQ ID NO: 172392 - DNA, 25 bp, Homo sapien
cgtccggatatgctccatcgcaagg

SEQ ID NO: 172393 - DNA, 25 bp, Homo sapien
tgaagactggcgatcccgcgcccga

SEQ ID NO: 172394 - DNA, 25 bp, Homo sapien
cggctacagaaacagggcggtgaca

SEQ ID NO: 172395 - DNA, 25 bp, Homo sapien
cgactaccttggtcgtccggatatg

SEQ ID NO: 172396 - DNA, 25 bp, Homo sapien
ggagcgtctaggtaaccgcactttc

SEQ ID NO: 172397 - DNA, 25 bp, Homo sapien
ccctaaagtgcggattatgtcagta

SEQ ID NO: 172398 - DNA, 25 bp, Homo sapien
tgggacggttgcatggattattttc

SEQ ID NO: 172399 - DNA, 25 bp, Homo sapien
gcagtacgcctattctcgcctggtc

SEQ ID NO: 172400 - DNA, 25 bp, Homo sapien
accagggctcattgcgtgacggtta

SEQ ID NO: 172401 - DNA, 25 bp, Homo sapien
gcgtacttttgcgtggttgctccac

SEQ ID NO: 172402 - DNA, 25 bp, Homo sapien
ttctccttcggaacgggagcgtcta

SEQ ID NO: 172403 - DNA, 25 bp, Homo sapien
agacatgtccacagggttctccttc

SEQ ID NO: 172404 - DNA, 25 bp, Homo sapien
gcgcaggcctggacaaagctcttaa

SEQ ID NO: 172405 - DNA, 25 bp, Homo sapien
cctgcgtaatattgcggatccctcc

SEQ ID NO: 172406 - DNA, 25 bp, Homo sapien
gctcttaagatgtccctgccgcgga

SEQ ID NO: 172407 - DNA, 25 bp, Homo sapien
gcgcctgcggttatgcgacactgcc

SEQ ID NO: 172408 - DNA, 25 bp, Homo sapien
cggctcgtccctgtacagatgtgtg

SEQ ID NO: 172409 - DNA, 25 bp, Homo sapien
cggcgcagagaagatgcagccttcc

SEQ ID NO: 172410 - DNA, 25 bp, Homo sapien
cgctgtgctgcagagctcaaaagca

SEQ ID NO: 172411 - DNA, 25 bp, Homo sapien
agggtccctcgagtgattctcacca

SEQ ID NO: 172412 - DNA, 25 bp, Homo sapien
cgacaagcagcttgggcgtccagcc

SEQ ID NO: 172413 - DNA, 25 bp, Homo sapien
tcccgcctggcggttgacttctttg

SEQ ID NO: 172414 - DNA, 25 bp, Homo sapien
ttgtgtcgtattctctgcctgcgcc

SEQ ID NO: 172415 - DNA, 25 bp, Homo sapien
gcgccctgtctctgcaggacctgtt

SEQ ID NO: 172416 - DNA, 25 bp, Homo sapien
gacctgttcgttcttctttgggcta

SEQ ID NO: 172417 - DNA, 25 bp, Homo sapien
ttccgcgacaaccagatcaggtagg

SEQ ID NO: 172418 - DNA, 25 bp, Homo sapien
tccagtagggtcatgcgaatgcagc

SEQ ID NO: 172419 - DNA, 25 bp, Homo sapien
cccgggccacgtctgttggagacca

SEQ ID NO: 172420 - DNA, 25 bp, Homo sapien
catctgctggaaatcacgggccgct

SEQ ID NO: 172421 - DNA, 25 bp, Homo sapien
gcgcttgctttatccgcaggctgaa

SEQ ID NO: 172422 - DNA, 25 bp, Homo sapien
caacccgagtgttcaggtgacaaga

SEQ ID NO: 172423 - DNA, 25 bp, Homo sapien
tggtgaagcaccacgccttacccga

SEQ ID NO: 172424 - DNA, 25 bp, Homo sapien
ttccacaacagggagccagcattga

SEQ ID NO: 172425 - DNA, 25 bp, Homo sapien
tatggaccgggcacatgcacacttc

SEQ ID NO: 172426 - DNA, 25 bp, Homo sapien
gaagtgtcctgaaaagcccacggtc

SEQ ID NO: 172427 - DNA, 25 bp, Homo sapien
tctgtctccttgtgcaacccgagtg

SEQ ID NO: 172428 - DNA, 25 bp, Homo sapien
gggcagaccctgctaatcaatagga

SEQ ID NO: 172429 - DNA, 25 bp, Homo sapien
cccaccgtccaagtttgtgacagag

SEQ ID NO: 172430 - DNA, 25 bp, Homo sapien
gcgggcgagaatgaatggtccctct

SEQ ID NO: 172431 - DNA, 25 bp, Homo sapien
aatggtccctctcccggcagttaag

SEQ ID NO: 172432 - DNA, 25 bp, Homo sapien
ccactcccacatggggaccgaggag

SEQ ID NO: 172433 - DNA, 25 bp, Homo sapien
cccttccaaagttaggagactcaga

SEQ ID NO: 172434 - DNA, 25 bp, Homo sapien
gccctttccaaagctgaggcaggtg

SEQ ID NO: 172435 - DNA, 25 bp, Homo sapien
ttcctcaagcagctctgctcgcagg

SEQ ID NO: 172436 - DNA, 25 bp, Homo sapien
taggtccaggagctcctaagccatc

SEQ ID NO: 172437 - DNA, 25 bp, Homo sapien
aatcttcccagcacgtcgccgaggg

SEQ ID NO: 172438 - DNA, 25 bp, Homo sapien
gctctgcgcagggtttaagcctcag

SEQ ID NO: 172439 - DNA, 25 bp, Homo sapien
ctcactcgagccgaatgaccgctgg

SEQ ID NO: 172440 - DNA, 25 bp, Homo sapien
gcctctggaggtttcactggcaacc

SEQ ID NO: 172441 - DNA, 25 bp, Homo sapien
aatctcgggatgcagtcagaaggcc

SEQ ID NO: 172442 - DNA, 25 bp, Homo sapien
ttgcactcgctgatggaaatctcgg

SEQ ID NO: 172443 - DNA, 25 bp, Homo sapien
agggactgccttatgagttgcactc

SEQ ID NO: 172444 - DNA, 25 bp, Homo sapien
accgcgtttctctgcaaggctgtcc

SEQ ID NO: 172445 - DNA, 25 bp, Homo sapien
cgcgtggagctttgagcagttaaaa

SEQ ID NO: 172446 - DNA, 25 bp, Homo sapien
gtagcgcgttccttcgctgtgctga

SEQ ID NO: 172447 - DNA, 25 bp, Homo sapien
gtcgcgctaccgactggcagtcagc

SEQ ID NO: 172448 - DNA, 25 bp, Homo sapien
cagtgcgtgtgtaagaccgcgtttc

SEQ ID NO: 172449 - DNA, 25 bp, Homo sapien
gagacgcttcggagcaggtctgtta

SEQ ID NO: 172450 - DNA, 25 bp, Homo sapien
cgagcctcggaattgggcctcctcg

SEQ ID NO: 172451 - DNA, 25 bp, Homo sapien
ggcgctataccttcggccacaggta

SEQ ID NO: 172452 - DNA, 25 bp, Homo sapien
tcgccgaggacaccgcccagggctt

SEQ ID NO: 172453 - DNA, 25 bp, Homo sapien
gtatcgataacgaggacaccgccca

SEQ ID NO: 172454 - DNA, 25 bp, Homo sapien
ctcgctgactgggtcgccgtccagg

SEQ ID NO: 172455 - DNA, 25 bp, Homo sapien
ggacgcagtccagctcatcgctgac

SEQ ID NO: 172456 - DNA, 25 bp, Homo sapien
gctaacgaggacaccgtccatggta

SEQ ID NO: 172457 - DNA, 25 bp, Homo sapien
gaggacaccgtccatggtatcccta

SEQ ID NO: 172458 - DNA, 25 bp, Homo sapien
cgtccatggtatccctaaagaggtc

SEQ ID NO: 172459 - DNA, 25 bp, Homo sapien
gtatccctaaagaggtcaccgtcca

SEQ ID NO: 172460 - DNA, 25 bp, Homo sapien
tggattccacggcatcgataacgag

SEQ ID NO: 172461 - DNA, 25 bp, Homo sapien
atcgccaactgggatgccgtccagg

SEQ ID NO: 172462 - DNA, 25 bp, Homo sapien
atcgctaacgaagatggattccacg

SEQ ID NO: 172463 - DNA, 25 bp, Homo sapien
ccgtccaggacatcgccaactggga

SEQ ID NO: 172464 - DNA, 25 bp, Homo sapien
tcgccaactgggatgctgtccagga

SEQ ID NO: 172465 - DNA, 25 bp, Homo sapien
cgctaacgaagatggattccacggc

SEQ ID NO: 172466 - DNA, 25 bp, Homo sapien
caactgggatgctgtccaggacatc

SEQ ID NO: 172467 - DNA, 25 bp, Homo sapien
aggaggccatccacggcatccctaa

SEQ ID NO: 172468 - DNA, 25 bp, Homo sapien
atcgccaactgggatgccgtccagg

SEQ ID NO: 172469 - DNA, 25 bp, Homo sapien
acatcgccaactgggatgccgtcca

SEQ ID NO: 172470 - DNA, 25 bp, Homo sapien
aggaggccatccacggcatccctaa

SEQ ID NO: 172471 - DNA, 25 bp, Homo sapien
ggacatcgctaacgaagatggattc

SEQ ID NO: 172472 - DNA, 25 bp, Homo sapien
agggcatcgccacctggcacgccgt

SEQ ID NO: 172473 - DNA, 25 bp, Homo sapien
gaagatggattccacggcatcgata

SEQ ID NO: 172474 - DNA, 25 bp, Homo sapien
gggcatcgccacctggcacgccgtc

SEQ ID NO: 172475 - DNA, 25 bp, Homo sapien
atgccgtccaggacatcgccaactg

SEQ ID NO: 172476 - DNA, 25 bp, Homo sapien
tccacggattcgctgacaggcacgc

SEQ ID NO: 172477 - DNA, 25 bp, Homo sapien
gccgtccacggattcgctgacaggc

SEQ ID NO: 172478 - DNA, 25 bp, Homo sapien
gattcactgactgggacgccgtcca

SEQ ID NO: 172479 - DNA, 25 bp, Homo sapien
ccgtccagggattcactgactggga

SEQ ID NO: 172480 - DNA, 25 bp, Homo sapien
agcatcgataacaaggacgccgccc

SEQ ID NO: 172481 - DNA, 25 bp, Homo sapien
acagcatcgataacaaggacgccgc

SEQ ID NO: 172482 - DNA, 25 bp, Homo sapien
tgcattgctaacgaagatggattcc

SEQ ID NO: 172483 - DNA, 25 bp, Homo sapien
ttcgctgacaggcacgccgtccatg

SEQ ID NO: 172484 - DNA, 25 bp, Homo sapien
gcggaggtggtagatcttcagcaca

SEQ ID NO: 172485 - DNA, 25 bp, Homo sapien
cctggcttcccggtgagcaaattcg

SEQ ID NO: 172486 - DNA, 25 bp, Homo sapien
gatgcatctgaactccaccggctcg

SEQ ID NO: 172487 - DNA, 25 bp, Homo sapien
actgtcgctctctttggccacgtta

SEQ ID NO: 172488 - DNA, 25 bp, Homo sapien
gtcacggttttctctcgctcagtca

SEQ ID NO: 172489 - DNA, 25 bp, Homo sapien
aacggtcgggaacattctgagcctc

SEQ ID NO: 172490 - DNA, 25 bp, Homo sapien
ttgtatttcccgctatcttcctggc

SEQ ID NO: 172491 - DNA, 25 bp, Homo sapien
tcagtcacccggcagttgtatttcc

SEQ ID NO: 172492 - DNA, 25 bp, Homo sapien
ggcaactccaatcccagcttttttc

SEQ ID NO: 172493 - DNA, 25 bp, Homo sapien
gcaactccaatcccagcttttttcg

SEQ ID NO: 172494 - DNA, 25 bp, Homo sapien
tcgttagtaaggcactccggctgca

SEQ ID NO: 172495 - DNA, 25 bp, Homo sapien
tggcaactccaatcccagctttttt

SEQ ID NO: 172496 - DNA, 25 bp, Homo sapien
caactccaatcccagcttttttcgt

SEQ ID NO: 172497 - DNA, 25 bp, Homo sapien
cgttagtaaggcactccggctgcag

SEQ ID NO: 172498 - DNA, 25 bp, Homo sapien
ctccaatcccagcttttttcgttag

SEQ ID NO: 172499 - DNA, 25 bp, Homo sapien
tttcgttagtaaggcactccggctg

SEQ ID NO: 172500 - DNA, 25 bp, Homo sapien
gcaggtctgctcaggttgttgtcaa

SEQ ID NO: 172501 - DNA, 25 bp, Homo sapien
agccaggggactcgctggcaagcca

SEQ ID NO: 172502 - DNA, 25 bp, Homo sapien
gactcgctggcaagccaggggactg

SEQ ID NO: 172503 - DNA, 25 bp, Homo sapien
ctgatcgctggaaggaaatgggacc

SEQ ID NO: 172504 - DNA, 25 bp, Homo sapien
tcgctggaaggaaatgggaccgcgc

SEQ ID NO: 172505 - DNA, 25 bp, Homo sapien
ctaggcgcaggtctgctcaggttgt

SEQ ID NO: 172506 - DNA, 25 bp, Homo sapien
cgcaggtctgctcaggttgttgtca

SEQ ID NO: 172507 - DNA, 25 bp, Homo sapien
caagccaggggactcgctggcaagc

SEQ ID NO: 172508 - DNA, 25 bp, Homo sapien
ttccctgccaataacgaaatcatca

SEQ ID NO: 172509 - DNA, 25 bp, Homo sapien
ttacaaccctgagcgctgtcccttt

SEQ ID NO: 172510 - DNA, 25 bp, Homo sapien
ggccgggtggtgattacaaccctga

SEQ ID NO: 172511 - DNA, 25 bp, Homo sapien
gttgcgacctcaaagccctctgtgc

SEQ ID NO: 172512 - DNA, 25 bp, Homo sapien
ccctagactcgcagctgcggaagcg

SEQ ID NO: 172513 - DNA, 25 bp, Homo sapien
tcatcacggacattaggaaagcggg

SEQ ID NO: 172514 - DNA, 25 bp, Homo sapien
gtgcttctccatcgataccgggccg

SEQ ID NO: 172515 - DNA, 25 bp, Homo sapien
ctctgtggttcctagagcgctcccg

SEQ ID NO: 172516 - DNA, 25 bp, Homo sapien
cctgcctcaactccaagcagaagct

SEQ ID NO: 172517 - DNA, 25 bp, Homo sapien
ctgcgatctcgccacctgcctcaac

SEQ ID NO: 172518 - DNA, 25 bp, Homo sapien
accagggctgcgatctcgccacctg

SEQ ID NO: 172519 - DNA, 25 bp, Homo sapien
cacctcttcccggatttaggcgtgg

SEQ ID NO: 172520 - DNA, 25 bp, Homo sapien
tcttcccggatttaggcgtggacca

SEQ ID NO: 172521 - DNA, 25 bp, Homo sapien
ttcccggatttaggcgtggaccagc

SEQ ID NO: 172522 - DNA, 25 bp, Homo sapien
tgcacagccgtcccagcattttgtc

SEQ ID NO: 172523 - DNA, 25 bp, Homo sapien
tttaggcgtggaccagcaaggattg

SEQ ID NO: 172524 - DNA, 25 bp, Homo sapien
taggtctcgtagaagaggtcttcgc

SEQ ID NO: 172525 - DNA, 25 bp, Homo sapien
acccggattgtagaggtgccctaga

SEQ ID NO: 172526 - DNA, 25 bp, Homo sapien
ctcaggctgtagtaggtctcgtaga

SEQ ID NO: 172527 - DNA, 25 bp, Homo sapien
acctgatggcggagtcacgctcgcc

SEQ ID NO: 172528 - DNA, 25 bp, Homo sapien
ggcaatcccgtctcctttttcaggc

SEQ ID NO: 172529 - DNA, 25 bp, Homo sapien
cagctggcgatgaggggatccctca

SEQ ID NO: 172530 - DNA, 25 bp, Homo sapien
tgagcttttctcacccgctcaaagc

SEQ ID NO: 172531 - DNA, 25 bp, Homo sapien
ggtgccctagaaaagcctcatcgcc

SEQ ID NO: 172532 - DNA, 25 bp, Homo sapien
agctcctggttctccagttcctcga

SEQ ID NO: 172533 - DNA, 25 bp, Homo sapien
gaacactgtgccgaacccgcctttg

SEQ ID NO: 172534 - DNA, 25 bp, Homo sapien
cacttcctatgttgcgcccggaaca

SEQ ID NO: 172535 - DNA, 25 bp, Homo sapien
cgagtttacgatcttgaccgccaca

SEQ ID NO: 172536 - DNA, 25 bp, Homo sapien
tcaaccggggtcactcacgagttta

SEQ ID NO: 172537 - DNA, 25 bp, Homo sapien
cagttcctcgatggacaccaagggg

SEQ ID NO: 172538 - DNA, 25 bp, Homo sapien
tgactcggcgttctcactgcaatcc

SEQ ID NO: 172539 - DNA, 25 bp, Homo sapien
ctcaaagacgttctctgagcgagtc

SEQ ID NO: 172540 - DNA, 25 bp, Homo sapien
ggactacataaacctcgatgcatta

SEQ ID NO: 172541 - DNA, 25 bp, Homo sapien
gaagaaatgcgcctttcagccgccg

SEQ ID NO: 172542 - DNA, 25 bp, Homo sapien
cggccatcctttgctgaggctggaa

SEQ ID NO: 172543 - DNA, 25 bp, Homo sapien
ctgctgatcaatcactggaccaggg

SEQ ID NO: 172544 - DNA, 25 bp, Homo sapien
caagcggaccattaaagcctcagta

SEQ ID NO: 172545 - DNA, 25 bp, Homo sapien
ggacggctcgccttggactacataa

SEQ ID NO: 172546 - DNA, 25 bp, Homo sapien
atccacttgcttttgctcgtcctcg

SEQ ID NO: 172547 - DNA, 25 bp, Homo sapien
ggccgttcatgctgtcatccacttg

SEQ ID NO: 172548 - DNA, 25 bp, Homo sapien
cgcccggcttctgagtgtttgtaaa

SEQ ID NO: 172549 - DNA, 25 bp, Homo sapien
gctcggcctcggaacattcttctct

SEQ ID NO: 172550 - DNA, 25 bp, Homo sapien
ggcagctccgcacgtcactggggtc

SEQ ID NO: 172551 - DNA, 25 bp, Homo sapien
tctcattagagtaacgggcgcggtc

SEQ ID NO: 172552 - DNA, 25 bp, Homo sapien
cgtcgcttaaccgtttagttgctgg

SEQ ID NO: 172553 - DNA, 25 bp, Homo sapien
tgtaaacgtctgacctggggccgtc

SEQ ID NO: 172554 - DNA, 25 bp, Homo sapien
gtcccgtagagcctgtttctcatta

SEQ ID NO: 172555 - DNA, 25 bp, Homo sapien
ctgaaccggagggatttagagactg

SEQ ID NO: 172556 - DNA, 25 bp, Homo sapien
cctccgcccctagatggcgaggaga

SEQ ID NO: 172557 - DNA, 25 bp, Homo sapien
cggctgggccgcctgtcactgaact

SEQ ID NO: 172558 - DNA, 25 bp, Homo sapien
ctgggccgcctgtcactgaactggg

SEQ ID NO: 172559 - DNA, 25 bp, Homo sapien
cccgtctggccgcaatgagaggcag

SEQ ID NO: 172560 - DNA, 25 bp, Homo sapien
cgtctggccgcaatgagaggcagat

SEQ ID NO: 172561 - DNA, 25 bp, Homo sapien
ccctcgtcaccacagccctgacgcc

SEQ ID NO: 172562 - DNA, 25 bp, Homo sapien
gctcgcacgaatccgcgctgcccgc

SEQ ID NO: 172563 - DNA, 25 bp, Homo sapien
ccgccgctcgcacgaatccgcgctg

SEQ ID NO: 172564 - DNA, 25 bp, Homo sapien
ggggacggctctcctagagattacc

SEQ ID NO: 172565 - DNA, 25 bp, Homo sapien
ctggcatgcattcgccaccgccgcg

SEQ ID NO: 172566 - DNA, 25 bp, Homo sapien
ctcgagtgtcccagcatccgcatca

SEQ ID NO: 172567 - DNA, 25 bp, Homo sapien
ggggccttcttcagcccaagccctg

SEQ ID NO: 172568 - DNA, 25 bp, Homo sapien
tctcccacgccggagccgccagcag

SEQ ID NO: 172569 - DNA, 25 bp, Homo sapien
cagcgctggaggacaaccctgatgc

SEQ ID NO: 172570 - DNA, 25 bp, Homo sapien
gtggccgtgttctcgagtgtcccag

SEQ ID NO: 172571 - DNA, 25 bp, Homo sapien
gctggaggacaaccctgatgcctgg

SEQ ID NO: 172572 - DNA, 25 bp, Homo sapien
tgctcctcttcccattttgacagaa

SEQ ID NO: 172573 - DNA, 25 bp, Homo sapien
gccatgctgccgtctggccttggga

SEQ ID NO: 172574 - DNA, 25 bp, Homo sapien
ccattttgacagaactggactcaga

SEQ ID NO: 172575 - DNA, 25 bp, Homo sapien
tatggcgctgcacctatcggtattc

SEQ ID NO: 172576 - DNA, 25 bp, Homo sapien
ggaacatagccatctcacctgcttc

SEQ ID NO: 172577 - DNA, 25 bp, Homo sapien
gccactcaaggaacatagccatctc

SEQ ID NO: 172578 - DNA, 25 bp, Homo sapien
gcggcctggccactcaaggaacata

SEQ ID NO: 172579 - DNA, 25 bp, Homo sapien
acagaactggactcagaggatgccc

SEQ ID NO: 172580 - DNA, 25 bp, Homo sapien
ggtcaagctgaacgccttccagagc

SEQ ID NO: 172581 - DNA, 25 bp, Homo sapien
cccgagacccgggtgacactatcgt

SEQ ID NO: 172582 - DNA, 25 bp, Homo sapien
acactatcgtctccttcgttccagg

SEQ ID NO: 172583 - DNA, 25 bp, Homo sapien
cgcatctttagggtcaagctgaacg

SEQ ID NO: 172584 - DNA, 25 bp, Homo sapien
cgcaggaatggttcatggtgcagac

SEQ ID NO: 172585 - DNA, 25 bp, Homo sapien
tggtgcagacaaaatcgaagcctcg

SEQ ID NO: 172586 - DNA, 25 bp, Homo sapien
cggctgcaagtgcagcgcatcttta

SEQ ID NO: 172587 - DNA, 25 bp, Homo sapien
cggtcgaaggggaccaagctccaga

SEQ ID NO: 172588 - DNA, 25 bp, Homo sapien
cgcgggaaacaactttcaacgcatg

SEQ ID NO: 172589 - DNA, 25 bp, Homo sapien
cctagagcaccagtgggccagtcac

SEQ ID NO: 172590 - DNA, 25 bp, Homo sapien
cctccgccacgattgctttggtgga

SEQ ID NO: 172591 - DNA, 25 bp, Homo sapien
ggccacatctttattcgcgggaaac

SEQ ID NO: 172592 - DNA, 25 bp, Homo sapien
cctttccgagaagtaactgcgcaga

SEQ ID NO: 172593 - DNA, 25 bp, Homo sapien
ccaggccaggaagtgactcaagaaa

SEQ ID NO: 172594 - DNA, 25 bp, Homo sapien
aaacagtttgcgtgcgatgtggaca

SEQ ID NO: 172595 - DNA, 25 bp, Homo sapien
gctgcctctttggtcggccacatct

SEQ ID NO: 172596 - DNA, 25 bp, Homo sapien
gctttcgggagaccaacgtcacttc

SEQ ID NO: 172597 - DNA, 25 bp, Homo sapien
cacccgcttccagaggatggactta

SEQ ID NO: 172598 - DNA, 25 bp, Homo sapien
cagcgagctcatcctgtcggagaaa

SEQ ID NO: 172599 - DNA, 25 bp, Homo sapien
caggtcacagggattagggagattc

SEQ ID NO: 172600 - DNA, 25 bp, Homo sapien
gcgcgttccaatcgaggtcgcaatc

SEQ ID NO: 172601 - DNA, 25 bp, Homo sapien
acgtcacttcgtggcctctggcatt

SEQ ID NO: 172602 - DNA, 25 bp, Homo sapien
gcaatcctgtgcgtgacccttctcg

SEQ ID NO: 172603 - DNA, 25 bp, Homo sapien
tgtcccgccacctgatcggaaaata

SEQ ID NO: 172604 - DNA, 25 bp, Homo sapien
ctcgcctcagttttggcagtaatga

SEQ ID NO: 172605 - DNA, 25 bp, Homo sapien
tttcctagaagatgccagagttcgc

SEQ ID NO: 172606 - DNA, 25 bp, Homo sapien
ttcgcggatttctgcgctcaagcta

SEQ ID NO: 172607 - DNA, 25 bp, Homo sapien
aggctccatcctcaactttctcgga

SEQ ID NO: 172608 - DNA, 25 bp, Homo sapien
ggaaatcgctccgttctgcggcttg

SEQ ID NO: 172609 - DNA, 25 bp, Homo sapien
tctctgcgcgcacaaagcagctgcg

SEQ ID NO: 172610 - DNA, 25 bp, Homo sapien
ccgccaacttggaagaatctctctg

SEQ ID NO: 172611 - DNA, 25 bp, Homo sapien
ggcaactccaactccgggcgctgga

SEQ ID NO: 172612 - DNA, 25 bp, Homo sapien
aggtccggcgtttcaccgccagctc

SEQ ID NO: 172613 - DNA, 25 bp, Homo sapien
tccggcgtttcaccgccagctctgg

SEQ ID NO: 172614 - DNA, 25 bp, Homo sapien
gcccacgaagaagtgaaagcacgaa

SEQ ID NO: 172615 - DNA, 25 bp, Homo sapien
agaagtgaaagcacgaaaacaggga

SEQ ID NO: 172616 - DNA, 25 bp, Homo sapien
atggaacccaccactgcttctccga

SEQ ID NO: 172617 - DNA, 25 bp, Homo sapien
actgcttctccgaagctcgctctga

SEQ ID NO: 172618 - DNA, 25 bp, Homo sapien
aggaagtgcagtctcagcttccgta

SEQ ID NO: 172619 - DNA, 25 bp, Homo sapien
ggaagtgcagtctcagcttccgtag

SEQ ID NO: 172620 - DNA, 25 bp, Homo sapien
agccgcgctgaactctagccttctg

SEQ ID NO: 172621 - DNA, 25 bp, Homo sapien
gacttctctattaaagccgcgctga

SEQ ID NO: 172622 - DNA, 25 bp, Homo sapien
aggagactcggagacttctctatta

SEQ ID NO: 172623 - DNA, 25 bp, Homo sapien
taggactcgagttcctttcaaagga

SEQ ID NO: 172624 - DNA, 25 bp, Homo sapien
ggcctgaggtttgcctaggactcga

SEQ ID NO: 172625 - DNA, 25 bp, Homo sapien
tgacagttcactatgcgcagcgcga

SEQ ID NO: 172626 - DNA, 25 bp, Homo sapien
cggtcttataaatcagtcgtcgctg

SEQ ID NO: 172627 - DNA, 25 bp, Homo sapien
ctagccttctggcaagccgcggcaa

SEQ ID NO: 172628 - DNA, 25 bp, Homo sapien
ggaggtggaagcgatacccaccgcc

SEQ ID NO: 172629 - DNA, 25 bp, Homo sapien
gtcctcttggtgctgccggcttcag

SEQ ID NO: 172630 - DNA, 25 bp, Homo sapien
cgtattggtcctcttggtgctgccg

SEQ ID NO: 172631 - DNA, 25 bp, Homo sapien
gcccgtattggtcctcttggtgctg

SEQ ID NO: 172632 - DNA, 25 bp, Homo sapien
accgcccgtattggtcctcttggtg

SEQ ID NO: 172633 - DNA, 25 bp, Homo sapien
gcttccagcggccttttccgcgagt

SEQ ID NO: 172634 - DNA, 25 bp, Homo sapien
aagcgatacccaccgcccgtattgg

SEQ ID NO: 172635 - DNA, 25 bp, Homo sapien
gtggaagcgatacccaccgcccgta

SEQ ID NO: 172636 - DNA, 25 bp, Homo sapien
agaggccaggtcttctggaaccagg

SEQ ID NO: 172637 - DNA, 25 bp, Homo sapien
agcacactgtggatcacacgcatta

SEQ ID NO: 172638 - DNA, 25 bp, Homo sapien
agtcagcacttctcagcacactgtg

SEQ ID NO: 172639 - DNA, 25 bp, Homo sapien
acacgcattagcctggcacctggca

SEQ ID NO: 172640 - DNA, 25 bp, Homo sapien
gggattgggaggcactccagtcaca

SEQ ID NO: 172641 - DNA, 25 bp, Homo sapien
cgcatcctcaggcaggacggagctc

SEQ ID NO: 172642 - DNA, 25 bp, Homo sapien
tcccagcgagtcagaagggtgcagc

SEQ ID NO: 172643 - DNA, 25 bp, Homo sapien
ctggacgctcgtcttggaatgactc

SEQ ID NO: 172644 - DNA, 25 bp, Homo sapien
cctctcatttcggaaggccatcaga

SEQ ID NO: 172645 - DNA, 25 bp, Homo sapien
cgcccaggcctcaggaatcgagtaa

SEQ ID NO: 172646 - DNA, 25 bp, Homo sapien
tgcgctagactattacctacaaagg

SEQ ID NO: 172647 - DNA, 25 bp, Homo sapien
agggcacaattttcctgctggctca

SEQ ID NO: 172648 - DNA, 25 bp, Homo sapien
ctcggaaaagtagtgcctcgcctct

SEQ ID NO: 172649 - DNA, 25 bp, Homo sapien
ccggaaatgtgagctattggcccta

SEQ ID NO: 172650 - DNA, 25 bp, Homo sapien
gcatgtgttacctgatttatttcga

SEQ ID NO: 172651 - DNA, 25 bp, Homo sapien
ttggtactgttttctctctgggcac

SEQ ID NO: 172652 - DNA, 25 bp, Homo sapien
aactactggatgctggacccgtcga

SEQ ID NO: 172653 - DNA, 25 bp, Homo sapien
ggcaagtacgagaagccgccgttca

SEQ ID NO: 172654 - DNA, 25 bp, Homo sapien
ccgtcaatgacttcgcagagcagca

SEQ ID NO: 172655 - DNA, 25 bp, Homo sapien
tgccctacagctccgtgttgactca

SEQ ID NO: 172656 - DNA, 25 bp, Homo sapien
tctgtccctcaacaagtgcttcgtg

SEQ ID NO: 172657 - DNA, 25 bp, Homo sapien
acgacgtgttcatcggcggcaccac

SEQ ID NO: 172658 - DNA, 25 bp, Homo sapien
cagagcagcacgtccatgagcgcca

SEQ ID NO: 172659 - DNA, 25 bp, Homo sapien
tttgagttacaacggcaccacgtcg

SEQ ID NO: 172660 - DNA, 25 bp, Homo sapien
tcggtagtacgctcgagagcctctc

SEQ ID NO: 172661 - DNA, 25 bp, Homo sapien
cagacacaggttggctcggcccgaa

SEQ ID NO: 172662 - DNA, 25 bp, Homo sapien
acttgaagtcgttgtggcagggacc

SEQ ID NO: 172663 - DNA, 25 bp, Homo sapien
tcggcccgaagcgaatttgggactc

SEQ ID NO: 172664 - DNA, 25 bp, Homo sapien
tctcgtcgcggtgtcctattaatta

SEQ ID NO: 172665 - DNA, 25 bp, Homo sapien
taattagcttttcccggcgcctcag

SEQ ID NO: 172666 - DNA, 25 bp, Homo sapien
ctctgtcccagagtggctgagagca

SEQ ID NO: 172667 - DNA, 25 bp, Homo sapien
cctggcagcgttgttttctcgggtt

SEQ ID NO: 172668 - DNA, 25 bp, Homo sapien
ctcgacaggtcgtgaataatcgttt

SEQ ID NO: 172669 - DNA, 25 bp, Homo sapien
tggcattctgtcgagattgagattc

SEQ ID NO: 172670 - DNA, 25 bp, Homo sapien
gagcatcggatgaacgggacttata

SEQ ID NO: 172671 - DNA, 25 bp, Homo sapien
cgggacttatagctaaggcgtactc

SEQ ID NO: 172672 - DNA, 25 bp, Homo sapien
gtctttttacgcacgcagcaactcg

SEQ ID NO: 172673 - DNA, 25 bp, Homo sapien
cgtcctcacgtgcataggggtagtg

SEQ ID NO: 172674 - DNA, 25 bp, Homo sapien
agcctttcctgtgaatgaacccgaa

SEQ ID NO: 172675 - DNA, 25 bp, Homo sapien
gaattgctgtccctcgttccaagcc

SEQ ID NO: 172676 - DNA, 25 bp, Homo sapien
cggagccagttctcagccctgatcg

SEQ ID NO: 172677 - DNA, 25 bp, Homo sapien
ccttctgtactgtgatggggctttg

SEQ ID NO: 172678 - DNA, 25 bp, Homo sapien
cctcttcggaaaagctgagaaatca

SEQ ID NO: 172679 - DNA, 25 bp, Homo sapien
cacgtcagggttacagccacattta

SEQ ID NO: 172680 - DNA, 25 bp, Homo sapien
agagcgcggacccttcactacaaac

SEQ ID NO: 172681 - DNA, 25 bp, Homo sapien
cgctccgcattagcggggcagttca

SEQ ID NO: 172682 - DNA, 25 bp, Homo sapien
agtgaccgctttctgcgatcgcgtc

SEQ ID NO: 172683 - DNA, 25 bp, Homo sapien
cttgagtttagagtcacgccctgcc

SEQ ID NO: 172684 - DNA, 25 bp, Homo sapien
ccgatctgcagatggaacgagatgc

SEQ ID NO: 172685 - DNA, 25 bp, Homo sapien
ctccgagagcccagacggaaaataa

SEQ ID NO: 172686 - DNA, 25 bp, Homo sapien
caggaaagttttgcagccgctgagc

SEQ ID NO: 172687 - DNA, 25 bp, Homo sapien
ggctcacggctcaggccgatctgca

SEQ ID NO: 172688 - DNA, 25 bp, Homo sapien
agcaagccatctcgcggacgtgcgc

SEQ ID NO: 172689 - DNA, 25 bp, Homo sapien
cttctggtcgacaatggagcaagcc

SEQ ID NO: 172690 - DNA, 25 bp, Homo sapien
gtgcggcgacttaccttctggtcga

SEQ ID NO: 172691 - DNA, 25 bp, Homo sapien
agccaggagcttctttctccgagag

SEQ ID NO: 172692 - DNA, 25 bp, Homo sapien
cttgtttatacgcatcctccgtggc

SEQ ID NO: 172693 - DNA, 25 bp, Homo sapien
cgaaggcgacacagccaggttagca

SEQ ID NO: 172694 - DNA, 25 bp, Homo sapien
cgaatttgaatcctgtgggccgttg

SEQ ID NO: 172695 - DNA, 25 bp, Homo sapien
tgaggctctggaacttctgcccagc

SEQ ID NO: 172696 - DNA, 25 bp, Homo sapien
tgcccagctctccttggtgagtaaa

SEQ ID NO: 172697 - DNA, 25 bp, Homo sapien
ccggcctggagactaagggaattcg

SEQ ID NO: 172698 - DNA, 25 bp, Homo sapien
cgcccggagtttttctgagctccta

SEQ ID NO: 172699 - DNA, 25 bp, Homo sapien
agccagctctcagtgttgaggattc

SEQ ID NO: 172700 - DNA, 25 bp, Homo sapien
gggacgttctccaagagcactagga

SEQ ID NO: 172701 - DNA, 25 bp, Homo sapien
tgcgcacggcccagcctttatagcg

SEQ ID NO: 172702 - DNA, 25 bp, Homo sapien
gatcctgggcttcgctcgatttgcc

SEQ ID NO: 172703 - DNA, 25 bp, Homo sapien
ctctcccaggtgtgagcagcctatc

SEQ ID NO: 172704 - DNA, 25 bp, Homo sapien
acgcttctctcttcgcaggtgtgtg

SEQ ID NO: 172705 - DNA, 25 bp, Homo sapien
tcacctgtttctcccatggtagggg

SEQ ID NO: 172706 - DNA, 25 bp, Homo sapien
ggtacaagcgggactcagatccagc

SEQ ID NO: 172707 - DNA, 25 bp, Homo sapien
cccagcctgtctgtcgtcgttttgg

SEQ ID NO: 172708 - DNA, 25 bp, Homo sapien
accggggtctcgtgcgtggtggact

SEQ ID NO: 172709 - DNA, 25 bp, Homo sapien
acagcacagaaggactgccgtccct

SEQ ID NO: 172710 - DNA, 25 bp, Homo sapien
tggtggactgcaggccgaggtgacc

SEQ ID NO: 172711 - DNA, 25 bp, Homo sapien
ctgcgcccacgacaaaggcaagcga

SEQ ID NO: 172712 - DNA, 25 bp, Homo sapien
tgcgcccacgacaaaggcaagcgag

SEQ ID NO: 172713 - DNA, 25 bp, Homo sapien
cgcccacgacaaaggcaagcgagga

SEQ ID NO: 172714 - DNA, 25 bp, Homo sapien
ccacgacaaaggcaagcgaggacct

SEQ ID NO: 172715 - DNA, 25 bp, Homo sapien
cacgacaaaggcaagcgaggacctg

SEQ ID NO: 172716 - DNA, 25 bp, Homo sapien
ctgggctccgactctgacttttgga

SEQ ID NO: 172717 - DNA, 25 bp, Homo sapien
ctgagcagcacaggtaggttccgct

SEQ ID NO: 172718 - DNA, 25 bp, Homo sapien
atgctgggtagcgaacgcagcctca

SEQ ID NO: 172719 - DNA, 25 bp, Homo sapien
cgtcactagcgcacagcatgctggg

SEQ ID NO: 172720 - DNA, 25 bp, Homo sapien
tccggcaagctcgtccattgtgtgt

SEQ ID NO: 172721 - DNA, 25 bp, Homo sapien
ctcgtgctggatgtagtgcagtatc

SEQ ID NO: 172722 - DNA, 25 bp, Homo sapien
ttgagaggaccatcacaacctgagc

SEQ ID NO: 172723 - DNA, 25 bp, Homo sapien
gcctcacgcttaatcgccaaataga

SEQ ID NO: 172724 - DNA, 25 bp, Homo sapien
acgggaggcgtcctctgaaccttgg

SEQ ID NO: 172725 - DNA, 25 bp, Homo sapien
ccgcgcgatcggttcgctccaggat

SEQ ID NO: 172726 - DNA, 25 bp, Homo sapien
tgctgcgagagtacccagccccagg

SEQ ID NO: 172727 - DNA, 25 bp, Homo sapien
tcggctgctgcgagagtacccagcc

SEQ ID NO: 172728 - DNA, 25 bp, Homo sapien
atctcggctgctgcgagagtaccca

SEQ ID NO: 172729 - DNA, 25 bp, Homo sapien
gaagatctcggctgctgcgagagta

SEQ ID NO: 172730 - DNA, 25 bp, Homo sapien
tcggttcgctccaggatctgtggcg

SEQ ID NO: 172731 - DNA, 25 bp, Homo sapien
cgatcggttcgctccaggatctgtg

SEQ ID NO: 172732 - DNA, 25 bp, Homo sapien
aggcccagtccatcgcgaaccggga

SEQ ID NO: 172733 - DNA, 25 bp, Homo sapien
ccgcggccctagagttcccaagaag

SEQ ID NO: 172734 - DNA, 25 bp, Homo sapien
ggcttgtcgttccaaaccgctccga

SEQ ID NO: 172735 - DNA, 25 bp, Homo sapien
caggctcttactcgggcttgtcgtt

SEQ ID NO: 172736 - DNA, 25 bp, Homo sapien
ttctcaagggcaaaaggagccggcc

SEQ ID NO: 172737 - DNA, 25 bp, Homo sapien
aggcctggcagcgaacccttctcaa

SEQ ID NO: 172738 - DNA, 25 bp, Homo sapien
cagcagcaagccttcgtgcccgaga

SEQ ID NO: 172739 - DNA, 25 bp, Homo sapien
cggcttttctatggtgcgccctggc

SEQ ID NO: 172740 - DNA, 25 bp, Homo sapien
accggcttctttcgcgatcacattg

SEQ ID NO: 172741 - DNA, 25 bp, Homo sapien
cagcggtttttcagtccggagattc

SEQ ID NO: 172742 - DNA, 25 bp, Homo sapien
ggaagaacggaccacgctgtttatc

SEQ ID NO: 172743 - DNA, 25 bp, Homo sapien
agagtccacgcctacctgttgtgca

SEQ ID NO: 172744 - DNA, 25 bp, Homo sapien
ctcaactcatacagcggccctggtg

SEQ ID NO: 172745 - DNA, 25 bp, Homo sapien
ttaccggctgctctgctaaccctag

SEQ ID NO: 172746 - DNA, 25 bp, Homo sapien
aggcgtgactgcttcaccgtcgaaa

SEQ ID NO: 172747 - DNA, 25 bp, Homo sapien
ggtgaagccagactttcccgtagtc

SEQ ID NO: 172748 - DNA, 25 bp, Homo sapien
tcgaatgtcccggatgtgcggtctt

SEQ ID NO: 172749 - DNA, 25 bp, Homo sapien
atgctggaccgaaaagacaagcgca

SEQ ID NO: 172750 - DNA, 25 bp, Homo sapien
acagagcggacgagtcaccgagaca

SEQ ID NO: 172751 - DNA, 25 bp, Homo sapien
agctgccgggctgacgttacctcca

SEQ ID NO: 172752 - DNA, 25 bp, Homo sapien
gggcctgaggaatccggctaccctc

SEQ ID NO: 172753 - DNA, 25 bp, Homo sapien
cggctaccctcagccatggcttaag

SEQ ID NO: 172754 - DNA, 25 bp, Homo sapien
cagttactaggccatgtgtcgctgg

SEQ ID NO: 172755 - DNA, 25 bp, Homo sapien
ggcctcggactgactctcgaatgtc

SEQ ID NO: 172756 - DNA, 25 bp, Homo sapien
gggaagctgaggaaaaatactcacg

SEQ ID NO: 172757 - DNA, 25 bp, Homo sapien
gctccgggcagtaaggcagtagctt

SEQ ID NO: 172758 - DNA, 25 bp, Homo sapien
gcagtagcttccaaagcgtggagga

SEQ ID NO: 172759 - DNA, 25 bp, Homo sapien
cagaatacggagaaagagggaagct

SEQ ID NO: 172760 - DNA, 25 bp, Homo sapien
gactggatagctcgcgccttcccag

SEQ ID NO: 172761 - DNA, 25 bp, Homo sapien
ggaaaaatactcacgccaatgggta

SEQ ID NO: 172762 - DNA, 25 bp, Homo sapien
tactcacgccaatgggtaaaaggga

SEQ ID NO: 172763 - DNA, 25 bp, Homo sapien
cgacgttgttaggtaggaccttgcg

SEQ ID NO: 172764 - DNA, 25 bp, Homo sapien
agtccgcggcacgagaaatcaaagc

SEQ ID NO: 172765 - DNA, 25 bp, Homo sapien
acctagtgacctagcgggccaaccg

SEQ ID NO: 172766 - DNA, 25 bp, Homo sapien
tttgggttcacttcagcaaagtctg

SEQ ID NO: 172767 - DNA, 25 bp, Homo sapien
aaacctgacagatcggtcgcggcca

SEQ ID NO: 172768 - DNA, 25 bp, Homo sapien
gccggagatagtcacgcagatgcca

SEQ ID NO: 172769 - DNA, 25 bp, Homo sapien
tggccgaatcgttgcaaggactctc

SEQ ID NO: 172770 - DNA, 25 bp, Homo sapien
cttagaatgtagtgccgacggctcc

SEQ ID NO: 172771 - DNA, 25 bp, Homo sapien
ggagtccaccgcaacttagaatgta

SEQ ID NO: 172772 - DNA, 25 bp, Homo sapien
tacctggccgcgatgacctgtcagg

SEQ ID NO: 172773 - DNA, 25 bp, Homo sapien
ccgataacgaggctgctgcggcacc

SEQ ID NO: 172774 - DNA, 25 bp, Homo sapien
ggagctgccaatgctgcggccgcct

SEQ ID NO: 172775 - DNA, 25 bp, Homo sapien
gcatgccgggagctgccaatgctgc

SEQ ID NO: 172776 - DNA, 25 bp, Homo sapien
ttgagttctcgtgccgcggagctca

SEQ ID NO: 172777 - DNA, 25 bp, Homo sapien
gctttgagttctcgtgccgcggagc

SEQ ID NO: 172778 - DNA, 25 bp, Homo sapien
gccgcgatgacctgtcaggtttacc

SEQ ID NO: 172779 - DNA, 25 bp, Homo sapien
ccaggtcgtacctggccgcgatgac

SEQ ID NO: 172780 - DNA, 25 bp, Homo sapien
ctctccattgcacaaaagcggcttc

SEQ ID NO: 172781 - DNA, 25 bp, Homo sapien
cgcgcctgagtcttgcactttgggt

SEQ ID NO: 172782 - DNA, 25 bp, Homo sapien
cccacccactagtcgagttggaatg

SEQ ID NO: 172783 - DNA, 25 bp, Homo sapien
aaccggacctcacctcacaagtttg

SEQ ID NO: 172784 - DNA, 25 bp, Homo sapien
taagtatcaagttctcgaggagccc

SEQ ID NO: 172785 - DNA, 25 bp, Homo sapien
ctcgcgctgcctgatgtgcataaga

SEQ ID NO: 172786 - DNA, 25 bp, Homo sapien
tgcctggatggtggttatttctcta

SEQ ID NO: 172787 - DNA, 25 bp, Homo sapien
tttcatcggtcgaaaggggcgtata

SEQ ID NO: 172788 - DNA, 25 bp, Homo sapien
acagtgcctcggtgctcaagatcaa

SEQ ID NO: 172789 - DNA, 25 bp, Homo sapien
ccaagacgcccatggagatgctcta

SEQ ID NO: 172790 - DNA, 25 bp, Homo sapien
agcgcgtccaactccttgctgtaca

SEQ ID NO: 172791 - DNA, 25 bp, Homo sapien
acgcgcacgctgttaacttcgtgga

SEQ ID NO: 172792 - DNA, 25 bp, Homo sapien
gagggtctacaccacgggcaccatc

SEQ ID NO: 172793 - DNA, 25 bp, Homo sapien
tgcgagtcactcacgtccgacagcg

SEQ ID NO: 172794 - DNA, 25 bp, Homo sapien
cgtgcaccggctcaacatgtcagga

SEQ ID NO: 172795 - DNA, 25 bp, Homo sapien
tgacagcagcatctggaactacccg

SEQ ID NO: 172796 - DNA, 25 bp, Homo sapien
cggccctgggaagtcgacatacaac

SEQ ID NO: 172797 - DNA, 25 bp, Homo sapien
ttgacgtagtatttgcccagccggc

SEQ ID NO: 172798 - DNA, 25 bp, Homo sapien
ctcccgcagtagaggaccagcctgt

SEQ ID NO: 172799 - DNA, 25 bp, Homo sapien
gttgtccaggtagcagaagcccacc

SEQ ID NO: 172800 - DNA, 25 bp, Homo sapien
gggcacgatgtactccagggcaatt

SEQ ID NO: 172801 - DNA, 25 bp, Homo sapien
aggtccagcctcatgatgtgtccca

SEQ ID NO: 172802 - DNA, 25 bp, Homo sapien
acgatctacacgagcgcgaagccga

SEQ ID NO: 172803 - DNA, 25 bp, Homo sapien
tgcaaccagagagggaacgatctac

SEQ ID NO: 172804 - DNA, 25 bp, Homo sapien
aaggacctccagcactccgcagtgc

SEQ ID NO: 172805 - DNA, 25 bp, Homo sapien
caaggacctccagcactccgcagtg

SEQ ID NO: 172806 - DNA, 25 bp, Homo sapien
tcaaggacctccagcactccgcagt

SEQ ID NO: 172807 - DNA, 25 bp, Homo sapien
ctcaaggacctccagcactccgcag

SEQ ID NO: 172808 - DNA, 25 bp, Homo sapien
gctcaaggacctccagcactccgca

SEQ ID NO: 172809 - DNA, 25 bp, Homo sapien
aaggaggagccgttccacctctgcc

SEQ ID NO: 172810 - DNA, 25 bp, Homo sapien
ttggaagccatttcgaaggaggagc

SEQ ID NO: 172811 - DNA, 25 bp, Homo sapien
cagcgcatatcggtgttggaagcca

SEQ ID NO: 172812 - DNA, 25 bp, Homo sapien
aggcttccaggtcccagcgcatatc

SEQ ID NO: 172813 - DNA, 25 bp, Homo sapien
gcagttgctcttgcaggcttccagg

SEQ ID NO: 172814 - DNA, 25 bp, Homo sapien
ccagcaggtctatgtcctcgggctc

SEQ ID NO: 172815 - DNA, 25 bp, Homo sapien
cccgtagttggtggtgaccagccag

SEQ ID NO: 172816 - DNA, 25 bp, Homo sapien
tctgcctcttgatgaactgggcttc

SEQ ID NO: 172817 - DNA, 25 bp, Homo sapien
agccggagggacaatcgaaatgatc

SEQ ID NO: 172818 - DNA, 25 bp, Homo sapien
cccgcagctgtcatgaagatagatg

SEQ ID NO: 172819 - DNA, 25 bp, Homo sapien
gctcgctcacgtttgtcccgactaa

SEQ ID NO: 172820 - DNA, 25 bp, Homo sapien
tgtcccttgcgtttcctttctttga

SEQ ID NO: 172821 - DNA, 25 bp, Homo sapien
aaatgatcaaaaatgcccggcgggc

SEQ ID NO: 172822 - DNA, 25 bp, Homo sapien
gtgccctcgcttcggatgcaagatc

SEQ ID NO: 172823 - DNA, 25 bp, Homo sapien
tgcctagcagataccggctggtgcc

SEQ ID NO: 172824 - DNA, 25 bp, Homo sapien
cgtgattcttcctcagccggagctc

SEQ ID NO: 172825 - DNA, 25 bp, Homo sapien
gccctttggcttcgcacaagtaaca

SEQ ID NO: 172826 - DNA, 25 bp, Homo sapien
ccgtgattccggaatatccctcttc

SEQ ID NO: 172827 - DNA, 25 bp, Homo sapien
agcgtctctgtttacactgcaagtc

SEQ ID NO: 172828 - DNA, 25 bp, Homo sapien
ggcctacaccgtccacaagcaattt

SEQ ID NO: 172829 - DNA, 25 bp, Homo sapien
gtagtcatccggaagccggttcatg

SEQ ID NO: 172830 - DNA, 25 bp, Homo sapien
ttcaaccgcgtaggggtcgtagtca

SEQ ID NO: 172831 - DNA, 25 bp, Homo sapien
ggctcctcgtcgctaggctcttcaa

SEQ ID NO: 172832 - DNA, 25 bp, Homo sapien
agtaacaggcacgacaggctcccga

SEQ ID NO: 172833 - DNA, 25 bp, Homo sapien
cacgagagaagtgaccgtgtgttga

SEQ ID NO: 172834 - DNA, 25 bp, Homo sapien
caagggcgtggcgtatgcagatgag

SEQ ID NO: 172835 - DNA, 25 bp, Homo sapien
ctgccggtcacgctcggcctgggac

SEQ ID NO: 172836 - DNA, 25 bp, Homo sapien
tgtcccgcgcgcgatatccgagtgc

SEQ ID NO: 172837 - DNA, 25 bp, Homo sapien
cgcgcgcgatatccgagtgctgtcg

SEQ ID NO: 172838 - DNA, 25 bp, Homo sapien
ccgcacgagagaagtgaccgtgtgt

SEQ ID NO: 172839 - DNA, 25 bp, Homo sapien
gcgagggtatgagaggaagccgcac

SEQ ID NO: 172840 - DNA, 25 bp, Homo sapien
tgtcttcccctagcggcaacggtgg

SEQ ID NO: 172841 - DNA, 25 bp, Homo sapien
acgatctcgtgctttctccaggcca

SEQ ID NO: 172842 - DNA, 25 bp, Homo sapien
tagggcgattgctgcttttttctca

SEQ ID NO: 172843 - DNA, 25 bp, Homo sapien
tctccagggtattgtcgtgaaaacg

SEQ ID NO: 172844 - DNA, 25 bp, Homo sapien
ggatcctttagtaacgcgccaatta

SEQ ID NO: 172845 - DNA, 25 bp, Homo sapien
tgggcagttcgctttcgttttcacg

SEQ ID NO: 172846 - DNA, 25 bp, Homo sapien
gtgttcaaaacacgggctgctgggc

SEQ ID NO: 172847 - DNA, 25 bp, Homo sapien
ggtctggatgtgtggtgttcaaaac

SEQ ID NO: 172848 - DNA, 25 bp, Homo sapien
gcgccaattatactgtgggtttatg

SEQ ID NO: 172849 - DNA, 25 bp, Homo sapien
ctggagaacataaacccacagtata

SEQ ID NO: 172850 - DNA, 25 bp, Homo sapien
ccacagtataattggcgcgttacta

SEQ ID NO: 172851 - DNA, 25 bp, Homo sapien
gttttgaacaccacacatccagacc

SEQ ID NO: 172852 - DNA, 25 bp, Homo sapien
gcccagcagcccgtgttttgaacac

SEQ ID NO: 172853 - DNA, 25 bp, Homo sapien
cgttttcacgacaataccctggaga

SEQ ID NO: 172854 - DNA, 25 bp, Homo sapien
ccgcggggtgagaaaaaagcagcaa

SEQ ID NO: 172855 - DNA, 25 bp, Homo sapien
cgtgaaaacgaaagcgaactgccca

SEQ ID NO: 172856 - DNA, 25 bp, Homo sapien
tttggcctggagaaagcacgagatc

SEQ ID NO: 172857 - DNA, 25 bp, Homo sapien
ggtccaccagaaggcccgaacagcg

SEQ ID NO: 172858 - DNA, 25 bp, Homo sapien
gtccgagaatgggttttcatggccc

SEQ ID NO: 172859 - DNA, 25 bp, Homo sapien
agttcgagatgtccacaccgggtga

SEQ ID NO: 172860 - DNA, 25 bp, Homo sapien
ccgcgagcgaaaggaaggcagaact

SEQ ID NO: 172861 - DNA, 25 bp, Homo sapien
aggcagaacttactccgcggtcctc

SEQ ID NO: 172862 - DNA, 25 bp, Homo sapien
cctcttctgagaggaagtccgggcc

SEQ ID NO: 172863 - DNA, 25 bp, Homo sapien
acattagtgacaggctggcgcggtc

SEQ ID NO: 172864 - DNA, 25 bp, Homo sapien
caccatcatggctgctccgaggcga

SEQ ID NO: 172865 - DNA, 25 bp, Homo sapien
cgcagagcagaagcgcccaccttgg

SEQ ID NO: 172866 - DNA, 25 bp, Homo sapien
agcctcgcgtgttaagtaaaattag

SEQ ID NO: 172867 - DNA, 25 bp, Homo sapien
cgtaccaattttaaagcctcgcgtg

SEQ ID NO: 172868 - DNA, 25 bp, Homo sapien
caccttggaggccaaaatcaggtta

SEQ ID NO: 172869 - DNA, 25 bp, Homo sapien
tcaggttaaaatggcggcctcactc

SEQ ID NO: 172870 - DNA, 25 bp, Homo sapien
gctcgtcttaccatagtgccctcgg

SEQ ID NO: 172871 - DNA, 25 bp, Homo sapien
agcatcacccgtcaagccggtggga

SEQ ID NO: 172872 - DNA, 25 bp, Homo sapien
cgttcgcagcacgtaccaattttaa

SEQ ID NO: 172873 - DNA, 25 bp, Homo sapien
ctcggctgccttttgtgtgactgac

SEQ ID NO: 172874 - DNA, 25 bp, Homo sapien
gcggaagatctcgttggtgacttta

SEQ ID NO: 172875 - DNA, 25 bp, Homo sapien
tagaaaacttcctcgtcgggccgca

SEQ ID NO: 172876 - DNA, 25 bp, Homo sapien
ggcggcttctgtctcacaaacggct

SEQ ID NO: 172877 - DNA, 25 bp, Homo sapien
cacaaacggctttcggtgtagcagc

SEQ ID NO: 172878 - DNA, 25 bp, Homo sapien
cccgcttccctatcaaaattggagg

SEQ ID NO: 172879 - DNA, 25 bp, Homo sapien
acacggcccggctcttactcgtagt

SEQ ID NO: 172880 - DNA, 25 bp, Homo sapien
ctcccgactgagaaaacgaagccca

SEQ ID NO: 172881 - DNA, 25 bp, Homo sapien
ctcctatagaaaggctggactacgc

SEQ ID NO: 172882 - DNA, 25 bp, Homo sapien
ccggaagcggaagtagattctccta

SEQ ID NO: 172883 - DNA, 25 bp, Homo sapien
tctaaactgtttcaggagccgcgta

SEQ ID NO: 172884 - DNA, 25 bp, Homo sapien
cacttttcttaaggtggctcgtcga

SEQ ID NO: 172885 - DNA, 25 bp, Homo sapien
tttccgctcttagctgggagtgctc

SEQ ID NO: 172886 - DNA, 25 bp, Homo sapien
agcctccggtctgcaaagccctaag

SEQ ID NO: 172887 - DNA, 25 bp, Homo sapien
gcctgcctcgcagtgggaaatttta

SEQ ID NO: 172888 - DNA, 25 bp, Homo sapien
tggcactccgttggtcttccagctg

SEQ ID NO: 172889 - DNA, 25 bp, Homo sapien
tccacggtccggttaaacacacagc

SEQ ID NO: 172890 - DNA, 25 bp, Homo sapien
gcaaactctccgtccgcaggatgga

SEQ ID NO: 172891 - DNA, 25 bp, Homo sapien
cactgtgtcgatacgtcgggagtcc

SEQ ID NO: 172892 - DNA, 25 bp, Homo sapien
gccgagtcagttgtgcccagaaatt

SEQ ID NO: 172893 - DNA, 25 bp, Homo sapien
atcctctctgtttggggcctgggac

SEQ ID NO: 172894 - DNA, 25 bp, Homo sapien
agtcccatgtggaaaggcggcctga

SEQ ID NO: 172895 - DNA, 25 bp, Homo sapien
attgcatccttcatcaaccgccggt

SEQ ID NO: 172896 - DNA, 25 bp, Homo sapien
ttctcatgagaagagccgatgcctc

SEQ ID NO: 172897 - DNA, 25 bp, Homo sapien
tgtaggcctatcatgcaacgtgtgg

SEQ ID NO: 172898 - DNA, 25 bp, Homo sapien
cctatcatgcaacgtgtggaccctg

SEQ ID NO: 172899 - DNA, 25 bp, Homo sapien
gcctgtcacgtaatgtgtggaccca

SEQ ID NO: 172900 - DNA, 25 bp, Homo sapien
aagcctgtcgtgcaacgtgtggacc

SEQ ID NO: 172901 - DNA, 25 bp, Homo sapien
tgtggacccagcctagtagaatgta

SEQ ID NO: 172902 - DNA, 25 bp, Homo sapien
ggacccggcctagtagaatgtaagc

SEQ ID NO: 172903 - DNA, 25 bp, Homo sapien
gtggacccggcctagtagaatgtaa

SEQ ID NO: 172904 - DNA, 25 bp, Homo sapien
cccggcttagtagaatgtaggccta

SEQ ID NO: 172905 - DNA, 25 bp, Homo sapien
gtagttgcgcctcccagactgcagt

SEQ ID NO: 172906 - DNA, 25 bp, Homo sapien
atggaagtgggcttaccggccatta

SEQ ID NO: 172907 - DNA, 25 bp, Homo sapien
gacagcctggctcggccagcgactg

SEQ ID NO: 172908 - DNA, 25 bp, Homo sapien
ccagactgcagttggccagctctcg

SEQ ID NO: 172909 - DNA, 25 bp, Homo sapien
tccacgagctctggatgcttgcttg

SEQ ID NO: 172910 - DNA, 25 bp, Homo sapien
ccagaaatgacgtcacaggcggtgc

SEQ ID NO: 172911 - DNA, 25 bp, Homo sapien
cgccaggcttcaggtacacgtacca

SEQ ID NO: 172912 - DNA, 25 bp, Homo sapien
gcgggtgagtcccacttcccgacag

SEQ ID NO: 172913 - DNA, 25 bp, Homo sapien
gaacgcctaagtccgggtcagtctc

SEQ ID NO: 172914 - DNA, 25 bp, Homo sapien
ggcactgtagtttccgccgcgttta

SEQ ID NO: 172915 - DNA, 25 bp, Homo sapien
ggaaggccgtccaaccaccatcttg

SEQ ID NO: 172916 - DNA, 25 bp, Homo sapien
acaattactgtcactgccgcggaga

SEQ ID NO: 172917 - DNA, 25 bp, Homo sapien
cccaagctcaccaagccggatttta

SEQ ID NO: 172918 - DNA, 25 bp, Homo sapien
agcccgcgttttcctttatcgtgtg

SEQ ID NO: 172919 - DNA, 25 bp, Homo sapien
gggaagcgccttctttcacaatttc

SEQ ID NO: 172920 - DNA, 25 bp, Homo sapien
tcattgcggatatctggaagccttc

SEQ ID NO: 172921 - DNA, 25 bp, Homo sapien
gtttcacgtctatccactcaagagg

SEQ ID NO: 172922 - DNA, 25 bp, Homo sapien
agtgcttctaccaacatgtcccgtg

SEQ ID NO: 172923 - DNA, 25 bp, Homo sapien
gctcagtgctcgaactggctccaga

SEQ ID NO: 172924 - DNA, 25 bp, Homo sapien
agcgccggttttgaccgccacatta

SEQ ID NO: 172925 - DNA, 25 bp, Homo sapien
tcacccgagggtcggctctaccaag

SEQ ID NO: 172926 - DNA, 25 bp, Homo sapien
tgtgggccacctgaattgccctgtc

SEQ ID NO: 172927 - DNA, 25 bp, Homo sapien
attgccctgtcatggtacgtgcctg

SEQ ID NO: 172928 - DNA, 25 bp, Homo sapien
tggcgcaggcgcataccttcaaagg

SEQ ID NO: 172929 - DNA, 25 bp, Homo sapien
tctttcatggagtccaggccgctgt

SEQ ID NO: 172930 - DNA, 25 bp, Homo sapien
tattatgagctgagtgttcctggca

SEQ ID NO: 172931 - DNA, 25 bp, Homo sapien
cgccttatgcaaccggggacttcgc

SEQ ID NO: 172932 - DNA, 25 bp, Homo sapien
gtgtggcgacgctgccatccaccag

SEQ ID NO: 172933 - DNA, 25 bp, Homo sapien
tgctcgtactcctcgtctttcatgg

SEQ ID NO: 172934 - DNA, 25 bp, Homo sapien
ggtgttttccgcgaggttattatga

SEQ ID NO: 172935 - DNA, 25 bp, Homo sapien
ggtcgtccagtagccgctccttctt

SEQ ID NO: 172936 - DNA, 25 bp, Homo sapien
tgcagctccttgaccatctgctcgt

SEQ ID NO: 172937 - DNA, 25 bp, Homo sapien
cctggtgaagcgaactaaacggaca

SEQ ID NO: 172938 - DNA, 25 bp, Homo sapien
gcccgcgtctcagctataaagatag

SEQ ID NO: 172939 - DNA, 25 bp, Homo sapien
tccaccatgccaaggggattcctgg

SEQ ID NO: 172940 - DNA, 25 bp, Homo sapien
ttctagttcatctgctggccggctc

SEQ ID NO: 172941 - DNA, 25 bp, Homo sapien
gccgcggcgaagctcttctagttca

SEQ ID NO: 172942 - DNA, 25 bp, Homo sapien
gagctttgccgatgaggtgaccaca

SEQ ID NO: 172943 - DNA, 25 bp, Homo sapien
gcttgtaccgagttcgccttgcgga

SEQ ID NO: 172944 - DNA, 25 bp, Homo sapien
ccgcgggaatcaagaagccaaaggc

SEQ ID NO: 172945 - DNA, 25 bp, Homo sapien
cgtctccgcagaggctacgatttgc

SEQ ID NO: 172946 - DNA, 25 bp, Homo sapien
aggctacgatttgccctctcctgca

SEQ ID NO: 172947 - DNA, 25 bp, Homo sapien
agcttctttagcagcttacaccctg

SEQ ID NO: 172948 - DNA, 25 bp, Homo sapien
ttacaccctgcagaggccgaaacgg

SEQ ID NO: 172949 - DNA, 25 bp, Homo sapien
tgatggggtttcacgactctgccgt

SEQ ID NO: 172950 - DNA, 25 bp, Homo sapien
tggcaaccgccttctgacgtcaaga

SEQ ID NO: 172951 - DNA, 25 bp, Homo sapien
gagttcttgacgtcatgccagcatg

SEQ ID NO: 172952 - DNA, 25 bp, Homo sapien
cagcatgagatcacccgtggcactc

SEQ ID NO: 172953 - DNA, 25 bp, Homo sapien
cgcggctggaaaatgccagtccatt

SEQ ID NO: 172954 - DNA, 25 bp, Homo sapien
gttccgcgcgcccttcattgaagcg

SEQ ID NO: 172955 - DNA, 25 bp, Homo sapien
agatagctcaggtgcgcgacccact

SEQ ID NO: 172956 - DNA, 25 bp, Homo sapien
acactgagagctcgtcggtctccga

SEQ ID NO: 172957 - DNA, 25 bp, Homo sapien
gaaggagaccaaccatcacgatgag

SEQ ID NO: 172958 - DNA, 25 bp, Homo sapien
aatcgtaccagagcagggcaagccc

SEQ ID NO: 172959 - DNA, 25 bp, Homo sapien
tgccagtccattcccgaggggataa

SEQ ID NO: 172960 - DNA, 25 bp, Homo sapien
cgcgtcgtaattgcgggcaaccaat

SEQ ID NO: 172961 - DNA, 25 bp, Homo sapien
gaagtcaagcctcgagctctccgga

SEQ ID NO: 172962 - DNA, 25 bp, Homo sapien
cccggcgaggagatgaagaagtcaa

SEQ ID NO: 172963 - DNA, 25 bp, Homo sapien
cgggctcagaggaagaccctgcaaa

SEQ ID NO: 172964 - DNA, 25 bp, Homo sapien
agaccctgcaaaaaagagcgctcgc

SEQ ID NO: 172965 - DNA, 25 bp, Homo sapien
cggccagcgccttagaagagcctgc

SEQ ID NO: 172966 - DNA, 25 bp, Homo sapien
gccgcaggaagaaagacgcccgaca

SEQ ID NO: 172967 - DNA, 25 bp, Homo sapien
gggcgtcatctccacacagttcttc

SEQ ID NO: 172968 - DNA, 25 bp, Homo sapien
cagagatcctgacgacctgggcgac

SEQ ID NO: 172969 - DNA, 25 bp, Homo sapien
ctgggtattaaaagggttgtgctgc

SEQ ID NO: 172970 - DNA, 25 bp, Homo sapien
tgacgcctttgtccaggctgcgctc

SEQ ID NO: 172971 - DNA, 25 bp, Homo sapien
gggatccgccttccatcctgggaaa

SEQ ID NO: 172972 - DNA, 25 bp, Homo sapien
gttgtgctgcagctaaaatatctca

SEQ ID NO: 172973 - DNA, 25 bp, Homo sapien
cctcgctcacacagtcgatgtcatg

SEQ ID NO: 172974 - DNA, 25 bp, Homo sapien
cagggaagcgtcttgatgtgcaccc

SEQ ID NO: 172975 - DNA, 25 bp, Homo sapien
ccagccaagctgacttcgcgaggtg

SEQ ID NO: 172976 - DNA, 25 bp, Homo sapien
tctcacagtgtgtgtgaacctcata

SEQ ID NO: 172977 - DNA, 25 bp, Homo sapien
ttgccactccaggtgaaaatcaaga

SEQ ID NO: 172978 - DNA, 25 bp, Homo sapien
gacggccttgatgccgctgcgctgc

SEQ ID NO: 172979 - DNA, 25 bp, Homo sapien
agccagtgcccgtgacggccttgat

SEQ ID NO: 172980 - DNA, 25 bp, Homo sapien
cccagagacgggcaagtatgtcaag

SEQ ID NO: 172981 - DNA, 25 bp, Homo sapien
caagaccttctatgacccagagacg

SEQ ID NO: 172982 - DNA, 25 bp, Homo sapien
cagtccggggagtactttgtcttcg

SEQ ID NO: 172983 - DNA, 25 bp, Homo sapien
ggcaagtatgtcaaggtctccatcc

SEQ ID NO: 172984 - DNA, 25 bp, Homo sapien
tttgtcttcgacttgccactccagg

SEQ ID NO: 172985 - DNA, 25 bp, Homo sapien
ctagaaaccaaactttcgtagcgag

SEQ ID NO: 172986 - DNA, 25 bp, Homo sapien
accaattcggaacagccgggccgcg

SEQ ID NO: 172987 - DNA, 25 bp, Homo sapien
gtttagacatttggcaaccaattcg

SEQ ID NO: 172988 - DNA, 25 bp, Homo sapien
agtgtccacacttctagtttagaca

SEQ ID NO: 172989 - DNA, 25 bp, Homo sapien
cagctcgagatttcaagtgtccaca

SEQ ID NO: 172990 - DNA, 25 bp, Homo sapien
ctttcgtagcgagagaccctaagac

SEQ ID NO: 172991 - DNA, 25 bp, Homo sapien
gctgcttctcttggtcctagaaacc

SEQ ID NO: 172992 - DNA, 25 bp, Homo sapien
agaccctaagacagctcgagatttc

SEQ ID NO: 172993 - DNA, 25 bp, Homo sapien
gacttcaaactatgccgactgtaga

SEQ ID NO: 172994 - DNA, 25 bp, Homo sapien
tcggtccgcaaacccgattgagttc

SEQ ID NO: 172995 - DNA, 25 bp, Homo sapien
aggtcctgtttgtctcggtccgcaa

SEQ ID NO: 172996 - DNA, 25 bp, Homo sapien
ccagcgtaattgatggcaagaaaga

SEQ ID NO: 172997 - DNA, 25 bp, Homo sapien
gtctcttcccgcagctgcgacaatt

SEQ ID NO: 172998 - DNA, 25 bp, Homo sapien
tcagattgcgttctaggtctcttcc

SEQ ID NO: 172999 - DNA, 25 bp, Homo sapien
agcgcgcacctatttccctaatgaa

SEQ ID NO: 173000 - DNA, 25 bp, Homo sapien
gttgcggaaccctcttgcactgctc

SEQ ID NO: 173001 - DNA, 25 bp, Homo sapien
cgctttgtggccacgctggatatta

SEQ ID NO: 173002 - DNA, 25 bp, Homo sapien
attctgcttcaattgggcgcctctc

SEQ ID NO: 173003 - DNA, 25 bp, Homo sapien
acctcgaacaaacctggtgtccctg

SEQ ID NO: 173004 - DNA, 25 bp, Homo sapien
ggcgtaaatggccagtcgctttgtg

SEQ ID NO: 173005 - DNA, 25 bp, Homo sapien
ctggagctgactttccgaggacatc

SEQ ID NO: 173006 - DNA, 25 bp, Homo sapien
gctcagccatgcaaaagtgctcttg

SEQ ID NO: 173007 - DNA, 25 bp, Homo sapien
aaagtgctcttgcttcccgggaata

SEQ ID NO: 173008 - DNA, 25 bp, Homo sapien
ggcgcctctcatccgacgagcaaga

SEQ ID NO: 173009 - DNA, 25 bp, Homo sapien
gacaggctggatacctggccctgca

SEQ ID NO: 173010 - DNA, 25 bp, Homo sapien
atgccgctcatgttcatgccgctcg

SEQ ID NO: 173011 - DNA, 25 bp, Homo sapien
cgggagactgtaagcgacaaacgca

SEQ ID NO: 173012 - DNA, 25 bp, Homo sapien
ccaggtccgaccgtatagcaaggtg

SEQ ID NO: 173013 - DNA, 25 bp, Homo sapien
cacggtttgccgtctttcaccagga

SEQ ID NO: 173014 - DNA, 25 bp, Homo sapien
ttggcctggcgcttcattttgtagc

SEQ ID NO: 173015 - DNA, 25 bp, Homo sapien
ggggccatgttcttgctcacgtccc

SEQ ID NO: 173016 - DNA, 25 bp, Homo sapien
ttgttaagaaaagtcgaagcgcgtg

SEQ ID NO: 173017 - DNA, 25 bp, Homo sapien
cgccaggttttaggcagccaccaga

SEQ ID NO: 173018 - DNA, 25 bp, Homo sapien
cgctgttcctcatggtgtcctggta

SEQ ID NO: 173019 - DNA, 25 bp, Homo sapien
gtgtgctttggactcatcgacatga

SEQ ID NO: 173020 - DNA, 25 bp, Homo sapien
ttcctccaggggactcaagatgtca

SEQ ID NO: 173021 - DNA, 25 bp, Homo sapien
gaccgagtcctccttaattggcttg

SEQ ID NO: 173022 - DNA, 25 bp, Homo sapien
agaagcctacatcttgcccgagata

SEQ ID NO: 173023 - DNA, 25 bp, Homo sapien
gcagagacgagacccaaagcatttc

SEQ ID NO: 173024 - DNA, 25 bp, Homo sapien
gccgatcttgttggatgtacacgta

SEQ ID NO: 173025 - DNA, 25 bp, Homo sapien
ttaagcgaaccacagaggagaactg

SEQ ID NO: 173026 - DNA, 25 bp, Homo sapien
aggagaactggcaacgctgaataca

SEQ ID NO: 173027 - DNA, 25 bp, Homo sapien
aacgctgaatacagaccttgtctgc

SEQ ID NO: 173028 - DNA, 25 bp, Homo sapien
gaatacagaccttgtctgcaggcgc

SEQ ID NO: 173029 - DNA, 25 bp, Homo sapien
acctggccgggcctgagtcccgaat

SEQ ID NO: 173030 - DNA, 25 bp, Homo sapien
cgacgccgggcttaagcgaaccaca

SEQ ID NO: 173031 - DNA, 25 bp, Homo sapien
ccgaatggggtctaattgcgaaggc

SEQ ID NO: 173032 - DNA, 25 bp, Homo sapien
cctgagtcccgaatggggtctaatt

SEQ ID NO: 173033 - DNA, 25 bp, Homo sapien
cgaagtctgcgcgtattcctttatc

SEQ ID NO: 173034 - DNA, 25 bp, Homo sapien
cagacccgggctaaaccagtgattt

SEQ ID NO: 173035 - DNA, 25 bp, Homo sapien
tccctctgaccgaagagcgtccttt

SEQ ID NO: 173036 - DNA, 25 bp, Homo sapien
agcccggagactaacgcaccttgta

SEQ ID NO: 173037 - DNA, 25 bp, Homo sapien
acacaactgggacggcgcttcaacc

SEQ ID NO: 173038 - DNA, 25 bp, Homo sapien
ccgcttcactctgggacacaactgg

SEQ ID NO: 173039 - DNA, 25 bp, Homo sapien
cggaatcgccatcagcctttgctta

SEQ ID NO: 173040 - DNA, 25 bp, Homo sapien
cgcaactagcttgctcccgggtgga

SEQ ID NO: 173041 - DNA, 25 bp, Homo sapien
tcgcagctgctcctgataattaaag

SEQ ID NO: 173042 - DNA, 25 bp, Homo sapien
ttcgtgctgcgctaaggtaagtttc

SEQ ID NO: 173043 - DNA, 25 bp, Homo sapien
ctccctttgaattgcgaggaaacca

SEQ ID NO: 173044 - DNA, 25 bp, Homo sapien
tgtcacgcagttcaagccaagattc

SEQ ID NO: 173045 - DNA, 25 bp, Homo sapien
cctttggtgttgaagaatctgctcc

SEQ ID NO: 173046 - DNA, 25 bp, Homo sapien
ccgatttgaccgtctagggcctttg

SEQ ID NO: 173047 - DNA, 25 bp, Homo sapien
tcacaggcatgctctacggagggta

SEQ ID NO: 173048 - DNA, 25 bp, Homo sapien
tttctcaattcgtggcctgtgggca

SEQ ID NO: 173049 - DNA, 25 bp, Homo sapien
cgagactttcgggatgaggccattt

SEQ ID NO: 173050 - DNA, 25 bp, Homo sapien
gcttgtagcgatgattctggaacca

SEQ ID NO: 173051 - DNA, 25 bp, Homo sapien
tggacatccacctctccgaatgcgg

SEQ ID NO: 173052 - DNA, 25 bp, Homo sapien
tggccgaccagtttatcacaagctg

SEQ ID NO: 173053 - DNA, 25 bp, Homo sapien
aggccatttcctgagtccacatctg

SEQ ID NO: 173054 - DNA, 25 bp, Homo sapien
gcttcttccttttctcggcgtccga

SEQ ID NO: 173055 - DNA, 25 bp, Homo sapien
cttggagaatagcacccgccgcttc

SEQ ID NO: 173056 - DNA, 25 bp, Homo sapien
tgcggcctcaccagttccaggagac

SEQ ID NO: 173057 - DNA, 25 bp, Homo sapien
cacaaatttgggtccaggcccgctt

SEQ ID NO: 173058 - DNA, 25 bp, Homo sapien
ccgctgccgatctcggagctcggag

SEQ ID NO: 173059 - DNA, 25 bp, Homo sapien
gagctccacaaatttgggtccaggc

SEQ ID NO: 173060 - DNA, 25 bp, Homo sapien
cttctcagggcatcctgtgagggct

SEQ ID NO: 173061 - DNA, 25 bp, Homo sapien
aggccgagctccacaaatttgggtc

SEQ ID NO: 173062 - DNA, 25 bp, Homo sapien
cggaggccgagctccacaaatttgg

SEQ ID NO: 173063 - DNA, 25 bp, Homo sapien
cgcttctcagggcatcctgtgaggg

SEQ ID NO: 173064 - DNA, 25 bp, Homo sapien
aggcccgctttagagcccctgggcg

SEQ ID NO: 173065 - DNA, 25 bp, Homo sapien
cctccttggagtcgccagatgaact

SEQ ID NO: 173066 - DNA, 25 bp, Homo sapien
tcgccagatgaactggtgccgcctg

SEQ ID NO: 173067 - DNA, 25 bp, Homo sapien
ctctcactgcctgggctttggtctt

SEQ ID NO: 173068 - DNA, 25 bp, Homo sapien
gctttggtctttgcccaggagcctg

SEQ ID NO: 173069 - DNA, 25 bp, Homo sapien
ctcgcagcatggcagaccctgacga

SEQ ID NO: 173070 - DNA, 25 bp, Homo sapien
ctgcccgccttggtccgggaatgga

SEQ ID NO: 173071 - DNA, 25 bp, Homo sapien
ccttggtccgggaatggaccgatcg

SEQ ID NO: 173072 - DNA, 25 bp, Homo sapien
ctttgaggcctccttggagtcgcca

SEQ ID NO: 173073 - DNA, 25 bp, Homo sapien
tccggtgttgtcatggttttcaatg

SEQ ID NO: 173074 - DNA, 25 bp, Homo sapien
tccggaataatgcatgattgacgtc

SEQ ID NO: 173075 - DNA, 25 bp, Homo sapien
cgccgggataaatcggagcttgtcc

SEQ ID NO: 173076 - DNA, 25 bp, Homo sapien
acgatcgactctgctggccgtcttt

SEQ ID NO: 173077 - DNA, 25 bp, Homo sapien
cgcggccctggcaatagatttatta

SEQ ID NO: 173078 - DNA, 25 bp, Homo sapien
actgaaatgacttggctgtcctctc

SEQ ID NO: 173079 - DNA, 25 bp, Homo sapien
tgacgtctgctcacaatgcgcttta

SEQ ID NO: 173080 - DNA, 25 bp, Homo sapien
cccggacctgttggaagcatttgtt

SEQ ID NO: 173081 - DNA, 25 bp, Homo sapien
gactcccgggctgcaaattggcaaa

SEQ ID NO: 173082 - DNA, 25 bp, Homo sapien
ggcccgggatacagccttgatctta

SEQ ID NO: 173083 - DNA, 25 bp, Homo sapien
acgatggcttcttggacagactaca

SEQ ID NO: 173084 - DNA, 25 bp, Homo sapien
ctgtgctccgtctagactgctgatt

SEQ ID NO: 173085 - DNA, 25 bp, Homo sapien
ctgcctgggtgaaaattaaactcta

SEQ ID NO: 173086 - DNA, 25 bp, Homo sapien
gctgcccttatcaaaggcctggtga

SEQ ID NO: 173087 - DNA, 25 bp, Homo sapien
cctttctccgagagagcctggtttg

SEQ ID NO: 173088 - DNA, 25 bp, Homo sapien
cttccctggcggaaagcctttatga

SEQ ID NO: 173089 - DNA, 25 bp, Homo sapien
gtttacggctttccgcgcatacgga

SEQ ID NO: 173090 - DNA, 25 bp, Homo sapien
agatcccggatctagggctctagtg

SEQ ID NO: 173091 - DNA, 25 bp, Homo sapien
ccctcaagtgaggaacggcgcttgt

SEQ ID NO: 173092 - DNA, 25 bp, Homo sapien
cagctctcgcgaagccctcaagtga

SEQ ID NO: 173093 - DNA, 25 bp, Homo sapien
tttcccgcctgctgcggacttagcg

SEQ ID NO: 173094 - DNA, 25 bp, Homo sapien
agcaccttcaggtctgagctcttta

SEQ ID NO: 173095 - DNA, 25 bp, Homo sapien
cacggcgtctccttcgccatggagg

SEQ ID NO: 173096 - DNA, 25 bp, Homo sapien
ctcggctagtgacctgtaggacatg

SEQ ID NO: 173097 - DNA, 25 bp, Homo sapien
cgcgatctaatctggctcctatagg

SEQ ID NO: 173098 - DNA, 25 bp, Homo sapien
tcggtcaagatgactccggcctgcg

SEQ ID NO: 173099 - DNA, 25 bp, Homo sapien
tgccacctagaggaaacgcgcagtg

SEQ ID NO: 173100 - DNA, 25 bp, Homo sapien
ctggaaacgcagctcctcgactttg

SEQ ID NO: 173101 - DNA, 25 bp, Homo sapien
gattagctaggactgtgcaacacca

SEQ ID NO: 173102 - DNA, 25 bp, Homo sapien
tccgcttcctgttttcgagggatta

SEQ ID NO: 173103 - DNA, 25 bp, Homo sapien
gctcctataggtggcgctgtgacaa

SEQ ID NO: 173104 - DNA, 25 bp, Homo sapien
cgggaaattttctgcgactccgacg

SEQ ID NO: 173105 - DNA, 25 bp, Homo sapien
ttgacaacaacctgagcagacctgc

SEQ ID NO: 173106 - DNA, 25 bp, Homo sapien
gtcccatttccttccagcgatcagt

SEQ ID NO: 173107 - DNA, 25 bp, Homo sapien
aacaacctgagcagacctgcgccta

SEQ ID NO: 173108 - DNA, 25 bp, Homo sapien
acaacctgagcagacctgcgcctag

SEQ ID NO: 173109 - DNA, 25 bp, Homo sapien
gacaacaacctgagcagacctgcgc

SEQ ID NO: 173110 - DNA, 25 bp, Homo sapien
tgacaacaacctgagcagacctgcg

SEQ ID NO: 173111 - DNA, 25 bp, Homo sapien
ggcttgccagcgagtcccctggctt

SEQ ID NO: 173112 - DNA, 25 bp, Homo sapien
ggtcccatttccttccagcgatcag

SEQ ID NO: 173113 - DNA, 25 bp, Homo sapien
gacctcggactctggctgtcttaca

SEQ ID NO: 173114 - DNA, 25 bp, Homo sapien
cttgccgctgcagtttcagggaaac

SEQ ID NO: 173115 - DNA, 25 bp, Homo sapien
ttttctctctgcaccgcgcgcaatg

SEQ ID NO: 173116 - DNA, 25 bp, Homo sapien
gtcatcactgacctgtagacccgga

SEQ ID NO: 173117 - DNA, 25 bp, Homo sapien
ctcgcgttccgcacaacctgtagtg

SEQ ID NO: 173118 - DNA, 25 bp, Homo sapien
acctgtagtgcttgggtctgacttc

SEQ ID NO: 173119 - DNA, 25 bp, Homo sapien
cggctgacagatttatggagacttc

SEQ ID NO: 173120 - DNA, 25 bp, Homo sapien
gcttaccctgcaagacggggacata

SEQ ID NO: 173121 - DNA, 25 bp, Homo sapien
tcagcccgagtagcaaaccaagttt

SEQ ID NO: 173122 - DNA, 25 bp, Homo sapien
cgttcggctatgttcagggaccata

SEQ ID NO: 173123 - DNA, 25 bp, Homo sapien
tgttcattttgcagagccagccttc

SEQ ID NO: 173124 - DNA, 25 bp, Homo sapien
tcgcatcgtggaactggcccaactg

SEQ ID NO: 173125 - DNA, 25 bp, Homo sapien
tccggacctacaagcagagagaccc

SEQ ID NO: 173126 - DNA, 25 bp, Homo sapien
gttcaggcgtcaagaccgatttctc

SEQ ID NO: 173127 - DNA, 25 bp, Homo sapien
ccaagttttgtttcacacgcgcgca

SEQ ID NO: 173128 - DNA, 25 bp, Homo sapien
agaggcccggcatctcaccacttta

SEQ ID NO: 173129 - DNA, 25 bp, Homo sapien
gggatttaggcgatggaacactttg

SEQ ID NO: 173130 - DNA, 25 bp, Homo sapien
gttcggactttctctccggtggctc

SEQ ID NO: 173131 - DNA, 25 bp, Homo sapien
gaacactttgtgatgggtccctttc

SEQ ID NO: 173132 - DNA, 25 bp, Homo sapien
cgtccctttgctgctacgagccaga

SEQ ID NO: 173133 - DNA, 25 bp, Homo sapien
tacgagccagatccttcgtggactg

SEQ ID NO: 173134 - DNA, 25 bp, Homo sapien
tagagttaaccaaagaaggcgcttc

SEQ ID NO: 173135 - DNA, 25 bp, Homo sapien
tggctctcggacaaacacgcttggc

SEQ ID NO: 173136 - DNA, 25 bp, Homo sapien
tctctccatcagtgagcgacagctc

SEQ ID NO: 173137 - DNA, 25 bp, Homo sapien
cggacgccgaggcaactttacttgg

SEQ ID NO: 173138 - DNA, 25 bp, Homo sapien
cctcggctccgaaaatgtctctgga

SEQ ID NO: 173139 - DNA, 25 bp, Homo sapien
ctgacttcaggcttggcggacatct

SEQ ID NO: 173140 - DNA, 25 bp, Homo sapien
agcctcgcgcactaagctgacttca

SEQ ID NO: 173141 - DNA, 25 bp, Homo sapien
gcgggctgtccttacctgcagaacc

SEQ ID NO: 173142 - DNA, 25 bp, Homo sapien
tctgggcaacggtttcaggacacgc

SEQ ID NO: 173143 - DNA, 25 bp, Homo sapien
ttggggcacccactactcgcaatca

SEQ ID NO: 173144 - DNA, 25 bp, Homo sapien
actgctccgggagcgctgaattttg

SEQ ID NO: 173145 - DNA, 25 bp, Homo sapien
ggagcccgatctggtgccattttca

SEQ ID NO: 173146 - DNA, 25 bp, Homo sapien
ccgcggaatctgtacttagtgaatg

SEQ ID NO: 173147 - DNA, 25 bp, Homo sapien
cggccgcagacttttccttggagaa

SEQ ID NO: 173148 - DNA, 25 bp, Homo sapien
ccaggcgcatctcaggtaaacggtt

SEQ ID NO: 173149 - DNA, 25 bp, Homo sapien
ttagggcaaccaccgcagcagacta

SEQ ID NO: 173150 - DNA, 25 bp, Homo sapien
tctgcgctcgtcgtcttggattcga

SEQ ID NO: 173151 - DNA, 25 bp, Homo sapien
gacaacgttttgctctttcagaaga

SEQ ID NO: 173152 - DNA, 25 bp, Homo sapien
gtatgaggccacaagacaccgtttt

SEQ ID NO: 173153 - DNA, 25 bp, Homo sapien
caccagggatggcttcccagctgga

SEQ ID NO: 173154 - DNA, 25 bp, Homo sapien
agccctgctttgctcttttcgttgg

SEQ ID NO: 173155 - DNA, 25 bp, Homo sapien
attgttgttcacctcgcggcccata

SEQ ID NO: 173156 - DNA, 25 bp, Homo sapien
aaaagctggcttctccttgagggca

SEQ ID NO: 173157 - DNA, 25 bp, Homo sapien
acctgtgtggctgatgagtccgact

SEQ ID NO: 173158 - DNA, 25 bp, Homo sapien
cttttgatgggctgagaaccgcctc

SEQ ID NO: 173159 - DNA, 25 bp, Homo sapien
tcgcggcccatacggctgaagaaag

SEQ ID NO: 173160 - DNA, 25 bp, Homo sapien
ttcgttggccaagcacaattgtgtt

SEQ ID NO: 173161 - DNA, 25 bp, Homo sapien
tgttgacttttaggtcccgggctca

SEQ ID NO: 173162 - DNA, 25 bp, Homo sapien
cggtctgagaactgcgagaagccca

SEQ ID NO: 173163 - DNA, 25 bp, Homo sapien
tgcacttgtcacctcgagacgcttg

SEQ ID NO: 173164 - DNA, 25 bp, Homo sapien
cccgggctcaacaggagatttattc

SEQ ID NO: 173165 - DNA, 25 bp, Homo sapien
cagatgttttcttcctgacccaggg

SEQ ID NO: 173166 - DNA, 25 bp, Homo sapien
actccctcggaaccacagatgtttt

SEQ ID NO: 173167 - DNA, 25 bp, Homo sapien
cgggcgaaattcctaagaccagcga

SEQ ID NO: 173168 - DNA, 25 bp, Homo sapien
tattcgctaggaagggaaaatgccc

SEQ ID NO: 173169 - DNA, 25 bp, Homo sapien
agaaagctgtctccgctgccggtca

SEQ ID NO: 173170 - DNA, 25 bp, Homo sapien
gcgcctttctacttgcgtgcgagca

SEQ ID NO: 173171 - DNA, 25 bp, Homo sapien
gcctggctcagcgtttgtttttaag

SEQ ID NO: 173172 - DNA, 25 bp, Homo sapien
agcgactccgacttctgctggtgcg

SEQ ID NO: 173173 - DNA, 25 bp, Homo sapien
ctgacaggctcaatcaccacggcga

SEQ ID NO: 173174 - DNA, 25 bp, Homo sapien
ctacagtgcgtcctcgctgacaggc

SEQ ID NO: 173175 - DNA, 25 bp, Homo sapien
ttggccctaagacccgctacagtgc

SEQ ID NO: 173176 - DNA, 25 bp, Homo sapien
ggacgtacatctagcccgactctct

SEQ ID NO: 173177 - DNA, 25 bp, Homo sapien
agctgcgcttgaacgtcttggcgtc

SEQ ID NO: 173178 - DNA, 25 bp, Homo sapien
tggagcccaggcctgagttcatgtt

SEQ ID NO: 173179 - DNA, 25 bp, Homo sapien
tgttgccgctcgtagtcatggtgtt

SEQ ID NO: 173180 - DNA, 25 bp, Homo sapien
ccgggttggcataggacatgttgaa

SEQ ID NO: 173181 - DNA, 25 bp, Homo sapien
tcagcgtgagcatcttgctgggcgc

SEQ ID NO: 173182 - DNA, 25 bp, Homo sapien
ccatggggctcatgcacgggttcat

SEQ ID NO: 173183 - DNA, 25 bp, Homo sapien
agtcatgctgttcatggcgcccgcc

SEQ ID NO: 173184 - DNA, 25 bp, Homo sapien
acatgttgaaggacgccggggtcat

SEQ ID NO: 173185 - DNA, 25 bp, Homo sapien
tcagccgagccaagtgacgttaggc

SEQ ID NO: 173186 - DNA, 25 bp, Homo sapien
cttcgtcactagaaaccgggtcatc

SEQ ID NO: 173187 - DNA, 25 bp, Homo sapien
agcggggccctcactttgtttgcaa

SEQ ID NO: 173188 - DNA, 25 bp, Homo sapien
ttcctcctgagagcttcagactaga

SEQ ID NO: 173189 - DNA, 25 bp, Homo sapien
ctgggcttagagaccttgtgggata

SEQ ID NO: 173190 - DNA, 25 bp, Homo sapien
aaccatccagccctgtgcgaagcga

SEQ ID NO: 173191 - DNA, 25 bp, Homo sapien
atcttacgtcgcttgagtgcccacc

SEQ ID NO: 173192 - DNA, 25 bp, Homo sapien
tttgtccgccgcacaaagacgctcg

SEQ ID NO: 173193 - DNA, 25 bp, Homo sapien
gttctgtacagagtcctaacccgta

SEQ ID NO: 173194 - DNA, 25 bp, Homo sapien
acgggcctttgcaggcagttctgta

SEQ ID NO: 173195 - DNA, 25 bp, Homo sapien
cccaactgggacacggctcagctta

SEQ ID NO: 173196 - DNA, 25 bp, Homo sapien
tgtggtcgttaacgcggttcaaagc

SEQ ID NO: 173197 - DNA, 25 bp, Homo sapien
gcttaagtcctccttctgcagggga

SEQ ID NO: 173198 - DNA, 25 bp, Homo sapien
gtcaggtgacggcttcagcaaccca

SEQ ID NO: 173199 - DNA, 25 bp, Homo sapien
cggtgcccattcgagtctctccagg

SEQ ID NO: 173200 - DNA, 25 bp, Homo sapien
gacagggtccttcctatttagcagg

SEQ ID NO: 173201 - DNA, 25 bp, Homo sapien
tcgctctggattctgccggtgggaa

SEQ ID NO: 173202 - DNA, 25 bp, Homo sapien
ggaagcagaaacttcgctctggatt

SEQ ID NO: 173203 - DNA, 25 bp, Homo sapien
agaaacttcgctctggattctgccg

SEQ ID NO: 173204 - DNA, 25 bp, Homo sapien
aacttcgctctggattctgccggtg

SEQ ID NO: 173205 - DNA, 25 bp, Homo sapien
atgcggatctgagaagagacggtgc

SEQ ID NO: 173206 - DNA, 25 bp, Homo sapien
agacgacatgccagggctgcgacgc

SEQ ID NO: 173207 - DNA, 25 bp, Homo sapien
tccgattcccgcagcaggaagcaga

SEQ ID NO: 173208 - DNA, 25 bp, Homo sapien
ccgggcaagacgacatgccagggct

SEQ ID NO: 173209 - DNA, 25 bp, Homo sapien
cgggagcagcgtctttttagcgccg

SEQ ID NO: 173210 - DNA, 25 bp, Homo sapien
accgagcgcgtcctctcttcggtgg

SEQ ID NO: 173211 - DNA, 25 bp, Homo sapien
ttcggtggagccagtcgagcccacc

SEQ ID NO: 173212 - DNA, 25 bp, Homo sapien
ccctaggcacaggaaaggcctgttg

SEQ ID NO: 173213 - DNA, 25 bp, Homo sapien
aaggcctgttggacactcgccgagc

SEQ ID NO: 173214 - DNA, 25 bp, Homo sapien
gctcaccgccacctgaattggagcg

SEQ ID NO: 173215 - DNA, 25 bp, Homo sapien
cagcgtctttttagcgccgggagaa

SEQ ID NO: 173216 - DNA, 25 bp, Homo sapien
ccgccacctgaattggagcggaggc

SEQ ID NO: 173217 - DNA, 25 bp, Homo sapien
ggcctccgaccagaccatcaaagag

SEQ ID NO: 173218 - DNA, 25 bp, Homo sapien
cagcccggacgtcgagaagataccc

SEQ ID NO: 173219 - DNA, 25 bp, Homo sapien
cttaaaggccctgcgatgtccgcgg

SEQ ID NO: 173220 - DNA, 25 bp, Homo sapien
gctccaggcaagacccggtcgtttc

SEQ ID NO: 173221 - DNA, 25 bp, Homo sapien
gggacttttacttgcggagctccgc

SEQ ID NO: 173222 - DNA, 25 bp, Homo sapien
tctccgcagaggacggctacatgga

SEQ ID NO: 173223 - DNA, 25 bp, Homo sapien
gtgaggatccgcagcaacttcgtga

SEQ ID NO: 173224 - DNA, 25 bp, Homo sapien
cgtccatcgaagagatcatcgcctc

SEQ ID NO: 173225 - DNA, 25 bp, Homo sapien
gcacggtggttgtcctttcttctca

SEQ ID NO: 173226 - DNA, 25 bp, Homo sapien
agcctaagctgcctgctgtgttata

SEQ ID NO: 173227 - DNA, 25 bp, Homo sapien
tgcgaatggttcactcaggtccctg

SEQ ID NO: 173228 - DNA, 25 bp, Homo sapien
ctctgagcgctacgagctttattaa

SEQ ID NO: 173229 - DNA, 25 bp, Homo sapien
aacgctcgcagcttagggccagttt

SEQ ID NO: 173230 - DNA, 25 bp, Homo sapien
gcgcagccttatctttcccgagtga

SEQ ID NO: 173231 - DNA, 25 bp, Homo sapien
gccagtttccgcgattctaagagta

SEQ ID NO: 173232 - DNA, 25 bp, Homo sapien
cgcgaagatcgtcaacctgctaaca

SEQ ID NO: 173233 - DNA, 25 bp, Homo sapien
ccgtgcctacagtgtggaagacttc

SEQ ID NO: 173234 - DNA, 25 bp, Homo sapien
ctgacagcctttgatggaggaaccc

SEQ ID NO: 173235 - DNA, 25 bp, Homo sapien
atgcctcagctggatggacaacgcc

SEQ ID NO: 173236 - DNA, 25 bp, Homo sapien
acggtggcttgcaacatgctcatgc

SEQ ID NO: 173237 - DNA, 25 bp, Homo sapien
ctcggagcgcaagatcaccttaatg

SEQ ID NO: 173238 - DNA, 25 bp, Homo sapien
ggcgtcttccgtaatggcacctgca

SEQ ID NO: 173239 - DNA, 25 bp, Homo sapien
ctaagatgcgcatggtggccctcaa

SEQ ID NO: 173240 - DNA, 25 bp, Homo sapien
ctgtgctacgtgctcatcattgcta

SEQ ID NO: 173241 - DNA, 25 bp, Homo sapien
caggcaaagcctcccaagtcgtcta

SEQ ID NO: 173242 - DNA, 25 bp, Homo sapien
gcgaacgccggcctcattctctgag

SEQ ID NO: 173243 - DNA, 25 bp, Homo sapien
gcaaaggctcgttctccagggtgca

SEQ ID NO: 173244 - DNA, 25 bp, Homo sapien
aggtggcatcgcatctccttccagc

SEQ ID NO: 173245 - DNA, 25 bp, Homo sapien
tcgtccgcgatgcaagtaactgaga

SEQ ID NO: 173246 - DNA, 25 bp, Homo sapien
acatcgcccgagagtttgtcccagc

SEQ ID NO: 173247 - DNA, 25 bp, Homo sapien
agctctgcgcatttgccagcacgga

SEQ ID NO: 173248 - DNA, 25 bp, Homo sapien
cgcagagctgctcccaacttggatc

SEQ ID NO: 173249 - DNA, 25 bp, Homo sapien
cgcagcctccgctttgcaaaatctg

SEQ ID NO: 173250 - DNA, 25 bp, Homo sapien
gacgaggcggccctttcctcactgt

SEQ ID NO: 173251 - DNA, 25 bp, Homo sapien
caggagcagtccgtggcaccgcaat

SEQ ID NO: 173252 - DNA, 25 bp, Homo sapien
gcaccgcaatcaggggtggcgccac

SEQ ID NO: 173253 - DNA, 25 bp, Homo sapien
ctgagcttgcttaataaccggagga

SEQ ID NO: 173254 - DNA, 25 bp, Homo sapien
taaccggaggatttgagaaaggcgc

SEQ ID NO: 173255 - DNA, 25 bp, Homo sapien
gaagaacccggaagacccaggcagc

SEQ ID NO: 173256 - DNA, 25 bp, Homo sapien
ctctgccacgtcaagaggaggggac

SEQ ID NO: 173257 - DNA, 25 bp, Homo sapien
catccagggtcaacgccgctctggg

SEQ ID NO: 173258 - DNA, 25 bp, Homo sapien
cgcccactggaacacgggttccatg

SEQ ID NO: 173259 - DNA, 25 bp, Homo sapien
gcctcaaggggtgcggccctctcag

SEQ ID NO: 173260 - DNA, 25 bp, Homo sapien
acacgggttccatgtgccatccagg

SEQ ID NO: 173261 - DNA, 25 bp, Homo sapien
tccatgtgccatccagggtcaacgc

SEQ ID NO: 173262 - DNA, 25 bp, Homo sapien
tgtcagctgagcacgggcgcctcaa

SEQ ID NO: 173263 - DNA, 25 bp, Homo sapien
ggcagctcagcctgtcagctgagca

SEQ ID NO: 173264 - DNA, 25 bp, Homo sapien
aggaaggtgagtctccctggagccc

SEQ ID NO: 173265 - DNA, 25 bp, Homo sapien
tttgaaaaccatggcgtgggtacca

SEQ ID NO: 173266 - DNA, 25 bp, Homo sapien
ggtgtctattagtacgcctgcgctg

SEQ ID NO: 173267 - DNA, 25 bp, Homo sapien
ccgagcggaactggctggtttgaaa

SEQ ID NO: 173268 - DNA, 25 bp, Homo sapien
aagagttgatgcctcggctattgcc

SEQ ID NO: 173269 - DNA, 25 bp, Homo sapien
tattgccggtagagccttgcgactt

SEQ ID NO: 173270 - DNA, 25 bp, Homo sapien
cttgacggaaggtttcgatccctcg

SEQ ID NO: 173271 - DNA, 25 bp, Homo sapien
ccgaggacgcctcaggaatacctga

SEQ ID NO: 173272 - DNA, 25 bp, Homo sapien
cgctgtgacctagaatgggcgcatg

SEQ ID NO: 173273 - DNA, 25 bp, Homo sapien
agccaaccagctgagatgcgatccg

SEQ ID NO: 173274 - DNA, 25 bp, Homo sapien
ctgtggctaagagaccgaggtattc

SEQ ID NO: 173275 - DNA, 25 bp, Homo sapien
cgaggtattcacacgacttcccaaa

SEQ ID NO: 173276 - DNA, 25 bp, Homo sapien
tgagtctggtactggagagagccca

SEQ ID NO: 173277 - DNA, 25 bp, Homo sapien
cacttcggggctaccaaatcctagg

SEQ ID NO: 173278 - DNA, 25 bp, Homo sapien
tcctagggccgaactaaagtctgac

SEQ ID NO: 173279 - DNA, 25 bp, Homo sapien
tctgacgggagctctaaccaaagcc

SEQ ID NO: 173280 - DNA, 25 bp, Homo sapien
ggccgccattctatccctgtggcta

SEQ ID NO: 173281 - DNA, 25 bp, Homo sapien
acattcgcaagctcaccgggcggga

SEQ ID NO: 173282 - DNA, 25 bp, Homo sapien
ttgaggccggaagacaacgctcatc

SEQ ID NO: 173283 - DNA, 25 bp, Homo sapien
cggcatgctttcttggcctgtgaga

SEQ ID NO: 173284 - DNA, 25 bp, Homo sapien
cggctcggcctgtaaagcagtctca

SEQ ID NO: 173285 - DNA, 25 bp, Homo sapien
tcgccgtgagaactttgcaggaaca

SEQ ID NO: 173286 - DNA, 25 bp, Homo sapien
agaagacccggactgctgattcccg

SEQ ID NO: 173287 - DNA, 25 bp, Homo sapien
caggcccggaactgcagcacaaagc

SEQ ID NO: 173288 - DNA, 25 bp, Homo sapien
agccttaagaagactggaacctcga

SEQ ID NO: 173289 - DNA, 25 bp, Homo sapien
gtcagaggtcccgaagccagtcctc

SEQ ID NO: 173290 - DNA, 25 bp, Homo sapien
gaccgaaggctgtgtgttctccgcc

SEQ ID NO: 173291 - DNA, 25 bp, Homo sapien
acccggacacgtctgcgaagcttgc

SEQ ID NO: 173292 - DNA, 25 bp, Homo sapien
tgaggccgaatctcatcctctagtc

SEQ ID NO: 173293 - DNA, 25 bp, Homo sapien
ccttgggacatagccctggtctttg

SEQ ID NO: 173294 - DNA, 25 bp, Homo sapien
cgccgagacgcctctaggagaagtc

SEQ ID NO: 173295 - DNA, 25 bp, Homo sapien
tttttctgactggaatgacggcggc

SEQ ID NO: 173296 - DNA, 25 bp, Homo sapien
tcaaccgtatttggggctgctcctg

SEQ ID NO: 173297 - DNA, 25 bp, Homo sapien
ctgtctcggaagaggctgctgattg

SEQ ID NO: 173298 - DNA, 25 bp, Homo sapien
aaaactggctcggatgctcctcgct

SEQ ID NO: 173299 - DNA, 25 bp, Homo sapien
cctcataggcaaaggtcagcacggc

SEQ ID NO: 173300 - DNA, 25 bp, Homo sapien
ccagcagcctgtctcggaagaggct

SEQ ID NO: 173301 - DNA, 25 bp, Homo sapien
ttgcggccaggatcacccgatgcac

SEQ ID NO: 173302 - DNA, 25 bp, Homo sapien
tcttcgtccagcaacagtctctgct

SEQ ID NO: 173303 - DNA, 25 bp, Homo sapien
ctgggcctcggcgaaaaactggctc

SEQ ID NO: 173304 - DNA, 25 bp, Homo sapien
aggctgctgattgcggccaggatca

SEQ ID NO: 173305 - DNA, 25 bp, Homo sapien
tctcggcggaaccaagtagaacaca

SEQ ID NO: 173306 - DNA, 25 bp, Homo sapien
tcggttaattttggcgctcggtcga

SEQ ID NO: 173307 - DNA, 25 bp, Homo sapien
ctgcgcccagtcacatctgtaagtc

SEQ ID NO: 173308 - DNA, 25 bp, Homo sapien
gctcgtaaacttcagcggcccggaa

SEQ ID NO: 173309 - DNA, 25 bp, Homo sapien
cgaggccggcacactgagtaactgc

SEQ ID NO: 173310 - DNA, 25 bp, Homo sapien
aactctactcacgtgcgtccgaggc

SEQ ID NO: 173311 - DNA, 25 bp, Homo sapien
ggctgcggcactgacaagaacaaca

SEQ ID NO: 173312 - DNA, 25 bp, Homo sapien
ccgcacttgcgcatgaggaattcca

SEQ ID NO: 173313 - DNA, 25 bp, Homo sapien
gtcactcacccatataagcgcgctg

SEQ ID NO: 173314 - DNA, 25 bp, Homo sapien
taagcgcgctgcacttttggcacag

SEQ ID NO: 173315 - DNA, 25 bp, Homo sapien
gcctgttcccgccatttattcccgc

SEQ ID NO: 173316 - DNA, 25 bp, Homo sapien
gggttcacctgtcttcttcccgcag

SEQ ID NO: 173317 - DNA, 25 bp, Homo sapien
gcatgcccactaaagcacgtcacta

SEQ ID NO: 173318 - DNA, 25 bp, Homo sapien
ctaaagcacgtcactaaggcaagtc

SEQ ID NO: 173319 - DNA, 25 bp, Homo sapien
gcacgtcactaaggcaagtcactca

SEQ ID NO: 173320 - DNA, 25 bp, Homo sapien
ggcaagtcactcacccatataagcg

SEQ ID NO: 173321 - DNA, 25 bp, Homo sapien
cctgataaatcggttcagaaccagt

SEQ ID NO: 173322 - DNA, 25 bp, Homo sapien
ttgcctcgcgcctgaactgcggact

SEQ ID NO: 173323 - DNA, 25 bp, Homo sapien
ttgcccacacgcgacgctttgggaa

SEQ ID NO: 173324 - DNA, 25 bp, Homo sapien
agggctcagttccacgcggccagga

SEQ ID NO: 173325 - DNA, 25 bp, Homo sapien
cagaaccagtctggctgggaggccc

SEQ ID NO: 173326 - DNA, 25 bp, Homo sapien
cctggggatttcctggcgcttcgcc

SEQ ID NO: 173327 - DNA, 25 bp, Homo sapien
cctcagcctggggatttcctggcgc

SEQ ID NO: 173328 - DNA, 25 bp, Homo sapien
tctcacggactctcggggtctggcc

SEQ ID NO: 173329 - DNA, 25 bp, Homo sapien
ttcgaggctttgcacacggagtccc

SEQ ID NO: 173330 - DNA, 25 bp, Homo sapien
tcctggtcttccttcttggcagcgt

SEQ ID NO: 173331 - DNA, 25 bp, Homo sapien
gccgttggttcgaggctttgcacac

SEQ ID NO: 173332 - DNA, 25 bp, Homo sapien
gcgttctttttgtccattgctgatg

SEQ ID NO: 173333 - DNA, 25 bp, Homo sapien
cattgctgatgcaggtagcgcagga

SEQ ID NO: 173334 - DNA, 25 bp, Homo sapien
ttccttcttggcagcgttctttttg

SEQ ID NO: 173335 - DNA, 25 bp, Homo sapien
ctgttcagacgggtactctcgggtg

SEQ ID NO: 173336 - DNA, 25 bp, Homo sapien
tttcggtcacgatgatctgttcaga

SEQ ID NO: 173337 - DNA, 25 bp, Homo sapien
cacacgcacattaggctggggcgtc

SEQ ID NO: 173338 - DNA, 25 bp, Homo sapien
gacagccggcggtactcatagatga

SEQ ID NO: 173339 - DNA, 25 bp, Homo sapien
ccagcctatttgtccgcagttctga

SEQ ID NO: 173340 - DNA, 25 bp, Homo sapien
gaggccatgccagagcccagaactc

SEQ ID NO: 173341 - DNA, 25 bp, Homo sapien
agaagcgacgtgtcccactgtcctg

SEQ ID NO: 173342 - DNA, 25 bp, Homo sapien
ttcctccgtaataagaagcgacgtg

SEQ ID NO: 173343 - DNA, 25 bp, Homo sapien
aggtcgtgccgaatcttcctccgta

SEQ ID NO: 173344 - DNA, 25 bp, Homo sapien
cgcgtggctgtacaggcgtatttta

SEQ ID NO: 173345 - DNA, 25 bp, Homo sapien
atcgtgcccatagtgcccgactaca

SEQ ID NO: 173346 - DNA, 25 bp, Homo sapien
ggtgctgtttgcttccaaggctatc

SEQ ID NO: 173347 - DNA, 25 bp, Homo sapien
aaggctatcctgcagctgctagtga

SEQ ID NO: 173348 - DNA, 25 bp, Homo sapien
ggcccttcatcgaccgcatgagcta

SEQ ID NO: 173349 - DNA, 25 bp, Homo sapien
atgttcgcctctacagtcctgttcg

SEQ ID NO: 173350 - DNA, 25 bp, Homo sapien
agccttcgccgacacgtctggcata

SEQ ID NO: 173351 - DNA, 25 bp, Homo sapien
ggcgctggccttcattagcttcgga

SEQ ID NO: 173352 - DNA, 25 bp, Homo sapien
tcccgggatcggctaagagtagctg

SEQ ID NO: 173353 - DNA, 25 bp, Homo sapien
ggctctgcttgcaacttctctcgga

SEQ ID NO: 173354 - DNA, 25 bp, Homo sapien
cccagagaccgatgatagtcgagtt

SEQ ID NO: 173355 - DNA, 25 bp, Homo sapien
aaaaactactacttccgtggagctg

SEQ ID NO: 173356 - DNA, 25 bp, Homo sapien
tcttgatgccctcggaggcagtctc

SEQ ID NO: 173357 - DNA, 25 bp, Homo sapien
aggcagtctcaagcagctggtctga

SEQ ID NO: 173358 - DNA, 25 bp, Homo sapien
actgcccgggatccttctgaggcct

SEQ ID NO: 173359 - DNA, 25 bp, Homo sapien
cccgacgcaaggaagctttgtatcg

SEQ ID NO: 173360 - DNA, 25 bp, Homo sapien
ctgaggccttccaggctttgcaagc

SEQ ID NO: 173361 - DNA, 25 bp, Homo sapien
gcgctgcgaacccacgtgacttttt

SEQ ID NO: 173362 - DNA, 25 bp, Homo sapien
ttcggctaggtcgtcacaggctccg

SEQ ID NO: 173363 - DNA, 25 bp, Homo sapien
cacgtgactttttcgcctccaggga

SEQ ID NO: 173364 - DNA, 25 bp, Homo sapien
gacgcatgcgcatcgtgccctggac

SEQ ID NO: 173365 - DNA, 25 bp, Homo sapien
catgcgcatcgtgccctggaccagg

SEQ ID NO: 173366 - DNA, 25 bp, Homo sapien
tgactttttcgcctccagggacact

SEQ ID NO: 173367 - DNA, 25 bp, Homo sapien
tgccatcttcggctaggtcgtcaca

SEQ ID NO: 173368 - DNA, 25 bp, Homo sapien
acggaggcggtgaagtgccatcttc

SEQ ID NO: 173369 - DNA, 25 bp, Homo sapien
ggtcgtctctgcagtcgactgagta

SEQ ID NO: 173370 - DNA, 25 bp, Homo sapien
tgaaccgtgttcctgcagaaacttg

SEQ ID NO: 173371 - DNA, 25 bp, Homo sapien
aatgtccttcttgggcagctgctca

SEQ ID NO: 173372 - DNA, 25 bp, Homo sapien
gcctctgctctagcagtcgggattg

SEQ ID NO: 173373 - DNA, 25 bp, Homo sapien
cctacgcctctggtaccgaatctga

SEQ ID NO: 173374 - DNA, 25 bp, Homo sapien
ggcttctttgttgagtccgggttga

SEQ ID NO: 173375 - DNA, 25 bp, Homo sapien
ctgagtagaagaccgctagagatct

SEQ ID NO: 173376 - DNA, 25 bp, Homo sapien
ggggcctgtctttgagtgacgtcaa

SEQ ID NO: 173377 - DNA, 25 bp, Homo sapien
aacgctttttcagacgtggggctca

SEQ ID NO: 173378 - DNA, 25 bp, Homo sapien
agccttcggtggttgtcggcctaat

SEQ ID NO: 173379 - DNA, 25 bp, Homo sapien
cccgccttctcgttccagagttttg

SEQ ID NO: 173380 - DNA, 25 bp, Homo sapien
acggaaactcagtagcggcattttc

SEQ ID NO: 173381 - DNA, 25 bp, Homo sapien
tttccgggaagccagccaatcattc

SEQ ID NO: 173382 - DNA, 25 bp, Homo sapien
ggggctcaagtatctcccgatcatc

SEQ ID NO: 173383 - DNA, 25 bp, Homo sapien
ccgatcatctgggactccgggttgc

SEQ ID NO: 173384 - DNA, 25 bp, Homo sapien
cgcaccggggaccatatttagagta

SEQ ID NO: 173385 - DNA, 25 bp, Homo sapien
ttcgtttcgtcttcgtagggcacgc

SEQ ID NO: 173386 - DNA, 25 bp, Homo sapien
cgtaccttggatgaagagcctggca

SEQ ID NO: 173387 - DNA, 25 bp, Homo sapien
ttcaaatttgaagagcccgccctcc

SEQ ID NO: 173388 - DNA, 25 bp, Homo sapien
gacggcagtgtgtccacaaaaagta

SEQ ID NO: 173389 - DNA, 25 bp, Homo sapien
taggcgaccctaagctgtcacaggc

SEQ ID NO: 173390 - DNA, 25 bp, Homo sapien
ggcgagctcctctagttgtcttcaa

SEQ ID NO: 173391 - DNA, 25 bp, Homo sapien
ctttcctctcgtgaagctctgccgg

SEQ ID NO: 173392 - DNA, 25 bp, Homo sapien
ctactgcggctaagtttggcctttc

SEQ ID NO: 173393 - DNA, 25 bp, Homo sapien
cggggttgctcttttgctcataaga

SEQ ID NO: 173394 - DNA, 25 bp, Homo sapien
tccgtcacgtggtgtcagacagacc

SEQ ID NO: 173395 - DNA, 25 bp, Homo sapien
aatcacgcgcattcttcggccacga

SEQ ID NO: 173396 - DNA, 25 bp, Homo sapien
agggacctgtcttcctaactgccag

SEQ ID NO: 173397 - DNA, 25 bp, Homo sapien
aagcgcgcctctgatcacgtgacca

SEQ ID NO: 173398 - DNA, 25 bp, Homo sapien
cggcaagcttgagtcaggaccctta

SEQ ID NO: 173399 - DNA, 25 bp, Homo sapien
gggctcagcgtgcacccttctttgt

SEQ ID NO: 173400 - DNA, 25 bp, Homo sapien
cagccttagctggtttcatgatttc

SEQ ID NO: 173401 - DNA, 25 bp, Homo sapien
tacaataccggtaacagcgagctgg

SEQ ID NO: 173402 - DNA, 25 bp, Homo sapien
tgcctcgaagtcaaaatgcgctctc

SEQ ID NO: 173403 - DNA, 25 bp, Homo sapien
cgcctgcgcgcatttatatacgttg

SEQ ID NO: 173404 - DNA, 25 bp, Homo sapien
cccatggcgacacagtaacgtcggc

SEQ ID NO: 173405 - DNA, 25 bp, Homo sapien
ttcaggacgtcccaaccagagacgc

SEQ ID NO: 173406 - DNA, 25 bp, Homo sapien
aggatgtgacgactctctttcagga

SEQ ID NO: 173407 - DNA, 25 bp, Homo sapien
tccctcgcgggaaccatagagtcct

SEQ ID NO: 173408 - DNA, 25 bp, Homo sapien
atgcgctctcttaactacgcctgcg

SEQ ID NO: 173409 - DNA, 25 bp, Homo sapien
gcaacgccaatcctgttacacgata

SEQ ID NO: 173410 - DNA, 25 bp, Homo sapien
ctcacaccgggtgcctgggaaaatc

SEQ ID NO: 173411 - DNA, 25 bp, Homo sapien
agctaacgtagtggtggcatccaga

SEQ ID NO: 173412 - DNA, 25 bp, Homo sapien
atacagactcgcatcgccgaacggg

SEQ ID NO: 173413 - DNA, 25 bp, Homo sapien
caccgccacttgcaagagagggaga

SEQ ID NO: 173414 - DNA, 25 bp, Homo sapien
gctctcttgcctggattcgccttta

SEQ ID NO: 173415 - DNA, 25 bp, Homo sapien
ctccaaaatagcctttagcgcccgg

SEQ ID NO: 173416 - DNA, 25 bp, Homo sapien
ttcccggagccgaaagcagagtcca

SEQ ID NO: 173417 - DNA, 25 bp, Homo sapien
ttcgcgtactgacggaaacactggc

SEQ ID NO: 173418 - DNA, 25 bp, Homo sapien
tgagattttaagcagcctagcgctc

SEQ ID NO: 173419 - DNA, 25 bp, Homo sapien
gtggcctcctctacttgagatttta

SEQ ID NO: 173420 - DNA, 25 bp, Homo sapien
gcctgcagacgcctaccttaatgaa

SEQ ID NO: 173421 - DNA, 25 bp, Homo sapien
gtacaggcctgtaatggcggcacca

SEQ ID NO: 173422 - DNA, 25 bp, Homo sapien
gccggtttgaacagacacgactgta

SEQ ID NO: 173423 - DNA, 25 bp, Homo sapien
agagcgagaaccctggccgaatttt

SEQ ID NO: 173424 - DNA, 25 bp, Homo sapien
ggcggcacatattgaggccatattt

SEQ ID NO: 173425 - DNA, 25 bp, Homo sapien
tccctgtaacgcagaggcacacctg

SEQ ID NO: 173426 - DNA, 25 bp, Homo sapien
tcagtctcgcgttcttcttggaagc

SEQ ID NO: 173427 - DNA, 25 bp, Homo sapien
ccgtgttgagcctctgtcagcagac

SEQ ID NO: 173428 - DNA, 25 bp, Homo sapien
ccgttgggcgagatgaagctacact

SEQ ID NO: 173429 - DNA, 25 bp, Homo sapien
cggaccagtccaacaggcaggcaga

SEQ ID NO: 173430 - DNA, 25 bp, Homo sapien
cgggcttcatacagacacggtgcta

SEQ ID NO: 173431 - DNA, 25 bp, Homo sapien
tgcctccggagagcagccaccaaaa

SEQ ID NO: 173432 - DNA, 25 bp, Homo sapien
ttacggggccactcagacagttcta

SEQ ID NO: 173433 - DNA, 25 bp, Homo sapien
tccatgtcccgaagaccgtagtctg

SEQ ID NO: 173434 - DNA, 25 bp, Homo sapien
cgaggcagagtcttcccatcatagc

SEQ ID NO: 173435 - DNA, 25 bp, Homo sapien
ccatcatagcgtgaagaggcggctg

SEQ ID NO: 173436 - DNA, 25 bp, Homo sapien
tcgcctgtgtgttagctgcgcctgt

SEQ ID NO: 173437 - DNA, 25 bp, Homo sapien
agggtctgctctgctgttgtgcgca

SEQ ID NO: 173438 - DNA, 25 bp, Homo sapien
tgttgtgcgcatgtctgtcctcgat

SEQ ID NO: 173439 - DNA, 25 bp, Homo sapien
tgtcctcgatctgcgagtcgggctg

SEQ ID NO: 173440 - DNA, 25 bp, Homo sapien
accgtagtctgatgatcgaggcaga

SEQ ID NO: 173441 - DNA, 25 bp, Homo sapien
ccgcatctacaaacggaaggtgcta

SEQ ID NO: 173442 - DNA, 25 bp, Homo sapien
cctgctctcgaactaaggccggcga

SEQ ID NO: 173443 - DNA, 25 bp, Homo sapien
ttagcttaccgagaaacagcgcccg

SEQ ID NO: 173444 - DNA, 25 bp, Homo sapien
ctttcgcagctctcgcctaacagga

SEQ ID NO: 173445 - DNA, 25 bp, Homo sapien
tggagaccatgaggttccgcatcta

SEQ ID NO: 173446 - DNA, 25 bp, Homo sapien
agccgccatgcctgagacctttttc

SEQ ID NO: 173447 - DNA, 25 bp, Homo sapien
ggcttcgtcctctggagcagcaatg

SEQ ID NO: 173448 - DNA, 25 bp, Homo sapien
cagttgcgggttgtcataacggtcc

SEQ ID NO: 173449 - DNA, 25 bp, Homo sapien
tcctcgagtcgaggcacagcagctt

SEQ ID NO: 173450 - DNA, 25 bp, Homo sapien
gttgaattgtgccttgccgcggcca

SEQ ID NO: 173451 - DNA, 25 bp, Homo sapien
gccggtagtcaggtttcctcgagtc

SEQ ID NO: 173452 - DNA, 25 bp, Homo sapien
cagcggcagttcgatggtgatcacc

SEQ ID NO: 173453 - DNA, 25 bp, Homo sapien
gaactgcttctcgacggcctccagg

SEQ ID NO: 173454 - DNA, 25 bp, Homo sapien
acgtcgtagaccatgtagcggctgc

SEQ ID NO: 173455 - DNA, 25 bp, Homo sapien
cagacattcacaaagcagcgccgcg

SEQ ID NO: 173456 - DNA, 25 bp, Homo sapien
caccaacgcgttgctgcagacattc

SEQ ID NO: 173457 - DNA, 25 bp, Homo sapien
tcaccgctgccctagacattgcagg

SEQ ID NO: 173458 - DNA, 25 bp, Homo sapien
cgcgtggcgctaaaccctgttaaga

SEQ ID NO: 173459 - DNA, 25 bp, Homo sapien
tatttgcgatttggcgccaccgccg

SEQ ID NO: 173460 - DNA, 25 bp, Homo sapien
ccgctccggcgccatatttgcgatt

SEQ ID NO: 173461 - DNA, 25 bp, Homo sapien
aagatccctgcttggtctccgctgc

SEQ ID NO: 173462 - DNA, 25 bp, Homo sapien
ccgagtaggctgaaagtggagacca

SEQ ID NO: 173463 - DNA, 25 bp, Homo sapien
acattgcaggactgcggccgagctt

SEQ ID NO: 173464 - DNA, 25 bp, Homo sapien
gccgcagcaactcagaccttacagt

SEQ ID NO: 173465 - DNA, 25 bp, Homo sapien
gtcccgccgttgcttcttctattaa

SEQ ID NO: 173466 - DNA, 25 bp, Homo sapien
ggacgccgtgctgtatcattttgta

SEQ ID NO: 173467 - DNA, 25 bp, Homo sapien
tgccagcaattcagtaaccacggtt

SEQ ID NO: 173468 - DNA, 25 bp, Homo sapien
tgcaaaggcagttacagcgcgatta

SEQ ID NO: 173469 - DNA, 25 bp, Homo sapien
tatatttccttattcccacggcgcg

SEQ ID NO: 173470 - DNA, 25 bp, Homo sapien
tactggcgcagacctagaaggaccc

SEQ ID NO: 173471 - DNA, 25 bp, Homo sapien
ccacggcgcgattcgaaataaaata

SEQ ID NO: 173472 - DNA, 25 bp, Homo sapien
actctcagctgttctgtgtggcgga

SEQ ID NO: 173473 - DNA, 25 bp, Homo sapien
ccgggctgtgaaccctctgagatca

SEQ ID NO: 173474 - DNA, 25 bp, Homo sapien
gccgctgtgcatttctctccttttc

SEQ ID NO: 173475 - DNA, 25 bp, Homo sapien
ctctaaggcgagaccagaaacttgc

SEQ ID NO: 173476 - DNA, 25 bp, Homo sapien
ggccagccttcgagagctatgagtc

SEQ ID NO: 173477 - DNA, 25 bp, Homo sapien
tatgagtccatggagcttgcctgcc

SEQ ID NO: 173478 - DNA, 25 bp, Homo sapien
ccctgtggttccctcagtgaaagga

SEQ ID NO: 173479 - DNA, 25 bp, Homo sapien
ttcagcagctttcagggaccgattc

SEQ ID NO: 173480 - DNA, 25 bp, Homo sapien
agcagggcctgcatcgactctaagg

SEQ ID NO: 173481 - DNA, 25 bp, Homo sapien
tcctcgaggcgaacgtatttgtgtc

SEQ ID NO: 173482 - DNA, 25 bp, Homo sapien
gcagaagacccaatattcctcgagg

SEQ ID NO: 173483 - DNA, 25 bp, Homo sapien
cggccgcgcagaagacccaatattc

SEQ ID NO: 173484 - DNA, 25 bp, Homo sapien
gcacttggcggagctctacggccgc

SEQ ID NO: 173485 - DNA, 25 bp, Homo sapien
gtcactaccgcaagttcctctactg

SEQ ID NO: 173486 - DNA, 25 bp, Homo sapien
aggcccgagggtcactaccgcaagt

SEQ ID NO: 173487 - DNA, 25 bp, Homo sapien
gtcaatggtgctaaagcggctcttc

SEQ ID NO: 173488 - DNA, 25 bp, Homo sapien
taaagcggctcttcatggcgaggcc

SEQ ID NO: 173489 - DNA, 25 bp, Homo sapien
gggctccaagcctcgccacagccgc

SEQ ID NO: 173490 - DNA, 25 bp, Homo sapien
agggctccaagcctcgccacagccg

SEQ ID NO: 173491 - DNA, 25 bp, Homo sapien
agagggctccaagcctcgccacagc

SEQ ID NO: 173492 - DNA, 25 bp, Homo sapien
aagagggctccaagcctcgccacag

SEQ ID NO: 173493 - DNA, 25 bp, Homo sapien
gaagagggctccaagcctcgccaca

SEQ ID NO: 173494 - DNA, 25 bp, Homo sapien
gcctcccgaaaggccgccaggtctc

SEQ ID NO: 173495 - DNA, 25 bp, Homo sapien
ctccaagcctcgccacagccgccac

SEQ ID NO: 173496 - DNA, 25 bp, Homo sapien
gctccaagcctcgccacagccgcca

SEQ ID NO: 173497 - DNA, 25 bp, Homo sapien
gtccctaggctgtggtcgcgattac

SEQ ID NO: 173498 - DNA, 25 bp, Homo sapien
ccgcccgggtcatgctattattcgc

SEQ ID NO: 173499 - DNA, 25 bp, Homo sapien
ccgttccgtctagcagcacgtgata

SEQ ID NO: 173500 - DNA, 25 bp, Homo sapien
agcagcggggaacgctctccatctg

SEQ ID NO: 173501 - DNA, 25 bp, Homo sapien
cgccaccgtcgatgggctcagacag

SEQ ID NO: 173502 - DNA, 25 bp, Homo sapien
catgtttaccggctccgtacggtgg

SEQ ID NO: 173503 - DNA, 25 bp, Homo sapien
gaagcctcgcccagtcacaggtgca

SEQ ID NO: 173504 - DNA, 25 bp, Homo sapien
cagtcacaggtgcagcagtcccgca

SEQ ID NO: 173505 - DNA, 25 bp, Homo sapien
caactggtgagctttcgcgctgaag

SEQ ID NO: 173506 - DNA, 25 bp, Homo sapien
cccaagcatcccgtcaactggtgag

SEQ ID NO: 173507 - DNA, 25 bp, Homo sapien
gctctctgtgatccggcggccattt

SEQ ID NO: 173508 - DNA, 25 bp, Homo sapien
tccgactgtctgtgggtaaacgagc

SEQ ID NO: 173509 - DNA, 25 bp, Homo sapien
cctgttggctccgaaggtaataaca

SEQ ID NO: 173510 - DNA, 25 bp, Homo sapien
acagcttttcgcagagacgttttga

SEQ ID NO: 173511 - DNA, 25 bp, Homo sapien
gacgttttgaatatgcgccggtagg

SEQ ID NO: 173512 - DNA, 25 bp, Homo sapien
agaacgtactttttgctctctgtga

SEQ ID NO: 173513 - DNA, 25 bp, Homo sapien
gccgttctgccttacagggttggga

SEQ ID NO: 173514 - DNA, 25 bp, Homo sapien
cgtccggacacgcagcgagagaaaa

SEQ ID NO: 173515 - DNA, 25 bp, Homo sapien
gaacaccacgttcctgcttaacaga

SEQ ID NO: 173516 - DNA, 25 bp, Homo sapien
aaacgcaataacctggtccgtcagc

SEQ ID NO: 173517 - DNA, 25 bp, Homo sapien
tgagcttggacacacccacactggg

SEQ ID NO: 173518 - DNA, 25 bp, Homo sapien
aatgctcatagtgtggcgtccggac

SEQ ID NO: 173519 - DNA, 25 bp, Homo sapien
aggctacgttagtgtggcgtcatcc

SEQ ID NO: 173520 - DNA, 25 bp, Homo sapien
ggtcagtatgcgcttaatgctcata

SEQ ID NO: 173521 - DNA, 25 bp, Homo sapien
ccagcatctgctaagtgaccaggtc

SEQ ID NO: 173522 - DNA, 25 bp, Homo sapien
tggagtcctctgagtcctgcgcagc

SEQ ID NO: 173523 - DNA, 25 bp, Homo sapien
caggattgcgttgcttcggtgcctg

SEQ ID NO: 173524 - DNA, 25 bp, Homo sapien
gggaggcttaaccatcagggcttcg

SEQ ID NO: 173525 - DNA, 25 bp, Homo sapien
gcatgttctcacttcacttggccca

SEQ ID NO: 173526 - DNA, 25 bp, Homo sapien
accaggtccgcgctttctgtgtcta

SEQ ID NO: 173527 - DNA, 25 bp, Homo sapien
cttcgggactccaagcgcatgttct

SEQ ID NO: 173528 - DNA, 25 bp, Homo sapien
tgcggccagcttgctttctccagtc

SEQ ID NO: 173529 - DNA, 25 bp, Homo sapien
tgtacaagttgaagctgggccagtc

SEQ ID NO: 173530 - DNA, 25 bp, Homo sapien
cagaggtcgctcttgtccgaacggt

SEQ ID NO: 173531 - DNA, 25 bp, Homo sapien
tcctttgtggagctctggcagtaac

SEQ ID NO: 173532 - DNA, 25 bp, Homo sapien
gttcccgcgaggatccatgacctga

SEQ ID NO: 173533 - DNA, 25 bp, Homo sapien
tggggaaggtgctatccaaaatctt

SEQ ID NO: 173534 - DNA, 25 bp, Homo sapien
cttcgggaacaaggaaatgcggatc

SEQ ID NO: 173535 - DNA, 25 bp, Homo sapien
acgcggccggcaagacaacaatcct

SEQ ID NO: 173536 - DNA, 25 bp, Homo sapien
aatgcggatcctcatgttgggcctg

SEQ ID NO: 173537 - DNA, 25 bp, Homo sapien
agcagttctccgcacctccggtaaa

SEQ ID NO: 173538 - DNA, 25 bp, Homo sapien
tggcgactcctgtcctgcgcgcagg

SEQ ID NO: 173539 - DNA, 25 bp, Homo sapien
cacctccggtaaaggtgcaggaccg

SEQ ID NO: 173540 - DNA, 25 bp, Homo sapien
ggcggagaaaagagcaatttgactt

SEQ ID NO: 173541 - DNA, 25 bp, Homo sapien
aatttgactttggacggagagctga

SEQ ID NO: 173542 - DNA, 25 bp, Homo sapien
ggaggaaatccaccaccggcctctg

SEQ ID NO: 173543 - DNA, 25 bp, Homo sapien
cagcggccggatatcagctgccacg

SEQ ID NO: 173544 - DNA, 25 bp, Homo sapien
atatcagctgccacgcccgcgtggg

SEQ ID NO: 173545 - DNA, 25 bp, Homo sapien
gctgtagtcgtagcactgtaccatc

SEQ ID NO: 173546 - DNA, 25 bp, Homo sapien
cagcgcgcgcgagttaacaaagccc

SEQ ID NO: 173547 - DNA, 25 bp, Homo sapien
attgcgcccggcaacagaaagcggc

SEQ ID NO: 173548 - DNA, 25 bp, Homo sapien
aggactccagcgtatccgccattgc

SEQ ID NO: 173549 - DNA, 25 bp, Homo sapien
acgccaccggagctatactgctgta

SEQ ID NO: 173550 - DNA, 25 bp, Homo sapien
gacaatggcagcgtcccacacaacg

SEQ ID NO: 173551 - DNA, 25 bp, Homo sapien
cgccagctcttacccgagggtagca

SEQ ID NO: 173552 - DNA, 25 bp, Homo sapien
cacacgtttggcttaacgaagaggc

SEQ ID NO: 173553 - DNA, 25 bp, Homo sapien
ttcggactgttctcctcgctgaaga

SEQ ID NO: 173554 - DNA, 25 bp, Homo sapien
ctcgctgaagaactcgtaaggctgc

SEQ ID NO: 173555 - DNA, 25 bp, Homo sapien
tcctcctcctttgtctgggttcgcg

SEQ ID NO: 173556 - DNA, 25 bp, Homo sapien
tcgagtcacctccacagagctctgg

SEQ ID NO: 173557 - DNA, 25 bp, Homo sapien
ccctttagcagcagcgcagagtgcc

SEQ ID NO: 173558 - DNA, 25 bp, Homo sapien
ggcccggcgctcattatcccgaata

SEQ ID NO: 173559 - DNA, 25 bp, Homo sapien
attatcccgaatagcccaagaggcc

SEQ ID NO: 173560 - DNA, 25 bp, Homo sapien
ccaagaggcctaacacggagcatgc

SEQ ID NO: 173561 - DNA, 25 bp, Homo sapien
tcgctcctcacggaggctctttgtc

SEQ ID NO: 173562 - DNA, 25 bp, Homo sapien
cagcccagtcgagcgtccactagaa

SEQ ID NO: 173563 - DNA, 25 bp, Homo sapien
gtcgccaacgctgggctgactgaaa

SEQ ID NO: 173564 - DNA, 25 bp, Homo sapien
cctccgacgctgtgagtagagaagc

SEQ ID NO: 173565 - DNA, 25 bp, Homo sapien
ctcagcgctcagaagaagccacttg

SEQ ID NO: 173566 - DNA, 25 bp, Homo sapien
gtccgcaggcaccaaccaaataacg

SEQ ID NO: 173567 - DNA, 25 bp, Homo sapien
ggctacctccacacagcggtcttgg

SEQ ID NO: 173568 - DNA, 25 bp, Homo sapien
ggctctttgtcacagcgaagactga

SEQ ID NO: 173569 - DNA, 25 bp, Homo sapien
tccgatctaagacacctgagctggc

SEQ ID NO: 173570 - DNA, 25 bp, Homo sapien
gccgagctgtaagataagctatctt

SEQ ID NO: 173571 - DNA, 25 bp, Homo sapien
tgccatcctaaaacgagccgagctg

SEQ ID NO: 173572 - DNA, 25 bp, Homo sapien
agctgcctccagtaacccgatttta

SEQ ID NO: 173573 - DNA, 25 bp, Homo sapien
acgcgatcaggagtaacagcctaga

SEQ ID NO: 173574 - DNA, 25 bp, Homo sapien
taatttcgggtctcatttccctgcg

SEQ ID NO: 173575 - DNA, 25 bp, Homo sapien
tttccctgcggcaagaagacacctc

SEQ ID NO: 173576 - DNA, 25 bp, Homo sapien
cgtgtcggcaatggcaacgcgatca

SEQ ID NO: 173577 - DNA, 25 bp, Homo sapien
gccagcctcacttaccttatagacg

SEQ ID NO: 173578 - DNA, 25 bp, Homo sapien
ggattcccgctaacaagcacgaacg

SEQ ID NO: 173579 - DNA, 25 bp, Homo sapien
tgcgtcaccgggagacacgttccca

SEQ ID NO: 173580 - DNA, 25 bp, Homo sapien
cgcagaaccagagtgccgccctgag

SEQ ID NO: 173581 - DNA, 25 bp, Homo sapien
ctctcagaaataaggcacacgcctg

SEQ ID NO: 173582 - DNA, 25 bp, Homo sapien
acacgcctgggcattcgtgggccaa

SEQ ID NO: 173583 - DNA, 25 bp, Homo sapien
cccacatttgtcaggtaggcctgta

SEQ ID NO: 173584 - DNA, 25 bp, Homo sapien
ccgaccctctggacgagttcgtagt

SEQ ID NO: 173585 - DNA, 25 bp, Homo sapien
ttccgccttagcgatcggttgggag

SEQ ID NO: 173586 - DNA, 25 bp, Homo sapien
acagaaacagttggggtgagtagca

SEQ ID NO: 173587 - DNA, 25 bp, Homo sapien
ttctgcagcctgcacggggtcttct

SEQ ID NO: 173588 - DNA, 25 bp, Homo sapien
ccactttctgcttctgtggagacag

SEQ ID NO: 173589 - DNA, 25 bp, Homo sapien
aaccatggccgagcggtacccgcgt

SEQ ID NO: 173590 - DNA, 25 bp, Homo sapien
cagcatttggacagcacccaccagg

SEQ ID NO: 173591 - DNA, 25 bp, Homo sapien
catggccaagaaccgcagggacaga

SEQ ID NO: 173592 - DNA, 25 bp, Homo sapien
agctcctggaccaccatggccaaga

SEQ ID NO: 173593 - DNA, 25 bp, Homo sapien
tagacctgacaaggttgccctccct

SEQ ID NO: 173594 - DNA, 25 bp, Homo sapien
gaaggcatctcgtccttaacaggta

SEQ ID NO: 173595 - DNA, 25 bp, Homo sapien
gcatctcgtccttaacaggtaccga

SEQ ID NO: 173596 - DNA, 25 bp, Homo sapien
ttaacaggtaccgaccgccgtgcgc

SEQ ID NO: 173597 - DNA, 25 bp, Homo sapien
ctccaaaccgttagacctgacaagg

SEQ ID NO: 173598 - DNA, 25 bp, Homo sapien
gtggtcggaaggcatctcgtcctta

SEQ ID NO: 173599 - DNA, 25 bp, Homo sapien
ttatccggtggtcggaaggcatctc

SEQ ID NO: 173600 - DNA, 25 bp, Homo sapien
ggctggcgctccaaaccgttagacc

SEQ ID NO: 173601 - DNA, 25 bp, Homo sapien
tgtcctcactcatcctcagcgagaa

SEQ ID NO: 173602 - DNA, 25 bp, Homo sapien
cgaccaaggacgaaggagaagccct

SEQ ID NO: 173603 - DNA, 25 bp, Homo sapien
cctgacactcactccgaagcagagg

SEQ ID NO: 173604 - DNA, 25 bp, Homo sapien
aattctgggaagctcgacgcagcgc

SEQ ID NO: 173605 - DNA, 25 bp, Homo sapien
tcctcagcgagaagcaggtcctgcc

SEQ ID NO: 173606 - DNA, 25 bp, Homo sapien
caggtcctgccgactgagaagatga

SEQ ID NO: 173607 - DNA, 25 bp, Homo sapien
agaagatgaaggacgaaacctgccc

SEQ ID NO: 173608 - DNA, 25 bp, Homo sapien
ggccgccgaataaccgctaccacta

SEQ ID NO: 173609 - DNA, 25 bp, Homo sapien
gcccaagaacgcagtggtcatcctg

SEQ ID NO: 173610 - DNA, 25 bp, Homo sapien
gtgtgtttctcccttgcctctgcgg

SEQ ID NO: 173611 - DNA, 25 bp, Homo sapien
ggttgcttagcagcgtgtgtttctc

SEQ ID NO: 173612 - DNA, 25 bp, Homo sapien
cgcgtatttgcggaccaggcgctga

SEQ ID NO: 173613 - DNA, 25 bp, Homo sapien
aggcctggcgatgcccaagaacgca

SEQ ID NO: 173614 - DNA, 25 bp, Homo sapien
tcatcctgcgctatgggccctacag

SEQ ID NO: 173615 - DNA, 25 bp, Homo sapien
atgggccctacagcgcggcaggcct

SEQ ID NO: 173616 - DNA, 25 bp, Homo sapien
gcaggcctaccggtggagcaccaca

SEQ ID NO: 173617 - DNA, 25 bp, Homo sapien
gaaacctcagacagcccattgtgtg

SEQ ID NO: 173618 - DNA, 25 bp, Homo sapien
gacgctttgttagggctggagaaac

SEQ ID NO: 173619 - DNA, 25 bp, Homo sapien
tctgaagttagaaacgccggggctc

SEQ ID NO: 173620 - DNA, 25 bp, Homo sapien
cgcccgcctccgagatctgaagtta

SEQ ID NO: 173621 - DNA, 25 bp, Homo sapien
agctcttacaaaagcgcggctctcg

SEQ ID NO: 173622 - DNA, 25 bp, Homo sapien
tttccatatgtaaggggccagctct

SEQ ID NO: 173623 - DNA, 25 bp, Homo sapien
cccgcgtgagcgtcatttccatatg

SEQ ID NO: 173624 - DNA, 25 bp, Homo sapien
acgggacaatacttcgcagccggcg

SEQ ID NO: 173625 - DNA, 25 bp, Homo sapien
ccagcccgtagctgcgtggccgcct

SEQ ID NO: 173626 - DNA, 25 bp, Homo sapien
gcgaacagcctgacccgggcggagc

SEQ ID NO: 173627 - DNA, 25 bp, Homo sapien
cccgccgtaccagcctgcctgaccg

SEQ ID NO: 173628 - DNA, 25 bp, Homo sapien
cctggtgggacatggtcgaccgcaa

SEQ ID NO: 173629 - DNA, 25 bp, Homo sapien
ggtcgaccgcaacctgcggtgagta

SEQ ID NO: 173630 - DNA, 25 bp, Homo sapien
caacctgcggtgagtaccgcccggt

SEQ ID NO: 173631 - DNA, 25 bp, Homo sapien
ggcccaaggcccagcattgtggctt

SEQ ID NO: 173632 - DNA, 25 bp, Homo sapien
aaggcccagcattgtggcttccggg

SEQ ID NO: 173633 - DNA, 25 bp, Homo sapien
ttaccttggggcacttgtcgtagta

SEQ ID NO: 173634 - DNA, 25 bp, Homo sapien
gtggcacctcggagacatgagttcg

SEQ ID NO: 173635 - DNA, 25 bp, Homo sapien
gccagcagctttcaacgcgcacgaa

SEQ ID NO: 173636 - DNA, 25 bp, Homo sapien
caggtgccggttgaaactcttcttc

SEQ ID NO: 173637 - DNA, 25 bp, Homo sapien
acagcctagacacgtctcctctgga

SEQ ID NO: 173638 - DNA, 25 bp, Homo sapien
caagggaccactctgaggggttctc

SEQ ID NO: 173639 - DNA, 25 bp, Homo sapien
atgccgcggatgctgatctgccgcc

SEQ ID NO: 173640 - DNA, 25 bp, Homo sapien
tcctctggacttcggggcaaggacc

SEQ ID NO: 173641 - DNA, 25 bp, Homo sapien
cgcctcgctgtataggctcatcttg

SEQ ID NO: 173642 - DNA, 25 bp, Homo sapien
ggcgcacgcctgacacaaattgtga

SEQ ID NO: 173643 - DNA, 25 bp, Homo sapien
tgtccaggtccagatagtcatagtc

SEQ ID NO: 173644 - DNA, 25 bp, Homo sapien
ccagtacgcgattcttggggaagcc

SEQ ID NO: 173645 - DNA, 25 bp, Homo sapien
cgccttctcgcagagctggcacttg

SEQ ID NO: 173646 - DNA, 25 bp, Homo sapien
actgttcgcacatgacggtggcttc

SEQ ID NO: 173647 - DNA, 25 bp, Homo sapien
actggtagcacacgggcatcttgca

SEQ ID NO: 173648 - DNA, 25 bp, Homo sapien
gtttgccctcctccaagcactggta

SEQ ID NO: 173649 - DNA, 25 bp, Homo sapien
gcggagagtcgttcttccctctttc

SEQ ID NO: 173650 - DNA, 25 bp, Homo sapien
taagtttcttctggggtgcaccctc

SEQ ID NO: 173651 - DNA, 25 bp, Homo sapien
cctcgtctcttacccgtgaatgtta

SEQ ID NO: 173652 - DNA, 25 bp, Homo sapien
caaactcttgggatctgccgccagc

SEQ ID NO: 173653 - DNA, 25 bp, Homo sapien
gtccgtgcctggacacacgacttca

SEQ ID NO: 173654 - DNA, 25 bp, Homo sapien
cctgtcatgcgcattgagagtcctc

SEQ ID NO: 173655 - DNA, 25 bp, Homo sapien
agcagccgcttttctgtcatgcgca

SEQ ID NO: 173656 - DNA, 25 bp, Homo sapien
gcccaaagggttagtgccaatgcga

SEQ ID NO: 173657 - DNA, 25 bp, Homo sapien
ttctccgtgagtcggaggtcgctca

SEQ ID NO: 173658 - DNA, 25 bp, Homo sapien
gtccctggttctctgcatcgcggag

SEQ ID NO: 173659 - DNA, 25 bp, Homo sapien
agcccaacgcctggtgctcaagact

SEQ ID NO: 173660 - DNA, 25 bp, Homo sapien
cttctcgctcccttagctctgggtg

SEQ ID NO: 173661 - DNA, 25 bp, Homo sapien
agtcccagcgaaggcagtgcaccgc

SEQ ID NO: 173662 - DNA, 25 bp, Homo sapien
gggtttctggaagtcgcgagtccca

SEQ ID NO: 173663 - DNA, 25 bp, Homo sapien
ggtatgaacaagaaccaggcgtctg

SEQ ID NO: 173664 - DNA, 25 bp, Homo sapien
tgctcaagactttctccgaggtatg

SEQ ID NO: 173665 - DNA, 25 bp, Homo sapien
gacgcaagttgacggctctcgacta

SEQ ID NO: 173666 - DNA, 25 bp, Homo sapien
ggcggccaccgcttttaagccacga

SEQ ID NO: 173667 - DNA, 25 bp, Homo sapien
taagccacgattggcgaaggccgcc

SEQ ID NO: 173668 - DNA, 25 bp, Homo sapien
gccgccgtcatttcggagcgactca

SEQ ID NO: 173669 - DNA, 25 bp, Homo sapien
cggggaccatgttccgacgcaagtt

SEQ ID NO: 173670 - DNA, 25 bp, Homo sapien
agttgacggctctcgactaccacaa

SEQ ID NO: 173671 - DNA, 25 bp, Homo sapien
cccgccggcttcaactgcaaaggtg

SEQ ID NO: 173672 - DNA, 25 bp, Homo sapien
catttcggagcgactcagcgcctgc

SEQ ID NO: 173673 - DNA, 25 bp, Homo sapien
ttcgtagaagtgcaggggattcgcc

SEQ ID NO: 173674 - DNA, 25 bp, Homo sapien
agccttctcgcggtcctaactgcaa

SEQ ID NO: 173675 - DNA, 25 bp, Homo sapien
acgcgtacgtggctgcgaacaattc

SEQ ID NO: 173676 - DNA, 25 bp, Homo sapien
caggcccacccagcaagctaattgg

SEQ ID NO: 173677 - DNA, 25 bp, Homo sapien
ggggaccaatcaccggctctgagaa

SEQ ID NO: 173678 - DNA, 25 bp, Homo sapien
ttaacttttctaaggcagcggccgc

SEQ ID NO: 173679 - DNA, 25 bp, Homo sapien
gcaacgccaccttttctgcctggga

SEQ ID NO: 173680 - DNA, 25 bp, Homo sapien
gcttcaccacggctgagctttcgtc

SEQ ID NO: 173681 - DNA, 25 bp, Homo sapien
ggtgctttatccagatggtccacga

SEQ ID NO: 173682 - DNA, 25 bp, Homo sapien
tttgggctctcctcgacactgcaac

SEQ ID NO: 173683 - DNA, 25 bp, Homo sapien
ccgcgagtttagataggaggttcct

SEQ ID NO: 173684 - DNA, 25 bp, Homo sapien
ggacaactcgttgtgccaagccttc

SEQ ID NO: 173685 - DNA, 25 bp, Homo sapien
tggctgcctacgctcagaaccggag

SEQ ID NO: 173686 - DNA, 25 bp, Homo sapien
cgcacgccatgaagtcgccgttcta

SEQ ID NO: 173687 - DNA, 25 bp, Homo sapien
ctcggagctttttctgtggcgcagc

SEQ ID NO: 173688 - DNA, 25 bp, Homo sapien
gcgctacctttcatgggcttcggga

SEQ ID NO: 173689 - DNA, 25 bp, Homo sapien
ccgaacgtccctgccctttcctatg

SEQ ID NO: 173690 - DNA, 25 bp, Homo sapien
gaacgcttttttcctctctattcgc

SEQ ID NO: 173691 - DNA, 25 bp, Homo sapien
tgaccgtgaactcgcaggaccttcg

SEQ ID NO: 173692 - DNA, 25 bp, Homo sapien
caactcctggcagcggtgaccgtga

SEQ ID NO: 173693 - DNA, 25 bp, Homo sapien
tgagccctattttaaagctgctttt

SEQ ID NO: 173694 - DNA, 25 bp, Homo sapien
gctccctgagccctattttaaagct

SEQ ID NO: 173695 - DNA, 25 bp, Homo sapien
ccctgcctgggttctacgtttatgc

SEQ ID NO: 173696 - DNA, 25 bp, Homo sapien
ttctacgtttatgcggtgctccctg

SEQ ID NO: 173697 - DNA, 25 bp, Homo sapien
catctgtaatcggagaccgcggtta

SEQ ID NO: 173698 - DNA, 25 bp, Homo sapien
ccgtctattaggctccttggtagtc

SEQ ID NO: 173699 - DNA, 25 bp, Homo sapien
ccttggtagtccgaagctgcctatg

SEQ ID NO: 173700 - DNA, 25 bp, Homo sapien
caaggtcagagccaaggtcacagtc

SEQ ID NO: 173701 - DNA, 25 bp, Homo sapien
cgcgccgtgccaattacctgggtca

SEQ ID NO: 173702 - DNA, 25 bp, Homo sapien
cccgtgtgctcgtcctaaaactagg

SEQ ID NO: 173703 - DNA, 25 bp, Homo sapien
atgcaagcagcgacctcaggccatg

SEQ ID NO: 173704 - DNA, 25 bp, Homo sapien
gcgaatgcgtactgcagcctgctgt

SEQ ID NO: 173705 - DNA, 25 bp, Homo sapien
tggggaacctcatagcactggcgct

SEQ ID NO: 173706 - DNA, 25 bp, Homo sapien
ggcaatgcctccaatgactcccagt

SEQ ID NO: 173707 - DNA, 25 bp, Homo sapien
tgccgctgctggactatgggcagta

SEQ ID NO: 173708 - DNA, 25 bp, Homo sapien
acgatgctcatgctcttcgccatgg

SEQ ID NO: 173709 - DNA, 25 bp, Homo sapien
ctctccttgttccacgtgctggtga

SEQ ID NO: 173710 - DNA, 25 bp, Homo sapien
atgaccttcttcagcctggccacga

SEQ ID NO: 173711 - DNA, 25 bp, Homo sapien
gtgcacctacttcgctttcgccatg

SEQ ID NO: 173712 - DNA, 25 bp, Homo sapien
ggagggcgcatctcttttccaggca

SEQ ID NO: 173713 - DNA, 25 bp, Homo sapien
tgggaaaaaacaacctgcgaagctc

SEQ ID NO: 173714 - DNA, 25 bp, Homo sapien
ccaacctgcaaaggcgtagcacttc

SEQ ID NO: 173715 - DNA, 25 bp, Homo sapien
tcgcctttgcctacctgcagctgtg

SEQ ID NO: 173716 - DNA, 25 bp, Homo sapien
ctccagccgagagttgttttttgca

SEQ ID NO: 173717 - DNA, 25 bp, Homo sapien
ctcgggtttctcagctgattgtctc

SEQ ID NO: 173718 - DNA, 25 bp, Homo sapien
gacgattacagagtcctcccgccgg

SEQ ID NO: 173719 - DNA, 25 bp, Homo sapien
cgaggcactctctaaccaatgggaa

SEQ ID NO: 173720 - DNA, 25 bp, Homo sapien
actagccgggtagcctggaaccact

SEQ ID NO: 173721 - DNA, 25 bp, Homo sapien
ggtccttccagttcccagagcgaga

SEQ ID NO: 173722 - DNA, 25 bp, Homo sapien
tcgtacgaattacgtgtccaccgtg

SEQ ID NO: 173723 - DNA, 25 bp, Homo sapien
cggccaatccttccgtatctcaatg

SEQ ID NO: 173724 - DNA, 25 bp, Homo sapien
tgaggctgacgcaccgaccagcttc

SEQ ID NO: 173725 - DNA, 25 bp, Homo sapien
tgcgccctcagatgaagcccgtgcg

SEQ ID NO: 173726 - DNA, 25 bp, Homo sapien
gcccattgcagctccggcagcttgt

SEQ ID NO: 173727 - DNA, 25 bp, Homo sapien
gcgcacatcgctcacctggcagaag

SEQ ID NO: 173728 - DNA, 25 bp, Homo sapien
cggagtctcattcccggtgggaaga

SEQ ID NO: 173729 - DNA, 25 bp, Homo sapien
ccgtcttaaggagtgtgagtgcacc

SEQ ID NO: 173730 - DNA, 25 bp, Homo sapien
cggcttctcatcatggcggacccta

SEQ ID NO: 173731 - DNA, 25 bp, Homo sapien
gtgagtgcacctttctttccattta

SEQ ID NO: 173732 - DNA, 25 bp, Homo sapien
cacaaggagatcgacggccgtctta

SEQ ID NO: 173733 - DNA, 25 bp, Homo sapien
aagcagaagcctttcgccgagcccg

SEQ ID NO: 173734 - DNA, 25 bp, Homo sapien
aaggcgcttcaggactaccgcaaga

SEQ ID NO: 173735 - DNA, 25 bp, Homo sapien
ggcgctctaggtgaaccgagacata

SEQ ID NO: 173736 - DNA, 25 bp, Homo sapien
tcgactcgcttctgcctctgacaaa

SEQ ID NO: 173737 - DNA, 25 bp, Homo sapien
ttccacagtgcaaggaagacgccga

SEQ ID NO: 173738 - DNA, 25 bp, Homo sapien
gctggagtcactgggaccctgtagt

SEQ ID NO: 173739 - DNA, 25 bp, Homo sapien
accctgtagtctgcgtgtgttagtt

SEQ ID NO: 173740 - DNA, 25 bp, Homo sapien
tgtgttagttgtaatcccgccgccc

SEQ ID NO: 173741 - DNA, 25 bp, Homo sapien
gaagctggagttcccttcccttcca

SEQ ID NO: 173742 - DNA, 25 bp, Homo sapien
gtcttagccgccacctgtacgggcg

SEQ ID NO: 173743 - DNA, 25 bp, Homo sapien
cactgagttgctcgtcctctccaga

SEQ ID NO: 173744 - DNA, 25 bp, Homo sapien
gtcggccggctgtgtaacactctcc

SEQ ID NO: 173745 - DNA, 25 bp, Homo sapien
cctgccaggccaagaccagcgtatg

SEQ ID NO: 173746 - DNA, 25 bp, Homo sapien
gtctcatttcccacgccaaagtctg

SEQ ID NO: 173747 - DNA, 25 bp, Homo sapien
gcgcgtgcgttcaacttcctgggaa

SEQ ID NO: 173748 - DNA, 25 bp, Homo sapien
tgcagagagcgcgaccaactgtctc

SEQ ID NO: 173749 - DNA, 25 bp, Homo sapien
tggcgaggattaacgcccagctcct

SEQ ID NO: 173750 - DNA, 25 bp, Homo sapien
cctgggacgttcgtgcccattcaaa

SEQ ID NO: 173751 - DNA, 25 bp, Homo sapien
cggggcaccagacacacctgttaga

SEQ ID NO: 173752 - DNA, 25 bp, Homo sapien
ttcaaaaccgatggctgcagagagc

SEQ ID NO: 173753 - DNA, 25 bp, Homo sapien
atccttatcccgtccagagccatgg

SEQ ID NO: 173754 - DNA, 25 bp, Homo sapien
aaatggctctcgtaagcgtcactcc

SEQ ID NO: 173755 - DNA, 25 bp, Homo sapien
gagcggctaatggagtcccgtcgtc

SEQ ID NO: 173756 - DNA, 25 bp, Homo sapien
cggagcgctgcccttttatggaaat

SEQ ID NO: 173757 - DNA, 25 bp, Homo sapien
tttatggaaatgaaggacccggctc

SEQ ID NO: 173758 - DNA, 25 bp, Homo sapien
ttgaatccaacatccgggctctagg

SEQ ID NO: 173759 - DNA, 25 bp, Homo sapien
gtccgcgtagcagccatctggcatc

SEQ ID NO: 173760 - DNA, 25 bp, Homo sapien
ggacccggctcaggaattgaatcca

SEQ ID NO: 173761 - DNA, 25 bp, Homo sapien
cccgggtaattcatgctgtggagac

SEQ ID NO: 173762 - DNA, 25 bp, Homo sapien
tcggcggagctgaagtcatagttct

SEQ ID NO: 173763 - DNA, 25 bp, Homo sapien
tcactacctcatagcggtgccgggc

SEQ ID NO: 173764 - DNA, 25 bp, Homo sapien
ttgtcctccttgtagaaccagcgta

SEQ ID NO: 173765 - DNA, 25 bp, Homo sapien
agggcttccaggtcttcttgtcctc

SEQ ID NO: 173766 - DNA, 25 bp, Homo sapien
ggtcctcatcgtcatcttctccgga

SEQ ID NO: 173767 - DNA, 25 bp, Homo sapien
cacgcacacaggctcgatgttcaca

SEQ ID NO: 173768 - DNA, 25 bp, Homo sapien
ggttccagtacaccgggtagcactc

SEQ ID NO: 173769 - DNA, 25 bp, Homo sapien
catgaaatctgcagagcgaccgccc

SEQ ID NO: 173770 - DNA, 25 bp, Homo sapien
gggctggatcttgacgccagtccaa

SEQ ID NO: 173771 - DNA, 25 bp, Homo sapien
gtgactactggggtctgcccgcgcc

SEQ ID NO: 173772 - DNA, 25 bp, Homo sapien
gccgagccctctcagtgtggcgctg

SEQ ID NO: 173773 - DNA, 25 bp, Homo sapien
acgccagtccaaggccgggtgacta

SEQ ID NO: 173774 - DNA, 25 bp, Homo sapien
tctgcagagcttcacctgaggcctg

SEQ ID NO: 173775 - DNA, 25 bp, Homo sapien
ccagcgagcgctaatcagatccgtc

SEQ ID NO: 173776 - DNA, 25 bp, Homo sapien
tcagatccgtctgtgtctgcagagc

SEQ ID NO: 173777 - DNA, 25 bp, Homo sapien
ctcaggtatcaaactagcatggctc

SEQ ID NO: 173778 - DNA, 25 bp, Homo sapien
tggccctgaatctcggcgacttttt

SEQ ID NO: 173779 - DNA, 25 bp, Homo sapien
gcccaaacatctgcagaagtgtcgc

SEQ ID NO: 173780 - DNA, 25 bp, Homo sapien
gcaggagctcatggctctgccctga

SEQ ID NO: 173781 - DNA, 25 bp, Homo sapien
agaagtgtcgcctcgaagtcccgca

SEQ ID NO: 173782 - DNA, 25 bp, Homo sapien
atgacggcactcttgctaggctgcg

SEQ ID NO: 173783 - DNA, 25 bp, Homo sapien
tagtccggaatgacggcactcttgc

SEQ ID NO: 173784 - DNA, 25 bp, Homo sapien
gtaaagatcccgcatgtagtccgga

SEQ ID NO: 173785 - DNA, 25 bp, Homo sapien
tccgctttcccgctgcgtctgccct

SEQ ID NO: 173786 - DNA, 25 bp, Homo sapien
ggtcccgagtgcctctgcgtgccag

SEQ ID NO: 173787 - DNA, 25 bp, Homo sapien
tgggtgagatcagcttccgctttcc

SEQ ID NO: 173788 - DNA, 25 bp, Homo sapien
tcttcggcatttggctgggtgagat

SEQ ID NO: 173789 - DNA, 25 bp, Homo sapien
tggcttcctcttcggcatttggctg

SEQ ID NO: 173790 - DNA, 25 bp, Homo sapien
ctcagtgttcccaggtgctcacaca

SEQ ID NO: 173791 - DNA, 25 bp, Homo sapien
tcagcgttcccaggtgctcacgcgc

SEQ ID NO: 173792 - DNA, 25 bp, Homo sapien
ccaggctcgtccacctgccgcctca

SEQ ID NO: 173793 - DNA, 25 bp, Homo sapien
cgggaaagcccggaaagatgccagc

SEQ ID NO: 173794 - DNA, 25 bp, Homo sapien
cactccgggtttcgactccgcgtgg

SEQ ID NO: 173795 - DNA, 25 bp, Homo sapien
ctgggagcagccgacatcggtctct

SEQ ID NO: 173796 - DNA, 25 bp, Homo sapien
atcggtctctgaaaccctgcgctgg

SEQ ID NO: 173797 - DNA, 25 bp, Homo sapien
ttcctgggcgctgaacaagttttcc

SEQ ID NO: 173798 - DNA, 25 bp, Homo sapien
cggtgtctgtccgagcgcagacaga

SEQ ID NO: 173799 - DNA, 25 bp, Homo sapien
gacgattcttgacgctgagcctgtg

SEQ ID NO: 173800 - DNA, 25 bp, Homo sapien
ccacaggaatctctcccgggaaagc

SEQ ID NO: 173801 - DNA, 25 bp, Homo sapien
gtcggtctacccgagcgtgcagagc

SEQ ID NO: 173802 - DNA, 25 bp, Homo sapien
gagcggccatcgagtttcctttgaa

SEQ ID NO: 173803 - DNA, 25 bp, Homo sapien
aacctctccttgctcaaactgcagg

SEQ ID NO: 173804 - DNA, 25 bp, Homo sapien
gtgcagagcggccttcttcctcaac

SEQ ID NO: 173805 - DNA, 25 bp, Homo sapien
ctttgaacgcggtgacaggcttaca

SEQ ID NO: 173806 - DNA, 25 bp, Homo sapien
tcctcaacaagaaacccggcaattg

SEQ ID NO: 173807 - DNA, 25 bp, Homo sapien
gcgcctaataagtgacgtgaacttc

SEQ ID NO: 173808 - DNA, 25 bp, Homo sapien
tctgtgaacgaaagggcgcctaata

SEQ ID NO: 173809 - DNA, 25 bp, Homo sapien
ctgcgcaagggcctcttcgaaaacc

SEQ ID NO: 173810 - DNA, 25 bp, Homo sapien
tgttttgagacgcagaagcccttta

SEQ ID NO: 173811 - DNA, 25 bp, Homo sapien
ccgactaggcgcaactcagcgttca

SEQ ID NO: 173812 - DNA, 25 bp, Homo sapien
tcagatcttaatgtggccgaggttt

SEQ ID NO: 173813 - DNA, 25 bp, Homo sapien
tgactaatcgaagatgctgccgcgc

SEQ ID NO: 173814 - DNA, 25 bp, Homo sapien
gcagcagagtcgcacgcagcaaata

SEQ ID NO: 173815 - DNA, 25 bp, Homo sapien
tccggagctcaagaactcgggttgc

SEQ ID NO: 173816 - DNA, 25 bp, Homo sapien
tcctccgttgcaccagcagcagagt

SEQ ID NO: 173817 - DNA, 25 bp, Homo sapien
cgatgtccgctaactaacgtaaaga

SEQ ID NO: 173818 - DNA, 25 bp, Homo sapien
ggaatttgcatccatccgcacgaga

SEQ ID NO: 173819 - DNA, 25 bp, Homo sapien
ggctaacctgatccacacttgaata

SEQ ID NO: 173820 - DNA, 25 bp, Homo sapien
ccactctcagactcgttttgcagga

SEQ ID NO: 173821 - DNA, 25 bp, Homo sapien
cgttatttttagttcggctgctgca

SEQ ID NO: 173822 - DNA, 25 bp, Homo sapien
tagtaagcctccacgcacgtcagcg

SEQ ID NO: 173823 - DNA, 25 bp, Homo sapien
ggtccctgaggcgacgccctagtaa

SEQ ID NO: 173824 - DNA, 25 bp, Homo sapien
cgcacgagaggttcctgagacgcta

SEQ ID NO: 173825 - DNA, 25 bp, Homo sapien
atctgattggttgctggaagacgcc

SEQ ID NO: 173826 - DNA, 25 bp, Homo sapien
tggggaaaccttgagtacgaatgcc

SEQ ID NO: 173827 - DNA, 25 bp, Homo sapien
tgcggggtctcataagcctcccagc

SEQ ID NO: 173828 - DNA, 25 bp, Homo sapien
gccgacgaaggaaagacggacattc

SEQ ID NO: 173829 - DNA, 25 bp, Homo sapien
tcttcggccacccaaaggcggagta

SEQ ID NO: 173830 - DNA, 25 bp, Homo sapien
ccagtcagcgattagaggccgagtc

SEQ ID NO: 173831 - DNA, 25 bp, Homo sapien
ccgcgcgtctttcaaaggtcttcta

SEQ ID NO: 173832 - DNA, 25 bp, Homo sapien
acggacattcgctgtgcacctgctg

SEQ ID NO: 173833 - DNA, 25 bp, Homo sapien
gctgtcgacatcctccccgggaatg

SEQ ID NO: 173834 - DNA, 25 bp, Homo sapien
aaagaggctgtgttgccgcctcgcc

SEQ ID NO: 173835 - DNA, 25 bp, Homo sapien
gcgccctctgatggccggagtctgc

SEQ ID NO: 173836 - DNA, 25 bp, Homo sapien
ccgcgaacgtgaacgccatggctgg

SEQ ID NO: 173837 - DNA, 25 bp, Homo sapien
cagaaggccgcgaacgtgaacgcca

SEQ ID NO: 173838 - DNA, 25 bp, Homo sapien
cagcatgtagcagaaggccgcgaac

SEQ ID NO: 173839 - DNA, 25 bp, Homo sapien
cagcgccagcatgtagcagaaggcc

SEQ ID NO: 173840 - DNA, 25 bp, Homo sapien
cagctactcacgtgccaaatggcga

SEQ ID NO: 173841 - DNA, 25 bp, Homo sapien
ctcccagcggcaactcaccattttc

SEQ ID NO: 173842 - DNA, 25 bp, Homo sapien
gcggctcaaaattagacagaatgcg

SEQ ID NO: 173843 - DNA, 25 bp, Homo sapien
ggcggcagaggccaagtactctagc

SEQ ID NO: 173844 - DNA, 25 bp, Homo sapien
agtactctagctatgggcactggcc

SEQ ID NO: 173845 - DNA, 25 bp, Homo sapien
tctagctatgggcactggccagctg

SEQ ID NO: 173846 - DNA, 25 bp, Homo sapien
tgtcgcctacactcgggcgccttta

SEQ ID NO: 173847 - DNA, 25 bp, Homo sapien
acactcgggcgcctttaagaatggc

SEQ ID NO: 173848 - DNA, 25 bp, Homo sapien
gcgcctttaagaatggcacggcggc

SEQ ID NO: 173849 - DNA, 25 bp, Homo sapien
cgggtgcctagaactccgactttct

SEQ ID NO: 173850 - DNA, 25 bp, Homo sapien
tcccaggtctgcgtagccaatagct

SEQ ID NO: 173851 - DNA, 25 bp, Homo sapien
ggctgccctaaagtctagctcatga

SEQ ID NO: 173852 - DNA, 25 bp, Homo sapien
tacaaagtttgtccgctccggggca

SEQ ID NO: 173853 - DNA, 25 bp, Homo sapien
tccggggcactgtagtggcttttac

SEQ ID NO: 173854 - DNA, 25 bp, Homo sapien
cgcggtggtctttacctgcttcatc

SEQ ID NO: 173855 - DNA, 25 bp, Homo sapien
ttaagacgcccgctgggtaccaatc

SEQ ID NO: 173856 - DNA, 25 bp, Homo sapien
gtcactgccctgcatcaccgtttgg

SEQ ID NO: 173857 - DNA, 25 bp, Homo sapien
tggcgttcttaagcacggcgcccga

SEQ ID NO: 173858 - DNA, 25 bp, Homo sapien
aagatctgttgctggtgctggcgtt

SEQ ID NO: 173859 - DNA, 25 bp, Homo sapien
ttgcaagttttctgcgcggggaaga

SEQ ID NO: 173860 - DNA, 25 bp, Homo sapien
cttcgcagccgcattgcaagttttc

SEQ ID NO: 173861 - DNA, 25 bp, Homo sapien
tgcctccgcctctgctttgcattag

SEQ ID NO: 173862 - DNA, 25 bp, Homo sapien
gctgctcacggcctaaatccagagg

SEQ ID NO: 173863 - DNA, 25 bp, Homo sapien
agccgaactttctttgctgtcgttg

SEQ ID NO: 173864 - DNA, 25 bp, Homo sapien
tgttgttggaagctagcggctcctt

SEQ ID NO: 173865 - DNA, 25 bp, Homo sapien
aaggtagagcctcattcgcccattt

SEQ ID NO: 173866 - DNA, 25 bp, Homo sapien
ttcacacgcgtcatggggaaaggta

SEQ ID NO: 173867 - DNA, 25 bp, Homo sapien
tgactccgatcaaggcctacagctc

SEQ ID NO: 173868 - DNA, 25 bp, Homo sapien
cctgagcctaacagaggtcttcctg

SEQ ID NO: 173869 - DNA, 25 bp, Homo sapien
ggataccactaaccagagcgacagg

SEQ ID NO: 173870 - DNA, 25 bp, Homo sapien
tggatgacccttattcctgagccta

SEQ ID NO: 173871 - DNA, 25 bp, Homo sapien
ctgcaccagatgatcctgactccga

SEQ ID NO: 173872 - DNA, 25 bp, Homo sapien
ccctgggtgctggataaattccctg

SEQ ID NO: 173873 - DNA, 25 bp, Homo sapien
gcttcgaggtctgcggctaaactcc

SEQ ID NO: 173874 - DNA, 25 bp, Homo sapien
ctgaggaaggtacgcaacctgctta

SEQ ID NO: 173875 - DNA, 25 bp, Homo sapien
tcctgcgccaaaagtgaggcaactc

SEQ ID NO: 173876 - DNA, 25 bp, Homo sapien
gaggcaactccggaaacttcctgga

SEQ ID NO: 173877 - DNA, 25 bp, Homo sapien
ctcctggtagcccttggtgaagaac

SEQ ID NO: 173878 - DNA, 25 bp, Homo sapien
tctcgcccagcgagctcaggatgga

SEQ ID NO: 173879 - DNA, 25 bp, Homo sapien
agctcgttatcctcctcgctgcggg

SEQ ID NO: 173880 - DNA, 25 bp, Homo sapien
gcttagatcacactccgagccggga

SEQ ID NO: 173881 - DNA, 25 bp, Homo sapien
agcgccgtagagcacgcagaacacg

SEQ ID NO: 173882 - DNA, 25 bp, Homo sapien
aattacggtggtgccgtccgccaag

SEQ ID NO: 173883 - DNA, 25 bp, Homo sapien
tgccggcatggcacattacaacttc

SEQ ID NO: 173884 - DNA, 25 bp, Homo sapien
gaagtgacgtacctcaaccgcccga

SEQ ID NO: 173885 - DNA, 25 bp, Homo sapien
gcaggaatttagtctccgcgctccc

SEQ ID NO: 173886 - DNA, 25 bp, Homo sapien
acccgcagggcagtctgtcggaaac

SEQ ID NO: 173887 - DNA, 25 bp, Homo sapien
aactttcgcgttctcctcagctggg

SEQ ID NO: 173888 - DNA, 25 bp, Homo sapien
aagtacccgcgtgcatacggctgcc

SEQ ID NO: 173889 - DNA, 25 bp, Homo sapien
aagccggaaagggaacacgcatctc

SEQ ID NO: 173890 - DNA, 25 bp, Homo sapien
tctgtcagacaataagccggaaagg

SEQ ID NO: 173891 - DNA, 25 bp, Homo sapien
gtgaccgagcctccgccactgagga

SEQ ID NO: 173892 - DNA, 25 bp, Homo sapien
actgaggatccacaagagctgcttc

SEQ ID NO: 173893 - DNA, 25 bp, Homo sapien
agcgcaggtcccgacagaggtcgcc

SEQ ID NO: 173894 - DNA, 25 bp, Homo sapien
taaggcagagggtctgtcagacaat

SEQ ID NO: 173895 - DNA, 25 bp, Homo sapien
cgagtgacaccagcgggataaggca

SEQ ID NO: 173896 - DNA, 25 bp, Homo sapien
tccgcgtggaaattagccggttgcc

SEQ ID NO: 173897 - DNA, 25 bp, Homo sapien
ccacaggccgcctgagatggttcta

SEQ ID NO: 173898 - DNA, 25 bp, Homo sapien
tttcggtgagtgaaatcggtcgttc

SEQ ID NO: 173899 - DNA, 25 bp, Homo sapien
gatggttctagtccctttgagtata

SEQ ID NO: 173900 - DNA, 25 bp, Homo sapien
agacccttcctgtgcattgaccgac

SEQ ID NO: 173901 - DNA, 25 bp, Homo sapien
ctcggcccggatcccgaaatgaacg

SEQ ID NO: 173902 - DNA, 25 bp, Homo sapien
ttctaccttcggaacgctgcgtctc

SEQ ID NO: 173903 - DNA, 25 bp, Homo sapien
gctgcgtctcggatccttctgaacc

SEQ ID NO: 173904 - DNA, 25 bp, Homo sapien
cgcggtgacctttatctttcggtga

SEQ ID NO: 173905 - DNA, 25 bp, Homo sapien
ttgttcgtgcgtccctaaacggctg

SEQ ID NO: 173906 - DNA, 25 bp, Homo sapien
tgatcccggactccctttgttcgtg

SEQ ID NO: 173907 - DNA, 25 bp, Homo sapien
ctggcaccaggactaagcgtttcta

SEQ ID NO: 173908 - DNA, 25 bp, Homo sapien
accgaggtgcatcgagtcacgtcca

SEQ ID NO: 173909 - DNA, 25 bp, Homo sapien
ccctactgcggtctcggatattgcc

SEQ ID NO: 173910 - DNA, 25 bp, Homo sapien
tgggagcttttagcccgcccaccag

SEQ ID NO: 173911 - DNA, 25 bp, Homo sapien
agtcctcggaactccggaaactctg

SEQ ID NO: 173912 - DNA, 25 bp, Homo sapien
tgaacatcggcagccactggcgttt

SEQ ID NO: 173913 - DNA, 25 bp, Homo sapien
cggggcagtcgcctttgattatcga

SEQ ID NO: 173914 - DNA, 25 bp, Homo sapien
gggctcgctcagcaaaccagacggc

SEQ ID NO: 173915 - DNA, 25 bp, Homo sapien
ggttggcagcaccttacgagaccca

SEQ ID NO: 173916 - DNA, 25 bp, Homo sapien
aagggacttcccaggactgcatagg

SEQ ID NO: 173917 - DNA, 25 bp, Homo sapien
cccttttgagcatcagctgaggctg

SEQ ID NO: 173918 - DNA, 25 bp, Homo sapien
gctccagtttctctaattggggttg

SEQ ID NO: 173919 - DNA, 25 bp, Homo sapien
gcgcgaatgagttcttccaccggga

SEQ ID NO: 173920 - DNA, 25 bp, Homo sapien
ctggacttggaggagatctcgctgt

SEQ ID NO: 173921 - DNA, 25 bp, Homo sapien
gccagttcaaaagatgggtgagaga

SEQ ID NO: 173922 - DNA, 25 bp, Homo sapien
cgagcctccacgaaattcaaacttg

SEQ ID NO: 173923 - DNA, 25 bp, Homo sapien
aaattcaaacttgccgcaccgagcc

SEQ ID NO: 173924 - DNA, 25 bp, Homo sapien
ttccactcaacgaggcttgcgattg

SEQ ID NO: 173925 - DNA, 25 bp, Homo sapien
ttgcgattggtttgctccgtgcgat

SEQ ID NO: 173926 - DNA, 25 bp, Homo sapien
ctccgtgcgatatttgaattgattg

SEQ ID NO: 173927 - DNA, 25 bp, Homo sapien
tgattgaaaggtgaagggccagttc

SEQ ID NO: 173928 - DNA, 25 bp, Homo sapien
gactccgaagcaggaaccctcacaa

SEQ ID NO: 173929 - DNA, 25 bp, Homo sapien
agtcgactgcggttcgtcctcagtc

SEQ ID NO: 173930 - DNA, 25 bp, Homo sapien
ggaagttgtcttccacgaacgcttg

SEQ ID NO: 173931 - DNA, 25 bp, Homo sapien
tccgtgtgtctgtgacgtcagaaga

SEQ ID NO: 173932 - DNA, 25 bp, Homo sapien
gtcctcagtccacgatgaagtcata

SEQ ID NO: 173933 - DNA, 25 bp, Homo sapien
gagctggcgcttgtccttaaccttc

SEQ ID NO: 173934 - DNA, 25 bp, Homo sapien
ctgaagccgaggagattcacggata

SEQ ID NO: 173935 - DNA, 25 bp, Homo sapien
cgtgacgtcactccgttttagccaa

SEQ ID NO: 173936 - DNA, 25 bp, Homo sapien
ccttcttcaacgacgaggcgggacg

SEQ ID NO: 173937 - DNA, 25 bp, Homo sapien
aaaatcgagcagaggcacggcacca

SEQ ID NO: 173938 - DNA, 25 bp, Homo sapien
taagaagaggtatgagaagcagctg

SEQ ID NO: 173939 - DNA, 25 bp, Homo sapien
aagaaaatcgagcagaggcacggca

SEQ ID NO: 173940 - DNA, 25 bp, Homo sapien
tcgagcagaggcacggcaccaaaaa

SEQ ID NO: 173941 - DNA, 25 bp, Homo sapien
aggcactgaagcgtaagaagaggta

SEQ ID NO: 173942 - DNA, 25 bp, Homo sapien
cactgaagcgtaagaagaggtatga

SEQ ID NO: 173943 - DNA, 25 bp, Homo sapien
tccaggcactgaagcgtaagaagag

SEQ ID NO: 173944 - DNA, 25 bp, Homo sapien
cgtaagaagaggtatgagaagcagc

SEQ ID NO: 173945 - DNA, 25 bp, Homo sapien
ttttcaaccgggtgcattctgggcc

SEQ ID NO: 173946 - DNA, 25 bp, Homo sapien
acgaaatcgccgctctgaacgcatt

SEQ ID NO: 173947 - DNA, 25 bp, Homo sapien
ctgaacgcatttggcgcaggtcagc

SEQ ID NO: 173948 - DNA, 25 bp, Homo sapien
ttgcacagcgggcagcgctccacag

SEQ ID NO: 173949 - DNA, 25 bp, Homo sapien
gcatcgtccacggagtccaccaggt

SEQ ID NO: 173950 - DNA, 25 bp, Homo sapien
ccagtcacgtgggattttgttttca

SEQ ID NO: 173951 - DNA, 25 bp, Homo sapien
ttcccactgggagacgccatgatgg

SEQ ID NO: 173952 - DNA, 25 bp, Homo sapien
cgcggccgtcgaagtagacgaaatc

SEQ ID NO: 173953 - DNA, 25 bp, Homo sapien
gatgcggaacccagctaccggccca

SEQ ID NO: 173954 - DNA, 25 bp, Homo sapien
cagcctcggaacccgctccggccag

SEQ ID NO: 173955 - DNA, 25 bp, Homo sapien
cggaacccagctaccggcccatggg

SEQ ID NO: 173956 - DNA, 25 bp, Homo sapien
ggcgcagaggccatttatgagcctg

SEQ ID NO: 173957 - DNA, 25 bp, Homo sapien
cgcagaggccatttatgagcctggg

SEQ ID NO: 173958 - DNA, 25 bp, Homo sapien
gagagaagcgttgggcgatgggctt

SEQ ID NO: 173959 - DNA, 25 bp, Homo sapien
gggcgcagaggccatttatgagcct

SEQ ID NO: 173960 - DNA, 25 bp, Homo sapien
cggccctcggcccaggttcctgcag

SEQ ID NO: 173961 - DNA, 25 bp, Homo sapien
ctttggaaaaatccatggaccactc

SEQ ID NO: 173962 - DNA, 25 bp, Homo sapien
ggcacctatttttagccaagcctga

SEQ ID NO: 173963 - DNA, 25 bp, Homo sapien
gtgtgtcctagcgattcggcctgac

SEQ ID NO: 173964 - DNA, 25 bp, Homo sapien
tggaccactctcgacaccggcgaag

SEQ ID NO: 173965 - DNA, 25 bp, Homo sapien
caccggcgaagttatcccttcctgt

SEQ ID NO: 173966 - DNA, 25 bp, Homo sapien
tgctggagttccagtcctcgccgct

SEQ ID NO: 173967 - DNA, 25 bp, Homo sapien
tgggccacacttacgccatgctgga

SEQ ID NO: 173968 - DNA, 25 bp, Homo sapien
gattaccgcctcctcggccggtgga

SEQ ID NO: 173969 - DNA, 25 bp, Homo sapien
gaggcatacatgctgcgccacaaga

SEQ ID NO: 173970 - DNA, 25 bp, Homo sapien
gctaagtagttactgctgggccgga

SEQ ID NO: 173971 - DNA, 25 bp, Homo sapien
gaagaatctggctttcctcggcaag

SEQ ID NO: 173972 - DNA, 25 bp, Homo sapien
tgaacaccaacccttttcgaagcgc

SEQ ID NO: 173973 - DNA, 25 bp, Homo sapien
gccatcgtggctaagtagttactgc

SEQ ID NO: 173974 - DNA, 25 bp, Homo sapien
cctccctggactgcctcaaggtgtt

SEQ ID NO: 173975 - DNA, 25 bp, Homo sapien
aagcgaggccatgcctccctggact

SEQ ID NO: 173976 - DNA, 25 bp, Homo sapien
ttctggccgacagtgcgaggcatac

SEQ ID NO: 173977 - DNA, 25 bp, Homo sapien
aagtggccagaactcgggcgaccca

SEQ ID NO: 173978 - DNA, 25 bp, Homo sapien
gtcgcttcccgaagctgagaggccg

SEQ ID NO: 173979 - DNA, 25 bp, Homo sapien
cccggctgcgctttgcaaattgttc

SEQ ID NO: 173980 - DNA, 25 bp, Homo sapien
gcaaattgttccgatgaccgccgcg

SEQ ID NO: 173981 - DNA, 25 bp, Homo sapien
gcagcccgagagcagtgaactgtgt

SEQ ID NO: 173982 - DNA, 25 bp, Homo sapien
ccaataaggagccagtgaaatacgg

SEQ ID NO: 173983 - DNA, 25 bp, Homo sapien
gccgagcggggctccatgttttccc

SEQ ID NO: 173984 - DNA, 25 bp, Homo sapien
cccgttctcgggatgggattgtagc

SEQ ID NO: 173985 - DNA, 25 bp, Homo sapien
cagttgcgcagtcagaattgtgtgc

SEQ ID NO: 173986 - DNA, 25 bp, Homo sapien
ctcggtatgcccgagtttcaggggc

SEQ ID NO: 173987 - DNA, 25 bp, Homo sapien
agcagcctcggtatgcccgagtttc

SEQ ID NO: 173988 - DNA, 25 bp, Homo sapien
aattgtgtgcgtcccaccgcctcag

SEQ ID NO: 173989 - DNA, 25 bp, Homo sapien
gcccagaggatgagcagcctcggta

SEQ ID NO: 173990 - DNA, 25 bp, Homo sapien
tccggcgttcacagttgcgcagtca

SEQ ID NO: 173991 - DNA, 25 bp, Homo sapien
acgtgtaagcggaagagccgagatt

SEQ ID NO: 173992 - DNA, 25 bp, Homo sapien
ggtccgcgcccagtgaggccaacag

SEQ ID NO: 173993 - DNA, 25 bp, Homo sapien
caggcggagaaaggtgcggtccaac

SEQ ID NO: 173994 - DNA, 25 bp, Homo sapien
gtccttctccctcggtcgccactgg

SEQ ID NO: 173995 - DNA, 25 bp, Homo sapien
acaagctgcgctcgtctctcggctg

SEQ ID NO: 173996 - DNA, 25 bp, Homo sapien
tcggtcgccactggcccatgagtcc

SEQ ID NO: 173997 - DNA, 25 bp, Homo sapien
catgagtccccatggcgacggcagg

SEQ ID NO: 173998 - DNA, 25 bp, Homo sapien
gccgtggccgcagtgttcaccttca

SEQ ID NO: 173999 - DNA, 25 bp, Homo sapien
agctccgtgtcgcaccgggttcttg

SEQ ID NO: 174000 - DNA, 25 bp, Homo sapien
ggttcttgggctggccgtgtccttc

SEQ ID NO: 174001 - DNA, 25 bp, Homo sapien
agccacttcagggattgcactccga

SEQ ID NO: 174002 - DNA, 25 bp, Homo sapien
tgtctcagttcccacgtcaagagga

SEQ ID NO: 174003 - DNA, 25 bp, Homo sapien
gctgcgagtttcagacccgcttccg

SEQ ID NO: 174004 - DNA, 25 bp, Homo sapien
tctgagcctcttgagcaactccctg

SEQ ID NO: 174005 - DNA, 25 bp, Homo sapien
cgcaggtgtgtactttacagccaga

SEQ ID NO: 174006 - DNA, 25 bp, Homo sapien
gaaggcctagctttcagggacattg

SEQ ID NO: 174007 - DNA, 25 bp, Homo sapien
gggagcactgtctctttgccaaatt

SEQ ID NO: 174008 - DNA, 25 bp, Homo sapien
tcttgcgggcaactgcacactcggt

SEQ ID NO: 174009 - DNA, 25 bp, Homo sapien
gccagctctttagccagagcgccta

SEQ ID NO: 174010 - DNA, 25 bp, Homo sapien
cgtctgtcagtctcggttttagctc

SEQ ID NO: 174011 - DNA, 25 bp, Homo sapien
cccggcaaggcaagagcctcagtct

SEQ ID NO: 174012 - DNA, 25 bp, Homo sapien
ggcagagatgtgagtgctgttccca

SEQ ID NO: 174013 - DNA, 25 bp, Homo sapien
tggggagttagaaaagccagctctt

SEQ ID NO: 174014 - DNA, 25 bp, Homo sapien
gtcagcggctcatcctaccgggaga

SEQ ID NO: 174015 - DNA, 25 bp, Homo sapien
ctcgcccttcgaggccaggagaagc

SEQ ID NO: 174016 - DNA, 25 bp, Homo sapien
tgctgttcccaggtaactccgactg

SEQ ID NO: 174017 - DNA, 25 bp, Homo sapien
gggttggccttgactattaattatc

SEQ ID NO: 174018 - DNA, 25 bp, Homo sapien
gtgcctgtaaaaagtcccgagctga

SEQ ID NO: 174019 - DNA, 25 bp, Homo sapien
gcgcaccagttctatctgtgaagga

SEQ ID NO: 174020 - DNA, 25 bp, Homo sapien
cgggcatcgatttcaagagtcactt

SEQ ID NO: 174021 - DNA, 25 bp, Homo sapien
cttcttgggagtttgcagagcgacc

SEQ ID NO: 174022 - DNA, 25 bp, Homo sapien
ccgcgacccggcaaagtcatgttga

SEQ ID NO: 174023 - DNA, 25 bp, Homo sapien
ggctgcgtaattacaacccagggtg

SEQ ID NO: 174024 - DNA, 25 bp, Homo sapien
tcttactgggccgatccatggcaca

SEQ ID NO: 174025 - DNA, 25 bp, Homo sapien
caaacgaccgacactgcgaggcctg

SEQ ID NO: 174026 - DNA, 25 bp, Homo sapien
tgttagaacaaacgccaccaaacga

SEQ ID NO: 174027 - DNA, 25 bp, Homo sapien
acactgcgaggcctggagctacctg

SEQ ID NO: 174028 - DNA, 25 bp, Homo sapien
agtgtgaggtcgacaagatatcgtg

SEQ ID NO: 174029 - DNA, 25 bp, Homo sapien
cagtttctgtgttagaacaaacgcc

SEQ ID NO: 174030 - DNA, 25 bp, Homo sapien
agatatcgtggaagagagcgaacga

SEQ ID NO: 174031 - DNA, 25 bp, Homo sapien
accgacactgcgaggcctggagcta

SEQ ID NO: 174032 - DNA, 25 bp, Homo sapien
tcgacaagatatcgtggaagagagc

SEQ ID NO: 174033 - DNA, 25 bp, Homo sapien
tatgaccctcgtggcgctggctgtc

SEQ ID NO: 174034 - DNA, 25 bp, Homo sapien
tccagtccggagacccgctggctgt

SEQ ID NO: 174035 - DNA, 25 bp, Homo sapien
cgttcccaggagtcaagagtttcta

SEQ ID NO: 174036 - DNA, 25 bp, Homo sapien
ctggctgtcgcgttcccaggagtca

SEQ ID NO: 174037 - DNA, 25 bp, Homo sapien
cccactgtactgaaacacctggcgg

SEQ ID NO: 174038 - DNA, 25 bp, Homo sapien
cccgggcgttatgaccctcgtggcg

SEQ ID NO: 174039 - DNA, 25 bp, Homo sapien
caggagtcaagagtttctaggggcc

SEQ ID NO: 174040 - DNA, 25 bp, Homo sapien
tgtactgaaacacctggcggccgcc

SEQ ID NO: 174041 - DNA, 25 bp, Homo sapien
ggatcccgccctcgtagcggaagga

SEQ ID NO: 174042 - DNA, 25 bp, Homo sapien
ctgtttggtctccacgaagtgcttc

SEQ ID NO: 174043 - DNA, 25 bp, Homo sapien
tcgatgttcgcaaaagggtaggccc

SEQ ID NO: 174044 - DNA, 25 bp, Homo sapien
ctctggggagttcgcaaagcttctc

SEQ ID NO: 174045 - DNA, 25 bp, Homo sapien
aagcttctcgctttgatcagccgcg

SEQ ID NO: 174046 - DNA, 25 bp, Homo sapien
tttcccttcttggacgaggtgcggc

SEQ ID NO: 174047 - DNA, 25 bp, Homo sapien
cttcccttcaccaaaggttagatgg

SEQ ID NO: 174048 - DNA, 25 bp, Homo sapien
cggcctctggtcttttcccttcttg

SEQ ID NO: 174049 - DNA, 25 bp, Homo sapien
cctgaactgcacgtgagcgtccttg

SEQ ID NO: 174050 - DNA, 25 bp, Homo sapien
cgggcggagagcctcatttcactaa

SEQ ID NO: 174051 - DNA, 25 bp, Homo sapien
atggggcctagcttgcgattatttc

SEQ ID NO: 174052 - DNA, 25 bp, Homo sapien
ctaacctgagagagatggactgcgc

SEQ ID NO: 174053 - DNA, 25 bp, Homo sapien
cgctgcctgcttctgcaattgctga

SEQ ID NO: 174054 - DNA, 25 bp, Homo sapien
gccgctttgattcgggattcgttca

SEQ ID NO: 174055 - DNA, 25 bp, Homo sapien
gggaaccactcggtttgctgcgata

SEQ ID NO: 174056 - DNA, 25 bp, Homo sapien
attttcccacgtaccaagcgaggtg

SEQ ID NO: 174057 - DNA, 25 bp, Homo sapien
gcttcacatgctgcgcctcagaggc

SEQ ID NO: 174058 - DNA, 25 bp, Homo sapien
tggatgccgtctccgcttcacatgc

SEQ ID NO: 174059 - DNA, 25 bp, Homo sapien
ggccatgaagcgaagccgcaaacgc

SEQ ID NO: 174060 - DNA, 25 bp, Homo sapien
aagccgcaaacgcttgtcagctgcc

SEQ ID NO: 174061 - DNA, 25 bp, Homo sapien
tgtcaccgcctcatacgccggaagt

SEQ ID NO: 174062 - DNA, 25 bp, Homo sapien
cggcgaataaaacgagcggcgaaag

SEQ ID NO: 174063 - DNA, 25 bp, Homo sapien
tcatacgccggaagtggaactgcgc

SEQ ID NO: 174064 - DNA, 25 bp, Homo sapien
aagagctcggccgtggtagccatcc

SEQ ID NO: 174065 - DNA, 25 bp, Homo sapien
tgagggacggtttctgcctttgttc

SEQ ID NO: 174066 - DNA, 25 bp, Homo sapien
ccggcctaacagctgaggcgcttta

SEQ ID NO: 174067 - DNA, 25 bp, Homo sapien
gggaagtgtcgtaaagccaggccca

SEQ ID NO: 174068 - DNA, 25 bp, Homo sapien
tcgcttctaggatggcggaggtacc

SEQ ID NO: 174069 - DNA, 25 bp, Homo sapien
cagcagcagctcaacggattgatta

SEQ ID NO: 174070 - DNA, 25 bp, Homo sapien
cgtagcagaggtggccgcgaccaca

SEQ ID NO: 174071 - DNA, 25 bp, Homo sapien
ctgcaacaaaaggagccggggtaca

SEQ ID NO: 174072 - DNA, 25 bp, Homo sapien
tctagtaatgcaagaactgcggtcc

SEQ ID NO: 174073 - DNA, 25 bp, Homo sapien
cctggtcgccagctttcatcattaa

SEQ ID NO: 174074 - DNA, 25 bp, Homo sapien
gggccgccttgacatccatagagag

SEQ ID NO: 174075 - DNA, 25 bp, Homo sapien
tctggctggagtaacctggataata

SEQ ID NO: 174076 - DNA, 25 bp, Homo sapien
gcggcgtcttacttttctggctgga

SEQ ID NO: 174077 - DNA, 25 bp, Homo sapien
cgaggacagcggacatacttttctc

SEQ ID NO: 174078 - DNA, 25 bp, Homo sapien
tgttagcctcctccgggcgtaaatc

SEQ ID NO: 174079 - DNA, 25 bp, Homo sapien
ttccgctaagtgaacagccatgtta

SEQ ID NO: 174080 - DNA, 25 bp, Homo sapien
gcagcgtctcaacagcccggagtga

SEQ ID NO: 174081 - DNA, 25 bp, Homo sapien
aggctcgttctttgcctgggctgcc

SEQ ID NO: 174082 - DNA, 25 bp, Homo sapien
gtgctctcgcggctgctgcccgttg

SEQ ID NO: 174083 - DNA, 25 bp, Homo sapien
ctgctgcccgttggggtccagctga

SEQ ID NO: 174084 - DNA, 25 bp, Homo sapien
agcgcggatcccaggctcgttcttt

SEQ ID NO: 174085 - DNA, 25 bp, Homo sapien
ggcgccagctccaagggcggatcca

SEQ ID NO: 174086 - DNA, 25 bp, Homo sapien
actacgcagaggctggcacgccgac

SEQ ID NO: 174087 - DNA, 25 bp, Homo sapien
tctccgtggaggcagtgctctcgcg

SEQ ID NO: 174088 - DNA, 25 bp, Homo sapien
gcggtcccaactacgcagaggctgg

SEQ ID NO: 174089 - DNA, 25 bp, Homo sapien
aagagaccagggcaccgtttacacg

SEQ ID NO: 174090 - DNA, 25 bp, Homo sapien
ggacactgcgatcgacggtttgaaa

SEQ ID NO: 174091 - DNA, 25 bp, Homo sapien
ctctctcactgctgtgggattgcga

SEQ ID NO: 174092 - DNA, 25 bp, Homo sapien
tcacctgtgcgccttcagctgagca

SEQ ID NO: 174093 - DNA, 25 bp, Homo sapien
ggcgcttcgctttgttgcttattca

SEQ ID NO: 174094 - DNA, 25 bp, Homo sapien
gcttattcataaggccgcggctacg

SEQ ID NO: 174095 - DNA, 25 bp, Homo sapien
tggtgaccgcagcaacgattcgctc

SEQ ID NO: 174096 - DNA, 25 bp, Homo sapien
cgcctccctatctacgcggaagaga

SEQ ID NO: 174097 - DNA, 25 bp, Homo sapien
cagcacctgcaagggtgggtccaac

SEQ ID NO: 174098 - DNA, 25 bp, Homo sapien
gtgacgccagctgtgttcgacccga

SEQ ID NO: 174099 - DNA, 25 bp, Homo sapien
gcgcccttgcaaataacagctctta

SEQ ID NO: 174100 - DNA, 25 bp, Homo sapien
ttatttcctccctgggcgatgcgaa

SEQ ID NO: 174101 - DNA, 25 bp, Homo sapien
gaacctcttcacagccgcgcgtggg

SEQ ID NO: 174102 - DNA, 25 bp, Homo sapien
taccatgccgctctacgagggcctg

SEQ ID NO: 174103 - DNA, 25 bp, Homo sapien
cctttaccaagtgagtggccgtgac

SEQ ID NO: 174104 - DNA, 25 bp, Homo sapien
tccaacgcggaatgaggcacagcct

SEQ ID NO: 174105 - DNA, 25 bp, Homo sapien
tccctttgggtttagcacgatgagc

SEQ ID NO: 174106 - DNA, 25 bp, Homo sapien
cctgttactagtttgcggcatcctg

SEQ ID NO: 174107 - DNA, 25 bp, Homo sapien
tgaagcttttcagcgcaggtgtagc

SEQ ID NO: 174108 - DNA, 25 bp, Homo sapien
cgctgtctgtcggtgtaatagttta

SEQ ID NO: 174109 - DNA, 25 bp, Homo sapien
ctcggacagaccacatggggttcgc

SEQ ID NO: 174110 - DNA, 25 bp, Homo sapien
gctgtttggagaccggtcgtcttta

SEQ ID NO: 174111 - DNA, 25 bp, Homo sapien
ggtgaccgtgactcctgaagctttt

SEQ ID NO: 174112 - DNA, 25 bp, Homo sapien
ctggaatccctacgcgtccctttgg

SEQ ID NO: 174113 - DNA, 25 bp, Homo sapien
gaagtttaccatggctgcctgcggc

SEQ ID NO: 174114 - DNA, 25 bp, Homo sapien
ggagaagtttaccatggctgcctgc

SEQ ID NO: 174115 - DNA, 25 bp, Homo sapien
ccgcagggagaagtttaccatggct

SEQ ID NO: 174116 - DNA, 25 bp, Homo sapien
cccgccgcagggagaagtttaccat

SEQ ID NO: 174117 - DNA, 25 bp, Homo sapien
tcggacaaccatagcctccaactga

SEQ ID NO: 174118 - DNA, 25 bp, Homo sapien
ccaactgacctttctgacagctctg

SEQ ID NO: 174119 - DNA, 25 bp, Homo sapien
catagcctccaactgacctttctga

SEQ ID NO: 174120 - DNA, 25 bp, Homo sapien
cagtcaatcggacaaccatagcctc

SEQ ID NO: 174121 - DNA, 25 bp, Homo sapien
tgggttccgtttccatgggacactc

SEQ ID NO: 174122 - DNA, 25 bp, Homo sapien
cctggctgcaattctgggttccgtt

SEQ ID NO: 174123 - DNA, 25 bp, Homo sapien
aatggcgccgacaagctggtttagc

SEQ ID NO: 174124 - DNA, 25 bp, Homo sapien
aaatgcgatggagctacggccaccg

SEQ ID NO: 174125 - DNA, 25 bp, Homo sapien
tcctccggccacgactaggtgctgt

SEQ ID NO: 174126 - DNA, 25 bp, Homo sapien
ccaccgctgccgagacaaaatggcg

SEQ ID NO: 174127 - DNA, 25 bp, Homo sapien
ggacggccgcacaaaaaccaatcta

SEQ ID NO: 174128 - DNA, 25 bp, Homo sapien
tctacctgatgaaaactccgttccc

SEQ ID NO: 174129 - DNA, 25 bp, Homo sapien
ctgaatggacgaagtggcagtagca

SEQ ID NO: 174130 - DNA, 25 bp, Homo sapien
cctggagctccgagttgagcattcc

SEQ ID NO: 174131 - DNA, 25 bp, Homo sapien
ctctggccttttccggagctatctg

SEQ ID NO: 174132 - DNA, 25 bp, Homo sapien
tgtacaaaaagttgaggcgggcgct

SEQ ID NO: 174133 - DNA, 25 bp, Homo sapien
cgagctgatacctctctgggctgta

SEQ ID NO: 174134 - DNA, 25 bp, Homo sapien
cgctaagtttgcttccgcgcggtga

SEQ ID NO: 174135 - DNA, 25 bp, Homo sapien
cattccgggtcaaagtggccagcga

SEQ ID NO: 174136 - DNA, 25 bp, Homo sapien
cagccattgaccagcggcagcaact

SEQ ID NO: 174137 - DNA, 25 bp, Homo sapien
gccttcctgggctattgtatttacc

SEQ ID NO: 174138 - DNA, 25 bp, Homo sapien
caggtagctcagtagacgcaggtcc

SEQ ID NO: 174139 - DNA, 25 bp, Homo sapien
gctttcgatccgcacaggtagctca

SEQ ID NO: 174140 - DNA, 25 bp, Homo sapien
tgtatttacctcaaccggaagcggc

SEQ ID NO: 174141 - DNA, 25 bp, Homo sapien
cacgcaggtgcagtgctttcgatcc

SEQ ID NO: 174142 - DNA, 25 bp, Homo sapien
ccgtgttgtgttcgcagaaagaaga

SEQ ID NO: 174143 - DNA, 25 bp, Homo sapien
ccagccagcatgtgccgtgttgtgt

SEQ ID NO: 174144 - DNA, 25 bp, Homo sapien
cggcagcaggtagttagttccctca

SEQ ID NO: 174145 - DNA, 25 bp, Homo sapien
taagcacaggctctcgcatccgaca

SEQ ID NO: 174146 - DNA, 25 bp, Homo sapien
cgcggccgccagatgggaaagaaca

SEQ ID NO: 174147 - DNA, 25 bp, Homo sapien
cgtgggagcagtaatgtcaagtgac

SEQ ID NO: 174148 - DNA, 25 bp, Homo sapien
caagtgacacttaaacccttagacg

SEQ ID NO: 174149 - DNA, 25 bp, Homo sapien
ttagacgccgattcgttataacgcg

SEQ ID NO: 174150 - DNA, 25 bp, Homo sapien
gcatccgacatcagtacaaggctgg

SEQ ID NO: 174151 - DNA, 25 bp, Homo sapien
cggcagagaacagacaccatactta

SEQ ID NO: 174152 - DNA, 25 bp, Homo sapien
cactttcctggagcgtagcctgcca

SEQ ID NO: 174153 - DNA, 25 bp, Homo sapien
aaagcaattggtaggtcgtgcccga

SEQ ID NO: 174154 - DNA, 25 bp, Homo sapien
ccgaaggtggagcacggctgttcct

SEQ ID NO: 174155 - DNA, 25 bp, Homo sapien
agatgctcgctgttatgggacgccc

SEQ ID NO: 174156 - DNA, 25 bp, Homo sapien
ttcttggaggagaacatcttgctgc

SEQ ID NO: 174157 - DNA, 25 bp, Homo sapien
ccagcgccaagagctgctggtcagg

SEQ ID NO: 174158 - DNA, 25 bp, Homo sapien
aggactcgagggcttctagccaccg

SEQ ID NO: 174159 - DNA, 25 bp, Homo sapien
aggcagacaccgagcggcagcgcac

SEQ ID NO: 174160 - DNA, 25 bp, Homo sapien
catcttgctgctaagaaagcaattg

SEQ ID NO: 174161 - DNA, 25 bp, Homo sapien
ctggagaacggcttgcccaccgtca

SEQ ID NO: 174162 - DNA, 25 bp, Homo sapien
ccaccaactgcttcggggacagcga

SEQ ID NO: 174163 - DNA, 25 bp, Homo sapien
ggacgagcagagcaattacaccacc

SEQ ID NO: 174164 - DNA, 25 bp, Homo sapien
tacgtggctagcgactccgagtact

SEQ ID NO: 174165 - DNA, 25 bp, Homo sapien
cctcggccgagatttcctacgaaga

SEQ ID NO: 174166 - DNA, 25 bp, Homo sapien
acaagcgaactgactaccggcggtg

SEQ ID NO: 174167 - DNA, 25 bp, Homo sapien
tggtggccaaacctaagcacaagcg

SEQ ID NO: 174168 - DNA, 25 bp, Homo sapien
agtgtcgcttcccagatgacttgga

SEQ ID NO: 174169 - DNA, 25 bp, Homo sapien
cgccgggcaaagtagaggtcaagtc

SEQ ID NO: 174170 - DNA, 25 bp, Homo sapien
tgcccgccgcactcattcattaagt

SEQ ID NO: 174171 - DNA, 25 bp, Homo sapien
cagagccgcctttccagcatgcagg

SEQ ID NO: 174172 - DNA, 25 bp, Homo sapien
cggatcccattgtacccagagtgca

SEQ ID NO: 174173 - DNA, 25 bp, Homo sapien
atgtcacctgcgagttagtaaccta

SEQ ID NO: 174174 - DNA, 25 bp, Homo sapien
gggagccactttgtatcctatcagg

SEQ ID NO: 174175 - DNA, 25 bp, Homo sapien
ccaccgctaacactgcaaggctgta

SEQ ID NO: 174176 - DNA, 25 bp, Homo sapien
agctcccgggccagtaggtaaatat

SEQ ID NO: 174177 - DNA, 25 bp, Homo sapien
gtggctgtatgggatcctactgata

SEQ ID NO: 174178 - DNA, 25 bp, Homo sapien
aaagtaggaaatggggctcgattgc

SEQ ID NO: 174179 - DNA, 25 bp, Homo sapien
tctgctactgtaaaccactggtggc

SEQ ID NO: 174180 - DNA, 25 bp, Homo sapien
ttaggattgggaacaacagagtgtg

SEQ ID NO: 174181 - DNA, 25 bp, Homo sapien
aacagagtgtgtagcttggagtatc

SEQ ID NO: 174182 - DNA, 25 bp, Homo sapien
gcttggagtatctgattaatagctc

SEQ ID NO: 174183 - DNA, 25 bp, Homo sapien
gattaatagctctaaggtcttgccc

SEQ ID NO: 174184 - DNA, 25 bp, Homo sapien
gtcttgccctaaccggtatgagcca

SEQ ID NO: 174185 - DNA, 25 bp, Homo sapien
tgctggctgcccagtaaggccatgc

SEQ ID NO: 174186 - DNA, 25 bp, Homo sapien
tcaccgcgcagttgccaaggctaga

SEQ ID NO: 174187 - DNA, 25 bp, Homo sapien
ggagctgccggtgcttcacaatcac

SEQ ID NO: 174188 - DNA, 25 bp, Homo sapien
cgccgtgagcagatccgatagggac

SEQ ID NO: 174189 - DNA, 25 bp, Homo sapien
gtccaacgagatgagcgccacgctg

SEQ ID NO: 174190 - DNA, 25 bp, Homo sapien
ccgtgcgcacctcgctgaagaagcg

SEQ ID NO: 174191 - DNA, 25 bp, Homo sapien
acaggcgcaccgtcttgcagatgtg

SEQ ID NO: 174192 - DNA, 25 bp, Homo sapien
cgcacgatagcgcagtaacggtcca

SEQ ID NO: 174193 - DNA, 25 bp, Homo sapien
cggtcccgcagctatggcttcaagc

SEQ ID NO: 174194 - DNA, 25 bp, Homo sapien
ctgtagccctcgttgtgcaggaaca

SEQ ID NO: 174195 - DNA, 25 bp, Homo sapien
ccgctgatctagtgcttctcgaaaa

SEQ ID NO: 174196 - DNA, 25 bp, Homo sapien
tactttcctacacggctggcctcgg

SEQ ID NO: 174197 - DNA, 25 bp, Homo sapien
tcgcatgccacgaaggcggtcacca

SEQ ID NO: 174198 - DNA, 25 bp, Homo sapien
gcccattacctgtggccagcacgaa

SEQ ID NO: 174199 - DNA, 25 bp, Homo sapien
ggcacaagcccgaagtccaaagcga

SEQ ID NO: 174200 - DNA, 25 bp, Homo sapien
ccaagatcccgggaagcgtttctgg

SEQ ID NO: 174201 - DNA, 25 bp, Homo sapien
ccagagccaaggattgccggttgcc

SEQ ID NO: 174202 - DNA, 25 bp, Homo sapien
gttcccgctgagtgcctcctaagcg

SEQ ID NO: 174203 - DNA, 25 bp, Homo sapien
taagcgccacctctgaggagacgtc

SEQ ID NO: 174204 - DNA, 25 bp, Homo sapien
ttccagcgcccgaggggcgtcttac

SEQ ID NO: 174205 - DNA, 25 bp, Homo sapien
ggcgtcttacccacaacaaacagct

SEQ ID NO: 174206 - DNA, 25 bp, Homo sapien
ttgagcgcctcctaagccagagcca

SEQ ID NO: 174207 - DNA, 25 bp, Homo sapien
ttgccacgggcaacgaggacaccga

SEQ ID NO: 174208 - DNA, 25 bp, Homo sapien
cagggccattttgccgctctacttg

SEQ ID NO: 174209 - DNA, 25 bp, Homo sapien
actcaagcgttggtgcccggctgct

SEQ ID NO: 174210 - DNA, 25 bp, Homo sapien
cagtggcctgcatcgtgcgggcttt

SEQ ID NO: 174211 - DNA, 25 bp, Homo sapien
gtaaagcggttctggccgcgaaggc

SEQ ID NO: 174212 - DNA, 25 bp, Homo sapien
ggccggcagcgaatcagcgcggcgc

SEQ ID NO: 174213 - DNA, 25 bp, Homo sapien
cgctccacgcgacagcgttggctgg

SEQ ID NO: 174214 - DNA, 25 bp, Homo sapien
tgcactcaagcgttggtgcccggct

SEQ ID NO: 174215 - DNA, 25 bp, Homo sapien
cgagcgtgcactcaagcgttggtgc

SEQ ID NO: 174216 - DNA, 25 bp, Homo sapien
ggcgccgagcgtgcactcaagcgtt

SEQ ID NO: 174217 - DNA, 25 bp, Homo sapien
gacctggccttgacctcgggcctgt

SEQ ID NO: 174218 - DNA, 25 bp, Homo sapien
gccgtgggttctcggcggtttcata

SEQ ID NO: 174219 - DNA, 25 bp, Homo sapien
gaggcgtcgcacgactcgatgatga

SEQ ID NO: 174220 - DNA, 25 bp, Homo sapien
cggacaccagctcgatctctgagtc

SEQ ID NO: 174221 - DNA, 25 bp, Homo sapien
cggccatggggtcctcggacaccag

SEQ ID NO: 174222 - DNA, 25 bp, Homo sapien
cgtggccaaagctcacatagcctga

SEQ ID NO: 174223 - DNA, 25 bp, Homo sapien
ctccctcaggatgctgtactggatg

SEQ ID NO: 174224 - DNA, 25 bp, Homo sapien
ctcgatgatgagctcgctgtccagc

SEQ ID NO: 174225 - DNA, 25 bp, Homo sapien
gcaacccggtagaaagcctgtgatc

SEQ ID NO: 174226 - DNA, 25 bp, Homo sapien
gacctgagggcgcttctctcccagg

SEQ ID NO: 174227 - DNA, 25 bp, Homo sapien
cccgcaacccggtagaaagcctgtg

SEQ ID NO: 174228 - DNA, 25 bp, Homo sapien
ccgcaacccggtagaaagcctgtga

SEQ ID NO: 174229 - DNA, 25 bp, Homo sapien
caacccggtagaaagcctgtgatca

SEQ ID NO: 174230 - DNA, 25 bp, Homo sapien
cgcttgctctcggtcttggtcttgg

SEQ ID NO: 174231 - DNA, 25 bp, Homo sapien
aggctcccctacctctcgctcctgg

SEQ ID NO: 174232 - DNA, 25 bp, Homo sapien
acccggtagaaagcctgtgatcagc

SEQ ID NO: 174233 - DNA, 25 bp, Homo sapien
tcggcgctcaaggcagaaagcgcga

SEQ ID NO: 174234 - DNA, 25 bp, Homo sapien
cttacctgtggatgcagtttccatg

SEQ ID NO: 174235 - DNA, 25 bp, Homo sapien
cctgtggatgcagtttccatggcaa

SEQ ID NO: 174236 - DNA, 25 bp, Homo sapien
cctttcggcgtcaccgcttcgttct

SEQ ID NO: 174237 - DNA, 25 bp, Homo sapien
cccgacgccatttgaggggcagcgg

SEQ ID NO: 174238 - DNA, 25 bp, Homo sapien
gaatattcccagtcgcccgtggcga

SEQ ID NO: 174239 - DNA, 25 bp, Homo sapien
agagccgcgcagaaggggactgact

SEQ ID NO: 174240 - DNA, 25 bp, Homo sapien
cgcgaatattcccagtcgcccgtgg

SEQ ID NO: 174241 - DNA, 25 bp, Homo sapien
tcacgccaccttgtgacatcacagg

SEQ ID NO: 174242 - DNA, 25 bp, Homo sapien
tgccagcgagaagctcccgccgttt

SEQ ID NO: 174243 - DNA, 25 bp, Homo sapien
cttccgctgattggttggaggtcgc

SEQ ID NO: 174244 - DNA, 25 bp, Homo sapien
ggaggtcgccaccacgtgatgcaaa

SEQ ID NO: 174245 - DNA, 25 bp, Homo sapien
ccaggacccgagagctaaagataat

SEQ ID NO: 174246 - DNA, 25 bp, Homo sapien
accttgcccataacgcgttgctttc

SEQ ID NO: 174247 - DNA, 25 bp, Homo sapien
cgttgctttcagtcacgttccgcga

SEQ ID NO: 174248 - DNA, 25 bp, Homo sapien
ccgcgaactggcgaaggtaagtgaa

SEQ ID NO: 174249 - DNA, 25 bp, Homo sapien
cagcttttctgcctccgcattcggg

SEQ ID NO: 174250 - DNA, 25 bp, Homo sapien
agccgaataggctgcatgaagtatc

SEQ ID NO: 174251 - DNA, 25 bp, Homo sapien
acgccagtgtgcgaattcattaatg

SEQ ID NO: 174252 - DNA, 25 bp, Homo sapien
cctctgcctgcgttaagacagcctg

SEQ ID NO: 174253 - DNA, 25 bp, Homo sapien
gcctgacccgacctctggtaaatta

SEQ ID NO: 174254 - DNA, 25 bp, Homo sapien
cccggcgcacaatcctgaggaagga

SEQ ID NO: 174255 - DNA, 25 bp, Homo sapien
ctcttccctcgggtgacttgaggta

SEQ ID NO: 174256 - DNA, 25 bp, Homo sapien
gcccgagtttacctgcaaaaatgcg

SEQ ID NO: 174257 - DNA, 25 bp, Homo sapien
caaaggacccgggatcactgcagaa

SEQ ID NO: 174258 - DNA, 25 bp, Homo sapien
aggtcgccgtcagccctcaggaagc

SEQ ID NO: 174259 - DNA, 25 bp, Homo sapien
aagacggcccgcaccagagtcgcgt

SEQ ID NO: 174260 - DNA, 25 bp, Homo sapien
gcaacccacaaaggacccgggatca

SEQ ID NO: 174261 - DNA, 25 bp, Homo sapien
cccatagtagcgtcaggtcgccgtc

SEQ ID NO: 174262 - DNA, 25 bp, Homo sapien
gggccttcgggaagctccacgcaac

SEQ ID NO: 174263 - DNA, 25 bp, Homo sapien
tgccactcggcccatagtagcgtca

SEQ ID NO: 174264 - DNA, 25 bp, Homo sapien
aggaagcgcagcagctgcaccaaga

SEQ ID NO: 174265 - DNA, 25 bp, Homo sapien
gctgtcgatctactgggcacctaat

SEQ ID NO: 174266 - DNA, 25 bp, Homo sapien
tccaacgcccggatgatctgagccg

SEQ ID NO: 174267 - DNA, 25 bp, Homo sapien
cgcgaaagcgatgagtcctcggctc

SEQ ID NO: 174268 - DNA, 25 bp, Homo sapien
ggcctgtaaacaagccgggcgtctg

SEQ ID NO: 174269 - DNA, 25 bp, Homo sapien
acgacatccgggtctctgtagctgc

SEQ ID NO: 174270 - DNA, 25 bp, Homo sapien
cctggtgctccaggccgtaaggcaa

SEQ ID NO: 174271 - DNA, 25 bp, Homo sapien
agctgggtaaggcagtgacgtcatc

SEQ ID NO: 174272 - DNA, 25 bp, Homo sapien
gggcacctaatagccgcacattctg

SEQ ID NO: 174273 - DNA, 25 bp, Homo sapien
tgccgccaaggacgctcagccattg

SEQ ID NO: 174274 - DNA, 25 bp, Homo sapien
tcactcccgccctggaagaagcggg

SEQ ID NO: 174275 - DNA, 25 bp, Homo sapien
ctgctggctggaaggcgcacttaca

SEQ ID NO: 174276 - DNA, 25 bp, Homo sapien
ggcgcacttacacattgcggtcatc

SEQ ID NO: 174277 - DNA, 25 bp, Homo sapien
cacattgcggtcatcgcggatcgcc

SEQ ID NO: 174278 - DNA, 25 bp, Homo sapien
gtgaggattccggaaaggaagcatc

SEQ ID NO: 174279 - DNA, 25 bp, Homo sapien
cgctcagccattggagtagaagtga

SEQ ID NO: 174280 - DNA, 25 bp, Homo sapien
cggaaaggaagcatcgtcaggaagc

SEQ ID NO: 174281 - DNA, 25 bp, Homo sapien
cccgcctcgcggctgggagttgccc

SEQ ID NO: 174282 - DNA, 25 bp, Homo sapien
gctccccggccctaggcttcgctgg

SEQ ID NO: 174283 - DNA, 25 bp, Homo sapien
atatagggcgcgctgacaaatccct

SEQ ID NO: 174284 - DNA, 25 bp, Homo sapien
cacttcgcgcctggctcggagggcg

SEQ ID NO: 174285 - DNA, 25 bp, Homo sapien
tatagggcgcgctgacaaatccctc

SEQ ID NO: 174286 - DNA, 25 bp, Homo sapien
gcctgggtgcacttcgcgcctggct

SEQ ID NO: 174287 - DNA, 25 bp, Homo sapien
ctgggtgcacttcgcgcctggctcg

SEQ ID NO: 174288 - DNA, 25 bp, Homo sapien
tagggcgcgctgacaaatccctctg

SEQ ID NO: 174289 - DNA, 25 bp, Homo sapien
gatggcggacgtgctagatcttcac

SEQ ID NO: 174290 - DNA, 25 bp, Homo sapien
agatctcgatcgaaggcgagatggc

SEQ ID NO: 174291 - DNA, 25 bp, Homo sapien
ggatggcgatgaacccggaccacaa

SEQ ID NO: 174292 - DNA, 25 bp, Homo sapien
cggcacagacgagatctcgatcgaa

SEQ ID NO: 174293 - DNA, 25 bp, Homo sapien
cggatgcgtgaggattatgacagcg

SEQ ID NO: 174294 - DNA, 25 bp, Homo sapien
gagagcattcacaaactgaaagaaa

SEQ ID NO: 174295 - DNA, 25 bp, Homo sapien
cgaagatttcgccatggatgaggat

SEQ ID NO: 174296 - DNA, 25 bp, Homo sapien
cgtgctagatcttcacgaggctggg

SEQ ID NO: 174297 - DNA, 25 bp, Homo sapien
gacgccacagcggatcctaactaca

SEQ ID NO: 174298 - DNA, 25 bp, Homo sapien
ctggggtcccaaactccactcagga

SEQ ID NO: 174299 - DNA, 25 bp, Homo sapien
tcccttggtggcgtgtgtacaacca

SEQ ID NO: 174300 - DNA, 25 bp, Homo sapien
gggttcacggacacccagatttctc

SEQ ID NO: 174301 - DNA, 25 bp, Homo sapien
cgagcgcttcagaaatcgttgttga

SEQ ID NO: 174302 - DNA, 25 bp, Homo sapien
gcatccggatcttccagggttcacg

SEQ ID NO: 174303 - DNA, 25 bp, Homo sapien
accgcttatgcgtgggattgcaaca

SEQ ID NO: 174304 - DNA, 25 bp, Homo sapien
ggaagcacccgcataaccgcttatg

SEQ ID NO: 174305 - DNA, 25 bp, Homo sapien
cgctaagggtgagcgccaagcaatt

SEQ ID NO: 174306 - DNA, 25 bp, Homo sapien
accgcctcttctgcgcgctaagggt

SEQ ID NO: 174307 - DNA, 25 bp, Homo sapien
gccaagcaatttcgcgagcaatagc

SEQ ID NO: 174308 - DNA, 25 bp, Homo sapien
taaacctctgcaaactggagcaagg

SEQ ID NO: 174309 - DNA, 25 bp, Homo sapien
gaggccctctttttctgcaccgcgg

SEQ ID NO: 174310 - DNA, 25 bp, Homo sapien
tcggggcccttgtatccgatgtttc

SEQ ID NO: 174311 - DNA, 25 bp, Homo sapien
taaaagttgtccttccggctgattc

SEQ ID NO: 174312 - DNA, 25 bp, Homo sapien
gcaatagccggcaaagtaaccaccc

SEQ ID NO: 174313 - DNA, 25 bp, Homo sapien
ggccgtgtctcagtccacccaaggt

SEQ ID NO: 174314 - DNA, 25 bp, Homo sapien
gaagattgtgttgtcgcgagaactc

SEQ ID NO: 174315 - DNA, 25 bp, Homo sapien
cctcctagagggcagtcaagggctt

SEQ ID NO: 174316 - DNA, 25 bp, Homo sapien
agtcaagggcttctggctgacccga

SEQ ID NO: 174317 - DNA, 25 bp, Homo sapien
ctcgcgagactgtcagacgtatggc

SEQ ID NO: 174318 - DNA, 25 bp, Homo sapien
cgagaactctgcctttgggccgtag

SEQ ID NO: 174319 - DNA, 25 bp, Homo sapien
aaggtctcctcggatcgcctggaga

SEQ ID NO: 174320 - DNA, 25 bp, Homo sapien
actcggacctggtaagaacgctgtg

SEQ ID NO: 174321 - DNA, 25 bp, Homo sapien
gggcacaggctcctactattaatcg

SEQ ID NO: 174322 - DNA, 25 bp, Homo sapien
gcaccgttagaaatggtatcccatg

SEQ ID NO: 174323 - DNA, 25 bp, Homo sapien
tcccggagtgtggatctcgattagc

SEQ ID NO: 174324 - DNA, 25 bp, Homo sapien
cgagttttcctcttcccatgcgctg

SEQ ID NO: 174325 - DNA, 25 bp, Homo sapien
aacagcaaactagtccgtgggccga

SEQ ID NO: 174326 - DNA, 25 bp, Homo sapien
gctgcctgccactcttgtctcaaaa

SEQ ID NO: 174327 - DNA, 25 bp, Homo sapien
gcgagtggtacctgcaggatccata

SEQ ID NO: 174328 - DNA, 25 bp, Homo sapien
gctaattcttgtcagcctgggcaca

SEQ ID NO: 174329 - DNA, 25 bp, Homo sapien
agccacggtccgctcccaaagagaa

SEQ ID NO: 174330 - DNA, 25 bp, Homo sapien
ttaaacctaggtgggagaatgagcc

SEQ ID NO: 174331 - DNA, 25 bp, Homo sapien
taataggtttgcctgtgagctgcga

SEQ ID NO: 174332 - DNA, 25 bp, Homo sapien
actcctactgttgggctgcgtgact

SEQ ID NO: 174333 - DNA, 25 bp, Homo sapien
acgtgtaggcctcgagccactccta

SEQ ID NO: 174334 - DNA, 25 bp, Homo sapien
cggctctgcgtaatcagggctaatg

SEQ ID NO: 174335 - DNA, 25 bp, Homo sapien
gcaacagcagttgtcgccaccggtc

SEQ ID NO: 174336 - DNA, 25 bp, Homo sapien
tgtcggcctgaatggctaataggtt

SEQ ID NO: 174337 - DNA, 25 bp, Homo sapien
cgcctctcctaagagctggcctgga

SEQ ID NO: 174338 - DNA, 25 bp, Homo sapien
agctgtgcgcagtcatcctgagcca

SEQ ID NO: 174339 - DNA, 25 bp, Homo sapien
ggtcggagcgccaacttctcagctc

SEQ ID NO: 174340 - DNA, 25 bp, Homo sapien
gcgcctacggcccacgcagagatgg

SEQ ID NO: 174341 - DNA, 25 bp, Homo sapien
gaggcagcggcttttccttcccact

SEQ ID NO: 174342 - DNA, 25 bp, Homo sapien
cgatcggaagggacgcctctcctaa

SEQ ID NO: 174343 - DNA, 25 bp, Homo sapien
tgcgcctgcatcaggcgtggtgatt

SEQ ID NO: 174344 - DNA, 25 bp, Homo sapien
ctggagcctccaagcgggcaagtag

SEQ ID NO: 174345 - DNA, 25 bp, Homo sapien
agtgcgggatacaagcctctattgg

SEQ ID NO: 174346 - DNA, 25 bp, Homo sapien
gcgcggatgacaggaaaagatcttc

SEQ ID NO: 174347 - DNA, 25 bp, Homo sapien
gcgcgattctctctgaaccggtgga

SEQ ID NO: 174348 - DNA, 25 bp, Homo sapien
ctgcgctatgatccgggtcttgaga

SEQ ID NO: 174349 - DNA, 25 bp, Homo sapien
tgtctggccttcgaatccatactgg

SEQ ID NO: 174350 - DNA, 25 bp, Homo sapien
agttgtaccacgaagctcaggccga

SEQ ID NO: 174351 - DNA, 25 bp, Homo sapien
ccaaggcgacgacagctgagttgta

SEQ ID NO: 174352 - DNA, 25 bp, Homo sapien
tctcagactccgaagagggcgactg

SEQ ID NO: 174353 - DNA, 25 bp, Homo sapien
acgcgcgggtgctcaaagcaaatga

SEQ ID NO: 174354 - DNA, 25 bp, Homo sapien
agagccaatgtctcaggccagcttc

SEQ ID NO: 174355 - DNA, 25 bp, Homo sapien
tcactgcccgttgatttagaaactc

SEQ ID NO: 174356 - DNA, 25 bp, Homo sapien
gccagggaggcataaagaccaaatc

SEQ ID NO: 174357 - DNA, 25 bp, Homo sapien
aagcacgccgcgtacctttccttgg

SEQ ID NO: 174358 - DNA, 25 bp, Homo sapien
cttggccttgagtacgctctcgttc

SEQ ID NO: 174359 - DNA, 25 bp, Homo sapien
tctcgttcttgtgcaggtggtcgca

SEQ ID NO: 174360 - DNA, 25 bp, Homo sapien
agcttctcggcctccacgtaatgcg

SEQ ID NO: 174361 - DNA, 25 bp, Homo sapien
cgccgcagcaagtggcaatgctttt

SEQ ID NO: 174362 - DNA, 25 bp, Homo sapien
cccagccagtcattcgcgttgaagc

SEQ ID NO: 174363 - DNA, 25 bp, Homo sapien
tggcttctcggtttcgtggaatctg

SEQ ID NO: 174364 - DNA, 25 bp, Homo sapien
cgggatctcctttcatgaagccgag

SEQ ID NO: 174365 - DNA, 25 bp, Homo sapien
cactcgcgaggagggagttttcttt

SEQ ID NO: 174366 - DNA, 25 bp, Homo sapien
tttcgcggactgatcctgagcctca

SEQ ID NO: 174367 - DNA, 25 bp, Homo sapien
ctgagcctcagtataactcgctgtg

SEQ ID NO: 174368 - DNA, 25 bp, Homo sapien
ctgtcttcctggcaaaggagttttc

SEQ ID NO: 174369 - DNA, 25 bp, Homo sapien
aacaagtccggtttcctgcagaaga

SEQ ID NO: 174370 - DNA, 25 bp, Homo sapien
ctgccacaggcactggctaacggtg

SEQ ID NO: 174371 - DNA, 25 bp, Homo sapien
tggcatcctaaagctgccgcacgtg

SEQ ID NO: 174372 - DNA, 25 bp, Homo sapien
acggtgcccagttattgctacttgg

SEQ ID NO: 174373 - DNA, 25 bp, Homo sapien
tgcagaagaggcctcatcgccagca

SEQ ID NO: 174374 - DNA, 25 bp, Homo sapien
cccggagtgacccaggtagataaca

SEQ ID NO: 174375 - DNA, 25 bp, Homo sapien
ctcgccgccttagtacccggagtga

SEQ ID NO: 174376 - DNA, 25 bp, Homo sapien
cgggactggacctacatgcaagtga

SEQ ID NO: 174377 - DNA, 25 bp, Homo sapien
ggctgcgctgaaacccgatcctaag

SEQ ID NO: 174378 - DNA, 25 bp, Homo sapien
agcgccatgtttgcgagcacttgga

SEQ ID NO: 174379 - DNA, 25 bp, Homo sapien
aagttggcgctcaccttttggactg

SEQ ID NO: 174380 - DNA, 25 bp, Homo sapien
tggcaacttcaaagccagcgggatg

SEQ ID NO: 174381 - DNA, 25 bp, Homo sapien
gccggtgtccacatttgcttcgtta

SEQ ID NO: 174382 - DNA, 25 bp, Homo sapien
acaccaagtgtctgactcgggagga

SEQ ID NO: 174383 - DNA, 25 bp, Homo sapien
taggggcagggtgaatgattaactc

SEQ ID NO: 174384 - DNA, 25 bp, Homo sapien
taggcgggcgaccagaaacttctgg

SEQ ID NO: 174385 - DNA, 25 bp, Homo sapien
tcccgctccggtaccgatcggatgt

SEQ ID NO: 174386 - DNA, 25 bp, Homo sapien
gccgaagagttgagtccgttgctaa

SEQ ID NO: 174387 - DNA, 25 bp, Homo sapien
cttcaacgctgagcggggctggtat

SEQ ID NO: 174388 - DNA, 25 bp, Homo sapien
ggctcgtagatggaactggtagtca

SEQ ID NO: 174389 - DNA, 25 bp, Homo sapien
ggcgcgcgtcatcagatcaagtcga

SEQ ID NO: 174390 - DNA, 25 bp, Homo sapien
acatcatcactgttcgccgcgaaga

SEQ ID NO: 174391 - DNA, 25 bp, Homo sapien
tgggcgggtcttctatgacatcatc

SEQ ID NO: 174392 - DNA, 25 bp, Homo sapien
aacgtaagtgggctgtgttcgcttc

SEQ ID NO: 174393 - DNA, 25 bp, Homo sapien
gtactccagctccttgatgccgttg

SEQ ID NO: 174394 - DNA, 25 bp, Homo sapien
ccacaccacgaagtcctgattgatg

SEQ ID NO: 174395 - DNA, 25 bp, Homo sapien
acttgacgtggtagtcggtccacca

SEQ ID NO: 174396 - DNA, 25 bp, Homo sapien
tagcgccggttgttctggtagaagt

SEQ ID NO: 174397 - DNA, 25 bp, Homo sapien
ggtagaagttggtcagctcgtagta

SEQ ID NO: 174398 - DNA, 25 bp, Homo sapien
ctcgtagtagaggtacactgggccc

SEQ ID NO: 174399 - DNA, 25 bp, Homo sapien
gggtcgcctgtatagtcgtactcca

SEQ ID NO: 174400 - DNA, 25 bp, Homo sapien
tgcgcgcgtacagtttgcggaacgt

SEQ ID NO: 174401 - DNA, 25 bp, Homo sapien
taaagcagcctgtcgcttgccgggc

SEQ ID NO: 174402 - DNA, 25 bp, Homo sapien
acaactgcgtgcgaatcggcgaccg

SEQ ID NO: 174403 - DNA, 25 bp, Homo sapien
gcagcggctgactgcacaactgcgt

SEQ ID NO: 174404 - DNA, 25 bp, Homo sapien
gtgacctggcctgtgaggtacgtct

SEQ ID NO: 174405 - DNA, 25 bp, Homo sapien
tcggggacctttcgcactcgggtca

SEQ ID NO: 174406 - DNA, 25 bp, Homo sapien
cagctcgctagtggcccgggcgaac

SEQ ID NO: 174407 - DNA, 25 bp, Homo sapien
cagggcaacaatgggcggagttttc

SEQ ID NO: 174408 - DNA, 25 bp, Homo sapien
cccttgaggccggtagccttgcagg

SEQ ID NO: 174409 - DNA, 25 bp, Homo sapien
tgcgccactcgctcttcaagaaggg

SEQ ID NO: 174410 - DNA, 25 bp, Homo sapien
gcgtgggccagaccagcaccaagca

SEQ ID NO: 174411 - DNA, 25 bp, Homo sapien
cccacgtacaacgaggagttttgcg

SEQ ID NO: 174412 - DNA, 25 bp, Homo sapien
gagttttgcgctaacgtcaccgacg

SEQ ID NO: 174413 - DNA, 25 bp, Homo sapien
caatggctatttgagggtccgcatc

SEQ ID NO: 174414 - DNA, 25 bp, Homo sapien
ccggcatgtcgtctggcaccatgaa

SEQ ID NO: 174415 - DNA, 25 bp, Homo sapien
gcggcagctgcttcctggtttgaag

SEQ ID NO: 174416 - DNA, 25 bp, Homo sapien
ttctgtgaacttggaacctggcggt

SEQ ID NO: 174417 - DNA, 25 bp, Homo sapien
cgccattggatctcgaggaacccgc

SEQ ID NO: 174418 - DNA, 25 bp, Homo sapien
cagtgcacagtgctgcctcgtctga

SEQ ID NO: 174419 - DNA, 25 bp, Homo sapien
tctagtctcacgaggggtttcccgc

SEQ ID NO: 174420 - DNA, 25 bp, Homo sapien
agacatcgcggggaccgattcacca

SEQ ID NO: 174421 - DNA, 25 bp, Homo sapien
gcggcgcgaacgacaagaaaaagta

SEQ ID NO: 174422 - DNA, 25 bp, Homo sapien
gggagacgcctcgaaagtgctttca

SEQ ID NO: 174423 - DNA, 25 bp, Homo sapien
cccgggaagagaaatgagctgcagc

SEQ ID NO: 174424 - DNA, 25 bp, Homo sapien
tccattgaaaactcggccctggggc

SEQ ID NO: 174425 - DNA, 25 bp, Homo sapien
ccgcgcaaggcgactttcgtgtacg

SEQ ID NO: 174426 - DNA, 25 bp, Homo sapien
ctcagtacgtgctcgggcgcagcac

SEQ ID NO: 174427 - DNA, 25 bp, Homo sapien
ggcaggccacgcctcagtacgtgct

SEQ ID NO: 174428 - DNA, 25 bp, Homo sapien
cgctacatgatgaggatgcgaaacc

SEQ ID NO: 174429 - DNA, 25 bp, Homo sapien
acccttctgttcctggtgtggctgg

SEQ ID NO: 174430 - DNA, 25 bp, Homo sapien
ccaagcatgcggaaggtacccggca

SEQ ID NO: 174431 - DNA, 25 bp, Homo sapien
cccgcggggagaataccaagcatgc

SEQ ID NO: 174432 - DNA, 25 bp, Homo sapien
aaggcgactttcgtgtacgctgtgg

SEQ ID NO: 174433 - DNA, 25 bp, Homo sapien
agcacacgaccggtggcaagagccc

SEQ ID NO: 174434 - DNA, 25 bp, Homo sapien
ttcacgcacgcgcagtaagcacacg

SEQ ID NO: 174435 - DNA, 25 bp, Homo sapien
ggacagtgtacgcttcgaggacttc

SEQ ID NO: 174436 - DNA, 25 bp, Homo sapien
ccgcttccaggagacggacagtgta

SEQ ID NO: 174437 - DNA, 25 bp, Homo sapien
tgcagaccgactgcgaggcgctgct

SEQ ID NO: 174438 - DNA, 25 bp, Homo sapien
agagcccggataaaggcggagctaa

SEQ ID NO: 174439 - DNA, 25 bp, Homo sapien
cggataatgcatcacggagcgcgtg

SEQ ID NO: 174440 - DNA, 25 bp, Homo sapien
gaccaccgctggctagtccgttaga

SEQ ID NO: 174441 - DNA, 25 bp, Homo sapien
agttgcggcgagcatcctctttggg

SEQ ID NO: 174442 - DNA, 25 bp, Homo sapien
ccaagttgcggcgagcatcctcttt

SEQ ID NO: 174443 - DNA, 25 bp, Homo sapien
tgtttccaagttgcggcgagcatcc

SEQ ID NO: 174444 - DNA, 25 bp, Homo sapien
agcgtgtttccaagttgcggcgagc

SEQ ID NO: 174445 - DNA, 25 bp, Homo sapien
gatatagcgggaacgttgtaggaaa

SEQ ID NO: 174446 - DNA, 25 bp, Homo sapien
tgactcgaaaacaaggatatagcgg

SEQ ID NO: 174447 - DNA, 25 bp, Homo sapien
gtgagaagctcgaggtagggatgaa

SEQ ID NO: 174448 - DNA, 25 bp, Homo sapien
gaatggaaaaggtgactcgaaaaca

SEQ ID NO: 174449 - DNA, 25 bp, Homo sapien
ttcaaggttcgcctcgagttctggg

SEQ ID NO: 174450 - DNA, 25 bp, Homo sapien
agccagccttcagcgagccgggcaa

SEQ ID NO: 174451 - DNA, 25 bp, Homo sapien
agccgggcaaacgaaggcactgcgc

SEQ ID NO: 174452 - DNA, 25 bp, Homo sapien
ccacgggctgtattcgcagcgggca

SEQ ID NO: 174453 - DNA, 25 bp, Homo sapien
ttttggcgctgtgagttcaaggttc

SEQ ID NO: 174454 - DNA, 25 bp, Homo sapien
tcgggtttgtgcgtctgccttttgg

SEQ ID NO: 174455 - DNA, 25 bp, Homo sapien
tgcccggtggcccacgggctgtatt

SEQ ID NO: 174456 - DNA, 25 bp, Homo sapien
aaggcactgcgcgtttttggcgctg

SEQ ID NO: 174457 - DNA, 25 bp, Homo sapien
tgagtgcggtactctcaggcccttt

SEQ ID NO: 174458 - DNA, 25 bp, Homo sapien
ccagaacgactggtttcggtgttgc

SEQ ID NO: 174459 - DNA, 25 bp, Homo sapien
gcggaaggccgctgtgttccaagat

SEQ ID NO: 174460 - DNA, 25 bp, Homo sapien
cggcctcaatttggcggtggaatga

SEQ ID NO: 174461 - DNA, 25 bp, Homo sapien
tcaggcccttttatgccggtcccta

SEQ ID NO: 174462 - DNA, 25 bp, Homo sapien
gcctggagggctaaatcacagtcta

SEQ ID NO: 174463 - DNA, 25 bp, Homo sapien
atggcgggatgctccgtgtcttaac

SEQ ID NO: 174464 - DNA, 25 bp, Homo sapien
ttaatgacgcatgtggctggccggt

SEQ ID NO: 174465 - DNA, 25 bp, Homo sapien
cactgcggagtgctggaggtccttg

SEQ ID NO: 174466 - DNA, 25 bp, Homo sapien
gcactgcggagtgctggaggtcctt

SEQ ID NO: 174467 - DNA, 25 bp, Homo sapien
ctgcggagtgctggaggtccttgag

SEQ ID NO: 174468 - DNA, 25 bp, Homo sapien
actgcggagtgctggaggtccttga

SEQ ID NO: 174469 - DNA, 25 bp, Homo sapien
tgcggagtgctggaggtccttgagc

SEQ ID NO: 174470 - DNA, 25 bp, Homo sapien
gctctgctcggctcaccaaaacatt

SEQ ID NO: 174471 - DNA, 25 bp, Homo sapien
ccgctataaatagagggcgatcgcg

SEQ ID NO: 174472 - DNA, 25 bp, Homo sapien
ctgctccgggagaagttggacaaca

SEQ ID NO: 174473 - DNA, 25 bp, Homo sapien
tggtacctctcctctctttgctgcg

SEQ ID NO: 174474 - DNA, 25 bp, Homo sapien
cgcccgaacacagagaactagatta

SEQ ID NO: 174475 - DNA, 25 bp, Homo sapien
ccacgacctggatctgcaattgcac

SEQ ID NO: 174476 - DNA, 25 bp, Homo sapien
ctcagcctttgtgcgcagcaaccga

SEQ ID NO: 174477 - DNA, 25 bp, Homo sapien
cccagactcagtggtgggaaccggt

SEQ ID NO: 174478 - DNA, 25 bp, Homo sapien
gagcccagttctgcctgctttttat

SEQ ID NO: 174479 - DNA, 25 bp, Homo sapien
actcactcaaatgccaatctccttt

SEQ ID NO: 174480 - DNA, 25 bp, Homo sapien
cagttcactcactcaaatgccaatc

SEQ ID NO: 174481 - DNA, 25 bp, Homo sapien
tttcccagttcactcactcaaatgc

SEQ ID NO: 174482 - DNA, 25 bp, Homo sapien
gaaagctgattagatggttcccacc

SEQ ID NO: 174483 - DNA, 25 bp, Homo sapien
tttattctggccatggtgaaagctg

SEQ ID NO: 174484 - DNA, 25 bp, Homo sapien
gttcactcactcaaatgccaatctc

SEQ ID NO: 174485 - DNA, 25 bp, Homo sapien
tggtgaaagctgattagatggttcc

SEQ ID NO: 174486 - DNA, 25 bp, Homo sapien
ttcaggctccttgaattttctactc

SEQ ID NO: 174487 - DNA, 25 bp, Homo sapien
tgaattttctactctgtgcacctga

SEQ ID NO: 174488 - DNA, 25 bp, Homo sapien
tgtgcacctgaacacacttttgttc

SEQ ID NO: 174489 - DNA, 25 bp, Homo sapien
cttttgttctcttgcaagcagttgc

SEQ ID NO: 174490 - DNA, 25 bp, Homo sapien
caagcagttgctttgcactggaggc

SEQ ID NO: 174491 - DNA, 25 bp, Homo sapien
tgctttgcactggaggcaatgaaga

SEQ ID NO: 174492 - DNA, 25 bp, Homo sapien
gcaatgaagacacggcggagtccca

SEQ ID NO: 174493 - DNA, 25 bp, Homo sapien
cgtgttccgaaacgtgagccgcgct

SEQ ID NO: 174494 - DNA, 25 bp, Homo sapien
aatccgcgtgcgagtaacctgctcc

SEQ ID NO: 174495 - DNA, 25 bp, Homo sapien
gctgggccgttactcctcaataaca

SEQ ID NO: 174496 - DNA, 25 bp, Homo sapien
ccggcggatcagcaattgcagaagc

SEQ ID NO: 174497 - DNA, 25 bp, Homo sapien
cgcgcagtccatctctctcaggtta

SEQ ID NO: 174498 - DNA, 25 bp, Homo sapien
tcaggttagtgaaatgaggctctcc

SEQ ID NO: 174499 - DNA, 25 bp, Homo sapien
cccaaggacgctcacgtgcagttca

SEQ ID NO: 174500 - DNA, 25 bp, Homo sapien
cacctcgcttggtacgtgggaaaat

SEQ ID NO: 174501 - DNA, 25 bp, Homo sapien
gcctccttccatggtatcgcagcaa

SEQ ID NO: 174502 - DNA, 25 bp, Homo sapien
cgcgcttctacctaacaggtgcatg

SEQ ID NO: 174503 - DNA, 25 bp, Homo sapien
agtgacagccgcaaaagcaggagtg

SEQ ID NO: 174504 - DNA, 25 bp, Homo sapien
gccggcgcactcgacctacaggaaa

SEQ ID NO: 174505 - DNA, 25 bp, Homo sapien
ctacaggaaagttgctcccgagctg

SEQ ID NO: 174506 - DNA, 25 bp, Homo sapien
gcaaccgggtaacatctgctccctg

SEQ ID NO: 174507 - DNA, 25 bp, Homo sapien
ctccctgtggtccaatgcgagctga

SEQ ID NO: 174508 - DNA, 25 bp, Homo sapien
gacaccgagccaaggcctgcagcga

SEQ ID NO: 174509 - DNA, 25 bp, Homo sapien
agcgcccgactgaagagtgacagcc

SEQ ID NO: 174510 - DNA, 25 bp, Homo sapien
gctgaacagcgtagcccaacttctg

SEQ ID NO: 174511 - DNA, 25 bp, Homo sapien
aggcagttcatggtagtagcgctcc

SEQ ID NO: 174512 - DNA, 25 bp, Homo sapien
gagccctgaagtccgagcgcacagc

SEQ ID NO: 174513 - DNA, 25 bp, Homo sapien
tcggaggctcacatctcggcgtctc

SEQ ID NO: 174514 - DNA, 25 bp, Homo sapien
aagcgatcgctgtccaatcgggccg

SEQ ID NO: 174515 - DNA, 25 bp, Homo sapien
tgcccagactgtggcggtgccgcac

SEQ ID NO: 174516 - DNA, 25 bp, Homo sapien
ggacgcagagcagccacctgacgct

SEQ ID NO: 174517 - DNA, 25 bp, Homo sapien
cccggagatcgaggcaagcgatcgc

SEQ ID NO: 174518 - DNA, 25 bp, Homo sapien
ttggaccggaggattccaagggctc

SEQ ID NO: 174519 - DNA, 25 bp, Homo sapien
cgcccactggagacttcaaacggga

SEQ ID NO: 174520 - DNA, 25 bp, Homo sapien
ggcctcattggccagtatccgcctt

SEQ ID NO: 174521 - DNA, 25 bp, Homo sapien
agtccatggcacacgcgcaaccgaa

SEQ ID NO: 174522 - DNA, 25 bp, Homo sapien
agcatgttcggctgagacctgatca

SEQ ID NO: 174523 - DNA, 25 bp, Homo sapien
ggtggctcctcgctcacattcctgg

SEQ ID NO: 174524 - DNA, 25 bp, Homo sapien
ccgaagcttgaggaacccggatgca

SEQ ID NO: 174525 - DNA, 25 bp, Homo sapien
tttaattccgggaggtgtgcgacta

SEQ ID NO: 174526 - DNA, 25 bp, Homo sapien
gcagctgggccagtactgactgcgc

SEQ ID NO: 174527 - DNA, 25 bp, Homo sapien
tgggccagtactgactgcgcgctgc

SEQ ID NO: 174528 - DNA, 25 bp, Homo sapien
gccaggcgtttccagcccacattgc

SEQ ID NO: 174529 - DNA, 25 bp, Homo sapien
gcccacattgctcctacctcgccag

SEQ ID NO: 174530 - DNA, 25 bp, Homo sapien
agagcgcaccttcctgcccgaaagc

SEQ ID NO: 174531 - DNA, 25 bp, Homo sapien
gcgcagctgggccagtactgactgc

SEQ ID NO: 174532 - DNA, 25 bp, Homo sapien
ttcctgcccgaaagccgtgcgcacc

SEQ ID NO: 174533 - DNA, 25 bp, Homo sapien
tacctcgccagagcgcaccttcctg

SEQ ID NO: 174534 - DNA, 25 bp, Homo sapien
cgtacgctgcgttagcggaagttta

SEQ ID NO: 174535 - DNA, 25 bp, Homo sapien
ggatgcatccgctggtactgattta

SEQ ID NO: 174536 - DNA, 25 bp, Homo sapien
tccgattggacgaaagcagaacgcc

SEQ ID NO: 174537 - DNA, 25 bp, Homo sapien
gcccggggaattcttgctagcttcc

SEQ ID NO: 174538 - DNA, 25 bp, Homo sapien
cgcctcgacctctctgattgggtaa

SEQ ID NO: 174539 - DNA, 25 bp, Homo sapien
gcctggcccagcaaaatgtacctta

SEQ ID NO: 174540 - DNA, 25 bp, Homo sapien
ccgcgatagctgtccagcaactcta

SEQ ID NO: 174541 - DNA, 25 bp, Homo sapien
tcagcatttagacgttccgagtttc

SEQ ID NO: 174542 - DNA, 25 bp, Homo sapien
ttgaggtcccgggtaatatccacca

SEQ ID NO: 174543 - DNA, 25 bp, Homo sapien
ccgaagcagaacaggcagtagagcg

SEQ ID NO: 174544 - DNA, 25 bp, Homo sapien
tgcccagctccgtgccgaagcagaa

SEQ ID NO: 174545 - DNA, 25 bp, Homo sapien
agtagagcggccagttgctcacgcg

SEQ ID NO: 174546 - DNA, 25 bp, Homo sapien
agccgctggaaacgggccactttct

SEQ ID NO: 174547 - DNA, 25 bp, Homo sapien
gctgcctcagcgacatgataacgga

SEQ ID NO: 174548 - DNA, 25 bp, Homo sapien
gtaatatccaccagcaggcgtcgcg

SEQ ID NO: 174549 - DNA, 25 bp, Homo sapien
cactttctgcgggtcctgcagacgg

SEQ ID NO: 174550 - DNA, 25 bp, Homo sapien
ggggccgctgattgttttcattcct

SEQ ID NO: 174551 - DNA, 25 bp, Homo sapien
gttttcattcctcgcgtcacgcctg

SEQ ID NO: 174552 - DNA, 25 bp, Homo sapien
cgtttgtctctctgggttctttgtg

SEQ ID NO: 174553 - DNA, 25 bp, Homo sapien
gagccgggccacaggaaactttgct

SEQ ID NO: 174554 - DNA, 25 bp, Homo sapien
agcaaaaggcgcgatccagagagcc

SEQ ID NO: 174555 - DNA, 25 bp, Homo sapien
ttcggccggacctgaaaaagcgaga

SEQ ID NO: 174556 - DNA, 25 bp, Homo sapien
ctttccgagcgccaaggagcggagc

SEQ ID NO: 174557 - DNA, 25 bp, Homo sapien
gaaagattttgaacgccgcgtgagc

SEQ ID NO: 174558 - DNA, 25 bp, Homo sapien
tgctcttcgccctgcaagtttcaag

SEQ ID NO: 174559 - DNA, 25 bp, Homo sapien
gcagttatttctcgcagcctccgcg

SEQ ID NO: 174560 - DNA, 25 bp, Homo sapien
cagggagcccgacggtctcaggaac

SEQ ID NO: 174561 - DNA, 25 bp, Homo sapien
gagtagtgcctgagcccacgtgacc

SEQ ID NO: 174562 - DNA, 25 bp, Homo sapien
tgggtgtccaaaaagccagcagctg

SEQ ID NO: 174563 - DNA, 25 bp, Homo sapien
gcaagtttcaagaggcagttatttc

SEQ ID NO: 174564 - DNA, 25 bp, Homo sapien
gtgacctctaagtgggagcaccctc

SEQ ID NO: 174565 - DNA, 25 bp, Homo sapien
tcacaagcgacttaacgataagccc

SEQ ID NO: 174566 - DNA, 25 bp, Homo sapien
gggacccgcccattactgcctggaa

SEQ ID NO: 174567 - DNA, 25 bp, Homo sapien
gtgacaaagtcggaaggcgcgccaa

SEQ ID NO: 174568 - DNA, 25 bp, Homo sapien
ggctcctctccctgattggctcgaa

SEQ ID NO: 174569 - DNA, 25 bp, Homo sapien
ttcaggcgggtttctagccacatgc

SEQ ID NO: 174570 - DNA, 25 bp, Homo sapien
atgcaaaggtgctttctggcccggc

SEQ ID NO: 174571 - DNA, 25 bp, Homo sapien
agcaactccctacgttgaagtcgtc

SEQ ID NO: 174572 - DNA, 25 bp, Homo sapien
tcgcgcgcgcttccatattcagagg

SEQ ID NO: 174573 - DNA, 25 bp, Homo sapien
ggcctcccgagctgttgtaagcacc

SEQ ID NO: 174574 - DNA, 25 bp, Homo sapien
aggctccggcctccgaggaactgca

SEQ ID NO: 174575 - DNA, 25 bp, Homo sapien
ttccgtccaccctttagaagagctc

SEQ ID NO: 174576 - DNA, 25 bp, Homo sapien
ccctttagaagagctcacggagctg

SEQ ID NO: 174577 - DNA, 25 bp, Homo sapien
ttcccggtgcctgctcagaggccag

SEQ ID NO: 174578 - DNA, 25 bp, Homo sapien
cagctgcaggggcacacgcgttcac

SEQ ID NO: 174579 - DNA, 25 bp, Homo sapien
aggcgaggccagacgttttctcatc

SEQ ID NO: 174580 - DNA, 25 bp, Homo sapien
ccaacaactgcccagaggctccggc

SEQ ID NO: 174581 - DNA, 25 bp, Homo sapien
aggccagacgttttctcatcatcgc

SEQ ID NO: 174582 - DNA, 25 bp, Homo sapien
atttcccggcctagtgtcacagcgg

SEQ ID NO: 174583 - DNA, 25 bp, Homo sapien
tttcccggcctagtgtcacagcggc

SEQ ID NO: 174584 - DNA, 25 bp, Homo sapien
tcccggcctagtgtcacagcggcgt

SEQ ID NO: 174585 - DNA, 25 bp, Homo sapien
ccggcctagtgtcacagcggcgtct

SEQ ID NO: 174586 - DNA, 25 bp, Homo sapien
gggagttctgaacccctaagcgcga

SEQ ID NO: 174587 - DNA, 25 bp, Homo sapien
ttctgaacccctaagcgcgagtcgg

SEQ ID NO: 174588 - DNA, 25 bp, Homo sapien
gcatttcccggcctagtgtcacagc

SEQ ID NO: 174589 - DNA, 25 bp, Homo sapien
catttcccggcctagtgtcacagcg

SEQ ID NO: 174590 - DNA, 25 bp, Homo sapien
cgaagaccgcgtgagttctccaacc

SEQ ID NO: 174591 - DNA, 25 bp, Homo sapien
cgggctaagcttcacctacggctga

SEQ ID NO: 174592 - DNA, 25 bp, Homo sapien
tgtgacaaagtatgagggcgcgcca

SEQ ID NO: 174593 - DNA, 25 bp, Homo sapien
tcgggtccttccgaactgcgcatgc

SEQ ID NO: 174594 - DNA, 25 bp, Homo sapien
ctccctgattggctggaattacggc

SEQ ID NO: 174595 - DNA, 25 bp, Homo sapien
ccgccgaatacaaaggcgcactgtg

SEQ ID NO: 174596 - DNA, 25 bp, Homo sapien
gcgcactgtgaactggctctttctt

SEQ ID NO: 174597 - DNA, 25 bp, Homo sapien
cgacctgttagctctcggttagtta

SEQ ID NO: 174598 - DNA, 25 bp, Homo sapien
ggacctcactatttagcgtctcaga

SEQ ID NO: 174599 - DNA, 25 bp, Homo sapien
aaccttccggctggctctcttgcgg

SEQ ID NO: 174600 - DNA, 25 bp, Homo sapien
ccacctcgggagcagtgttggccaa

SEQ ID NO: 174601 - DNA, 25 bp, Homo sapien
cgacgccctacgtaagtaaaggcag

SEQ ID NO: 174602 - DNA, 25 bp, Homo sapien
aggtgcccactggatacggggtatc

SEQ ID NO: 174603 - DNA, 25 bp, Homo sapien
cctctgaggtgctgggagtaagaac

SEQ ID NO: 174604 - DNA, 25 bp, Homo sapien
tcgcttgtccgctggaatccgcggc

SEQ ID NO: 174605 - DNA, 25 bp, Homo sapien
cgtctcagaaaacgcggggttcatt

SEQ ID NO: 174606 - DNA, 25 bp, Homo sapien
agtgggaaagcagcctcgcatcctg

SEQ ID NO: 174607 - DNA, 25 bp, Homo sapien
ccgccgccacagttcgcagttgtga

SEQ ID NO: 174608 - DNA, 25 bp, Homo sapien
agcggaagtcctttgttgcagcaca

SEQ ID NO: 174609 - DNA, 25 bp, Homo sapien
ttgtgactctgtaggcggaagcata

SEQ ID NO: 174610 - DNA, 25 bp, Homo sapien
ttgttgcaacaaacaggcgaccgcg

SEQ ID NO: 174611 - DNA, 25 bp, Homo sapien
cctcggagctcgacgcagaaacttg

SEQ ID NO: 174612 - DNA, 25 bp, Homo sapien
gaggaggtcccaagcctacccttga

SEQ ID NO: 174613 - DNA, 25 bp, Homo sapien
ggagcccagttccatccagctgtgc

SEQ ID NO: 174614 - DNA, 25 bp, Homo sapien
tcgctcgcctttcagtcaggatgtc

SEQ ID NO: 174615 - DNA, 25 bp, Homo sapien
cccgcttcgaggagctcaatgccga

SEQ ID NO: 174616 - DNA, 25 bp, Homo sapien
gcggcgagaagaacgtgctcatctt

SEQ ID NO: 174617 - DNA, 25 bp, Homo sapien
cgcaggcaccatcacggggctcaat

SEQ ID NO: 174618 - DNA, 25 bp, Homo sapien
ccacagtgcagtcggatatgaaaca

SEQ ID NO: 174619 - DNA, 25 bp, Homo sapien
cggaaattcgaggatgccacagtgc

SEQ ID NO: 174620 - DNA, 25 bp, Homo sapien
tcggggtcttccaacatggcaaggt

SEQ ID NO: 174621 - DNA, 25 bp, Homo sapien
atcttcgacgccaagaggctgattg

SEQ ID NO: 174622 - DNA, 25 bp, Homo sapien
gcttccagggcgaggccatgtaccg

SEQ ID NO: 174623 - DNA, 25 bp, Homo sapien
ttacttgatggatgtaagtgcagcc

SEQ ID NO: 174624 - DNA, 25 bp, Homo sapien
cccgagttttatgcgaggaggaagc

SEQ ID NO: 174625 - DNA, 25 bp, Homo sapien
taccgggtgcccgagttttatgcga

SEQ ID NO: 174626 - DNA, 25 bp, Homo sapien
cgtcgccacggcttttaagactggg

SEQ ID NO: 174627 - DNA, 25 bp, Homo sapien
ctttagaaatcgctggagaagcctg

SEQ ID NO: 174628 - DNA, 25 bp, Homo sapien
ctcggcgacgccgtatggcttccag

SEQ ID NO: 174629 - DNA, 25 bp, Homo sapien
caccaggctgggctttagaaatcgc

SEQ ID NO: 174630 - DNA, 25 bp, Homo sapien
ttaagcattttttacatacatgtat

SEQ ID NO: 174631 - DNA, 25 bp, Homo sapien
cattttgtaagtcgacaaaagttat

SEQ ID NO: 174632 - DNA, 25 bp, Homo sapien
cggccattttgtaagtcgacaaaag

SEQ ID NO: 174633 - DNA, 25 bp, Homo sapien
gcggccattttgtaagtcgacaaaa

SEQ ID NO: 174634 - DNA, 25 bp, Homo sapien
caaacaccatgtccccagggggctc

SEQ ID NO: 174635 - DNA, 25 bp, Homo sapien
tcaaacaccatgtccccagggggct

SEQ ID NO: 174636 - DNA, 25 bp, Homo sapien
ggcgaaacctggcgcgaggcggcgc

SEQ ID NO: 174637 - DNA, 25 bp, Homo sapien
taagcattttttacatacatgtatt

SEQ ID NO: 174638 - DNA, 25 bp, Homo sapien
gatcccaattcctatctgtcagttc

SEQ ID NO: 174639 - DNA, 25 bp, Homo sapien
ggctctattcttcaagacttcctca

SEQ ID NO: 174640 - DNA, 25 bp, Homo sapien
ttatggctctattcttcaagacttc

SEQ ID NO: 174641 - DNA, 25 bp, Homo sapien
ttctgcgctttgctttctttatggc

SEQ ID NO: 174642 - DNA, 25 bp, Homo sapien
gcgctttgctttctttatggctcta

SEQ ID NO: 174643 - DNA, 25 bp, Homo sapien
tgctttctttatggctctattcttc

SEQ ID NO: 174644 - DNA, 25 bp, Homo sapien
tcctatctgtcagttccttctcggc

SEQ ID NO: 174645 - DNA, 25 bp, Homo sapien
agcttcatcttcttgatcccaattc

SEQ ID NO: 174646 - DNA, 25 bp, Homo sapien
tccagagaggctcagtttgaaatcc

SEQ ID NO: 174647 - DNA, 25 bp, Homo sapien
tcgctgttgggaatctcggctacct

SEQ ID NO: 174648 - DNA, 25 bp, Homo sapien
cctggaactgtgttggctgcttccc

SEQ ID NO: 174649 - DNA, 25 bp, Homo sapien
atctccctgcattaggctgagcggc

SEQ ID NO: 174650 - DNA, 25 bp, Homo sapien
ccttcagagagcgactttcaaactc

SEQ ID NO: 174651 - DNA, 25 bp, Homo sapien
cgcagagccgccaattgctggactg

SEQ ID NO: 174652 - DNA, 25 bp, Homo sapien
cagtttgaaatccaggaagcccgcg

SEQ ID NO: 174653 - DNA, 25 bp, Homo sapien
gccaattgctggactgcagccgcga

SEQ ID NO: 174654 - DNA, 25 bp, Homo sapien
tcccgcgatgaggcacgccgagcag

SEQ ID NO: 174655 - DNA, 25 bp, Homo sapien
atggtagagccacctctgtcgggca

SEQ ID NO: 174656 - DNA, 25 bp, Homo sapien
tgccggagaacatggtagagccacc

SEQ ID NO: 174657 - DNA, 25 bp, Homo sapien
acccgtcaacaggagccactcggtg

SEQ ID NO: 174658 - DNA, 25 bp, Homo sapien
tgctccaagtatgcctcccgcgatg

SEQ ID NO: 174659 - DNA, 25 bp, Homo sapien
cgacgtccgtgagctctgctccaag

SEQ ID NO: 174660 - DNA, 25 bp, Homo sapien
ttcagctggcccgacgtccgtgagc

SEQ ID NO: 174661 - DNA, 25 bp, Homo sapien
ggagccactcggtgccggagaacat

SEQ ID NO: 174662 - DNA, 25 bp, Homo sapien
gcgaaggcagcttttgcagtgcagc

SEQ ID NO: 174663 - DNA, 25 bp, Homo sapien
ttctttttggggaagaagctgaatc

SEQ ID NO: 174664 - DNA, 25 bp, Homo sapien
atctcttctccttgtctttcttgcc

SEQ ID NO: 174665 - DNA, 25 bp, Homo sapien
ccttgtctttcttgccgaggctggc

SEQ ID NO: 174666 - DNA, 25 bp, Homo sapien
caggctctgcgccttgacgcggatg

SEQ ID NO: 174667 - DNA, 25 bp, Homo sapien
caggacagcatctcctcctgcgggg

SEQ ID NO: 174668 - DNA, 25 bp, Homo sapien
cgcgactcgactcatctcgattcga

SEQ ID NO: 174669 - DNA, 25 bp, Homo sapien
ctcatctcgattcgaccggcgggcg

SEQ ID NO: 174670 - DNA, 25 bp, Homo sapien
ccgtccttccactcggcgatggtgg

SEQ ID NO: 174671 - DNA, 25 bp, Homo sapien
ttctcgtcgatgaggcccaggatct

SEQ ID NO: 174672 - DNA, 25 bp, Homo sapien
aaggactcggccgtgctggcgtcca

SEQ ID NO: 174673 - DNA, 25 bp, Homo sapien
tctcggcacccgtgtagaagtagcg

SEQ ID NO: 174674 - DNA, 25 bp, Homo sapien
tgagctccaggaggtctgcccacat

SEQ ID NO: 174675 - DNA, 25 bp, Homo sapien
ccgcgtcgatgagtcgctcgatgaa

SEQ ID NO: 174676 - DNA, 25 bp, Homo sapien
tgaaggcattcacattgtccacccg

SEQ ID NO: 174677 - DNA, 25 bp, Homo sapien
ctgcatgcgcgtgtcaatgagctcc

SEQ ID NO: 174678 - DNA, 25 bp, Homo sapien
ctcagcactgacacggaggccacgg

SEQ ID NO: 174679 - DNA, 25 bp, Homo sapien
actcagcactgacacggaggccacg

SEQ ID NO: 174680 - DNA, 25 bp, Homo sapien
cccacgaagagtgggacggacactc

SEQ ID NO: 174681 - DNA, 25 bp, Homo sapien
tcagcactgacacggaggccacggc

SEQ ID NO: 174682 - DNA, 25 bp, Homo sapien
aagagtgggacggacactcagcact

SEQ ID NO: 174683 - DNA, 25 bp, Homo sapien
agagtgggacggacactcagcactg

SEQ ID NO: 174684 - DNA, 25 bp, Homo sapien
tgggacggacactcagcactgacac

SEQ ID NO: 174685 - DNA, 25 bp, Homo sapien
gtgggacggacactcagcactgaca

SEQ ID NO: 174686 - DNA, 25 bp, Homo sapien
ggcggcccaagggaattcacgcacg

SEQ ID NO: 174687 - DNA, 25 bp, Homo sapien
ccggcgccgagccatggtgagtcca

SEQ ID NO: 174688 - DNA, 25 bp, Homo sapien
ccatggtgagtccagcgtcgcagcc

SEQ ID NO: 174689 - DNA, 25 bp, Homo sapien
tgtcccttagccagacccggcgaga

SEQ ID NO: 174690 - DNA, 25 bp, Homo sapien
ggagctgtcccttagccagacccgg

SEQ ID NO: 174691 - DNA, 25 bp, Homo sapien
acgcccggggaacggcagagatctc

SEQ ID NO: 174692 - DNA, 25 bp, Homo sapien
aggctaaactgatcccgcggggagc

SEQ ID NO: 174693 - DNA, 25 bp, Homo sapien
gcatcccttgccgaggctaaactga

SEQ ID NO: 174694 - DNA, 25 bp, Homo sapien
gggcgcctccatcgtcgttcattgc

SEQ ID NO: 174695 - DNA, 25 bp, Homo sapien
ctggtgcattagaaagcgcgctccc

SEQ ID NO: 174696 - DNA, 25 bp, Homo sapien
gggatcccgctctccaaagctagca

SEQ ID NO: 174697 - DNA, 25 bp, Homo sapien
cccgggatgatctttgccgcagctg

SEQ ID NO: 174698 - DNA, 25 bp, Homo sapien
taacattatctgaggagggacattc

SEQ ID NO: 174699 - DNA, 25 bp, Homo sapien
ttggactctagctcgggcctaattc

SEQ ID NO: 174700 - DNA, 25 bp, Homo sapien
cctggtggcgaaaatgagccctcca

SEQ ID NO: 174701 - DNA, 25 bp, Homo sapien
cccactgcacacagttcagttttta

SEQ ID NO: 174702 - DNA, 25 bp, Homo sapien
ccgaggtgtctcatatccaaggctg

SEQ ID NO: 174703 - DNA, 25 bp, Homo sapien
ttggaggacattccctgttgactgc

SEQ ID NO: 174704 - DNA, 25 bp, Homo sapien
cttcccggaagcgttggaggacatt

SEQ ID NO: 174705 - DNA, 25 bp, Homo sapien
ggcaaccgtatctcagttctcgcga

SEQ ID NO: 174706 - DNA, 25 bp, Homo sapien
ccaggagtcgagtacttgggcgcat

SEQ ID NO: 174707 - DNA, 25 bp, Homo sapien
tcccgagacggaatacccaggagtc

SEQ ID NO: 174708 - DNA, 25 bp, Homo sapien
gagacttcggctcggttcccgagac

SEQ ID NO: 174709 - DNA, 25 bp, Homo sapien
gaaggaatatcccaaccgggtgagc

SEQ ID NO: 174710 - DNA, 25 bp, Homo sapien
ggacaccctcacctgccaaaaccta

SEQ ID NO: 174711 - DNA, 25 bp, Homo sapien
cgtttttccgcggacgctccgaatg

SEQ ID NO: 174712 - DNA, 25 bp, Homo sapien
ccactcgctcgctgggtgccgggaa

SEQ ID NO: 174713 - DNA, 25 bp, Homo sapien
agcacatcgtactgcttcgccatga

SEQ ID NO: 174714 - DNA, 25 bp, Homo sapien
tactgcttcgccatgactggggcca

SEQ ID NO: 174715 - DNA, 25 bp, Homo sapien
gcagcagccggaacagcacatcgta

SEQ ID NO: 174716 - DNA, 25 bp, Homo sapien
ccaagtctggcgccggtaattccgc

SEQ ID NO: 174717 - DNA, 25 bp, Homo sapien
agccggaggggctggcaattcctcc

SEQ ID NO: 174718 - DNA, 25 bp, Homo sapien
ctcgagtttcaatgcgcgttgttgc

SEQ ID NO: 174719 - DNA, 25 bp, Homo sapien
tttttgcctctatccgctcgccgta

SEQ ID NO: 174720 - DNA, 25 bp, Homo sapien
gtcctacgccatctcgctgaaatga

SEQ ID NO: 174721 - DNA, 25 bp, Homo sapien
cgggaggagacattcgcgttcaaaa

SEQ ID NO: 174722 - DNA, 25 bp, Homo sapien
ggcggcagcatctcagtaactcact

SEQ ID NO: 174723 - DNA, 25 bp, Homo sapien
cgcttcaggactctacgctcttgca

SEQ ID NO: 174724 - DNA, 25 bp, Homo sapien
cggatgtagacacccttgcgcttca

SEQ ID NO: 174725 - DNA, 25 bp, Homo sapien
gctctcctgatcatggcttctccga

SEQ ID NO: 174726 - DNA, 25 bp, Homo sapien
tatcgctcatttcctacggcccagg

SEQ ID NO: 174727 - DNA, 25 bp, Homo sapien
cctctctttggtgtgactggttata

SEQ ID NO: 174728 - DNA, 25 bp, Homo sapien
gtagccggctgtctaaataatgctg

SEQ ID NO: 174729 - DNA, 25 bp, Homo sapien
accgcgagttgtcaggagattttcc

SEQ ID NO: 174730 - DNA, 25 bp, Homo sapien
agcccggcttgttgacggagcccaa

SEQ ID NO: 174731 - DNA, 25 bp, Homo sapien
ggggcagccgagacttgtagttctt

SEQ ID NO: 174732 - DNA, 25 bp, Homo sapien
gctctccacctcgatgtcatcgtta

SEQ ID NO: 174733 - DNA, 25 bp, Homo sapien
agttcttgtccctctaacagacggc

SEQ ID NO: 174734 - DNA, 25 bp, Homo sapien
gtggccttcgacctttcagttccca

SEQ ID NO: 174735 - DNA, 25 bp, Homo sapien
gatgtgctgcaccagattttctcca

SEQ ID NO: 174736 - DNA, 25 bp, Homo sapien
tcggcacagtgaagaccatcacatt

SEQ ID NO: 174737 - DNA, 25 bp, Homo sapien
cgagaacgcccagcataccaagctg

SEQ ID NO: 174738 - DNA, 25 bp, Homo sapien
tgtcgctggattggcagaacaccta

SEQ ID NO: 174739 - DNA, 25 bp, Homo sapien
acacgctgtgcatcgacttctccaa

SEQ ID NO: 174740 - DNA, 25 bp, Homo sapien
tggaccagacatggccgtggccttc

SEQ ID NO: 174741 - DNA, 25 bp, Homo sapien
tttcagttcccaacatccacggagc

SEQ ID NO: 174742 - DNA, 25 bp, Homo sapien
gaagcagcagtcaagcggccaaatg

SEQ ID NO: 174743 - DNA, 25 bp, Homo sapien
ccattgtaggatcgcgctggaagca

SEQ ID NO: 174744 - DNA, 25 bp, Homo sapien
gttcggtcgggagtagcatcctcca

SEQ ID NO: 174745 - DNA, 25 bp, Homo sapien
ctctgcctcagtcagtggcgccgaa

SEQ ID NO: 174746 - DNA, 25 bp, Homo sapien
gtggatgctgctgctacgctctcca

SEQ ID NO: 174747 - DNA, 25 bp, Homo sapien
acagcattctctggaggcgagtctc

SEQ ID NO: 174748 - DNA, 25 bp, Homo sapien
ggagccagcttcaaaacctctagtg

SEQ ID NO: 174749 - DNA, 25 bp, Homo sapien
ccctaaaagtagcaaggagccagct

SEQ ID NO: 174750 - DNA, 25 bp, Homo sapien
cctccgctagtgctcttcagagaga

SEQ ID NO: 174751 - DNA, 25 bp, Homo sapien
tccgcagtctgaagcatgccgctct

SEQ ID NO: 174752 - DNA, 25 bp, Homo sapien
ggggtgcattttacaaccgctgaga

SEQ ID NO: 174753 - DNA, 25 bp, Homo sapien
gcgaccgagggaatgatccttacta

SEQ ID NO: 174754 - DNA, 25 bp, Homo sapien
agtatctgtgcttgcctggacgaga

SEQ ID NO: 174755 - DNA, 25 bp, Homo sapien
gcttgcctccttcttgccggacttg

SEQ ID NO: 174756 - DNA, 25 bp, Homo sapien
agcgtgtgctatcctttcctctcag

SEQ ID NO: 174757 - DNA, 25 bp, Homo sapien
gctgctgtccctgcattgccttagg

SEQ ID NO: 174758 - DNA, 25 bp, Homo sapien
gtcgggagtttctggattctttatc

SEQ ID NO: 174759 - DNA, 25 bp, Homo sapien
cgaaggggctctaccgggccagcta

SEQ ID NO: 174760 - DNA, 25 bp, Homo sapien
gcccggagcagtccgcgttttagac

SEQ ID NO: 174761 - DNA, 25 bp, Homo sapien
tctcgcgcggtctagaagtggagtt

SEQ ID NO: 174762 - DNA, 25 bp, Homo sapien
gctgtcgcttctgcagtgcgtagga

SEQ ID NO: 174763 - DNA, 25 bp, Homo sapien
tgggctgtagagatcttaatcaaca

SEQ ID NO: 174764 - DNA, 25 bp, Homo sapien
gtgagcccaacctttgtccctcgga

SEQ ID NO: 174765 - DNA, 25 bp, Homo sapien
ttttagacttagaggcgcgcgactg

SEQ ID NO: 174766 - DNA, 25 bp, Homo sapien
cgtctttggtcacagcgccatctca

SEQ ID NO: 174767 - DNA, 25 bp, Homo sapien
aagaggggcctctattcgttcagcg

SEQ ID NO: 174768 - DNA, 25 bp, Homo sapien
gtcctatgtctttctcgcgccttga

SEQ ID NO: 174769 - DNA, 25 bp, Homo sapien
ggtgactaatcccaagctcggtttc

SEQ ID NO: 174770 - DNA, 25 bp, Homo sapien
tgcccgacattctgacgataacttt

SEQ ID NO: 174771 - DNA, 25 bp, Homo sapien
gcggcttatcccattcctttactta

SEQ ID NO: 174772 - DNA, 25 bp, Homo sapien
cctaaacctgtgaaagcggcttatc

SEQ ID NO: 174773 - DNA, 25 bp, Homo sapien
gttctcggaggacccagactctatg

SEQ ID NO: 174774 - DNA, 25 bp, Homo sapien
gcgcgctgacgcactgaatgtcccg

SEQ ID NO: 174775 - DNA, 25 bp, Homo sapien
agactctcgctcagccatgagctca

SEQ ID NO: 174776 - DNA, 25 bp, Homo sapien
gcctcgctgctcaagccctagctcc

SEQ ID NO: 174777 - DNA, 25 bp, Homo sapien
actccctgccttggagcagacggcc

SEQ ID NO: 174778 - DNA, 25 bp, Homo sapien
cacccacgcgcactgcgtccgcctg

SEQ ID NO: 174779 - DNA, 25 bp, Homo sapien
tgtctgctcgcccacacaccttggg

SEQ ID NO: 174780 - DNA, 25 bp, Homo sapien
tctgcgcgctgacgcactgaatgtc

SEQ ID NO: 174781 - DNA, 25 bp, Homo sapien
tttcctgtggctgagactctcgctc

SEQ ID NO: 174782 - DNA, 25 bp, Homo sapien
gatgggaaccagagcatgcccgttc

SEQ ID NO: 174783 - DNA, 25 bp, Homo sapien
gcgcattgccctcgaggaacgctta

SEQ ID NO: 174784 - DNA, 25 bp, Homo sapien
gtgcttcccgggcacttagcgcatt

SEQ ID NO: 174785 - DNA, 25 bp, Homo sapien
gctcagcgtccttcgccaggtgctt

SEQ ID NO: 174786 - DNA, 25 bp, Homo sapien
gtcctccaggtacagagcggccaac

SEQ ID NO: 174787 - DNA, 25 bp, Homo sapien
ctgacgtgacgtttccacccaaagg

SEQ ID NO: 174788 - DNA, 25 bp, Homo sapien
gcaatgtcccgaagctcgacgcgca

SEQ ID NO: 174789 - DNA, 25 bp, Homo sapien
accaagtcgggatttctgacgtgac

SEQ ID NO: 174790 - DNA, 25 bp, Homo sapien
gtgaacatcacctcgcagaagtagc

SEQ ID NO: 174791 - DNA, 25 bp, Homo sapien
tcaaagtcgaactgggagtagtccc

SEQ ID NO: 174792 - DNA, 25 bp, Homo sapien
atgaagccggtggtgaactcccaca

SEQ ID NO: 174793 - DNA, 25 bp, Homo sapien
ctcccacaggtaggtccagagcgtg

SEQ ID NO: 174794 - DNA, 25 bp, Homo sapien
aggtacatgcgctccacgatgagga

SEQ ID NO: 174795 - DNA, 25 bp, Homo sapien
tgccgtagatgaagagggcccacac

SEQ ID NO: 174796 - DNA, 25 bp, Homo sapien
atgaggcccatgaagtcaaagtcga

SEQ ID NO: 174797 - DNA, 25 bp, Homo sapien
ccgtggatggcatacaggtaccagc

SEQ ID NO: 174798 - DNA, 25 bp, Homo sapien
gggcgcaccacctatctaatctgcg

SEQ ID NO: 174799 - DNA, 25 bp, Homo sapien
gcggcactcacccatagtacggatg

SEQ ID NO: 174800 - DNA, 25 bp, Homo sapien
tagtcccgcattgtgtgtcggcgtc

SEQ ID NO: 174801 - DNA, 25 bp, Homo sapien
ctaatctgcggctggatctcgaacc

SEQ ID NO: 174802 - DNA, 25 bp, Homo sapien
actgcacatgctcgcgtctgacagg

SEQ ID NO: 174803 - DNA, 25 bp, Homo sapien
cggccacctctctgggcggcggaaa

SEQ ID NO: 174804 - DNA, 25 bp, Homo sapien
gtacggatgcgctgcaaactgcaca

SEQ ID NO: 174805 - DNA, 25 bp, Homo sapien
ggcagcagcctcgaaaccgaaagca

SEQ ID NO: 174806 - DNA, 25 bp, Homo sapien
ccgctatttggggtcaagcagatcc

SEQ ID NO: 174807 - DNA, 25 bp, Homo sapien
aggctggagcctgctgaggtcattt

SEQ ID NO: 174808 - DNA, 25 bp, Homo sapien
tgcctctccgcgagctgcctggaga

SEQ ID NO: 174809 - DNA, 25 bp, Homo sapien
aggacgatccggagcaggtgcctcc

SEQ ID NO: 174810 - DNA, 25 bp, Homo sapien
tacctggaagcgagctcccagcggc

SEQ ID NO: 174811 - DNA, 25 bp, Homo sapien
agtacctggacttggggatcggtca

SEQ ID NO: 174812 - DNA, 25 bp, Homo sapien
tgcaggctgccaccttgctatcggt

SEQ ID NO: 174813 - DNA, 25 bp, Homo sapien
agacggtctggtcttgtcccgcagc

SEQ ID NO: 174814 - DNA, 25 bp, Homo sapien
aggcgtctccatgtcctcactgagc

SEQ ID NO: 174815 - DNA, 25 bp, Homo sapien
tcggcaaggcgtctccatgtcctca

SEQ ID NO: 174816 - DNA, 25 bp, Homo sapien
tgagcacaaactgcagcgcacctca

SEQ ID NO: 174817 - DNA, 25 bp, Homo sapien
cctcactgagctccgagggtgacta

SEQ ID NO: 174818 - DNA, 25 bp, Homo sapien
tcatcctactccaccgacgggctgg

SEQ ID NO: 174819 - DNA, 25 bp, Homo sapien
cctgctcactggacagtgactactc

SEQ ID NO: 174820 - DNA, 25 bp, Homo sapien
ctggacagtgactactcagagcctg

SEQ ID NO: 174821 - DNA, 25 bp, Homo sapien
agctccgagggtgactacgccatcc

SEQ ID NO: 174822 - DNA, 25 bp, Homo sapien
tgactgtcttcgaaaaaacctcgtc

SEQ ID NO: 174823 - DNA, 25 bp, Homo sapien
cagaggtccgggctcgaccaaagac

SEQ ID NO: 174824 - DNA, 25 bp, Homo sapien
gaggggccgacttgccattacctcg

SEQ ID NO: 174825 - DNA, 25 bp, Homo sapien
cttgccattacctcgcagagggtga

SEQ ID NO: 174826 - DNA, 25 bp, Homo sapien
gcgcagcctcagttgcgcgccgaga

SEQ ID NO: 174827 - DNA, 25 bp, Homo sapien
tgatggttgtgcgttcttccgggcc

SEQ ID NO: 174828 - DNA, 25 bp, Homo sapien
gccctcctgtcctatcactgtagga

SEQ ID NO: 174829 - DNA, 25 bp, Homo sapien
cagttgcgcgccgagagctctgctg

SEQ ID NO: 174830 - DNA, 25 bp, Homo sapien
cggatattggccttctggcgtcagc

SEQ ID NO: 174831 - DNA, 25 bp, Homo sapien
ttggagattctcagtgctgcggatc

SEQ ID NO: 174832 - DNA, 25 bp, Homo sapien
ctgcggatcatgtccctaaggggca

SEQ ID NO: 174833 - DNA, 25 bp, Homo sapien
agacgcgagtgcattccatcctgaa

SEQ ID NO: 174834 - DNA, 25 bp, Homo sapien
tgagaactggcacctggaaccgccg

SEQ ID NO: 174835 - DNA, 25 bp, Homo sapien
tcttactggccagacccggatattg

SEQ ID NO: 174836 - DNA, 25 bp, Homo sapien
gaaatccgtccactccgtggctgtg

SEQ ID NO: 174837 - DNA, 25 bp, Homo sapien
acacctgttggtcaccgcgctctta

SEQ ID NO: 174838 - DNA, 25 bp, Homo sapien
gggagaatcttccttccaaagcgcg

SEQ ID NO: 174839 - DNA, 25 bp, Homo sapien
ttgactgttagctttcggccctgga

SEQ ID NO: 174840 - DNA, 25 bp, Homo sapien
tcctcgtttcgcgtcttgactgtta

SEQ ID NO: 174841 - DNA, 25 bp, Homo sapien
atcgcgctttgctttgccaccctga

SEQ ID NO: 174842 - DNA, 25 bp, Homo sapien
tcgtcctcactgtcatcgcgctttg

SEQ ID NO: 174843 - DNA, 25 bp, Homo sapien
tgtttgcgtctagacgtcgtcctca

SEQ ID NO: 174844 - DNA, 25 bp, Homo sapien
gcttcggcccgatttgatgtatgtt

SEQ ID NO: 174845 - DNA, 25 bp, Homo sapien
cggcgcgaaagcctgacgagaagtc

SEQ ID NO: 174846 - DNA, 25 bp, Homo sapien
tccgctgacaaagaatggcaacgtc

SEQ ID NO: 174847 - DNA, 25 bp, Homo sapien
cgtacgcgcttgacgacacaatctc

SEQ ID NO: 174848 - DNA, 25 bp, Homo sapien
acctccgcatggctggaccaatgga

SEQ ID NO: 174849 - DNA, 25 bp, Homo sapien
aatctcgccaagcttcgcctggtgg

SEQ ID NO: 174850 - DNA, 25 bp, Homo sapien
tgcgactcggtttccagttccacga

SEQ ID NO: 174851 - DNA, 25 bp, Homo sapien
gctgcgaacggtgcctaacgtcaga

SEQ ID NO: 174852 - DNA, 25 bp, Homo sapien
taacgtcagacgtctcgaggctcgc

SEQ ID NO: 174853 - DNA, 25 bp, Homo sapien
actgtgcgcagacgacgatcttttc

SEQ ID NO: 174854 - DNA, 25 bp, Homo sapien
ggcacagaacccgagcgcacaggtc

SEQ ID NO: 174855 - DNA, 25 bp, Homo sapien
gctttgttctctcggctctgtttta

SEQ ID NO: 174856 - DNA, 25 bp, Homo sapien
tacctggggtaaaagccggcacaga

SEQ ID NO: 174857 - DNA, 25 bp, Homo sapien
ctgctgcacaaaggcctgctttgtt

SEQ ID NO: 174858 - DNA, 25 bp, Homo sapien
cacaacggcgcattgtggggccaag

SEQ ID NO: 174859 - DNA, 25 bp, Homo sapien
tgcgccaagttgactctgccgtttg

SEQ ID NO: 174860 - DNA, 25 bp, Homo sapien
tgactctgccgtttgggtcacctgg

SEQ ID NO: 174861 - DNA, 25 bp, Homo sapien
cggctctgttttaaatatctgacga

SEQ ID NO: 174862 - DNA, 25 bp, Homo sapien
aagcggctgtctcgcgagctcagag

SEQ ID NO: 174863 - DNA, 25 bp, Homo sapien
cccttccgagaaggagcggtctcgg

SEQ ID NO: 174864 - DNA, 25 bp, Homo sapien
cggcgctcttcagcgttgtggatga

SEQ ID NO: 174865 - DNA, 25 bp, Homo sapien
tgccgtgtgcgaactggcacttgtc

SEQ ID NO: 174866 - DNA, 25 bp, Homo sapien
gtacttacaggcaccgttttcctca

SEQ ID NO: 174867 - DNA, 25 bp, Homo sapien
gttttcctcaaaggggcggcacagc

SEQ ID NO: 174868 - DNA, 25 bp, Homo sapien
cagctccgtcttgtacttggggtgg

SEQ ID NO: 174869 - DNA, 25 bp, Homo sapien
cagctccgtcttgtagcggctggag

SEQ ID NO: 174870 - DNA, 25 bp, Homo sapien
gcccaacggctcataggccagcagg

SEQ ID NO: 174871 - DNA, 25 bp, Homo sapien
cctagtgtttcggtagccctcacct

SEQ ID NO: 174872 - DNA, 25 bp, Homo sapien
ctcgcagatgcactttgaggtgatg

SEQ ID NO: 174873 - DNA, 25 bp, Homo sapien
ttttccgcagaaaggacaatccttg

SEQ ID NO: 174874 - DNA, 25 bp, Homo sapien
agcccattctcttctgcaacacata

SEQ ID NO: 174875 - DNA, 25 bp, Homo sapien
tgttctcaaatgatggcaaagcctc

SEQ ID NO: 174876 - DNA, 25 bp, Homo sapien
ggtacctacataccctgcgtggcgg

SEQ ID NO: 174877 - DNA, 25 bp, Homo sapien
caggctcaggtagcccaagaggctc

SEQ ID NO: 174878 - DNA, 25 bp, Homo sapien
ctgcggagtggctaagattgagttc

SEQ ID NO: 174879 - DNA, 25 bp, Homo sapien
ccattgcgatgtaattaggtcaccc

SEQ ID NO: 174880 - DNA, 25 bp, Homo sapien
gaggccgccgagtctgttatgaaac

SEQ ID NO: 174881 - DNA, 25 bp, Homo sapien
gctgcgcttctttccgatttccacg

SEQ ID NO: 174882 - DNA, 25 bp, Homo sapien
atactgttaggtttggatgccgccc

SEQ ID NO: 174883 - DNA, 25 bp, Homo sapien
cccaccggagtggaacatatggctt

SEQ ID NO: 174884 - DNA, 25 bp, Homo sapien
aggcggcacttttaacttattgttg

SEQ ID NO: 174885 - DNA, 25 bp, Homo sapien
ttgctgcagccacgaacctacgtga

SEQ ID NO: 174886 - DNA, 25 bp, Homo sapien
cggatcacgcgggaaggctgccctt

SEQ ID NO: 174887 - DNA, 25 bp, Homo sapien
gagcttcgcggtcgggctctcccgt

SEQ ID NO: 174888 - DNA, 25 bp, Homo sapien
tcagccgcgagcgagaaccaagccg

SEQ ID NO: 174889 - DNA, 25 bp, Homo sapien
aggcccgaggccatccagacgtgca

SEQ ID NO: 174890 - DNA, 25 bp, Homo sapien
aggccatccagacgtgcacaccagg

SEQ ID NO: 174891 - DNA, 25 bp, Homo sapien
gaggttctcgctacggcttcgttcc

SEQ ID NO: 174892 - DNA, 25 bp, Homo sapien
gcacgatggacgtggccacactgcc

SEQ ID NO: 174893 - DNA, 25 bp, Homo sapien
agccctcggaggcagcacgatggac

SEQ ID NO: 174894 - DNA, 25 bp, Homo sapien
aggctgggagctgaaaccgaaccca

SEQ ID NO: 174895 - DNA, 25 bp, Homo sapien
cgccgtggagaaggacatgtagtcc

SEQ ID NO: 174896 - DNA, 25 bp, Homo sapien
gacatgtagtccagagcacctggca

SEQ ID NO: 174897 - DNA, 25 bp, Homo sapien
ggccatccgcgcgatgcagtactca

SEQ ID NO: 174898 - DNA, 25 bp, Homo sapien
atgcagtactcagcctggtcgggtg

SEQ ID NO: 174899 - DNA, 25 bp, Homo sapien
cgcagctcgtccatggtaatgtagt

SEQ ID NO: 174900 - DNA, 25 bp, Homo sapien
ggccgcaaagtccagcagccgtaaa

SEQ ID NO: 174901 - DNA, 25 bp, Homo sapien
tagaggtcactctcgccgtacagcg

SEQ ID NO: 174902 - DNA, 25 bp, Homo sapien
atcgcctctcattgggaattcctgg

SEQ ID NO: 174903 - DNA, 25 bp, Homo sapien
gcacactgaactaggcggacacact

SEQ ID NO: 174904 - DNA, 25 bp, Homo sapien
ggcgcttggacctaatctccacgca

SEQ ID NO: 174905 - DNA, 25 bp, Homo sapien
cttctctctgagcaacggctgctgc

SEQ ID NO: 174906 - DNA, 25 bp, Homo sapien
gtcctcttctggctgcatgtaatcg

SEQ ID NO: 174907 - DNA, 25 bp, Homo sapien
ggcggctgctaacctttctctgctg

SEQ ID NO: 174908 - DNA, 25 bp, Homo sapien
gctgccaccgcacgccatatggaga

SEQ ID NO: 174909 - DNA, 25 bp, Homo sapien
ttggccaggccgagttgcccaaact

SEQ ID NO: 174910 - DNA, 25 bp, Homo sapien
gcctgcctcgcaagttgcgcattca

SEQ ID NO: 174911 - DNA, 25 bp, Homo sapien
ttgcgcattcaagttcaggctggtg

SEQ ID NO: 174912 - DNA, 25 bp, Homo sapien
ggccacaaccgaacgaaaggcgatg

SEQ ID NO: 174913 - DNA, 25 bp, Homo sapien
aggctggtgccctttagcctccaca

SEQ ID NO: 174914 - DNA, 25 bp, Homo sapien
acaagacgcagaagaggccacaacc

SEQ ID NO: 174915 - DNA, 25 bp, Homo sapien
cctcgccactctcgaaactgtatta

SEQ ID NO: 174916 - DNA, 25 bp, Homo sapien
cccgggagcaataggctatcgattc

SEQ ID NO: 174917 - DNA, 25 bp, Homo sapien
agaccacttgcaacagcggccgcgg

SEQ ID NO: 174918 - DNA, 25 bp, Homo sapien
gctttcccagttgagccgcttcccg

SEQ ID NO: 174919 - DNA, 25 bp, Homo sapien
ggcgttcgcggcttcctgacggtcc

SEQ ID NO: 174920 - DNA, 25 bp, Homo sapien
tgtgcagacactcggcggcgttcgc

SEQ ID NO: 174921 - DNA, 25 bp, Homo sapien
gcggagttgaatgcgcgtaacaatc

SEQ ID NO: 174922 - DNA, 25 bp, Homo sapien
atgcgcgtaacaatccgagtggccg

SEQ ID NO: 174923 - DNA, 25 bp, Homo sapien
ccgcactccgcggagttgaatgcgc

SEQ ID NO: 174924 - DNA, 25 bp, Homo sapien
tagggccgcacacttggaggaacgt

SEQ ID NO: 174925 - DNA, 25 bp, Homo sapien
gcacacttggaggaacgttgcctgg

SEQ ID NO: 174926 - DNA, 25 bp, Homo sapien
cggcccagtccgagacagcaggtaa

SEQ ID NO: 174927 - DNA, 25 bp, Homo sapien
acgccagctgggattacgtcctcca

SEQ ID NO: 174928 - DNA, 25 bp, Homo sapien
ggccgcacaggttccaggtctttaa

SEQ ID NO: 174929 - DNA, 25 bp, Homo sapien
aggtctttaacgtgagcccgctgca

SEQ ID NO: 174930 - DNA, 25 bp, Homo sapien
tgcgtgtcccagtcagctaaaaagg

SEQ ID NO: 174931 - DNA, 25 bp, Homo sapien
tctcctggattcgtgtgagccgcca

SEQ ID NO: 174932 - DNA, 25 bp, Homo sapien
taccagaccttcgaggctgcgtgtc

SEQ ID NO: 174933 - DNA, 25 bp, Homo sapien
tcgacgcggcaacagctgctgtttt

SEQ ID NO: 174934 - DNA, 25 bp, Homo sapien
cctcagaggctccaagagcggggtt

SEQ ID NO: 174935 - DNA, 25 bp, Homo sapien
cgccgtagtagaattggcactgatt

SEQ ID NO: 174936 - DNA, 25 bp, Homo sapien
tgcggtattttaatcggttcacacc

SEQ ID NO: 174937 - DNA, 25 bp, Homo sapien
tcggttcacaccgtctgttagtgta

SEQ ID NO: 174938 - DNA, 25 bp, Homo sapien
taatgaaccacagcatctccggagc

SEQ ID NO: 174939 - DNA, 25 bp, Homo sapien
tctccggagcaacacttacggtctc

SEQ ID NO: 174940 - DNA, 25 bp, Homo sapien
agttcctggggcaccaagtttgcgc

SEQ ID NO: 174941 - DNA, 25 bp, Homo sapien
gggtcaactgcgagctagacgccca

SEQ ID NO: 174942 - DNA, 25 bp, Homo sapien
tctactacttatggcaggacaaccg

SEQ ID NO: 174943 - DNA, 25 bp, Homo sapien
ccgtctgcccaccatgaggaagatc

SEQ ID NO: 174944 - DNA, 25 bp, Homo sapien
ggtctcgcactgtacgcgtctctca

SEQ ID NO: 174945 - DNA, 25 bp, Homo sapien
cgcaccatcccgctcattgtgagta

SEQ ID NO: 174946 - DNA, 25 bp, Homo sapien
ggatcctgggcactttctactactt

SEQ ID NO: 174947 - DNA, 25 bp, Homo sapien
atcgccatcctgaccgtagcctgga

SEQ ID NO: 174948 - DNA, 25 bp, Homo sapien
tgaacccgcttcttcggcgcggaca

SEQ ID NO: 174949 - DNA, 25 bp, Homo sapien
ccggctttgtatatgttggagcatt

SEQ ID NO: 174950 - DNA, 25 bp, Homo sapien
gctaacagccaatcctcgcgagagg

SEQ ID NO: 174951 - DNA, 25 bp, Homo sapien
gagcttaactacaacgccgctaaca

SEQ ID NO: 174952 - DNA, 25 bp, Homo sapien
cgccgccgttacacgagcttaacta

SEQ ID NO: 174953 - DNA, 25 bp, Homo sapien
aaactctcttcgctacagcagctgc

SEQ ID NO: 174954 - DNA, 25 bp, Homo sapien
aatccaccgactagagtggcgggga

SEQ ID NO: 174955 - DNA, 25 bp, Homo sapien
aagggtcaatccaccgactagagtg

SEQ ID NO: 174956 - DNA, 25 bp, Homo sapien
gcgggaagaagggtcaatccaccga

SEQ ID NO: 174957 - DNA, 25 bp, Homo sapien
ggtagccgcggaggcctttctcacc

SEQ ID NO: 174958 - DNA, 25 bp, Homo sapien
aattccaggccggagtgtgtgaccc

SEQ ID NO: 174959 - DNA, 25 bp, Homo sapien
cgcagttcacggagcggtaggaatt

SEQ ID NO: 174960 - DNA, 25 bp, Homo sapien
cagacacggtcaggttccaggaaga

SEQ ID NO: 174961 - DNA, 25 bp, Homo sapien
tcgccacttcactggggagaaaagc

SEQ ID NO: 174962 - DNA, 25 bp, Homo sapien
aaatccgatccgatgcgcgctaggc

SEQ ID NO: 174963 - DNA, 25 bp, Homo sapien
gccaggcgcgcagataaatcacgga

SEQ ID NO: 174964 - DNA, 25 bp, Homo sapien
cggacacacactgcacggatagctc

SEQ ID NO: 174965 - DNA, 25 bp, Homo sapien
ctccagactggcgttgagtgccaaa

SEQ ID NO: 174966 - DNA, 25 bp, Homo sapien
cccgcattgtgtgcggcgggaggcg

SEQ ID NO: 174967 - DNA, 25 bp, Homo sapien
cgcacagaggattccaacaggagac

SEQ ID NO: 174968 - DNA, 25 bp, Homo sapien
ccaacaggagactggaagagatttt

SEQ ID NO: 174969 - DNA, 25 bp, Homo sapien
caggagactggaagagattttgaaa

SEQ ID NO: 174970 - DNA, 25 bp, Homo sapien
ctggaagagattttgaaaggtcatc

SEQ ID NO: 174971 - DNA, 25 bp, Homo sapien
gattttgaaaggtcatctcgtcctt

SEQ ID NO: 174972 - DNA, 25 bp, Homo sapien
gggcgcacagaggattccaacagga

SEQ ID NO: 174973 - DNA, 25 bp, Homo sapien
gtggggcgcacagaggattccaaca

SEQ ID NO: 174974 - DNA, 25 bp, Homo sapien
ttgcgggctccacgggataatcaac

SEQ ID NO: 174975 - DNA, 25 bp, Homo sapien
tccaacgccggtgaggctcagcact

SEQ ID NO: 174976 - DNA, 25 bp, Homo sapien
agcactcattgtctcactggcagca

SEQ ID NO: 174977 - DNA, 25 bp, Homo sapien
actggcagcacagacaaagccttgc

SEQ ID NO: 174978 - DNA, 25 bp, Homo sapien
tccggaaagagacaccattggttgc

SEQ ID NO: 174979 - DNA, 25 bp, Homo sapien
taaatgcgcgcttcgtgcagaccgc

SEQ ID NO: 174980 - DNA, 25 bp, Homo sapien
ggacctcatctcctcgcagaggctg

SEQ ID NO: 174981 - DNA, 25 bp, Homo sapien
cagcgtcagtcgtctgcaggaattt

SEQ ID NO: 174982 - DNA, 25 bp, Homo sapien
tgagtccagcgaatggctcttcctg

SEQ ID NO: 174983 - DNA, 25 bp, Homo sapien
aaactggcttccagcgagctccgca

SEQ ID NO: 174984 - DNA, 25 bp, Homo sapien
ctgtagaccttcctcacgttgcttc

SEQ ID NO: 174985 - DNA, 25 bp, Homo sapien
acgttgcttcaggttctgctcctgc

SEQ ID NO: 174986 - DNA, 25 bp, Homo sapien
ctgctgaagcttgcgcagccgatcc

SEQ ID NO: 174987 - DNA, 25 bp, Homo sapien
tctgcacgcacttgacgcacgatgc

SEQ ID NO: 174988 - DNA, 25 bp, Homo sapien
cactgtaggatgacgacgatgcgcc

SEQ ID NO: 174989 - DNA, 25 bp, Homo sapien
acgcacgatgcgctccacgtgctga

SEQ ID NO: 174990 - DNA, 25 bp, Homo sapien
tgctggtttgtttgcttcgaggacg

SEQ ID NO: 174991 - DNA, 25 bp, Homo sapien
cgccaagggcttttgttcgcagctc

SEQ ID NO: 174992 - DNA, 25 bp, Homo sapien
tactgccggctgcaaccgtgaaagg

SEQ ID NO: 174993 - DNA, 25 bp, Homo sapien
agcgtctctccatggggtctgcgaa

SEQ ID NO: 174994 - DNA, 25 bp, Homo sapien
ccagatgctacctacacgtgggagg

SEQ ID NO: 174995 - DNA, 25 bp, Homo sapien
gtctccctaaaataacgcggctctg

SEQ ID NO: 174996 - DNA, 25 bp, Homo sapien
aaagaagcccggttccgtcgctgcg

SEQ ID NO: 174997 - DNA, 25 bp, Homo sapien
tacaaccgtggaggtaccgcaggtc

SEQ ID NO: 174998 - DNA, 25 bp, Homo sapien
tgtgccactgtcattactgccctca

SEQ ID NO: 174999 - DNA, 25 bp, Homo sapien
taccgccgcgttctattctccgaag

SEQ ID NO: 175000 - DNA, 25 bp, Homo sapien
gcctcgcctagacccgagaagactg

SEQ ID NO: 175001 - DNA, 25 bp, Homo sapien
ccagagcgagctagacaagggcacg

SEQ ID NO: 175002 - DNA, 25 bp, Homo sapien
gaggaaatctcagagcccgcctgtg

SEQ ID NO: 175003 - DNA, 25 bp, Homo sapien
gcattgtgccatcgacgcgctcggc

SEQ ID NO: 175004 - DNA, 25 bp, Homo sapien
ctggcttagagaaggtggatttcct

SEQ ID NO: 175005 - DNA, 25 bp, Homo sapien
ttctattctccgaagccggcgaccg

SEQ ID NO: 175006 - DNA, 25 bp, Homo sapien
ggagggtccgatttcctccctctga

SEQ ID NO: 175007 - DNA, 25 bp, Homo sapien
ccctgggaagaactcgaagaagttg

SEQ ID NO: 175008 - DNA, 25 bp, Homo sapien
caccttggatttgtggtctcggccc

SEQ ID NO: 175009 - DNA, 25 bp, Homo sapien
aggatcccacgaagccgggccggct

SEQ ID NO: 175010 - DNA, 25 bp, Homo sapien
ccgctggcgccatctagtgtcgaat

SEQ ID NO: 175011 - DNA, 25 bp, Homo sapien
ggtgagttagcttccaggttatgca

SEQ ID NO: 175012 - DNA, 25 bp, Homo sapien
aagggcatatccttctgcctgcgca

SEQ ID NO: 175013 - DNA, 25 bp, Homo sapien
ggatgtctgatcttcaccttggatt

SEQ ID NO: 175014 - DNA, 25 bp, Homo sapien
taggacgcgccctccattttgtgga

SEQ ID NO: 175015 - DNA, 25 bp, Homo sapien
cggcctttcctaactgcggcagatg

SEQ ID NO: 175016 - DNA, 25 bp, Homo sapien
gtccctgccagtcttaatgtcttca

SEQ ID NO: 175017 - DNA, 25 bp, Homo sapien
tcactgttcgggtcgtttttacaca

SEQ ID NO: 175018 - DNA, 25 bp, Homo sapien
tggggcacgtctcccttttggcata

SEQ ID NO: 175019 - DNA, 25 bp, Homo sapien
tctctttgcggaggatggcgtctaa

SEQ ID NO: 175020 - DNA, 25 bp, Homo sapien
aggcttcttcatggccgctcagatc

SEQ ID NO: 175021 - DNA, 25 bp, Homo sapien
ctttgagggcaagccttctcggatc

SEQ ID NO: 175022 - DNA, 25 bp, Homo sapien
tcattcctaggaaacggccgacctg

SEQ ID NO: 175023 - DNA, 25 bp, Homo sapien
ccgctggtgcgaacgctttcgactt

SEQ ID NO: 175024 - DNA, 25 bp, Homo sapien
ctagcgggagccagattttacaatc

SEQ ID NO: 175025 - DNA, 25 bp, Homo sapien
agccgctagagctggtcacaaagca

SEQ ID NO: 175026 - DNA, 25 bp, Homo sapien
gggaacgcaaactcagcctgctgga

SEQ ID NO: 175027 - DNA, 25 bp, Homo sapien
ccaggcacgagtttgcgaactacta

SEQ ID NO: 175028 - DNA, 25 bp, Homo sapien
gggctgcgacacttgggattaatgc

SEQ ID NO: 175029 - DNA, 25 bp, Homo sapien
cgacctgactattcggcccattttc

SEQ ID NO: 175030 - DNA, 25 bp, Homo sapien
tttggccgctgcgtggttcaaaaga

SEQ ID NO: 175031 - DNA, 25 bp, Homo sapien
tccgggctctgctaattgacgtttg

SEQ ID NO: 175032 - DNA, 25 bp, Homo sapien
gagcgcagagcgcactcatttttcc

SEQ ID NO: 175033 - DNA, 25 bp, Homo sapien
gcgctcctttgttgcgagcgtgtga

SEQ ID NO: 175034 - DNA, 25 bp, Homo sapien
aacgcccttgttggaggcacaatag

SEQ ID NO: 175035 - DNA, 25 bp, Homo sapien
gcattagatgcactcagctcttttc

SEQ ID NO: 175036 - DNA, 25 bp, Homo sapien
cgcagccagggaccacagtgcagct

SEQ ID NO: 175037 - DNA, 25 bp, Homo sapien
gaggcggacacggataactgcatta

SEQ ID NO: 175038 - DNA, 25 bp, Homo sapien
gttgaccacgagtggctcctcttgc

SEQ ID NO: 175039 - DNA, 25 bp, Homo sapien
tcccattggctttcacctgccagag

SEQ ID NO: 175040 - DNA, 25 bp, Homo sapien
acctgccagagggtcggcttcaaca

SEQ ID NO: 175041 - DNA, 25 bp, Homo sapien
ggtcggcttcaacaggcctcttggc

SEQ ID NO: 175042 - DNA, 25 bp, Homo sapien
aacaggcctcttggcccgtcaatca

SEQ ID NO: 175043 - DNA, 25 bp, Homo sapien
ggctcaggcgtccaacctgctgccg

SEQ ID NO: 175044 - DNA, 25 bp, Homo sapien
tcctgcgcggttcatgactgtgtcc

SEQ ID NO: 175045 - DNA, 25 bp, Homo sapien
gcgcagagcacacgctcgcgctcca

SEQ ID NO: 175046 - DNA, 25 bp, Homo sapien
aggccgatgcccaggaagacattga

SEQ ID NO: 175047 - DNA, 25 bp, Homo sapien
gccgccttcggtacaagagcacgct

SEQ ID NO: 175048 - DNA, 25 bp, Homo sapien
agagcacgctgatgcagacaaatgc

SEQ ID NO: 175049 - DNA, 25 bp, Homo sapien
agaaggccagtgtgccggccgacac

SEQ ID NO: 175050 - DNA, 25 bp, Homo sapien
tgcccgtcacgttgccaatggaggc

SEQ ID NO: 175051 - DNA, 25 bp, Homo sapien
tgtccctgcagagcccagtagatgg

SEQ ID NO: 175052 - DNA, 25 bp, Homo sapien
cccaggaagacattgacggcgttgc

SEQ ID NO: 175053 - DNA, 25 bp, Homo sapien
gccggccgacacgtggaactcctgt

SEQ ID NO: 175054 - DNA, 25 bp, Homo sapien
ctttgcccattaagctgccggaaga

SEQ ID NO: 175055 - DNA, 25 bp, Homo sapien
tgacaagccgcgcatatttatcctc

SEQ ID NO: 175056 - DNA, 25 bp, Homo sapien
cttccgcacggatttcagaaagagg

SEQ ID NO: 175057 - DNA, 25 bp, Homo sapien
tgactggaatctacgcccgggagag

SEQ ID NO: 175058 - DNA, 25 bp, Homo sapien
cggaacgtcaccctatcagctggga

SEQ ID NO: 175059 - DNA, 25 bp, Homo sapien
gacagcgccgcactgactgacaagc

SEQ ID NO: 175060 - DNA, 25 bp, Homo sapien
acccaccctagtcgttggagcctgg

SEQ ID NO: 175061 - DNA, 25 bp, Homo sapien
gtcctgacctggattccgccgagtt

SEQ ID NO: 175062 - DNA, 25 bp, Homo sapien
ccactgcaatagagagctggatctg

SEQ ID NO: 175063 - DNA, 25 bp, Homo sapien
ccgacctttgatctcggctgcggtc

SEQ ID NO: 175064 - DNA, 25 bp, Homo sapien
accctttatctccaacgcgggagcg

SEQ ID NO: 175065 - DNA, 25 bp, Homo sapien
cctcttgcgagcacgccggtgtaac

SEQ ID NO: 175066 - DNA, 25 bp, Homo sapien
aagtcctgagacttggagcgcgcgc

SEQ ID NO: 175067 - DNA, 25 bp, Homo sapien
gcccaggtccgaagtcctgagactt

SEQ ID NO: 175068 - DNA, 25 bp, Homo sapien
gggcttcccagatgctgtcgccgca

SEQ ID NO: 175069 - DNA, 25 bp, Homo sapien
cgtgaccggctaggaaataaagagc

SEQ ID NO: 175070 - DNA, 25 bp, Homo sapien
ctggagatgtggaagaaaagaagca

SEQ ID NO: 175071 - DNA, 25 bp, Homo sapien
tacacggcggtatggtcctgcgctc

SEQ ID NO: 175072 - DNA, 25 bp, Homo sapien
ggggactttaagaagatagggatca

SEQ ID NO: 175073 - DNA, 25 bp, Homo sapien
ttagggcttgtcatatgcaacaaga

SEQ ID NO: 175074 - DNA, 25 bp, Homo sapien
tctcttgtttttagggcttgtcata

SEQ ID NO: 175075 - DNA, 25 bp, Homo sapien
ccaggtcaaatagtaagagggagct

SEQ ID NO: 175076 - DNA, 25 bp, Homo sapien
caagaggtgatgttccaggtcaaat

SEQ ID NO: 175077 - DNA, 25 bp, Homo sapien
catatgcaacaagaggtgatgttcc

SEQ ID NO: 175078 - DNA, 25 bp, Homo sapien
gagtgaactcttccatcggctcaga

SEQ ID NO: 175079 - DNA, 25 bp, Homo sapien
gggcctagcgcagactcccaaatct

SEQ ID NO: 175080 - DNA, 25 bp, Homo sapien
gctcacgctctcaccaagacgagta

SEQ ID NO: 175081 - DNA, 25 bp, Homo sapien
gctcggtccttagtgaatggtttcc

SEQ ID NO: 175082 - DNA, 25 bp, Homo sapien
ttccgctaggcaaaagcaatcgagc

SEQ ID NO: 175083 - DNA, 25 bp, Homo sapien
aacgtcggcgtgcaattgggattta

SEQ ID NO: 175084 - DNA, 25 bp, Homo sapien
gtaacatacttgtgcgtccgcccag

SEQ ID NO: 175085 - DNA, 25 bp, Homo sapien
cgagagtcttgttcttgcgaaaagc

SEQ ID NO: 175086 - DNA, 25 bp, Homo sapien
ggggccgtctttgtcattaatcctc

SEQ ID NO: 175087 - DNA, 25 bp, Homo sapien
ccataggcaaataccaccgggcgtt

SEQ ID NO: 175088 - DNA, 25 bp, Homo sapien
caagaaattccgtgaagccataggc

SEQ ID NO: 175089 - DNA, 25 bp, Homo sapien
cgcagtgctacaaggacaagaaatt

SEQ ID NO: 175090 - DNA, 25 bp, Homo sapien
tccgacgagcgcacgagttcaaaag

SEQ ID NO: 175091 - DNA, 25 bp, Homo sapien
agcttcttccgggtcagcgaccatc

SEQ ID NO: 175092 - DNA, 25 bp, Homo sapien
tccttcgggcaagccaagcttcttc

SEQ ID NO: 175093 - DNA, 25 bp, Homo sapien
cctgccgcaccttttcttgtagtta

SEQ ID NO: 175094 - DNA, 25 bp, Homo sapien
gcctattgttcatgcgcctccgcag

SEQ ID NO: 175095 - DNA, 25 bp, Homo sapien
agggctccatggagcggccgatcca

SEQ ID NO: 175096 - DNA, 25 bp, Homo sapien
cgagaagcgctctggagggctccat

SEQ ID NO: 175097 - DNA, 25 bp, Homo sapien
cgtactcgaacacggccgtccagta

SEQ ID NO: 175098 - DNA, 25 bp, Homo sapien
ggaagatgcccacccgctggttcag

SEQ ID NO: 175099 - DNA, 25 bp, Homo sapien
ttgcgggctctgtcattctcaaacc

SEQ ID NO: 175100 - DNA, 25 bp, Homo sapien
tgcgagtccttggacagcacctcca

SEQ ID NO: 175101 - DNA, 25 bp, Homo sapien
gttaccgcggtacgagaagagcgcc

SEQ ID NO: 175102 - DNA, 25 bp, Homo sapien
cttccgcgcctctgcaaggcggtga

SEQ ID NO: 175103 - DNA, 25 bp, Homo sapien
cggtgagtcgtttcttcccggcaca

SEQ ID NO: 175104 - DNA, 25 bp, Homo sapien
taggtccgcagccagtgcggagaaa

SEQ ID NO: 175105 - DNA, 25 bp, Homo sapien
ggatcctcggcgctgacgttctctc

SEQ ID NO: 175106 - DNA, 25 bp, Homo sapien
cgagctacatacagaggctgccttc

SEQ ID NO: 175107 - DNA, 25 bp, Homo sapien
cgtgcaaaatgcaccgagctacata

SEQ ID NO: 175108 - DNA, 25 bp, Homo sapien
gggagcagcctatcttcgtgcaaaa

SEQ ID NO: 175109 - DNA, 25 bp, Homo sapien
ctgccttccaggactcagcgcggag

SEQ ID NO: 175110 - DNA, 25 bp, Homo sapien
ggctcgtgtggcagcgcacggggca

SEQ ID NO: 175111 - DNA, 25 bp, Homo sapien
gcctcaaggctcgtgtggcagcgca

SEQ ID NO: 175112 - DNA, 25 bp, Homo sapien
ccgcctcaaggctcgtgtggcagcg

SEQ ID NO: 175113 - DNA, 25 bp, Homo sapien
cctcaaggctcgtgtggcagcgcac

SEQ ID NO: 175114 - DNA, 25 bp, Homo sapien
gccggcctcacgctgggagcggttg

SEQ ID NO: 175115 - DNA, 25 bp, Homo sapien
aacgatcccgcctttgagcgcagcc

SEQ ID NO: 175116 - DNA, 25 bp, Homo sapien
gaacgatcccgcctttgagcgcagc

SEQ ID NO: 175117 - DNA, 25 bp, Homo sapien
ctcaaggctcgtgtggcagcgcacg

SEQ ID NO: 175118 - DNA, 25 bp, Homo sapien
tgacacgagcaacgagcccacggca

SEQ ID NO: 175119 - DNA, 25 bp, Homo sapien
ggctggtactacgacccgcaccagg

SEQ ID NO: 175120 - DNA, 25 bp, Homo sapien
aggccaccttcgtgaacgcgctgca

SEQ ID NO: 175121 - DNA, 25 bp, Homo sapien
gaacgcgctgcacctctacctgtgg

SEQ ID NO: 175122 - DNA, 25 bp, Homo sapien
agacgctgcagatcctccgacaggg

SEQ ID NO: 175123 - DNA, 25 bp, Homo sapien
atccatccttggcacgctgggttcc

SEQ ID NO: 175124 - DNA, 25 bp, Homo sapien
cggctttaggggacgccgcatccat

SEQ ID NO: 175125 - DNA, 25 bp, Homo sapien
ggctttcctggtttcggaggtgaca

SEQ ID NO: 175126 - DNA, 25 bp, Homo sapien
taagccgctccgtggtgatctcacc

SEQ ID NO: 175127 - DNA, 25 bp, Homo sapien
gccgtctacacggtttctctttctc

SEQ ID NO: 175128 - DNA, 25 bp, Homo sapien
agcctcgggaattgggctgattcca

SEQ ID NO: 175129 - DNA, 25 bp, Homo sapien
atagttgatgcccaaggacggggcc

SEQ ID NO: 175130 - DNA, 25 bp, Homo sapien
cccgggcgcctagacaatagttgat

SEQ ID NO: 175131 - DNA, 25 bp, Homo sapien
cctcagttctttctgctggcgggcg

SEQ ID NO: 175132 - DNA, 25 bp, Homo sapien
aaaagtcagtgcagcgccgagtccc

SEQ ID NO: 175133 - DNA, 25 bp, Homo sapien
ccactgccggcaactttgtgagcga

SEQ ID NO: 175134 - DNA, 25 bp, Homo sapien
tcgagcaaatcacggtctgcgcctt

SEQ ID NO: 175135 - DNA, 25 bp, Homo sapien
cggcttcttgaggatgaggcatttc

SEQ ID NO: 175136 - DNA, 25 bp, Homo sapien
cggtcgagccagtctctcggttttc

SEQ ID NO: 175137 - DNA, 25 bp, Homo sapien
gtttggaattgacgaaagcagcctc

SEQ ID NO: 175138 - DNA, 25 bp, Homo sapien
ccttgacgccgctgaagtttccgga

SEQ ID NO: 175139 - DNA, 25 bp, Homo sapien
ggaatccctaagagaaccttgacgc

SEQ ID NO: 175140 - DNA, 25 bp, Homo sapien
tcagtgagggagattcagaagccgc

SEQ ID NO: 175141 - DNA, 25 bp, Homo sapien
tcgccaccacggaaactcggaaaga

SEQ ID NO: 175142 - DNA, 25 bp, Homo sapien
aagagcgccctgcaaactccggagc

SEQ ID NO: 175143 - DNA, 25 bp, Homo sapien
cggtgctccaactccggaaggtttg

SEQ ID NO: 175144 - DNA, 25 bp, Homo sapien
agccagctcgctcgcaaatacacga

SEQ ID NO: 175145 - DNA, 25 bp, Homo sapien
tcgttaatccactaaagccagctcg

SEQ ID NO: 175146 - DNA, 25 bp, Homo sapien
caccattcataagacctgcggcttc

SEQ ID NO: 175147 - DNA, 25 bp, Homo sapien
caggatctgggcaagcgctcaaagt

SEQ ID NO: 175148 - DNA, 25 bp, Homo sapien
cttggcggcttaacagttccactga

SEQ ID NO: 175149 - DNA, 25 bp, Homo sapien
gcgacactagttttccgaggccacc

SEQ ID NO: 175150 - DNA, 25 bp, Homo sapien
cgccgccagtcgtaacatcacgtta

SEQ ID NO: 175151 - DNA, 25 bp, Homo sapien
acggtctctcacgaaagggtctcca

SEQ ID NO: 175152 - DNA, 25 bp, Homo sapien
gggtctccagacagttccgctgctc

SEQ ID NO: 175153 - DNA, 25 bp, Homo sapien
cgccttcttcatgagatcgtcccta

SEQ ID NO: 175154 - DNA, 25 bp, Homo sapien
ggctgacgctacaccttggtctttc

SEQ ID NO: 175155 - DNA, 25 bp, Homo sapien
gccggatcagtgctgcaaccgtaaa

SEQ ID NO: 175156 - DNA, 25 bp, Homo sapien
ggcgtttctctaagcgcttctctga

SEQ ID NO: 175157 - DNA, 25 bp, Homo sapien
ttccactacagcgagaggacttctc

SEQ ID NO: 175158 - DNA, 25 bp, Homo sapien
tgggtggaaactcgcctttgtatcg

SEQ ID NO: 175159 - DNA, 25 bp, Homo sapien
tccacatgcgtgagagaaactagtt

SEQ ID NO: 175160 - DNA, 25 bp, Homo sapien
tattggctattgcacgggacgaccc

SEQ ID NO: 175161 - DNA, 25 bp, Homo sapien
cccttagagtgcctagtagaagatc

SEQ ID NO: 175162 - DNA, 25 bp, Homo sapien
tcacatccgggtatctgggaggcct

SEQ ID NO: 175163 - DNA, 25 bp, Homo sapien
tttcgctcccgctcctaattagaca

SEQ ID NO: 175164 - DNA, 25 bp, Homo sapien
ctgagaatcttcctattggctgtgc

SEQ ID NO: 175165 - DNA, 25 bp, Homo sapien
tctgcgtagagaagccgactgctgc

SEQ ID NO: 175166 - DNA, 25 bp, Homo sapien
ctcggactaacaggaaggcgtgagc

SEQ ID NO: 175167 - DNA, 25 bp, Homo sapien
gtgaacttctcccagctcggactaa

SEQ ID NO: 175168 - DNA, 25 bp, Homo sapien
atcagctgatcggagtgaacttctc

SEQ ID NO: 175169 - DNA, 25 bp, Homo sapien
cctcctctcctgttgtcagttggga

SEQ ID NO: 175170 - DNA, 25 bp, Homo sapien
ggctattcctcaggacaccggcaga

SEQ ID NO: 175171 - DNA, 25 bp, Homo sapien
accactgagaagctcggccgcagca

SEQ ID NO: 175172 - DNA, 25 bp, Homo sapien
cccggagccgaatccattgtttata

SEQ ID NO: 175173 - DNA, 25 bp, Homo sapien
agatgtagctcctcgaggcgcgctc

SEQ ID NO: 175174 - DNA, 25 bp, Homo sapien
tcgcgaaggcagtaccgtttcctca

SEQ ID NO: 175175 - DNA, 25 bp, Homo sapien
agacgctgcttctctatggttattc

SEQ ID NO: 175176 - DNA, 25 bp, Homo sapien
gcgcactcgtaacctggatcccaga

SEQ ID NO: 175177 - DNA, 25 bp, Homo sapien
gccgggcaagaggaagacctccatc

SEQ ID NO: 175178 - DNA, 25 bp, Homo sapien
gagccaacagcggagacgatctata

SEQ ID NO: 175179 - DNA, 25 bp, Homo sapien
cagtcggctccaatcaaacatggtg

SEQ ID NO: 175180 - DNA, 25 bp, Homo sapien
tggcgtcccgtagtcgtaagattca

SEQ ID NO: 175181 - DNA, 25 bp, Homo sapien
cttgacctcaagatggcgtcccgta

SEQ ID NO: 175182 - DNA, 25 bp, Homo sapien
atataggggctttcgtcctcagctc

SEQ ID NO: 175183 - DNA, 25 bp, Homo sapien
tctgcttgagcaactggtgaaactc

SEQ ID NO: 175184 - DNA, 25 bp, Homo sapien
tttgctcgaagacgtctcagggcgc

SEQ ID NO: 175185 - DNA, 25 bp, Homo sapien
cttggtccggaaatgctgtttgctc

SEQ ID NO: 175186 - DNA, 25 bp, Homo sapien
cgcgaagccggtgtcctaaaagatg

SEQ ID NO: 175187 - DNA, 25 bp, Homo sapien
atcggaaacaaaacagcggctggtc

SEQ ID NO: 175188 - DNA, 25 bp, Homo sapien
ggtccgcggtttcacatcggaaaca

SEQ ID NO: 175189 - DNA, 25 bp, Homo sapien
ccgcaatcgtttctccaggccggag

SEQ ID NO: 175190 - DNA, 25 bp, Homo sapien
agggcctctacgaagggctctgtcc

SEQ ID NO: 175191 - DNA, 25 bp, Homo sapien
gctctgtcctcccacggggattgga

SEQ ID NO: 175192 - DNA, 25 bp, Homo sapien
gccctagctcaaggcagacgcgttc

SEQ ID NO: 175193 - DNA, 25 bp, Homo sapien
ggaacaacacgttgagggcgcccac

SEQ ID NO: 175194 - DNA, 25 bp, Homo sapien
ctcggaccttcccttcaggcgaatg

SEQ ID NO: 175195 - DNA, 25 bp, Homo sapien
gccttcggccctagctcaaggcaga

SEQ ID NO: 175196 - DNA, 25 bp, Homo sapien
aatttgctcgcctggctcacggcga

SEQ ID NO: 175197 - DNA, 25 bp, Homo sapien
gggcttctgcaggaatttgctcgcc

SEQ ID NO: 175198 - DNA, 25 bp, Homo sapien
caattgtgaacaggttcggtgctgc

SEQ ID NO: 175199 - DNA, 25 bp, Homo sapien
gcccgcacacagctgttgactagtc

SEQ ID NO: 175200 - DNA, 25 bp, Homo sapien
tgttgactagtcttccagctctccc

SEQ ID NO: 175201 - DNA, 25 bp, Homo sapien
ggagcagcatatttcacctttaacg

SEQ ID NO: 175202 - DNA, 25 bp, Homo sapien
gcagcatatttcacctttaacggag

SEQ ID NO: 175203 - DNA, 25 bp, Homo sapien
tatttcacctttaacggaggcgtgc

SEQ ID NO: 175204 - DNA, 25 bp, Homo sapien
ggcgcccgcacacagctgttgacta

SEQ ID NO: 175205 - DNA, 25 bp, Homo sapien
gcacacagctgttgactagtcttcc

SEQ ID NO: 175206 - DNA, 25 bp, Homo sapien
tcacctgtgggccatagggagagac

SEQ ID NO: 175207 - DNA, 25 bp, Homo sapien
gggccgctctaacccaatgcgtctc

SEQ ID NO: 175208 - DNA, 25 bp, Homo sapien
atgcgtctcccgcaggctgagatgc

SEQ ID NO: 175209 - DNA, 25 bp, Homo sapien
tctcctggtcacctgtgggccatag

SEQ ID NO: 175210 - DNA, 25 bp, Homo sapien
ttctctgcggtgcaccgaggcgcac

SEQ ID NO: 175211 - DNA, 25 bp, Homo sapien
ctcacgctgtgttctctgcggtgca

SEQ ID NO: 175212 - DNA, 25 bp, Homo sapien
ggggcgccctcacgctgtgttctct

SEQ ID NO: 175213 - DNA, 25 bp, Homo sapien
cacccggctgtcctgttgcgggtct

SEQ ID NO: 175214 - DNA, 25 bp, Homo sapien
cagcctagagcaccatggaggggca

SEQ ID NO: 175215 - DNA, 25 bp, Homo sapien
ttgtcgcacggaggtaaagctcacg

SEQ ID NO: 175216 - DNA, 25 bp, Homo sapien
gacgttgggtctcggtcaggtcttc

SEQ ID NO: 175217 - DNA, 25 bp, Homo sapien
agagcaccatggaggggcacgcaca

SEQ ID NO: 175218 - DNA, 25 bp, Homo sapien
ggcggtatcggtggctgccctacta

SEQ ID NO: 175219 - DNA, 25 bp, Homo sapien
ctgccctactacagcggtgagcgcg

SEQ ID NO: 175220 - DNA, 25 bp, Homo sapien
aggtcttcccggtgctctggtcccg

SEQ ID NO: 175221 - DNA, 25 bp, Homo sapien
ggagccaccgctcttgtcgcacgga

SEQ ID NO: 175222 - DNA, 25 bp, Homo sapien
gtctgctccctgtcacccgggaccc

SEQ ID NO: 175223 - DNA, 25 bp, Homo sapien
aagtctgctccctgtcacccgggac

SEQ ID NO: 175224 - DNA, 25 bp, Homo sapien
caagtctgctccctgtcacccggga

SEQ ID NO: 175225 - DNA, 25 bp, Homo sapien
tttcctcagacgcccctacttggag

SEQ ID NO: 175226 - DNA, 25 bp, Homo sapien
gtttcctcagacgcccctacttgga

SEQ ID NO: 175227 - DNA, 25 bp, Homo sapien
gcgtttcctcagacgcccctacttg

SEQ ID NO: 175228 - DNA, 25 bp, Homo sapien
cgagcgtttcctcagacgcccctac

SEQ ID NO: 175229 - DNA, 25 bp, Homo sapien
agtctgctccctgtcacccgggacc

SEQ ID NO: 175230 - DNA, 25 bp, Homo sapien
ggcacccaagccgtcctgggtattc

SEQ ID NO: 175231 - DNA, 25 bp, Homo sapien
cgcccttgaagcaggtcgttacagg

SEQ ID NO: 175232 - DNA, 25 bp, Homo sapien
tgaagcaggtcgttacaggtcaccc

SEQ ID NO: 175233 - DNA, 25 bp, Homo sapien
tggccgcttccgtttcctcagatac

SEQ ID NO: 175234 - DNA, 25 bp, Homo sapien
agccgtcctgggtattcccaagaca

SEQ ID NO: 175235 - DNA, 25 bp, Homo sapien
agcagctggacgtcccaagggacct

SEQ ID NO: 175236 - DNA, 25 bp, Homo sapien
tcagcgcgctagaccggagcagctg

SEQ ID NO: 175237 - DNA, 25 bp, Homo sapien
cagatacctactcctcacacagtgg

SEQ ID NO: 175238 - DNA, 25 bp, Homo sapien
cgcaggctttctctactactgtgtg

SEQ ID NO: 175239 - DNA, 25 bp, Homo sapien
gggacttttctctaccgctgacctg

SEQ ID NO: 175240 - DNA, 25 bp, Homo sapien
tgacctggattcgatgctgcgcaac

SEQ ID NO: 175241 - DNA, 25 bp, Homo sapien
ggacgccgctcgctacatcaacgga

SEQ ID NO: 175242 - DNA, 25 bp, Homo sapien
ggcccgcctctttgagtggctcatc

SEQ ID NO: 175243 - DNA, 25 bp, Homo sapien
aagcagctgcgaagtgttgtatccc

SEQ ID NO: 175244 - DNA, 25 bp, Homo sapien
gaaactctggcgtgtataccgaccc

SEQ ID NO: 175245 - DNA, 25 bp, Homo sapien
cagatcacttttaccggcgcctatg

SEQ ID NO: 175246 - DNA, 25 bp, Homo sapien
ccaggtgactcacctccgctaattg

SEQ ID NO: 175247 - DNA, 25 bp, Homo sapien
aggtgactcacctccgctaattgtt

SEQ ID NO: 175248 - DNA, 25 bp, Homo sapien
ggtgactcacctccgctaattgttc

SEQ ID NO: 175249 - DNA, 25 bp, Homo sapien
acgaaccggtgcgaatcgccgtgcg

SEQ ID NO: 175250 - DNA, 25 bp, Homo sapien
ctgctgggacgaaccggtgcgaatc

SEQ ID NO: 175251 - DNA, 25 bp, Homo sapien
cgaaccggtgcgaatcgccgtgcgc

SEQ ID NO: 175252 - DNA, 25 bp, Homo sapien
gctggatggccacgaccccgacccc

SEQ ID NO: 175253 - DNA, 25 bp, Homo sapien
tgcgaatcgccgtgcgcggcctagc

SEQ ID NO: 175254 - DNA, 25 bp, Homo sapien
cagcctcgcgtccaagtgggacaca

SEQ ID NO: 175255 - DNA, 25 bp, Homo sapien
tctcggagaccgcaaggcgcgggca

SEQ ID NO: 175256 - DNA, 25 bp, Homo sapien
gcaccgactgcaagggcatttccac

SEQ ID NO: 175257 - DNA, 25 bp, Homo sapien
gggcatttccactgcgtcggccctg

SEQ ID NO: 175258 - DNA, 25 bp, Homo sapien
tccacacagccggtgcaccggtgcc

SEQ ID NO: 175259 - DNA, 25 bp, Homo sapien
ctcgcgtccaagtgggacacagaca

SEQ ID NO: 175260 - DNA, 25 bp, Homo sapien
tccaagtgggacacagacagctcca

SEQ ID NO: 175261 - DNA, 25 bp, Homo sapien
tgcaagggcatttccactgcgtcgg

SEQ ID NO: 175262 - DNA, 25 bp, Homo sapien
tccgctaattgttccgtgttcgttc

SEQ ID NO: 175263 - DNA, 25 bp, Homo sapien
gctaattgttccgtgttcgttcgcc

SEQ ID NO: 175264 - DNA, 25 bp, Homo sapien
ttgttccgtgttcgttcgcctttca

SEQ ID NO: 175265 - DNA, 25 bp, Homo sapien
gtgttcgttcgcctttcactttgtg

SEQ ID NO: 175266 - DNA, 25 bp, Homo sapien
gttcgttcgcctttcactttgtgtg

SEQ ID NO: 175267 - DNA, 25 bp, Homo sapien
tcgttcgcctttcactttgtgtgtc

SEQ ID NO: 175268 - DNA, 25 bp, Homo sapien
gttcgcctttcactttgtgtgtctc

SEQ ID NO: 175269 - DNA, 25 bp, Homo sapien
tcgcctttcactttgtgtgtctccc

SEQ ID NO: 175270 - DNA, 25 bp, Homo sapien
ggttgggcgccacaccttgcgcgcc

SEQ ID NO: 175271 - DNA, 25 bp, Homo sapien
gagaagcctttttggcgcttcctga

SEQ ID NO: 175272 - DNA, 25 bp, Homo sapien
ccgagaagcctttttggcgcttcct

SEQ ID NO: 175273 - DNA, 25 bp, Homo sapien
aacgagccggtgcgcattgccgtgc

SEQ ID NO: 175274 - DNA, 25 bp, Homo sapien
ctgctggaacgagccggtgcgcatt

SEQ ID NO: 175275 - DNA, 25 bp, Homo sapien
cggacattcggcgcgcttgccacga

SEQ ID NO: 175276 - DNA, 25 bp, Homo sapien
aagaggagcctggctacttttgcct

SEQ ID NO: 175277 - DNA, 25 bp, Homo sapien
gccgtccggacattcggcgcgcttg

SEQ ID NO: 175278 - DNA, 25 bp, Homo sapien
tacccagattgggatggcagcgacg

SEQ ID NO: 175279 - DNA, 25 bp, Homo sapien
tcgactactttccagcgctcggcaa

SEQ ID NO: 175280 - DNA, 25 bp, Homo sapien
gtgggcgttggagcccgagaaagcc

SEQ ID NO: 175281 - DNA, 25 bp, Homo sapien
ccctgttctacccagattgggatgg

SEQ ID NO: 175282 - DNA, 25 bp, Homo sapien
attgggatggcagcgacgctgatcc

SEQ ID NO: 175283 - DNA, 25 bp, Homo sapien
gacggccacgacaccgagcccgggc

SEQ ID NO: 175284 - DNA, 25 bp, Homo sapien
tactttccagcgctcggcaaagccg

SEQ ID NO: 175285 - DNA, 25 bp, Homo sapien
acgagccgctgcgcatcgcagtgcg

SEQ ID NO: 175286 - DNA, 25 bp, Homo sapien
ccgacaggcattccggaagttcacc

SEQ ID NO: 175287 - DNA, 25 bp, Homo sapien
cgctcgagtacttagcgcccattca

SEQ ID NO: 175288 - DNA, 25 bp, Homo sapien
agcgagctagaggaagactttgcca

SEQ ID NO: 175289 - DNA, 25 bp, Homo sapien
cgagccgcagacgtacaggtccttc

SEQ ID NO: 175290 - DNA, 25 bp, Homo sapien
ttcaccaagtccgaaaggtaggcgc

SEQ ID NO: 175291 - DNA, 25 bp, Homo sapien
gcccatcacgtgctgtgcttgtctc

SEQ ID NO: 175292 - DNA, 25 bp, Homo sapien
gcggaaagtttactcgcgcgggcta

SEQ ID NO: 175293 - DNA, 25 bp, Homo sapien
acaaatgccagtcggtgctcccagt

SEQ ID NO: 175294 - DNA, 25 bp, Homo sapien
actcgcgaggggatcctacctcttc

SEQ ID NO: 175295 - DNA, 25 bp, Homo sapien
ttccacacgggacctctaggagctc

SEQ ID NO: 175296 - DNA, 25 bp, Homo sapien
ggccctccgaagtcgtctcttcttg

SEQ ID NO: 175297 - DNA, 25 bp, Homo sapien
ttgcagcccgttgctaagtggcgcc

SEQ ID NO: 175298 - DNA, 25 bp, Homo sapien
cctggaggccgatatccacatcgtc

SEQ ID NO: 175299 - DNA, 25 bp, Homo sapien
ctggccgacaagtgcctggatatga

SEQ ID NO: 175300 - DNA, 25 bp, Homo sapien
cttcgaaggatccacgcctcagtcg

SEQ ID NO: 175301 - DNA, 25 bp, Homo sapien
gccagaggccggcacttaccgttaa

SEQ ID NO: 175302 - DNA, 25 bp, Homo sapien
caaccgccggaatggtgagtacctt

SEQ ID NO: 175303 - DNA, 25 bp, Homo sapien
tcgcaccaccctgagggcggagaga

SEQ ID NO: 175304 - DNA, 25 bp, Homo sapien
gaatggtgagtacctttcgggccgc

SEQ ID NO: 175305 - DNA, 25 bp, Homo sapien
ggccctagcaaccagagcagtgaca

SEQ ID NO: 175306 - DNA, 25 bp, Homo sapien
agcgccgagaagtgcgcacgcgcac

SEQ ID NO: 175307 - DNA, 25 bp, Homo sapien
cggccgccacgcagtcccacaatgc

SEQ ID NO: 175308 - DNA, 25 bp, Homo sapien
gcttccgccgagagcgccgagaagt

SEQ ID NO: 175309 - DNA, 25 bp, Homo sapien
agcagtgacagtagcaaccgccgga

SEQ ID NO: 175310 - DNA, 25 bp, Homo sapien
aaactgtgccgaagtcgcggcggct

SEQ ID NO: 175311 - DNA, 25 bp, Homo sapien
tagccagagggagaaactgtgccga

SEQ ID NO: 175312 - DNA, 25 bp, Homo sapien
tccatggcaacggtgtcccagccgg

SEQ ID NO: 175313 - DNA, 25 bp, Homo sapien
ccgaggaccagaaacgaaggcagca

SEQ ID NO: 175314 - DNA, 25 bp, Homo sapien
gccatcttgcgtctgggtctgggtc

SEQ ID NO: 175315 - DNA, 25 bp, Homo sapien
acgctgaggcagtcacgcggccgtc

SEQ ID NO: 175316 - DNA, 25 bp, Homo sapien
gccgcgacgttactgctgcagtgga

SEQ ID NO: 175317 - DNA, 25 bp, Homo sapien
cgtaggtgcactcggagccgagctc

SEQ ID NO: 175318 - DNA, 25 bp, Homo sapien
ttcttctcctgctctgcgtggctct

SEQ ID NO: 175319 - DNA, 25 bp, Homo sapien
tggctcttcatatgcgcactgcggc

SEQ ID NO: 175320 - DNA, 25 bp, Homo sapien
gcactgcggctcttcaccttgtaaa

SEQ ID NO: 175321 - DNA, 25 bp, Homo sapien
ttgtaaaacaccctgcagccgggtg

SEQ ID NO: 175322 - DNA, 25 bp, Homo sapien
ggttgctcagaaccggcctagccca

SEQ ID NO: 175323 - DNA, 25 bp, Homo sapien
ggccagctcgcgtcattttccgaaa

SEQ ID NO: 175324 - DNA, 25 bp, Homo sapien
tagaaacccgctgagccaaccagaa

SEQ ID NO: 175325 - DNA, 25 bp, Homo sapien
ctgagccaaccagaaacgaggcgga

SEQ ID NO: 175326 - DNA, 25 bp, Homo sapien
catcggttgagctcacagcttgaaa

SEQ ID NO: 175327 - DNA, 25 bp, Homo sapien
ttgcacggctctgactcatcggttg

SEQ ID NO: 175328 - DNA, 25 bp, Homo sapien
cctgcgatgcagtgtcaggattgca

SEQ ID NO: 175329 - DNA, 25 bp, Homo sapien
gcctgcacgcactcccgattttaaa

SEQ ID NO: 175330 - DNA, 25 bp, Homo sapien
caggccgcagaagttcgagcgcagc

SEQ ID NO: 175331 - DNA, 25 bp, Homo sapien
cgcaagctgcgtagctgcacaaaca

SEQ ID NO: 175332 - DNA, 25 bp, Homo sapien
ggacaccacgtttctctccagcgga

SEQ ID NO: 175333 - DNA, 25 bp, Homo sapien
ctctggcgtgctacaaaggattgca

SEQ ID NO: 175334 - DNA, 25 bp, Homo sapien
agccgcgtcgtttccgcgccgaagt

SEQ ID NO: 175335 - DNA, 25 bp, Homo sapien
gaggtcatttcccagggaagcaccg

SEQ ID NO: 175336 - DNA, 25 bp, Homo sapien
gcgcagtcgtcacttcctcgcggag

SEQ ID NO: 175337 - DNA, 25 bp, Homo sapien
taactttgttgctctcgggacggcg

SEQ ID NO: 175338 - DNA, 25 bp, Homo sapien
gtcccgcggcaaagcggcgacaaca

SEQ ID NO: 175339 - DNA, 25 bp, Homo sapien
agcccttgctgtttgaagtcccgcg

SEQ ID NO: 175340 - DNA, 25 bp, Homo sapien
tacctcaggccaacggcgcctggag

SEQ ID NO: 175341 - DNA, 25 bp, Homo sapien
tgcggcccgcagactctaactttgt

SEQ ID NO: 175342 - DNA, 25 bp, Homo sapien
tcacgcgagatttcgttcacccggg

SEQ ID NO: 175343 - DNA, 25 bp, Homo sapien
ggtcgtgcagtacagcctctttccg

SEQ ID NO: 175344 - DNA, 25 bp, Homo sapien
ggaagaagactctcaaccagggtga

SEQ ID NO: 175345 - DNA, 25 bp, Homo sapien
accagggtgacttctaggcgtcctc

SEQ ID NO: 175346 - DNA, 25 bp, Homo sapien
acttctaggcgtcctcccggagcta

SEQ ID NO: 175347 - DNA, 25 bp, Homo sapien
agctaccggggacactggcgttatt

SEQ ID NO: 175348 - DNA, 25 bp, Homo sapien
ttcacccgggctccacagggtcagt

SEQ ID NO: 175349 - DNA, 25 bp, Homo sapien
cctctttccggcaaatcacgcgaga

SEQ ID NO: 175350 - DNA, 25 bp, Homo sapien
tgtacagtctcttcactcgccgata

SEQ ID NO: 175351 - DNA, 25 bp, Homo sapien
gacccggaagtatcgacctcaaaga

SEQ ID NO: 175352 - DNA, 25 bp, Homo sapien
gtttgtcaacttcgccactgccgca

SEQ ID NO: 175353 - DNA, 25 bp, Homo sapien
gacggtctgcctccgcccttattaa

SEQ ID NO: 175354 - DNA, 25 bp, Homo sapien
cggcggtttccaggacctcagactt

SEQ ID NO: 175355 - DNA, 25 bp, Homo sapien
cctcagactttttgccgaggcggca

SEQ ID NO: 175356 - DNA, 25 bp, Homo sapien
gacggttataatcctggcgggacca

SEQ ID NO: 175357 - DNA, 25 bp, Homo sapien
tgctgctatgcatgaccaaggctgg

SEQ ID NO: 175358 - DNA, 25 bp, Homo sapien
tgttttttcgggcttcgcggacata

SEQ ID NO: 175359 - DNA, 25 bp, Homo sapien
gaggaaaccgccctccttgggcatc

SEQ ID NO: 175360 - DNA, 25 bp, Homo sapien
tgcggcagccacacgacactgaggc

SEQ ID NO: 175361 - DNA, 25 bp, Homo sapien
agcacccttgacgtctgggtcccga

SEQ ID NO: 175362 - DNA, 25 bp, Homo sapien
ctccgctgatgggaaaaactactcc

SEQ ID NO: 175363 - DNA, 25 bp, Homo sapien
cgcggacataggagtcccgaaggcc

SEQ ID NO: 175364 - DNA, 25 bp, Homo sapien
gggtggcagtgacgtcaacgaatta

SEQ ID NO: 175365 - DNA, 25 bp, Homo sapien
ggccagtctgaagccctgcggcttt

SEQ ID NO: 175366 - DNA, 25 bp, Homo sapien
tgtgccttgggtaagcccttctcca

SEQ ID NO: 175367 - DNA, 25 bp, Homo sapien
tggcctattttctccgcgcatttta

SEQ ID NO: 175368 - DNA, 25 bp, Homo sapien
gcgcattttatttccggttctgagg

SEQ ID NO: 175369 - DNA, 25 bp, Homo sapien
ggcgcctcaacagacaccgtgtatg

SEQ ID NO: 175370 - DNA, 25 bp, Homo sapien
aatttctcaggtctcgcgacgcttc

SEQ ID NO: 175371 - DNA, 25 bp, Homo sapien
tccaggctactagtggccggaaacc

SEQ ID NO: 175372 - DNA, 25 bp, Homo sapien
agccctagcacgacttgcccaaaga

SEQ ID NO: 175373 - DNA, 25 bp, Homo sapien
gctctgctccggacgcactacgtag

SEQ ID NO: 175374 - DNA, 25 bp, Homo sapien
gggatttacagtacgcgctccagga

SEQ ID NO: 175375 - DNA, 25 bp, Homo sapien
gcatgggcaccttgcgggatttaca

SEQ ID NO: 175376 - DNA, 25 bp, Homo sapien
ggatcgtagctcaacattctccagg

SEQ ID NO: 175377 - DNA, 25 bp, Homo sapien
ccagcccagagaagtggaatctgca

SEQ ID NO: 175378 - DNA, 25 bp, Homo sapien
accgctcgggagctttccttagtga

SEQ ID NO: 175379 - DNA, 25 bp, Homo sapien
tgcctcgtacgtcgctaggatcgta

SEQ ID NO: 175380 - DNA, 25 bp, Homo sapien
cagagctttgatgatgcagagtccc

SEQ ID NO: 175381 - DNA, 25 bp, Homo sapien
ggccggccgtcaaaatacctccaga

SEQ ID NO: 175382 - DNA, 25 bp, Homo sapien
gtaaggagaagccacccgagagtcc

SEQ ID NO: 175383 - DNA, 25 bp, Homo sapien
tcgggaaagtcctcgactgcctatc

SEQ ID NO: 175384 - DNA, 25 bp, Homo sapien
aaacatttggcctgggacgtccgct

SEQ ID NO: 175385 - DNA, 25 bp, Homo sapien
gctggctgcactatcccttacagaa

SEQ ID NO: 175386 - DNA, 25 bp, Homo sapien
cggatcagcggggatctaagtctcc

SEQ ID NO: 175387 - DNA, 25 bp, Homo sapien
taagtctcctgaggcaagggcgccc

SEQ ID NO: 175388 - DNA, 25 bp, Homo sapien
tcccggttcccttggagacagagct

SEQ ID NO: 175389 - DNA, 25 bp, Homo sapien
ggaagtatcggccacacaggaccta

SEQ ID NO: 175390 - DNA, 25 bp, Homo sapien
aagatggcgtctcccacagacggta

SEQ ID NO: 175391 - DNA, 25 bp, Homo sapien
tgacttggacactccctaccgagca

SEQ ID NO: 175392 - DNA, 25 bp, Homo sapien
ctaccgagcacacggggaagacgcc

SEQ ID NO: 175393 - DNA, 25 bp, Homo sapien
cctaacctggaactccgattggcca

SEQ ID NO: 175394 - DNA, 25 bp, Homo sapien
agaattttgcagtcgctccacctca

SEQ ID NO: 175395 - DNA, 25 bp, Homo sapien
tccacctcaacatccgcgtaagggg

SEQ ID NO: 175396 - DNA, 25 bp, Homo sapien
gcgtggcttatggaacctcgttttc

SEQ ID NO: 175397 - DNA, 25 bp, Homo sapien
acgtcacgtgacatgggttggaaga

SEQ ID NO: 175398 - DNA, 25 bp, Homo sapien
gctccgacaagactggtcccttctt

SEQ ID NO: 175399 - DNA, 25 bp, Homo sapien
ctgcgaggctccgacaagactggtc

SEQ ID NO: 175400 - DNA, 25 bp, Homo sapien
cctttcacccgcctcgcaggggctg

SEQ ID NO: 175401 - DNA, 25 bp, Homo sapien
gaagtctcccgcttgcggcttcgct

SEQ ID NO: 175402 - DNA, 25 bp, Homo sapien
gcggcttcgctcaggcgctgccttt

SEQ ID NO: 175403 - DNA, 25 bp, Homo sapien
tgtcattaggccctaggcccgcagc

SEQ ID NO: 175404 - DNA, 25 bp, Homo sapien
ggtcccttcttgtcattaggcccta

SEQ ID NO: 175405 - DNA, 25 bp, Homo sapien
gccgggagcgtctccgaagtctccc

SEQ ID NO: 175406 - DNA, 25 bp, Homo sapien
ccgccttgcgaaaaggacggtgctc

SEQ ID NO: 175407 - DNA, 25 bp, Homo sapien
gctcgaacctccgattcctgtttga

SEQ ID NO: 175408 - DNA, 25 bp, Homo sapien
gggcctttgcctctcttacaacgaa

SEQ ID NO: 175409 - DNA, 25 bp, Homo sapien
cctggtgtccaaagttgtctgattc

SEQ ID NO: 175410 - DNA, 25 bp, Homo sapien
gtctgattcccaaatcccgcgctgg

SEQ ID NO: 175411 - DNA, 25 bp, Homo sapien
cgcgctggtcaactggggtttattt

SEQ ID NO: 175412 - DNA, 25 bp, Homo sapien
tctcccacgtaagcgccactatata

SEQ ID NO: 175413 - DNA, 25 bp, Homo sapien
actatatactggagcccggggacgc

SEQ ID NO: 175414 - DNA, 25 bp, Homo sapien
gcagccgctttaatttcccgtggta

SEQ ID NO: 175415 - DNA, 25 bp, Homo sapien
gtcagcggcgcgatgttaaacaggt

SEQ ID NO: 175416 - DNA, 25 bp, Homo sapien
agcgccagacggcaagcaatttttt

SEQ ID NO: 175417 - DNA, 25 bp, Homo sapien
gcctgaggcccatcgattcaaactg

SEQ ID NO: 175418 - DNA, 25 bp, Homo sapien
ttatttttcaatcagcccagggctg

SEQ ID NO: 175419 - DNA, 25 bp, Homo sapien
ttttgccgcctcctgaatagagctg

SEQ ID NO: 175420 - DNA, 25 bp, Homo sapien
taaaagctgatacctctgccgcggg

SEQ ID NO: 175421 - DNA, 25 bp, Homo sapien
agataaattacccaggcgctgccga

SEQ ID NO: 175422 - DNA, 25 bp, Homo sapien
accagagagtggactcggctgaccc

SEQ ID NO: 175423 - DNA, 25 bp, Homo sapien
gaccgacgtctctaaaagtaccaga

SEQ ID NO: 175424 - DNA, 25 bp, Homo sapien
tcccggaagcgaccgacgtctctaa

SEQ ID NO: 175425 - DNA, 25 bp, Homo sapien
cctctttctctcagaagtcacgggg

SEQ ID NO: 175426 - DNA, 25 bp, Homo sapien
ccggctaccacagagacggcgtttg

SEQ ID NO: 175427 - DNA, 25 bp, Homo sapien
ccctagttcagtactgggtagagtc

SEQ ID NO: 175428 - DNA, 25 bp, Homo sapien
cacggagggcaggaaagcccattcc

SEQ ID NO: 175429 - DNA, 25 bp, Homo sapien
ccatgacctgagacccgagggactc

SEQ ID NO: 175430 - DNA, 25 bp, Homo sapien
ccagcagcttctccaacgtgtggca

SEQ ID NO: 175431 - DNA, 25 bp, Homo sapien
cgcctctgtcctccagcggaacatc

SEQ ID NO: 175432 - DNA, 25 bp, Homo sapien
aggccatcttcgatgccgacgtcaa

SEQ ID NO: 175433 - DNA, 25 bp, Homo sapien
tgccgacgtcaaggcctcctgtttc

SEQ ID NO: 175434 - DNA, 25 bp, Homo sapien
gcacttgtatgctctcgcctctgtc

SEQ ID NO: 175435 - DNA, 25 bp, Homo sapien
aagatccggccctacttcaaccgtg

SEQ ID NO: 175436 - DNA, 25 bp, Homo sapien
caacgtgtggcacttgtatgctctc

SEQ ID NO: 175437 - DNA, 25 bp, Homo sapien
cgccacgctggaggccatcttcgat

SEQ ID NO: 175438 - DNA, 25 bp, Homo sapien
ctccgcgccgacttgggagagcagc

SEQ ID NO: 175439 - DNA, 25 bp, Homo sapien
ctcgcggtcgcggtggaactcccag

SEQ ID NO: 175440 - DNA, 25 bp, Homo sapien
aagtgcaagccttggcggagcgcaa

SEQ ID NO: 175441 - DNA, 25 bp, Homo sapien
tcccttccacgctccggaatcagcc

SEQ ID NO: 175442 - DNA, 25 bp, Homo sapien
gaatcagcccaccaggcactccgga

SEQ ID NO: 175443 - DNA, 25 bp, Homo sapien
ctggaacccgcgtacccgcttcctg

SEQ ID NO: 175444 - DNA, 25 bp, Homo sapien
tggagccgagccctctttcccagcc

SEQ ID NO: 175445 - DNA, 25 bp, Homo sapien
cccgctccgtgcctagctctgcgct

SEQ ID NO: 175446 - DNA, 25 bp, Homo sapien
gtcctcgcttgcctttgtcgtgggc

SEQ ID NO: 175447 - DNA, 25 bp, Homo sapien
aggtcctcgcttgcctttgtcgtgg

SEQ ID NO: 175448 - DNA, 25 bp, Homo sapien
agggacggcagtccttctgtgctgt

SEQ ID NO: 175449 - DNA, 25 bp, Homo sapien
ctgcagtccaccacgcacgagaccc

SEQ ID NO: 175450 - DNA, 25 bp, Homo sapien
ggcctgcagtccaccacgcacgaga

SEQ ID NO: 175451 - DNA, 25 bp, Homo sapien
ggtcacctcggcctgcagtccacca

SEQ ID NO: 175452 - DNA, 25 bp, Homo sapien
tcgcttgcctttgtcgtgggcgcag

SEQ ID NO: 175453 - DNA, 25 bp, Homo sapien
ctcgcttgcctttgtcgtgggcgca

SEQ ID NO: 175454 - DNA, 25 bp, Homo sapien
ctctgacgactcagttcacaggcgg

SEQ ID NO: 175455 - DNA, 25 bp, Homo sapien
agtagtccattctccctaggctccg

SEQ ID NO: 175456 - DNA, 25 bp, Homo sapien
ccggcctcttccagcgagctagtgt

SEQ ID NO: 175457 - DNA, 25 bp, Homo sapien
ttccagcgagctagtgtgagcgcca

SEQ ID NO: 175458 - DNA, 25 bp, Homo sapien
tgagaagggtacgtaggcgaccaca

SEQ ID NO: 175459 - DNA, 25 bp, Homo sapien
tgaaaataaaatctggcggcggctc

SEQ ID NO: 175460 - DNA, 25 bp, Homo sapien
ctcgcctcaatctagcttgctagta

SEQ ID NO: 175461 - DNA, 25 bp, Homo sapien
ggcgaccacaaatatgcctgattga

SEQ ID NO: 175462 - DNA, 25 bp, Homo sapien
gatcgatccattgccgggtctctca

SEQ ID NO: 175463 - DNA, 25 bp, Homo sapien
tggccgcatagacttcaccgtagta

SEQ ID NO: 175464 - DNA, 25 bp, Homo sapien
acgacacgcttggtacgagatgacc

SEQ ID NO: 175465 - DNA, 25 bp, Homo sapien
acgttccgctgactttctgtggggc

SEQ ID NO: 175466 - DNA, 25 bp, Homo sapien
gcttgaatcgttccgcttgcctgtg

SEQ ID NO: 175467 - DNA, 25 bp, Homo sapien
gcggctttcaagatccgggcagaaa

SEQ ID NO: 175468 - DNA, 25 bp, Homo sapien
ggcgtctgtcctcttgcgaccgaca

SEQ ID NO: 175469 - DNA, 25 bp, Homo sapien
ccgatagcggattcttcgaggcgtc

SEQ ID NO: 175470 - DNA, 25 bp, Homo sapien
cccgcactacccaataggcatgttg

SEQ ID NO: 175471 - DNA, 25 bp, Homo sapien
cgcagtccttgaactgcaccggttc

SEQ ID NO: 175472 - DNA, 25 bp, Homo sapien
gctgccaggaaacgcatcgcggata

SEQ ID NO: 175473 - DNA, 25 bp, Homo sapien
tcgcggataacgaagttccaagctc

SEQ ID NO: 175474 - DNA, 25 bp, Homo sapien
gcccgcggtcacaagacaaacctgt

SEQ ID NO: 175475 - DNA, 25 bp, Homo sapien
tggttctgcgcctctaggacaaatg

SEQ ID NO: 175476 - DNA, 25 bp, Homo sapien
tggagcattcctagccaatcagaca

SEQ ID NO: 175477 - DNA, 25 bp, Homo sapien
ccagtcaggcgacctgtcaccagta

SEQ ID NO: 175478 - DNA, 25 bp, Homo sapien
agttctgggggtcaaattcctcatc

SEQ ID NO: 175479 - DNA, 25 bp, Homo sapien
aacgctcggcccagcgtcgaggtgc

SEQ ID NO: 175480 - DNA, 25 bp, Homo sapien
ctcctgcgcaggttgggtgaacgct

SEQ ID NO: 175481 - DNA, 25 bp, Homo sapien
ccggttctggcacggcggctcgcaa

SEQ ID NO: 175482 - DNA, 25 bp, Homo sapien
cgcagcgggctccacggaaaccaga

SEQ ID NO: 175483 - DNA, 25 bp, Homo sapien
ttcctcatcgggaatgacctcctcg

SEQ ID NO: 175484 - DNA, 25 bp, Homo sapien
atcgggaatgacctcctcgcagcgg

SEQ ID NO: 175485 - DNA, 25 bp, Homo sapien
cgtcgaggtgccagcctggagttct

SEQ ID NO: 175486 - DNA, 25 bp, Homo sapien
ctgccttcaactcttcgaaagcgga

SEQ ID NO: 175487 - DNA, 25 bp, Homo sapien
ccgcgcccacgaagagagccagggt

SEQ ID NO: 175488 - DNA, 25 bp, Homo sapien
agccggctcgtatctccctacgggg

SEQ ID NO: 175489 - DNA, 25 bp, Homo sapien
acagactgtacaccttggctgcagc

SEQ ID NO: 175490 - DNA, 25 bp, Homo sapien
tcctgctcccggaacagactgtaca

SEQ ID NO: 175491 - DNA, 25 bp, Homo sapien
cgaaagcggatcaaatcttccaatc

SEQ ID NO: 175492 - DNA, 25 bp, Homo sapien
tgtttcccgaagtactaaagacaga

SEQ ID NO: 175493 - DNA, 25 bp, Homo sapien
accgcgaagagctttgtggtcggca

SEQ ID NO: 175494 - DNA, 25 bp, Homo sapien
cgcttccgggctatcctttgccgga

SEQ ID NO: 175495 - DNA, 25 bp, Homo sapien
agcactcagcagaagacgggctccc

SEQ ID NO: 175496 - DNA, 25 bp, Homo sapien
ttgcagcgcgacgaagttccacctc

SEQ ID NO: 175497 - DNA, 25 bp, Homo sapien
cggcagcactcagcagaagacgggc

SEQ ID NO: 175498 - DNA, 25 bp, Homo sapien
tgaatgacgtagaagtattgcgccg

SEQ ID NO: 175499 - DNA, 25 bp, Homo sapien
ccggaagcagtatgtgaatgacgta

SEQ ID NO: 175500 - DNA, 25 bp, Homo sapien
gggctatcctttgccggaagcagta

SEQ ID NO: 175501 - DNA, 25 bp, Homo sapien
aagtattgcgccgttggtgattacg

SEQ ID NO: 175502 - DNA, 25 bp, Homo sapien
ggaccgctctatctcgcctttgttc

SEQ ID NO: 175503 - DNA, 25 bp, Homo sapien
gcgaacagcacttggcgcagctcca

SEQ ID NO: 175504 - DNA, 25 bp, Homo sapien
tttcgatatgtacccgaattggggc

SEQ ID NO: 175505 - DNA, 25 bp, Homo sapien
gccctgcgccttctttttcgatatg

SEQ ID NO: 175506 - DNA, 25 bp, Homo sapien
cgggcttcatgagcttccgcgaaca

SEQ ID NO: 175507 - DNA, 25 bp, Homo sapien
ttctcctctcggtggttactgcgca

SEQ ID NO: 175508 - DNA, 25 bp, Homo sapien
agtcgccaagtaaaggaccgctcta

SEQ ID NO: 175509 - DNA, 25 bp, Homo sapien
ctgcgcagacgtagtcgcccaagtc

SEQ ID NO: 175510 - DNA, 25 bp, Homo sapien
tccggttgttgtccggccctatatc

SEQ ID NO: 175511 - DNA, 25 bp, Homo sapien
tgcggggaacgtttcctgctgtacc

SEQ ID NO: 175512 - DNA, 25 bp, Homo sapien
tcgggaccgttttgcggagcccagc

SEQ ID NO: 175513 - DNA, 25 bp, Homo sapien
cgcccgtccagatacttgactcaga

SEQ ID NO: 175514 - DNA, 25 bp, Homo sapien
tgtccggccctatatccggtgtccg

SEQ ID NO: 175515 - DNA, 25 bp, Homo sapien
tgatgctgtcccgatcccgctgtgt

SEQ ID NO: 175516 - DNA, 25 bp, Homo sapien
tcccgctgtgtgtctcgggcgttca

SEQ ID NO: 175517 - DNA, 25 bp, Homo sapien
tccgccttccagaaggtacggtctg

SEQ ID NO: 175518 - DNA, 25 bp, Homo sapien
cggatgagctcatacttgagcctta

SEQ ID NO: 175519 - DNA, 25 bp, Homo sapien
agaaagcggcgcgtgcaacccacgg

SEQ ID NO: 175520 - DNA, 25 bp, Homo sapien
cagccgcaaggtgcacggtcccagg

SEQ ID NO: 175521 - DNA, 25 bp, Homo sapien
taaagccgcaaggtctgcacggctg

SEQ ID NO: 175522 - DNA, 25 bp, Homo sapien
cggccattggctgcggatgagctca

SEQ ID NO: 175523 - DNA, 25 bp, Homo sapien
tgagccttagaataaaccaccaatc

SEQ ID NO: 175524 - DNA, 25 bp, Homo sapien
gccggccttaaagccgcaaggtctg

SEQ ID NO: 175525 - DNA, 25 bp, Homo sapien
tgctttccggcatccagcgtgcggg

SEQ ID NO: 175526 - DNA, 25 bp, Homo sapien
accgcagacgaggttcccgagccga

SEQ ID NO: 175527 - DNA, 25 bp, Homo sapien
cggccgtccgtcgatgcagtttcct

SEQ ID NO: 175528 - DNA, 25 bp, Homo sapien
gatgcagtttcctccgcagacagca

SEQ ID NO: 175529 - DNA, 25 bp, Homo sapien
gacagcagctcccttctgagactgc

SEQ ID NO: 175530 - DNA, 25 bp, Homo sapien
gtggttcgagcatcttctggaagcc

SEQ ID NO: 175531 - DNA, 25 bp, Homo sapien
agcagctcccttctgagactgcagc

SEQ ID NO: 175532 - DNA, 25 bp, Homo sapien
agccttgcggagtcaggagcccgta

SEQ ID NO: 175533 - DNA, 25 bp, Homo sapien
catcttctggaagccttgcggagtc

SEQ ID NO: 175534 - DNA, 25 bp, Homo sapien
tggctgcgaggccaattactgcggc

SEQ ID NO: 175535 - DNA, 25 bp, Homo sapien
tactgcggccttaatcaccacggtg

SEQ ID NO: 175536 - DNA, 25 bp, Homo sapien
tcatcagtctccttcctggggcgtc

SEQ ID NO: 175537 - DNA, 25 bp, Homo sapien
tgtctgctcatcagtctccttcctg

SEQ ID NO: 175538 - DNA, 25 bp, Homo sapien
aggagcttgaaactggatcccaaca

SEQ ID NO: 175539 - DNA, 25 bp, Homo sapien
ccgatggccgccgtccagggaaacg

SEQ ID NO: 175540 - DNA, 25 bp, Homo sapien
gcgcggcgttaacaactgtctgctc

SEQ ID NO: 175541 - DNA, 25 bp, Homo sapien
ctcctcgaaggagcttgaaactgga

SEQ ID NO: 175542 - DNA, 25 bp, Homo sapien
gttacttccgttcaccgtcggctga

SEQ ID NO: 175543 - DNA, 25 bp, Homo sapien
cgcgtagagacttgctgctcccata

SEQ ID NO: 175544 - DNA, 25 bp, Homo sapien
agaaaggccgcttccgatcctccag

SEQ ID NO: 175545 - DNA, 25 bp, Homo sapien
gcggacgcccggttataactgaaca

SEQ ID NO: 175546 - DNA, 25 bp, Homo sapien
gtagccggcttccactcaaacttga

SEQ ID NO: 175547 - DNA, 25 bp, Homo sapien
gttgtcagagaggatcgagagcttc

SEQ ID NO: 175548 - DNA, 25 bp, Homo sapien
tcgagagcttcgtggagaccctgaa

SEQ ID NO: 175549 - DNA, 25 bp, Homo sapien
ttgctgcgccagatcatcacggacc

SEQ ID NO: 175550 - DNA, 25 bp, Homo sapien
aatccacaattttatgctgcctttg

SEQ ID NO: 175551 - DNA, 25 bp, Homo sapien
caagtgttcagtgaggtgtgccgca

SEQ ID NO: 175552 - DNA, 25 bp, Homo sapien
ctgtgcccgccgtaatttgtttatc

SEQ ID NO: 175553 - DNA, 25 bp, Homo sapien
tctgtccaaagattatgcagttgaa

SEQ ID NO: 175554 - DNA, 25 bp, Homo sapien
tttgtaaattaccacgctgcgtttg

SEQ ID NO: 175555 - DNA, 25 bp, Homo sapien
ggagcctcggtgacaagtgttcagt

SEQ ID NO: 175556 - DNA, 25 bp, Homo sapien
cgctgcgtttgatgaatgtttctcc

SEQ ID NO: 175557 - DNA, 25 bp, Homo sapien
cgccgtaatttgtttatctgtccaa

SEQ ID NO: 175558 - DNA, 25 bp, Homo sapien
tacccgggtctttgtcgcgatggta

SEQ ID NO: 175559 - DNA, 25 bp, Homo sapien
tccctcttgagtccttctgagatga

SEQ ID NO: 175560 - DNA, 25 bp, Homo sapien
ggacgcaggcgtgcaaatctgtctc

SEQ ID NO: 175561 - DNA, 25 bp, Homo sapien
gtgagcgccaccttgaactcggttc

SEQ ID NO: 175562 - DNA, 25 bp, Homo sapien
ccaggcttgcaaagtgacggtcatt

SEQ ID NO: 175563 - DNA, 25 bp, Homo sapien
ggcgggaataagtaccagaccattg

SEQ ID NO: 175564 - DNA, 25 bp, Homo sapien
ggagcatttggtaaccctgcatttg

SEQ ID NO: 175565 - DNA, 25 bp, Homo sapien
cactgatgagtactgcgctagtccc

SEQ ID NO: 175566 - DNA, 25 bp, Homo sapien
gggttacctgtgtctccgatgatga

SEQ ID NO: 175567 - DNA, 25 bp, Homo sapien
cacccaatttgggagcttcgaatgc

SEQ ID NO: 175568 - DNA, 25 bp, Homo sapien
gcataagtcatggtgtcgcgtcctc

SEQ ID NO: 175569 - DNA, 25 bp, Homo sapien
tcatccttaggtcgggagtacccta

SEQ ID NO: 175570 - DNA, 25 bp, Homo sapien
gggacgcttctagcacttctacatg

SEQ ID NO: 175571 - DNA, 25 bp, Homo sapien
cggcgctccttccaatcagcagaga

SEQ ID NO: 175572 - DNA, 25 bp, Homo sapien
tgtcagggtcaaaagccatcgctcc

SEQ ID NO: 175573 - DNA, 25 bp, Homo sapien
tccttgcggaagtgacggcagttcc

SEQ ID NO: 175574 - DNA, 25 bp, Homo sapien
atccggctccgaaagctgcgcgcag

SEQ ID NO: 175575 - DNA, 25 bp, Homo sapien
cccggcatcatcttttcgtcgcgtg

SEQ ID NO: 175576 - DNA, 25 bp, Homo sapien
cggcagcaactgacgggtaaacgtt

SEQ ID NO: 175577 - DNA, 25 bp, Homo sapien
cctggagtcccgcttaacaaattct

SEQ ID NO: 175578 - DNA, 25 bp, Homo sapien
gcccttctggtgttagaagagaccc

SEQ ID NO: 175579 - DNA, 25 bp, Homo sapien
gcagccatcatcagggcccttctgg

SEQ ID NO: 175580 - DNA, 25 bp, Homo sapien
ccaatgatttcctgatgacgcctcc

SEQ ID NO: 175581 - DNA, 25 bp, Homo sapien
cgacgcgcgcaccttggatcttgag

SEQ ID NO: 175582 - DNA, 25 bp, Homo sapien
atactgcgtagcaaaaacgttggca

SEQ ID NO: 175583 - DNA, 25 bp, Homo sapien
gccggacactgactgggtcaagtga

SEQ ID NO: 175584 - DNA, 25 bp, Homo sapien
acgccggcatcctgcggcggaagca

SEQ ID NO: 175585 - DNA, 25 bp, Homo sapien
ctgggagcgtcgttctcagaaaagt

SEQ ID NO: 175586 - DNA, 25 bp, Homo sapien
ttccaaagccttggcgaggacaagc

SEQ ID NO: 175587 - DNA, 25 bp, Homo sapien
cgttggcagcaagttccaaagcctt

SEQ ID NO: 175588 - DNA, 25 bp, Homo sapien
tccaggcaccgggaataacagaagc

SEQ ID NO: 175589 - DNA, 25 bp, Homo sapien
gcgccagtgcctcggtttccaggca

SEQ ID NO: 175590 - DNA, 25 bp, Homo sapien
cgtgggcgcctaaagcactaagctc

SEQ ID NO: 175591 - DNA, 25 bp, Homo sapien
actaagctcacgacgctgggaaagc

SEQ ID NO: 175592 - DNA, 25 bp, Homo sapien
ctcgctcccaaagtccgagttgatg

SEQ ID NO: 175593 - DNA, 25 bp, Homo sapien
tggaatcgcagtgtcgctcgtactc

SEQ ID NO: 175594 - DNA, 25 bp, Homo sapien
cccgacccggaaacagttctctgtg

SEQ ID NO: 175595 - DNA, 25 bp, Homo sapien
tgcttaccctcttggctagtctagc

SEQ ID NO: 175596 - DNA, 25 bp, Homo sapien
gcctgcaaagtgaggcctcgggcta

SEQ ID NO: 175597 - DNA, 25 bp, Homo sapien
acaagggcatcactgacggtacggc

SEQ ID NO: 175598 - DNA, 25 bp, Homo sapien
ccagactggtcggagatctcgtacg

SEQ ID NO: 175599 - DNA, 25 bp, Homo sapien
ctggagactcgttcaccaccgaagg

SEQ ID NO: 175600 - DNA, 25 bp, Homo sapien
gcaaggaccaatctggggccgagca

SEQ ID NO: 175601 - DNA, 25 bp, Homo sapien
gcacttgcgagagttaatgggcaga

SEQ ID NO: 175602 - DNA, 25 bp, Homo sapien
aatctcctcacggaggcacttgcga

SEQ ID NO: 175603 - DNA, 25 bp, Homo sapien
cgcccaatgccgcaccttgaggtgg

SEQ ID NO: 175604 - DNA, 25 bp, Homo sapien
tcgtacgcgccagtcactagcaggt

SEQ ID NO: 175605 - DNA, 25 bp, Homo sapien
ctagcaggtccttgtgaatctcctc

SEQ ID NO: 175606 - DNA, 25 bp, Homo sapien
atgggaacgtcaggcggccaaacac

SEQ ID NO: 175607 - DNA, 25 bp, Homo sapien
ttccgtctccatgggaacgtcaggc

SEQ ID NO: 175608 - DNA, 25 bp, Homo sapien
ggtgtgtaacgttcttccgtctcca

SEQ ID NO: 175609 - DNA, 25 bp, Homo sapien
agacgtcaacgtcgccagtgtttgg

SEQ ID NO: 175610 - DNA, 25 bp, Homo sapien
tccatggatataatgcatagacgtc

SEQ ID NO: 175611 - DNA, 25 bp, Homo sapien
gtttactctgtcgtctccatggata

SEQ ID NO: 175612 - DNA, 25 bp, Homo sapien
ttcgctcctggcgtccagcacgtga

SEQ ID NO: 175613 - DNA, 25 bp, Homo sapien
cttccaaaggcggagcttcgtctcc

SEQ ID NO: 175614 - DNA, 25 bp, Homo sapien
ggtctgcttccacgctttgcactga

SEQ ID NO: 175615 - DNA, 25 bp, Homo sapien
ggtcctgtactcgatgccgtttctc

SEQ ID NO: 175616 - DNA, 25 bp, Homo sapien
ttctcgggcttcaacgcagactacg

SEQ ID NO: 175617 - DNA, 25 bp, Homo sapien
cggctttgcctaaccgccacgatga

SEQ ID NO: 175618 - DNA, 25 bp, Homo sapien
gttgagcccgtgacgtttacactca

SEQ ID NO: 175619 - DNA, 25 bp, Homo sapien
tgctcacgagattaggacacgcgcc

SEQ ID NO: 175620 - DNA, 25 bp, Homo sapien
ctgcgtcagcaggtttccacggcct

SEQ ID NO: 175621 - DNA, 25 bp, Homo sapien
aaccaggtgcgaatgttctctctca

SEQ ID NO: 175622 - DNA, 25 bp, Homo sapien
ttccgctctgcccatatttggctca

SEQ ID NO: 175623 - DNA, 25 bp, Homo sapien
ggcgaaggctccgagccacgagacc

SEQ ID NO: 175624 - DNA, 25 bp, Homo sapien
caggagctcgcgagtcctctgttta

SEQ ID NO: 175625 - DNA, 25 bp, Homo sapien
gtcggccaggccaaggtttctcctg

SEQ ID NO: 175626 - DNA, 25 bp, Homo sapien
tttccacggtgacacgtaggcgccg

SEQ ID NO: 175627 - DNA, 25 bp, Homo sapien
atatttggctcagccactgcgccgc

SEQ ID NO: 175628 - DNA, 25 bp, Homo sapien
ccctggaatgctgggcgaaggctcc

SEQ ID NO: 175629 - DNA, 25 bp, Homo sapien
ctctgtttactgtttggtttccacg

SEQ ID NO: 175630 - DNA, 25 bp, Homo sapien
ccgtccgtttgcagggaggtgctct

SEQ ID NO: 175631 - DNA, 25 bp, Homo sapien
ggggtgcgcttacataaccgctcgc

SEQ ID NO: 175632 - DNA, 25 bp, Homo sapien
tcctgctttctcgagcgctcctgca

SEQ ID NO: 175633 - DNA, 25 bp, Homo sapien
ggactgcatggaacccgggacgccc

SEQ ID NO: 175634 - DNA, 25 bp, Homo sapien
cctctgacgtctggagctggcagct

SEQ ID NO: 175635 - DNA, 25 bp, Homo sapien
ccgctatatagccggggctgatgca

SEQ ID NO: 175636 - DNA, 25 bp, Homo sapien
cagcctgaggcttccttttggttcc

SEQ ID NO: 175637 - DNA, 25 bp, Homo sapien
tggacagccggggtgctccctcctt

SEQ ID NO: 175638 - DNA, 25 bp, Homo sapien
acagactgtggcagagctgcgccca

SEQ ID NO: 175639 - DNA, 25 bp, Homo sapien
cagaggcctggacaaggagtgaaca

SEQ ID NO: 175640 - DNA, 25 bp, Homo sapien
tgaacacgggaactgtcacgactgg

SEQ ID NO: 175641 - DNA, 25 bp, Homo sapien
cagccctgagcttccgatgcgggga

SEQ ID NO: 175642 - DNA, 25 bp, Homo sapien
ctgaagtacttcacgtcggtgctga

SEQ ID NO: 175643 - DNA, 25 bp, Homo sapien
gatcaagcagctcacagaggaactg

SEQ ID NO: 175644 - DNA, 25 bp, Homo sapien
cgcggctctacgcaaggagatcaag

SEQ ID NO: 175645 - DNA, 25 bp, Homo sapien
aggtggtgtacagcgcccacgcatt

SEQ ID NO: 175646 - DNA, 25 bp, Homo sapien
gttaacccaatgtttctgccttgca

SEQ ID NO: 175647 - DNA, 25 bp, Homo sapien
cctctatgatctgtagaactataca

SEQ ID NO: 175648 - DNA, 25 bp, Homo sapien
caattatgtgccacacattttgaga

SEQ ID NO: 175649 - DNA, 25 bp, Homo sapien
gtcaaactataagaatttatcgccc

SEQ ID NO: 175650 - DNA, 25 bp, Homo sapien
gggaatgagcagtcagaatatttta

SEQ ID NO: 175651 - DNA, 25 bp, Homo sapien
gaactatacattttgcagaggcatc

SEQ ID NO: 175652 - DNA, 25 bp, Homo sapien
ctgccttgcacttaattgagatatt

SEQ ID NO: 175653 - DNA, 25 bp, Homo sapien
aattgagatattttgggaatgagca

SEQ ID NO: 175654 - DNA, 25 bp, Homo sapien
gacaggcaccggagaggctctattt

SEQ ID NO: 175655 - DNA, 25 bp, Homo sapien
aggctctattttgggcattacttcg

SEQ ID NO: 175656 - DNA, 25 bp, Homo sapien
cattacttcgggaaggcggatcttc

SEQ ID NO: 175657 - DNA, 25 bp, Homo sapien
gatcttcttgcagggtccgctgata

SEQ ID NO: 175658 - DNA, 25 bp, Homo sapien
ggaggaatgcatcccgcaagctgtg

SEQ ID NO: 175659 - DNA, 25 bp, Homo sapien
agctgtggcgaaacaactgctctgc

SEQ ID NO: 175660 - DNA, 25 bp, Homo sapien
tcgagaaggcaagagacactgggtc

SEQ ID NO: 175661 - DNA, 25 bp, Homo sapien
tggctgcgcaaggagagaacttttc

SEQ ID NO: 175662 - DNA, 25 bp, Homo sapien
cggtgtcgcgctttcttggaagcta

SEQ ID NO: 175663 - DNA, 25 bp, Homo sapien
cgcgcatgcggccatgttgaatatt

SEQ ID NO: 175664 - DNA, 25 bp, Homo sapien
cggccatgttgcttatagacgcgca

SEQ ID NO: 175665 - DNA, 25 bp, Homo sapien
ctcaagcgtccgtccggtaaaagtg

SEQ ID NO: 175666 - DNA, 25 bp, Homo sapien
agagcggccggtatagtcctcatac

SEQ ID NO: 175667 - DNA, 25 bp, Homo sapien
gagctttttctctagggatcccgcc

SEQ ID NO: 175668 - DNA, 25 bp, Homo sapien
ggaggaaccgcgaactacttgcaga

SEQ ID NO: 175669 - DNA, 25 bp, Homo sapien
ctctctcatgcttccggacacagtg

SEQ ID NO: 175670 - DNA, 25 bp, Homo sapien
cctcctgttggacctagcggaactc

SEQ ID NO: 175671 - DNA, 25 bp, Homo sapien
ttggagtcaacctcttaggggcgga

SEQ ID NO: 175672 - DNA, 25 bp, Homo sapien
agaagactcccttcagctgagggca

SEQ ID NO: 175673 - DNA, 25 bp, Homo sapien
ccgcagctgagcgttatgagcgcct

SEQ ID NO: 175674 - DNA, 25 bp, Homo sapien
ttgttgtagtaaccggggaagcagc

SEQ ID NO: 175675 - DNA, 25 bp, Homo sapien
cccgaaccatgggaagatgagacag

SEQ ID NO: 175676 - DNA, 25 bp, Homo sapien
ttccctaccctagggaggagcattc

SEQ ID NO: 175677 - DNA, 25 bp, Homo sapien
tgagacaggtaaacgcctgcgcccg

SEQ ID NO: 175678 - DNA, 25 bp, Homo sapien
tcttcattgacaagatcggagtcgg

SEQ ID NO: 175679 - DNA, 25 bp, Homo sapien
cgatcctggcccgattcttcattga

SEQ ID NO: 175680 - DNA, 25 bp, Homo sapien
atgccagcctcgcagaggggactcc

SEQ ID NO: 175681 - DNA, 25 bp, Homo sapien
ttccggaagatcgagggtgccctct

SEQ ID NO: 175682 - DNA, 25 bp, Homo sapien
ctgcggtagagagcgagaaaaacaa

SEQ ID NO: 175683 - DNA, 25 bp, Homo sapien
tccggagccgctctcgcagaaatgt

SEQ ID NO: 175684 - DNA, 25 bp, Homo sapien
ttggcccgagcccatttcccagatg

SEQ ID NO: 175685 - DNA, 25 bp, Homo sapien
ggctctgtgctttcgctcctcttct

SEQ ID NO: 175686 - DNA, 25 bp, Homo sapien
ccagaacagatcgatcacagggtga

SEQ ID NO: 175687 - DNA, 25 bp, Homo sapien
tccgagcctttctccgttttctaga

SEQ ID NO: 175688 - DNA, 25 bp, Homo sapien
cccgacttctctgaggcgactcagg

SEQ ID NO: 175689 - DNA, 25 bp, Homo sapien
gctacctccgtgaggaccaattcgg

SEQ ID NO: 175690 - DNA, 25 bp, Homo sapien
tcgctacagcttggctacctccgtg

SEQ ID NO: 175691 - DNA, 25 bp, Homo sapien
cttggacgaggagcttcgctacagc

SEQ ID NO: 175692 - DNA, 25 bp, Homo sapien
cggtttccaggaagtgacgtcaggc

SEQ ID NO: 175693 - DNA, 25 bp, Homo sapien
tggaggatttgctcgacttggacga

SEQ ID NO: 175694 - DNA, 25 bp, Homo sapien
ctgatagagtcagcctcgcagaggc

SEQ ID NO: 175695 - DNA, 25 bp, Homo sapien
gcggtctgatctacagtgacgagta

SEQ ID NO: 175696 - DNA, 25 bp, Homo sapien
gtgacgagtaccaatgttaactgtc

SEQ ID NO: 175697 - DNA, 25 bp, Homo sapien
gttaactgtcacctctcatctccaa

SEQ ID NO: 175698 - DNA, 25 bp, Homo sapien
ctaaatcacacctggaattggagga

SEQ ID NO: 175699 - DNA, 25 bp, Homo sapien
tcgcagaggcgacaagtcaatcagc

SEQ ID NO: 175700 - DNA, 25 bp, Homo sapien
acaagtcaatcagcgcggagatgcc

SEQ ID NO: 175701 - DNA, 25 bp, Homo sapien
gacagcgtgactgcggtctgatcta

SEQ ID NO: 175702 - DNA, 25 bp, Homo sapien
tccatgctgccgctggcataataaa

SEQ ID NO: 175703 - DNA, 25 bp, Homo sapien
taatgccgcgacaggcgcctcttac

SEQ ID NO: 175704 - DNA, 25 bp, Homo sapien
ctgacccgtgtattaggggcctgta

SEQ ID NO: 175705 - DNA, 25 bp, Homo sapien
aagtgccggcggcatagaccatctc

SEQ ID NO: 175706 - DNA, 25 bp, Homo sapien
cgctgccagcttcattattcgctta

SEQ ID NO: 175707 - DNA, 25 bp, Homo sapien
aatgaagcgatatctcctcagcgga

SEQ ID NO: 175708 - DNA, 25 bp, Homo sapien
ttattcgcttaagttgccggagaga

SEQ ID NO: 175709 - DNA, 25 bp, Homo sapien
gccggagagaattacttaaccctga

SEQ ID NO: 175710 - DNA, 25 bp, Homo sapien
tagcgcctgtgaaaaggcctagctc

SEQ ID NO: 175711 - DNA, 25 bp, Homo sapien
ccgacgttaatgaagccgcggcgcg

SEQ ID NO: 175712 - DNA, 25 bp, Homo sapien
gcgccgctgaaaggccgacgttaat

SEQ ID NO: 175713 - DNA, 25 bp, Homo sapien
aaaggcctagctctgatatgcgcgc

SEQ ID NO: 175714 - DNA, 25 bp, Homo sapien
ggaaggctccaaattgctaattagc

SEQ ID NO: 175715 - DNA, 25 bp, Homo sapien
tcccacttgttagattgaaggcgcc

SEQ ID NO: 175716 - DNA, 25 bp, Homo sapien
agaaaaaagggagcgcagcgccgtt

SEQ ID NO: 175717 - DNA, 25 bp, Homo sapien
agcgccgttcccacttgttagattg

SEQ ID NO: 175718 - DNA, 25 bp, Homo sapien
tcaggggcccaatcgtgcagccagc

SEQ ID NO: 175719 - DNA, 25 bp, Homo sapien
aagcactgggtcaggggcccaatcg

SEQ ID NO: 175720 - DNA, 25 bp, Homo sapien
ctccggcccagaccggaaatgaggt

SEQ ID NO: 175721 - DNA, 25 bp, Homo sapien
tgagagtcggcccaaaaagcggcgg

SEQ ID NO: 175722 - DNA, 25 bp, Homo sapien
gaatgggttgagagtgttggggtcc

SEQ ID NO: 175723 - DNA, 25 bp, Homo sapien
gtaccagaggggatcggagcgccaa

SEQ ID NO: 175724 - DNA, 25 bp, Homo sapien
gcggctgagcggctaagggcgtctt

SEQ ID NO: 175725 - DNA, 25 bp, Homo sapien
cccagaccggaaatgaggtcagaga

SEQ ID NO: 175726 - DNA, 25 bp, Homo sapien
gcctctctcacgagcgtgccattgt

SEQ ID NO: 175727 - DNA, 25 bp, Homo sapien
ggttgctctgagctagctgattgga

SEQ ID NO: 175728 - DNA, 25 bp, Homo sapien
ttgctcttgtgagaaaagctgcctc

SEQ ID NO: 175729 - DNA, 25 bp, Homo sapien
tgaggcaccctagaccttggctttc

SEQ ID NO: 175730 - DNA, 25 bp, Homo sapien
gctgattggaaagccctaaccctcg

SEQ ID NO: 175731 - DNA, 25 bp, Homo sapien
ataacatctggctttctggtgagga

SEQ ID NO: 175732 - DNA, 25 bp, Homo sapien
ctggtgaggattggataacagtgcc

SEQ ID NO: 175733 - DNA, 25 bp, Homo sapien
gagagtccgggagttgaaacagccc

SEQ ID NO: 175734 - DNA, 25 bp, Homo sapien
gaggggcaccgcttccctaagattg

SEQ ID NO: 175735 - DNA, 25 bp, Homo sapien
agactgcgcattccaaccgcggtgc

SEQ ID NO: 175736 - DNA, 25 bp, Homo sapien
attcgcggccagactgcgcattcca

SEQ ID NO: 175737 - DNA, 25 bp, Homo sapien
gaggccagggcgcaactgcaagccc

SEQ ID NO: 175738 - DNA, 25 bp, Homo sapien
aggaggcttcgtgcctcggtgtccc

SEQ ID NO: 175739 - DNA, 25 bp, Homo sapien
gcagaggcagcacaacagaggtgca

SEQ ID NO: 175740 - DNA, 25 bp, Homo sapien
ctaagattgcgggagacacacctgg

SEQ ID NO: 175741 - DNA, 25 bp, Homo sapien
accgcttccctaagattgcgggaga

SEQ ID NO: 175742 - DNA, 25 bp, Homo sapien
cagcggaacagaagggcaccatttc

SEQ ID NO: 175743 - DNA, 25 bp, Homo sapien
cgccgtctttctctaccaactggga

SEQ ID NO: 175744 - DNA, 25 bp, Homo sapien
cctggggatcgcagttccttttctg

SEQ ID NO: 175745 - DNA, 25 bp, Homo sapien
cttctgggtttctttctagggcata

SEQ ID NO: 175746 - DNA, 25 bp, Homo sapien
actttcaggcaagagtggcgctttc

SEQ ID NO: 175747 - DNA, 25 bp, Homo sapien
ctctgatcttgctccggggtgagaa

SEQ ID NO: 175748 - DNA, 25 bp, Homo sapien
ctgtcccgtcagagaaagcctttcc

SEQ ID NO: 175749 - DNA, 25 bp, Homo sapien
tgcgtcgtaggcaaagttcgttctc

SEQ ID NO: 175750 - DNA, 25 bp, Homo sapien
gggacattgcctctggctaccacta

SEQ ID NO: 175751 - DNA, 25 bp, Homo sapien
tcggccatcaagtgcgagtacatgc

SEQ ID NO: 175752 - DNA, 25 bp, Homo sapien
tgcgagtacatgctcaacgccatcc

SEQ ID NO: 175753 - DNA, 25 bp, Homo sapien
tacgaggactgtgccagcggcatca

SEQ ID NO: 175754 - DNA, 25 bp, Homo sapien
ccatgccgcaagagctacgaggact

SEQ ID NO: 175755 - DNA, 25 bp, Homo sapien
gctgcggctccttcatcaagactga

SEQ ID NO: 175756 - DNA, 25 bp, Homo sapien
tctggactcgccacccatgtttgca

SEQ ID NO: 175757 - DNA, 25 bp, Homo sapien
cggcatcatggaggactcggccatc

SEQ ID NO: 175758 - DNA, 25 bp, Homo sapien
ggccagggcgcgtaacaactaatgc

SEQ ID NO: 175759 - DNA, 25 bp, Homo sapien
cggtcagcagtatatacagcaggta

SEQ ID NO: 175760 - DNA, 25 bp, Homo sapien
agcaggtacgcgtccagcaacttca

SEQ ID NO: 175761 - DNA, 25 bp, Homo sapien
acaccggatgtgctgtttgcgcatg

SEQ ID NO: 175762 - DNA, 25 bp, Homo sapien
ctaatgcgcagacgcggactgcatc

SEQ ID NO: 175763 - DNA, 25 bp, Homo sapien
tgcgtctgcgcaatggccctatcaa

SEQ ID NO: 175764 - DNA, 25 bp, Homo sapien
cctatcaatgagctggggacgtgta

SEQ ID NO: 175765 - DNA, 25 bp, Homo sapien
cgccgacataactgcacgcaaggta

SEQ ID NO: 175766 - DNA, 25 bp, Homo sapien
ctggtgtacgctgaggactacatca

SEQ ID NO: 175767 - DNA, 25 bp, Homo sapien
gaggagtttgtgacgctcaaggccc

SEQ ID NO: 175768 - DNA, 25 bp, Homo sapien
tgtaccgctcgctgccctatgacga

SEQ ID NO: 175769 - DNA, 25 bp, Homo sapien
ccctatgacgacaagctggtgtacg

SEQ ID NO: 175770 - DNA, 25 bp, Homo sapien
tacatcatggatgaggagcactccc

SEQ ID NO: 175771 - DNA, 25 bp, Homo sapien
tgctggagctctaccgggccatcct

SEQ ID NO: 175772 - DNA, 25 bp, Homo sapien
ccatcctgcagctggtacgcaggta

SEQ ID NO: 175773 - DNA, 25 bp, Homo sapien
gtacgcaggtacaagaagctcaagg

SEQ ID NO: 175774 - DNA, 25 bp, Homo sapien
tgtctcgtcgcgtcggagaaatcgc

SEQ ID NO: 175775 - DNA, 25 bp, Homo sapien
ggagcgaatgcccaccggcgtcctt

SEQ ID NO: 175776 - DNA, 25 bp, Homo sapien
ggtaacttgggacagaggcaccgcc

SEQ ID NO: 175777 - DNA, 25 bp, Homo sapien
cgagcgaacagccacggagcatcct

SEQ ID NO: 175778 - DNA, 25 bp, Homo sapien
caggggacccagacaaagcccactt

SEQ ID NO: 175779 - DNA, 25 bp, Homo sapien
agcccactttgtgcagggagttggc

SEQ ID NO: 175780 - DNA, 25 bp, Homo sapien
cgagtcttggctcccggacttgtct

SEQ ID NO: 175781 - DNA, 25 bp, Homo sapien
ttgaaaacgtcctccgcagcttcgc

SEQ ID NO: 175782 - DNA, 25 bp, Homo sapien
tcagcgagctcgtgctggacttcga

SEQ ID NO: 175783 - DNA, 25 bp, Homo sapien
gccgcgatgacttccgcaaggagct

SEQ ID NO: 175784 - DNA, 25 bp, Homo sapien
tgctggcacgtgctcaagaaggtga

SEQ ID NO: 175785 - DNA, 25 bp, Homo sapien
ctgggccagagcgtgtcacacgacc

SEQ ID NO: 175786 - DNA, 25 bp, Homo sapien
cacgacccgcacagcgtggagcaga

SEQ ID NO: 175787 - DNA, 25 bp, Homo sapien
tggagcagatcgagtggaagcactc

SEQ ID NO: 175788 - DNA, 25 bp, Homo sapien
gcgacatgcggctcaaggtctgccc

SEQ ID NO: 175789 - DNA, 25 bp, Homo sapien
aggacctgatgtacaagccgcccgc

SEQ ID NO: 175790 - DNA, 25 bp, Homo sapien
gcactcgcctaggtccgagctacta

SEQ ID NO: 175791 - DNA, 25 bp, Homo sapien
cgctgagaatttgggcactcgccta

SEQ ID NO: 175792 - DNA, 25 bp, Homo sapien
ggccggacgccatctgacaacaggc

SEQ ID NO: 175793 - DNA, 25 bp, Homo sapien
gtaacacaagcacgacgcgatcatg

SEQ ID NO: 175794 - DNA, 25 bp, Homo sapien
caacaacaactttattgggagcgca

SEQ ID NO: 175795 - DNA, 25 bp, Homo sapien
ccaggcgtcccgaattaaaattgag

SEQ ID NO: 175796 - DNA, 25 bp, Homo sapien
tttcaaccaaagacaccggtgagcg

SEQ ID NO: 175797 - DNA, 25 bp, Homo sapien
ggtgcgtccagtacttcggccataa

SEQ ID NO: 175798 - DNA, 25 bp, Homo sapien
accttgggctgcaaagtcgggcgtt

SEQ ID NO: 175799 - DNA, 25 bp, Homo sapien
gcatgctaagtgctcgcgcccgttc

SEQ ID NO: 175800 - DNA, 25 bp, Homo sapien
tctgcatgctaagtgctcgcgcccg

SEQ ID NO: 175801 - DNA, 25 bp, Homo sapien
aacgcgctctgcatgctaagtgctc

SEQ ID NO: 175802 - DNA, 25 bp, Homo sapien
ggcacgaacgcgctctgcatgctaa

SEQ ID NO: 175803 - DNA, 25 bp, Homo sapien
aagtcaaagcgagtcacttcctccc

SEQ ID NO: 175804 - DNA, 25 bp, Homo sapien
agtcgggcgtttgcaaagtcaaagc

SEQ ID NO: 175805 - DNA, 25 bp, Homo sapien
tgcaaagtcaaagcgagtcacttcc

SEQ ID NO: 175806 - DNA, 25 bp, Homo sapien
acgccgccgctgaagaagaattggg

SEQ ID NO: 175807 - DNA, 25 bp, Homo sapien
caggcttgctggaaccatcaacgtg

SEQ ID NO: 175808 - DNA, 25 bp, Homo sapien
gtcgcacaggtagcaagattgtctc

SEQ ID NO: 175809 - DNA, 25 bp, Homo sapien
ggcatacgggttccgagaagtccca

SEQ ID NO: 175810 - DNA, 25 bp, Homo sapien
attcgatgcgatcagcgccctcgta

SEQ ID NO: 175811 - DNA, 25 bp, Homo sapien
ggcgcgctgtctcgatcacgaattc

SEQ ID NO: 175812 - DNA, 25 bp, Homo sapien
gcttccttagccgacagggccactg

SEQ ID NO: 175813 - DNA, 25 bp, Homo sapien
ccgttaagcagcgtctgcggtagca

SEQ ID NO: 175814 - DNA, 25 bp, Homo sapien
tctcctgcccccgccgttttgtggc

SEQ ID NO: 175815 - DNA, 25 bp, Homo sapien
cgccaggcgcgcacttcgaagctcc

SEQ ID NO: 175816 - DNA, 25 bp, Homo sapien
gccaggcgcgcacttcgaagctccc

SEQ ID NO: 175817 - DNA, 25 bp, Homo sapien
ccaggcgcgcacttcgaagctccct

SEQ ID NO: 175818 - DNA, 25 bp, Homo sapien
caggcgcgcacttcgaagctccctg

SEQ ID NO: 175819 - DNA, 25 bp, Homo sapien
tgcccccgccgttttgtggcagaga

SEQ ID NO: 175820 - DNA, 25 bp, Homo sapien
ctgcccccgccgttttgtggcagag

SEQ ID NO: 175821 - DNA, 25 bp, Homo sapien
cctgcccccgccgttttgtggcaga

SEQ ID NO: 175822 - DNA, 25 bp, Homo sapien
tcaaccttcaaggaggcccgggctg

SEQ ID NO: 175823 - DNA, 25 bp, Homo sapien
ctccagcgagagaaaggcctttttt

SEQ ID NO: 175824 - DNA, 25 bp, Homo sapien
ctgcagtcagctggctcaaccttca

SEQ ID NO: 175825 - DNA, 25 bp, Homo sapien
gccgccaagcgctccagcgagagaa

SEQ ID NO: 175826 - DNA, 25 bp, Homo sapien
cgcggtaagcgggacccacttctct

SEQ ID NO: 175827 - DNA, 25 bp, Homo sapien
ggacccacttctctggcctgcgaga

SEQ ID NO: 175828 - DNA, 25 bp, Homo sapien
tgcgagatccgccttggagaagatg

SEQ ID NO: 175829 - DNA, 25 bp, Homo sapien
acaaacgtctgcgttgggccctcct

SEQ ID NO: 175830 - DNA, 25 bp, Homo sapien
ctttcgcagggaacagctgattctg

SEQ ID NO: 175831 - DNA, 25 bp, Homo sapien
aggagccgaacactgaccgcgccgt

SEQ ID NO: 175832 - DNA, 25 bp, Homo sapien
aaggggtcttcagcgcgcccagacc

SEQ ID NO: 175833 - DNA, 25 bp, Homo sapien
cgacaccggaagtgcattagcgcca

SEQ ID NO: 175834 - DNA, 25 bp, Homo sapien
gtcctgcgcgtcttcgggtcagtac

SEQ ID NO: 175835 - DNA, 25 bp, Homo sapien
tcttcctacctgtcaggcgccgagt

SEQ ID NO: 175836 - DNA, 25 bp, Homo sapien
ccttcccagccaatggtgatcaaaa

SEQ ID NO: 175837 - DNA, 25 bp, Homo sapien
agcttcaggacgctggtgagtcact

SEQ ID NO: 175838 - DNA, 25 bp, Homo sapien
ggatctctgactgatttcttcctgg

SEQ ID NO: 175839 - DNA, 25 bp, Homo sapien
gtagggttacgcaagagccactcga

SEQ ID NO: 175840 - DNA, 25 bp, Homo sapien
gccactcgagcatgaaatcccagga

SEQ ID NO: 175841 - DNA, 25 bp, Homo sapien
ggaaagcctgcaccgcctgccagga

SEQ ID NO: 175842 - DNA, 25 bp, Homo sapien
cgggctctccgtgcaaaatcgggtg

SEQ ID NO: 175843 - DNA, 25 bp, Homo sapien
gcgtagtgtttagtgcaggcacagt

SEQ ID NO: 175844 - DNA, 25 bp, Homo sapien
gccacagcgagcgatggatctctga

SEQ ID NO: 175845 - DNA, 25 bp, Homo sapien
aacaacgtgattcgctgagaagccc

SEQ ID NO: 175846 - DNA, 25 bp, Homo sapien
tctctctgtatcgactccaagccgg

SEQ ID NO: 175847 - DNA, 25 bp, Homo sapien
caagacagtgcgagagtcgctcctc

SEQ ID NO: 175848 - DNA, 25 bp, Homo sapien
gcgcctcgacctcgtgaagcacggt

SEQ ID NO: 175849 - DNA, 25 bp, Homo sapien
tgcccaagccgctcattgctcaagg

SEQ ID NO: 175850 - DNA, 25 bp, Homo sapien
cctgaggaaccaaccatagagacgc

SEQ ID NO: 175851 - DNA, 25 bp, Homo sapien
ggcgcatttccaagggcccttctag

SEQ ID NO: 175852 - DNA, 25 bp, Homo sapien
ccttctaggagaacagcgtgcggtc

SEQ ID NO: 175853 - DNA, 25 bp, Homo sapien
acccagcgacgacgaggttgtcatg

SEQ ID NO: 175854 - DNA, 25 bp, Homo sapien
ccggcacctgcgagggaatttttgc

SEQ ID NO: 175855 - DNA, 25 bp, Homo sapien
ctgtttattaagtacccggcacctg

SEQ ID NO: 175856 - DNA, 25 bp, Homo sapien
taaatcctttctccggcgagccgtc

SEQ ID NO: 175857 - DNA, 25 bp, Homo sapien
tctctcccgaaagcgttgctaatta

SEQ ID NO: 175858 - DNA, 25 bp, Homo sapien
cggcaccactgcttcctgtaattta

SEQ ID NO: 175859 - DNA, 25 bp, Homo sapien
gattctgtggtctttgtggtccgca

SEQ ID NO: 175860 - DNA, 25 bp, Homo sapien
tggcatcaagagtctgggcccatga

SEQ ID NO: 175861 - DNA, 25 bp, Homo sapien
gtttcgagtaagaccactgctggca

SEQ ID NO: 175862 - DNA, 25 bp, Homo sapien
cccgaaagcaagcttgtgggacgcg

SEQ ID NO: 175863 - DNA, 25 bp, Homo sapien
tttctttagctgtcgcccaccgaga

SEQ ID NO: 175864 - DNA, 25 bp, Homo sapien
cggggatcctggctttctaccttag

SEQ ID NO: 175865 - DNA, 25 bp, Homo sapien
ttctaccttagtcctcgcgagtgcc

SEQ ID NO: 175866 - DNA, 25 bp, Homo sapien
cagccaggcgtgctcgtctcgactt

SEQ ID NO: 175867 - DNA, 25 bp, Homo sapien
cgcgctgaaattggtgtggaacaac

SEQ ID NO: 175868 - DNA, 25 bp, Homo sapien
caacgggcttgcaagtttctttagc

SEQ ID NO: 175869 - DNA, 25 bp, Homo sapien
agaggtctccatcgcgctgaaattg

SEQ ID NO: 175870 - DNA, 25 bp, Homo sapien
acacacacatcttgggcagcactca

SEQ ID NO: 175871 - DNA, 25 bp, Homo sapien
tgtctgtgactctgtacgtgtaatc

SEQ ID NO: 175872 - DNA, 25 bp, Homo sapien
cgtgtaatctgtgtgcgcttgagta

SEQ ID NO: 175873 - DNA, 25 bp, Homo sapien
ggggcgcaaccagaatacctgtgtc

SEQ ID NO: 175874 - DNA, 25 bp, Homo sapien
gctgcccgggctatttctttgcgaa

SEQ ID NO: 175875 - DNA, 25 bp, Homo sapien
cgagagaacttttccaggggctaag

SEQ ID NO: 175876 - DNA, 25 bp, Homo sapien
ggtcgactggtcaccttggaatccc

SEQ ID NO: 175877 - DNA, 25 bp, Homo sapien
caccaggttacccaaggctctttgg

SEQ ID NO: 175878 - DNA, 25 bp, Homo sapien
ccggatccaggtcccgcacggggag

SEQ ID NO: 175879 - DNA, 25 bp, Homo sapien
gagcgtggagcctgtcactgcagcc

SEQ ID NO: 175880 - DNA, 25 bp, Homo sapien
agcgtggagcctgtcactgcagcct

SEQ ID NO: 175881 - DNA, 25 bp, Homo sapien
gggccgcggtgctgaggacgcaaat

SEQ ID NO: 175882 - DNA, 25 bp, Homo sapien
ctgaggacgcaaatgtggtgagcac

SEQ ID NO: 175883 - DNA, 25 bp, Homo sapien
acgcaaatgtggtgagcacgcgatg

SEQ ID NO: 175884 - DNA, 25 bp, Homo sapien
cacgcgatgcgggtgcggtgaccgg

SEQ ID NO: 175885 - DNA, 25 bp, Homo sapien
cgcaaatgtggtgagcacgcgatgc

SEQ ID NO: 175886 - DNA, 25 bp, Homo sapien
ccctgcagtcgctacctaaggaaga

SEQ ID NO: 175887 - DNA, 25 bp, Homo sapien
gcccggcctgcagaacgtaactgac

SEQ ID NO: 175888 - DNA, 25 bp, Homo sapien
cgtaactgacatcgcggaggctctc

SEQ ID NO: 175889 - DNA, 25 bp, Homo sapien
aaacaggacggtgccgtgctccagc

SEQ ID NO: 175890 - DNA, 25 bp, Homo sapien
ccagccgctatggtggcctgggaaa

SEQ ID NO: 175891 - DNA, 25 bp, Homo sapien
agggcactgtgttgaatttggtcgc

SEQ ID NO: 175892 - DNA, 25 bp, Homo sapien
ccagtaccctgataccggcagcggg

SEQ ID NO: 175893 - DNA, 25 bp, Homo sapien
gtgtagccctcacctggcaaacagg

SEQ ID NO: 175894 - DNA, 25 bp, Homo sapien
ggcctgattcgtcgagtctcactga

SEQ ID NO: 175895 - DNA, 25 bp, Homo sapien
cggacgaaagacacgggcctgattc

SEQ ID NO: 175896 - DNA, 25 bp, Homo sapien
cccggaggcacactttgtctgacca

SEQ ID NO: 175897 - DNA, 25 bp, Homo sapien
ccgggaaatgcaacgcccttcactg

SEQ ID NO: 175898 - DNA, 25 bp, Homo sapien
gacagcagcgtcaccaaggccagca

SEQ ID NO: 175899 - DNA, 25 bp, Homo sapien
actgagccttagtcgtcggcaggtc

SEQ ID NO: 175900 - DNA, 25 bp, Homo sapien
gctggttagacacctggagaccctg

SEQ ID NO: 175901 - DNA, 25 bp, Homo sapien
ggcgaccggaaggatctttctagtc

SEQ ID NO: 175902 - DNA, 25 bp, Homo sapien
agggttactgcgtgcttgtgacaga

SEQ ID NO: 175903 - DNA, 25 bp, Homo sapien
aaaagctagctgacccaggggcggc

SEQ ID NO: 175904 - DNA, 25 bp, Homo sapien
cggcggccgcttgaaaagctagctg

SEQ ID NO: 175905 - DNA, 25 bp, Homo sapien
tcagccgcctgcaggtcagacatct

SEQ ID NO: 175906 - DNA, 25 bp, Homo sapien
gtgcttgtgacagacgatttttaaa

SEQ ID NO: 175907 - DNA, 25 bp, Homo sapien
caaacaaaacctggggaagagtcag

SEQ ID NO: 175908 - DNA, 25 bp, Homo sapien
tcgtggtatccatagagacgctatc

SEQ ID NO: 175909 - DNA, 25 bp, Homo sapien
agacactgccggaaatcgtggtatc

SEQ ID NO: 175910 - DNA, 25 bp, Homo sapien
cccgatggagtctgaaggatctcta

SEQ ID NO: 175911 - DNA, 25 bp, Homo sapien
tccagggaagcaatgagacgtgttc

SEQ ID NO: 175912 - DNA, 25 bp, Homo sapien
ctcagcaagggcgatttagggtcca

SEQ ID NO: 175913 - DNA, 25 bp, Homo sapien
ccgcggttatccagcgagtcacgta

SEQ ID NO: 175914 - DNA, 25 bp, Homo sapien
aagcaccgtgctaggtcatttcctc

SEQ ID NO: 175915 - DNA, 25 bp, Homo sapien
ttgcggccgcttctagtagtttcca

SEQ ID NO: 175916 - DNA, 25 bp, Homo sapien
tgtcccgacgaaccacaaggcttct

SEQ ID NO: 175917 - DNA, 25 bp, Homo sapien
agggcatgctggaagtcgtagtttc

SEQ ID NO: 175918 - DNA, 25 bp, Homo sapien
acgcgctggcgtgagcatgcccact

SEQ ID NO: 175919 - DNA, 25 bp, Homo sapien
tccgtatacccacgcgctggcgtga

SEQ ID NO: 175920 - DNA, 25 bp, Homo sapien
aaagcagcgcaaagccctccgtata

SEQ ID NO: 175921 - DNA, 25 bp, Homo sapien
ccgggtttcctaaagcagcgcaaag

SEQ ID NO: 175922 - DNA, 25 bp, Homo sapien
tgcaggaactgcctcggaacccggg

SEQ ID NO: 175923 - DNA, 25 bp, Homo sapien
ggagcagtcccgctgcaggaactgc

SEQ ID NO: 175924 - DNA, 25 bp, Homo sapien
tagaggaaatcctatctcgggaacc

SEQ ID NO: 175925 - DNA, 25 bp, Homo sapien
tctcgggaacccagggatcagccca

SEQ ID NO: 175926 - DNA, 25 bp, Homo sapien
ccagacagcatggaacgcaggcaga

SEQ ID NO: 175927 - DNA, 25 bp, Homo sapien
atccagggcgtcgtgtcgaacttga

SEQ ID NO: 175928 - DNA, 25 bp, Homo sapien
cgtgtcgaacttgaagtgcagctta

SEQ ID NO: 175929 - DNA, 25 bp, Homo sapien
tgaagtgcagcttaggtgagaagtc

SEQ ID NO: 175930 - DNA, 25 bp, Homo sapien
agccggctgtcctcgtcatagcagc

SEQ ID NO: 175931 - DNA, 25 bp, Homo sapien
tcatagcagcagtgctgggcggcca

SEQ ID NO: 175932 - DNA, 25 bp, Homo sapien
actggcatccctccaccggaagctg

SEQ ID NO: 175933 - DNA, 25 bp, Homo sapien
tgtcctcgtcatagcagcagtgctg

SEQ ID NO: 175934 - DNA, 25 bp, Homo sapien
agtcaaacttgtcacccggctggtc

SEQ ID NO: 175935 - DNA, 25 bp, Homo sapien
cgcggcttcttcacggggagcccta

SEQ ID NO: 175936 - DNA, 25 bp, Homo sapien
agcgcacgcatcgtctcggttccga

SEQ ID NO: 175937 - DNA, 25 bp, Homo sapien
cgaattcctgttcgcgggaagctgc

SEQ ID NO: 175938 - DNA, 25 bp, Homo sapien
tgggcggctctctttgatctggccg

SEQ ID NO: 175939 - DNA, 25 bp, Homo sapien
acagctctagggtccgcgcacctgg

SEQ ID NO: 175940 - DNA, 25 bp, Homo sapien
tcactccgcacagaagtcaaacttg

SEQ ID NO: 175941 - DNA, 25 bp, Homo sapien
accgtggagtgtcggccacctcact

SEQ ID NO: 175942 - DNA, 25 bp, Homo sapien
ccaaggccacgcagcgaagggaaaa

SEQ ID NO: 175943 - DNA, 25 bp, Homo sapien
ctgctgcctggccaatcacggacga

SEQ ID NO: 175944 - DNA, 25 bp, Homo sapien
tggtcctgaggaccgctgaccaatc

SEQ ID NO: 175945 - DNA, 25 bp, Homo sapien
atcacggacgagagcaaagcgcctc

SEQ ID NO: 175946 - DNA, 25 bp, Homo sapien
ccgctgaccaatctggaagagaagg

SEQ ID NO: 175947 - DNA, 25 bp, Homo sapien
gtccttgagcctccaggctcgtgga

SEQ ID NO: 175948 - DNA, 25 bp, Homo sapien
agaggaccggtctcggccaaggcca

SEQ ID NO: 175949 - DNA, 25 bp, Homo sapien
attgcccagcggatggcccggagac

SEQ ID NO: 175950 - DNA, 25 bp, Homo sapien
agccggacaattctgggaacccagg

SEQ ID NO: 175951 - DNA, 25 bp, Homo sapien
ctttggaggaatagccggacaattc

SEQ ID NO: 175952 - DNA, 25 bp, Homo sapien
ccggaaggaagtcggaagcaagata

SEQ ID NO: 175953 - DNA, 25 bp, Homo sapien
gtgtttacagaaagcgccggaagga

SEQ ID NO: 175954 - DNA, 25 bp, Homo sapien
ggctagcccaggaaactgaaagatg

SEQ ID NO: 175955 - DNA, 25 bp, Homo sapien
ggagaagggcgtgatttccaccctc

SEQ ID NO: 175956 - DNA, 25 bp, Homo sapien
cacggagtcattccgagaagggaga

SEQ ID NO: 175957 - DNA, 25 bp, Homo sapien
ggggccgaccctgataaggatcgca

SEQ ID NO: 175958 - DNA, 25 bp, Homo sapien
cagcccggtgtcagcttctggaatt

SEQ ID NO: 175959 - DNA, 25 bp, Homo sapien
agctccgttctcttttaccgcctga

SEQ ID NO: 175960 - DNA, 25 bp, Homo sapien
gatctgcggctacaattctggcttc

SEQ ID NO: 175961 - DNA, 25 bp, Homo sapien
gctcaccgggacctgaatgtcatga

SEQ ID NO: 175962 - DNA, 25 bp, Homo sapien
gccctccgatgtgggtctgcgataa

SEQ ID NO: 175963 - DNA, 25 bp, Homo sapien
cgataactgagatgcggggaaccca

SEQ ID NO: 175964 - DNA, 25 bp, Homo sapien
ggggctccatcatccttttacacgc

SEQ ID NO: 175965 - DNA, 25 bp, Homo sapien
tcctcttccgggcaaaatggcgatg

SEQ ID NO: 175966 - DNA, 25 bp, Homo sapien
aagaattccttggactgcggcgtcg

SEQ ID NO: 175967 - DNA, 25 bp, Homo sapien
gcggcctataccctctgatccggaa

SEQ ID NO: 175968 - DNA, 25 bp, Homo sapien
agcagattctctcgtgttccggatc

SEQ ID NO: 175969 - DNA, 25 bp, Homo sapien
ctcggctcgagaaggtgctttagtc

SEQ ID NO: 175970 - DNA, 25 bp, Homo sapien
ctttagtctgaagatggcggcctca

SEQ ID NO: 175971 - DNA, 25 bp, Homo sapien
cggcgctgcgtagaagtatcaatca

SEQ ID NO: 175972 - DNA, 25 bp, Homo sapien
tcagccggttgcttttgtgagaaga

SEQ ID NO: 175973 - DNA, 25 bp, Homo sapien
tctgtaccttttgggcaccaggacc

SEQ ID NO: 175974 - DNA, 25 bp, Homo sapien
cccgcaagatgctcacgcgaaaaac

SEQ ID NO: 175975 - DNA, 25 bp, Homo sapien
cgcgaaaaacccactcttcagtgtc

SEQ ID NO: 175976 - DNA, 25 bp, Homo sapien
tgtctgagaccactccgcagctttc

SEQ ID NO: 175977 - DNA, 25 bp, Homo sapien
actaggcctagtcgtagcggcggcc

SEQ ID NO: 175978 - DNA, 25 bp, Homo sapien
agccgtagtcttggcccacgtcatt

SEQ ID NO: 175979 - DNA, 25 bp, Homo sapien
tgaagaagactggtactcccagacc

SEQ ID NO: 175980 - DNA, 25 bp, Homo sapien
caatcaacaacccacctggtgagcg

SEQ ID NO: 175981 - DNA, 25 bp, Homo sapien
ctgggcgggtctttccagatgatga

SEQ ID NO: 175982 - DNA, 25 bp, Homo sapien
cacgtggctcgggtgactcgcattg

SEQ ID NO: 175983 - DNA, 25 bp, Homo sapien
gacacgccgggagtcggcctctgct

SEQ ID NO: 175984 - DNA, 25 bp, Homo sapien
gcctcggcttcactaagcgcagtca

SEQ ID NO: 175985 - DNA, 25 bp, Homo sapien
gagggacagccccatgaccttgtca

SEQ ID NO: 175986 - DNA, 25 bp, Homo sapien
ctctgcttccctcggggtgagtagg

SEQ ID NO: 175987 - DNA, 25 bp, Homo sapien
aaccggcatggacacgccgggagtc

SEQ ID NO: 175988 - DNA, 25 bp, Homo sapien
actaagcgcagtcaggtggctgtcc

SEQ ID NO: 175989 - DNA, 25 bp, Homo sapien
tcggcctctgctccggttgtgcagc

SEQ ID NO: 175990 - DNA, 25 bp, Homo sapien
atgttcctgcccagtgcgtgtccag

SEQ ID NO: 175991 - DNA, 25 bp, Homo sapien
tttgcgctttttgcctgttccctgg

SEQ ID NO: 175992 - DNA, 25 bp, Homo sapien
taacgagggctcagctccgactacc

SEQ ID NO: 175993 - DNA, 25 bp, Homo sapien
tccttctaacgagggctcagctccg

SEQ ID NO: 175994 - DNA, 25 bp, Homo sapien
ccgagaaaatggaacagaacgttag

SEQ ID NO: 175995 - DNA, 25 bp, Homo sapien
tgcgtgtccagaatagccgctcaga

SEQ ID NO: 175996 - DNA, 25 bp, Homo sapien
ctctgggcgccaggatgttcctgcc

SEQ ID NO: 175997 - DNA, 25 bp, Homo sapien
agacaccggctccaggttcagccag

SEQ ID NO: 175998 - DNA, 25 bp, Homo sapien
gtactcggctgccacgcgcttcctc

SEQ ID NO: 175999 - DNA, 25 bp, Homo sapien
caagcggccctggaacaaactcagc

SEQ ID NO: 176000 - DNA, 25 bp, Homo sapien
ctggaacaaactcagcccgcctgcg

SEQ ID NO: 176001 - DNA, 25 bp, Homo sapien
ccaggcccttgtggttgccaatgaa

SEQ ID NO: 176002 - DNA, 25 bp, Homo sapien
ccttgtggttgccaatgaaggccga

SEQ ID NO: 176003 - DNA, 25 bp, Homo sapien
gttgccaatgaaggccgagagccct

SEQ ID NO: 176004 - DNA, 25 bp, Homo sapien
acgcgctcctgcgtactcggctgcc

SEQ ID NO: 176005 - DNA, 25 bp, Homo sapien
cggtctcgccgctctcggcagggca

SEQ ID NO: 176006 - DNA, 25 bp, Homo sapien
gagtccgagctgccgcctgcaaaag

SEQ ID NO: 176007 - DNA, 25 bp, Homo sapien
ggagtccgagctgccgcctgcaaaa

SEQ ID NO: 176008 - DNA, 25 bp, Homo sapien
ggggtctggccactctgcgcgcgcg

SEQ ID NO: 176009 - DNA, 25 bp, Homo sapien
ccacggattgtagcgcgcacagggc

SEQ ID NO: 176010 - DNA, 25 bp, Homo sapien
gagaggctgcggggaactcgaggca

SEQ ID NO: 176011 - DNA, 25 bp, Homo sapien
gggagtccgagctgccgcctgcaaa

SEQ ID NO: 176012 - DNA, 25 bp, Homo sapien
aagagtgaggggagtccgagctgcc

SEQ ID NO: 176013 - DNA, 25 bp, Homo sapien
cccacggattgtagcgcgcacaggg

SEQ ID NO: 176014 - DNA, 25 bp, Homo sapien
ctgctgtgagtgcacttgccgaatt

SEQ ID NO: 176015 - DNA, 25 bp, Homo sapien
gagtgtcaaaccctggagcccatcg

SEQ ID NO: 176016 - DNA, 25 bp, Homo sapien
gtgtcaaaccctggagcccatcgtc

SEQ ID NO: 176017 - DNA, 25 bp, Homo sapien
tcaaaccctggagcccatcgtcaag

SEQ ID NO: 176018 - DNA, 25 bp, Homo sapien
cctggagcccatcgtcaagacgtta

SEQ ID NO: 176019 - DNA, 25 bp, Homo sapien
tggagcccatcgtcaagacgttata

SEQ ID NO: 176020 - DNA, 25 bp, Homo sapien
tggcagttctgctgtgagtgcactt

SEQ ID NO: 176021 - DNA, 25 bp, Homo sapien
cagttctgctgtgagtgcacttgcc

SEQ ID NO: 176022 - DNA, 25 bp, Homo sapien
cgcgctgcctcaaggggtttatttt

SEQ ID NO: 176023 - DNA, 25 bp, Homo sapien
tccgaaattgtgagaaggtgccttc

SEQ ID NO: 176024 - DNA, 25 bp, Homo sapien
agtgtcggtctgtcggtgtcacaca

SEQ ID NO: 176025 - DNA, 25 bp, Homo sapien
cgggtgtatacgagcctgtgcttga

SEQ ID NO: 176026 - DNA, 25 bp, Homo sapien
gggctgcactgatttgctctcggga

SEQ ID NO: 176027 - DNA, 25 bp, Homo sapien
ctcgggagtgcgctatttgcatatg

SEQ ID NO: 176028 - DNA, 25 bp, Homo sapien
tccagcacgcccagggttaaaagcc

SEQ ID NO: 176029 - DNA, 25 bp, Homo sapien
tctatttggagctacttcggcctta

SEQ ID NO: 176030 - DNA, 25 bp, Homo sapien
tcttgatcctcctgtacgccatgta

SEQ ID NO: 176031 - DNA, 25 bp, Homo sapien
cacaacagggatggtcgtcggcatt

SEQ ID NO: 176032 - DNA, 25 bp, Homo sapien
acgaggggtcctatcaagtggacga

SEQ ID NO: 176033 - DNA, 25 bp, Homo sapien
ggacgagacgcggaactacatcagc

SEQ ID NO: 176034 - DNA, 25 bp, Homo sapien
agcaacggcacgctcatgaaggaga

SEQ ID NO: 176035 - DNA, 25 bp, Homo sapien
ggacagggagtattacgtgtaaaca

SEQ ID NO: 176036 - DNA, 25 bp, Homo sapien
tgtaaacatgcgaacactgctcaca

SEQ ID NO: 176037 - DNA, 25 bp, Homo sapien
gtcgagcagcacaacagggatggtc

SEQ ID NO: 176038 - DNA, 25 bp, Homo sapien
cgcccagccacagcaagagtacagg

SEQ ID NO: 176039 - DNA, 25 bp, Homo sapien
gatgatcccagctccttaatgccgg

SEQ ID NO: 176040 - DNA, 25 bp, Homo sapien
ttaatgccggatcatcgcctaggcc

SEQ ID NO: 176041 - DNA, 25 bp, Homo sapien
gcggctaccagtgacccagaaggtg

SEQ ID NO: 176042 - DNA, 25 bp, Homo sapien
tgcaactgaccaaacgcagcgactc

SEQ ID NO: 176043 - DNA, 25 bp, Homo sapien
gcagcgactcaaccgactgtgctct

SEQ ID NO: 176044 - DNA, 25 bp, Homo sapien
agactcgcagctatggcaacttgaa

SEQ ID NO: 176045 - DNA, 25 bp, Homo sapien
gtacctgagacggaggatgatccca

SEQ ID NO: 176046 - DNA, 25 bp, Homo sapien
ccctgcagttggatagcaacgagaa

SEQ ID NO: 176047 - DNA, 25 bp, Homo sapien
gcaacgagaatcctccaggggtgca

SEQ ID NO: 176048 - DNA, 25 bp, Homo sapien
ctgaccctcagcagaggtgtctctg

SEQ ID NO: 176049 - DNA, 25 bp, Homo sapien
ggagctgaagttctgcaggacattg

SEQ ID NO: 176050 - DNA, 25 bp, Homo sapien
caggacattggtccgcccgcggaca

SEQ ID NO: 176051 - DNA, 25 bp, Homo sapien
gccagtcgactcaaccaccggagtg

SEQ ID NO: 176052 - DNA, 25 bp, Homo sapien
cactccgcggggactttctctggat

SEQ ID NO: 176053 - DNA, 25 bp, Homo sapien
ctttctctggataaggagtgcgtgc

SEQ ID NO: 176054 - DNA, 25 bp, Homo sapien
ctcgcgtgatcacgtggttggcacc

SEQ ID NO: 176055 - DNA, 25 bp, Homo sapien
tgacactccagtccaaagctaggtg

SEQ ID NO: 176056 - DNA, 25 bp, Homo sapien
cggtgaagaacttgcaaagcgttgc

SEQ ID NO: 176057 - DNA, 25 bp, Homo sapien
tagtgaaatcggacctacgcctctc

SEQ ID NO: 176058 - DNA, 25 bp, Homo sapien
ccgcagctgaaaacctcgagaatcg

SEQ ID NO: 176059 - DNA, 25 bp, Homo sapien
atttgccgagttcgccatttccaca

SEQ ID NO: 176060 - DNA, 25 bp, Homo sapien
ttaccacggtgtttgtatttgccga

SEQ ID NO: 176061 - DNA, 25 bp, Homo sapien
ttgctggaaaagacgggagttctac

SEQ ID NO: 176062 - DNA, 25 bp, Homo sapien
tatggccgcgaaagggtgaagggca

SEQ ID NO: 176063 - DNA, 25 bp, Homo sapien
ggaggcgaacgctcaggttcacaca

SEQ ID NO: 176064 - DNA, 25 bp, Homo sapien
agctaagtgctatggccgcgaaagg

SEQ ID NO: 176065 - DNA, 25 bp, Homo sapien
gcgaacgctcaggttcacacatatg

SEQ ID NO: 176066 - DNA, 25 bp, Homo sapien
gaacgctcaggttcacacatatgca

SEQ ID NO: 176067 - DNA, 25 bp, Homo sapien
cgctcaggttcacacatatgcaagt

SEQ ID NO: 176068 - DNA, 25 bp, Homo sapien
atggcgagagctaagtgctatggcc

SEQ ID NO: 176069 - DNA, 25 bp, Homo sapien
cgagagctaagtgctatggccgcga

SEQ ID NO: 176070 - DNA, 25 bp, Homo sapien
cgtccaggcacgaggcaacacggaa

SEQ ID NO: 176071 - DNA, 25 bp, Homo sapien
cgcgcagagaaaactccatccaagc

SEQ ID NO: 176072 - DNA, 25 bp, Homo sapien
cactcgggccgatgaagacatcctg

SEQ ID NO: 176073 - DNA, 25 bp, Homo sapien
cctgggcgtcccaatctcgaagaca

SEQ ID NO: 176074 - DNA, 25 bp, Homo sapien
tccgccgaaaggtcgccgcggcaaa

SEQ ID NO: 176075 - DNA, 25 bp, Homo sapien
ggcaacacggaaagcatcgattcga

SEQ ID NO: 176076 - DNA, 25 bp, Homo sapien
tcgattcgagcgacatggaaatggc

SEQ ID NO: 176077 - DNA, 25 bp, Homo sapien
cccgtcggccagaagtgtctgtgta

SEQ ID NO: 176078 - DNA, 25 bp, Homo sapien
ggggtcattcattggccaatcattg

SEQ ID NO: 176079 - DNA, 25 bp, Homo sapien
tcgtgagaagagtcgcgcaaagttt

SEQ ID NO: 176080 - DNA, 25 bp, Homo sapien
acagcccagtgcgagatgtgcccag

SEQ ID NO: 176081 - DNA, 25 bp, Homo sapien
caccagctttctcggttggaccacg

SEQ ID NO: 176082 - DNA, 25 bp, Homo sapien
ttggaccacgactcacggacatggc

SEQ ID NO: 176083 - DNA, 25 bp, Homo sapien
cgcaaagtttgttacgtgggagaga

SEQ ID NO: 176084 - DNA, 25 bp, Homo sapien
gcgggcttctggtccaatcaccatg

SEQ ID NO: 176085 - DNA, 25 bp, Homo sapien
ggccaatcattgtacgaagctccca

SEQ ID NO: 176086 - DNA, 25 bp, Homo sapien
cattatccattgtcaccgcggagga

SEQ ID NO: 176087 - DNA, 25 bp, Homo sapien
gttcgaaacctgtcgccgtcacttg

SEQ ID NO: 176088 - DNA, 25 bp, Homo sapien
agtttccagtaaccggccgagctgc

SEQ ID NO: 176089 - DNA, 25 bp, Homo sapien
gcgttgccaggtgaagtttccagta

SEQ ID NO: 176090 - DNA, 25 bp, Homo sapien
accctgtcggattcggatgagccca

SEQ ID NO: 176091 - DNA, 25 bp, Homo sapien
cgagcgctcgagatatcatcagtgc

SEQ ID NO: 176092 - DNA, 25 bp, Homo sapien
gtcacttgcgcgtttggcattatcc

SEQ ID NO: 176093 - DNA, 25 bp, Homo sapien
aggcgctgagctactcctttccgag

SEQ ID NO: 176094 - DNA, 25 bp, Homo sapien
ctgccgcggtctttcgtcatttata

SEQ ID NO: 176095 - DNA, 25 bp, Homo sapien
ggctcgctcccgcactttgaaggct

SEQ ID NO: 176096 - DNA, 25 bp, Homo sapien
ccacttaaactcttctgcggggaga

SEQ ID NO: 176097 - DNA, 25 bp, Homo sapien
ggacgggctggacccatacttgata

SEQ ID NO: 176098 - DNA, 25 bp, Homo sapien
actgtctgttcccttccgattagca

SEQ ID NO: 176099 - DNA, 25 bp, Homo sapien
atcgggcgtttctccaagtcgtctt

SEQ ID NO: 176100 - DNA, 25 bp, Homo sapien
tggtgccaagtcactcaggctttga

SEQ ID NO: 176101 - DNA, 25 bp, Homo sapien
gtccggaaatcatcctcagcctgtg

SEQ ID NO: 176102 - DNA, 25 bp, Homo sapien
tgtctggatctacactgacccgttg

SEQ ID NO: 176103 - DNA, 25 bp, Homo sapien
gagggtactccttggccgaattgac

SEQ ID NO: 176104 - DNA, 25 bp, Homo sapien
cgttgacgcgctttcccaaaggagg

SEQ ID NO: 176105 - DNA, 25 bp, Homo sapien
atcgctcgtgggagattttctacca

SEQ ID NO: 176106 - DNA, 25 bp, Homo sapien
cggtttccactcaaaaggatgcgga

SEQ ID NO: 176107 - DNA, 25 bp, Homo sapien
aacaagtgttttccgctcagtcatg

SEQ ID NO: 176108 - DNA, 25 bp, Homo sapien
gcgcgcggcaagaaccaccttctag

SEQ ID NO: 176109 - DNA, 25 bp, Homo sapien
agatcagattctcggggactccatg

SEQ ID NO: 176110 - DNA, 25 bp, Homo sapien
gagtcccgggatcctccaaatccga

SEQ ID NO: 176111 - DNA, 25 bp, Homo sapien
aggcgaagttcaagatcccggggat

SEQ ID NO: 176112 - DNA, 25 bp, Homo sapien
cctcgcgggtctggcagaaagtaag

SEQ ID NO: 176113 - DNA, 25 bp, Homo sapien
agcgggattaccaccagggctggaa

SEQ ID NO: 176114 - DNA, 25 bp, Homo sapien
gcgatcccgcgaattcattactgta

SEQ ID NO: 176115 - DNA, 25 bp, Homo sapien
ccgcacacacgcgtcggaggagagc

SEQ ID NO: 176116 - DNA, 25 bp, Homo sapien
tcgagaacctttgcaggtaacgcgc

SEQ ID NO: 176117 - DNA, 25 bp, Homo sapien
gagaaagtggcatgcccgaaccctg

SEQ ID NO: 176118 - DNA, 25 bp, Homo sapien
cgtcgccgccacgatagatacgggc

SEQ ID NO: 176119 - DNA, 25 bp, Homo sapien
ccattgtgtgggtcacatgactccg

SEQ ID NO: 176120 - DNA, 25 bp, Homo sapien
agagtagccactcagccattgtgtg

SEQ ID NO: 176121 - DNA, 25 bp, Homo sapien
tgccaggaagccgagagtagccact

SEQ ID NO: 176122 - DNA, 25 bp, Homo sapien
atagctttcgctcggcgttgccagg

SEQ ID NO: 176123 - DNA, 25 bp, Homo sapien
aacccgcggccgcagtcatagcttt

SEQ ID NO: 176124 - DNA, 25 bp, Homo sapien
ctgctgactggcaccctaggggaat

SEQ ID NO: 176125 - DNA, 25 bp, Homo sapien
cgccgccattttgagtgcgggtcaa

SEQ ID NO: 176126 - DNA, 25 bp, Homo sapien
cgtgccagccatgagccttttgttc

SEQ ID NO: 176127 - DNA, 25 bp, Homo sapien
cttgctggagttgcagccggagaca

SEQ ID NO: 176128 - DNA, 25 bp, Homo sapien
gccttttgttctgggaccgctccgc

SEQ ID NO: 176129 - DNA, 25 bp, Homo sapien
acacgcttggttgcctggaaggcgc

SEQ ID NO: 176130 - DNA, 25 bp, Homo sapien
gagcagcggaccgaggctcccagct

SEQ ID NO: 176131 - DNA, 25 bp, Homo sapien
gggaagctcgctcccaaggcacagc

SEQ ID NO: 176132 - DNA, 25 bp, Homo sapien
cccgaaagccattggatgtaggggt

SEQ ID NO: 176133 - DNA, 25 bp, Homo sapien
tgggcgcgccgctacttactggctc

SEQ ID NO: 176134 - DNA, 25 bp, Homo sapien
caatgaacagctcagccagagaaga

SEQ ID NO: 176135 - DNA, 25 bp, Homo sapien
ccagagaagagtcgaacacggattc

SEQ ID NO: 176136 - DNA, 25 bp, Homo sapien
tctcagggtggctggcaatgaacag

SEQ ID NO: 176137 - DNA, 25 bp, Homo sapien
cccagtcatctctggcaacgaagtt

SEQ ID NO: 176138 - DNA, 25 bp, Homo sapien
cactttaatgaatgccgtgtggccc

SEQ ID NO: 176139 - DNA, 25 bp, Homo sapien
ggcacgggtctctgcagctcaaaac

SEQ ID NO: 176140 - DNA, 25 bp, Homo sapien
acaaaacatcgtggcgcaaagtctc

SEQ ID NO: 176141 - DNA, 25 bp, Homo sapien
ggctggagcgcaccaatagttgccc

SEQ ID NO: 176142 - DNA, 25 bp, Homo sapien
actaagcatggatggcagccggaga

SEQ ID NO: 176143 - DNA, 25 bp, Homo sapien
gcaactgtcctcctagtaccgggta

SEQ ID NO: 176144 - DNA, 25 bp, Homo sapien
ctagtaccgggtatcccgcaggcgg

SEQ ID NO: 176145 - DNA, 25 bp, Homo sapien
cgtcacaatagcgactcactggacc

SEQ ID NO: 176146 - DNA, 25 bp, Homo sapien
agcccttagcaacggcctggcaacg

SEQ ID NO: 176147 - DNA, 25 bp, Homo sapien
gcctggcaacggtttccctgctgct

SEQ ID NO: 176148 - DNA, 25 bp, Homo sapien
gaccgaaggggatacagcgtgtccc

SEQ ID NO: 176149 - DNA, 25 bp, Homo sapien
cggctgcaagaggactaagcatgga

SEQ ID NO: 176150 - DNA, 25 bp, Homo sapien
tgtgtcctctcggtgaaaacgctgg

SEQ ID NO: 176151 - DNA, 25 bp, Homo sapien
tggattagcatggtggcgtccgaca

SEQ ID NO: 176152 - DNA, 25 bp, Homo sapien
tgtcctcctggaacgtttgcaccga

SEQ ID NO: 176153 - DNA, 25 bp, Homo sapien
tacgagctgccgatgttgaggtttc

SEQ ID NO: 176154 - DNA, 25 bp, Homo sapien
cctgcgtccgcatgatgttgggaga

SEQ ID NO: 176155 - DNA, 25 bp, Homo sapien
ccgacagggacttcttatggccgta

SEQ ID NO: 176156 - DNA, 25 bp, Homo sapien
tcggactccgacatggagggcatca

SEQ ID NO: 176157 - DNA, 25 bp, Homo sapien
acctcgatgctgttccgtttgtgca

SEQ ID NO: 176158 - DNA, 25 bp, Homo sapien
gcttaatcaaaaatgtccgggccga

SEQ ID NO: 176159 - DNA, 25 bp, Homo sapien
ggagcgtctttcatctgaagtctta

SEQ ID NO: 176160 - DNA, 25 bp, Homo sapien
aggaggcagcgcttaatcaaaaatg

SEQ ID NO: 176161 - DNA, 25 bp, Homo sapien
gctccactaagctgggaaggcgtcg

SEQ ID NO: 176162 - DNA, 25 bp, Homo sapien
tcagcttccagattccaaaccaaag

SEQ ID NO: 176163 - DNA, 25 bp, Homo sapien
cctcggggtagctgttgcatcagct

SEQ ID NO: 176164 - DNA, 25 bp, Homo sapien
ccctgcataagctggcggccagaca

SEQ ID NO: 176165 - DNA, 25 bp, Homo sapien
atgcttggctgaatctcggtagtgc

SEQ ID NO: 176166 - DNA, 25 bp, Homo sapien
acatttaaagggaccagcgcgtgcc

SEQ ID NO: 176167 - DNA, 25 bp, Homo sapien
catcctgagttaatgagcggccgga

SEQ ID NO: 176168 - DNA, 25 bp, Homo sapien
gcggccggaggcaacaaacccaaga

SEQ ID NO: 176169 - DNA, 25 bp, Homo sapien
agcccacggggccttggagcactca

SEQ ID NO: 176170 - DNA, 25 bp, Homo sapien
ttgccaggccaaccagtagactcgg

SEQ ID NO: 176171 - DNA, 25 bp, Homo sapien
cgcgtttctggacggacgcgctcta

SEQ ID NO: 176172 - DNA, 25 bp, Homo sapien
tggacggacgcgctctaaaaggacc

SEQ ID NO: 176173 - DNA, 25 bp, Homo sapien
ggtcttccacgccatcctgagttaa

SEQ ID NO: 176174 - DNA, 25 bp, Homo sapien
cgaggagcgccgcacaaagaagccc

SEQ ID NO: 176175 - DNA, 25 bp, Homo sapien
acctcagagagttggaatgcgggca

SEQ ID NO: 176176 - DNA, 25 bp, Homo sapien
tgtctccaaaaacccggctcgcaga

SEQ ID NO: 176177 - DNA, 25 bp, Homo sapien
gcacgcctcacttcctgtctccaaa

SEQ ID NO: 176178 - DNA, 25 bp, Homo sapien
cgctcatggggctcgcacgcctcac

SEQ ID NO: 176179 - DNA, 25 bp, Homo sapien
cattcccctgggcagagtccggcgg

SEQ ID NO: 176180 - DNA, 25 bp, Homo sapien
ggcccgtgacctcagagagttggaa

SEQ ID NO: 176181 - DNA, 25 bp, Homo sapien
gacggacagaccgtcggaccgacgc

SEQ ID NO: 176182 - DNA, 25 bp, Homo sapien
atcggcaccgagatcagccgcaaga

SEQ ID NO: 176183 - DNA, 25 bp, Homo sapien
atcagccgcaagatccgggtgaggc

SEQ ID NO: 176184 - DNA, 25 bp, Homo sapien
ccgcagagccatggagatcggcacc

SEQ ID NO: 176185 - DNA, 25 bp, Homo sapien
ccgggtaagccaagcgccgcgcagt

SEQ ID NO: 176186 - DNA, 25 bp, Homo sapien
ctgagcacaggtttcgcgggtagaa

SEQ ID NO: 176187 - DNA, 25 bp, Homo sapien
gccctccttgcctgagcacaggttt

SEQ ID NO: 176188 - DNA, 25 bp, Homo sapien
aggcggagctgcaagaccacccgca

SEQ ID NO: 176189 - DNA, 25 bp, Homo sapien
ccgaggtgcgcgcaccagcaaagtg

SEQ ID NO: 176190 - DNA, 25 bp, Homo sapien
ccagagactataagtgggcttgagc

SEQ ID NO: 176191 - DNA, 25 bp, Homo sapien
cgggcatcaaggaccattgtgcgct

SEQ ID NO: 176192 - DNA, 25 bp, Homo sapien
ccattgtgcgctctaattggcaggc

SEQ ID NO: 176193 - DNA, 25 bp, Homo sapien
ctctaattggcaggcgcggattcgc

SEQ ID NO: 176194 - DNA, 25 bp, Homo sapien
gattcgctcgttggcgggcctcgct

SEQ ID NO: 176195 - DNA, 25 bp, Homo sapien
cgctgcttggcgcaagcgcggttat

SEQ ID NO: 176196 - DNA, 25 bp, Homo sapien
tccttacgcggtgccagagactata

SEQ ID NO: 176197 - DNA, 25 bp, Homo sapien
gcctgcgcgctagtccttacgcggt

SEQ ID NO: 176198 - DNA, 25 bp, Homo sapien
gtatacgatctccttggccgcagtg

SEQ ID NO: 176199 - DNA, 25 bp, Homo sapien
tttgtagccacagcctggcggaccc

SEQ ID NO: 176200 - DNA, 25 bp, Homo sapien
accagagagacagctgcggattccc

SEQ ID NO: 176201 - DNA, 25 bp, Homo sapien
gctgtcaagtggatgcccagagccc

SEQ ID NO: 176202 - DNA, 25 bp, Homo sapien
gaaaaccctcgcctcgcggaacatg

SEQ ID NO: 176203 - DNA, 25 bp, Homo sapien
ctcgttgagctgcttaagcccaggc

SEQ ID NO: 176204 - DNA, 25 bp, Homo sapien
gcccgtcaggtgcatctcgtttcgg

SEQ ID NO: 176205 - DNA, 25 bp, Homo sapien
cccggtacctgatgatgtcgtcgct

SEQ ID NO: 176206 - DNA, 25 bp, Homo sapien
ccgatctatgcacgcagatgctgga

SEQ ID NO: 176207 - DNA, 25 bp, Homo sapien
caccggcagccatgagctcggagat

SEQ ID NO: 176208 - DNA, 25 bp, Homo sapien
agttccagctctgcgccgatctatg

SEQ ID NO: 176209 - DNA, 25 bp, Homo sapien
cttatgaccaggtaccggccagctc

SEQ ID NO: 176210 - DNA, 25 bp, Homo sapien
agcctgtgcatcctgacgctgaggc

SEQ ID NO: 176211 - DNA, 25 bp, Homo sapien
cgagaccttgtggagctgtgactag

SEQ ID NO: 176212 - DNA, 25 bp, Homo sapien
tgactagcgggtccgctgtccgcca

SEQ ID NO: 176213 - DNA, 25 bp, Homo sapien
tattttaggcgcaggaagttccagc

SEQ ID NO: 176214 - DNA, 25 bp, Homo sapien
acctgcgaggcagttgttgcccaaa

SEQ ID NO: 176215 - DNA, 25 bp, Homo sapien
cgctccgtccactcgtaactggtga

SEQ ID NO: 176216 - DNA, 25 bp, Homo sapien
cgcgaggccaagtgtaggtcattcc

SEQ ID NO: 176217 - DNA, 25 bp, Homo sapien
gacgcggaccctgaacgctcacatg

SEQ ID NO: 176218 - DNA, 25 bp, Homo sapien
cgctcacatgagatccttagggaaa

SEQ ID NO: 176219 - DNA, 25 bp, Homo sapien
agtccactctcctgtccgtaagaag

SEQ ID NO: 176220 - DNA, 25 bp, Homo sapien
ccgagttaatccgttctgcaagcta

SEQ ID NO: 176221 - DNA, 25 bp, Homo sapien
ccacactgttgagaggcggtgttca

SEQ ID NO: 176222 - DNA, 25 bp, Homo sapien
ccttggtggcaaactcatagtggtc

SEQ ID NO: 176223 - DNA, 25 bp, Homo sapien
ctgtcgtcctcttccgtgtcgctgg

SEQ ID NO: 176224 - DNA, 25 bp, Homo sapien
ttctggctgtgcttcctgtcgtcct

SEQ ID NO: 176225 - DNA, 25 bp, Homo sapien
cgcttcttgtgctgggatgcgtacc

SEQ ID NO: 176226 - DNA, 25 bp, Homo sapien
gaccttcctggccttggcgaagtgc

SEQ ID NO: 176227 - DNA, 25 bp, Homo sapien
gtctctttttgaggggcagtgtgtc

SEQ ID NO: 176228 - DNA, 25 bp, Homo sapien
gcttttcggtgcgtctctttttgag

SEQ ID NO: 176229 - DNA, 25 bp, Homo sapien
actcatagtggtcgtcggctgagga

SEQ ID NO: 176230 - DNA, 25 bp, Homo sapien
cctgtttctcatcttggggtctcca

SEQ ID NO: 176231 - DNA, 25 bp, Homo sapien
aaaggcgacacatgaccaggcagga

SEQ ID NO: 176232 - DNA, 25 bp, Homo sapien
gccgagcggcgagaaattgtttcca

SEQ ID NO: 176233 - DNA, 25 bp, Homo sapien
gatctttgttaggagcctgtttctc

SEQ ID NO: 176234 - DNA, 25 bp, Homo sapien
tcagcaggagccgacaaactttcgc

SEQ ID NO: 176235 - DNA, 25 bp, Homo sapien
accaactctgttccttgcgggcgtc

SEQ ID NO: 176236 - DNA, 25 bp, Homo sapien
gcaggaaactcttcggacccggcaa

SEQ ID NO: 176237 - DNA, 25 bp, Homo sapien
ttggggtctccacttgatcggaacc

SEQ ID NO: 176238 - DNA, 25 bp, Homo sapien
tctcggtcccttgcgaaagcggccg

SEQ ID NO: 176239 - DNA, 25 bp, Homo sapien
agcgccgcgagtctccgggcgaggc

SEQ ID NO: 176240 - DNA, 25 bp, Homo sapien
tgctgggtcctagtgcgcgccgcgc

SEQ ID NO: 176241 - DNA, 25 bp, Homo sapien
cgctgcttctcgcggccgcattggg

SEQ ID NO: 176242 - DNA, 25 bp, Homo sapien
tcccagcgccgcgagtctccgggcg

SEQ ID NO: 176243 - DNA, 25 bp, Homo sapien
tcggtcccttgcgaaagcggccgcg

SEQ ID NO: 176244 - DNA, 25 bp, Homo sapien
gcgacgctggactcgcgggtggccc

SEQ ID NO: 176245 - DNA, 25 bp, Homo sapien
agccctgctgggtcctagtgcgcgc

SEQ ID NO: 176246 - DNA, 25 bp, Homo sapien
caaatttagatgaatgcaacgcttc

SEQ ID NO: 176247 - DNA, 25 bp, Homo sapien
ccatcgggaagccacgtggtggccc

SEQ ID NO: 176248 - DNA, 25 bp, Homo sapien
ggagacggcgctcagcaaatttaga

SEQ ID NO: 176249 - DNA, 25 bp, Homo sapien
gtacaagtattgagtcccgcgccct

SEQ ID NO: 176250 - DNA, 25 bp, Homo sapien
cttccaggtcgagttgacggccttt

SEQ ID NO: 176251 - DNA, 25 bp, Homo sapien
ggcctcgcggctcattctgcgttgc

SEQ ID NO: 176252 - DNA, 25 bp, Homo sapien
ggcgactcggtttctccactgacac

SEQ ID NO: 176253 - DNA, 25 bp, Homo sapien
tgcaacgcttcaacgtgggctctcg

SEQ ID NO: 176254 - DNA, 25 bp, Homo sapien
ctgcactgcagcgtagccgcttggg

SEQ ID NO: 176255 - DNA, 25 bp, Homo sapien
tacgatgacccaagatggcggagcc

SEQ ID NO: 176256 - DNA, 25 bp, Homo sapien
ggagccgtgattgaaaacccagatt

SEQ ID NO: 176257 - DNA, 25 bp, Homo sapien
gctctgttctcccagcaggtgtccg

SEQ ID NO: 176258 - DNA, 25 bp, Homo sapien
tctcttcagtgagtgggtatagata

SEQ ID NO: 176259 - DNA, 25 bp, Homo sapien
gctttagggactgttctcttcagtg

SEQ ID NO: 176260 - DNA, 25 bp, Homo sapien
cggctactcctgctcagcatggctg

SEQ ID NO: 176261 - DNA, 25 bp, Homo sapien
ttcaagatggcgacttcctgcttcc

SEQ ID NO: 176262 - DNA, 25 bp, Homo sapien
acgagcgcttcagctgcatcaccgg

SEQ ID NO: 176263 - DNA, 25 bp, Homo sapien
tcagctgcatcaccgggtcctttta

SEQ ID NO: 176264 - DNA, 25 bp, Homo sapien
ttcagctgcatcaccgggtcctttt

SEQ ID NO: 176265 - DNA, 25 bp, Homo sapien
cttcagctgcatcaccgggtccttt

SEQ ID NO: 176266 - DNA, 25 bp, Homo sapien
agcgcttcagctgcatcaccgggtc

SEQ ID NO: 176267 - DNA, 25 bp, Homo sapien
gagcgcttcagctgcatcaccgggt

SEQ ID NO: 176268 - DNA, 25 bp, Homo sapien
gctgcatcaccgggtccttttaccg

SEQ ID NO: 176269 - DNA, 25 bp, Homo sapien
cgagcgcttcagctgcatcaccggg

SEQ ID NO: 176270 - DNA, 25 bp, Homo sapien
gcgccgagtgctaccgccgcgcgct

SEQ ID NO: 176271 - DNA, 25 bp, Homo sapien
agggctgccgctaccaatttcgggt

SEQ ID NO: 176272 - DNA, 25 bp, Homo sapien
ggctgccgctaccaatttcgggtcg

SEQ ID NO: 176273 - DNA, 25 bp, Homo sapien
tgccgctaccaatttcgggtcgcgc

SEQ ID NO: 176274 - DNA, 25 bp, Homo sapien
ccgctaccaatttcgggtcgcgctg

SEQ ID NO: 176275 - DNA, 25 bp, Homo sapien
taccaatttcgggtcgcgctgctgg

SEQ ID NO: 176276 - DNA, 25 bp, Homo sapien
cgagggctgccgctaccaatttcgg

SEQ ID NO: 176277 - DNA, 25 bp, Homo sapien
agacgtcgctgctgcggagctacgt

SEQ ID NO: 176278 - DNA, 25 bp, Homo sapien
agggactggcttcccacgtccgcga

SEQ ID NO: 176279 - DNA, 25 bp, Homo sapien
ctctggcctcggagaagaacatcgc

SEQ ID NO: 176280 - DNA, 25 bp, Homo sapien
ctcggagaagaacatcgcgactaca

SEQ ID NO: 176281 - DNA, 25 bp, Homo sapien
aacatcgcgactacaacaaccgagc

SEQ ID NO: 176282 - DNA, 25 bp, Homo sapien
ccgcggctcaggaagccgaacttca

SEQ ID NO: 176283 - DNA, 25 bp, Homo sapien
ggaagccgaacttcaccgcgcaact

SEQ ID NO: 176284 - DNA, 25 bp, Homo sapien
tccgacgtctcctcccattggacaa

SEQ ID NO: 176285 - DNA, 25 bp, Homo sapien
ccacttcctgtgttccgagggactg

SEQ ID NO: 176286 - DNA, 25 bp, Homo sapien
gtgatacgattaccggacagcatga

SEQ ID NO: 176287 - DNA, 25 bp, Homo sapien
cgatgtggcccagcaagttgcgcaa

SEQ ID NO: 176288 - DNA, 25 bp, Homo sapien
tgagcatcctgaacgccactggaag

SEQ ID NO: 176289 - DNA, 25 bp, Homo sapien
catgaatgtgatccgcgatgtggcc

SEQ ID NO: 176290 - DNA, 25 bp, Homo sapien
gagcgaggtgcgcatctttctacgg

SEQ ID NO: 176291 - DNA, 25 bp, Homo sapien
accgaagctctcatccgtcaatggg

SEQ ID NO: 176292 - DNA, 25 bp, Homo sapien
ggttcgttcagcaagcagccactgc

SEQ ID NO: 176293 - DNA, 25 bp, Homo sapien
agcagccactgcgaagtcttcggaa

SEQ ID NO: 176294 - DNA, 25 bp, Homo sapien
ggcctcgaggcacaagccgctgccg

SEQ ID NO: 176295 - DNA, 25 bp, Homo sapien
atcacagcgcctcagggggcgcgca

SEQ ID NO: 176296 - DNA, 25 bp, Homo sapien
ctttaggacccagcggtgggctctc

SEQ ID NO: 176297 - DNA, 25 bp, Homo sapien
gctgccgccagggtttgaactgcgc

SEQ ID NO: 176298 - DNA, 25 bp, Homo sapien
gatccgaggcaagcgttggttctgt

SEQ ID NO: 176299 - DNA, 25 bp, Homo sapien
caagcgttggttctgtgcgcctcag

SEQ ID NO: 176300 - DNA, 25 bp, Homo sapien
ttctgtgcgcctcaggtacgtgttg

SEQ ID NO: 176301 - DNA, 25 bp, Homo sapien
ggtttcctccgatcacagcgcctca

SEQ ID NO: 176302 - DNA, 25 bp, Homo sapien
gcgaccgtctctttgcgggaaactc

SEQ ID NO: 176303 - DNA, 25 bp, Homo sapien
ggcaaaactctggaacgcactaggc

SEQ ID NO: 176304 - DNA, 25 bp, Homo sapien
accaagggcgctctggcatggtcaa

SEQ ID NO: 176305 - DNA, 25 bp, Homo sapien
gcatcccagcgccaagcagacgtga

SEQ ID NO: 176306 - DNA, 25 bp, Homo sapien
caactaggaggcaccatcgtcgatc

SEQ ID NO: 176307 - DNA, 25 bp, Homo sapien
catcgtcgatctacctggggaggca

SEQ ID NO: 176308 - DNA, 25 bp, Homo sapien
ctgcgaagcgatagtcaaaggaacc

SEQ ID NO: 176309 - DNA, 25 bp, Homo sapien
agagccttgctactgttctgcatga

SEQ ID NO: 176310 - DNA, 25 bp, Homo sapien
ctccgccgaccagggctttgctgat

SEQ ID NO: 176311 - DNA, 25 bp, Homo sapien
cagaacggatcaggccgctggcttt

SEQ ID NO: 176312 - DNA, 25 bp, Homo sapien
ctgggacagccctcttctccttttg

SEQ ID NO: 176313 - DNA, 25 bp, Homo sapien
aggaactgggacagccctcttctcc

SEQ ID NO: 176314 - DNA, 25 bp, Homo sapien
tttctttccgctggtcgtcgcggtg

SEQ ID NO: 176315 - DNA, 25 bp, Homo sapien
tggtgagtgactaagggtttctttc

SEQ ID NO: 176316 - DNA, 25 bp, Homo sapien
agcggcagctcaagtggccaaggca

SEQ ID NO: 176317 - DNA, 25 bp, Homo sapien
accagggctttgctgatcggcgctg

SEQ ID NO: 176318 - DNA, 25 bp, Homo sapien
gtacctccgttcttctctataggga

SEQ ID NO: 176319 - DNA, 25 bp, Homo sapien
cggctcgtttgtgtgcttacctttc

SEQ ID NO: 176320 - DNA, 25 bp, Homo sapien
tgtgtgcttacctttcctggagctc

SEQ ID NO: 176321 - DNA, 25 bp, Homo sapien
tgggaacagcgccatgaccacaggc

SEQ ID NO: 176322 - DNA, 25 bp, Homo sapien
ggccgtacctccgttcttctctata

SEQ ID NO: 176323 - DNA, 25 bp, Homo sapien
ttcttctctatagggatggcgccgg

SEQ ID NO: 176324 - DNA, 25 bp, Homo sapien
gaaatgtggttttcgcggcgctctc

SEQ ID NO: 176325 - DNA, 25 bp, Homo sapien
aacagcgccatgaccacaggccgta

SEQ ID NO: 176326 - DNA, 25 bp, Homo sapien
caccctcatgggcactttgtttcta

SEQ ID NO: 176327 - DNA, 25 bp, Homo sapien
gtccgcgctgccactagtaaagatg

SEQ ID NO: 176328 - DNA, 25 bp, Homo sapien
aactcgggcgcagagcctatttcta

SEQ ID NO: 176329 - DNA, 25 bp, Homo sapien
gctcttttcggccaaccactgcagg

SEQ ID NO: 176330 - DNA, 25 bp, Homo sapien
cggcctatcagagcgtccttgtcaa

SEQ ID NO: 176331 - DNA, 25 bp, Homo sapien
ctccgctgggagatatagtgccctc

SEQ ID NO: 176332 - DNA, 25 bp, Homo sapien
tggcgccgcagaaatgagataaacg

SEQ ID NO: 176333 - DNA, 25 bp, Homo sapien
tttctactggccaaagagcgccgcc

SEQ ID NO: 176334 - DNA, 25 bp, Homo sapien
ccttcgctcgcaccatggtaggtcg

SEQ ID NO: 176335 - DNA, 25 bp, Homo sapien
gcctcggtgcaccaggaggcacttc

SEQ ID NO: 176336 - DNA, 25 bp, Homo sapien
tggcttgttcctgccgctttcgcac

SEQ ID NO: 176337 - DNA, 25 bp, Homo sapien
cctctgccagggagcttcatttatt

SEQ ID NO: 176338 - DNA, 25 bp, Homo sapien
ctgcgcttaaaggaggttgcatttt

SEQ ID NO: 176339 - DNA, 25 bp, Homo sapien
tttctgagtgttacgcagcagctgc

SEQ ID NO: 176340 - DNA, 25 bp, Homo sapien
ggcgtagcagctgcccgagatttct

SEQ ID NO: 176341 - DNA, 25 bp, Homo sapien
ccgagatttcttcccagatttctag

SEQ ID NO: 176342 - DNA, 25 bp, Homo sapien
cgtcgctgggtcagctgtttcgagc

SEQ ID NO: 176343 - DNA, 25 bp, Homo sapien
ccgctgctgcgtgtccctttctgag

SEQ ID NO: 176344 - DNA, 25 bp, Homo sapien
cctttctgaggcctcggaccgcacc

SEQ ID NO: 176345 - DNA, 25 bp, Homo sapien
gcccggctcggtagcctgatcagtc

SEQ ID NO: 176346 - DNA, 25 bp, Homo sapien
tagcctgatcagtcgcgttcccggc

SEQ ID NO: 176347 - DNA, 25 bp, Homo sapien
gggtcgatctgtgcagacgctgcta

SEQ ID NO: 176348 - DNA, 25 bp, Homo sapien
ttccgcagtcgtcgctgggtcagct

SEQ ID NO: 176349 - DNA, 25 bp, Homo sapien
agacgctgctagtggttccgcagtc

SEQ ID NO: 176350 - DNA, 25 bp, Homo sapien
gaggatcttctccgccagactgtag

SEQ ID NO: 176351 - DNA, 25 bp, Homo sapien
caaggctgtcaggaagcactccgta

SEQ ID NO: 176352 - DNA, 25 bp, Homo sapien
aggaagcactccgtagccgccgcat

SEQ ID NO: 176353 - DNA, 25 bp, Homo sapien
cgccgcatcgttgccctgagcttgg

SEQ ID NO: 176354 - DNA, 25 bp, Homo sapien
tgccctgagcttggaggacctcgcc

SEQ ID NO: 176355 - DNA, 25 bp, Homo sapien
agcccgttccagacctcgtgggctg

SEQ ID NO: 176356 - DNA, 25 bp, Homo sapien
gctgtcgagttcacctgcaccgcgt

SEQ ID NO: 176357 - DNA, 25 bp, Homo sapien
agacctcgtgggctgtcgagttcac

SEQ ID NO: 176358 - DNA, 25 bp, Homo sapien
ggtctcctaggggacagcctctatt

SEQ ID NO: 176359 - DNA, 25 bp, Homo sapien
tcccagtccttggaagaactttaca

SEQ ID NO: 176360 - DNA, 25 bp, Homo sapien
ggccgcgtttccgtacacacaaagc

SEQ ID NO: 176361 - DNA, 25 bp, Homo sapien
cgcgagagtttgttgtttcttcgac

SEQ ID NO: 176362 - DNA, 25 bp, Homo sapien
cggctcctcgtcatgcgcgagagtt

SEQ ID NO: 176363 - DNA, 25 bp, Homo sapien
tctggaaccgcctgataaacatttg

SEQ ID NO: 176364 - DNA, 25 bp, Homo sapien
tccagatcgatccaacttttgcccg

SEQ ID NO: 176365 - DNA, 25 bp, Homo sapien
agctctccttgtgagccgggcgatc

SEQ ID NO: 176366 - DNA, 25 bp, Homo sapien
ccagaatgttgagcagaggccacgg

SEQ ID NO: 176367 - DNA, 25 bp, Homo sapien
cgtgggtatagccagaatgttgagc

SEQ ID NO: 176368 - DNA, 25 bp, Homo sapien
gccacgtgggtatagccagaatgtt

SEQ ID NO: 176369 - DNA, 25 bp, Homo sapien
caggtaggccacgtgggtatagcca

SEQ ID NO: 176370 - DNA, 25 bp, Homo sapien
gcagaagccacgcaggtaggccacg

SEQ ID NO: 176371 - DNA, 25 bp, Homo sapien
ccacatgggttcggctgggacgata

SEQ ID NO: 176372 - DNA, 25 bp, Homo sapien
cgataggcagaagccacatgggttc

SEQ ID NO: 176373 - DNA, 25 bp, Homo sapien
ccacggggtacagccgggacgatag

SEQ ID NO: 176374 - DNA, 25 bp, Homo sapien
tggaaccgacacgaatttcagactg

SEQ ID NO: 176375 - DNA, 25 bp, Homo sapien
gcagcttattagagatgcgccttca

SEQ ID NO: 176376 - DNA, 25 bp, Homo sapien
actggggtcaaatcttaggtatctg

SEQ ID NO: 176377 - DNA, 25 bp, Homo sapien
gattgctgtctctaaaccgctctta

SEQ ID NO: 176378 - DNA, 25 bp, Homo sapien
ttgattcctgtatgtccgccgctgg

SEQ ID NO: 176379 - DNA, 25 bp, Homo sapien
ccgccgctggcatgttatataaaag

SEQ ID NO: 176380 - DNA, 25 bp, Homo sapien
ctggccttgaaggtaaatcgtcaca

SEQ ID NO: 176381 - DNA, 25 bp, Homo sapien
tgcgccttcaaaatacccttcgagt

SEQ ID NO: 176382 - DNA, 25 bp, Homo sapien
tcgacgtgtcctccttcagtccgga

SEQ ID NO: 176383 - DNA, 25 bp, Homo sapien
tcccagcacaccaggatcgacgtgt

SEQ ID NO: 176384 - DNA, 25 bp, Homo sapien
agaggtcccaagactcgttcacagg

SEQ ID NO: 176385 - DNA, 25 bp, Homo sapien
cctgagtcagcttttagaggtccca

SEQ ID NO: 176386 - DNA, 25 bp, Homo sapien
gagtcctagctgatgtggccctgag

SEQ ID NO: 176387 - DNA, 25 bp, Homo sapien
gcggcagctagcagcgagtcctagc

SEQ ID NO: 176388 - DNA, 25 bp, Homo sapien
gcgcgactgcgctagaacgcggctc

SEQ ID NO: 176389 - DNA, 25 bp, Homo sapien
ttcacaggccgctaaacgcaaacta

SEQ ID NO: 176390 - DNA, 25 bp, Homo sapien
cagctgcttgacgagctcagggatc

SEQ ID NO: 176391 - DNA, 25 bp, Homo sapien
gctcgatctccgtctccagccgcga

SEQ ID NO: 176392 - DNA, 25 bp, Homo sapien
actggcactcggagcggcagcgctc

SEQ ID NO: 176393 - DNA, 25 bp, Homo sapien
agcttggccgacagctgcttgacga

SEQ ID NO: 176394 - DNA, 25 bp, Homo sapien
cgtaccgttggcgatgagcttggcc

SEQ ID NO: 176395 - DNA, 25 bp, Homo sapien
ttcttggtcgccatcgcggcctggc

SEQ ID NO: 176396 - DNA, 25 bp, Homo sapien
cccacaccgcgtgactccggggcac

SEQ ID NO: 176397 - DNA, 25 bp, Homo sapien
ttgacgagctcagggatccgctccc

SEQ ID NO: 176398 - DNA, 25 bp, Homo sapien
gagccgccttcgctgattggacaca

SEQ ID NO: 176399 - DNA, 25 bp, Homo sapien
agacgagtctctttcccgctctggc

SEQ ID NO: 176400 - DNA, 25 bp, Homo sapien
ttcccattgggcagtacgctgtgac

SEQ ID NO: 176401 - DNA, 25 bp, Homo sapien
cgcctcgctcctcgaattgttgttg

SEQ ID NO: 176402 - DNA, 25 bp, Homo sapien
gccactccgattggtgagacccaaa

SEQ ID NO: 176403 - DNA, 25 bp, Homo sapien
gtgcgcactcgcagtcaagaccttc

SEQ ID NO: 176404 - DNA, 25 bp, Homo sapien
cccagcttcgatctgttagtaaaca

SEQ ID NO: 176405 - DNA, 25 bp, Homo sapien
gtccgcagctcgtgcttgacagtga

SEQ ID NO: 176406 - DNA, 25 bp, Homo sapien
tgagaccagttgtcgtgctgcagca

SEQ ID NO: 176407 - DNA, 25 bp, Homo sapien
ttctcgtacaggaggatgccgcaca

SEQ ID NO: 176408 - DNA, 25 bp, Homo sapien
gcccacgctgatgtagatgttctcg

SEQ ID NO: 176409 - DNA, 25 bp, Homo sapien
tgacctcctcgtgcatcaggaagta

SEQ ID NO: 176410 - DNA, 25 bp, Homo sapien
gtgctggttctcgtcctcgatgacc

SEQ ID NO: 176411 - DNA, 25 bp, Homo sapien
gcccaccaggaagcggtagtagttg

SEQ ID NO: 176412 - DNA, 25 bp, Homo sapien
gtggtctcgctgacgaagcagtaga

SEQ ID NO: 176413 - DNA, 25 bp, Homo sapien
gccaggaagatgaccacggtgctga

SEQ ID NO: 176414 - DNA, 25 bp, Homo sapien
caaacggactcggaatggccggtgc

SEQ ID NO: 176415 - DNA, 25 bp, Homo sapien
aaatgaagggctcgcggtgtctcgc

SEQ ID NO: 176416 - DNA, 25 bp, Homo sapien
gctcgcggtgtctcgcactttttgt

SEQ ID NO: 176417 - DNA, 25 bp, Homo sapien
cttgccagcgcgcacgcagatggcg

SEQ ID NO: 176418 - DNA, 25 bp, Homo sapien
aacgcagggccaagttgtgctccga

SEQ ID NO: 176419 - DNA, 25 bp, Homo sapien
ggagtaattaccaggtggccgcgga

SEQ ID NO: 176420 - DNA, 25 bp, Homo sapien
cagatctgggggatgtaaaggccca

SEQ ID NO: 176421 - DNA, 25 bp, Homo sapien
ggccaagttgtgctccgattccacg

SEQ ID NO: 176422 - DNA, 25 bp, Homo sapien
cgctgaaggtcagccgttcccgggt

SEQ ID NO: 176423 - DNA, 25 bp, Homo sapien
gctggcgccgccgtcaaccctcgcc

SEQ ID NO: 176424 - DNA, 25 bp, Homo sapien
actcacctctgtcgggtcccgggtg

SEQ ID NO: 176425 - DNA, 25 bp, Homo sapien
ctcgctgaaggtcagccgttcccgg

SEQ ID NO: 176426 - DNA, 25 bp, Homo sapien
ggcctcgctgaaggtcagccgttcc

SEQ ID NO: 176427 - DNA, 25 bp, Homo sapien
ccggcctcgctgaaggtcagccgtt

SEQ ID NO: 176428 - DNA, 25 bp, Homo sapien
gagccggcctcgctgaaggtcagcc

SEQ ID NO: 176429 - DNA, 25 bp, Homo sapien
cacctctgtcgggtcccgggtgcag

SEQ ID NO: 176430 - DNA, 25 bp, Homo sapien
gtactcataccacacggtctgcgga

SEQ ID NO: 176431 - DNA, 25 bp, Homo sapien
ttcaggtttgcgagctcaaccacga

SEQ ID NO: 176432 - DNA, 25 bp, Homo sapien
gagacgctccctcgactgcagtcct

SEQ ID NO: 176433 - DNA, 25 bp, Homo sapien
acagtcacacacagccgtactcata

SEQ ID NO: 176434 - DNA, 25 bp, Homo sapien
agctcaaccacgagacagtcacaca

SEQ ID NO: 176435 - DNA, 25 bp, Homo sapien
tcggaaggcgcgtcagtagttttca

SEQ ID NO: 176436 - DNA, 25 bp, Homo sapien
cagtagttttcaggtttgcgagctc

SEQ ID NO: 176437 - DNA, 25 bp, Homo sapien
ggagccaaatcgggagaccgacctg

SEQ ID NO: 176438 - DNA, 25 bp, Homo sapien
tcttctgcacagttggagcccagtg

SEQ ID NO: 176439 - DNA, 25 bp, Homo sapien
cggtcgccacgctgaatttctactt

SEQ ID NO: 176440 - DNA, 25 bp, Homo sapien
gaatttctacttggctcgtaacaca

SEQ ID NO: 176441 - DNA, 25 bp, Homo sapien
cgtaacacatctaagcgaaggcgca

SEQ ID NO: 176442 - DNA, 25 bp, Homo sapien
gcgaaggcgcacatgcagtcaccca

SEQ ID NO: 176443 - DNA, 25 bp, Homo sapien
cctggcacgttcctgcacacgtgtg

SEQ ID NO: 176444 - DNA, 25 bp, Homo sapien
cgtcgcgctcttctgcacagttgga

SEQ ID NO: 176445 - DNA, 25 bp, Homo sapien
acacgtgtgcacagccaccggtgcg

SEQ ID NO: 176446 - DNA, 25 bp, Homo sapien
tactcggccgattgccgctcgtgca

SEQ ID NO: 176447 - DNA, 25 bp, Homo sapien
gtggagttctccacctgccgagagg

SEQ ID NO: 176448 - DNA, 25 bp, Homo sapien
aggctttcgttctccgtctccttgg

SEQ ID NO: 176449 - DNA, 25 bp, Homo sapien
gctcgagcagacacgaaaatagccg

SEQ ID NO: 176450 - DNA, 25 bp, Homo sapien
tcgtaggccgctgtaagttgctcct

SEQ ID NO: 176451 - DNA, 25 bp, Homo sapien
cccaggtgctcgtggtcctgcagca

SEQ ID NO: 176452 - DNA, 25 bp, Homo sapien
agcaggtcaagtgctcgagcagaca

SEQ ID NO: 176453 - DNA, 25 bp, Homo sapien
cgctctgggaactcagcgtggagtt

SEQ ID NO: 176454 - DNA, 25 bp, Homo sapien
taaaaattgggttgaacatgagaac

SEQ ID NO: 176455 - DNA, 25 bp, Homo sapien
taaatgctcgcactgctcatacatc

SEQ ID NO: 176456 - DNA, 25 bp, Homo sapien
aatgctcgcactgctcatacatcca

SEQ ID NO: 176457 - DNA, 25 bp, Homo sapien
ttgggttgaacatgagaacataatc

SEQ ID NO: 176458 - DNA, 25 bp, Homo sapien
gaacatgagaacataatcattcata

SEQ ID NO: 176459 - DNA, 25 bp, Homo sapien
cattcatattttatccatttgcatg

SEQ ID NO: 176460 - DNA, 25 bp, Homo sapien
gttgcagctctcctgcagctgtggg

SEQ ID NO: 176461 - DNA, 25 bp, Homo sapien
gttgaacatgagaacataatcattc

SEQ ID NO: 176462 - DNA, 25 bp, Homo sapien
tggcacacagacaagcgaccggggt

SEQ ID NO: 176463 - DNA, 25 bp, Homo sapien
gaccctcccgggtcaagttcacaga

SEQ ID NO: 176464 - DNA, 25 bp, Homo sapien
gggtcctctgctcccataaaaaaca

SEQ ID NO: 176465 - DNA, 25 bp, Homo sapien
gccaccagtggcctatgtccataac

SEQ ID NO: 176466 - DNA, 25 bp, Homo sapien
ggccgggaatcgagtctgccatgtt

SEQ ID NO: 176467 - DNA, 25 bp, Homo sapien
tggcaagctcttggttgactgtccc

SEQ ID NO: 176468 - DNA, 25 bp, Homo sapien
ggtcaccaagtcctgcgcagcagag

SEQ ID NO: 176469 - DNA, 25 bp, Homo sapien
ccatgttcgctttcagacgggcctc

SEQ ID NO: 176470 - DNA, 25 bp, Homo sapien
cgtccagaccgtcccgaaatctgtg

SEQ ID NO: 176471 - DNA, 25 bp, Homo sapien
tagagagcctcttgcgcgtccagac

SEQ ID NO: 176472 - DNA, 25 bp, Homo sapien
ctcggccagtggtcccgagagacat

SEQ ID NO: 176473 - DNA, 25 bp, Homo sapien
tgcccacgctgactcggccagtggt

SEQ ID NO: 176474 - DNA, 25 bp, Homo sapien
catccctgacccatggcgctgaaga

SEQ ID NO: 176475 - DNA, 25 bp, Homo sapien
ggagccagcctagctgccagcgagc

SEQ ID NO: 176476 - DNA, 25 bp, Homo sapien
cggaaacaaaagagtctcgccggcg

SEQ ID NO: 176477 - DNA, 25 bp, Homo sapien
tcccgaaatctgtgcttcacggtca

SEQ ID NO: 176478 - DNA, 25 bp, Homo sapien
gcggtgggccttgcagtcttcttct

SEQ ID NO: 176479 - DNA, 25 bp, Homo sapien
tgatcatcattgaggtggacgagga

SEQ ID NO: 176480 - DNA, 25 bp, Homo sapien
gacaaggtctgacgcccaccgccgg

SEQ ID NO: 176481 - DNA, 25 bp, Homo sapien
agtcttcttcttcagacgccatggg

SEQ ID NO: 176482 - DNA, 25 bp, Homo sapien
ttcttcttcagacgccatgggaccc

SEQ ID NO: 176483 - DNA, 25 bp, Homo sapien
tctactgccagcgttccctgctgga

SEQ ID NO: 176484 - DNA, 25 bp, Homo sapien
actgccagcgttccctgctggacaa

SEQ ID NO: 176485 - DNA, 25 bp, Homo sapien
aggagacggaggtgatcatcattga

SEQ ID NO: 176486 - DNA, 25 bp, Homo sapien
ccgcgttccagagcggaagaaataa

SEQ ID NO: 176487 - DNA, 25 bp, Homo sapien
caggaggaaaaacttcctcgccact

SEQ ID NO: 176488 - DNA, 25 bp, Homo sapien
ggcaacagacacgagacaggaggaa

SEQ ID NO: 176489 - DNA, 25 bp, Homo sapien
cttttctcccgcgttccagagcgga

SEQ ID NO: 176490 - DNA, 25 bp, Homo sapien
cgcgcggggcaacagacacgagaca

SEQ ID NO: 176491 - DNA, 25 bp, Homo sapien
aggacttttcaataaatgtctcacg

SEQ ID NO: 176492 - DNA, 25 bp, Homo sapien
tgtctcacgtctcaaatccattgta

SEQ ID NO: 176493 - DNA, 25 bp, Homo sapien
cagtctgttcgctttcccattcggc

SEQ ID NO: 176494 - DNA, 25 bp, Homo sapien
accactttgccggaggcgagctaaa

SEQ ID NO: 176495 - DNA, 25 bp, Homo sapien
gggcaaagaagaaactttatgttga

SEQ ID NO: 176496 - DNA, 25 bp, Homo sapien
tcctcacgcttgtgcgcggcgcgat

SEQ ID NO: 176497 - DNA, 25 bp, Homo sapien
tatgttgagtttaggccttaggggc

SEQ ID NO: 176498 - DNA, 25 bp, Homo sapien
gggctgcctgccttctaaaagttcc

SEQ ID NO: 176499 - DNA, 25 bp, Homo sapien
gcgagctaaattccagccggggttc

SEQ ID NO: 176500 - DNA, 25 bp, Homo sapien
ggttcctagcagcagcttagtggca

SEQ ID NO: 176501 - DNA, 25 bp, Homo sapien
accgtgccatgttccgggctgcctg

SEQ ID NO: 176502 - DNA, 25 bp, Homo sapien
atgatctccgcgaagcagcttcccg

SEQ ID NO: 176503 - DNA, 25 bp, Homo sapien
gtcgcgccctgtgttcgtcatcagc

SEQ ID NO: 176504 - DNA, 25 bp, Homo sapien
cgtggatacgtttgcggcctctgcc

SEQ ID NO: 176505 - DNA, 25 bp, Homo sapien
ttgcacgcaccgtcgtgcgagcgct

SEQ ID NO: 176506 - DNA, 25 bp, Homo sapien
aactgctaccactgcccgggagact

SEQ ID NO: 176507 - DNA, 25 bp, Homo sapien
cgacaggcgcctgatcctgctgcaa

SEQ ID NO: 176508 - DNA, 25 bp, Homo sapien
ttttaaacgtcagaagccgacaggc

SEQ ID NO: 176509 - DNA, 25 bp, Homo sapien
cgccgccatattttccttccttata

SEQ ID NO: 176510 - DNA, 25 bp, Homo sapien
cagcgtggtttctccttctccggga

SEQ ID NO: 176511 - DNA, 25 bp, Homo sapien
cccgttgggtgctcatgacgcaaag

SEQ ID NO: 176512 - DNA, 25 bp, Homo sapien
ctaggatttgctcctcacagcggga

SEQ ID NO: 176513 - DNA, 25 bp, Homo sapien
tggccgggcacttacgtgtttcaaa

SEQ ID NO: 176514 - DNA, 25 bp, Homo sapien
acgtgtttcaaagcgggtgacagcc

SEQ ID NO: 176515 - DNA, 25 bp, Homo sapien
tcgggtgtactgttcgctctctccc

SEQ ID NO: 176516 - DNA, 25 bp, Homo sapien
tcccgccaggatccgagttcttgtt

SEQ ID NO: 176517 - DNA, 25 bp, Homo sapien
atgacgcaaaggtccctaggatttg

SEQ ID NO: 176518 - DNA, 25 bp, Homo sapien
tggtgccctccagaccaccgcgctt

SEQ ID NO: 176519 - DNA, 25 bp, Homo sapien
cgcttccagctgtcgcggggcctaa

SEQ ID NO: 176520 - DNA, 25 bp, Homo sapien
cgcggggcctaaagctctctcaggc

SEQ ID NO: 176521 - DNA, 25 bp, Homo sapien
gacaaaagagacagaactgacactc

SEQ ID NO: 176522 - DNA, 25 bp, Homo sapien
agacagaactgacactcacctccag

SEQ ID NO: 176523 - DNA, 25 bp, Homo sapien
agaagcgcacctgagccaagccacg

SEQ ID NO: 176524 - DNA, 25 bp, Homo sapien
actgtgactccggtcacctcgcgcg

SEQ ID NO: 176525 - DNA, 25 bp, Homo sapien
ccgtcggaagcccgagcacggagca

SEQ ID NO: 176526 - DNA, 25 bp, Homo sapien
tcacaacaatcttggggcgtctgcc

SEQ ID NO: 176527 - DNA, 25 bp, Homo sapien
actcacgatcgattgggaaaccaga

SEQ ID NO: 176528 - DNA, 25 bp, Homo sapien
gccctcagcgcaagcacctggtttt

SEQ ID NO: 176529 - DNA, 25 bp, Homo sapien
cgcgagaacgttgtcgcctccggaa

SEQ ID NO: 176530 - DNA, 25 bp, Homo sapien
cctcagtctggacacagctggttca

SEQ ID NO: 176531 - DNA, 25 bp, Homo sapien
tggttttgcttagccctcttcagta

SEQ ID NO: 176532 - DNA, 25 bp, Homo sapien
ctccagggactagaaactcacgatc

SEQ ID NO: 176533 - DNA, 25 bp, Homo sapien
gttttattccagaggggccgagcga

SEQ ID NO: 176534 - DNA, 25 bp, Homo sapien
taatgactttcctcagttccgtggg

SEQ ID NO: 176535 - DNA, 25 bp, Homo sapien
cgtttcaaagcagagccgacccttg

SEQ ID NO: 176536 - DNA, 25 bp, Homo sapien
gtgggttactcctgccaactcgacg

SEQ ID NO: 176537 - DNA, 25 bp, Homo sapien
ttgggccacttctttctcagctcta

SEQ ID NO: 176538 - DNA, 25 bp, Homo sapien
agggccttctgctcattcccacgaa

SEQ ID NO: 176539 - DNA, 25 bp, Homo sapien
gccgactccaggttctgcctagaaa

SEQ ID NO: 176540 - DNA, 25 bp, Homo sapien
tgccttcgcgagacaggatacgata

SEQ ID NO: 176541 - DNA, 25 bp, Homo sapien
gggcgatccgaccaaatatccttga

SEQ ID NO: 176542 - DNA, 25 bp, Homo sapien
aaggcagaagcaaacccactgggcg

SEQ ID NO: 176543 - DNA, 25 bp, Homo sapien
gaacgcggacactcactttctcgtg

SEQ ID NO: 176544 - DNA, 25 bp, Homo sapien
cactttctcgtggaagatggactcc

SEQ ID NO: 176545 - DNA, 25 bp, Homo sapien
gatggactccatgtttatttgtctg

SEQ ID NO: 176546 - DNA, 25 bp, Homo sapien
tttatttgtctggagccaacggccc

SEQ ID NO: 176547 - DNA, 25 bp, Homo sapien
gcacgcagaccaatcacccgtgagg

SEQ ID NO: 176548 - DNA, 25 bp, Homo sapien
atcacccgtgaggatgcgagtgtcg

SEQ ID NO: 176549 - DNA, 25 bp, Homo sapien
tgaacgccggggacacgtgaccttg

SEQ ID NO: 176550 - DNA, 25 bp, Homo sapien
agcaccgagggcttgcctagaaccc

SEQ ID NO: 176551 - DNA, 25 bp, Homo sapien
ggggtgacgccagcaaatcatacta

SEQ ID NO: 176552 - DNA, 25 bp, Homo sapien
gctagtctccagctccaaaatggcg

SEQ ID NO: 176553 - DNA, 25 bp, Homo sapien
tcctcagggttgactcctctcattt

SEQ ID NO: 176554 - DNA, 25 bp, Homo sapien
tgctgacccagcatcggcttttcta

SEQ ID NO: 176555 - DNA, 25 bp, Homo sapien
ggcttttctacgtcttgaacctgga

SEQ ID NO: 176556 - DNA, 25 bp, Homo sapien
agtgacttctccatgggtttcaagc

SEQ ID NO: 176557 - DNA, 25 bp, Homo sapien
ttcaagctcccagctgttttgcggc

SEQ ID NO: 176558 - DNA, 25 bp, Homo sapien
tagaggattgcggtttcccttcatc

SEQ ID NO: 176559 - DNA, 25 bp, Homo sapien
taccgaccggatgttagcagatttc

SEQ ID NO: 176560 - DNA, 25 bp, Homo sapien
gatttcccatagtgcctcgctagtg

SEQ ID NO: 176561 - DNA, 25 bp, Homo sapien
gcatgataacacacgccggagggtc

SEQ ID NO: 176562 - DNA, 25 bp, Homo sapien
tcatccaccggagcgatggcgtttc

SEQ ID NO: 176563 - DNA, 25 bp, Homo sapien
cgatggcgtttctccgaagcatgtg

SEQ ID NO: 176564 - DNA, 25 bp, Homo sapien
ctggcttgaactgagacgctccgct

SEQ ID NO: 176565 - DNA, 25 bp, Homo sapien
tgtctgttacgtacagcccttgtga

SEQ ID NO: 176566 - DNA, 25 bp, Homo sapien
tctccagcttttttgcaggtcggtg

SEQ ID NO: 176567 - DNA, 25 bp, Homo sapien
tgtggggcccgcagatctctctggt

SEQ ID NO: 176568 - DNA, 25 bp, Homo sapien
agcttttttgcaggtcggtgtcgcg

SEQ ID NO: 176569 - DNA, 25 bp, Homo sapien
tccagcttttttgcaggtcggtgtc

SEQ ID NO: 176570 - DNA, 25 bp, Homo sapien
gtgtcgcggcctcgcagatccccaa

SEQ ID NO: 176571 - DNA, 25 bp, Homo sapien
ccgtctccagcttttttgcaggtcg

SEQ ID NO: 176572 - DNA, 25 bp, Homo sapien
ggggcccgcagatctctctggttcc

SEQ ID NO: 176573 - DNA, 25 bp, Homo sapien
ccagcttttttgcaggtcggtgtcg

SEQ ID NO: 176574 - DNA, 25 bp, Homo sapien
ccaattaattttctcctgcatcttc

SEQ ID NO: 176575 - DNA, 25 bp, Homo sapien
gagctggtcccagcgggtccaagct

SEQ ID NO: 176576 - DNA, 25 bp, Homo sapien
agcgggtccaagctcgtgttggctt

SEQ ID NO: 176577 - DNA, 25 bp, Homo sapien
agctcgtgttggcttggtgcaagcc

SEQ ID NO: 176578 - DNA, 25 bp, Homo sapien
cttggtgcaagcctgtttgttagct

SEQ ID NO: 176579 - DNA, 25 bp, Homo sapien
agctctgcacgaccaattaattttc

SEQ ID NO: 176580 - DNA, 25 bp, Homo sapien
cctgtttgttagctctgcacgacca

SEQ ID NO: 176581 - DNA, 25 bp, Homo sapien
caagcctgtttgttagctctgcacg

SEQ ID NO: 176582 - DNA, 25 bp, Homo sapien
gctgacagtcggcaaagtttggccc

SEQ ID NO: 176583 - DNA, 25 bp, Homo sapien
agaccacagaagctccgggaccctt

SEQ ID NO: 176584 - DNA, 25 bp, Homo sapien
cccatcgggtagaccacagaagctc

SEQ ID NO: 176585 - DNA, 25 bp, Homo sapien
gcatccagagtacgggtcgagcccg

SEQ ID NO: 176586 - DNA, 25 bp, Homo sapien
ccagccctggcatccagagtacggg

SEQ ID NO: 176587 - DNA, 25 bp, Homo sapien
tccaaagttggcgaaaggcaccgcc

SEQ ID NO: 176588 - DNA, 25 bp, Homo sapien
tcggcaaagtttggcccgaagagga

SEQ ID NO: 176589 - DNA, 25 bp, Homo sapien
gcggcggacggagaaaacaactcca

SEQ ID NO: 176590 - DNA, 25 bp, Homo sapien
cgctcggccactgattgcactctgg

SEQ ID NO: 176591 - DNA, 25 bp, Homo sapien
cttcctcatcaggttggtcccaagg

SEQ ID NO: 176592 - DNA, 25 bp, Homo sapien
tgattgcactctggccgctgaagct

SEQ ID NO: 176593 - DNA, 25 bp, Homo sapien
ctccggccgctcaaagttcgcagga

SEQ ID NO: 176594 - DNA, 25 bp, Homo sapien
cggctgcaggtgtgtgttactaaga

SEQ ID NO: 176595 - DNA, 25 bp, Homo sapien
atgctgccgcagcaagtcggcttcg

SEQ ID NO: 176596 - DNA, 25 bp, Homo sapien
tggtcccaagggttcatccagtccc

SEQ ID NO: 176597 - DNA, 25 bp, Homo sapien
cgcccagaagagctgatggacgctc

SEQ ID NO: 176598 - DNA, 25 bp, Homo sapien
attacgagggagtgcgtcgctacct

SEQ ID NO: 176599 - DNA, 25 bp, Homo sapien
cccgctcgctccgatacaggaagta

SEQ ID NO: 176600 - DNA, 25 bp, Homo sapien
cttcttgtcccagagagtccttcgg

SEQ ID NO: 176601 - DNA, 25 bp, Homo sapien
ccgctggacccgatgttggctaaac

SEQ ID NO: 176602 - DNA, 25 bp, Homo sapien
ggccaggcatttcactgggaaccca

SEQ ID NO: 176603 - DNA, 25 bp, Homo sapien
tgggaacccagtgcacactttaggc

SEQ ID NO: 176604 - DNA, 25 bp, Homo sapien
acactttaggctgctggtggacgga

SEQ ID NO: 176605 - DNA, 25 bp, Homo sapien
ccgctgccgaatggcttttgacaaa

SEQ ID NO: 176606 - DNA, 25 bp, Homo sapien
tgtgttcgtcgagggctgcctgact

SEQ ID NO: 176607 - DNA, 25 bp, Homo sapien
cctgactgtgcgtttgctgggagat

SEQ ID NO: 176608 - DNA, 25 bp, Homo sapien
tttgctgggagatgcctgactgtgt

SEQ ID NO: 176609 - DNA, 25 bp, Homo sapien
actgtgtgttcgtcgagggctgcct

SEQ ID NO: 176610 - DNA, 25 bp, Homo sapien
tgcctgactgcgtttgctgggagat

SEQ ID NO: 176611 - DNA, 25 bp, Homo sapien
cgtttgctgggagatgcctgactgt

SEQ ID NO: 176612 - DNA, 25 bp, Homo sapien
cctgactgtgtgttcgtcgagggct

SEQ ID NO: 176613 - DNA, 25 bp, Homo sapien
gcctgactgtgcgtttgctgggaga

SEQ ID NO: 176614 - DNA, 25 bp, Homo sapien
gacgcgccttaattcatctcccaga

SEQ ID NO: 176615 - DNA, 25 bp, Homo sapien
gagcccaagcgcgacttccactttg

SEQ ID NO: 176616 - DNA, 25 bp, Homo sapien
gctcgacgaatcaaggccacacagg

SEQ ID NO: 176617 - DNA, 25 bp, Homo sapien
cttcttatctgtgctgccctccgtg

SEQ ID NO: 176618 - DNA, 25 bp, Homo sapien
gctcctctttgcagggactccgaga

SEQ ID NO: 176619 - DNA, 25 bp, Homo sapien
tcgcgtctccgcaggacttcatctg

SEQ ID NO: 176620 - DNA, 25 bp, Homo sapien
cgctgccgcactgcatcaagggcta

SEQ ID NO: 176621 - DNA, 25 bp, Homo sapien
ttcatctgcgtgtcgtacctggagc

SEQ ID NO: 176622 - DNA, 25 bp, Homo sapien
tccgttttctttcgggtcgcgctca

SEQ ID NO: 176623 - DNA, 25 bp, Homo sapien
taggccgtagtgcagcctctccgga

SEQ ID NO: 176624 - DNA, 25 bp, Homo sapien
gaggaggtttactcagcttgggccc

SEQ ID NO: 176625 - DNA, 25 bp, Homo sapien
agccactctgttgtggggtcctcgc

SEQ ID NO: 176626 - DNA, 25 bp, Homo sapien
gccgtgcaggcagctcgaaagccac

SEQ ID NO: 176627 - DNA, 25 bp, Homo sapien
caggtggctgttcgcgtctccctgc

SEQ ID NO: 176628 - DNA, 25 bp, Homo sapien
caccgcctgagtcgcctgcaggtgg

SEQ ID NO: 176629 - DNA, 25 bp, Homo sapien
gccctttgtgggtgtggcctttcac

SEQ ID NO: 176630 - DNA, 25 bp, Homo sapien
ctccgccgctgtcctggctcttctg

SEQ ID NO: 176631 - DNA, 25 bp, Homo sapien
ggccaagacccaccagctccaagcg

SEQ ID NO: 176632 - DNA, 25 bp, Homo sapien
tcctgccactgcagtgctcgagccc

SEQ ID NO: 176633 - DNA, 25 bp, Homo sapien
agacggacgcacgccgaggcactgc

SEQ ID NO: 176634 - DNA, 25 bp, Homo sapien
ggctcttctgctctgcgccgggcaa

SEQ ID NO: 176635 - DNA, 25 bp, Homo sapien
ctccacacttcccttcgggcgcggc

SEQ ID NO: 176636 - DNA, 25 bp, Homo sapien
ttcgggcgcggcgagttttcagcac

SEQ ID NO: 176637 - DNA, 25 bp, Homo sapien
cttgcgggaggatcgaccgacagac

SEQ ID NO: 176638 - DNA, 25 bp, Homo sapien
ctgggtccggaggaaatcgcccaca

SEQ ID NO: 176639 - DNA, 25 bp, Homo sapien
actcggcccggccagagatcctcac

SEQ ID NO: 176640 - DNA, 25 bp, Homo sapien
tttcttctcgctcagccagtagcca

SEQ ID NO: 176641 - DNA, 25 bp, Homo sapien
gtagccaactctcttccctttcaga

SEQ ID NO: 176642 - DNA, 25 bp, Homo sapien
ccctttcagaaaggtctgcatcttc

SEQ ID NO: 176643 - DNA, 25 bp, Homo sapien
ttcagcttcttgattttcttctcgc

SEQ ID NO: 176644 - DNA, 25 bp, Homo sapien
aaatcgcccacaggccgagtctggc

SEQ ID NO: 176645 - DNA, 25 bp, Homo sapien
tctgatgttcccagccgggccgtaa

SEQ ID NO: 176646 - DNA, 25 bp, Homo sapien
ccctaggctctgacggacactcggg

SEQ ID NO: 176647 - DNA, 25 bp, Homo sapien
gcctgtggtactgtctgcaacgaga

SEQ ID NO: 176648 - DNA, 25 bp, Homo sapien
ctgagtcgccagacccagagagcca

SEQ ID NO: 176649 - DNA, 25 bp, Homo sapien
tccagcccggattccacctgttttg

SEQ ID NO: 176650 - DNA, 25 bp, Homo sapien
tccacctgttttggtctcgctcggg

SEQ ID NO: 176651 - DNA, 25 bp, Homo sapien
accacgggacaggaaggtgagatcc

SEQ ID NO: 176652 - DNA, 25 bp, Homo sapien
tcagctttgcaagcaggctccgccg

SEQ ID NO: 176653 - DNA, 25 bp, Homo sapien
actcaccgtgatctagtgctcgtgc

SEQ ID NO: 176654 - DNA, 25 bp, Homo sapien
ccatgttacaaggtaggcatccctc

SEQ ID NO: 176655 - DNA, 25 bp, Homo sapien
atgccaactttagcccggacacctg

SEQ ID NO: 176656 - DNA, 25 bp, Homo sapien
ctggactttggagatgccaacttta

SEQ ID NO: 176657 - DNA, 25 bp, Homo sapien
cgcccaagttgcgttctggactttg

SEQ ID NO: 176658 - DNA, 25 bp, Homo sapien
cgagtttgtactggcgcgcccaagt

SEQ ID NO: 176659 - DNA, 25 bp, Homo sapien
aggcatccctcgtgttctcggactc

SEQ ID NO: 176660 - DNA, 25 bp, Homo sapien
cgcttccgcgtggacaggaagaaac

SEQ ID NO: 176661 - DNA, 25 bp, Homo sapien
ccctgtgcgaacttgactggcttca

SEQ ID NO: 176662 - DNA, 25 bp, Homo sapien
tggtgaccgctaagcttccagaaca

SEQ ID NO: 176663 - DNA, 25 bp, Homo sapien
gcgactccgagaagtgctcctactc

SEQ ID NO: 176664 - DNA, 25 bp, Homo sapien
atccgtttgtcggaagtcgctcctc

SEQ ID NO: 176665 - DNA, 25 bp, Homo sapien
cgttaccatgtccttcatctgggcc

SEQ ID NO: 176666 - DNA, 25 bp, Homo sapien
tatcgttggtcgacgtccttgagga

SEQ ID NO: 176667 - DNA, 25 bp, Homo sapien
tccttgtcattggttcctggcactc

SEQ ID NO: 176668 - DNA, 25 bp, Homo sapien
tcaccgtccaagtcctcgtctggag

SEQ ID NO: 176669 - DNA, 25 bp, Homo sapien
ctgtaccagagggtcgaataattcc

SEQ ID NO: 176670 - DNA, 25 bp, Homo sapien
cccatagacctctcggtagcactgg

SEQ ID NO: 176671 - DNA, 25 bp, Homo sapien
ggcgcccatagacctctcggtagca

SEQ ID NO: 176672 - DNA, 25 bp, Homo sapien
caggcgcccatagacctctcggtag

SEQ ID NO: 176673 - DNA, 25 bp, Homo sapien
atctcgatggaatgggcccaggtgc

SEQ ID NO: 176674 - DNA, 25 bp, Homo sapien
ttcaggatctcgatggaatgggccc

SEQ ID NO: 176675 - DNA, 25 bp, Homo sapien
tcaccttcaggatctcgatggaatg

SEQ ID NO: 176676 - DNA, 25 bp, Homo sapien
cttcaccttcaggatctcgatggaa

SEQ ID NO: 176677 - DNA, 25 bp, Homo sapien
gaactgcttgatggccggccggctg

SEQ ID NO: 176678 - DNA, 25 bp, Homo sapien
gttcttcaagcagcgctccaggtcg

SEQ ID NO: 176679 - DNA, 25 bp, Homo sapien
agctgcaagcacatcgagacgtcgg

SEQ ID NO: 176680 - DNA, 25 bp, Homo sapien
tgcaccacaacacgagggagctctt

SEQ ID NO: 176681 - DNA, 25 bp, Homo sapien
cgcgagagcctcaccaagaaagcca

SEQ ID NO: 176682 - DNA, 25 bp, Homo sapien
gccgcgcaacgccaagttcttcaag

SEQ ID NO: 176683 - DNA, 25 bp, Homo sapien
gtgtcacgacctctcggtgctctga

SEQ ID NO: 176684 - DNA, 25 bp, Homo sapien
caacgcgttctctggagctttgggc

SEQ ID NO: 176685 - DNA, 25 bp, Homo sapien
agccaagaggttcctcgccaacctg

SEQ ID NO: 176686 - DNA, 25 bp, Homo sapien
gcctcttgtggcagcatcctgctta

SEQ ID NO: 176687 - DNA, 25 bp, Homo sapien
tctcctctcctgtcagtggctcagg

SEQ ID NO: 176688 - DNA, 25 bp, Homo sapien
attcatgtttccgttcggcggccgg

SEQ ID NO: 176689 - DNA, 25 bp, Homo sapien
ccagatggccatttccacgaattca

SEQ ID NO: 176690 - DNA, 25 bp, Homo sapien
tgtcactactacgtcaccagatggc

SEQ ID NO: 176691 - DNA, 25 bp, Homo sapien
atcctgcttagtccagcgaattgtg

SEQ ID NO: 176692 - DNA, 25 bp, Homo sapien
cgccattttgactcctagacggagc

SEQ ID NO: 176693 - DNA, 25 bp, Homo sapien
gagtgcgcgcgcattatttttgctc

SEQ ID NO: 176694 - DNA, 25 bp, Homo sapien
tgtctcacctgacgcgatatgcctc

SEQ ID NO: 176695 - DNA, 25 bp, Homo sapien
cctcacgagcactggagcttgcgtt

SEQ ID NO: 176696 - DNA, 25 bp, Homo sapien
agcttgcgttacttggcctcacctc

SEQ ID NO: 176697 - DNA, 25 bp, Homo sapien
cggcactgcgaagatctagcgtttt

SEQ ID NO: 176698 - DNA, 25 bp, Homo sapien
atttaccatcctcggacgtcctcgg

SEQ ID NO: 176699 - DNA, 25 bp, Homo sapien
tttcgcggaggaatgatttaccatc

SEQ ID NO: 176700 - DNA, 25 bp, Homo sapien
gctgtccacgcctggctttgtctca

SEQ ID NO: 176701 - DNA, 25 bp, Homo sapien
tgagttgaggcccagccatcatggt

SEQ ID NO: 176702 - DNA, 25 bp, Homo sapien
tttacaggcccggagaacgccaatg

SEQ ID NO: 176703 - DNA, 25 bp, Homo sapien
cagattttggggcaaagcctttcca

SEQ ID NO: 176704 - DNA, 25 bp, Homo sapien
gggagctcacacgacacagattttg

SEQ ID NO: 176705 - DNA, 25 bp, Homo sapien
ccgaatggtagcgacacgggcctaa

SEQ ID NO: 176706 - DNA, 25 bp, Homo sapien
ttccgggaccgaattctgcaatttg

SEQ ID NO: 176707 - DNA, 25 bp, Homo sapien
cggtcgagcccattttcccatttca

SEQ ID NO: 176708 - DNA, 25 bp, Homo sapien
ccaccaaagcggagcagtgtaagta

SEQ ID NO: 176709 - DNA, 25 bp, Homo sapien
cctccgtgcgccttatgaatggaaa

SEQ ID NO: 176710 - DNA, 25 bp, Homo sapien
gaatactgcgtgcataccttggccc

SEQ ID NO: 176711 - DNA, 25 bp, Homo sapien
tccagaaacagccaagcacacttac

SEQ ID NO: 176712 - DNA, 25 bp, Homo sapien
cccggcgctggagcaaaagtttgcg

SEQ ID NO: 176713 - DNA, 25 bp, Homo sapien
gcaacataggcacctccgtgcgctg

SEQ ID NO: 176714 - DNA, 25 bp, Homo sapien
gcctcattgcgcacactgcaacata

SEQ ID NO: 176715 - DNA, 25 bp, Homo sapien
agaaacagccgtgcacacacactga

SEQ ID NO: 176716 - DNA, 25 bp, Homo sapien
tgtgagcacacttcaaacccggcgg

SEQ ID NO: 176717 - DNA, 25 bp, Homo sapien
tggggtgcccgagctctctactacc

SEQ ID NO: 176718 - DNA, 25 bp, Homo sapien
ccacgctacccaggacgcaggttaa

SEQ ID NO: 176719 - DNA, 25 bp, Homo sapien
tgaggaacttgagcagcgacaggca

SEQ ID NO: 176720 - DNA, 25 bp, Homo sapien
cgacaggcacttcatggcgaacatg

SEQ ID NO: 176721 - DNA, 25 bp, Homo sapien
cgtggcgatataggcgtcgatgttc

SEQ ID NO: 176722 - DNA, 25 bp, Homo sapien
acacgttgttgttgaccaccgcgaa

SEQ ID NO: 176723 - DNA, 25 bp, Homo sapien
agcatctgcacgatcctgccgggtc

SEQ ID NO: 176724 - DNA, 25 bp, Homo sapien
tgggccacacccaaaaggcgtgctc

SEQ ID NO: 176725 - DNA, 25 bp, Homo sapien
ccgaagggtgttaatcactagtcca

SEQ ID NO: 176726 - DNA, 25 bp, Homo sapien
ccggacggatactgagggccaagtc

SEQ ID NO: 176727 - DNA, 25 bp, Homo sapien
gtcgcctcctctttgttaagtagcc

SEQ ID NO: 176728 - DNA, 25 bp, Homo sapien
ttgcccgcctgagacgtcaatcgca

SEQ ID NO: 176729 - DNA, 25 bp, Homo sapien
atgtgcagctgaggaggtccagctc

SEQ ID NO: 176730 - DNA, 25 bp, Homo sapien
ctgaaatacggagtccggacggata

SEQ ID NO: 176731 - DNA, 25 bp, Homo sapien
cggctctggtcactatggtcagtga

SEQ ID NO: 176732 - DNA, 25 bp, Homo sapien
tgggacacagtggaggtctaacctt

SEQ ID NO: 176733 - DNA, 25 bp, Homo sapien
aggctgcagcactacgggtcgcctc

SEQ ID NO: 176734 - DNA, 25 bp, Homo sapien
ccgtcagtcgcgagtgaagaacctc

SEQ ID NO: 176735 - DNA, 25 bp, Homo sapien
ccctatggcaaactcagctacctga

SEQ ID NO: 176736 - DNA, 25 bp, Homo sapien
cgccaggcagagtagaagggcctct

SEQ ID NO: 176737 - DNA, 25 bp, Homo sapien
tctcgctttgtctcaggcacgaacg

SEQ ID NO: 176738 - DNA, 25 bp, Homo sapien
cgcgcgcacgaaaccgagaaaccga

SEQ ID NO: 176739 - DNA, 25 bp, Homo sapien
ctcgttttggtactcaccgtgtgga

SEQ ID NO: 176740 - DNA, 25 bp, Homo sapien
tctgatgaccggacaaggagcccaa

SEQ ID NO: 176741 - DNA, 25 bp, Homo sapien
ccaaggccgtcaggctctgatgacc

SEQ ID NO: 176742 - DNA, 25 bp, Homo sapien
gcgcgcgtcgaagccctatacatca

SEQ ID NO: 176743 - DNA, 25 bp, Homo sapien
ggtgatcaaaaacctcagcctggag

SEQ ID NO: 176744 - DNA, 25 bp, Homo sapien
cctggatacgaagcaggcgggcttc

SEQ ID NO: 176745 - DNA, 25 bp, Homo sapien
gccaaatggctatcaccaggagaga

SEQ ID NO: 176746 - DNA, 25 bp, Homo sapien
caccgagagcagacagaagacgcca

SEQ ID NO: 176747 - DNA, 25 bp, Homo sapien
tcttggtaaacaacaaacatgctcg

SEQ ID NO: 176748 - DNA, 25 bp, Homo sapien
cccaataccgtacagagagtccgaa

SEQ ID NO: 176749 - DNA, 25 bp, Homo sapien
taaatgcagatgtgggttaccctcc

SEQ ID NO: 176750 - DNA, 25 bp, Homo sapien
ttcctcagagcggaccgggtcctct

SEQ ID NO: 176751 - DNA, 25 bp, Homo sapien
gaccgggtcctctctagtctggacc

SEQ ID NO: 176752 - DNA, 25 bp, Homo sapien
ccaagagccggagaaagtcctgctg

SEQ ID NO: 176753 - DNA, 25 bp, Homo sapien
ccgccgcgatggatttcagtcagaa

SEQ ID NO: 176754 - DNA, 25 bp, Homo sapien
ggatttcagtcagaacagcctgttc

SEQ ID NO: 176755 - DNA, 25 bp, Homo sapien
cctgttcggttacatggaggacctg

SEQ ID NO: 176756 - DNA, 25 bp, Homo sapien
gcaggagctcaccatcatcgagagg

SEQ ID NO: 176757 - DNA, 25 bp, Homo sapien
tcaccatcatcgagaggccggtccg

SEQ ID NO: 176758 - DNA, 25 bp, Homo sapien
ccgccatcgggatgtttttaaagtg

SEQ ID NO: 176759 - DNA, 25 bp, Homo sapien
tttctcctcgcggaggtgcactttc

SEQ ID NO: 176760 - DNA, 25 bp, Homo sapien
ggtgaattaaccaaccggctccatg

SEQ ID NO: 176761 - DNA, 25 bp, Homo sapien
tccgggtacttggtctcctggaaga

SEQ ID NO: 176762 - DNA, 25 bp, Homo sapien
gcgtgttagagcatccatccgcaca

SEQ ID NO: 176763 - DNA, 25 bp, Homo sapien
cccgggcaggcactgaattccagtt

SEQ ID NO: 176764 - DNA, 25 bp, Homo sapien
ttcgcgaactctggccaaaagtttg

SEQ ID NO: 176765 - DNA, 25 bp, Homo sapien
tttgcaaactcctgcgcccgatcgg

SEQ ID NO: 176766 - DNA, 25 bp, Homo sapien
ttagtcctgtccgagggcactactg

SEQ ID NO: 176767 - DNA, 25 bp, Homo sapien
agagccattgcacggaggtttagtc

SEQ ID NO: 176768 - DNA, 25 bp, Homo sapien
tcgccgccgtaaggctaagtaagtg

SEQ ID NO: 176769 - DNA, 25 bp, Homo sapien
tctgttcgggtttcaaagagccatt

SEQ ID NO: 176770 - DNA, 25 bp, Homo sapien
gggaaagcccacttgtcaatttctg

SEQ ID NO: 176771 - DNA, 25 bp, Homo sapien
tgcaactcaggccactccaggggaa

SEQ ID NO: 176772 - DNA, 25 bp, Homo sapien
tctcaggctaattaaccaagggacc

SEQ ID NO: 176773 - DNA, 25 bp, Homo sapien
aaagttgtctgaagtcgccgccgta

SEQ ID NO: 176774 - DNA, 25 bp, Homo sapien
cgtccggggatgctgaactcgaaat

SEQ ID NO: 176775 - DNA, 25 bp, Homo sapien
ggccgtccctactcggatttgctga

SEQ ID NO: 176776 - DNA, 25 bp, Homo sapien
agcgtcctttggtagccgcccatca

SEQ ID NO: 176777 - DNA, 25 bp, Homo sapien
gcaaccaccgagttcccattgattg

SEQ ID NO: 176778 - DNA, 25 bp, Homo sapien
tcctaagtatgggtggagcaaactc

SEQ ID NO: 176779 - DNA, 25 bp, Homo sapien
tcgcggcaaccgtccaaagtacagg

SEQ ID NO: 176780 - DNA, 25 bp, Homo sapien
cccggctttggaaataacctcactg

SEQ ID NO: 176781 - DNA, 25 bp, Homo sapien
gcctgaatctcttcgtgacgccatt

SEQ ID NO: 176782 - DNA, 25 bp, Homo sapien
cgtgctaaacaaaccatcagggccc

SEQ ID NO: 176783 - DNA, 25 bp, Homo sapien
acaagtgtcctcaacgtgctaaaca

SEQ ID NO: 176784 - DNA, 25 bp, Homo sapien
aattgtccacctcgtgttgctaagc

SEQ ID NO: 176785 - DNA, 25 bp, Homo sapien
cccgcatcgcctggcgcaattggaa

SEQ ID NO: 176786 - DNA, 25 bp, Homo sapien
cgcctggcgcaattggaataacaaa

SEQ ID NO: 176787 - DNA, 25 bp, Homo sapien
ttggaataacaaatgcgacgcacgc

SEQ ID NO: 176788 - DNA, 25 bp, Homo sapien
tgcgacgcacgcaaattgtccacct

SEQ ID NO: 176789 - DNA, 25 bp, Homo sapien
gcgggcggaaactcacaagtgtcct

SEQ ID NO: 176790 - DNA, 25 bp, Homo sapien
agtcggatttttcgtgtcatgtgca

SEQ ID NO: 176791 - DNA, 25 bp, Homo sapien
tcgtgtcatgtgcaaaaagccggtg

SEQ ID NO: 176792 - DNA, 25 bp, Homo sapien
gcaaaaagccggtgtgtccttttca

SEQ ID NO: 176793 - DNA, 25 bp, Homo sapien
tccttttcaaggtacggagccctca

SEQ ID NO: 176794 - DNA, 25 bp, Homo sapien
agccctcatcggagggcgcattagc

SEQ ID NO: 176795 - DNA, 25 bp, Homo sapien
tcagaggaattaggagcaatgcgca

SEQ ID NO: 176796 - DNA, 25 bp, Homo sapien
gaattaggagcaatgcgcagagccc

SEQ ID NO: 176797 - DNA, 25 bp, Homo sapien
atcggatgcgtttaagtcggatttt

SEQ ID NO: 176798 - DNA, 25 bp, Homo sapien
gcagtctgctctcgccgtttttatt

SEQ ID NO: 176799 - DNA, 25 bp, Homo sapien
caaaggccacgtggtggggaaacag

SEQ ID NO: 176800 - DNA, 25 bp, Homo sapien
tggtcccgccacttggcagtctgct

SEQ ID NO: 176801 - DNA, 25 bp, Homo sapien
aatggtcccgccacttggcagtctg

SEQ ID NO: 176802 - DNA, 25 bp, Homo sapien
tggagctgtaaagccctctgggcgc

SEQ ID NO: 176803 - DNA, 25 bp, Homo sapien
tggcagtctgctctcgccgttttta

SEQ ID NO: 176804 - DNA, 25 bp, Homo sapien
ggggacacaatggtggcacagtgac

SEQ ID NO: 176805 - DNA, 25 bp, Homo sapien
cgcgaggtggagctgtaaagccctc

SEQ ID NO: 176806 - DNA, 25 bp, Homo sapien
agccactcaggagcagggagacagc

SEQ ID NO: 176807 - DNA, 25 bp, Homo sapien
agcgcctggactggaccttggcgtt

SEQ ID NO: 176808 - DNA, 25 bp, Homo sapien
ccgaggccggctaagtttggcagac

SEQ ID NO: 176809 - DNA, 25 bp, Homo sapien
gtttggcagactctctgagctctcg

SEQ ID NO: 176810 - DNA, 25 bp, Homo sapien
atgagagcgagcctgtgattggaca

SEQ ID NO: 176811 - DNA, 25 bp, Homo sapien
cacagccgcttggagaatcccactg

SEQ ID NO: 176812 - DNA, 25 bp, Homo sapien
aggttactccattcacctgggcctg

SEQ ID NO: 176813 - DNA, 25 bp, Homo sapien
ccggacacaaagctgctccgcggga

SEQ ID NO: 176814 - DNA, 25 bp, Homo sapien
caagtgacaggaacaacgagcggcc

SEQ ID NO: 176815 - DNA, 25 bp, Homo sapien
cctgggcaactgtaaacctggccgc

SEQ ID NO: 176816 - DNA, 25 bp, Homo sapien
ctgggctgcgttaccttgcaggttc

SEQ ID NO: 176817 - DNA, 25 bp, Homo sapien
tgcaggttctgcactcggatgtcgc

SEQ ID NO: 176818 - DNA, 25 bp, Homo sapien
cggatgtcgctaatctgcccgatga

SEQ ID NO: 176819 - DNA, 25 bp, Homo sapien
tgagctcctcgcgttggaaccagtc

SEQ ID NO: 176820 - DNA, 25 bp, Homo sapien
tcccactcgtgtgcagccatgaagc

SEQ ID NO: 176821 - DNA, 25 bp, Homo sapien
ccctaatgaaaatgcgagccctcgc

SEQ ID NO: 176822 - DNA, 25 bp, Homo sapien
ccctagcgctgagacaaatgcaccg

SEQ ID NO: 176823 - DNA, 25 bp, Homo sapien
ctcccaggcgcgaccttgatggagc

SEQ ID NO: 176824 - DNA, 25 bp, Homo sapien
aagcgctctattgagccggctggcg

SEQ ID NO: 176825 - DNA, 25 bp, Homo sapien
ccttgatggagcgacccttggccgc

SEQ ID NO: 176826 - DNA, 25 bp, Homo sapien
gccgggactcagacaatgcacaatg

SEQ ID NO: 176827 - DNA, 25 bp, Homo sapien
acaatgcacaatgcgccgagcctgg

SEQ ID NO: 176828 - DNA, 25 bp, Homo sapien
agcgcggccacaagcgctctattga

SEQ ID NO: 176829 - DNA, 25 bp, Homo sapien
aaatgcaccgtgtcgctgcccagcg

SEQ ID NO: 176830 - DNA, 25 bp, Homo sapien
actcgctctaagcagccgggcaact

SEQ ID NO: 176831 - DNA, 25 bp, Homo sapien
tgtgtagtccctaaagccaaagaga

SEQ ID NO: 176832 - DNA, 25 bp, Homo sapien
acaatattaagtgcgtggagaaacc

SEQ ID NO: 176833 - DNA, 25 bp, Homo sapien
ctccacagaaaggacttgaaaagta

SEQ ID NO: 176834 - DNA, 25 bp, Homo sapien
gtggagaaaccggaactcgctctaa

SEQ ID NO: 176835 - DNA, 25 bp, Homo sapien
gcgtgtgtggagaaaccggaaacca

SEQ ID NO: 176836 - DNA, 25 bp, Homo sapien
aaaccagaaccaggagcagccctgc

SEQ ID NO: 176837 - DNA, 25 bp, Homo sapien
caaaagaactatcagtgtgtagtcc

SEQ ID NO: 176838 - DNA, 25 bp, Homo sapien
gccagcacagaacggttggatttaa

SEQ ID NO: 176839 - DNA, 25 bp, Homo sapien
gcagatcttgccctcacagagcgga

SEQ ID NO: 176840 - DNA, 25 bp, Homo sapien
gcgcccagacatggaaaagggatta

SEQ ID NO: 176841 - DNA, 25 bp, Homo sapien
tccgggaaagttggatctgtgcgcc

SEQ ID NO: 176842 - DNA, 25 bp, Homo sapien
gggtcctgtccacgcttgcctggaa

SEQ ID NO: 176843 - DNA, 25 bp, Homo sapien
cccgtaggcgcgaaatccaagaaga

SEQ ID NO: 176844 - DNA, 25 bp, Homo sapien
cgcaagccttggtgacaggtcagcc

SEQ ID NO: 176845 - DNA, 25 bp, Homo sapien
tcgggaatttcgcagccagcacaga

SEQ ID NO: 176846 - DNA, 25 bp, Homo sapien
acccggagctccgacaaggtcaggc

SEQ ID NO: 176847 - DNA, 25 bp, Homo sapien
aagcggttgccgacgaccaatagta

SEQ ID NO: 176848 - DNA, 25 bp, Homo sapien
gacaaggtggtggtcttcctcaagg

SEQ ID NO: 176849 - DNA, 25 bp, Homo sapien
tgtccaatcacggagggcagtttag

SEQ ID NO: 176850 - DNA, 25 bp, Homo sapien
atgaggctccggcataaggcccacc

SEQ ID NO: 176851 - DNA, 25 bp, Homo sapien
gttgccctgcaagcgtgaccctgat

SEQ ID NO: 176852 - DNA, 25 bp, Homo sapien
ttccctcttgttttgcctctcgttg

SEQ ID NO: 176853 - DNA, 25 bp, Homo sapien
cagctggcctcattggctcacagga

SEQ ID NO: 176854 - DNA, 25 bp, Homo sapien
tacctcgatggttaagggcagccag

SEQ ID NO: 176855 - DNA, 25 bp, Homo sapien
tgacttgctccctggaacggtggca

SEQ ID NO: 176856 - DNA, 25 bp, Homo sapien
tttatatccgggcagcatgcggccg

SEQ ID NO: 176857 - DNA, 25 bp, Homo sapien
atgtggggccgaccctttatatccg

SEQ ID NO: 176858 - DNA, 25 bp, Homo sapien
gccatccgctccaaagctggctgta

SEQ ID NO: 176859 - DNA, 25 bp, Homo sapien
tcctcgggccgcctaagaagcaaga

SEQ ID NO: 176860 - DNA, 25 bp, Homo sapien
ggcgtgctgcttctcgtccaaatac

SEQ ID NO: 176861 - DNA, 25 bp, Homo sapien
gcagctcctgggaacgcagacccgg

SEQ ID NO: 176862 - DNA, 25 bp, Homo sapien
tgcgcgttctcatgctgtctctctc

SEQ ID NO: 176863 - DNA, 25 bp, Homo sapien
gggtgcagctctgcgcgttctcatg

SEQ ID NO: 176864 - DNA, 25 bp, Homo sapien
ccggaccggccatgtgctaaagttt

SEQ ID NO: 176865 - DNA, 25 bp, Homo sapien
cgaagagcagggcagctacggccac

SEQ ID NO: 176866 - DNA, 25 bp, Homo sapien
cgcaggtgcgcactgctgtgcttgc

SEQ ID NO: 176867 - DNA, 25 bp, Homo sapien
ctgcgccgattgctgccgccgaggt

SEQ ID NO: 176868 - DNA, 25 bp, Homo sapien
agaatgccttaacctgcgccgattg

SEQ ID NO: 176869 - DNA, 25 bp, Homo sapien
caggcggaggccacgtctttcccgg

SEQ ID NO: 176870 - DNA, 25 bp, Homo sapien
ctatttcggggacgcaattcaggtc

SEQ ID NO: 176871 - DNA, 25 bp, Homo sapien
aacaaccagagcgtctgccacagct

SEQ ID NO: 176872 - DNA, 25 bp, Homo sapien
gggacgagtcgccttaacaaccaga

SEQ ID NO: 176873 - DNA, 25 bp, Homo sapien
cctagtgtgtcagctatttcgggga

SEQ ID NO: 176874 - DNA, 25 bp, Homo sapien
cgggattccttgatactagtagcca

SEQ ID NO: 176875 - DNA, 25 bp, Homo sapien
tggggagtggcttttcctgccaatc

SEQ ID NO: 176876 - DNA, 25 bp, Homo sapien
ccacagctcccgaacaggagggatg

SEQ ID NO: 176877 - DNA, 25 bp, Homo sapien
tgtccacgccgggattccttgatac

SEQ ID NO: 176878 - DNA, 25 bp, Homo sapien
ctcaggctcgggataacgtgtcagc

SEQ ID NO: 176879 - DNA, 25 bp, Homo sapien
cgccaacagctcaggacttgggttg

SEQ ID NO: 176880 - DNA, 25 bp, Homo sapien
ttgcaggctggttcttgcaccaacc

SEQ ID NO: 176881 - DNA, 25 bp, Homo sapien
gggccctccgcctagtagagatctg

SEQ ID NO: 176882 - DNA, 25 bp, Homo sapien
gcagcgacaccatggatctctcctt

SEQ ID NO: 176883 - DNA, 25 bp, Homo sapien
tctctcctttatggccgcgcaggta

SEQ ID NO: 176884 - DNA, 25 bp, Homo sapien
ctgttttcccgaggcgccagtaatc

SEQ ID NO: 176885 - DNA, 25 bp, Homo sapien
gccagtaatctgtctcttgccggtg

SEQ ID NO: 176886 - DNA, 25 bp, Homo sapien
ccatccctatttggtgccgggagtc

SEQ ID NO: 176887 - DNA, 25 bp, Homo sapien
acccgagcattgaccggtgcccatt

SEQ ID NO: 176888 - DNA, 25 bp, Homo sapien
ccgccgcgcgacgaatttgttgtca

SEQ ID NO: 176889 - DNA, 25 bp, Homo sapien
ggtgcccattgtcagcaagttcttc

SEQ ID NO: 176890 - DNA, 25 bp, Homo sapien
tcctggcgcgttcacgagacccaga

SEQ ID NO: 176891 - DNA, 25 bp, Homo sapien
aatttgttgtcatccgcgaggcgcg

SEQ ID NO: 176892 - DNA, 25 bp, Homo sapien
tcccaaccggctcggagagagtgca

SEQ ID NO: 176893 - DNA, 25 bp, Homo sapien
caggtattgtttctgaggcagcttc

SEQ ID NO: 176894 - DNA, 25 bp, Homo sapien
gggccattccctcttcttcagaatt

SEQ ID NO: 176895 - DNA, 25 bp, Homo sapien
ttcggaaagaaaccatgcactgccc

SEQ ID NO: 176896 - DNA, 25 bp, Homo sapien
cgcggaaagcactcgcagggacatc

SEQ ID NO: 176897 - DNA, 25 bp, Homo sapien
ttagtcatcgggtcaagcggacaca

SEQ ID NO: 176898 - DNA, 25 bp, Homo sapien
ggcaacagcttttcttcgcagctga

SEQ ID NO: 176899 - DNA, 25 bp, Homo sapien
ttcgggagcccgaaactccatggca

SEQ ID NO: 176900 - DNA, 25 bp, Homo sapien
ttcccggaacgtgcgtctggaaaca

SEQ ID NO: 176901 - DNA, 25 bp, Homo sapien
tgctgagtaactcccacgtgtcggg

SEQ ID NO: 176902 - DNA, 25 bp, Homo sapien
ctgtctgaggttcacccgcgtggcg

SEQ ID NO: 176903 - DNA, 25 bp, Homo sapien
cgctgtctgaggttcacccgcgtgg

SEQ ID NO: 176904 - DNA, 25 bp, Homo sapien
gtgctccgctcgtccaccgccaccc

SEQ ID NO: 176905 - DNA, 25 bp, Homo sapien
gcccggaccgctgtctgaggttcac

SEQ ID NO: 176906 - DNA, 25 bp, Homo sapien
accgctgtctgaggttcacccgcgt

SEQ ID NO: 176907 - DNA, 25 bp, Homo sapien
gggcacggtgctccgctcgtccacc

SEQ ID NO: 176908 - DNA, 25 bp, Homo sapien
cggaccgctgtctgaggttcacccg

SEQ ID NO: 176909 - DNA, 25 bp, Homo sapien
gccaccccgtgcaggtgacatgcag

SEQ ID NO: 176910 - DNA, 25 bp, Homo sapien
ccactgctaagtgtgagaggaccca

SEQ ID NO: 176911 - DNA, 25 bp, Homo sapien
gatctctccgggttcttccttgcgc

SEQ ID NO: 176912 - DNA, 25 bp, Homo sapien
cccaaggcagcgactcatgcgagtc

SEQ ID NO: 176913 - DNA, 25 bp, Homo sapien
ggacctcacaatgcgccggaagcgg

SEQ ID NO: 176914 - DNA, 25 bp, Homo sapien
tccggaattgctggcggaacctcta

SEQ ID NO: 176915 - DNA, 25 bp, Homo sapien
gccggagacgatgccgttgtaagta

SEQ ID NO: 176916 - DNA, 25 bp, Homo sapien
ctagaacgttgctgtggtagcgctc

SEQ ID NO: 176917 - DNA, 25 bp, Homo sapien
ttaggaactccgcttcccgtgaggc

SEQ ID NO: 176918 - DNA, 25 bp, Homo sapien
gtgggaacccttgctgttgtgcgtc

SEQ ID NO: 176919 - DNA, 25 bp, Homo sapien
gtccctgtgacgtgggaacccttgc

SEQ ID NO: 176920 - DNA, 25 bp, Homo sapien
gctgtgtgtccatgtgacgtgttgc

SEQ ID NO: 176921 - DNA, 25 bp, Homo sapien
tccctgtgacgtgttctcgtgcggc

SEQ ID NO: 176922 - DNA, 25 bp, Homo sapien
gctgctgtgcgtccatgtgacatgt

SEQ ID NO: 176923 - DNA, 25 bp, Homo sapien
ccatgtgacatgtttccgtgctgcc

SEQ ID NO: 176924 - DNA, 25 bp, Homo sapien
atgtttccgtgctgccgtgcgtccc

SEQ ID NO: 176925 - DNA, 25 bp, Homo sapien
atgtgacgtgttgccgtgctgctgt

SEQ ID NO: 176926 - DNA, 25 bp, Homo sapien
ccacgcggtgagataggcatggtta

SEQ ID NO: 176927 - DNA, 25 bp, Homo sapien
cctaagtcgcggaagcgtagacacc

SEQ ID NO: 176928 - DNA, 25 bp, Homo sapien
gctccgtcgaagctttggtccatta

SEQ ID NO: 176929 - DNA, 25 bp, Homo sapien
cgtccactgatgagaggtgccacca

SEQ ID NO: 176930 - DNA, 25 bp, Homo sapien
gtttccatagtcattcgccagcgtc

SEQ ID NO: 176931 - DNA, 25 bp, Homo sapien
tggttatcaacccacgccaaggcgg

SEQ ID NO: 176932 - DNA, 25 bp, Homo sapien
cggggatggatgcttcacgcagtaa

SEQ ID NO: 176933 - DNA, 25 bp, Homo sapien
cctggcatagaaaacactgctgttg

SEQ ID NO: 176934 - DNA, 25 bp, Homo sapien
ctctagcgtcagcatcggggattac

SEQ ID NO: 176935 - DNA, 25 bp, Homo sapien
tggcgcggcgcagcaacctttgcgc

SEQ ID NO: 176936 - DNA, 25 bp, Homo sapien
gtgcctgggctcgtgcatttacacg

SEQ ID NO: 176937 - DNA, 25 bp, Homo sapien
gcatttacacgaagtccctccgaga

SEQ ID NO: 176938 - DNA, 25 bp, Homo sapien
cgggcgtgggtgattttattgcaaa

SEQ ID NO: 176939 - DNA, 25 bp, Homo sapien
caagcccggacccttggaagtggcg

SEQ ID NO: 176940 - DNA, 25 bp, Homo sapien
gcaggccctacgctttttgcgtttc

SEQ ID NO: 176941 - DNA, 25 bp, Homo sapien
atcggggattaccacgagctggccc

SEQ ID NO: 176942 - DNA, 25 bp, Homo sapien
ccatctgagctccacgttctggacg

SEQ ID NO: 176943 - DNA, 25 bp, Homo sapien
tgctttcttagaaacgggacaggca

SEQ ID NO: 176944 - DNA, 25 bp, Homo sapien
ctgcgatgttttgcggatacggaaa

SEQ ID NO: 176945 - DNA, 25 bp, Homo sapien
agggaaacaacacacgcagctgcga

SEQ ID NO: 176946 - DNA, 25 bp, Homo sapien
gagctcactctgtagaagggaaaca

SEQ ID NO: 176947 - DNA, 25 bp, Homo sapien
ctcgtcgcctccgagccaatgggaa

SEQ ID NO: 176948 - DNA, 25 bp, Homo sapien
aaggctccatactgcagggtgcgaa

SEQ ID NO: 176949 - DNA, 25 bp, Homo sapien
tgccgagttacgagtcggcgaaagc

SEQ ID NO: 176950 - DNA, 25 bp, Homo sapien
ggtttagggtccacagctcttgcca

SEQ ID NO: 176951 - DNA, 25 bp, Homo sapien
cacgcgtgacctgatcgctgcgaca

SEQ ID NO: 176952 - DNA, 25 bp, Homo sapien
ctcttgccaaattccagaggctgga

SEQ ID NO: 176953 - DNA, 25 bp, Homo sapien
aatcccacggtgcaggcccagagct

SEQ ID NO: 176954 - DNA, 25 bp, Homo sapien
cgctccttcagtttcgctatgcgga

SEQ ID NO: 176955 - DNA, 25 bp, Homo sapien
tggtggtctctgcatcgcctctctc

SEQ ID NO: 176956 - DNA, 25 bp, Homo sapien
tgggcatctgttcggcctcctctgt

SEQ ID NO: 176957 - DNA, 25 bp, Homo sapien
gaggactcagaaactctgctgcagc

SEQ ID NO: 176958 - DNA, 25 bp, Homo sapien
cgtcccgagtcccagattggattaa

SEQ ID NO: 176959 - DNA, 25 bp, Homo sapien
gaatctgctcttctgctttgcgggc

SEQ ID NO: 176960 - DNA, 25 bp, Homo sapien
tctgccgtgtgtttagctgaattca

SEQ ID NO: 176961 - DNA, 25 bp, Homo sapien
attcggttttcttcgccatggcagg

SEQ ID NO: 176962 - DNA, 25 bp, Homo sapien
ctaaagaggcctggtcatcgggacc

SEQ ID NO: 176963 - DNA, 25 bp, Homo sapien
tctgtcccacaaaggcagcctgagc

SEQ ID NO: 176964 - DNA, 25 bp, Homo sapien
ctgtgtcccttcatgaggctctgtc

SEQ ID NO: 176965 - DNA, 25 bp, Homo sapien
caacagtgtctcacggctcgggagc

SEQ ID NO: 176966 - DNA, 25 bp, Homo sapien
tggccggaatgactctcccagagct

SEQ ID NO: 176967 - DNA, 25 bp, Homo sapien
gttcccaacgccctgggttcgcatg

SEQ ID NO: 176968 - DNA, 25 bp, Homo sapien
tctgggcggccaaggattcccaaga

SEQ ID NO: 176969 - DNA, 25 bp, Homo sapien
caagagcgacgacggtctccggcca

SEQ ID NO: 176970 - DNA, 25 bp, Homo sapien
tgaagctctcaaggcggtgccgaga

SEQ ID NO: 176971 - DNA, 25 bp, Homo sapien
gaacctctcgttcgggccgggcgca

SEQ ID NO: 176972 - DNA, 25 bp, Homo sapien
agaccaagctgaaaggcccgggaag

SEQ ID NO: 176973 - DNA, 25 bp, Homo sapien
gaaagtgcactagaggccgcgacga

SEQ ID NO: 176974 - DNA, 25 bp, Homo sapien
tagagacatagatcgcgctcgcgcg

SEQ ID NO: 176975 - DNA, 25 bp, Homo sapien
ttctcggtcaggcacttggctaagc

SEQ ID NO: 176976 - DNA, 25 bp, Homo sapien
ggccctgcttctaacccgagtgtca

SEQ ID NO: 176977 - DNA, 25 bp, Homo sapien
cccgcgtcttgagagattctgatgc

SEQ ID NO: 176978 - DNA, 25 bp, Homo sapien
aaatgtggcttcctcacttcgcgaa

SEQ ID NO: 176979 - DNA, 25 bp, Homo sapien
cggcaccatgtgtgcgacgctatca

SEQ ID NO: 176980 - DNA, 25 bp, Homo sapien
atcatttacactgaggagccgggta

SEQ ID NO: 176981 - DNA, 25 bp, Homo sapien
caccatattgtgcaaggcgcgggct

SEQ ID NO: 176982 - DNA, 25 bp, Homo sapien
ccggtgcacgatgagattgctctgg

SEQ ID NO: 176983 - DNA, 25 bp, Homo sapien
taggcccacgttctccatgaccttg

SEQ ID NO: 176984 - DNA, 25 bp, Homo sapien
ccgcgcttctgcttgtcggccagga

SEQ ID NO: 176985 - DNA, 25 bp, Homo sapien
tctccaccttgatgcgcttggcggc

SEQ ID NO: 176986 - DNA, 25 bp, Homo sapien
tccatgctgaagctcgactcgggcc

SEQ ID NO: 176987 - DNA, 25 bp, Homo sapien
tgctctggaacttgaaggtcttgcc

SEQ ID NO: 176988 - DNA, 25 bp, Homo sapien
gccggctctcgttctccagtagcag

SEQ ID NO: 176989 - DNA, 25 bp, Homo sapien
gcagaactcgcacgacttgctcttg

SEQ ID NO: 176990 - DNA, 25 bp, Homo sapien
aggcggctccgattcactgcatgcc

SEQ ID NO: 176991 - DNA, 25 bp, Homo sapien
cccaaccattgagcccttggaggga

SEQ ID NO: 176992 - DNA, 25 bp, Homo sapien
ttgtgttctcctgtgtggcaatgaa

SEQ ID NO: 176993 - DNA, 25 bp, Homo sapien
tttgaagttgccaaagtgtccgcgc

SEQ ID NO: 176994 - DNA, 25 bp, Homo sapien
cccgcgcagttttgaagttgccaaa

SEQ ID NO: 176995 - DNA, 25 bp, Homo sapien
cacaatcaacgtgcgcagcgggcgc

SEQ ID NO: 176996 - DNA, 25 bp, Homo sapien
tatgcatggaccttgagccctctcg

SEQ ID NO: 176997 - DNA, 25 bp, Homo sapien
gtgctccgaggaagcctgcattcca

SEQ ID NO: 176998 - DNA, 25 bp, Homo sapien
ttgagcccggcaaacagccgcgcag

SEQ ID NO: 176999 - DNA, 25 bp, Homo sapien
ctgcgacctgccttgtttatttaga

SEQ ID NO: 177000 - DNA, 25 bp, Homo sapien
tggatttccactgcgacctgccttg

SEQ ID NO: 177001 - DNA, 25 bp, Homo sapien
tcgacacgatttcagccggtggatt

SEQ ID NO: 177002 - DNA, 25 bp, Homo sapien
agccacatgcttgaaatcgacacga

SEQ ID NO: 177003 - DNA, 25 bp, Homo sapien
acccaacagggacggtggaagctgc

SEQ ID NO: 177004 - DNA, 25 bp, Homo sapien
caaagccaccttcccggtgcaagtg

SEQ ID NO: 177005 - DNA, 25 bp, Homo sapien
agccgcgcagctggattattttgca

SEQ ID NO: 177006 - DNA, 25 bp, Homo sapien
ggctgctgtctgcacatgctcgtaa

SEQ ID NO: 177007 - DNA, 25 bp, Homo sapien
tctaccttgggctgctgtctgcaca

SEQ ID NO: 177008 - DNA, 25 bp, Homo sapien
aggagcacctggagagttaccacac

SEQ ID NO: 177009 - DNA, 25 bp, Homo sapien
acgggcgaaccacaaagcccggcag

SEQ ID NO: 177010 - DNA, 25 bp, Homo sapien
gtctgcacatgctcgtaacgacacc

SEQ ID NO: 177011 - DNA, 25 bp, Homo sapien
ggcacgctcgctctaccttgggctg

SEQ ID NO: 177012 - DNA, 25 bp, Homo sapien
gcacctggagagttaccacacgacc

SEQ ID NO: 177013 - DNA, 25 bp, Homo sapien
agcggcacgggcgaaccacaaagcc

SEQ ID NO: 177014 - DNA, 25 bp, Homo sapien
tactcgcccggactctaaatttgaa

SEQ ID NO: 177015 - DNA, 25 bp, Homo sapien
ggggcgatggcaccaacaatttaac

SEQ ID NO: 177016 - DNA, 25 bp, Homo sapien
cccagagtccgtgagcgagaacaga

SEQ ID NO: 177017 - DNA, 25 bp, Homo sapien
cctccacgtggtccaaagtctagta

SEQ ID NO: 177018 - DNA, 25 bp, Homo sapien
actcgcgctctctttctgagaacta

SEQ ID NO: 177019 - DNA, 25 bp, Homo sapien
ggtgagcactttgccctaggacaca

SEQ ID NO: 177020 - DNA, 25 bp, Homo sapien
tctggacccaaaacaccgcggcgtg

SEQ ID NO: 177021 - DNA, 25 bp, Homo sapien
tgccctggcttgcagttctgtaaac

SEQ ID NO: 177022 - DNA, 25 bp, Homo sapien
acgggcctcatcagcgcgcaaagct

SEQ ID NO: 177023 - DNA, 25 bp, Homo sapien
cgcaaagctgttaatgtctggtctc

SEQ ID NO: 177024 - DNA, 25 bp, Homo sapien
ccctttagtcttgctgcgctccatg

SEQ ID NO: 177025 - DNA, 25 bp, Homo sapien
tgcgctccatgtctcacgttccaag

SEQ ID NO: 177026 - DNA, 25 bp, Homo sapien
tctcacgttccaagccggatcaata

SEQ ID NO: 177027 - DNA, 25 bp, Homo sapien
agccggatcaatagccgcctctcgg

SEQ ID NO: 177028 - DNA, 25 bp, Homo sapien
tctctagatgcccagacagcaggcg

SEQ ID NO: 177029 - DNA, 25 bp, Homo sapien
gcagggagcgatcccagctgccact

SEQ ID NO: 177030 - DNA, 25 bp, Homo sapien
gagtgaccgtctactcggtcaggga

SEQ ID NO: 177031 - DNA, 25 bp, Homo sapien
gtgagtgaccgtccacacggtcagg

SEQ ID NO: 177032 - DNA, 25 bp, Homo sapien
gtgaccgtctacacggtcagggaga

SEQ ID NO: 177033 - DNA, 25 bp, Homo sapien
gcgagtgagtgaccgtccacacggt

SEQ ID NO: 177034 - DNA, 25 bp, Homo sapien
agggcgagtgagtgaccgtccacac

SEQ ID NO: 177035 - DNA, 25 bp, Homo sapien
tgagtgaccgtccacacggtcaggg

SEQ ID NO: 177036 - DNA, 25 bp, Homo sapien
agtgagtgaccgtctacagggtcag

SEQ ID NO: 177037 - DNA, 25 bp, Homo sapien
gtgaccgtctactcggtcagggaga

SEQ ID NO: 177038 - DNA, 25 bp, Homo sapien
ctcgttcctcttttgagagctctgc

SEQ ID NO: 177039 - DNA, 25 bp, Homo sapien
cccgccagagctttgattggacgaa

SEQ ID NO: 177040 - DNA, 25 bp, Homo sapien
tagcgcagcgggaacgacgtactcc

SEQ ID NO: 177041 - DNA, 25 bp, Homo sapien
cgttcattggcccacgcttcggacg

SEQ ID NO: 177042 - DNA, 25 bp, Homo sapien
cacgatgtcgcaactggctgcgttc

SEQ ID NO: 177043 - DNA, 25 bp, Homo sapien
gattggacgaatctcgacccgggcc

SEQ ID NO: 177044 - DNA, 25 bp, Homo sapien
cgcgcccaagttccgttagcaggtt

SEQ ID NO: 177045 - DNA, 25 bp, Homo sapien
gttcggttgctccagaatgcctttt

SEQ ID NO: 177046 - DNA, 25 bp, Homo sapien
acgcgcgaaaatagcagtcgagccc

SEQ ID NO: 177047 - DNA, 25 bp, Homo sapien
gcttcccttaaaggcgacgcgcgaa

SEQ ID NO: 177048 - DNA, 25 bp, Homo sapien
cgcttttaaaatgcaggtacggctg

SEQ ID NO: 177049 - DNA, 25 bp, Homo sapien
ggctacagggcgcttttaaaatgca

SEQ ID NO: 177050 - DNA, 25 bp, Homo sapien
ggccttagccaatcccagggctaca

SEQ ID NO: 177051 - DNA, 25 bp, Homo sapien
cggctcccggcggttcaagtttctg

SEQ ID NO: 177052 - DNA, 25 bp, Homo sapien
gcgctctcagggttctggagaagca

SEQ ID NO: 177053 - DNA, 25 bp, Homo sapien
aatacccacgatccgggcgacggcg

SEQ ID NO: 177054 - DNA, 25 bp, Homo sapien
ctccctggctaaagagcgccctgtg

SEQ ID NO: 177055 - DNA, 25 bp, Homo sapien
gcatccgtttccctagcccagtggg

SEQ ID NO: 177056 - DNA, 25 bp, Homo sapien
gcctctgcgcgcagtactcggactt

SEQ ID NO: 177057 - DNA, 25 bp, Homo sapien
ccgggccactcccatcgaatttgga

SEQ ID NO: 177058 - DNA, 25 bp, Homo sapien
gcgcatccgcagtgcctggacttca

SEQ ID NO: 177059 - DNA, 25 bp, Homo sapien
cccgaccagaggtgacctcctagaa

SEQ ID NO: 177060 - DNA, 25 bp, Homo sapien
agtcctggagcagagatcggaaccc

SEQ ID NO: 177061 - DNA, 25 bp, Homo sapien
taaaagaggtcgtgccgcattctgc

SEQ ID NO: 177062 - DNA, 25 bp, Homo sapien
ctagattcaccctttctgcggccga

SEQ ID NO: 177063 - DNA, 25 bp, Homo sapien
cgtcagacccagaccggctagattc

SEQ ID NO: 177064 - DNA, 25 bp, Homo sapien
tttcgctcagcgtccagggaacctt

SEQ ID NO: 177065 - DNA, 25 bp, Homo sapien
cgcctcaaaggagccgcgctgattt

SEQ ID NO: 177066 - DNA, 25 bp, Homo sapien
ggccgctgagcgtacaatcggtcca

SEQ ID NO: 177067 - DNA, 25 bp, Homo sapien
aagctgttagctcgtcctggtaccg

SEQ ID NO: 177068 - DNA, 25 bp, Homo sapien
accgtcaggcgaagcaaagctgtta

SEQ ID NO: 177069 - DNA, 25 bp, Homo sapien
tctccagcaggcgactggctttctc

SEQ ID NO: 177070 - DNA, 25 bp, Homo sapien
ttcctgaacatcagccgggtggtgc

SEQ ID NO: 177071 - DNA, 25 bp, Homo sapien
tactcagtgggtatccgcagcagtg

SEQ ID NO: 177072 - DNA, 25 bp, Homo sapien
tccgcatcagcgagttcagagtctc

SEQ ID NO: 177073 - DNA, 25 bp, Homo sapien
agtctccgaggatgacgagaacgcc

SEQ ID NO: 177074 - DNA, 25 bp, Homo sapien
catggtccatgccagggatggcacc

SEQ ID NO: 177075 - DNA, 25 bp, Homo sapien
gctggggaagcctttcctgaacatc

SEQ ID NO: 177076 - DNA, 25 bp, Homo sapien
aggctctacgtctactactcagtgg

SEQ ID NO: 177077 - DNA, 25 bp, Homo sapien
accgcttcttcgtggccgagcaggt

SEQ ID NO: 177078 - DNA, 25 bp, Homo sapien
ccgcacacggttggcaagtcggtca

SEQ ID NO: 177079 - DNA, 25 bp, Homo sapien
tgcgcaacatgtggcgctgctcctt

SEQ ID NO: 177080 - DNA, 25 bp, Homo sapien
tgtgcgccaacacctctctcagtga

SEQ ID NO: 177081 - DNA, 25 bp, Homo sapien
ggagatccctgaccctgagtctgtc

SEQ ID NO: 177082 - DNA, 25 bp, Homo sapien
agccaaagcctccttcggtgactgc

SEQ ID NO: 177083 - DNA, 25 bp, Homo sapien
tcccagcagcgctcttgagttcttc

SEQ ID NO: 177084 - DNA, 25 bp, Homo sapien
ttctcctggctgatgaaccttcccg

SEQ ID NO: 177085 - DNA, 25 bp, Homo sapien
agatgacttgctgccgattttcgcc

SEQ ID NO: 177086 - DNA, 25 bp, Homo sapien
cgccgtcaagagagccgagttcggc

SEQ ID NO: 177087 - DNA, 25 bp, Homo sapien
caccgtgtgcgacgactcctggaac

SEQ ID NO: 177088 - DNA, 25 bp, Homo sapien
attctgctggacgatgtgcgctgcg

SEQ ID NO: 177089 - DNA, 25 bp, Homo sapien
gggcgtcgtgtgcagccaccagaac

SEQ ID NO: 177090 - DNA, 25 bp, Homo sapien
cacaactgcgagcacgacgaggatg

SEQ ID NO: 177091 - DNA, 25 bp, Homo sapien
gcgtgggcacccacaactgcgagca

SEQ ID NO: 177092 - DNA, 25 bp, Homo sapien
tgctggagtgccagcacaacggcgt

SEQ ID NO: 177093 - DNA, 25 bp, Homo sapien
gactcctggaacatcagcggcgccg

SEQ ID NO: 177094 - DNA, 25 bp, Homo sapien
gagtattaggcaatcggtcccgcta

SEQ ID NO: 177095 - DNA, 25 bp, Homo sapien
cagccgggcggctatttatccgagc

SEQ ID NO: 177096 - DNA, 25 bp, Homo sapien
ctccgagtcggagttacttcttgcc

SEQ ID NO: 177097 - DNA, 25 bp, Homo sapien
tggaggcccacctgcatcacatgca

SEQ ID NO: 177098 - DNA, 25 bp, Homo sapien
aaaagcccggttccatgctgctcca

SEQ ID NO: 177099 - DNA, 25 bp, Homo sapien
aactccgtacaaaatgccgccttcg

SEQ ID NO: 177100 - DNA, 25 bp, Homo sapien
acttcttgcctctaggacgctgggc

SEQ ID NO: 177101 - DNA, 25 bp, Homo sapien
gcaaccctggaagctctctggagtc

SEQ ID NO: 177102 - DNA, 25 bp, Homo sapien
ttggtgaagaccacatgctcggggt

SEQ ID NO: 177103 - DNA, 25 bp, Homo sapien
ccgagtctctgggagaacagcctcc

SEQ ID NO: 177104 - DNA, 25 bp, Homo sapien
tgcgctctcggtcgcagacacaggc

SEQ ID NO: 177105 - DNA, 25 bp, Homo sapien
ccggggcaactggagaacaactttg

SEQ ID NO: 177106 - DNA, 25 bp, Homo sapien
tccaaggagaagtttgggaacagtc

SEQ ID NO: 177107 - DNA, 25 bp, Homo sapien
cggcgttatgcggacttttgcaggc

SEQ ID NO: 177108 - DNA, 25 bp, Homo sapien
cgttgccagggacaacgcgttctgg

SEQ ID NO: 177109 - DNA, 25 bp, Homo sapien
cgcgcgcggaaagatgccgttattt

SEQ ID NO: 177110 - DNA, 25 bp, Homo sapien
agtggcaagctctggccacggcgta

SEQ ID NO: 177111 - DNA, 25 bp, Homo sapien
tgccctcactaagcggctccagaga

SEQ ID NO: 177112 - DNA, 25 bp, Homo sapien
cctctcttgtgacctcggccagtgg

SEQ ID NO: 177113 - DNA, 25 bp, Homo sapien
tgacctcggccagtggcagcctttt

SEQ ID NO: 177114 - DNA, 25 bp, Homo sapien
gccagtggcagccttttctgagcct

SEQ ID NO: 177115 - DNA, 25 bp, Homo sapien
cccttctctgtaaacctggacgtgt

SEQ ID NO: 177116 - DNA, 25 bp, Homo sapien
acctggacgtgtttgatctacgctc

SEQ ID NO: 177117 - DNA, 25 bp, Homo sapien
acgtgtttgatctacgctcgcgtcc

SEQ ID NO: 177118 - DNA, 25 bp, Homo sapien
tccggttgcagagccaaggccgcca

SEQ ID NO: 177119 - DNA, 25 bp, Homo sapien
gcgctatatttacccgctgtggctc

SEQ ID NO: 177120 - DNA, 25 bp, Homo sapien
tgagtggcagcgctatatttacccg

SEQ ID NO: 177121 - DNA, 25 bp, Homo sapien
cggtgagtggcagcgctatatttac

SEQ ID NO: 177122 - DNA, 25 bp, Homo sapien
ctccgccggtgagtggcagcgctat

SEQ ID NO: 177123 - DNA, 25 bp, Homo sapien
ggccgcccatcttccacaccatgtc

SEQ ID NO: 177124 - DNA, 25 bp, Homo sapien
gaggctctgagtgaccctgcaggct

SEQ ID NO: 177125 - DNA, 25 bp, Homo sapien
ttgcagagccaaggccgccagtcgc

SEQ ID NO: 177126 - DNA, 25 bp, Homo sapien
gtggaaacggccgaaatgtgcgggc

SEQ ID NO: 177127 - DNA, 25 bp, Homo sapien
gctctctcccggccttggtctttgt

SEQ ID NO: 177128 - DNA, 25 bp, Homo sapien
catgtttggtcgtggagctgcccgc

SEQ ID NO: 177129 - DNA, 25 bp, Homo sapien
atgtgcgggcgcgttgtccatgttt

SEQ ID NO: 177130 - DNA, 25 bp, Homo sapien
cgcggcgtggaaacggccgaaatgt

SEQ ID NO: 177131 - DNA, 25 bp, Homo sapien
acgcgccggtcggatgtgggccaca

SEQ ID NO: 177132 - DNA, 25 bp, Homo sapien
aaacgtgtggacagaggaacgcgcc

SEQ ID NO: 177133 - DNA, 25 bp, Homo sapien
tccatgtttggtcgtggagctgccc

SEQ ID NO: 177134 - DNA, 25 bp, Homo sapien
ggcgaacagcaacgcgcgtacccta

SEQ ID NO: 177135 - DNA, 25 bp, Homo sapien
aacgcgcgtaccctagctcttggct

SEQ ID NO: 177136 - DNA, 25 bp, Homo sapien
accctagctcttggctgctgtgctg

SEQ ID NO: 177137 - DNA, 25 bp, Homo sapien
ctgctgtgctgagactagcccgcgc

SEQ ID NO: 177138 - DNA, 25 bp, Homo sapien
gacgcccacccggagaagatgagcc

SEQ ID NO: 177139 - DNA, 25 bp, Homo sapien
gcattcagagcgcgggaatggcttc

SEQ ID NO: 177140 - DNA, 25 bp, Homo sapien
ctctgcagagattcgggggcattca

SEQ ID NO: 177141 - DNA, 25 bp, Homo sapien
cccgcgccttttgtgtcgggctttg

SEQ ID NO: 177142 - DNA, 25 bp, Homo sapien
gttagcgcctcagctggcggtgaca

SEQ ID NO: 177143 - DNA, 25 bp, Homo sapien
accacggtgaccaggagtcgtagga

SEQ ID NO: 177144 - DNA, 25 bp, Homo sapien
tcgcattggtccatcacgctccggg

SEQ ID NO: 177145 - DNA, 25 bp, Homo sapien
ggctcaggccctcgcattggtccat

SEQ ID NO: 177146 - DNA, 25 bp, Homo sapien
tgtgtccacacagtaataaacggtt

SEQ ID NO: 177147 - DNA, 25 bp, Homo sapien
cagcgctcatggtgttgaaactgtc

SEQ ID NO: 177148 - DNA, 25 bp, Homo sapien
tgaaactgtctgtcatgcaccacgg

SEQ ID NO: 177149 - DNA, 25 bp, Homo sapien
gcaccacggtgtctgtgtccacaca

SEQ ID NO: 177150 - DNA, 25 bp, Homo sapien
cgggtgtgcagaagaaccagccctc

SEQ ID NO: 177151 - DNA, 25 bp, Homo sapien
tgagcacctccatgcgggtcacggc

SEQ ID NO: 177152 - DNA, 25 bp, Homo sapien
ccaccaaaggcgtaggcccagaaca

SEQ ID NO: 177153 - DNA, 25 bp, Homo sapien
tggtccacgtggtacttcttgaagg

SEQ ID NO: 177154 - DNA, 25 bp, Homo sapien
gctgcaccagcgtgttgagcacctc

SEQ ID NO: 177155 - DNA, 25 bp, Homo sapien
gcaggttggcgaacacggccagcca

SEQ ID NO: 177156 - DNA, 25 bp, Homo sapien
ccagcgtcagcgagtggttcacgca

SEQ ID NO: 177157 - DNA, 25 bp, Homo sapien
gagtggttcacgcagccaccaaagg

SEQ ID NO: 177158 - DNA, 25 bp, Homo sapien
gtgccctaccatacagtgcgctctg

SEQ ID NO: 177159 - DNA, 25 bp, Homo sapien
gagacagaactatccgcggcgcctg

SEQ ID NO: 177160 - DNA, 25 bp, Homo sapien
ctaccgcacgggctgactcagctag

SEQ ID NO: 177161 - DNA, 25 bp, Homo sapien
gctttgcagccctacagatgttcta

SEQ ID NO: 177162 - DNA, 25 bp, Homo sapien
agggtgactcgccactgtgccctac

SEQ ID NO: 177163 - DNA, 25 bp, Homo sapien
agagatcggcgactgctcaagaggc

SEQ ID NO: 177164 - DNA, 25 bp, Homo sapien
ttcagctacgggaaaggcgatcgca

SEQ ID NO: 177165 - DNA, 25 bp, Homo sapien
acagatgttctaccgcgtgtgcctg

SEQ ID NO: 177166 - DNA, 25 bp, Homo sapien
cagtatctccttgcgccgctgcgtg

SEQ ID NO: 177167 - DNA, 25 bp, Homo sapien
cgtactggggtcctcggaatcctca

SEQ ID NO: 177168 - DNA, 25 bp, Homo sapien
cggaatcctcaggtcccagggagtt

SEQ ID NO: 177169 - DNA, 25 bp, Homo sapien
tcccagggagtttcagacccggcca

SEQ ID NO: 177170 - DNA, 25 bp, Homo sapien
gcgcggaaccagctctgattagggc

SEQ ID NO: 177171 - DNA, 25 bp, Homo sapien
cccactggaatttgggccagagctg

SEQ ID NO: 177172 - DNA, 25 bp, Homo sapien
acctcagttgcctcggttggaaatg

SEQ ID NO: 177173 - DNA, 25 bp, Homo sapien
cggcaatggcggaacgcccactgga

SEQ ID NO: 177174 - DNA, 25 bp, Homo sapien
gcccctgggagcattgatcctcctg

SEQ ID NO: 177175 - DNA, 25 bp, Homo sapien
gcgcctgtcctcgaacctggcccaa

SEQ ID NO: 177176 - DNA, 25 bp, Homo sapien
agggtgctttgcactcgcggttccc

SEQ ID NO: 177177 - DNA, 25 bp, Homo sapien
cctggcccaacgctcgccgggagca

SEQ ID NO: 177178 - DNA, 25 bp, Homo sapien
agggacctgcgtgcagctatggaac

SEQ ID NO: 177179 - DNA, 25 bp, Homo sapien
gacctgcgtgcagctatggaaccga

SEQ ID NO: 177180 - DNA, 25 bp, Homo sapien
ctgcgtgcagctatggaaccgaggc

SEQ ID NO: 177181 - DNA, 25 bp, Homo sapien
ggagcagcccacgttgctcccgctg

SEQ ID NO: 177182 - DNA, 25 bp, Homo sapien
gcaccttgttctcttgctgcagcga

SEQ ID NO: 177183 - DNA, 25 bp, Homo sapien
gcagtgccttgcacttcagtttgta

SEQ ID NO: 177184 - DNA, 25 bp, Homo sapien
cagtttgtaggtctccagctctatc

SEQ ID NO: 177185 - DNA, 25 bp, Homo sapien
actcacgatggtcacgctggctttg

SEQ ID NO: 177186 - DNA, 25 bp, Homo sapien
cgccagccacacgtgttccaaggga

SEQ ID NO: 177187 - DNA, 25 bp, Homo sapien
aagctggctgaaagctccgggaccc

SEQ ID NO: 177188 - DNA, 25 bp, Homo sapien
gcagtattgcactggggctcgctcc

SEQ ID NO: 177189 - DNA, 25 bp, Homo sapien
gcggaacggcgagatgacaatgccc

SEQ ID NO: 177190 - DNA, 25 bp, Homo sapien
cggcggctcaagttgccctttgtcg

SEQ ID NO: 177191 - DNA, 25 bp, Homo sapien
gcacacgccatagaaaggtcaccga

SEQ ID NO: 177192 - DNA, 25 bp, Homo sapien
ctcggaaatagtgggcatgggtccc

SEQ ID NO: 177193 - DNA, 25 bp, Homo sapien
ttggccgctctgtgtcatgtgtcct

SEQ ID NO: 177194 - DNA, 25 bp, Homo sapien
gccaaccagcgagggaggcaaagtc

SEQ ID NO: 177195 - DNA, 25 bp, Homo sapien
gtcccgtagcccttcagcgagctgt

SEQ ID NO: 177196 - DNA, 25 bp, Homo sapien
gctctttcgcccaggtgccttggag

SEQ ID NO: 177197 - DNA, 25 bp, Homo sapien
aggccacacgaggagagcccactgc

SEQ ID NO: 177198 - DNA, 25 bp, Homo sapien
ccgcttcccaggcagttgcggcgtt

SEQ ID NO: 177199 - DNA, 25 bp, Homo sapien
cgagggcgccgtgttctcaactgca

SEQ ID NO: 177200 - DNA, 25 bp, Homo sapien
gtgttctcaactgcagggcctgaag

SEQ ID NO: 177201 - DNA, 25 bp, Homo sapien
ggtaagggcgcacactacccaggca

SEQ ID NO: 177202 - DNA, 25 bp, Homo sapien
acgcaaagccgcttcccaggcagtt

SEQ ID NO: 177203 - DNA, 25 bp, Homo sapien
gtgactgcgactctcccagcggaga

SEQ ID NO: 177204 - DNA, 25 bp, Homo sapien
tagctcgcgaggtgcacccggcaca

SEQ ID NO: 177205 - DNA, 25 bp, Homo sapien
ccagcctcccaactgctgaggatga

SEQ ID NO: 177206 - DNA, 25 bp, Homo sapien
cgccgacccgggcaacaagaagtgg

SEQ ID NO: 177207 - DNA, 25 bp, Homo sapien
tacattgaacaaacgctggtcaccg

SEQ ID NO: 177208 - DNA, 25 bp, Homo sapien
tctacatcgccacggacggctcgga

SEQ ID NO: 177209 - DNA, 25 bp, Homo sapien
atcccggtggagaccatcgagacca

SEQ ID NO: 177210 - DNA, 25 bp, Homo sapien
cgaggacggcttcgaggatcagatt

SEQ ID NO: 177211 - DNA, 25 bp, Homo sapien
gcggcgacgacgactacattgaaca

SEQ ID NO: 177212 - DNA, 25 bp, Homo sapien
gagcggcaagaagagttacctcagc

SEQ ID NO: 177213 - DNA, 25 bp, Homo sapien
gatcagattctcatcccggtgcccg

SEQ ID NO: 177214 - DNA, 25 bp, Homo sapien
gccctccaagctggggatgcttttc

SEQ ID NO: 177215 - DNA, 25 bp, Homo sapien
tggagccctccaagctggggatgct

SEQ ID NO: 177216 - DNA, 25 bp, Homo sapien
gtcctggagccctccaagctgggga

SEQ ID NO: 177217 - DNA, 25 bp, Homo sapien
tgccggcccaaagggacgtcctgga

SEQ ID NO: 177218 - DNA, 25 bp, Homo sapien
tcagagcccgagaaacgcggaagga

SEQ ID NO: 177219 - DNA, 25 bp, Homo sapien
gattcagagcccgagaaacgcggaa

SEQ ID NO: 177220 - DNA, 25 bp, Homo sapien
tccagaatccctgagtgtggggtcc

SEQ ID NO: 177221 - DNA, 25 bp, Homo sapien
ccgggggcttctagacctgcgcctg

SEQ ID NO: 177222 - DNA, 25 bp, Homo sapien
ggcagtccagcgagcccttgtaggt

SEQ ID NO: 177223 - DNA, 25 bp, Homo sapien
gcgacttgaccacgtccacaggata

SEQ ID NO: 177224 - DNA, 25 bp, Homo sapien
taggtagagagccaggacacgatgc

SEQ ID NO: 177225 - DNA, 25 bp, Homo sapien
cgaagctgggcgtctcacgcagcaa

SEQ ID NO: 177226 - DNA, 25 bp, Homo sapien
gcagaccctcgtgcccgtagatctg

SEQ ID NO: 177227 - DNA, 25 bp, Homo sapien
accagcgcgttgatgaaggtgagcc

SEQ ID NO: 177228 - DNA, 25 bp, Homo sapien
agagacgccatcagagccggcaacg

SEQ ID NO: 177229 - DNA, 25 bp, Homo sapien
ctcacgcagcaacgtggacaccatg

SEQ ID NO: 177230 - DNA, 25 bp, Homo sapien
tccagccaagaagtccagcgccatg

SEQ ID NO: 177231 - DNA, 25 bp, Homo sapien
cggggacgcctcagacaaagagcgc

SEQ ID NO: 177232 - DNA, 25 bp, Homo sapien
cccgaggcaagagaactgtggtccc

SEQ ID NO: 177233 - DNA, 25 bp, Homo sapien
ctgaagtcaatttacgcccacgaga

SEQ ID NO: 177234 - DNA, 25 bp, Homo sapien
acagcccgggcctgaagtcaattta

SEQ ID NO: 177235 - DNA, 25 bp, Homo sapien
gaataaagacacctgccctcgcgga

SEQ ID NO: 177236 - DNA, 25 bp, Homo sapien
tccgagcgtgcccagagagaataaa

SEQ ID NO: 177237 - DNA, 25 bp, Homo sapien
cctgccgcgaaaacggccgtggagc

SEQ ID NO: 177238 - DNA, 25 bp, Homo sapien
gtcgcccactgaggtggccaaagtc

SEQ ID NO: 177239 - DNA, 25 bp, Homo sapien
tggccaaagtccgcttgcagacgca

SEQ ID NO: 177240 - DNA, 25 bp, Homo sapien
ggtggccaaagtccgcttgcagacg

SEQ ID NO: 177241 - DNA, 25 bp, Homo sapien
ggccaaagtccgcttgcagacgcag

SEQ ID NO: 177242 - DNA, 25 bp, Homo sapien
gtggccaaagtccgcttgcagacgc

SEQ ID NO: 177243 - DNA, 25 bp, Homo sapien
aggtggccaaagtccgcttgcagac

SEQ ID NO: 177244 - DNA, 25 bp, Homo sapien
cgtcgcccactgaggtggccaaagt

SEQ ID NO: 177245 - DNA, 25 bp, Homo sapien
gccaaagtccgcttgcagacgcaga

SEQ ID NO: 177246 - DNA, 25 bp, Homo sapien
ctgcccagagcccaagtaccgcggg

SEQ ID NO: 177247 - DNA, 25 bp, Homo sapien
ctgtgcggcctctacaagggcagct

SEQ ID NO: 177248 - DNA, 25 bp, Homo sapien
gcggcctctacaagggcagctcggc

SEQ ID NO: 177249 - DNA, 25 bp, Homo sapien
tttcctacgcggtcctctgcgagtg

SEQ ID NO: 177250 - DNA, 25 bp, Homo sapien
ttacgggacggccactcctttgcca

SEQ ID NO: 177251 - DNA, 25 bp, Homo sapien
tgccacctacttcctttcctacgcg

SEQ ID NO: 177252 - DNA, 25 bp, Homo sapien
ctggtcttacgggacggccactcct

SEQ ID NO: 177253 - DNA, 25 bp, Homo sapien
gcggtcctctgcgagtggctcagcc

SEQ ID NO: 177254 - DNA, 25 bp, Homo sapien
caaggggctggtactcaattgctgc

SEQ ID NO: 177255 - DNA, 25 bp, Homo sapien
cttttcaaggggctggtactcaatt

SEQ ID NO: 177256 - DNA, 25 bp, Homo sapien
ggtactcaattgctgccgcgccttc

SEQ ID NO: 177257 - DNA, 25 bp, Homo sapien
cgccttccctgtcaacatggtggtc

SEQ ID NO: 177258 - DNA, 25 bp, Homo sapien
ccctgtcaacatggtggtcttcgtc

SEQ ID NO: 177259 - DNA, 25 bp, Homo sapien
tcaacatggtggtcttcgtcgccta

SEQ ID NO: 177260 - DNA, 25 bp, Homo sapien
tcttcgtcgcctatgaggcagtgct

SEQ ID NO: 177261 - DNA, 25 bp, Homo sapien
ggggtctgctcacatagccggtccc

SEQ ID NO: 177262 - DNA, 25 bp, Homo sapien
cgccctcccggattggccgtccgcg

SEQ ID NO: 177263 - DNA, 25 bp, Homo sapien
tgtgtgtgcaaaaaggaggactcgc

SEQ ID NO: 177264 - DNA, 25 bp, Homo sapien
cgtgtgtgtgcaaaaaggaggactc

SEQ ID NO: 177265 - DNA, 25 bp, Homo sapien
ggctctttgtattcgtgtgtgtgca

SEQ ID NO: 177266 - DNA, 25 bp, Homo sapien
gtatggctctttgtattcgtgtgtg

SEQ ID NO: 177267 - DNA, 25 bp, Homo sapien
tcgtatggctctttgtattcgtgtg

SEQ ID NO: 177268 - DNA, 25 bp, Homo sapien
ggtcgtatggctctttgtattcgtg

SEQ ID NO: 177269 - DNA, 25 bp, Homo sapien
cgaaggtcgtatggctctttgtatt

SEQ ID NO: 177270 - DNA, 25 bp, Homo sapien
gcctcacagtgccagaacgcggcgg

SEQ ID NO: 177271 - DNA, 25 bp, Homo sapien
agaaccgagcgcttccggtgcgtgt

SEQ ID NO: 177272 - DNA, 25 bp, Homo sapien
cagaggccgccactgattggctggc

SEQ ID NO: 177273 - DNA, 25 bp, Homo sapien
cccgacggcgccgtcattggctgtt

SEQ ID NO: 177274 - DNA, 25 bp, Homo sapien
tctcctgggcgtccgtggaaacgcc

SEQ ID NO: 177275 - DNA, 25 bp, Homo sapien
tcagcaaccggctgtctcctgggcg

SEQ ID NO: 177276 - DNA, 25 bp, Homo sapien
cgtgccgcttaacgcggtctctcat

SEQ ID NO: 177277 - DNA, 25 bp, Homo sapien
gcaagccgggctctaaggatactcc

SEQ ID NO: 177278 - DNA, 25 bp, Homo sapien
gcggctcaggaacaccaagcgcggc

SEQ ID NO: 177279 - DNA, 25 bp, Homo sapien
ttcggccgcggctcaggaacaccaa

SEQ ID NO: 177280 - DNA, 25 bp, Homo sapien
tgggaaaaagttcggccgcggctca

SEQ ID NO: 177281 - DNA, 25 bp, Homo sapien
gctcctcgggcctccaaacgtggga

SEQ ID NO: 177282 - DNA, 25 bp, Homo sapien
actggactcccacgatccgcaggaa

SEQ ID NO: 177283 - DNA, 25 bp, Homo sapien
ctctcgcctctgtcccgggccgcaa

SEQ ID NO: 177284 - DNA, 25 bp, Homo sapien
agctcccggcgatcacatccagtcg

SEQ ID NO: 177285 - DNA, 25 bp, Homo sapien
gggccgcaacttccaggcgcaactg

SEQ ID NO: 177286 - DNA, 25 bp, Homo sapien
tcgcggctgttcaggtagatggcct

SEQ ID NO: 177287 - DNA, 25 bp, Homo sapien
ccttggcaaagcgagggctgccctc

SEQ ID NO: 177288 - DNA, 25 bp, Homo sapien
gtacggtgacatggtccgcccgaag

SEQ ID NO: 177289 - DNA, 25 bp, Homo sapien
gccgatgtcctccacgctcagggga

SEQ ID NO: 177290 - DNA, 25 bp, Homo sapien
ccgtagtagcgttcagagaagctgc

SEQ ID NO: 177291 - DNA, 25 bp, Homo sapien
caaggagtccctggaaccctgctcg

SEQ ID NO: 177292 - DNA, 25 bp, Homo sapien
cttctcctccgacgtggcgctgaag

SEQ ID NO: 177293 - DNA, 25 bp, Homo sapien
aagctgtcggccttgtagctggcgt

SEQ ID NO: 177294 - DNA, 25 bp, Homo sapien
cagcgcgctgcaacgacatggcggc

SEQ ID NO: 177295 - DNA, 25 bp, Homo sapien
gctcgatctccaggtagtggcgcgt

SEQ ID NO: 177296 - DNA, 25 bp, Homo sapien
agtcgaactcggtctcgagcttctc

SEQ ID NO: 177297 - DNA, 25 bp, Homo sapien
tcctgcagcgcgctgcaacgacatg

SEQ ID NO: 177298 - DNA, 25 bp, Homo sapien
ggcgtgccgcactaacacgcgagta

SEQ ID NO: 177299 - DNA, 25 bp, Homo sapien
tgccgcactaacacgcgagtaccgg

SEQ ID NO: 177300 - DNA, 25 bp, Homo sapien
taacacgcgagtaccggcgcgcgcg

SEQ ID NO: 177301 - DNA, 25 bp, Homo sapien
tcgagcttctcgagcttgtgtgtgg

SEQ ID NO: 177302 - DNA, 25 bp, Homo sapien
gaggcctgcgagaaaccaaacgaga

SEQ ID NO: 177303 - DNA, 25 bp, Homo sapien
gagacgctccactcacctgagtttc

SEQ ID NO: 177304 - DNA, 25 bp, Homo sapien
ggaatcgcagaacctccgagtcgga

SEQ ID NO: 177305 - DNA, 25 bp, Homo sapien
ggccgtgcaggattgcagaacctga

SEQ ID NO: 177306 - DNA, 25 bp, Homo sapien
cacacaatccgagggcgatggcatt

SEQ ID NO: 177307 - DNA, 25 bp, Homo sapien
ttggagcctcgactcctcaatcagg

SEQ ID NO: 177308 - DNA, 25 bp, Homo sapien
cccgctgccctcagattctggggtt

SEQ ID NO: 177309 - DNA, 25 bp, Homo sapien
tgagtttctccatgtctgcggcaga

SEQ ID NO: 177310 - DNA, 25 bp, Homo sapien
ccacctcccgcgctgagcagggacc

SEQ ID NO: 177311 - DNA, 25 bp, Homo sapien
gaggatagtacctgccgcgaggtac

SEQ ID NO: 177312 - DNA, 25 bp, Homo sapien
cctgccgcgaggtactgaatgggat

SEQ ID NO: 177313 - DNA, 25 bp, Homo sapien
tttcctcgcctgtaaaggggcagga

SEQ ID NO: 177314 - DNA, 25 bp, Homo sapien
cgctgcaaacgctcaatgaggcggc

SEQ ID NO: 177315 - DNA, 25 bp, Homo sapien
agacgcaggcgggtccaggcctgcc

SEQ ID NO: 177316 - DNA, 25 bp, Homo sapien
ctcccgggccagtgaagcctccacg

SEQ ID NO: 177317 - DNA, 25 bp, Homo sapien
cccacccgagagtgcccagttccca

SEQ ID NO: 177318 - DNA, 25 bp, Homo sapien
cgcctgcaccgtggaaggggagggc

SEQ ID NO: 177319 - DNA, 25 bp, Homo sapien
agtgagatgggattcctgtgtcggg

SEQ ID NO: 177320 - DNA, 25 bp, Homo sapien
gcagcgttgtgaggagctttccaga

SEQ ID NO: 177321 - DNA, 25 bp, Homo sapien
gcgttgtgaggagctttccagaaga

SEQ ID NO: 177322 - DNA, 25 bp, Homo sapien
ttgtgaggagctttccagaagaggc

SEQ ID NO: 177323 - DNA, 25 bp, Homo sapien
ctcctctgcggcgaagagcgtgggt

SEQ ID NO: 177324 - DNA, 25 bp, Homo sapien
acccggctcacctgagcgaaggttg

SEQ ID NO: 177325 - DNA, 25 bp, Homo sapien
ctgagcgaaggttgcggcctcgctg

SEQ ID NO: 177326 - DNA, 25 bp, Homo sapien
tccgctgtattgtcgtcttaatgcc

SEQ ID NO: 177327 - DNA, 25 bp, Homo sapien
tcacgtcctatactgtgcggcggcc

SEQ ID NO: 177328 - DNA, 25 bp, Homo sapien
gctctgtactcccaaacgtcacgtt

SEQ ID NO: 177329 - DNA, 25 bp, Homo sapien
cctggctgaacttgctgggaaccga

SEQ ID NO: 177330 - DNA, 25 bp, Homo sapien
cacgcaattgcgatcccagtgatgg

SEQ ID NO: 177331 - DNA, 25 bp, Homo sapien
ctgtgcgatgaggtgtgaaattcta

SEQ ID NO: 177332 - DNA, 25 bp, Homo sapien
tccatcattccggagggaaccttcg

SEQ ID NO: 177333 - DNA, 25 bp, Homo sapien
cggcaggcttcattaggctcgaaac

SEQ ID NO: 177334 - DNA, 25 bp, Homo sapien
tctagccaagagtgcacccgtgtgc

SEQ ID NO: 177335 - DNA, 25 bp, Homo sapien
gctttcggccacagcacctatggtg

SEQ ID NO: 177336 - DNA, 25 bp, Homo sapien
cccgggacttcagcgataagtgttt

SEQ ID NO: 177337 - DNA, 25 bp, Homo sapien
taagtgtttcggtgttcctgcgtgc

SEQ ID NO: 177338 - DNA, 25 bp, Homo sapien
aaacgctcgcgggatacctgtgccc

SEQ ID NO: 177339 - DNA, 25 bp, Homo sapien
tgagggaacgtgtaccaaacgctcg

SEQ ID NO: 177340 - DNA, 25 bp, Homo sapien
tgcgacttgtcctaggcaggcctgt

SEQ ID NO: 177341 - DNA, 25 bp, Homo sapien
gcccaggttcgattcctgcgacttg

SEQ ID NO: 177342 - DNA, 25 bp, Homo sapien
cacccaggtgagctacgagtgtctg

SEQ ID NO: 177343 - DNA, 25 bp, Homo sapien
tcacctgtgtcaagaagcgcgcgct

SEQ ID NO: 177344 - DNA, 25 bp, Homo sapien
agtgtctgtgcaagcccgagttcac

SEQ ID NO: 177345 - DNA, 25 bp, Homo sapien
gcccagcggctatgggctggcctac

SEQ ID NO: 177346 - DNA, 25 bp, Homo sapien
gcttcatcgacaagacctgcagccg

SEQ ID NO: 177347 - DNA, 25 bp, Homo sapien
tgcccagccggcttcatcgacaaga

SEQ ID NO: 177348 - DNA, 25 bp, Homo sapien
aacgacggcgtctgcactgacattg

SEQ ID NO: 177349 - DNA, 25 bp, Homo sapien
gagttcacaggtctcacctgtgtca

SEQ ID NO: 177350 - DNA, 25 bp, Homo sapien
cgctacctttagatctttccgattg

SEQ ID NO: 177351 - DNA, 25 bp, Homo sapien
gaaaccgttacgagtgctgtacatg

SEQ ID NO: 177352 - DNA, 25 bp, Homo sapien
tgctgtacatgaccacccactgtgc

SEQ ID NO: 177353 - DNA, 25 bp, Homo sapien
cccactgtgcaaagagctacgattg

SEQ ID NO: 177354 - DNA, 25 bp, Homo sapien
gagctacgattgctttcgttcgtta

SEQ ID NO: 177355 - DNA, 25 bp, Homo sapien
ccacatggtcctcgtgaaaccgtta

SEQ ID NO: 177356 - DNA, 25 bp, Homo sapien
atccagctcaacatcgctaccttta

SEQ ID NO: 177357 - DNA, 25 bp, Homo sapien
atttgagatttagcggagtgcagcg

SEQ ID NO: 177358 - DNA, 25 bp, Homo sapien
ttctgccgccgcagggccacgaaga

SEQ ID NO: 177359 - DNA, 25 bp, Homo sapien
cctccagtaccatcagtgcttcttg

SEQ ID NO: 177360 - DNA, 25 bp, Homo sapien
agggccacgaagagcaccaccaggg

SEQ ID NO: 177361 - DNA, 25 bp, Homo sapien
ctcgtcgtcgtaggtgatgatgttc

SEQ ID NO: 177362 - DNA, 25 bp, Homo sapien
tcgtagccgtacacctgcaccgagt

SEQ ID NO: 177363 - DNA, 25 bp, Homo sapien
tctgcaaggccgtgatgtcgaaggc

SEQ ID NO: 177364 - DNA, 25 bp, Homo sapien
tacacctgcaccgagtcgtacgggg

SEQ ID NO: 177365 - DNA, 25 bp, Homo sapien
tgatgatgttctctcggacgtcctc

SEQ ID NO: 177366 - DNA, 25 bp, Homo sapien
ttgaaagctgcatcgagaacccgcc

SEQ ID NO: 177367 - DNA, 25 bp, Homo sapien
cgtgttcctggccttccgaatcatg

SEQ ID NO: 177368 - DNA, 25 bp, Homo sapien
tcatgcccggggcaggtaaacctca

SEQ ID NO: 177369 - DNA, 25 bp, Homo sapien
tggtggtaaatatgactcctccctc

SEQ ID NO: 177370 - DNA, 25 bp, Homo sapien
tcctggtgcgtttgttcctttaaca

SEQ ID NO: 177371 - DNA, 25 bp, Homo sapien
tccgtgacagggaagagatgccagc

SEQ ID NO: 177372 - DNA, 25 bp, Homo sapien
ctccctgtagccgtggaccgaatac

SEQ ID NO: 177373 - DNA, 25 bp, Homo sapien
aggacacttcgtgagcctccctgta

SEQ ID NO: 177374 - DNA, 25 bp, Homo sapien
ctgctttgaaagtctacgggctacc

SEQ ID NO: 177375 - DNA, 25 bp, Homo sapien
gccgccctgagaaaccgatcctgga

SEQ ID NO: 177376 - DNA, 25 bp, Homo sapien
ccacactgggctggctttagaggga

SEQ ID NO: 177377 - DNA, 25 bp, Homo sapien
ctgctcgcacttggcttcaaagctg

SEQ ID NO: 177378 - DNA, 25 bp, Homo sapien
tacgggctacccgattggtgaatcc

SEQ ID NO: 177379 - DNA, 25 bp, Homo sapien
tgctccgctgactagaaacagtagg

SEQ ID NO: 177380 - DNA, 25 bp, Homo sapien
gaacagtagcttcctgctccgctga

SEQ ID NO: 177381 - DNA, 25 bp, Homo sapien
cctttagcgcggtgagtttgaaact

SEQ ID NO: 177382 - DNA, 25 bp, Homo sapien
cgacaggggctcctggttgctgatt

SEQ ID NO: 177383 - DNA, 25 bp, Homo sapien
tctggctgtttcctagctattaata

SEQ ID NO: 177384 - DNA, 25 bp, Homo sapien
aagcgttcttgacgtctgtggctgg

SEQ ID NO: 177385 - DNA, 25 bp, Homo sapien
actgtggctaataaacgttctcctg

SEQ ID NO: 177386 - DNA, 25 bp, Homo sapien
ctggcactgtgtctacgacagcctc

SEQ ID NO: 177387 - DNA, 25 bp, Homo sapien
aacgttctcctgttgacgcgggtgc

SEQ ID NO: 177388 - DNA, 25 bp, Homo sapien
ggtgctcggagccatgattttttga

SEQ ID NO: 177389 - DNA, 25 bp, Homo sapien
cccgagaggctagcaaccgggcctg

SEQ ID NO: 177390 - DNA, 25 bp, Homo sapien
ccggccaatcacttttagagaaatg

SEQ ID NO: 177391 - DNA, 25 bp, Homo sapien
ttccgaaaccgccaggtgtgggatc

SEQ ID NO: 177392 - DNA, 25 bp, Homo sapien
acccgcgaccacagggtgttggtca

SEQ ID NO: 177393 - DNA, 25 bp, Homo sapien
ggcactgcggcagaattttttcctc

SEQ ID NO: 177394 - DNA, 25 bp, Homo sapien
ttctttgctgcaatctgggtgcggc

SEQ ID NO: 177395 - DNA, 25 bp, Homo sapien
ggtgcggctagagcaatttgtcata

SEQ ID NO: 177396 - DNA, 25 bp, Homo sapien
gggctcatttttccggccaatcact

SEQ ID NO: 177397 - DNA, 25 bp, Homo sapien
tcctccgatggatgttccgaaaccg

SEQ ID NO: 177398 - DNA, 25 bp, Homo sapien
atagaagggtctcccgggcatattt

SEQ ID NO: 177399 - DNA, 25 bp, Homo sapien
ggaagcacccgaatagaagggtctc

SEQ ID NO: 177400 - DNA, 25 bp, Homo sapien
agtggaggttcctcttcgcgaggtt

SEQ ID NO: 177401 - DNA, 25 bp, Homo sapien
agatatggcggcgatgccttctgcg

SEQ ID NO: 177402 - DNA, 25 bp, Homo sapien
tcgcgttaatagtgggagatatggc

SEQ ID NO: 177403 - DNA, 25 bp, Homo sapien
tcgccagctgttggccaggtttttg

SEQ ID NO: 177404 - DNA, 25 bp, Homo sapien
ctgttggccaggtttttggtggatc

SEQ ID NO: 177405 - DNA, 25 bp, Homo sapien
gggcatatttgcctcgccagctgtt

SEQ ID NO: 177406 - DNA, 25 bp, Homo sapien
ggatcctggattcgtttacccaaga

SEQ ID NO: 177407 - DNA, 25 bp, Homo sapien
gcgcacagaggcacgttagttgatt

SEQ ID NO: 177408 - DNA, 25 bp, Homo sapien
ggtcttaggaaggtgtggctcattt

SEQ ID NO: 177409 - DNA, 25 bp, Homo sapien
tactttccagcgatgtcacaggttc

SEQ ID NO: 177410 - DNA, 25 bp, Homo sapien
acaggttctgtctctcgttccgaga

SEQ ID NO: 177411 - DNA, 25 bp, Homo sapien
tctgactttagtgaacgtgtgttta

SEQ ID NO: 177412 - DNA, 25 bp, Homo sapien
tctgcttttccctgtagcaggcgga

SEQ ID NO: 177413 - DNA, 25 bp, Homo sapien
gttccgagaccacccacatgcgtga

SEQ ID NO: 177414 - DNA, 25 bp, Homo sapien
cagcaggctctcttgccggtttggt

SEQ ID NO: 177415 - DNA, 25 bp, Homo sapien
tgaagcgctccacgaagtggcggta

SEQ ID NO: 177416 - DNA, 25 bp, Homo sapien
ctctgcgatgatgctgaagcgctcc

SEQ ID NO: 177417 - DNA, 25 bp, Homo sapien
ccagtagaactggtaggagctcagc

SEQ ID NO: 177418 - DNA, 25 bp, Homo sapien
tcaggcactcgaaggcctcttgctc

SEQ ID NO: 177419 - DNA, 25 bp, Homo sapien
cgccttgcggaaagccctcttcagg

SEQ ID NO: 177420 - DNA, 25 bp, Homo sapien
ccggtttggtcgtcgatttggatca

SEQ ID NO: 177421 - DNA, 25 bp, Homo sapien
gtgacgccggtttccaagtagaatg

SEQ ID NO: 177422 - DNA, 25 bp, Homo sapien
gtgctcttgggcgaacttctcatcc

SEQ ID NO: 177423 - DNA, 25 bp, Homo sapien
tcgttgccaatcagcgagccgtcca

SEQ ID NO: 177424 - DNA, 25 bp, Homo sapien
agcggcctttgatccagtcgacttc

SEQ ID NO: 177425 - DNA, 25 bp, Homo sapien
actcctggtggttctggtggataca

SEQ ID NO: 177426 - DNA, 25 bp, Homo sapien
tggctggtcggaagtctcatcatct

SEQ ID NO: 177427 - DNA, 25 bp, Homo sapien
tcatccatgaagttgccgtcagctc

SEQ ID NO: 177428 - DNA, 25 bp, Homo sapien
tcatctgcttccttcgggttaaaca

SEQ ID NO: 177429 - DNA, 25 bp, Homo sapien
acggcttctcgtagagctcgacgta

SEQ ID NO: 177430 - DNA, 25 bp, Homo sapien
ccgatggcactctgggtacctgaga

SEQ ID NO: 177431 - DNA, 25 bp, Homo sapien
atcaaattccaccagggaggccgtc

SEQ ID NO: 177432 - DNA, 25 bp, Homo sapien
ccggcatcagcaccattctggggta

SEQ ID NO: 177433 - DNA, 25 bp, Homo sapien
tcagcgcctttcctggtacttgaag

SEQ ID NO: 177434 - DNA, 25 bp, Homo sapien
gaccgtgttatattcgctttattga

SEQ ID NO: 177435 - DNA, 25 bp, Homo sapien
gagcaactttgcatctggacgacga

SEQ ID NO: 177436 - DNA, 25 bp, Homo sapien
cccgttggagatgaagcccttttga

SEQ ID NO: 177437 - DNA, 25 bp, Homo sapien
tggcctgttttcagtaccgctaccg

SEQ ID NO: 177438 - DNA, 25 bp, Homo sapien
ctcgggcccgcagaagacaaatagc

SEQ ID NO: 177439 - DNA, 25 bp, Homo sapien
gaacaccatgtacaggcaaagccca

SEQ ID NO: 177440 - DNA, 25 bp, Homo sapien
cttgatgtgaccagagaacaccatg

SEQ ID NO: 177441 - DNA, 25 bp, Homo sapien
acgcaacctcgtcttgatgtgacca

SEQ ID NO: 177442 - DNA, 25 bp, Homo sapien
cacagtccggggattacgcaacctc

SEQ ID NO: 177443 - DNA, 25 bp, Homo sapien
gctccatcctcgtaaatcagcctgg

SEQ ID NO: 177444 - DNA, 25 bp, Homo sapien
gaataggagcttcccaggccgaatc

SEQ ID NO: 177445 - DNA, 25 bp, Homo sapien
caaatagcagggaggaaggagcata

SEQ ID NO: 177446 - DNA, 25 bp, Homo sapien
tccggcgctgcatccttagcatccc

SEQ ID NO: 177447 - DNA, 25 bp, Homo sapien
ttcctcacctcgtgcagcattgctg

SEQ ID NO: 177448 - DNA, 25 bp, Homo sapien
ctttgcggggaccacctcttcgcag

SEQ ID NO: 177449 - DNA, 25 bp, Homo sapien
tgggcgacaaggaacctcgtggtct

SEQ ID NO: 177450 - DNA, 25 bp, Homo sapien
tctccgtgtgctttgcggggaccac

SEQ ID NO: 177451 - DNA, 25 bp, Homo sapien
cagcattgctgtgagtgggcgacaa

SEQ ID NO: 177452 - DNA, 25 bp, Homo sapien
cccggatctccttcagggaggtgcg

SEQ ID NO: 177453 - DNA, 25 bp, Homo sapien
aggaacctcgtggtctccgtgtgct

SEQ ID NO: 177454 - DNA, 25 bp, Homo sapien
ggggtctcactacctaagacagtga

SEQ ID NO: 177455 - DNA, 25 bp, Homo sapien
atcctccagtgacattgccaggccg

SEQ ID NO: 177456 - DNA, 25 bp, Homo sapien
gggccggctgctaatgtgattaaag

SEQ ID NO: 177457 - DNA, 25 bp, Homo sapien
cagttaaacgtttctccgagcaggg

SEQ ID NO: 177458 - DNA, 25 bp, Homo sapien
ggcctttggaactgcgccctaagcc

SEQ ID NO: 177459 - DNA, 25 bp, Homo sapien
gacagtgactcaggacagtgggacc

SEQ ID NO: 177460 - DNA, 25 bp, Homo sapien
gccgagggcatgaaaggatctttat

SEQ ID NO: 177461 - DNA, 25 bp, Homo sapien
ttagggattcttttcgcacagtttc

SEQ ID NO: 177462 - DNA, 25 bp, Homo sapien
tttcattcatgaaaccggggcctgg

SEQ ID NO: 177463 - DNA, 25 bp, Homo sapien
gcctgctaagggtgcctgttgtaca

SEQ ID NO: 177464 - DNA, 25 bp, Homo sapien
tttctcagctccaagttaggggtgc

SEQ ID NO: 177465 - DNA, 25 bp, Homo sapien
cgggcgctcctagaaatctcttgtg

SEQ ID NO: 177466 - DNA, 25 bp, Homo sapien
agcggctgctcggagaagtttcata

SEQ ID NO: 177467 - DNA, 25 bp, Homo sapien
gaacctaccctgaagccgagcgaga

SEQ ID NO: 177468 - DNA, 25 bp, Homo sapien
tcgcactgtgacgttagcagccttc

SEQ ID NO: 177469 - DNA, 25 bp, Homo sapien
ggcaaaggttcctcggctctacgca

SEQ ID NO: 177470 - DNA, 25 bp, Homo sapien
tcggagaagcagtggtgggttccat

SEQ ID NO: 177471 - DNA, 25 bp, Homo sapien
ttcgtgctttcacttcttcgtgggc

SEQ ID NO: 177472 - DNA, 25 bp, Homo sapien
tccctgttttcgtgctttcacttct

SEQ ID NO: 177473 - DNA, 25 bp, Homo sapien
cagagctggcggtgaaacgccggac

SEQ ID NO: 177474 - DNA, 25 bp, Homo sapien
tcagagcgagcttcggagaagcagt

SEQ ID NO: 177475 - DNA, 25 bp, Homo sapien
acggaagctgagactgcacttcctg

SEQ ID NO: 177476 - DNA, 25 bp, Homo sapien
ctacggaagctgagactgcacttcc

SEQ ID NO: 177477 - DNA, 25 bp, Homo sapien
tgttttcgtgctttcacttcttcgt

SEQ ID NO: 177478 - DNA, 25 bp, Homo sapien
cccatgcaaagcacggtagcaggtc

SEQ ID NO: 177479 - DNA, 25 bp, Homo sapien
gcggcgttttgagagcccatgcaaa

SEQ ID NO: 177480 - DNA, 25 bp, Homo sapien
tggatggaatcccagctgcaaggcg

SEQ ID NO: 177481 - DNA, 25 bp, Homo sapien
aattcggagcccactgcggagagac

SEQ ID NO: 177482 - DNA, 25 bp, Homo sapien
acccgggagcgcgaagctgccagtc

SEQ ID NO: 177483 - DNA, 25 bp, Homo sapien
gcccttacctggcactgccgagggg

SEQ ID NO: 177484 - DNA, 25 bp, Homo sapien
cttaaggacggcagaagggtccaga

SEQ ID NO: 177485 - DNA, 25 bp, Homo sapien
ggcgccaggccatttccgaagagct

SEQ ID NO: 177486 - DNA, 25 bp, Homo sapien
tgaccgcccagtgctctgtgcgggc

SEQ ID NO: 177487 - DNA, 25 bp, Homo sapien
cgtctgagagacaataataatatgg

SEQ ID NO: 177488 - DNA, 25 bp, Homo sapien
cccttcagcggagatgtgatgtgtc

SEQ ID NO: 177489 - DNA, 25 bp, Homo sapien
ataataatatggcagctgccgcgga

SEQ ID NO: 177490 - DNA, 25 bp, Homo sapien
gccttgcagcgtctgagagacaata

SEQ ID NO: 177491 - DNA, 25 bp, Homo sapien
tttaacatgactgaccgcccagtgc

SEQ ID NO: 177492 - DNA, 25 bp, Homo sapien
ccaccatgtggctttaacatgactg

SEQ ID NO: 177493 - DNA, 25 bp, Homo sapien
actccatctgcgtggtgagccttgc

SEQ ID NO: 177494 - DNA, 25 bp, Homo sapien
cgcgctgctcctccgtaaaaacttt

SEQ ID NO: 177495 - DNA, 25 bp, Homo sapien
tgtgccagcgaaaccttgaacatta

SEQ ID NO: 177496 - DNA, 25 bp, Homo sapien
agccaacggcgtccctaattctgcg

SEQ ID NO: 177497 - DNA, 25 bp, Homo sapien
ctttggcacccacgaaatttctgca

SEQ ID NO: 177498 - DNA, 25 bp, Homo sapien
ttctcatcccgaaaccgccaggaag

SEQ ID NO: 177499 - DNA, 25 bp, Homo sapien
ccaggaagcaaaggagatcgcggca

SEQ ID NO: 177500 - DNA, 25 bp, Homo sapien
cctggagcttcccagatcgaaactc

SEQ ID NO: 177501 - DNA, 25 bp, Homo sapien
ctgggaacccaggattgtcagggtc

SEQ ID NO: 177502 - DNA, 25 bp, Homo sapien
gctccggcgttcaggcaacagctac

SEQ ID NO: 177503 - DNA, 25 bp, Homo sapien
acgctcagcacccatttacggttga

SEQ ID NO: 177504 - DNA, 25 bp, Homo sapien
aaaggagacttgctcccggcctctg

SEQ ID NO: 177505 - DNA, 25 bp, Homo sapien
acagaccctcgcgacctggttcagg

SEQ ID NO: 177506 - DNA, 25 bp, Homo sapien
ctgcgacagtgtctcgggcagttca

SEQ ID NO: 177507 - DNA, 25 bp, Homo sapien
cgagaagaagtttcgcggctggtcc

SEQ ID NO: 177508 - DNA, 25 bp, Homo sapien
agcgctgtctccgtcccgagaagaa

SEQ ID NO: 177509 - DNA, 25 bp, Homo sapien
tccttcgctgccgaaagcgattcgc

SEQ ID NO: 177510 - DNA, 25 bp, Homo sapien
cagcgtgccctcagccaagtgcttt

SEQ ID NO: 177511 - DNA, 25 bp, Homo sapien
ttcccgcagctgcacagagaccttg

SEQ ID NO: 177512 - DNA, 25 bp, Homo sapien
ggcgcctacttcgagcgtctctatg

SEQ ID NO: 177513 - DNA, 25 bp, Homo sapien
cactattatgtaccagggcggccgt

SEQ ID NO: 177514 - DNA, 25 bp, Homo sapien
accaggtctctgagctgcgcacttg

SEQ ID NO: 177515 - DNA, 25 bp, Homo sapien
cgtgcaagcgcctcaaaccaagtca

SEQ ID NO: 177516 - DNA, 25 bp, Homo sapien
tgcctggctcactggaaatcctctt

SEQ ID NO: 177517 - DNA, 25 bp, Homo sapien
aaccgcccgctggttctcaatttcg

SEQ ID NO: 177518 - DNA, 25 bp, Homo sapien
gttcggagccgcagaaaacatgaca

SEQ ID NO: 177519 - DNA, 25 bp, Homo sapien
ctccgctagtaaattgtgaaacaga

SEQ ID NO: 177520 - DNA, 25 bp, Homo sapien
gcctcggattccaacggctttcctg

SEQ ID NO: 177521 - DNA, 25 bp, Homo sapien
cttccggaaatacgatcgagctgtc

SEQ ID NO: 177522 - DNA, 25 bp, Homo sapien
gagaaacatttttatcgcttccgga

SEQ ID NO: 177523 - DNA, 25 bp, Homo sapien
cagctgtaatcaattagggtggttc

SEQ ID NO: 177524 - DNA, 25 bp, Homo sapien
gcagaggtggcgcaaaccagcaccc

SEQ ID NO: 177525 - DNA, 25 bp, Homo sapien
agctgtcaaagctcatgaactccgc

SEQ ID NO: 177526 - DNA, 25 bp, Homo sapien
ctggttgcttagactcggatgaatg

SEQ ID NO: 177527 - DNA, 25 bp, Homo sapien
tgctctcgcagctaaaaccgttctc

SEQ ID NO: 177528 - DNA, 25 bp, Homo sapien
ggatgaatgctccaccgctccgagg

SEQ ID NO: 177529 - DNA, 25 bp, Homo sapien
ctctgcgctgtctaatcgtgctttg

SEQ ID NO: 177530 - DNA, 25 bp, Homo sapien
ctttgacgacgccaaaggccttgga

SEQ ID NO: 177531 - DNA, 25 bp, Homo sapien
cggctgcttaagtaacggggatttg

SEQ ID NO: 177532 - DNA, 25 bp, Homo sapien
ccattgttcccgtacagtgagcggc

SEQ ID NO: 177533 - DNA, 25 bp, Homo sapien
aggctcgcgcagcatttcaggactg

SEQ ID NO: 177534 - DNA, 25 bp, Homo sapien
tcgctgcacagagctgtcaggagtg

SEQ ID NO: 177535 - DNA, 25 bp, Homo sapien
tcgcgcacgaactcgctgcacagag

SEQ ID NO: 177536 - DNA, 25 bp, Homo sapien
gccctttaactaggcgcggaggctg

SEQ ID NO: 177537 - DNA, 25 bp, Homo sapien
agtgaagccctcttgggcacccgcg

SEQ ID NO: 177538 - DNA, 25 bp, Homo sapien
tctttccagaagcagtgaagccctc

SEQ ID NO: 177539 - DNA, 25 bp, Homo sapien
tcctggccgtgttgtcaccgccaat

SEQ ID NO: 177540 - DNA, 25 bp, Homo sapien
tgacctgaggacacccgaagacacg

SEQ ID NO: 177541 - DNA, 25 bp, Homo sapien
gcggaggtggtttttccttgtgatc

SEQ ID NO: 177542 - DNA, 25 bp, Homo sapien
aaggccagacgttctcagagtccga

SEQ ID NO: 177543 - DNA, 25 bp, Homo sapien
ccgctttcctctagggtgggcgtat

SEQ ID NO: 177544 - DNA, 25 bp, Homo sapien
accctcagcgttggtggccgctttc

SEQ ID NO: 177545 - DNA, 25 bp, Homo sapien
tcgggtacaggtgttgcgcctccga

SEQ ID NO: 177546 - DNA, 25 bp, Homo sapien
tcaaaagcctttatgcccgggccgc

SEQ ID NO: 177547 - DNA, 25 bp, Homo sapien
gcgcgaggcctatctaaaggccaga

SEQ ID NO: 177548 - DNA, 25 bp, Homo sapien
aggggttcacctccattgcatccgg

SEQ ID NO: 177549 - DNA, 25 bp, Homo sapien
cctcgctggtacacgaggcggctcg

SEQ ID NO: 177550 - DNA, 25 bp, Homo sapien
ctgagccgccgcagggaaagcacgt

SEQ ID NO: 177551 - DNA, 25 bp, Homo sapien
gaacctggacgagccgcgaccgcag

SEQ ID NO: 177552 - DNA, 25 bp, Homo sapien
agcgcggcggttccttgaaaaagcg

SEQ ID NO: 177553 - DNA, 25 bp, Homo sapien
cacttcctgggcgaggccgctgcag

SEQ ID NO: 177554 - DNA, 25 bp, Homo sapien
ccggcgcatattcaccacgggtgag

SEQ ID NO: 177555 - DNA, 25 bp, Homo sapien
agccgaagcctgaacctggacgagc

SEQ ID NO: 177556 - DNA, 25 bp, Homo sapien
cttccgggagcagccgaagcctgaa

SEQ ID NO: 177557 - DNA, 25 bp, Homo sapien
cgtgctctgtgaccggcgcatattc

SEQ ID NO: 177558 - DNA, 25 bp, Homo sapien
cagcggccaccaagtctttgaggcc

SEQ ID NO: 177559 - DNA, 25 bp, Homo sapien
gcggccaccaagtctttgaggcctc

SEQ ID NO: 177560 - DNA, 25 bp, Homo sapien
ggccaccaagtctttgaggcctcgc

SEQ ID NO: 177561 - DNA, 25 bp, Homo sapien
accaagtctttgaggcctcgcctcg

SEQ ID NO: 177562 - DNA, 25 bp, Homo sapien
ccaagtctttgaggcctcgcctcgg

SEQ ID NO: 177563 - DNA, 25 bp, Homo sapien
cgcatgtgggcgtgacctcgcggaa

SEQ ID NO: 177564 - DNA, 25 bp, Homo sapien
tgggtgggacctcgcggcaaaagct

SEQ ID NO: 177565 - DNA, 25 bp, Homo sapien
ctcgcggcaaaagctgcggagggcg

SEQ ID NO: 177566 - DNA, 25 bp, Homo sapien
ccggtctttggacctggcccctgtg

SEQ ID NO: 177567 - DNA, 25 bp, Homo sapien
gctgtcacccgctggcgcgtggggc

SEQ ID NO: 177568 - DNA, 25 bp, Homo sapien
gcctgccggacagtcctgcgggcgg

SEQ ID NO: 177569 - DNA, 25 bp, Homo sapien
catcctcgcggcctgccggacagtc

SEQ ID NO: 177570 - DNA, 25 bp, Homo sapien
ctggcgcgggctttgtaaagccgcc

SEQ ID NO: 177571 - DNA, 25 bp, Homo sapien
gtctttggacctggcccctgtggcc

SEQ ID NO: 177572 - DNA, 25 bp, Homo sapien
ctgcggcctcgccattctccgctca

SEQ ID NO: 177573 - DNA, 25 bp, Homo sapien
cgccattctccgctcagggcccgag

SEQ ID NO: 177574 - DNA, 25 bp, Homo sapien
tgtcaccgcagtcgcagccacatgc

SEQ ID NO: 177575 - DNA, 25 bp, Homo sapien
ccgctccagccatgccgaataaaaa

SEQ ID NO: 177576 - DNA, 25 bp, Homo sapien
ttctctcggcctcatgcccggtggg

SEQ ID NO: 177577 - DNA, 25 bp, Homo sapien
tgtcttgcgcctccacagcgggcca

SEQ ID NO: 177578 - DNA, 25 bp, Homo sapien
tcgaccaatggcagggcgctgttga

SEQ ID NO: 177579 - DNA, 25 bp, Homo sapien
ggaagcgagagcaagcgaaagactc

SEQ ID NO: 177580 - DNA, 25 bp, Homo sapien
cgagagcaagcgaaagactcagtcc

SEQ ID NO: 177581 - DNA, 25 bp, Homo sapien
ccagccatgccgaataaaaacaaga

SEQ ID NO: 177582 - DNA, 25 bp, Homo sapien
gatctggcctcctgcgttgcgcgct

SEQ ID NO: 177583 - DNA, 25 bp, Homo sapien
tcctgttgtcgctgcagacccgcgt

SEQ ID NO: 177584 - DNA, 25 bp, Homo sapien
accacgttttctcaagagtgttgtc

SEQ ID NO: 177585 - DNA, 25 bp, Homo sapien
agtgttgtctgtcccggccttccaa

SEQ ID NO: 177586 - DNA, 25 bp, Homo sapien
gcggaggacgccgatctggcctcct

SEQ ID NO: 177587 - DNA, 25 bp, Homo sapien
agccgctaggctgccaaggcgcgct

SEQ ID NO: 177588 - DNA, 25 bp, Homo sapien
aggctcgacctcactcctgttgtcg

SEQ ID NO: 177589 - DNA, 25 bp, Homo sapien
ggccttccaaggagacccttagctc

SEQ ID NO: 177590 - DNA, 25 bp, Homo sapien
cagctgtcggttccgttcccgctcg

SEQ ID NO: 177591 - DNA, 25 bp, Homo sapien
tggcgcttggtgtccctgcgatccc

SEQ ID NO: 177592 - DNA, 25 bp, Homo sapien
gactgtgctcccgacgtttctctcg

SEQ ID NO: 177593 - DNA, 25 bp, Homo sapien
gtccctctcccgactgtgctcccga

SEQ ID NO: 177594 - DNA, 25 bp, Homo sapien
tccggcttctgctgtggcgcttggt

SEQ ID NO: 177595 - DNA, 25 bp, Homo sapien
tgtgctccgactccggcttctgctg

SEQ ID NO: 177596 - DNA, 25 bp, Homo sapien
cacaggtgtgctccgactccggctt

SEQ ID NO: 177597 - DNA, 25 bp, Homo sapien
tctcgctccagctgtcggttccgtt

SEQ ID NO: 177598 - DNA, 25 bp, Homo sapien
tgctcccttcgcactgacagaggtg

SEQ ID NO: 177599 - DNA, 25 bp, Homo sapien
acctctccatagctgcgtgtggtca

SEQ ID NO: 177600 - DNA, 25 bp, Homo sapien
tagcttccttctctacccagtggcg

SEQ ID NO: 177601 - DNA, 25 bp, Homo sapien
gctggctgtttcgaagaaccgcaca

SEQ ID NO: 177602 - DNA, 25 bp, Homo sapien
gaagacttcacatcctgcaccgcta

SEQ ID NO: 177603 - DNA, 25 bp, Homo sapien
ctcacgtcgatgtttccgcagacta

SEQ ID NO: 177604 - DNA, 25 bp, Homo sapien
gtggttataacctcacctctccata

SEQ ID NO: 177605 - DNA, 25 bp, Homo sapien
gtggactcgccagccagaagacttc

SEQ ID NO: 177606 - DNA, 25 bp, Homo sapien
gtggaccactgacttgtaatcttta

SEQ ID NO: 177607 - DNA, 25 bp, Homo sapien
gaagttcgttctttcctccaggata

SEQ ID NO: 177608 - DNA, 25 bp, Homo sapien
tggacctcagttccctctccagtga

SEQ ID NO: 177609 - DNA, 25 bp, Homo sapien
ccgacgccagtcgttgtggaccact

SEQ ID NO: 177610 - DNA, 25 bp, Homo sapien
tgtcagacgcccaatctcgcgagtg

SEQ ID NO: 177611 - DNA, 25 bp, Homo sapien
accgtgccgatctaggtcgtgtgac

SEQ ID NO: 177612 - DNA, 25 bp, Homo sapien
cccgtctggtgtagtcctggaacaa

SEQ ID NO: 177613 - DNA, 25 bp, Homo sapien
tatgtcacgtgttcctctcccaatg

SEQ ID NO: 177614 - DNA, 25 bp, Homo sapien
gttaatatctgccagcgcccgctcg

SEQ ID NO: 177615 - DNA, 25 bp, Homo sapien
tgcactggacgctgccgcccagaga

SEQ ID NO: 177616 - DNA, 25 bp, Homo sapien
ggctttctgcactggacgctgccgc

SEQ ID NO: 177617 - DNA, 25 bp, Homo sapien
tgaaagcgtccggatgcgctggccc

SEQ ID NO: 177618 - DNA, 25 bp, Homo sapien
acctgaaagcgtccggatgcgctgg

SEQ ID NO: 177619 - DNA, 25 bp, Homo sapien
ggacctgaaagcgtccggatgcgct

SEQ ID NO: 177620 - DNA, 25 bp, Homo sapien
gctgtgcgctggtggggacctgaaa

SEQ ID NO: 177621 - DNA, 25 bp, Homo sapien
gacgctgccgcccagagagctgctc

SEQ ID NO: 177622 - DNA, 25 bp, Homo sapien
tgcagaagcacctgcgcaagctggt

SEQ ID NO: 177623 - DNA, 25 bp, Homo sapien
agtgtcacatgagcttttcggtttc

SEQ ID NO: 177624 - DNA, 25 bp, Homo sapien
cgccctggagcagatgcgcaagttc

SEQ ID NO: 177625 - DNA, 25 bp, Homo sapien
cgcaagttcctttcggacccgcagg

SEQ ID NO: 177626 - DNA, 25 bp, Homo sapien
cgtctgccgtcacccaaaacaatgg

SEQ ID NO: 177627 - DNA, 25 bp, Homo sapien
acaatggggtcgctttgtctgctcg

SEQ ID NO: 177628 - DNA, 25 bp, Homo sapien
cggtttcgatttgtgtccaagccaa

SEQ ID NO: 177629 - DNA, 25 bp, Homo sapien
tctcatcgctcctggaaggtcccga

SEQ ID NO: 177630 - DNA, 25 bp, Homo sapien
gtggcgcagtataacgccaaccatc

SEQ ID NO: 177631 - DNA, 25 bp, Homo sapien
atgcaaccgtacttcacgtccaacg

SEQ ID NO: 177632 - DNA, 25 bp, Homo sapien
acgtccaacggcctggtcaccaagg

SEQ ID NO: 177633 - DNA, 25 bp, Homo sapien
gcctggtcaccaaggcgctagagca

SEQ ID NO: 177634 - DNA, 25 bp, Homo sapien
ccagctggagcacatcatggaccta

SEQ ID NO: 177635 - DNA, 25 bp, Homo sapien
tcatggacctaacacgcctgcgctg

SEQ ID NO: 177636 - DNA, 25 bp, Homo sapien
cctgccgcaacgtggcgcagtataa

SEQ ID NO: 177637 - DNA, 25 bp, Homo sapien
agtataacgccaaccatcccgactt

SEQ ID NO: 177638 - DNA, 25 bp, Homo sapien
cagcgcgcggcgctttttccagaag

SEQ ID NO: 177639 - DNA, 25 bp, Homo sapien
ccgcgcctgccttatatagcgacgg

SEQ ID NO: 177640 - DNA, 25 bp, Homo sapien
cacaccgggacgctgaagcaactga

SEQ ID NO: 177641 - DNA, 25 bp, Homo sapien
taagtgaccgcacaggaccaacggc

SEQ ID NO: 177642 - DNA, 25 bp, Homo sapien
aaccacccgtcaccttggctaagtg

SEQ ID NO: 177643 - DNA, 25 bp, Homo sapien
tgaagtgaggtgtagttggtcaccc

SEQ ID NO: 177644 - DNA, 25 bp, Homo sapien
ccgaggcctccggaatagaaagcgc

SEQ ID NO: 177645 - DNA, 25 bp, Homo sapien
cccattcctgaagcggggtgcggaa

SEQ ID NO: 177646 - DNA, 25 bp, Homo sapien
atcacctgggaagcagccatgccgc

SEQ ID NO: 177647 - DNA, 25 bp, Homo sapien
aactccactggggtactcctgagga

SEQ ID NO: 177648 - DNA, 25 bp, Homo sapien
tggccgtcgctcttacttttgagtg

SEQ ID NO: 177649 - DNA, 25 bp, Homo sapien
gccgggagctgtacttctatatcta

SEQ ID NO: 177650 - DNA, 25 bp, Homo sapien
gcgaccgcctctgcttcaatgtggg

SEQ ID NO: 177651 - DNA, 25 bp, Homo sapien
tgtacaagctgctgccgcactcgga

SEQ ID NO: 177652 - DNA, 25 bp, Homo sapien
ccacccgggaaggtctgtacaagct

SEQ ID NO: 177653 - DNA, 25 bp, Homo sapien
tccgggcacttagggcaggatgaac

SEQ ID NO: 177654 - DNA, 25 bp, Homo sapien
catttgtagcctctgccgcgcttga

SEQ ID NO: 177655 - DNA, 25 bp, Homo sapien
ccgaccagcgagtgcagcaggaaca

SEQ ID NO: 177656 - DNA, 25 bp, Homo sapien
ctcagcgcccgatgccggtagaact

SEQ ID NO: 177657 - DNA, 25 bp, Homo sapien
cgcgccttccaagcgatcagcgagg

SEQ ID NO: 177658 - DNA, 25 bp, Homo sapien
cggggtccaaattcgagtagaatct

SEQ ID NO: 177659 - DNA, 25 bp, Homo sapien
gttaaggaagaccagtccctccatg

SEQ ID NO: 177660 - DNA, 25 bp, Homo sapien
cccaccggtgagcaggaatatgaca

SEQ ID NO: 177661 - DNA, 25 bp, Homo sapien
agcgcagtctccaggaagagcaaga

SEQ ID NO: 177662 - DNA, 25 bp, Homo sapien
ttccttagcagtgagaacctccaca

SEQ ID NO: 177663 - DNA, 25 bp, Homo sapien
ctgaggtttcgttccttagcagtga

SEQ ID NO: 177664 - DNA, 25 bp, Homo sapien
cgattcatggaacacagcgtctggc

SEQ ID NO: 177665 - DNA, 25 bp, Homo sapien
gtgagaacctccacatgcgtgggta

SEQ ID NO: 177666 - DNA, 25 bp, Homo sapien
acagcgtctggcgtccagctttgtg

SEQ ID NO: 177667 - DNA, 25 bp, Homo sapien
ctggcctctgactgcggggttgcac

SEQ ID NO: 177668 - DNA, 25 bp, Homo sapien
tgcccttggctgaggtttcgttcct

SEQ ID NO: 177669 - DNA, 25 bp, Homo sapien
acctccacatgcgtgggtaggggtc

SEQ ID NO: 177670 - DNA, 25 bp, Homo sapien
tacagacacaaaattcagtggcggc

SEQ ID NO: 177671 - DNA, 25 bp, Homo sapien
gagaagctggttccgcgctaccttc

SEQ ID NO: 177672 - DNA, 25 bp, Homo sapien
caggcttaaggtccttctgcggatc

SEQ ID NO: 177673 - DNA, 25 bp, Homo sapien
tcttccgcctttccgcactatggtg

SEQ ID NO: 177674 - DNA, 25 bp, Homo sapien
acgacggtgctgctcagttatcttc

SEQ ID NO: 177675 - DNA, 25 bp, Homo sapien
ttggtgttgcctccgaagtcgagac

SEQ ID NO: 177676 - DNA, 25 bp, Homo sapien
ctgcggatctgtctgtcaaagaaaa

SEQ ID NO: 177677 - DNA, 25 bp, Homo sapien
tcagcagcagatcacccaggcctgg

SEQ ID NO: 177678 - DNA, 25 bp, Homo sapien
ttagcgatttggaacccactacgtg

SEQ ID NO: 177679 - DNA, 25 bp, Homo sapien
ttcctccgcttccatgtaaatactg

SEQ ID NO: 177680 - DNA, 25 bp, Homo sapien
cagcccggttgctaagcagcctttc

SEQ ID NO: 177681 - DNA, 25 bp, Homo sapien
gccatgttgtgtccctgtcacccta

SEQ ID NO: 177682 - DNA, 25 bp, Homo sapien
ccctcgaaggagagcgttagagatc

SEQ ID NO: 177683 - DNA, 25 bp, Homo sapien
gtcccgcactaggatctccgtggtg

SEQ ID NO: 177684 - DNA, 25 bp, Homo sapien
ctgctttccacttccctgaggcggg

SEQ ID NO: 177685 - DNA, 25 bp, Homo sapien
ccttgccgacactggacggaaaaga

SEQ ID NO: 177686 - DNA, 25 bp, Homo sapien
cggcttcgggcatcttcggtaattt

SEQ ID NO: 177687 - DNA, 25 bp, Homo sapien
ccatcttgcgtgaggtactcgggtc

SEQ ID NO: 177688 - DNA, 25 bp, Homo sapien
tgagccgcttgaccagggcactctt

SEQ ID NO: 177689 - DNA, 25 bp, Homo sapien
acgcccttcgaacgtaccgagatga

SEQ ID NO: 177690 - DNA, 25 bp, Homo sapien
tcctccggatgtcctcggatgtttc

SEQ ID NO: 177691 - DNA, 25 bp, Homo sapien
cctgctttcaggctcggttttcttc

SEQ ID NO: 177692 - DNA, 25 bp, Homo sapien
cgtcttgccgaagctttgaatcgaa

SEQ ID NO: 177693 - DNA, 25 bp, Homo sapien
cgtttatttccggacctagagatga

SEQ ID NO: 177694 - DNA, 25 bp, Homo sapien
gcacccacaagggtcgatcaactcg

SEQ ID NO: 177695 - DNA, 25 bp, Homo sapien
aatgccacggttgcacccacaaggg

SEQ ID NO: 177696 - DNA, 25 bp, Homo sapien
aagtcccgggaatgccacggttgca

SEQ ID NO: 177697 - DNA, 25 bp, Homo sapien
gcccactcgggacgcgtggcttgaa

SEQ ID NO: 177698 - DNA, 25 bp, Homo sapien
ctctagcggctgacgtcagtcacgg

SEQ ID NO: 177699 - DNA, 25 bp, Homo sapien
ccaggtgccctctagcggctgacgt

SEQ ID NO: 177700 - DNA, 25 bp, Homo sapien
ccctaagcctgggttcggagctgat

SEQ ID NO: 177701 - DNA, 25 bp, Homo sapien
agctgcacgtgggtcgccctaagcc

SEQ ID NO: 177702 - DNA, 25 bp, Homo sapien
ggccagacacggtcgccttcctagg

SEQ ID NO: 177703 - DNA, 25 bp, Homo sapien
gcactccacgactttcccggccaga

SEQ ID NO: 177704 - DNA, 25 bp, Homo sapien
cccaggctgagcttcttagggacgg

SEQ ID NO: 177705 - DNA, 25 bp, Homo sapien
cagtatccgcccgggttaagactca

SEQ ID NO: 177706 - DNA, 25 bp, Homo sapien
cttgtccggggaggccagtatccgc

SEQ ID NO: 177707 - DNA, 25 bp, Homo sapien
cgtacattggagacgccgtcgctca

SEQ ID NO: 177708 - DNA, 25 bp, Homo sapien
cctaggtgacgtacattggagacgc

SEQ ID NO: 177709 - DNA, 25 bp, Homo sapien
ccctctcctaggtgacgtacattgg

SEQ ID NO: 177710 - DNA, 25 bp, Homo sapien
cagatatccgtagaaggagacgcga

SEQ ID NO: 177711 - DNA, 25 bp, Homo sapien
tcgccttaagattgacgtcgtgttc

SEQ ID NO: 177712 - DNA, 25 bp, Homo sapien
taaatgccacaacacacggagcgcc

SEQ ID NO: 177713 - DNA, 25 bp, Homo sapien
ccggaaacgcatttgcgtcacgtcc

SEQ ID NO: 177714 - DNA, 25 bp, Homo sapien
tccataaggtccacagatatccgta

SEQ ID NO: 177715 - DNA, 25 bp, Homo sapien
cgatctcacgcaccttccataaggt

SEQ ID NO: 177716 - DNA, 25 bp, Homo sapien
gggaaaggaaccgatctcacgcacc

SEQ ID NO: 177717 - DNA, 25 bp, Homo sapien
gcggagtggcggacactaaatgcca

SEQ ID NO: 177718 - DNA, 25 bp, Homo sapien
acctctgctggaaatgcccttgctg

SEQ ID NO: 177719 - DNA, 25 bp, Homo sapien
cccagggacccactggaagagcttc

SEQ ID NO: 177720 - DNA, 25 bp, Homo sapien
ctgggctgttcagaggcatgatcca

SEQ ID NO: 177721 - DNA, 25 bp, Homo sapien
ccgcgatcacctagttccggggatg

SEQ ID NO: 177722 - DNA, 25 bp, Homo sapien
cctggccgagcctcagctttatctg

SEQ ID NO: 177723 - DNA, 25 bp, Homo sapien
gcttacacgttagctcctgggagga

SEQ ID NO: 177724 - DNA, 25 bp, Homo sapien
cctgcgtctcagtttgggctcattc

SEQ ID NO: 177725 - DNA, 25 bp, Homo sapien
actgactgggtcactatcactggca

SEQ ID NO: 177726 - DNA, 25 bp, Homo sapien
agtcccaagggtgacagcggccagt

SEQ ID NO: 177727 - DNA, 25 bp, Homo sapien
agcgccgctgaactgcgccatggtc

SEQ ID NO: 177728 - DNA, 25 bp, Homo sapien
ccagtcgggagacgccctcaaggtc

SEQ ID NO: 177729 - DNA, 25 bp, Homo sapien
caagatcactttccgggcccgaggc

SEQ ID NO: 177730 - DNA, 25 bp, Homo sapien
gggtccctgcgtccgcaagatcact

SEQ ID NO: 177731 - DNA, 25 bp, Homo sapien
gggtgaaatggccacagtcccgcca

SEQ ID NO: 177732 - DNA, 25 bp, Homo sapien
gtgttccctggtcggaccctgccga

SEQ ID NO: 177733 - DNA, 25 bp, Homo sapien
gtcgcacagtgcagggcagtcccaa

SEQ ID NO: 177734 - DNA, 25 bp, Homo sapien
cgcctcgccttccagtctgtgaaat

SEQ ID NO: 177735 - DNA, 25 bp, Homo sapien
tcaaggctcccggacgggcctcagt

SEQ ID NO: 177736 - DNA, 25 bp, Homo sapien
gctccctaagccttgccaggtggtg

SEQ ID NO: 177737 - DNA, 25 bp, Homo sapien
gagtaatccgattgctttccaaacc

SEQ ID NO: 177738 - DNA, 25 bp, Homo sapien
cccgcgggagaacatctgcgccagg

SEQ ID NO: 177739 - DNA, 25 bp, Homo sapien
cctgatggggaggagtaatccgatt

SEQ ID NO: 177740 - DNA, 25 bp, Homo sapien
gtggggactctgaaccctgtctcca

SEQ ID NO: 177741 - DNA, 25 bp, Homo sapien
acacagctaggggaggcgcagaaac

SEQ ID NO: 177742 - DNA, 25 bp, Homo sapien
ttcttccattggacggctccgtgcc

SEQ ID NO: 177743 - DNA, 25 bp, Homo sapien
ccagcgggtctaaatgtatgaattc

SEQ ID NO: 177744 - DNA, 25 bp, Homo sapien
gctcattcccagtccgcggagtctg

SEQ ID NO: 177745 - DNA, 25 bp, Homo sapien
caaatccggtctccgaagaggcgcc

SEQ ID NO: 177746 - DNA, 25 bp, Homo sapien
gtctgcggccaagccaaatccggtc

SEQ ID NO: 177747 - DNA, 25 bp, Homo sapien
gccttccgctgggatctgttcccag

SEQ ID NO: 177748 - DNA, 25 bp, Homo sapien
gggccgcttctctcggccgagattg

SEQ ID NO: 177749 - DNA, 25 bp, Homo sapien
ggtaccagagacctccgagcgctca

SEQ ID NO: 177750 - DNA, 25 bp, Homo sapien
gcgaccctcgcgctgacattggcgt

SEQ ID NO: 177751 - DNA, 25 bp, Homo sapien
cccgtgctccgacctgaaggtgacg

SEQ ID NO: 177752 - DNA, 25 bp, Homo sapien
gtgttcagaacaccgacagtcgctc

SEQ ID NO: 177753 - DNA, 25 bp, Homo sapien
ggccgccacgttgtgttcagaacac

SEQ ID NO: 177754 - DNA, 25 bp, Homo sapien
tgaatgaatcgactcaacccgggcc

SEQ ID NO: 177755 - DNA, 25 bp, Homo sapien
aggccacctcgctttgggtcttgtc

SEQ ID NO: 177756 - DNA, 25 bp, Homo sapien
ctcctgggcgttagatgaatgaatc

SEQ ID NO: 177757 - DNA, 25 bp, Homo sapien
cgtagtgaccgcgagacaaagaccc

SEQ ID NO: 177758 - DNA, 25 bp, Homo sapien
ttactttgagaagtcgacgggactc

SEQ ID NO: 177759 - DNA, 25 bp, Homo sapien
gcttcccagcgccagacacatttta

SEQ ID NO: 177760 - DNA, 25 bp, Homo sapien
actctcagcggggtccttcagatgg

SEQ ID NO: 177761 - DNA, 25 bp, Homo sapien
ggagatggcaaacctcaaaccacgt

SEQ ID NO: 177762 - DNA, 25 bp, Homo sapien
ctcaaaccacgtacggcgggcgata

SEQ ID NO: 177763 - DNA, 25 bp, Homo sapien
gggcgatacgcgtcaaccgaacctc

SEQ ID NO: 177764 - DNA, 25 bp, Homo sapien
tgtccaaatcccaccagagccaatg

SEQ ID NO: 177765 - DNA, 25 bp, Homo sapien
agccatctcgcgtcagttgggctgc

SEQ ID NO: 177766 - DNA, 25 bp, Homo sapien
atctgtcctgggtgtgccttcgccc

SEQ ID NO: 177767 - DNA, 25 bp, Homo sapien
caaaaccaatgtgtgcgaactgtca

SEQ ID NO: 177768 - DNA, 25 bp, Homo sapien
tgcgaactgtcacacctgtgccact

SEQ ID NO: 177769 - DNA, 25 bp, Homo sapien
cacaattggccagctgggccgtgca

SEQ ID NO: 177770 - DNA, 25 bp, Homo sapien
gtgcacgtcagactgcctgcctcgg

SEQ ID NO: 177771 - DNA, 25 bp, Homo sapien
gtggcccacctgtctctggtgctgc

SEQ ID NO: 177772 - DNA, 25 bp, Homo sapien
cgcgacgggtgcttcttaggcaaaa

SEQ ID NO: 177773 - DNA, 25 bp, Homo sapien
agtgcctgctggaagtgccctccgt

SEQ ID NO: 177774 - DNA, 25 bp, Homo sapien
ctcgcggtttttccgtctgcgaaat

SEQ ID NO: 177775 - DNA, 25 bp, Homo sapien
tcttacttctcataccgggttgcgc

SEQ ID NO: 177776 - DNA, 25 bp, Homo sapien
ttcctgattccaaggccgagaagag

SEQ ID NO: 177777 - DNA, 25 bp, Homo sapien
ctgtccttaacaacgctgtcctctg

SEQ ID NO: 177778 - DNA, 25 bp, Homo sapien
aggctatctaggcaggcgtcctgca

SEQ ID NO: 177779 - DNA, 25 bp, Homo sapien
ctctgcaggtatcagtagaagtccg

SEQ ID NO: 177780 - DNA, 25 bp, Homo sapien
tgacccaggcggtctccaaactctg

SEQ ID NO: 177781 - DNA, 25 bp, Homo sapien
ggacttcgacgtcgcagccaactgg

SEQ ID NO: 177782 - DNA, 25 bp, Homo sapien
aagcgcactgggctggccattggct

SEQ ID NO: 177783 - DNA, 25 bp, Homo sapien
cgagtcctgattggtaggcgcaggc

SEQ ID NO: 177784 - DNA, 25 bp, Homo sapien
tgccaaggtggcccgagtcctgatt

SEQ ID NO: 177785 - DNA, 25 bp, Homo sapien
cccagccctgctcgagcaagttgga

SEQ ID NO: 177786 - DNA, 25 bp, Homo sapien
tacccagccctgctcgagcaagttg

SEQ ID NO: 177787 - DNA, 25 bp, Homo sapien
ccagcgatggccgaaaccgggactg

SEQ ID NO: 177788 - DNA, 25 bp, Homo sapien
agcgatggccgaaaccgggactgcc

SEQ ID NO: 177789 - DNA, 25 bp, Homo sapien
gggagcgcgccggtctacccagccc

SEQ ID NO: 177790 - DNA, 25 bp, Homo sapien
gagccgttgtgttgctgacccacgg

SEQ ID NO: 177791 - DNA, 25 bp, Homo sapien
ctgagcactcaggtgaagtctcttc

SEQ ID NO: 177792 - DNA, 25 bp, Homo sapien
cgcgacgaggacctggctgttttcc

SEQ ID NO: 177793 - DNA, 25 bp, Homo sapien
tgcacacgttgggtctgagcactca

SEQ ID NO: 177794 - DNA, 25 bp, Homo sapien
tgctgtgacctctgtggtaagcgcc

SEQ ID NO: 177795 - DNA, 25 bp, Homo sapien
cccgcatttgacctggagcggtacc

SEQ ID NO: 177796 - DNA, 25 bp, Homo sapien
acaccttcctgggtctggtaatggg

SEQ ID NO: 177797 - DNA, 25 bp, Homo sapien
ttgcttctcggaggcatcgcccttc

SEQ ID NO: 177798 - DNA, 25 bp, Homo sapien
catggtgcgcacatcaaagacgtcc

SEQ ID NO: 177799 - DNA, 25 bp, Homo sapien
ggggccttatctggattggaaacca

SEQ ID NO: 177800 - DNA, 25 bp, Homo sapien
gccttcagagttcaggggccttatc

SEQ ID NO: 177801 - DNA, 25 bp, Homo sapien
aggctcacccgagaacttgctcttg

SEQ ID NO: 177802 - DNA, 25 bp, Homo sapien
tgtccggcacgttgagaaccgctcc

SEQ ID NO: 177803 - DNA, 25 bp, Homo sapien
cctggtgcgcagcatctgcttcttg

SEQ ID NO: 177804 - DNA, 25 bp, Homo sapien
aaccgccttttgctcctggtgcgca

SEQ ID NO: 177805 - DNA, 25 bp, Homo sapien
agacgtccacgccatactcgctgta

SEQ ID NO: 177806 - DNA, 25 bp, Homo sapien
tgcctcctaaggctccagcaaacgc

SEQ ID NO: 177807 - DNA, 25 bp, Homo sapien
gtgtgagtctcgctacccagcgtgg

SEQ ID NO: 177808 - DNA, 25 bp, Homo sapien
acctcagtgccagaacggcctgcta

SEQ ID NO: 177809 - DNA, 25 bp, Homo sapien
ccagaacggcctgctattcggggct

SEQ ID NO: 177810 - DNA, 25 bp, Homo sapien
tgaacccgacgtgctgcctcctaag

SEQ ID NO: 177811 - DNA, 25 bp, Homo sapien
ttccaggcgaggagcatcggagccc

SEQ ID NO: 177812 - DNA, 25 bp, Homo sapien
ctcctgcaggtgaacccgacgtgct

SEQ ID NO: 177813 - DNA, 25 bp, Homo sapien
acaagcacccgctgccgtcaaaaca

SEQ ID NO: 177814 - DNA, 25 bp, Homo sapien
aggagcctagcgctgcgcaagcccg

SEQ ID NO: 177815 - DNA, 25 bp, Homo sapien
tacaggcagacgagcacgtcgagca

SEQ ID NO: 177816 - DNA, 25 bp, Homo sapien
tggctgcactcggtgtacaggcaga

SEQ ID NO: 177817 - DNA, 25 bp, Homo sapien
gagcacgtcgagcagcgtttccacg

SEQ ID NO: 177818 - DNA, 25 bp, Homo sapien
aggaactcggccacgtacttgtcgc

SEQ ID NO: 177819 - DNA, 25 bp, Homo sapien
tttccacgctcagggcgctctcgtt

SEQ ID NO: 177820 - DNA, 25 bp, Homo sapien
tgagccgcaccttggccgacatggt

SEQ ID NO: 177821 - DNA, 25 bp, Homo sapien
cctaggccgacatcttgggctccgt

SEQ ID NO: 177822 - DNA, 25 bp, Homo sapien
tccgtgcaatgggaagcaagcctcg

SEQ ID NO: 177823 - DNA, 25 bp, Homo sapien
tggatcctgcttggctttgcctgga

SEQ ID NO: 177824 - DNA, 25 bp, Homo sapien
tgggcgctcctagtcgcctagatcg

SEQ ID NO: 177825 - DNA, 25 bp, Homo sapien
gcttggctttgcctggagcctcatt

SEQ ID NO: 177826 - DNA, 25 bp, Homo sapien
tggagcctcattctctccggctgtg

SEQ ID NO: 177827 - DNA, 25 bp, Homo sapien
cgggcgttcctctctcgagccggga

SEQ ID NO: 177828 - DNA, 25 bp, Homo sapien
tttcctatgagcagggtgtcggctc

SEQ ID NO: 177829 - DNA, 25 bp, Homo sapien
agcaagcctcgctttcctatgagca

SEQ ID NO: 177830 - DNA, 25 bp, Homo sapien
aactattttggggagtctgtgccca

SEQ ID NO: 177831 - DNA, 25 bp, Homo sapien
ctcagcgccgtggtacctaccgagg

SEQ ID NO: 177832 - DNA, 25 bp, Homo sapien
gctgaccgacctcagcgccgtggta

SEQ ID NO: 177833 - DNA, 25 bp, Homo sapien
tgtgaccgcagttctgcgggctccc

SEQ ID NO: 177834 - DNA, 25 bp, Homo sapien
atttcatgtgtgaccgcagttctgc

SEQ ID NO: 177835 - DNA, 25 bp, Homo sapien
ctcccttcggctctgtcatttcatg

SEQ ID NO: 177836 - DNA, 25 bp, Homo sapien
gggtccagcgttctccgtgcccaga

SEQ ID NO: 177837 - DNA, 25 bp, Homo sapien
ggacgtcctcctgcgcgatctttgg

SEQ ID NO: 177838 - DNA, 25 bp, Homo sapien
atttgggagttttgagtcgagctcc

SEQ ID NO: 177839 - DNA, 25 bp, Homo sapien
cccgggagcgccctgacggctaggt

SEQ ID NO: 177840 - DNA, 25 bp, Homo sapien
ccctcgatgtgtggtgccccggctg

SEQ ID NO: 177841 - DNA, 25 bp, Homo sapien
tgtgcccagcaagacctgggatccc

SEQ ID NO: 177842 - DNA, 25 bp, Homo sapien
aacgccatgcctccgcgcgcttgtg

SEQ ID NO: 177843 - DNA, 25 bp, Homo sapien
ggtcagcccggctgtggaacgccat

SEQ ID NO: 177844 - DNA, 25 bp, Homo sapien
gatttgggagttttgagtcgagctc

SEQ ID NO: 177845 - DNA, 25 bp, Homo sapien
agcccggctgtggaacgccatgcct

SEQ ID NO: 177846 - DNA, 25 bp, Homo sapien
tgcgcttaacgctggtcccggcagc

SEQ ID NO: 177847 - DNA, 25 bp, Homo sapien
ccaccacacggctccggggtgagaa

SEQ ID NO: 177848 - DNA, 25 bp, Homo sapien
tgacgccatttactgagatttgatc

SEQ ID NO: 177849 - DNA, 25 bp, Homo sapien
ctccggggtgagaattatgacatct

SEQ ID NO: 177850 - DNA, 25 bp, Homo sapien
tctgggtgctcacgctgcgcttaac

SEQ ID NO: 177851 - DNA, 25 bp, Homo sapien
ccacctcaaccctgcaatatggggt

SEQ ID NO: 177852 - DNA, 25 bp, Homo sapien
tatgacatctggctcaacacggctg

SEQ ID NO: 177853 - DNA, 25 bp, Homo sapien
tctggctcaacacggctgcccggga

SEQ ID NO: 177854 - DNA, 25 bp, Homo sapien
catctgggttcagggtacagcctgc

SEQ ID NO: 177855 - DNA, 25 bp, Homo sapien
gcccgactggagagcgactacacca

SEQ ID NO: 177856 - DNA, 25 bp, Homo sapien
gcgttagactttgagcctggccaga

SEQ ID NO: 177857 - DNA, 25 bp, Homo sapien
tagccgtccttcagcgttctgcagg

SEQ ID NO: 177858 - DNA, 25 bp, Homo sapien
tggccgattcctgagctgtgtttga

SEQ ID NO: 177859 - DNA, 25 bp, Homo sapien
tccttaaattgtgtggggtcagacc

SEQ ID NO: 177860 - DNA, 25 bp, Homo sapien
gttgcctgaagtcccgcactcctta

SEQ ID NO: 177861 - DNA, 25 bp, Homo sapien
ctcccgctctctgcctgggatgagg

SEQ ID NO: 177862 - DNA, 25 bp, Homo sapien
gatgggtgcgccttccacatcctgc

SEQ ID NO: 177863 - DNA, 25 bp, Homo sapien
tatcaggagccgtcgtcggacaatg

SEQ ID NO: 177864 - DNA, 25 bp, Homo sapien
ccgggcgacacaggccgagtcactt

SEQ ID NO: 177865 - DNA, 25 bp, Homo sapien
acggtaagtgacctccgcttccaca

SEQ ID NO: 177866 - DNA, 25 bp, Homo sapien
ctatttcaggccttgcggaacccgg

SEQ ID NO: 177867 - DNA, 25 bp, Homo sapien
tcggacaatggctccgcgcctgaca

SEQ ID NO: 177868 - DNA, 25 bp, Homo sapien
cggtgacaccggaacacttcagagg

SEQ ID NO: 177869 - DNA, 25 bp, Homo sapien
cggggctgactctgcgactatttca

SEQ ID NO: 177870 - DNA, 25 bp, Homo sapien
ccgtggcgcagttcgagctgtgcga

SEQ ID NO: 177871 - DNA, 25 bp, Homo sapien
ccaccagcacttcgcggcccacctg

SEQ ID NO: 177872 - DNA, 25 bp, Homo sapien
gagagctaccaccagcacttcgcgg

SEQ ID NO: 177873 - DNA, 25 bp, Homo sapien
cgtggcggcctacgccgagagctac

SEQ ID NO: 177874 - DNA, 25 bp, Homo sapien
tggagcggctgaagccgctgttccc

SEQ ID NO: 177875 - DNA, 25 bp, Homo sapien
gagagcgtctttctgcacttgggcc

SEQ ID NO: 177876 - DNA, 25 bp, Homo sapien
cccgagagcgtctttctgcacttgg

SEQ ID NO: 177877 - DNA, 25 bp, Homo sapien
gcacttgggccgcaccatgaaggag

SEQ ID NO: 177878 - DNA, 25 bp, Homo sapien
ccgccgttgttgtcccagaactcgt

SEQ ID NO: 177879 - DNA, 25 bp, Homo sapien
ctgtcacacggtagcgcaaggcgaa

SEQ ID NO: 177880 - DNA, 25 bp, Homo sapien
gtcagagcaaggcactggaccaatc

SEQ ID NO: 177881 - DNA, 25 bp, Homo sapien
tgggtgctctttggcaaatccactc

SEQ ID NO: 177882 - DNA, 25 bp, Homo sapien
gggcgtccctctgcaattggatctg

SEQ ID NO: 177883 - DNA, 25 bp, Homo sapien
tgcgtcggcgaaacgcactctcttg

SEQ ID NO: 177884 - DNA, 25 bp, Homo sapien
cgtagagcatagtcacggccgccgt

SEQ ID NO: 177885 - DNA, 25 bp, Homo sapien
cctagagccactcgcagatggggtc

SEQ ID NO: 177886 - DNA, 25 bp, Homo sapien
caggcctggtgcctttgtgcaagga

SEQ ID NO: 177887 - DNA, 25 bp, Homo sapien
ttcctctcctcggagcacagggtca

SEQ ID NO: 177888 - DNA, 25 bp, Homo sapien
gcctccagcagtgggaagcagcccg

SEQ ID NO: 177889 - DNA, 25 bp, Homo sapien
gatctgcaccagtaacttctccagg

SEQ ID NO: 177890 - DNA, 25 bp, Homo sapien
tgtcccgccagctgttggatctgca

SEQ ID NO: 177891 - DNA, 25 bp, Homo sapien
tcagtgggccctggcacacattctc

SEQ ID NO: 177892 - DNA, 25 bp, Homo sapien
aacaagcagcttgagtgcaggcgcg

SEQ ID NO: 177893 - DNA, 25 bp, Homo sapien
aggagccaggagcaagcaaacaagc

SEQ ID NO: 177894 - DNA, 25 bp, Homo sapien
acccgcgcgggaacttggcagagac

SEQ ID NO: 177895 - DNA, 25 bp, Homo sapien
ccctgatgcgtacctggcgggactg

SEQ ID NO: 177896 - DNA, 25 bp, Homo sapien
ctgctgaggactacctcgcgggccg

SEQ ID NO: 177897 - DNA, 25 bp, Homo sapien
aagggcgctgttaagaaggacagtc

SEQ ID NO: 177898 - DNA, 25 bp, Homo sapien
cgctgttaagaaggacagtcccggg

SEQ ID NO: 177899 - DNA, 25 bp, Homo sapien
taagaaggacagtcccggggaatga

SEQ ID NO: 177900 - DNA, 25 bp, Homo sapien
agaagatgacagacggggcagagta

SEQ ID NO: 177901 - DNA, 25 bp, Homo sapien
acgtcccgccggctgtacctggcgc

SEQ ID NO: 177902 - DNA, 25 bp, Homo sapien
ggaggccctgatcccgcccgaggtg

SEQ ID NO: 177903 - DNA, 25 bp, Homo sapien
caggtgttcacgctggcggtgcgcg

SEQ ID NO: 177904 - DNA, 25 bp, Homo sapien
ggaggatggaccaggtgttcacgct

SEQ ID NO: 177905 - DNA, 25 bp, Homo sapien
caagatccagcggaggatggaccag

SEQ ID NO: 177906 - DNA, 25 bp, Homo sapien
cacggccaagatccagcggaggatg

SEQ ID NO: 177907 - DNA, 25 bp, Homo sapien
gtcacggccaagatccagcggagga

SEQ ID NO: 177908 - DNA, 25 bp, Homo sapien
gcacccaggccgaccgggactccga

SEQ ID NO: 177909 - DNA, 25 bp, Homo sapien
tggaaatcgtggacgcggcggacgc

SEQ ID NO: 177910 - DNA, 25 bp, Homo sapien
tgacaagatctggacgtggcgactc

SEQ ID NO: 177911 - DNA, 25 bp, Homo sapien
gcctccaggcaacgcgcagccgcgt

SEQ ID NO: 177912 - DNA, 25 bp, Homo sapien
tccaggagcgctcatcggggcgcca

SEQ ID NO: 177913 - DNA, 25 bp, Homo sapien
gaggctgaggttccttcgccccttc

SEQ ID NO: 177914 - DNA, 25 bp, Homo sapien
tcccgggccggtgacaagatctgga

SEQ ID NO: 177915 - DNA, 25 bp, Homo sapien
catgggaccgtccttcctaacggca

SEQ ID NO: 177916 - DNA, 25 bp, Homo sapien
tctgctctgcgcagtccgtcctctt

SEQ ID NO: 177917 - DNA, 25 bp, Homo sapien
gggtccgtgccggtcgcgctatcca

SEQ ID NO: 177918 - DNA, 25 bp, Homo sapien
ctgagcgtcgcacgctttgcgtaga

SEQ ID NO: 177919 - DNA, 25 bp, Homo sapien
cgcacgctttgcgtagatgagggat

SEQ ID NO: 177920 - DNA, 25 bp, Homo sapien
agcgtcgcacgctttgcgtagatga

SEQ ID NO: 177921 - DNA, 25 bp, Homo sapien
caggcacaggcctgagcgtcgcacg

SEQ ID NO: 177922 - DNA, 25 bp, Homo sapien
gagcgtcgcacgctttgcgtagatg

SEQ ID NO: 177923 - DNA, 25 bp, Homo sapien
ctttgcgtagatgagggatggcgcc

SEQ ID NO: 177924 - DNA, 25 bp, Homo sapien
tgacgcaggcacaggcctgagcgtc

SEQ ID NO: 177925 - DNA, 25 bp, Homo sapien
aggcctgagcgtcgcacgctttgcg

SEQ ID NO: 177926 - DNA, 25 bp, Homo sapien
aggcctctgtcttcacacaggagga

SEQ ID NO: 177927 - DNA, 25 bp, Homo sapien
tcctgcagcgtcaggacccgaacga

SEQ ID NO: 177928 - DNA, 25 bp, Homo sapien
cgcgcgcagaactcggccgagtgca

SEQ ID NO: 177929 - DNA, 25 bp, Homo sapien
ctccaggccaaaggctgtgtcagcc

SEQ ID NO: 177930 - DNA, 25 bp, Homo sapien
ctcccttccggtgcgcgaaaaagca

SEQ ID NO: 177931 - DNA, 25 bp, Homo sapien
atgtcgcccggaatcccggtgccta

SEQ ID NO: 177932 - DNA, 25 bp, Homo sapien
aaaggagacgcttcccgctgggcga

SEQ ID NO: 177933 - DNA, 25 bp, Homo sapien
tagccctgggtccaaacgggcagga

SEQ ID NO: 177934 - DNA, 25 bp, Homo sapien
aggtcatggccaagagccagcggat

SEQ ID NO: 177935 - DNA, 25 bp, Homo sapien
cgttcccggaggtcatggccaagag

SEQ ID NO: 177936 - DNA, 25 bp, Homo sapien
cctggactccatccagaaaaagatg

SEQ ID NO: 177937 - DNA, 25 bp, Homo sapien
ggaactgagcctgccgggacgcttc

SEQ ID NO: 177938 - DNA, 25 bp, Homo sapien
tgagcctgccgggacgcttctaacc

SEQ ID NO: 177939 - DNA, 25 bp, Homo sapien
tgcctcgagtccctccggtgcccag

SEQ ID NO: 177940 - DNA, 25 bp, Homo sapien
ccaagacccacgggtgcagagcaga

SEQ ID NO: 177941 - DNA, 25 bp, Homo sapien
ccatccagaaaaagatggccctggt

SEQ ID NO: 177942 - DNA, 25 bp, Homo sapien
agcgagaacattccagaggtgagtc

SEQ ID NO: 177943 - DNA, 25 bp, Homo sapien
tcgggtttatatcgcgcctcacttc

SEQ ID NO: 177944 - DNA, 25 bp, Homo sapien
gagcagcgttgggtttatgtcttta

SEQ ID NO: 177945 - DNA, 25 bp, Homo sapien
ttatttgacgaaaacggtgagtcgc

SEQ ID NO: 177946 - DNA, 25 bp, Homo sapien
cggcgttgttcagtcagagcgagaa

SEQ ID NO: 177947 - DNA, 25 bp, Homo sapien
tgactcaggcttcagctgctgcatt

SEQ ID NO: 177948 - DNA, 25 bp, Homo sapien
gcgaaccaatgacgagcgagctgtg

SEQ ID NO: 177949 - DNA, 25 bp, Homo sapien
gccgcgagttgagcctcaggaagca

SEQ ID NO: 177950 - DNA, 25 bp, Homo sapien
ccttttcggaactgccgtggactcg

SEQ ID NO: 177951 - DNA, 25 bp, Homo sapien
ttgccaacggtgaatgaacgagaca

SEQ ID NO: 177952 - DNA, 25 bp, Homo sapien
ctgttttgttttgaccctcgcattg

SEQ ID NO: 177953 - DNA, 25 bp, Homo sapien
gctgaggcagcaagctcgctagaga

SEQ ID NO: 177954 - DNA, 25 bp, Homo sapien
catcttggctccgtgaggctctgag

SEQ ID NO: 177955 - DNA, 25 bp, Homo sapien
ccggctttctcaggccatgctgatt

SEQ ID NO: 177956 - DNA, 25 bp, Homo sapien
gtttctcggctctttcgcggttgcc

SEQ ID NO: 177957 - DNA, 25 bp, Homo sapien
cctcgcattgtgcagaattaaagtg

SEQ ID NO: 177958 - DNA, 25 bp, Homo sapien
ttgtccacgcctgtctggatgacgt

SEQ ID NO: 177959 - DNA, 25 bp, Homo sapien
agaagccacggatgctgcggcccgt

SEQ ID NO: 177960 - DNA, 25 bp, Homo sapien
agcccacggtcatgatgtacgggtg

SEQ ID NO: 177961 - DNA, 25 bp, Homo sapien
tgacgtcgtccagcgtgaagccgct

SEQ ID NO: 177962 - DNA, 25 bp, Homo sapien
gcaccttggccatgtggttgttgtg

SEQ ID NO: 177963 - DNA, 25 bp, Homo sapien
aagcgcagcttcagtgcgttgtggc

SEQ ID NO: 177964 - DNA, 25 bp, Homo sapien
ttccaccgcgagcttctcgatggcg

SEQ ID NO: 177965 - DNA, 25 bp, Homo sapien
gcacccgcgagctcagcacgtagtt

SEQ ID NO: 177966 - DNA, 25 bp, Homo sapien
gccggaagtgttgtggccgccgccg

SEQ ID NO: 177967 - DNA, 25 bp, Homo sapien
cgcccaggaaacgtcctctgggagg

SEQ ID NO: 177968 - DNA, 25 bp, Homo sapien
cgcaggtgagactccgcggggtaca

SEQ ID NO: 177969 - DNA, 25 bp, Homo sapien
tctgcatcggctgggcggtgtttgc

SEQ ID NO: 177970 - DNA, 25 bp, Homo sapien
cccttgttgcctctgcatcggctgg

SEQ ID NO: 177971 - DNA, 25 bp, Homo sapien
cagcaggagcgtcgcaggtgagact

SEQ ID NO: 177972 - DNA, 25 bp, Homo sapien
cgcgacgtcatcagcgggcgcggag

SEQ ID NO: 177973 - DNA, 25 bp, Homo sapien
gcagcctggcgctcccaggatcccg

SEQ ID NO: 177974 - DNA, 25 bp, Homo sapien
tggggccttatttgattgccaagta

SEQ ID NO: 177975 - DNA, 25 bp, Homo sapien
gcaaggttcacctgtcacgaaacga

SEQ ID NO: 177976 - DNA, 25 bp, Homo sapien
cgtgttgattgacaggcagatttcc

SEQ ID NO: 177977 - DNA, 25 bp, Homo sapien
tcgtcacagcgtggcggtattatta

SEQ ID NO: 177978 - DNA, 25 bp, Homo sapien
tccagtcgcctagctagggccaatc

SEQ ID NO: 177979 - DNA, 25 bp, Homo sapien
aggcgatcggaagattggtcctttc

SEQ ID NO: 177980 - DNA, 25 bp, Homo sapien
ttcgactctcgcaagccaatcggca

SEQ ID NO: 177981 - DNA, 25 bp, Homo sapien
gggcaggcagcttgactaatgagtc

SEQ ID NO: 177982 - DNA, 25 bp, Homo sapien
atccgcaccattgcacccacgggtc

SEQ ID NO: 177983 - DNA, 25 bp, Homo sapien
acacggtggagttccaccagcagcg

SEQ ID NO: 177984 - DNA, 25 bp, Homo sapien
tggccgacgccgtcttcctggacat

SEQ ID NO: 177985 - DNA, 25 bp, Homo sapien
gtgactgtgcgcacccaggacgtgt

SEQ ID NO: 177986 - DNA, 25 bp, Homo sapien
cacccaggacgtgtgccgcagtggc

SEQ ID NO: 177987 - DNA, 25 bp, Homo sapien
ccgcagtggctttggcgtgagccac

SEQ ID NO: 177988 - DNA, 25 bp, Homo sapien
cgccctcaaggtcgaaggtgcatcc

SEQ ID NO: 177989 - DNA, 25 bp, Homo sapien
acctgcacacggtggagttccacca

SEQ ID NO: 177990 - DNA, 25 bp, Homo sapien
gcatcgagcaggtgcaacgcacatg

SEQ ID NO: 177991 - DNA, 25 bp, Homo sapien
acaggcacagatggccctgccggct

SEQ ID NO: 177992 - DNA, 25 bp, Homo sapien
gccacaggtctacaacgtgcgcact

SEQ ID NO: 177993 - DNA, 25 bp, Homo sapien
ggtgctgccacaggtctacaacgtg

SEQ ID NO: 177994 - DNA, 25 bp, Homo sapien
tcagagctgagcaccctggaggtgc

SEQ ID NO: 177995 - DNA, 25 bp, Homo sapien
tgcaacgcacatgccaggcgctggc

SEQ ID NO: 177996 - DNA, 25 bp, Homo sapien
cttctcaccgtgcatcgagcaggtg

SEQ ID NO: 177997 - DNA, 25 bp, Homo sapien
ggcttctcagagctgagcaccctgg

SEQ ID NO: 177998 - DNA, 25 bp, Homo sapien
tcgcaccgctgggaaagcgcacggt

SEQ ID NO: 177999 - DNA, 25 bp, Homo sapien
gcagcctggagtgaccgcgaccaag

SEQ ID NO: 178000 - DNA, 25 bp, Homo sapien
atcagccctttacggggtgcggcac

SEQ ID NO: 178001 - DNA, 25 bp, Homo sapien
gcgcctgcaggacgtgacctcacaa

SEQ ID NO: 178002 - DNA, 25 bp, Homo sapien
acgtgacctcacaatgggcgcgcga

SEQ ID NO: 178003 - DNA, 25 bp, Homo sapien
atcgcgcgatgcgtcgccgacgctt

SEQ ID NO: 178004 - DNA, 25 bp, Homo sapien
ccgagagagggaaaaggctacaagc

SEQ ID NO: 178005 - DNA, 25 bp, Homo sapien
gcttcgcgaccctgccgtaaagcgg

SEQ ID NO: 178006 - DNA, 25 bp, Homo sapien
taccaagtcccagtcgcaggggccg

SEQ ID NO: 178007 - DNA, 25 bp, Homo sapien
gactcctccacaaagcaaatgcgcg

SEQ ID NO: 178008 - DNA, 25 bp, Homo sapien
gggagaggctttcccgactcctcca

SEQ ID NO: 178009 - DNA, 25 bp, Homo sapien
ttctggccaccgctgaaatagagga

SEQ ID NO: 178010 - DNA, 25 bp, Homo sapien
taatccctccctttgtttctggcca

SEQ ID NO: 178011 - DNA, 25 bp, Homo sapien
ttccgatgtccaggccctttagagc

SEQ ID NO: 178012 - DNA, 25 bp, Homo sapien
agcaaatgcgcgaggaacagaaccc

SEQ ID NO: 178013 - DNA, 25 bp, Homo sapien
ggccgtcgccactccttcaaaggga

SEQ ID NO: 178014 - DNA, 25 bp, Homo sapien
gggaccgaaacgagcgcatgaagct

SEQ ID NO: 178015 - DNA, 25 bp, Homo sapien
ggggagcaacactgagacgccattt

SEQ ID NO: 178016 - DNA, 25 bp, Homo sapien
gccgcattctggtagggcccacagt

SEQ ID NO: 178017 - DNA, 25 bp, Homo sapien
ccctagctggtgactgctgcgccgt

SEQ ID NO: 178018 - DNA, 25 bp, Homo sapien
cgggatcatctgattccggggcctc

SEQ ID NO: 178019 - DNA, 25 bp, Homo sapien
caaaggctgtcggttttcctggagg

SEQ ID NO: 178020 - DNA, 25 bp, Homo sapien
gtcagggtctcgaccaaaggctgtc

SEQ ID NO: 178021 - DNA, 25 bp, Homo sapien
gaagctgccgaagcgctcggtcatc

SEQ ID NO: 178022 - DNA, 25 bp, Homo sapien
gcagacgcgttttaaaggcccgagc

SEQ ID NO: 178023 - DNA, 25 bp, Homo sapien
cggcccaggcagacgcgttttaaag

SEQ ID NO: 178024 - DNA, 25 bp, Homo sapien
gcttctcaggcagggctgttgtgca

SEQ ID NO: 178025 - DNA, 25 bp, Homo sapien
cactgatcgtgtaggaacaggagga

SEQ ID NO: 178026 - DNA, 25 bp, Homo sapien
tcggcactgatcgtgtaggaacagg

SEQ ID NO: 178027 - DNA, 25 bp, Homo sapien
cccttcggcactgatcgtgtaggaa

SEQ ID NO: 178028 - DNA, 25 bp, Homo sapien
agccgccaccgtgtcagtgggactg

SEQ ID NO: 178029 - DNA, 25 bp, Homo sapien
gcagggctgttgtgcagccgccacc

SEQ ID NO: 178030 - DNA, 25 bp, Homo sapien
agttcaagctccgattagtccgcgc

SEQ ID NO: 178031 - DNA, 25 bp, Homo sapien
ccctgagtgggctacaccaatcaga

SEQ ID NO: 178032 - DNA, 25 bp, Homo sapien
accaatcagagacgaagcggcgcta

SEQ ID NO: 178033 - DNA, 25 bp, Homo sapien
cggcgctaacgtgactgactaacta

SEQ ID NO: 178034 - DNA, 25 bp, Homo sapien
tcaatctccctgagaggggcggagc

SEQ ID NO: 178035 - DNA, 25 bp, Homo sapien
gcggtgcccttacacggattggaga

SEQ ID NO: 178036 - DNA, 25 bp, Homo sapien
gtcatgtcctccgaggtgtccgcgc

SEQ ID NO: 178037 - DNA, 25 bp, Homo sapien
gccgccgattggtgatcgacctcag

SEQ ID NO: 178038 - DNA, 25 bp, Homo sapien
cgtgtccctcaaggaggcggagttc

SEQ ID NO: 178039 - DNA, 25 bp, Homo sapien
ggcggagttctacgacaagcagctc

SEQ ID NO: 178040 - DNA, 25 bp, Homo sapien
ctggattcgtttagaagcggttata

SEQ ID NO: 178041 - DNA, 25 bp, Homo sapien
agcggttatagagccttcccttctt

SEQ ID NO: 178042 - DNA, 25 bp, Homo sapien
cccttcttttcagaggcggaatgtc

SEQ ID NO: 178043 - DNA, 25 bp, Homo sapien
tctaaaatgttggtgctgactccgc

SEQ ID NO: 178044 - DNA, 25 bp, Homo sapien
gggcgtttgcaaccactgtggctcc

SEQ ID NO: 178045 - DNA, 25 bp, Homo sapien
ggccggagacctttgcccaatagca

SEQ ID NO: 178046 - DNA, 25 bp, Homo sapien
agatcgaactctccttccagagacg

SEQ ID NO: 178047 - DNA, 25 bp, Homo sapien
tgatcctctgcaccagatcgaactc

SEQ ID NO: 178048 - DNA, 25 bp, Homo sapien
ctcatagatgatcctctgcaccaga

SEQ ID NO: 178049 - DNA, 25 bp, Homo sapien
cggctgcagctcacctcatagatga

SEQ ID NO: 178050 - DNA, 25 bp, Homo sapien
ttccacctaggacacacggcctgtg

SEQ ID NO: 178051 - DNA, 25 bp, Homo sapien
gcttgctgggatcttccacctagga

SEQ ID NO: 178052 - DNA, 25 bp, Homo sapien
atcccttcgtcgttgggcttgctgg

SEQ ID NO: 178053 - DNA, 25 bp, Homo sapien
tccagagacgcgtctaggagcagtg

SEQ ID NO: 178054 - DNA, 25 bp, Homo sapien
tgacaggacgctccgcgccgagctg

SEQ ID NO: 178055 - DNA, 25 bp, Homo sapien
cgacgcccttggctggcacctgctt

SEQ ID NO: 178056 - DNA, 25 bp, Homo sapien
gagccttggccttcgcccgagcgat

SEQ ID NO: 178057 - DNA, 25 bp, Homo sapien
cgcccgcactctgaccgcggcctga

SEQ ID NO: 178058 - DNA, 25 bp, Homo sapien
tccggccgcctcctaaggccgcgct

SEQ ID NO: 178059 - DNA, 25 bp, Homo sapien
catcatcgcggggagagtccgcgac

SEQ ID NO: 178060 - DNA, 25 bp, Homo sapien
acccaccggcatcatcgcggggaga

SEQ ID NO: 178061 - DNA, 25 bp, Homo sapien
ctaccctcgctctcagcggcggcca

SEQ ID NO: 178062 - DNA, 25 bp, Homo sapien
gagacgccgcaaggccagagtgcct

SEQ ID NO: 178063 - DNA, 25 bp, Homo sapien
gcaggcctaggcgatgcttccctct

SEQ ID NO: 178064 - DNA, 25 bp, Homo sapien
ggcgatgcttccctctggcaaccga

SEQ ID NO: 178065 - DNA, 25 bp, Homo sapien
gacggctcagaacgcaccacaaatc

SEQ ID NO: 178066 - DNA, 25 bp, Homo sapien
gaacgcaccacaaatctgcagccaa

SEQ ID NO: 178067 - DNA, 25 bp, Homo sapien
gcagccaactcggaaaggtcaccga

SEQ ID NO: 178068 - DNA, 25 bp, Homo sapien
actcggaaaggtcaccgagcgcgca

SEQ ID NO: 178069 - DNA, 25 bp, Homo sapien
aagcagcagagacgccgcaaggcca

SEQ ID NO: 178070 - DNA, 25 bp, Homo sapien
agggaaggccggcgacacagctccc

SEQ ID NO: 178071 - DNA, 25 bp, Homo sapien
tgcaggaaggctccatggcccatgt

SEQ ID NO: 178072 - DNA, 25 bp, Homo sapien
tccggcagcagcataatgctgagaa

SEQ ID NO: 178073 - DNA, 25 bp, Homo sapien
gtctccggcagcagcataatgctga

SEQ ID NO: 178074 - DNA, 25 bp, Homo sapien
aggagcttgcgcttggtctccggca

SEQ ID NO: 178075 - DNA, 25 bp, Homo sapien
agcacctcgggcaggagcttgcgct

SEQ ID NO: 178076 - DNA, 25 bp, Homo sapien
tcccggagcacctcgggcaggagct

SEQ ID NO: 178077 - DNA, 25 bp, Homo sapien
ctccatggcccatgtggaggcgctg

SEQ ID NO: 178078 - DNA, 25 bp, Homo sapien
gccttgaggatgctgcggaagctca

SEQ ID NO: 178079 - DNA, 25 bp, Homo sapien
tccagggcgagtggtcactacacaa

SEQ ID NO: 178080 - DNA, 25 bp, Homo sapien
gggccatccagatccttctcgcgag

SEQ ID NO: 178081 - DNA, 25 bp, Homo sapien
ccgctgcgttcgaaaggtaggacgc

SEQ ID NO: 178082 - DNA, 25 bp, Homo sapien
catcgagcagatcaacgactggttc

SEQ ID NO: 178083 - DNA, 25 bp, Homo sapien
cgcgttctgattggaaggcctcgag

SEQ ID NO: 178084 - DNA, 25 bp, Homo sapien
tgaggtcctagaaaggctcaccctg

SEQ ID NO: 178085 - DNA, 25 bp, Homo sapien
gactggttcaccatcggcaagacgg

SEQ ID NO: 178086 - DNA, 25 bp, Homo sapien
agctcggcggtgagtccgagaccct

SEQ ID NO: 178087 - DNA, 25 bp, Homo sapien
cccgacctggacagaggagattgcg

SEQ ID NO: 178088 - DNA, 25 bp, Homo sapien
tggggagtcaaatccgcgcctggat

SEQ ID NO: 178089 - DNA, 25 bp, Homo sapien
tcgttggggagtcaaatccgcgcct

SEQ ID NO: 178090 - DNA, 25 bp, Homo sapien
gaggctgctggccgtctacaccggc

SEQ ID NO: 178091 - DNA, 25 bp, Homo sapien
ctacaccggcggcaccattggcatg

SEQ ID NO: 178092 - DNA, 25 bp, Homo sapien
gtaggcctctggacctggccgcgac

SEQ ID NO: 178093 - DNA, 25 bp, Homo sapien
accggcggcaccattggcatgcgga

SEQ ID NO: 178094 - DNA, 25 bp, Homo sapien
aatcctgagtcggatcgggctcccg

SEQ ID NO: 178095 - DNA, 25 bp, Homo sapien
ctctcgcagtgatgtcagtgtaatc

SEQ ID NO: 178096 - DNA, 25 bp, Homo sapien
ggggaatgatcccagcatctctcgc

SEQ ID NO: 178097 - DNA, 25 bp, Homo sapien
ccggcccggctcagtctgatttacg

SEQ ID NO: 178098 - DNA, 25 bp, Homo sapien
ggctctgctgaaaaccgcttcgctc

SEQ ID NO: 178099 - DNA, 25 bp, Homo sapien
catgtgcacacgaatccactctggc

SEQ ID NO: 178100 - DNA, 25 bp, Homo sapien
ccaccagcaggaactcatgtgcaca

SEQ ID NO: 178101 - DNA, 25 bp, Homo sapien
gcgaggctgacacgcgtctttcctt

SEQ ID NO: 178102 - DNA, 25 bp, Homo sapien
tggccaacgagtgcctcctcccaca

SEQ ID NO: 178103 - DNA, 25 bp, Homo sapien
attgctcggccatcggtctctcgct

SEQ ID NO: 178104 - DNA, 25 bp, Homo sapien
ttgcccattgctcggccatcggtct

SEQ ID NO: 178105 - DNA, 25 bp, Homo sapien
gactgtgttgcccattgctcggcca

SEQ ID NO: 178106 - DNA, 25 bp, Homo sapien
acccttgagactgtgttgcccattg

SEQ ID NO: 178107 - DNA, 25 bp, Homo sapien
tgggcttcacccttgagactgtgtt

SEQ ID NO: 178108 - DNA, 25 bp, Homo sapien
tggccagcggagtttccctgggctt

SEQ ID NO: 178109 - DNA, 25 bp, Homo sapien
atgcggcctgcaagacacagccggg

SEQ ID NO: 178110 - DNA, 25 bp, Homo sapien
atgtttaggaccactagacccggcg

SEQ ID NO: 178111 - DNA, 25 bp, Homo sapien
cgcagctcggcgaaccgacggtgtt

SEQ ID NO: 178112 - DNA, 25 bp, Homo sapien
tcaacagttctgtagcgcaattgtg

SEQ ID NO: 178113 - DNA, 25 bp, Homo sapien
tcagagtcacagtcaggggtgcgcc

SEQ ID NO: 178114 - DNA, 25 bp, Homo sapien
ccgcacctcgaaactccgtggaatt

SEQ ID NO: 178115 - DNA, 25 bp, Homo sapien
ctccgtggaattcccagcgaggaac

SEQ ID NO: 178116 - DNA, 25 bp, Homo sapien
gggtccagtggttcttaacagttca

SEQ ID NO: 178117 - DNA, 25 bp, Homo sapien
ggcgaccaatccaggggagcccacg

SEQ ID NO: 178118 - DNA, 25 bp, Homo sapien
gggtcactttgacgtactgagtctc

SEQ ID NO: 178119 - DNA, 25 bp, Homo sapien
gttgtcctcagtacccagatccaga

SEQ ID NO: 178120 - DNA, 25 bp, Homo sapien
ctgccaggcctgctgacaacaggtc

SEQ ID NO: 178121 - DNA, 25 bp, Homo sapien
agtctctgcgaaggcctcaccgtat

SEQ ID NO: 178122 - DNA, 25 bp, Homo sapien
agcgactgcaggcttacggatctca

SEQ ID NO: 178123 - DNA, 25 bp, Homo sapien
tgacgcccgttttcattctccaggc

SEQ ID NO: 178124 - DNA, 25 bp, Homo sapien
atatagagagtgtgtgtcccggagc

SEQ ID NO: 178125 - DNA, 25 bp, Homo sapien
ttccggagctgagttcccatctgcc

SEQ ID NO: 178126 - DNA, 25 bp, Homo sapien
gccagacggcttcttttggcatgcc

SEQ ID NO: 178127 - DNA, 25 bp, Homo sapien
ctggccgcaggcctgtaccgttgct

SEQ ID NO: 178128 - DNA, 25 bp, Homo sapien
cgtgccggactcctgagacaggtca

SEQ ID NO: 178129 - DNA, 25 bp, Homo sapien
ctgcttccggcaggaattggcagtg

SEQ ID NO: 178130 - DNA, 25 bp, Homo sapien
gcttcttttggcatgcccgggctct

SEQ ID NO: 178131 - DNA, 25 bp, Homo sapien
ggctctcgctttgccagacggcttc

SEQ ID NO: 178132 - DNA, 25 bp, Homo sapien
gtgttgtggtcttccctctcgccgt

SEQ ID NO: 178133 - DNA, 25 bp, Homo sapien
cccgggctctgcttccggcaggaat

SEQ ID NO: 178134 - DNA, 25 bp, Homo sapien
accatcgcgttggagcacagccaga

SEQ ID NO: 178135 - DNA, 25 bp, Homo sapien
cgcgggtcagtgtcccattagcagc

SEQ ID NO: 178136 - DNA, 25 bp, Homo sapien
gtgctgataagcttgaacatgcatc

SEQ ID NO: 178137 - DNA, 25 bp, Homo sapien
atgcatcacacccagcggccagaga

SEQ ID NO: 178138 - DNA, 25 bp, Homo sapien
cggccagagacgagggcgtcttatc

SEQ ID NO: 178139 - DNA, 25 bp, Homo sapien
tctgattgcagagtgacggggcata

SEQ ID NO: 178140 - DNA, 25 bp, Homo sapien
gctgagggctgatgagcacaccatc

SEQ ID NO: 178141 - DNA, 25 bp, Homo sapien
tatgattagggcattgtcgcacgcc

SEQ ID NO: 178142 - DNA, 25 bp, Homo sapien
tgcaggtccttccacactggggtca

SEQ ID NO: 178143 - DNA, 25 bp, Homo sapien
tccttccacactggggtcagtttta

SEQ ID NO: 178144 - DNA, 25 bp, Homo sapien
cactggggtcagttttagggagtca

SEQ ID NO: 178145 - DNA, 25 bp, Homo sapien
gggtcagttttagggagtcaagata

SEQ ID NO: 178146 - DNA, 25 bp, Homo sapien
agtcaagatagacgtgagaggccga

SEQ ID NO: 178147 - DNA, 25 bp, Homo sapien
ggtggtcagcgttcaccacaccctt

SEQ ID NO: 178148 - DNA, 25 bp, Homo sapien
ttcgccgggtggcatcctggcctct

SEQ ID NO: 178149 - DNA, 25 bp, Homo sapien
ctctggggtgcaggtccttccacac

SEQ ID NO: 178150 - DNA, 25 bp, Homo sapien
tcctgaaggtggaccctcggaagaa

SEQ ID NO: 178151 - DNA, 25 bp, Homo sapien
gatgtttgccttcgatgccgtcttc

SEQ ID NO: 178152 - DNA, 25 bp, Homo sapien
ccgggaagctttccgagcagctgtt

SEQ ID NO: 178153 - DNA, 25 bp, Homo sapien
tggctcagcacatgggtccgatctg

SEQ ID NO: 178154 - DNA, 25 bp, Homo sapien
gccgaggccatgtccttcctgaagg

SEQ ID NO: 178155 - DNA, 25 bp, Homo sapien
actgctgcagttcccaagatgtttg

SEQ ID NO: 178156 - DNA, 25 bp, Homo sapien
ctcggaagaagcaggtgatcctcta

SEQ ID NO: 178157 - DNA, 25 bp, Homo sapien
tctgggccaagtccacagggaaagg

SEQ ID NO: 178158 - DNA, 25 bp, Homo sapien
cccaggcaagtcgtacaccatgatc

SEQ ID NO: 178159 - DNA, 25 bp, Homo sapien
tgttcacgctgcacgtctaccagta

SEQ ID NO: 178160 - DNA, 25 bp, Homo sapien
cgacgcagctcccacatgttgttca

SEQ ID NO: 178161 - DNA, 25 bp, Homo sapien
ctaccagtaccgcatggagaagtgc

SEQ ID NO: 178162 - DNA, 25 bp, Homo sapien
agaaggcggctttctacctggatgc

SEQ ID NO: 178163 - DNA, 25 bp, Homo sapien
aaccaaagcgagctgcgggcaccca

SEQ ID NO: 178164 - DNA, 25 bp, Homo sapien
caccatgatcgggaaggacagctca

SEQ ID NO: 178165 - DNA, 25 bp, Homo sapien
cctggctcttcaggctcatcgagga

SEQ ID NO: 178166 - DNA, 25 bp, Homo sapien
cggacacagacagctcgaagagatc

SEQ ID NO: 178167 - DNA, 25 bp, Homo sapien
ctcgggcacttactccgttggaggt

SEQ ID NO: 178168 - DNA, 25 bp, Homo sapien
aggaaaatgccagacgctccgcggg

SEQ ID NO: 178169 - DNA, 25 bp, Homo sapien
gtcccaatccttgaggcaatggttg

SEQ ID NO: 178170 - DNA, 25 bp, Homo sapien
atctccgagggtcccgacctgctgt

SEQ ID NO: 178171 - DNA, 25 bp, Homo sapien
tgagcacaggaaggccattatagtc

SEQ ID NO: 178172 - DNA, 25 bp, Homo sapien
cgccgaaaggatgcgctgtcctctg

SEQ ID NO: 178173 - DNA, 25 bp, Homo sapien
ctacagtgttgtcgattttgccgcc

SEQ ID NO: 178174 - DNA, 25 bp, Homo sapien
caccatgctgctgcgtgaatccctg

SEQ ID NO: 178175 - DNA, 25 bp, Homo sapien
atcgcccacgtgtcggatgcgccag

SEQ ID NO: 178176 - DNA, 25 bp, Homo sapien
ggctcaccatgctgctgcgtgaatc

SEQ ID NO: 178177 - DNA, 25 bp, Homo sapien
cgcagagacactcagcaccgtgcag

SEQ ID NO: 178178 - DNA, 25 bp, Homo sapien
gcatccaccgcctgcgcaggaagaa

SEQ ID NO: 178179 - DNA, 25 bp, Homo sapien
gaagaaggccaaggtgctccccacc

SEQ ID NO: 178180 - DNA, 25 bp, Homo sapien
accatgatcgcccacgtgtcggatg

SEQ ID NO: 178181 - DNA, 25 bp, Homo sapien
tgctgctgcgtgaatccctggccac

SEQ ID NO: 178182 - DNA, 25 bp, Homo sapien
tgcgagggagaaccctatccaggtc

SEQ ID NO: 178183 - DNA, 25 bp, Homo sapien
catggcctccttgatccaacggatc

SEQ ID NO: 178184 - DNA, 25 bp, Homo sapien
tgttcctgctcaagagcggcacgtc

SEQ ID NO: 178185 - DNA, 25 bp, Homo sapien
cccacaggccgatgacttctggtgc

SEQ ID NO: 178186 - DNA, 25 bp, Homo sapien
acgatggccgggactgccactatta

SEQ ID NO: 178187 - DNA, 25 bp, Homo sapien
cacggcatgctcaaggtgctgtacg

SEQ ID NO: 178188 - DNA, 25 bp, Homo sapien
ctgcatggacaagctagacgcgggc

SEQ ID NO: 178189 - DNA, 25 bp, Homo sapien
acctgcaccagatcgacgccgtgga

SEQ ID NO: 178190 - DNA, 25 bp, Homo sapien
tgggctcggcagctccacttttctt

SEQ ID NO: 178191 - DNA, 25 bp, Homo sapien
gaaggtccgcctgacttcgtgccca

SEQ ID NO: 178192 - DNA, 25 bp, Homo sapien
gagacgcagaccacttccgctgcag

SEQ ID NO: 178193 - DNA, 25 bp, Homo sapien
tcaccgacaacgaaggtccgcctga

SEQ ID NO: 178194 - DNA, 25 bp, Homo sapien
tgtcagaccgggagctcaccgacaa

SEQ ID NO: 178195 - DNA, 25 bp, Homo sapien
gacacggtcatctacgtggggcccg

SEQ ID NO: 178196 - DNA, 25 bp, Homo sapien
tcctgtgacacggtcatctacgtgg

SEQ ID NO: 178197 - DNA, 25 bp, Homo sapien
atgcatggacggcaacgagggtccc

SEQ ID NO: 178198 - DNA, 25 bp, Homo sapien
taccgtcatgggcacaaagcaggcg

SEQ ID NO: 178199 - DNA, 25 bp, Homo sapien
agccgcgtccatgagctgtcagcca

SEQ ID NO: 178200 - DNA, 25 bp, Homo sapien
gcggactcagacagcggccatgaca

SEQ ID NO: 178201 - DNA, 25 bp, Homo sapien
agaagcagcacaccgtcttgccgga

SEQ ID NO: 178202 - DNA, 25 bp, Homo sapien
acacgcgtctctggagcggtacgaa

SEQ ID NO: 178203 - DNA, 25 bp, Homo sapien
ccgggccagcaaggtagaagcagca

SEQ ID NO: 178204 - DNA, 25 bp, Homo sapien
cagcgctacagcagcggccatggca

SEQ ID NO: 178205 - DNA, 25 bp, Homo sapien
tgaagctgtctacggcctctgtgac

SEQ ID NO: 178206 - DNA, 25 bp, Homo sapien
tgccctgggccgtaagcccagcctc

SEQ ID NO: 178207 - DNA, 25 bp, Homo sapien
atcgatgacgtggagcgccttcagc

SEQ ID NO: 178208 - DNA, 25 bp, Homo sapien
tctccgttccaggtctgcagcggcg

SEQ ID NO: 178209 - DNA, 25 bp, Homo sapien
tggctggctccctgaaggagccgtt

SEQ ID NO: 178210 - DNA, 25 bp, Homo sapien
ctccctgaaggagccgttcgagatc

SEQ ID NO: 178211 - DNA, 25 bp, Homo sapien
agccgttcgagatcaaggtgtacga

SEQ ID NO: 178212 - DNA, 25 bp, Homo sapien
tcaaggtgtacgagatcgatgacgt

SEQ ID NO: 178213 - DNA, 25 bp, Homo sapien
tacgagatcgatgacgtggagcgcc

SEQ ID NO: 178214 - DNA, 25 bp, Homo sapien
gtctggcgtgcgtcagtacaaggct

SEQ ID NO: 178215 - DNA, 25 bp, Homo sapien
cagggtctggcgtgcgtcagtacaa

SEQ ID NO: 178216 - DNA, 25 bp, Homo sapien
agcacaagcacctgtgtgaggagct

SEQ ID NO: 178217 - DNA, 25 bp, Homo sapien
ccaagcacaagcacctgtgtgagga

SEQ ID NO: 178218 - DNA, 25 bp, Homo sapien
gctggctggagcagtgtgagtcccg

SEQ ID NO: 178219 - DNA, 25 bp, Homo sapien
tcagtacaaggctgcggctggcgga

SEQ ID NO: 178220 - DNA, 25 bp, Homo sapien
cgtgcgtcagtacaaggctgcggct

SEQ ID NO: 178221 - DNA, 25 bp, Homo sapien
tgtgtgaggagctggccgagaccca

SEQ ID NO: 178222 - DNA, 25 bp, Homo sapien
tgccagggtgaccagaagaccgtca

SEQ ID NO: 178223 - DNA, 25 bp, Homo sapien
cccttttgcatttggtgctacagac

SEQ ID NO: 178224 - DNA, 25 bp, Homo sapien
gatttggacttttctcccttttgca

SEQ ID NO: 178225 - DNA, 25 bp, Homo sapien
acttgagacaccagcagaagttgtg

SEQ ID NO: 178226 - DNA, 25 bp, Homo sapien
agcagaagttgtgttcagcccggcc

SEQ ID NO: 178227 - DNA, 25 bp, Homo sapien
gtgcctttgaccttgatttggactt

SEQ ID NO: 178228 - DNA, 25 bp, Homo sapien
ccgacagcaacgcaagtgcctttga

SEQ ID NO: 178229 - DNA, 25 bp, Homo sapien
catttggtgctacagacttgagaca

SEQ ID NO: 178230 - DNA, 25 bp, Homo sapien
gcacgtgcttccctgcgaaaagcag

SEQ ID NO: 178231 - DNA, 25 bp, Homo sapien
ccaggaccctgctctgtagcggggc

SEQ ID NO: 178232 - DNA, 25 bp, Homo sapien
gccgccgacaaaagcccactttaca

SEQ ID NO: 178233 - DNA, 25 bp, Homo sapien
gcccactttacactcaccagcttgg

SEQ ID NO: 178234 - DNA, 25 bp, Homo sapien
agctctgcgtgtggtccaaagccgt

SEQ ID NO: 178235 - DNA, 25 bp, Homo sapien
tgcgtgtggtccaaagccgtgtccc

SEQ ID NO: 178236 - DNA, 25 bp, Homo sapien
cgaaaagcagggtgaagcgacgtct

SEQ ID NO: 178237 - DNA, 25 bp, Homo sapien
ggctgcacgtgcttccctgcgaaaa

SEQ ID NO: 178238 - DNA, 25 bp, Homo sapien
tgagttgaggttaatgtttccatta

SEQ ID NO: 178239 - DNA, 25 bp, Homo sapien
ttctcagacctcagtgcgaggagga

SEQ ID NO: 178240 - DNA, 25 bp, Homo sapien
tcgggtgagttgaggttaatgtttc

SEQ ID NO: 178241 - DNA, 25 bp, Homo sapien
taaacctggatggattttccctgcg

SEQ ID NO: 178242 - DNA, 25 bp, Homo sapien
aaggagctgttacgcgccagggctc

SEQ ID NO: 178243 - DNA, 25 bp, Homo sapien
ctgttacgcgccagggctctgagca

SEQ ID NO: 178244 - DNA, 25 bp, Homo sapien
tccagcctcggagcctcttcccgtt

SEQ ID NO: 178245 - DNA, 25 bp, Homo sapien
tttccctgcgtggaaggagctgtta

SEQ ID NO: 178246 - DNA, 25 bp, Homo sapien
ggctgccgtgtaattggaccattca

SEQ ID NO: 178247 - DNA, 25 bp, Homo sapien
ctgcctgtcaggacctcagcctgta

SEQ ID NO: 178248 - DNA, 25 bp, Homo sapien
tgtcagggcctccttagacagtgcc

SEQ ID NO: 178249 - DNA, 25 bp, Homo sapien
gacaccattatctcccgggcgaacg

SEQ ID NO: 178250 - DNA, 25 bp, Homo sapien
acaagacactgccttttaactcggg

SEQ ID NO: 178251 - DNA, 25 bp, Homo sapien
tcgagacatcgctgggaaaagcagt

SEQ ID NO: 178252 - DNA, 25 bp, Homo sapien
ttcaaagccaccatgggcggcgagc

SEQ ID NO: 178253 - DNA, 25 bp, Homo sapien
tgcccaggtcgggaacagatatgtc

SEQ ID NO: 178254 - DNA, 25 bp, Homo sapien
gcgggcgcagcaccatatccattca

SEQ ID NO: 178255 - DNA, 25 bp, Homo sapien
tgcggaggcagcaccatatccattc

SEQ ID NO: 178256 - DNA, 25 bp, Homo sapien
ggggaggcagcaccctatccattca

SEQ ID NO: 178257 - DNA, 25 bp, Homo sapien
gggcgcagcaccatatccattcatc

SEQ ID NO: 178258 - DNA, 25 bp, Homo sapien
ggaggcagcaccctatccgttcatc

SEQ ID NO: 178259 - DNA, 25 bp, Homo sapien
ggaggcagcaccctatccattcatc

SEQ ID NO: 178260 - DNA, 25 bp, Homo sapien
ggcgcagcaccatatccattcatct

SEQ ID NO: 178261 - DNA, 25 bp, Homo sapien
cgggcgcagcaccatatccattcat

SEQ ID NO: 178262 - DNA, 25 bp, Homo sapien
ttccaaaggcgggtgttgagtttca

SEQ ID NO: 178263 - DNA, 25 bp, Homo sapien
tgttgagtttcagctcaggaccctc

SEQ ID NO: 178264 - DNA, 25 bp, Homo sapien
accctcgggtccaactgcctgtggt

SEQ ID NO: 178265 - DNA, 25 bp, Homo sapien
acactgagagggctgcgaaggctcc

SEQ ID NO: 178266 - DNA, 25 bp, Homo sapien
gcggcggttttcacgcgcgcactca

SEQ ID NO: 178267 - DNA, 25 bp, Homo sapien
agagcgagaactgagacgcttgccc

SEQ ID NO: 178268 - DNA, 25 bp, Homo sapien
aagagggacgatccttccaaaggcg

SEQ ID NO: 178269 - DNA, 25 bp, Homo sapien
cccaagttgcctggagccaaaggcc

SEQ ID NO: 178270 - DNA, 25 bp, Homo sapien
gcatttctctcgcaacaggccaggg

SEQ ID NO: 178271 - DNA, 25 bp, Homo sapien
gcttcatctgctcaatgccagactc

SEQ ID NO: 178272 - DNA, 25 bp, Homo sapien
tgccagactccaaaaagcatttctc

SEQ ID NO: 178273 - DNA, 25 bp, Homo sapien
gccggcctggacagttttcctagaa

SEQ ID NO: 178274 - DNA, 25 bp, Homo sapien
cgggctattttcagccacgccgagc

SEQ ID NO: 178275 - DNA, 25 bp, Homo sapien
ccgagccctgttttaggagcttgca

SEQ ID NO: 178276 - DNA, 25 bp, Homo sapien
ggcgccgtgcgattatttttatgtt

SEQ ID NO: 178277 - DNA, 25 bp, Homo sapien
tgacgatacgggaagccagagaata

SEQ ID NO: 178278 - DNA, 25 bp, Homo sapien
cttttttcccgaagtgagcgcattc

SEQ ID NO: 178279 - DNA, 25 bp, Homo sapien
ccggcaaaggccctgcattgtcttt

SEQ ID NO: 178280 - DNA, 25 bp, Homo sapien
ggtctcctagcagttcccggcaaag

SEQ ID NO: 178281 - DNA, 25 bp, Homo sapien
agccctaggcgagttgccaagctgc

SEQ ID NO: 178282 - DNA, 25 bp, Homo sapien
tcactgaggtgacttgtcccgcgca

SEQ ID NO: 178283 - DNA, 25 bp, Homo sapien
tcagcctgtatttgtggggctccta

SEQ ID NO: 178284 - DNA, 25 bp, Homo sapien
ggcagaggccattcaagtttgtttt

SEQ ID NO: 178285 - DNA, 25 bp, Homo sapien
cacgttcttgtaagccgtggaagtc

SEQ ID NO: 178286 - DNA, 25 bp, Homo sapien
ggatttctctttgcggtcctagttc

SEQ ID NO: 178287 - DNA, 25 bp, Homo sapien
aataatcagagcgaagccctcggcc

SEQ ID NO: 178288 - DNA, 25 bp, Homo sapien
gcgcagagggactttggaaataatc

SEQ ID NO: 178289 - DNA, 25 bp, Homo sapien
tcctagttcggaagaaactgctttc

SEQ ID NO: 178290 - DNA, 25 bp, Homo sapien
gctccgcgggcggaattatttcgga

SEQ ID NO: 178291 - DNA, 25 bp, Homo sapien
tcgtaccaccgcagtgatatcatta

SEQ ID NO: 178292 - DNA, 25 bp, Homo sapien
cgcgccgagtttaagccctttctat

SEQ ID NO: 178293 - DNA, 25 bp, Homo sapien
tccgcaaatgccaagagaaatcgta

SEQ ID NO: 178294 - DNA, 25 bp, Homo sapien
ccggggacgaaataaatccagcttg

SEQ ID NO: 178295 - DNA, 25 bp, Homo sapien
cgcgcactccatgaagggcccatta

SEQ ID NO: 178296 - DNA, 25 bp, Homo sapien
taggcaaaggttttcatgcgaaatc

SEQ ID NO: 178297 - DNA, 25 bp, Homo sapien
tgcctctggtttcgccgacacgcgg

SEQ ID NO: 178298 - DNA, 25 bp, Homo sapien
caggatgtgacctgggcccacgact

SEQ ID NO: 178299 - DNA, 25 bp, Homo sapien
acagagaccaggacggcctcagcgc

SEQ ID NO: 178300 - DNA, 25 bp, Homo sapien
cagcggcagaaacgcggccttagac

SEQ ID NO: 178301 - DNA, 25 bp, Homo sapien
ggcctcgagtccacggaatccacgg

SEQ ID NO: 178302 - DNA, 25 bp, Homo sapien
cgggcaaactttcggccacagtagt

SEQ ID NO: 178303 - DNA, 25 bp, Homo sapien
acagtagtcacaggcgaagggcttc

SEQ ID NO: 178304 - DNA, 25 bp, Homo sapien
ggagaaccgccggtcgcagccttct

SEQ ID NO: 178305 - DNA, 25 bp, Homo sapien
tggggtacttgcgaggcctcagaat

SEQ ID NO: 178306 - DNA, 25 bp, Homo sapien
ttctcaccggtgtgggtgcggatat

SEQ ID NO: 178307 - DNA, 25 bp, Homo sapien
ggattcggatgtgccgtgtcagctc

SEQ ID NO: 178308 - DNA, 25 bp, Homo sapien
ggcttatgcccagtgtggattcgga

SEQ ID NO: 178309 - DNA, 25 bp, Homo sapien
tgtcagctcgtcagagcgggagaac

SEQ ID NO: 178310 - DNA, 25 bp, Homo sapien
gctgcccggacagcaggtgcacccg

SEQ ID NO: 178311 - DNA, 25 bp, Homo sapien
gcggggctaacaaggcactccaggc

SEQ ID NO: 178312 - DNA, 25 bp, Homo sapien
cgtcgcgcggggctaacaaggcact

SEQ ID NO: 178313 - DNA, 25 bp, Homo sapien
gcctcggcgcatttccagggcgaat

SEQ ID NO: 178314 - DNA, 25 bp, Homo sapien
ttgtcccctacggagaggagccctg

SEQ ID NO: 178315 - DNA, 25 bp, Homo sapien
cgtggccttggacaagaggctcggc

SEQ ID NO: 178316 - DNA, 25 bp, Homo sapien
ttgtcgccagtgaacagggagccgt

SEQ ID NO: 178317 - DNA, 25 bp, Homo sapien
agctcggagacgcagcagccgtcgc

SEQ ID NO: 178318 - DNA, 25 bp, Homo sapien
actctgaggaatgggcgttcccaca

SEQ ID NO: 178319 - DNA, 25 bp, Homo sapien
ctctgcagggcaagctggcctctgc

SEQ ID NO: 178320 - DNA, 25 bp, Homo sapien
aggaatgggcgttcccacagctccc

SEQ ID NO: 178321 - DNA, 25 bp, Homo sapien
tcagagcagctcacggtgggcacgc

SEQ ID NO: 178322 - DNA, 25 bp, Homo sapien
tttcagagctacattctcaggcaga

SEQ ID NO: 178323 - DNA, 25 bp, Homo sapien
ctcacggcgccatttcagagctaca

SEQ ID NO: 178324 - DNA, 25 bp, Homo sapien
gccacgaccggctctgcagggcaag

SEQ ID NO: 178325 - DNA, 25 bp, Homo sapien
agctcccgccgtgttgctcagagca

SEQ ID NO: 178326 - DNA, 25 bp, Homo sapien
cgtagcacttttgcacacggacagc

SEQ ID NO: 178327 - DNA, 25 bp, Homo sapien
cccacagtgggaacctgggctgacc

SEQ ID NO: 178328 - DNA, 25 bp, Homo sapien
tgtgtgacgtgtgaatgctcggccc

SEQ ID NO: 178329 - DNA, 25 bp, Homo sapien
cacgcttctggtgtgagaatgaggc

SEQ ID NO: 178330 - DNA, 25 bp, Homo sapien
ctgcgccacagagaatgcacgcttc

SEQ ID NO: 178331 - DNA, 25 bp, Homo sapien
acagatgtgtggcttgcctgcgcca

SEQ ID NO: 178332 - DNA, 25 bp, Homo sapien
acagttcggcgcacatgtccacaga

SEQ ID NO: 178333 - DNA, 25 bp, Homo sapien
cacggacagcgtggccctcacagtt

SEQ ID NO: 178334 - DNA, 25 bp, Homo sapien
gggccaagcccgtggcaacggcact

SEQ ID NO: 178335 - DNA, 25 bp, Homo sapien
tgtgcgtcctgctcgtgctggccct

SEQ ID NO: 178336 - DNA, 25 bp, Homo sapien
ccaagcccgtggcaacggcactgga

SEQ ID NO: 178337 - DNA, 25 bp, Homo sapien
tgggcctatactgcggccgggccaa

SEQ ID NO: 178338 - DNA, 25 bp, Homo sapien
gtgctggccctgggcctatactgcg

SEQ ID NO: 178339 - DNA, 25 bp, Homo sapien
tgcgtcctgctcgtgctggccctgg

SEQ ID NO: 178340 - DNA, 25 bp, Homo sapien
gctggctggcgctgaccctgcctgc

SEQ ID NO: 178341 - DNA, 25 bp, Homo sapien
ccgtggcaacggcactggaggacct

SEQ ID NO: 178342 - DNA, 25 bp, Homo sapien
aaagacttcgggagccacctgtacg

SEQ ID NO: 178343 - DNA, 25 bp, Homo sapien
gtccctggatgtgtgtgtagacaaa

SEQ ID NO: 178344 - DNA, 25 bp, Homo sapien
attgttgacatttgcgggcctcgga

SEQ ID NO: 178345 - DNA, 25 bp, Homo sapien
agccacatgccctcggtgaagagca

SEQ ID NO: 178346 - DNA, 25 bp, Homo sapien
cgcactgagcgaaaaggaaattgtt

SEQ ID NO: 178347 - DNA, 25 bp, Homo sapien
tgggtcgtcagttcctcatcagctc

SEQ ID NO: 178348 - DNA, 25 bp, Homo sapien
ggaccgaccctgtgccgctaaagac

SEQ ID NO: 178349 - DNA, 25 bp, Homo sapien
gatgcgggaattttaccaggtcggc

SEQ ID NO: 178350 - DNA, 25 bp, Homo sapien
accacccgtcgtccgagacctgtgt

SEQ ID NO: 178351 - DNA, 25 bp, Homo sapien
cgagacctgtgtcgccacccactga

SEQ ID NO: 178352 - DNA, 25 bp, Homo sapien
gagacctgtgtcgccacccactgag

SEQ ID NO: 178353 - DNA, 25 bp, Homo sapien
gacctgtgtcgccacccactgagga

SEQ ID NO: 178354 - DNA, 25 bp, Homo sapien
tgaggaacgggcaccacccgtcgtc

SEQ ID NO: 178355 - DNA, 25 bp, Homo sapien
acctgtgtcgccacccactgaggaa

SEQ ID NO: 178356 - DNA, 25 bp, Homo sapien
cacccactgaggaacgggcaccacc

SEQ ID NO: 178357 - DNA, 25 bp, Homo sapien
gcccgagacctgtgtcgccacccac

SEQ ID NO: 178358 - DNA, 25 bp, Homo sapien
tgtgcaggacctcagccgtgctgcc

SEQ ID NO: 178359 - DNA, 25 bp, Homo sapien
gagccgagcacaagatcagcgatta

SEQ ID NO: 178360 - DNA, 25 bp, Homo sapien
aagatcagcgattacccaggtcaca

SEQ ID NO: 178361 - DNA, 25 bp, Homo sapien
gattacccaggtcacagtcccagga

SEQ ID NO: 178362 - DNA, 25 bp, Homo sapien
acagtcccaggatgcacagagcccg

SEQ ID NO: 178363 - DNA, 25 bp, Homo sapien
acagagcccgcgtgtggcactagga

SEQ ID NO: 178364 - DNA, 25 bp, Homo sapien
ctcggcttgggtttgcacggtcccg

SEQ ID NO: 178365 - DNA, 25 bp, Homo sapien
ggtttgcacggtcccggcagtgcac

SEQ ID NO: 178366 - DNA, 25 bp, Homo sapien
cttgacaaaggagggcgatgccacc

SEQ ID NO: 178367 - DNA, 25 bp, Homo sapien
gatgccaccgcttaccgccagaggg

SEQ ID NO: 178368 - DNA, 25 bp, Homo sapien
ctgagacgggccaccgggaatcgct

SEQ ID NO: 178369 - DNA, 25 bp, Homo sapien
ctttctgggcgtccgggcaagtcca

SEQ ID NO: 178370 - DNA, 25 bp, Homo sapien
tccgggcaagtccatgctccgggtg

SEQ ID NO: 178371 - DNA, 25 bp, Homo sapien
cccgtcgtcagccttgacaaaggag

SEQ ID NO: 178372 - DNA, 25 bp, Homo sapien
ccaaacggacactgaagcgggcgcc

SEQ ID NO: 178373 - DNA, 25 bp, Homo sapien
aagtcgagggtctggacattcgctg

SEQ ID NO: 178374 - DNA, 25 bp, Homo sapien
cgaacctggtgtatccaggccgggc

SEQ ID NO: 178375 - DNA, 25 bp, Homo sapien
acctggtgtatccaggcctggcgag

SEQ ID NO: 178376 - DNA, 25 bp, Homo sapien
tgggcgaacctggtgtatccaggcc

SEQ ID NO: 178377 - DNA, 25 bp, Homo sapien
ctgggcgaacctggtgtatccaggc

SEQ ID NO: 178378 - DNA, 25 bp, Homo sapien
ggcgaacctggtgtatccaggcctg

SEQ ID NO: 178379 - DNA, 25 bp, Homo sapien
cggctgggcgaacctggtgtatcca

SEQ ID NO: 178380 - DNA, 25 bp, Homo sapien
gcgaacctggtgtatccaggcctgg

SEQ ID NO: 178381 - DNA, 25 bp, Homo sapien
ggctgggcgaacctggtgtatccag

SEQ ID NO: 178382 - DNA, 25 bp, Homo sapien
gccttgcacgggcttcacagtttgc

SEQ ID NO: 178383 - DNA, 25 bp, Homo sapien
cctcagctgagacgtgaatttcctc

SEQ ID NO: 178384 - DNA, 25 bp, Homo sapien
gatgcctcttaaacctcagctgaga

SEQ ID NO: 178385 - DNA, 25 bp, Homo sapien
cggacccacgctgcccgagtatttt

SEQ ID NO: 178386 - DNA, 25 bp, Homo sapien
actgcaccgctctgcaggtcgctgg

SEQ ID NO: 178387 - DNA, 25 bp, Homo sapien
agtttctcccatggagctggtctgc

SEQ ID NO: 178388 - DNA, 25 bp, Homo sapien
ttcacagtttgccagcgagggcaca

SEQ ID NO: 178389 - DNA, 25 bp, Homo sapien
cgtgaatttcctccctgacagctgc

SEQ ID NO: 178390 - DNA, 25 bp, Homo sapien
tgggaaagtttctcgctcgcgctgt

SEQ ID NO: 178391 - DNA, 25 bp, Homo sapien
ggccggccatctctctgacttaagt

SEQ ID NO: 178392 - DNA, 25 bp, Homo sapien
tgctcttccactgaagcgctgcttc

SEQ ID NO: 178393 - DNA, 25 bp, Homo sapien
cgcgctgtgcgcttttttccaattg

SEQ ID NO: 178394 - DNA, 25 bp, Homo sapien
tcgcagcaaggttagcaccctagta

SEQ ID NO: 178395 - DNA, 25 bp, Homo sapien
agctgcgttcttaccacgtgcgcca

SEQ ID NO: 178396 - DNA, 25 bp, Homo sapien
ctgaccatgggcaagacgacgcctc

SEQ ID NO: 178397 - DNA, 25 bp, Homo sapien
aaaaccgcgaggtcttcggctgcca

SEQ ID NO: 178398 - DNA, 25 bp, Homo sapien
ggcctgcgaagacacgcggcttacc

SEQ ID NO: 178399 - DNA, 25 bp, Homo sapien
gcgagagacgactttccacagcatc

SEQ ID NO: 178400 - DNA, 25 bp, Homo sapien
cggccactccgttcatctggtcaaa

SEQ ID NO: 178401 - DNA, 25 bp, Homo sapien
ccctggtctcagctgtcgcaggttc

SEQ ID NO: 178402 - DNA, 25 bp, Homo sapien
acgcacgccggtttgctggcgacct

SEQ ID NO: 178403 - DNA, 25 bp, Homo sapien
cccaggagggagctaccgacgcttt

SEQ ID NO: 178404 - DNA, 25 bp, Homo sapien
gaagggagcgctccgagattttccc

SEQ ID NO: 178405 - DNA, 25 bp, Homo sapien
ttcatctggtcaaaggggcctccca

SEQ ID NO: 178406 - DNA, 25 bp, Homo sapien
cgagagaaatcctcagccggagaca

SEQ ID NO: 178407 - DNA, 25 bp, Homo sapien
aaccctaggaggagcagaattactg

SEQ ID NO: 178408 - DNA, 25 bp, Homo sapien
ttcacggaagctgactgcttttttc

SEQ ID NO: 178409 - DNA, 25 bp, Homo sapien
cctactcactttcttggcagctcaa

SEQ ID NO: 178410 - DNA, 25 bp, Homo sapien
gcggagccgagacactacagtcaaa

SEQ ID NO: 178411 - DNA, 25 bp, Homo sapien
gcggcttttgccgtcacatggctga

SEQ ID NO: 178412 - DNA, 25 bp, Homo sapien
tggaagcttggacactcaccctgcc

SEQ ID NO: 178413 - DNA, 25 bp, Homo sapien
gatttgcatacacgggctcggccgc

SEQ ID NO: 178414 - DNA, 25 bp, Homo sapien
agctcggccacgctgtcggcgtgct

SEQ ID NO: 178415 - DNA, 25 bp, Homo sapien
cgcgcttcttgttcatctcgatctg

SEQ ID NO: 178416 - DNA, 25 bp, Homo sapien
tgcaggttgtcgatctgctcgccca

SEQ ID NO: 178417 - DNA, 25 bp, Homo sapien
ggcctcgcgcttcttgttcatctcg

SEQ ID NO: 178418 - DNA, 25 bp, Homo sapien
ttgtcgatctgctcgcccagctcgg

SEQ ID NO: 178419 - DNA, 25 bp, Homo sapien
aggtcccgccgcatcttctggaact

SEQ ID NO: 178420 - DNA, 25 bp, Homo sapien
tcatctcgatctgcacggacgtggc

SEQ ID NO: 178421 - DNA, 25 bp, Homo sapien
acgctgtcggcgtgcttcttgcgca

SEQ ID NO: 178422 - DNA, 25 bp, Homo sapien
ccctcctaggcagctaatttcccgc

SEQ ID NO: 178423 - DNA, 25 bp, Homo sapien
aggcagctaatttcccgcccacccg

SEQ ID NO: 178424 - DNA, 25 bp, Homo sapien
cccacccggcgacggcagaggacgt

SEQ ID NO: 178425 - DNA, 25 bp, Homo sapien
caactcatctggagaacgcagggct

SEQ ID NO: 178426 - DNA, 25 bp, Homo sapien
cggagcgtgactcagcaccgcagct

SEQ ID NO: 178427 - DNA, 25 bp, Homo sapien
tcccgcaactcatctggagaacgca

SEQ ID NO: 178428 - DNA, 25 bp, Homo sapien
tgccgagcccaccttcccggagccc

SEQ ID NO: 178429 - DNA, 25 bp, Homo sapien
gagcgtgactcagcaccgcagctgc

SEQ ID NO: 178430 - DNA, 25 bp, Homo sapien
ctcaccgggtaagtccttggcctcg

SEQ ID NO: 178431 - DNA, 25 bp, Homo sapien
tgaccatgaatcagccacagttggg

SEQ ID NO: 178432 - DNA, 25 bp, Homo sapien
gccacagttgggaaaataaacttca

SEQ ID NO: 178433 - DNA, 25 bp, Homo sapien
gcggctgccacatcctgaccatgaa

SEQ ID NO: 178434 - DNA, 25 bp, Homo sapien
tccgcttggagcttcaggggaaact

SEQ ID NO: 178435 - DNA, 25 bp, Homo sapien
tctggccgttgcctcaccgggtaag

SEQ ID NO: 178436 - DNA, 25 bp, Homo sapien
gagccaccgtccgagccttgcggag

SEQ ID NO: 178437 - DNA, 25 bp, Homo sapien
tcgggactatggtcctccgcgccga

SEQ ID NO: 178438 - DNA, 25 bp, Homo sapien
tcctcatgcgcgcagtagggccctt

SEQ ID NO: 178439 - DNA, 25 bp, Homo sapien
ggtaatgttccagccaggggagcct

SEQ ID NO: 178440 - DNA, 25 bp, Homo sapien
gcctcgtgctgcaggtttctgagcc

SEQ ID NO: 178441 - DNA, 25 bp, Homo sapien
atccggtcccgtcactctgcagggg

SEQ ID NO: 178442 - DNA, 25 bp, Homo sapien
ttaccgtgggtaatgttccagccag

SEQ ID NO: 178443 - DNA, 25 bp, Homo sapien
gccgttttgtcgcatcattaccgtg

SEQ ID NO: 178444 - DNA, 25 bp, Homo sapien
cctgccgcctcggttgctgaaattc

SEQ ID NO: 178445 - DNA, 25 bp, Homo sapien
ctgcaggtttctgagccggctcctc

SEQ ID NO: 178446 - DNA, 25 bp, Homo sapien
agctctcccagggtgagccgcagtg

SEQ ID NO: 178447 - DNA, 25 bp, Homo sapien
agctcacctgcgtcagctgcgtgcg

SEQ ID NO: 178448 - DNA, 25 bp, Homo sapien
tgcgtgcgcgccgtcatgaactcgc

SEQ ID NO: 178449 - DNA, 25 bp, Homo sapien
ccgtcatgaactcgcggcagggcat

SEQ ID NO: 178450 - DNA, 25 bp, Homo sapien
cggcagggcatcgagtacatcctca

SEQ ID NO: 178451 - DNA, 25 bp, Homo sapien
tcgagtacatcctcagcaaccaggg

SEQ ID NO: 178452 - DNA, 25 bp, Homo sapien
tcctcagcaaccagggctacgtgcg

SEQ ID NO: 178453 - DNA, 25 bp, Homo sapien
gcaaccagggctacgtgcgccagct

SEQ ID NO: 178454 - DNA, 25 bp, Homo sapien
ttctccgaggatgcggtgaccgact

SEQ ID NO: 178455 - DNA, 25 bp, Homo sapien
gtgcaactattcctccaacctacta

SEQ ID NO: 178456 - DNA, 25 bp, Homo sapien
cagcggcacccaggagaggtgactt

SEQ ID NO: 178457 - DNA, 25 bp, Homo sapien
cccattgggcactgcaagttccagc

SEQ ID NO: 178458 - DNA, 25 bp, Homo sapien
aggaagaagcgtccctccaggagcc

SEQ ID NO: 178459 - DNA, 25 bp, Homo sapien
ttcacgccacctccgttagggagta

SEQ ID NO: 178460 - DNA, 25 bp, Homo sapien
cactggacacatccctggacaagtc

SEQ ID NO: 178461 - DNA, 25 bp, Homo sapien
ctccaggagccaggaaggtaactca

SEQ ID NO: 178462 - DNA, 25 bp, Homo sapien
ctgctgtggacgtctgcgtcgtcct

SEQ ID NO: 178463 - DNA, 25 bp, Homo sapien
gacgtctgcgtagtctcgtgtggat

SEQ ID NO: 178464 - DNA, 25 bp, Homo sapien
gtctgcgtagtctcgtgtggatgct

SEQ ID NO: 178465 - DNA, 25 bp, Homo sapien
acgtctgcgtcgtcctcgtgtggat

SEQ ID NO: 178466 - DNA, 25 bp, Homo sapien
atgctgctgtggacgtctgcgtcgt

SEQ ID NO: 178467 - DNA, 25 bp, Homo sapien
gacgtctgcgtcgtctcgtgtggat

SEQ ID NO: 178468 - DNA, 25 bp, Homo sapien
acgtctgcgtagtctcgtgtggatg

SEQ ID NO: 178469 - DNA, 25 bp, Homo sapien
tctgcgtcgtcctcgtgtggatgct

SEQ ID NO: 178470 - DNA, 25 bp, Homo sapien
cgacgggctagcgagaaactgcctc

SEQ ID NO: 178471 - DNA, 25 bp, Homo sapien
gctccatttaatggcgcggacgccg

SEQ ID NO: 178472 - DNA, 25 bp, Homo sapien
ctcctcgagagtgcggaccctctag

SEQ ID NO: 178473 - DNA, 25 bp, Homo sapien
tgctcgagactcaactgggcttccc

SEQ ID NO: 178474 - DNA, 25 bp, Homo sapien
aactgcctccgttggcaaattcgtg

SEQ ID NO: 178475 - DNA, 25 bp, Homo sapien
agcggaagagccaagccagcatgtc

SEQ ID NO: 178476 - DNA, 25 bp, Homo sapien
tgctggccacggacgccgacatcat

SEQ ID NO: 178477 - DNA, 25 bp, Homo sapien
tgcggggacacaaagtcctcggaga

SEQ ID NO: 178478 - DNA, 25 bp, Homo sapien
gaagcccacgccacaggacgggtcg

SEQ ID NO: 178479 - DNA, 25 bp, Homo sapien
agcccacgccacaggacgggtcggt

SEQ ID NO: 178480 - DNA, 25 bp, Homo sapien
ccacgccacaggacgggtcggttct

SEQ ID NO: 178481 - DNA, 25 bp, Homo sapien
gagccgcctctggtgagcagaaccc

SEQ ID NO: 178482 - DNA, 25 bp, Homo sapien
gccacaggacgggtcggttctgtac

SEQ ID NO: 178483 - DNA, 25 bp, Homo sapien
gagagccgcctctggtgagcagaac

SEQ ID NO: 178484 - DNA, 25 bp, Homo sapien
ctctggtgagcagaaccccggagaa

SEQ ID NO: 178485 - DNA, 25 bp, Homo sapien
agagccgcctctggtgagcagaacc

SEQ ID NO: 178486 - DNA, 25 bp, Homo sapien
tgcacctcgcggcatggggacacca

SEQ ID NO: 178487 - DNA, 25 bp, Homo sapien
catggggacaccaagtcagacgaac

SEQ ID NO: 178488 - DNA, 25 bp, Homo sapien
ccaagtcagacgaacccgctgtgca

SEQ ID NO: 178489 - DNA, 25 bp, Homo sapien
gacgaacccgctgtgcaagaacatt

SEQ ID NO: 178490 - DNA, 25 bp, Homo sapien
acccgctgtgcaagaacattttcca

SEQ ID NO: 178491 - DNA, 25 bp, Homo sapien
aacattttccacacagcggcgcata

SEQ ID NO: 178492 - DNA, 25 bp, Homo sapien
cccacacgcctttacttctggaagg

SEQ ID NO: 178493 - DNA, 25 bp, Homo sapien
cacgcctttacttctggaaggcgga

SEQ ID NO: 178494 - DNA, 25 bp, Homo sapien
gcagctgtgacgtcacggcgtcgtt

SEQ ID NO: 178495 - DNA, 25 bp, Homo sapien
tgtccaacagcctgaaagaaaaggg

SEQ ID NO: 178496 - DNA, 25 bp, Homo sapien
gctactcgcaggaggtcttcggtga

SEQ ID NO: 178497 - DNA, 25 bp, Homo sapien
cgccctcttccacgatcccggttag

SEQ ID NO: 178498 - DNA, 25 bp, Homo sapien
ccgctacagctcaaggtccgcgtga

SEQ ID NO: 178499 - DNA, 25 bp, Homo sapien
gagtccagtacaccgacgcacgagt

SEQ ID NO: 178500 - DNA, 25 bp, Homo sapien
ctttcccgcggcgtcgagtccagta

SEQ ID NO: 178501 - DNA, 25 bp, Homo sapien
ccgagcgctactcgcaggaggtctt

SEQ ID NO: 178502 - DNA, 25 bp, Homo sapien
tggtgagtgtcccacagaatatagc

SEQ ID NO: 178503 - DNA, 25 bp, Homo sapien
agccttttgcgcgtgtgacgtcatg

SEQ ID NO: 178504 - DNA, 25 bp, Homo sapien
gaggttgttgctccttcagcgccta

SEQ ID NO: 178505 - DNA, 25 bp, Homo sapien
attcccaccttgaaccagccttttg

SEQ ID NO: 178506 - DNA, 25 bp, Homo sapien
ctcgcaagcgtacatcagctggtgc

SEQ ID NO: 178507 - DNA, 25 bp, Homo sapien
cttctcgcgagaggaaagattgacc

SEQ ID NO: 178508 - DNA, 25 bp, Homo sapien
atatagcgttcgtcttgggtgcctt

SEQ ID NO: 178509 - DNA, 25 bp, Homo sapien
ttcagcgcctatcgctggctcttgg

SEQ ID NO: 178510 - DNA, 25 bp, Homo sapien
tggggacgcagcaacgcgtatgcac

SEQ ID NO: 178511 - DNA, 25 bp, Homo sapien
ctcctccatgaggatgagctcaaaa

SEQ ID NO: 178512 - DNA, 25 bp, Homo sapien
gcaggcgaccgcacatcatctcgta

SEQ ID NO: 178513 - DNA, 25 bp, Homo sapien
gcacggccgtagtcattgtcctcca

SEQ ID NO: 178514 - DNA, 25 bp, Homo sapien
caggactcggcatcaaggggtgtcc

SEQ ID NO: 178515 - DNA, 25 bp, Homo sapien
gggcacagagaggacacagcattgc

SEQ ID NO: 178516 - DNA, 25 bp, Homo sapien
cagcattgcgtgtgctcaggacgtg

SEQ ID NO: 178517 - DNA, 25 bp, Homo sapien
agcttctcatggtcctggttgtaga

SEQ ID NO: 178518 - DNA, 25 bp, Homo sapien
accgcttccgcagctgcgagtctag

SEQ ID NO: 178519 - DNA, 25 bp, Homo sapien
cccgctttcctaatgtccgtgatga

SEQ ID NO: 178520 - DNA, 25 bp, Homo sapien
ggcgtcccacgaagtcgcaggtcct

SEQ ID NO: 178521 - DNA, 25 bp, Homo sapien
cggcccggtatcgatggagaagcac

SEQ ID NO: 178522 - DNA, 25 bp, Homo sapien
tcccgggagcgctctaggaaccaca

SEQ ID NO: 178523 - DNA, 25 bp, Homo sapien
gtgatgatttcgttattggcaggga

SEQ ID NO: 178524 - DNA, 25 bp, Homo sapien
acagcgctcagggttgtaatcacca

SEQ ID NO: 178525 - DNA, 25 bp, Homo sapien
gcacagagggctttgaggtcgcaac

SEQ ID NO: 178526 - DNA, 25 bp, Homo sapien
aaagagtacttcagggcctgcaagg

SEQ ID NO: 178527 - DNA, 25 bp, Homo sapien
ctgcttgataccacgtcgcctgata

SEQ ID NO: 178528 - DNA, 25 bp, Homo sapien
ttgataccacgtcgcctgataccac

SEQ ID NO: 178529 - DNA, 25 bp, Homo sapien
accacgctgcccgacaccacgctgc

SEQ ID NO: 178530 - DNA, 25 bp, Homo sapien
tctggaaagagtacttcagggcctg

SEQ ID NO: 178531 - DNA, 25 bp, Homo sapien
ggcgtactccatgacaaagcagagg

SEQ ID NO: 178532 - DNA, 25 bp, Homo sapien
cccgttggcgtactccatgacaaag

SEQ ID NO: 178533 - DNA, 25 bp, Homo sapien
acgctgcttgataccacgtcgcctg

SEQ ID NO: 178534 - DNA, 25 bp, Homo sapien
acggcagcccatgaggggcccgcaa

SEQ ID NO: 178535 - DNA, 25 bp, Homo sapien
tgagcagacggctccgctgacggca

SEQ ID NO: 178536 - DNA, 25 bp, Homo sapien
cacattgagcagacggctccgctga

SEQ ID NO: 178537 - DNA, 25 bp, Homo sapien
ccagcacattgagcagacggctccg

SEQ ID NO: 178538 - DNA, 25 bp, Homo sapien
ccatttaccttctccagcacattga

SEQ ID NO: 178539 - DNA, 25 bp, Homo sapien
gggggcccatttaccttctccagca

SEQ ID NO: 178540 - DNA, 25 bp, Homo sapien
gagaccgcacagctcaccgcgaagg

SEQ ID NO: 178541 - DNA, 25 bp, Homo sapien
gccagctgacagcggccaccgtggt

SEQ ID NO: 178542 - DNA, 25 bp, Homo sapien
ccacaaacttgaaggccggccgcgg

SEQ ID NO: 178543 - DNA, 25 bp, Homo sapien
cctccccaaggtcatgagggaggct

SEQ ID NO: 178544 - DNA, 25 bp, Homo sapien
cgcggcgagtctttctccaaccccg

SEQ ID NO: 178545 - DNA, 25 bp, Homo sapien
gccgcggcgagtctttctccaaccc

SEQ ID NO: 178546 - DNA, 25 bp, Homo sapien
caaacttgaaggccggccgcggcga

SEQ ID NO: 178547 - DNA, 25 bp, Homo sapien
acaaacttgaaggccggccgcggcg

SEQ ID NO: 178548 - DNA, 25 bp, Homo sapien
caccacgtacaacttttcgtccgtg

SEQ ID NO: 178549 - DNA, 25 bp, Homo sapien
cacaaacttgaaggccggccgcggc

SEQ ID NO: 178550 - DNA, 25 bp, Homo sapien
aagcgccaagtatcgcgagagaccc

SEQ ID NO: 178551 - DNA, 25 bp, Homo sapien
ccgcctgagacagcagcgcgagctg

SEQ ID NO: 178552 - DNA, 25 bp, Homo sapien
ggcgtcccgtttgtgcccaggtgat

SEQ ID NO: 178553 - DNA, 25 bp, Homo sapien
gatcgagtttttcctgctcggggca

SEQ ID NO: 178554 - DNA, 25 bp, Homo sapien
ggcggagctgctactgtttactttc

SEQ ID NO: 178555 - DNA, 25 bp, Homo sapien
cggccgcgctgccataaatggggcc

SEQ ID NO: 178556 - DNA, 25 bp, Homo sapien
agctgggcttcctatgcgactgcac

SEQ ID NO: 178557 - DNA, 25 bp, Homo sapien
cccgagtttcgctctctctggggcg

SEQ ID NO: 178558 - DNA, 25 bp, Homo sapien
acctgagccggcacaccgtagtgca

SEQ ID NO: 178559 - DNA, 25 bp, Homo sapien
acactcgagagaagccgcatgcctg

SEQ ID NO: 178560 - DNA, 25 bp, Homo sapien
gttttcagtactcccacaacctgag

SEQ ID NO: 178561 - DNA, 25 bp, Homo sapien
tgtgtgcagtgtggcaaaagttttc

SEQ ID NO: 178562 - DNA, 25 bp, Homo sapien
agaagccctatacgtgtgtgcagtg

SEQ ID NO: 178563 - DNA, 25 bp, Homo sapien
agcggacacactcgggtgagaagcc

SEQ ID NO: 178564 - DNA, 25 bp, Homo sapien
catacacactgaagaggcacgagcg

SEQ ID NO: 178565 - DNA, 25 bp, Homo sapien
gggaagaccttctcgtgcacataca

SEQ ID NO: 178566 - DNA, 25 bp, Homo sapien
agcggtcacagccatcgctcgcgta

SEQ ID NO: 178567 - DNA, 25 bp, Homo sapien
gaacctccctgtgtccttgctagtg

SEQ ID NO: 178568 - DNA, 25 bp, Homo sapien
cgatacgcgcattcggcggtgatcc

SEQ ID NO: 178569 - DNA, 25 bp, Homo sapien
cgctgcgcgttacttggtgcgatac

SEQ ID NO: 178570 - DNA, 25 bp, Homo sapien
tgccagcgatttcctcgcctttgtg

SEQ ID NO: 178571 - DNA, 25 bp, Homo sapien
tgccgacttccgtgttgtcgctctc

SEQ ID NO: 178572 - DNA, 25 bp, Homo sapien
cttctccgagctgatgccaaggccg

SEQ ID NO: 178573 - DNA, 25 bp, Homo sapien
tctgcgagcttcttgaggcctcacg

SEQ ID NO: 178574 - DNA, 25 bp, Homo sapien
cgcccaggactggtatcagtgaaca

SEQ ID NO: 178575 - DNA, 25 bp, Homo sapien
tcgggtccagctcaaaaacgccagg

SEQ ID NO: 178576 - DNA, 25 bp, Homo sapien
gaggtcgctttgtctcttgagtgga

SEQ ID NO: 178577 - DNA, 25 bp, Homo sapien
cttcgtccgcaaggcgagacgggcc

SEQ ID NO: 178578 - DNA, 25 bp, Homo sapien
gtgaccttagcaccagcgcttcggt

SEQ ID NO: 178579 - DNA, 25 bp, Homo sapien
aagccctggggtggactcacgtcca

SEQ ID NO: 178580 - DNA, 25 bp, Homo sapien
agcgtcgaaggattttaaggagtgc

SEQ ID NO: 178581 - DNA, 25 bp, Homo sapien
tcggactctcagtcctgcaggggcc

SEQ ID NO: 178582 - DNA, 25 bp, Homo sapien
gcggaaccaccgcagacggaaagta

SEQ ID NO: 178583 - DNA, 25 bp, Homo sapien
aagcctgcaaggtacgtctgcgaga

SEQ ID NO: 178584 - DNA, 25 bp, Homo sapien
tctcttaccgccaggtccggattgc

SEQ ID NO: 178585 - DNA, 25 bp, Homo sapien
gtctctaccgccatagctgtcgctg

SEQ ID NO: 178586 - DNA, 25 bp, Homo sapien
tcctccagtgcgagggaaccgatga

SEQ ID NO: 178587 - DNA, 25 bp, Homo sapien
ttggactcccagattcgcagccttg

SEQ ID NO: 178588 - DNA, 25 bp, Homo sapien
tgctgcagcgccacacaagaaaact

SEQ ID NO: 178589 - DNA, 25 bp, Homo sapien
gcaaacgcgccaagggttcagcaga

SEQ ID NO: 178590 - DNA, 25 bp, Homo sapien
gtgctttccgctgctctgttacccg

SEQ ID NO: 178591 - DNA, 25 bp, Homo sapien
cctgcctggctgctgaaagcctgga

SEQ ID NO: 178592 - DNA, 25 bp, Homo sapien
gccaggacgcgcatatattcccaga

SEQ ID NO: 178593 - DNA, 25 bp, Homo sapien
tgaagccaaacgaaaaccctgtctc

SEQ ID NO: 178594 - DNA, 25 bp, Homo sapien
agccgcatcgctcgaattccagaaa

SEQ ID NO: 178595 - DNA, 25 bp, Homo sapien
gctccctggtgagcaaagccgcatc

SEQ ID NO: 178596 - DNA, 25 bp, Homo sapien
taaatctggccctcccggttcagca

SEQ ID NO: 178597 - DNA, 25 bp, Homo sapien
aatccgcgctcagtgcgttcggtcc

SEQ ID NO: 178598 - DNA, 25 bp, Homo sapien
cgtccaggtaagacggcgtcgatgc

SEQ ID NO: 178599 - DNA, 25 bp, Homo sapien
agccggagaccgagcccgaacagca

SEQ ID NO: 178600 - DNA, 25 bp, Homo sapien
tgagcctcccgcagacgtcagggac

SEQ ID NO: 178601 - DNA, 25 bp, Homo sapien
gctcctggagcgtagttaagcgtta

SEQ ID NO: 178602 - DNA, 25 bp, Homo sapien
gcggctggagcctacagctcctgga

SEQ ID NO: 178603 - DNA, 25 bp, Homo sapien
atgtcggacatacgcccagtctggc

SEQ ID NO: 178604 - DNA, 25 bp, Homo sapien
agcagtccgcgggaacttacccagg

SEQ ID NO: 178605 - DNA, 25 bp, Homo sapien
gagcggcctctggaactcaccctga

SEQ ID NO: 178606 - DNA, 25 bp, Homo sapien
gctcggcttcatttcgccttaaaca

SEQ ID NO: 178607 - DNA, 25 bp, Homo sapien
cgtttattattcttcctcctagcaa

SEQ ID NO: 178608 - DNA, 25 bp, Homo sapien
tcttcctcctagcaacgatggccag

SEQ ID NO: 178609 - DNA, 25 bp, Homo sapien
cgttttggagcgtcgcgggctccca

SEQ ID NO: 178610 - DNA, 25 bp, Homo sapien
ctcccaggccttttcagggtgggcg

SEQ ID NO: 178611 - DNA, 25 bp, Homo sapien
ggggctcggcttcatttcgccttaa

SEQ ID NO: 178612 - DNA, 25 bp, Homo sapien
gcttcatttcgccttaaacagggac

SEQ ID NO: 178613 - DNA, 25 bp, Homo sapien
aaacagggaccgtggactcctcagg

SEQ ID NO: 178614 - DNA, 25 bp, Homo sapien
gcccatccatcagcccgccggccgc

SEQ ID NO: 178615 - DNA, 25 bp, Homo sapien
gctagcccatccatcagcccgccgg

SEQ ID NO: 178616 - DNA, 25 bp, Homo sapien
cgaagactgagagtatccacgtccc

SEQ ID NO: 178617 - DNA, 25 bp, Homo sapien
cccagcgcgctagcccatccatcag

SEQ ID NO: 178618 - DNA, 25 bp, Homo sapien
agactgagagtatccacgtcccctc

SEQ ID NO: 178619 - DNA, 25 bp, Homo sapien
cgaacgaagactgagagtatccacg

SEQ ID NO: 178620 - DNA, 25 bp, Homo sapien
aacgaagactgagagtatccacgtc

SEQ ID NO: 178621 - DNA, 25 bp, Homo sapien
acgaagactgagagtatccacgtcc

SEQ ID NO: 178622 - DNA, 25 bp, Homo sapien
aggctttccatacccttcgtctgtc

SEQ ID NO: 178623 - DNA, 25 bp, Homo sapien
ctaggctttccatacccttcgtctg

SEQ ID NO: 178624 - DNA, 25 bp, Homo sapien
gtctaggctttccatacccttcgtc

SEQ ID NO: 178625 - DNA, 25 bp, Homo sapien
gcggtccgtctaggctttccatacc

SEQ ID NO: 178626 - DNA, 25 bp, Homo sapien
aactcggcgcggtccgtctaggctt

SEQ ID NO: 178627 - DNA, 25 bp, Homo sapien
tgagccctcacactcaccgggcctc

SEQ ID NO: 178628 - DNA, 25 bp, Homo sapien
caggctgacagctctgagccctcac

SEQ ID NO: 178629 - DNA, 25 bp, Homo sapien
ggccgcggttctcccatcccacagc

SEQ ID NO: 178630 - DNA, 25 bp, Homo sapien
gggacatacaccatcgagaccgagg

SEQ ID NO: 178631 - DNA, 25 bp, Homo sapien
ccagcaggcctttgtcatcgagttc

SEQ ID NO: 178632 - DNA, 25 bp, Homo sapien
tcgagttcttcgacgaggacacacc

SEQ ID NO: 178633 - DNA, 25 bp, Homo sapien
cggctcgctcaagcgggagaagaca

SEQ ID NO: 178634 - DNA, 25 bp, Homo sapien
acttcatggcccagtgtctgcggga

SEQ ID NO: 178635 - DNA, 25 bp, Homo sapien
acagcctcagtgacgcagggacata

SEQ ID NO: 178636 - DNA, 25 bp, Homo sapien
cggaagatgatcgaccaggtgcagc

SEQ ID NO: 178637 - DNA, 25 bp, Homo sapien
aggagctactacataaccagcaggc

SEQ ID NO: 178638 - DNA, 25 bp, Homo sapien
ggagcctgacccttatggtttcatc

SEQ ID NO: 178639 - DNA, 25 bp, Homo sapien
cccgggacacggacgacgatgagga

SEQ ID NO: 178640 - DNA, 25 bp, Homo sapien
attacacgtccacctctgaggagga

SEQ ID NO: 178641 - DNA, 25 bp, Homo sapien
cccttatggtttcatcgtgcagacg

SEQ ID NO: 178642 - DNA, 25 bp, Homo sapien
ggctcggattacacgtccacctctg

SEQ ID NO: 178643 - DNA, 25 bp, Homo sapien
cagcagggctcggattacacgtcca

SEQ ID NO: 178644 - DNA, 25 bp, Homo sapien
tcccacacctcaacagccactcaga

SEQ ID NO: 178645 - DNA, 25 bp, Homo sapien
tgaggaggagtacggctcccgccac

SEQ ID NO: 178646 - DNA, 25 bp, Homo sapien
cggtgtcccagctgtcgcaggccat

SEQ ID NO: 178647 - DNA, 25 bp, Homo sapien
gctcgctgaactctcgggactttga

SEQ ID NO: 178648 - DNA, 25 bp, Homo sapien
cgggactttgaccagaacatgaacg

SEQ ID NO: 178649 - DNA, 25 bp, Homo sapien
tgaacgacagctgtgaggacgccct

SEQ ID NO: 178650 - DNA, 25 bp, Homo sapien
gggctcttgcaggtgatcttcgata

SEQ ID NO: 178651 - DNA, 25 bp, Homo sapien
ataacctgatgctgaacccggtgtc

SEQ ID NO: 178652 - DNA, 25 bp, Homo sapien
tggccaacaagacgcggcctcggaa

SEQ ID NO: 178653 - DNA, 25 bp, Homo sapien
tccctcttgcagctggtgcagcgca

SEQ ID NO: 178654 - DNA, 25 bp, Homo sapien
ctgtcgctgcaggtgggaaccatca

SEQ ID NO: 178655 - DNA, 25 bp, Homo sapien
ccctgcaggtgggaaccgagagcca

SEQ ID NO: 178656 - DNA, 25 bp, Homo sapien
caggtgggaaccatcagccaggacg

SEQ ID NO: 178657 - DNA, 25 bp, Homo sapien
tgcaggtgggaaccatcagccagga

SEQ ID NO: 178658 - DNA, 25 bp, Homo sapien
cgctgcaggtgggaaccatcagcca

SEQ ID NO: 178659 - DNA, 25 bp, Homo sapien
agctgtcgctgcaggtgggaaccat

SEQ ID NO: 178660 - DNA, 25 bp, Homo sapien
cgctgcaggtgggaaccgtcagcca

SEQ ID NO: 178661 - DNA, 25 bp, Homo sapien
tgggaaccatcagccaggacgggca

SEQ ID NO: 178662 - DNA, 25 bp, Homo sapien
ctaagaaagtcttcatcgtgccggt

SEQ ID NO: 178663 - DNA, 25 bp, Homo sapien
atcccattcagcagggtgaaccaca

SEQ ID NO: 178664 - DNA, 25 bp, Homo sapien
gcctgctctctgatttccgagtcca

SEQ ID NO: 178665 - DNA, 25 bp, Homo sapien
aggattacttcagcagcacggcggg

SEQ ID NO: 178666 - DNA, 25 bp, Homo sapien
ctacataggtgagcgcgatcagatc

SEQ ID NO: 178667 - DNA, 25 bp, Homo sapien
tccaactggtcggaggattacttca

SEQ ID NO: 178668 - DNA, 25 bp, Homo sapien
aaggtggagttctaccgcgaccagc

SEQ ID NO: 178669 - DNA, 25 bp, Homo sapien
cacagcaagttcatggtcacggaga

SEQ ID NO: 178670 - DNA, 25 bp, Homo sapien
cagacactttagtcagaagctgggg

SEQ ID NO: 178671 - DNA, 25 bp, Homo sapien
cgcaggaggtgatctggcagcataa

SEQ ID NO: 178672 - DNA, 25 bp, Homo sapien
gaaggcccagaaccacgcgcgagtc

SEQ ID NO: 178673 - DNA, 25 bp, Homo sapien
taactttggactcccgccagggagc

SEQ ID NO: 178674 - DNA, 25 bp, Homo sapien
tgtcgcgtccgcagaattaactttg

SEQ ID NO: 178675 - DNA, 25 bp, Homo sapien
tcggcctcattcagcccattggctg

SEQ ID NO: 178676 - DNA, 25 bp, Homo sapien
cagcaccatgtggaagcagtcgcac

SEQ ID NO: 178677 - DNA, 25 bp, Homo sapien
ggcagcataaggacaagatagaatt

SEQ ID NO: 178678 - DNA, 25 bp, Homo sapien
ctctcttggcggctgattgccattc

SEQ ID NO: 178679 - DNA, 25 bp, Homo sapien
gattgccattcggtcacgtgtggta

SEQ ID NO: 178680 - DNA, 25 bp, Homo sapien
gagcctttgtatcccgcggctgatg

SEQ ID NO: 178681 - DNA, 25 bp, Homo sapien
gatgcgacggcagtgccgagccttt

SEQ ID NO: 178682 - DNA, 25 bp, Homo sapien
gaggctccgcgatcctcccgaggat

SEQ ID NO: 178683 - DNA, 25 bp, Homo sapien
tcaccttggtccacgtcgctgcgga

SEQ ID NO: 178684 - DNA, 25 bp, Homo sapien
ggatgatctccagagccgtggtgta

SEQ ID NO: 178685 - DNA, 25 bp, Homo sapien
ccgtggtgtaagtgcctctcactgc

SEQ ID NO: 178686 - DNA, 25 bp, Homo sapien
ttttgggattcaggagtcagcaaga

SEQ ID NO: 178687 - DNA, 25 bp, Homo sapien
ttgggattcaggagtcagcaagacg

SEQ ID NO: 178688 - DNA, 25 bp, Homo sapien
ggattcaggagtcagcaagacggac

SEQ ID NO: 178689 - DNA, 25 bp, Homo sapien
attcaggagtcagcaagacggactt

SEQ ID NO: 178690 - DNA, 25 bp, Homo sapien
ttcaggagtcagcaagacggacttg

SEQ ID NO: 178691 - DNA, 25 bp, Homo sapien
caggagtcagcaagacggacttggc

SEQ ID NO: 178692 - DNA, 25 bp, Homo sapien
ggagtcagcaagacggacttggctc

SEQ ID NO: 178693 - DNA, 25 bp, Homo sapien
gagtcagcaagacggacttggctct

SEQ ID NO: 178694 - DNA, 25 bp, Homo sapien
cttagccggccacctcgggccctgt

SEQ ID NO: 178695 - DNA, 25 bp, Homo sapien
gtacgcgcctctgtgtcggactccg

SEQ ID NO: 178696 - DNA, 25 bp, Homo sapien
tctggtacgcgcctctgtgtcggac

SEQ ID NO: 178697 - DNA, 25 bp, Homo sapien
cgctcctctggccagcgtgggcctc

SEQ ID NO: 178698 - DNA, 25 bp, Homo sapien
gttgcaggtttctctcgccctggtc

SEQ ID NO: 178699 - DNA, 25 bp, Homo sapien
agctggcgcacgccgttgccaggca

SEQ ID NO: 178700 - DNA, 25 bp, Homo sapien
gacgccacggcgacggacgccggaa

SEQ ID NO: 178701 - DNA, 25 bp, Homo sapien
ctcacacctgccgtgggtctggtac

SEQ ID NO: 178702 - DNA, 25 bp, Homo sapien
gcacaaaagtgcacgccgccgtaga

SEQ ID NO: 178703 - DNA, 25 bp, Homo sapien
cgcgctccgcaaggaacgcagacgg

SEQ ID NO: 178704 - DNA, 25 bp, Homo sapien
tctggccctgaactgaacgcgcctg

SEQ ID NO: 178705 - DNA, 25 bp, Homo sapien
ctcttgttcaaacccacgcgggcgg

SEQ ID NO: 178706 - DNA, 25 bp, Homo sapien
ctccgctgcaactagagccgaggta

SEQ ID NO: 178707 - DNA, 25 bp, Homo sapien
ggaggcttgcgtctgacttctgcaa

SEQ ID NO: 178708 - DNA, 25 bp, Homo sapien
cttctgcaagtgtctcggggacttt

SEQ ID NO: 178709 - DNA, 25 bp, Homo sapien
ccactcggcgtccacaaagggtcga

SEQ ID NO: 178710 - DNA, 25 bp, Homo sapien
tcaggctctcggtttccgcgttcgc

SEQ ID NO: 178711 - DNA, 25 bp, Homo sapien
tcgcgctctcggtttccgcgttcgc

SEQ ID NO: 178712 - DNA, 25 bp, Homo sapien
gtcgcgctctcggtttccgcgttcg

SEQ ID NO: 178713 - DNA, 25 bp, Homo sapien
tttccgcgttcgctcccggtcgcgc

SEQ ID NO: 178714 - DNA, 25 bp, Homo sapien
ccgtcaggctctcggtttccgcgtt

SEQ ID NO: 178715 - DNA, 25 bp, Homo sapien
aggctctcggtttccgcgttcgctc

SEQ ID NO: 178716 - DNA, 25 bp, Homo sapien
gtcaggctctcggtttccgcgttcg

SEQ ID NO: 178717 - DNA, 25 bp, Homo sapien
cgcgctctcggtttccgcgttcgct

SEQ ID NO: 178718 - DNA, 25 bp, Homo sapien
tcaatgctatttggctgcggctgaa

SEQ ID NO: 178719 - DNA, 25 bp, Homo sapien
ggtttccattgattcaccctgggca

SEQ ID NO: 178720 - DNA, 25 bp, Homo sapien
cgcctcattcactggctggagtcta

SEQ ID NO: 178721 - DNA, 25 bp, Homo sapien
ggcgtcccacacaatggaataatca

SEQ ID NO: 178722 - DNA, 25 bp, Homo sapien
gaataatcaatacccaggcgcccgg

SEQ ID NO: 178723 - DNA, 25 bp, Homo sapien
gagttgtagtctgttcgcgcccgcc

SEQ ID NO: 178724 - DNA, 25 bp, Homo sapien
ggaagtgaaggaaaataatcaatgc

SEQ ID NO: 178725 - DNA, 25 bp, Homo sapien
tggagtctaggcgtcccacacaatg

SEQ ID NO: 178726 - DNA, 25 bp, Homo sapien
gcgccctctagggtcgttcttggga

SEQ ID NO: 178727 - DNA, 25 bp, Homo sapien
cccacgggcgccctttgcagctgct

SEQ ID NO: 178728 - DNA, 25 bp, Homo sapien
gccgcgggcggctactagcgggaaa

SEQ ID NO: 178729 - DNA, 25 bp, Homo sapien
gcggctactagcgggaaagcgaaac

SEQ ID NO: 178730 - DNA, 25 bp, Homo sapien
cgcccggtccattcaagccccgctg

SEQ ID NO: 178731 - DNA, 25 bp, Homo sapien
ctggcgccctctagggtcgttcttg

SEQ ID NO: 178732 - DNA, 25 bp, Homo sapien
tggcgccctctagggtcgttcttgg

SEQ ID NO: 178733 - DNA, 25 bp, Homo sapien
cctgcgaaggttccgcggtggcggg

SEQ ID NO: 178734 - DNA, 25 bp, Homo sapien
ggtgatgctattgttcccacttttc

SEQ ID NO: 178735 - DNA, 25 bp, Homo sapien
gaccttagggacctcaccgagcctg

SEQ ID NO: 178736 - DNA, 25 bp, Homo sapien
gtttgcgcagaaacaagcatcattc

SEQ ID NO: 178737 - DNA, 25 bp, Homo sapien
ctccctggagaaatggcgagccatc

SEQ ID NO: 178738 - DNA, 25 bp, Homo sapien
ctcgcctctggctcttttatttgca

SEQ ID NO: 178739 - DNA, 25 bp, Homo sapien
ccctggtctagaaccgagactcaca

SEQ ID NO: 178740 - DNA, 25 bp, Homo sapien
ttcgtatccaggttccagacaccgc

SEQ ID NO: 178741 - DNA, 25 bp, Homo sapien
tcgagacacaactggaattcgtatc

SEQ ID NO: 178742 - DNA, 25 bp, Homo sapien
cagaaggcgcctttgtgcgtcgcgt

SEQ ID NO: 178743 - DNA, 25 bp, Homo sapien
aggccacgaggggattctgcgggcc

SEQ ID NO: 178744 - DNA, 25 bp, Homo sapien
gcgcgcatacctggcgaggccacga

SEQ ID NO: 178745 - DNA, 25 bp, Homo sapien
ccgacacgcggctgcgcactcgctc

SEQ ID NO: 178746 - DNA, 25 bp, Homo sapien
cgcgggtggagaaagagagtatggc

SEQ ID NO: 178747 - DNA, 25 bp, Homo sapien
tcctgatcaccgcaagcatggaccc

SEQ ID NO: 178748 - DNA, 25 bp, Homo sapien
gccgtgccaccctcctgatcaccgc

SEQ ID NO: 178749 - DNA, 25 bp, Homo sapien
ggctgaggattcttttgggaagccc

SEQ ID NO: 178750 - DNA, 25 bp, Homo sapien
tttaagacaaaatctaggccaggcg

SEQ ID NO: 178751 - DNA, 25 bp, Homo sapien
accacgcccagctatcaatattatt

SEQ ID NO: 178752 - DNA, 25 bp, Homo sapien
ccacgcccagctatcaatattattt

SEQ ID NO: 178753 - DNA, 25 bp, Homo sapien
cgcccagctatcaatattatttttt

SEQ ID NO: 178754 - DNA, 25 bp, Homo sapien
ccagctatcaatattattttttaaa

SEQ ID NO: 178755 - DNA, 25 bp, Homo sapien
ttaagacaaaatctaggccaggcgt

SEQ ID NO: 178756 - DNA, 25 bp, Homo sapien
taagacaaaatctaggccaggcgtg

SEQ ID NO: 178757 - DNA, 25 bp, Homo sapien
gcccagctatcaatattatttttta

SEQ ID NO: 178758 - DNA, 25 bp, Homo sapien
aggccctcgtgtgagtctcggcacc

SEQ ID NO: 178759 - DNA, 25 bp, Homo sapien
ctagctccggaaagccattttgtgc

SEQ ID NO: 178760 - DNA, 25 bp, Homo sapien
tgatcacgtcaaatgagcatctttg

SEQ ID NO: 178761 - DNA, 25 bp, Homo sapien
ttttgtgccgcactttgatcacgtc

SEQ ID NO: 178762 - DNA, 25 bp, Homo sapien
ggctccaggccctcgtgtgagtctc

SEQ ID NO: 178763 - DNA, 25 bp, Homo sapien
tgcccggttgctctttgggacctca

SEQ ID NO: 178764 - DNA, 25 bp, Homo sapien
atctttgacgatgagccaagcgcct

SEQ ID NO: 178765 - DNA, 25 bp, Homo sapien
gacctcagggatctagctccggaaa

SEQ ID NO: 178766 - DNA, 25 bp, Homo sapien
cttgcgtctatttgatgctcccatc

SEQ ID NO: 178767 - DNA, 25 bp, Homo sapien
ccactgcgtgggattttacaaccta

SEQ ID NO: 178768 - DNA, 25 bp, Homo sapien
tgtcaggacgcgtcaacccagatga

SEQ ID NO: 178769 - DNA, 25 bp, Homo sapien
tgacccgacccggagatcctggatc

SEQ ID NO: 178770 - DNA, 25 bp, Homo sapien
gagctaccaatgtcctccagacgtt

SEQ ID NO: 178771 - DNA, 25 bp, Homo sapien
agacgttctccaaagcccgagctgc

SEQ ID NO: 178772 - DNA, 25 bp, Homo sapien
ttgcacgcaggggttttgacgtttc

SEQ ID NO: 178773 - DNA, 25 bp, Homo sapien
agcaacagcgtttgccagggaatca

SEQ ID NO: 178774 - DNA, 25 bp, Homo sapien
ccacggcacgcgtggacagttgcga

SEQ ID NO: 178775 - DNA, 25 bp, Homo sapien
ggtctgtgtgaaggcacttgtcacg

SEQ ID NO: 178776 - DNA, 25 bp, Homo sapien
cagcaggaagggcacttctgaaagc

SEQ ID NO: 178777 - DNA, 25 bp, Homo sapien
ggcacttctgaaagcacagtggaga

SEQ ID NO: 178778 - DNA, 25 bp, Homo sapien
actggccagcaagcgcgaggttgac

SEQ ID NO: 178779 - DNA, 25 bp, Homo sapien
aggttgacctgccagccttgggcca

SEQ ID NO: 178780 - DNA, 25 bp, Homo sapien
taacaaccacaggtgcgtcaacagc

SEQ ID NO: 178781 - DNA, 25 bp, Homo sapien
gtcacgagcttcaatactgccgccg

SEQ ID NO: 178782 - DNA, 25 bp, Homo sapien
ttgcgtgtccaccacacgcacagga

SEQ ID NO: 178783 - DNA, 25 bp, Homo sapien
gcccactggttgttggcgctctcct

SEQ ID NO: 178784 - DNA, 25 bp, Homo sapien
tgcactggtagagcacgtccttgtg

SEQ ID NO: 178785 - DNA, 25 bp, Homo sapien
gcggcgtgaagttcttgcactggta

SEQ ID NO: 178786 - DNA, 25 bp, Homo sapien
gcggccaggatctttggtgaatttg

SEQ ID NO: 178787 - DNA, 25 bp, Homo sapien
ggcctcattgatgctcctgaccgcg

SEQ ID NO: 178788 - DNA, 25 bp, Homo sapien
cctgaccgcgcggttgtccactttg

SEQ ID NO: 178789 - DNA, 25 bp, Homo sapien
gaatttgtgtgagaggaacttctcc

SEQ ID NO: 178790 - DNA, 25 bp, Homo sapien
agtagaagtcattgaccaggtcgta

SEQ ID NO: 178791 - DNA, 25 bp, Homo sapien
actcacgtgagtggcaggtcttgcc

SEQ ID NO: 178792 - DNA, 25 bp, Homo sapien
ctgttggcacatgggccgctcagca

SEQ ID NO: 178793 - DNA, 25 bp, Homo sapien
gcatcgcactggaactcgcctgttg

SEQ ID NO: 178794 - DNA, 25 bp, Homo sapien
ttgctgcaggtgtaggcatcgcact

SEQ ID NO: 178795 - DNA, 25 bp, Homo sapien
tcgccgctgtcgtagcaggtgccac

SEQ ID NO: 178796 - DNA, 25 bp, Homo sapien
cgtcgtcgcacgcacagtagaagtc

SEQ ID NO: 178797 - DNA, 25 bp, Homo sapien
tagcaggtgccaccgttgctgcagg

SEQ ID NO: 178798 - DNA, 25 bp, Homo sapien
caggcagtacagtcaggagtcaggc

SEQ ID NO: 178799 - DNA, 25 bp, Homo sapien
gtcatcagggcaggcgcagtaatag

SEQ ID NO: 178800 - DNA, 25 bp, Homo sapien
cgcagtaatagtcaccctccaggtt

SEQ ID NO: 178801 - DNA, 25 bp, Homo sapien
tccaggttatagcagcgagcgccgt

SEQ ID NO: 178802 - DNA, 25 bp, Homo sapien
gcacggagcagttcttgccaccaaa

SEQ ID NO: 178803 - DNA, 25 bp, Homo sapien
catcgatcactatggcaggcagtac

SEQ ID NO: 178804 - DNA, 25 bp, Homo sapien
tgacccgcagccatcgatcactatg

SEQ ID NO: 178805 - DNA, 25 bp, Homo sapien
gttcttgccaccaaagtcatcaggg

SEQ ID NO: 178806 - DNA, 25 bp, Homo sapien
ggtcccatgtgcctcggcccacccg

SEQ ID NO: 178807 - DNA, 25 bp, Homo sapien
gggccagccaggtgagcgtcccgca

SEQ ID NO: 178808 - DNA, 25 bp, Homo sapien
gggcacacacactggtacccgttca

SEQ ID NO: 178809 - DNA, 25 bp, Homo sapien
gtgggcacacacactggtacccgtt

SEQ ID NO: 178810 - DNA, 25 bp, Homo sapien
gtctcgttccagctcgcaatgccgg

SEQ ID NO: 178811 - DNA, 25 bp, Homo sapien
actcgtctcgttccagctcgcaatg

SEQ ID NO: 178812 - DNA, 25 bp, Homo sapien
tgcccgcgacagtcgttgacgtctg

SEQ ID NO: 178813 - DNA, 25 bp, Homo sapien
acactgcccgcgacagtcgttgacg

SEQ ID NO: 178814 - DNA, 25 bp, Homo sapien
tcccggcattcctcgcgagtgtatg

SEQ ID NO: 178815 - DNA, 25 bp, Homo sapien
tagagtaccgcaggcaccaagtgca

SEQ ID NO: 178816 - DNA, 25 bp, Homo sapien
agtgcagctttcctgtcgccatagc

SEQ ID NO: 178817 - DNA, 25 bp, Homo sapien
ctcagcctcaggcatgagacctgta

SEQ ID NO: 178818 - DNA, 25 bp, Homo sapien
cggcaccgccacaacgggcgtaata

SEQ ID NO: 178819 - DNA, 25 bp, Homo sapien
tctcgggctttgaggtgagacctga

SEQ ID NO: 178820 - DNA, 25 bp, Homo sapien
ggcctcccattacatagcgcgtgtc

SEQ ID NO: 178821 - DNA, 25 bp, Homo sapien
ccagttcagctttaggtagagtacc

SEQ ID NO: 178822 - DNA, 25 bp, Homo sapien
ctcgatcagcagctcctcttgggga

SEQ ID NO: 178823 - DNA, 25 bp, Homo sapien
tagtagttctcgtcgcagcgcacgc

SEQ ID NO: 178824 - DNA, 25 bp, Homo sapien
ttgcaagtggcgctgtagtagttct

SEQ ID NO: 178825 - DNA, 25 bp, Homo sapien
gtgtagtggccgaaaaagtcgttgc

SEQ ID NO: 178826 - DNA, 25 bp, Homo sapien
gtcagcacaggccagagaaaccagc

SEQ ID NO: 178827 - DNA, 25 bp, Homo sapien
tccagcggtcctccgggttgatcat

SEQ ID NO: 178828 - DNA, 25 bp, Homo sapien
atgccggcatgcgacactcgctcga

SEQ ID NO: 178829 - DNA, 25 bp, Homo sapien
cggccaggctgctacagaaagctca

SEQ ID NO: 178830 - DNA, 25 bp, Homo sapien
ctctgagcatgctccgtgggcgcgc

SEQ ID NO: 178831 - DNA, 25 bp, Homo sapien
aggtgccacctgtcgggtgccgcgc

SEQ ID NO: 178832 - DNA, 25 bp, Homo sapien
ccgcggctctgagcatgctccgtgg

SEQ ID NO: 178833 - DNA, 25 bp, Homo sapien
ctgtcccgacaggagccttcgggcg

SEQ ID NO: 178834 - DNA, 25 bp, Homo sapien
gcggcgccctgtcccgacaggagcc

SEQ ID NO: 178835 - DNA, 25 bp, Homo sapien
gacgccccctcgatgcgctccatgg

SEQ ID NO: 178836 - DNA, 25 bp, Homo sapien
cggtaatgcagcgtgagcggccgca

SEQ ID NO: 178837 - DNA, 25 bp, Homo sapien
gcgcaggcacgtgggcgtcgcccgg

SEQ ID NO: 178838 - DNA, 25 bp, Homo sapien
gcccataaagcattctccacgctga

SEQ ID NO: 178839 - DNA, 25 bp, Homo sapien
ctttgcagacgatgccctggttctc

SEQ ID NO: 178840 - DNA, 25 bp, Homo sapien
cacagttttagggaacgccttatgg

SEQ ID NO: 178841 - DNA, 25 bp, Homo sapien
ggctgggctggcctcacagttttag

SEQ ID NO: 178842 - DNA, 25 bp, Homo sapien
agagcagccaaacaggcccacagca

SEQ ID NO: 178843 - DNA, 25 bp, Homo sapien
ccagacctttgcagacgatgccctg

SEQ ID NO: 178844 - DNA, 25 bp, Homo sapien
gggtagcacatcagcccataaagca

SEQ ID NO: 178845 - DNA, 25 bp, Homo sapien
gccctggttctctgggtagcacatc

SEQ ID NO: 178846 - DNA, 25 bp, Homo sapien
ggaccggcggacaatggccattgaa

SEQ ID NO: 178847 - DNA, 25 bp, Homo sapien
agcgcaccggggagccaccctagca

SEQ ID NO: 178848 - DNA, 25 bp, Homo sapien
acaatggccattgaattgggccggg

SEQ ID NO: 178849 - DNA, 25 bp, Homo sapien
gcggacacctcagaacaaagggacc

SEQ ID NO: 178850 - DNA, 25 bp, Homo sapien
ggcaggaagcggacacctcagaaca

SEQ ID NO: 178851 - DNA, 25 bp, Homo sapien
cccgccctgcagaccgcacaccgag

SEQ ID NO: 178852 - DNA, 25 bp, Homo sapien
cccgctggggactaaagaggagcca

SEQ ID NO: 178853 - DNA, 25 bp, Homo sapien
agctgcccgcgctgataagaccctc

SEQ ID NO: 178854 - DNA, 25 bp, Homo sapien
ctggtgcgccctttctttgccacgt

SEQ ID NO: 178855 - DNA, 25 bp, Homo sapien
tttgccacgtgctccagtgactgtc

SEQ ID NO: 178856 - DNA, 25 bp, Homo sapien
agtcgatagctaggcgatctctgcg

SEQ ID NO: 178857 - DNA, 25 bp, Homo sapien
tgcgcctagcaactacaacagagct

SEQ ID NO: 178858 - DNA, 25 bp, Homo sapien
tggccagatcgctcggttccctgca

SEQ ID NO: 178859 - DNA, 25 bp, Homo sapien
agctcaaacggctcctcacaggcaa

SEQ ID NO: 178860 - DNA, 25 bp, Homo sapien
tcacaggcaactcactggcagcttc

SEQ ID NO: 178861 - DNA, 25 bp, Homo sapien
gcggctaagattgccctctggcgcc

SEQ ID NO: 178862 - DNA, 25 bp, Homo sapien
gcatgacagtcggactttcccaggg

SEQ ID NO: 178863 - DNA, 25 bp, Homo sapien
cagggaggcatgacagtcggacttt

SEQ ID NO: 178864 - DNA, 25 bp, Homo sapien
ctttcccagggcgtcagaagagcaa

SEQ ID NO: 178865 - DNA, 25 bp, Homo sapien
ggcgtcagaagagcaaacccgttaa

SEQ ID NO: 178866 - DNA, 25 bp, Homo sapien
gcaaacccgttaacacaggcaggga

SEQ ID NO: 178867 - DNA, 25 bp, Homo sapien
cgagtctcgacagtctgccccggtg

SEQ ID NO: 178868 - DNA, 25 bp, Homo sapien
aaagctgagcacacgccctccaagg

SEQ ID NO: 178869 - DNA, 25 bp, Homo sapien
ccggtgctgcatccagaaggttacc

SEQ ID NO: 178870 - DNA, 25 bp, Homo sapien
cagcctctatttagtgcggagcctg

SEQ ID NO: 178871 - DNA, 25 bp, Homo sapien
gcagcctctatttagtgcggagcct

SEQ ID NO: 178872 - DNA, 25 bp, Homo sapien
agcctctatttagtgcggagcctgg

SEQ ID NO: 178873 - DNA, 25 bp, Homo sapien
ggcagcctctatttagtgcggagcc

SEQ ID NO: 178874 - DNA, 25 bp, Homo sapien
cctctatttagtgcggagcctgggc

SEQ ID NO: 178875 - DNA, 25 bp, Homo sapien
cggggcagcctctatttagtgcgga

SEQ ID NO: 178876 - DNA, 25 bp, Homo sapien
cccggggcagcctctatttagtgcg

SEQ ID NO: 178877 - DNA, 25 bp, Homo sapien
gggcagcctctatttagtgcggagc

SEQ ID NO: 178878 - DNA, 25 bp, Homo sapien
tgttcccgcaggtactcggcgttct

SEQ ID NO: 178879 - DNA, 25 bp, Homo sapien
gcatgctaaggtcgcgctggccagc

SEQ ID NO: 178880 - DNA, 25 bp, Homo sapien
agccttcgcacaccggggcatgcta

SEQ ID NO: 178881 - DNA, 25 bp, Homo sapien
tggcttttagccttcgcacaccggg

SEQ ID NO: 178882 - DNA, 25 bp, Homo sapien
attcaggatgtactgggcgagcaca

SEQ ID NO: 178883 - DNA, 25 bp, Homo sapien
gggcttccgactcattcaggatgta

SEQ ID NO: 178884 - DNA, 25 bp, Homo sapien
gctggccagcgggaagtatttccac

SEQ ID NO: 178885 - DNA, 25 bp, Homo sapien
ttcacgcgggcttccgactcattca

SEQ ID NO: 178886 - DNA, 25 bp, Homo sapien
gctcagtgcctgacctccttgcttt

SEQ ID NO: 178887 - DNA, 25 bp, Homo sapien
cgtccgccgtgtggctgacacgcag

SEQ ID NO: 178888 - DNA, 25 bp, Homo sapien
gctttctcctcccagtacgtcttgg

SEQ ID NO: 178889 - DNA, 25 bp, Homo sapien
tcccagtacgtcttggctgtcggca

SEQ ID NO: 178890 - DNA, 25 bp, Homo sapien
gtaagtccactctactggggaggga

SEQ ID NO: 178891 - DNA, 25 bp, Homo sapien
ctgaagggaagcacacaggagctga

SEQ ID NO: 178892 - DNA, 25 bp, Homo sapien
aagatggcggcggaactctacgctc

SEQ ID NO: 178893 - DNA, 25 bp, Homo sapien
agcccgtgcctctacctttgcagga

SEQ ID NO: 178894 - DNA, 25 bp, Homo sapien
caagctgcacaccgctgagggtcgg

SEQ ID NO: 178895 - DNA, 25 bp, Homo sapien
gtgtccacgcacaaggccaagctgc

SEQ ID NO: 178896 - DNA, 25 bp, Homo sapien
ctgcagtcacggtgtccacgcacaa

SEQ ID NO: 178897 - DNA, 25 bp, Homo sapien
acgcacaaggccaagctgcacaccg

SEQ ID NO: 178898 - DNA, 25 bp, Homo sapien
gccaagctgcacaccgctgagggtc

SEQ ID NO: 178899 - DNA, 25 bp, Homo sapien
accgcctgcagtcacggtgtccacg

SEQ ID NO: 178900 - DNA, 25 bp, Homo sapien
aaggccaagctgcacaccgctgagg

SEQ ID NO: 178901 - DNA, 25 bp, Homo sapien
ggccaagctgcacaccgctgagggt

SEQ ID NO: 178902 - DNA, 25 bp, Homo sapien
ctcccgtggagagacggcctgcgaa

SEQ ID NO: 178903 - DNA, 25 bp, Homo sapien
gtcctcctcggatagtgagcgcggt

SEQ ID NO: 178904 - DNA, 25 bp, Homo sapien
tcggacacgatgatgttgtcctcca

SEQ ID NO: 178905 - DNA, 25 bp, Homo sapien
tgttgtcctccagcactgagccgca

SEQ ID NO: 178906 - DNA, 25 bp, Homo sapien
cagccgattcgcagccgcagattcg

SEQ ID NO: 178907 - DNA, 25 bp, Homo sapien
acgcagtcggggactaaagctggac

SEQ ID NO: 178908 - DNA, 25 bp, Homo sapien
gtccagggacacgaactggcccacg

SEQ ID NO: 178909 - DNA, 25 bp, Homo sapien
cgggcccttggcgatgaacgcagtc

SEQ ID NO: 178910 - DNA, 25 bp, Homo sapien
catcgccagggcgacgatgagcttt

SEQ ID NO: 178911 - DNA, 25 bp, Homo sapien
agggcgacgatgagctttccttagg

SEQ ID NO: 178912 - DNA, 25 bp, Homo sapien
ggcgcgctcaacacgcccgtgccca

SEQ ID NO: 178913 - DNA, 25 bp, Homo sapien
tgcccatgaacctgttcgccacctg

SEQ ID NO: 178914 - DNA, 25 bp, Homo sapien
agctgcgtgcccaggtacgcgccgc

SEQ ID NO: 178915 - DNA, 25 bp, Homo sapien
cccgcccgccggttcgacgcgtgca

SEQ ID NO: 178916 - DNA, 25 bp, Homo sapien
tggctcgccgcaaccgcacctgcac

SEQ ID NO: 178917 - DNA, 25 bp, Homo sapien
aggacccggtgctgctcagacccgg

SEQ ID NO: 178918 - DNA, 25 bp, Homo sapien
aaacactctctggtcgggcgtgcct

SEQ ID NO: 178919 - DNA, 25 bp, Homo sapien
atgtgggcacactccttttggatca

SEQ ID NO: 178920 - DNA, 25 bp, Homo sapien
agtccgggagtggagaaacactctc

SEQ ID NO: 178921 - DNA, 25 bp, Homo sapien
cgtcctgtgtcaagaccctaagagc

SEQ ID NO: 178922 - DNA, 25 bp, Homo sapien
caggtaccctaaaattgcgcccgca

SEQ ID NO: 178923 - DNA, 25 bp, Homo sapien
cccttcctattgagcatgcgcggga

SEQ ID NO: 178924 - DNA, 25 bp, Homo sapien
ccgatttccatctcaggcagcggca

SEQ ID NO: 178925 - DNA, 25 bp, Homo sapien
tgaagcttcagcgaaggcaccacca

SEQ ID NO: 178926 - DNA, 25 bp, Homo sapien
ttccgggaggctcactatagtgatg

SEQ ID NO: 178927 - DNA, 25 bp, Homo sapien
ctcactatagtgatgtcctgcctta

SEQ ID NO: 178928 - DNA, 25 bp, Homo sapien
ttgagccagagcctccgagaagcct

SEQ ID NO: 178929 - DNA, 25 bp, Homo sapien
gaaggttactgtgccgcagagtttt

SEQ ID NO: 178930 - DNA, 25 bp, Homo sapien
gtcctgccttagacgaggtcacaca

SEQ ID NO: 178931 - DNA, 25 bp, Homo sapien
tcacacaggggaaggttactgtgcc

SEQ ID NO: 178932 - DNA, 25 bp, Homo sapien
agttttctttccgagcactcaatgc

SEQ ID NO: 178933 - DNA, 25 bp, Homo sapien
caatgctcacctcctgggagggagt

SEQ ID NO: 178934 - DNA, 25 bp, Homo sapien
agcggctgcttgtttctcggggcac

SEQ ID NO: 178935 - DNA, 25 bp, Homo sapien
ctgctcccacccgaacctgggctgg

SEQ ID NO: 178936 - DNA, 25 bp, Homo sapien
ggaaccttgtgcctgggaccccgca

SEQ ID NO: 178937 - DNA, 25 bp, Homo sapien
ctctcatccactgtgtcccgcgcgc

SEQ ID NO: 178938 - DNA, 25 bp, Homo sapien
ccagccacctggcacctctcatcca

SEQ ID NO: 178939 - DNA, 25 bp, Homo sapien
ccagcacaaggggaggaccagagtc

SEQ ID NO: 178940 - DNA, 25 bp, Homo sapien
accagagtccgccatggacgtctca

SEQ ID NO: 178941 - DNA, 25 bp, Homo sapien
tggacgtctcatggagcccgagtac

SEQ ID NO: 178942 - DNA, 25 bp, Homo sapien
tgctgattgcctcaggcacatgagc

SEQ ID NO: 178943 - DNA, 25 bp, Homo sapien
acatgagccgccacactgtttccga

SEQ ID NO: 178944 - DNA, 25 bp, Homo sapien
gccacactgtttccgagtgtccaca

SEQ ID NO: 178945 - DNA, 25 bp, Homo sapien
tttccgagtgtccacaggcgcgctc

SEQ ID NO: 178946 - DNA, 25 bp, Homo sapien
atcccggacactgcagcacatagtc

SEQ ID NO: 178947 - DNA, 25 bp, Homo sapien
tgcagcacatagtccttgtccacct

SEQ ID NO: 178948 - DNA, 25 bp, Homo sapien
ccttgtccacctgccatggctgtta

SEQ ID NO: 178949 - DNA, 25 bp, Homo sapien
cctgccatggctgttagcgtggcgc

SEQ ID NO: 178950 - DNA, 25 bp, Homo sapien
ccttctaagacctccgctaggcatt

SEQ ID NO: 178951 - DNA, 25 bp, Homo sapien
agacctccgctaggcattatcagtg

SEQ ID NO: 178952 - DNA, 25 bp, Homo sapien
tatcagtgactgtgctcgtgagcgc

SEQ ID NO: 178953 - DNA, 25 bp, Homo sapien
ctaggcgatatcagggactgtgctc

SEQ ID NO: 178954 - DNA, 25 bp, Homo sapien
actgtgctcatgagggcggactttc

SEQ ID NO: 178955 - DNA, 25 bp, Homo sapien
tcatgagggcggactttcaccagcc

SEQ ID NO: 178956 - DNA, 25 bp, Homo sapien
gggcggactttcaccagccacgctt

SEQ ID NO: 178957 - DNA, 25 bp, Homo sapien
atgagggcggactttcaccagccac

SEQ ID NO: 178958 - DNA, 25 bp, Homo sapien
tcccttgccgcctagcatggctccc

SEQ ID NO: 178959 - DNA, 25 bp, Homo sapien
ttcccttgccgcctagcatggctcc

SEQ ID NO: 178960 - DNA, 25 bp, Homo sapien
ccaggtggtgcttcctctctgacct

SEQ ID NO: 178961 - DNA, 25 bp, Homo sapien
gctccgccataagggccaggtgcgg

SEQ ID NO: 178962 - DNA, 25 bp, Homo sapien
ggctccgccataagggccaggtgcg

SEQ ID NO: 178963 - DNA, 25 bp, Homo sapien
gggctccgccataagggccaggtgc

SEQ ID NO: 178964 - DNA, 25 bp, Homo sapien
ccgggctccgccataagggccaggt

SEQ ID NO: 178965 - DNA, 25 bp, Homo sapien
gccgcctagcatggctccccgcatg

SEQ ID NO: 178966 - DNA, 25 bp, Homo sapien
gtccagatgtccagggatcaggtga

SEQ ID NO: 178967 - DNA, 25 bp, Homo sapien
tccagggatcaggtgaaaatgatga

SEQ ID NO: 178968 - DNA, 25 bp, Homo sapien
ggccgcgggctccatcagcatggct

SEQ ID NO: 178969 - DNA, 25 bp, Homo sapien
tcagcatggctgaggtgagtgctcc

SEQ ID NO: 178970 - DNA, 25 bp, Homo sapien
catggctgaggtgagtgctccgtct

SEQ ID NO: 178971 - DNA, 25 bp, Homo sapien
cctgggtgccagagcattcgcccgt

SEQ ID NO: 178972 - DNA, 25 bp, Homo sapien
tgccagagcattcgcccgtgggaga

SEQ ID NO: 178973 - DNA, 25 bp, Homo sapien
cgtgggagatggagatgtctctccc

SEQ ID NO: 178974 - DNA, 25 bp, Homo sapien
catacctctgtcgttacgtggtgca

SEQ ID NO: 178975 - DNA, 25 bp, Homo sapien
tcctcaccatgcatgtctcagaaca

SEQ ID NO: 178976 - DNA, 25 bp, Homo sapien
tgacacagacaccaagtgaacacgt

SEQ ID NO: 178977 - DNA, 25 bp, Homo sapien
agggttgccaaaagccttcactgta

SEQ ID NO: 178978 - DNA, 25 bp, Homo sapien
atccaggcttgctgcgatgttggca

SEQ ID NO: 178979 - DNA, 25 bp, Homo sapien
tggcgctgatagacttgcttgatgc

SEQ ID NO: 178980 - DNA, 25 bp, Homo sapien
cgtggtgcatgactgtttttgtaaa

SEQ ID NO: 178981 - DNA, 25 bp, Homo sapien
atgttggcaagaggacgaggtctcc

SEQ ID NO: 178982 - DNA, 25 bp, Homo sapien
tcaaagtgtccgacgaggtgagtgc

SEQ ID NO: 178983 - DNA, 25 bp, Homo sapien
cgcctgcaacagcacctggtcggga

SEQ ID NO: 178984 - DNA, 25 bp, Homo sapien
ctgctgcggaggttcaaagtgtccg

SEQ ID NO: 178985 - DNA, 25 bp, Homo sapien
cttcaagcagaaagtggtagcgctg

SEQ ID NO: 178986 - DNA, 25 bp, Homo sapien
gtcttgcagcaacagaacttcaagc

SEQ ID NO: 178987 - DNA, 25 bp, Homo sapien
gcaccgcctgtcttgcagcaacaga

SEQ ID NO: 178988 - DNA, 25 bp, Homo sapien
cgagcgaatccatcagcgtggctgg

SEQ ID NO: 178989 - DNA, 25 bp, Homo sapien
gtgctgaggccttgctgctctccca

SEQ ID NO: 178990 - DNA, 25 bp, Homo sapien
actgagtgccctcggcggtccctgg

SEQ ID NO: 178991 - DNA, 25 bp, Homo sapien
caccttccctagactacaggggaga

SEQ ID NO: 178992 - DNA, 25 bp, Homo sapien
aagtcctgcggagacctgtctgtcc

SEQ ID NO: 178993 - DNA, 25 bp, Homo sapien
tccctagactacaggggagagagcc

SEQ ID NO: 178994 - DNA, 25 bp, Homo sapien
ccggccgaaagtcctgcggagacct

SEQ ID NO: 178995 - DNA, 25 bp, Homo sapien
agagccgagtgcaaggcgcaaagcc

SEQ ID NO: 178996 - DNA, 25 bp, Homo sapien
ggcgcaaagccagcgctcacgggct

SEQ ID NO: 178997 - DNA, 25 bp, Homo sapien
tggcgccactgtcccacaccttccc

SEQ ID NO: 178998 - DNA, 25 bp, Homo sapien
gtagcggccatagacccggatatgc

SEQ ID NO: 178999 - DNA, 25 bp, Homo sapien
caggctgccgaaggctttccaggct

SEQ ID NO: 179000 - DNA, 25 bp, Homo sapien
ccctggaacgtttgagaaggctggc

SEQ ID NO: 179001 - DNA, 25 bp, Homo sapien
ctcaagccgcggtgtactccagcgg

SEQ ID NO: 179002 - DNA, 25 bp, Homo sapien
ttcaggtctgtgcttcgggagaccc

SEQ ID NO: 179003 - DNA, 25 bp, Homo sapien
gctcagcggcatcgcgccgcttgaa

SEQ ID NO: 179004 - DNA, 25 bp, Homo sapien
agtgtgattctctcggccgtccacc

SEQ ID NO: 179005 - DNA, 25 bp, Homo sapien
gtggcaagagctctgggcctttcct

SEQ ID NO: 179006 - DNA, 25 bp, Homo sapien
acgtggacaaggacgtgctccttcc

SEQ ID NO: 179007 - DNA, 25 bp, Homo sapien
cgcagtgcgcctttctggcataatg

SEQ ID NO: 179008 - DNA, 25 bp, Homo sapien
gcataatgcgactttcgaggcctcg

SEQ ID NO: 179009 - DNA, 25 bp, Homo sapien
gactaagcggtccacaggcagccct

SEQ ID NO: 179010 - DNA, 25 bp, Homo sapien
ggcagccctgctgtacatgaagcgg

SEQ ID NO: 179011 - DNA, 25 bp, Homo sapien
cggtgtcctggcacagatgactgtg

SEQ ID NO: 179012 - DNA, 25 bp, Homo sapien
cacagagggccacactgcctgaggc

SEQ ID NO: 179013 - DNA, 25 bp, Homo sapien
acgtcgtgcagatggtagcccagct

SEQ ID NO: 179014 - DNA, 25 bp, Homo sapien
cttggctttgcagaaacaccgcttg

SEQ ID NO: 179015 - DNA, 25 bp, Homo sapien
gcaacgaatacagctttaaaaacgc

SEQ ID NO: 179016 - DNA, 25 bp, Homo sapien
aagtctcgcagcagtagtgtggtgc

SEQ ID NO: 179017 - DNA, 25 bp, Homo sapien
ttcccacgcccgattcgaattgtga

SEQ ID NO: 179018 - DNA, 25 bp, Homo sapien
gattcgaattgtgactccggctggc

SEQ ID NO: 179019 - DNA, 25 bp, Homo sapien
aggacgctccggcaccacagcagga

SEQ ID NO: 179020 - DNA, 25 bp, Homo sapien
cccgctggagaaacgccttccttgg

SEQ ID NO: 179021 - DNA, 25 bp, Homo sapien
aaacaccgcttgctattaatacagc

SEQ ID NO: 179022 - DNA, 25 bp, Homo sapien
agcagcagcgaacggcgaaagaatc

SEQ ID NO: 179023 - DNA, 25 bp, Homo sapien
gccgcctgatggtagggcacactct

SEQ ID NO: 179024 - DNA, 25 bp, Homo sapien
tagcaggagccctacgtggattttg

SEQ ID NO: 179025 - DNA, 25 bp, Homo sapien
ctggtcagggcgtttagataggcaa

SEQ ID NO: 179026 - DNA, 25 bp, Homo sapien
aacagtactctgaggggcacgccga

SEQ ID NO: 179027 - DNA, 25 bp, Homo sapien
cacgcggacgagcagacagacactg

SEQ ID NO: 179028 - DNA, 25 bp, Homo sapien
ctcagtgccgtagccgtcctggaaa

SEQ ID NO: 179029 - DNA, 25 bp, Homo sapien
acctccgtcggagtaggtctcagtg

SEQ ID NO: 179030 - DNA, 25 bp, Homo sapien
ccaactcactctggcgtctcttttt

SEQ ID NO: 179031 - DNA, 25 bp, Homo sapien
gtttggtcgcgtttctcagacgccc

SEQ ID NO: 179032 - DNA, 25 bp, Homo sapien
ctttttctcccttccacagtgggcg

SEQ ID NO: 179033 - DNA, 25 bp, Homo sapien
caagcacgcaagtgagtccggcctt

SEQ ID NO: 179034 - DNA, 25 bp, Homo sapien
ccctggccgacaagcacgcaagtga

SEQ ID NO: 179035 - DNA, 25 bp, Homo sapien
tgcttctaccggaggcgggacatct

SEQ ID NO: 179036 - DNA, 25 bp, Homo sapien
tgctgttacagacggccaatgggaa

SEQ ID NO: 179037 - DNA, 25 bp, Homo sapien
tgggtgaatgaagtcctcgcacgcc

SEQ ID NO: 179038 - DNA, 25 bp, Homo sapien
cagtctgctataaggccggaccggg

SEQ ID NO: 179039 - DNA, 25 bp, Homo sapien
cgtcgaggcccagatgatcttcaac

SEQ ID NO: 179040 - DNA, 25 bp, Homo sapien
ccagatgatcttcaaccgggtggtc

SEQ ID NO: 179041 - DNA, 25 bp, Homo sapien
cctgtcagtctgctataaggccgga

SEQ ID NO: 179042 - DNA, 25 bp, Homo sapien
gggcgtcctcctgtctgtgtccctg

SEQ ID NO: 179043 - DNA, 25 bp, Homo sapien
tcttcaaccgggtggtcttcacgcc

SEQ ID NO: 179044 - DNA, 25 bp, Homo sapien
accctgtgctgaccgtgctgccggg

SEQ ID NO: 179045 - DNA, 25 bp, Homo sapien
tgtctgttatatagccctgtcagtc

SEQ ID NO: 179046 - DNA, 25 bp, Homo sapien
caaggcttccccacgtctgttgaca

SEQ ID NO: 179047 - DNA, 25 bp, Homo sapien
aatcacaaacgagggggctgcagcg

SEQ ID NO: 179048 - DNA, 25 bp, Homo sapien
gcgaaagcaaggcttccccacgtct

SEQ ID NO: 179049 - DNA, 25 bp, Homo sapien
ttccccacgtctgttgacaggacgg

SEQ ID NO: 179050 - DNA, 25 bp, Homo sapien
gacggccgcctctctacttccgctg

SEQ ID NO: 179051 - DNA, 25 bp, Homo sapien
gcctctctacttccgctggctacgg

SEQ ID NO: 179052 - DNA, 25 bp, Homo sapien
acttccgctggctacggcctctacg

SEQ ID NO: 179053 - DNA, 25 bp, Homo sapien
gcaaatcacaaacgagggggctgca

SEQ ID NO: 179054 - DNA, 25 bp, Homo sapien
gcacctacatgctgggtccggagaa

SEQ ID NO: 179055 - DNA, 25 bp, Homo sapien
acggcctctacgcagtagaggtacc

SEQ ID NO: 179056 - DNA, 25 bp, Homo sapien
ctacgcagtagaggtaccgcgtctg

SEQ ID NO: 179057 - DNA, 25 bp, Homo sapien
cacctacatgctgggtccggagaaa

SEQ ID NO: 179058 - DNA, 25 bp, Homo sapien
ggcacctacatgctgggtccggaga

SEQ ID NO: 179059 - DNA, 25 bp, Homo sapien
ccggcacctacatgctgggtccgga

SEQ ID NO: 179060 - DNA, 25 bp, Homo sapien
ctctacgcagtagaggtaccgcgtc

SEQ ID NO: 179061 - DNA, 25 bp, Homo sapien
ctacggcctctacgcagtagaggta

SEQ ID NO: 179062 - DNA, 25 bp, Homo sapien
cgtcaacaacgtcaaggccggtgtg

SEQ ID NO: 179063 - DNA, 25 bp, Homo sapien
ctgacatcgctggttctgcttaaga

SEQ ID NO: 179064 - DNA, 25 bp, Homo sapien
tccaactttgttgtccgtagccaca

SEQ ID NO: 179065 - DNA, 25 bp, Homo sapien
gtctctgcgcatcttgttggacata

SEQ ID NO: 179066 - DNA, 25 bp, Homo sapien
gcttgaaaatgccaacccggttaga

SEQ ID NO: 179067 - DNA, 25 bp, Homo sapien
gccaggaccaaaccgcagtaacatg

SEQ ID NO: 179068 - DNA, 25 bp, Homo sapien
ttctatctgcacacgacgaagctga

SEQ ID NO: 179069 - DNA, 25 bp, Homo sapien
ccatcaaggccgagtgtgagtcacc

SEQ ID NO: 179070 - DNA, 25 bp, Homo sapien
aaggtggcccccgtcatcaacaacg

SEQ ID NO: 179071 - DNA, 25 bp, Homo sapien
tgcgtgctgacgctgtcttctctcc

SEQ ID NO: 179072 - DNA, 25 bp, Homo sapien
cgtgcgtgctgacgctgtcttctct

SEQ ID NO: 179073 - DNA, 25 bp, Homo sapien
tacgagcagcacaacggggtggacg

SEQ ID NO: 179074 - DNA, 25 bp, Homo sapien
gcaagcgcagctacgagcagcacaa

SEQ ID NO: 179075 - DNA, 25 bp, Homo sapien
cctgggcaagcgcagctacgagcag

SEQ ID NO: 179076 - DNA, 25 bp, Homo sapien
catcctgggcaagcgcagctacgag

SEQ ID NO: 179077 - DNA, 25 bp, Homo sapien
accatcctgggcaagcgcagctacg

SEQ ID NO: 179078 - DNA, 25 bp, Homo sapien
acgagcccatcgtcatcgaggacta

SEQ ID NO: 179079 - DNA, 25 bp, Homo sapien
atcctcggaaaccaagcgtgctgcc

SEQ ID NO: 179080 - DNA, 25 bp, Homo sapien
cgcaagctgctctcatcctcggaaa

SEQ ID NO: 179081 - DNA, 25 bp, Homo sapien
tgcccacaggaagatccgcaagctg

SEQ ID NO: 179082 - DNA, 25 bp, Homo sapien
tctacatggccacagaggagaccag

SEQ ID NO: 179083 - DNA, 25 bp, Homo sapien
catcgtcatcgaggactaggggccg

SEQ ID NO: 179084 - DNA, 25 bp, Homo sapien
cggcggatgaactggatcgacgccc

SEQ ID NO: 179085 - DNA, 25 bp, Homo sapien
cccggatgacgtgttctacatggcc

SEQ ID NO: 179086 - DNA, 25 bp, Homo sapien
cctaggcccaagtcactagggctcc

SEQ ID NO: 179087 - DNA, 25 bp, Homo sapien
ctatggaaaccgagcaacaaaggga

SEQ ID NO: 179088 - DNA, 25 bp, Homo sapien
tgtagacgccacctccggcgcgagg

SEQ ID NO: 179089 - DNA, 25 bp, Homo sapien
gcgcaccgaccatggcctccaaatg

SEQ ID NO: 179090 - DNA, 25 bp, Homo sapien
cccaagtgcgacaagaccgtgtact

SEQ ID NO: 179091 - DNA, 25 bp, Homo sapien
gcgacaagaccgtgtacttcggtga

SEQ ID NO: 179092 - DNA, 25 bp, Homo sapien
ctgcccaagcggctaaagccaaagg

SEQ ID NO: 179093 - DNA, 25 bp, Homo sapien
gggatccgcggacgcatcccggttc

SEQ ID NO: 179094 - DNA, 25 bp, Homo sapien
agccgttctgccacaagccgtgcta

SEQ ID NO: 179095 - DNA, 25 bp, Homo sapien
ttctgcctcaagtgcgagcgctgca

SEQ ID NO: 179096 - DNA, 25 bp, Homo sapien
acgtctctgggcaaggattggcacc

SEQ ID NO: 179097 - DNA, 25 bp, Homo sapien
ctttccagctgagaaggtgacgtct

SEQ ID NO: 179098 - DNA, 25 bp, Homo sapien
cgcgctgcagcaagaaggtgtactt

SEQ ID NO: 179099 - DNA, 25 bp, Homo sapien
agtgtcaccactttcaccggggagc

SEQ ID NO: 179100 - DNA, 25 bp, Homo sapien
ctgttcggacccaaaggtgagctcc

SEQ ID NO: 179101 - DNA, 25 bp, Homo sapien
gcgcgggctcctacatctacgagaa

SEQ ID NO: 179102 - DNA, 25 bp, Homo sapien
accagatgatctttcttgggccctg

SEQ ID NO: 179103 - DNA, 25 bp, Homo sapien
agtgatgtttggtccagtcctggcc

SEQ ID NO: 179104 - DNA, 25 bp, Homo sapien
acggtctctgccgtttcctctcagg

SEQ ID NO: 179105 - DNA, 25 bp, Homo sapien
gatctctgcctgctagtggtcttgc

SEQ ID NO: 179106 - DNA, 25 bp, Homo sapien
gccgtcatgcccaagtgtcccaagt

SEQ ID NO: 179107 - DNA, 25 bp, Homo sapien
cgcggcttgaactcgcctaaagagc

SEQ ID NO: 179108 - DNA, 25 bp, Homo sapien
cctcgtaaccctgcgtgggatggaa

SEQ ID NO: 179109 - DNA, 25 bp, Homo sapien
cccaagtgcaacaaggaggtgtact

SEQ ID NO: 179110 - DNA, 25 bp, Homo sapien
cggactctgcggtgttctccatatc

SEQ ID NO: 179111 - DNA, 25 bp, Homo sapien
ggtccgcacgagacagaatagacta

SEQ ID NO: 179112 - DNA, 25 bp, Homo sapien
tagactacactcaaactccagggga

SEQ ID NO: 179113 - DNA, 25 bp, Homo sapien
gggaaccgttcattgggcttggaca

SEQ ID NO: 179114 - DNA, 25 bp, Homo sapien
ggaccctgccgacgcagtgattgga

SEQ ID NO: 179115 - DNA, 25 bp, Homo sapien
cagtgattggatgcatgtccggcca

SEQ ID NO: 179116 - DNA, 25 bp, Homo sapien
ccgtgccatgattgggctcaggttc

SEQ ID NO: 179117 - DNA, 25 bp, Homo sapien
tcgtgacgattgagcctgcaagggc

SEQ ID NO: 179118 - DNA, 25 bp, Homo sapien
tgggtccagctgtccatccgactgt

SEQ ID NO: 179119 - DNA, 25 bp, Homo sapien
ccatggggtcccgtgtgaggttcta

SEQ ID NO: 179120 - DNA, 25 bp, Homo sapien
aggccagctgccgtttgccttccag

SEQ ID NO: 179121 - DNA, 25 bp, Homo sapien
ctctggagcgtgagaaccagcgcct

SEQ ID NO: 179122 - DNA, 25 bp, Homo sapien
catccgactgtctgtccatggggtc

SEQ ID NO: 179123 - DNA, 25 bp, Homo sapien
cgctctgagctggtcttctggcggt

SEQ ID NO: 179124 - DNA, 25 bp, Homo sapien
tgcggactctggagcgtgagaacca

SEQ ID NO: 179125 - DNA, 25 bp, Homo sapien
aggttctaggccagctgccgtttgc

SEQ ID NO: 179126 - DNA, 25 bp, Homo sapien
ctctgtgcccgggcttggaattcgg

SEQ ID NO: 179127 - DNA, 25 bp, Homo sapien
agaccgctcacagcggtaccggggc

SEQ ID NO: 179128 - DNA, 25 bp, Homo sapien
ccctgggaagagtggaacccatact

SEQ ID NO: 179129 - DNA, 25 bp, Homo sapien
cctgggaagagtggaacccatactt

SEQ ID NO: 179130 - DNA, 25 bp, Homo sapien
ctgggaagagtggaacccatacttg

SEQ ID NO: 179131 - DNA, 25 bp, Homo sapien
gggaagagtggaacccatacttgct

SEQ ID NO: 179132 - DNA, 25 bp, Homo sapien
tcaggcggaaggtagatggtggagg

SEQ ID NO: 179133 - DNA, 25 bp, Homo sapien
acagaccgctcacagcggtaccggg

SEQ ID NO: 179134 - DNA, 25 bp, Homo sapien
ccatgggccacaccggctggtgaga

SEQ ID NO: 179135 - DNA, 25 bp, Homo sapien
gcagctgtggtgatcaggacgctga

SEQ ID NO: 179136 - DNA, 25 bp, Homo sapien
cggtgctacgtcgactacagggaca

SEQ ID NO: 179137 - DNA, 25 bp, Homo sapien
ctacgtcgactacagggacagtgtc

SEQ ID NO: 179138 - DNA, 25 bp, Homo sapien
tacagggacagtgtcggcaggaact

SEQ ID NO: 179139 - DNA, 25 bp, Homo sapien
agctgggagctctacagcagtgctg

SEQ ID NO: 179140 - DNA, 25 bp, Homo sapien
ggtctcatctggatcccgccacctg

SEQ ID NO: 179141 - DNA, 25 bp, Homo sapien
acctggacgctgagggcctgtcgac

SEQ ID NO: 179142 - DNA, 25 bp, Homo sapien
cagcctcctgccggttttcccaccg

SEQ ID NO: 179143 - DNA, 25 bp, Homo sapien
tcccaccggtggctcccgccactgg

SEQ ID NO: 179144 - DNA, 25 bp, Homo sapien
ccgccggctgctacccgcgctccgt

SEQ ID NO: 179145 - DNA, 25 bp, Homo sapien
atggcaggcggtgtccaaaagcctc

SEQ ID NO: 179146 - DNA, 25 bp, Homo sapien
tggcaggcggtgtccaaaagcctct

SEQ ID NO: 179147 - DNA, 25 bp, Homo sapien
gcaggcggtgtccaaaagcctctga

SEQ ID NO: 179148 - DNA, 25 bp, Homo sapien
gcgcgagtcgctgaccgaccgggag

SEQ ID NO: 179149 - DNA, 25 bp, Homo sapien
gccgccgttagctcacccgcccggc

SEQ ID NO: 179150 - DNA, 25 bp, Homo sapien
ctcgccaaggcaatgcggagccatg

SEQ ID NO: 179151 - DNA, 25 bp, Homo sapien
cgaggcctccttgggtactccaaga

SEQ ID NO: 179152 - DNA, 25 bp, Homo sapien
gcctttgtctagacacggcagtaaa

SEQ ID NO: 179153 - DNA, 25 bp, Homo sapien
cgcccgactgtcacggggacattaa

SEQ ID NO: 179154 - DNA, 25 bp, Homo sapien
gggagtaagcctgtcagtgactttg

SEQ ID NO: 179155 - DNA, 25 bp, Homo sapien
cgggcctccattgtcacccaggtgt

SEQ ID NO: 179156 - DNA, 25 bp, Homo sapien
ggggactccgacagcacggccatga

SEQ ID NO: 179157 - DNA, 25 bp, Homo sapien
ttcccgagattcgagggcagccaca

SEQ ID NO: 179158 - DNA, 25 bp, Homo sapien
agcccggctccacattcggctcttc

SEQ ID NO: 179159 - DNA, 25 bp, Homo sapien
ctgcggtgtccataaggacctcggc

SEQ ID NO: 179160 - DNA, 25 bp, Homo sapien
caggctgctccggaagtgaacgctg

SEQ ID NO: 179161 - DNA, 25 bp, Homo sapien
gactcaggctgctccggaagtgaac

SEQ ID NO: 179162 - DNA, 25 bp, Homo sapien
cgccgccactggacggaagctggca

SEQ ID NO: 179163 - DNA, 25 bp, Homo sapien
acgccgatggaagggatgtgcacct

SEQ ID NO: 179164 - DNA, 25 bp, Homo sapien
gtgtccataaggacctcggcagcca

SEQ ID NO: 179165 - DNA, 25 bp, Homo sapien
cgagaggccagccacgccgatggaa

SEQ ID NO: 179166 - DNA, 25 bp, Homo sapien
gaccatagtgaagacccgcaggccc

SEQ ID NO: 179167 - DNA, 25 bp, Homo sapien
atgcagcatcccgtgggtccattcg

SEQ ID NO: 179168 - DNA, 25 bp, Homo sapien
cgtgggtccattcgcgaccatagtg

SEQ ID NO: 179169 - DNA, 25 bp, Homo sapien
agcatcggatgctgccggcagaagt

SEQ ID NO: 179170 - DNA, 25 bp, Homo sapien
cgttcgatgctgctgtcggccacac

SEQ ID NO: 179171 - DNA, 25 bp, Homo sapien
cgcgtgtgaaacgtccgagtgcgct

SEQ ID NO: 179172 - DNA, 25 bp, Homo sapien
aagctcgtgcgcctcatgcagcatc

SEQ ID NO: 179173 - DNA, 25 bp, Homo sapien
gatcacagtgctggacacggaccgg

SEQ ID NO: 179174 - DNA, 25 bp, Homo sapien
gagaggccaaggcgtacgctctccg

SEQ ID NO: 179175 - DNA, 25 bp, Homo sapien
tgtcgtggggcagcaactgtgacct

SEQ ID NO: 179176 - DNA, 25 bp, Homo sapien
caggtgtcctcgggacgtggtccac

SEQ ID NO: 179177 - DNA, 25 bp, Homo sapien
tggggcagcaactgtgacctctgcc

SEQ ID NO: 179178 - DNA, 25 bp, Homo sapien
tggtccacgcggtgctgacacgagc

SEQ ID NO: 179179 - DNA, 25 bp, Homo sapien
gcagacccggacatgccgccagaga

SEQ ID NO: 179180 - DNA, 25 bp, Homo sapien
agacccggacatgccgccagagagg

SEQ ID NO: 179181 - DNA, 25 bp, Homo sapien
cggtgctgacacgagctggccctga

SEQ ID NO: 179182 - DNA, 25 bp, Homo sapien
tgactcggctgtgtggggtgccggg

SEQ ID NO: 179183 - DNA, 25 bp, Homo sapien
gcggccggtcgggagcagtcggtcg

SEQ ID NO: 179184 - DNA, 25 bp, Homo sapien
ccaggcagtggcgaatccctgagct

SEQ ID NO: 179185 - DNA, 25 bp, Homo sapien
gcagtggcgaatccctgagctgcca

SEQ ID NO: 179186 - DNA, 25 bp, Homo sapien
agtggcgaatccctgagctgccagg

SEQ ID NO: 179187 - DNA, 25 bp, Homo sapien
gtggcgaatccctgagctgccagga

SEQ ID NO: 179188 - DNA, 25 bp, Homo sapien
aggcagtggcgaatccctgagctgc

SEQ ID NO: 179189 - DNA, 25 bp, Homo sapien
agcccaggcagtggcgaatccctga

SEQ ID NO: 179190 - DNA, 25 bp, Homo sapien
cccgccagcgatgctggccctggag

SEQ ID NO: 179191 - DNA, 25 bp, Homo sapien
ctgctgcagcggagtcctggaaagc

SEQ ID NO: 179192 - DNA, 25 bp, Homo sapien
tcctggaaagcgtgggcgtgaatgg

SEQ ID NO: 179193 - DNA, 25 bp, Homo sapien
atggaagatgccctggccatggggc

SEQ ID NO: 179194 - DNA, 25 bp, Homo sapien
gagagatcccgccagcgatgctggc

SEQ ID NO: 179195 - DNA, 25 bp, Homo sapien
agagatcccgccagcgatgctggcc

SEQ ID NO: 179196 - DNA, 25 bp, Homo sapien
gcgtgaatggaagatgccctggcca

SEQ ID NO: 179197 - DNA, 25 bp, Homo sapien
tgaatggaagatgccctggccatgg

SEQ ID NO: 179198 - DNA, 25 bp, Homo sapien
acaccggagggctgtgtgaggccca

SEQ ID NO: 179199 - DNA, 25 bp, Homo sapien
cgcccctcttctctggcctccgtgg

SEQ ID NO: 179200 - DNA, 25 bp, Homo sapien
ccctctcgggttggaatctgtggta

SEQ ID NO: 179201 - DNA, 25 bp, Homo sapien
tctcgggttggaatctgtggtacac

SEQ ID NO: 179202 - DNA, 25 bp, Homo sapien
ctcgggttggaatctgtggtacacc

SEQ ID NO: 179203 - DNA, 25 bp, Homo sapien
aatctgtggtacaccggagggctgt

SEQ ID NO: 179204 - DNA, 25 bp, Homo sapien
gagggctgtgtgaggcccacccgcc

SEQ ID NO: 179205 - DNA, 25 bp, Homo sapien
tcgggttggaatctgtggtacaccg

SEQ ID NO: 179206 - DNA, 25 bp, Homo sapien
ctcctttctggtggagtggttcaca

SEQ ID NO: 179207 - DNA, 25 bp, Homo sapien
gtgccaggtccaccaccagacaggt

SEQ ID NO: 179208 - DNA, 25 bp, Homo sapien
ggttaacgtgccattgcgctgcttc

SEQ ID NO: 179209 - DNA, 25 bp, Homo sapien
tgggtcaccctgcactggtaggtct

SEQ ID NO: 179210 - DNA, 25 bp, Homo sapien
tccggcgtcgcaaacgcatagactt

SEQ ID NO: 179211 - DNA, 25 bp, Homo sapien
caggcatgaagttctggatcaggca

SEQ ID NO: 179212 - DNA, 25 bp, Homo sapien
tgcaccgagatgtcctcaggcatga

SEQ ID NO: 179213 - DNA, 25 bp, Homo sapien
gggatttacagacaccgctcgctgg

SEQ ID NO: 179214 - DNA, 25 bp, Homo sapien
ccaccgtggagctcatctgagagtt

SEQ ID NO: 179215 - DNA, 25 bp, Homo sapien
ccggcaagaaaggtcggcgccagcc

SEQ ID NO: 179216 - DNA, 25 bp, Homo sapien
tcaccgcccgggctttactgaagcg

SEQ ID NO: 179217 - DNA, 25 bp, Homo sapien
tactgaagcggagtctagcatgtgc

SEQ ID NO: 179218 - DNA, 25 bp, Homo sapien
tgacactgggcgacacacgctgagc

SEQ ID NO: 179219 - DNA, 25 bp, Homo sapien
ggtagcatcccagatccagcacgtt

SEQ ID NO: 179220 - DNA, 25 bp, Homo sapien
agttgtaaggtacgggactgcctcg

SEQ ID NO: 179221 - DNA, 25 bp, Homo sapien
tagcatgtgcggctgctccacagcg

SEQ ID NO: 179222 - DNA, 25 bp, Homo sapien
cagcgtctacactgggtccgggaac

SEQ ID NO: 179223 - DNA, 25 bp, Homo sapien
tgggtacagcgtctacactgggtcc

SEQ ID NO: 179224 - DNA, 25 bp, Homo sapien
tgcagcgtctacactgggtccggga

SEQ ID NO: 179225 - DNA, 25 bp, Homo sapien
gcagcgtctacactgggtccgggaa

SEQ ID NO: 179226 - DNA, 25 bp, Homo sapien
ccgtgtgggtgcagcgtctacactg

SEQ ID NO: 179227 - DNA, 25 bp, Homo sapien
tgcgtgcagcgtctacactgggtcc

SEQ ID NO: 179228 - DNA, 25 bp, Homo sapien
tgggtgcagcgtctacactgggtcc

SEQ ID NO: 179229 - DNA, 25 bp, Homo sapien
acagcgtctacactgggtccgggaa

SEQ ID NO: 179230 - DNA, 25 bp, Homo sapien
acttccattgcgtgacgggcaaggg

SEQ ID NO: 179231 - DNA, 25 bp, Homo sapien
agggaactgttctgctacgtaggaa

SEQ ID NO: 179232 - DNA, 25 bp, Homo sapien
acgaacttccattgcgtgacgggca

SEQ ID NO: 179233 - DNA, 25 bp, Homo sapien
tttcccaggactaggggcactccgc

SEQ ID NO: 179234 - DNA, 25 bp, Homo sapien
aggggcactccgcactggaccctag

SEQ ID NO: 179235 - DNA, 25 bp, Homo sapien
ctggaccctagtcctggcgcgggat

SEQ ID NO: 179236 - DNA, 25 bp, Homo sapien
cgcggcgagggaactgttctgctac

SEQ ID NO: 179237 - DNA, 25 bp, Homo sapien
gaactgttctgctacgtaggaaacc

SEQ ID NO: 179238 - DNA, 25 bp, Homo sapien
tggcagctcagggattcgccactgc

SEQ ID NO: 179239 - DNA, 25 bp, Homo sapien
tcctcctggcagctcagggattcgc

SEQ ID NO: 179240 - DNA, 25 bp, Homo sapien
cgaccgactgctcccgaccggccgc

SEQ ID NO: 179241 - DNA, 25 bp, Homo sapien
cctggcagctcagggattcgccact

SEQ ID NO: 179242 - DNA, 25 bp, Homo sapien
cagggattcgccactgcctgggctc

SEQ ID NO: 179243 - DNA, 25 bp, Homo sapien
agctcagggattcgccactgcctgg

SEQ ID NO: 179244 - DNA, 25 bp, Homo sapien
tcagggattcgccactgcctgggct

SEQ ID NO: 179245 - DNA, 25 bp, Homo sapien
ctcctggcagctcagggattcgcca

SEQ ID NO: 179246 - DNA, 25 bp, Homo sapien
gcgctctgctggctctgcccaaccc

SEQ ID NO: 179247 - DNA, 25 bp, Homo sapien
gaagagtgcggcgaagatgcagagg

SEQ ID NO: 179248 - DNA, 25 bp, Homo sapien
cgctgtagctcacgctgagcaggaa

SEQ ID NO: 179249 - DNA, 25 bp, Homo sapien
gtgcccaccatgaggagcgtgatgg

SEQ ID NO: 179250 - DNA, 25 bp, Homo sapien
tcccctgccgcgtggctgagaggaa

SEQ ID NO: 179251 - DNA, 25 bp, Homo sapien
ggcgaagatgcagaggccggtccac

SEQ ID NO: 179252 - DNA, 25 bp, Homo sapien
acgttggtgtagtcgagggaggtct

SEQ ID NO: 179253 - DNA, 25 bp, Homo sapien
ggctgagaggaaccgctgcacctga

SEQ ID NO: 179254 - DNA, 25 bp, Homo sapien
gtacacggggtacgtgccaagcatc

SEQ ID NO: 179255 - DNA, 25 bp, Homo sapien
tccacggtgagcttgctgtagagga

SEQ ID NO: 179256 - DNA, 25 bp, Homo sapien
tgccacctgctcttgtccacggtga

SEQ ID NO: 179257 - DNA, 25 bp, Homo sapien
agagcctcatgcatcacggagcatg

SEQ ID NO: 179258 - DNA, 25 bp, Homo sapien
aagcggttgtgcagagcctcatgca

SEQ ID NO: 179259 - DNA, 25 bp, Homo sapien
tcgcactcatttacccggagacagg

SEQ ID NO: 179260 - DNA, 25 bp, Homo sapien
gtacgtgccaagcatcctcgcgcga

SEQ ID NO: 179261 - DNA, 25 bp, Homo sapien
tgtagttgttctccggctgcccgct

SEQ ID NO: 179262 - DNA, 25 bp, Homo sapien
tagtgcctgtatgagagagaccctc

SEQ ID NO: 179263 - DNA, 25 bp, Homo sapien
cgtgacgggcttagtgcctgtatga

SEQ ID NO: 179264 - DNA, 25 bp, Homo sapien
gcctgtatgagagagaccctcgtga

SEQ ID NO: 179265 - DNA, 25 bp, Homo sapien
ctcgtgacgggcttagtgcctgtat

SEQ ID NO: 179266 - DNA, 25 bp, Homo sapien
cttagtgcctgtatgagagagaccc

SEQ ID NO: 179267 - DNA, 25 bp, Homo sapien
agtgcctgtatgagagagaccctcg

SEQ ID NO: 179268 - DNA, 25 bp, Homo sapien
tgacgggcttagtgcctgtatgaga

SEQ ID NO: 179269 - DNA, 25 bp, Homo sapien
tgcctgtatgagagagaccctcgtg

SEQ ID NO: 179270 - DNA, 25 bp, Homo sapien
agacgctcactttgggaggcagctc

SEQ ID NO: 179271 - DNA, 25 bp, Homo sapien
agggacacgtgtcagcccggtgccc

SEQ ID NO: 179272 - DNA, 25 bp, Homo sapien
ggcagctcggcaatcactgcagtga

SEQ ID NO: 179273 - DNA, 25 bp, Homo sapien
gacacctgaatctgccggggactga

SEQ ID NO: 179274 - DNA, 25 bp, Homo sapien
gcctggcagatgagcttggacttgc

SEQ ID NO: 179275 - DNA, 25 bp, Homo sapien
aatctgccggggactgaaacccgtg

SEQ ID NO: 179276 - DNA, 25 bp, Homo sapien
tcgcgcagccaggacacctgaatct

SEQ ID NO: 179277 - DNA, 25 bp, Homo sapien
actgcagtgagggacacgtgtcagc

SEQ ID NO: 179278 - DNA, 25 bp, Homo sapien
gtggcccacgcactgtttaggacgc

SEQ ID NO: 179279 - DNA, 25 bp, Homo sapien
acgcactgtttaggacgcggccttt

SEQ ID NO: 179280 - DNA, 25 bp, Homo sapien
aggacgcggcctttagagcctgctc

SEQ ID NO: 179281 - DNA, 25 bp, Homo sapien
cccacgcactgtttaggacgcggcc

SEQ ID NO: 179282 - DNA, 25 bp, Homo sapien
cacgcactgtttaggacgcggcctt

SEQ ID NO: 179283 - DNA, 25 bp, Homo sapien
gacgcggcctttagagcctgctccg

SEQ ID NO: 179284 - DNA, 25 bp, Homo sapien
tggcccacgcactgtttaggacgcg

SEQ ID NO: 179285 - DNA, 25 bp, Homo sapien
gcccacgcactgtttaggacgcggc

SEQ ID NO: 179286 - DNA, 25 bp, Homo sapien
tcttcatccctgtgggttagagaca

SEQ ID NO: 179287 - DNA, 25 bp, Homo sapien
tcatccctgtgggttagagacacac

SEQ ID NO: 179288 - DNA, 25 bp, Homo sapien
ctctgtgggttacagacacacagac

SEQ ID NO: 179289 - DNA, 25 bp, Homo sapien
tcttcatctctgtgggttacagaca

SEQ ID NO: 179290 - DNA, 25 bp, Homo sapien
acacaccgcggcgtcttcatctctg

SEQ ID NO: 179291 - DNA, 25 bp, Homo sapien
cttcatctctgtgggttacagacac

SEQ ID NO: 179292 - DNA, 25 bp, Homo sapien
catccctgtgggttagagacacaca

SEQ ID NO: 179293 - DNA, 25 bp, Homo sapien
ccctgtgggttagagacacacagac

SEQ ID NO: 179294 - DNA, 25 bp, Homo sapien
cagatctttttgtttcacggccctc

SEQ ID NO: 179295 - DNA, 25 bp, Homo sapien
tgtctccgcctgtcgaatattctcg

SEQ ID NO: 179296 - DNA, 25 bp, Homo sapien
catgagcgcagtggttgttacacta

SEQ ID NO: 179297 - DNA, 25 bp, Homo sapien
taccctgtagttgccgcaccctgag

SEQ ID NO: 179298 - DNA, 25 bp, Homo sapien
cggccctctcgtagacctaataagc

SEQ ID NO: 179299 - DNA, 25 bp, Homo sapien
cgggctcgcagcacgtaacagaaca

SEQ ID NO: 179300 - DNA, 25 bp, Homo sapien
gaagacgcttctctcgcagaaatgc

SEQ ID NO: 179301 - DNA, 25 bp, Homo sapien
gcaaggttgcgattttcggagcaca

SEQ ID NO: 179302 - DNA, 25 bp, Homo sapien
gtctgatccatgcagatggccaggc

SEQ ID NO: 179303 - DNA, 25 bp, Homo sapien
cctgggcacggaagtcggtgcggat

SEQ ID NO: 179304 - DNA, 25 bp, Homo sapien
tctgtgcctgggcacggaagtcggt

SEQ ID NO: 179305 - DNA, 25 bp, Homo sapien
tctgatccatgcagatggccaggct

SEQ ID NO: 179306 - DNA, 25 bp, Homo sapien
aaacgtggacaagcagatgcagaag

SEQ ID NO: 179307 - DNA, 25 bp, Homo sapien
ggtctgatccatgcagatggccagg

SEQ ID NO: 179308 - DNA, 25 bp, Homo sapien
cgtggacaagcagatgcagaagggc

SEQ ID NO: 179309 - DNA, 25 bp, Homo sapien
aacgtggacaagcagatgcagaagg

SEQ ID NO: 179310 - DNA, 25 bp, Homo sapien
gaggggcgagccctacaggcaactt

SEQ ID NO: 179311 - DNA, 25 bp, Homo sapien
cttggagaaggaattctgaagaagc

SEQ ID NO: 179312 - DNA, 25 bp, Homo sapien
acatagacccagactttcttggaga

SEQ ID NO: 179313 - DNA, 25 bp, Homo sapien
cctacaggcaacttgaacggagagc

SEQ ID NO: 179314 - DNA, 25 bp, Homo sapien
gagccctacaggcaacttgaacgga

SEQ ID NO: 179315 - DNA, 25 bp, Homo sapien
gagaaggaattctgaagaagcaaaa

SEQ ID NO: 179316 - DNA, 25 bp, Homo sapien
gggcgagccctacaggcaacttgaa

SEQ ID NO: 179317 - DNA, 25 bp, Homo sapien
tagacccagactttcttggagaagg

SEQ ID NO: 179318 - DNA, 25 bp, Homo sapien
gcagccggaagtcggtctcccgccg

SEQ ID NO: 179319 - DNA, 25 bp, Homo sapien
tcttcctctgctccgcactggccgt

SEQ ID NO: 179320 - DNA, 25 bp, Homo sapien
tcctctgctccgcactggccgtcga

SEQ ID NO: 179321 - DNA, 25 bp, Homo sapien
tctgctccgcactggccgtcgactc

SEQ ID NO: 179322 - DNA, 25 bp, Homo sapien
tccgcactggccgtcgactcctgca

SEQ ID NO: 179323 - DNA, 25 bp, Homo sapien
cgcactggccgtcgactcctgcagc

SEQ ID NO: 179324 - DNA, 25 bp, Homo sapien
cgtgggcagccggaagtcggtctcc

SEQ ID NO: 179325 - DNA, 25 bp, Homo sapien
cactggccgtcgactcctgcagcgc

SEQ ID NO: 179326 - DNA, 25 bp, Homo sapien
gcgcccatcctggagaactgcatct

SEQ ID NO: 179327 - DNA, 25 bp, Homo sapien
gcggctcagtggaggcgcagcagcc

SEQ ID NO: 179328 - DNA, 25 bp, Homo sapien
gcccatcctggagaactgcatctgc

SEQ ID NO: 179329 - DNA, 25 bp, Homo sapien
catcctggagaactgcatctgcgca

SEQ ID NO: 179330 - DNA, 25 bp, Homo sapien
ctggagaactgcatctgcgcaggcc

SEQ ID NO: 179331 - DNA, 25 bp, Homo sapien
ggagaactgcatctgcgcaggccca

SEQ ID NO: 179332 - DNA, 25 bp, Homo sapien
caggcgagccaggatggcgcctcct

SEQ ID NO: 179333 - DNA, 25 bp, Homo sapien
gcagcagctgctccaagttcgaacc

SEQ ID NO: 179334 - DNA, 25 bp, Homo sapien
gtgtcccggtagctcagcgcggact

SEQ ID NO: 179335 - DNA, 25 bp, Homo sapien
tgtcccggtagctcagcgcggactt

SEQ ID NO: 179336 - DNA, 25 bp, Homo sapien
gtcccggtagctcagcgcggacttc

SEQ ID NO: 179337 - DNA, 25 bp, Homo sapien
cgcggaggccggcgagatcctgtct

SEQ ID NO: 179338 - DNA, 25 bp, Homo sapien
gcggaggccggcgagatcctgtctg

SEQ ID NO: 179339 - DNA, 25 bp, Homo sapien
cggaggccggcgagatcctgtctgg

SEQ ID NO: 179340 - DNA, 25 bp, Homo sapien
cgagatcctgtctgggagagaccgc

SEQ ID NO: 179341 - DNA, 25 bp, Homo sapien
gagatcctgtctgggagagaccgcc

SEQ ID NO: 179342 - DNA, 25 bp, Homo sapien
ctttgaggtcaaggctcctcggtgg

SEQ ID NO: 179343 - DNA, 25 bp, Homo sapien
cgactcatctgaggctcagggcgga

SEQ ID NO: 179344 - DNA, 25 bp, Homo sapien
gcggagggtccagtgaactgacctt

SEQ ID NO: 179345 - DNA, 25 bp, Homo sapien
agggtccagtgaactgaccttgccc

SEQ ID NO: 179346 - DNA, 25 bp, Homo sapien
tggcggccacagcaaaggctccagt

SEQ ID NO: 179347 - DNA, 25 bp, Homo sapien
ctttatgtggtacagggttgggcct

SEQ ID NO: 179348 - DNA, 25 bp, Homo sapien
acttcctttatgtggtacagggttg

SEQ ID NO: 179349 - DNA, 25 bp, Homo sapien
aggctccagtgtccgccgcagggca

SEQ ID NO: 179350 - DNA, 25 bp, Homo sapien
cccggattctcgggattattactcg

SEQ ID NO: 179351 - DNA, 25 bp, Homo sapien
gctccatgcccggattctcgggatt

SEQ ID NO: 179352 - DNA, 25 bp, Homo sapien
ctccatgcccggattctcgggatta

SEQ ID NO: 179353 - DNA, 25 bp, Homo sapien
ccatgcccggattctcgggattatt

SEQ ID NO: 179354 - DNA, 25 bp, Homo sapien
catgcccggattctcgggattatta

SEQ ID NO: 179355 - DNA, 25 bp, Homo sapien
atgcccggattctcgggattattac

SEQ ID NO: 179356 - DNA, 25 bp, Homo sapien
tgcccggattctcgggattattact

SEQ ID NO: 179357 - DNA, 25 bp, Homo sapien
atggggctccatgcccggattctcg

SEQ ID NO: 179358 - DNA, 25 bp, Homo sapien
tttcatcgtccgtcccgttgacact

SEQ ID NO: 179359 - DNA, 25 bp, Homo sapien
ttgtggttcccagactgcaggtgcg

SEQ ID NO: 179360 - DNA, 25 bp, Homo sapien
cccgttgacactggatgccggagta

SEQ ID NO: 179361 - DNA, 25 bp, Homo sapien
ggcctttcatcgtccgtcccgttga

SEQ ID NO: 179362 - DNA, 25 bp, Homo sapien
ctgagaggcctttcatcgtccgtcc

SEQ ID NO: 179363 - DNA, 25 bp, Homo sapien
ctgcagcggcctgagaggcctttca

SEQ ID NO: 179364 - DNA, 25 bp, Homo sapien
ggttcccagactgcaggtgcgtgtc

SEQ ID NO: 179365 - DNA, 25 bp, Homo sapien
cgttgacactggatgccggagtaga

SEQ ID NO: 179366 - DNA, 25 bp, Homo sapien
tcgtcatcagctctgcccgggcctc

SEQ ID NO: 179367 - DNA, 25 bp, Homo sapien
ctacgggccggggtcgtcatcagct

SEQ ID NO: 179368 - DNA, 25 bp, Homo sapien
agccgcatgtcagggtgaccatgga

SEQ ID NO: 179369 - DNA, 25 bp, Homo sapien
aggttctgtgcaggctgcttgggcc

SEQ ID NO: 179370 - DNA, 25 bp, Homo sapien
ctgggccttgggaggttctgtgcag

SEQ ID NO: 179371 - DNA, 25 bp, Homo sapien
ggcagcggagcagccgctgtgccca

SEQ ID NO: 179372 - DNA, 25 bp, Homo sapien
atggaggccgccactcccgactacg

SEQ ID NO: 179373 - DNA, 25 bp, Homo sapien
cgcctccttgaaaacccgggcagcg

SEQ ID NO: 179374 - DNA, 25 bp, Homo sapien
tggacatgtccattttggaagaaac

SEQ ID NO: 179375 - DNA, 25 bp, Homo sapien
gaaacagctccttacacctccggtg

SEQ ID NO: 179376 - DNA, 25 bp, Homo sapien
ccatctgaatgggaaacagctcctt

SEQ ID NO: 179377 - DNA, 25 bp, Homo sapien
gagcttgacaccctccatctgaatg

SEQ ID NO: 179378 - DNA, 25 bp, Homo sapien
tacacctccggtggcactcctggaa

SEQ ID NO: 179379 - DNA, 25 bp, Homo sapien
tggttcacctggaaacggttactca

SEQ ID NO: 179380 - DNA, 25 bp, Homo sapien
gccagcatggtgtatcttttggaca

SEQ ID NO: 179381 - DNA, 25 bp, Homo sapien
ccctttgttgactgtgagcttgaca

SEQ ID NO: 179382 - DNA, 25 bp, Homo sapien
ttgcagaatgaaatcggcgcctttc

SEQ ID NO: 179383 - DNA, 25 bp, Homo sapien
attcgtccttatttcccgacacacg

SEQ ID NO: 179384 - DNA, 25 bp, Homo sapien
ctgtgcctgcaaccattcgtcctta

SEQ ID NO: 179385 - DNA, 25 bp, Homo sapien
aacgcaggttccagaaactgtgcct

SEQ ID NO: 179386 - DNA, 25 bp, Homo sapien
ttttccaaatacgagcaaaggaggc

SEQ ID NO: 179387 - DNA, 25 bp, Homo sapien
agcctcgcttcaaagttctgtattg

SEQ ID NO: 179388 - DNA, 25 bp, Homo sapien
cgcggccctgaaagtcgcactctga

SEQ ID NO: 179389 - DNA, 25 bp, Homo sapien
caaaggaggcacaaaacgcaggttc

SEQ ID NO: 179390 - DNA, 25 bp, Homo sapien
cacaaggcgcggctacgaggccact

SEQ ID NO: 179391 - DNA, 25 bp, Homo sapien
acaaggcgcggctacgaggccactg

SEQ ID NO: 179392 - DNA, 25 bp, Homo sapien
caaggcgcggctacgaggccactgt

SEQ ID NO: 179393 - DNA, 25 bp, Homo sapien
ccatgcacaaggcgcggctacgagg

SEQ ID NO: 179394 - DNA, 25 bp, Homo sapien
aggcgcggctacgaggccactgtgc

SEQ ID NO: 179395 - DNA, 25 bp, Homo sapien
gcgcggctacgaggccactgtgccc

SEQ ID NO: 179396 - DNA, 25 bp, Homo sapien
gcggctacgaggccactgtgcccgg

SEQ ID NO: 179397 - DNA, 25 bp, Homo sapien
tccatgcacaaggcgcggctacgag

SEQ ID NO: 179398 - DNA, 25 bp, Homo sapien
gggagcatcccagacccagcgcgtt

SEQ ID NO: 179399 - DNA, 25 bp, Homo sapien
tggtgcatcccagcccggtgtctca

SEQ ID NO: 179400 - DNA, 25 bp, Homo sapien
ctgcattccagtccgggcatcgctg

SEQ ID NO: 179401 - DNA, 25 bp, Homo sapien
tgctgaagccgggtctagcatgtgc

SEQ ID NO: 179402 - DNA, 25 bp, Homo sapien
aggtgcagttccctggcgctccctg

SEQ ID NO: 179403 - DNA, 25 bp, Homo sapien
tgaccgctgcgtggcttaacaccct

SEQ ID NO: 179404 - DNA, 25 bp, Homo sapien
gagctcacccgcgagttgcaaggta

SEQ ID NO: 179405 - DNA, 25 bp, Homo sapien
gaagcgtccagtctcccatccggag

SEQ ID NO: 179406 - DNA, 25 bp, Homo sapien
atgcagagaaccgtgcagccgcctc

SEQ ID NO: 179407 - DNA, 25 bp, Homo sapien
tgtgtccagtggacccgcacccaga

SEQ ID NO: 179408 - DNA, 25 bp, Homo sapien
ccagctgaccgttgctccagtcagg

SEQ ID NO: 179409 - DNA, 25 bp, Homo sapien
cacgcagtctgtttcggtccagagc

SEQ ID NO: 179410 - DNA, 25 bp, Homo sapien
acagacatcgagaccagcgccgcgt

SEQ ID NO: 179411 - DNA, 25 bp, Homo sapien
ccggtcacagcgagccttgtagaga

SEQ ID NO: 179412 - DNA, 25 bp, Homo sapien
cagaaggcgctctggtaacgatgca

SEQ ID NO: 179413 - DNA, 25 bp, Homo sapien
agccttgtagagatcgcgctcccgg

SEQ ID NO: 179414 - DNA, 25 bp, Homo sapien
cggaggaaagctagtgccagcccta

SEQ ID NO: 179415 - DNA, 25 bp, Homo sapien
ggcgactgctgtgggtccagcctcc

SEQ ID NO: 179416 - DNA, 25 bp, Homo sapien
caggtttcccatcctaggcggaggc

SEQ ID NO: 179417 - DNA, 25 bp, Homo sapien
attgtaccgccctggcctgcggtga

SEQ ID NO: 179418 - DNA, 25 bp, Homo sapien
cccaggtgccatggccgcattgtac

SEQ ID NO: 179419 - DNA, 25 bp, Homo sapien
aagctagtgccagccctaccaggtt

SEQ ID NO: 179420 - DNA, 25 bp, Homo sapien
tcctccaatgggagagatgggtttg

SEQ ID NO: 179421 - DNA, 25 bp, Homo sapien
gaagagtggacccagtcctccaatg

SEQ ID NO: 179422 - DNA, 25 bp, Homo sapien
gcctagttcggctgtctctgattca

SEQ ID NO: 179423 - DNA, 25 bp, Homo sapien
ctagcgaaggtctgcaaatcccgga

SEQ ID NO: 179424 - DNA, 25 bp, Homo sapien
cagcggaaccggaaaagctttgaca

SEQ ID NO: 179425 - DNA, 25 bp, Homo sapien
acgcgtgtattagggaacgtctgca

SEQ ID NO: 179426 - DNA, 25 bp, Homo sapien
ggcccttgggcactgtctgaaaagt

SEQ ID NO: 179427 - DNA, 25 bp, Homo sapien
tcaggaagctggcagttcccactta

SEQ ID NO: 179428 - DNA, 25 bp, Homo sapien
taacagccctccttgggtgtgcact

SEQ ID NO: 179429 - DNA, 25 bp, Homo sapien
cggcagtcggtgtaaacaaggcctc

SEQ ID NO: 179430 - DNA, 25 bp, Homo sapien
ggcgcgtggcagtaactgccagaca

SEQ ID NO: 179431 - DNA, 25 bp, Homo sapien
acacctgagccgactggtagtaggg

SEQ ID NO: 179432 - DNA, 25 bp, Homo sapien
tgctcatcgaggacctgactggctc

SEQ ID NO: 179433 - DNA, 25 bp, Homo sapien
gaggacctgactggctcctgcttcg

SEQ ID NO: 179434 - DNA, 25 bp, Homo sapien
gactggctcctgcttcgagccactg

SEQ ID NO: 179435 - DNA, 25 bp, Homo sapien
aactgccagacacctgagccgactg

SEQ ID NO: 179436 - DNA, 25 bp, Homo sapien
gccggccaccagtggcgaggctaca

SEQ ID NO: 179437 - DNA, 25 bp, Homo sapien
cccagggtctgctgctccacgagct

SEQ ID NO: 179438 - DNA, 25 bp, Homo sapien
gcgagcgccctaccgctttcgcttt

SEQ ID NO: 179439 - DNA, 25 bp, Homo sapien
cgcggggtctagaaagggcccactg

SEQ ID NO: 179440 - DNA, 25 bp, Homo sapien
cggtcatggccatgctcagggtcca

SEQ ID NO: 179441 - DNA, 25 bp, Homo sapien
actccactccttgtgcggcgctagg

SEQ ID NO: 179442 - DNA, 25 bp, Homo sapien
gagcctggaagctggccctcgcgag

SEQ ID NO: 179443 - DNA, 25 bp, Homo sapien
agctgggtgcgagcgccctaccgct

SEQ ID NO: 179444 - DNA, 25 bp, Homo sapien
cgtcccggtcatggccatgctcagg

SEQ ID NO: 179445 - DNA, 25 bp, Homo sapien
tgaagagcgcctgtgcgcgctaggc

SEQ ID NO: 179446 - DNA, 25 bp, Homo sapien
tgcctgttacctgtgttgcccacta

SEQ ID NO: 179447 - DNA, 25 bp, Homo sapien
cccgcactcttattggctaggttcc

SEQ ID NO: 179448 - DNA, 25 bp, Homo sapien
gctggcgccaaaaacagcccgttga

SEQ ID NO: 179449 - DNA, 25 bp, Homo sapien
acatcttcacgtaggccagggccga

SEQ ID NO: 179450 - DNA, 25 bp, Homo sapien
ctctcacttcggttcggcgacaacg

SEQ ID NO: 179451 - DNA, 25 bp, Homo sapien
tgggagacagaccaaactgcagctc

SEQ ID NO: 179452 - DNA, 25 bp, Homo sapien
cacgtggtgctccttgatagggcta

SEQ ID NO: 179453 - DNA, 25 bp, Homo sapien
cccaaggatggatcgctatcccgta

SEQ ID NO: 179454 - DNA, 25 bp, Homo sapien
agccatttgccttctcattggttgg

SEQ ID NO: 179455 - DNA, 25 bp, Homo sapien
tcctccgaaattgggtcgcagtccc

SEQ ID NO: 179456 - DNA, 25 bp, Homo sapien
aggcgttttccctggagcagctccg

SEQ ID NO: 179457 - DNA, 25 bp, Homo sapien
acttcctgttctcggctaaccctgg

SEQ ID NO: 179458 - DNA, 25 bp, Homo sapien
ttgtccgctgcaacgctcatgggga

SEQ ID NO: 179459 - DNA, 25 bp, Homo sapien
agagtgaccgtggtctgagtgacct

SEQ ID NO: 179460 - DNA, 25 bp, Homo sapien
tgactcctgcctcaggatgccgggg

SEQ ID NO: 179461 - DNA, 25 bp, Homo sapien
agcgtaccggactggtccagctaga

SEQ ID NO: 179462 - DNA, 25 bp, Homo sapien
tgccaccagagaagtccaaatcctg

SEQ ID NO: 179463 - DNA, 25 bp, Homo sapien
ttaacttggctttctaggtgcaccc

SEQ ID NO: 179464 - DNA, 25 bp, Homo sapien
ggaaatcctcaattacgtgctggta

SEQ ID NO: 179465 - DNA, 25 bp, Homo sapien
ctgacttctctccaaggtgttggga

SEQ ID NO: 179466 - DNA, 25 bp, Homo sapien
cagcggtaatcagggcgcattgttc

SEQ ID NO: 179467 - DNA, 25 bp, Homo sapien
cggctgctttgccaccatctggtaa

SEQ ID NO: 179468 - DNA, 25 bp, Homo sapien
gtgccctaaagaattccgactcaga

SEQ ID NO: 179469 - DNA, 25 bp, Homo sapien
ctgcccattgttcgttgcctcatta

SEQ ID NO: 179470 - DNA, 25 bp, Homo sapien
caccgctggccgacaacttgtacga

SEQ ID NO: 179471 - DNA, 25 bp, Homo sapien
tcacgtgatggggtttaaatctccc

SEQ ID NO: 179472 - DNA, 25 bp, Homo sapien
gacccgtagtgttgtggtctggccc

SEQ ID NO: 179473 - DNA, 25 bp, Homo sapien
agctgccagtggattcgctcttttc

SEQ ID NO: 179474 - DNA, 25 bp, Homo sapien
tacacgctcgccacaaagaggaagg

SEQ ID NO: 179475 - DNA, 25 bp, Homo sapien
ttgttctttccgcagcagccaggtc

SEQ ID NO: 179476 - DNA, 25 bp, Homo sapien
aggggcgaatttggctgcactacac

SEQ ID NO: 179477 - DNA, 25 bp, Homo sapien
ctcctactggcctgaggttgagggc

SEQ ID NO: 179478 - DNA, 25 bp, Homo sapien
ccgccagcgaccatggggaacatgt

SEQ ID NO: 179479 - DNA, 25 bp, Homo sapien
caccgccagcgaccatggggaacat

SEQ ID NO: 179480 - DNA, 25 bp, Homo sapien
accgccagcgaccatggggaacatg

SEQ ID NO: 179481 - DNA, 25 bp, Homo sapien
cgccagcgaccatggggaacatgtt

SEQ ID NO: 179482 - DNA, 25 bp, Homo sapien
gccagcgaccatggggaacatgttg

SEQ ID NO: 179483 - DNA, 25 bp, Homo sapien
agcgaccatggggaacatgttggcc

SEQ ID NO: 179484 - DNA, 25 bp, Homo sapien
gagcaggcgccaccgccagcgacca

SEQ ID NO: 179485 - DNA, 25 bp, Homo sapien
ggagcaggcgccaccgccagcgacc

SEQ ID NO: 179486 - DNA, 25 bp, Homo sapien
cgcgggttgccaaggtgattcaatt

SEQ ID NO: 179487 - DNA, 25 bp, Homo sapien
gcacggccgcaaactggcggatcta

SEQ ID NO: 179488 - DNA, 25 bp, Homo sapien
cccgaagaacgatctggagctgttc

SEQ ID NO: 179489 - DNA, 25 bp, Homo sapien
ggttctgacacccacttccggagga

SEQ ID NO: 179490 - DNA, 25 bp, Homo sapien
ggctcctccacttccgttaggctga

SEQ ID NO: 179491 - DNA, 25 bp, Homo sapien
ctgagcaccggctgaatcgcggaaa

SEQ ID NO: 179492 - DNA, 25 bp, Homo sapien
gcggaaacccgactctggcaatgta

SEQ ID NO: 179493 - DNA, 25 bp, Homo sapien
cggctgactccatggcagcaactga

SEQ ID NO: 179494 - DNA, 25 bp, Homo sapien
ggacaccgctctggcttactcaaga

SEQ ID NO: 179495 - DNA, 25 bp, Homo sapien
cagtgaccgttcagagcccacgata

SEQ ID NO: 179496 - DNA, 25 bp, Homo sapien
tgccgaccgacttctacggggttgc

SEQ ID NO: 179497 - DNA, 25 bp, Homo sapien
gcggcccaggacacgtcagtcttac

SEQ ID NO: 179498 - DNA, 25 bp, Homo sapien
cggaaagctccttgcctggaacgca

SEQ ID NO: 179499 - DNA, 25 bp, Homo sapien
gccgctcgcttgctcctggaaagat

SEQ ID NO: 179500 - DNA, 25 bp, Homo sapien
gcaagggtcccaacatctgaatctc

SEQ ID NO: 179501 - DNA, 25 bp, Homo sapien
ggccagcgccaaagtgataaatatg

SEQ ID NO: 179502 - DNA, 25 bp, Homo sapien
aagagcctgccgagaccactcatcg

SEQ ID NO: 179503 - DNA, 25 bp, Homo sapien
ccggggttttccagtcagcctgtct

SEQ ID NO: 179504 - DNA, 25 bp, Homo sapien
cccgacatggtgtgccttttggcac

SEQ ID NO: 179505 - DNA, 25 bp, Homo sapien
cagacttccgccttgctcctgggag

SEQ ID NO: 179506 - DNA, 25 bp, Homo sapien
tgatgtctcatcacacagggaccag

SEQ ID NO: 179507 - DNA, 25 bp, Homo sapien
gccgcgacatcaagaggcgcaaacg

SEQ ID NO: 179508 - DNA, 25 bp, Homo sapien
ggcgcaaacgagaccaccggtgtca

SEQ ID NO: 179509 - DNA, 25 bp, Homo sapien
ggtgtcacgtgacccaagccaccag

SEQ ID NO: 179510 - DNA, 25 bp, Homo sapien
cccagaaggcttagcgggattgcac

SEQ ID NO: 179511 - DNA, 25 bp, Homo sapien
tcgccggcaactagaggaacctgtt

SEQ ID NO: 179512 - DNA, 25 bp, Homo sapien
gctggaattcgtcggctagtagttc

SEQ ID NO: 179513 - DNA, 25 bp, Homo sapien
ctgttatccagaaggcctcgccctg

SEQ ID NO: 179514 - DNA, 25 bp, Homo sapien
cctcagtgcgtgaactctgttatcc

SEQ ID NO: 179515 - DNA, 25 bp, Homo sapien
ctgcgattctgagagtccctggcga

SEQ ID NO: 179516 - DNA, 25 bp, Homo sapien
tgaggcatccagtttagcaacagca

SEQ ID NO: 179517 - DNA, 25 bp, Homo sapien
cgcgtttcggttcagtgacgtcgta

SEQ ID NO: 179518 - DNA, 25 bp, Homo sapien
atgggtgaggctttccgatcactcc

SEQ ID NO: 179519 - DNA, 25 bp, Homo sapien
cgcagagatcgcagaaactccagta

SEQ ID NO: 179520 - DNA, 25 bp, Homo sapien
cgcggaaaatgttccacgcagcgtc

SEQ ID NO: 179521 - DNA, 25 bp, Homo sapien
tctctgccggctgacatgagttggc

SEQ ID NO: 179522 - DNA, 25 bp, Homo sapien
aagctgaccgtctccagtggcactg

SEQ ID NO: 179523 - DNA, 25 bp, Homo sapien
ggtacctcgcgatctgactcggctc

SEQ ID NO: 179524 - DNA, 25 bp, Homo sapien
gggcttctggcaactccctgtcgct

SEQ ID NO: 179525 - DNA, 25 bp, Homo sapien
gcactgggtcgctcagctttaaacg

SEQ ID NO: 179526 - DNA, 25 bp, Homo sapien
tagccacctggtgtgtacgagtgcg

SEQ ID NO: 179527 - DNA, 25 bp, Homo sapien
gaaacgcctcgtacctgttagccac

SEQ ID NO: 179528 - DNA, 25 bp, Homo sapien
ccacctggtgtgtacgagtgcgcac

SEQ ID NO: 179529 - DNA, 25 bp, Homo sapien
acgcagcgcactctgcaggcttggg

SEQ ID NO: 179530 - DNA, 25 bp, Homo sapien
ggctcatcgaaacgcagcgcactct

SEQ ID NO: 179531 - DNA, 25 bp, Homo sapien
agagcggcgccacgtcccggctcat

SEQ ID NO: 179532 - DNA, 25 bp, Homo sapien
gggcgttggggaccactctgctccc

SEQ ID NO: 179533 - DNA, 25 bp, Homo sapien
gctcgctgtccggaaacgcctcgta

SEQ ID NO: 179534 - DNA, 25 bp, Homo sapien
ggcagagtcccaggccaaagttaga

SEQ ID NO: 179535 - DNA, 25 bp, Homo sapien
gtccgcgctctccacacaaggtggg

SEQ ID NO: 179536 - DNA, 25 bp, Homo sapien
agcgcgcccgcgtttctaaactttg

SEQ ID NO: 179537 - DNA, 25 bp, Homo sapien
agcccggaagctctgggatatttcc

SEQ ID NO: 179538 - DNA, 25 bp, Homo sapien
gcctggagatcctaagccctaagtg

SEQ ID NO: 179539 - DNA, 25 bp, Homo sapien
agagtcctgggctatctgaagctcc

SEQ ID NO: 179540 - DNA, 25 bp, Homo sapien
tttgtctggataaggcgcacgcttg

SEQ ID NO: 179541 - DNA, 25 bp, Homo sapien
ccgtccgcagttaaggaagcttttg

SEQ ID NO: 179542 - DNA, 25 bp, Homo sapien
gttctagcgtcaacccggtgctcta

SEQ ID NO: 179543 - DNA, 25 bp, Homo sapien
agggaccatggagctccgaactacc

SEQ ID NO: 179544 - DNA, 25 bp, Homo sapien
tgctctacgtcttcaccgctggaga

SEQ ID NO: 179545 - DNA, 25 bp, Homo sapien
gctttcgtgcttcctttcgggctga

SEQ ID NO: 179546 - DNA, 25 bp, Homo sapien
ggccttggccttcttcagttctagc

SEQ ID NO: 179547 - DNA, 25 bp, Homo sapien
gcctggagactctgaccgctttcgt

SEQ ID NO: 179548 - DNA, 25 bp, Homo sapien
acgccgctctttgtggccttcctga

SEQ ID NO: 179549 - DNA, 25 bp, Homo sapien
agtcaaccttctgcaggcggtcgca

SEQ ID NO: 179550 - DNA, 25 bp, Homo sapien
atctaatcttcgaggctgtcacggg

SEQ ID NO: 179551 - DNA, 25 bp, Homo sapien
ggtggtgctcatcatcctgaccttc

SEQ ID NO: 179552 - DNA, 25 bp, Homo sapien
gtcctgcttatcacggccatgagtc

SEQ ID NO: 179553 - DNA, 25 bp, Homo sapien
gtgtcccagaagctacgcaccaagg

SEQ ID NO: 179554 - DNA, 25 bp, Homo sapien
cgtcctcgcgtaccgcacagtagtg

SEQ ID NO: 179555 - DNA, 25 bp, Homo sapien
gccctggaaaacgaacatgagcctg

SEQ ID NO: 179556 - DNA, 25 bp, Homo sapien
ggcaccgggccttccatctaatctt

SEQ ID NO: 179557 - DNA, 25 bp, Homo sapien
gctgccctaccacgtggtgaacctg

SEQ ID NO: 179558 - DNA, 25 bp, Homo sapien
ctggccggaagtgaaccgcagagca

SEQ ID NO: 179559 - DNA, 25 bp, Homo sapien
acgccactgctgtccagtccagaga

SEQ ID NO: 179560 - DNA, 25 bp, Homo sapien
tccttagagaaaagcggacgccact

SEQ ID NO: 179561 - DNA, 25 bp, Homo sapien
ctgtcagccagtggcgacgatcacc

SEQ ID NO: 179562 - DNA, 25 bp, Homo sapien
cggccgctcgcaacagcttcagagg

SEQ ID NO: 179563 - DNA, 25 bp, Homo sapien
agtgcgcggcctcaacctgagagaa

SEQ ID NO: 179564 - DNA, 25 bp, Homo sapien
ctcgcccaagcccttcagggtaggg

SEQ ID NO: 179565 - DNA, 25 bp, Homo sapien
cccaggcagatgagacattccagcc

SEQ ID NO: 179566 - DNA, 25 bp, Homo sapien
gcgacccataccaagccggacaggg

SEQ ID NO: 179567 - DNA, 25 bp, Homo sapien
gcagcctgtgctacttgcgtgctca

SEQ ID NO: 179568 - DNA, 25 bp, Homo sapien
gctattcaaggcctggtgagggatc

SEQ ID NO: 179569 - DNA, 25 bp, Homo sapien
ccgaaggcccaagtggggctattca

SEQ ID NO: 179570 - DNA, 25 bp, Homo sapien
gcatacgccgtgaagatgacgaaga

SEQ ID NO: 179571 - DNA, 25 bp, Homo sapien
tgcccaagggcagcatggcatacgc

SEQ ID NO: 179572 - DNA, 25 bp, Homo sapien
cccgaggaccagcagatgcgagagt

SEQ ID NO: 179573 - DNA, 25 bp, Homo sapien
tgtggcccaagatacagcccgagga

SEQ ID NO: 179574 - DNA, 25 bp, Homo sapien
gccatggctttttccgcgctcccgc

SEQ ID NO: 179575 - DNA, 25 bp, Homo sapien
tgaagcggagggtggtgcaggggct

SEQ ID NO: 179576 - DNA, 25 bp, Homo sapien
catggctttttccgcgctcccgcgg

SEQ ID NO: 179577 - DNA, 25 bp, Homo sapien
ccatggctttttccgcgctcccgcg

SEQ ID NO: 179578 - DNA, 25 bp, Homo sapien
cgccatggctttttccgcgctcccg

SEQ ID NO: 179579 - DNA, 25 bp, Homo sapien
cgcggctttgcagtcgcggattttg

SEQ ID NO: 179580 - DNA, 25 bp, Homo sapien
ccgccgctaaggctttttggcgtcg

SEQ ID NO: 179581 - DNA, 25 bp, Homo sapien
tcgcgactttttaccagccgcggct

SEQ ID NO: 179582 - DNA, 25 bp, Homo sapien
tgcagtcgcggattttggcccgctc

SEQ ID NO: 179583 - DNA, 25 bp, Homo sapien
ttggcccgctctgggtttttgccac

SEQ ID NO: 179584 - DNA, 25 bp, Homo sapien
ctaaggctttttggcgtcgcgtctt

SEQ ID NO: 179585 - DNA, 25 bp, Homo sapien
cgctaaggctttttggcgtcgcgtc

SEQ ID NO: 179586 - DNA, 25 bp, Homo sapien
cgtcgcgactttttaccagccgcgg

SEQ ID NO: 179587 - DNA, 25 bp, Homo sapien
agcaacagaggcgacttcgaccccg

SEQ ID NO: 179588 - DNA, 25 bp, Homo sapien
ggaagacgggaacctgcactcagca

SEQ ID NO: 179589 - DNA, 25 bp, Homo sapien
ccgcatctcaggaagacgggaacct

SEQ ID NO: 179590 - DNA, 25 bp, Homo sapien
aggacggtgaacttggtgaccctga

SEQ ID NO: 179591 - DNA, 25 bp, Homo sapien
acagaggctaattccagtggtcgcc

SEQ ID NO: 179592 - DNA, 25 bp, Homo sapien
cagataccaccacagaggctaattc

SEQ ID NO: 179593 - DNA, 25 bp, Homo sapien
gacgggaacctgcactcagcaccat

SEQ ID NO: 179594 - DNA, 25 bp, Homo sapien
ggcgcctaagaccttaggccacgca

SEQ ID NO: 179595 - DNA, 25 bp, Homo sapien
gtaatcctccacagtcactcggctg

SEQ ID NO: 179596 - DNA, 25 bp, Homo sapien
tggcgtaatcctccacagtcactcg

SEQ ID NO: 179597 - DNA, 25 bp, Homo sapien
ccctcttgggcagggcaatcgtgtc

SEQ ID NO: 179598 - DNA, 25 bp, Homo sapien
atcctccacagtcactcggctggag

SEQ ID NO: 179599 - DNA, 25 bp, Homo sapien
cagaggagcgacttgagtcgctttc

SEQ ID NO: 179600 - DNA, 25 bp, Homo sapien
gcaatcgtgtctgggcgaggcctgc

SEQ ID NO: 179601 - DNA, 25 bp, Homo sapien
ttggcgtaatcctccacagtcactc

SEQ ID NO: 179602 - DNA, 25 bp, Homo sapien
cctgggccacgtctgtggcctggag

SEQ ID NO: 179603 - DNA, 25 bp, Homo sapien
cttaagtagagctccgcgtgttggt

SEQ ID NO: 179604 - DNA, 25 bp, Homo sapien
cgcttattcgcaggagtcagcttaa

SEQ ID NO: 179605 - DNA, 25 bp, Homo sapien
ttggttgcagaagtcgcctgtcttc

SEQ ID NO: 179606 - DNA, 25 bp, Homo sapien
tgctcgctttgacactgaatgctcc

SEQ ID NO: 179607 - DNA, 25 bp, Homo sapien
tcaccgactgcggagaggagtctca

SEQ ID NO: 179608 - DNA, 25 bp, Homo sapien
gcacctacggtatgggagcctttaa

SEQ ID NO: 179609 - DNA, 25 bp, Homo sapien
tgccaagcctgtggaagcgagacgc

SEQ ID NO: 179610 - DNA, 25 bp, Homo sapien
ggcgtttcatctgcgccggcctatg

SEQ ID NO: 179611 - DNA, 25 bp, Homo sapien
cttgacttacacatgggccgacttc

SEQ ID NO: 179612 - DNA, 25 bp, Homo sapien
actacggacgacagaacttcgggca

SEQ ID NO: 179613 - DNA, 25 bp, Homo sapien
cctgggcgagcattgttttgaagct

SEQ ID NO: 179614 - DNA, 25 bp, Homo sapien
tttacaagttttcgccgagccagtg

SEQ ID NO: 179615 - DNA, 25 bp, Homo sapien
ctgcagtcctgggacagttcccttg

SEQ ID NO: 179616 - DNA, 25 bp, Homo sapien
gccatctcaagagcgcggcctctgg

SEQ ID NO: 179617 - DNA, 25 bp, Homo sapien
accgtgtcccgtgctagtgccggaa

SEQ ID NO: 179618 - DNA, 25 bp, Homo sapien
ccgggcgtaaagctctcagtgcggc

SEQ ID NO: 179619 - DNA, 25 bp, Homo sapien
tggacgactgctgctcatcctcctt

SEQ ID NO: 179620 - DNA, 25 bp, Homo sapien
aacaagaagaatcagtttcgtggcg

SEQ ID NO: 179621 - DNA, 25 bp, Homo sapien
agtgtcggccacgtgaaaaacaaga

SEQ ID NO: 179622 - DNA, 25 bp, Homo sapien
ggggacgctacacgtacctttcaga

SEQ ID NO: 179623 - DNA, 25 bp, Homo sapien
atgcagcctctttagctcctcgtcg

SEQ ID NO: 179624 - DNA, 25 bp, Homo sapien
cggatgcgctcgtcgctggacgact

SEQ ID NO: 179625 - DNA, 25 bp, Homo sapien
tttcagaagtgacccggatgcgctc

SEQ ID NO: 179626 - DNA, 25 bp, Homo sapien
ctcgtcgctaaggaagagctctgtg

SEQ ID NO: 179627 - DNA, 25 bp, Homo sapien
gcgctgacccactttccctcctgcc

SEQ ID NO: 179628 - DNA, 25 bp, Homo sapien
tgctagctccggctcgcggtgttag

SEQ ID NO: 179629 - DNA, 25 bp, Homo sapien
ctccggctcgcggtgttaggccttg

SEQ ID NO: 179630 - DNA, 25 bp, Homo sapien
gtgttaggccttggggacatcgctc

SEQ ID NO: 179631 - DNA, 25 bp, Homo sapien
ggaacacagtccatgcgtgcggcgc

SEQ ID NO: 179632 - DNA, 25 bp, Homo sapien
ctttccaagcacaacagcagccctg

SEQ ID NO: 179633 - DNA, 25 bp, Homo sapien
ccgccgccaagcaggtgcgagccgt

SEQ ID NO: 179634 - DNA, 25 bp, Homo sapien
ccctttgtgcctggagtgtcacgcg

SEQ ID NO: 179635 - DNA, 25 bp, Homo sapien
gcctgccacaatgcgcggcgaagct

SEQ ID NO: 179636 - DNA, 25 bp, Homo sapien
tgacgactcgcagcaagagcaccgc

SEQ ID NO: 179637 - DNA, 25 bp, Homo sapien
tgccgctcggcatccttagaaccgg

SEQ ID NO: 179638 - DNA, 25 bp, Homo sapien
ggatcctagcggacctcaaccagca

SEQ ID NO: 179639 - DNA, 25 bp, Homo sapien
cgcgacggtaaggacagcgcctcgc

SEQ ID NO: 179640 - DNA, 25 bp, Homo sapien
ctatgtggaccacttcgccgccgag

SEQ ID NO: 179641 - DNA, 25 bp, Homo sapien
ggtccctaacgttgccgctcggcat

SEQ ID NO: 179642 - DNA, 25 bp, Homo sapien
cgagtgcctcgtgtccatgtcgagc

SEQ ID NO: 179643 - DNA, 25 bp, Homo sapien
tacttggacagctttttatcctggc

SEQ ID NO: 179644 - DNA, 25 bp, Homo sapien
cgcgccctaggtggccatctggaag

SEQ ID NO: 179645 - DNA, 25 bp, Homo sapien
cgaagagtctctggctgtacagctc

SEQ ID NO: 179646 - DNA, 25 bp, Homo sapien
ccgaagtgctcacagtggagaccca

SEQ ID NO: 179647 - DNA, 25 bp, Homo sapien
caccctgcgtaagcggtcgaaggca

SEQ ID NO: 179648 - DNA, 25 bp, Homo sapien
ccactggggaaccaccctgcgtaag

SEQ ID NO: 179649 - DNA, 25 bp, Homo sapien
catgatgtagctcagggccatctgc

SEQ ID NO: 179650 - DNA, 25 bp, Homo sapien
atccgggtcagagccatgatgtagc

SEQ ID NO: 179651 - DNA, 25 bp, Homo sapien
ccgcgcgagcctcttgactagaata

SEQ ID NO: 179652 - DNA, 25 bp, Homo sapien
gttcatctcccgcttcaggctctgg

SEQ ID NO: 179653 - DNA, 25 bp, Homo sapien
gactagaatattggcgcaggggctc

SEQ ID NO: 179654 - DNA, 25 bp, Homo sapien
ccagtttcctcggagcgcctggaaa

SEQ ID NO: 179655 - DNA, 25 bp, Homo sapien
tcagccttgggatgtcttcctggtg

SEQ ID NO: 179656 - DNA, 25 bp, Homo sapien
cagggcctcagccttgggatgtctt

SEQ ID NO: 179657 - DNA, 25 bp, Homo sapien
cttcctggtgggttcatctcccgct

SEQ ID NO: 179658 - DNA, 25 bp, Homo sapien
cctcccgctgtaggtggggccagtt

SEQ ID NO: 179659 - DNA, 25 bp, Homo sapien
ccgccacagccatgagcagccgctc

SEQ ID NO: 179660 - DNA, 25 bp, Homo sapien
ccctgagcccgccacagccatgagc

SEQ ID NO: 179661 - DNA, 25 bp, Homo sapien
ggctccctcagcgactacagccgct

SEQ ID NO: 179662 - DNA, 25 bp, Homo sapien
cgagaagaagttcagctgccccatc

SEQ ID NO: 179663 - DNA, 25 bp, Homo sapien
gcgccgccacgccaacttccacccg

SEQ ID NO: 179664 - DNA, 25 bp, Homo sapien
tccacccgggaatgctgcagcggcg

SEQ ID NO: 179665 - DNA, 25 bp, Homo sapien
tcagcgactacagccgctccgacgc

SEQ ID NO: 179666 - DNA, 25 bp, Homo sapien
acttccacccgggaatgctgcagcg

SEQ ID NO: 179667 - DNA, 25 bp, Homo sapien
ttccaaggagaacccacagcggctt

SEQ ID NO: 179668 - DNA, 25 bp, Homo sapien
tcctcacgtgagctcatgtaccgcg

SEQ ID NO: 179669 - DNA, 25 bp, Homo sapien
cgggcagcgactatcagtgagactg

SEQ ID NO: 179670 - DNA, 25 bp, Homo sapien
tggggtagacgccacctctttggcc

SEQ ID NO: 179671 - DNA, 25 bp, Homo sapien
gggtccgccctagaaatagctcgga

SEQ ID NO: 179672 - DNA, 25 bp, Homo sapien
agtagagtctgctcgcggtatttta

SEQ ID NO: 179673 - DNA, 25 bp, Homo sapien
cctggagagcatggaggcaagttct

SEQ ID NO: 179674 - DNA, 25 bp, Homo sapien
gcgcgcgagccctttccaaggagaa

SEQ ID NO: 179675 - DNA, 25 bp, Homo sapien
attgccgaccattctcaggcctggg

SEQ ID NO: 179676 - DNA, 25 bp, Homo sapien
cgccagcataattaccgggagaata

SEQ ID NO: 179677 - DNA, 25 bp, Homo sapien
ccagcgccagcataattaccgggag

SEQ ID NO: 179678 - DNA, 25 bp, Homo sapien
gagaataattacgagcccagagagc

SEQ ID NO: 179679 - DNA, 25 bp, Homo sapien
cgaccattctcaggcctggggcggt

SEQ ID NO: 179680 - DNA, 25 bp, Homo sapien
tcagtgacgcgcacttgcaaaggct

SEQ ID NO: 179681 - DNA, 25 bp, Homo sapien
ctgcaggccaagaggtccagacgcc

SEQ ID NO: 179682 - DNA, 25 bp, Homo sapien
taccgggagaataattacgagccca

SEQ ID NO: 179683 - DNA, 25 bp, Homo sapien
cccatccgagtcacgcggactagga

SEQ ID NO: 179684 - DNA, 25 bp, Homo sapien
cgttggcggaactgtggaagcttca

SEQ ID NO: 179685 - DNA, 25 bp, Homo sapien
gaagcttcaggccacccatccgagt

SEQ ID NO: 179686 - DNA, 25 bp, Homo sapien
ccgagtcacgcggactaggatgccc

SEQ ID NO: 179687 - DNA, 25 bp, Homo sapien
agtccccgctcctgtggccgatgtg

SEQ ID NO: 179688 - DNA, 25 bp, Homo sapien
ccagcggaaagcgcgagtcagagtc

SEQ ID NO: 179689 - DNA, 25 bp, Homo sapien
cctgcagacccgctccagagacgcc

SEQ ID NO: 179690 - DNA, 25 bp, Homo sapien
tgtggaagcttcaggccacccatcc

SEQ ID NO: 179691 - DNA, 25 bp, Homo sapien
gctatcttggccacctctggaccta

SEQ ID NO: 179692 - DNA, 25 bp, Homo sapien
cgctgtcctatagtccgtcacgggc

SEQ ID NO: 179693 - DNA, 25 bp, Homo sapien
ggctcggttggtttgactacttgtc

SEQ ID NO: 179694 - DNA, 25 bp, Homo sapien
ttcatgatggatacacgggcggcca

SEQ ID NO: 179695 - DNA, 25 bp, Homo sapien
ctaaggctcttgtcaggccgccgaa

SEQ ID NO: 179696 - DNA, 25 bp, Homo sapien
gccctcactgtgactcaactgtttc

SEQ ID NO: 179697 - DNA, 25 bp, Homo sapien
ctctggacctatggcagcttcgata

SEQ ID NO: 179698 - DNA, 25 bp, Homo sapien
tcttccacgagtctgaggctgacgc

SEQ ID NO: 179699 - DNA, 25 bp, Homo sapien
agctgcccagcttgttggccacgga

SEQ ID NO: 179700 - DNA, 25 bp, Homo sapien
tcatctcctcgtggaactggtgccg

SEQ ID NO: 179701 - DNA, 25 bp, Homo sapien
gcgctcgtcaggtagtagccgatca

SEQ ID NO: 179702 - DNA, 25 bp, Homo sapien
ctcggccgctccttgagcttgagca

SEQ ID NO: 179703 - DNA, 25 bp, Homo sapien
tggtcttttccgacggcgacgtgct

SEQ ID NO: 179704 - DNA, 25 bp, Homo sapien
catccgtgctgtacttccaggcgtc

SEQ ID NO: 179705 - DNA, 25 bp, Homo sapien
ttgaggctcagcttcacatccgtgc

SEQ ID NO: 179706 - DNA, 25 bp, Homo sapien
ccgaggccgcccatgtttttcttca

SEQ ID NO: 179707 - DNA, 25 bp, Homo sapien
tggttccctatagctgccacccggt

SEQ ID NO: 179708 - DNA, 25 bp, Homo sapien
gacttccgaagcctggttccctata

SEQ ID NO: 179709 - DNA, 25 bp, Homo sapien
agtgcccagcgcagcttctggctga

SEQ ID NO: 179710 - DNA, 25 bp, Homo sapien
gcgtcgctcctgcacggtaaagcca

SEQ ID NO: 179711 - DNA, 25 bp, Homo sapien
ctgcagctccgggactcaacatgcg

SEQ ID NO: 179712 - DNA, 25 bp, Homo sapien
actcaacatgcgctgctcgccggga

SEQ ID NO: 179713 - DNA, 25 bp, Homo sapien
gcctgggccaggtttgggatctccc

SEQ ID NO: 179714 - DNA, 25 bp, Homo sapien
ttgtctggttggcaagacttccgaa

SEQ ID NO: 179715 - DNA, 25 bp, Homo sapien
cgtggttcctgcgaatgaagaggcc

SEQ ID NO: 179716 - DNA, 25 bp, Homo sapien
aggaggtccgctacattgccaaccg

SEQ ID NO: 179717 - DNA, 25 bp, Homo sapien
cgggaacctgctgtacatcggcttc

SEQ ID NO: 179718 - DNA, 25 bp, Homo sapien
gcctgtgcctcatggccttctcggt

SEQ ID NO: 179719 - DNA, 25 bp, Homo sapien
atcatctgcaccatcggcatcctga

SEQ ID NO: 179720 - DNA, 25 bp, Homo sapien
tggaggccgtgtccaaagactttgc

SEQ ID NO: 179721 - DNA, 25 bp, Homo sapien
aaccgcttccgctgccaggacgaaa

SEQ ID NO: 179722 - DNA, 25 bp, Homo sapien
gcatcctgatgtcggctcccaactt

SEQ ID NO: 179723 - DNA, 25 bp, Homo sapien
tgcgcagctccctaagcggttgtca

SEQ ID NO: 179724 - DNA, 25 bp, Homo sapien
cgcctgacagggtatctgaagtaaa

SEQ ID NO: 179725 - DNA, 25 bp, Homo sapien
acggcacggttccttctacacactg

SEQ ID NO: 179726 - DNA, 25 bp, Homo sapien
actggaacagcctctgctcggtcta

SEQ ID NO: 179727 - DNA, 25 bp, Homo sapien
tcgcggcccagaaacactcctattt

SEQ ID NO: 179728 - DNA, 25 bp, Homo sapien
gcggggccctcacagaatttgttca

SEQ ID NO: 179729 - DNA, 25 bp, Homo sapien
tgcgcgctgcagctctttaactgga

SEQ ID NO: 179730 - DNA, 25 bp, Homo sapien
ggcctccgccattttgggtacagtg

SEQ ID NO: 179731 - DNA, 25 bp, Homo sapien
cctgcttgtacgtctagtactggcg

SEQ ID NO: 179732 - DNA, 25 bp, Homo sapien
acgtctagtactggcgccgcgagga

SEQ ID NO: 179733 - DNA, 25 bp, Homo sapien
tgtacgtctagtactggcgccgcga

SEQ ID NO: 179734 - DNA, 25 bp, Homo sapien
tgcttgtacgtctagtactggcgcc

SEQ ID NO: 179735 - DNA, 25 bp, Homo sapien
acctgcttgtacgtctagtactggc

SEQ ID NO: 179736 - DNA, 25 bp, Homo sapien
cacctgcttgtacgtctagtactgg

SEQ ID NO: 179737 - DNA, 25 bp, Homo sapien
tccacctgcttgtacgtctagtact

SEQ ID NO: 179738 - DNA, 25 bp, Homo sapien
cttgtacgtctagtactggcgccgc

SEQ ID NO: 179739 - DNA, 25 bp, Homo sapien
aagctcatgaccacggcctgctgca

SEQ ID NO: 179740 - DNA, 25 bp, Homo sapien
atggtcagccagatgtccgtcatgc

SEQ ID NO: 179741 - DNA, 25 bp, Homo sapien
ggacatgtactgctccacctgcttg

SEQ ID NO: 179742 - DNA, 25 bp, Homo sapien
gtgctcgtagtagtcgtggatcttc

SEQ ID NO: 179743 - DNA, 25 bp, Homo sapien
tcgtcgaacatcttgccctggtaac

SEQ ID NO: 179744 - DNA, 25 bp, Homo sapien
cccaggatgctgtcctcgtcgaaca

SEQ ID NO: 179745 - DNA, 25 bp, Homo sapien
aagttgacaatctcctcccgcaggg

SEQ ID NO: 179746 - DNA, 25 bp, Homo sapien
cggccatacccaatgcacagcatgt

SEQ ID NO: 179747 - DNA, 25 bp, Homo sapien
ctggccgagctcttgtgagcctaaa

SEQ ID NO: 179748 - DNA, 25 bp, Homo sapien
taaaagggcaacaggacaacagaac

SEQ ID NO: 179749 - DNA, 25 bp, Homo sapien
ggcaacaggacaacagaaccaccgc

SEQ ID NO: 179750 - DNA, 25 bp, Homo sapien
cgcctgggctcaaaagccgccattc

SEQ ID NO: 179751 - DNA, 25 bp, Homo sapien
tgtgagcctaaagacccgcctcttc

SEQ ID NO: 179752 - DNA, 25 bp, Homo sapien
tgagcctcctggttctcgtggaaga

SEQ ID NO: 179753 - DNA, 25 bp, Homo sapien
ttttccgcgggtgcacaagtccaga

SEQ ID NO: 179754 - DNA, 25 bp, Homo sapien
ggccttgaatcttgacacagacatc

SEQ ID NO: 179755 - DNA, 25 bp, Homo sapien
gcgggatcaggttgttactactgca

SEQ ID NO: 179756 - DNA, 25 bp, Homo sapien
gtgggaactgtaatccggaaatcca

SEQ ID NO: 179757 - DNA, 25 bp, Homo sapien
gcagccagtagtcccgagcgaagcc

SEQ ID NO: 179758 - DNA, 25 bp, Homo sapien
ccaaacggtgacactccgacttttg

SEQ ID NO: 179759 - DNA, 25 bp, Homo sapien
actcgccgcagagaagccgtgggaa

SEQ ID NO: 179760 - DNA, 25 bp, Homo sapien
ccggaaatccatgggcgtcggaatt

SEQ ID NO: 179761 - DNA, 25 bp, Homo sapien
acttctgtaggaccgcgccagttta

SEQ ID NO: 179762 - DNA, 25 bp, Homo sapien
gcgtcggaattacctggctagaccc

SEQ ID NO: 179763 - DNA, 25 bp, Homo sapien
tgggactctgggcacccgctttccg

SEQ ID NO: 179764 - DNA, 25 bp, Homo sapien
ccctgtcgcggtccctagagcaggt

SEQ ID NO: 179765 - DNA, 25 bp, Homo sapien
tgtggctcctggttctcctggaaga

SEQ ID NO: 179766 - DNA, 25 bp, Homo sapien
tgaacccggacatggacatcttccc

SEQ ID NO: 179767 - DNA, 25 bp, Homo sapien
tgggctccaacaacgcgggagccgc

SEQ ID NO: 179768 - DNA, 25 bp, Homo sapien
ggctcccgtcaagccgcagtttaaa

SEQ ID NO: 179769 - DNA, 25 bp, Homo sapien
cacccggcgactcaccttaatgttg

SEQ ID NO: 179770 - DNA, 25 bp, Homo sapien
tcaccttaatgttgcggtggggcgt

SEQ ID NO: 179771 - DNA, 25 bp, Homo sapien
ctcggcatcggcgaagaggccttgc

SEQ ID NO: 179772 - DNA, 25 bp, Homo sapien
catcggcgaagaggccttgccggac

SEQ ID NO: 179773 - DNA, 25 bp, Homo sapien
acacagcggccttgggtttgggctc

SEQ ID NO: 179774 - DNA, 25 bp, Homo sapien
ccagttgggcgggaacacggcagct

SEQ ID NO: 179775 - DNA, 25 bp, Homo sapien
agccgcgaaaacagcgtggcgcacg

SEQ ID NO: 179776 - DNA, 25 bp, Homo sapien
tttagccgcgaaaacagcgtggcgc

SEQ ID NO: 179777 - DNA, 25 bp, Homo sapien
agccgcgcggcctttagccgcgaaa

SEQ ID NO: 179778 - DNA, 25 bp, Homo sapien
gcctttagccgcgaaaacagcgtgg

SEQ ID NO: 179779 - DNA, 25 bp, Homo sapien
ggccagtccggagcgcaaactttcc

SEQ ID NO: 179780 - DNA, 25 bp, Homo sapien
ccctggcgactgcagcgctgaatct

SEQ ID NO: 179781 - DNA, 25 bp, Homo sapien
agcgagatggaccacctggaaggcc

SEQ ID NO: 179782 - DNA, 25 bp, Homo sapien
ttcctgcggcccagagactgcttga

SEQ ID NO: 179783 - DNA, 25 bp, Homo sapien
cgctctgctcggactcagggcagga

SEQ ID NO: 179784 - DNA, 25 bp, Homo sapien
cacagcgcacatgggtcagccggta

SEQ ID NO: 179785 - DNA, 25 bp, Homo sapien
tctcctctgggatcccgaatcgcgg

SEQ ID NO: 179786 - DNA, 25 bp, Homo sapien
aggatgcaccgtcacctatggctcg

SEQ ID NO: 179787 - DNA, 25 bp, Homo sapien
gactggaagagttgcctgagcagcc

SEQ ID NO: 179788 - DNA, 25 bp, Homo sapien
tgggctgaaactgcgggtgtgaccc

SEQ ID NO: 179789 - DNA, 25 bp, Homo sapien
agcatgaggctaacggcttggcttc

SEQ ID NO: 179790 - DNA, 25 bp, Homo sapien
taacggcttggcttcagtgaacgca

SEQ ID NO: 179791 - DNA, 25 bp, Homo sapien
cttggcttcagtgaacgcaccggga

SEQ ID NO: 179792 - DNA, 25 bp, Homo sapien
ttcagtgaacgcaccgggatgtgca

SEQ ID NO: 179793 - DNA, 25 bp, Homo sapien
agggaacgagcagcctgtgagacgg

SEQ ID NO: 179794 - DNA, 25 bp, Homo sapien
cgctgccatttgagcctgggctgaa

SEQ ID NO: 179795 - DNA, 25 bp, Homo sapien
cgggttggagcatccggagaatcca

SEQ ID NO: 179796 - DNA, 25 bp, Homo sapien
ctgccgccggcatttaaacgggaga

SEQ ID NO: 179797 - DNA, 25 bp, Homo sapien
gtgttcagccacagcggaaaaccga

SEQ ID NO: 179798 - DNA, 25 bp, Homo sapien
ccgaacggtgggtaatccgacagct

SEQ ID NO: 179799 - DNA, 25 bp, Homo sapien
ccatgatgtgtgcatttgccgatcc

SEQ ID NO: 179800 - DNA, 25 bp, Homo sapien
agttgccttgagagggtcccatgtg

SEQ ID NO: 179801 - DNA, 25 bp, Homo sapien
caggagcatccggacctgctagtcg

SEQ ID NO: 179802 - DNA, 25 bp, Homo sapien
attgtgaagaaccatcgcggggtcc

SEQ ID NO: 179803 - DNA, 25 bp, Homo sapien
tctaagacggacagccagggcgaca

SEQ ID NO: 179804 - DNA, 25 bp, Homo sapien
gctgtcttttggcaccgtctgatcc

SEQ ID NO: 179805 - DNA, 25 bp, Homo sapien
caggctgggaagcagtgctgtcttt

SEQ ID NO: 179806 - DNA, 25 bp, Homo sapien
caatcagcagccgagccgttgggcc

SEQ ID NO: 179807 - DNA, 25 bp, Homo sapien
aagaccagtggaaacgtgcagcggc

SEQ ID NO: 179808 - DNA, 25 bp, Homo sapien
gcagtaaactgatcggcagggctga

SEQ ID NO: 179809 - DNA, 25 bp, Homo sapien
cgacaaccagtctctcgctacgtgt

SEQ ID NO: 179810 - DNA, 25 bp, Homo sapien
gcggtggtcgctaagctaggtctaa

SEQ ID NO: 179811 - DNA, 25 bp, Homo sapien
cataagatcggcgttggaagccctc

SEQ ID NO: 179812 - DNA, 25 bp, Homo sapien
ttcgcggttgtcctgacccataaga

SEQ ID NO: 179813 - DNA, 25 bp, Homo sapien
cttggtctgaaacccttgatgccca

SEQ ID NO: 179814 - DNA, 25 bp, Homo sapien
ccaggcaacttgctacttggtctga

SEQ ID NO: 179815 - DNA, 25 bp, Homo sapien
cagctccctatatggtcggggatta

SEQ ID NO: 179816 - DNA, 25 bp, Homo sapien
ctctgcagtgcagtggagtgttagc

SEQ ID NO: 179817 - DNA, 25 bp, Homo sapien
gagtgttagcccagctccctatatg

SEQ ID NO: 179818 - DNA, 25 bp, Homo sapien
gaggggaattcacccagcgctgccc

SEQ ID NO: 179819 - DNA, 25 bp, Homo sapien
ggcacccaggccaaaacctgagatg

SEQ ID NO: 179820 - DNA, 25 bp, Homo sapien
aaaggaacgtgaaggagaccacatg

SEQ ID NO: 179821 - DNA, 25 bp, Homo sapien
ggctgcgctacaggacttctccggc

SEQ ID NO: 179822 - DNA, 25 bp, Homo sapien
cgcaaggagtaccagggccagtgcc

SEQ ID NO: 179823 - DNA, 25 bp, Homo sapien
gacccgggagtgacaccctgcctgg

SEQ ID NO: 179824 - DNA, 25 bp, Homo sapien
actatgcctcagaacccgggcggga

SEQ ID NO: 179825 - DNA, 25 bp, Homo sapien
actgagggcctagcgttcggtttcg

SEQ ID NO: 179826 - DNA, 25 bp, Homo sapien
aggagaccacatgtgtgaggagcca

SEQ ID NO: 179827 - DNA, 25 bp, Homo sapien
cgagctcctcgctccgcctgcatct

SEQ ID NO: 179828 - DNA, 25 bp, Homo sapien
tcttgcggctcttgactggcggcct

SEQ ID NO: 179829 - DNA, 25 bp, Homo sapien
gctcgctgtggcgatctccgccagg

SEQ ID NO: 179830 - DNA, 25 bp, Homo sapien
agggccaagcgcatacccaggcgcg

SEQ ID NO: 179831 - DNA, 25 bp, Homo sapien
cctccgtcccatagtggtactcgta

SEQ ID NO: 179832 - DNA, 25 bp, Homo sapien
ccatagtggtactcgtacagacagc

SEQ ID NO: 179833 - DNA, 25 bp, Homo sapien
ttgcagccctgacacacggccttgg

SEQ ID NO: 179834 - DNA, 25 bp, Homo sapien
cacgagggccaagcgcatacccagg

SEQ ID NO: 179835 - DNA, 25 bp, Homo sapien
atcatggccgatcgactagcgaggc

SEQ ID NO: 179836 - DNA, 25 bp, Homo sapien
ccgccgagatccagtcctgaggctt

SEQ ID NO: 179837 - DNA, 25 bp, Homo sapien
ttgaagcgatctcctatgccgaccc

SEQ ID NO: 179838 - DNA, 25 bp, Homo sapien
tgatgttgtcatcactgcgcgcccg

SEQ ID NO: 179839 - DNA, 25 bp, Homo sapien
agctgtgggatccaaccagagggaa

SEQ ID NO: 179840 - DNA, 25 bp, Homo sapien
gaagtactgcccttaactcccggca

SEQ ID NO: 179841 - DNA, 25 bp, Homo sapien
actcccggcactctggattggaaga

SEQ ID NO: 179842 - DNA, 25 bp, Homo sapien
tgcgcgcccgtttctgtcataagct

SEQ ID NO: 179843 - DNA, 25 bp, Homo sapien
agctcatccgtcaggaatccgagga

SEQ ID NO: 179844 - DNA, 25 bp, Homo sapien
cctaggcgctctgcggaaaacctgt

SEQ ID NO: 179845 - DNA, 25 bp, Homo sapien
ccgtcggaaaataaggaaatgcctg

SEQ ID NO: 179846 - DNA, 25 bp, Homo sapien
agcttcgcacggtagccttgctatg

SEQ ID NO: 179847 - DNA, 25 bp, Homo sapien
agcctagagagtccctcggcttctg

SEQ ID NO: 179848 - DNA, 25 bp, Homo sapien
tgacaacaggttcggtccacgcctc

SEQ ID NO: 179849 - DNA, 25 bp, Homo sapien
tgcagctgtcgactccacccgaaga

SEQ ID NO: 179850 - DNA, 25 bp, Homo sapien
ttgctatggcgcgagaagtgatact

SEQ ID NO: 179851 - DNA, 25 bp, Homo sapien
cgcagctgttgtttactagccggta

SEQ ID NO: 179852 - DNA, 25 bp, Homo sapien
tgaaccttgcgaagagaagcccggg

SEQ ID NO: 179853 - DNA, 25 bp, Homo sapien
tagctagtccactgagccacggtcc

SEQ ID NO: 179854 - DNA, 25 bp, Homo sapien
ggtaactgtttcagagccgcggcgc

SEQ ID NO: 179855 - DNA, 25 bp, Homo sapien
cagctcagagtcgtggcaagtcgta

SEQ ID NO: 179856 - DNA, 25 bp, Homo sapien
cttctcctagcagaaaggtcctcgg

SEQ ID NO: 179857 - DNA, 25 bp, Homo sapien
cccgcgtgaagaggggaataatcct

SEQ ID NO: 179858 - DNA, 25 bp, Homo sapien
tagcggatcaagacacctcggactg

SEQ ID NO: 179859 - DNA, 25 bp, Homo sapien
agccgctcgggccattgttccgcgg

SEQ ID NO: 179860 - DNA, 25 bp, Homo sapien
cgtcgttcctctctgaagacctggc

SEQ ID NO: 179861 - DNA, 25 bp, Homo sapien
agcgcagagctcagagcgccctctg

SEQ ID NO: 179862 - DNA, 25 bp, Homo sapien
ccgggcgtcgaggtcacccagcaag

SEQ ID NO: 179863 - DNA, 25 bp, Homo sapien
acccagcaagcgcagatcggggtga

SEQ ID NO: 179864 - DNA, 25 bp, Homo sapien
cccgctcttcctatgggctccttgg

SEQ ID NO: 179865 - DNA, 25 bp, Homo sapien
ccatcgcgcggggacttgaggcact

SEQ ID NO: 179866 - DNA, 25 bp, Homo sapien
cttgaggcacttgcgtcctctggcg

SEQ ID NO: 179867 - DNA, 25 bp, Homo sapien
agttctcccagggaagtgaacccag

SEQ ID NO: 179868 - DNA, 25 bp, Homo sapien
gatgcgaaagccatcgcctagtccc

SEQ ID NO: 179869 - DNA, 25 bp, Homo sapien
cgggatgcgaaagccatcgcctagt

SEQ ID NO: 179870 - DNA, 25 bp, Homo sapien
tcccgggatgcgaaagccatcgcct

SEQ ID NO: 179871 - DNA, 25 bp, Homo sapien
cagggaagtgaacccagaggcgatc

SEQ ID NO: 179872 - DNA, 25 bp, Homo sapien
ctcgagttctcccagggaagtgaac

SEQ ID NO: 179873 - DNA, 25 bp, Homo sapien
cgggctcgagttctcccagggaagt

SEQ ID NO: 179874 - DNA, 25 bp, Homo sapien
accagcccggcgagacgcgagcggg

SEQ ID NO: 179875 - DNA, 25 bp, Homo sapien
aacaacaagtgtgccttctgtaccc

SEQ ID NO: 179876 - DNA, 25 bp, Homo sapien
catcaccgtgttgcgcggggagcac

SEQ ID NO: 179877 - DNA, 25 bp, Homo sapien
tgaagttcatcaaccgcgccatcac

SEQ ID NO: 179878 - DNA, 25 bp, Homo sapien
acttcgacattgagcggcgtgaccg

SEQ ID NO: 179879 - DNA, 25 bp, Homo sapien
gccagctgctacttcgacattgagc

SEQ ID NO: 179880 - DNA, 25 bp, Homo sapien
cgcgacaacaacaagtgtgccttct

SEQ ID NO: 179881 - DNA, 25 bp, Homo sapien
cacgcgccagggtatggacctgtct

SEQ ID NO: 179882 - DNA, 25 bp, Homo sapien
tgctacttcgacattgagcggcgtg

SEQ ID NO: 179883 - DNA, 25 bp, Homo sapien
caagcttacgccacgcgaggagtcg

SEQ ID NO: 179884 - DNA, 25 bp, Homo sapien
tgtcacggccgcgactacccagcgg

SEQ ID NO: 179885 - DNA, 25 bp, Homo sapien
cccagccgagctttcgcgactctgc

SEQ ID NO: 179886 - DNA, 25 bp, Homo sapien
ctgccgcctggacccttgtgggagc

SEQ ID NO: 179887 - DNA, 25 bp, Homo sapien
gcttcaaagggcaacataaccactg

SEQ ID NO: 179888 - DNA, 25 bp, Homo sapien
cctgcgcgcaccagtttcggcgggt

SEQ ID NO: 179889 - DNA, 25 bp, Homo sapien
tgtggaagatagtcccagaaacttc

SEQ ID NO: 179890 - DNA, 25 bp, Homo sapien
agccgcagcttcaaagggcaacata

SEQ ID NO: 179891 - DNA, 25 bp, Homo sapien
agctccttgagagcccgcacgtagc

SEQ ID NO: 179892 - DNA, 25 bp, Homo sapien
aaaaagatgcgtccgtgccgggcgt

SEQ ID NO: 179893 - DNA, 25 bp, Homo sapien
tcacccgctcttggatcactggggc

SEQ ID NO: 179894 - DNA, 25 bp, Homo sapien
taccgcaagcggagtacggaaagca

SEQ ID NO: 179895 - DNA, 25 bp, Homo sapien
atagcggcgggtacataccgcaagc

SEQ ID NO: 179896 - DNA, 25 bp, Homo sapien
attagcccggaagctgaatagcggc

SEQ ID NO: 179897 - DNA, 25 bp, Homo sapien
agtacggaaagcacgcagggctgcc

SEQ ID NO: 179898 - DNA, 25 bp, Homo sapien
gcggcacaccgcgactgctaattag

SEQ ID NO: 179899 - DNA, 25 bp, Homo sapien
tagcatcccgggtctcagcagtcat

SEQ ID NO: 179900 - DNA, 25 bp, Homo sapien
cttgctgcggtgctaactttgtgtc

SEQ ID NO: 179901 - DNA, 25 bp, Homo sapien
tccaggcacagaatcgagcccgttc

SEQ ID NO: 179902 - DNA, 25 bp, Homo sapien
cagcagtcataggtgcgcgtgaaca

SEQ ID NO: 179903 - DNA, 25 bp, Homo sapien
ggtccctgctgtgttcatctgaata

SEQ ID NO: 179904 - DNA, 25 bp, Homo sapien
ctcgcaggtggaacacgtgcttgct

SEQ ID NO: 179905 - DNA, 25 bp, Homo sapien
cgcgtgaacacagggcatgcgctcc

SEQ ID NO: 179906 - DNA, 25 bp, Homo sapien
aagcactggtggaggtagcatcccg

SEQ ID NO: 179907 - DNA, 25 bp, Homo sapien
tgcatccggaggcagcagacaaaga

SEQ ID NO: 179908 - DNA, 25 bp, Homo sapien
ccttaagtagtctccgcctgcgtca

SEQ ID NO: 179909 - DNA, 25 bp, Homo sapien
accggagccttgacctaggacgatg

SEQ ID NO: 179910 - DNA, 25 bp, Homo sapien
ttccagaatgggagtgaattgcctc

SEQ ID NO: 179911 - DNA, 25 bp, Homo sapien
ttcctgctacttcagcgggcacctg

SEQ ID NO: 179912 - DNA, 25 bp, Homo sapien
cccgatcatagtggagtgctgctgc

SEQ ID NO: 179913 - DNA, 25 bp, Homo sapien
caggagaagtctcagcgccgctctc

SEQ ID NO: 179914 - DNA, 25 bp, Homo sapien
aaatccaagcgcgtcccgaccgatg

SEQ ID NO: 179915 - DNA, 25 bp, Homo sapien
ggccacgatcttcttgggctgcgca

SEQ ID NO: 179916 - DNA, 25 bp, Homo sapien
ctccgcattgatttgggacaccgta

SEQ ID NO: 179917 - DNA, 25 bp, Homo sapien
ccagtggaaactaaaggaccgctct

SEQ ID NO: 179918 - DNA, 25 bp, Homo sapien
gggccggatatcctcagccttcaga

SEQ ID NO: 179919 - DNA, 25 bp, Homo sapien
cagccttcagagtcccgtagggaac

SEQ ID NO: 179920 - DNA, 25 bp, Homo sapien
ctagcgagccaagagctttgacctc

SEQ ID NO: 179921 - DNA, 25 bp, Homo sapien
acagcccaagcgttcctcgggaagc

SEQ ID NO: 179922 - DNA, 25 bp, Homo sapien
acctgggtcacgaactccgcattga

SEQ ID NO: 179923 - DNA, 25 bp, Homo sapien
agacgggtacattttccatctcacc

SEQ ID NO: 179924 - DNA, 25 bp, Homo sapien
tcaaagccgattcggggcagccctc

SEQ ID NO: 179925 - DNA, 25 bp, Homo sapien
gcgagtcagcgttcaaagccgattc

SEQ ID NO: 179926 - DNA, 25 bp, Homo sapien
ctgactagtgggctcaagggccgac

SEQ ID NO: 179927 - DNA, 25 bp, Homo sapien
aatttcagggccgttgtcgcctccg

SEQ ID NO: 179928 - DNA, 25 bp, Homo sapien
ctgaacctcggttaggaaaacgctg

SEQ ID NO: 179929 - DNA, 25 bp, Homo sapien
tcattgcaggggagagaacagaata

SEQ ID NO: 179930 - DNA, 25 bp, Homo sapien
gaaaacgctgtagccctgactagtg

SEQ ID NO: 179931 - DNA, 25 bp, Homo sapien
gcatagatcaagatcccgatcccgg

SEQ ID NO: 179932 - DNA, 25 bp, Homo sapien
atcccgggagcgtcattctcggtct

SEQ ID NO: 179933 - DNA, 25 bp, Homo sapien
tgtcacctgtgacggacttcagggg

SEQ ID NO: 179934 - DNA, 25 bp, Homo sapien
tcagtatgagatgggagaatgcaca

SEQ ID NO: 179935 - DNA, 25 bp, Homo sapien
agaatgcacacgaggcggcttctgc

SEQ ID NO: 179936 - DNA, 25 bp, Homo sapien
gcggcttctgcaacttcatgcattt

SEQ ID NO: 179937 - DNA, 25 bp, Homo sapien
catgcatttgaagcccatttccaga

SEQ ID NO: 179938 - DNA, 25 bp, Homo sapien
ggcagcgtcgcaagaagcatagatc

SEQ ID NO: 179939 - DNA, 25 bp, Homo sapien
tccgtcaagatacgtttgccacagg

SEQ ID NO: 179940 - DNA, 25 bp, Homo sapien
cgtcaagatacgtttgccacaggga

SEQ ID NO: 179941 - DNA, 25 bp, Homo sapien
caagatacgtttgccacagggattc

SEQ ID NO: 179942 - DNA, 25 bp, Homo sapien
agatacgtttgccacagggattcgg

SEQ ID NO: 179943 - DNA, 25 bp, Homo sapien
gtcttccgtcaagatacgtttgcca

SEQ ID NO: 179944 - DNA, 25 bp, Homo sapien
tacgtttgccacagggattcgggta

SEQ ID NO: 179945 - DNA, 25 bp, Homo sapien
tgtcttccgtcaagatacgtttgcc

SEQ ID NO: 179946 - DNA, 25 bp, Homo sapien
cttccgtcaagatacgtttgccaca

SEQ ID NO: 179947 - DNA, 25 bp, Homo sapien
ccaacgcgcgactcagacggagaca

SEQ ID NO: 179948 - DNA, 25 bp, Homo sapien
ggagacacccactctttcggcgcta

SEQ ID NO: 179949 - DNA, 25 bp, Homo sapien
gcggctccaggaccgcattacctga

SEQ ID NO: 179950 - DNA, 25 bp, Homo sapien
ggaccgcattacctgatcagagccg

SEQ ID NO: 179951 - DNA, 25 bp, Homo sapien
atcagagccgcgaccctcatgctgg

SEQ ID NO: 179952 - DNA, 25 bp, Homo sapien
ggcaacagcgaaggctccgcctctt

SEQ ID NO: 179953 - DNA, 25 bp, Homo sapien
actctttcggcgctagcggcggctg

SEQ ID NO: 179954 - DNA, 25 bp, Homo sapien
cgcctcttcctgtggctcggaggag

SEQ ID NO: 179955 - DNA, 25 bp, Homo sapien
tcctggttggtttgcccttaactga

SEQ ID NO: 179956 - DNA, 25 bp, Homo sapien
tactgaaactctggcgcggcgcctt

SEQ ID NO: 179957 - DNA, 25 bp, Homo sapien
ccctttgatcctaggtgggcgatgc

SEQ ID NO: 179958 - DNA, 25 bp, Homo sapien
agcatcccttgttgaccctttgatc

SEQ ID NO: 179959 - DNA, 25 bp, Homo sapien
aggccgccctggcttctagtaattg

SEQ ID NO: 179960 - DNA, 25 bp, Homo sapien
agtgtattcaaatcgcgcgctctgg

SEQ ID NO: 179961 - DNA, 25 bp, Homo sapien
actggcgcgttaggaagtgtattca

SEQ ID NO: 179962 - DNA, 25 bp, Homo sapien
ccaagctagggcactctggtgtaca

SEQ ID NO: 179963 - DNA, 25 bp, Homo sapien
ctgctcggtcaggattctttgtttg

SEQ ID NO: 179964 - DNA, 25 bp, Homo sapien
cagatgccggcgaagggaacttgat

SEQ ID NO: 179965 - DNA, 25 bp, Homo sapien
tgccggcgaagggaacttgatgccc

SEQ ID NO: 179966 - DNA, 25 bp, Homo sapien
atgcccgctgctcggtcaggattct

SEQ ID NO: 179967 - DNA, 25 bp, Homo sapien
tggggagcggtaccgctgccaccac

SEQ ID NO: 179968 - DNA, 25 bp, Homo sapien
tttcccggcgtccagggcccagatg

SEQ ID NO: 179969 - DNA, 25 bp, Homo sapien
tcgctttcgcggcgacgtccgggct

SEQ ID NO: 179970 - DNA, 25 bp, Homo sapien
aagggaacttgatgcccgctgctcg

SEQ ID NO: 179971 - DNA, 25 bp, Homo sapien
ggtgaacttcctcaggtgacgtctg

SEQ ID NO: 179972 - DNA, 25 bp, Homo sapien
ccttggagactgtaggcggaatcgc

SEQ ID NO: 179973 - DNA, 25 bp, Homo sapien
tccttcttggtttggtaagagcagc

SEQ ID NO: 179974 - DNA, 25 bp, Homo sapien
ctctaggggcctatctgggtttcct

SEQ ID NO: 179975 - DNA, 25 bp, Homo sapien
tgagccttttgtccatccgggcgtg

SEQ ID NO: 179976 - DNA, 25 bp, Homo sapien
gaccagtgtggcctgtgagcctttt

SEQ ID NO: 179977 - DNA, 25 bp, Homo sapien
ccgcaccgagtgcacgtgtttcaca

SEQ ID NO: 179978 - DNA, 25 bp, Homo sapien
tccattgcgtttcacagcggctccg

SEQ ID NO: 179979 - DNA, 25 bp, Homo sapien
atgtcccaaatgacctgcgccaggc

SEQ ID NO: 179980 - DNA, 25 bp, Homo sapien
acccgcagatgtcccaaatgacctg

SEQ ID NO: 179981 - DNA, 25 bp, Homo sapien
gccaacccgcagatgtcccaaatga

SEQ ID NO: 179982 - DNA, 25 bp, Homo sapien
gcggggatcgcaaactgtagacaga

SEQ ID NO: 179983 - DNA, 25 bp, Homo sapien
catcagcagctccagttcgttcagc

SEQ ID NO: 179984 - DNA, 25 bp, Homo sapien
caaaaactcttctccatcagcagct

SEQ ID NO: 179985 - DNA, 25 bp, Homo sapien
tccttctttcaaatctcccgctttg

SEQ ID NO: 179986 - DNA, 25 bp, Homo sapien
actccggaggctcgtcgggtgccca

SEQ ID NO: 179987 - DNA, 25 bp, Homo sapien
gaaacacctagagaacctcgagccc

SEQ ID NO: 179988 - DNA, 25 bp, Homo sapien
atgtagtcatagaaacacctagaga

SEQ ID NO: 179989 - DNA, 25 bp, Homo sapien
cacacaatgtagtcatagaaacacc

SEQ ID NO: 179990 - DNA, 25 bp, Homo sapien
gttccaacgacaaaaacagccagcg

SEQ ID NO: 179991 - DNA, 25 bp, Homo sapien
tcatagaaacacctagagaacctcg

SEQ ID NO: 179992 - DNA, 25 bp, Homo sapien
ctcccacacacacaatgtagtcata

SEQ ID NO: 179993 - DNA, 25 bp, Homo sapien
caggaacggccctctcgcgggcaac

SEQ ID NO: 179994 - DNA, 25 bp, Homo sapien
cagatccaaaccagttccaacgaca

SEQ ID NO: 179995 - DNA, 25 bp, Homo sapien
ggaaataactcacttctcgcagttt

SEQ ID NO: 179996 - DNA, 25 bp, Homo sapien
tggttacatccttcgggttagccgc

SEQ ID NO: 179997 - DNA, 25 bp, Homo sapien
gccagtggttacatccttcgggtta

SEQ ID NO: 179998 - DNA, 25 bp, Homo sapien
ctcagccgtgccagtggttacatcc

SEQ ID NO: 179999 - DNA, 25 bp, Homo sapien
cagtttactcctggggccgagacct

SEQ ID NO: 180000 - DNA, 25 bp, Homo sapien
tggggccgagacctgggaaacatcc

SEQ ID NO: 180001 - DNA, 25 bp, Homo sapien
gttcatcctgctcctcgctcgccag

SEQ ID NO: 180002 - DNA, 25 bp, Homo sapien
tctcgcagtttactcctggggccga

SEQ ID NO: 180003 - DNA, 25 bp, Homo sapien
atactggccggcatgacattggggt

SEQ ID NO: 180004 - DNA, 25 bp, Homo sapien
tctccgtacatggaagcgggaaccc

SEQ ID NO: 180005 - DNA, 25 bp, Homo sapien
tcgttgacagcggatcccatactgg

SEQ ID NO: 180006 - DNA, 25 bp, Homo sapien
ttcaaggcgtcgttgacagcggatc

SEQ ID NO: 180007 - DNA, 25 bp, Homo sapien
ttgtcccgcttcaaggcgtcgttga

SEQ ID NO: 180008 - DNA, 25 bp, Homo sapien
cgcgtgagggtctccgtacatggaa

SEQ ID NO: 180009 - DNA, 25 bp, Homo sapien
gtccttgtcccgcttcaaggcgtcg

SEQ ID NO: 180010 - DNA, 25 bp, Homo sapien
ggatcccatactggccggcatgaca

SEQ ID NO: 180011 - DNA, 25 bp, Homo sapien
gctcctgcctaactgggtcttgccg

SEQ ID NO: 180012 - DNA, 25 bp, Homo sapien
ctagtgtgcgtctccaaagtggatc

SEQ ID NO: 180013 - DNA, 25 bp, Homo sapien
tccaggaccagaagagaccagctta

SEQ ID NO: 180014 - DNA, 25 bp, Homo sapien
atggggccagctccgaaagaacttt

SEQ ID NO: 180015 - DNA, 25 bp, Homo sapien
tctgcgcagatccagcaaccttgtc

SEQ ID NO: 180016 - DNA, 25 bp, Homo sapien
tggcatggcgctctagcttttgttc

SEQ ID NO: 180017 - DNA, 25 bp, Homo sapien
gtacggtaccgcctcagatcttttc

SEQ ID NO: 180018 - DNA, 25 bp, Homo sapien
agtggcactttcttttctgcgcaga

SEQ ID NO: 180019 - DNA, 25 bp, Homo sapien
agccgctgtctcttccgtcgagttc

SEQ ID NO: 180020 - DNA, 25 bp, Homo sapien
gatattcaccagagctccttcggtc

SEQ ID NO: 180021 - DNA, 25 bp, Homo sapien
tccgaacctgatattcaccagagct

SEQ ID NO: 180022 - DNA, 25 bp, Homo sapien
ctgagttgtcactaatccgaacctg

SEQ ID NO: 180023 - DNA, 25 bp, Homo sapien
cgccggcgtgacttctgagttgtca

SEQ ID NO: 180024 - DNA, 25 bp, Homo sapien
ttctgagaccttggcaaacttccct

SEQ ID NO: 180025 - DNA, 25 bp, Homo sapien
agagctccttcggtcaccgacaacg

SEQ ID NO: 180026 - DNA, 25 bp, Homo sapien
ccgtcgagttctgagaccttggcaa

SEQ ID NO: 180027 - DNA, 25 bp, Homo sapien
gacgtgccctacgagcagcttatgc

SEQ ID NO: 180028 - DNA, 25 bp, Homo sapien
cttaccgcggtgtgggcctggacca

SEQ ID NO: 180029 - DNA, 25 bp, Homo sapien
tggaccagatgctggacgtgcccta

SEQ ID NO: 180030 - DNA, 25 bp, Homo sapien
cttatgcagctatacagtgcgcgtc

SEQ ID NO: 180031 - DNA, 25 bp, Homo sapien
cggcagcagcgtttgaaccgggtct

SEQ ID NO: 180032 - DNA, 25 bp, Homo sapien
gggcggaaacagcactcgccgctga

SEQ ID NO: 180033 - DNA, 25 bp, Homo sapien
caagttcacttaccgcggtgtgggc

SEQ ID NO: 180034 - DNA, 25 bp, Homo sapien
cagctatacagtgcgcgtcggcagc

SEQ ID NO: 180035 - DNA, 25 bp, Homo sapien
gcacagggctccgattcaggacgcc

SEQ ID NO: 180036 - DNA, 25 bp, Homo sapien
gttcctttccggctggccagcattc

SEQ ID NO: 180037 - DNA, 25 bp, Homo sapien
tttccggctggccagcattcctcag

SEQ ID NO: 180038 - DNA, 25 bp, Homo sapien
cagggcctgaggctcatttccattc

SEQ ID NO: 180039 - DNA, 25 bp, Homo sapien
ggctcatttccattcctctcgcata

SEQ ID NO: 180040 - DNA, 25 bp, Homo sapien
ttcctctcgcatacagcctctgttg

SEQ ID NO: 180041 - DNA, 25 bp, Homo sapien
catacagcctctgttgtgcgggccg

SEQ ID NO: 180042 - DNA, 25 bp, Homo sapien
gtagccgcggctgcctacgaacaaa

SEQ ID NO: 180043 - DNA, 25 bp, Homo sapien
taccgttctgggtgaggcatccacc

SEQ ID NO: 180044 - DNA, 25 bp, Homo sapien
ctcggatcccttggctgggcactga

SEQ ID NO: 180045 - DNA, 25 bp, Homo sapien
agcagctctccagtcagcctttgca

SEQ ID NO: 180046 - DNA, 25 bp, Homo sapien
agcgtgtctggaggaatccgccgcc

SEQ ID NO: 180047 - DNA, 25 bp, Homo sapien
cggggaacctgcagccgctcttgtc

SEQ ID NO: 180048 - DNA, 25 bp, Homo sapien
tgaggcatccaccatggtgaggccc

SEQ ID NO: 180049 - DNA, 25 bp, Homo sapien
tgacttcgagttgcagtgattcgcc

SEQ ID NO: 180050 - DNA, 25 bp, Homo sapien
aagtcgcgagggactacttcgcctc

SEQ ID NO: 180051 - DNA, 25 bp, Homo sapien
tcgcctcagcgcgtggagttcctat

SEQ ID NO: 180052 - DNA, 25 bp, Homo sapien
ctcgaggtccgcttcttcggctcgt

SEQ ID NO: 180053 - DNA, 25 bp, Homo sapien
tgggcagcctcaccaacctgacgga

SEQ ID NO: 180054 - DNA, 25 bp, Homo sapien
ggacctgtgcatgccgctcgaggtc

SEQ ID NO: 180055 - DNA, 25 bp, Homo sapien
gggcgtgctctaccgcaagctcacg

SEQ ID NO: 180056 - DNA, 25 bp, Homo sapien
cacaactacgggctgcagctcaacg

SEQ ID NO: 180057 - DNA, 25 bp, Homo sapien
gatgagttcctgctgccgttcacca

SEQ ID NO: 180058 - DNA, 25 bp, Homo sapien
cactcgctgcgcgactcggagatca

SEQ ID NO: 180059 - DNA, 25 bp, Homo sapien
cgggctacttagagcgccgaacagc

SEQ ID NO: 180060 - DNA, 25 bp, Homo sapien
acagctctgggccaaaggaccatga

SEQ ID NO: 180061 - DNA, 25 bp, Homo sapien
tgagtgcttttggagacgccttttc

SEQ ID NO: 180062 - DNA, 25 bp, Homo sapien
gaaaacgcaacctctccttggcctg

SEQ ID NO: 180063 - DNA, 25 bp, Homo sapien
ggctgcttagcctacttcccttggg

SEQ ID NO: 180064 - DNA, 25 bp, Homo sapien
gcctcgaaactctgttgcaggaatc

SEQ ID NO: 180065 - DNA, 25 bp, Homo sapien
cggcccttctagcaccggttttctg

SEQ ID NO: 180066 - DNA, 25 bp, Homo sapien
cgcccgcaggtgatatttgtgttga

SEQ ID NO: 180067 - DNA, 25 bp, Homo sapien
atggacgcctccacaggtcctcggg

SEQ ID NO: 180068 - DNA, 25 bp, Homo sapien
ttcccgtccaggtcttcacagaggc

SEQ ID NO: 180069 - DNA, 25 bp, Homo sapien
gccacgtggcgcacgcgctaattga

SEQ ID NO: 180070 - DNA, 25 bp, Homo sapien
gcgctaattgagtgctgagcccttg

SEQ ID NO: 180071 - DNA, 25 bp, Homo sapien
cttggagatttgtgtcaggagcctg

SEQ ID NO: 180072 - DNA, 25 bp, Homo sapien
ccttggctgtgatccgaggatgaga

SEQ ID NO: 180073 - DNA, 25 bp, Homo sapien
tcccagtgatggacgcctccacagg

SEQ ID NO: 180074 - DNA, 25 bp, Homo sapien
agccgtgtctgcgtgacagaagccg

SEQ ID NO: 180075 - DNA, 25 bp, Homo sapien
gtcaggagcctaggttgccaactta

SEQ ID NO: 180076 - DNA, 25 bp, Homo sapien
cagggcgtcacccaggctcgtaaac

SEQ ID NO: 180077 - DNA, 25 bp, Homo sapien
acctccggccagaaaggagcgcagc

SEQ ID NO: 180078 - DNA, 25 bp, Homo sapien
ggagcgcagccagtagaagtctctg

SEQ ID NO: 180079 - DNA, 25 bp, Homo sapien
cgccatcaggaccagggtcgcgtca

SEQ ID NO: 180080 - DNA, 25 bp, Homo sapien
ggctcttcgtggcatggacccacct

SEQ ID NO: 180081 - DNA, 25 bp, Homo sapien
tgccaacttacagaacaccggacgg

SEQ ID NO: 180082 - DNA, 25 bp, Homo sapien
accatagccggaacaggcggtgaca

SEQ ID NO: 180083 - DNA, 25 bp, Homo sapien
tccgcgaagagcttcggccctagca

SEQ ID NO: 180084 - DNA, 25 bp, Homo sapien
ggccctagcagatctcaccggacga

SEQ ID NO: 180085 - DNA, 25 bp, Homo sapien
ttcccaagaaaggacacaggcgctc

SEQ ID NO: 180086 - DNA, 25 bp, Homo sapien
gtgcaccgcaggcacaaactttgtg

SEQ ID NO: 180087 - DNA, 25 bp, Homo sapien
tctcttggccaaagggttaagtctc

SEQ ID NO: 180088 - DNA, 25 bp, Homo sapien
tccacctcagctcgggaaacgggct

SEQ ID NO: 180089 - DNA, 25 bp, Homo sapien
tgtatatatcagagcgcggagtccg

SEQ ID NO: 180090 - DNA, 25 bp, Homo sapien
agcactgcagtgaggacgccttctc

SEQ ID NO: 180091 - DNA, 25 bp, Homo sapien
cgcgctccggtacacacaggtaagt

SEQ ID NO: 180092 - DNA, 25 bp, Homo sapien
tgtcgctctccaggagcaacctcta

SEQ ID NO: 180093 - DNA, 25 bp, Homo sapien
cgaggaccaaagctgcccgggacat

SEQ ID NO: 180094 - DNA, 25 bp, Homo sapien
tgagaagttctagtgctcccaagcc

SEQ ID NO: 180095 - DNA, 25 bp, Homo sapien
gcgggcaccgacttttctgagaagt

SEQ ID NO: 180096 - DNA, 25 bp, Homo sapien
caaccaggcattccgggagatcagc

SEQ ID NO: 180097 - DNA, 25 bp, Homo sapien
cccttttcgggatgcttgctgatca

SEQ ID NO: 180098 - DNA, 25 bp, Homo sapien
ggtactttaacgaatggctctcttg

SEQ ID NO: 180099 - DNA, 25 bp, Homo sapien
tcgcgatagcggaaagggctgtacc

SEQ ID NO: 180100 - DNA, 25 bp, Homo sapien
gggctgtaccatccggaaatgggac

SEQ ID NO: 180101 - DNA, 25 bp, Homo sapien
gacagtccatctacatgccaagcgg

SEQ ID NO: 180102 - DNA, 25 bp, Homo sapien
aggagaggggtctctcccgccacct

SEQ ID NO: 180103 - DNA, 25 bp, Homo sapien
gggaccgctgtttccctggcaacca

SEQ ID NO: 180104 - DNA, 25 bp, Homo sapien
ctggcaaccagatgcgcgatgcttc

SEQ ID NO: 180105 - DNA, 25 bp, Homo sapien
tgtgtccttccgtcttcgctgccga

SEQ ID NO: 180106 - DNA, 25 bp, Homo sapien
agatgcgcgatgcttccggtctcgc

SEQ ID NO: 180107 - DNA, 25 bp, Homo sapien
tggatcccagtcagcagccacaaga

SEQ ID NO: 180108 - DNA, 25 bp, Homo sapien
gatccagctcccgttatgtcccatg

SEQ ID NO: 180109 - DNA, 25 bp, Homo sapien
cagcgcctttttgcctctgcatggc

SEQ ID NO: 180110 - DNA, 25 bp, Homo sapien
cccagcccactcgacaggaatggaa

SEQ ID NO: 180111 - DNA, 25 bp, Homo sapien
agggctagggcatccctctccagtc

SEQ ID NO: 180112 - DNA, 25 bp, Homo sapien
tggccgaagctatttttcagtcctg

SEQ ID NO: 180113 - DNA, 25 bp, Homo sapien
gcgatgtgaagccaacgtaatgccc

SEQ ID NO: 180114 - DNA, 25 bp, Homo sapien
cctcggccgctagaacacagcttga

SEQ ID NO: 180115 - DNA, 25 bp, Homo sapien
gccaaagcccggacacttccagatt

SEQ ID NO: 180116 - DNA, 25 bp, Homo sapien
gcggacttccaagacctgcggccgg

SEQ ID NO: 180117 - DNA, 25 bp, Homo sapien
ggaggccatttacggcgcggacttc

SEQ ID NO: 180118 - DNA, 25 bp, Homo sapien
gctacaggccctggaggccatttac

SEQ ID NO: 180119 - DNA, 25 bp, Homo sapien
cgcaacgacaggaccacgagctaca

SEQ ID NO: 180120 - DNA, 25 bp, Homo sapien
tccggagagctacccgcaacgacag

SEQ ID NO: 180121 - DNA, 25 bp, Homo sapien
acgagcccgtttccagcgtggaaca

SEQ ID NO: 180122 - DNA, 25 bp, Homo sapien
ttccagcgtggaacaccgcccatag

SEQ ID NO: 180123 - DNA, 25 bp, Homo sapien
agtccttcctgtaagcgcacggcgc

SEQ ID NO: 180124 - DNA, 25 bp, Homo sapien
ctggccaaggatgaccgagctgcac

SEQ ID NO: 180125 - DNA, 25 bp, Homo sapien
tgtgcgctactacaacgcctggatc

SEQ ID NO: 180126 - DNA, 25 bp, Homo sapien
tcacggctgcaccatgagaacattg

SEQ ID NO: 180127 - DNA, 25 bp, Homo sapien
ttccgcaggatcaagggcgaagtga

SEQ ID NO: 180128 - DNA, 25 bp, Homo sapien
tgctgctacgcagtgaagcgcatcc

SEQ ID NO: 180129 - DNA, 25 bp, Homo sapien
agaacaagttggacggctgctgcta

SEQ ID NO: 180130 - DNA, 25 bp, Homo sapien
ctgtgccgcaggtgcagaacaagtt

SEQ ID NO: 180131 - DNA, 25 bp, Homo sapien
cctgggtcgtcacatgcgagaaatc

SEQ ID NO: 180132 - DNA, 25 bp, Homo sapien
aaatcctcgtcctgccgcgtcaagg

SEQ ID NO: 180133 - DNA, 25 bp, Homo sapien
cgctgcttacacttcttcaaggtga

SEQ ID NO: 180134 - DNA, 25 bp, Homo sapien
tccgtcaggaactggaaaacaacag

SEQ ID NO: 180135 - DNA, 25 bp, Homo sapien
ggcacaggtctcgagtaacgcctga

SEQ ID NO: 180136 - DNA, 25 bp, Homo sapien
gacttccgctactagacttccattg

SEQ ID NO: 180137 - DNA, 25 bp, Homo sapien
aaaagtctggtcagctccgtcagga

SEQ ID NO: 180138 - DNA, 25 bp, Homo sapien
ttcaaggtgatatagacgctgcccg

SEQ ID NO: 180139 - DNA, 25 bp, Homo sapien
tgcaaggggccgagcaaaattccga

SEQ ID NO: 180140 - DNA, 25 bp, Homo sapien
ttcccatggaaacattgcaaggggc

SEQ ID NO: 180141 - DNA, 25 bp, Homo sapien
ctgccagggacggtcacgaatgtac

SEQ ID NO: 180142 - DNA, 25 bp, Homo sapien
gcgtcacgccgaggactgaccaatg

SEQ ID NO: 180143 - DNA, 25 bp, Homo sapien
cggggcatcccgcaaacagctgatg

SEQ ID NO: 180144 - DNA, 25 bp, Homo sapien
tgtttccaaaatacgcctgctcggg

SEQ ID NO: 180145 - DNA, 25 bp, Homo sapien
cgcacggtgcggtattgtttccaaa

SEQ ID NO: 180146 - DNA, 25 bp, Homo sapien
acgaatgtacgaaccttcccatgga

SEQ ID NO: 180147 - DNA, 25 bp, Homo sapien
gagccgcgactcaagacagcacctg

SEQ ID NO: 180148 - DNA, 25 bp, Homo sapien
acgtgccttggtcgcttctgtagct

SEQ ID NO: 180149 - DNA, 25 bp, Homo sapien
tatttgttttgcctaagcctgctgc

SEQ ID NO: 180150 - DNA, 25 bp, Homo sapien
cgagttcgcggactaaacaggcata

SEQ ID NO: 180151 - DNA, 25 bp, Homo sapien
cacggccattgaatcccaaaaacta

SEQ ID NO: 180152 - DNA, 25 bp, Homo sapien
ttcccattatgcaccgcgagttcgc

SEQ ID NO: 180153 - DNA, 25 bp, Homo sapien
tcggctcagagactcggcttcgagc

SEQ ID NO: 180154 - DNA, 25 bp, Homo sapien
ccagaatgccttgggcgagacgcga

SEQ ID NO: 180155 - DNA, 25 bp, Homo sapien
ctgacccactgactaggctgagccg

SEQ ID NO: 180156 - DNA, 25 bp, Homo sapien
gcaagaagaaatatgtgaaaacgga

SEQ ID NO: 180157 - DNA, 25 bp, Homo sapien
gacccactgactaggctgagccggg

SEQ ID NO: 180158 - DNA, 25 bp, Homo sapien
ccgtggacggtgtacaacagagcta

SEQ ID NO: 180159 - DNA, 25 bp, Homo sapien
gtggacggtgtacaacagagctacc

SEQ ID NO: 180160 - DNA, 25 bp, Homo sapien
ggacggtgtacaacagagctaccca

SEQ ID NO: 180161 - DNA, 25 bp, Homo sapien
cggtgtacaacagagctacccactc

SEQ ID NO: 180162 - DNA, 25 bp, Homo sapien
atatactccaaagttgtgttctttt

SEQ ID NO: 180163 - DNA, 25 bp, Homo sapien
gaggtatcggccacccgctccggag

SEQ ID NO: 180164 - DNA, 25 bp, Homo sapien
tggacctttgggaaccgactcctca

SEQ ID NO: 180165 - DNA, 25 bp, Homo sapien
ggcgcgagttggaaagtttgcccga

SEQ ID NO: 180166 - DNA, 25 bp, Homo sapien
tgccctgggaatgtgacccggccag

SEQ ID NO: 180167 - DNA, 25 bp, Homo sapien
tggctctcccgctgcctcaggggtg

SEQ ID NO: 180168 - DNA, 25 bp, Homo sapien
ttgttgccggagataaacaatgccc

SEQ ID NO: 180169 - DNA, 25 bp, Homo sapien
gcctcgcccaagtcatgcagcccta

SEQ ID NO: 180170 - DNA, 25 bp, Homo sapien
cgggacgcttttgttgccggagata

SEQ ID NO: 180171 - DNA, 25 bp, Homo sapien
ctcggcggccacactctggagacag

SEQ ID NO: 180172 - DNA, 25 bp, Homo sapien
aagccggcccactagcactgagtca

SEQ ID NO: 180173 - DNA, 25 bp, Homo sapien
cgccagcagccatccaggtgactaa

SEQ ID NO: 180174 - DNA, 25 bp, Homo sapien
tctggagacagccacggtccaggca

SEQ ID NO: 180175 - DNA, 25 bp, Homo sapien
atggagaaatcccaaagtgagccgg

SEQ ID NO: 180176 - DNA, 25 bp, Homo sapien
cgagcaggtcgatgcctgaggattt

SEQ ID NO: 180177 - DNA, 25 bp, Homo sapien
ttgccaagcaacgttggagcagctc

SEQ ID NO: 180178 - DNA, 25 bp, Homo sapien
ctgctcccgtcctgatgtgccagga

SEQ ID NO: 180179 - DNA, 25 bp, Homo sapien
ttctgatctgtttccgcgcaggcct

SEQ ID NO: 180180 - DNA, 25 bp, Homo sapien
cccgcgggaacacttgctacatttg

SEQ ID NO: 180181 - DNA, 25 bp, Homo sapien
ggcgctcagctgattctccaggtcg

SEQ ID NO: 180182 - DNA, 25 bp, Homo sapien
gcctggacgtcagccagtcgcaaca

SEQ ID NO: 180183 - DNA, 25 bp, Homo sapien
gcgatgccagtgaacgaggtgatta

SEQ ID NO: 180184 - DNA, 25 bp, Homo sapien
ccggcgctgcaccaacgtgtaagcg

SEQ ID NO: 180185 - DNA, 25 bp, Homo sapien
atcaaaatcgcggtcaggtgaagcc

SEQ ID NO: 180186 - DNA, 25 bp, Homo sapien
acctcttcgagcgttcctgggcttc

SEQ ID NO: 180187 - DNA, 25 bp, Homo sapien
ccagctctcgccagagtttgatata

SEQ ID NO: 180188 - DNA, 25 bp, Homo sapien
gacccgctgctttctgcttcatata

SEQ ID NO: 180189 - DNA, 25 bp, Homo sapien
ttaagcctcggaatcagacccgctg

SEQ ID NO: 180190 - DNA, 25 bp, Homo sapien
gccgtttcacgtcgcaaacacttta

SEQ ID NO: 180191 - DNA, 25 bp, Homo sapien
cgggtctcgaactctagcatccatc

SEQ ID NO: 180192 - DNA, 25 bp, Homo sapien
tgcggttgcctctgacttactcatc

SEQ ID NO: 180193 - DNA, 25 bp, Homo sapien
cgccgcctcgctaggccagtatagg

SEQ ID NO: 180194 - DNA, 25 bp, Homo sapien
ccctcgcggagcttctatttaaaga

SEQ ID NO: 180195 - DNA, 25 bp, Homo sapien
tcgggagcagagactcgaccctctc

SEQ ID NO: 180196 - DNA, 25 bp, Homo sapien
gggtcaccgctgaactgcaccagca

SEQ ID NO: 180197 - DNA, 25 bp, Homo sapien
cctggaggtgttgattgctcgctac

SEQ ID NO: 180198 - DNA, 25 bp, Homo sapien
gaggttcctactccgctgtcccgga

SEQ ID NO: 180199 - DNA, 25 bp, Homo sapien
gcacaggtccttgggtttgagcatg

SEQ ID NO: 180200 - DNA, 25 bp, Homo sapien
gcggtccagcgcatccaacacgaag

SEQ ID NO: 180201 - DNA, 25 bp, Homo sapien
cggcagtcgatgatgctgcggtcca

SEQ ID NO: 180202 - DNA, 25 bp, Homo sapien
gcgctcgtctcgcaggttcactgca

SEQ ID NO: 180203 - DNA, 25 bp, Homo sapien
acgagccttacctcttcttgcgaga

SEQ ID NO: 180204 - DNA, 25 bp, Homo sapien
ctcttcttgcgagagcccttgccgg

SEQ ID NO: 180205 - DNA, 25 bp, Homo sapien
acgtgctgctccttgcgcttcagaa

SEQ ID NO: 180206 - DNA, 25 bp, Homo sapien
tgcgcttcagaacgcactcgtactg

SEQ ID NO: 180207 - DNA, 25 bp, Homo sapien
ttcagaacgcactcgtactgctcct

SEQ ID NO: 180208 - DNA, 25 bp, Homo sapien
agcctgtctttcagctcccgcacgc

SEQ ID NO: 180209 - DNA, 25 bp, Homo sapien
ggacaggccctgagatcctgcgcca

SEQ ID NO: 180210 - DNA, 25 bp, Homo sapien
agcccttgccgggaccgagcttgca

SEQ ID NO: 180211 - DNA, 25 bp, Homo sapien
aggcgccagagttgacagctcgcgc

SEQ ID NO: 180212 - DNA, 25 bp, Homo sapien
gtgttcgcctacgtgctctccgtgt

SEQ ID NO: 180213 - DNA, 25 bp, Homo sapien
tacgtgctctccgtgtcgctggccg

SEQ ID NO: 180214 - DNA, 25 bp, Homo sapien
tacagcctcatctggcagccggtgg

SEQ ID NO: 180215 - DNA, 25 bp, Homo sapien
tggcggccaagaccaacaagaagtg

SEQ ID NO: 180216 - DNA, 25 bp, Homo sapien
gagttgacagctcgcgctccgaccg

SEQ ID NO: 180217 - DNA, 25 bp, Homo sapien
ttaagagccagcctcccttaactct

SEQ ID NO: 180218 - DNA, 25 bp, Homo sapien
acaagaagtgggtccggctcgccac

SEQ ID NO: 180219 - DNA, 25 bp, Homo sapien
tcagagcctacgcatgcgcacgagc

SEQ ID NO: 180220 - DNA, 25 bp, Homo sapien
cgcagtaacctcagtccgggtttca

SEQ ID NO: 180221 - DNA, 25 bp, Homo sapien
gggtcaatttcctcgctccctgaca

SEQ ID NO: 180222 - DNA, 25 bp, Homo sapien
gacagctccgcagatccgtatcaca

SEQ ID NO: 180223 - DNA, 25 bp, Homo sapien
atcttagagacagagcgctccgctc

SEQ ID NO: 180224 - DNA, 25 bp, Homo sapien
cggactcctaacagcggctctctgg

SEQ ID NO: 180225 - DNA, 25 bp, Homo sapien
gagctcgccctctatccggctggaa

SEQ ID NO: 180226 - DNA, 25 bp, Homo sapien
ggatctctgcatgtgtcgcgctctc

SEQ ID NO: 180227 - DNA, 25 bp, Homo sapien
agagcttcttcgacaccctgcagga

SEQ ID NO: 180228 - DNA, 25 bp, Homo sapien
atcttcttcgacctgtggcgcctta

SEQ ID NO: 180229 - DNA, 25 bp, Homo sapien
gccttagcaagagccagctgccgtc

SEQ ID NO: 180230 - DNA, 25 bp, Homo sapien
cggcgtcatcaagttccgctacatc

SEQ ID NO: 180231 - DNA, 25 bp, Homo sapien
cttcgagcgcttcgacgcggagtat

SEQ ID NO: 180232 - DNA, 25 bp, Homo sapien
atcgccagctgttcctgttcgagca

SEQ ID NO: 180233 - DNA, 25 bp, Homo sapien
gggcccggaatcagagcttcttcga

SEQ ID NO: 180234 - DNA, 25 bp, Homo sapien
acgctgtgtttcgtggagaccctcc

SEQ ID NO: 180235 - DNA, 25 bp, Homo sapien
ctatttgaaacccaggcggccgact

SEQ ID NO: 180236 - DNA, 25 bp, Homo sapien
cctcgttacgatgaccagtgtggtt

SEQ ID NO: 180237 - DNA, 25 bp, Homo sapien
cacgacagttgctgcagggaatctt

SEQ ID NO: 180238 - DNA, 25 bp, Homo sapien
tccgcctagctaccggaagtttcta

SEQ ID NO: 180239 - DNA, 25 bp, Homo sapien
ggctgtctacagagtgcgattccca

SEQ ID NO: 180240 - DNA, 25 bp, Homo sapien
gttttccgtacaacatggctgtcta

SEQ ID NO: 180241 - DNA, 25 bp, Homo sapien
ttccgtacagtatggcggctcccga

SEQ ID NO: 180242 - DNA, 25 bp, Homo sapien
ctgtaccttccagggttcagccgtg

SEQ ID NO: 180243 - DNA, 25 bp, Homo sapien
tcgcttttgcccgtggacgatgcaa

SEQ ID NO: 180244 - DNA, 25 bp, Homo sapien
ccagcatttgcagcgttcggggcag

SEQ ID NO: 180245 - DNA, 25 bp, Homo sapien
caggcgatcacggttgattggctcg

SEQ ID NO: 180246 - DNA, 25 bp, Homo sapien
ccgcctagggtgattggctgctgca

SEQ ID NO: 180247 - DNA, 25 bp, Homo sapien
ggagctaagagctggctcagtttca

SEQ ID NO: 180248 - DNA, 25 bp, Homo sapien
acgatgcaatcaatgggctaagcga

SEQ ID NO: 180249 - DNA, 25 bp, Homo sapien
cttcgtgcatggcagagatggcgac

SEQ ID NO: 180250 - DNA, 25 bp, Homo sapien
agtttcagcgctggctcttcgtgca

SEQ ID NO: 180251 - DNA, 25 bp, Homo sapien
cggatcacgtgaccgccatttcttt

SEQ ID NO: 180252 - DNA, 25 bp, Homo sapien
ttctccgtgcgtggtaaacgagccc

SEQ ID NO: 180253 - DNA, 25 bp, Homo sapien
atcttgtcgaatctgtggaagggcc

SEQ ID NO: 180254 - DNA, 25 bp, Homo sapien
gccgggtctcttaacatcttgtcga

SEQ ID NO: 180255 - DNA, 25 bp, Homo sapien
gcatgcgcctaaagctgacgggttt

SEQ ID NO: 180256 - DNA, 25 bp, Homo sapien
cccgctcattgttaagcgaggccaa

SEQ ID NO: 180257 - DNA, 25 bp, Homo sapien
gcccttccttcagagcaagcgcaag

SEQ ID NO: 180258 - DNA, 25 bp, Homo sapien
aggcaacccttaggcgcgctctatt

SEQ ID NO: 180259 - DNA, 25 bp, Homo sapien
tacgtgttgctgtcataaagttatc

SEQ ID NO: 180260 - DNA, 25 bp, Homo sapien
ttgctgtcataaagttatcactctg

SEQ ID NO: 180261 - DNA, 25 bp, Homo sapien
tgtctacttgtctctctagccccag

SEQ ID NO: 180262 - DNA, 25 bp, Homo sapien
ctaaggcaggccctctgcctggggc

SEQ ID NO: 180263 - DNA, 25 bp, Homo sapien
gagtccttcgcccttgcggcgggct

SEQ ID NO: 180264 - DNA, 25 bp, Homo sapien
gggccaggtgatctcgaaccttctc

SEQ ID NO: 180265 - DNA, 25 bp, Homo sapien
gtgatctcgaaccttctctctctca

SEQ ID NO: 180266 - DNA, 25 bp, Homo sapien
tatcactctgttttctgtctacttg

SEQ ID NO: 180267 - DNA, 25 bp, Homo sapien
gggaatcgaagttgtcagaccgcct

SEQ ID NO: 180268 - DNA, 25 bp, Homo sapien
cgcgccgcccgttctggtgagtcag

SEQ ID NO: 180269 - DNA, 25 bp, Homo sapien
aagtgacagcgggaccctgtgctcg

SEQ ID NO: 180270 - DNA, 25 bp, Homo sapien
cgctgggagctgaccggttattgct

SEQ ID NO: 180271 - DNA, 25 bp, Homo sapien
gaagttgtcagaccgcctccaagtg

SEQ ID NO: 180272 - DNA, 25 bp, Homo sapien
acccgactcgatcgggctgagagga

SEQ ID NO: 180273 - DNA, 25 bp, Homo sapien
ggagtagtgtagacccgactcgatc

SEQ ID NO: 180274 - DNA, 25 bp, Homo sapien
gtcagaccgcctccaagtgacagcg

SEQ ID NO: 180275 - DNA, 25 bp, Homo sapien
acagcgtggacgtccgcctcaagat

SEQ ID NO: 180276 - DNA, 25 bp, Homo sapien
gcctgctctaactggaagcgggtga

SEQ ID NO: 180277 - DNA, 25 bp, Homo sapien
tgctgccgtccatgctgatgtttgc

SEQ ID NO: 180278 - DNA, 25 bp, Homo sapien
ctgctcatgatcgagcggggcatcc

SEQ ID NO: 180279 - DNA, 25 bp, Homo sapien
atccgagagtaccagcaacgctatg

SEQ ID NO: 180280 - DNA, 25 bp, Homo sapien
gccacatcctcgtaagtgaccgtta

SEQ ID NO: 180281 - DNA, 25 bp, Homo sapien
tgaggagattcgctaccgcctgcag

SEQ ID NO: 180282 - DNA, 25 bp, Homo sapien
gcctcaagatggaccaccgcagtga

SEQ ID NO: 180283 - DNA, 25 bp, Homo sapien
tgcaggatctgcagagacgcctcct

SEQ ID NO: 180284 - DNA, 25 bp, Homo sapien
aggctctggaacactcccgccaagg

SEQ ID NO: 180285 - DNA, 25 bp, Homo sapien
aacactcccgccaaggccaagaggg

SEQ ID NO: 180286 - DNA, 25 bp, Homo sapien
cctccgccagactctggcggtggga

SEQ ID NO: 180287 - DNA, 25 bp, Homo sapien
acgcctcctgggctttctgttctgg

SEQ ID NO: 180288 - DNA, 25 bp, Homo sapien
ggctttctgttctggcctcgcgttt

SEQ ID NO: 180289 - DNA, 25 bp, Homo sapien
cgcctcggtgtgaaggcagcttagt

SEQ ID NO: 180290 - DNA, 25 bp, Homo sapien
aggcagcttagtgctgtgcccgccc

SEQ ID NO: 180291 - DNA, 25 bp, Homo sapien
tctagccgccgcgtaagagccgagg

SEQ ID NO: 180292 - DNA, 25 bp, Homo sapien
cgccacttagttcacgctggttgta

SEQ ID NO: 180293 - DNA, 25 bp, Homo sapien
agtgaaccgcgtctccgctcttctg

SEQ ID NO: 180294 - DNA, 25 bp, Homo sapien
ttttaagacgactctcccgatgccg

SEQ ID NO: 180295 - DNA, 25 bp, Homo sapien
cggactgtatgtgcctcccacgatg

SEQ ID NO: 180296 - DNA, 25 bp, Homo sapien
tctgatcatggctctggcctcacgc

SEQ ID NO: 180297 - DNA, 25 bp, Homo sapien
ccctggcagataacaggcctctgtg

SEQ ID NO: 180298 - DNA, 25 bp, Homo sapien
cccgatcagatggaaaagaacgttt

SEQ ID NO: 180299 - DNA, 25 bp, Homo sapien
gggccgcctgcaactcaacgagaag

SEQ ID NO: 180300 - DNA, 25 bp, Homo sapien
ggtgcggccctattactttgacttc

SEQ ID NO: 180301 - DNA, 25 bp, Homo sapien
tggacattggcgctacgaccttagg

SEQ ID NO: 180302 - DNA, 25 bp, Homo sapien
agttattacttcgagggcggcctgc

SEQ ID NO: 180303 - DNA, 25 bp, Homo sapien
gggcttcgcatcagcaaaacggtga

SEQ ID NO: 180304 - DNA, 25 bp, Homo sapien
ggcccaatggcagaaacagtgtcta

SEQ ID NO: 180305 - DNA, 25 bp, Homo sapien
ggcgccctagctttaccaggacttg

SEQ ID NO: 180306 - DNA, 25 bp, Homo sapien
gcacgtcttcagtaccgagttccga

SEQ ID NO: 180307 - DNA, 25 bp, Homo sapien
ctaggcggttagatttgaatacttc

SEQ ID NO: 180308 - DNA, 25 bp, Homo sapien
actctttcgttctgggcttcaggga

SEQ ID NO: 180309 - DNA, 25 bp, Homo sapien
tgcgcaaaatttgtcgaggaggttt

SEQ ID NO: 180310 - DNA, 25 bp, Homo sapien
tgaatacttcactgaggcgagccgg

SEQ ID NO: 180311 - DNA, 25 bp, Homo sapien
cgcggcaggtaaagagaatgactct

SEQ ID NO: 180312 - DNA, 25 bp, Homo sapien
cgtgcgcatcacctaggcggttaga

SEQ ID NO: 180313 - DNA, 25 bp, Homo sapien
cggctgtctgtttccgctctaagga

SEQ ID NO: 180314 - DNA, 25 bp, Homo sapien
taaggaaactcagagcgtgtggacc

SEQ ID NO: 180315 - DNA, 25 bp, Homo sapien
cgcgcaggatcaagctctcgagctc

SEQ ID NO: 180316 - DNA, 25 bp, Homo sapien
agtccagctgcgatggtgagaactc

SEQ ID NO: 180317 - DNA, 25 bp, Homo sapien
ggccgacgcattacctcttgggagt

SEQ ID NO: 180318 - DNA, 25 bp, Homo sapien
gtcgtggtcttcgatctggtaaaca

SEQ ID NO: 180319 - DNA, 25 bp, Homo sapien
actcctaggctcagacgatactctc

SEQ ID NO: 180320 - DNA, 25 bp, Homo sapien
gcagtctgtaaactcgcgcaggatc

SEQ ID NO: 180321 - DNA, 25 bp, Homo sapien
gctgggaactgcaactcatctgggt

SEQ ID NO: 180322 - DNA, 25 bp, Homo sapien
ttgccgtggttagcctcgaactcct

SEQ ID NO: 180323 - DNA, 25 bp, Homo sapien
tcagtgaccgtgacgtcaggcaggc

SEQ ID NO: 180324 - DNA, 25 bp, Homo sapien
tggcctggcaggagatccactcaga

SEQ ID NO: 180325 - DNA, 25 bp, Homo sapien
agagtccggcttctgggccttcaac

SEQ ID NO: 180326 - DNA, 25 bp, Homo sapien
ggcaggagatccactcagaccctta

SEQ ID NO: 180327 - DNA, 25 bp, Homo sapien
ggaaagcaagaaggggcccaagaca

SEQ ID NO: 180328 - DNA, 25 bp, Homo sapien
cgacccgggtcacagagtccggctt

SEQ ID NO: 180329 - DNA, 25 bp, Homo sapien
gcgggctcacgctgtcagtgaccgt

SEQ ID NO: 180330 - DNA, 25 bp, Homo sapien
acttcttgggcggacgctcgcgcag

SEQ ID NO: 180331 - DNA, 25 bp, Homo sapien
cgccgcgcggcttccgcatcagggc

SEQ ID NO: 180332 - DNA, 25 bp, Homo sapien
ggctcgctggcgctagtgctgtgcc

SEQ ID NO: 180333 - DNA, 25 bp, Homo sapien
gctcgctggcgctagtgctgtgccg

SEQ ID NO: 180334 - DNA, 25 bp, Homo sapien
gcggtgttccgcgctttccgtcgcg

SEQ ID NO: 180335 - DNA, 25 bp, Homo sapien
gccaacgcgcgctgcttctggaacg

SEQ ID NO: 180336 - DNA, 25 bp, Homo sapien
aacgcgcgctgcttctggaacgcgc

SEQ ID NO: 180337 - DNA, 25 bp, Homo sapien
gccgccgcgcggcttccgcatcagg

SEQ ID NO: 180338 - DNA, 25 bp, Homo sapien
cgcgctgcttctggaacgcgcggct

SEQ ID NO: 180339 - DNA, 25 bp, Homo sapien
cggctggaagtcgagggcatcgcca

SEQ ID NO: 180340 - DNA, 25 bp, Homo sapien
ccgccggcgaaagcatggcccggcc

SEQ ID NO: 180341 - DNA, 25 bp, Homo sapien
tcggccgatcctcccgccgagcgag

SEQ ID NO: 180342 - DNA, 25 bp, Homo sapien
gacccgcgcgcagtcggccgatcct

SEQ ID NO: 180343 - DNA, 25 bp, Homo sapien
cctccagagcgctccgccggcctaa

SEQ ID NO: 180344 - DNA, 25 bp, Homo sapien
acgctgggctctggattctcctcca

SEQ ID NO: 180345 - DNA, 25 bp, Homo sapien
aagccgaacgctgggctctggattc

SEQ ID NO: 180346 - DNA, 25 bp, Homo sapien
gaacgaagccgaacgctgggctctg

SEQ ID NO: 180347 - DNA, 25 bp, Homo sapien
cctcagcgcttaaggaatctctgga

SEQ ID NO: 180348 - DNA, 25 bp, Homo sapien
agcgcgcggttcctttacagacttt

SEQ ID NO: 180349 - DNA, 25 bp, Homo sapien
acagactttcctgcgggtccacaga

SEQ ID NO: 180350 - DNA, 25 bp, Homo sapien
ccgcctctgtgctggaattagagtc

SEQ ID NO: 180351 - DNA, 25 bp, Homo sapien
acagtgcgccctgggtggtatttta

SEQ ID NO: 180352 - DNA, 25 bp, Homo sapien
caactggatcactcggcggaagcct

SEQ ID NO: 180353 - DNA, 25 bp, Homo sapien
atctctggagcgcatgtcttggcga

SEQ ID NO: 180354 - DNA, 25 bp, Homo sapien
ctggagcttcaggatagtgtccttc

SEQ ID NO: 180355 - DNA, 25 bp, Homo sapien
accaattcgttagacgcgcgctgca

SEQ ID NO: 180356 - DNA, 25 bp, Homo sapien
tcgaactgtcgcgagaatagcggtc

SEQ ID NO: 180357 - DNA, 25 bp, Homo sapien
cgtaccgtcgggcaaccagaaaatg

SEQ ID NO: 180358 - DNA, 25 bp, Homo sapien
ttcgcctggtccaacttcaggtgtg

SEQ ID NO: 180359 - DNA, 25 bp, Homo sapien
acgcgtcctgatcgtcacggggaaa

SEQ ID NO: 180360 - DNA, 25 bp, Homo sapien
tccacagccggagctcgaactgtcg

SEQ ID NO: 180361 - DNA, 25 bp, Homo sapien
cgaactctcgcgagaatgccgccag

SEQ ID NO: 180362 - DNA, 25 bp, Homo sapien
tctcgcgcgacaggcaccaattcgt

SEQ ID NO: 180363 - DNA, 25 bp, Homo sapien
aggccggcagtcgtgaatgaactac

SEQ ID NO: 180364 - DNA, 25 bp, Homo sapien
cgcctagccctctgggaattgtgtt

SEQ ID NO: 180365 - DNA, 25 bp, Homo sapien
cctcggaccgtccaggaaatgtctg

SEQ ID NO: 180366 - DNA, 25 bp, Homo sapien
ctcccaagagtctaagcgcgcgtga

SEQ ID NO: 180367 - DNA, 25 bp, Homo sapien
caatgcctagcagcgcgtacaggtc

SEQ ID NO: 180368 - DNA, 25 bp, Homo sapien
taagagctccttggtcactgccatg

SEQ ID NO: 180369 - DNA, 25 bp, Homo sapien
ccggcctgacggattcgtactacaa

SEQ ID NO: 180370 - DNA, 25 bp, Homo sapien
agcgtccggattccctgctctaggt

SEQ ID NO: 180371 - DNA, 25 bp, Homo sapien
cgctgactcagtttcaccagaaacc

SEQ ID NO: 180372 - DNA, 25 bp, Homo sapien
catgtccggccctttgttctgcgct

SEQ ID NO: 180373 - DNA, 25 bp, Homo sapien
gggtacttgagctccctagcggtcc

SEQ ID NO: 180374 - DNA, 25 bp, Homo sapien
ggctgatcaggtgtgtctcctcctc

SEQ ID NO: 180375 - DNA, 25 bp, Homo sapien
tcgccttgtggcttctgtgcacgct

SEQ ID NO: 180376 - DNA, 25 bp, Homo sapien
ggagccgactgcctgaacagcttta

SEQ ID NO: 180377 - DNA, 25 bp, Homo sapien
ctgaacagctttaccgccggggtgc

SEQ ID NO: 180378 - DNA, 25 bp, Homo sapien
tgctggacaccaacgcctcggtcag

SEQ ID NO: 180379 - DNA, 25 bp, Homo sapien
ccagcgctaccagcgggtttgtgta

SEQ ID NO: 180380 - DNA, 25 bp, Homo sapien
ctggctgcctctgactgaatgggtc

SEQ ID NO: 180381 - DNA, 25 bp, Homo sapien
ctgacgatgaggctgctcttgccca

SEQ ID NO: 180382 - DNA, 25 bp, Homo sapien
tacccattgcaggtgtagctgacga

SEQ ID NO: 180383 - DNA, 25 bp, Homo sapien
cacgggcgattgaacgtacgtacca

SEQ ID NO: 180384 - DNA, 25 bp, Homo sapien
agcctgagttaggaagagcgtcctg

SEQ ID NO: 180385 - DNA, 25 bp, Homo sapien
ggagctccatccaccaggacttgca

SEQ ID NO: 180386 - DNA, 25 bp, Homo sapien
gctgtgtcccagagctcaatgcgca

SEQ ID NO: 180387 - DNA, 25 bp, Homo sapien
taaggtgcaagactgcgccagattc

SEQ ID NO: 180388 - DNA, 25 bp, Homo sapien
ttcggctctcctagcatttgcgtgg

SEQ ID NO: 180389 - DNA, 25 bp, Homo sapien
tccatcctggatgagtacgagaact

SEQ ID NO: 180390 - DNA, 25 bp, Homo sapien
ggctgcccgattatctcgctgcata

SEQ ID NO: 180391 - DNA, 25 bp, Homo sapien
gcttgggcacgaaagccaaaactgg

SEQ ID NO: 180392 - DNA, 25 bp, Homo sapien
cctggtgtcaaagctcggaactgca

SEQ ID NO: 180393 - DNA, 25 bp, Homo sapien
ggcttgtgttcagcagcactcgcca

SEQ ID NO: 180394 - DNA, 25 bp, Homo sapien
ctggggagttacagcttccattctg

SEQ ID NO: 180395 - DNA, 25 bp, Homo sapien
gcacaattgcgtttcctgcgggtta

SEQ ID NO: 180396 - DNA, 25 bp, Homo sapien
agtctccgtcttcccagtttatgtc

SEQ ID NO: 180397 - DNA, 25 bp, Homo sapien
cccagctcttgggacacgattttca

SEQ ID NO: 180398 - DNA, 25 bp, Homo sapien
ttgacccgggcgcagtaactgaatc

SEQ ID NO: 180399 - DNA, 25 bp, Homo sapien
agggtaccttctcgctcatcatcga

SEQ ID NO: 180400 - DNA, 25 bp, Homo sapien
tcatcatcgaagcttggcacgcgcc

SEQ ID NO: 180401 - DNA, 25 bp, Homo sapien
cggcgcagcgccgaaagagttaatc

SEQ ID NO: 180402 - DNA, 25 bp, Homo sapien
tccacgccggtattgggcaccaact

SEQ ID NO: 180403 - DNA, 25 bp, Homo sapien
ggtccttgaaactgcggcgcctgaa

SEQ ID NO: 180404 - DNA, 25 bp, Homo sapien
cgggaagctgctgcattaaattgta

SEQ ID NO: 180405 - DNA, 25 bp, Homo sapien
tcgccagctcactcccaattgtagg

SEQ ID NO: 180406 - DNA, 25 bp, Homo sapien
acgcgccggcctcatttcaatgtga

SEQ ID NO: 180407 - DNA, 25 bp, Homo sapien
agtttgcaaatctccacgccttctg

SEQ ID NO: 180408 - DNA, 25 bp, Homo sapien
ccggtcctcagtgccggttcttatg

SEQ ID NO: 180409 - DNA, 25 bp, Homo sapien
tcttatggctggaggactatgcgca

SEQ ID NO: 180410 - DNA, 25 bp, Homo sapien
aatcgatttattgaccggcaggtgc

SEQ ID NO: 180411 - DNA, 25 bp, Homo sapien
ctcggcgtcgcaaagagagagctcc

SEQ ID NO: 180412 - DNA, 25 bp, Homo sapien
gctcagagtggccacagagaggtta

SEQ ID NO: 180413 - DNA, 25 bp, Homo sapien
gcggggccagaacctcattaccata

SEQ ID NO: 180414 - DNA, 25 bp, Homo sapien
agtggcctgagccaactctggcgtc

SEQ ID NO: 180415 - DNA, 25 bp, Homo sapien
accttgattctccagtggcctgagc

SEQ ID NO: 180416 - DNA, 25 bp, Homo sapien
tgggaagccgcctgaaactcaaaca

SEQ ID NO: 180417 - DNA, 25 bp, Homo sapien
gatcacgccgggttccgagaaagca

SEQ ID NO: 180418 - DNA, 25 bp, Homo sapien
tcagaccatgctcggcattggcagc

SEQ ID NO: 180419 - DNA, 25 bp, Homo sapien
gtggcacttgccatgacctggagaa

SEQ ID NO: 180420 - DNA, 25 bp, Homo sapien
cgtcctggattcacgggcacctact

SEQ ID NO: 180421 - DNA, 25 bp, Homo sapien
gtgcaactgcccttatggctttgtg

SEQ ID NO: 180422 - DNA, 25 bp, Homo sapien
tgtgaactccacgtcagcgactgtg

SEQ ID NO: 180423 - DNA, 25 bp, Homo sapien
tggagaatgggctcatgtgcacctg

SEQ ID NO: 180424 - DNA, 25 bp, Homo sapien
gtgcggacatccatcgatgcctgtg

SEQ ID NO: 180425 - DNA, 25 bp, Homo sapien
gcctcgagtccctgcttcaacaggg

SEQ ID NO: 180426 - DNA, 25 bp, Homo sapien
ccacagacacctttgtgtgcaactg

SEQ ID NO: 180427 - DNA, 25 bp, Homo sapien
ttgttacagcccgacttcctgtttg

SEQ ID NO: 180428 - DNA, 25 bp, Homo sapien
aaggccgcgagcttctcggaggctc

SEQ ID NO: 180429 - DNA, 25 bp, Homo sapien
gaagccgccgaaggccgcgagcttc

SEQ ID NO: 180430 - DNA, 25 bp, Homo sapien
acagcccgacttcctgtttgcggca

SEQ ID NO: 180431 - DNA, 25 bp, Homo sapien
ccgctgcccggcactagagggcgct

SEQ ID NO: 180432 - DNA, 25 bp, Homo sapien
cgcgctctttgttacagcccgactt

SEQ ID NO: 180433 - DNA, 25 bp, Homo sapien
cgcctgcgaggtcccagcggccttc

SEQ ID NO: 180434 - DNA, 25 bp, Homo sapien
cgacttcctgtttgcggcagccgac

SEQ ID NO: 180435 - DNA, 25 bp, Homo sapien
cgttgcatcactcctgccaggtttg

SEQ ID NO: 180436 - DNA, 25 bp, Homo sapien
tttgctcacaatggccaacggcgtg

SEQ ID NO: 180437 - DNA, 25 bp, Homo sapien
cggaagtttacgacgcccagagcgc

SEQ ID NO: 180438 - DNA, 25 bp, Homo sapien
ccacagaggtggagctgaaccaatc

SEQ ID NO: 180439 - DNA, 25 bp, Homo sapien
cgcggttaagtgagaagcagaatcc

SEQ ID NO: 180440 - DNA, 25 bp, Homo sapien
tgccaggcaccatgaagcaggagtc

SEQ ID NO: 180441 - DNA, 25 bp, Homo sapien
ggcgaccctcaagcgctgtggattt

SEQ ID NO: 180442 - DNA, 25 bp, Homo sapien
agctttcccgcagtgcatgatctca

SEQ ID NO: 180443 - DNA, 25 bp, Homo sapien
gagggcttcagcttccggctgcaaa

SEQ ID NO: 180444 - DNA, 25 bp, Homo sapien
cggaccctgtctaccgccgttgaag

SEQ ID NO: 180445 - DNA, 25 bp, Homo sapien
ttcccagccctagcagtgcgtactg

SEQ ID NO: 180446 - DNA, 25 bp, Homo sapien
tcacttcagaacaagggcgggcccg

SEQ ID NO: 180447 - DNA, 25 bp, Homo sapien
cgggcccgttgatatctctcacact

SEQ ID NO: 180448 - DNA, 25 bp, Homo sapien
tgcggcgcaatggaaggtcttaaac

SEQ ID NO: 180449 - DNA, 25 bp, Homo sapien
gtctgtccctgatgatggcctgtca

SEQ ID NO: 180450 - DNA, 25 bp, Homo sapien
cgcgcgaagctgttggtcgttaaca

SEQ ID NO: 180451 - DNA, 25 bp, Homo sapien
ccaggccagaacaatcgagccgcta

SEQ ID NO: 180452 - DNA, 25 bp, Homo sapien
caaccgccgatgcaaggttactttt

SEQ ID NO: 180453 - DNA, 25 bp, Homo sapien
aaaatgtcgcgagagctttccaggc

SEQ ID NO: 180454 - DNA, 25 bp, Homo sapien
tcgctacagtgagcaagcagatctc

SEQ ID NO: 180455 - DNA, 25 bp, Homo sapien
ctgggactggcgaagattgccgaaa

SEQ ID NO: 180456 - DNA, 25 bp, Homo sapien
atcgagccgctacacgggtggctta

SEQ ID NO: 180457 - DNA, 25 bp, Homo sapien
ggggcgcaacaagacctacacaacc

SEQ ID NO: 180458 - DNA, 25 bp, Homo sapien
ggagaccctgatccatgccatctga

SEQ ID NO: 180459 - DNA, 25 bp, Homo sapien
cctccacgttactgcgggacgaaga

SEQ ID NO: 180460 - DNA, 25 bp, Homo sapien
gtttcccgaggagccaatcagcacg

SEQ ID NO: 180461 - DNA, 25 bp, Homo sapien
gcgaagtttctctccgcaatccgtg

SEQ ID NO: 180462 - DNA, 25 bp, Homo sapien
ccgtgccacctatcgagtaggattc

SEQ ID NO: 180463 - DNA, 25 bp, Homo sapien
cgaacgctgacgttggctcctgagc

SEQ ID NO: 180464 - DNA, 25 bp, Homo sapien
tggcctcacaaccaagggcggctgt

SEQ ID NO: 180465 - DNA, 25 bp, Homo sapien
acccggcggcggttatcaaatcaca

SEQ ID NO: 180466 - DNA, 25 bp, Homo sapien
gcctgtcgcaggttagtttgttgta

SEQ ID NO: 180467 - DNA, 25 bp, Homo sapien
gccgagtgtttcctggcgcattccc

SEQ ID NO: 180468 - DNA, 25 bp, Homo sapien
ctttgttaaggaggcgcgatcgtta

SEQ ID NO: 180469 - DNA, 25 bp, Homo sapien
tacggaggcagcactgtttcgcaca

SEQ ID NO: 180470 - DNA, 25 bp, Homo sapien
gcgtgagcttaatttgcagcacatt

SEQ ID NO: 180471 - DNA, 25 bp, Homo sapien
tgttaatgttgcactaaggtcgcgc

SEQ ID NO: 180472 - DNA, 25 bp, Homo sapien
gccattccgggcattcttggagaga

SEQ ID NO: 180473 - DNA, 25 bp, Homo sapien
gcgcagcaagatctgaacccgtttt

SEQ ID NO: 180474 - DNA, 25 bp, Homo sapien
gcacagctccagtggcgaaggaata

SEQ ID NO: 180475 - DNA, 25 bp, Homo sapien
tcacccgccttctgggtgtgttgca

SEQ ID NO: 180476 - DNA, 25 bp, Homo sapien
cgagtgcatctgttggaccgtgcga

SEQ ID NO: 180477 - DNA, 25 bp, Homo sapien
ggagtaaggcgtgccgctgcaaact

SEQ ID NO: 180478 - DNA, 25 bp, Homo sapien
gccaccttgagaagctgcgaagatg

SEQ ID NO: 180479 - DNA, 25 bp, Homo sapien
cgcgcgagcaagacgatgcccaata

SEQ ID NO: 180480 - DNA, 25 bp, Homo sapien
acctacgacgcaaggagagcgcgcg

SEQ ID NO: 180481 - DNA, 25 bp, Homo sapien
tgacgtgcattccaaccaacctacg

SEQ ID NO: 180482 - DNA, 25 bp, Homo sapien
cgagtgctattgattgacgtgcatt

SEQ ID NO: 180483 - DNA, 25 bp, Homo sapien
agcttggtcaatcgccctctcagtg

SEQ ID NO: 180484 - DNA, 25 bp, Homo sapien
tccgcgcactcgttacctgaacagg

SEQ ID NO: 180485 - DNA, 25 bp, Homo sapien
ggactccctcaagtacagtgacctg

SEQ ID NO: 180486 - DNA, 25 bp, Homo sapien
gtgaagtgtgaaaaaagcgcgcctc

SEQ ID NO: 180487 - DNA, 25 bp, Homo sapien
tgttgggacgggaaatcagcctttc

SEQ ID NO: 180488 - DNA, 25 bp, Homo sapien
ttcaaccaatggaagcgcggcattc

SEQ ID NO: 180489 - DNA, 25 bp, Homo sapien
ccgggatttcgaatcgcgatgatca

SEQ ID NO: 180490 - DNA, 25 bp, Homo sapien
cgctgacgaagtttggtgatccatc

SEQ ID NO: 180491 - DNA, 25 bp, Homo sapien
accctcaagtgccagggctctgtcg

SEQ ID NO: 180492 - DNA, 25 bp, Homo sapien
acaaggcgtcagaacaccaaagttc

SEQ ID NO: 180493 - DNA, 25 bp, Homo sapien
ttccgatgccaaacaaggcgtcaga

SEQ ID NO: 180494 - DNA, 25 bp, Homo sapien
tgcttttcccttccgatgccaaaca

SEQ ID NO: 180495 - DNA, 25 bp, Homo sapien
acccgtataggtccatctgcttttc

SEQ ID NO: 180496 - DNA, 25 bp, Homo sapien
gagcctatagtgtaccttccgccca

SEQ ID NO: 180497 - DNA, 25 bp, Homo sapien
gcctccggaggctagacggttcgcc

SEQ ID NO: 180498 - DNA, 25 bp, Homo sapien
gcccagaagccactttacccgtata

SEQ ID NO: 180499 - DNA, 25 bp, Homo sapien
agagaacctggatccttgcggctcc

SEQ ID NO: 180500 - DNA, 25 bp, Homo sapien
cggcagcgacgagaacctggatcag

SEQ ID NO: 180501 - DNA, 25 bp, Homo sapien
agataggaagtatcgcccgccaacc

SEQ ID NO: 180502 - DNA, 25 bp, Homo sapien
tggtccaggcgacttatgtcttcca

SEQ ID NO: 180503 - DNA, 25 bp, Homo sapien
ccgcgtcgtgatcgactcggacaca

SEQ ID NO: 180504 - DNA, 25 bp, Homo sapien
cccgataggaagagagcccaccaaa

SEQ ID NO: 180505 - DNA, 25 bp, Homo sapien
gcagtcgcgggtaaagccaccacca

SEQ ID NO: 180506 - DNA, 25 bp, Homo sapien
cgcagcagagatacagccaaggact

SEQ ID NO: 180507 - DNA, 25 bp, Homo sapien
cgctaagcgcgtgcgatgcagcaca

SEQ ID NO: 180508 - DNA, 25 bp, Homo sapien
agcgcccagtccacgcagcaaggga

SEQ ID NO: 180509 - DNA, 25 bp, Homo sapien
tgcatgcgtctccagccgtggatcc

SEQ ID NO: 180510 - DNA, 25 bp, Homo sapien
cggaagcctcaggttgactccatca

SEQ ID NO: 180511 - DNA, 25 bp, Homo sapien
gacgcatgggcactacggtcccaga

SEQ ID NO: 180512 - DNA, 25 bp, Homo sapien
cgggccactgcatgctctgtggact

SEQ ID NO: 180513 - DNA, 25 bp, Homo sapien
cgccaccatgactacacgatgcagg

SEQ ID NO: 180514 - DNA, 25 bp, Homo sapien
tccatcagttttgccgggagagccc

SEQ ID NO: 180515 - DNA, 25 bp, Homo sapien
ttgaataactgtccgtggtcagcgc

SEQ ID NO: 180516 - DNA, 25 bp, Homo sapien
cctgacgcccgccacttagggatgt

SEQ ID NO: 180517 - DNA, 25 bp, Homo sapien
agccctgggcactgttaagtcattc

SEQ ID NO: 180518 - DNA, 25 bp, Homo sapien
ctctgcctctgatagcctgggtgtt

SEQ ID NO: 180519 - DNA, 25 bp, Homo sapien
ttgccacggtttccctctcctgagt

SEQ ID NO: 180520 - DNA, 25 bp, Homo sapien
tggtcagcgcgaaggactttcttta

SEQ ID NO: 180521 - DNA, 25 bp, Homo sapien
acgtttcgcaagtgtccctgaggcc

SEQ ID NO: 180522 - DNA, 25 bp, Homo sapien
tccctccagcggaaggtcctgttct

SEQ ID NO: 180523 - DNA, 25 bp, Homo sapien
tcctgcagcaccgacttcaagacta

SEQ ID NO: 180524 - DNA, 25 bp, Homo sapien
tggatcctgaagctcccacggagga

SEQ ID NO: 180525 - DNA, 25 bp, Homo sapien
cggaccttgtgtgctcgactgcaaa

SEQ ID NO: 180526 - DNA, 25 bp, Homo sapien
catttgccaagcacagcgtgggtcc

SEQ ID NO: 180527 - DNA, 25 bp, Homo sapien
agagcaggtgcttcgcgtctttgaa

SEQ ID NO: 180528 - DNA, 25 bp, Homo sapien
cgggatcccaaaccctgaggtgttg

SEQ ID NO: 180529 - DNA, 25 bp, Homo sapien
cttccgcatcgagggcatcaaggtg

SEQ ID NO: 180530 - DNA, 25 bp, Homo sapien
ggtcccggctcctcatcgttagcag

SEQ ID NO: 180531 - DNA, 25 bp, Homo sapien
ccgtagtgacgctggtttggaatca

SEQ ID NO: 180532 - DNA, 25 bp, Homo sapien
cggcggataacagcgcgtccagaca

SEQ ID NO: 180533 - DNA, 25 bp, Homo sapien
tcctctgagcttataggcatccaca

SEQ ID NO: 180534 - DNA, 25 bp, Homo sapien
gcatccacaggtcggaactctggta

SEQ ID NO: 180535 - DNA, 25 bp, Homo sapien
acacagtgcgcagagttggaccttc

SEQ ID NO: 180536 - DNA, 25 bp, Homo sapien
ccttcagtcaggctccacgttgttg

SEQ ID NO: 180537 - DNA, 25 bp, Homo sapien
tggctaagacagaactcccggcatg

SEQ ID NO: 180538 - DNA, 25 bp, Homo sapien
tgcgctgaagatgccgggaaaactc

SEQ ID NO: 180539 - DNA, 25 bp, Homo sapien
gcgcacgtggacttcgttaccctga

SEQ ID NO: 180540 - DNA, 25 bp, Homo sapien
cgcggaatagtccaagacgcaagtc

SEQ ID NO: 180541 - DNA, 25 bp, Homo sapien
taagggctaactcggtggcgactac

SEQ ID NO: 180542 - DNA, 25 bp, Homo sapien
cttccgctcggtgtaagaggttccg

SEQ ID NO: 180543 - DNA, 25 bp, Homo sapien
ctccgccgtgcacttacagatactg

SEQ ID NO: 180544 - DNA, 25 bp, Homo sapien
cgtgctcttcaacggctcgagactc

SEQ ID NO: 180545 - DNA, 25 bp, Homo sapien
ttgctgagacgaagacgccatgcgc

SEQ ID NO: 180546 - DNA, 25 bp, Homo sapien
acttggaggctgcaatcgactctga

SEQ ID NO: 180547 - DNA, 25 bp, Homo sapien
cccgcaggcaggttccagcaaagaa

SEQ ID NO: 180548 - DNA, 25 bp, Homo sapien
cccggtcttatctcggagcattctg

SEQ ID NO: 180549 - DNA, 25 bp, Homo sapien
gaggccacagttgctcccttacaga

SEQ ID NO: 180550 - DNA, 25 bp, Homo sapien
gggccgtgcccgagatctatgcaca

SEQ ID NO: 180551 - DNA, 25 bp, Homo sapien
tggaccacccaactctacaatgagg

SEQ ID NO: 180552 - DNA, 25 bp, Homo sapien
cgctcaggtcaagggctccagttaa

SEQ ID NO: 180553 - DNA, 25 bp, Homo sapien
gcgtgactgcccttaccgctcaggt

SEQ ID NO: 180554 - DNA, 25 bp, Homo sapien
atcatcgagtcgcagctttcgccgc

SEQ ID NO: 180555 - DNA, 25 bp, Homo sapien
tttgggactgcattttcccgcctcg

SEQ ID NO: 180556 - DNA, 25 bp, Homo sapien
gatgttcccagctgttagctccctc

SEQ ID NO: 180557 - DNA, 25 bp, Homo sapien
ctgcggagtgctcgccgccagatct

SEQ ID NO: 180558 - DNA, 25 bp, Homo sapien
aactttctggcgctcggggctcttc

SEQ ID NO: 180559 - DNA, 25 bp, Homo sapien
cctcgatgttcccagctgttagctc

SEQ ID NO: 180560 - DNA, 25 bp, Homo sapien
gcgaaggtccgcctcggaaaccaca

SEQ ID NO: 180561 - DNA, 25 bp, Homo sapien
cgcacgcgaaggtccgcctcggaaa

SEQ ID NO: 180562 - DNA, 25 bp, Homo sapien
ccgcctcgatgttcccagctgttag

SEQ ID NO: 180563 - DNA, 25 bp, Homo sapien
gtcgcccttgcggaaggagagctca

SEQ ID NO: 180564 - DNA, 25 bp, Homo sapien
agctcatccggggactcggccacat

SEQ ID NO: 180565 - DNA, 25 bp, Homo sapien
catagagggctttggccagcacatt

SEQ ID NO: 180566 - DNA, 25 bp, Homo sapien
gggctttggccagcacattcaggtg

SEQ ID NO: 180567 - DNA, 25 bp, Homo sapien
tttggccagcacattcaggtggttc

SEQ ID NO: 180568 - DNA, 25 bp, Homo sapien
ccagcacattcaggtggttcatggt

SEQ ID NO: 180569 - DNA, 25 bp, Homo sapien
atgatgtcgcccttgcggaaggaga

SEQ ID NO: 180570 - DNA, 25 bp, Homo sapien
agcaccgtcatgatgtcgcccttgc

SEQ ID NO: 180571 - DNA, 25 bp, Homo sapien
cagggcctgcagctgttgtcgcagt

SEQ ID NO: 180572 - DNA, 25 bp, Homo sapien
cctgcagctgttgtcgcagtggagc

SEQ ID NO: 180573 - DNA, 25 bp, Homo sapien
gtgcccgccttgtgcaggtggtcac

SEQ ID NO: 180574 - DNA, 25 bp, Homo sapien
gcccagaagacggacgcggagtacc

SEQ ID NO: 180575 - DNA, 25 bp, Homo sapien
cggacgcggagtaccgcaagctctt

SEQ ID NO: 180576 - DNA, 25 bp, Homo sapien
gcggagtaccgcaagctcttcgacc

SEQ ID NO: 180577 - DNA, 25 bp, Homo sapien
caagctcttcgacctggcgctgcag

SEQ ID NO: 180578 - DNA, 25 bp, Homo sapien
cgcacgtgatggaagtggtaggccc

SEQ ID NO: 180579 - DNA, 25 bp, Homo sapien
gcgggacgaatcctcacctctgcgg

SEQ ID NO: 180580 - DNA, 25 bp, Homo sapien
tggccggcgggacaccagcgccttt

SEQ ID NO: 180581 - DNA, 25 bp, Homo sapien
tcacacgcgcggtcacgagccggtt

SEQ ID NO: 180582 - DNA, 25 bp, Homo sapien
tcgtcgcggaatgcccgcgcttctt

SEQ ID NO: 180583 - DNA, 25 bp, Homo sapien
gagaacactccatcgtcgcggaatg

SEQ ID NO: 180584 - DNA, 25 bp, Homo sapien
caagggtgcccgagaacactccatc

SEQ ID NO: 180585 - DNA, 25 bp, Homo sapien
acgggatccatcctcccaagggtgc

SEQ ID NO: 180586 - DNA, 25 bp, Homo sapien
gcagctccgggtctacgggatccat

SEQ ID NO: 180587 - DNA, 25 bp, Homo sapien
cggtgagcacagacgacaagttctc

SEQ ID NO: 180588 - DNA, 25 bp, Homo sapien
gcctgtaaattctggccgcggcttt

SEQ ID NO: 180589 - DNA, 25 bp, Homo sapien
gcgacgtgttcactgaggttcgacc

SEQ ID NO: 180590 - DNA, 25 bp, Homo sapien
cgtggacgccacagccaatctcagg

SEQ ID NO: 180591 - DNA, 25 bp, Homo sapien
cagccaatgactagccgggtggtcc

SEQ ID NO: 180592 - DNA, 25 bp, Homo sapien
cgtgacccgaactggcagccaatga

SEQ ID NO: 180593 - DNA, 25 bp, Homo sapien
gtgcgagcttccttagctttgagcc

SEQ ID NO: 180594 - DNA, 25 bp, Homo sapien
ctgcggtcggattgcctgtttttac

SEQ ID NO: 180595 - DNA, 25 bp, Homo sapien
acgcttacgcgcttttcagtttaga

SEQ ID NO: 180596 - DNA, 25 bp, Homo sapien
gtgtgcgaaccgaacagaataaccc

SEQ ID NO: 180597 - DNA, 25 bp, Homo sapien
ggcatcgcttagtactggcccgatt

SEQ ID NO: 180598 - DNA, 25 bp, Homo sapien
ctggcccgattggagtttttcgaga

SEQ ID NO: 180599 - DNA, 25 bp, Homo sapien
tctaggtcgagagccacgcttacgc

SEQ ID NO: 180600 - DNA, 25 bp, Homo sapien
cctaggtctcgtggttctagaactc

SEQ ID NO: 180601 - DNA, 25 bp, Homo sapien
tcggcgtcgcttttctgagaacttg

SEQ ID NO: 180602 - DNA, 25 bp, Homo sapien
cgcgtcgctcagctacctaactggg

SEQ ID NO: 180603 - DNA, 25 bp, Homo sapien
gcacgtgatctgtcgggactcttcc

SEQ ID NO: 180604 - DNA, 25 bp, Homo sapien
gcggctgagtccctggttaacaact

SEQ ID NO: 180605 - DNA, 25 bp, Homo sapien
acccgcgcgtgttgttgtagagctt

SEQ ID NO: 180606 - DNA, 25 bp, Homo sapien
cttgcggcattttttcacgtggttc

SEQ ID NO: 180607 - DNA, 25 bp, Homo sapien
cgtatcggaacagcgctagtgtttc

SEQ ID NO: 180608 - DNA, 25 bp, Homo sapien
cgccggagcaaacacgtggatcatg

SEQ ID NO: 180609 - DNA, 25 bp, Homo sapien
tgagaccgagccttttactttcctg

SEQ ID NO: 180610 - DNA, 25 bp, Homo sapien
ctagtgtttcttgccgccaacggtt

SEQ ID NO: 180611 - DNA, 25 bp, Homo sapien
gggcattaacgggaaccagatcgtc

SEQ ID NO: 180612 - DNA, 25 bp, Homo sapien
cctggcatttcttcgtggcttagga

SEQ ID NO: 180613 - DNA, 25 bp, Homo sapien
tgaaattgccgaacgcgatgcccga

SEQ ID NO: 180614 - DNA, 25 bp, Homo sapien
ttcgcgttttgagccgatcgtgcca

SEQ ID NO: 180615 - DNA, 25 bp, Homo sapien
tcccttggacactacagttgccatg

SEQ ID NO: 180616 - DNA, 25 bp, Homo sapien
tggttccctagtcccaagccgtctg

SEQ ID NO: 180617 - DNA, 25 bp, Homo sapien
tggaagcgctctcctgactacaggc

SEQ ID NO: 180618 - DNA, 25 bp, Homo sapien
atcgtccacgagaccaactggggcc

SEQ ID NO: 180619 - DNA, 25 bp, Homo sapien
tcgcgggtggaactgcataaaaatc

SEQ ID NO: 180620 - DNA, 25 bp, Homo sapien
tggactgagtcccaaagagcgtctg

SEQ ID NO: 180621 - DNA, 25 bp, Homo sapien
gggagtcccgactgcaaacattgag

SEQ ID NO: 180622 - DNA, 25 bp, Homo sapien
gctggcagtcatcgagttccacctc

SEQ ID NO: 180623 - DNA, 25 bp, Homo sapien
cattggtgtccgagaccctcctaca

SEQ ID NO: 180624 - DNA, 25 bp, Homo sapien
cgcaacgtgtcgagagccgtaagta

SEQ ID NO: 180625 - DNA, 25 bp, Homo sapien
gagcgtctgtggtcttcaaaaaagc

SEQ ID NO: 180626 - DNA, 25 bp, Homo sapien
cccacgtttttgtagctctggactg

SEQ ID NO: 180627 - DNA, 25 bp, Homo sapien
caattgtttgttaaccctgggatgc

SEQ ID NO: 180628 - DNA, 25 bp, Homo sapien
aacttttatactttgtgcaggtcgc

SEQ ID NO: 180629 - DNA, 25 bp, Homo sapien
tatactttgtgcaggtcgcggcgct

SEQ ID NO: 180630 - DNA, 25 bp, Homo sapien
cctcatcctcggctgcatggggcgg

SEQ ID NO: 180631 - DNA, 25 bp, Homo sapien
acgtgcccgtttgtactgatgtatg

SEQ ID NO: 180632 - DNA, 25 bp, Homo sapien
acttgtcaataaacacaattgtttg

SEQ ID NO: 180633 - DNA, 25 bp, Homo sapien
cccttctgcatgtctgaggccaccg

SEQ ID NO: 180634 - DNA, 25 bp, Homo sapien
gtactgatgtatgaacttgtcaata

SEQ ID NO: 180635 - DNA, 25 bp, Homo sapien
caaggggtgagtggctctcccacag

SEQ ID NO: 180636 - DNA, 25 bp, Homo sapien
gtgcggagcgagttacgagaattcc

SEQ ID NO: 180637 - DNA, 25 bp, Homo sapien
gattctgttcacgttgttcccaagg

SEQ ID NO: 180638 - DNA, 25 bp, Homo sapien
cggcttcctgggtgattctgttcac

SEQ ID NO: 180639 - DNA, 25 bp, Homo sapien
cgctcgggttgctcttctgtggcaa

SEQ ID NO: 180640 - DNA, 25 bp, Homo sapien
aacctcgtgtgtgcgactgccctga

SEQ ID NO: 180641 - DNA, 25 bp, Homo sapien
acaggctgcggcgatttccgaacac

SEQ ID NO: 180642 - DNA, 25 bp, Homo sapien
agttacgagaattcccggccgctgc

SEQ ID NO: 180643 - DNA, 25 bp, Homo sapien
gcgatctggctgagatcccggccca

SEQ ID NO: 180644 - DNA, 25 bp, Homo sapien
tggtggcggtggacctcagcttcca

SEQ ID NO: 180645 - DNA, 25 bp, Homo sapien
cggggagctgacaccttgtgtttct

SEQ ID NO: 180646 - DNA, 25 bp, Homo sapien
tgcaggaccagcagggctgtctgca

SEQ ID NO: 180647 - DNA, 25 bp, Homo sapien
tcaccgtgaataacgacgcccgggc

SEQ ID NO: 180648 - DNA, 25 bp, Homo sapien
caggacgctctctccagcgaggatc

SEQ ID NO: 180649 - DNA, 25 bp, Homo sapien
acaccttgtgtttctgcagggcgcc

SEQ ID NO: 180650 - DNA, 25 bp, Homo sapien
gcacgagatctacgcacacggcctg

SEQ ID NO: 180651 - DNA, 25 bp, Homo sapien
gggcttgtctttggccacgacccac

SEQ ID NO: 180652 - DNA, 25 bp, Homo sapien
ccagatcttgcccaggacgctgttg

SEQ ID NO: 180653 - DNA, 25 bp, Homo sapien
agagctcgtcgtagacgggcttgtc

SEQ ID NO: 180654 - DNA, 25 bp, Homo sapien
ccattgatgggcgacagagtgtaga

SEQ ID NO: 180655 - DNA, 25 bp, Homo sapien
acacctgatatcttgccattgatgg

SEQ ID NO: 180656 - DNA, 25 bp, Homo sapien
tccttcttggcgttgacacctgata

SEQ ID NO: 180657 - DNA, 25 bp, Homo sapien
gtagccgtcgagcttgatcttgatg

SEQ ID NO: 180658 - DNA, 25 bp, Homo sapien
tcaagcatgccgtcgcagtcgcagt

SEQ ID NO: 180659 - DNA, 25 bp, Homo sapien
tgtccacttggtcggccttgttcag

SEQ ID NO: 180660 - DNA, 25 bp, Homo sapien
gacacggatcttgtcgtcctggccc

SEQ ID NO: 180661 - DNA, 25 bp, Homo sapien
gatgaccttgcctagggaccacatg

SEQ ID NO: 180662 - DNA, 25 bp, Homo sapien
agtacctcgggcgtgttgatgacct

SEQ ID NO: 180663 - DNA, 25 bp, Homo sapien
aagagccggcggttgtccgtgttct

SEQ ID NO: 180664 - DNA, 25 bp, Homo sapien
ctgggcctcagcctcgaagagccgg

SEQ ID NO: 180665 - DNA, 25 bp, Homo sapien
tgtctctaaagaggtcctgggcctc

SEQ ID NO: 180666 - DNA, 25 bp, Homo sapien
ggccttgttcagcacgacacggatc

SEQ ID NO: 180667 - DNA, 25 bp, Homo sapien
gtctctgttcgtgttctcgaggctg

SEQ ID NO: 180668 - DNA, 25 bp, Homo sapien
tccgctgtgcccctccaccctgtct

SEQ ID NO: 180669 - DNA, 25 bp, Homo sapien
ctctgttcgtgttctcgaggctgtt

SEQ ID NO: 180670 - DNA, 25 bp, Homo sapien
ctgtctctgttcgtgttctcgaggc

SEQ ID NO: 180671 - DNA, 25 bp, Homo sapien
tctctgttcgtgttctcgaggctgt

SEQ ID NO: 180672 - DNA, 25 bp, Homo sapien
tgttcgtgttctcgaggctgttggc

SEQ ID NO: 180673 - DNA, 25 bp, Homo sapien
tctgttcgtgttctcgaggctgttg

SEQ ID NO: 180674 - DNA, 25 bp, Homo sapien
cctgtctctgttcgtgttctcgagg

SEQ ID NO: 180675 - DNA, 25 bp, Homo sapien
aggatcatgggcttgttctcgaagt

SEQ ID NO: 180676 - DNA, 25 bp, Homo sapien
tgccacagccagtcttcggccgcta

SEQ ID NO: 180677 - DNA, 25 bp, Homo sapien
acgctcggatgggaccctgctccgg

SEQ ID NO: 180678 - DNA, 25 bp, Homo sapien
gccgccagtccacgctcggatggga

SEQ ID NO: 180679 - DNA, 25 bp, Homo sapien
tccagcggcagcaccttgcgcaggt

SEQ ID NO: 180680 - DNA, 25 bp, Homo sapien
ccagcaggatcatgggcttgttctc

SEQ ID NO: 180681 - DNA, 25 bp, Homo sapien
gggagcaacgccttccgaaccgcaa

SEQ ID NO: 180682 - DNA, 25 bp, Homo sapien
accttgcgcaggtagagcgagcgca

SEQ ID NO: 180683 - DNA, 25 bp, Homo sapien
tacgcacgcgcatgtcagccgcttg

SEQ ID NO: 180684 - DNA, 25 bp, Homo sapien
acgcgcatgtcagccgcttgggagc

SEQ ID NO: 180685 - DNA, 25 bp, Homo sapien
tgtcagccgcttgggagccctgcct

SEQ ID NO: 180686 - DNA, 25 bp, Homo sapien
tacctggccgtgcagcatggactcc

SEQ ID NO: 180687 - DNA, 25 bp, Homo sapien
ccgtgcagcatggactccagcacta

SEQ ID NO: 180688 - DNA, 25 bp, Homo sapien
actagcgcccacaggtccacaaagg

SEQ ID NO: 180689 - DNA, 25 bp, Homo sapien
gctgcaagaaatacgcacgcgcatg

SEQ ID NO: 180690 - DNA, 25 bp, Homo sapien
cgcccacaggtccacaaaggtcgtg

SEQ ID NO: 180691 - DNA, 25 bp, Homo sapien
tcgatttgcagaggcagcttttcta

SEQ ID NO: 180692 - DNA, 25 bp, Homo sapien
gtgtagcatccaaccgaagcccaca

SEQ ID NO: 180693 - DNA, 25 bp, Homo sapien
gcctcagaaaagatccggaccgctc

SEQ ID NO: 180694 - DNA, 25 bp, Homo sapien
ccggacttcctgctagttaggcccg

SEQ ID NO: 180695 - DNA, 25 bp, Homo sapien
cactggctcgaaagcgtcgtgcatg

SEQ ID NO: 180696 - DNA, 25 bp, Homo sapien
gcttttctaggatcggcactggctc

SEQ ID NO: 180697 - DNA, 25 bp, Homo sapien
ggcagccagacagtcgatttgcaga

SEQ ID NO: 180698 - DNA, 25 bp, Homo sapien
aagcccacacggatggacgcctgtc

SEQ ID NO: 180699 - DNA, 25 bp, Homo sapien
ccgtggagtgcctaccgaaagcatt

SEQ ID NO: 180700 - DNA, 25 bp, Homo sapien
gtgccatttggaccggtcggcagca

SEQ ID NO: 180701 - DNA, 25 bp, Homo sapien
cgacggtatcggaatgtgccatttg

SEQ ID NO: 180702 - DNA, 25 bp, Homo sapien
tcggcagcagctacggttgccggtc

SEQ ID NO: 180703 - DNA, 25 bp, Homo sapien
tcccagaagcagaagaatgacaggc

SEQ ID NO: 180704 - DNA, 25 bp, Homo sapien
ggctctgctctaagggcgggattat

SEQ ID NO: 180705 - DNA, 25 bp, Homo sapien
aagcatttcaccctcttccggttcg

SEQ ID NO: 180706 - DNA, 25 bp, Homo sapien
tgccggtcccgcactgaaaaacgac

SEQ ID NO: 180707 - DNA, 25 bp, Homo sapien
ctgggaaaagctggcggcgccacct

SEQ ID NO: 180708 - DNA, 25 bp, Homo sapien
agaggccggacacggaaccgctcgt

SEQ ID NO: 180709 - DNA, 25 bp, Homo sapien
accgctcgtccggtgaccgaagaga

SEQ ID NO: 180710 - DNA, 25 bp, Homo sapien
tgctctcctggccatgtcggagcct

SEQ ID NO: 180711 - DNA, 25 bp, Homo sapien
ccaccctccgaagggtggagcctga

SEQ ID NO: 180712 - DNA, 25 bp, Homo sapien
ttcttcgactgcttgttggggctct

SEQ ID NO: 180713 - DNA, 25 bp, Homo sapien
tctgcccgcgttcttcgactgcttg

SEQ ID NO: 180714 - DNA, 25 bp, Homo sapien
cgcccactcgacgtaatttgcccgc

SEQ ID NO: 180715 - DNA, 25 bp, Homo sapien
aggactcattgcgtacacgccctca

SEQ ID NO: 180716 - DNA, 25 bp, Homo sapien
ccaggttcttaacgctcttgatttt

SEQ ID NO: 180717 - DNA, 25 bp, Homo sapien
tcggcatttccaggttcttaacgct

SEQ ID NO: 180718 - DNA, 25 bp, Homo sapien
gcagatgcttcgtcccagtcaggga

SEQ ID NO: 180719 - DNA, 25 bp, Homo sapien
gatctgcagatgcttcgtcccagtc

SEQ ID NO: 180720 - DNA, 25 bp, Homo sapien
ctgagatagatctgcagatgcttcg

SEQ ID NO: 180721 - DNA, 25 bp, Homo sapien
gatttttaccctctaggactcattg

SEQ ID NO: 180722 - DNA, 25 bp, Homo sapien
ccctctaggactcattgcgtacacg

SEQ ID NO: 180723 - DNA, 25 bp, Homo sapien
agaaacccggtggtgtcttgcagcc

SEQ ID NO: 180724 - DNA, 25 bp, Homo sapien
gcagcctgcaggagtagaaacccgg

SEQ ID NO: 180725 - DNA, 25 bp, Homo sapien
ctccctaaggggcagacgaccagga

SEQ ID NO: 180726 - DNA, 25 bp, Homo sapien
cgaccaggacccttgggctccgata

SEQ ID NO: 180727 - DNA, 25 bp, Homo sapien
ttgggctccgatacgctcaacgcag

SEQ ID NO: 180728 - DNA, 25 bp, Homo sapien
ggcccgtcgatactcacattcacag

SEQ ID NO: 180729 - DNA, 25 bp, Homo sapien
ccgaagccgtcacgctcgctttttt

SEQ ID NO: 180730 - DNA, 25 bp, Homo sapien
ctctgggagagtggaccaccaggtt

SEQ ID NO: 180731 - DNA, 25 bp, Homo sapien
ggaacgccctgtgacgtcatcgagc

SEQ ID NO: 180732 - DNA, 25 bp, Homo sapien
agccctcggtccttaagctgaaaga

SEQ ID NO: 180733 - DNA, 25 bp, Homo sapien
cgtttccacatgagcgcggagcgca

SEQ ID NO: 180734 - DNA, 25 bp, Homo sapien
gcggagcgcactgtttcccatccta

SEQ ID NO: 180735 - DNA, 25 bp, Homo sapien
ggcccgacccaagagcgacaaggaa

SEQ ID NO: 180736 - DNA, 25 bp, Homo sapien
acaccagttttctgcgccgtttcca

SEQ ID NO: 180737 - DNA, 25 bp, Homo sapien
gctgccgtaaggctccgcaggtgaa

SEQ ID NO: 180738 - DNA, 25 bp, Homo sapien
cctctgggagcctacggaagatcag

SEQ ID NO: 180739 - DNA, 25 bp, Homo sapien
ggccgctcagcaagaggtgagtctc

SEQ ID NO: 180740 - DNA, 25 bp, Homo sapien
cctgccagcaggagtttcgagggac

SEQ ID NO: 180741 - DNA, 25 bp, Homo sapien
acctcagtcgagctttcgcgttgtg

SEQ ID NO: 180742 - DNA, 25 bp, Homo sapien
ccctgcagagattctggcgcgcaga

SEQ ID NO: 180743 - DNA, 25 bp, Homo sapien
tgagctgacccgctggacttgggtt

SEQ ID NO: 180744 - DNA, 25 bp, Homo sapien
gattggccgaagctaggcaggcacc

SEQ ID NO: 180745 - DNA, 25 bp, Homo sapien
ccaggctaaggactggccgaacgtc

SEQ ID NO: 180746 - DNA, 25 bp, Homo sapien
ggcgcgcagaaatcggtgacaaagt

SEQ ID NO: 180747 - DNA, 25 bp, Homo sapien
gccagccgatcctcgggcctcgcca

SEQ ID NO: 180748 - DNA, 25 bp, Homo sapien
cttcctctagttccctcgtctggct

SEQ ID NO: 180749 - DNA, 25 bp, Homo sapien
ctagttccctcgtctggctccgccc

SEQ ID NO: 180750 - DNA, 25 bp, Homo sapien
ggtggaaaagcgagctctgcgcact

SEQ ID NO: 180751 - DNA, 25 bp, Homo sapien
gcgccgggccggtctgctccagctc

SEQ ID NO: 180752 - DNA, 25 bp, Homo sapien
tggccgctgccagcggaggaggaca

SEQ ID NO: 180753 - DNA, 25 bp, Homo sapien
tggaaaagcgagctctgcgcactcc

SEQ ID NO: 180754 - DNA, 25 bp, Homo sapien
tgccgccagccgatcctcgggcctc

SEQ ID NO: 180755 - DNA, 25 bp, Homo sapien
ccatctcctgcatgagagctgagtc

SEQ ID NO: 180756 - DNA, 25 bp, Homo sapien
gcgtgtcaccgctgttacctccgaa

SEQ ID NO: 180757 - DNA, 25 bp, Homo sapien
actccactgcgggaaccggcttcga

SEQ ID NO: 180758 - DNA, 25 bp, Homo sapien
ccagcgttatcctagggcagaagca

SEQ ID NO: 180759 - DNA, 25 bp, Homo sapien
ctcctccaggttgctgaggtttggc

SEQ ID NO: 180760 - DNA, 25 bp, Homo sapien
gagccttcgtggtacccatctcctg

SEQ ID NO: 180761 - DNA, 25 bp, Homo sapien
agcgccgagctcgaatgactgactc

SEQ ID NO: 180762 - DNA, 25 bp, Homo sapien
tgctccctcaggaagttcaacagga

SEQ ID NO: 180763 - DNA, 25 bp, Homo sapien
ttcaaaatcaaactccggcgtggcc

SEQ ID NO: 180764 - DNA, 25 bp, Homo sapien
ttctccgacacaaggcgggctggct

SEQ ID NO: 180765 - DNA, 25 bp, Homo sapien
ctgaggattacaggaaaaccgcttc

SEQ ID NO: 180766 - DNA, 25 bp, Homo sapien
cggcaatccgattcacggtgggttt

SEQ ID NO: 180767 - DNA, 25 bp, Homo sapien
cttcgcgcttgcctgaaaggaagga

SEQ ID NO: 180768 - DNA, 25 bp, Homo sapien
cttccgtgggactgaacggcaatcc

SEQ ID NO: 180769 - DNA, 25 bp, Homo sapien
ggcgttggccgatcagttcaaaatc

SEQ ID NO: 180770 - DNA, 25 bp, Homo sapien
acctaggcgcggctaaatgacgcaa

SEQ ID NO: 180771 - DNA, 25 bp, Homo sapien
cggaaatgctttgtcacgatacgaa

SEQ ID NO: 180772 - DNA, 25 bp, Homo sapien
ggtgttctcctagcgtgacagttaa

SEQ ID NO: 180773 - DNA, 25 bp, Homo sapien
ccgagacaagtagtttgcgcacata

SEQ ID NO: 180774 - DNA, 25 bp, Homo sapien
tgggcctcgtagttccagccatagc

SEQ ID NO: 180775 - DNA, 25 bp, Homo sapien
ttaccgggaaaggagcatcacaatg

SEQ ID NO: 180776 - DNA, 25 bp, Homo sapien
acctctccgctacaggtgctgattg

SEQ ID NO: 180777 - DNA, 25 bp, Homo sapien
gtcggttggctagtcccattgccta

SEQ ID NO: 180778 - DNA, 25 bp, Homo sapien
gcgcctaggaattctgggcctcgta

SEQ ID NO: 180779 - DNA, 25 bp, Homo sapien
cagctctggccctgcgacaatagag

SEQ ID NO: 180780 - DNA, 25 bp, Homo sapien
gagcccagtcacttgcgcggccaga

SEQ ID NO: 180781 - DNA, 25 bp, Homo sapien
gggcccggagacagcaacatcttct

SEQ ID NO: 180782 - DNA, 25 bp, Homo sapien
atgctcttggagcactacggcctgg

SEQ ID NO: 180783 - DNA, 25 bp, Homo sapien
caatagagtccggaagtgcaggcaa

SEQ ID NO: 180784 - DNA, 25 bp, Homo sapien
caccctaggcccagtgtctggctcc

SEQ ID NO: 180785 - DNA, 25 bp, Homo sapien
acagcaacatcttctggggcctgca

SEQ ID NO: 180786 - DNA, 25 bp, Homo sapien
tggtggccatgctcttggagcacta

SEQ ID NO: 180787 - DNA, 25 bp, Homo sapien
cggaaacgagcccttgacgctgtgg

SEQ ID NO: 180788 - DNA, 25 bp, Homo sapien
cccttgacgctgtggcccggaagtg

SEQ ID NO: 180789 - DNA, 25 bp, Homo sapien
aggcctgtgtttgcggccttcggca

SEQ ID NO: 180790 - DNA, 25 bp, Homo sapien
caagcgactgagatggcgagcgcaa

SEQ ID NO: 180791 - DNA, 25 bp, Homo sapien
gatggcgagcgcaactgcacctgca

SEQ ID NO: 180792 - DNA, 25 bp, Homo sapien
gcttcgcctttggagcagctccggc

SEQ ID NO: 180793 - DNA, 25 bp, Homo sapien
aaacgagcccttgacgctgtggccc

SEQ ID NO: 180794 - DNA, 25 bp, Homo sapien
cagctccggcacttggcggaggagc

SEQ ID NO: 180795 - DNA, 25 bp, Homo sapien
gtggctccaaaataccaaacacgtc

SEQ ID NO: 180796 - DNA, 25 bp, Homo sapien
tctgcctccggtggctccaaaatac

SEQ ID NO: 180797 - DNA, 25 bp, Homo sapien
gtgccctattgtgggctcggctccc

SEQ ID NO: 180798 - DNA, 25 bp, Homo sapien
gtccttctcccgtgccctattgtgg

SEQ ID NO: 180799 - DNA, 25 bp, Homo sapien
agtgtagaacctgcggcctcgatgt

SEQ ID NO: 180800 - DNA, 25 bp, Homo sapien
cggctgcgccagacagtgtagaacc

SEQ ID NO: 180801 - DNA, 25 bp, Homo sapien
gtctttctggacagcaggcgctgga

SEQ ID NO: 180802 - DNA, 25 bp, Homo sapien
gtcaggcgttttcccgggcagctta

SEQ ID NO: 180803 - DNA, 25 bp, Homo sapien
cagtagtctgcgctctcaaagcaca

SEQ ID NO: 180804 - DNA, 25 bp, Homo sapien
tctgctcatagaccacgaaaagggc

SEQ ID NO: 180805 - DNA, 25 bp, Homo sapien
ctgccgcaagtccagacccaggatg

SEQ ID NO: 180806 - DNA, 25 bp, Homo sapien
aaaggcccggttaacgcgcacagct

SEQ ID NO: 180807 - DNA, 25 bp, Homo sapien
gggcgcgccaatctgctccaaaaaa

SEQ ID NO: 180808 - DNA, 25 bp, Homo sapien
agcgcatctcgccaaccagaattga

SEQ ID NO: 180809 - DNA, 25 bp, Homo sapien
aggcggtccagccagcttgaaggaa

SEQ ID NO: 180810 - DNA, 25 bp, Homo sapien
agccagcgccgagagacaagatctg

SEQ ID NO: 180811 - DNA, 25 bp, Homo sapien
tacctgtcggaaaacctcgcgcaag

SEQ ID NO: 180812 - DNA, 25 bp, Homo sapien
ctcgcgcaaggagagaagctggttt

SEQ ID NO: 180813 - DNA, 25 bp, Homo sapien
ttgagctgccgaacttccgggactc

SEQ ID NO: 180814 - DNA, 25 bp, Homo sapien
cccgcgtagtagtagccgctcagca

SEQ ID NO: 180815 - DNA, 25 bp, Homo sapien
ctcggtgggttgattcggcacaaac

SEQ ID NO: 180816 - DNA, 25 bp, Homo sapien
gggaatgatccacgaactgctcttg

SEQ ID NO: 180817 - DNA, 25 bp, Homo sapien
tgggtccattttcacctggaacaag

SEQ ID NO: 180818 - DNA, 25 bp, Homo sapien
ctcagcaaggattagggagctacct

SEQ ID NO: 180819 - DNA, 25 bp, Homo sapien
atcccgtggatgataggtagctgcg

SEQ ID NO: 180820 - DNA, 25 bp, Homo sapien
tccctcgcgctcgagctagaggtct

SEQ ID NO: 180821 - DNA, 25 bp, Homo sapien
cgccactcaagaaatcccgtggatg

SEQ ID NO: 180822 - DNA, 25 bp, Homo sapien
tatcggatcgtccattcgctgccgc

SEQ ID NO: 180823 - DNA, 25 bp, Homo sapien
cgtcacgtcacacaatatcggatcg

SEQ ID NO: 180824 - DNA, 25 bp, Homo sapien
agatcgatccctaggtcgccgctgt

SEQ ID NO: 180825 - DNA, 25 bp, Homo sapien
aagtccctccagatcgatccctagg

SEQ ID NO: 180826 - DNA, 25 bp, Homo sapien
gagctagaggtctctgcacgctccc

SEQ ID NO: 180827 - DNA, 25 bp, Homo sapien
tctttgctaattgtgatcggcgata

SEQ ID NO: 180828 - DNA, 25 bp, Homo sapien
gggacctgcagaagcactctttgct

SEQ ID NO: 180829 - DNA, 25 bp, Homo sapien
tcggcgatatcggtacagagagtca

SEQ ID NO: 180830 - DNA, 25 bp, Homo sapien
tgccatggagacaactccggggctg

SEQ ID NO: 180831 - DNA, 25 bp, Homo sapien
ctcaagtctaagtggaagctcccgc

SEQ ID NO: 180832 - DNA, 25 bp, Homo sapien
cgagaccgcagagcacgagcttcca

SEQ ID NO: 180833 - DNA, 25 bp, Homo sapien
ggcagcagccaatgaactgcacctg

SEQ ID NO: 180834 - DNA, 25 bp, Homo sapien
cctgcagcggaagctgccggactaa

SEQ ID NO: 180835 - DNA, 25 bp, Homo sapien
cgcgacttctttgcggttccaccaa

SEQ ID NO: 180836 - DNA, 25 bp, Homo sapien
cggcccaatcaaagcgcgacttctt

SEQ ID NO: 180837 - DNA, 25 bp, Homo sapien
gtaacagagtcaggctgcgttggcc

SEQ ID NO: 180838 - DNA, 25 bp, Homo sapien
gggtcacgaataccgccctcgcatc

SEQ ID NO: 180839 - DNA, 25 bp, Homo sapien
cgcatcccgactccactagcctttg

SEQ ID NO: 180840 - DNA, 25 bp, Homo sapien
cgaacctgcaggcagcgacacctga

SEQ ID NO: 180841 - DNA, 25 bp, Homo sapien
ctgacagcggcccaatcaaagcgcg

SEQ ID NO: 180842 - DNA, 25 bp, Homo sapien
cgcgcaccggtaacagagtcaggct

SEQ ID NO: 180843 - DNA, 25 bp, Homo sapien
caggatcccgtagccagacctcaag

SEQ ID NO: 180844 - DNA, 25 bp, Homo sapien
cggaacctgtacgagctgccagtga

SEQ ID NO: 180845 - DNA, 25 bp, Homo sapien
ggatcttatcttgcgccagcgccta

SEQ ID NO: 180846 - DNA, 25 bp, Homo sapien
agtctgattggcaccggctcccatt

SEQ ID NO: 180847 - DNA, 25 bp, Homo sapien
ccgctaattacctggcgggtgctgc

SEQ ID NO: 180848 - DNA, 25 bp, Homo sapien
cgcgagtctcaggtcccgctaatta

SEQ ID NO: 180849 - DNA, 25 bp, Homo sapien
cccggctttagacgcgcgagtctca

SEQ ID NO: 180850 - DNA, 25 bp, Homo sapien
gtttctgctccgaccggaacctgta

SEQ ID NO: 180851 - DNA, 25 bp, Homo sapien
cggagcaacgctcgcccagccactc

SEQ ID NO: 180852 - DNA, 25 bp, Homo sapien
cgagcctggctacccctatgcaaga

SEQ ID NO: 180853 - DNA, 25 bp, Homo sapien
tggctacccctatgcaagacgagct

SEQ ID NO: 180854 - DNA, 25 bp, Homo sapien
caggaccatgcggagcaacgctcgc

SEQ ID NO: 180855 - DNA, 25 bp, Homo sapien
acgcgccagcgcaggcagccggttt

SEQ ID NO: 180856 - DNA, 25 bp, Homo sapien
ccgctgcctccgaactcacggacga

SEQ ID NO: 180857 - DNA, 25 bp, Homo sapien
acgccactctgccaaggcgggggaa

SEQ ID NO: 180858 - DNA, 25 bp, Homo sapien
ggtttttcgccccctgatgacgcca

SEQ ID NO: 180859 - DNA, 25 bp, Homo sapien
ctctaccgagcgtaccctaggagcg

SEQ ID NO: 180860 - DNA, 25 bp, Homo sapien
ccttcttctgtagcacgaacgtgga

SEQ ID NO: 180861 - DNA, 25 bp, Homo sapien
gaaatcccaggtcttgctctaccga

SEQ ID NO: 180862 - DNA, 25 bp, Homo sapien
gggaagcccgcacaccaaagcaagc

SEQ ID NO: 180863 - DNA, 25 bp, Homo sapien
aaagcaagccgctccagccgctgag

SEQ ID NO: 180864 - DNA, 25 bp, Homo sapien
cagccgctgagaacggagaaaagcc

SEQ ID NO: 180865 - DNA, 25 bp, Homo sapien
ggacgctcaggacgcacctgtgatt

SEQ ID NO: 180866 - DNA, 25 bp, Homo sapien
tggcacgcacgatgcccttcttctg

SEQ ID NO: 180867 - DNA, 25 bp, Homo sapien
aatattcctggcctcacacggggct

SEQ ID NO: 180868 - DNA, 25 bp, Homo sapien
tgcacctgcgtcaaccttctaatcg

SEQ ID NO: 180869 - DNA, 25 bp, Homo sapien
gagtgggaatggtcctcccttttca

SEQ ID NO: 180870 - DNA, 25 bp, Homo sapien
gttgataatctccaggtccgcgctg

SEQ ID NO: 180871 - DNA, 25 bp, Homo sapien
ccgcccagtggtggcgttgataatc

SEQ ID NO: 180872 - DNA, 25 bp, Homo sapien
agacagcacgtgcttgcagagccgg

SEQ ID NO: 180873 - DNA, 25 bp, Homo sapien
tgcccacgacccagttcatgctgaa

SEQ ID NO: 180874 - DNA, 25 bp, Homo sapien
aggactggccagttcacgtgtcacc

SEQ ID NO: 180875 - DNA, 25 bp, Homo sapien
gccactcggcggtaacgagttggtc

SEQ ID NO: 180876 - DNA, 25 bp, Homo sapien
cgagcgcaagcagcgggttagtggt

SEQ ID NO: 180877 - DNA, 25 bp, Homo sapien
tccattctgccgaggcgggggaaga

SEQ ID NO: 180878 - DNA, 25 bp, Homo sapien
gtgagtccattctgccgaggcgggg

SEQ ID NO: 180879 - DNA, 25 bp, Homo sapien
ctggtgagtccattctgccgaggcg

SEQ ID NO: 180880 - DNA, 25 bp, Homo sapien
cctggtgagtccattctgccgaggc

SEQ ID NO: 180881 - DNA, 25 bp, Homo sapien
ccctggtgagtccattctgccgagg

SEQ ID NO: 180882 - DNA, 25 bp, Homo sapien
gccagacgcgcgagcgcaagcagcg

SEQ ID NO: 180883 - DNA, 25 bp, Homo sapien
gacgaaggcgacgcgcagccaatca

SEQ ID NO: 180884 - DNA, 25 bp, Homo sapien
gaactcacggacgacaacttcgaga

SEQ ID NO: 180885 - DNA, 25 bp, Homo sapien
ggcgggcacatttctcattcccggg

SEQ ID NO: 180886 - DNA, 25 bp, Homo sapien
ccaaggaaaacccgaaggctgcgct

SEQ ID NO: 180887 - DNA, 25 bp, Homo sapien
tgctgatcggcccaaggaaaacccg

SEQ ID NO: 180888 - DNA, 25 bp, Homo sapien
gaactgttgggcctacgcagcgccg

SEQ ID NO: 180889 - DNA, 25 bp, Homo sapien
agtcggtgctgatcggcccaaggaa

SEQ ID NO: 180890 - DNA, 25 bp, Homo sapien
acatttctcattcccgggagctgga

SEQ ID NO: 180891 - DNA, 25 bp, Homo sapien
ccttggaaagcaatcaccggccgta

SEQ ID NO: 180892 - DNA, 25 bp, Homo sapien
cagcgtcgttgagcctgagcagtaa

SEQ ID NO: 180893 - DNA, 25 bp, Homo sapien
gttccaccgctctgaaaccgatttc

SEQ ID NO: 180894 - DNA, 25 bp, Homo sapien
ccgcatgaatcgctttgggctatcg

SEQ ID NO: 180895 - DNA, 25 bp, Homo sapien
tacctgttgccgctgacactcttgc

SEQ ID NO: 180896 - DNA, 25 bp, Homo sapien
ggcgctttcttctaggatccgcatg

SEQ ID NO: 180897 - DNA, 25 bp, Homo sapien
tcctccatggcgacgagttcgagtg

SEQ ID NO: 180898 - DNA, 25 bp, Homo sapien
accctgaatttggagttgctgtctc

SEQ ID NO: 180899 - DNA, 25 bp, Homo sapien
acgactgtgctacgttgccagaagg

SEQ ID NO: 180900 - DNA, 25 bp, Homo sapien
agtccgtattttgacctggcccgtg

SEQ ID NO: 180901 - DNA, 25 bp, Homo sapien
ctttgcccacggctacttcacggga

SEQ ID NO: 180902 - DNA, 25 bp, Homo sapien
tccgtagcttccctagcaaggcgtt

SEQ ID NO: 180903 - DNA, 25 bp, Homo sapien
tttccttaggcggtaaccagcgtga

SEQ ID NO: 180904 - DNA, 25 bp, Homo sapien
cacgtgctttttcttgtccaatggg

SEQ ID NO: 180905 - DNA, 25 bp, Homo sapien
acgtgacccggcctagtttctccag

SEQ ID NO: 180906 - DNA, 25 bp, Homo sapien
ctcacactcggtgcccggaaatcga

SEQ ID NO: 180907 - DNA, 25 bp, Homo sapien
ccggagaagccacggaaacatgaca

SEQ ID NO: 180908 - DNA, 25 bp, Homo sapien
ttccaatctggagacggtaaggttg

SEQ ID NO: 180909 - DNA, 25 bp, Homo sapien
caatagggtagagccgagggaaaca

SEQ ID NO: 180910 - DNA, 25 bp, Homo sapien
gaagctgtgtcagttgccggaagtc

SEQ ID NO: 180911 - DNA, 25 bp, Homo sapien
actgagaccagtggaccagagcggc

SEQ ID NO: 180912 - DNA, 25 bp, Homo sapien
cgggtcaccgactatgcagaggaga

SEQ ID NO: 180913 - DNA, 25 bp, Homo sapien
gagaaggagatccagagttccaatc

SEQ ID NO: 180914 - DNA, 25 bp, Homo sapien
cagcgctccaagacggggttctgat

SEQ ID NO: 180915 - DNA, 25 bp, Homo sapien
ggctgagctagataaaccggaaata

SEQ ID NO: 180916 - DNA, 25 bp, Homo sapien
aagtcgagtcggtttctgcgcatgc

SEQ ID NO: 180917 - DNA, 25 bp, Homo sapien
gctgcgcgactgatagagaaactac

SEQ ID NO: 180918 - DNA, 25 bp, Homo sapien
agcgacggtgattcccgaaacttga

SEQ ID NO: 180919 - DNA, 25 bp, Homo sapien
ttgcttcatgagagcgcttgggacc

SEQ ID NO: 180920 - DNA, 25 bp, Homo sapien
ttctcattgcgaactgggacggccc

SEQ ID NO: 180921 - DNA, 25 bp, Homo sapien
atgctcattggctgcccgcatgtcc

SEQ ID NO: 180922 - DNA, 25 bp, Homo sapien
gcgcccacagctaggaagtcgagtc

SEQ ID NO: 180923 - DNA, 25 bp, Homo sapien
aagccgaaagatgtccaggtcgggc

SEQ ID NO: 180924 - DNA, 25 bp, Homo sapien
taagaagccgaaagatgtccaggtc

SEQ ID NO: 180925 - DNA, 25 bp, Homo sapien
cgctaagaagccgaaagatgtccag

SEQ ID NO: 180926 - DNA, 25 bp, Homo sapien
tcccgccgcaatcttggcgggaagg

SEQ ID NO: 180927 - DNA, 25 bp, Homo sapien
cccaacttcctgctctggcgctgcg

SEQ ID NO: 180928 - DNA, 25 bp, Homo sapien
gccttcttaagaagcgcgcgtaaaa

SEQ ID NO: 180929 - DNA, 25 bp, Homo sapien
cggccttcttaagaagcgcgcgtaa

SEQ ID NO: 180930 - DNA, 25 bp, Homo sapien
ccggccgctaagaagccgaaagatg

SEQ ID NO: 180931 - DNA, 25 bp, Homo sapien
ccgtggttcctatggatgctgtttc

SEQ ID NO: 180932 - DNA, 25 bp, Homo sapien
gccgccggccaagttgaccagactt

SEQ ID NO: 180933 - DNA, 25 bp, Homo sapien
caggtgtactcgctgtcgtccagca

SEQ ID NO: 180934 - DNA, 25 bp, Homo sapien
tcggacctagtcaagccggagcagc

SEQ ID NO: 180935 - DNA, 25 bp, Homo sapien
caggtgtgagcacccaactggattg

SEQ ID NO: 180936 - DNA, 25 bp, Homo sapien
tgccgcctgaaatacacttgatctg

SEQ ID NO: 180937 - DNA, 25 bp, Homo sapien
cacttgatctgcgtttccgaagcca

SEQ ID NO: 180938 - DNA, 25 bp, Homo sapien
actggattgatgtctgccgcctgaa

SEQ ID NO: 180939 - DNA, 25 bp, Homo sapien
ggcaggtgcagggtcgggttcaaag

SEQ ID NO: 180940 - DNA, 25 bp, Homo sapien
caactactggagcatctcctcccgc

SEQ ID NO: 180941 - DNA, 25 bp, Homo sapien
ttcaactactggagcatctcctccc

SEQ ID NO: 180942 - DNA, 25 bp, Homo sapien
cggctcgcagccgaccggtaagccc

SEQ ID NO: 180943 - DNA, 25 bp, Homo sapien
cgcctcccaaccgtgaggtgttggg

SEQ ID NO: 180944 - DNA, 25 bp, Homo sapien
tgtcgacggaaactcggaaatggtc

SEQ ID NO: 180945 - DNA, 25 bp, Homo sapien
ttctcgcgacaagaggggtgtcgac

SEQ ID NO: 180946 - DNA, 25 bp, Homo sapien
cagccgaccggtaagcccgcctcct

SEQ ID NO: 180947 - DNA, 25 bp, Homo sapien
ggacacttctctgtcgtcacagtta

SEQ ID NO: 180948 - DNA, 25 bp, Homo sapien
ggcatgcactctttggcgcctcgta

SEQ ID NO: 180949 - DNA, 25 bp, Homo sapien
cacacattgcgcagtcgggaccatc

SEQ ID NO: 180950 - DNA, 25 bp, Homo sapien
atcgacccagtactaaggccttgtg

SEQ ID NO: 180951 - DNA, 25 bp, Homo sapien
ctgcccaagcagttccgttaggagc

SEQ ID NO: 180952 - DNA, 25 bp, Homo sapien
aggcgccagattcgctttctcccgg

SEQ ID NO: 180953 - DNA, 25 bp, Homo sapien
cagggtgcactacgcgttcctaagc

SEQ ID NO: 180954 - DNA, 25 bp, Homo sapien
ggcccttgctcatcctgataggttt

SEQ ID NO: 180955 - DNA, 25 bp, Homo sapien
gggtcacagtggctcacaagccgta

SEQ ID NO: 180956 - DNA, 25 bp, Homo sapien
tgtagacccgttactgccatggccc

SEQ ID NO: 180957 - DNA, 25 bp, Homo sapien
agttcattgcaggacccggcttgga

SEQ ID NO: 180958 - DNA, 25 bp, Homo sapien
tggacgcactgtcccacagcacagg

SEQ ID NO: 180959 - DNA, 25 bp, Homo sapien
tatgggattccagggtgggtacatc

SEQ ID NO: 180960 - DNA, 25 bp, Homo sapien
gcctcacacgtgctgccctgatgta

SEQ ID NO: 180961 - DNA, 25 bp, Homo sapien
gggactgaaatcaggccgcagtctc

SEQ ID NO: 180962 - DNA, 25 bp, Homo sapien
cctgggaagaagttgccgtcctctg

SEQ ID NO: 180963 - DNA, 25 bp, Homo sapien
ctggccacggtcaggatgctgccca

SEQ ID NO: 180964 - DNA, 25 bp, Homo sapien
tccagctgacccgagagcagctcgt

SEQ ID NO: 180965 - DNA, 25 bp, Homo sapien
cccgagagcagctcgtggacgtgca

SEQ ID NO: 180966 - DNA, 25 bp, Homo sapien
tatgggctgaagaagaagagccacg

SEQ ID NO: 180967 - DNA, 25 bp, Homo sapien
gtgctggctttgttccagctgaccc

SEQ ID NO: 180968 - DNA, 25 bp, Homo sapien
aggcccagcggaagcagatcgacag

SEQ ID NO: 180969 - DNA, 25 bp, Homo sapien
cagatcgacagggtgctggctttgt

SEQ ID NO: 180970 - DNA, 25 bp, Homo sapien
acggtcaggatgctgcccacctacg

SEQ ID NO: 180971 - DNA, 25 bp, Homo sapien
acgccgacgctttctccgtggaaga

SEQ ID NO: 180972 - DNA, 25 bp, Homo sapien
ctcttctgagcacggcgtgggtatc

SEQ ID NO: 180973 - DNA, 25 bp, Homo sapien
ctccagtactggtctgcgttgtagg

SEQ ID NO: 180974 - DNA, 25 bp, Homo sapien
ccatggacggtgatcacagtgacca

SEQ ID NO: 180975 - DNA, 25 bp, Homo sapien
gcgccggtcaacgagagcaaaccca

SEQ ID NO: 180976 - DNA, 25 bp, Homo sapien
ggcaggcactaacacggctcgcttt

SEQ ID NO: 180977 - DNA, 25 bp, Homo sapien
cactctgctaacttcctggcactta

SEQ ID NO: 180978 - DNA, 25 bp, Homo sapien
gctcgctttcttccgtagacgccga

SEQ ID NO: 180979 - DNA, 25 bp, Homo sapien
agaaagcacttggaggctgcccgca

SEQ ID NO: 180980 - DNA, 25 bp, Homo sapien
ggctgtctccggtcgattccattcg

SEQ ID NO: 180981 - DNA, 25 bp, Homo sapien
tgcaacgaggcgagcgtttcaggtc

SEQ ID NO: 180982 - DNA, 25 bp, Homo sapien
ttctgtgaggaaaccacgctcgcct

SEQ ID NO: 180983 - DNA, 25 bp, Homo sapien
acttactgccagaaggggccctcca

SEQ ID NO: 180984 - DNA, 25 bp, Homo sapien
cggctgccaggcgtcaaagaaagca

SEQ ID NO: 180985 - DNA, 25 bp, Homo sapien
tttcgccggaacctgactgcgtcgt

SEQ ID NO: 180986 - DNA, 25 bp, Homo sapien
gggactggcaccaacagcatcggta

SEQ ID NO: 180987 - DNA, 25 bp, Homo sapien
tcgcatgtcctagcacctctgggtc

SEQ ID NO: 180988 - DNA, 25 bp, Homo sapien
cccagtctagtgcatgccttcttaa

SEQ ID NO: 180989 - DNA, 25 bp, Homo sapien
attggctgggcacgcgtttaatata

SEQ ID NO: 180990 - DNA, 25 bp, Homo sapien
gggcattcctgaagctgacagcatt

SEQ ID NO: 180991 - DNA, 25 bp, Homo sapien
ggctatccagcgtgagtctctccta

SEQ ID NO: 180992 - DNA, 25 bp, Homo sapien
ggctctgcttcccttagactggaga

SEQ ID NO: 180993 - DNA, 25 bp, Homo sapien
taggcgcccgctaagttcgcatgtc

SEQ ID NO: 180994 - DNA, 25 bp, Homo sapien
gcgccgatgtacagacagcaaactc

SEQ ID NO: 180995 - DNA, 25 bp, Homo sapien
agagccaaaagagctccatggcggc

SEQ ID NO: 180996 - DNA, 25 bp, Homo sapien
cacaaaggaggaagcctagtcccgc

SEQ ID NO: 180997 - DNA, 25 bp, Homo sapien
ctggaccctcggctgggtagcgcca

SEQ ID NO: 180998 - DNA, 25 bp, Homo sapien
gggtagcgccaccagagcgaccaaa

SEQ ID NO: 180999 - DNA, 25 bp, Homo sapien
gagcgaccaaacgtcccgcgccttc

SEQ ID NO: 181000 - DNA, 25 bp, Homo sapien
caggccgcactccagagccaaaaga

SEQ ID NO: 181001 - DNA, 25 bp, Homo sapien
ctggcacaaaggaggaagcctagtc

SEQ ID NO: 181002 - DNA, 25 bp, Homo sapien
caagcccaacaacctttccctggtg

SEQ ID NO: 181003 - DNA, 25 bp, Homo sapien
ctcaccacgtcggaaagaacatggt

SEQ ID NO: 181004 - DNA, 25 bp, Homo sapien
gtgacaaaccgtccgtattgcgccc

SEQ ID NO: 181005 - DNA, 25 bp, Homo sapien
gccaatacgtgacaaaccgtccgta

SEQ ID NO: 181006 - DNA, 25 bp, Homo sapien
gggcgccaatacgtgacaaaccgtc

SEQ ID NO: 181007 - DNA, 25 bp, Homo sapien
catggggcgccaatacgtgacaaac

SEQ ID NO: 181008 - DNA, 25 bp, Homo sapien
aagaacatggtagcctgcgggcatg

SEQ ID NO: 181009 - DNA, 25 bp, Homo sapien
cgtcggaaagaacatggtagcctgc

SEQ ID NO: 181010 - DNA, 25 bp, Homo sapien
ccacgtcggaaagaacatggtagcc

SEQ ID NO: 181011 - DNA, 25 bp, Homo sapien
acaccgtcggcgtaattggctggta

SEQ ID NO: 181012 - DNA, 25 bp, Homo sapien
ctgacagaaccttccctcaagggtc

SEQ ID NO: 181013 - DNA, 25 bp, Homo sapien
gctcgtggtgcctcaggttgttaaa

SEQ ID NO: 181014 - DNA, 25 bp, Homo sapien
ggttgttaaaccagccgtcatagcg

SEQ ID NO: 181015 - DNA, 25 bp, Homo sapien
tcccgagcaacgaaggccttggcca

SEQ ID NO: 181016 - DNA, 25 bp, Homo sapien
agctgcacggcgaaatgaccttcca

SEQ ID NO: 181017 - DNA, 25 bp, Homo sapien
tgaccttccagtctcagggagccgc

SEQ ID NO: 181018 - DNA, 25 bp, Homo sapien
tccagagcctgatacacaccgtcgg

SEQ ID NO: 181019 - DNA, 25 bp, Homo sapien
gctcgccggctagaaaaactctgtc

SEQ ID NO: 181020 - DNA, 25 bp, Homo sapien
ccttaacggagaggtgcaggactca

SEQ ID NO: 181021 - DNA, 25 bp, Homo sapien
ggtcccagccttgtacgcaaagaga

SEQ ID NO: 181022 - DNA, 25 bp, Homo sapien
gagaaatagtttcgctcgccggcta

SEQ ID NO: 181023 - DNA, 25 bp, Homo sapien
ggcgtgcagcatgaccctgtggaac

SEQ ID NO: 181024 - DNA, 25 bp, Homo sapien
tgtggaacggcgtactgccttttta

SEQ ID NO: 181025 - DNA, 25 bp, Homo sapien
aggcttcagcgttccactgctcatc

SEQ ID NO: 181026 - DNA, 25 bp, Homo sapien
acgtcgcccacgctgctataaaagg

SEQ ID NO: 181027 - DNA, 25 bp, Homo sapien
atccgcttagttgcgaggtctccga

SEQ ID NO: 181028 - DNA, 25 bp, Homo sapien
ccacgagatctgcacagacggaatc

SEQ ID NO: 181029 - DNA, 25 bp, Homo sapien
cctcggccacgctatggtaagtgct

SEQ ID NO: 181030 - DNA, 25 bp, Homo sapien
ggagaagttcacaccgagtagccct

SEQ ID NO: 181031 - DNA, 25 bp, Homo sapien
tcacctggcgtctgaaagagaatta

SEQ ID NO: 181032 - DNA, 25 bp, Homo sapien
ttgactacaacgagcagttcacctg

SEQ ID NO: 181033 - DNA, 25 bp, Homo sapien
gtgcatcagctgaacgagaccattg

SEQ ID NO: 181034 - DNA, 25 bp, Homo sapien
acagcctcgcgggttagaagatcca

SEQ ID NO: 181035 - DNA, 25 bp, Homo sapien
ggcaccgacggaacatctctacctg

SEQ ID NO: 181036 - DNA, 25 bp, Homo sapien
tcgatggccttggacttggagccca

SEQ ID NO: 181037 - DNA, 25 bp, Homo sapien
ctctcccggcctggtacagagaagg

SEQ ID NO: 181038 - DNA, 25 bp, Homo sapien
tctggggtgcttccagtcactcttc

SEQ ID NO: 181039 - DNA, 25 bp, Homo sapien
taactcacgtaaggacccggctgtg

SEQ ID NO: 181040 - DNA, 25 bp, Homo sapien
aaacgcgcgcccttactctcagtgg

SEQ ID NO: 181041 - DNA, 25 bp, Homo sapien
ccaggccggagacaagttgcagtcc

SEQ ID NO: 181042 - DNA, 25 bp, Homo sapien
ccaggtcccgacgttctgtgaacaa

SEQ ID NO: 181043 - DNA, 25 bp, Homo sapien
gcagtcgagaccctactccaagtac

SEQ ID NO: 181044 - DNA, 25 bp, Homo sapien
tccgagtcagcatcgtaaaggcccg

SEQ ID NO: 181045 - DNA, 25 bp, Homo sapien
cccacgttgaggacgatgtactcca

SEQ ID NO: 181046 - DNA, 25 bp, Homo sapien
tactccatgaggaaggcgtagtaca

SEQ ID NO: 181047 - DNA, 25 bp, Homo sapien
gcgtagtacaggatcagcacattga

SEQ ID NO: 181048 - DNA, 25 bp, Homo sapien
cattgacgaagaacaggcccacgta

SEQ ID NO: 181049 - DNA, 25 bp, Homo sapien
cacgtagaacatagagggcagcagc

SEQ ID NO: 181050 - DNA, 25 bp, Homo sapien
catcaaagacgtcgagctccgagtc

SEQ ID NO: 181051 - DNA, 25 bp, Homo sapien
ccagcatcgagttggactgcagggc

SEQ ID NO: 181052 - DNA, 25 bp, Homo sapien
actgcagggcgcaaggaaagccttc

SEQ ID NO: 181053 - DNA, 25 bp, Homo sapien
aagccttcgccttcgattctaccgg

SEQ ID NO: 181054 - DNA, 25 bp, Homo sapien
ggggctgccagtccctagactagcc

SEQ ID NO: 181055 - DNA, 25 bp, Homo sapien
tctaccggcattgtcagtgtctctg

SEQ ID NO: 181056 - DNA, 25 bp, Homo sapien
cagtgtccttgaaacgggccctgga

SEQ ID NO: 181057 - DNA, 25 bp, Homo sapien
atgaccaggtcaaaaaggtgagccc

SEQ ID NO: 181058 - DNA, 25 bp, Homo sapien
gcagctcctggcctattacttcacg

SEQ ID NO: 181059 - DNA, 25 bp, Homo sapien
ctatcacgtgctttcagacctggtg

SEQ ID NO: 181060 - DNA, 25 bp, Homo sapien
cgtgctttcagacctggtgagcgtg

SEQ ID NO: 181061 - DNA, 25 bp, Homo sapien
ggctatcacgtgctttcagacctgg

SEQ ID NO: 181062 - DNA, 25 bp, Homo sapien
cacgtgctttcagacctggtgagcg

SEQ ID NO: 181063 - DNA, 25 bp, Homo sapien
cgcaggctatcacgtgctttcagac

SEQ ID NO: 181064 - DNA, 25 bp, Homo sapien
ggccttccctagctcgccgccgccc

SEQ ID NO: 181065 - DNA, 25 bp, Homo sapien
tcaacattcgcatcccgcccggaga

SEQ ID NO: 181066 - DNA, 25 bp, Homo sapien
gctttcagacctggtgagcgtggaa

SEQ ID NO: 181067 - DNA, 25 bp, Homo sapien
gcgtgcaagcccacgggagactccg

SEQ ID NO: 181068 - DNA, 25 bp, Homo sapien
agggtcatcgccacctaccaggtca

SEQ ID NO: 181069 - DNA, 25 bp, Homo sapien
gaggagctgttccagcacgcacgca

SEQ ID NO: 181070 - DNA, 25 bp, Homo sapien
ccgcaggccaaccaggtgacgggct

SEQ ID NO: 181071 - DNA, 25 bp, Homo sapien
cacgtcggatgcagccttcggggca

SEQ ID NO: 181072 - DNA, 25 bp, Homo sapien
tgggcctgctctggttccgctacca

SEQ ID NO: 181073 - DNA, 25 bp, Homo sapien
tggttccgctaccacaacctgtggg

SEQ ID NO: 181074 - DNA, 25 bp, Homo sapien
cacgcacgcaagagggtcatcgcca

SEQ ID NO: 181075 - DNA, 25 bp, Homo sapien
gaatcatcctgtcgcggggcacagc

SEQ ID NO: 181076 - DNA, 25 bp, Homo sapien
cacccgcgtgggaatcatcctgtcg

SEQ ID NO: 181077 - DNA, 25 bp, Homo sapien
ggcacagcagccagcatctctttca

SEQ ID NO: 181078 - DNA, 25 bp, Homo sapien
ctctttcatgttctcctacatcttg

SEQ ID NO: 181079 - DNA, 25 bp, Homo sapien
tacatcttgctcaccatgtgccgca

SEQ ID NO: 181080 - DNA, 25 bp, Homo sapien
tcatcaccttcctgcgagaaacctt

SEQ ID NO: 181081 - DNA, 25 bp, Homo sapien
agaaaccttcctcaaccgctacgtg

SEQ ID NO: 181082 - DNA, 25 bp, Homo sapien
gccgtggacttccatcgcctcattg

SEQ ID NO: 181083 - DNA, 25 bp, Homo sapien
gctccagagctgatttatacgcaga

SEQ ID NO: 181084 - DNA, 25 bp, Homo sapien
gccctcagttcctcggccaaggaga

SEQ ID NO: 181085 - DNA, 25 bp, Homo sapien
tgcccggcaggatcgggtttattta

SEQ ID NO: 181086 - DNA, 25 bp, Homo sapien
tcgaaagtgcttttcacagccgggc

SEQ ID NO: 181087 - DNA, 25 bp, Homo sapien
cggggatgttttgacatctcgtcaa

SEQ ID NO: 181088 - DNA, 25 bp, Homo sapien
ctgttggcaggaaattggacgcgct

SEQ ID NO: 181089 - DNA, 25 bp, Homo sapien
cctcctcccagacaaatggctgttg

SEQ ID NO: 181090 - DNA, 25 bp, Homo sapien
tttatttattgcctctggcccggag

SEQ ID NO: 181091 - DNA, 25 bp, Homo sapien
taggggtcttcgaagtcgcgctccc

SEQ ID NO: 181092 - DNA, 25 bp, Homo sapien
gctcagtaacatggggccagccaga

SEQ ID NO: 181093 - DNA, 25 bp, Homo sapien
gccggaggagctccgctcagtaaca

SEQ ID NO: 181094 - DNA, 25 bp, Homo sapien
tgctcccggagccacttggctactc

SEQ ID NO: 181095 - DNA, 25 bp, Homo sapien
gtctcgacccgaataaggcggtgtg

SEQ ID NO: 181096 - DNA, 25 bp, Homo sapien
gggtccggagatccgctcatcagca

SEQ ID NO: 181097 - DNA, 25 bp, Homo sapien
ctcgcgtctgccagaagctgagaca

SEQ ID NO: 181098 - DNA, 25 bp, Homo sapien
cagaagctgagacaccgaggggccc

SEQ ID NO: 181099 - DNA, 25 bp, Homo sapien
ggcaaacacatctcacatcacatac

SEQ ID NO: 181100 - DNA, 25 bp, Homo sapien
tcacatacaaacaactccctagaga

SEQ ID NO: 181101 - DNA, 25 bp, Homo sapien
acttctcccgtgtcgttttcacaca

SEQ ID NO: 181102 - DNA, 25 bp, Homo sapien
agcacctgctccaaacgggcccaca

SEQ ID NO: 181103 - DNA, 25 bp, Homo sapien
acgggcccacatggccctgacgata

SEQ ID NO: 181104 - DNA, 25 bp, Homo sapien
catggccctgacgatagcatgcgca

SEQ ID NO: 181105 - DNA, 25 bp, Homo sapien
cctgacgatagcatgcgcacgcacg

SEQ ID NO: 181106 - DNA, 25 bp, Homo sapien
cgttacttcccgatccaggcaaaca

SEQ ID NO: 181107 - DNA, 25 bp, Homo sapien
gcaggcgcgttgtactccgccagtt

SEQ ID NO: 181108 - DNA, 25 bp, Homo sapien
ctgtccctgagtctgataatgcgca

SEQ ID NO: 181109 - DNA, 25 bp, Homo sapien
gcgtcattaaatggcctacttacgg

SEQ ID NO: 181110 - DNA, 25 bp, Homo sapien
tgggcggaactcagactacccttgg

SEQ ID NO: 181111 - DNA, 25 bp, Homo sapien
gcccattagccacgggctgtggtga

SEQ ID NO: 181112 - DNA, 25 bp, Homo sapien
ttgtactccgccagttgcttttctt

SEQ ID NO: 181113 - DNA, 25 bp, Homo sapien
cctgagtctgataatgcgcaggcgc

SEQ ID NO: 181114 - DNA, 25 bp, Homo sapien
tcttcttctgttttggcccattagc

SEQ ID NO: 181115 - DNA, 25 bp, Homo sapien
tcctctccagacgtgggatcccatg

SEQ ID NO: 181116 - DNA, 25 bp, Homo sapien
gacccagacccgagcgtcgcaagaa

SEQ ID NO: 181117 - DNA, 25 bp, Homo sapien
ttggagtgaatctggtcgctcgctc

SEQ ID NO: 181118 - DNA, 25 bp, Homo sapien
acggcttctgttgcacgtccggacc

SEQ ID NO: 181119 - DNA, 25 bp, Homo sapien
tgaagctgagcttcccagggatacc

SEQ ID NO: 181120 - DNA, 25 bp, Homo sapien
actctcgtgcaattccggctaggga

SEQ ID NO: 181121 - DNA, 25 bp, Homo sapien
agcctccgatgcttgccctttttta

SEQ ID NO: 181122 - DNA, 25 bp, Homo sapien
gcacgcacccgagatccgatgtagt

SEQ ID NO: 181123 - DNA, 25 bp, Homo sapien
gctcggcagtgaagatctcgctacc

SEQ ID NO: 181124 - DNA, 25 bp, Homo sapien
tgaagggccgctcttaaagctgcta

SEQ ID NO: 181125 - DNA, 25 bp, Homo sapien
tgctacccttagacgctagagaccg

SEQ ID NO: 181126 - DNA, 25 bp, Homo sapien
gatcccggaggagtctcagcctgaa

SEQ ID NO: 181127 - DNA, 25 bp, Homo sapien
gctgctgagaaaccgaccgatctcc

SEQ ID NO: 181128 - DNA, 25 bp, Homo sapien
ctgccttgcacatcgtcggcgggac

SEQ ID NO: 181129 - DNA, 25 bp, Homo sapien
tcttcctggacgagatggacgcctt

SEQ ID NO: 181130 - DNA, 25 bp, Homo sapien
ctgcctggttcatctgtgtgcgatg

SEQ ID NO: 181131 - DNA, 25 bp, Homo sapien
ggtgagtctcccatctgcagagacg

SEQ ID NO: 181132 - DNA, 25 bp, Homo sapien
gggcgttaccatcgtccgtgcgcac

SEQ ID NO: 181133 - DNA, 25 bp, Homo sapien
gggcggttgtggtcgctatatataa

SEQ ID NO: 181134 - DNA, 25 bp, Homo sapien
gcgcttcacgtcagccgcagaatgt

SEQ ID NO: 181135 - DNA, 25 bp, Homo sapien
ctatatataaggtggggaggccgcc

SEQ ID NO: 181136 - DNA, 25 bp, Homo sapien
agtctcccatctgcagagacgcgga

SEQ ID NO: 181137 - DNA, 25 bp, Homo sapien
cgtgcccaacggggaaagcgagtca

SEQ ID NO: 181138 - DNA, 25 bp, Homo sapien
tcagccgcagaatgtcctgcagggg

SEQ ID NO: 181139 - DNA, 25 bp, Homo sapien
cggcgcatcatccttccttagcata

SEQ ID NO: 181140 - DNA, 25 bp, Homo sapien
ctcatccgagaagtcaaaggcgctg

SEQ ID NO: 181141 - DNA, 25 bp, Homo sapien
tacttcaccggagcgccagttctcg

SEQ ID NO: 181142 - DNA, 25 bp, Homo sapien
atcggccaccacaactcgaagtttg

SEQ ID NO: 181143 - DNA, 25 bp, Homo sapien
ccttagcatagatttgaggcgcttc

SEQ ID NO: 181144 - DNA, 25 bp, Homo sapien
tgtcctcaagttccgaagccgctgg

SEQ ID NO: 181145 - DNA, 25 bp, Homo sapien
gggcggcacatctatttaatacctg

SEQ ID NO: 181146 - DNA, 25 bp, Homo sapien
tcactggccaactgaggggactttg

SEQ ID NO: 181147 - DNA, 25 bp, Homo sapien
caggttggcaccgtgcgcctgatgt

SEQ ID NO: 181148 - DNA, 25 bp, Homo sapien
cgatcaccacgaggtggtacctgca

SEQ ID NO: 181149 - DNA, 25 bp, Homo sapien
gggcgactccgaagtctgccagcgc

SEQ ID NO: 181150 - DNA, 25 bp, Homo sapien
ggctacaaacatcaccgcgagcggc

SEQ ID NO: 181151 - DNA, 25 bp, Homo sapien
gccgatgacgctgtaggctacaaac

SEQ ID NO: 181152 - DNA, 25 bp, Homo sapien
cctccagagcgtgaggccgatgacg

SEQ ID NO: 181153 - DNA, 25 bp, Homo sapien
gcactgcgcgcctccagagcgtgag

SEQ ID NO: 181154 - DNA, 25 bp, Homo sapien
caggaagtagatgagggcgatcacc

SEQ ID NO: 181155 - DNA, 25 bp, Homo sapien
acggcggcctcgggcttgtgctcca

SEQ ID NO: 181156 - DNA, 25 bp, Homo sapien
ttagccgcgaagagagcgtcgcgca

SEQ ID NO: 181157 - DNA, 25 bp, Homo sapien
tagccgcgaagagagcgtcgcgcac

SEQ ID NO: 181158 - DNA, 25 bp, Homo sapien
cagccgtgggaagcagtgttccaga

SEQ ID NO: 181159 - DNA, 25 bp, Homo sapien
ccgtgggaagcagtgttccagaggc

SEQ ID NO: 181160 - DNA, 25 bp, Homo sapien
cgaagagagcgtcgcgcacggtggc

SEQ ID NO: 181161 - DNA, 25 bp, Homo sapien
cggcctcgggcttgtgctccagccc

SEQ ID NO: 181162 - DNA, 25 bp, Homo sapien
gtgggaagcagtgttccagaggcgg

SEQ ID NO: 181163 - DNA, 25 bp, Homo sapien
gacaacgctcttccggtcttcgtga

SEQ ID NO: 181164 - DNA, 25 bp, Homo sapien
cacactgctgagtccgctgacactg

SEQ ID NO: 181165 - DNA, 25 bp, Homo sapien
agagccaactctcgagcgcgtgatc

SEQ ID NO: 181166 - DNA, 25 bp, Homo sapien
cgcgtgatcgaagcccgcagttttt

SEQ ID NO: 181167 - DNA, 25 bp, Homo sapien
cgtcacttccgggtgcgacaatctc

SEQ ID NO: 181168 - DNA, 25 bp, Homo sapien
tgcttctgacgagccacacgtttgc

SEQ ID NO: 181169 - DNA, 25 bp, Homo sapien
agccgacgcctggtacgtactatcg

SEQ ID NO: 181170 - DNA, 25 bp, Homo sapien
cgtttgcttcttccctgtgttccca

SEQ ID NO: 181171 - DNA, 25 bp, Homo sapien
ctgttgactgtcactcggcaccgtc

SEQ ID NO: 181172 - DNA, 25 bp, Homo sapien
ttccttctcagagtgtcagagcctc

SEQ ID NO: 181173 - DNA, 25 bp, Homo sapien
gggtcttgggactcttgcttccttc

SEQ ID NO: 181174 - DNA, 25 bp, Homo sapien
cttaactcggtttccgcagctggga

SEQ ID NO: 181175 - DNA, 25 bp, Homo sapien
cgaaggtttttgctgcgccaacgca

SEQ ID NO: 181176 - DNA, 25 bp, Homo sapien
caacgccctggtgtgttcactgacc

SEQ ID NO: 181177 - DNA, 25 bp, Homo sapien
gacgcttgttcctggttctgtgccc

SEQ ID NO: 181178 - DNA, 25 bp, Homo sapien
tgcctgccctgattacaaaacgctg

SEQ ID NO: 181179 - DNA, 25 bp, Homo sapien
tctgtgacagaaccgtgcaagtaat

SEQ ID NO: 181180 - DNA, 25 bp, Homo sapien
ccctttcaacgtcgcagggcttgtc

SEQ ID NO: 181181 - DNA, 25 bp, Homo sapien
ctgcgcactgtcagcgctgagtaaa

SEQ ID NO: 181182 - DNA, 25 bp, Homo sapien
gctgtgaatgtttaccacctgcgca

SEQ ID NO: 181183 - DNA, 25 bp, Homo sapien
tagaagtaacgccacgctgtgaatg

SEQ ID NO: 181184 - DNA, 25 bp, Homo sapien
cgcttggcttgaccagttagaagta

SEQ ID NO: 181185 - DNA, 25 bp, Homo sapien
cctggccttttataggccgtgccta

SEQ ID NO: 181186 - DNA, 25 bp, Homo sapien
gccgtgcctagaaacgcttggcttg

SEQ ID NO: 181187 - DNA, 25 bp, Homo sapien
tccagtcctcgataagtggagtccc

SEQ ID NO: 181188 - DNA, 25 bp, Homo sapien
gtgctagacacctgccgagtccgaa

SEQ ID NO: 181189 - DNA, 25 bp, Homo sapien
ggtcccttgtctggctcattgttcg

SEQ ID NO: 181190 - DNA, 25 bp, Homo sapien
agtgagcgccaaacccgcaagctgg

SEQ ID NO: 181191 - DNA, 25 bp, Homo sapien
gggatttcaaaatgccgcggactcg

SEQ ID NO: 181192 - DNA, 25 bp, Homo sapien
tgttggcactgataagacccgtctt

SEQ ID NO: 181193 - DNA, 25 bp, Homo sapien
ttctttatctgcgaagcgaggagct

SEQ ID NO: 181194 - DNA, 25 bp, Homo sapien
cgctcaccgggctgtaaataaaagt

SEQ ID NO: 181195 - DNA, 25 bp, Homo sapien
ggacgcgtcaaaactggcaaagctg

SEQ ID NO: 181196 - DNA, 25 bp, Homo sapien
taggatacctgtcagtgagcgcccg

SEQ ID NO: 181197 - DNA, 25 bp, Homo sapien
cccgcacatagctggggttagcagg

SEQ ID NO: 181198 - DNA, 25 bp, Homo sapien
gccactggacagttgatttattttc

SEQ ID NO: 181199 - DNA, 25 bp, Homo sapien
tttgctaatgctcttgtggcgcccg

SEQ ID NO: 181200 - DNA, 25 bp, Homo sapien
ttttctttcttccttgcgcgtggca

SEQ ID NO: 181201 - DNA, 25 bp, Homo sapien
tggtggcgagtttcaggattctatc

SEQ ID NO: 181202 - DNA, 25 bp, Homo sapien
gcgagcattagcctgcgtcctggag

SEQ ID NO: 181203 - DNA, 25 bp, Homo sapien
ctcgggctagaaatcagggaagagc

SEQ ID NO: 181204 - DNA, 25 bp, Homo sapien
gagcgctcagtaacccggatctcgc

SEQ ID NO: 181205 - DNA, 25 bp, Homo sapien
gaagcggtaacggatcccgatttga

SEQ ID NO: 181206 - DNA, 25 bp, Homo sapien
ggcacctcggccttgttggcgtccg

SEQ ID NO: 181207 - DNA, 25 bp, Homo sapien
cggatctcgcgagaaccggtcgaga

SEQ ID NO: 181208 - DNA, 25 bp, Homo sapien
taacgccattggagctgctgctgtg

SEQ ID NO: 181209 - DNA, 25 bp, Homo sapien
agacaatacattttaacgccattgg

SEQ ID NO: 181210 - DNA, 25 bp, Homo sapien
gcacctgctcctcaggaagccgatg

SEQ ID NO: 181211 - DNA, 25 bp, Homo sapien
tgggacccagtagtttcccatccca

SEQ ID NO: 181212 - DNA, 25 bp, Homo sapien
cccacgcgctgaatgtggaaagttg

SEQ ID NO: 181213 - DNA, 25 bp, Homo sapien
tggcgtacactctcggaaaaatggg

SEQ ID NO: 181214 - DNA, 25 bp, Homo sapien
tctggaaggaatccacgcggcttga

SEQ ID NO: 181215 - DNA, 25 bp, Homo sapien
caaacctgctttccgagaagggctt

SEQ ID NO: 181216 - DNA, 25 bp, Homo sapien
tacgtctctgcttcgctcagcgatg

SEQ ID NO: 181217 - DNA, 25 bp, Homo sapien
tgcttccgaggtcatgttcccagga

SEQ ID NO: 181218 - DNA, 25 bp, Homo sapien
agccagaggcggcagcaagactcaa

SEQ ID NO: 181219 - DNA, 25 bp, Homo sapien
tcttcaagtatcgtccgcgcagcgg

SEQ ID NO: 181220 - DNA, 25 bp, Homo sapien
cgcgcagcggtttctcgcgagagaa

SEQ ID NO: 181221 - DNA, 25 bp, Homo sapien
cgcgtggcgcagttaatttgggtaa

SEQ ID NO: 181222 - DNA, 25 bp, Homo sapien
cggcgcaaacgcaaaagcctccgtg

SEQ ID NO: 181223 - DNA, 25 bp, Homo sapien
ttttttagcggcacgaattgcgcgc

SEQ ID NO: 181224 - DNA, 25 bp, Homo sapien
agcgcggcgcaaagtacccatatcc

SEQ ID NO: 181225 - DNA, 25 bp, Homo sapien
gggaagaccgtttggtccacagctg

SEQ ID NO: 181226 - DNA, 25 bp, Homo sapien
gcctctcgctcgcaggattagcgca

SEQ ID NO: 181227 - DNA, 25 bp, Homo sapien
gctacggcactacaaacatgaccaa

SEQ ID NO: 181228 - DNA, 25 bp, Homo sapien
cagctacggcactacaaacatgacc

SEQ ID NO: 181229 - DNA, 25 bp, Homo sapien
cgtcagctacggcactacaaacatg

SEQ ID NO: 181230 - DNA, 25 bp, Homo sapien
gcactacaaacatgaccaaagccgc

SEQ ID NO: 181231 - DNA, 25 bp, Homo sapien
accaaagccgcacggggcccaggat

SEQ ID NO: 181232 - DNA, 25 bp, Homo sapien
aacatgaccaaagccgcacggggcc

SEQ ID NO: 181233 - DNA, 25 bp, Homo sapien
tacaaacatgaccaaagccgcacgg

SEQ ID NO: 181234 - DNA, 25 bp, Homo sapien
acggcactacaaacatgaccaaagc

SEQ ID NO: 181235 - DNA, 25 bp, Homo sapien
tactgtgagccaggcgtgacgccag

SEQ ID NO: 181236 - DNA, 25 bp, Homo sapien
ccgcagagtagggtctcagggcgac

SEQ ID NO: 181237 - DNA, 25 bp, Homo sapien
tgtactcggtcaacacacgtgcaca

SEQ ID NO: 181238 - DNA, 25 bp, Homo sapien
gcgtcacttgtactcggtcaacaca

SEQ ID NO: 181239 - DNA, 25 bp, Homo sapien
tgccagcgtcacttgtactcggtca

SEQ ID NO: 181240 - DNA, 25 bp, Homo sapien
tactggcttcgggtgccagcgtcac

SEQ ID NO: 181241 - DNA, 25 bp, Homo sapien
ccaggatgcccggggctactggctt

SEQ ID NO: 181242 - DNA, 25 bp, Homo sapien
cacgtgcacagagcacctactgtga

SEQ ID NO: 181243 - DNA, 25 bp, Homo sapien
gcgcgcggactccttgtctttctac

SEQ ID NO: 181244 - DNA, 25 bp, Homo sapien
gcttctcctacctctggctcaagtt

SEQ ID NO: 181245 - DNA, 25 bp, Homo sapien
tgggtccacacttagccgctccagg

SEQ ID NO: 181246 - DNA, 25 bp, Homo sapien
tgtctttctacctcacattcgggcg

SEQ ID NO: 181247 - DNA, 25 bp, Homo sapien
gcggccagagctcagcctgaatttt

SEQ ID NO: 181248 - DNA, 25 bp, Homo sapien
cctgaattttcagccgccctttcgg

SEQ ID NO: 181249 - DNA, 25 bp, Homo sapien
tccagtgtcagtcccggagagaacg

SEQ ID NO: 181250 - DNA, 25 bp, Homo sapien
ccaccgtgttctgggtgagtgaccc

SEQ ID NO: 181251 - DNA, 25 bp, Homo sapien
tacggctgtttgaaagcgggcgcca

SEQ ID NO: 181252 - DNA, 25 bp, Homo sapien
ttcgagagccaattacgaggaagtc

SEQ ID NO: 181253 - DNA, 25 bp, Homo sapien
gttgcctagagacgccgaggcgctt

SEQ ID NO: 181254 - DNA, 25 bp, Homo sapien
taccggagactgcaaaggtgactcg

SEQ ID NO: 181255 - DNA, 25 bp, Homo sapien
aaaggtgactcgtgcctcctgcgct

SEQ ID NO: 181256 - DNA, 25 bp, Homo sapien
gcttcagcacacagaatcccgcaga

SEQ ID NO: 181257 - DNA, 25 bp, Homo sapien
cttgcccgtttggtaccggagactg

SEQ ID NO: 181258 - DNA, 25 bp, Homo sapien
cgcccattggtggattcgagagcca

SEQ ID NO: 181259 - DNA, 25 bp, Homo sapien
ggtggcgctcacactaactatagct

SEQ ID NO: 181260 - DNA, 25 bp, Homo sapien
atgagaacgcatctttgtgcggtcg

SEQ ID NO: 181261 - DNA, 25 bp, Homo sapien
ccctgggtatgagaacgcatctttg

SEQ ID NO: 181262 - DNA, 25 bp, Homo sapien
tatagctatccagggcgcgggtcga

SEQ ID NO: 181263 - DNA, 25 bp, Homo sapien
taactatagctatccagggcgcggg

SEQ ID NO: 181264 - DNA, 25 bp, Homo sapien
ccgcgtacggccaatcgcaacgagg

SEQ ID NO: 181265 - DNA, 25 bp, Homo sapien
caatcgcaacgaggctgctccgtgg

SEQ ID NO: 181266 - DNA, 25 bp, Homo sapien
gcactcccacgggagactgcttggc

SEQ ID NO: 181267 - DNA, 25 bp, Homo sapien
actgggaggacgactacgactatcc

SEQ ID NO: 181268 - DNA, 25 bp, Homo sapien
ctgagttgtccgagctgtatgaaga

SEQ ID NO: 181269 - DNA, 25 bp, Homo sapien
gcacaatgtcggaaatggctgagtt

SEQ ID NO: 181270 - DNA, 25 bp, Homo sapien
tcctagaggttgagcggtttgcaca

SEQ ID NO: 181271 - DNA, 25 bp, Homo sapien
catctgtcttgctggaagctttttc

SEQ ID NO: 181272 - DNA, 25 bp, Homo sapien
tccaaccacagtggcgcgccaagta

SEQ ID NO: 181273 - DNA, 25 bp, Homo sapien
cgtagctcaaaaggcgacgccaaca

SEQ ID NO: 181274 - DNA, 25 bp, Homo sapien
gttcgaatcgatggaaacgtagctc

SEQ ID NO: 181275 - DNA, 25 bp, Homo sapien
gtcgctcacggccaactcttaggcg

SEQ ID NO: 181276 - DNA, 25 bp, Homo sapien
ctgtacttggccctgtgcagcatcc

SEQ ID NO: 181277 - DNA, 25 bp, Homo sapien
cgcgttctcgcatagccttggcagt

SEQ ID NO: 181278 - DNA, 25 bp, Homo sapien
tcgcctcgtcgtctggtagataaac

SEQ ID NO: 181279 - DNA, 25 bp, Homo sapien
gcaccagtgttctcgccttggaatc

SEQ ID NO: 181280 - DNA, 25 bp, Homo sapien
gggtgcccgaagagtcctacataca

SEQ ID NO: 181281 - DNA, 25 bp, Homo sapien
aatccttgtcgggagagcctagacc

SEQ ID NO: 181282 - DNA, 25 bp, Homo sapien
tccaaggacgtgatcgactcgttcc

SEQ ID NO: 181283 - DNA, 25 bp, Homo sapien
ggctgtgcccttctcgagaagcccg

SEQ ID NO: 181284 - DNA, 25 bp, Homo sapien
cgctttcgcacggtctccctgaaaa

SEQ ID NO: 181285 - DNA, 25 bp, Homo sapien
gcggatgagtttcccggatgagctc

SEQ ID NO: 181286 - DNA, 25 bp, Homo sapien
gcacagcatcaaagctgcgggcgcc

SEQ ID NO: 181287 - DNA, 25 bp, Homo sapien
cggtctccctgaaaaagaccagcgg

SEQ ID NO: 181288 - DNA, 25 bp, Homo sapien
ggctgccaggcgcacagcatcaaag

SEQ ID NO: 181289 - DNA, 25 bp, Homo sapien
ggctgcctgtttttcgtctgaaagg

SEQ ID NO: 181290 - DNA, 25 bp, Homo sapien
agagcgtctggtccgcgctttcgca

SEQ ID NO: 181291 - DNA, 25 bp, Homo sapien
gatcatctgggacggaagccgagga

SEQ ID NO: 181292 - DNA, 25 bp, Homo sapien
gctagtcggtgtaaacagcgcctcg

SEQ ID NO: 181293 - DNA, 25 bp, Homo sapien
cgcctcgggccgctttctccatggc

SEQ ID NO: 181294 - DNA, 25 bp, Homo sapien
ccgctcgggtccagactgggttccg

SEQ ID NO: 181295 - DNA, 25 bp, Homo sapien
gctggccgcgacaccgattcggcta

SEQ ID NO: 181296 - DNA, 25 bp, Homo sapien
attcggctacgccactggccgagga

SEQ ID NO: 181297 - DNA, 25 bp, Homo sapien
ggcccgcgctagtcggtgtaaacag

SEQ ID NO: 181298 - DNA, 25 bp, Homo sapien
cacgttcggagaactgggcctggcc

SEQ ID NO: 181299 - DNA, 25 bp, Homo sapien
acagagaaccgaacgcctgggacca

SEQ ID NO: 181300 - DNA, 25 bp, Homo sapien
cgctgggcccgaaagggcaaagcca

SEQ ID NO: 181301 - DNA, 25 bp, Homo sapien
agggcaaagccagggcctacaccgc

SEQ ID NO: 181302 - DNA, 25 bp, Homo sapien
cgctcagactcggagggcaaggccc

SEQ ID NO: 181303 - DNA, 25 bp, Homo sapien
caggggcatccgtgtaaaccgaaga

SEQ ID NO: 181304 - DNA, 25 bp, Homo sapien
gaggcagaagacagagaaccgaacg

SEQ ID NO: 181305 - DNA, 25 bp, Homo sapien
tacaccgcagcatggtcaccgaggc

SEQ ID NO: 181306 - DNA, 25 bp, Homo sapien
gtaaaccgaagaggcgctcagactc

SEQ ID NO: 181307 - DNA, 25 bp, Homo sapien
tgtctcccggaaagcgctccgtctg

SEQ ID NO: 181308 - DNA, 25 bp, Homo sapien
ccgcgggaagtggacattctttgtc

SEQ ID NO: 181309 - DNA, 25 bp, Homo sapien
cgcgcctctctggagaccagtggtc

SEQ ID NO: 181310 - DNA, 25 bp, Homo sapien
tgcaggtctgagtaccactccgatc

SEQ ID NO: 181311 - DNA, 25 bp, Homo sapien
ccctgccttagcaacgacgctagta

SEQ ID NO: 181312 - DNA, 25 bp, Homo sapien
ggctgaggcggaacttcccgtctaa

SEQ ID NO: 181313 - DNA, 25 bp, Homo sapien
gagaagtgcgacaccgccgctgatt

SEQ ID NO: 181314 - DNA, 25 bp, Homo sapien
cattctttgtcaggaccctagcgga

SEQ ID NO: 181315 - DNA, 25 bp, Homo sapien
tggcgtgcctcaattacaacatccg

SEQ ID NO: 181316 - DNA, 25 bp, Homo sapien
gccttgactgacgagccacagcgtg

SEQ ID NO: 181317 - DNA, 25 bp, Homo sapien
cttcttccaggacataggctacttc

SEQ ID NO: 181318 - DNA, 25 bp, Homo sapien
gacgagactctcacctacgcgcagg

SEQ ID NO: 181319 - DNA, 25 bp, Homo sapien
ggtgaacctctgctgcccatacttc

SEQ ID NO: 181320 - DNA, 25 bp, Homo sapien
ggcaacgcgcatacgactacacctg

SEQ ID NO: 181321 - DNA, 25 bp, Homo sapien
ctccttatgggtaacgagccggcct

SEQ ID NO: 181322 - DNA, 25 bp, Homo sapien
ttcctggagaaagcgcgccagacgc

SEQ ID NO: 181323 - DNA, 25 bp, Homo sapien
tcaggctgccgagacaaagggtacc

SEQ ID NO: 181324 - DNA, 25 bp, Homo sapien
ccacatccggtggtaacagggccct

SEQ ID NO: 181325 - DNA, 25 bp, Homo sapien
acccgcactgacctggaaaagcttc

SEQ ID NO: 181326 - DNA, 25 bp, Homo sapien
cacaaagcgcttcagctgcacaggg

SEQ ID NO: 181327 - DNA, 25 bp, Homo sapien
ctgcacagggcgctattttccgaaa

SEQ ID NO: 181328 - DNA, 25 bp, Homo sapien
ttttccgaaaatgccgcgtctggtc

SEQ ID NO: 181329 - DNA, 25 bp, Homo sapien
tcttcagctcatcgcccgaggattt

SEQ ID NO: 181330 - DNA, 25 bp, Homo sapien
acccggcgccttaatgcaataaaca

SEQ ID NO: 181331 - DNA, 25 bp, Homo sapien
tttcccagttcacagcctggtcttc

SEQ ID NO: 181332 - DNA, 25 bp, Homo sapien
cccggacctgattgggagtagagca

SEQ ID NO: 181333 - DNA, 25 bp, Homo sapien
aggcgccctgaaatcccggacctga

SEQ ID NO: 181334 - DNA, 25 bp, Homo sapien
ggcaatggctccgaaaagtgcacga

SEQ ID NO: 181335 - DNA, 25 bp, Homo sapien
ctgcagcgcagctcacgtttcaggc

SEQ ID NO: 181336 - DNA, 25 bp, Homo sapien
cgggctagcgctttcccagttcaca

SEQ ID NO: 181337 - DNA, 25 bp, Homo sapien
acgtttcaggcgcagttcgcaggga

SEQ ID NO: 181338 - DNA, 25 bp, Homo sapien
gggtcgccttcgtggctttaaggca

SEQ ID NO: 181339 - DNA, 25 bp, Homo sapien
gcttccgtcctggtagccaaggcta

SEQ ID NO: 181340 - DNA, 25 bp, Homo sapien
cctagcacctgttctctgggaagtc

SEQ ID NO: 181341 - DNA, 25 bp, Homo sapien
ccgctgtgaacgatgaacgcctttc

SEQ ID NO: 181342 - DNA, 25 bp, Homo sapien
gccaaggctaattctccctcgagtt

SEQ ID NO: 181343 - DNA, 25 bp, Homo sapien
gacgcgtcgcctcgcaatgcaaatc

SEQ ID NO: 181344 - DNA, 25 bp, Homo sapien
tatgttgacccgactcagagaaacc

SEQ ID NO: 181345 - DNA, 25 bp, Homo sapien
taagggaccggccaactatgttgac

SEQ ID NO: 181346 - DNA, 25 bp, Homo sapien
ccctcgagttcttgggagatgggca

SEQ ID NO: 181347 - DNA, 25 bp, Homo sapien
cgctagcagcagaagccgagtcttt

SEQ ID NO: 181348 - DNA, 25 bp, Homo sapien
cctcaaggcaattcgagggtccttc

SEQ ID NO: 181349 - DNA, 25 bp, Homo sapien
ctgtagccatctatcgggaagcgtc

SEQ ID NO: 181350 - DNA, 25 bp, Homo sapien
agccgagtctttcataattgtgcga

SEQ ID NO: 181351 - DNA, 25 bp, Homo sapien
attgtgcgaccaactcctccgggtg

SEQ ID NO: 181352 - DNA, 25 bp, Homo sapien
gttcacgccgtatctccgttgggta

SEQ ID NO: 181353 - DNA, 25 bp, Homo sapien
gggtccagtaccattctcctcacgg

SEQ ID NO: 181354 - DNA, 25 bp, Homo sapien
gaggtgtcgcctctaacttgctacc

SEQ ID NO: 181355 - DNA, 25 bp, Homo sapien
ctttgaagaaagatagggccgctgg

SEQ ID NO: 181356 - DNA, 25 bp, Homo sapien
cttggctctagccaccgggacatct

SEQ ID NO: 181357 - DNA, 25 bp, Homo sapien
gggcagaccatctggcttggctcta

SEQ ID NO: 181358 - DNA, 25 bp, Homo sapien
gtgtagccgccatcgggcagaccat

SEQ ID NO: 181359 - DNA, 25 bp, Homo sapien
gatcgcgagtacaccgagcctgaga

SEQ ID NO: 181360 - DNA, 25 bp, Homo sapien
acggtgacatttggccctggttctg

SEQ ID NO: 181361 - DNA, 25 bp, Homo sapien
gccagtttttgtttttagtgcagcc

SEQ ID NO: 181362 - DNA, 25 bp, Homo sapien
cactccgcagcctacagagatgggg

SEQ ID NO: 181363 - DNA, 25 bp, Homo sapien
gcctggcgggagaacggatttctca

SEQ ID NO: 181364 - DNA, 25 bp, Homo sapien
ggctacgactggaccgccgctgcta

SEQ ID NO: 181365 - DNA, 25 bp, Homo sapien
ggtctgagcctgtcgctttccggct

SEQ ID NO: 181366 - DNA, 25 bp, Homo sapien
tcgctttccggctgcccgactttaa

SEQ ID NO: 181367 - DNA, 25 bp, Homo sapien
tgcccgactttaactcacaccgaag

SEQ ID NO: 181368 - DNA, 25 bp, Homo sapien
ttaactcacaccgaagcctggcggg

SEQ ID NO: 181369 - DNA, 25 bp, Homo sapien
acggatttctcaaggctcggaagtg

SEQ ID NO: 181370 - DNA, 25 bp, Homo sapien
ctcggaagtgtctgagcgtctgctc

SEQ ID NO: 181371 - DNA, 25 bp, Homo sapien
tctttctgcagaaccagcccggtgg

SEQ ID NO: 181372 - DNA, 25 bp, Homo sapien
tggcacgccgaatcctcaggacagc

SEQ ID NO: 181373 - DNA, 25 bp, Homo sapien
ttcctcaggaggactcacggttctg

SEQ ID NO: 181374 - DNA, 25 bp, Homo sapien
cccgtcgcgagaaaggaggtctact

SEQ ID NO: 181375 - DNA, 25 bp, Homo sapien
aggaggtctacttacgcgcgcaatc

SEQ ID NO: 181376 - DNA, 25 bp, Homo sapien
aatctcgagcgagcggccttttcca

SEQ ID NO: 181377 - DNA, 25 bp, Homo sapien
caggtgggacgccaataaagatttc

SEQ ID NO: 181378 - DNA, 25 bp, Homo sapien
tctcgcgagaacgacgctgaacttg

SEQ ID NO: 181379 - DNA, 25 bp, Homo sapien
gcagcaaactacagtacgcggattc

SEQ ID NO: 181380 - DNA, 25 bp, Homo sapien
aatccgaatccatgctgcgggctgc

SEQ ID NO: 181381 - DNA, 25 bp, Homo sapien
aaggcagatgtgttgcaaccctctc

SEQ ID NO: 181382 - DNA, 25 bp, Homo sapien
ggcccgcgctcggaaagttatttca

SEQ ID NO: 181383 - DNA, 25 bp, Homo sapien
ccagtcacgttcttggacccagtca

SEQ ID NO: 181384 - DNA, 25 bp, Homo sapien
tcgcgaggccttttctgttcagagc

SEQ ID NO: 181385 - DNA, 25 bp, Homo sapien
tgggctctcctagcagcctcgggaa

SEQ ID NO: 181386 - DNA, 25 bp, Homo sapien
ctatcgattgtgaaaagccggcggg

SEQ ID NO: 181387 - DNA, 25 bp, Homo sapien
aagcagccgtgctatttcgcgccct

SEQ ID NO: 181388 - DNA, 25 bp, Homo sapien
cctgccaatcaagcagccgtgctat

SEQ ID NO: 181389 - DNA, 25 bp, Homo sapien
tggagccaccctgccaatcaagcag

SEQ ID NO: 181390 - DNA, 25 bp, Homo sapien
gttggagccaccctgccaatcaagc

SEQ ID NO: 181391 - DNA, 25 bp, Homo sapien
ctcgcctggaaggttggagccaccc

SEQ ID NO: 181392 - DNA, 25 bp, Homo sapien
atcaagcagccgtgctatttcgcgc

SEQ ID NO: 181393 - DNA, 25 bp, Homo sapien
gccaatcaagcagccgtgctatttc

SEQ ID NO: 181394 - DNA, 25 bp, Homo sapien
acactggctcgcctggaaggttgga

SEQ ID NO: 181395 - DNA, 25 bp, Homo sapien
ggcctggcacctagtgacgaagtaa

SEQ ID NO: 181396 - DNA, 25 bp, Homo sapien
ggcacctagtgacgaagtaaacaca

SEQ ID NO: 181397 - DNA, 25 bp, Homo sapien
gacgaagtaaacacacaggcaggta

SEQ ID NO: 181398 - DNA, 25 bp, Homo sapien
aggcaggtaatgctaactccggctg

SEQ ID NO: 181399 - DNA, 25 bp, Homo sapien
ggtaatgctaactccggctgtttga

SEQ ID NO: 181400 - DNA, 25 bp, Homo sapien
aactccggctgtttgagtcttctgc

SEQ ID NO: 181401 - DNA, 25 bp, Homo sapien
ggctcggtgagtctgaacactggct

SEQ ID NO: 181402 - DNA, 25 bp, Homo sapien
ctgtttgagtcttctgccagcgagg

SEQ ID NO: 181403 - DNA, 25 bp, Homo sapien
gcgtataaaggctgccagggccgca

SEQ ID NO: 181404 - DNA, 25 bp, Homo sapien
gatgacctactccatggtgccggta

SEQ ID NO: 181405 - DNA, 25 bp, Homo sapien
agccatgacatgctgatgatgatga

SEQ ID NO: 181406 - DNA, 25 bp, Homo sapien
catatccgcgccgagagccatgaca

SEQ ID NO: 181407 - DNA, 25 bp, Homo sapien
ctgggccaaagggtgacttgactca

SEQ ID NO: 181408 - DNA, 25 bp, Homo sapien
ctgcccaaggcgcatagagcatggc

SEQ ID NO: 181409 - DNA, 25 bp, Homo sapien
cacggcttgcccgaggcgtataaag

SEQ ID NO: 181410 - DNA, 25 bp, Homo sapien
gcgctccttcctggccgagttgagc

SEQ ID NO: 181411 - DNA, 25 bp, Homo sapien
agtccagtcacctcaggcccgtttg

SEQ ID NO: 181412 - DNA, 25 bp, Homo sapien
aatgcccggatgttcccactgcctg

SEQ ID NO: 181413 - DNA, 25 bp, Homo sapien
cgcggaggctctggcttaactcctc

SEQ ID NO: 181414 - DNA, 25 bp, Homo sapien
ctgcccacggagtagcagttgtctc

SEQ ID NO: 181415 - DNA, 25 bp, Homo sapien
ggtggggcccaccaacatctcacag

SEQ ID NO: 181416 - DNA, 25 bp, Homo sapien
gtgatttcctacaccagacgcagga

SEQ ID NO: 181417 - DNA, 25 bp, Homo sapien
agtgcggtggattcctaagcctttc

SEQ ID NO: 181418 - DNA, 25 bp, Homo sapien
ccgccctaggaggagccttctagtc

SEQ ID NO: 181419 - DNA, 25 bp, Homo sapien
ctgcttatcccttgaccgtcgagtg

SEQ ID NO: 181420 - DNA, 25 bp, Homo sapien
tagcgttggagtcaccgacgccatc

SEQ ID NO: 181421 - DNA, 25 bp, Homo sapien
cgtgcatggagcatgcgcttccttc

SEQ ID NO: 181422 - DNA, 25 bp, Homo sapien
cacttcctctgcaggagggagcgag

SEQ ID NO: 181423 - DNA, 25 bp, Homo sapien
cgagagtaaagctacgccctggcgc

SEQ ID NO: 181424 - DNA, 25 bp, Homo sapien
tacctggagacttgactcccgcgcg

SEQ ID NO: 181425 - DNA, 25 bp, Homo sapien
accgtcgagtgtcagagatcctgca

SEQ ID NO: 181426 - DNA, 25 bp, Homo sapien
acaggaacttcagcacccacagggc

SEQ ID NO: 181427 - DNA, 25 bp, Homo sapien
cgctccgtctcacgggtcacttgga

SEQ ID NO: 181428 - DNA, 25 bp, Homo sapien
tgctcagtgccaactcgctcttagg

SEQ ID NO: 181429 - DNA, 25 bp, Homo sapien
gcttctggtcgccaagttcagctga

SEQ ID NO: 181430 - DNA, 25 bp, Homo sapien
aagtttgagtccgtcactgggcgca

SEQ ID NO: 181431 - DNA, 25 bp, Homo sapien
tacaagctgtggtccgctatgcgca

SEQ ID NO: 181432 - DNA, 25 bp, Homo sapien
cgctgggtcagaggatccctctttc

SEQ ID NO: 181433 - DNA, 25 bp, Homo sapien
ctcggaggcctccaaatattacctt

SEQ ID NO: 181434 - DNA, 25 bp, Homo sapien
gcgtttgagtcagcgcccagatgta

SEQ ID NO: 181435 - DNA, 25 bp, Homo sapien
ggtgctccacatggcgctcgatgac

SEQ ID NO: 181436 - DNA, 25 bp, Homo sapien
aggaatccgccatgggtcctgccga

SEQ ID NO: 181437 - DNA, 25 bp, Homo sapien
tccctcacgcgacagatctagtctg

SEQ ID NO: 181438 - DNA, 25 bp, Homo sapien
ggaactcgatgcagctacctaggga

SEQ ID NO: 181439 - DNA, 25 bp, Homo sapien
tgcaggaccagctttggcgaccact

SEQ ID NO: 181440 - DNA, 25 bp, Homo sapien
ctgctcaccgtgacaccgtacttga

SEQ ID NO: 181441 - DNA, 25 bp, Homo sapien
acaccgtacttgagcgcgatgccct

SEQ ID NO: 181442 - DNA, 25 bp, Homo sapien
cacctgcaaggttaagagcgaaagc

SEQ ID NO: 181443 - DNA, 25 bp, Homo sapien
gcagggcgtttcagcctcccagtaa

SEQ ID NO: 181444 - DNA, 25 bp, Homo sapien
tctcaacgcggcttccgtgtcagga

SEQ ID NO: 181445 - DNA, 25 bp, Homo sapien
ctttcctgagatcgctggagctgtc

SEQ ID NO: 181446 - DNA, 25 bp, Homo sapien
gctcctggagcggtatgcatctccc

SEQ ID NO: 181447 - DNA, 25 bp, Homo sapien
ttcctgtgcatgtttggtgagctcc

SEQ ID NO: 181448 - DNA, 25 bp, Homo sapien
ggctgtgttcttccactccgggctt

SEQ ID NO: 181449 - DNA, 25 bp, Homo sapien
acaggaatgctcatcacaggcttga

SEQ ID NO: 181450 - DNA, 25 bp, Homo sapien
tcaggatgctcgctcacaggaatgc

SEQ ID NO: 181451 - DNA, 25 bp, Homo sapien
agatggcaccgagcctccttcaaag

SEQ ID NO: 181452 - DNA, 25 bp, Homo sapien
gacgcgatcacaccgagatggcacc

SEQ ID NO: 181453 - DNA, 25 bp, Homo sapien
gcgaacctggcgttcccagtgaatc

SEQ ID NO: 181454 - DNA, 25 bp, Homo sapien
gtgctttccaggaagtccgtctgcg

SEQ ID NO: 181455 - DNA, 25 bp, Homo sapien
tcaggtaagcccagcccggtgcttt

SEQ ID NO: 181456 - DNA, 25 bp, Homo sapien
accgcacctacagggcggtcgagtg

SEQ ID NO: 181457 - DNA, 25 bp, Homo sapien
gcgaaggaggaacccaccgcaccta

SEQ ID NO: 181458 - DNA, 25 bp, Homo sapien
tccttcaaaggcttcggcttgttga

SEQ ID NO: 181459 - DNA, 25 bp, Homo sapien
accacatgagctcgtgcgccttctg

SEQ ID NO: 181460 - DNA, 25 bp, Homo sapien
aagaactcgtattcgggcggctcca

SEQ ID NO: 181461 - DNA, 25 bp, Homo sapien
tgttctgacatgtctgcgccgtctg

SEQ ID NO: 181462 - DNA, 25 bp, Homo sapien
cttgtagctgccgatgacatctttc

SEQ ID NO: 181463 - DNA, 25 bp, Homo sapien
aactccatggtgtgcaggctggtta

SEQ ID NO: 181464 - DNA, 25 bp, Homo sapien
gggacgcgctggtacttcaggtaat

SEQ ID NO: 181465 - DNA, 25 bp, Homo sapien
tgcgtccaggagctcttcgagcctg

SEQ ID NO: 181466 - DNA, 25 bp, Homo sapien
cggcccttcacgtagatgaggctca

SEQ ID NO: 181467 - DNA, 25 bp, Homo sapien
tatttgccaggattcttaccagggg

SEQ ID NO: 181468 - DNA, 25 bp, Homo sapien
agcccggccatttcgtcaatatctg

SEQ ID NO: 181469 - DNA, 25 bp, Homo sapien
ttacgtgacctagttttcgctcgcc

SEQ ID NO: 181470 - DNA, 25 bp, Homo sapien
gtcgctcccgaagagatcctccata

SEQ ID NO: 181471 - DNA, 25 bp, Homo sapien
ctctctttacggcacggaaccactg

SEQ ID NO: 181472 - DNA, 25 bp, Homo sapien
cgacagtgtcgcaaagattcgccga

SEQ ID NO: 181473 - DNA, 25 bp, Homo sapien
ctcgcctgggtatgcatggtatata

SEQ ID NO: 181474 - DNA, 25 bp, Homo sapien
tttcgctcgcccagtgaacctgttc

SEQ ID NO: 181475 - DNA, 25 bp, Homo sapien
cgcactctctcgatgagtcggagaa

SEQ ID NO: 181476 - DNA, 25 bp, Homo sapien
tggcacgctgcctttcgaaatgctc

SEQ ID NO: 181477 - DNA, 25 bp, Homo sapien
gtggagtctcgccttactggcacgc

SEQ ID NO: 181478 - DNA, 25 bp, Homo sapien
ctgccgctcaacaaaggcgtttttg

SEQ ID NO: 181479 - DNA, 25 bp, Homo sapien
ctccattgtgtgtgaccctccggcg

SEQ ID NO: 181480 - DNA, 25 bp, Homo sapien
aaagtctccagtggcgtagcgcgca

SEQ ID NO: 181481 - DNA, 25 bp, Homo sapien
gcgactgcggcaaagcgagagcctc

SEQ ID NO: 181482 - DNA, 25 bp, Homo sapien
agaacccgtggagtgagcctgtgac

SEQ ID NO: 181483 - DNA, 25 bp, Homo sapien
tgcgaaggtcacgagcgtcaccact

SEQ ID NO: 181484 - DNA, 25 bp, Homo sapien
ggaccggtgaatctgccgtaacctg

SEQ ID NO: 181485 - DNA, 25 bp, Homo sapien
cacgaaacctcgttccaggggcctg

SEQ ID NO: 181486 - DNA, 25 bp, Homo sapien
agacttcacagcgaacgttccaggc

SEQ ID NO: 181487 - DNA, 25 bp, Homo sapien
cctgctcctttagccgcggctggaa

SEQ ID NO: 181488 - DNA, 25 bp, Homo sapien
ggcccgctgaaacgagcctttctgc

SEQ ID NO: 181489 - DNA, 25 bp, Homo sapien
aactggtcaaccatggtccggcctc

SEQ ID NO: 181490 - DNA, 25 bp, Homo sapien
gccgtctaagaaggccgatttctgc

SEQ ID NO: 181491 - DNA, 25 bp, Homo sapien
atgaggatagctagtcccgcggtcc

SEQ ID NO: 181492 - DNA, 25 bp, Homo sapien
cctggtgcgatgtccgcgtcagcct

SEQ ID NO: 181493 - DNA, 25 bp, Homo sapien
cttccaggcaggtgatgaggatagc

SEQ ID NO: 181494 - DNA, 25 bp, Homo sapien
acgccagcgtctcgttctcgtgcag

SEQ ID NO: 181495 - DNA, 25 bp, Homo sapien
tccagcttgcccttgaggctctcgg

SEQ ID NO: 181496 - DNA, 25 bp, Homo sapien
gcgatccgttcgcagcttccaggca

SEQ ID NO: 181497 - DNA, 25 bp, Homo sapien
tcacgctccacatcgtgcagcttgg

SEQ ID NO: 181498 - DNA, 25 bp, Homo sapien
ccctccgcatgggaggggcaagaac

SEQ ID NO: 181499 - DNA, 25 bp, Homo sapien
cgccgggccatcttgcccaaagttt

SEQ ID NO: 181500 - DNA, 25 bp, Homo sapien
gaacagatgcatccggaggctgccc

SEQ ID NO: 181501 - DNA, 25 bp, Homo sapien
gtctcatcttcctacgtccgcatgg

SEQ ID NO: 181502 - DNA, 25 bp, Homo sapien
ccgaggcgctccagtcccgggagat

SEQ ID NO: 181503 - DNA, 25 bp, Homo sapien
cgccaggtcgagtcagcgttagcag

SEQ ID NO: 181504 - DNA, 25 bp, Homo sapien
tggcccggctagtcggcgctgccat

SEQ ID NO: 181505 - DNA, 25 bp, Homo sapien
cgtccgcatgggcaactctgattcc

SEQ ID NO: 181506 - DNA, 25 bp, Homo sapien
ggcaactctgattccacccgtggtg

SEQ ID NO: 181507 - DNA, 25 bp, Homo sapien
tacctttgtgtagagctccgacgca

SEQ ID NO: 181508 - DNA, 25 bp, Homo sapien
ctcacagaaaggctagctggcggta

SEQ ID NO: 181509 - DNA, 25 bp, Homo sapien
cgccgccctgtgcattatgggagcg

SEQ ID NO: 181510 - DNA, 25 bp, Homo sapien
tctcgcccgaaagaggaaggtgccg

SEQ ID NO: 181511 - DNA, 25 bp, Homo sapien
tccgatctactggagcaagcatctc

SEQ ID NO: 181512 - DNA, 25 bp, Homo sapien
caagacgttattttaagcgcgtgtc

SEQ ID NO: 181513 - DNA, 25 bp, Homo sapien
agcggcactgcataccaacacaaga

SEQ ID NO: 181514 - DNA, 25 bp, Homo sapien
tcggctacgagcacagagcatcatc

SEQ ID NO: 181515 - DNA, 25 bp, Homo sapien
agtgtccacattatcctcgccggcg

SEQ ID NO: 181516 - DNA, 25 bp, Homo sapien
gggctcttgaactctcggatggtga

SEQ ID NO: 181517 - DNA, 25 bp, Homo sapien
tccagtttggagctcttgccctttg

SEQ ID NO: 181518 - DNA, 25 bp, Homo sapien
cgcgagatgcccatatgtccggctc

SEQ ID NO: 181519 - DNA, 25 bp, Homo sapien
atgcacatttgttcccagcgcttgg

SEQ ID NO: 181520 - DNA, 25 bp, Homo sapien
aagacacctgttgaagcggctcctc

SEQ ID NO: 181521 - DNA, 25 bp, Homo sapien
cgcggcgcctggaaacaaagtgtcc

SEQ ID NO: 181522 - DNA, 25 bp, Homo sapien
tggcctcgccttttgagagtttagc

SEQ ID NO: 181523 - DNA, 25 bp, Homo sapien
ggccgccgccttatgacgacacgga

SEQ ID NO: 181524 - DNA, 25 bp, Homo sapien
gacgccgggaaaagatgcaattagc

SEQ ID NO: 181525 - DNA, 25 bp, Homo sapien
tttccttcaaaggtcgccgctcctg

SEQ ID NO: 181526 - DNA, 25 bp, Homo sapien
cctcggggacttccgcagacatagt

SEQ ID NO: 181527 - DNA, 25 bp, Homo sapien
ttggaactcccaattcgtcggcgca

SEQ ID NO: 181528 - DNA, 25 bp, Homo sapien
catagtgctccctctgcagacgaga

SEQ ID NO: 181529 - DNA, 25 bp, Homo sapien
caccgcgacccacggaggtgttaca

SEQ ID NO: 181530 - DNA, 25 bp, Homo sapien
gtcctgggctctcgcgtaaatataa

SEQ ID NO: 181531 - DNA, 25 bp, Homo sapien
tctttctctgctgtttgccctgtca

SEQ ID NO: 181532 - DNA, 25 bp, Homo sapien
gagacaccagcagagtcccggaagc

SEQ ID NO: 181533 - DNA, 25 bp, Homo sapien
ctggcgcccggttactatggcaatg

SEQ ID NO: 181534 - DNA, 25 bp, Homo sapien
ttgccctgtcaaaacactgcctagg

SEQ ID NO: 181535 - DNA, 25 bp, Homo sapien
ttttcatggcgctctcgagctggcc

SEQ ID NO: 181536 - DNA, 25 bp, Homo sapien
cccgctggagagttgttttcatggc

SEQ ID NO: 181537 - DNA, 25 bp, Homo sapien
tttacacagaaacccgagtcacctc

SEQ ID NO: 181538 - DNA, 25 bp, Homo sapien
acactgcctaggtcacgtgtcccaa

SEQ ID NO: 181539 - DNA, 25 bp, Homo sapien
tctcccggcccagaagtcttcaagg

SEQ ID NO: 181540 - DNA, 25 bp, Homo sapien
aggtgctgcacccattgacgggata

SEQ ID NO: 181541 - DNA, 25 bp, Homo sapien
ccagccatagcggttccagtcgtcg

SEQ ID NO: 181542 - DNA, 25 bp, Homo sapien
ctatggtcctacaccctcgagggga

SEQ ID NO: 181543 - DNA, 25 bp, Homo sapien
cagagccttctggtgactgtccgca

SEQ ID NO: 181544 - DNA, 25 bp, Homo sapien
ctaccgggatgcactgccacttttc

SEQ ID NO: 181545 - DNA, 25 bp, Homo sapien
tgcaggggccagttatcaatcaacc

SEQ ID NO: 181546 - DNA, 25 bp, Homo sapien
tccgcaggagcgagaccttttttgg

SEQ ID NO: 181547 - DNA, 25 bp, Homo sapien
cgcttcggggcacgaatcgcaggct

SEQ ID NO: 181548 - DNA, 25 bp, Homo sapien
caaagaacgctttgggtcgcttcgg

SEQ ID NO: 181549 - DNA, 25 bp, Homo sapien
aacctggcagggcagagtctcagcc

SEQ ID NO: 181550 - DNA, 25 bp, Homo sapien
catgaggactttgcctggggcgaac

SEQ ID NO: 181551 - DNA, 25 bp, Homo sapien
ctgcaggaacctgcatgaggacttt

SEQ ID NO: 181552 - DNA, 25 bp, Homo sapien
cacaagagctagagagtggaaaacc

SEQ ID NO: 181553 - DNA, 25 bp, Homo sapien
tatggtgccggtagcacaagagcta

SEQ ID NO: 181554 - DNA, 25 bp, Homo sapien
tccggaacctcagttgctcgcgggc

SEQ ID NO: 181555 - DNA, 25 bp, Homo sapien
agagtaaagcgcctggcgccaggac

SEQ ID NO: 181556 - DNA, 25 bp, Homo sapien
cgcagaactttagagcggcggtctc

SEQ ID NO: 181557 - DNA, 25 bp, Homo sapien
ttagagcggcggtctcattccgccc

SEQ ID NO: 181558 - DNA, 25 bp, Homo sapien
tccatcagaagctgagcgcagcctc

SEQ ID NO: 181559 - DNA, 25 bp, Homo sapien
tgagcgcagcctcaccggaagctgt

SEQ ID NO: 181560 - DNA, 25 bp, Homo sapien
ctcaccggaagctgtggatgaaacc

SEQ ID NO: 181561 - DNA, 25 bp, Homo sapien
ctgtggatgaaaccggtgcccagct

SEQ ID NO: 181562 - DNA, 25 bp, Homo sapien
tgcccagctgcgcagagtaaagcgc

SEQ ID NO: 181563 - DNA, 25 bp, Homo sapien
ttcttaaaattctgaggtctccggc

SEQ ID NO: 181564 - DNA, 25 bp, Homo sapien
tagaggttattcatggaggccagcc

SEQ ID NO: 181565 - DNA, 25 bp, Homo sapien
tcccgcatgagcgtgaagctaccgc

SEQ ID NO: 181566 - DNA, 25 bp, Homo sapien
tcgccgatcgcttccatggtcagct

SEQ ID NO: 181567 - DNA, 25 bp, Homo sapien
agtccggtcttcacatcggctgctg

SEQ ID NO: 181568 - DNA, 25 bp, Homo sapien
tttccaaagaggatccgcgccgttg

SEQ ID NO: 181569 - DNA, 25 bp, Homo sapien
gagccatggctctgttactgttaca

SEQ ID NO: 181570 - DNA, 25 bp, Homo sapien
tgttgccttccttcctctcactgtg

SEQ ID NO: 181571 - DNA, 25 bp, Homo sapien
cgcaactaactccacgttctgggag

SEQ ID NO: 181572 - DNA, 25 bp, Homo sapien
cagaccactcggctcgtatctctgg

SEQ ID NO: 181573 - DNA, 25 bp, Homo sapien
gcggccatcccaggacaccagacca

SEQ ID NO: 181574 - DNA, 25 bp, Homo sapien
ggctcgtatctctggttacttcctg

SEQ ID NO: 181575 - DNA, 25 bp, Homo sapien
accactcggctcgtatctctggtta

SEQ ID NO: 181576 - DNA, 25 bp, Homo sapien
aggacaccagaccactcggctcgta

SEQ ID NO: 181577 - DNA, 25 bp, Homo sapien
actccacgttctgggagttgccgag

SEQ ID NO: 181578 - DNA, 25 bp, Homo sapien
ctcggctcgtatctctggttacttc

SEQ ID NO: 181579 - DNA, 25 bp, Homo sapien
ttttcacggcttcaagccaagagcg

SEQ ID NO: 181580 - DNA, 25 bp, Homo sapien
cgagggctttttcacggcttcaagc

SEQ ID NO: 181581 - DNA, 25 bp, Homo sapien
gcctaattccgcgagggctttttca

SEQ ID NO: 181582 - DNA, 25 bp, Homo sapien
tggaatccgttttggcggtcgccta

SEQ ID NO: 181583 - DNA, 25 bp, Homo sapien
tcgggtaaactacaggcggcttctc

SEQ ID NO: 181584 - DNA, 25 bp, Homo sapien
gaaaaaagaacacgcttgctctcct

SEQ ID NO: 181585 - DNA, 25 bp, Homo sapien
tggggaaaaaagaacacgcttgctc

SEQ ID NO: 181586 - DNA, 25 bp, Homo sapien
ctggttacttcctgcgctggggaaa

SEQ ID NO: 181587 - DNA, 25 bp, Homo sapien
gagctcgcggcccacttagctaatg

SEQ ID NO: 181588 - DNA, 25 bp, Homo sapien
agctaatgccgggtaatgccgaccc

SEQ ID NO: 181589 - DNA, 25 bp, Homo sapien
cacttagctaatgccgggtaatgcc

SEQ ID NO: 181590 - DNA, 25 bp, Homo sapien
ggcccacttagctaatgccgggtaa

SEQ ID NO: 181591 - DNA, 25 bp, Homo sapien
tcgcggcccacttagctaatgccgg

SEQ ID NO: 181592 - DNA, 25 bp, Homo sapien
cccacttagctaatgccgggtaatg

SEQ ID NO: 181593 - DNA, 25 bp, Homo sapien
gcctctgatccacggggcttggacc

SEQ ID NO: 181594 - DNA, 25 bp, Homo sapien
gatccacggggcttggaccagccac

SEQ ID NO: 181595 - DNA, 25 bp, Homo sapien
caggacgatcttcaggcgcaccatt

SEQ ID NO: 181596 - DNA, 25 bp, Homo sapien
gcaaagtcggcccaggacgatcttc

SEQ ID NO: 181597 - DNA, 25 bp, Homo sapien
tccaagcgacccgaaatgaggaaaa

SEQ ID NO: 181598 - DNA, 25 bp, Homo sapien
atgtagttccaagcgacccgaaatg

SEQ ID NO: 181599 - DNA, 25 bp, Homo sapien
cgacggatgtagttccaagcgaccc

SEQ ID NO: 181600 - DNA, 25 bp, Homo sapien
gatcttcaggcgcaccattctctcg

SEQ ID NO: 181601 - DNA, 25 bp, Homo sapien
tgcaccgacggatgtagttccaagc

SEQ ID NO: 181602 - DNA, 25 bp, Homo sapien
gagagaactcttgcaccgacggatg

SEQ ID NO: 181603 - DNA, 25 bp, Homo sapien
acgcgtgctcctgtagttgccacta

SEQ ID NO: 181604 - DNA, 25 bp, Homo sapien
agttgccactagctcggggcacgcc

SEQ ID NO: 181605 - DNA, 25 bp, Homo sapien
cgtgttatttacaccctgctcgggg

SEQ ID NO: 181606 - DNA, 25 bp, Homo sapien
ggcaagttgcttctgtgacatgaga

SEQ ID NO: 181607 - DNA, 25 bp, Homo sapien
tcgcagcgcattagcggatttcatg

SEQ ID NO: 181608 - DNA, 25 bp, Homo sapien
cccaaacgcttgtgagactggctta

SEQ ID NO: 181609 - DNA, 25 bp, Homo sapien
ccctgtttgcatggccacaagctca

SEQ ID NO: 181610 - DNA, 25 bp, Homo sapien
tgacatgagatcaggttcgcgttcg

SEQ ID NO: 181611 - DNA, 25 bp, Homo sapien
caggtgcaattcctcaggcggccta

SEQ ID NO: 181612 - DNA, 25 bp, Homo sapien
tgcaattcctcaggcggcctacaga

SEQ ID NO: 181613 - DNA, 25 bp, Homo sapien
gggagcgcatccctcgctgcagccc

SEQ ID NO: 181614 - DNA, 25 bp, Homo sapien
cccggcccggaatgtcaggtgcgcc

SEQ ID NO: 181615 - DNA, 25 bp, Homo sapien
ggcgcgatgacaaagcacaaaggga

SEQ ID NO: 181616 - DNA, 25 bp, Homo sapien
actgcgcgcgaccaccatccgctcg

SEQ ID NO: 181617 - DNA, 25 bp, Homo sapien
ccggcgcgcgcttcctgtgaggtca

SEQ ID NO: 181618 - DNA, 25 bp, Homo sapien
acaaagcacaaagggactgcgcgcg

SEQ ID NO: 181619 - DNA, 25 bp, Homo sapien
ttgatcctacaatgccggctgcgga

SEQ ID NO: 181620 - DNA, 25 bp, Homo sapien
tgcggatcaatacccgctcactgta

SEQ ID NO: 181621 - DNA, 25 bp, Homo sapien
ccagtaattgtagggctcgcagctt

SEQ ID NO: 181622 - DNA, 25 bp, Homo sapien
gcagcacgcgggatttagccttttc

SEQ ID NO: 181623 - DNA, 25 bp, Homo sapien
tggggacccaggatgctggaactca

SEQ ID NO: 181624 - DNA, 25 bp, Homo sapien
cttcggcctagaaagacagaggttt

SEQ ID NO: 181625 - DNA, 25 bp, Homo sapien
gaggttttgtctcctttctgccgcc

SEQ ID NO: 181626 - DNA, 25 bp, Homo sapien
taggacctggtgatctaacgcccgc

SEQ ID NO: 181627 - DNA, 25 bp, Homo sapien
cgccgtgctctgaaggcgggaaggc

SEQ ID NO: 181628 - DNA, 25 bp, Homo sapien
tggcgggtctcgcccttagggtcac

SEQ ID NO: 181629 - DNA, 25 bp, Homo sapien
tgcctgccttacctgagccgtgggg

SEQ ID NO: 181630 - DNA, 25 bp, Homo sapien
gggtgcctgccttacctgagccgtg

SEQ ID NO: 181631 - DNA, 25 bp, Homo sapien
ccaggggcagacgaagaccaccagc

SEQ ID NO: 181632 - DNA, 25 bp, Homo sapien
agctgtatccaagcgcgggccgtcc

SEQ ID NO: 181633 - DNA, 25 bp, Homo sapien
cggcccagctgtatccaagcgcggg

SEQ ID NO: 181634 - DNA, 25 bp, Homo sapien
cagacgaagaccaccagcctgggac

SEQ ID NO: 181635 - DNA, 25 bp, Homo sapien
gcaagaactggtgtcgaccgcctta

SEQ ID NO: 181636 - DNA, 25 bp, Homo sapien
gaccgccttaccttgcaatcgttgc

SEQ ID NO: 181637 - DNA, 25 bp, Homo sapien
gtgtggtcaaatgcgctgccgtttg

SEQ ID NO: 181638 - DNA, 25 bp, Homo sapien
tagaccagatgcgaacacgactgtg

SEQ ID NO: 181639 - DNA, 25 bp, Homo sapien
aaggcaagcgtccttcgttctcgcg

SEQ ID NO: 181640 - DNA, 25 bp, Homo sapien
tttcgatacgcatgttgaacccgcg

SEQ ID NO: 181641 - DNA, 25 bp, Homo sapien
ttgcggacgaacatcatgccgtgtc

SEQ ID NO: 181642 - DNA, 25 bp, Homo sapien
tagctgggatcgctcctgaagttcc

SEQ ID NO: 181643 - DNA, 25 bp, Homo sapien
cccattctggaaggcgctacaaaat

SEQ ID NO: 181644 - DNA, 25 bp, Homo sapien
tttgtcccaacactagtttccgctg

SEQ ID NO: 181645 - DNA, 25 bp, Homo sapien
acatcacttcccgtaaaggagagcg

SEQ ID NO: 181646 - DNA, 25 bp, Homo sapien
ctcctggcttaggtcggcctggaca

SEQ ID NO: 181647 - DNA, 25 bp, Homo sapien
ttttccacggcatcagttcgcggtc

SEQ ID NO: 181648 - DNA, 25 bp, Homo sapien
agccatgttctaagggtgttttcca

SEQ ID NO: 181649 - DNA, 25 bp, Homo sapien
atttacaaactgcaccaaggaccgg

SEQ ID NO: 181650 - DNA, 25 bp, Homo sapien
tttgggacacaggagggacatttac

SEQ ID NO: 181651 - DNA, 25 bp, Homo sapien
tgggagctacgaagttgcccgttcc

SEQ ID NO: 181652 - DNA, 25 bp, Homo sapien
gcctcactttgcatggtctccagaa

SEQ ID NO: 181653 - DNA, 25 bp, Homo sapien
actgcagctttcttccgccttagga

SEQ ID NO: 181654 - DNA, 25 bp, Homo sapien
gcgacgactgctctcaaaggccaaa

SEQ ID NO: 181655 - DNA, 25 bp, Homo sapien
gctcccacggcaagataaagctgcg

SEQ ID NO: 181656 - DNA, 25 bp, Homo sapien
caagccaaaggcgagtagcaatccc

SEQ ID NO: 181657 - DNA, 25 bp, Homo sapien
tcaggtacctccgactgttctgcgc

SEQ ID NO: 181658 - DNA, 25 bp, Homo sapien
aacttaatggatggacgagcagcgc

SEQ ID NO: 181659 - DNA, 25 bp, Homo sapien
ctaagcccgcctagtacagtacctg

SEQ ID NO: 181660 - DNA, 25 bp, Homo sapien
ctcctctactgagccgagcgtgtcg

SEQ ID NO: 181661 - DNA, 25 bp, Homo sapien
cagttcggtatagcactcggggttt

SEQ ID NO: 181662 - DNA, 25 bp, Homo sapien
ggccgctgacaccaggcgtcaagtc

SEQ ID NO: 181663 - DNA, 25 bp, Homo sapien
ttgcaacctccagaaagaattcgtg

SEQ ID NO: 181664 - DNA, 25 bp, Homo sapien
ccggcgaccacttccagttgctatg

SEQ ID NO: 181665 - DNA, 25 bp, Homo sapien
tcgggcgccaatgacgcctcttata

SEQ ID NO: 181666 - DNA, 25 bp, Homo sapien
acagtacctgaaggggcagcgccac

SEQ ID NO: 181667 - DNA, 25 bp, Homo sapien
gctgccagctgtaatcgctaacctg

SEQ ID NO: 181668 - DNA, 25 bp, Homo sapien
gatgccgattcttggggttacctta

SEQ ID NO: 181669 - DNA, 25 bp, Homo sapien
cccagaccagagagtgatgccgatt

SEQ ID NO: 181670 - DNA, 25 bp, Homo sapien
cctgaagaggcattccggtagcaac

SEQ ID NO: 181671 - DNA, 25 bp, Homo sapien
gtgtctctgacgcacacgcctttga

SEQ ID NO: 181672 - DNA, 25 bp, Homo sapien
tttccgtgcagaacacgtccgtgtc

SEQ ID NO: 181673 - DNA, 25 bp, Homo sapien
ctcgcggactccatgcgtgactatc

SEQ ID NO: 181674 - DNA, 25 bp, Homo sapien
gctcttgcagaagcttcggaccaca

SEQ ID NO: 181675 - DNA, 25 bp, Homo sapien
acgcgggccgactttgcaaagtttg

SEQ ID NO: 181676 - DNA, 25 bp, Homo sapien
tcggttacctcgaactctcttcagc

SEQ ID NO: 181677 - DNA, 25 bp, Homo sapien
ggaaagggcatctccgaacttcgtc

SEQ ID NO: 181678 - DNA, 25 bp, Homo sapien
ccgggcccagctttcgcaaggaaag

SEQ ID NO: 181679 - DNA, 25 bp, Homo sapien
gctcccgagtcgcagacacaaaagc

SEQ ID NO: 181680 - DNA, 25 bp, Homo sapien
cgcgggaattcggtctctttgatgc

SEQ ID NO: 181681 - DNA, 25 bp, Homo sapien
gactggagccgcctgtaaaacccgc

SEQ ID NO: 181682 - DNA, 25 bp, Homo sapien
tctcttcagcgaaatgggatccttc

SEQ ID NO: 181683 - DNA, 25 bp, Homo sapien
cagaggccgcaagcaactagtgtct

SEQ ID NO: 181684 - DNA, 25 bp, Homo sapien
caactagtgtctgcagctggcggtt

SEQ ID NO: 181685 - DNA, 25 bp, Homo sapien
cccacagcggtaagagaaagcagaa

SEQ ID NO: 181686 - DNA, 25 bp, Homo sapien
cctggcaaaggactgagcagcagca

SEQ ID NO: 181687 - DNA, 25 bp, Homo sapien
ccaccgtcggggacagagccacaaa

SEQ ID NO: 181688 - DNA, 25 bp, Homo sapien
ggcctgggactactttctacatctg

SEQ ID NO: 181689 - DNA, 25 bp, Homo sapien
gtcccgccggacaatgcacctgggg

SEQ ID NO: 181690 - DNA, 25 bp, Homo sapien
aggcgccattcagcgtagccgcgcg

SEQ ID NO: 181691 - DNA, 25 bp, Homo sapien
gtcaagttacagaggcgccggaatc

SEQ ID NO: 181692 - DNA, 25 bp, Homo sapien
taccgctggttgtgctttttcggca

SEQ ID NO: 181693 - DNA, 25 bp, Homo sapien
ttttccgtcctctttgccgggagca

SEQ ID NO: 181694 - DNA, 25 bp, Homo sapien
gttttccagcgatacaagccctttc

SEQ ID NO: 181695 - DNA, 25 bp, Homo sapien
cccgcagtttggatagagccttttg

SEQ ID NO: 181696 - DNA, 25 bp, Homo sapien
gcggctgtcgcctttatttattcta

SEQ ID NO: 181697 - DNA, 25 bp, Homo sapien
ttgggacgagtcaatcaactgctgg

SEQ ID NO: 181698 - DNA, 25 bp, Homo sapien
ctccagactgttcagccggtgtccg

SEQ ID NO: 181699 - DNA, 25 bp, Homo sapien
ggcctccgccagagcaagcaaatca

SEQ ID NO: 181700 - DNA, 25 bp, Homo sapien
gcctgggaatccgtgagcttaatcc

SEQ ID NO: 181701 - DNA, 25 bp, Homo sapien
gcctctgactagacgcctgggaatc

SEQ ID NO: 181702 - DNA, 25 bp, Homo sapien
tcgctgagatccgacccagagttcg

SEQ ID NO: 181703 - DNA, 25 bp, Homo sapien
ctgcagtgttcctcagcaacaagtc

SEQ ID NO: 181704 - DNA, 25 bp, Homo sapien
gttgccatttccgaacgcttccagc

SEQ ID NO: 181705 - DNA, 25 bp, Homo sapien
gtccggctgctgaataacccgaagg

SEQ ID NO: 181706 - DNA, 25 bp, Homo sapien
aactgacaagtaaggcggcggccgc

SEQ ID NO: 181707 - DNA, 25 bp, Homo sapien
ttcgcctgccgcctggggaacatca

SEQ ID NO: 181708 - DNA, 25 bp, Homo sapien
cgagtgagtcgctttcgcctgccgc

SEQ ID NO: 181709 - DNA, 25 bp, Homo sapien
ggcgcagaccgcacaacacctaccg

SEQ ID NO: 181710 - DNA, 25 bp, Homo sapien
ttgctcagggatttggcggccaagc

SEQ ID NO: 181711 - DNA, 25 bp, Homo sapien
aagaacggttgctcagggatttggc

SEQ ID NO: 181712 - DNA, 25 bp, Homo sapien
caaaatccaagaagaacggttgctc

SEQ ID NO: 181713 - DNA, 25 bp, Homo sapien
gatttggcggccaagccttccttcc

SEQ ID NO: 181714 - DNA, 25 bp, Homo sapien
aacatcaccggggagaccagcggct

SEQ ID NO: 181715 - DNA, 25 bp, Homo sapien
aacttcgggtctgaaagtctgtggc

SEQ ID NO: 181716 - DNA, 25 bp, Homo sapien
tccggcgactaggacgcctaacttc

SEQ ID NO: 181717 - DNA, 25 bp, Homo sapien
gtgtctcacggtcagttcaactcca

SEQ ID NO: 181718 - DNA, 25 bp, Homo sapien
gttgcctcggtaaccgcgtcgcagt

SEQ ID NO: 181719 - DNA, 25 bp, Homo sapien
gctcgcagcacagaacctgagagtg

SEQ ID NO: 181720 - DNA, 25 bp, Homo sapien
aactctcgcgggaagatgcgtcgtt

SEQ ID NO: 181721 - DNA, 25 bp, Homo sapien
ggcaaccgggatgtggaaactctcg

SEQ ID NO: 181722 - DNA, 25 bp, Homo sapien
ctcttttacagagaagcagcgttcc

SEQ ID NO: 181723 - DNA, 25 bp, Homo sapien
gcagaacgtggcctcccattggacg

SEQ ID NO: 181724 - DNA, 25 bp, Homo sapien
cgctcgggtgtttacgcggcgtctt

SEQ ID NO: 181725 - DNA, 25 bp, Homo sapien
tcttggcaacggtggagctgcgcgc

SEQ ID NO: 181726 - DNA, 25 bp, Homo sapien
gccctccgctcgaccaaaagtgacc

SEQ ID NO: 181727 - DNA, 25 bp, Homo sapien
ctcgaccaaaagtgacccacgcaga

SEQ ID NO: 181728 - DNA, 25 bp, Homo sapien
cacgcagaacgtggcctcccattgg

SEQ ID NO: 181729 - DNA, 25 bp, Homo sapien
ccattggacgcgataagatacaatc

SEQ ID NO: 181730 - DNA, 25 bp, Homo sapien
ccaaaagtgacccacgcagaacgtg

SEQ ID NO: 181731 - DNA, 25 bp, Homo sapien
ccagtccgttggcttggaaagtgaa

SEQ ID NO: 181732 - DNA, 25 bp, Homo sapien
cggatcggcctgactggagccctga

SEQ ID NO: 181733 - DNA, 25 bp, Homo sapien
gaaaaactacactgcggcgacggcg

SEQ ID NO: 181734 - DNA, 25 bp, Homo sapien
gctcccattgcggagctggcagccg

SEQ ID NO: 181735 - DNA, 25 bp, Homo sapien
tgcctcatgggtaggctccgggtca

SEQ ID NO: 181736 - DNA, 25 bp, Homo sapien
cccaaaatccggactgctcggaatt

SEQ ID NO: 181737 - DNA, 25 bp, Homo sapien
actgctcggaatttgcaggcgagga

SEQ ID NO: 181738 - DNA, 25 bp, Homo sapien
aaggtcatgggatacagccgccgtt

SEQ ID NO: 181739 - DNA, 25 bp, Homo sapien
tccctagggaagagtaattggcttc

SEQ ID NO: 181740 - DNA, 25 bp, Homo sapien
gaagcccttggctaatctcctgcca

SEQ ID NO: 181741 - DNA, 25 bp, Homo sapien
gcggaagtcggctgctaagcctgca

SEQ ID NO: 181742 - DNA, 25 bp, Homo sapien
cgcgcgcggaaggacaaatagttcc

SEQ ID NO: 181743 - DNA, 25 bp, Homo sapien
aggacaaatagttccggcggcagtg

SEQ ID NO: 181744 - DNA, 25 bp, Homo sapien
gtaattggcttccaggctccctcca

SEQ ID NO: 181745 - DNA, 25 bp, Homo sapien
ccctccagccgggatcagcggaagt

SEQ ID NO: 181746 - DNA, 25 bp, Homo sapien
ggctccgctctttgcggccagacgg

SEQ ID NO: 181747 - DNA, 25 bp, Homo sapien
tgaggccgcctcagcgaaaaaaatg

SEQ ID NO: 181748 - DNA, 25 bp, Homo sapien
acgccggccgagagcgagactagtt

SEQ ID NO: 181749 - DNA, 25 bp, Homo sapien
gccaggctcattgttcggcaggtcc

SEQ ID NO: 181750 - DNA, 25 bp, Homo sapien
gcggagccaggctcattgttcggca

SEQ ID NO: 181751 - DNA, 25 bp, Homo sapien
agagacccacaagttctattcgggg

SEQ ID NO: 181752 - DNA, 25 bp, Homo sapien
tccgcctgaagagacccacaagttc

SEQ ID NO: 181753 - DNA, 25 bp, Homo sapien
agcgagactagttgtcggggtttct

SEQ ID NO: 181754 - DNA, 25 bp, Homo sapien
aaaaatgtccgcctgaagagaccca

SEQ ID NO: 181755 - DNA, 25 bp, Homo sapien
tcaatccttttggaggtgtaggtgg

SEQ ID NO: 181756 - DNA, 25 bp, Homo sapien
ctcaatccttttggaggtgtaggtg

SEQ ID NO: 181757 - DNA, 25 bp, Homo sapien
cctcaatccttttggaggtgtaggt

SEQ ID NO: 181758 - DNA, 25 bp, Homo sapien
tccttttggaggtgtaggtgggatc

SEQ ID NO: 181759 - DNA, 25 bp, Homo sapien
attatgtacataattgttacttacc

SEQ ID NO: 181760 - DNA, 25 bp, Homo sapien
ttatgtacataattgttacttacct

SEQ ID NO: 181761 - DNA, 25 bp, Homo sapien
cttttggaggtgtaggtgggatcca

SEQ ID NO: 181762 - DNA, 25 bp, Homo sapien
cccttttatattatgtacataattg

SEQ ID NO: 181763 - DNA, 25 bp, Homo sapien
cctgcctgtgtcgtcgtccctgttt

SEQ ID NO: 181764 - DNA, 25 bp, Homo sapien
gcctgtgtcgtcgtccctgtttgtt

SEQ ID NO: 181765 - DNA, 25 bp, Homo sapien
ctgtgtcgtcgtccctgtttgttct

SEQ ID NO: 181766 - DNA, 25 bp, Homo sapien
gtgtcgtcgtccctgtttgttcttc

SEQ ID NO: 181767 - DNA, 25 bp, Homo sapien
caggatttctccgtgtttcccagac

SEQ ID NO: 181768 - DNA, 25 bp, Homo sapien
ggtgcctgcctgtgtcgtcgtccct

SEQ ID NO: 181769 - DNA, 25 bp, Homo sapien
ctttctgtcacatatgcccttttat

SEQ ID NO: 181770 - DNA, 25 bp, Homo sapien
gtcacatatgcccttttatattatg

SEQ ID NO: 181771 - DNA, 25 bp, Homo sapien
cccagacgggaatgggcttttcaga

SEQ ID NO: 181772 - DNA, 25 bp, Homo sapien
gcgaggggacgatgcattattttta

SEQ ID NO: 181773 - DNA, 25 bp, Homo sapien
gggcccagctgcctttgtgatcccg

SEQ ID NO: 181774 - DNA, 25 bp, Homo sapien
tccatcagaaaagagccggcactgc

SEQ ID NO: 181775 - DNA, 25 bp, Homo sapien
gaaccgaggggcagatgatccatca

SEQ ID NO: 181776 - DNA, 25 bp, Homo sapien
ctatctgggactctgggttctcagc

SEQ ID NO: 181777 - DNA, 25 bp, Homo sapien
ccgtgtttattttcagacgaagcca

SEQ ID NO: 181778 - DNA, 25 bp, Homo sapien
tccggactcccagccttcagagagg

SEQ ID NO: 181779 - DNA, 25 bp, Homo sapien
atccttgtctcagctgtcccacatg

SEQ ID NO: 181780 - DNA, 25 bp, Homo sapien
caagtctgcgatgacagtgctggca

SEQ ID NO: 181781 - DNA, 25 bp, Homo sapien
ccttcatcaggtagacgacggggtt

SEQ ID NO: 181782 - DNA, 25 bp, Homo sapien
tccactaggaggtcgaaggccttca

SEQ ID NO: 181783 - DNA, 25 bp, Homo sapien
taaactctcacgagggtcgccggtc

SEQ ID NO: 181784 - DNA, 25 bp, Homo sapien
gcgtgctgccactctataaactctc

SEQ ID NO: 181785 - DNA, 25 bp, Homo sapien
taatacctgttctttgcgtgctgcc

SEQ ID NO: 181786 - DNA, 25 bp, Homo sapien
tactgccggtggtagtagtaatacc

SEQ ID NO: 181787 - DNA, 25 bp, Homo sapien
gccgccattgacacgcacagataga

SEQ ID NO: 181788 - DNA, 25 bp, Homo sapien
aggtctcctgggaatgcggagtttc

SEQ ID NO: 181789 - DNA, 25 bp, Homo sapien
aagaagtggtcaaattcctgcggcc

SEQ ID NO: 181790 - DNA, 25 bp, Homo sapien
ccaacttgcttccttgggcgataaa

SEQ ID NO: 181791 - DNA, 25 bp, Homo sapien
gcccgccatggcgatggcattattg

SEQ ID NO: 181792 - DNA, 25 bp, Homo sapien
agaactgccgcttgccgccattgac

SEQ ID NO: 181793 - DNA, 25 bp, Homo sapien
ggctgagcaactcctcctagaggtg

SEQ ID NO: 181794 - DNA, 25 bp, Homo sapien
ttcttaaatccagctgcccaacttg

SEQ ID NO: 181795 - DNA, 25 bp, Homo sapien
gccaggaatttggagaggccgaggc

SEQ ID NO: 181796 - DNA, 25 bp, Homo sapien
gcggcccttgcactccggccgggct

SEQ ID NO: 181797 - DNA, 25 bp, Homo sapien
tcagccaggtgcactgtgctcagtc

SEQ ID NO: 181798 - DNA, 25 bp, Homo sapien
agtccgcgcgtccactctcggtgac

SEQ ID NO: 181799 - DNA, 25 bp, Homo sapien
gggctcgaagatgcgacccggactc

SEQ ID NO: 181800 - DNA, 25 bp, Homo sapien
cggcgcagtcgagagcgcgaaatag

SEQ ID NO: 181801 - DNA, 25 bp, Homo sapien
gagcgcgaaatagggagggcttcct

SEQ ID NO: 181802 - DNA, 25 bp, Homo sapien
cgcagaacagatgcgggcgatccct

SEQ ID NO: 181803 - DNA, 25 bp, Homo sapien
gaaaatgcagcctgacgggtcgggt

SEQ ID NO: 181804 - DNA, 25 bp, Homo sapien
cttcgcggtgcagctgaggctgcaa

SEQ ID NO: 181805 - DNA, 25 bp, Homo sapien
aggctgcaagtagccggcgccgtcc

SEQ ID NO: 181806 - DNA, 25 bp, Homo sapien
gcacgcttattctgcccgggaggaa

SEQ ID NO: 181807 - DNA, 25 bp, Homo sapien
cggcgccctcgggagaaaatgcagc

SEQ ID NO: 181808 - DNA, 25 bp, Homo sapien
cgctgcgggatgctgcgctccacgt

SEQ ID NO: 181809 - DNA, 25 bp, Homo sapien
ggatgctgcgctccacgtccacggt

SEQ ID NO: 181810 - DNA, 25 bp, Homo sapien
acgtccacggtcaccctgctctcgg

SEQ ID NO: 181811 - DNA, 25 bp, Homo sapien
tgaccgcatgaatgctcacacaagg

SEQ ID NO: 181812 - DNA, 25 bp, Homo sapien
gcacgtatgcctgcgaggatagctc

SEQ ID NO: 181813 - DNA, 25 bp, Homo sapien
ttcgcttcagtcctacgggcgagtg

SEQ ID NO: 181814 - DNA, 25 bp, Homo sapien
agccggcgtcatccgacgtaacttc

SEQ ID NO: 181815 - DNA, 25 bp, Homo sapien
ccgacgaacagctgatgaccgcatg

SEQ ID NO: 181816 - DNA, 25 bp, Homo sapien
agctcggattgaacggctacctggc

SEQ ID NO: 181817 - DNA, 25 bp, Homo sapien
cgctggcgctgaatactttttgtat

SEQ ID NO: 181818 - DNA, 25 bp, Homo sapien
gccaggagagacttttgcgcaacga

SEQ ID NO: 181819 - DNA, 25 bp, Homo sapien
cgccgggcatctctatcttgctgga

SEQ ID NO: 181820 - DNA, 25 bp, Homo sapien
ccggtgctgcttcggagtagagaaa

SEQ ID NO: 181821 - DNA, 25 bp, Homo sapien
cggcgcagcctccatttacataaag

SEQ ID NO: 181822 - DNA, 25 bp, Homo sapien
gggctggtccatcctacctaggacg

SEQ ID NO: 181823 - DNA, 25 bp, Homo sapien
gggcgcgctcgcctgtatataggca

SEQ ID NO: 181824 - DNA, 25 bp, Homo sapien
gcggccgcttaccttggtgtactta

SEQ ID NO: 181825 - DNA, 25 bp, Homo sapien
agccctcacccgctgaagagatcgg

SEQ ID NO: 181826 - DNA, 25 bp, Homo sapien
ctggggctcttcttattggacgtga

SEQ ID NO: 181827 - DNA, 25 bp, Homo sapien
gagaaacggcgaagcacctccctct

SEQ ID NO: 181828 - DNA, 25 bp, Homo sapien
gcagactggagggatgcagccacca

SEQ ID NO: 181829 - DNA, 25 bp, Homo sapien
cccgacttcgcttctctgggaggcg

SEQ ID NO: 181830 - DNA, 25 bp, Homo sapien
gctcctagctcctccaaaacaggga

SEQ ID NO: 181831 - DNA, 25 bp, Homo sapien
gagaggacttcggaatccgccaccg

SEQ ID NO: 181832 - DNA, 25 bp, Homo sapien
caggagaggagcagaattaacactc

SEQ ID NO: 181833 - DNA, 25 bp, Homo sapien
gcctcctcacgggttaacagcagca

SEQ ID NO: 181834 - DNA, 25 bp, Homo sapien
acagcagcacatcgatccggaggga

SEQ ID NO: 181835 - DNA, 25 bp, Homo sapien
cggcctcagcagcagttgcagcgac

SEQ ID NO: 181836 - DNA, 25 bp, Homo sapien
cagggcgctgttgctgccaatacag

SEQ ID NO: 181837 - DNA, 25 bp, Homo sapien
gccggcacctgccaagcagaactga

SEQ ID NO: 181838 - DNA, 25 bp, Homo sapien
ctcctccgcgggtttggacttgaag

SEQ ID NO: 181839 - DNA, 25 bp, Homo sapien
caggttcttcgcaggaagggctaca

SEQ ID NO: 181840 - DNA, 25 bp, Homo sapien
ccagcgtcagggacaggttcttcgc

SEQ ID NO: 181841 - DNA, 25 bp, Homo sapien
aatacagctgtcatggcgtccaagg

SEQ ID NO: 181842 - DNA, 25 bp, Homo sapien
cctctgagagggcagtacaaggtga

SEQ ID NO: 181843 - DNA, 25 bp, Homo sapien
cagccgtcagccgctaagctgggag

SEQ ID NO: 181844 - DNA, 25 bp, Homo sapien
cagagccggcacttgactccgtggg

SEQ ID NO: 181845 - DNA, 25 bp, Homo sapien
cggcacttgactccgtgggatccca

SEQ ID NO: 181846 - DNA, 25 bp, Homo sapien
cacttgactccgtgggatcccacga

SEQ ID NO: 181847 - DNA, 25 bp, Homo sapien
ggatcccacgagacagacacccttt

SEQ ID NO: 181848 - DNA, 25 bp, Homo sapien
ggagctgacggtgccgctgaagcag

SEQ ID NO: 181849 - DNA, 25 bp, Homo sapien
ggagcagtttctgagcgcgctgcca

SEQ ID NO: 181850 - DNA, 25 bp, Homo sapien
agcagtttctgagcgcgctgccagc

SEQ ID NO: 181851 - DNA, 25 bp, Homo sapien
tctcgtcgcttcgttagccattttc

SEQ ID NO: 181852 - DNA, 25 bp, Homo sapien
acggtcttgactccggtgatgtcta

SEQ ID NO: 181853 - DNA, 25 bp, Homo sapien
gcaacgtcttgagtcttgagcaaca

SEQ ID NO: 181854 - DNA, 25 bp, Homo sapien
caccggtagcggcagccatcttaga

SEQ ID NO: 181855 - DNA, 25 bp, Homo sapien
ggtgatctttttaccttccgcctga

SEQ ID NO: 181856 - DNA, 25 bp, Homo sapien
ggacttcagatcgatgacccgcaga

SEQ ID NO: 181857 - DNA, 25 bp, Homo sapien
gtgatgtctaagttccgccgcttca

SEQ ID NO: 181858 - DNA, 25 bp, Homo sapien
ctgaatgacatagtgcgcgcgttac

SEQ ID NO: 181859 - DNA, 25 bp, Homo sapien
tgttcttgactctaggggcctatta

SEQ ID NO: 181860 - DNA, 25 bp, Homo sapien
aggctactgcgctctcactttccga

SEQ ID NO: 181861 - DNA, 25 bp, Homo sapien
cgtagtccgcggaacagctgaaata

SEQ ID NO: 181862 - DNA, 25 bp, Homo sapien
cgctggctctcgacgcattactctt

SEQ ID NO: 181863 - DNA, 25 bp, Homo sapien
cgctgccgcacgtacagttttggtg

SEQ ID NO: 181864 - DNA, 25 bp, Homo sapien
cgcccgcagcttcagagaaggagtt

SEQ ID NO: 181865 - DNA, 25 bp, Homo sapien
tccgaactgtcgtaaagagccctag

SEQ ID NO: 181866 - DNA, 25 bp, Homo sapien
ggtctccgcagacgatttgtgtttg

SEQ ID NO: 181867 - DNA, 25 bp, Homo sapien
gagtcccaggctgaagaaacagccc

SEQ ID NO: 181868 - DNA, 25 bp, Homo sapien
catggcgagtcccaggctgaagaaa

SEQ ID NO: 181869 - DNA, 25 bp, Homo sapien
gcactgagcttctgtaggccacgcg

SEQ ID NO: 181870 - DNA, 25 bp, Homo sapien
gtggctcccgcactgagcttctgta

SEQ ID NO: 181871 - DNA, 25 bp, Homo sapien
acaggcagccttgacctcacgtggc

SEQ ID NO: 181872 - DNA, 25 bp, Homo sapien
attctgaggttgcacaggcagcctt

SEQ ID NO: 181873 - DNA, 25 bp, Homo sapien
ccctccctcacggaggggattctga

SEQ ID NO: 181874 - DNA, 25 bp, Homo sapien
tggcgggaacgccttcggcagaccc

SEQ ID NO: 181875 - DNA, 25 bp, Homo sapien
tctccttgaactgggacgtctcctc

SEQ ID NO: 181876 - DNA, 25 bp, Homo sapien
cgcacgagagtgaagaggatgatcc

SEQ ID NO: 181877 - DNA, 25 bp, Homo sapien
caggtgcgtctctccattcccgggt

SEQ ID NO: 181878 - DNA, 25 bp, Homo sapien
gattcctccttaagccggctacctg

SEQ ID NO: 181879 - DNA, 25 bp, Homo sapien
tctcccactgggaggatggtttctg

SEQ ID NO: 181880 - DNA, 25 bp, Homo sapien
atgcggcgtctcctccttgtgcctg

SEQ ID NO: 181881 - DNA, 25 bp, Homo sapien
ggcgtctcctccaactggggcgtct

SEQ ID NO: 181882 - DNA, 25 bp, Homo sapien
ttgtgcctgtgcgtctgagagaact

SEQ ID NO: 181883 - DNA, 25 bp, Homo sapien
gctgcttttctcttctccggagctc

SEQ ID NO: 181884 - DNA, 25 bp, Homo sapien
tgtcgcttctctcatctgctccgag

SEQ ID NO: 181885 - DNA, 25 bp, Homo sapien
gaccgctctcagaggcgagtccgtc

SEQ ID NO: 181886 - DNA, 25 bp, Homo sapien
tagtgtcctcccttttcagtccgcg

SEQ ID NO: 181887 - DNA, 25 bp, Homo sapien
acggcgcctcgtacgctagtgtcct

SEQ ID NO: 181888 - DNA, 25 bp, Homo sapien
atcctggaacaaggctacagcgtcg

SEQ ID NO: 181889 - DNA, 25 bp, Homo sapien
agcgacgcggtatttgaatcctgga

SEQ ID NO: 181890 - DNA, 25 bp, Homo sapien
tcggagagcagtcctaacggcgcct

SEQ ID NO: 181891 - DNA, 25 bp, Homo sapien
attgagcgtttcacttccgagaagc

SEQ ID NO: 181892 - DNA, 25 bp, Homo sapien
ggctctcttggcgtctcaacgttcg

SEQ ID NO: 181893 - DNA, 25 bp, Homo sapien
caacgttcggatcagcagctttttt

SEQ ID NO: 181894 - DNA, 25 bp, Homo sapien
gccatgagttggactgtgcctgttg

SEQ ID NO: 181895 - DNA, 25 bp, Homo sapien
ctcggtgggagcgaatttcctatgc

SEQ ID NO: 181896 - DNA, 25 bp, Homo sapien
ccgtgagcaagatggcgactgtgaa

SEQ ID NO: 181897 - DNA, 25 bp, Homo sapien
tgctgaaggtcctgccaacggctct

SEQ ID NO: 181898 - DNA, 25 bp, Homo sapien
aagcacgtgtcggagactctggcaa

SEQ ID NO: 181899 - DNA, 25 bp, Homo sapien
tttcgcgacgcagaaaccgacttgg

SEQ ID NO: 181900 - DNA, 25 bp, Homo sapien
caggaaatcagagctcgcgacgtgc

SEQ ID NO: 181901 - DNA, 25 bp, Homo sapien
gcgcggccaactcaccatggtgact

SEQ ID NO: 181902 - DNA, 25 bp, Homo sapien
aacgcagtcttctgggcgaacttca

SEQ ID NO: 181903 - DNA, 25 bp, Homo sapien
gcactcacaggagccaatgggaacc

SEQ ID NO: 181904 - DNA, 25 bp, Homo sapien
aagagtccactcgtactcgccggtc

SEQ ID NO: 181905 - DNA, 25 bp, Homo sapien
caacccggccacagaaagtttcgcg

SEQ ID NO: 181906 - DNA, 25 bp, Homo sapien
acagctggcagccatagcaacccgg

SEQ ID NO: 181907 - DNA, 25 bp, Homo sapien
cttggggcagcctctcaggagatag

SEQ ID NO: 181908 - DNA, 25 bp, Homo sapien
ggctgcatgctagcgaaccaaccga

SEQ ID NO: 181909 - DNA, 25 bp, Homo sapien
caactggcgttgcattttcgcgggg

SEQ ID NO: 181910 - DNA, 25 bp, Homo sapien
cccatgtgacatgccgcgggcgaga

SEQ ID NO: 181911 - DNA, 25 bp, Homo sapien
cagcagcgacgagcagaggctattt

SEQ ID NO: 181912 - DNA, 25 bp, Homo sapien
gatgcgagctctgtgggaaacagca

SEQ ID NO: 181913 - DNA, 25 bp, Homo sapien
tccaaggcgcttggatgcgagctct

SEQ ID NO: 181914 - DNA, 25 bp, Homo sapien
aactgcatgtgacgcgaagggctga

SEQ ID NO: 181915 - DNA, 25 bp, Homo sapien
gcaacggtcggtaacgggcagatcc

SEQ ID NO: 181916 - DNA, 25 bp, Homo sapien
taacgggcagatcccaggagcgaag

SEQ ID NO: 181917 - DNA, 25 bp, Homo sapien
agaagccgccacgagcccggcagga

SEQ ID NO: 181918 - DNA, 25 bp, Homo sapien
agcccggcaggaggttcctacttct

SEQ ID NO: 181919 - DNA, 25 bp, Homo sapien
ccgcagaaaccgcagaactgagctg

SEQ ID NO: 181920 - DNA, 25 bp, Homo sapien
aactgagctgacgacccggaagtgc

SEQ ID NO: 181921 - DNA, 25 bp, Homo sapien
gccactcaagccttgtcagggaagg

SEQ ID NO: 181922 - DNA, 25 bp, Homo sapien
tccgcggagcggacagaagccgcca

SEQ ID NO: 181923 - DNA, 25 bp, Homo sapien
atgagcggagcttttcggatatctg

SEQ ID NO: 181924 - DNA, 25 bp, Homo sapien
tcctgccgggaattctgcctcagct

SEQ ID NO: 181925 - DNA, 25 bp, Homo sapien
tgcgttcgctcaccgctgtcacctg

SEQ ID NO: 181926 - DNA, 25 bp, Homo sapien
ctgccgggaattctgcctcagctgc

SEQ ID NO: 181927 - DNA, 25 bp, Homo sapien
agcggagcttttcggatatctgcgg

SEQ ID NO: 181928 - DNA, 25 bp, Homo sapien
tgagcggagcttttcggatatctgc

SEQ ID NO: 181929 - DNA, 25 bp, Homo sapien
ggatgagcggagcttttcggatatc

SEQ ID NO: 181930 - DNA, 25 bp, Homo sapien
tctcgctgcgttcgctcaccgctgt

SEQ ID NO: 181931 - DNA, 25 bp, Homo sapien
gcgttactacgcctcaaggcgtttc

SEQ ID NO: 181932 - DNA, 25 bp, Homo sapien
tgacggccaggtcgcaaaaagcagg

SEQ ID NO: 181933 - DNA, 25 bp, Homo sapien
gcagctgacccggacacagtgagaa

SEQ ID NO: 181934 - DNA, 25 bp, Homo sapien
cccggcggaagtgataacatcccga

SEQ ID NO: 181935 - DNA, 25 bp, Homo sapien
aggcgtggcgtcttcttgaaaccca

SEQ ID NO: 181936 - DNA, 25 bp, Homo sapien
cgactccttattggtggcgttacta

SEQ ID NO: 181937 - DNA, 25 bp, Homo sapien
ttcttccctctttgctgttcgcagg

SEQ ID NO: 181938 - DNA, 25 bp, Homo sapien
gacccgtcgcgtcgactccttattg

SEQ ID NO: 181939 - DNA, 25 bp, Homo sapien
cgcagctaaattcctgggcgcattc

SEQ ID NO: 181940 - DNA, 25 bp, Homo sapien
ggagggcgttcagcttcagaaagca

SEQ ID NO: 181941 - DNA, 25 bp, Homo sapien
ggcacttggggaaacatcgtaggtc

SEQ ID NO: 181942 - DNA, 25 bp, Homo sapien
gacccgagagaagtcgctcacactt

SEQ ID NO: 181943 - DNA, 25 bp, Homo sapien
ggaggacgcttggatcccgaaaatg

SEQ ID NO: 181944 - DNA, 25 bp, Homo sapien
gaagcgctgcggtcttcaaaactgc

SEQ ID NO: 181945 - DNA, 25 bp, Homo sapien
cggcgcccagcctgaaataagtggc

SEQ ID NO: 181946 - DNA, 25 bp, Homo sapien
tctccctttcttggcgagtccagtg

SEQ ID NO: 181947 - DNA, 25 bp, Homo sapien
cgcgaggagggccagagtgcaccgc

SEQ ID NO: 181948 - DNA, 25 bp, Homo sapien
gtttgcaccgcgctggggttggcac

SEQ ID NO: 181949 - DNA, 25 bp, Homo sapien
ctaggacccacgaagcggcgcgcta

SEQ ID NO: 181950 - DNA, 25 bp, Homo sapien
cggcgcgctagtcccaggtgagcac

SEQ ID NO: 181951 - DNA, 25 bp, Homo sapien
gctagtcccaggtgagcacgaaatg

SEQ ID NO: 181952 - DNA, 25 bp, Homo sapien
cgcgctgctagagcgcccaaagcag

SEQ ID NO: 181953 - DNA, 25 bp, Homo sapien
ctagtcccaggtgagcacgaaatga

SEQ ID NO: 181954 - DNA, 25 bp, Homo sapien
cgcgctagtcccaggtgagcacgaa

SEQ ID NO: 181955 - DNA, 25 bp, Homo sapien
cggactaaccttgaccctgagcgaa

SEQ ID NO: 181956 - DNA, 25 bp, Homo sapien
cggtcctcgcaagatccgggttaca

SEQ ID NO: 181957 - DNA, 25 bp, Homo sapien
tagcagggatttaggggccaaacca

SEQ ID NO: 181958 - DNA, 25 bp, Homo sapien
tcggccaggagcacatctccctgtt

SEQ ID NO: 181959 - DNA, 25 bp, Homo sapien
gcttggtcgtcttcccgagttactg

SEQ ID NO: 181960 - DNA, 25 bp, Homo sapien
tgagcgaacggccttgaactttgaa

SEQ ID NO: 181961 - DNA, 25 bp, Homo sapien
aaatgctcccatggccagatgtcgc

SEQ ID NO: 181962 - DNA, 25 bp, Homo sapien
ggcctgagtcgagtatccctctcct

SEQ ID NO: 181963 - DNA, 25 bp, Homo sapien
ggcagtttgatttcccgccagactc

SEQ ID NO: 181964 - DNA, 25 bp, Homo sapien
gcgggctcaaactccaaaggcagtc

SEQ ID NO: 181965 - DNA, 25 bp, Homo sapien
gtgggtacggagtcctttcactgcc

SEQ ID NO: 181966 - DNA, 25 bp, Homo sapien
cgcctctctcccttgggcagtttga

SEQ ID NO: 181967 - DNA, 25 bp, Homo sapien
cgccagactcagtcggagtggcctg

SEQ ID NO: 181968 - DNA, 25 bp, Homo sapien
tcggcagttggcaccagagcggaaa

SEQ ID NO: 181969 - DNA, 25 bp, Homo sapien
ctccaaaggcagtcgtgggagagtc

SEQ ID NO: 181970 - DNA, 25 bp, Homo sapien
cctgcaagtcgatgttgtccggtga

SEQ ID NO: 181971 - DNA, 25 bp, Homo sapien
gttgactaccatgggcagctcgctg

SEQ ID NO: 181972 - DNA, 25 bp, Homo sapien
tcgagaacatcatcgcgcgggaata

SEQ ID NO: 181973 - DNA, 25 bp, Homo sapien
gcttcaaggtgcttaagtccgacca

SEQ ID NO: 181974 - DNA, 25 bp, Homo sapien
cggtgtctctgtgcatccatgctac

SEQ ID NO: 181975 - DNA, 25 bp, Homo sapien
gaagtctgttactcggtctggctga

SEQ ID NO: 181976 - DNA, 25 bp, Homo sapien
gcaactttaaggtgagcagctctct

SEQ ID NO: 181977 - DNA, 25 bp, Homo sapien
accggctggccacacgtgtatggct

SEQ ID NO: 181978 - DNA, 25 bp, Homo sapien
cgcaaagttgctggcgaaagagtcc

SEQ ID NO: 181979 - DNA, 25 bp, Homo sapien
cgtacccttcttcccagcgtctcca

SEQ ID NO: 181980 - DNA, 25 bp, Homo sapien
cgcttacctgggccgtgcgccgaga

SEQ ID NO: 181981 - DNA, 25 bp, Homo sapien
cgcgtctggaatgcggggcctccct

SEQ ID NO: 181982 - DNA, 25 bp, Homo sapien
ctcccgctagggcttcttagagaag

SEQ ID NO: 181983 - DNA, 25 bp, Homo sapien
tagggcttcttagagaagcccgacc

SEQ ID NO: 181984 - DNA, 25 bp, Homo sapien
ccagtgccggccgtcccttcagccc

SEQ ID NO: 181985 - DNA, 25 bp, Homo sapien
tgccaggccgtacccttcttcccag

SEQ ID NO: 181986 - DNA, 25 bp, Homo sapien
agagcgtccccaaatgctgagcaga

SEQ ID NO: 181987 - DNA, 25 bp, Homo sapien
ccctgtccctagcacggctgtgctc

SEQ ID NO: 181988 - DNA, 25 bp, Homo sapien
gagattcgccctgtgctgcaaagcc

SEQ ID NO: 181989 - DNA, 25 bp, Homo sapien
agattcgccctgtgctgcaaagcct

SEQ ID NO: 181990 - DNA, 25 bp, Homo sapien
gattcgccctgtgctgcaaagcctg

SEQ ID NO: 181991 - DNA, 25 bp, Homo sapien
attcgccctgtgctgcaaagcctgg

SEQ ID NO: 181992 - DNA, 25 bp, Homo sapien
ttcgccctgtgctgcaaagcctggc

SEQ ID NO: 181993 - DNA, 25 bp, Homo sapien
ctgtgctgcaaagcctggcccgccc

SEQ ID NO: 181994 - DNA, 25 bp, Homo sapien
ctgtccctagcacggctgtgctccg

SEQ ID NO: 181995 - DNA, 25 bp, Homo sapien
tcctcgaccttcgtcggggagagga

SEQ ID NO: 181996 - DNA, 25 bp, Homo sapien
cctgcgtgatgacgtctcagcgaca

SEQ ID NO: 181997 - DNA, 25 bp, Homo sapien
cacaagcgctcgctgtggttctggc

SEQ ID NO: 181998 - DNA, 25 bp, Homo sapien
gcgtgttttcctagaaagtcctcga

SEQ ID NO: 181999 - DNA, 25 bp, Homo sapien
catatttaaaggatgtggccgcgcc

SEQ ID NO: 182000 - DNA, 25 bp, Homo sapien
gcgcgcgcccaaaaaagaccatatt

SEQ ID NO: 182001 - DNA, 25 bp, Homo sapien
cgtctgggctgcaacacagcctttc

SEQ ID NO: 182002 - DNA, 25 bp, Homo sapien
agtggttggagactgcgtgttttcc

SEQ ID NO: 182003 - DNA, 25 bp, Homo sapien
cggtgccaagcggacccaagagact

SEQ ID NO: 182004 - DNA, 25 bp, Homo sapien
cccggggatgacatcgcgacaacgc

SEQ ID NO: 182005 - DNA, 25 bp, Homo sapien
cgggctcacctttcatcgctgcgat

SEQ ID NO: 182006 - DNA, 25 bp, Homo sapien
cgctgcgatcacaaaatacatcatt

SEQ ID NO: 182007 - DNA, 25 bp, Homo sapien
tacatcatttaagccgcggtgcgga

SEQ ID NO: 182008 - DNA, 25 bp, Homo sapien
gccgagagccatcccgagccataag

SEQ ID NO: 182009 - DNA, 25 bp, Homo sapien
aggctccatgtgaccggctgacatc

SEQ ID NO: 182010 - DNA, 25 bp, Homo sapien
ccagccaaagtgtcaagcggggtgc

SEQ ID NO: 182011 - DNA, 25 bp, Homo sapien
gccgcggtcaccctttggaaatcgc

SEQ ID NO: 182012 - DNA, 25 bp, Homo sapien
ctacaacatcgagaggaagggagca

SEQ ID NO: 182013 - DNA, 25 bp, Homo sapien
catcctgatggcttttactgtactc

SEQ ID NO: 182014 - DNA, 25 bp, Homo sapien
ccgccagaagccgagtgcaagagga

SEQ ID NO: 182015 - DNA, 25 bp, Homo sapien
agccagcacatgatcagccatattc

SEQ ID NO: 182016 - DNA, 25 bp, Homo sapien
tccgtgaatgggaaagcgcctggac

SEQ ID NO: 182017 - DNA, 25 bp, Homo sapien
tactgtactcgaattccgtgaatgg

SEQ ID NO: 182018 - DNA, 25 bp, Homo sapien
gtttttcgcgtgtgtcatcctgatg

SEQ ID NO: 182019 - DNA, 25 bp, Homo sapien
cgccgtgctccaaagaaggtgtcca

SEQ ID NO: 182020 - DNA, 25 bp, Homo sapien
ccagatctgagagggaccgaaaaca

SEQ ID NO: 182021 - DNA, 25 bp, Homo sapien
aggagggtggccataaacagatttt

SEQ ID NO: 182022 - DNA, 25 bp, Homo sapien
gcagctttcctccagtgtttgcaga

SEQ ID NO: 182023 - DNA, 25 bp, Homo sapien
ttttttcccaatgtagagatcgctg

SEQ ID NO: 182024 - DNA, 25 bp, Homo sapien
tggaatagctctgtctgcgcaccgg

SEQ ID NO: 182025 - DNA, 25 bp, Homo sapien
gctgccggagctgactccatgtttt

SEQ ID NO: 182026 - DNA, 25 bp, Homo sapien
tttaattgaggcaacgcagctttcc

SEQ ID NO: 182027 - DNA, 25 bp, Homo sapien
gggctgcgaccagcgctgcaaatga

SEQ ID NO: 182028 - DNA, 25 bp, Homo sapien
ccgaccgcgttcttgtcctgctaga

SEQ ID NO: 182029 - DNA, 25 bp, Homo sapien
gtcacctgctgttgaactccggccg

SEQ ID NO: 182030 - DNA, 25 bp, Homo sapien
ggacatctatgtggccgctctgctt

SEQ ID NO: 182031 - DNA, 25 bp, Homo sapien
ggaagttagcttgcgcctgtctcgt

SEQ ID NO: 182032 - DNA, 25 bp, Homo sapien
ggttcagcaagtccgcgaccaccga

SEQ ID NO: 182033 - DNA, 25 bp, Homo sapien
gggacttgttcaggttctccacata

SEQ ID NO: 182034 - DNA, 25 bp, Homo sapien
gttaccgagtacagggacatctatg

SEQ ID NO: 182035 - DNA, 25 bp, Homo sapien
tgcgctccggaattcttgggtcgaa

SEQ ID NO: 182036 - DNA, 25 bp, Homo sapien
aaatgtgctcactccggaccgcatc

SEQ ID NO: 182037 - DNA, 25 bp, Homo sapien
ggcaccgcgcttcggcaatgcagca

SEQ ID NO: 182038 - DNA, 25 bp, Homo sapien
cttcggcaatgcagcactgtggtgg

SEQ ID NO: 182039 - DNA, 25 bp, Homo sapien
tctgcatcccgccacggctcatgcc

SEQ ID NO: 182040 - DNA, 25 bp, Homo sapien
cgtgcgcaaatgtgctcactccgga

SEQ ID NO: 182041 - DNA, 25 bp, Homo sapien
aattcttgggtcgaagaagcaggga

SEQ ID NO: 182042 - DNA, 25 bp, Homo sapien
ggaccgcatccctgagttctgcatc

SEQ ID NO: 182043 - DNA, 25 bp, Homo sapien
cggacactcgggagcttctccgaga

SEQ ID NO: 182044 - DNA, 25 bp, Homo sapien
attcgccggccttccaacagagcgg

SEQ ID NO: 182045 - DNA, 25 bp, Homo sapien
gcagaccagcaatggcgcacccttg

SEQ ID NO: 182046 - DNA, 25 bp, Homo sapien
ggcgcaggtcgtccctgcaactgtc

SEQ ID NO: 182047 - DNA, 25 bp, Homo sapien
cgtggcaaagcaccaggcccgggct

SEQ ID NO: 182048 - DNA, 25 bp, Homo sapien
ttctccgagaaacagcaagctagcg

SEQ ID NO: 182049 - DNA, 25 bp, Homo sapien
tacccggtccggctgaagctgccta

SEQ ID NO: 182050 - DNA, 25 bp, Homo sapien
cgcggtcaggacttcgctgccagct

SEQ ID NO: 182051 - DNA, 25 bp, Homo sapien
aggcacggctagctctaaatgggca

SEQ ID NO: 182052 - DNA, 25 bp, Homo sapien
cctcatagaggccacgcggtgcaac

SEQ ID NO: 182053 - DNA, 25 bp, Homo sapien
tcgcaggcgtagagccagtcagttt

SEQ ID NO: 182054 - DNA, 25 bp, Homo sapien
agtcagtttgtgcttggtcgccaga

SEQ ID NO: 182055 - DNA, 25 bp, Homo sapien
ccactgctgaccctgttttacggta

SEQ ID NO: 182056 - DNA, 25 bp, Homo sapien
aggccttcagcagccagcatcttcg

SEQ ID NO: 182057 - DNA, 25 bp, Homo sapien
acacagggccactgcgtgcaacagc

SEQ ID NO: 182058 - DNA, 25 bp, Homo sapien
ctgaggagagttgagtccactgctg

SEQ ID NO: 182059 - DNA, 25 bp, Homo sapien
tcgaggagccgcatccttggaggct

SEQ ID NO: 182060 - DNA, 25 bp, Homo sapien
gccgaggaacagagtttctcgagga

SEQ ID NO: 182061 - DNA, 25 bp, Homo sapien
atgcgattcggcgtgagcactttgg

SEQ ID NO: 182062 - DNA, 25 bp, Homo sapien
cctgcggccgaggaacagagtttct

SEQ ID NO: 182063 - DNA, 25 bp, Homo sapien
ccggattggagactcgagcgtgcaa

SEQ ID NO: 182064 - DNA, 25 bp, Homo sapien
attcggcgtgagcactttggcgaag

SEQ ID NO: 182065 - DNA, 25 bp, Homo sapien
aggtcgctttcagcggcgcagcgcc

SEQ ID NO: 182066 - DNA, 25 bp, Homo sapien
gccacaggtcgctttcagcggcgca

SEQ ID NO: 182067 - DNA, 25 bp, Homo sapien
ccatctggccctaacggaaggagga

SEQ ID NO: 182068 - DNA, 25 bp, Homo sapien
cttccagtcgcatgtcttccggtga

SEQ ID NO: 182069 - DNA, 25 bp, Homo sapien
gttccctgagattcgcctgagtctg

SEQ ID NO: 182070 - DNA, 25 bp, Homo sapien
cacacacggccgcagggtataaaca

SEQ ID NO: 182071 - DNA, 25 bp, Homo sapien
caacgccctttaacggctgcgtggg

SEQ ID NO: 182072 - DNA, 25 bp, Homo sapien
tcttccggtgactttgaacaatgtc

SEQ ID NO: 182073 - DNA, 25 bp, Homo sapien
gaacaatgtcactctcccgggtcac

SEQ ID NO: 182074 - DNA, 25 bp, Homo sapien
cgcgaggcgggaaatcaacgccctt

SEQ ID NO: 182075 - DNA, 25 bp, Homo sapien
cctcccttttgcttctcgtgagtga

SEQ ID NO: 182076 - DNA, 25 bp, Homo sapien
gatgccaatgcaggaaaaacccgta

SEQ ID NO: 182077 - DNA, 25 bp, Homo sapien
acccgtaaagctcccagatttgatg

SEQ ID NO: 182078 - DNA, 25 bp, Homo sapien
aggagcagcttcattccagcactgg

SEQ ID NO: 182079 - DNA, 25 bp, Homo sapien
ggactccagcgccactttgcaaaca

SEQ ID NO: 182080 - DNA, 25 bp, Homo sapien
gatcccacgactgccctttacttgg

SEQ ID NO: 182081 - DNA, 25 bp, Homo sapien
tcggtcccacgagctgaaattttgc

SEQ ID NO: 182082 - DNA, 25 bp, Homo sapien
tttcgagggcgccatattttcagtg

SEQ ID NO: 182083 - DNA, 25 bp, Homo sapien
gcagatgcaccgaggccacatgccg

SEQ ID NO: 182084 - DNA, 25 bp, Homo sapien
cacagcagcaggtcatggttgggca

SEQ ID NO: 182085 - DNA, 25 bp, Homo sapien
tgagaccttcaacgttggcagcatg

SEQ ID NO: 182086 - DNA, 25 bp, Homo sapien
cacatgccgccactggtgaggcttc

SEQ ID NO: 182087 - DNA, 25 bp, Homo sapien
ctcccgcatgcagggtggacaccag

SEQ ID NO: 182088 - DNA, 25 bp, Homo sapien
cagagcacggctcagtggcgctgcc

SEQ ID NO: 182089 - DNA, 25 bp, Homo sapien
gctgagtgttggaacgctctctatt

SEQ ID NO: 182090 - DNA, 25 bp, Homo sapien
gaacgctctctatttcccggctgaa

SEQ ID NO: 182091 - DNA, 25 bp, Homo sapien
gcagaccagagagccctaagcagcc

SEQ ID NO: 182092 - DNA, 25 bp, Homo sapien
cgatcggtagcgagagtggagagca

SEQ ID NO: 182093 - DNA, 25 bp, Homo sapien
tatttaccatcacaacccaggagga

SEQ ID NO: 182094 - DNA, 25 bp, Homo sapien
tttaccatcacaacccaggaggagc

SEQ ID NO: 182095 - DNA, 25 bp, Homo sapien
ctatttaccatcacaacccaggagg

SEQ ID NO: 182096 - DNA, 25 bp, Homo sapien
ggcctatttaccatcacaacccagg

SEQ ID NO: 182097 - DNA, 25 bp, Homo sapien
gaacggtgtcctgggcggcctcaca

SEQ ID NO: 182098 - DNA, 25 bp, Homo sapien
tccgccggcctatttaccatcacaa

SEQ ID NO: 182099 - DNA, 25 bp, Homo sapien
aggcgctttattctcaggactggga

SEQ ID NO: 182100 - DNA, 25 bp, Homo sapien
atggcccgcgaaatcaagtcctaga

SEQ ID NO: 182101 - DNA, 25 bp, Homo sapien
ggagtcctggagttgttacctaaga

SEQ ID NO: 182102 - DNA, 25 bp, Homo sapien
ggtctgaggacgcttatttcccttc

SEQ ID NO: 182103 - DNA, 25 bp, Homo sapien
gccaggcttagtctaacttagtctg

SEQ ID NO: 182104 - DNA, 25 bp, Homo sapien
agaacgccttggatcgagctgagca

SEQ ID NO: 182105 - DNA, 25 bp, Homo sapien
tccctggcgcgcaggtttagaaaca

SEQ ID NO: 182106 - DNA, 25 bp, Homo sapien
atatccaccgtcaactgggaggccg

SEQ ID NO: 182107 - DNA, 25 bp, Homo sapien
tccgtactttgagaaggggcgccga

SEQ ID NO: 182108 - DNA, 25 bp, Homo sapien
gagaccgtaagggatacacccatca

SEQ ID NO: 182109 - DNA, 25 bp, Homo sapien
ggcctgttctcctgagcctttgttt

SEQ ID NO: 182110 - DNA, 25 bp, Homo sapien
tctcgctgatccaaagtaaacgctc

SEQ ID NO: 182111 - DNA, 25 bp, Homo sapien
gctgctggcttgctttactctgaga

SEQ ID NO: 182112 - DNA, 25 bp, Homo sapien
aggtccttcctcttggagatccgta

SEQ ID NO: 182113 - DNA, 25 bp, Homo sapien
aagccagagccctagtgcagtggcc

SEQ ID NO: 182114 - DNA, 25 bp, Homo sapien
gctttcagtcgtgtctgtgcgtccc

SEQ ID NO: 182115 - DNA, 25 bp, Homo sapien
cccttgctgttagtgagtgaccatg

SEQ ID NO: 182116 - DNA, 25 bp, Homo sapien
cggcttccgagaaagacttcccatt

SEQ ID NO: 182117 - DNA, 25 bp, Homo sapien
cggacaggcacatcccttgctgtta

SEQ ID NO: 182118 - DNA, 25 bp, Homo sapien
gcacaggatcaaggtgcggccactg

SEQ ID NO: 182119 - DNA, 25 bp, Homo sapien
ccggctgtgcagagacgccatgtac

SEQ ID NO: 182120 - DNA, 25 bp, Homo sapien
atgtaccggctcatgtcagcagtga

SEQ ID NO: 182121 - DNA, 25 bp, Homo sapien
tcagcaggcccgtaactgtcggttc

SEQ ID NO: 182122 - DNA, 25 bp, Homo sapien
ttcgccagagccatcgagagcagcc

SEQ ID NO: 182123 - DNA, 25 bp, Homo sapien
cgcgaagacgctgcgcaacctgagc

SEQ ID NO: 182124 - DNA, 25 bp, Homo sapien
ggtgaccgggcaagtcactacatgc

SEQ ID NO: 182125 - DNA, 25 bp, Homo sapien
agccggactcatccgtcccatatga

SEQ ID NO: 182126 - DNA, 25 bp, Homo sapien
cccatatgactctcggtaaagaagc

SEQ ID NO: 182127 - DNA, 25 bp, Homo sapien
cccggagcccgatgtaaacaactca

SEQ ID NO: 182128 - DNA, 25 bp, Homo sapien
caggcatgttgatcctcttgcaagc

SEQ ID NO: 182129 - DNA, 25 bp, Homo sapien
tagcaagctgcaagcgatctgcgct

SEQ ID NO: 182130 - DNA, 25 bp, Homo sapien
gcgctcggcatcaacttccgggata

SEQ ID NO: 182131 - DNA, 25 bp, Homo sapien
ggatcgcggcttcccattccagacg

SEQ ID NO: 182132 - DNA, 25 bp, Homo sapien
agctactcgccggatgtacgtcaca

SEQ ID NO: 182133 - DNA, 25 bp, Homo sapien
tcctccggcaaaacagcggctggct

SEQ ID NO: 182134 - DNA, 25 bp, Homo sapien
gcagatctggccaagttgtcccgtc

SEQ ID NO: 182135 - DNA, 25 bp, Homo sapien
agaaactgttatccggcccagcagc

SEQ ID NO: 182136 - DNA, 25 bp, Homo sapien
tggagccatttcgtaaaccggagcg

SEQ ID NO: 182137 - DNA, 25 bp, Homo sapien
agcgctcacactcgctaactgcgga

SEQ ID NO: 182138 - DNA, 25 bp, Homo sapien
ggctgtgaggctcttccgagacaga

SEQ ID NO: 182139 - DNA, 25 bp, Homo sapien
agcaggtcttttatccgctggagcc

SEQ ID NO: 182140 - DNA, 25 bp, Homo sapien
ttcccagctcgggtggaaacgcctc

SEQ ID NO: 182141 - DNA, 25 bp, Homo sapien
ctacaagtcccatgaagtcccgggg

SEQ ID NO: 182142 - DNA, 25 bp, Homo sapien
atgacgaagccctcgccgattggcc

SEQ ID NO: 182143 - DNA, 25 bp, Homo sapien
gatggcgaagacgtacgattatctc

SEQ ID NO: 182144 - DNA, 25 bp, Homo sapien
tcttcaagctcctgctgatcggcga

SEQ ID NO: 182145 - DNA, 25 bp, Homo sapien
ggtaggcaagacctgcctcctgttc

SEQ ID NO: 182146 - DNA, 25 bp, Homo sapien
cgcggctcgaccagcagagtacgaa

SEQ ID NO: 182147 - DNA, 25 bp, Homo sapien
gcttatggcgtctgctaggagtctc

SEQ ID NO: 182148 - DNA, 25 bp, Homo sapien
tgtgccgcagaaaacctttaacctg

SEQ ID NO: 182149 - DNA, 25 bp, Homo sapien
tcgctcaagtatacgtggcggggcc

SEQ ID NO: 182150 - DNA, 25 bp, Homo sapien
agctactccgatctcacagggatgg

SEQ ID NO: 182151 - DNA, 25 bp, Homo sapien
ggtggcaggaaatgcgccattgttc

SEQ ID NO: 182152 - DNA, 25 bp, Homo sapien
attgttcggcgcagcgaaacagccc

SEQ ID NO: 182153 - DNA, 25 bp, Homo sapien
aatgtcgctggtctcccgtcaccgt

SEQ ID NO: 182154 - DNA, 25 bp, Homo sapien
aggagtctcctatccggcgtttgtg

SEQ ID NO: 182155 - DNA, 25 bp, Homo sapien
cgtgttcttcggctgcgccttcatt

SEQ ID NO: 182156 - DNA, 25 bp, Homo sapien
cggctcgaccttgttgcgtttcaga

SEQ ID NO: 182157 - DNA, 25 bp, Homo sapien
atcatcttcctcatcgccgggtgag

SEQ ID NO: 182158 - DNA, 25 bp, Homo sapien
ccgagccgttgcgtatcatcttcct

SEQ ID NO: 182159 - DNA, 25 bp, Homo sapien
tgcgccttcattgccttcgggcctg

SEQ ID NO: 182160 - DNA, 25 bp, Homo sapien
cactggaacccgatcggagtgtatc

SEQ ID NO: 182161 - DNA, 25 bp, Homo sapien
gggctagggagcttcccttctctta

SEQ ID NO: 182162 - DNA, 25 bp, Homo sapien
ttatgtcttcaccatcgccaccgag

SEQ ID NO: 182163 - DNA, 25 bp, Homo sapien
gctccagatacccagcaggaaggcc

SEQ ID NO: 182164 - DNA, 25 bp, Homo sapien
gcattgtcgggccacatacctttcc

SEQ ID NO: 182165 - DNA, 25 bp, Homo sapien
tcacatcctgcgacagctgaatccg

SEQ ID NO: 182166 - DNA, 25 bp, Homo sapien
ccagggtcctgcagttcaccaggtg

SEQ ID NO: 182167 - DNA, 25 bp, Homo sapien
cagctgaatccgagcccgaggacca

SEQ ID NO: 182168 - DNA, 25 bp, Homo sapien
cgcactggcaggtggtccctgtgcc

SEQ ID NO: 182169 - DNA, 25 bp, Homo sapien
agcgaggctgcaactgctccagata

SEQ ID NO: 182170 - DNA, 25 bp, Homo sapien
cggggacaccctcggtggcattgtc

SEQ ID NO: 182171 - DNA, 25 bp, Homo sapien
aacacttgatgtcatcgtgcgggga

SEQ ID NO: 182172 - DNA, 25 bp, Homo sapien
acgccaaacacttgatgtcatcgtg

SEQ ID NO: 182173 - DNA, 25 bp, Homo sapien
tggagcaactcaacgccaaacactt

SEQ ID NO: 182174 - DNA, 25 bp, Homo sapien
gcttttatggagcaactcaacgcca

SEQ ID NO: 182175 - DNA, 25 bp, Homo sapien
ggcagcttttatggagcaactcaac

SEQ ID NO: 182176 - DNA, 25 bp, Homo sapien
gtggcgagtacgtccgcccttcgct

SEQ ID NO: 182177 - DNA, 25 bp, Homo sapien
tgccgtggcgagtacgtccgccctt

SEQ ID NO: 182178 - DNA, 25 bp, Homo sapien
ctcgctctccagctgcacaccggga

SEQ ID NO: 182179 - DNA, 25 bp, Homo sapien
cagcgtctgcattgctccggactca

SEQ ID NO: 182180 - DNA, 25 bp, Homo sapien
ctttctttgacgcaagggctcgaga

SEQ ID NO: 182181 - DNA, 25 bp, Homo sapien
gtccggaagcccgtgctttctttga

SEQ ID NO: 182182 - DNA, 25 bp, Homo sapien
ccggatctcggagttacacgttcta

SEQ ID NO: 182183 - DNA, 25 bp, Homo sapien
acttcggaacacagccggactctgc

SEQ ID NO: 182184 - DNA, 25 bp, Homo sapien
cgagtagtccgcaccacataggttc

SEQ ID NO: 182185 - DNA, 25 bp, Homo sapien
ttaccacgaagccaccgagtagtcc

SEQ ID NO: 182186 - DNA, 25 bp, Homo sapien
tcttctttacactttgcggagcggc

SEQ ID NO: 182187 - DNA, 25 bp, Homo sapien
ggccacgttaccgacgactgcctgg

SEQ ID NO: 182188 - DNA, 25 bp, Homo sapien
ccaccgcatattctgagcctcattt

SEQ ID NO: 182189 - DNA, 25 bp, Homo sapien
ctccgatcgccgttggaccgaaatc

SEQ ID NO: 182190 - DNA, 25 bp, Homo sapien
tatttggaaaacactcggctggttc

SEQ ID NO: 182191 - DNA, 25 bp, Homo sapien
cgagccgctcctccttgcggttttg

SEQ ID NO: 182192 - DNA, 25 bp, Homo sapien
tgcacgtggacttctgccgcaacgt

SEQ ID NO: 182193 - DNA, 25 bp, Homo sapien
gaggacctgaccactcggagttcgc

SEQ ID NO: 182194 - DNA, 25 bp, Homo sapien
cacagtggggataagaaagcctacc

SEQ ID NO: 182195 - DNA, 25 bp, Homo sapien
gcgtcaggcgagtctcacgagattt

SEQ ID NO: 182196 - DNA, 25 bp, Homo sapien
tcggcttctacgctgctccgaggcg

SEQ ID NO: 182197 - DNA, 25 bp, Homo sapien
cgcgtcctttatttttgctgcagca

SEQ ID NO: 182198 - DNA, 25 bp, Homo sapien
cagcagcagcgacttgtcaaaggga

SEQ ID NO: 182199 - DNA, 25 bp, Homo sapien
ctcacgagatttgggcggaactctc

SEQ ID NO: 182200 - DNA, 25 bp, Homo sapien
ggggacctgactccacagatgaagc

SEQ ID NO: 182201 - DNA, 25 bp, Homo sapien
atgcgttaccgtacgtggctctgga

SEQ ID NO: 182202 - DNA, 25 bp, Homo sapien
ggcacagacgttgtaagccgctgga

SEQ ID NO: 182203 - DNA, 25 bp, Homo sapien
tcccaggtcaaagtgccaggctccg

SEQ ID NO: 182204 - DNA, 25 bp, Homo sapien
cgagcccgcagacgggtgctactca

SEQ ID NO: 182205 - DNA, 25 bp, Homo sapien
ggtaggggacacctcagggctccca

SEQ ID NO: 182206 - DNA, 25 bp, Homo sapien
gggcctaactcgatggacgtctgtc

SEQ ID NO: 182207 - DNA, 25 bp, Homo sapien
agggctcccagactcccgggagagc

SEQ ID NO: 182208 - DNA, 25 bp, Homo sapien
agtcggtagcaagaccctctgcgcg

SEQ ID NO: 182209 - DNA, 25 bp, Homo sapien
tctaccctgtctcccaggtcaaagt

SEQ ID NO: 182210 - DNA, 25 bp, Homo sapien
tcgatggacgtctgtctcccatctc

SEQ ID NO: 182211 - DNA, 25 bp, Homo sapien
ctctcagcagcctcgggattgatca

SEQ ID NO: 182212 - DNA, 25 bp, Homo sapien
ggggcctcaaggactacaagttcca

SEQ ID NO: 182213 - DNA, 25 bp, Homo sapien
acttcctggtcttcaaatgggccga

SEQ ID NO: 182214 - DNA, 25 bp, Homo sapien
ttccagcgtgctttgctcgatttcg

SEQ ID NO: 182215 - DNA, 25 bp, Homo sapien
atcttcgcggctcgtcagcacattg

SEQ ID NO: 182216 - DNA, 25 bp, Homo sapien
cgtgagctattttcttcggaaggca

SEQ ID NO: 182217 - DNA, 25 bp, Homo sapien
cagacggagtagctcgaaggaccta

SEQ ID NO: 182218 - DNA, 25 bp, Homo sapien
tgggccgagacaagcctaaaggttc

SEQ ID NO: 182219 - DNA, 25 bp, Homo sapien
cgataatctgagctacggcggcgga

SEQ ID NO: 182220 - DNA, 25 bp, Homo sapien
ctcactgaggaagactcggtactcc

SEQ ID NO: 182221 - DNA, 25 bp, Homo sapien
gggcaaatgcgcaggctctaagctt

SEQ ID NO: 182222 - DNA, 25 bp, Homo sapien
tcggtgatttccttttcccaacaga

SEQ ID NO: 182223 - DNA, 25 bp, Homo sapien
caagtatgcaatgtgaggccggcca

SEQ ID NO: 182224 - DNA, 25 bp, Homo sapien
taacgcggctctgctagtgttccca

SEQ ID NO: 182225 - DNA, 25 bp, Homo sapien
cgtgacaaagggaccatctccgttc

SEQ ID NO: 182226 - DNA, 25 bp, Homo sapien
tgaagccgctcatagtgccggagtc

SEQ ID NO: 182227 - DNA, 25 bp, Homo sapien
ttgctcacggcgctatctctcgata

SEQ ID NO: 182228 - DNA, 25 bp, Homo sapien
tcgcaccgttggatcgctttgctca

SEQ ID NO: 182229 - DNA, 25 bp, Homo sapien
aaccaggcctcggatttgctgcgca

SEQ ID NO: 182230 - DNA, 25 bp, Homo sapien
taatatctcagcatcgcgaaccagg

SEQ ID NO: 182231 - DNA, 25 bp, Homo sapien
aggacattttcaccggcgccgcggt

SEQ ID NO: 182232 - DNA, 25 bp, Homo sapien
cccaggcgggaagagtaaagaatga

SEQ ID NO: 182233 - DNA, 25 bp, Homo sapien
taaagttgttgttgcggcttccgcc

SEQ ID NO: 182234 - DNA, 25 bp, Homo sapien
accctggatgtgctcgaagcggtag

SEQ ID NO: 182235 - DNA, 25 bp, Homo sapien
ttgacaaacggttgactccactgcc

SEQ ID NO: 182236 - DNA, 25 bp, Homo sapien
acacacggtgccaaggcgctacagc

SEQ ID NO: 182237 - DNA, 25 bp, Homo sapien
aggccgctttgtgcctttgagagcg

SEQ ID NO: 182238 - DNA, 25 bp, Homo sapien
accatggttcgagctcttgagggac

SEQ ID NO: 182239 - DNA, 25 bp, Homo sapien
agcccggagaaaagccacatggtga

SEQ ID NO: 182240 - DNA, 25 bp, Homo sapien
ctggaagttcacatcccgtcggtgg

SEQ ID NO: 182241 - DNA, 25 bp, Homo sapien
tcctcagtccgctccgggagagtta

SEQ ID NO: 182242 - DNA, 25 bp, Homo sapien
tccaggtcccgcctaatcttctagg

SEQ ID NO: 182243 - DNA, 25 bp, Homo sapien
gcttcaagcggatctcttccggtta

SEQ ID NO: 182244 - DNA, 25 bp, Homo sapien
attctgagcggtgcctcacagccta

SEQ ID NO: 182245 - DNA, 25 bp, Homo sapien
cagcaaatgcgccactgtccggtgc

SEQ ID NO: 182246 - DNA, 25 bp, Homo sapien
cagatcctatttgcgcctgcgcggg

SEQ ID NO: 182247 - DNA, 25 bp, Homo sapien
taggtcctccaacctcacagggcgg

SEQ ID NO: 182248 - DNA, 25 bp, Homo sapien
ctatttccgtttccgcgcttcaagc

SEQ ID NO: 182249 - DNA, 25 bp, Homo sapien
gggagtgtcttatcagccgcttata

SEQ ID NO: 182250 - DNA, 25 bp, Homo sapien
gactggaggattcggtgttgccctt

SEQ ID NO: 182251 - DNA, 25 bp, Homo sapien
cagacgccacgaggccacagacaga

SEQ ID NO: 182252 - DNA, 25 bp, Homo sapien
ttgccacgttattgctccctcattg

SEQ ID NO: 182253 - DNA, 25 bp, Homo sapien
agcaccttcatgttgcgttcggaga

SEQ ID NO: 182254 - DNA, 25 bp, Homo sapien
cggcggcaaggagcaccttcatgtt

SEQ ID NO: 182255 - DNA, 25 bp, Homo sapien
tcttcttctcatcggccgcagaagg

SEQ ID NO: 182256 - DNA, 25 bp, Homo sapien
ggcaccgtaaatgccgcggactcca

SEQ ID NO: 182257 - DNA, 25 bp, Homo sapien
gcccgggctccgagaagaccacaag

SEQ ID NO: 182258 - DNA, 25 bp, Homo sapien
ccaccggaccttgacggtgactttg

SEQ ID NO: 182259 - DNA, 25 bp, Homo sapien
ctgacaccatcacttccgggttatc

SEQ ID NO: 182260 - DNA, 25 bp, Homo sapien
caaactttgggcaggcagcgttaaa

SEQ ID NO: 182261 - DNA, 25 bp, Homo sapien
cacccgcagcggtggtttctctctt

SEQ ID NO: 182262 - DNA, 25 bp, Homo sapien
gaggcgccaagtgcttctctaccca

SEQ ID NO: 182263 - DNA, 25 bp, Homo sapien
ccagcagtgctgcaaggcgcaaatg

SEQ ID NO: 182264 - DNA, 25 bp, Homo sapien
ccgggcagatacctggtccagcagt

SEQ ID NO: 182265 - DNA, 25 bp, Homo sapien
caccggctagagtcagtttctcgga

SEQ ID NO: 182266 - DNA, 25 bp, Homo sapien
ctggcgggcctaataggacaaactt

SEQ ID NO: 182267 - DNA, 25 bp, Homo sapien
ttggtgttgcgaagggaactagtcc

SEQ ID NO: 182268 - DNA, 25 bp, Homo sapien
cactgcctgagcgaaccgggaagcg

SEQ ID NO: 182269 - DNA, 25 bp, Homo sapien
tcattcagtgagaacagttcgggtc

SEQ ID NO: 182270 - DNA, 25 bp, Homo sapien
agctctgggatgtgcactgcctgag

SEQ ID NO: 182271 - DNA, 25 bp, Homo sapien
tgcggaagactttcggcctggatgt

SEQ ID NO: 182272 - DNA, 25 bp, Homo sapien
gacgtggggcttttgcagctcagct

SEQ ID NO: 182273 - DNA, 25 bp, Homo sapien
tgcacccagcagttgcggaagactt

SEQ ID NO: 182274 - DNA, 25 bp, Homo sapien
tggatgtcagcgaggagatcattca

SEQ ID NO: 182275 - DNA, 25 bp, Homo sapien
tcttccgggtgactctggttgtccc

SEQ ID NO: 182276 - DNA, 25 bp, Homo sapien
gcgcgcattccgagacccaggattt

SEQ ID NO: 182277 - DNA, 25 bp, Homo sapien
cgagacccaggatttcgctccttca

SEQ ID NO: 182278 - DNA, 25 bp, Homo sapien
cgctccttcatccaggttccgggtt

SEQ ID NO: 182279 - DNA, 25 bp, Homo sapien
tccagactccacacaagcgcggaat

SEQ ID NO: 182280 - DNA, 25 bp, Homo sapien
acacaagcgcggaatccggatccga

SEQ ID NO: 182281 - DNA, 25 bp, Homo sapien
aatccggatccgagggcctggcagt

SEQ ID NO: 182282 - DNA, 25 bp, Homo sapien
cctggcagtccagtgtccgcgtctt

SEQ ID NO: 182283 - DNA, 25 bp, Homo sapien
ctccttttgcctcagcgagcgcctg

SEQ ID NO: 182284 - DNA, 25 bp, Homo sapien
cgttacctgtcctgggtgtttatca

SEQ ID NO: 182285 - DNA, 25 bp, Homo sapien
gggtgtttatcatcctcggcggctc

SEQ ID NO: 182286 - DNA, 25 bp, Homo sapien
cggcccagaagatgcgttgtgtttc

SEQ ID NO: 182287 - DNA, 25 bp, Homo sapien
gcaggcgcaccacggaccgatcgtg

SEQ ID NO: 182288 - DNA, 25 bp, Homo sapien
cccgagtgcctcatctgcatagccc

SEQ ID NO: 182289 - DNA, 25 bp, Homo sapien
gagcgcctgcctccaactgaccctc

SEQ ID NO: 182290 - DNA, 25 bp, Homo sapien
atctctgcgggctaagtccctgtca

SEQ ID NO: 182291 - DNA, 25 bp, Homo sapien
gagacaatgcctgtccggcggggca

SEQ ID NO: 182292 - DNA, 25 bp, Homo sapien
ccttttcactgcgaccggcgagtgc

SEQ ID NO: 182293 - DNA, 25 bp, Homo sapien
ccagggtcacatcaagtttggcggg

SEQ ID NO: 182294 - DNA, 25 bp, Homo sapien
tccggcttcaggttgctcatggtgc

SEQ ID NO: 182295 - DNA, 25 bp, Homo sapien
cgtgctcgccgtccggcttcaggtt

SEQ ID NO: 182296 - DNA, 25 bp, Homo sapien
tggcgtgcgcttcacccggcaagtc

SEQ ID NO: 182297 - DNA, 25 bp, Homo sapien
ttaaactttgatgaactcgcccggc

SEQ ID NO: 182298 - DNA, 25 bp, Homo sapien
ctttgatgaactcgcccggcgaact

SEQ ID NO: 182299 - DNA, 25 bp, Homo sapien
ggcgctcgttgcgacccaggctcag

SEQ ID NO: 182300 - DNA, 25 bp, Homo sapien
gcagcatcaactcgcggcgctcgtt

SEQ ID NO: 182301 - DNA, 25 bp, Homo sapien
ctggcgcttgcagccgcagcatcaa

SEQ ID NO: 182302 - DNA, 25 bp, Homo sapien
ccggcctcggcgaaacgcgtgaaga

SEQ ID NO: 182303 - DNA, 25 bp, Homo sapien
ccgcagccagcttgaggcgcaatgt

SEQ ID NO: 182304 - DNA, 25 bp, Homo sapien
tcaccagcgtagtgtccggaacccg

SEQ ID NO: 182305 - DNA, 25 bp, Homo sapien
cgcttcaccagcgtagtgtccggaa

SEQ ID NO: 182306 - DNA, 25 bp, Homo sapien
gcctctgctggtctgcgaagacacc

SEQ ID NO: 182307 - DNA, 25 bp, Homo sapien
agcgtgaagaacagcgccaccatga

SEQ ID NO: 182308 - DNA, 25 bp, Homo sapien
atgaccagcatgtgcaccacgcgcg

SEQ ID NO: 182309 - DNA, 25 bp, Homo sapien
agcacagtggtgtagaccctgcgca

SEQ ID NO: 182310 - DNA, 25 bp, Homo sapien
cctcccagcaggagtagagcgggta

SEQ ID NO: 182311 - DNA, 25 bp, Homo sapien
gcttctcgcggaaagggtgcacgat

SEQ ID NO: 182312 - DNA, 25 bp, Homo sapien
tcatcatcgcatctagggcggcgtc

SEQ ID NO: 182313 - DNA, 25 bp, Homo sapien
cggcggaagttctcgttgaagtagc

SEQ ID NO: 182314 - DNA, 25 bp, Homo sapien
tgcccgtagtcgatgagcagcagca

SEQ ID NO: 182315 - DNA, 25 bp, Homo sapien
ccagagggagccctacctcctgggg

SEQ ID NO: 182316 - DNA, 25 bp, Homo sapien
gctccacgcgccgtgggcctaccag

SEQ ID NO: 182317 - DNA, 25 bp, Homo sapien
gggcctaccagctgcatcctgattg

SEQ ID NO: 182318 - DNA, 25 bp, Homo sapien
cagctgcatcctgattggcccgcgg

SEQ ID NO: 182319 - DNA, 25 bp, Homo sapien
ccgccgtgaggtcagtctggattga

SEQ ID NO: 182320 - DNA, 25 bp, Homo sapien
cctgctgccgccgtgaggtcagtct

SEQ ID NO: 182321 - DNA, 25 bp, Homo sapien
cgcccgacactctgctccctgctgc

SEQ ID NO: 182322 - DNA, 25 bp, Homo sapien
ggcggttctgggcatccgcccgaca

SEQ ID NO: 182323 - DNA, 25 bp, Homo sapien
acagaacgcggagagtcgccgcctg

SEQ ID NO: 182324 - DNA, 25 bp, Homo sapien
ttccagggagaagaccaggccaccg

SEQ ID NO: 182325 - DNA, 25 bp, Homo sapien
tcacctcaggaagagcctgggcaaa

SEQ ID NO: 182326 - DNA, 25 bp, Homo sapien
acctcggcggactcgccatggagga

SEQ ID NO: 182327 - DNA, 25 bp, Homo sapien
cagcccactggttcgggagacctca

SEQ ID NO: 182328 - DNA, 25 bp, Homo sapien
ctcgcctcagtctctgggccggaag

SEQ ID NO: 182329 - DNA, 25 bp, Homo sapien
ccgcccagaggttccagggagaaga

SEQ ID NO: 182330 - DNA, 25 bp, Homo sapien
agcaggagaacactgcgcttggaga

SEQ ID NO: 182331 - DNA, 25 bp, Homo sapien
tcctctgcgtcaggttacgtgcttg

SEQ ID NO: 182332 - DNA, 25 bp, Homo sapien
agggaaactgaacgcccatacgctc

SEQ ID NO: 182333 - DNA, 25 bp, Homo sapien
acgctaagcgcgagaagccaggctc

SEQ ID NO: 182334 - DNA, 25 bp, Homo sapien
agttccaggaggacgctaagcgcga

SEQ ID NO: 182335 - DNA, 25 bp, Homo sapien
aaccgaaactgcagcgaggcccaga

SEQ ID NO: 182336 - DNA, 25 bp, Homo sapien
ccgcgtgtcgacaaccgaaactgca

SEQ ID NO: 182337 - DNA, 25 bp, Homo sapien
ttacggtatttacagctgctcttcg

SEQ ID NO: 182338 - DNA, 25 bp, Homo sapien
ctccatcactgtcgtgccggtcgtg

SEQ ID NO: 182339 - DNA, 25 bp, Homo sapien
cttcgcaagcgttaacctgcgtttt

SEQ ID NO: 182340 - DNA, 25 bp, Homo sapien
ggtctcactgctacccacatggcta

SEQ ID NO: 182341 - DNA, 25 bp, Homo sapien
gcccgcaagaaatgtgccaccgttc

SEQ ID NO: 182342 - DNA, 25 bp, Homo sapien
gccaccgttctgagcggccgacaaa

SEQ ID NO: 182343 - DNA, 25 bp, Homo sapien
gacaaacccgcagtgcgctacggga

SEQ ID NO: 182344 - DNA, 25 bp, Homo sapien
gctacgggaaggtcacctgacagtt

SEQ ID NO: 182345 - DNA, 25 bp, Homo sapien
cacctgacagttggggagaacggca

SEQ ID NO: 182346 - DNA, 25 bp, Homo sapien
ttcgctcaagtttccgtggcgggtc

SEQ ID NO: 182347 - DNA, 25 bp, Homo sapien
aatggttaccggtccgcgcactggg

SEQ ID NO: 182348 - DNA, 25 bp, Homo sapien
gaccttgccagtgcgtctgggactc

SEQ ID NO: 182349 - DNA, 25 bp, Homo sapien
atgagcctgccagatgccttgtgcg

SEQ ID NO: 182350 - DNA, 25 bp, Homo sapien
gccttgtgcgcatctatctccaggg

SEQ ID NO: 182351 - DNA, 25 bp, Homo sapien
gtcagggacacctgcggaactcggc

SEQ ID NO: 182352 - DNA, 25 bp, Homo sapien
cccgcatccgtttggggagtgccag

SEQ ID NO: 182353 - DNA, 25 bp, Homo sapien
accacacccgccaggtgagcgggga

SEQ ID NO: 182354 - DNA, 25 bp, Homo sapien
gctccgagcggaatggttaccggtc

SEQ ID NO: 182355 - DNA, 25 bp, Homo sapien
tcgctccagtacgagcgcgggccgt

SEQ ID NO: 182356 - DNA, 25 bp, Homo sapien
tcttcgctccagtacgagcgcgggc

SEQ ID NO: 182357 - DNA, 25 bp, Homo sapien
ctccgtgggatgcttggctgcggct

SEQ ID NO: 182358 - DNA, 25 bp, Homo sapien
cgtggccgagcgagcttgggccgcc

SEQ ID NO: 182359 - DNA, 25 bp, Homo sapien
actcgggacccacgggcacagcagg

SEQ ID NO: 182360 - DNA, 25 bp, Homo sapien
gagcactcgggacccacgggcacag

SEQ ID NO: 182361 - DNA, 25 bp, Homo sapien
ggagcactcgggacccacgggcaca

SEQ ID NO: 182362 - DNA, 25 bp, Homo sapien
ccgcataccgcacacccagccgctt

SEQ ID NO: 182363 - DNA, 25 bp, Homo sapien
gaagacgccgagatctgggcccaca

SEQ ID NO: 182364 - DNA, 25 bp, Homo sapien
agaccgcaggtactaggcgcccaaa

SEQ ID NO: 182365 - DNA, 25 bp, Homo sapien
aatggcgcaccttctgggagccaga

SEQ ID NO: 182366 - DNA, 25 bp, Homo sapien
ccgaagaagagcacccgccagggag

SEQ ID NO: 182367 - DNA, 25 bp, Homo sapien
tgctttccgcaaccagaagtccaaa

SEQ ID NO: 182368 - DNA, 25 bp, Homo sapien
cgaactggtccgtgccgaagaagag

SEQ ID NO: 182369 - DNA, 25 bp, Homo sapien
aggcttctcgcggactctggagtcc

SEQ ID NO: 182370 - DNA, 25 bp, Homo sapien
cgcccaaaggctgaccggcgggaat

SEQ ID NO: 182371 - DNA, 25 bp, Homo sapien
ccaggatggccaggttgacctcgag

SEQ ID NO: 182372 - DNA, 25 bp, Homo sapien
ggcgccactcaccagacttgccagc

SEQ ID NO: 182373 - DNA, 25 bp, Homo sapien
gaggaccctgccgtcaccctcccga

SEQ ID NO: 182374 - DNA, 25 bp, Homo sapien
aagcgccaccaaattccttgtaagg

SEQ ID NO: 182375 - DNA, 25 bp, Homo sapien
caccgaggacatggcgacgccctgg

SEQ ID NO: 182376 - DNA, 25 bp, Homo sapien
aaacaccgaggacatggcgacgccc

SEQ ID NO: 182377 - DNA, 25 bp, Homo sapien
gttttccaaacaccgaggacatggc

SEQ ID NO: 182378 - DNA, 25 bp, Homo sapien
aattccttgtaagggctgcggagcc

SEQ ID NO: 182379 - DNA, 25 bp, Homo sapien
cacgctgggcaacaagctttacatc

SEQ ID NO: 182380 - DNA, 25 bp, Homo sapien
acagtgccgcgctcttcatctgcga

SEQ ID NO: 182381 - DNA, 25 bp, Homo sapien
ctcacgtcggacaactgcgcattgc

SEQ ID NO: 182382 - DNA, 25 bp, Homo sapien
tttctggagcacaacctcacgtcgg

SEQ ID NO: 182383 - DNA, 25 bp, Homo sapien
tccgcagagctatggccactgcatg

SEQ ID NO: 182384 - DNA, 25 bp, Homo sapien
tgcactgcgccatcgactgtctcaa

SEQ ID NO: 182385 - DNA, 25 bp, Homo sapien
cacgctgtgttacctggacgaggaa

SEQ ID NO: 182386 - DNA, 25 bp, Homo sapien
acagcctctatgtggtgcgcaacgg

SEQ ID NO: 182387 - DNA, 25 bp, Homo sapien
gggcagaatccttaccgcgaccgta

SEQ ID NO: 182388 - DNA, 25 bp, Homo sapien
gcgaccgtaggcttgtggctccgca

SEQ ID NO: 182389 - DNA, 25 bp, Homo sapien
ccatgttcggggctgactagcaaga

SEQ ID NO: 182390 - DNA, 25 bp, Homo sapien
gctgactagcaagagccaggctgga

SEQ ID NO: 182391 - DNA, 25 bp, Homo sapien
tcaccgcactggtacgggctgggtc

SEQ ID NO: 182392 - DNA, 25 bp, Homo sapien
agagtgccgtcctctccaggctgaa

SEQ ID NO: 182393 - DNA, 25 bp, Homo sapien
cctctccaggctgaagtcgtgctgc

SEQ ID NO: 182394 - DNA, 25 bp, Homo sapien
agcacgtccagcgagcacaggcgac

SEQ ID NO: 182395 - DNA, 25 bp, Homo sapien
ctcgtgaggcgcagtcgtcatggca

SEQ ID NO: 182396 - DNA, 25 bp, Homo sapien
gcgcccctccgaagtaggggacaca

SEQ ID NO: 182397 - DNA, 25 bp, Homo sapien
tccgcgctccgcaggtccggtcggt

SEQ ID NO: 182398 - DNA, 25 bp, Homo sapien
tcccgcatggcgctctctccacaga

SEQ ID NO: 182399 - DNA, 25 bp, Homo sapien
acggtctccgggcacttggttgcgg

SEQ ID NO: 182400 - DNA, 25 bp, Homo sapien
aggcgcagtcgtcatggcacccgcg

SEQ ID NO: 182401 - DNA, 25 bp, Homo sapien
cctcgggctgactggctcccgcgca

SEQ ID NO: 182402 - DNA, 25 bp, Homo sapien
gtcgtcatggcacccgcgcacctgt

SEQ ID NO: 182403 - DNA, 25 bp, Homo sapien
gtgacaggaatctgagtggctcctc

SEQ ID NO: 182404 - DNA, 25 bp, Homo sapien
cgcccacataggcagcctgggtcaa

SEQ ID NO: 182405 - DNA, 25 bp, Homo sapien
gtcaacggctgtagccgctcggcca

SEQ ID NO: 182406 - DNA, 25 bp, Homo sapien
cggtctgggagtacagcaggaccca

SEQ ID NO: 182407 - DNA, 25 bp, Homo sapien
cgaccctggccgaagaatggtggca

SEQ ID NO: 182408 - DNA, 25 bp, Homo sapien
ccatgttcacgacggagatgctttg

SEQ ID NO: 182409 - DNA, 25 bp, Homo sapien
gacggaagtgacgtcgttacgacgc

SEQ ID NO: 182410 - DNA, 25 bp, Homo sapien
gtggctcctcatgagaaccttccga

SEQ ID NO: 182411 - DNA, 25 bp, Homo sapien
ccacagccgtctattcaccagagta

SEQ ID NO: 182412 - DNA, 25 bp, Homo sapien
gtagggacagatcctcagccgagcc

SEQ ID NO: 182413 - DNA, 25 bp, Homo sapien
agcattttgtgcctttcagggtttc

SEQ ID NO: 182414 - DNA, 25 bp, Homo sapien
ttccaatttgagcaacggctgctcc

SEQ ID NO: 182415 - DNA, 25 bp, Homo sapien
gagggctcaggagtggcactatttc

SEQ ID NO: 182416 - DNA, 25 bp, Homo sapien
tgggcgccaatgagttccctacggc

SEQ ID NO: 182417 - DNA, 25 bp, Homo sapien
ctatttcgttacctctctgcgcgga

SEQ ID NO: 182418 - DNA, 25 bp, Homo sapien
tacaagcaccgcagctgggcatctc

SEQ ID NO: 182419 - DNA, 25 bp, Homo sapien
atggaatgacaaccgcgggaacgtg

SEQ ID NO: 182420 - DNA, 25 bp, Homo sapien
cgatcacccgcagctacgagagttg

SEQ ID NO: 182421 - DNA, 25 bp, Homo sapien
agctccaccgtacgggttgtgcccg

SEQ ID NO: 182422 - DNA, 25 bp, Homo sapien
aacgtgctgacacgtgtcctccgcg

SEQ ID NO: 182423 - DNA, 25 bp, Homo sapien
gaagggctatgacaatggaatgaca

SEQ ID NO: 182424 - DNA, 25 bp, Homo sapien
ccgccgaagagagagaccgaggcct

SEQ ID NO: 182425 - DNA, 25 bp, Homo sapien
accgagtcgcgcttgtagctctgca

SEQ ID NO: 182426 - DNA, 25 bp, Homo sapien
gctgcatcccaggtcactgcgcgtt

SEQ ID NO: 182427 - DNA, 25 bp, Homo sapien
cgcaagcgagtatttctgcgagatc

SEQ ID NO: 182428 - DNA, 25 bp, Homo sapien
cagcagtgtgtgaagtggagcacca

SEQ ID NO: 182429 - DNA, 25 bp, Homo sapien
ccacgtgaaggagactggcttccac

SEQ ID NO: 182430 - DNA, 25 bp, Homo sapien
cccacgtggcccgtaaagagtgagc

SEQ ID NO: 182431 - DNA, 25 bp, Homo sapien
cgtggcccgtaaagagtgagcagca

SEQ ID NO: 182432 - DNA, 25 bp, Homo sapien
aaggagactggcttccacttcacca

SEQ ID NO: 182433 - DNA, 25 bp, Homo sapien
tgtgaagtggagcaccagcacgccc

SEQ ID NO: 182434 - DNA, 25 bp, Homo sapien
acagccagctgggtgacgaccacgt

SEQ ID NO: 182435 - DNA, 25 bp, Homo sapien
ccagtgcatagggattttaggcgga

SEQ ID NO: 182436 - DNA, 25 bp, Homo sapien
tgcctgacgcatctgtctgaggagc

SEQ ID NO: 182437 - DNA, 25 bp, Homo sapien
ggggagcggccacttttattcatca

SEQ ID NO: 182438 - DNA, 25 bp, Homo sapien
cgatggtatcctgtccgctcgcatt

SEQ ID NO: 182439 - DNA, 25 bp, Homo sapien
acatcagggtgattgcagttccgtg

SEQ ID NO: 182440 - DNA, 25 bp, Homo sapien
ccagatccggaatgttcagaggctt

SEQ ID NO: 182441 - DNA, 25 bp, Homo sapien
gccctaaagtcctttgttctggaga

SEQ ID NO: 182442 - DNA, 25 bp, Homo sapien
tcgcgacaggtcctattgcgggtgt

SEQ ID NO: 182443 - DNA, 25 bp, Homo sapien
cgcatagcaatagtgtccgcgctga

SEQ ID NO: 182444 - DNA, 25 bp, Homo sapien
ctgaatggcgctggctaattacctc

SEQ ID NO: 182445 - DNA, 25 bp, Homo sapien
accaccgcgggtgaatgagagaatc

SEQ ID NO: 182446 - DNA, 25 bp, Homo sapien
ataggcccttcaccttccgtggaag

SEQ ID NO: 182447 - DNA, 25 bp, Homo sapien
ctgcagattctcaggggcgctctaa

SEQ ID NO: 182448 - DNA, 25 bp, Homo sapien
tgagcgcgcagttgtccttaattca

SEQ ID NO: 182449 - DNA, 25 bp, Homo sapien
tcctcgcacgccaaacgagggtttg

SEQ ID NO: 182450 - DNA, 25 bp, Homo sapien
acgggcacggctctgcattcaaaga

SEQ ID NO: 182451 - DNA, 25 bp, Homo sapien
gcggcgctaattgcacaggatccca

SEQ ID NO: 182452 - DNA, 25 bp, Homo sapien
atcctgaaacttcgcagcctgggct

SEQ ID NO: 182453 - DNA, 25 bp, Homo sapien
cgatgacttgacagccgagcaacca

SEQ ID NO: 182454 - DNA, 25 bp, Homo sapien
gagcaaccatgcagcgcggcgctaa

SEQ ID NO: 182455 - DNA, 25 bp, Homo sapien
ctcctgcctcgaggacgaggcatca

SEQ ID NO: 182456 - DNA, 25 bp, Homo sapien
acgaggcatcattttcggagcctgc

SEQ ID NO: 182457 - DNA, 25 bp, Homo sapien
tctgcgaccgcatcctgaaacttcg

SEQ ID NO: 182458 - DNA, 25 bp, Homo sapien
agacgttctgcgaccagggatctgc

SEQ ID NO: 182459 - DNA, 25 bp, Homo sapien
ggagcgccgcttgcgccatcttgca

SEQ ID NO: 182460 - DNA, 25 bp, Homo sapien
tctcggtcagctcggctcggcgacg

SEQ ID NO: 182461 - DNA, 25 bp, Homo sapien
acagccatggggctctcggtcagct

SEQ ID NO: 182462 - DNA, 25 bp, Homo sapien
cggtcagcgcttagccttgcggtct

SEQ ID NO: 182463 - DNA, 25 bp, Homo sapien
tcgggctatgtccacggccgggcac

SEQ ID NO: 182464 - DNA, 25 bp, Homo sapien
agtgcagccgtcagagtcccggtct

SEQ ID NO: 182465 - DNA, 25 bp, Homo sapien
aaatgcaggtcgtgccatctccgcc

SEQ ID NO: 182466 - DNA, 25 bp, Homo sapien
gcccagtaccagctccaaatgcagg

SEQ ID NO: 182467 - DNA, 25 bp, Homo sapien
aagccgatgatctgctcgctgtgca

SEQ ID NO: 182468 - DNA, 25 bp, Homo sapien
cgcggcacacgaagcgcgctgtgct

SEQ ID NO: 182469 - DNA, 25 bp, Homo sapien
cctggaccttgacgcgcccgttggg

SEQ ID NO: 182470 - DNA, 25 bp, Homo sapien
acgcactggtagtagccggcgtcct

SEQ ID NO: 182471 - DNA, 25 bp, Homo sapien
tcctgcaggccgatctgtgtgatga

SEQ ID NO: 182472 - DNA, 25 bp, Homo sapien
ttctcagccacgcactggtagtagc

SEQ ID NO: 182473 - DNA, 25 bp, Homo sapien
cccgtgccttctggtagtggagaga

SEQ ID NO: 182474 - DNA, 25 bp, Homo sapien
atctgtgtgatgaccaggctgccac

SEQ ID NO: 182475 - DNA, 25 bp, Homo sapien
tgttggcgcggcagacatagacgcc

SEQ ID NO: 182476 - DNA, 25 bp, Homo sapien
atctgtggagatgggcttcccgtct

SEQ ID NO: 182477 - DNA, 25 bp, Homo sapien
ggcagacatagacgccggagtgcca

SEQ ID NO: 182478 - DNA, 25 bp, Homo sapien
cagggctgcgcgttggcaattagta

SEQ ID NO: 182479 - DNA, 25 bp, Homo sapien
gcaattagtaggttggtgcggccca

SEQ ID NO: 182480 - DNA, 25 bp, Homo sapien
tgcggcccaggacgatgacatctgt

SEQ ID NO: 182481 - DNA, 25 bp, Homo sapien
cccaggacgatgacatctgtggaga

SEQ ID NO: 182482 - DNA, 25 bp, Homo sapien
tcacccagcacacggagctcagcgg

SEQ ID NO: 182483 - DNA, 25 bp, Homo sapien
ggacgctgcaaaaatcggaacactt

SEQ ID NO: 182484 - DNA, 25 bp, Homo sapien
gtgctccctcgctaacatctaggca

SEQ ID NO: 182485 - DNA, 25 bp, Homo sapien
ctgcaacgcttgacctcggactaca

SEQ ID NO: 182486 - DNA, 25 bp, Homo sapien
cggactacatttactttgcggggca

SEQ ID NO: 182487 - DNA, 25 bp, Homo sapien
gagcggttctccgagctccctattc

SEQ ID NO: 182488 - DNA, 25 bp, Homo sapien
tttggctccacttacggcgacaatg

SEQ ID NO: 182489 - DNA, 25 bp, Homo sapien
cttcggggacgaaatgcacagcagc

SEQ ID NO: 182490 - DNA, 25 bp, Homo sapien
aaccgctttgtgtgctgcttctaga

SEQ ID NO: 182491 - DNA, 25 bp, Homo sapien
aacaggcagaaggtcaacgcgagga

SEQ ID NO: 182492 - DNA, 25 bp, Homo sapien
gcgaccatggcacgcactgcggaca

SEQ ID NO: 182493 - DNA, 25 bp, Homo sapien
cactgcggacacgacaggagcactc

SEQ ID NO: 182494 - DNA, 25 bp, Homo sapien
ggacacgacaggagcactcccaaca

SEQ ID NO: 182495 - DNA, 25 bp, Homo sapien
actccagactctgcgaaccaaaggc

SEQ ID NO: 182496 - DNA, 25 bp, Homo sapien
acttgctcgggactccggcttgagc

SEQ ID NO: 182497 - DNA, 25 bp, Homo sapien
gcgcggccaacaggcagaaggtcaa

SEQ ID NO: 182498 - DNA, 25 bp, Homo sapien
gcgaaagccaccgacaccgcagcta

SEQ ID NO: 182499 - DNA, 25 bp, Homo sapien
gggtccaacaccacagcgcagtcta

SEQ ID NO: 182500 - DNA, 25 bp, Homo sapien
tgaccctgagaacgcgccgagcagt

SEQ ID NO: 182501 - DNA, 25 bp, Homo sapien
tggcctcggaggctttagcacttcc

SEQ ID NO: 182502 - DNA, 25 bp, Homo sapien
ggcgaacgcggcactaagaagcagc

SEQ ID NO: 182503 - DNA, 25 bp, Homo sapien
ccgggtaaaccgcaaagcgcgctga

SEQ ID NO: 182504 - DNA, 25 bp, Homo sapien
tgcgatccgctttccgactggcgaa

SEQ ID NO: 182505 - DNA, 25 bp, Homo sapien
ctccactccggtcctggttgcagtg

SEQ ID NO: 182506 - DNA, 25 bp, Homo sapien
tagcacttccggttcgttgcgatcc

SEQ ID NO: 182507 - DNA, 25 bp, Homo sapien
tcgcgccagcagagcactacctgag

SEQ ID NO: 182508 - DNA, 25 bp, Homo sapien
cagcgacaccgcgagctatatctgc

SEQ ID NO: 182509 - DNA, 25 bp, Homo sapien
tggcgcttttcgaggctcatctgca

SEQ ID NO: 182510 - DNA, 25 bp, Homo sapien
cgggcctcttctttgttcgcagtcg

SEQ ID NO: 182511 - DNA, 25 bp, Homo sapien
cccttcgagatgtgggatgagcttg

SEQ ID NO: 182512 - DNA, 25 bp, Homo sapien
gtagctgaatgcctgccgctggcct

SEQ ID NO: 182513 - DNA, 25 bp, Homo sapien
cgcatgtctactgggctcagcgaca

SEQ ID NO: 182514 - DNA, 25 bp, Homo sapien
atcaggtgttgacgccgcatgtcta

SEQ ID NO: 182515 - DNA, 25 bp, Homo sapien
gccggaactataaggccgcgcgaca

SEQ ID NO: 182516 - DNA, 25 bp, Homo sapien
cgcgacagaagggaatccggcgcct

SEQ ID NO: 182517 - DNA, 25 bp, Homo sapien
cgaaatcgtgcagtttacgcggagc

SEQ ID NO: 182518 - DNA, 25 bp, Homo sapien
tccttggagagcttcagggtcgccc

SEQ ID NO: 182519 - DNA, 25 bp, Homo sapien
cggaactggcgcctcacagacagcg

SEQ ID NO: 182520 - DNA, 25 bp, Homo sapien
ggccctgggttgttcttcacccata

SEQ ID NO: 182521 - DNA, 25 bp, Homo sapien
ccaacaagcagcgaaaggcagtccc

SEQ ID NO: 182522 - DNA, 25 bp, Homo sapien
cggacacagtccgtcggcataaact

SEQ ID NO: 182523 - DNA, 25 bp, Homo sapien
tccgacttacgtaacgggcttgtca

SEQ ID NO: 182524 - DNA, 25 bp, Homo sapien
gcgaccggcgccatcttggcaatga

SEQ ID NO: 182525 - DNA, 25 bp, Homo sapien
ctcagataccgagcaggtgggattc

SEQ ID NO: 182526 - DNA, 25 bp, Homo sapien
gagcaccaatcgaaggccggatctg

SEQ ID NO: 182527 - DNA, 25 bp, Homo sapien
gggtcctagcgccaaactgataatg

SEQ ID NO: 182528 - DNA, 25 bp, Homo sapien
taagtcgccttagtccgtgacgtgc

SEQ ID NO: 182529 - DNA, 25 bp, Homo sapien
ccaggccagcctggaatagaaaatc

SEQ ID NO: 182530 - DNA, 25 bp, Homo sapien
ggcttgtcaaaatcccagatccagg

SEQ ID NO: 182531 - DNA, 25 bp, Homo sapien
ggatcaggtgctacctctcccgggt

SEQ ID NO: 182532 - DNA, 25 bp, Homo sapien
gatcaggtgctacctctcccgggtg

SEQ ID NO: 182533 - DNA, 25 bp, Homo sapien
cgggagaccgagtcggcgccggtga

SEQ ID NO: 182534 - DNA, 25 bp, Homo sapien
acaggacatggtcggccgcctgcct

SEQ ID NO: 182535 - DNA, 25 bp, Homo sapien
gacaggacatggtcggccgcctgcc

SEQ ID NO: 182536 - DNA, 25 bp, Homo sapien
cgacaggacatggtcggccgcctgc

SEQ ID NO: 182537 - DNA, 25 bp, Homo sapien
cgtcaggcgacaggacatggtcggc

SEQ ID NO: 182538 - DNA, 25 bp, Homo sapien
gccgtcaggcgacaggacatggtcg

SEQ ID NO: 182539 - DNA, 25 bp, Homo sapien
cgagctattccgaggaggagccgaa

SEQ ID NO: 182540 - DNA, 25 bp, Homo sapien
atcttgggagacacacggatctcgc

SEQ ID NO: 182541 - DNA, 25 bp, Homo sapien
gctacaggccgcgagctattccgag

SEQ ID NO: 182542 - DNA, 25 bp, Homo sapien
cgcgcttccttatccggaaaacgag

SEQ ID NO: 182543 - DNA, 25 bp, Homo sapien
gcggccgcctcactggtcgtagtcg

SEQ ID NO: 182544 - DNA, 25 bp, Homo sapien
accaggggcctacttctggcaccag

SEQ ID NO: 182545 - DNA, 25 bp, Homo sapien
gactgacagttacggctgcagcagc

SEQ ID NO: 182546 - DNA, 25 bp, Homo sapien
gctcagccaggactgacagttacgg

SEQ ID NO: 182547 - DNA, 25 bp, Homo sapien
tgagcaagcggccactaagactatg

SEQ ID NO: 182548 - DNA, 25 bp, Homo sapien
gctcttcacccagtccggcagttga

SEQ ID NO: 182549 - DNA, 25 bp, Homo sapien
atgggctctcgcactctacacagtc

SEQ ID NO: 182550 - DNA, 25 bp, Homo sapien
tcagcccttcctttttgtgcggttc

SEQ ID NO: 182551 - DNA, 25 bp, Homo sapien
ccatctctcttttcgggtgtagcgc

SEQ ID NO: 182552 - DNA, 25 bp, Homo sapien
tgacgggttcttcgcttccctcttg

SEQ ID NO: 182553 - DNA, 25 bp, Homo sapien
ggtgcagactcccattacaggtctt

SEQ ID NO: 182554 - DNA, 25 bp, Homo sapien
ctcgagcgagcgtctcttctgtatc

SEQ ID NO: 182555 - DNA, 25 bp, Homo sapien
tctggcactggcaccggttgctgca

SEQ ID NO: 182556 - DNA, 25 bp, Homo sapien
cagtggtcgctgtcgcagcctgcaa

SEQ ID NO: 182557 - DNA, 25 bp, Homo sapien
atggggttacacagggcgccgttct

SEQ ID NO: 182558 - DNA, 25 bp, Homo sapien
caggcgcctgtgatggggttacaca

SEQ ID NO: 182559 - DNA, 25 bp, Homo sapien
ctggcatcccttgccgtgggtgcca

SEQ ID NO: 182560 - DNA, 25 bp, Homo sapien
acggcagctggcatcccttgccgtg

SEQ ID NO: 182561 - DNA, 25 bp, Homo sapien
gcaccgtgtcggcactggcacggca

SEQ ID NO: 182562 - DNA, 25 bp, Homo sapien
tagccaggtgcgcagaggcactcgc

SEQ ID NO: 182563 - DNA, 25 bp, Homo sapien
caccggactacatcctctaggaagc

SEQ ID NO: 182564 - DNA, 25 bp, Homo sapien
gcctcacgtggtatcagagggctta

SEQ ID NO: 182565 - DNA, 25 bp, Homo sapien
cagagggcttactgtccaacaagga

SEQ ID NO: 182566 - DNA, 25 bp, Homo sapien
tctttcaatgatgttcgctggggtt

SEQ ID NO: 182567 - DNA, 25 bp, Homo sapien
tgtccgaactgctggtctttcaatg

SEQ ID NO: 182568 - DNA, 25 bp, Homo sapien
cctacctcgtagcaagtgtcagtta

SEQ ID NO: 182569 - DNA, 25 bp, Homo sapien
agccatttggctgagggttctgagc

SEQ ID NO: 182570 - DNA, 25 bp, Homo sapien
taggaagcctggactgtctcaaagc

SEQ ID NO: 182571 - DNA, 25 bp, Homo sapien
aaagagctcttgtttccgcttcgtg

SEQ ID NO: 182572 - DNA, 25 bp, Homo sapien
ctgtcctgtcgcgaaaaagagctct

SEQ ID NO: 182573 - DNA, 25 bp, Homo sapien
ttctccaccacaccgggaggtgagc

SEQ ID NO: 182574 - DNA, 25 bp, Homo sapien
tccgcttcgtggcaggcttacgcat

SEQ ID NO: 182575 - DNA, 25 bp, Homo sapien
ttacttcgtgttcgctcttgcccgc

SEQ ID NO: 182576 - DNA, 25 bp, Homo sapien
tccgtccgcctgaggagccgaagca

SEQ ID NO: 182577 - DNA, 25 bp, Homo sapien
agagcgcgcttttccgtccgcctga

SEQ ID NO: 182578 - DNA, 25 bp, Homo sapien
cccactcgggaatgtggctgtcctg

SEQ ID NO: 182579 - DNA, 25 bp, Homo sapien
gaccactcgggagacagtcacactg

SEQ ID NO: 182580 - DNA, 25 bp, Homo sapien
tttttccggagaacatgaccactcg

SEQ ID NO: 182581 - DNA, 25 bp, Homo sapien
ggctgcatcccactcagggaccttg

SEQ ID NO: 182582 - DNA, 25 bp, Homo sapien
cgccctcgaggaacgattctgccta

SEQ ID NO: 182583 - DNA, 25 bp, Homo sapien
cgcgcgcagagagtcacttgcttct

SEQ ID NO: 182584 - DNA, 25 bp, Homo sapien
tttaactttgggagccagggtcgca

SEQ ID NO: 182585 - DNA, 25 bp, Homo sapien
ggatcgtcctgggagccaaccaaca

SEQ ID NO: 182586 - DNA, 25 bp, Homo sapien
caggtcctggacttcccggaataga

SEQ ID NO: 182587 - DNA, 25 bp, Homo sapien
ccgccatgctgcagaagcgggagaa

SEQ ID NO: 182588 - DNA, 25 bp, Homo sapien
agacacgccgccatgctgcagaagc

SEQ ID NO: 182589 - DNA, 25 bp, Homo sapien
gcccgggactcccttactgctccgc

SEQ ID NO: 182590 - DNA, 25 bp, Homo sapien
tgctccgccctgtccaatgggaggg

SEQ ID NO: 182591 - DNA, 25 bp, Homo sapien
caacctcgcgccgtggagaaatggg

SEQ ID NO: 182592 - DNA, 25 bp, Homo sapien
cccgggagctacaggccagctgctg

SEQ ID NO: 182593 - DNA, 25 bp, Homo sapien
gctgctgccgctgcgaagctgacat

SEQ ID NO: 182594 - DNA, 25 bp, Homo sapien
cctggagcgtgtagctccgggcctc

SEQ ID NO: 182595 - DNA, 25 bp, Homo sapien
tctcacctcacgcagaaaacacggg

SEQ ID NO: 182596 - DNA, 25 bp, Homo sapien
tgggcggagcctgcaaaacccgcct

SEQ ID NO: 182597 - DNA, 25 bp, Homo sapien
taggctttcccgctagtctgtctgg

SEQ ID NO: 182598 - DNA, 25 bp, Homo sapien
cccttcctgcgacaattaggctttc

SEQ ID NO: 182599 - DNA, 25 bp, Homo sapien
gcaagaacttcattggcccgccagc

SEQ ID NO: 182600 - DNA, 25 bp, Homo sapien
ggcgtgcagactaagcgcgcttctc

SEQ ID NO: 182601 - DNA, 25 bp, Homo sapien
ttctcgcgatactcgggaactcctg

SEQ ID NO: 182602 - DNA, 25 bp, Homo sapien
agcgtttggcgccaaatccgtgcgg

SEQ ID NO: 182603 - DNA, 25 bp, Homo sapien
tggcctggagagctcaccacacagc

SEQ ID NO: 182604 - DNA, 25 bp, Homo sapien
agcctttcggctctctgcgcgcgaa

SEQ ID NO: 182605 - DNA, 25 bp, Homo sapien
cggctctgcagttaacgggaccagc

SEQ ID NO: 182606 - DNA, 25 bp, Homo sapien
accagctctgcggagtaagtatggg

SEQ ID NO: 182607 - DNA, 25 bp, Homo sapien
gctccgatctggtttgtcacgtacg

SEQ ID NO: 182608 - DNA, 25 bp, Homo sapien
ccgccgaggtatcggtgactaagca

SEQ ID NO: 182609 - DNA, 25 bp, Homo sapien
gtatttccgcgtcatctgccgccga

SEQ ID NO: 182610 - DNA, 25 bp, Homo sapien
cacagacttcttctcagctgggtcc

SEQ ID NO: 182611 - DNA, 25 bp, Homo sapien
accttgaggcggttcagctggtcgt

SEQ ID NO: 182612 - DNA, 25 bp, Homo sapien
ggtcacatagccaacctccgggctg

SEQ ID NO: 182613 - DNA, 25 bp, Homo sapien
gctcagcatgttgcctggtcacata

SEQ ID NO: 182614 - DNA, 25 bp, Homo sapien
tccttgcgcagttcctgaagccggc

SEQ ID NO: 182615 - DNA, 25 bp, Homo sapien
ggtgatgacgccatcgccgccgact

SEQ ID NO: 182616 - DNA, 25 bp, Homo sapien
gcccggcactcggtgatgacgccat

SEQ ID NO: 182617 - DNA, 25 bp, Homo sapien
gggctgcccgacacattgaggaaag

SEQ ID NO: 182618 - DNA, 25 bp, Homo sapien
ccgacacattgaggaaaggcgagga

SEQ ID NO: 182619 - DNA, 25 bp, Homo sapien
gaaagggcagctttgtccccatcgc

SEQ ID NO: 182620 - DNA, 25 bp, Homo sapien
ggaaggaggtcactgacgattcttc

SEQ ID NO: 182621 - DNA, 25 bp, Homo sapien
acgattcttccaggccctcgtttca

SEQ ID NO: 182622 - DNA, 25 bp, Homo sapien
ctgcagccaaagagacggctgctgc

SEQ ID NO: 182623 - DNA, 25 bp, Homo sapien
cgagccctgggcgttatctgcgcta

SEQ ID NO: 182624 - DNA, 25 bp, Homo sapien
gcgttatctgcgctagcccggccgg

SEQ ID NO: 182625 - DNA, 25 bp, Homo sapien
agggcgtcaactccccgtctgcgga

SEQ ID NO: 182626 - DNA, 25 bp, Homo sapien
ggtggccagggacagtcccttcgcc

SEQ ID NO: 182627 - DNA, 25 bp, Homo sapien
atcccggctctgagtggggcgcatc

SEQ ID NO: 182628 - DNA, 25 bp, Homo sapien
cccgcgccgccggatgtttgagttt

SEQ ID NO: 182629 - DNA, 25 bp, Homo sapien
cggatgtttgagtttggtttttgtg

SEQ ID NO: 182630 - DNA, 25 bp, Homo sapien
ccactcccttggcagtggatgtggg

SEQ ID NO: 182631 - DNA, 25 bp, Homo sapien
ctaaccactcccttggcagtggatg

SEQ ID NO: 182632 - DNA, 25 bp, Homo sapien
taggactggtgtcacgaagacgccc

SEQ ID NO: 182633 - DNA, 25 bp, Homo sapien
ggagccgccgccttatcgggctgtc

SEQ ID NO: 182634 - DNA, 25 bp, Homo sapien
tttggtttttgtgatcgagcggagc

SEQ ID NO: 182635 - DNA, 25 bp, Homo sapien
tttattgaagcaggggcccatctag

SEQ ID NO: 182636 - DNA, 25 bp, Homo sapien
gtgtaaacggccctgaagttgcgcc

SEQ ID NO: 182637 - DNA, 25 bp, Homo sapien
ccatctagctgtgcggctgattcca

SEQ ID NO: 182638 - DNA, 25 bp, Homo sapien
gcgccgtctgtctgtgtgaacagga

SEQ ID NO: 182639 - DNA, 25 bp, Homo sapien
gagaacgtttaggatcatgcatgtc

SEQ ID NO: 182640 - DNA, 25 bp, Homo sapien
tccacactgtgacggttagcaaggc

SEQ ID NO: 182641 - DNA, 25 bp, Homo sapien
agcagattctccaacgcgtcttcca

SEQ ID NO: 182642 - DNA, 25 bp, Homo sapien
attccatatgtcaggcagggcggcg

SEQ ID NO: 182643 - DNA, 25 bp, Homo sapien
ccagcagctctttgggatttttaca

SEQ ID NO: 182644 - DNA, 25 bp, Homo sapien
caagtgcatctagcgcctgggacct

SEQ ID NO: 182645 - DNA, 25 bp, Homo sapien
cgttggcctttcgtgcatgcaaatc

SEQ ID NO: 182646 - DNA, 25 bp, Homo sapien
cctgcctttcggatcctgcgggaaa

SEQ ID NO: 182647 - DNA, 25 bp, Homo sapien
cctgcgggaaaagcccatgtagtta

SEQ ID NO: 182648 - DNA, 25 bp, Homo sapien
tccagacacatttaggggttcgcgc

SEQ ID NO: 182649 - DNA, 25 bp, Homo sapien
tggaccagccgcacaacttttgaag

SEQ ID NO: 182650 - DNA, 25 bp, Homo sapien
agcgctttgtgctcatggaccagcc

SEQ ID NO: 182651 - DNA, 25 bp, Homo sapien
ggcttcggcatcctgctcagcaagg

SEQ ID NO: 182652 - DNA, 25 bp, Homo sapien
gcgaacgcgcagcaagatcggcttc

SEQ ID NO: 182653 - DNA, 25 bp, Homo sapien
acgacctacctcagggcagcggctt

SEQ ID NO: 182654 - DNA, 25 bp, Homo sapien
ggccgtcagcatcttctacgaccta

SEQ ID NO: 182655 - DNA, 25 bp, Homo sapien
cgcctctatgcggtgtacgaccagg

SEQ ID NO: 182656 - DNA, 25 bp, Homo sapien
ccaagccgagccactggtgcagcgt

SEQ ID NO: 182657 - DNA, 25 bp, Homo sapien
ttgtcccgcagacgccagcatgtct

SEQ ID NO: 182658 - DNA, 25 bp, Homo sapien
tactccatcaaggtgttcgacttcg

SEQ ID NO: 182659 - DNA, 25 bp, Homo sapien
aggacacaccctgaacgctagaatc

SEQ ID NO: 182660 - DNA, 25 bp, Homo sapien
ccggggttaagcgagacacttgaca

SEQ ID NO: 182661 - DNA, 25 bp, Homo sapien
ccacagttcgcgacttcgggacagc

SEQ ID NO: 182662 - DNA, 25 bp, Homo sapien
caacgaccgttgactgtggctgtgc

SEQ ID NO: 182663 - DNA, 25 bp, Homo sapien
gcgtttcgcgcgcattgtcatctcg

SEQ ID NO: 182664 - DNA, 25 bp, Homo sapien
gtcatctcgcgctttccacagtctg

SEQ ID NO: 182665 - DNA, 25 bp, Homo sapien
ccaggctccgggataagcaacttca

SEQ ID NO: 182666 - DNA, 25 bp, Homo sapien
ccacagtctgataggcgaggtgtta

SEQ ID NO: 182667 - DNA, 25 bp, Homo sapien
cggaacccgtcatcagctaagtaca

SEQ ID NO: 182668 - DNA, 25 bp, Homo sapien
atcagctaagtacagagcgggcggc

SEQ ID NO: 182669 - DNA, 25 bp, Homo sapien
ccggtactgagctcgagaacggccc

SEQ ID NO: 182670 - DNA, 25 bp, Homo sapien
cccgtcatcagctaagtacagagcg

SEQ ID NO: 182671 - DNA, 25 bp, Homo sapien
cgagggccgcggaacccgtcatcag

SEQ ID NO: 182672 - DNA, 25 bp, Homo sapien
gaacccgtcatcagctaagtacaga

SEQ ID NO: 182673 - DNA, 25 bp, Homo sapien
ccgagtgcgccggtactgagctcga

SEQ ID NO: 182674 - DNA, 25 bp, Homo sapien
cgcggaacccgtcatcagctaagta

SEQ ID NO: 182675 - DNA, 25 bp, Homo sapien
agaaagagcattgggctccgggcca

SEQ ID NO: 182676 - DNA, 25 bp, Homo sapien
cccggctcttagaaagagcattggg

SEQ ID NO: 182677 - DNA, 25 bp, Homo sapien
ccagcccttagtgaattgcttcatc

SEQ ID NO: 182678 - DNA, 25 bp, Homo sapien
cttagtgaattgcttcatctgccac

SEQ ID NO: 182679 - DNA, 25 bp, Homo sapien
gccactcatgtcctgcgccctggaa

SEQ ID NO: 182680 - DNA, 25 bp, Homo sapien
ccgtgcaagcgctgggctgacaact

SEQ ID NO: 182681 - DNA, 25 bp, Homo sapien
ctgacaactgacagcggcgacgctt

SEQ ID NO: 182682 - DNA, 25 bp, Homo sapien
acagcggcgacgcttggaatgagac

SEQ ID NO: 182683 - DNA, 25 bp, Homo sapien
gcctccgtcggcgacgctggcccac

SEQ ID NO: 182684 - DNA, 25 bp, Homo sapien
acccagtttcccagctctcgtcctc

SEQ ID NO: 182685 - DNA, 25 bp, Homo sapien
ggaggcgacccagtttcccagctct

SEQ ID NO: 182686 - DNA, 25 bp, Homo sapien
acattgcagggcgcaagcgtgcccg

SEQ ID NO: 182687 - DNA, 25 bp, Homo sapien
cgcgcacattgcagggcgcaagcgt

SEQ ID NO: 182688 - DNA, 25 bp, Homo sapien
aaggacgcgcacattgcagggcgca

SEQ ID NO: 182689 - DNA, 25 bp, Homo sapien
gacgttcttcgcgaaggacgcgcac

SEQ ID NO: 182690 - DNA, 25 bp, Homo sapien
gtcctcgccacttcctctgcatggg

SEQ ID NO: 182691 - DNA, 25 bp, Homo sapien
cgtgcggaaacccaaacttctgctg

SEQ ID NO: 182692 - DNA, 25 bp, Homo sapien
caaagctagcgaggcgagcgaagtt

SEQ ID NO: 182693 - DNA, 25 bp, Homo sapien
ggccgctcttctcttcgccgtggga

SEQ ID NO: 182694 - DNA, 25 bp, Homo sapien
aagagcctggtcaagaaactcaaga

SEQ ID NO: 182695 - DNA, 25 bp, Homo sapien
tggacgagctggagaaggccatcac

SEQ ID NO: 182696 - DNA, 25 bp, Homo sapien
gcagaacgtcaacaccaagtgcatc

SEQ ID NO: 182697 - DNA, 25 bp, Homo sapien
cacgcggatttgcatgaaacacaga

SEQ ID NO: 182698 - DNA, 25 bp, Homo sapien
gagggatctgcgcatcaaagctagc

SEQ ID NO: 182699 - DNA, 25 bp, Homo sapien
ctaacgcacagggtacgccagcagc

SEQ ID NO: 182700 - DNA, 25 bp, Homo sapien
tggaccagctggtctcctgagaaga

SEQ ID NO: 182701 - DNA, 25 bp, Homo sapien
gttctcggaatgaccaggctggcct

SEQ ID NO: 182702 - DNA, 25 bp, Homo sapien
ctccggctgaaggtttccgtgcttg

SEQ ID NO: 182703 - DNA, 25 bp, Homo sapien
tagccgttccctgacctagccatgg

SEQ ID NO: 182704 - DNA, 25 bp, Homo sapien
cgaccctgtcggatccatcttaatc

SEQ ID NO: 182705 - DNA, 25 bp, Homo sapien
gattcaccgacgctcacccatttgg

SEQ ID NO: 182706 - DNA, 25 bp, Homo sapien
caggcgcctatctactcacgttgga

SEQ ID NO: 182707 - DNA, 25 bp, Homo sapien
tcagccaccgagcacgtgacgaacg

SEQ ID NO: 182708 - DNA, 25 bp, Homo sapien
ttcttcacggcgctcaaggtcgtca

SEQ ID NO: 182709 - DNA, 25 bp, Homo sapien
tgagctcctggcacccgaagccgtt

SEQ ID NO: 182710 - DNA, 25 bp, Homo sapien
atcaagtaccactgctccaaggctc

SEQ ID NO: 182711 - DNA, 25 bp, Homo sapien
agttcggcctctcgcacttcaactg

SEQ ID NO: 182712 - DNA, 25 bp, Homo sapien
ggtgcagggcgccaactaccacgtc

SEQ ID NO: 182713 - DNA, 25 bp, Homo sapien
tcgcacttcaactggccggtgcagg

SEQ ID NO: 182714 - DNA, 25 bp, Homo sapien
tggggtcctttgtactcctcgccca

SEQ ID NO: 182715 - DNA, 25 bp, Homo sapien
tctcctgagcgagcaagaccagtct

SEQ ID NO: 182716 - DNA, 25 bp, Homo sapien
ccttttccaacatggcgccgcggga

SEQ ID NO: 182717 - DNA, 25 bp, Homo sapien
tttggttccggagtaacagtgtcgc

SEQ ID NO: 182718 - DNA, 25 bp, Homo sapien
tctcctagtccactgacgagcggtg

SEQ ID NO: 182719 - DNA, 25 bp, Homo sapien
agcggtggacacctgccgctgtatc

SEQ ID NO: 182720 - DNA, 25 bp, Homo sapien
tccgctagttcctgcgggcctttgc

SEQ ID NO: 182721 - DNA, 25 bp, Homo sapien
atagcgttcgctcaactccagaacc

SEQ ID NO: 182722 - DNA, 25 bp, Homo sapien
gcagagaccttcaccatagcgttcg

SEQ ID NO: 182723 - DNA, 25 bp, Homo sapien
gctgtccgtagcttggtgctgaacg

SEQ ID NO: 182724 - DNA, 25 bp, Homo sapien
ctgtccacgcgcctttctccagctc

SEQ ID NO: 182725 - DNA, 25 bp, Homo sapien
cggacgccggcccatagtagagccc

SEQ ID NO: 182726 - DNA, 25 bp, Homo sapien
gcggtgatattaacccgccggacgc

SEQ ID NO: 182727 - DNA, 25 bp, Homo sapien
tgcggtccgcggtgatattaacccg

SEQ ID NO: 182728 - DNA, 25 bp, Homo sapien
ctgcaatcggtaaagtgcggtccgc

SEQ ID NO: 182729 - DNA, 25 bp, Homo sapien
cggctctgcaatcggtaaagtgcgg

SEQ ID NO: 182730 - DNA, 25 bp, Homo sapien
ggacgcagagtcgacgctgcacacc

SEQ ID NO: 182731 - DNA, 25 bp, Homo sapien
gccgctccacaagcacgcagttgta

SEQ ID NO: 182732 - DNA, 25 bp, Homo sapien
cagttgtaggctctggccgcataca

SEQ ID NO: 182733 - DNA, 25 bp, Homo sapien
acggaatcgaaacccagtgtgtgca

SEQ ID NO: 182734 - DNA, 25 bp, Homo sapien
tccagcctgagaagcatgccgtcgc

SEQ ID NO: 182735 - DNA, 25 bp, Homo sapien
ttgatctcatcggtaagcgggtgcc

SEQ ID NO: 182736 - DNA, 25 bp, Homo sapien
cgggtgccggatcaccactgacatc

SEQ ID NO: 182737 - DNA, 25 bp, Homo sapien
ctgacatcctcttgcggacggaatc

SEQ ID NO: 182738 - DNA, 25 bp, Homo sapien
gggcagctccactgacacttggtcg

SEQ ID NO: 182739 - DNA, 25 bp, Homo sapien
tgctcgcctagctcttttccaaggg

SEQ ID NO: 182740 - DNA, 25 bp, Homo sapien
tgcagtacacccagacacggcgtta

SEQ ID NO: 182741 - DNA, 25 bp, Homo sapien
ttattcagcaagtgtgtttggccgc

SEQ ID NO: 182742 - DNA, 25 bp, Homo sapien
ctcgcccgccgatgatttggaaacg

SEQ ID NO: 182743 - DNA, 25 bp, Homo sapien
cctgaagcccggagatgagcagacc

SEQ ID NO: 182744 - DNA, 25 bp, Homo sapien
tatctgcgcgcgatgtaggtcgctc

SEQ ID NO: 182745 - DNA, 25 bp, Homo sapien
gccttaccaggttcctcacagagga

SEQ ID NO: 182746 - DNA, 25 bp, Homo sapien
gaggcggccacgacgcttttaatta

SEQ ID NO: 182747 - DNA, 25 bp, Homo sapien
cgggccaggcatagttgccgatttc

SEQ ID NO: 182748 - DNA, 25 bp, Homo sapien
atggctcttcgcctgtgctttccgc

SEQ ID NO: 182749 - DNA, 25 bp, Homo sapien
ttcgtttagttctgatttgggctcc

SEQ ID NO: 182750 - DNA, 25 bp, Homo sapien
aacggctcagggttcgcatctccgc

SEQ ID NO: 182751 - DNA, 25 bp, Homo sapien
tccttgtcgctgcatatggctcttc

SEQ ID NO: 182752 - DNA, 25 bp, Homo sapien
caagctcgtccatctagctccggga

SEQ ID NO: 182753 - DNA, 25 bp, Homo sapien
tgtcttcactgtatgcgggccaggc

SEQ ID NO: 182754 - DNA, 25 bp, Homo sapien
gcactgtgagtacccacgtccggta

SEQ ID NO: 182755 - DNA, 25 bp, Homo sapien
gggcgagcacaaaccacccaagctg

SEQ ID NO: 182756 - DNA, 25 bp, Homo sapien
gcacgccggtacagctggagattct

SEQ ID NO: 182757 - DNA, 25 bp, Homo sapien
cggcgtacgaagctacccggtgatc

SEQ ID NO: 182758 - DNA, 25 bp, Homo sapien
tggcgtcgtcacctcaaactcagtg

SEQ ID NO: 182759 - DNA, 25 bp, Homo sapien
gtgcggctactgcagcatgtacttc

SEQ ID NO: 182760 - DNA, 25 bp, Homo sapien
gttacaacagctctcgtgccaagtg

SEQ ID NO: 182761 - DNA, 25 bp, Homo sapien
tggtagcttcatccctgcgcgttac

SEQ ID NO: 182762 - DNA, 25 bp, Homo sapien
acttcgccttcgatgtggtgcacga

SEQ ID NO: 182763 - DNA, 25 bp, Homo sapien
ccctcccgcaccgaggtgtccaggc

SEQ ID NO: 182764 - DNA, 25 bp, Homo sapien
caccgaggtgtccaggcccgcgcag

SEQ ID NO: 182765 - DNA, 25 bp, Homo sapien
cacactgccattcgccaggcctcca

SEQ ID NO: 182766 - DNA, 25 bp, Homo sapien
ggggaacacactgccattcgccagg

SEQ ID NO: 182767 - DNA, 25 bp, Homo sapien
gctgctccaactgagggcgctctgg

SEQ ID NO: 182768 - DNA, 25 bp, Homo sapien
cgtccagcccggtgaggaccagggc

SEQ ID NO: 182769 - DNA, 25 bp, Homo sapien
gggtgacggcaccaggactggaccc

SEQ ID NO: 182770 - DNA, 25 bp, Homo sapien
cccgcaggacgtccagcccggtgag

SEQ ID NO: 182771 - DNA, 25 bp, Homo sapien
agacagagacgctccggcgcgagct

SEQ ID NO: 182772 - DNA, 25 bp, Homo sapien
caagagcctagtgagacagagacgc

SEQ ID NO: 182773 - DNA, 25 bp, Homo sapien
gccgggacaagagcctagtgagaca

SEQ ID NO: 182774 - DNA, 25 bp, Homo sapien
ctgcggagcaagaagaccgaggctg

SEQ ID NO: 182775 - DNA, 25 bp, Homo sapien
tcagccgaagagcagacgggctgcg

SEQ ID NO: 182776 - DNA, 25 bp, Homo sapien
gcgacccgggtgagtcagccgaaga

SEQ ID NO: 182777 - DNA, 25 bp, Homo sapien
cctagtgagacagagacgctccggc

SEQ ID NO: 182778 - DNA, 25 bp, Homo sapien
catggcaggacctacggagcccggt

SEQ ID NO: 182779 - DNA, 25 bp, Homo sapien
gaggcgcccagagtgaccctcgcga

SEQ ID NO: 182780 - DNA, 25 bp, Homo sapien
tccttgtaaatacccgctgctgcgg

SEQ ID NO: 182781 - DNA, 25 bp, Homo sapien
gccctgagcgaggaacaagccattc

SEQ ID NO: 182782 - DNA, 25 bp, Homo sapien
aagccattcggacccgaccgatgta

SEQ ID NO: 182783 - DNA, 25 bp, Homo sapien
accgatgtaaatacagccgcccgtc

SEQ ID NO: 182784 - DNA, 25 bp, Homo sapien
ttccaagtgtaaataccgcctcgcg

SEQ ID NO: 182785 - DNA, 25 bp, Homo sapien
ctcaagccatgctgctccttgtaaa

SEQ ID NO: 182786 - DNA, 25 bp, Homo sapien
tttctcctgcaagatgctgacgccc

SEQ ID NO: 182787 - DNA, 25 bp, Homo sapien
tgtccctttagatggcgcgggcacc

SEQ ID NO: 182788 - DNA, 25 bp, Homo sapien
tcccaggatgttccgacggctaaga

SEQ ID NO: 182789 - DNA, 25 bp, Homo sapien
agccagtccctagagtcctttgcgc

SEQ ID NO: 182790 - DNA, 25 bp, Homo sapien
cgcattttctgttcggtccatttta

SEQ ID NO: 182791 - DNA, 25 bp, Homo sapien
gccgggaatcccaggttcaaccaga

SEQ ID NO: 182792 - DNA, 25 bp, Homo sapien
gccgagggttcatccatgcccattt

SEQ ID NO: 182793 - DNA, 25 bp, Homo sapien
ttcctcaagagctcgaaggcgccga

SEQ ID NO: 182794 - DNA, 25 bp, Homo sapien
cacctcctgcttgggctacagacga

SEQ ID NO: 182795 - DNA, 25 bp, Homo sapien
aaagcatttttggagcgaggggcca

SEQ ID NO: 182796 - DNA, 25 bp, Homo sapien
gacccgagagacgtgaccctagcga

SEQ ID NO: 182797 - DNA, 25 bp, Homo sapien
ccatgggattcccacgggtgttgga

SEQ ID NO: 182798 - DNA, 25 bp, Homo sapien
ggcttctcggaactagctctctgca

SEQ ID NO: 182799 - DNA, 25 bp, Homo sapien
cccgaaactaccgagcagtgtctgc

SEQ ID NO: 182800 - DNA, 25 bp, Homo sapien
tcagacgcgggctcttactcaaacg

SEQ ID NO: 182801 - DNA, 25 bp, Homo sapien
ctccgtcacgtggtgcgttttgcct

SEQ ID NO: 182802 - DNA, 25 bp, Homo sapien
cccgaaaaggttgcgagtcgctggt

SEQ ID NO: 182803 - DNA, 25 bp, Homo sapien
aactgctgtaactttcgcacgccgc

SEQ ID NO: 182804 - DNA, 25 bp, Homo sapien
ccggggcagagcgaactgctgtaac

SEQ ID NO: 182805 - DNA, 25 bp, Homo sapien
tcgcgcccgcagtgcctttaaaacg

SEQ ID NO: 182806 - DNA, 25 bp, Homo sapien
cggcgagtccttccactatgcaggg

SEQ ID NO: 182807 - DNA, 25 bp, Homo sapien
gcctgctttccagagtcccggcgtt

SEQ ID NO: 182808 - DNA, 25 bp, Homo sapien
aagtagacgccacgcagcctgcttt

SEQ ID NO: 182809 - DNA, 25 bp, Homo sapien
aaacgtgcgttggaagtagacgcca

SEQ ID NO: 182810 - DNA, 25 bp, Homo sapien
cagtgcctttaaaacgtgcgttgga

SEQ ID NO: 182811 - DNA, 25 bp, Homo sapien
agacgcaatcgcaccggaggaattc

SEQ ID NO: 182812 - DNA, 25 bp, Homo sapien
tcgcttggcagcaaccgctcctggg

SEQ ID NO: 182813 - DNA, 25 bp, Homo sapien
acggagtcgcttggcagcaaccgct

SEQ ID NO: 182814 - DNA, 25 bp, Homo sapien
tgcccttaggggcacggagtcgctt

SEQ ID NO: 182815 - DNA, 25 bp, Homo sapien
ctcgggacccgcagttgcaaaggct

SEQ ID NO: 182816 - DNA, 25 bp, Homo sapien
ccggaggaattctctggtctctttg

SEQ ID NO: 182817 - DNA, 25 bp, Homo sapien
cgccgcgtgtgcagacgcaatcgca

SEQ ID NO: 182818 - DNA, 25 bp, Homo sapien
ctggtctctttgctaacctcgggac

SEQ ID NO: 182819 - DNA, 25 bp, Homo sapien
ttcacaaaacgcagcccgactggtg

SEQ ID NO: 182820 - DNA, 25 bp, Homo sapien
ctggtttccatgttcacaaaacgca

SEQ ID NO: 182821 - DNA, 25 bp, Homo sapien
ttccatgttcacaaaacgcagcccg

SEQ ID NO: 182822 - DNA, 25 bp, Homo sapien
tcgcgactccagacgcagagaagct

SEQ ID NO: 182823 - DNA, 25 bp, Homo sapien
aaaacgcagcccgactggtggaact

SEQ ID NO: 182824 - DNA, 25 bp, Homo sapien
gactggtggaactcgcgactccaga

SEQ ID NO: 182825 - DNA, 25 bp, Homo sapien
tggaactcgcgactccagacgcaga

SEQ ID NO: 182826 - DNA, 25 bp, Homo sapien
cgactccagacgcagagaagctgtg

SEQ ID NO: 182827 - DNA, 25 bp, Homo sapien
gctcggctttttcaccttccagtta

SEQ ID NO: 182828 - DNA, 25 bp, Homo sapien
aacgtgcctgtctcgcagctgtacg

SEQ ID NO: 182829 - DNA, 25 bp, Homo sapien
cggaactaaaggtaaagcgcagctc

SEQ ID NO: 182830 - DNA, 25 bp, Homo sapien
ggggcagtaactgtcaaacctcgcc

SEQ ID NO: 182831 - DNA, 25 bp, Homo sapien
gcgcagctcgaattcacttctaata

SEQ ID NO: 182832 - DNA, 25 bp, Homo sapien
gccgcttggcgccattatttaaatg

SEQ ID NO: 182833 - DNA, 25 bp, Homo sapien
cagctgtctcatgggctcggctttt

SEQ ID NO: 182834 - DNA, 25 bp, Homo sapien
cacttctaatattcggccgcggaga

SEQ ID NO: 182835 - DNA, 25 bp, Homo sapien
gaggtgtgtgtacccaccgccctgg

SEQ ID NO: 182836 - DNA, 25 bp, Homo sapien
gcgcccggaacttgcggataagttg

SEQ ID NO: 182837 - DNA, 25 bp, Homo sapien
cgagtgacgaggtgtgtgtacccac

SEQ ID NO: 182838 - DNA, 25 bp, Homo sapien
ctcccacccgagcaacggcgaagcg

SEQ ID NO: 182839 - DNA, 25 bp, Homo sapien
ccggcagccctaggagcgtcacgtg

SEQ ID NO: 182840 - DNA, 25 bp, Homo sapien
cggccctgcctttccgaggaagaga

SEQ ID NO: 182841 - DNA, 25 bp, Homo sapien
agagaccggttcagctcggctgccc

SEQ ID NO: 182842 - DNA, 25 bp, Homo sapien
tttccgaggaagagaccggttcagc

SEQ ID NO: 182843 - DNA, 25 bp, Homo sapien
acgcagaggtcgcaataccgctggg

SEQ ID NO: 182844 - DNA, 25 bp, Homo sapien
acgcgcccggcgtcgctgagggctt

SEQ ID NO: 182845 - DNA, 25 bp, Homo sapien
tgacgcagaggtcgcaataccgctg

SEQ ID NO: 182846 - DNA, 25 bp, Homo sapien
ctgcctggtgccatgcggttgggcc

SEQ ID NO: 182847 - DNA, 25 bp, Homo sapien
ggaaagagagacacctggcctgact

SEQ ID NO: 182848 - DNA, 25 bp, Homo sapien
ctggaggcagcggaacgcacgcgcc

SEQ ID NO: 182849 - DNA, 25 bp, Homo sapien
cgcgactgacgcagaggtcgcaata

SEQ ID NO: 182850 - DNA, 25 bp, Homo sapien
gactgacgcagaggtcgcaataccg

SEQ ID NO: 182851 - DNA, 25 bp, Homo sapien
tggcttctcgcattcgatcacgctg

SEQ ID NO: 182852 - DNA, 25 bp, Homo sapien
catgcagccgcgaaacctactcagg

SEQ ID NO: 182853 - DNA, 25 bp, Homo sapien
cagcacgtagacattagagaaatcc

SEQ ID NO: 182854 - DNA, 25 bp, Homo sapien
tcacgctggtgaacgtcaaaggatt

SEQ ID NO: 182855 - DNA, 25 bp, Homo sapien
cggagacctaaaataacagcacgta

SEQ ID NO: 182856 - DNA, 25 bp, Homo sapien
gcttttctgtctcgcatccgcggca

SEQ ID NO: 182857 - DNA, 25 bp, Homo sapien
tcaggctgcgccgttctaaaaggca

SEQ ID NO: 182858 - DNA, 25 bp, Homo sapien
cgcaggcagacacacgatactcaca

SEQ ID NO: 182859 - DNA, 25 bp, Homo sapien
ggtcactgaggtgctcgccgctgat

SEQ ID NO: 182860 - DNA, 25 bp, Homo sapien
atagcatcagagcagcgtggcccac

SEQ ID NO: 182861 - DNA, 25 bp, Homo sapien
gctgatgcacttggtccccgaggac

SEQ ID NO: 182862 - DNA, 25 bp, Homo sapien
acgacctccgcgtggcagtcattca

SEQ ID NO: 182863 - DNA, 25 bp, Homo sapien
tagaggaagtgcaggaacgcccgcc

SEQ ID NO: 182864 - DNA, 25 bp, Homo sapien
ctccagctgcgtgtagaggaagtgc

SEQ ID NO: 182865 - DNA, 25 bp, Homo sapien
acgacctgcgcctgccgagcatcca

SEQ ID NO: 182866 - DNA, 25 bp, Homo sapien
gcctggggacacagatagcatcaga

SEQ ID NO: 182867 - DNA, 25 bp, Homo sapien
gacgagagcctgcaggtttcctcca

SEQ ID NO: 182868 - DNA, 25 bp, Homo sapien
cgcttcgacgggtaggtacatccca

SEQ ID NO: 182869 - DNA, 25 bp, Homo sapien
cttgctcttagaacattaccgggtg

SEQ ID NO: 182870 - DNA, 25 bp, Homo sapien
gccctgtctgcgaaagctcgtcttc

SEQ ID NO: 182871 - DNA, 25 bp, Homo sapien
cgcaaaggtggtacgcttgctctta

SEQ ID NO: 182872 - DNA, 25 bp, Homo sapien
agcccgcaatggacacgcaaaggtg

SEQ ID NO: 182873 - DNA, 25 bp, Homo sapien
gcgacatccgctatctgcttggcta

SEQ ID NO: 182874 - DNA, 25 bp, Homo sapien
tctcaaccggtctgaaagcgacatc

SEQ ID NO: 182875 - DNA, 25 bp, Homo sapien
cccgacacctggagtgcattaggcg

SEQ ID NO: 182876 - DNA, 25 bp, Homo sapien
ttgactgaaccgctagactggggcc

SEQ ID NO: 182877 - DNA, 25 bp, Homo sapien
gcacctccctctttagcgaaacttg

SEQ ID NO: 182878 - DNA, 25 bp, Homo sapien
caccagatctgggagcttttcaact

SEQ ID NO: 182879 - DNA, 25 bp, Homo sapien
agggcacactctcttggcgctgatt

SEQ ID NO: 182880 - DNA, 25 bp, Homo sapien
gcgcccggctctccaaactttgaga

SEQ ID NO: 182881 - DNA, 25 bp, Homo sapien
taattgcataattccgagcgcgggt

SEQ ID NO: 182882 - DNA, 25 bp, Homo sapien
cccaagagcagctgaggtctgaccc

SEQ ID NO: 182883 - DNA, 25 bp, Homo sapien
agggcgaagttgaccgtgccaagcc

SEQ ID NO: 182884 - DNA, 25 bp, Homo sapien
cagacggaacaagcgtgctgatggt

SEQ ID NO: 182885 - DNA, 25 bp, Homo sapien
gaagttgaccgtgccaagccggccc

SEQ ID NO: 182886 - DNA, 25 bp, Homo sapien
aagccggcccgctggaagagctgca

SEQ ID NO: 182887 - DNA, 25 bp, Homo sapien
gtgctgatggtaagaggcccccaga

SEQ ID NO: 182888 - DNA, 25 bp, Homo sapien
tccggttttccggttggtgcagtgc

SEQ ID NO: 182889 - DNA, 25 bp, Homo sapien
aaacgcgcgcgcacggagagcacaa

SEQ ID NO: 182890 - DNA, 25 bp, Homo sapien
tgcggcgcccgagaccgctccacgt

SEQ ID NO: 182891 - DNA, 25 bp, Homo sapien
actgtcacaaaggtaagcgccgctc

SEQ ID NO: 182892 - DNA, 25 bp, Homo sapien
acgggccgactttgcgagcctccag

SEQ ID NO: 182893 - DNA, 25 bp, Homo sapien
ttgctgccggatccgctcgagtcac

SEQ ID NO: 182894 - DNA, 25 bp, Homo sapien
taaatgcacattcggggctgacatc

SEQ ID NO: 182895 - DNA, 25 bp, Homo sapien
cggcgaaggaggctcatctattata

SEQ ID NO: 182896 - DNA, 25 bp, Homo sapien
tccgcctcctcctttgtagcgagtt

SEQ ID NO: 182897 - DNA, 25 bp, Homo sapien
ccgcggagtttctgcatgactgtca

SEQ ID NO: 182898 - DNA, 25 bp, Homo sapien
gtccagcctgtgacttcaccagcgt

SEQ ID NO: 182899 - DNA, 25 bp, Homo sapien
cgcacactaacctgatcgccgtgga

SEQ ID NO: 182900 - DNA, 25 bp, Homo sapien
tggcaaatgctcacatcagagggcg

SEQ ID NO: 182901 - DNA, 25 bp, Homo sapien
agctctaaatgaatccgtctgccca

SEQ ID NO: 182902 - DNA, 25 bp, Homo sapien
cgcgccggcggaattcaatcaataa

SEQ ID NO: 182903 - DNA, 25 bp, Homo sapien
tgaaggctcaaccagctccgctcgg

SEQ ID NO: 182904 - DNA, 25 bp, Homo sapien
atcgccaccctcgtatacataagtc

SEQ ID NO: 182905 - DNA, 25 bp, Homo sapien
cttttggatgacttaccgcgcggtc

SEQ ID NO: 182906 - DNA, 25 bp, Homo sapien
cgcgttttaggactttgaaggctca

SEQ ID NO: 182907 - DNA, 25 bp, Homo sapien
ggagctcgacctaccttcccggaga

SEQ ID NO: 182908 - DNA, 25 bp, Homo sapien
cccatcggggctcatagcacaactg

SEQ ID NO: 182909 - DNA, 25 bp, Homo sapien
gcatttgcacagaggatcgtcgtcc

SEQ ID NO: 182910 - DNA, 25 bp, Homo sapien
ttccgccgaaagagcaaacaccaga

SEQ ID NO: 182911 - DNA, 25 bp, Homo sapien
caccagagcgatcggttagtcctta

SEQ ID NO: 182912 - DNA, 25 bp, Homo sapien
ttaactacgtctgagcgcctgcagg

SEQ ID NO: 182913 - DNA, 25 bp, Homo sapien
acatggctgctcgtcctatttcggc

SEQ ID NO: 182914 - DNA, 25 bp, Homo sapien
tccttggcttcagtcagggccacta

SEQ ID NO: 182915 - DNA, 25 bp, Homo sapien
tgggcaacttgcaccagcgatcgct

SEQ ID NO: 182916 - DNA, 25 bp, Homo sapien
ggctagcgggcaaactcccatccta

SEQ ID NO: 182917 - DNA, 25 bp, Homo sapien
tcgcgtcctgacaaagtttcccgtg

SEQ ID NO: 182918 - DNA, 25 bp, Homo sapien
gcggggattatctgtgccttagcac

SEQ ID NO: 182919 - DNA, 25 bp, Homo sapien
tcctagagctgcgtgtttgccatgc

SEQ ID NO: 182920 - DNA, 25 bp, Homo sapien
tcctcaggggtaagctttcgctcga

SEQ ID NO: 182921 - DNA, 25 bp, Homo sapien
ctcgcgattcccacccgtgtaagtt

SEQ ID NO: 182922 - DNA, 25 bp, Homo sapien
cgcgttcacgaacactacaaagtta

SEQ ID NO: 182923 - DNA, 25 bp, Homo sapien
ttgcgcttttgctatggccttcgtc

SEQ ID NO: 182924 - DNA, 25 bp, Homo sapien
aagcccttagtccttctagttgcgc

SEQ ID NO: 182925 - DNA, 25 bp, Homo sapien
acggacgacgcctatgaagccctta

SEQ ID NO: 182926 - DNA, 25 bp, Homo sapien
tcgcatggcagagtgctacggacga

SEQ ID NO: 182927 - DNA, 25 bp, Homo sapien
caggacggtactccgctgacacctt

SEQ ID NO: 182928 - DNA, 25 bp, Homo sapien
gacaaccgttgctgggtgtcccagg

SEQ ID NO: 182929 - DNA, 25 bp, Homo sapien
ctcctggtcagggaacgcagcaact

SEQ ID NO: 182930 - DNA, 25 bp, Homo sapien
tgtgccggcttatccgagtgagtga

SEQ ID NO: 182931 - DNA, 25 bp, Homo sapien
cggcgttagactcctggtcggaagt

SEQ ID NO: 182932 - DNA, 25 bp, Homo sapien
ggtctcgggcattggcactgtccac

SEQ ID NO: 182933 - DNA, 25 bp, Homo sapien
cctgaccatcaggtacggccgggtc

SEQ ID NO: 182934 - DNA, 25 bp, Homo sapien
ccatcaccttcgaggagctccggga

SEQ ID NO: 182935 - DNA, 25 bp, Homo sapien
cgctcttcgaatcggccgacgcgga

SEQ ID NO: 182936 - DNA, 25 bp, Homo sapien
agcgccatctcgctgcctgacgaga

SEQ ID NO: 182937 - DNA, 25 bp, Homo sapien
tcgtgtctgcgcgagagcgccatct

SEQ ID NO: 182938 - DNA, 25 bp, Homo sapien
atgagctgcgcactgtgctgcagtc

SEQ ID NO: 182939 - DNA, 25 bp, Homo sapien
cgcctctgagcggaacccgcctctc

SEQ ID NO: 182940 - DNA, 25 bp, Homo sapien
cgcctactggcacaaccaccgcagc

SEQ ID NO: 182941 - DNA, 25 bp, Homo sapien
tgacccgcgcctactggcacaacca

SEQ ID NO: 182942 - DNA, 25 bp, Homo sapien
gttctgcctggccacctatgcaggc

SEQ ID NO: 182943 - DNA, 25 bp, Homo sapien
ctggccacctatgcaggcctccacg

SEQ ID NO: 182944 - DNA, 25 bp, Homo sapien
ctccacgtgctgctcttcgggctgg

SEQ ID NO: 182945 - DNA, 25 bp, Homo sapien
tcggcgccagcgtcatggtggccaa

SEQ ID NO: 182946 - DNA, 25 bp, Homo sapien
tcaacttcgactgcagcttcatcgc

SEQ ID NO: 182947 - DNA, 25 bp, Homo sapien
ttctcgccttttcccgctggatgtg

SEQ ID NO: 182948 - DNA, 25 bp, Homo sapien
tttgcataaagggaggaatcgagtc

SEQ ID NO: 182949 - DNA, 25 bp, Homo sapien
gtctttcgcttgcttggcattgccc

SEQ ID NO: 182950 - DNA, 25 bp, Homo sapien
cggtttgcaaccctacgaggtcgtg

SEQ ID NO: 182951 - DNA, 25 bp, Homo sapien
tggatgtgcagctttcggaacgtgc

SEQ ID NO: 182952 - DNA, 25 bp, Homo sapien
ggcgggagtgtctacaacctaagaa

SEQ ID NO: 182953 - DNA, 25 bp, Homo sapien
gggaggtcccagcagattttgcata

SEQ ID NO: 182954 - DNA, 25 bp, Homo sapien
aaccgcctcgctgtggtctttcgct

SEQ ID NO: 182955 - DNA, 25 bp, Homo sapien
tgcagtttagcaaggtttacaccgg

SEQ ID NO: 182956 - DNA, 25 bp, Homo sapien
gagggctctcctcacacaagcgctt

SEQ ID NO: 182957 - DNA, 25 bp, Homo sapien
tccgacgctgctcaggttagaaagc

SEQ ID NO: 182958 - DNA, 25 bp, Homo sapien
gcacacggggtcctaggtctttgac

SEQ ID NO: 182959 - DNA, 25 bp, Homo sapien
tctttgacgtcgagggagatttatc

SEQ ID NO: 182960 - DNA, 25 bp, Homo sapien
actgtcactcgaggagctgccgcta

SEQ ID NO: 182961 - DNA, 25 bp, Homo sapien
cggtgtaaaccttgtctctggaggc

SEQ ID NO: 182962 - DNA, 25 bp, Homo sapien
cgtccgtttcgcattgctgggatga

SEQ ID NO: 182963 - DNA, 25 bp, Homo sapien
cactagcgacgagggaagaggaact

SEQ ID NO: 182964 - DNA, 25 bp, Homo sapien
tgtcgggtttgggtgtcttccagaa

SEQ ID NO: 182965 - DNA, 25 bp, Homo sapien
gtgcagagcgcaccatcatccagct

SEQ ID NO: 182966 - DNA, 25 bp, Homo sapien
tccatccaaagctctgctctgctgt

SEQ ID NO: 182967 - DNA, 25 bp, Homo sapien
tcttccagaaggagccgcactagcg

SEQ ID NO: 182968 - DNA, 25 bp, Homo sapien
ggtcactgcctggagccgcatgatg

SEQ ID NO: 182969 - DNA, 25 bp, Homo sapien
tgccgcctagtgctagtccgcgcgt

SEQ ID NO: 182970 - DNA, 25 bp, Homo sapien
caggcctatggtgcgggtcactgcc

SEQ ID NO: 182971 - DNA, 25 bp, Homo sapien
gccacgccggatagcgggaaacaaa

SEQ ID NO: 182972 - DNA, 25 bp, Homo sapien
caccctgagtggagctgccttctaa

SEQ ID NO: 182973 - DNA, 25 bp, Homo sapien
taggttatcatcactcgcggcccgg

SEQ ID NO: 182974 - DNA, 25 bp, Homo sapien
gcgccggcctcttaggttatcatca

SEQ ID NO: 182975 - DNA, 25 bp, Homo sapien
agcagcgtgtacttggtagtcttga

SEQ ID NO: 182976 - DNA, 25 bp, Homo sapien
gcggtggaactgctcgaacaggttc

SEQ ID NO: 182977 - DNA, 25 bp, Homo sapien
gcgcgatgaagacaaagtacacgtt

SEQ ID NO: 182978 - DNA, 25 bp, Homo sapien
ttcaccgccggcacgaagttgagca

SEQ ID NO: 182979 - DNA, 25 bp, Homo sapien
tctctgctgcaatcgagggcggtga

SEQ ID NO: 182980 - DNA, 25 bp, Homo sapien
ggagctgttgccttctcgcaccttt

SEQ ID NO: 182981 - DNA, 25 bp, Homo sapien
aggagtgtctggtctccggcctgcc

SEQ ID NO: 182982 - DNA, 25 bp, Homo sapien
tggtctccggcctgcctgtgctgtc

SEQ ID NO: 182983 - DNA, 25 bp, Homo sapien
cactggactcccgagacccttggaa

SEQ ID NO: 182984 - DNA, 25 bp, Homo sapien
tgcgcccgtggagcccgttgagcct

SEQ ID NO: 182985 - DNA, 25 bp, Homo sapien
aaggctctctgctgcaatcgagggc

SEQ ID NO: 182986 - DNA, 25 bp, Homo sapien
tctccagggcgtttgcgccgcttat

SEQ ID NO: 182987 - DNA, 25 bp, Homo sapien
tgccatgaagtcagcgtgagtacga

SEQ ID NO: 182988 - DNA, 25 bp, Homo sapien
agcgaagtcacttccgcggaggtcc

SEQ ID NO: 182989 - DNA, 25 bp, Homo sapien
ccgcctccagagtgcagttggccaa

SEQ ID NO: 182990 - DNA, 25 bp, Homo sapien
cagttggccaacttagtgcgggtcg

SEQ ID NO: 182991 - DNA, 25 bp, Homo sapien
cgccttagccgcgaagttctagttc

SEQ ID NO: 182992 - DNA, 25 bp, Homo sapien
ctgattggcccgtttgaaatgcgcc

SEQ ID NO: 182993 - DNA, 25 bp, Homo sapien
agctcacctgggctcttagcgtcgc

SEQ ID NO: 182994 - DNA, 25 bp, Homo sapien
gttctagttcttgctgccggtccta

SEQ ID NO: 182995 - DNA, 25 bp, Homo sapien
cggccctcattctgcacgacgatga

SEQ ID NO: 182996 - DNA, 25 bp, Homo sapien
tgactttcggctctccatgcggttc

SEQ ID NO: 182997 - DNA, 25 bp, Homo sapien
ctccaggccgttcgactgagcactt

SEQ ID NO: 182998 - DNA, 25 bp, Homo sapien
tccaagagccttcgtgtagaaaagc

SEQ ID NO: 182999 - DNA, 25 bp, Homo sapien
aaagctcttccgcagtgcttgggca

SEQ ID NO: 183000 - DNA, 25 bp, Homo sapien
tctctctcagggacacttactcgga

SEQ ID NO: 183001 - DNA, 25 bp, Homo sapien
actcggacctctttcggtgtaattg

SEQ ID NO: 183002 - DNA, 25 bp, Homo sapien
tccgcgtggacacataagaggctgc

SEQ ID NO: 183003 - DNA, 25 bp, Homo sapien
agataacagcagctgacgcggccga

SEQ ID NO: 183004 - DNA, 25 bp, Homo sapien
gcctggctcagacaatgcgaacaca

SEQ ID NO: 183005 - DNA, 25 bp, Homo sapien
tgcgaacacacaatcattcattata

SEQ ID NO: 183006 - DNA, 25 bp, Homo sapien
cagtgattaaagctggtggcatgca

SEQ ID NO: 183007 - DNA, 25 bp, Homo sapien
ttgccaacaaaatttacactccgtg

SEQ ID NO: 183008 - DNA, 25 bp, Homo sapien
tccgtgtcatcagcgagagataaca

SEQ ID NO: 183009 - DNA, 25 bp, Homo sapien
ccgctgcgcgctaatggtggaccgt

SEQ ID NO: 183010 - DNA, 25 bp, Homo sapien
actgggatagcagcagcgctggcta

SEQ ID NO: 183011 - DNA, 25 bp, Homo sapien
gcgagctctttcttctcatgcagtc

SEQ ID NO: 183012 - DNA, 25 bp, Homo sapien
gtcaggcatttagcggcatcgatcc

SEQ ID NO: 183013 - DNA, 25 bp, Homo sapien
gtcaggctgaaaaccctcgccgcta

SEQ ID NO: 183014 - DNA, 25 bp, Homo sapien
catttcctctgacggtggtggccac

SEQ ID NO: 183015 - DNA, 25 bp, Homo sapien
gccggcagaaaaatcaccgtcattt

SEQ ID NO: 183016 - DNA, 25 bp, Homo sapien
caattagctgctgcaatcgccggca

SEQ ID NO: 183017 - DNA, 25 bp, Homo sapien
tgcgcgcacagccacaattcaatta

SEQ ID NO: 183018 - DNA, 25 bp, Homo sapien
ctaccggagagtcatgtcaggcatt

SEQ ID NO: 183019 - DNA, 25 bp, Homo sapien
ggggtcctacagcaggtctcgattt

SEQ ID NO: 183020 - DNA, 25 bp, Homo sapien
agacccacgtcgagttcacctgtga

SEQ ID NO: 183021 - DNA, 25 bp, Homo sapien
tgtcgtcgtcctccagaagtctaga

SEQ ID NO: 183022 - DNA, 25 bp, Homo sapien
aatgccttcaagatgccagggacgc

SEQ ID NO: 183023 - DNA, 25 bp, Homo sapien
agcccacgttctggaggaagcctga

SEQ ID NO: 183024 - DNA, 25 bp, Homo sapien
cccaggtcgggtcttccgaagattg

SEQ ID NO: 183025 - DNA, 25 bp, Homo sapien
aaactctacggtgtggcgactcctg

SEQ ID NO: 183026 - DNA, 25 bp, Homo sapien
gtgcgtctcgctcggatttattaaa

SEQ ID NO: 183027 - DNA, 25 bp, Homo sapien
ccgtcttctcgtttgccagcttgtc

SEQ ID NO: 183028 - DNA, 25 bp, Homo sapien
gggctcccatgcctttcaccaaggg

SEQ ID NO: 183029 - DNA, 25 bp, Homo sapien
caagtttctcagctctccgacgggg

SEQ ID NO: 183030 - DNA, 25 bp, Homo sapien
cgtgaatttaaatcccggctgcccg

SEQ ID NO: 183031 - DNA, 25 bp, Homo sapien
accggccttacctgtgatactgagc

SEQ ID NO: 183032 - DNA, 25 bp, Homo sapien
ttcccgcgagccaaaggacttatca

SEQ ID NO: 183033 - DNA, 25 bp, Homo sapien
ccaagggcctctagagccacttttc

SEQ ID NO: 183034 - DNA, 25 bp, Homo sapien
gccagcttgtcgtactccactttga

SEQ ID NO: 183035 - DNA, 25 bp, Homo sapien
aacagctcctttgatgtgcggcggc

SEQ ID NO: 183036 - DNA, 25 bp, Homo sapien
ggcggcgaacgattcctccctctaa

SEQ ID NO: 183037 - DNA, 25 bp, Homo sapien
tgccgcgagagcagttccaaatagg

SEQ ID NO: 183038 - DNA, 25 bp, Homo sapien
tatcagtttattctgcagcggcggc

SEQ ID NO: 183039 - DNA, 25 bp, Homo sapien
cccacggtctactagcaaataatta

SEQ ID NO: 183040 - DNA, 25 bp, Homo sapien
acagcgctcctcagatcaggaatta

SEQ ID NO: 183041 - DNA, 25 bp, Homo sapien
gccctcttgtgtctaaaactatgca

SEQ ID NO: 183042 - DNA, 25 bp, Homo sapien
ctacccgctggtgactttcgcatgg

SEQ ID NO: 183043 - DNA, 25 bp, Homo sapien
gggcgtcaggcctccaccaaagaaa

SEQ ID NO: 183044 - DNA, 25 bp, Homo sapien
cagggtttcagcgtcaaggggttct

SEQ ID NO: 183045 - DNA, 25 bp, Homo sapien
caggagcgcagggtttcagcgtcaa

SEQ ID NO: 183046 - DNA, 25 bp, Homo sapien
cgcagcgattgccaggcaggtctcc

SEQ ID NO: 183047 - DNA, 25 bp, Homo sapien
ccggtaccgccgatgcgcagcgatt

SEQ ID NO: 183048 - DNA, 25 bp, Homo sapien
tgggcgaccccagcatttcctttga

SEQ ID NO: 183049 - DNA, 25 bp, Homo sapien
tcaggcctccaccaaagaaacagca

SEQ ID NO: 183050 - DNA, 25 bp, Homo sapien
ttccaggcgggactggacaacttgg

SEQ ID NO: 183051 - DNA, 25 bp, Homo sapien
tgaggctcttcatggctaactcttg

SEQ ID NO: 183052 - DNA, 25 bp, Homo sapien
tgcctcgctggggaatcaaacttcc

SEQ ID NO: 183053 - DNA, 25 bp, Homo sapien
agggcttgacgctgtctcagacccg

SEQ ID NO: 183054 - DNA, 25 bp, Homo sapien
tttcttccagaagttcggaggcttg

SEQ ID NO: 183055 - DNA, 25 bp, Homo sapien
gtagccaattgacccgctgccctgg

SEQ ID NO: 183056 - DNA, 25 bp, Homo sapien
cgcgaccaatcggaatgcgggaatg

SEQ ID NO: 183057 - DNA, 25 bp, Homo sapien
tcctctcccagctggaggaaaagtt

SEQ ID NO: 183058 - DNA, 25 bp, Homo sapien
tgccaatcgaggaactttggattta

SEQ ID NO: 183059 - DNA, 25 bp, Homo sapien
cctccgtcttttcgccgctgtgggg

SEQ ID NO: 183060 - DNA, 25 bp, Homo sapien
cggttctgactcaggggctcggccc

SEQ ID NO: 183061 - DNA, 25 bp, Homo sapien
cgccttctttcacggcgccgcaggg

SEQ ID NO: 183062 - DNA, 25 bp, Homo sapien
gagggcggctttccggagctcctcc

SEQ ID NO: 183063 - DNA, 25 bp, Homo sapien
acgcggatctgcaccgccgtcttgg

SEQ ID NO: 183064 - DNA, 25 bp, Homo sapien
ctcctggatggcgacgcggatctgc

SEQ ID NO: 183065 - DNA, 25 bp, Homo sapien
cctctgcccgaggagttgtcgcgcg

SEQ ID NO: 183066 - DNA, 25 bp, Homo sapien
cccgaggagttgtcgcgcgcagtca

SEQ ID NO: 183067 - DNA, 25 bp, Homo sapien
agcttcagtggagctgactttggcc

SEQ ID NO: 183068 - DNA, 25 bp, Homo sapien
gcacgaacttgtggctgcgcttgca

SEQ ID NO: 183069 - DNA, 25 bp, Homo sapien
cagccatgcaccaggcacgaacttg

SEQ ID NO: 183070 - DNA, 25 bp, Homo sapien
ggccgcaggaacctttgtgtgtcca

SEQ ID NO: 183071 - DNA, 25 bp, Homo sapien
cattttcacagagggtgcaggtgcc

SEQ ID NO: 183072 - DNA, 25 bp, Homo sapien
tgactttggccctggttacatggcg

SEQ ID NO: 183073 - DNA, 25 bp, Homo sapien
gaccttccagtcgttgcggatgcta

SEQ ID NO: 183074 - DNA, 25 bp, Homo sapien
ggtgccctcctgtagggcattttca

SEQ ID NO: 183075 - DNA, 25 bp, Homo sapien
tgtccaggcggcctgcttggtctcc

SEQ ID NO: 183076 - DNA, 25 bp, Homo sapien
ccaccagcctcaggcgctgggagaa

SEQ ID NO: 183077 - DNA, 25 bp, Homo sapien
cttgggaaagcggaacagcgacttc

SEQ ID NO: 183078 - DNA, 25 bp, Homo sapien
ccgaagagacgtcaaaacaggctgg

SEQ ID NO: 183079 - DNA, 25 bp, Homo sapien
agcggtcattgcctccgtaccagtc

SEQ ID NO: 183080 - DNA, 25 bp, Homo sapien
ttcccagacttggtggtgttgccgc

SEQ ID NO: 183081 - DNA, 25 bp, Homo sapien
gaacagcgacttcccagacttggtg

SEQ ID NO: 183082 - DNA, 25 bp, Homo sapien
agcgcaggttcttctggataaccga

SEQ ID NO: 183083 - DNA, 25 bp, Homo sapien
agaagcggaccttgagaggcagcca

SEQ ID NO: 183084 - DNA, 25 bp, Homo sapien
tcccagtccgagatcctgggctcgg

SEQ ID NO: 183085 - DNA, 25 bp, Homo sapien
gtgggaatccgctcccagtccgaga

SEQ ID NO: 183086 - DNA, 25 bp, Homo sapien
acactggacgtggaacctgagacta

SEQ ID NO: 183087 - DNA, 25 bp, Homo sapien
caaagcctgcgttgtagcccgctta

SEQ ID NO: 183088 - DNA, 25 bp, Homo sapien
gactccaagtagaagcggaccttga

SEQ ID NO: 183089 - DNA, 25 bp, Homo sapien
gggcagagcgtgaaaccttcaccga

SEQ ID NO: 183090 - DNA, 25 bp, Homo sapien
gggcgcggcaagactccaagtagaa

SEQ ID NO: 183091 - DNA, 25 bp, Homo sapien
cttccttgctgggagtcttgctctg

SEQ ID NO: 183092 - DNA, 25 bp, Homo sapien
ctagggacaatccacctcagtcgtc

SEQ ID NO: 183093 - DNA, 25 bp, Homo sapien
gggacagtcttaaactctagggaca

SEQ ID NO: 183094 - DNA, 25 bp, Homo sapien
accctcgactctagggacagtctta

SEQ ID NO: 183095 - DNA, 25 bp, Homo sapien
ccgctctcggatcgcaaactctgag

SEQ ID NO: 183096 - DNA, 25 bp, Homo sapien
tctctggttctcttccttgctggga

SEQ ID NO: 183097 - DNA, 25 bp, Homo sapien
aaactctgagccagagctctccgcg

SEQ ID NO: 183098 - DNA, 25 bp, Homo sapien
ctccagatgacagcgggaggccgca

SEQ ID NO: 183099 - DNA, 25 bp, Homo sapien
caccggagccgcgacgagacgccag

SEQ ID NO: 183100 - DNA, 25 bp, Homo sapien
agcggcggcgtgatggagcagacgc

SEQ ID NO: 183101 - DNA, 25 bp, Homo sapien
cgcgccttcgcggaccacgtggtgt

SEQ ID NO: 183102 - DNA, 25 bp, Homo sapien
ccttcgcggaccacgtggtgtcggc

SEQ ID NO: 183103 - DNA, 25 bp, Homo sapien
cggtgcgcacgtcggtgccactgca

SEQ ID NO: 183104 - DNA, 25 bp, Homo sapien
ctggccggtacggacgccagccgcc

SEQ ID NO: 183105 - DNA, 25 bp, Homo sapien
acgagacgccagcgctggccggtac

SEQ ID NO: 183106 - DNA, 25 bp, Homo sapien
cctggtcggcctgctcgcgtagctg

SEQ ID NO: 183107 - DNA, 25 bp, Homo sapien
ggactggcgtgtcgtcctgaccctt

SEQ ID NO: 183108 - DNA, 25 bp, Homo sapien
aggtccacctggacagcatggagtc

SEQ ID NO: 183109 - DNA, 25 bp, Homo sapien
ctggacagcatggagtccaacactg

SEQ ID NO: 183110 - DNA, 25 bp, Homo sapien
tggagtccaacactgagtcccggcc

SEQ ID NO: 183111 - DNA, 25 bp, Homo sapien
gaacgagcgccagccgcgaagcaca

SEQ ID NO: 183112 - DNA, 25 bp, Homo sapien
agccgtgcagaacgagcgccagccg

SEQ ID NO: 183113 - DNA, 25 bp, Homo sapien
tggcgtgtcgtcctgacccttcctg

SEQ ID NO: 183114 - DNA, 25 bp, Homo sapien
ccgcgaagcacagcccaggtccacc

SEQ ID NO: 183115 - DNA, 25 bp, Homo sapien
tagctgtcgctttccggccaacaca

SEQ ID NO: 183116 - DNA, 25 bp, Homo sapien
ctctgagtttgcgaccgtagctgtc

SEQ ID NO: 183117 - DNA, 25 bp, Homo sapien
gcagggaactcagctttagattctc

SEQ ID NO: 183118 - DNA, 25 bp, Homo sapien
ttcttcaccttacggcagagcaggg

SEQ ID NO: 183119 - DNA, 25 bp, Homo sapien
ccactggagagtacagcgtgcgctt

SEQ ID NO: 183120 - DNA, 25 bp, Homo sapien
cgggctgtcctgtactctctcaaca

SEQ ID NO: 183121 - DNA, 25 bp, Homo sapien
tcagattctggcgtatccgtgctcc

SEQ ID NO: 183122 - DNA, 25 bp, Homo sapien
cggcccgaccggagccaaatagcga

SEQ ID NO: 183123 - DNA, 25 bp, Homo sapien
tcacagccagagcttgcgcaggccg

SEQ ID NO: 183124 - DNA, 25 bp, Homo sapien
cccagctgaccctttgcaggaggct

SEQ ID NO: 183125 - DNA, 25 bp, Homo sapien
cggcggcactgatcccgcccggctg

SEQ ID NO: 183126 - DNA, 25 bp, Homo sapien
accctttgcaggaggctggtggtca

SEQ ID NO: 183127 - DNA, 25 bp, Homo sapien
taccaagcgtggtaactggcctggc

SEQ ID NO: 183128 - DNA, 25 bp, Homo sapien
tgcagtgcgtgtaccaagcgtggta

SEQ ID NO: 183129 - DNA, 25 bp, Homo sapien
ccttcctggtgcagtgcgtgtacca

SEQ ID NO: 183130 - DNA, 25 bp, Homo sapien
gctggtggtcacagccagagcttgc

SEQ ID NO: 183131 - DNA, 25 bp, Homo sapien
aacagtctggccctccaggggacgc

SEQ ID NO: 183132 - DNA, 25 bp, Homo sapien
cgcgggccgctacaatacggattcg

SEQ ID NO: 183133 - DNA, 25 bp, Homo sapien
tcgtgctgagacagctccgagctgc

SEQ ID NO: 183134 - DNA, 25 bp, Homo sapien
taccgcgggcaacgaatgatgaatg

SEQ ID NO: 183135 - DNA, 25 bp, Homo sapien
ctcgctccggcttaaagcggtcatc

SEQ ID NO: 183136 - DNA, 25 bp, Homo sapien
ggtcctagtgcgaacacctcgcggg

SEQ ID NO: 183137 - DNA, 25 bp, Homo sapien
tcagccaagacacccggtcctagtg

SEQ ID NO: 183138 - DNA, 25 bp, Homo sapien
caggtcgcagcagactcagccaaga

SEQ ID NO: 183139 - DNA, 25 bp, Homo sapien
ggcgcagtcaccttcaggaggaagc

SEQ ID NO: 183140 - DNA, 25 bp, Homo sapien
agcctcaaggttatcccgctgcggg

SEQ ID NO: 183141 - DNA, 25 bp, Homo sapien
tgctgtgcaaggagccactgcctca

SEQ ID NO: 183142 - DNA, 25 bp, Homo sapien
ctacgctgcaaagacgaagagatcc

SEQ ID NO: 183143 - DNA, 25 bp, Homo sapien
gactgatggcgtagcctcctgcacc

SEQ ID NO: 183144 - DNA, 25 bp, Homo sapien
cggacccgcctgatctggaaggaac

SEQ ID NO: 183145 - DNA, 25 bp, Homo sapien
tggaatcaatcacgagggaccgaga

SEQ ID NO: 183146 - DNA, 25 bp, Homo sapien
tagaatcaggggacacgcacagctt

SEQ ID NO: 183147 - DNA, 25 bp, Homo sapien
gcgaaaacactctctggcacccgtg

SEQ ID NO: 183148 - DNA, 25 bp, Homo sapien
cagcctggcgagtactcacggcgac

SEQ ID NO: 183149 - DNA, 25 bp, Homo sapien
gcaggttagcgctatctcgggcacc

SEQ ID NO: 183150 - DNA, 25 bp, Homo sapien
tgacacgatggcacgtggcccgctc

SEQ ID NO: 183151 - DNA, 25 bp, Homo sapien
ctctcccggggaagcagttacacct

SEQ ID NO: 183152 - DNA, 25 bp, Homo sapien
gcagttacacctgttctccggggct

SEQ ID NO: 183153 - DNA, 25 bp, Homo sapien
gaaagacgctctgggcccgatctat

SEQ ID NO: 183154 - DNA, 25 bp, Homo sapien
agtgaagcctgtccagcctaggagg

SEQ ID NO: 183155 - DNA, 25 bp, Homo sapien
agcgcggccacatggctccactccg

SEQ ID NO: 183156 - DNA, 25 bp, Homo sapien
cgggctgaccgaccagccggcagtt

SEQ ID NO: 183157 - DNA, 25 bp, Homo sapien
gctgaccgaccagccggcagttggc

SEQ ID NO: 183158 - DNA, 25 bp, Homo sapien
gggtggcccaaggttgccccagcca

SEQ ID NO: 183159 - DNA, 25 bp, Homo sapien
cagccagccggtgctccgacagccc

SEQ ID NO: 183160 - DNA, 25 bp, Homo sapien
tgcctttgcactgtgcgctctgcgc

SEQ ID NO: 183161 - DNA, 25 bp, Homo sapien
agtcccggagcgtcactgcgcgggc

SEQ ID NO: 183162 - DNA, 25 bp, Homo sapien
accagccggcagttggcaccgggtg

SEQ ID NO: 183163 - DNA, 25 bp, Homo sapien
gccatggtccggctgccgtgcagac

SEQ ID NO: 183164 - DNA, 25 bp, Homo sapien
tgtccgccagcttgaccacgaggct

SEQ ID NO: 183165 - DNA, 25 bp, Homo sapien
caggtggccggccatctgctgcatc

SEQ ID NO: 183166 - DNA, 25 bp, Homo sapien
tacctaccgccgtggtgtaggcgcc

SEQ ID NO: 183167 - DNA, 25 bp, Homo sapien
cacgtgttgcatctgggccgccact

SEQ ID NO: 183168 - DNA, 25 bp, Homo sapien
aaaggccgccacgtgttgcatctgg

SEQ ID NO: 183169 - DNA, 25 bp, Homo sapien
caacagaggcgcagctaccaggcta

SEQ ID NO: 183170 - DNA, 25 bp, Homo sapien
tttcgcggggcaccgagcacactcg

SEQ ID NO: 183171 - DNA, 25 bp, Homo sapien
cccacgaagagcttgatggcgtcgt

SEQ ID NO: 183172 - DNA, 25 bp, Homo sapien
cttcgtcatgcgtgatggtgtctgc

SEQ ID NO: 183173 - DNA, 25 bp, Homo sapien
ggaagcagcttcgtcatgcgtgatg

SEQ ID NO: 183174 - DNA, 25 bp, Homo sapien
aaccggaccctcgaatgccctgtgt

SEQ ID NO: 183175 - DNA, 25 bp, Homo sapien
tttgcataatgaggaagcagccgcc

SEQ ID NO: 183176 - DNA, 25 bp, Homo sapien
ggccgccgagtctacgcaaatgatt

SEQ ID NO: 183177 - DNA, 25 bp, Homo sapien
gggtttagcccgctcatgccgacgc

SEQ ID NO: 183178 - DNA, 25 bp, Homo sapien
ggtccttcagcaccgtcagctcgta

SEQ ID NO: 183179 - DNA, 25 bp, Homo sapien
tcctccgtgcgatttgggaagagca

SEQ ID NO: 183180 - DNA, 25 bp, Homo sapien
cagtttccagaaagctcctccgtgc

SEQ ID NO: 183181 - DNA, 25 bp, Homo sapien
gccctggtccctaggaaactgcagc

SEQ ID NO: 183182 - DNA, 25 bp, Homo sapien
tacccagttcttcagcagcgctgtg

SEQ ID NO: 183183 - DNA, 25 bp, Homo sapien
agcacggtttgaatggttgaaaata

SEQ ID NO: 183184 - DNA, 25 bp, Homo sapien
tggctgctggcactacccagttctt

SEQ ID NO: 183185 - DNA, 25 bp, Homo sapien
gctttcggtgctgaccgcttgttga

SEQ ID NO: 183186 - DNA, 25 bp, Homo sapien
ccgcttgttgatagaggtgtgctcc

SEQ ID NO: 183187 - DNA, 25 bp, Homo sapien
cgggacaagtccgactcacctgtga

SEQ ID NO: 183188 - DNA, 25 bp, Homo sapien
tggaactagacagctcacccgactc

SEQ ID NO: 183189 - DNA, 25 bp, Homo sapien
gggcccagtagagcagtaaataacc

SEQ ID NO: 183190 - DNA, 25 bp, Homo sapien
cgccagactgttcacgggcccagta

SEQ ID NO: 183191 - DNA, 25 bp, Homo sapien
tcctgctacgtgcagcggattgtgc

SEQ ID NO: 183192 - DNA, 25 bp, Homo sapien
cttatcggcgaatcacgtgaccaga

SEQ ID NO: 183193 - DNA, 25 bp, Homo sapien
ccgaaaagcaggtcacgatagcgct

SEQ ID NO: 183194 - DNA, 25 bp, Homo sapien
ccgagctgacatcgtactggaattg

SEQ ID NO: 183195 - DNA, 25 bp, Homo sapien
gaggtcaacgaggtcatccaggtga

SEQ ID NO: 183196 - DNA, 25 bp, Homo sapien
caggaaagcaattcccgctcggctc

SEQ ID NO: 183197 - DNA, 25 bp, Homo sapien
ggccgagcagattctacaacacatg

SEQ ID NO: 183198 - DNA, 25 bp, Homo sapien
ccctttgttggctcagtagcgatag

SEQ ID NO: 183199 - DNA, 25 bp, Homo sapien
ggactgttttctctcggaggccgga

SEQ ID NO: 183200 - DNA, 25 bp, Homo sapien
ggcagcggatcgaaccaggaaagca

SEQ ID NO: 183201 - DNA, 25 bp, Homo sapien
cggacgagggctacaactacgagtt

SEQ ID NO: 183202 - DNA, 25 bp, Homo sapien
acgacgagccggacgatgataccct

SEQ ID NO: 183203 - DNA, 25 bp, Homo sapien
tcctttcaggtcttctctagctcca

SEQ ID NO: 183204 - DNA, 25 bp, Homo sapien
gtaatgccttaaatccgtcctcagt

SEQ ID NO: 183205 - DNA, 25 bp, Homo sapien
cgctggttttttccagggcaggatt

SEQ ID NO: 183206 - DNA, 25 bp, Homo sapien
caggtcttctctagctccaaaagga

SEQ ID NO: 183207 - DNA, 25 bp, Homo sapien
cggccggcttagagttccctgcttc

SEQ ID NO: 183208 - DNA, 25 bp, Homo sapien
ctgtctttcgtaatgccttaaatcc

SEQ ID NO: 183209 - DNA, 25 bp, Homo sapien
tagctccaaaaggacctcccaagga

SEQ ID NO: 183210 - DNA, 25 bp, Homo sapien
cggcttagagttccctgcttccctg

SEQ ID NO: 183211 - DNA, 25 bp, Homo sapien
agaccatgtacagaccacggcgagg

SEQ ID NO: 183212 - DNA, 25 bp, Homo sapien
cttctcgggataaaggcagcgagtg

SEQ ID NO: 183213 - DNA, 25 bp, Homo sapien
ctctttcagaggtaagccttctgtg

SEQ ID NO: 183214 - DNA, 25 bp, Homo sapien
gccttctgtggagcagaccctaatc

SEQ ID NO: 183215 - DNA, 25 bp, Homo sapien
attccttaggtcactcggcgattta

SEQ ID NO: 183216 - DNA, 25 bp, Homo sapien
ctcgtcgtctgggaaaccgccgact

SEQ ID NO: 183217 - DNA, 25 bp, Homo sapien
agattctctttagttgcccggccgc

SEQ ID NO: 183218 - DNA, 25 bp, Homo sapien
tggcttttgtcccatgcagcggttc

SEQ ID NO: 183219 - DNA, 25 bp, Homo sapien
tttgctagacttgtcctcttccagg

SEQ ID NO: 183220 - DNA, 25 bp, Homo sapien
gacgtccgacacttctcgccaaggg

SEQ ID NO: 183221 - DNA, 25 bp, Homo sapien
ctgagaagccctgtttctgcgcggc

SEQ ID NO: 183222 - DNA, 25 bp, Homo sapien
cgacacaagcgctacgtcacaaggg

SEQ ID NO: 183223 - DNA, 25 bp, Homo sapien
taatattcgaaccagtgggtgtccc

SEQ ID NO: 183224 - DNA, 25 bp, Homo sapien
taggctcacagaatagcggcgctgc

SEQ ID NO: 183225 - DNA, 25 bp, Homo sapien
cgcttctgagaggaataggctcaca

SEQ ID NO: 183226 - DNA, 25 bp, Homo sapien
gaagcggacaaacctcgcgttaata

SEQ ID NO: 183227 - DNA, 25 bp, Homo sapien
gtgcacagaactaaggccggcctgc

SEQ ID NO: 183228 - DNA, 25 bp, Homo sapien
accggacctcctggcccgaaggctg

SEQ ID NO: 183229 - DNA, 25 bp, Homo sapien
cctgggaggtccttgaattccgcgg

SEQ ID NO: 183230 - DNA, 25 bp, Homo sapien
aggtccttgaattccgcgggatttg

SEQ ID NO: 183231 - DNA, 25 bp, Homo sapien
ccaaaaacgccatccacttaacaga

SEQ ID NO: 183232 - DNA, 25 bp, Homo sapien
atccacttaacagatccgtgctagg

SEQ ID NO: 183233 - DNA, 25 bp, Homo sapien
gccctggctcagtccttccaccaaa

SEQ ID NO: 183234 - DNA, 25 bp, Homo sapien
cacttaacagatccgtgctaggagg

SEQ ID NO: 183235 - DNA, 25 bp, Homo sapien
agtcgggcgggatcgctattgtttt

SEQ ID NO: 183236 - DNA, 25 bp, Homo sapien
aggagcaggaggatccgcttctccg

SEQ ID NO: 183237 - DNA, 25 bp, Homo sapien
gccctatatagaggctccaggcccg

SEQ ID NO: 183238 - DNA, 25 bp, Homo sapien
tcggtttcctctgaggccctatata

SEQ ID NO: 183239 - DNA, 25 bp, Homo sapien
gaggcctttcggtttcctctgaggc

SEQ ID NO: 183240 - DNA, 25 bp, Homo sapien
tgtttttggcgagcacataaatccc

SEQ ID NO: 183241 - DNA, 25 bp, Homo sapien
cgctattgtttttggcgagcacata

SEQ ID NO: 183242 - DNA, 25 bp, Homo sapien
tccggggtttccctgacgccagcag

SEQ ID NO: 183243 - DNA, 25 bp, Homo sapien
aggaccctggtagcctcggcacctt

SEQ ID NO: 183244 - DNA, 25 bp, Homo sapien
ctcggcaccttcagcccgggttagg

SEQ ID NO: 183245 - DNA, 25 bp, Homo sapien
agagcgaggccgtgctgattctgaa

SEQ ID NO: 183246 - DNA, 25 bp, Homo sapien
gccaggatttgctggtcctccgacg

SEQ ID NO: 183247 - DNA, 25 bp, Homo sapien
caccagccgctgaggtccaagcaag

SEQ ID NO: 183248 - DNA, 25 bp, Homo sapien
cggcctggttgagacattcactgga

SEQ ID NO: 183249 - DNA, 25 bp, Homo sapien
ccaggacggcctggttgagacattc

SEQ ID NO: 183250 - DNA, 25 bp, Homo sapien
ccgctgaggtccaagcaagtggacg

SEQ ID NO: 183251 - DNA, 25 bp, Homo sapien
acggcactccctataccggcgggag

SEQ ID NO: 183252 - DNA, 25 bp, Homo sapien
ggagacacggcactccctataccgg

SEQ ID NO: 183253 - DNA, 25 bp, Homo sapien
ctcctagggcgggagacacggcact

SEQ ID NO: 183254 - DNA, 25 bp, Homo sapien
agctgcctccttagcaacgggactc

SEQ ID NO: 183255 - DNA, 25 bp, Homo sapien
agggcccgctgagctgcctccttag

SEQ ID NO: 183256 - DNA, 25 bp, Homo sapien
aaggaagcaccaacgcctggccgca

SEQ ID NO: 183257 - DNA, 25 bp, Homo sapien
gagccgcgaggacttggtttttcca

SEQ ID NO: 183258 - DNA, 25 bp, Homo sapien
aagcaccaacgcctggccgcagggg

SEQ ID NO: 183259 - DNA, 25 bp, Homo sapien
ggcccaggttagaccctcgctagac

SEQ ID NO: 183260 - DNA, 25 bp, Homo sapien
cggcggcagcttgtccatggcgcca

SEQ ID NO: 183261 - DNA, 25 bp, Homo sapien
ctcaggcgcccatgcttgggcaggc

SEQ ID NO: 183262 - DNA, 25 bp, Homo sapien
ggaggatcctagtcccgctccgagt

SEQ ID NO: 183263 - DNA, 25 bp, Homo sapien
tcagggaaccgctccggagtgcaga

SEQ ID NO: 183264 - DNA, 25 bp, Homo sapien
tttgtggctggccacccgcgagctc

SEQ ID NO: 183265 - DNA, 25 bp, Homo sapien
tagaccctcgctagaccttcggggc

SEQ ID NO: 183266 - DNA, 25 bp, Homo sapien
ggaatattcatgaagccgccgcagc

SEQ ID NO: 183267 - DNA, 25 bp, Homo sapien
gcccattggcttctgctgaacggga

SEQ ID NO: 183268 - DNA, 25 bp, Homo sapien
gcaaccatctcggtgcccaaggtca

SEQ ID NO: 183269 - DNA, 25 bp, Homo sapien
ccaaggtcaagagagacaccgaagc

SEQ ID NO: 183270 - DNA, 25 bp, Homo sapien
ccgaagcccggaaatgccctaagcg

SEQ ID NO: 183271 - DNA, 25 bp, Homo sapien
cctaagcgggaatcttcggagcctg

SEQ ID NO: 183272 - DNA, 25 bp, Homo sapien
gcgctccgcttactgattggttcga

SEQ ID NO: 183273 - DNA, 25 bp, Homo sapien
gcccttgagcctcgggcttaccgga

SEQ ID NO: 183274 - DNA, 25 bp, Homo sapien
gcccttcaacgtagaagcaaccatc

SEQ ID NO: 183275 - DNA, 25 bp, Homo sapien
cacgagggagtctcccggtatcccg

SEQ ID NO: 183276 - DNA, 25 bp, Homo sapien
ctctgctctttacaggagaggctga

SEQ ID NO: 183277 - DNA, 25 bp, Homo sapien
tgtgactgtcgcttcctctccatct

SEQ ID NO: 183278 - DNA, 25 bp, Homo sapien
ccgccacgctaaccggaagttgtga

SEQ ID NO: 183279 - DNA, 25 bp, Homo sapien
cccgacttttacctcttctgtctgg

SEQ ID NO: 183280 - DNA, 25 bp, Homo sapien
ggtatcccggtgctgaggtcccaaa

SEQ ID NO: 183281 - DNA, 25 bp, Homo sapien
ctcttctgtctggtaggtggcccac

SEQ ID NO: 183282 - DNA, 25 bp, Homo sapien
aggtcccaaagactccgagagcctc

SEQ ID NO: 183283 - DNA, 25 bp, Homo sapien
cccaacagcgaatgggccggggcca

SEQ ID NO: 183284 - DNA, 25 bp, Homo sapien
gaccgccgcaaggatcgcgagaaga

SEQ ID NO: 183285 - DNA, 25 bp, Homo sapien
cctagcgcgaggtaggtcacgtgcc

SEQ ID NO: 183286 - DNA, 25 bp, Homo sapien
tgggcagcgacgaacccgacatcct

SEQ ID NO: 183287 - DNA, 25 bp, Homo sapien
cgcttaccgttctgagcggcgcctg

SEQ ID NO: 183288 - DNA, 25 bp, Homo sapien
cggataggagcctccggtcctcaca

SEQ ID NO: 183289 - DNA, 25 bp, Homo sapien
gagcctccgagtgggcaacacctcg

SEQ ID NO: 183290 - DNA, 25 bp, Homo sapien
ccctgcagaggctgattggcctagc

SEQ ID NO: 183291 - DNA, 25 bp, Homo sapien
gggcagatctgtcccgtgttgaagc

SEQ ID NO: 183292 - DNA, 25 bp, Homo sapien
tgcagaggaaaacgcccagctccgg

SEQ ID NO: 183293 - DNA, 25 bp, Homo sapien
ttaacgaagccaccggccggcgctg

SEQ ID NO: 183294 - DNA, 25 bp, Homo sapien
tcccgtgttgaagcttaacgaagcc

SEQ ID NO: 183295 - DNA, 25 bp, Homo sapien
tcgcacaggagtcccgggaaccgcg

SEQ ID NO: 183296 - DNA, 25 bp, Homo sapien
tggatcccgcggaggtccgcacgtt

SEQ ID NO: 183297 - DNA, 25 bp, Homo sapien
ttccgggcctcaggcggattctccg

SEQ ID NO: 183298 - DNA, 25 bp, Homo sapien
ttgaagcttaacgaagccaccggcc

SEQ ID NO: 183299 - DNA, 25 bp, Homo sapien
aggtcccagcgcgtgagccaaagtc

SEQ ID NO: 183300 - DNA, 25 bp, Homo sapien
ccacggctcagttcacgttccgaaa

SEQ ID NO: 183301 - DNA, 25 bp, Homo sapien
ttcgctctgtccagtccagatcggc

SEQ ID NO: 183302 - DNA, 25 bp, Homo sapien
ctcagttcacgttccgaaaggtccg

SEQ ID NO: 183303 - DNA, 25 bp, Homo sapien
tcagcccggacccagaacgtccgtg

SEQ ID NO: 183304 - DNA, 25 bp, Homo sapien
agatcggccgggtccgtgttccgct

SEQ ID NO: 183305 - DNA, 25 bp, Homo sapien
gggattcgctctgtccagtccagat

SEQ ID NO: 183306 - DNA, 25 bp, Homo sapien
cgggcgctggctcccttaaaggccg

SEQ ID NO: 183307 - DNA, 25 bp, Homo sapien
acccattcggctttggccaggtgcc

SEQ ID NO: 183308 - DNA, 25 bp, Homo sapien
cacagtctgtacagcgagggcaccc

SEQ ID NO: 183309 - DNA, 25 bp, Homo sapien
gcgcccttcgtcagccagtacgaga

SEQ ID NO: 183310 - DNA, 25 bp, Homo sapien
gacctcagcgctccgagagtagctc

SEQ ID NO: 183311 - DNA, 25 bp, Homo sapien
gcttgctcaactcgggctcagagta

SEQ ID NO: 183312 - DNA, 25 bp, Homo sapien
cgggcaggtgtacagcttgctcaac

SEQ ID NO: 183313 - DNA, 25 bp, Homo sapien
tcaccatggctctggcccgaggcag

SEQ ID NO: 183314 - DNA, 25 bp, Homo sapien
gccgctactcgcacagtctgtacag

SEQ ID NO: 183315 - DNA, 25 bp, Homo sapien
ctactgggtgtgatcggcgttcctc

SEQ ID NO: 183316 - DNA, 25 bp, Homo sapien
ccggccgactcctcggaggcagaga

SEQ ID NO: 183317 - DNA, 25 bp, Homo sapien
agcagcccttctgcgagcccagaaa

SEQ ID NO: 183318 - DNA, 25 bp, Homo sapien
gcccagaaagccgaagctcgactgc

SEQ ID NO: 183319 - DNA, 25 bp, Homo sapien
gctcgactgctggaagcggtcaaaa

SEQ ID NO: 183320 - DNA, 25 bp, Homo sapien
gcggtcaaaatcacccaggggcagc

SEQ ID NO: 183321 - DNA, 25 bp, Homo sapien
gcatggcttttgacaggagacacgc

SEQ ID NO: 183322 - DNA, 25 bp, Homo sapien
cagacctgccgagcatggcttttga

SEQ ID NO: 183323 - DNA, 25 bp, Homo sapien
ccgctgcaaagagtcggccgacttc

SEQ ID NO: 183324 - DNA, 25 bp, Homo sapien
ccgacttctggtgctttgagtgcga

SEQ ID NO: 183325 - DNA, 25 bp, Homo sapien
gccaagtgcttcgaggcacaccagt

SEQ ID NO: 183326 - DNA, 25 bp, Homo sapien
gcacaccagtggttcctcaagcacg

SEQ ID NO: 183327 - DNA, 25 bp, Homo sapien
gaagctgctgccttgtctgcacacg

SEQ ID NO: 183328 - DNA, 25 bp, Homo sapien
cggaagccaagtgcccgaagctgct

SEQ ID NO: 183329 - DNA, 25 bp, Homo sapien
gagttccagtttctgcgctgccagc

SEQ ID NO: 183330 - DNA, 25 bp, Homo sapien
aacgtctttttcgagagtctgcagc

SEQ ID NO: 183331 - DNA, 25 bp, Homo sapien
ctggcctcccaactgggtgggattc

SEQ ID NO: 183332 - DNA, 25 bp, Homo sapien
agggtcccggaacaagcactggccg

SEQ ID NO: 183333 - DNA, 25 bp, Homo sapien
gggacgagatccgtggactcctcca

SEQ ID NO: 183334 - DNA, 25 bp, Homo sapien
atcgggccaccaaggggacgagatc

SEQ ID NO: 183335 - DNA, 25 bp, Homo sapien
ccagtataaagcagaatcgggccac

SEQ ID NO: 183336 - DNA, 25 bp, Homo sapien
acaggcacgcacacgagcgcgcaaa

SEQ ID NO: 183337 - DNA, 25 bp, Homo sapien
ccgtacccagagtgccagcgggaag

SEQ ID NO: 183338 - DNA, 25 bp, Homo sapien
cagagcgtgagtcccaggcagaccc

SEQ ID NO: 183339 - DNA, 25 bp, Homo sapien
cgcaccgatggcttcgacgagttca

SEQ ID NO: 183340 - DNA, 25 bp, Homo sapien
gcgctccttgacagcagccacagtg

SEQ ID NO: 183341 - DNA, 25 bp, Homo sapien
aggatgttccaagccgctgtgctgc

SEQ ID NO: 183342 - DNA, 25 bp, Homo sapien
gacatgcacggtttcctgcgccagg

SEQ ID NO: 183343 - DNA, 25 bp, Homo sapien
ccacagtgagctcaagtgcgacatc

SEQ ID NO: 183344 - DNA, 25 bp, Homo sapien
gctgcaggagcaggatagtgccttt

SEQ ID NO: 183345 - DNA, 25 bp, Homo sapien
ggatgaagtgctacgcctcggacca

SEQ ID NO: 183346 - DNA, 25 bp, Homo sapien
gtaccagcgcgactacgaggagatg

SEQ ID NO: 183347 - DNA, 25 bp, Homo sapien
tgcctcatacatcgcgcgaggaagc

SEQ ID NO: 183348 - DNA, 25 bp, Homo sapien
ctggtgcctcatacatcgcgcgagg

SEQ ID NO: 183349 - DNA, 25 bp, Homo sapien
tggtgcctcatacatcgcgcgagga

SEQ ID NO: 183350 - DNA, 25 bp, Homo sapien
gtgcctcatacatcgcgcgaggaag

SEQ ID NO: 183351 - DNA, 25 bp, Homo sapien
gcctcatacatcgcgcgaggaagcc

SEQ ID NO: 183352 - DNA, 25 bp, Homo sapien
cctcatacatcgcgcgaggaagcca

SEQ ID NO: 183353 - DNA, 25 bp, Homo sapien
cctggtgcctcatacatcgcgcgag

SEQ ID NO: 183354 - DNA, 25 bp, Homo sapien
ggtgcctcatacatcgcgcgaggaa

SEQ ID NO: 183355 - DNA, 25 bp, Homo sapien
actgaggacggatttaaggcattac

SEQ ID NO: 183356 - DNA, 25 bp, Homo sapien
cagggaagcagggaactctaagccg

SEQ ID NO: 183357 - DNA, 25 bp, Homo sapien
tggagctagagaagacctgaaagga

SEQ ID NO: 183358 - DNA, 25 bp, Homo sapien
ccttttggagctagagaagacctga

SEQ ID NO: 183359 - DNA, 25 bp, Homo sapien
gaggtccttttggagctagagaaga

SEQ ID NO: 183360 - DNA, 25 bp, Homo sapien
tccttgggaggtccttttggagcta

SEQ ID NO: 183361 - DNA, 25 bp, Homo sapien
cggatttaaggcattacgaaagaca

SEQ ID NO: 183362 - DNA, 25 bp, Homo sapien
gaagcagggaactctaagccggccg

SEQ ID NO: 183363 - DNA, 25 bp, Homo sapien
tctgaactggggctgagcaagatgc

SEQ ID NO: 183364 - DNA, 25 bp, Homo sapien
gtgtgagcgcaccagtctgttcata

SEQ ID NO: 183365 - DNA, 25 bp, Homo sapien
cctttcctggttatggccggtagct

SEQ ID NO: 183366 - DNA, 25 bp, Homo sapien
cggggtattgatctccacggaagcc

SEQ ID NO: 183367 - DNA, 25 bp, Homo sapien
tgctcaacactcaaatcggggtatt

SEQ ID NO: 183368 - DNA, 25 bp, Homo sapien
ttagacgctgcgctcttagcctgtc

SEQ ID NO: 183369 - DNA, 25 bp, Homo sapien
agcaagatgcgatggtctcagcccg

SEQ ID NO: 183370 - DNA, 25 bp, Homo sapien
gctagggacccaatcctggctgtcc

SEQ ID NO: 183371 - DNA, 25 bp, Homo sapien
gttttccaccaagaaggagctccca

SEQ ID NO: 183372 - DNA, 25 bp, Homo sapien
cgtgcttcgtacctcgagtccgaga

SEQ ID NO: 183373 - DNA, 25 bp, Homo sapien
ccctgaccctatggagaagcgcatc

SEQ ID NO: 183374 - DNA, 25 bp, Homo sapien
gctcccatcgctgctggtcatagtg

SEQ ID NO: 183375 - DNA, 25 bp, Homo sapien
cctgccacgtgcaagtggtgttttc

SEQ ID NO: 183376 - DNA, 25 bp, Homo sapien
gggtaccaactactccgtgtgcctg

SEQ ID NO: 183377 - DNA, 25 bp, Homo sapien
tgcgcctactctatctgtgtccagc

SEQ ID NO: 183378 - DNA, 25 bp, Homo sapien
catctgctggctaaacacccgggca

SEQ ID NO: 183379 - DNA, 25 bp, Homo sapien
aacgcgggctcaagcccagcgggta

SEQ ID NO: 183380 - DNA, 25 bp, Homo sapien
caggcagagatgtgcaggatgctcc

SEQ ID NO: 183381 - DNA, 25 bp, Homo sapien
tccacgccagctctcgagccgcgcg

SEQ ID NO: 183382 - DNA, 25 bp, Homo sapien
tcacgggcacagagccacgtgaagg

SEQ ID NO: 183383 - DNA, 25 bp, Homo sapien
aagtctcccggtgcgggagcctaca

SEQ ID NO: 183384 - DNA, 25 bp, Homo sapien
cccgggacacagtctgcagcagcag

SEQ ID NO: 183385 - DNA, 25 bp, Homo sapien
acgcaagaagtctcccggtgcggga

SEQ ID NO: 183386 - DNA, 25 bp, Homo sapien
tcacctgggaggagacgcaagaagt

SEQ ID NO: 183387 - DNA, 25 bp, Homo sapien
tgctcaagggtacgccgctgagccg

SEQ ID NO: 183388 - DNA, 25 bp, Homo sapien
aaccacaaccgcttgcacacattgg

SEQ ID NO: 183389 - DNA, 25 bp, Homo sapien
cccatgtgctcaagggtacgccgct

SEQ ID NO: 183390 - DNA, 25 bp, Homo sapien
tcccggagcaggacaacatcgcctg

SEQ ID NO: 183391 - DNA, 25 bp, Homo sapien
acatgggccctgaccacggccgtgt

SEQ ID NO: 183392 - DNA, 25 bp, Homo sapien
tgtggctcaagacatgggccctgac

SEQ ID NO: 183393 - DNA, 25 bp, Homo sapien
cttgcacacattggccgagggcacc

SEQ ID NO: 183394 - DNA, 25 bp, Homo sapien
gcacctgcggcatcgtgtggctcaa

SEQ ID NO: 183395 - DNA, 25 bp, Homo sapien
tatcgccgatcatctcgggagattg

SEQ ID NO: 183396 - DNA, 25 bp, Homo sapien
gagattgaggccctgactgtcacca

SEQ ID NO: 183397 - DNA, 25 bp, Homo sapien
tcatctcgggagattgaggccctga

SEQ ID NO: 183398 - DNA, 25 bp, Homo sapien
tctccgctcagctatttccataaac

SEQ ID NO: 183399 - DNA, 25 bp, Homo sapien
tgactgtcaccaatccggcctgggc

SEQ ID NO: 183400 - DNA, 25 bp, Homo sapien
ttccataaaccaattatcgccgatc

SEQ ID NO: 183401 - DNA, 25 bp, Homo sapien
gtggctcctaggcaggcaccgcgac

SEQ ID NO: 183402 - DNA, 25 bp, Homo sapien
cccgcgccatcacccggttgccatg

SEQ ID NO: 183403 - DNA, 25 bp, Homo sapien
cacgctagggcggacccaatttcgg

SEQ ID NO: 183404 - DNA, 25 bp, Homo sapien
tcgccctgaggtaaacgcgggtcga

SEQ ID NO: 183405 - DNA, 25 bp, Homo sapien
ccaatttcggaatagcgcggcccgg

SEQ ID NO: 183406 - DNA, 25 bp, Homo sapien
cagagtgactgggacctaggacctg

SEQ ID NO: 183407 - DNA, 25 bp, Homo sapien
gtaacacctcaaagcgcacggagtc

SEQ ID NO: 183408 - DNA, 25 bp, Homo sapien
cagggccagcgaagccagtgctcca

SEQ ID NO: 183409 - DNA, 25 bp, Homo sapien
gcagagaaacgcataccgggtcgct

SEQ ID NO: 183410 - DNA, 25 bp, Homo sapien
ggtctgtcgctagcgccaaacttga

SEQ ID NO: 183411 - DNA, 25 bp, Homo sapien
gcatccacctacagaggctgcggtg

SEQ ID NO: 183412 - DNA, 25 bp, Homo sapien
cggagcagcggaaagcatccaccta

SEQ ID NO: 183413 - DNA, 25 bp, Homo sapien
gcggagccttctgagactggcctaa

SEQ ID NO: 183414 - DNA, 25 bp, Homo sapien
gcacgagaagaaggtgcggcttcca

SEQ ID NO: 183415 - DNA, 25 bp, Homo sapien
attgatcgagcatctggagtggcca

SEQ ID NO: 183416 - DNA, 25 bp, Homo sapien
acacgcttggctccggagcctagga

SEQ ID NO: 183417 - DNA, 25 bp, Homo sapien
tgcggcttccagaagggagatcctg

SEQ ID NO: 183418 - DNA, 25 bp, Homo sapien
actggcctaagctgcagaattgatc

SEQ ID NO: 183419 - DNA, 25 bp, Homo sapien
gttctcgatgaacaggatgcagttg

SEQ ID NO: 183420 - DNA, 25 bp, Homo sapien
cgttctccttgtggcgccatgagta

SEQ ID NO: 183421 - DNA, 25 bp, Homo sapien
tgaccaggttcgcagctctgctcca

SEQ ID NO: 183422 - DNA, 25 bp, Homo sapien
cctcgcagaagtagtggccgtactg

SEQ ID NO: 183423 - DNA, 25 bp, Homo sapien
agcctcgcggaagtaggagccctcc

SEQ ID NO: 183424 - DNA, 25 bp, Homo sapien
agcagctgccagtgctgagcctcgc

SEQ ID NO: 183425 - DNA, 25 bp, Homo sapien
atgatgccgtcctcgggcagcagct

SEQ ID NO: 183426 - DNA, 25 bp, Homo sapien
agctctgctccacgttctccttgtg

SEQ ID NO: 183427 - DNA, 25 bp, Homo sapien
cctctccagtcagttgtaaggtccc

SEQ ID NO: 183428 - DNA, 25 bp, Homo sapien
ccaaggagatgtctgacccggagga

SEQ ID NO: 183429 - DNA, 25 bp, Homo sapien
tgtctgacccggaggaatggagcct

SEQ ID NO: 183430 - DNA, 25 bp, Homo sapien
cccttccattgttgaggaagaccca

SEQ ID NO: 183431 - DNA, 25 bp, Homo sapien
ctgtaggtacgcagcctgggtaatg

SEQ ID NO: 183432 - DNA, 25 bp, Homo sapien
gatgctacctctccagtcagttgta

SEQ ID NO: 183433 - DNA, 25 bp, Homo sapien
acagagaggctgtaggtacgcagcc

SEQ ID NO: 183434 - DNA, 25 bp, Homo sapien
cattgttgaggaagacccaggccca

SEQ ID NO: 183435 - DNA, 25 bp, Homo sapien
aagatgcggggtccgctccttaggt

SEQ ID NO: 183436 - DNA, 25 bp, Homo sapien
cattgctgaggcagcgccctggtac

SEQ ID NO: 183437 - DNA, 25 bp, Homo sapien
tctttgttcccgctgccgaagcgcg

SEQ ID NO: 183438 - DNA, 25 bp, Homo sapien
ctgccagggacttggtgcgacttag

SEQ ID NO: 183439 - DNA, 25 bp, Homo sapien
cgttacagccggctctggtgtgcca

SEQ ID NO: 183440 - DNA, 25 bp, Homo sapien
cgacagcggcaatcagccgagactg

SEQ ID NO: 183441 - DNA, 25 bp, Homo sapien
cgcaggcagacccaagcgccaggag

SEQ ID NO: 183442 - DNA, 25 bp, Homo sapien
tggtgtgccagcgtgtacactcaca

SEQ ID NO: 183443 - DNA, 25 bp, Homo sapien
gggtcccatttccagtcattcttca

SEQ ID NO: 183444 - DNA, 25 bp, Homo sapien
gccgccggtgtaaacactcactctg

SEQ ID NO: 183445 - DNA, 25 bp, Homo sapien
ccagtctacaagaggcgctagttgc

SEQ ID NO: 183446 - DNA, 25 bp, Homo sapien
tggcttccgcgctctttgaaatgtc

SEQ ID NO: 183447 - DNA, 25 bp, Homo sapien
ccctgaggagcatatgaagtacgtc

SEQ ID NO: 183448 - DNA, 25 bp, Homo sapien
tttagacacatccaagcggttgccg

SEQ ID NO: 183449 - DNA, 25 bp, Homo sapien
ccgacggccctcacgatgaaaactg

SEQ ID NO: 183450 - DNA, 25 bp, Homo sapien
ctagttgcaaagcttccggttctgg

SEQ ID NO: 183451 - DNA, 25 bp, Homo sapien
cccattagggcatttgagataaagc

SEQ ID NO: 183452 - DNA, 25 bp, Homo sapien
cgcaatagaaaacgctcggagaaca

SEQ ID NO: 183453 - DNA, 25 bp, Homo sapien
aacgctcggagaacacgatctcccg

SEQ ID NO: 183454 - DNA, 25 bp, Homo sapien
cctctgtgtccgcactttgccattg

SEQ ID NO: 183455 - DNA, 25 bp, Homo sapien
ccacaactcagtcgggctgcgcggt

SEQ ID NO: 183456 - DNA, 25 bp, Homo sapien
tgagataaagcgtttgagataaagc

SEQ ID NO: 183457 - DNA, 25 bp, Homo sapien
ggtccctttctagcagcttccggct

SEQ ID NO: 183458 - DNA, 25 bp, Homo sapien
gtccgtaggagtcacttccgcctcg

SEQ ID NO: 183459 - DNA, 25 bp, Homo sapien
acgctcacagtgaggtctcaaaaga

SEQ ID NO: 183460 - DNA, 25 bp, Homo sapien
ttctcatctggaaagtggggcctcg

SEQ ID NO: 183461 - DNA, 25 bp, Homo sapien
cggaactagtctcctaggccgcggc

SEQ ID NO: 183462 - DNA, 25 bp, Homo sapien
atgtgtcgttcgctcgtttcgcgca

SEQ ID NO: 183463 - DNA, 25 bp, Homo sapien
tggggcctcgtaatcctgtccgacc

SEQ ID NO: 183464 - DNA, 25 bp, Homo sapien
ctagggtatcttcccagaaactgcc

SEQ ID NO: 183465 - DNA, 25 bp, Homo sapien
cccgccagagtagctctagggtatc

SEQ ID NO: 183466 - DNA, 25 bp, Homo sapien
cacgctcgaggcctctgcaaaaggg

SEQ ID NO: 183467 - DNA, 25 bp, Homo sapien
accttggaatccagggccgtcaatt

SEQ ID NO: 183468 - DNA, 25 bp, Homo sapien
cttcggccttacagaattgcgcttg

SEQ ID NO: 183469 - DNA, 25 bp, Homo sapien
attgcgcttgggtagtcattttgcc

SEQ ID NO: 183470 - DNA, 25 bp, Homo sapien
attttgccctccacgcttacttatg

SEQ ID NO: 183471 - DNA, 25 bp, Homo sapien
tacttatgtcctgtggcgtcttggc

SEQ ID NO: 183472 - DNA, 25 bp, Homo sapien
aggctcgatgaaaagcacccgcttc

SEQ ID NO: 183473 - DNA, 25 bp, Homo sapien
ccagaggacccacagaagaattctc

SEQ ID NO: 183474 - DNA, 25 bp, Homo sapien
aagccgaccactcaacaccagagga

SEQ ID NO: 183475 - DNA, 25 bp, Homo sapien
gaagcacaggacacggcgatcagcc

SEQ ID NO: 183476 - DNA, 25 bp, Homo sapien
ggcgggcactcaccatgttgacttc

SEQ ID NO: 183477 - DNA, 25 bp, Homo sapien
cgaagtcgggtcttaggcgaatgtc

SEQ ID NO: 183478 - DNA, 25 bp, Homo sapien
ggcgaatgtcgtagcctttcaacag

SEQ ID NO: 183479 - DNA, 25 bp, Homo sapien
tgtccaccgtctccttcacaaagga

SEQ ID NO: 183480 - DNA, 25 bp, Homo sapien
atgttcccgggatcgttcacactgg

SEQ ID NO: 183481 - DNA, 25 bp, Homo sapien
tgctggcgatgtcgatgttcatccc

SEQ ID NO: 183482 - DNA, 25 bp, Homo sapien
ttgacttcggaaaccatgtcgatgc

SEQ ID NO: 183483 - DNA, 25 bp, Homo sapien
gcaggctcgctgagcgctcactagc

SEQ ID NO: 183484 - DNA, 25 bp, Homo sapien
aaagttgtatttgcgtgcctagctc

SEQ ID NO: 183485 - DNA, 25 bp, Homo sapien
tgccatttggcatggcctagctgcc

SEQ ID NO: 183486 - DNA, 25 bp, Homo sapien
tccgcattttcggtccacgcctgtg

SEQ ID NO: 183487 - DNA, 25 bp, Homo sapien
tagtgctgattgcaacgcgcggtcc

SEQ ID NO: 183488 - DNA, 25 bp, Homo sapien
cgcagcctctaggatcgccttagtg

SEQ ID NO: 183489 - DNA, 25 bp, Homo sapien
gttcgcgcctcttgattgaaggatc

SEQ ID NO: 183490 - DNA, 25 bp, Homo sapien
agcgctacagcctaccaggactcgg

SEQ ID NO: 183491 - DNA, 25 bp, Homo sapien
gcgcgtctagtctctgttgctgcca

SEQ ID NO: 183492 - DNA, 25 bp, Homo sapien
agtgcctggccgtcccggagtgtcc

SEQ ID NO: 183493 - DNA, 25 bp, Homo sapien
ctccttgcacccatacctctttgta

SEQ ID NO: 183494 - DNA, 25 bp, Homo sapien
aaatcgaacctcagtggcggcgctc

SEQ ID NO: 183495 - DNA, 25 bp, Homo sapien
gcagccagcgcgacgttccaaaatc

SEQ ID NO: 183496 - DNA, 25 bp, Homo sapien
ggccgcgccggctacattgtttcct

SEQ ID NO: 183497 - DNA, 25 bp, Homo sapien
tagtctctgttgctgccactgtcgc

SEQ ID NO: 183498 - DNA, 25 bp, Homo sapien
gcgcgacgttccaaaatcgaacctc

SEQ ID NO: 183499 - DNA, 25 bp, Homo sapien
gcgcttgaccatgttgcactgtttg

SEQ ID NO: 183500 - DNA, 25 bp, Homo sapien
ccgtgtttgcgcttgaccatgttgc

SEQ ID NO: 183501 - DNA, 25 bp, Homo sapien
ttgcactgtttgcatgcgcccgagg

SEQ ID NO: 183502 - DNA, 25 bp, Homo sapien
cagacgtctgtcaggggcttggatt

SEQ ID NO: 183503 - DNA, 25 bp, Homo sapien
ggcttggatttcgtgtgccgctgcc

SEQ ID NO: 183504 - DNA, 25 bp, Homo sapien
acccgccttgtgagatggaattgta

SEQ ID NO: 183505 - DNA, 25 bp, Homo sapien
ggaattgtaataaaccacgccatga

SEQ ID NO: 183506 - DNA, 25 bp, Homo sapien
ataaaccacgccatgaggacaccgc

SEQ ID NO: 183507 - DNA, 25 bp, Homo sapien
cccgcgagcctagaagttaacaacg

SEQ ID NO: 183508 - DNA, 25 bp, Homo sapien
gctactggcacgagaaggcgccttt

SEQ ID NO: 183509 - DNA, 25 bp, Homo sapien
cgcagctctgaaaggagagctactg

SEQ ID NO: 183510 - DNA, 25 bp, Homo sapien
taggccttgtacaccgtggcgtacg

SEQ ID NO: 183511 - DNA, 25 bp, Homo sapien
gcgtctagagatcgcccacgtgagg

SEQ ID NO: 183512 - DNA, 25 bp, Homo sapien
caacctccgccgagggtcagctggg

SEQ ID NO: 183513 - DNA, 25 bp, Homo sapien
actgtcgctaacctctcagagtctc

SEQ ID NO: 183514 - DNA, 25 bp, Homo sapien
ctaactattcccacactgtcgctaa

SEQ ID NO: 183515 - DNA, 25 bp, Homo sapien
taacttactagtctggtcccggctc

SEQ ID NO: 183516 - DNA, 25 bp, Homo sapien
cccaaagtgggcaatggcgcatcca

SEQ ID NO: 183517 - DNA, 25 bp, Homo sapien
gcaagggcgcccaagttagaatgta

SEQ ID NO: 183518 - DNA, 25 bp, Homo sapien
aggtggtctttcgtcgcatcgatgc

SEQ ID NO: 183519 - DNA, 25 bp, Homo sapien
tgcgcctcactctgtcctgaagttg

SEQ ID NO: 183520 - DNA, 25 bp, Homo sapien
gctcgctcctgaaagggatcccttc

SEQ ID NO: 183521 - DNA, 25 bp, Homo sapien
ctcgcctaggctcttacgcgctata

SEQ ID NO: 183522 - DNA, 25 bp, Homo sapien
gcccgcaggtctggaagaattatta

SEQ ID NO: 183523 - DNA, 25 bp, Homo sapien
tcacgcgttacgataggccagacct

SEQ ID NO: 183524 - DNA, 25 bp, Homo sapien
tctcccattgggcagatgacccgtc

SEQ ID NO: 183525 - DNA, 25 bp, Homo sapien
gccctagggaaatctgagagctgga

SEQ ID NO: 183526 - DNA, 25 bp, Homo sapien
gctctacctggaaggggtttacatc

SEQ ID NO: 183527 - DNA, 25 bp, Homo sapien
tttacatccactgggtccgcgaagg

SEQ ID NO: 183528 - DNA, 25 bp, Homo sapien
gacccagcggcgcttcgtgtagacc

SEQ ID NO: 183529 - DNA, 25 bp, Homo sapien
tgggcattcggcttccgtccacatc

SEQ ID NO: 183530 - DNA, 25 bp, Homo sapien
acatcttcgctctgctggggattca

SEQ ID NO: 183531 - DNA, 25 bp, Homo sapien
acctgcgatggggattgacctccga

SEQ ID NO: 183532 - DNA, 25 bp, Homo sapien
ggccaggttgagtccgctcctggca

SEQ ID NO: 183533 - DNA, 25 bp, Homo sapien
acgactcccggcattatcggccagg

SEQ ID NO: 183534 - DNA, 25 bp, Homo sapien
catacgtgcttaatcctggtgcagg

SEQ ID NO: 183535 - DNA, 25 bp, Homo sapien
gctgccgggaaaggcatacgtgctt

SEQ ID NO: 183536 - DNA, 25 bp, Homo sapien
catttcccgtgaagctctgggcgca

SEQ ID NO: 183537 - DNA, 25 bp, Homo sapien
gcggaacgctcagggaactacattt

SEQ ID NO: 183538 - DNA, 25 bp, Homo sapien
aagatcgcggccgtaagcctctggg

SEQ ID NO: 183539 - DNA, 25 bp, Homo sapien
gtctgaggacttggccgaaatgttc

SEQ ID NO: 183540 - DNA, 25 bp, Homo sapien
aatactgatactgtcgtggggctgc

SEQ ID NO: 183541 - DNA, 25 bp, Homo sapien
ctctccggttcggtagtctgaggac

SEQ ID NO: 183542 - DNA, 25 bp, Homo sapien
tcttttaacaagatggcggtgcgca

SEQ ID NO: 183543 - DNA, 25 bp, Homo sapien
acggagggctctattaccgatctgc

SEQ ID NO: 183544 - DNA, 25 bp, Homo sapien
actcacgcagcttggcttgaatgga

SEQ ID NO: 183545 - DNA, 25 bp, Homo sapien
gccgctctttccgaacggattttga

SEQ ID NO: 183546 - DNA, 25 bp, Homo sapien
tttctccgcagaacggccttggcca

SEQ ID NO: 183547 - DNA, 25 bp, Homo sapien
gaggagcaaccgaccgtgatcttgt

SEQ ID NO: 183548 - DNA, 25 bp, Homo sapien
cgctaaccgagaaatgcctgattga

SEQ ID NO: 183549 - DNA, 25 bp, Homo sapien
gtgcccggaggctcaatgtcacctt

SEQ ID NO: 183550 - DNA, 25 bp, Homo sapien
atcgtgtgtcccatacggaagtata

SEQ ID NO: 183551 - DNA, 25 bp, Homo sapien
ggcgcgctgaggacaaactgttagc

SEQ ID NO: 183552 - DNA, 25 bp, Homo sapien
tcccgccttgtctctggtcaggtga

SEQ ID NO: 183553 - DNA, 25 bp, Homo sapien
agctgccatcctgtaagtaggaatg

SEQ ID NO: 183554 - DNA, 25 bp, Homo sapien
cggaagtatattgtgtcctcggacc

SEQ ID NO: 183555 - DNA, 25 bp, Homo sapien
cgcttgccgtgcaaacactgcttca

SEQ ID NO: 183556 - DNA, 25 bp, Homo sapien
ggtatccgagcccttcccatttgca

SEQ ID NO: 183557 - DNA, 25 bp, Homo sapien
cactgcttcaaatccggtatccgag

SEQ ID NO: 183558 - DNA, 25 bp, Homo sapien
gaagttctccatgcgccgtcgtcgc

SEQ ID NO: 183559 - DNA, 25 bp, Homo sapien
agttccactataatcgccatcagcg

SEQ ID NO: 183560 - DNA, 25 bp, Homo sapien
tcactagcctttcctggcgagtctg

SEQ ID NO: 183561 - DNA, 25 bp, Homo sapien
tcaggttccggatcttgctgccttc

SEQ ID NO: 183562 - DNA, 25 bp, Homo sapien
tcggagcgcaccttacggaagttct

SEQ ID NO: 183563 - DNA, 25 bp, Homo sapien
acctcctaaactgctgtcggatgta

SEQ ID NO: 183564 - DNA, 25 bp, Homo sapien
tgtcggatgtagaagactcgcattc

SEQ ID NO: 183565 - DNA, 25 bp, Homo sapien
attcattacactgtcagcgcgcgtc

SEQ ID NO: 183566 - DNA, 25 bp, Homo sapien
cgcggggtcgctaattacagctgaa

SEQ ID NO: 183567 - DNA, 25 bp, Homo sapien
tgtacatcgtgattagccgcggggt

SEQ ID NO: 183568 - DNA, 25 bp, Homo sapien
gcgctccctctgcagcacttaaaat

SEQ ID NO: 183569 - DNA, 25 bp, Homo sapien
gagaacgccgaaaagggccgcattc

SEQ ID NO: 183570 - DNA, 25 bp, Homo sapien
ctgctctccacagtcggtgaaggga

SEQ ID NO: 183571 - DNA, 25 bp, Homo sapien
ccagcccaggcgacatcaacggcca

SEQ ID NO: 183572 - DNA, 25 bp, Homo sapien
gtcacgtgtttgtgctgcaggtgca

SEQ ID NO: 183573 - DNA, 25 bp, Homo sapien
ggtccgggacaagaagatgctcagt

SEQ ID NO: 183574 - DNA, 25 bp, Homo sapien
cgtcccgggaacgaagccgccgctg

SEQ ID NO: 183575 - DNA, 25 bp, Homo sapien
gaagatgctcagtcacgtgtttgtg

SEQ ID NO: 183576 - DNA, 25 bp, Homo sapien
catacgcgtgaggattgcggcacca

SEQ ID NO: 183577 - DNA, 25 bp, Homo sapien
gccgctgcagatgaggggctttgta

SEQ ID NO: 183578 - DNA, 25 bp, Homo sapien
gcttcctggggtccaacgccgagag

SEQ ID NO: 183579 - DNA, 25 bp, Homo sapien
gaaaactgcgactctaccttcgtgg

SEQ ID NO: 183580 - DNA, 25 bp, Homo sapien
tgcgactctaccttcgtggaaacgg

SEQ ID NO: 183581 - DNA, 25 bp, Homo sapien
tccagcctccttcagaaaactgcga

SEQ ID NO: 183582 - DNA, 25 bp, Homo sapien
agttctcctcatggccacaagaggg

SEQ ID NO: 183583 - DNA, 25 bp, Homo sapien
tcggacagttctcctcatggccaca

SEQ ID NO: 183584 - DNA, 25 bp, Homo sapien
tcttggccacgatcggacagttctc

SEQ ID NO: 183585 - DNA, 25 bp, Homo sapien
cactgcggcgtcttggccacgatcg

SEQ ID NO: 183586 - DNA, 25 bp, Homo sapien
ggcggccccactctctttattggca

SEQ ID NO: 183587 - DNA, 25 bp, Homo sapien
tgtttgtgaaccgatccttgtcctc

SEQ ID NO: 183588 - DNA, 25 bp, Homo sapien
gccttaggagcagagcggaagtctc

SEQ ID NO: 183589 - DNA, 25 bp, Homo sapien
tttgggtgacgtcagaccctggatc

SEQ ID NO: 183590 - DNA, 25 bp, Homo sapien
ttgggcctttccttccaactagcgc

SEQ ID NO: 183591 - DNA, 25 bp, Homo sapien
ccgacctttggatggcggacctcag

SEQ ID NO: 183592 - DNA, 25 bp, Homo sapien
tcatttcaacgctggccggaggtca

SEQ ID NO: 183593 - DNA, 25 bp, Homo sapien
cgtccttctcgcgagctcaggagga

SEQ ID NO: 183594 - DNA, 25 bp, Homo sapien
ggcgccggatttggctcatttcaac

SEQ ID NO: 183595 - DNA, 25 bp, Homo sapien
agataccgcgatatttgggagcggc

SEQ ID NO: 183596 - DNA, 25 bp, Homo sapien
gagcggcagagataccgcgatattt

SEQ ID NO: 183597 - DNA, 25 bp, Homo sapien
ccagcccggtgctctcgtgaggcgt

SEQ ID NO: 183598 - DNA, 25 bp, Homo sapien
tgtgcgacctcactttcccggctgt

SEQ ID NO: 183599 - DNA, 25 bp, Homo sapien
gaagctctgtttgcgactgtgcgtg

SEQ ID NO: 183600 - DNA, 25 bp, Homo sapien
tgccagtcagattccgcgggagagc

SEQ ID NO: 183601 - DNA, 25 bp, Homo sapien
ctctcgtgaggcgtgccagtcagat

SEQ ID NO: 183602 - DNA, 25 bp, Homo sapien
ctgtgtgcccatgaagctctgtttg

SEQ ID NO: 183603 - DNA, 25 bp, Homo sapien
ggcctgattagcatcgccgccgctt

SEQ ID NO: 183604 - DNA, 25 bp, Homo sapien
gctgggcgccagaatttaccttttc

SEQ ID NO: 183605 - DNA, 25 bp, Homo sapien
cggctccatgcatttccctgaggca

SEQ ID NO: 183606 - DNA, 25 bp, Homo sapien
cctcccggtcttcggggatgctaat

SEQ ID NO: 183607 - DNA, 25 bp, Homo sapien
taccttttccatcttagcggcctga

SEQ ID NO: 183608 - DNA, 25 bp, Homo sapien
cgccaccgcctagcgagtgagtgca

SEQ ID NO: 183609 - DNA, 25 bp, Homo sapien
cgagctaaatcggtctgcggagccc

SEQ ID NO: 183610 - DNA, 25 bp, Homo sapien
tggcgcttgattggaactccggccc

SEQ ID NO: 183611 - DNA, 25 bp, Homo sapien
gttgcaattgggttcagcccgggca

SEQ ID NO: 183612 - DNA, 25 bp, Homo sapien
cctgggactttgttgcaattgggtt

SEQ ID NO: 183613 - DNA, 25 bp, Homo sapien
ccgcctgtgtccgagaagcagagag

SEQ ID NO: 183614 - DNA, 25 bp, Homo sapien
ggttacatcacggttccctggagac

SEQ ID NO: 183615 - DNA, 25 bp, Homo sapien
cgctgggttacatcacggttccctg

SEQ ID NO: 183616 - DNA, 25 bp, Homo sapien
gtcgagtaaacaagccacgggcggc

SEQ ID NO: 183617 - DNA, 25 bp, Homo sapien
ccctagtcgagtaaacaagccacgg

SEQ ID NO: 183618 - DNA, 25 bp, Homo sapien
actttgttgcaattgggttcagccc

SEQ ID NO: 183619 - DNA, 25 bp, Homo sapien
ctgcggttttctcgccacctcttga

SEQ ID NO: 183620 - DNA, 25 bp, Homo sapien
tgcacgtacgtgcaggcacgggttt

SEQ ID NO: 183621 - DNA, 25 bp, Homo sapien
ctccggcggagaacaggcgcctaat

SEQ ID NO: 183622 - DNA, 25 bp, Homo sapien
gcctaatctggcgagaaggaactca

SEQ ID NO: 183623 - DNA, 25 bp, Homo sapien
agaaggaactcaggccgagccctcc

SEQ ID NO: 183624 - DNA, 25 bp, Homo sapien
cgcaggaccctgtcacgtggattgc

SEQ ID NO: 183625 - DNA, 25 bp, Homo sapien
gcagatgtgggccatgcacgtacgt

SEQ ID NO: 183626 - DNA, 25 bp, Homo sapien
tcctggcgctctgcaggtaggagct

SEQ ID NO: 183627 - DNA, 25 bp, Homo sapien
atgctgaagttactggcgctgcgcc

SEQ ID NO: 183628 - DNA, 25 bp, Homo sapien
ggctgcacctcacgcatgctgaagt

SEQ ID NO: 183629 - DNA, 25 bp, Homo sapien
tgcggcccaccacgctgtcggagga

SEQ ID NO: 183630 - DNA, 25 bp, Homo sapien
ccatgtgctgcaggagcatcgtgtg

SEQ ID NO: 183631 - DNA, 25 bp, Homo sapien
acccgcttctgtggaccatgtgctg

SEQ ID NO: 183632 - DNA, 25 bp, Homo sapien
agctggcgccatcttcgtgcccatt

SEQ ID NO: 183633 - DNA, 25 bp, Homo sapien
attcacctggtgaaggagcggctct

SEQ ID NO: 183634 - DNA, 25 bp, Homo sapien
ctgcagtggcgcgactgtgtacgcc

SEQ ID NO: 183635 - DNA, 25 bp, Homo sapien
ctgtgagtctggtagggaaaagtcc

SEQ ID NO: 183636 - DNA, 25 bp, Homo sapien
tggtagggaaaagtccaccactctc

SEQ ID NO: 183637 - DNA, 25 bp, Homo sapien
ccctggcttcttggcgcgatggtga

SEQ ID NO: 183638 - DNA, 25 bp, Homo sapien
tggtgaggcactaggggcgaagcga

SEQ ID NO: 183639 - DNA, 25 bp, Homo sapien
actaggggcgaagcgaggcttgggc

SEQ ID NO: 183640 - DNA, 25 bp, Homo sapien
ggcgccaagtggctccggaaactgg

SEQ ID NO: 183641 - DNA, 25 bp, Homo sapien
gtgagtctggtagggaaaagtccac

SEQ ID NO: 183642 - DNA, 25 bp, Homo sapien
ctggtagggaaaagtccaccactct

SEQ ID NO: 183643 - DNA, 25 bp, Homo sapien
tctcgctgcggccaagcggccgatt

SEQ ID NO: 183644 - DNA, 25 bp, Homo sapien
gaccctgtcccacgctagctgggtg

SEQ ID NO: 183645 - DNA, 25 bp, Homo sapien
caggcagtgggaagtcaggttcttc

SEQ ID NO: 183646 - DNA, 25 bp, Homo sapien
gcgaccgcttccctgagggactaca

SEQ ID NO: 183647 - DNA, 25 bp, Homo sapien
gattaaccgaggacagggtcgcagc

SEQ ID NO: 183648 - DNA, 25 bp, Homo sapien
ctaggatttggagcctcacgttctc

SEQ ID NO: 183649 - DNA, 25 bp, Homo sapien
ttaaggcacaccttcgcctccgatt

SEQ ID NO: 183650 - DNA, 25 bp, Homo sapien
gttctcccgcaaaacgagccctgtg

SEQ ID NO: 183651 - DNA, 25 bp, Homo sapien
ggtgaagacacggaaaacgcactcc

SEQ ID NO: 183652 - DNA, 25 bp, Homo sapien
ctcctgaaccggcagcgacaagtgc

SEQ ID NO: 183653 - DNA, 25 bp, Homo sapien
gcagcgacaagtgcagccagcagtc

SEQ ID NO: 183654 - DNA, 25 bp, Homo sapien
gccagcagtccacgtggctgccgtg

SEQ ID NO: 183655 - DNA, 25 bp, Homo sapien
gtgggcctcatacagcctcaggacc

SEQ ID NO: 183656 - DNA, 25 bp, Homo sapien
ctccgcctgcagaggaacacgtctg

SEQ ID NO: 183657 - DNA, 25 bp, Homo sapien
tctccaatacgaccgcgggtgaaga

SEQ ID NO: 183658 - DNA, 25 bp, Homo sapien
cttgcctgcttgacggtctccaata

SEQ ID NO: 183659 - DNA, 25 bp, Homo sapien
agtagagcggcgacacgaacttctc

SEQ ID NO: 183660 - DNA, 25 bp, Homo sapien
actgcctcctggtagggaagtctct

SEQ ID NO: 183661 - DNA, 25 bp, Homo sapien
tgccgcggaggttacagtcggtaaa

SEQ ID NO: 183662 - DNA, 25 bp, Homo sapien
gggctctcgctcctctttccggaag

SEQ ID NO: 183663 - DNA, 25 bp, Homo sapien
tccgctccacggcaggaaaccaaag

SEQ ID NO: 183664 - DNA, 25 bp, Homo sapien
gcttttcttggaacaccggcggctc

SEQ ID NO: 183665 - DNA, 25 bp, Homo sapien
ttacctacgtgggtccgaagctgtc

SEQ ID NO: 183666 - DNA, 25 bp, Homo sapien
cccggaaggaaagcttgaggcgcac

SEQ ID NO: 183667 - DNA, 25 bp, Homo sapien
cgcccttgtccagcgtgggtagcca

SEQ ID NO: 183668 - DNA, 25 bp, Homo sapien
cccggttctagtcggtgtgcggaat

SEQ ID NO: 183669 - DNA, 25 bp, Homo sapien
ccgactgctcggtgagataaactag

SEQ ID NO: 183670 - DNA, 25 bp, Homo sapien
taaactaggctacacggccggcgca

SEQ ID NO: 183671 - DNA, 25 bp, Homo sapien
ggaccaaattaaaagcagctgttta

SEQ ID NO: 183672 - DNA, 25 bp, Homo sapien
gctgtttaacataccttccgagcca

SEQ ID NO: 183673 - DNA, 25 bp, Homo sapien
cgcatccgtggtagaggcccatata

SEQ ID NO: 183674 - DNA, 25 bp, Homo sapien
ccgccgactcgagtttcttgaggtc

SEQ ID NO: 183675 - DNA, 25 bp, Homo sapien
atacacaccctcgagtccggcgtta

SEQ ID NO: 183676 - DNA, 25 bp, Homo sapien
cggccaaccggatcccaagaaggcg

SEQ ID NO: 183677 - DNA, 25 bp, Homo sapien
caagaaggcggaggaactcagactt

SEQ ID NO: 183678 - DNA, 25 bp, Homo sapien
gcgccctgaatctacacgcgggaga

SEQ ID NO: 183679 - DNA, 25 bp, Homo sapien
gcccgtctgctctacgggaagccga

SEQ ID NO: 183680 - DNA, 25 bp, Homo sapien
tctccactaacgaagcggtcacagg

SEQ ID NO: 183681 - DNA, 25 bp, Homo sapien
gcggccgcttctctgttacccggga

SEQ ID NO: 183682 - DNA, 25 bp, Homo sapien
ggtcggccgcaaactgcactcagcg

SEQ ID NO: 183683 - DNA, 25 bp, Homo sapien
gcagaactgacccacggctactttt

SEQ ID NO: 183684 - DNA, 25 bp, Homo sapien
ctgcagagttctcgagcttaagctc

SEQ ID NO: 183685 - DNA, 25 bp, Homo sapien
gtgggcctgacgctgatcttacttt

SEQ ID NO: 183686 - DNA, 25 bp, Homo sapien
agggtaccacctgcgctaagatctc

SEQ ID NO: 183687 - DNA, 25 bp, Homo sapien
ccagggccaaactgctcggaggtta

SEQ ID NO: 183688 - DNA, 25 bp, Homo sapien
ctagactgagtaccacagggcattc

SEQ ID NO: 183689 - DNA, 25 bp, Homo sapien
gggcattcccaccatggtatcaaga

SEQ ID NO: 183690 - DNA, 25 bp, Homo sapien
cgttgttaccgctctcccgaataag

SEQ ID NO: 183691 - DNA, 25 bp, Homo sapien
aggccagagcgcaaactttaccctg

SEQ ID NO: 183692 - DNA, 25 bp, Homo sapien
gaaagccagcgtcagccccggggct

SEQ ID NO: 183693 - DNA, 25 bp, Homo sapien
gtgagatcgcccacctggaaagcca

SEQ ID NO: 183694 - DNA, 25 bp, Homo sapien
cgttgccaccatcacgggagccgga

SEQ ID NO: 183695 - DNA, 25 bp, Homo sapien
gagaaggaggatgcatcctcaccga

SEQ ID NO: 183696 - DNA, 25 bp, Homo sapien
tttaccctggcgactgcggggctga

SEQ ID NO: 183697 - DNA, 25 bp, Homo sapien
gctcggtccgcacccttctcctcgg

SEQ ID NO: 183698 - DNA, 25 bp, Homo sapien
ctggcggagcgcttggctcgtaccc

SEQ ID NO: 183699 - DNA, 25 bp, Homo sapien
cttgggttaggcaaagctttcacag

SEQ ID NO: 183700 - DNA, 25 bp, Homo sapien
atacaaaaaaggtctcttccgtgag

SEQ ID NO: 183701 - DNA, 25 bp, Homo sapien
aatataagagtaaatctttgtgacc

SEQ ID NO: 183702 - DNA, 25 bp, Homo sapien
ggcaaagctttcacagatatgatac

SEQ ID NO: 183703 - DNA, 25 bp, Homo sapien
tcacagatatgataccaaaggcgta

SEQ ID NO: 183704 - DNA, 25 bp, Homo sapien
gggttaggcaaagctttcacagata

SEQ ID NO: 183705 - DNA, 25 bp, Homo sapien
aattaaaaacttatgccaggcgcgg

SEQ ID NO: 183706 - DNA, 25 bp, Homo sapien
taccaaaggcgtaagtgacaaaaga

SEQ ID NO: 183707 - DNA, 25 bp, Homo sapien
agcagcgtcggccactggtttgcca

SEQ ID NO: 183708 - DNA, 25 bp, Homo sapien
gctcagcaggatggccgcctcaacg

SEQ ID NO: 183709 - DNA, 25 bp, Homo sapien
ttgacgcccaccaggctcagcagga

SEQ ID NO: 183710 - DNA, 25 bp, Homo sapien
caggatgctcttgacgcccaccagg

SEQ ID NO: 183711 - DNA, 25 bp, Homo sapien
ccactggtttgccaggatgctcttg

SEQ ID NO: 183712 - DNA, 25 bp, Homo sapien
cgtcggccactggtttgccaggatg

SEQ ID NO: 183713 - DNA, 25 bp, Homo sapien
acgcactttcccataagacgctggc

SEQ ID NO: 183714 - DNA, 25 bp, Homo sapien
ggggcccacgcactttcccataaga

SEQ ID NO: 183715 - DNA, 25 bp, Homo sapien
cggctcgggctcttccggctacggt

SEQ ID NO: 183716 - DNA, 25 bp, Homo sapien
aagcccagtggtcctggccgtgcgc

SEQ ID NO: 183717 - DNA, 25 bp, Homo sapien
tgccaagcccagtggtcctggccgt

SEQ ID NO: 183718 - DNA, 25 bp, Homo sapien
aagcgtgtttgcaaacggggaagcg

SEQ ID NO: 183719 - DNA, 25 bp, Homo sapien
cggcagaagacaaaggaaaaaagcg

SEQ ID NO: 183720 - DNA, 25 bp, Homo sapien
gcgccggcagaagacaaaggaaaaa

SEQ ID NO: 183721 - DNA, 25 bp, Homo sapien
gcgcgccggcagaagacaaaggaaa

SEQ ID NO: 183722 - DNA, 25 bp, Homo sapien
gactcgcgctcagcgacctccctcc

SEQ ID NO: 183723 - DNA, 25 bp, Homo sapien
ctcattcacaagctggcggcgagga

SEQ ID NO: 183724 - DNA, 25 bp, Homo sapien
cccgcggctccattgagaaactgag

SEQ ID NO: 183725 - DNA, 25 bp, Homo sapien
caggaacttttagagccgggagcga

SEQ ID NO: 183726 - DNA, 25 bp, Homo sapien
tgccgctctcttccgggaggaaatc

SEQ ID NO: 183727 - DNA, 25 bp, Homo sapien
ccgtggctgcaaagagccggcactc

SEQ ID NO: 183728 - DNA, 25 bp, Homo sapien
tgcttccttaagaaaaatctctccg

SEQ ID NO: 183729 - DNA, 25 bp, Homo sapien
ccgggcggacaaaactcgctcgcga

SEQ ID NO: 183730 - DNA, 25 bp, Homo sapien
agagctaacagccactcgggattta

SEQ ID NO: 183731 - DNA, 25 bp, Homo sapien
ggtcatctaggccatgcatgattcg

SEQ ID NO: 183732 - DNA, 25 bp, Homo sapien
cctttttctaggcatggggtcatct

SEQ ID NO: 183733 - DNA, 25 bp, Homo sapien
tcctggccggacagcacggaataga

SEQ ID NO: 183734 - DNA, 25 bp, Homo sapien
ggcctggctctatccctccagatga

SEQ ID NO: 183735 - DNA, 25 bp, Homo sapien
tccagatgacgtcccaggaggccag

SEQ ID NO: 183736 - DNA, 25 bp, Homo sapien
cacagtccggcaccgagaggcaact

SEQ ID NO: 183737 - DNA, 25 bp, Homo sapien
aacgctgggagttccgttgcctaca

SEQ ID NO: 183738 - DNA, 25 bp, Homo sapien
acgctatctgcttcactcggccgtg

SEQ ID NO: 183739 - DNA, 25 bp, Homo sapien
cagcagcttctgctcgtggaactta

SEQ ID NO: 183740 - DNA, 25 bp, Homo sapien
tgcactgggatctcgcgtttcttct

SEQ ID NO: 183741 - DNA, 25 bp, Homo sapien
gaagtcatcgcgctcctcattgtac

SEQ ID NO: 183742 - DNA, 25 bp, Homo sapien
ttgtactctagcacgtgccgcttga

SEQ ID NO: 183743 - DNA, 25 bp, Homo sapien
tgccgcttgatcttggacgagtcca

SEQ ID NO: 183744 - DNA, 25 bp, Homo sapien
gtcctccatgctgcgcgtgacaagg

SEQ ID NO: 183745 - DNA, 25 bp, Homo sapien
cgtacgtgcccttgctccacaaagg

SEQ ID NO: 183746 - DNA, 25 bp, Homo sapien
cggtgacctcccagttcaggaagtc

SEQ ID NO: 183747 - DNA, 25 bp, Homo sapien
cagcgtcaggctcagaaactgctga

SEQ ID NO: 183748 - DNA, 25 bp, Homo sapien
ctgctgaggaattaggcaaacaaaa

SEQ ID NO: 183749 - DNA, 25 bp, Homo sapien
ctcagcgagtggctagaagtcgccc

SEQ ID NO: 183750 - DNA, 25 bp, Homo sapien
gagttttactccatttgcgtcacgg

SEQ ID NO: 183751 - DNA, 25 bp, Homo sapien
ttgttttggagctgccttctcgctg

SEQ ID NO: 183752 - DNA, 25 bp, Homo sapien
ccaaactgttgagtgtgtgcgtgca

SEQ ID NO: 183753 - DNA, 25 bp, Homo sapien
cacggaagtgcagcggagtttgccc

SEQ ID NO: 183754 - DNA, 25 bp, Homo sapien
gtttgcccgattctccagcctgctt

SEQ ID NO: 183755 - DNA, 25 bp, Homo sapien
ggggaagtgtgctcgccgtcagaga

SEQ ID NO: 183756 - DNA, 25 bp, Homo sapien
gggaagtgtgctcgccgtcagagag

SEQ ID NO: 183757 - DNA, 25 bp, Homo sapien
agtgtgctcgccgtcagagaggcgg

SEQ ID NO: 183758 - DNA, 25 bp, Homo sapien
tgtgctcgccgtcagagaggcggaa

SEQ ID NO: 183759 - DNA, 25 bp, Homo sapien
tgctcgccgtcagagaggcggaagc

SEQ ID NO: 183760 - DNA, 25 bp, Homo sapien
gctcgccgtcagagaggcggaagcg

SEQ ID NO: 183761 - DNA, 25 bp, Homo sapien
cgtcactcggaagaagtgtccgggg

SEQ ID NO: 183762 - DNA, 25 bp, Homo sapien
tcgccgtcagagaggcggaagcgga

SEQ ID NO: 183763 - DNA, 25 bp, Homo sapien
gctcctcagagcctccgcagggatg

SEQ ID NO: 183764 - DNA, 25 bp, Homo sapien
gctgctcgatggtgtagaccagatc

SEQ ID NO: 183765 - DNA, 25 bp, Homo sapien
gctcgatggtgtagaccagatcctc

SEQ ID NO: 183766 - DNA, 25 bp, Homo sapien
atggtgtagaccagatcctcagacc

SEQ ID NO: 183767 - DNA, 25 bp, Homo sapien
agatcctcagacccagagtcgccgt

SEQ ID NO: 183768 - DNA, 25 bp, Homo sapien
gtgctcctcagagcctccgcaggga

SEQ ID NO: 183769 - DNA, 25 bp, Homo sapien
ctgtgtgagaacagcacgagcccgc

SEQ ID NO: 183770 - DNA, 25 bp, Homo sapien
gagtcgccgtccgtgctcctcagag

SEQ ID NO: 183771 - DNA, 25 bp, Homo sapien
tcattcacgggctggatggccactc

SEQ ID NO: 183772 - DNA, 25 bp, Homo sapien
tgggctcatctacggccacgatact

SEQ ID NO: 183773 - DNA, 25 bp, Homo sapien
cgatactgccaaagaggaggtcctt

SEQ ID NO: 183774 - DNA, 25 bp, Homo sapien
aggtccttgcgggtaagcaccagct

SEQ ID NO: 183775 - DNA, 25 bp, Homo sapien
ctgaaggccacgtcgtctgtagtca

SEQ ID NO: 183776 - DNA, 25 bp, Homo sapien
gaagatccggctgatggtctgcaca

SEQ ID NO: 183777 - DNA, 25 bp, Homo sapien
gtgcacgaacagtactcgcctcttc

SEQ ID NO: 183778 - DNA, 25 bp, Homo sapien
cctggcctccttgagggaccacaag

SEQ ID NO: 183779 - DNA, 25 bp, Homo sapien
tcaagtcctgtgcaggaccaccgcg

SEQ ID NO: 183780 - DNA, 25 bp, Homo sapien
actcccggcaggagaactcggtcgc

SEQ ID NO: 183781 - DNA, 25 bp, Homo sapien
accaccgcggtggacatagactagg

SEQ ID NO: 183782 - DNA, 25 bp, Homo sapien
tcgctgacccggaacgtcaagtcct

SEQ ID NO: 183783 - DNA, 25 bp, Homo sapien
tgcagtccatcgctgacccggaacg

SEQ ID NO: 183784 - DNA, 25 bp, Homo sapien
tcgcaaccctgtgctgcggtggatc

SEQ ID NO: 183785 - DNA, 25 bp, Homo sapien
ggcattggtctccaccgacaggttg

SEQ ID NO: 183786 - DNA, 25 bp, Homo sapien
atagactaggctgccggcctccaac

SEQ ID NO: 183787 - DNA, 25 bp, Homo sapien
tgggacctgattgatgcttgtgctg

SEQ ID NO: 183788 - DNA, 25 bp, Homo sapien
tcctgaaggcccgaggcggtcaccg

SEQ ID NO: 183789 - DNA, 25 bp, Homo sapien
gcccgaggcggtcaccggagcttaa

SEQ ID NO: 183790 - DNA, 25 bp, Homo sapien
ctgcagccaggagtcatccacagga

SEQ ID NO: 183791 - DNA, 25 bp, Homo sapien
tgtgctgacgatggtcgtcttgatg

SEQ ID NO: 183792 - DNA, 25 bp, Homo sapien
atggtcgtcttgatgtcaccgatga

SEQ ID NO: 183793 - DNA, 25 bp, Homo sapien
aaggagactgggacctgattgatgc

SEQ ID NO: 183794 - DNA, 25 bp, Homo sapien
ggcggcctctcctgtcatattcagc

SEQ ID NO: 183795 - DNA, 25 bp, Homo sapien
actgccagttcctggtgccgcagca

SEQ ID NO: 183796 - DNA, 25 bp, Homo sapien
tctttccggcttctcgccaggggct

SEQ ID NO: 183797 - DNA, 25 bp, Homo sapien
gagcgattccgcatcgtcagttgga

SEQ ID NO: 183798 - DNA, 25 bp, Homo sapien
cttcgacaagaaccacgagcgattc

SEQ ID NO: 183799 - DNA, 25 bp, Homo sapien
gttcctggcgtccatcttcgacaag

SEQ ID NO: 183800 - DNA, 25 bp, Homo sapien
gctcaaggccgagctgaagttcctg

SEQ ID NO: 183801 - DNA, 25 bp, Homo sapien
tcggttacaaaggaagcgccaccca

SEQ ID NO: 183802 - DNA, 25 bp, Homo sapien
tctggcctcgtgcacgcgctgaaac

SEQ ID NO: 183803 - DNA, 25 bp, Homo sapien
cgtgccttcctttccactaggagta

SEQ ID NO: 183804 - DNA, 25 bp, Homo sapien
tctttcagagcgcatcactcaggtg

SEQ ID NO: 183805 - DNA, 25 bp, Homo sapien
cttggacgttctttcccagggctgc

SEQ ID NO: 183806 - DNA, 25 bp, Homo sapien
gcggagctgttctgaccataggtct

SEQ ID NO: 183807 - DNA, 25 bp, Homo sapien
gaagaagtccatcgctcacaacatg

SEQ ID NO: 183808 - DNA, 25 bp, Homo sapien
tcactcaggtgaggaccgacatcta

SEQ ID NO: 183809 - DNA, 25 bp, Homo sapien
cccagggacctgtgtctgtctttca

SEQ ID NO: 183810 - DNA, 25 bp, Homo sapien
ccgtggccgtttgtcatttggactc

SEQ ID NO: 183811 - DNA, 25 bp, Homo sapien
gttcagcaactcatggctatgccga

SEQ ID NO: 183812 - DNA, 25 bp, Homo sapien
tggcgaatcgtcaggtccgcaaaac

SEQ ID NO: 183813 - DNA, 25 bp, Homo sapien
tgctcccggaagatgctctaagctg

SEQ ID NO: 183814 - DNA, 25 bp, Homo sapien
agctcggccagaaacagctcctaga

SEQ ID NO: 183815 - DNA, 25 bp, Homo sapien
tggagacgcccacggcagtgacaca

SEQ ID NO: 183816 - DNA, 25 bp, Homo sapien
ctggcctctggcaggcaaacagcca

SEQ ID NO: 183817 - DNA, 25 bp, Homo sapien
acaccaagcggggtatggcgaatcg

SEQ ID NO: 183818 - DNA, 25 bp, Homo sapien
acagccaccggccacgaaatagatg

SEQ ID NO: 183819 - DNA, 25 bp, Homo sapien
cgggcaaccctatgctggcgtaatc

SEQ ID NO: 183820 - DNA, 25 bp, Homo sapien
agcaccttcgtgttgagtaacctgg

SEQ ID NO: 183821 - DNA, 25 bp, Homo sapien
atctggctcttcttccgaactagcg

SEQ ID NO: 183822 - DNA, 25 bp, Homo sapien
tgaacgtccgttcgcaatcctttgt

SEQ ID NO: 183823 - DNA, 25 bp, Homo sapien
aatcctttgtgcgtttgcgtcctca

SEQ ID NO: 183824 - DNA, 25 bp, Homo sapien
cagagtattgcggacccatcggagc

SEQ ID NO: 183825 - DNA, 25 bp, Homo sapien
cccatcggagcgtaacctggatctc

SEQ ID NO: 183826 - DNA, 25 bp, Homo sapien
tacacctcggagtacgggctccaga

SEQ ID NO: 183827 - DNA, 25 bp, Homo sapien
cccgcgcggatgaaacggagcaact

SEQ ID NO: 183828 - DNA, 25 bp, Homo sapien
tgaaacggagcaactgggaaagagc

SEQ ID NO: 183829 - DNA, 25 bp, Homo sapien
gagcaactgggaaagagctctggaa

SEQ ID NO: 183830 - DNA, 25 bp, Homo sapien
ctggaaactgcaaagcgctgcgcca

SEQ ID NO: 183831 - DNA, 25 bp, Homo sapien
ctgcgccaaagcgacgggaggttcc

SEQ ID NO: 183832 - DNA, 25 bp, Homo sapien
aagcgacgggaggttcccattctca

SEQ ID NO: 183833 - DNA, 25 bp, Homo sapien
cgggaggttcccattctcagctgta

SEQ ID NO: 183834 - DNA, 25 bp, Homo sapien
agcgcagcgggcactgcgtgccatc

SEQ ID NO: 183835 - DNA, 25 bp, Homo sapien
gcagcaggtatgtgtcctcgcagcc

SEQ ID NO: 183836 - DNA, 25 bp, Homo sapien
caggtatgtgtcctcgcagccggcc

SEQ ID NO: 183837 - DNA, 25 bp, Homo sapien
gcctcactgcccgagtcttgtggtc

SEQ ID NO: 183838 - DNA, 25 bp, Homo sapien
tcactgcccgagtcttgtggtcggg

SEQ ID NO: 183839 - DNA, 25 bp, Homo sapien
aaggtttgcaggatgcgtgctcgga

SEQ ID NO: 183840 - DNA, 25 bp, Homo sapien
ggctgggatcttgccgctgaccttc

SEQ ID NO: 183841 - DNA, 25 bp, Homo sapien
agcccgggcagcaggtatgtgtcct

SEQ ID NO: 183842 - DNA, 25 bp, Homo sapien
cgctgcagagccgagcgaatcccga

SEQ ID NO: 183843 - DNA, 25 bp, Homo sapien
taagaagctcttgcgaaccgcgatg

SEQ ID NO: 183844 - DNA, 25 bp, Homo sapien
agctgcagccctcgcaaggtaagcc

SEQ ID NO: 183845 - DNA, 25 bp, Homo sapien
cttcaaagtgttggaggccggcacg

SEQ ID NO: 183846 - DNA, 25 bp, Homo sapien
gccgcgcagccgcttcaaagtgttg

SEQ ID NO: 183847 - DNA, 25 bp, Homo sapien
aaccgcgatgctgggagattcctaa

SEQ ID NO: 183848 - DNA, 25 bp, Homo sapien
gctccgcaaccgtaagaagctcttg

SEQ ID NO: 183849 - DNA, 25 bp, Homo sapien
tcgcacaggttggaaaaggctccgc

SEQ ID NO: 183850 - DNA, 25 bp, Homo sapien
tccgcagtttgagatccggcagctg

SEQ ID NO: 183851 - DNA, 25 bp, Homo sapien
tttccgcctgcccattgggcggctg

SEQ ID NO: 183852 - DNA, 25 bp, Homo sapien
gccgctcggaacatggtctccgctt

SEQ ID NO: 183853 - DNA, 25 bp, Homo sapien
cgaacgagataagacgccctaggcc

SEQ ID NO: 183854 - DNA, 25 bp, Homo sapien
cgcgagacgcgcgaacgagataaga

SEQ ID NO: 183855 - DNA, 25 bp, Homo sapien
agccagtcacctaatgctcgcgaga

SEQ ID NO: 183856 - DNA, 25 bp, Homo sapien
gcagccaatagacggcgggaagtta

SEQ ID NO: 183857 - DNA, 25 bp, Homo sapien
acaaagctggccacccgctgatgac

SEQ ID NO: 183858 - DNA, 25 bp, Homo sapien
ggggccagtgatctttgcaagaccc

SEQ ID NO: 183859 - DNA, 25 bp, Homo sapien
ggacgctactggacgaggcttaaag

SEQ ID NO: 183860 - DNA, 25 bp, Homo sapien
tgaggaacgttcaccgtggaccatg

SEQ ID NO: 183861 - DNA, 25 bp, Homo sapien
ataatgttagcgtgcactcggggcc

SEQ ID NO: 183862 - DNA, 25 bp, Homo sapien
tcggctgcatccgtttcgacgccaa

SEQ ID NO: 183863 - DNA, 25 bp, Homo sapien
gccaaccaacctcatgctcttagta

SEQ ID NO: 183864 - DNA, 25 bp, Homo sapien
tcaggcccacaagcccgaaggtctg

SEQ ID NO: 183865 - DNA, 25 bp, Homo sapien
gagacactttatccgcaggcgtttc

SEQ ID NO: 183866 - DNA, 25 bp, Homo sapien
cggagctcaaaagccggacgctact

SEQ ID NO: 183867 - DNA, 25 bp, Homo sapien
cagttctggggaagcttcgtgacgc

SEQ ID NO: 183868 - DNA, 25 bp, Homo sapien
tgcgtgttgacgtcatgctgcgtgc

SEQ ID NO: 183869 - DNA, 25 bp, Homo sapien
gggaagcttcgtgacgccacaggtc

SEQ ID NO: 183870 - DNA, 25 bp, Homo sapien
ctagtgcgtgttgacgtcatgctgc

SEQ ID NO: 183871 - DNA, 25 bp, Homo sapien
ccggtgcggaatcgctccttcaact

SEQ ID NO: 183872 - DNA, 25 bp, Homo sapien
gctccttcaactccgcggggcagta

SEQ ID NO: 183873 - DNA, 25 bp, Homo sapien
ggcagtaggagttagttagcaaaga

SEQ ID NO: 183874 - DNA, 25 bp, Homo sapien
gttagttagcaaagagccgaggccg

SEQ ID NO: 183875 - DNA, 25 bp, Homo sapien
cagcgtgtaccacatcgagtgcttc

SEQ ID NO: 183876 - DNA, 25 bp, Homo sapien
gggagtcagatccacgaccagttta

SEQ ID NO: 183877 - DNA, 25 bp, Homo sapien
accagtttatcctgcgggtgtcgcc

SEQ ID NO: 183878 - DNA, 25 bp, Homo sapien
caagtgtgccgagtgcagccagtac

SEQ ID NO: 183879 - DNA, 25 bp, Homo sapien
agccagtacctggacgagacgtgca

SEQ ID NO: 183880 - DNA, 25 bp, Homo sapien
cttcgtgagagacgggaagacctac

SEQ ID NO: 183881 - DNA, 25 bp, Homo sapien
accgcagtctcctggtggccacaaa

SEQ ID NO: 183882 - DNA, 25 bp, Homo sapien
ggtacgcttgtgtccctaacgagaa

SEQ ID NO: 183883 - DNA, 25 bp, Homo sapien
ggcgccaggatgcaacctgctttca

SEQ ID NO: 183884 - DNA, 25 bp, Homo sapien
ggccattccagttccgaaagctctc

SEQ ID NO: 183885 - DNA, 25 bp, Homo sapien
cccaacagtatggtgccgagtcccg

SEQ ID NO: 183886 - DNA, 25 bp, Homo sapien
caagggacactttccgactcggagc

SEQ ID NO: 183887 - DNA, 25 bp, Homo sapien
ctcacaagagaggtcgcaggattaa

SEQ ID NO: 183888 - DNA, 25 bp, Homo sapien
gtctccctggattaaagtgctcaca

SEQ ID NO: 183889 - DNA, 25 bp, Homo sapien
cgggcagtcccatccgccatgagaa

SEQ ID NO: 183890 - DNA, 25 bp, Homo sapien
cttccaacagctggtgaggccctgc

SEQ ID NO: 183891 - DNA, 25 bp, Homo sapien
gcgaagttgtcgctttcactccgaa

SEQ ID NO: 183892 - DNA, 25 bp, Homo sapien
gtcgcaccgtcaacttcataggctg

SEQ ID NO: 183893 - DNA, 25 bp, Homo sapien
tatccctagtgtggaaggagcctgc

SEQ ID NO: 183894 - DNA, 25 bp, Homo sapien
ggcctgggtttgcttcttacgcctc

SEQ ID NO: 183895 - DNA, 25 bp, Homo sapien
ccagcgagctttgggaactcctatc

SEQ ID NO: 183896 - DNA, 25 bp, Homo sapien
ctttcagctgcaaggatcctgcgtc

SEQ ID NO: 183897 - DNA, 25 bp, Homo sapien
ctgggaggttagtcacagctgtctc

SEQ ID NO: 183898 - DNA, 25 bp, Homo sapien
caacgccgctgagtgttcaaacgtc

SEQ ID NO: 183899 - DNA, 25 bp, Homo sapien
gcacagtgcctcgtcacagtttagt

SEQ ID NO: 183900 - DNA, 25 bp, Homo sapien
agtgcctcgtcacagtttagtgcct

SEQ ID NO: 183901 - DNA, 25 bp, Homo sapien
cccatggcacggcgcctcccgacgg

SEQ ID NO: 183902 - DNA, 25 bp, Homo sapien
acggcacggcgcctctggtagcaca

SEQ ID NO: 183903 - DNA, 25 bp, Homo sapien
ggcacggcgcctctggtagcacagc

SEQ ID NO: 183904 - DNA, 25 bp, Homo sapien
tgcacagtgcctcgtcacagtttag

SEQ ID NO: 183905 - DNA, 25 bp, Homo sapien
gcccacagttcagcgcctccccaag

SEQ ID NO: 183906 - DNA, 25 bp, Homo sapien
acagtgcctcgtcacagtttagtgc

SEQ ID NO: 183907 - DNA, 25 bp, Homo sapien
ttcctggcaacgctgctagggtccc

SEQ ID NO: 183908 - DNA, 25 bp, Homo sapien
ggcgctcgctttcacttacttttta

SEQ ID NO: 183909 - DNA, 25 bp, Homo sapien
ctcttaggactaagagccagtcttc

SEQ ID NO: 183910 - DNA, 25 bp, Homo sapien
ttgtgagaaccgattcgttacccta

SEQ ID NO: 183911 - DNA, 25 bp, Homo sapien
aggctggagctgttccgtcattacc

SEQ ID NO: 183912 - DNA, 25 bp, Homo sapien
tttccctttctattcccgcgagcta

SEQ ID NO: 183913 - DNA, 25 bp, Homo sapien
ccaccgcgggatctgaaaggcgctt

SEQ ID NO: 183914 - DNA, 25 bp, Homo sapien
acgtctgcgcttcggttgtgagaac

SEQ ID NO: 183915 - DNA, 25 bp, Homo sapien
tgatttggttcgatgtcccggcgcg

SEQ ID NO: 183916 - DNA, 25 bp, Homo sapien
cccaagtgaggtgacgcggcagccc

SEQ ID NO: 183917 - DNA, 25 bp, Homo sapien
gcaagatctgtgttgtccgcgcgca

SEQ ID NO: 183918 - DNA, 25 bp, Homo sapien
tcccggctgcaagatctgtgttgtc

SEQ ID NO: 183919 - DNA, 25 bp, Homo sapien
gcggctcaaagcgtcccgccgggaa

SEQ ID NO: 183920 - DNA, 25 bp, Homo sapien
ccctgcttagttcggggcggctcaa

SEQ ID NO: 183921 - DNA, 25 bp, Homo sapien
gctcaactcgcactcccaggtgagg

SEQ ID NO: 183922 - DNA, 25 bp, Homo sapien
tgtgcggggtctcacgtccctcaca

SEQ ID NO: 183923 - DNA, 25 bp, Homo sapien
catgggcgttgtggccgccaccgca

SEQ ID NO: 183924 - DNA, 25 bp, Homo sapien
aacgtacgtcgcaccgcctctctgt

SEQ ID NO: 183925 - DNA, 25 bp, Homo sapien
cgcgggtcgtagaggtctaccctct

SEQ ID NO: 183926 - DNA, 25 bp, Homo sapien
gtcgtagaggtctaccctctctgca

SEQ ID NO: 183927 - DNA, 25 bp, Homo sapien
ctccgcgccggccatataggcctcc

SEQ ID NO: 183928 - DNA, 25 bp, Homo sapien
ctccgcaccgcattggtggaccggc

SEQ ID NO: 183929 - DNA, 25 bp, Homo sapien
cccagcccgtccatgggcgttgtgg

SEQ ID NO: 183930 - DNA, 25 bp, Homo sapien
aggagctgcactacccgctgggcga

SEQ ID NO: 183931 - DNA, 25 bp, Homo sapien
aagctgtcgctctacaagaaggcca

SEQ ID NO: 183932 - DNA, 25 bp, Homo sapien
gaacaggctgacctcagccttggtc

SEQ ID NO: 183933 - DNA, 25 bp, Homo sapien
ggccttccctcgaggagcagcgcag

SEQ ID NO: 183934 - DNA, 25 bp, Homo sapien
tccagaagagcaagctgtcgctcta

SEQ ID NO: 183935 - DNA, 25 bp, Homo sapien
accgggtccagaagagcaagctgtc

SEQ ID NO: 183936 - DNA, 25 bp, Homo sapien
atgaggccgtcatggaccgggtcca

SEQ ID NO: 183937 - DNA, 25 bp, Homo sapien
gccctcggctcagaacctcgtgtcc

SEQ ID NO: 183938 - DNA, 25 bp, Homo sapien
agggcatttggaacaggctgacctc

SEQ ID NO: 183939 - DNA, 25 bp, Homo sapien
gttcaggcccacagaggggcagagt

SEQ ID NO: 183940 - DNA, 25 bp, Homo sapien
cgacagtttcatccaggccaagagc

SEQ ID NO: 183941 - DNA, 25 bp, Homo sapien
acgccgacatcgacagtttcatcca

SEQ ID NO: 183942 - DNA, 25 bp, Homo sapien
gcatagacgccgacatcgacagttt

SEQ ID NO: 183943 - DNA, 25 bp, Homo sapien
ctgacgctggaaggctgcagcatag

SEQ ID NO: 183944 - DNA, 25 bp, Homo sapien
caggccaagagcacgggcacagagc

SEQ ID NO: 183945 - DNA, 25 bp, Homo sapien
cgctggtcagagttcaggcccacag

SEQ ID NO: 183946 - DNA, 25 bp, Homo sapien
aggctgcagcatagacgccgacatc

SEQ ID NO: 183947 - DNA, 25 bp, Homo sapien
acctgagcctctggcgaagatccta

SEQ ID NO: 183948 - DNA, 25 bp, Homo sapien
aagatcctatttcgagcccgacgtc

SEQ ID NO: 183949 - DNA, 25 bp, Homo sapien
ttcgagcccgacgtcctgctacagt

SEQ ID NO: 183950 - DNA, 25 bp, Homo sapien
agtctgcaataagcgctctccgtcc

SEQ ID NO: 183951 - DNA, 25 bp, Homo sapien
gaggttgagaaagaccagcacggtc

SEQ ID NO: 183952 - DNA, 25 bp, Homo sapien
tgcgctcaccgagagagcggcaatg

SEQ ID NO: 183953 - DNA, 25 bp, Homo sapien
gtagcttcagccaatcgcctctgcg

SEQ ID NO: 183954 - DNA, 25 bp, Homo sapien
cacgcggccggtagcttcagccaat

SEQ ID NO: 183955 - DNA, 25 bp, Homo sapien
tgagtagaagacaaccgagcggacg

SEQ ID NO: 183956 - DNA, 25 bp, Homo sapien
acagacggcgcgtgagtagaagaca

SEQ ID NO: 183957 - DNA, 25 bp, Homo sapien
acaaccgagcggacgcggacagccg

SEQ ID NO: 183958 - DNA, 25 bp, Homo sapien
acagccgggccgctgttacctgagg

SEQ ID NO: 183959 - DNA, 25 bp, Homo sapien
cgagcaactgacactgactaacaac

SEQ ID NO: 183960 - DNA, 25 bp, Homo sapien
acaactaactaactactcgccgcgg

SEQ ID NO: 183961 - DNA, 25 bp, Homo sapien
gccttccaacctccagaggacgaga

SEQ ID NO: 183962 - DNA, 25 bp, Homo sapien
acgagacctaaagggtgcctgattg

SEQ ID NO: 183963 - DNA, 25 bp, Homo sapien
agcctcttgaaggagtagtcccgga

SEQ ID NO: 183964 - DNA, 25 bp, Homo sapien
ggttgcatttctccagcgtcagctg

SEQ ID NO: 183965 - DNA, 25 bp, Homo sapien
accttgagtcggtacagcctcttga

SEQ ID NO: 183966 - DNA, 25 bp, Homo sapien
cagagacattgagcacgcgcaggta

SEQ ID NO: 183967 - DNA, 25 bp, Homo sapien
gcccaccgagtggaagactgattcc

SEQ ID NO: 183968 - DNA, 25 bp, Homo sapien
gaagtccttgaactccttgccctgg

SEQ ID NO: 183969 - DNA, 25 bp, Homo sapien
cgcccattgctcttggctgagacca

SEQ ID NO: 183970 - DNA, 25 bp, Homo sapien
ggtcattgtcgccaacctccagtga

SEQ ID NO: 183971 - DNA, 25 bp, Homo sapien
cacgcttagggcagcgaaacaggca

SEQ ID NO: 183972 - DNA, 25 bp, Homo sapien
gcgcgcacaccgttgtgtgtgattt

SEQ ID NO: 183973 - DNA, 25 bp, Homo sapien
cgcgcgagtgtgtttacacgtgtta

SEQ ID NO: 183974 - DNA, 25 bp, Homo sapien
cacgtgttaactgggctgtggacga

SEQ ID NO: 183975 - DNA, 25 bp, Homo sapien
tggacgaacacacgcacgaggacgg

SEQ ID NO: 183976 - DNA, 25 bp, Homo sapien
agggctccctacacgaacagggttg

SEQ ID NO: 183977 - DNA, 25 bp, Homo sapien
cgcggccgcaaaacctggtgatggt

SEQ ID NO: 183978 - DNA, 25 bp, Homo sapien
gtggttcgtctcctttcagcggagg

SEQ ID NO: 183979 - DNA, 25 bp, Homo sapien
accagcccgacaggaatagacgctc

SEQ ID NO: 183980 - DNA, 25 bp, Homo sapien
ctgctccctgcctcagtgatctcgg

SEQ ID NO: 183981 - DNA, 25 bp, Homo sapien
ggctattcctggtgcggtgactgac

SEQ ID NO: 183982 - DNA, 25 bp, Homo sapien
ggctcctgcgtaaaggctccgccag

SEQ ID NO: 183983 - DNA, 25 bp, Homo sapien
gacaggaatagacgctcgctggctc

SEQ ID NO: 183984 - DNA, 25 bp, Homo sapien
tgtttgtgagctacccgtgcgctcc

SEQ ID NO: 183985 - DNA, 25 bp, Homo sapien
ccggctgtttgtgagctacccgtgc

SEQ ID NO: 183986 - DNA, 25 bp, Homo sapien
ctcgctggctcctgcgtaaaggctc

SEQ ID NO: 183987 - DNA, 25 bp, Homo sapien
ttcctgggaactcgaattccattcg

SEQ ID NO: 183988 - DNA, 25 bp, Homo sapien
aagggaaagttgatcgcggacttga

SEQ ID NO: 183989 - DNA, 25 bp, Homo sapien
aattccattcgcgttggccttggga

SEQ ID NO: 183990 - DNA, 25 bp, Homo sapien
atgcttggctagaggacgcgtccga

SEQ ID NO: 183991 - DNA, 25 bp, Homo sapien
ccttgggaggacaggcatcccatcc

SEQ ID NO: 183992 - DNA, 25 bp, Homo sapien
gtgaccgcggctgccgaaccacttg

SEQ ID NO: 183993 - DNA, 25 bp, Homo sapien
agtggagcgcgttgggatccaatcc

SEQ ID NO: 183994 - DNA, 25 bp, Homo sapien
cgacgcgcggcaactttgattcctg

SEQ ID NO: 183995 - DNA, 25 bp, Homo sapien
caggtgccgactcgggcttctcgca

SEQ ID NO: 183996 - DNA, 25 bp, Homo sapien
tccgcactcccgactcgccctcctg

SEQ ID NO: 183997 - DNA, 25 bp, Homo sapien
atgccggcagaatctctaccgcgcg

SEQ ID NO: 183998 - DNA, 25 bp, Homo sapien
atgcgatgccggcagaatctctacc

SEQ ID NO: 183999 - DNA, 25 bp, Homo sapien
ccacgatgcgatgccggcagaatct

SEQ ID NO: 184000 - DNA, 25 bp, Homo sapien
tgctcgccacgatgcgatgccggca

SEQ ID NO: 184001 - DNA, 25 bp, Homo sapien
ccggcgggcagacacaccggctccc

SEQ ID NO: 184002 - DNA, 25 bp, Homo sapien
cgccctcctggagcgctcacaaaga

SEQ ID NO: 184003 - DNA, 25 bp, Homo sapien
cgacttagcacgaagagtgcgatgg

SEQ ID NO: 184004 - DNA, 25 bp, Homo sapien
agggctgcttttggcaaaccgtctc

SEQ ID NO: 184005 - DNA, 25 bp, Homo sapien
acctgcactggggtagaaatggctg

SEQ ID NO: 184006 - DNA, 25 bp, Homo sapien
gcgggctcgctctcatggtgccaac

SEQ ID NO: 184007 - DNA, 25 bp, Homo sapien
tggcctcaaactccgagtccattca

SEQ ID NO: 184008 - DNA, 25 bp, Homo sapien
tcaggcgtgtaattggggaaactcc

SEQ ID NO: 184009 - DNA, 25 bp, Homo sapien
ggccagcgccagagtagatacctgt

SEQ ID NO: 184010 - DNA, 25 bp, Homo sapien
tctgcctgttctcgggcttgcacgc

SEQ ID NO: 184011 - DNA, 25 bp, Homo sapien
gtctgaggatctggtctacaccatc

SEQ ID NO: 184012 - DNA, 25 bp, Homo sapien
catccctgcggaggctctgaggagc

SEQ ID NO: 184013 - DNA, 25 bp, Homo sapien
tccctgcggaggctctgaggagcac

SEQ ID NO: 184014 - DNA, 25 bp, Homo sapien
atctggtctacaccatcgagcagcc

SEQ ID NO: 184015 - DNA, 25 bp, Homo sapien
acggcgactctgggtctgaggatct

SEQ ID NO: 184016 - DNA, 25 bp, Homo sapien
gaggatctggtctacaccatcgagc

SEQ ID NO: 184017 - DNA, 25 bp, Homo sapien
ctctgaggagcacggacggcgactc

SEQ ID NO: 184018 - DNA, 25 bp, Homo sapien
gcgggctcgtgctgttctcacacag

SEQ ID NO: 184019 - DNA, 25 bp, Homo sapien
ggtccgacagggtcaactgagtcga

SEQ ID NO: 184020 - DNA, 25 bp, Homo sapien
tccgacagggtcaactgagtcgacg

SEQ ID NO: 184021 - DNA, 25 bp, Homo sapien
ggtggacttttctcacgcccgcaca

SEQ ID NO: 184022 - DNA, 25 bp, Homo sapien
ccctgtctcgggagcggagtagcgg

SEQ ID NO: 184023 - DNA, 25 bp, Homo sapien
atcatcgcaccaggaagccagggcc

SEQ ID NO: 184024 - DNA, 25 bp, Homo sapien
agaggccagggcagacaacctccac

SEQ ID NO: 184025 - DNA, 25 bp, Homo sapien
gtgcctcatcatcgcaccaggaagc

SEQ ID NO: 184026 - DNA, 25 bp, Homo sapien
ctcatcatcgcaccaggaagccagg

SEQ ID NO: 184027 - DNA, 25 bp, Homo sapien
cgcgtcgaacacgaaccagcggctg

SEQ ID NO: 184028 - DNA, 25 bp, Homo sapien
gaaatagtaaaggtagcagcggcgc

SEQ ID NO: 184029 - DNA, 25 bp, Homo sapien
cgtcctgcggactcttgaaatagta

SEQ ID NO: 184030 - DNA, 25 bp, Homo sapien
cgtccgcgatgtccaagtggccgag

SEQ ID NO: 184031 - DNA, 25 bp, Homo sapien
ccttgcccgacagcttctgcagata

SEQ ID NO: 184032 - DNA, 25 bp, Homo sapien
ggtcccaccttgagcaccgtgacgg

SEQ ID NO: 184033 - DNA, 25 bp, Homo sapien
tgaagcaggcgtccgcgatgtccaa

SEQ ID NO: 184034 - DNA, 25 bp, Homo sapien
gcttctgcagatagccacacagccg

SEQ ID NO: 184035 - DNA, 25 bp, Homo sapien
acgggaacccggagcggcagcgact

SEQ ID NO: 184036 - DNA, 25 bp, Homo sapien
cgagtggcgccccttgacctggggc

SEQ ID NO: 184037 - DNA, 25 bp, Homo sapien
aaaaaccctctcgaggcgggcagtg

SEQ ID NO: 184038 - DNA, 25 bp, Homo sapien
agtccaggtcgcacggcgtgagggt

SEQ ID NO: 184039 - DNA, 25 bp, Homo sapien
ggcacgaacccttggctcccgcggc

SEQ ID NO: 184040 - DNA, 25 bp, Homo sapien
gacgctgcccggcacgaacccttgg

SEQ ID NO: 184041 - DNA, 25 bp, Homo sapien
cgactcccatcagcggccgccagac

SEQ ID NO: 184042 - DNA, 25 bp, Homo sapien
tgcccggcacgaacccttggctccc

SEQ ID NO: 184043 - DNA, 25 bp, Homo sapien
agtttccgggttcgcctggcgctca

SEQ ID NO: 184044 - DNA, 25 bp, Homo sapien
atctctaaggtgagcgctggcaggc

SEQ ID NO: 184045 - DNA, 25 bp, Homo sapien
gcccgcgtggatctctaaggtgagc

SEQ ID NO: 184046 - DNA, 25 bp, Homo sapien
tgcgcactgccgctgcggctgttgc

SEQ ID NO: 184047 - DNA, 25 bp, Homo sapien
cgcgaagcaatcctgaggcggtcta

SEQ ID NO: 184048 - DNA, 25 bp, Homo sapien
cggcgattcgccagcggaatgtcca

SEQ ID NO: 184049 - DNA, 25 bp, Homo sapien
agccaggccagtcacagagagacga

SEQ ID NO: 184050 - DNA, 25 bp, Homo sapien
aaggtcacgggagcctctgtcccgg

SEQ ID NO: 184051 - DNA, 25 bp, Homo sapien
gtgaaggagacccagtactatgaca

SEQ ID NO: 184052 - DNA, 25 bp, Homo sapien
cctccgcgaaggttctaggcctttg

SEQ ID NO: 184053 - DNA, 25 bp, Homo sapien
tactatgacatcctgggcgtgaagc

SEQ ID NO: 184054 - DNA, 25 bp, Homo sapien
ggcgctcaagtaccacccggacaag

SEQ ID NO: 184055 - DNA, 25 bp, Homo sapien
gtcaccgtctccttgcggaagcttc

SEQ ID NO: 184056 - DNA, 25 bp, Homo sapien
gccaagggttattaagccaggagca

SEQ ID NO: 184057 - DNA, 25 bp, Homo sapien
cccgcagacacaagatggtgaagga

SEQ ID NO: 184058 - DNA, 25 bp, Homo sapien
gctccacggacccacggaagggcaa

SEQ ID NO: 184059 - DNA, 25 bp, Homo sapien
cttgcgagctcagagtgtgcccgct

SEQ ID NO: 184060 - DNA, 25 bp, Homo sapien
tctccgccttgcgagctcagagtgt

SEQ ID NO: 184061 - DNA, 25 bp, Homo sapien
cagtctccgccttgcgagctcagag

SEQ ID NO: 184062 - DNA, 25 bp, Homo sapien
agctcagagtgtgcccgctgcgccg

SEQ ID NO: 184063 - DNA, 25 bp, Homo sapien
ccaacttcgccggcacctggaagat

SEQ ID NO: 184064 - DNA, 25 bp, Homo sapien
agatgcgcagcagcgagaatttcga

SEQ ID NO: 184065 - DNA, 25 bp, Homo sapien
agcgagaatttcgacgagctgctca

SEQ ID NO: 184066 - DNA, 25 bp, Homo sapien
aatttcgacgagctgctcaaggcac

SEQ ID NO: 184067 - DNA, 25 bp, Homo sapien
ccctcctcgatggtgcggactttat

SEQ ID NO: 184068 - DNA, 25 bp, Homo sapien
gtttgctgaatgtttggcgccctcc

SEQ ID NO: 184069 - DNA, 25 bp, Homo sapien
acccacgcgttcagcgaacgtttgc

SEQ ID NO: 184070 - DNA, 25 bp, Homo sapien
tagagatcccggaacccacgcgttc

SEQ ID NO: 184071 - DNA, 25 bp, Homo sapien
tctcggagaagctggtagagatccc

SEQ ID NO: 184072 - DNA, 25 bp, Homo sapien
ccggggcaatagatcgccttgtctc

SEQ ID NO: 184073 - DNA, 25 bp, Homo sapien
gctgctcaaggcactgggtaagctg

SEQ ID NO: 184074 - DNA, 25 bp, Homo sapien
gcggactttatctcgtgctagatca

SEQ ID NO: 184075 - DNA, 25 bp, Homo sapien
tacagttttagcagtcccgatggcc

SEQ ID NO: 184076 - DNA, 25 bp, Homo sapien
cgcgttcccagcagtggcttttgca

SEQ ID NO: 184077 - DNA, 25 bp, Homo sapien
cttttgcagcggtttgcagcgccaa

SEQ ID NO: 184078 - DNA, 25 bp, Homo sapien
agccgccaggttctctgtcgcaggt

SEQ ID NO: 184079 - DNA, 25 bp, Homo sapien
aggtgaagccgcagctcttgcattc

SEQ ID NO: 184080 - DNA, 25 bp, Homo sapien
gcctgggtacgctctggatacagtt

SEQ ID NO: 184081 - DNA, 25 bp, Homo sapien
ccctggctcaagacaaagtattacc

SEQ ID NO: 184082 - DNA, 25 bp, Homo sapien
cttccttgcagggtgtgtacactgg

SEQ ID NO: 184083 - DNA, 25 bp, Homo sapien
gtcccagcgagtcagctccacttga

SEQ ID NO: 184084 - DNA, 25 bp, Homo sapien
accttacctagggacgcagccagga

SEQ ID NO: 184085 - DNA, 25 bp, Homo sapien
gaagcctcccgcgactgagtgcgag

SEQ ID NO: 184086 - DNA, 25 bp, Homo sapien
ctcccgcgactgagtgcgagcgagt

SEQ ID NO: 184087 - DNA, 25 bp, Homo sapien
tcagctccacttgatcggcagttta

SEQ ID NO: 184088 - DNA, 25 bp, Homo sapien
aactgcctctccgagggccgcgtgg

SEQ ID NO: 184089 - DNA, 25 bp, Homo sapien
cttgatcggcagtttaaagcccgtt

SEQ ID NO: 184090 - DNA, 25 bp, Homo sapien
agccagcgtgcgtcccagcgagtca

SEQ ID NO: 184091 - DNA, 25 bp, Homo sapien
gctctgctgctctcgcgatatttgc

SEQ ID NO: 184092 - DNA, 25 bp, Homo sapien
ctaggcgccgaattccttgcttttc

SEQ ID NO: 184093 - DNA, 25 bp, Homo sapien
cgacggcgcgagaaatcgctttctg

SEQ ID NO: 184094 - DNA, 25 bp, Homo sapien
gggccgcccacgtctgacaagttaa

SEQ ID NO: 184095 - DNA, 25 bp, Homo sapien
ggatcgctgcgaaggccaaactagc

SEQ ID NO: 184096 - DNA, 25 bp, Homo sapien
gagctctttctcctagcagttccga

SEQ ID NO: 184097 - DNA, 25 bp, Homo sapien
tctcgcgggagttaggcgacaaatc

SEQ ID NO: 184098 - DNA, 25 bp, Homo sapien
caaaagcaggtcagtttcgggcctc

SEQ ID NO: 184099 - DNA, 25 bp, Homo sapien
gtgccactcaagagccgaaagcctg

SEQ ID NO: 184100 - DNA, 25 bp, Homo sapien
ggagctgtcagtgttaccgccacga

SEQ ID NO: 184101 - DNA, 25 bp, Homo sapien
ctgcgaaactcggaggtgccactca

SEQ ID NO: 184102 - DNA, 25 bp, Homo sapien
tagccggattctgactgggatactc

SEQ ID NO: 184103 - DNA, 25 bp, Homo sapien
aatttctgttcgcagcctcctaggc

SEQ ID NO: 184104 - DNA, 25 bp, Homo sapien
ctcacctgtaacctaggagggctga

SEQ ID NO: 184105 - DNA, 25 bp, Homo sapien
accgggaggagccaatcagaagtca

SEQ ID NO: 184106 - DNA, 25 bp, Homo sapien
cgacaacgtggaccctgcgaaactc

SEQ ID NO: 184107 - DNA, 25 bp, Homo sapien
cccgctatccgtgcggctcgtggtg

SEQ ID NO: 184108 - DNA, 25 bp, Homo sapien
cgccgtgccctcagctgggcctcgt

SEQ ID NO: 184109 - DNA, 25 bp, Homo sapien
ggctcgtggtgtcctagtgaaatga

SEQ ID NO: 184110 - DNA, 25 bp, Homo sapien
cgtcccgcgagggattggaggccct

SEQ ID NO: 184111 - DNA, 25 bp, Homo sapien
ccctgtgtccctgtcgtcccgcgag

SEQ ID NO: 184112 - DNA, 25 bp, Homo sapien
ggacccgccctcaccaagtggcctc

SEQ ID NO: 184113 - DNA, 25 bp, Homo sapien
agtggcctccagtagcccctgtgtc

SEQ ID NO: 184114 - DNA, 25 bp, Homo sapien
ggcgcccgacgtgccttggcgacac

SEQ ID NO: 184115 - DNA, 25 bp, Homo sapien
ggggccatattagcagcggttattc

SEQ ID NO: 184116 - DNA, 25 bp, Homo sapien
tcaggcgtggagacaacagaaagtt

SEQ ID NO: 184117 - DNA, 25 bp, Homo sapien
cggaggtgccggtgaactcaaaata

SEQ ID NO: 184118 - DNA, 25 bp, Homo sapien
tcggtacgtgaaagttagctctccc

SEQ ID NO: 184119 - DNA, 25 bp, Homo sapien
gctccgtggacatctcaggtcttca

SEQ ID NO: 184120 - DNA, 25 bp, Homo sapien
ttcagggtcttccatctggtgagcc

SEQ ID NO: 184121 - DNA, 25 bp, Homo sapien
tcgtgaacgtcaagacagtcggtcc

SEQ ID NO: 184122 - DNA, 25 bp, Homo sapien
tccgtcctcaggagttcggtacgtg

SEQ ID NO: 184123 - DNA, 25 bp, Homo sapien
gggagcttccacatgcgtcccgagc

SEQ ID NO: 184124 - DNA, 25 bp, Homo sapien
gactccacatcgcggtgcccaggaa

SEQ ID NO: 184125 - DNA, 25 bp, Homo sapien
tcgttttgtctcacgactcacactc

SEQ ID NO: 184126 - DNA, 25 bp, Homo sapien
tcccgagcccgccagaagctgctag

SEQ ID NO: 184127 - DNA, 25 bp, Homo sapien
gccaaaaggaacaaggcgaggattg

SEQ ID NO: 184128 - DNA, 25 bp, Homo sapien
tgaatagaccggactgggccaaaag

SEQ ID NO: 184129 - DNA, 25 bp, Homo sapien
gctatgaatagaccggactgggcca

SEQ ID NO: 184130 - DNA, 25 bp, Homo sapien
tgcgtctgccctcgttttgtctcac

SEQ ID NO: 184131 - DNA, 25 bp, Homo sapien
caggaccagatcgattttcgcctta

SEQ ID NO: 184132 - DNA, 25 bp, Homo sapien
cttgaggttcatggaagagccgatc

SEQ ID NO: 184133 - DNA, 25 bp, Homo sapien
cgctctcccaatagtccttgaggtt

SEQ ID NO: 184134 - DNA, 25 bp, Homo sapien
ctggggctttgatgatggcccactc

SEQ ID NO: 184135 - DNA, 25 bp, Homo sapien
acttgatgtcgtgtttgtagcctgg

SEQ ID NO: 184136 - DNA, 25 bp, Homo sapien
ggtagatctcctcgcagcagttgta

SEQ ID NO: 184137 - DNA, 25 bp, Homo sapien
cgccggatgtacagcgagtatgtga

SEQ ID NO: 184138 - DNA, 25 bp, Homo sapien
gtaggaccaggaaccgaacttcatg

SEQ ID NO: 184139 - DNA, 25 bp, Homo sapien
tgactcccaggtttggtggtggcta

SEQ ID NO: 184140 - DNA, 25 bp, Homo sapien
ggccttggccaagtcttcagccatc

SEQ ID NO: 184141 - DNA, 25 bp, Homo sapien
ggacaggaaccatccggagtgaagc

SEQ ID NO: 184142 - DNA, 25 bp, Homo sapien
acgcctgtgcgcgtacctggcagca

SEQ ID NO: 184143 - DNA, 25 bp, Homo sapien
tgcgcccaagacgaaggacccggtc

SEQ ID NO: 184144 - DNA, 25 bp, Homo sapien
cttcagccatctccgtcaaatgagg

SEQ ID NO: 184145 - DNA, 25 bp, Homo sapien
ggtccctcagcgacgcagccaggag

SEQ ID NO: 184146 - DNA, 25 bp, Homo sapien
gcgcgtacctggcagcagagacagc

SEQ ID NO: 184147 - DNA, 25 bp, Homo sapien
acagtgcgggcacccttggtacagc

SEQ ID NO: 184148 - DNA, 25 bp, Homo sapien
cgcctggcttccctatctcttcggg

SEQ ID NO: 184149 - DNA, 25 bp, Homo sapien
cagggatgtactgggcccgctgctc

SEQ ID NO: 184150 - DNA, 25 bp, Homo sapien
cccgcccactcagggatgtactggg

SEQ ID NO: 184151 - DNA, 25 bp, Homo sapien
cgcaaagggcgaccaggaagaaaag

SEQ ID NO: 184152 - DNA, 25 bp, Homo sapien
tggccgggacaatctcgggccactc

SEQ ID NO: 184153 - DNA, 25 bp, Homo sapien
tgcctcagcgagtgggctcagccct

SEQ ID NO: 184154 - DNA, 25 bp, Homo sapien
ccatctggccgggacaatctcgggc

SEQ ID NO: 184155 - DNA, 25 bp, Homo sapien
ccctgcagcttgctttagaaagcgg

SEQ ID NO: 184156 - DNA, 25 bp, Homo sapien
gccgctgccctcagttctgtactgg

SEQ ID NO: 184157 - DNA, 25 bp, Homo sapien
cagcttgctttagaaagcggggtcg

SEQ ID NO: 184158 - DNA, 25 bp, Homo sapien
gcggtacggtctcccctgcagcttg

SEQ ID NO: 184159 - DNA, 25 bp, Homo sapien
gcctccttgtgagcggctcgcggta

SEQ ID NO: 184160 - DNA, 25 bp, Homo sapien
ggccttgcatggtcctgcagcgcct

SEQ ID NO: 184161 - DNA, 25 bp, Homo sapien
tcccacactgctgggccttgcatgg

SEQ ID NO: 184162 - DNA, 25 bp, Homo sapien
acactgctgggccttgcatggtcct

SEQ ID NO: 184163 - DNA, 25 bp, Homo sapien
ctggcgcagtcagcggcgggcaacc

SEQ ID NO: 184164 - DNA, 25 bp, Homo sapien
catcctggcgcagtcagcggcgggc

SEQ ID NO: 184165 - DNA, 25 bp, Homo sapien
gcggcgggcaacccgctgatggcct

SEQ ID NO: 184166 - DNA, 25 bp, Homo sapien
tctgtgcatcctggcgcagtcagcg

SEQ ID NO: 184167 - DNA, 25 bp, Homo sapien
tgcatcctggcgcagtcagcggcgg

SEQ ID NO: 184168 - DNA, 25 bp, Homo sapien
tgtgcatcctggcgcagtcagcggc

SEQ ID NO: 184169 - DNA, 25 bp, Homo sapien
ctgtgcatcctggcgcagtcagcgg

SEQ ID NO: 184170 - DNA, 25 bp, Homo sapien
tcctggcgcagtcagcggcgggcaa

SEQ ID NO: 184171 - DNA, 25 bp, Homo sapien
ggcggtcccgctcacagcctggagt

SEQ ID NO: 184172 - DNA, 25 bp, Homo sapien
gaatggtagatgctcatttatgtaa

SEQ ID NO: 184173 - DNA, 25 bp, Homo sapien
ggtagatgctcatttatgtaaaatc

SEQ ID NO: 184174 - DNA, 25 bp, Homo sapien
tcataataaatgttacacaaactgt

SEQ ID NO: 184175 - DNA, 25 bp, Homo sapien
aaatgttacacaaactgttagaata

SEQ ID NO: 184176 - DNA, 25 bp, Homo sapien
tagtgagagggggttagcaccatta

SEQ ID NO: 184177 - DNA, 25 bp, Homo sapien
tgggcactgaggtctgtcggtcggt

SEQ ID NO: 184178 - DNA, 25 bp, Homo sapien
aaggacaggcggtcccgctcacagc

SEQ ID NO: 184179 - DNA, 25 bp, Homo sapien
tgcgctccaacgtgtacgaggtcta

SEQ ID NO: 184180 - DNA, 25 bp, Homo sapien
cacggacaaggatgagggcctcaac

SEQ ID NO: 184181 - DNA, 25 bp, Homo sapien
ctcaacggggcggtgcgctacagct

SEQ ID NO: 184182 - DNA, 25 bp, Homo sapien
cttcctgaagactgcgggcaaccgg

SEQ ID NO: 184183 - DNA, 25 bp, Homo sapien
gactgggagttcttcatcatcgacc

SEQ ID NO: 184184 - DNA, 25 bp, Homo sapien
tcatccagactgctcagcgcctgga

SEQ ID NO: 184185 - DNA, 25 bp, Homo sapien
gtgtacgaggtctacgccacggaca

SEQ ID NO: 184186 - DNA, 25 bp, Homo sapien
tctacgccacggacaaggatgaggg

SEQ ID NO: 184187 - DNA, 25 bp, Homo sapien
gtgtccacacactgcacgtcccgca

SEQ ID NO: 184188 - DNA, 25 bp, Homo sapien
aggcccacaggcgtgaccccgtgag

SEQ ID NO: 184189 - DNA, 25 bp, Homo sapien
ccgggctgacaatggaagggccgca

SEQ ID NO: 184190 - DNA, 25 bp, Homo sapien
actgaggaacctccgccgcagctgc

SEQ ID NO: 184191 - DNA, 25 bp, Homo sapien
aggtcccgtgtgtccacacactgca

SEQ ID NO: 184192 - DNA, 25 bp, Homo sapien
tgtggcgggaaaggcatccaggccc

SEQ ID NO: 184193 - DNA, 25 bp, Homo sapien
gccggaggtcccgtgtgtccacaca

SEQ ID NO: 184194 - DNA, 25 bp, Homo sapien
accgagagacgtgtatggacacatc

SEQ ID NO: 184195 - DNA, 25 bp, Homo sapien
cgtcgactcgaaccgggtgcacgat

SEQ ID NO: 184196 - DNA, 25 bp, Homo sapien
ctcgcgcccgcggtattgtagctcg

SEQ ID NO: 184197 - DNA, 25 bp, Homo sapien
cgactcgaaccgggtgcacgatgtc

SEQ ID NO: 184198 - DNA, 25 bp, Homo sapien
cgcgtcgactcgaaccgggtgcacg

SEQ ID NO: 184199 - DNA, 25 bp, Homo sapien
gccacagctcgtaggacaggaagga

SEQ ID NO: 184200 - DNA, 25 bp, Homo sapien
cgcggtattgtagctcgtagaaggc

SEQ ID NO: 184201 - DNA, 25 bp, Homo sapien
cccgcggtattgtagctcgtagaag

SEQ ID NO: 184202 - DNA, 25 bp, Homo sapien
gcccgcggtattgtagctcgtagaa

SEQ ID NO: 184203 - DNA, 25 bp, Homo sapien
acgaggtgcccttcgctgtgttccc

SEQ ID NO: 184204 - DNA, 25 bp, Homo sapien
ctggtcccaggtccggctcaggaca

SEQ ID NO: 184205 - DNA, 25 bp, Homo sapien
gaagacgcgaccaactccaggcaca

SEQ ID NO: 184206 - DNA, 25 bp, Homo sapien
cttattccaggcgacaggcagtgtc

SEQ ID NO: 184207 - DNA, 25 bp, Homo sapien
tgtcagtaactgaatcaggggccga

SEQ ID NO: 184208 - DNA, 25 bp, Homo sapien
cgaagagcggaaggggcttattcca

SEQ ID NO: 184209 - DNA, 25 bp, Homo sapien
cctaaattgggctccacgaggtgcc

SEQ ID NO: 184210 - DNA, 25 bp, Homo sapien
ttccagaattaatgtgttgtcccta

SEQ ID NO: 184211 - DNA, 25 bp, Homo sapien
gaggctttcagtgcgcccggtttct

SEQ ID NO: 184212 - DNA, 25 bp, Homo sapien
aagaggctcattgccgcctgtctgc

SEQ ID NO: 184213 - DNA, 25 bp, Homo sapien
ggccacggagacactgcgcggaccc

SEQ ID NO: 184214 - DNA, 25 bp, Homo sapien
tgtctgctctccctgagaaccggca

SEQ ID NO: 184215 - DNA, 25 bp, Homo sapien
ctgccctggagaagcgaccacctcc

SEQ ID NO: 184216 - DNA, 25 bp, Homo sapien
agaagcgaccacctcccggctccag

SEQ ID NO: 184217 - DNA, 25 bp, Homo sapien
gtctccgccggcagaagaggctcat

SEQ ID NO: 184218 - DNA, 25 bp, Homo sapien
tcagtgcgcccggtttctcagacct

SEQ ID NO: 184219 - DNA, 25 bp, Homo sapien
acgctcaccgtgctcaacatgtatg

SEQ ID NO: 184220 - DNA, 25 bp, Homo sapien
ggtgctgatcaaactgaacgccatg

SEQ ID NO: 184221 - DNA, 25 bp, Homo sapien
ccaagcgttcacactctgaggggtg

SEQ ID NO: 184222 - DNA, 25 bp, Homo sapien
agcatcttcctcctcagtgccatga

SEQ ID NO: 184223 - DNA, 25 bp, Homo sapien
atctgcaaggtgatgctgacgctca

SEQ ID NO: 184224 - DNA, 25 bp, Homo sapien
ctgggcaacggatcagagaacacta

SEQ ID NO: 184225 - DNA, 25 bp, Homo sapien
gagcggatccctgcatcgccatcaa

SEQ ID NO: 184226 - DNA, 25 bp, Homo sapien
tattgcattgtgactggcgcgctgc

SEQ ID NO: 184227 - DNA, 25 bp, Homo sapien
cgccgaagcaggacccgaagcctaa

SEQ ID NO: 184228 - DNA, 25 bp, Homo sapien
gaggcacagcttacgggcagatgca

SEQ ID NO: 184229 - DNA, 25 bp, Homo sapien
aagtgcgttgtaaaatggccgttgc

SEQ ID NO: 184230 - DNA, 25 bp, Homo sapien
gcgctggcaaatccggcccaggatg

SEQ ID NO: 184231 - DNA, 25 bp, Homo sapien
ggaggcggcgaatcacttataaatg

SEQ ID NO: 184232 - DNA, 25 bp, Homo sapien
ttccacgacgaccagaaggttgccg

SEQ ID NO: 184233 - DNA, 25 bp, Homo sapien
cgtggcacaccctcgtcaagtgttt

SEQ ID NO: 184234 - DNA, 25 bp, Homo sapien
ttccggtgcgtcattgtgagaaagc

SEQ ID NO: 184235 - DNA, 25 bp, Homo sapien
tagggcctgctagcaccctctcggg

SEQ ID NO: 184236 - DNA, 25 bp, Homo sapien
gcgccctctgcgtacctaaggagtt

SEQ ID NO: 184237 - DNA, 25 bp, Homo sapien
agcgtggcccacatcgcagcgctgg

SEQ ID NO: 184238 - DNA, 25 bp, Homo sapien
agttctcccagcgtccactctaggg

SEQ ID NO: 184239 - DNA, 25 bp, Homo sapien
ttcctggcctctcaccggggaaagc

SEQ ID NO: 184240 - DNA, 25 bp, Homo sapien
cgtgccagcacgcagagttcctggc

SEQ ID NO: 184241 - DNA, 25 bp, Homo sapien
agctctagttcacctgtcggccggc

SEQ ID NO: 184242 - DNA, 25 bp, Homo sapien
ggagttcacgcacagttcggcggca

SEQ ID NO: 184243 - DNA, 25 bp, Homo sapien
gcgagctcgagtcgctctcgaagta

SEQ ID NO: 184244 - DNA, 25 bp, Homo sapien
tttgtgttgtccgaactccgcttgc

SEQ ID NO: 184245 - DNA, 25 bp, Homo sapien
ccgcggcttcttgaatccagatata

SEQ ID NO: 184246 - DNA, 25 bp, Homo sapien
agagcccgtttcagcagcgcggaca

SEQ ID NO: 184247 - DNA, 25 bp, Homo sapien
cagttgtcattttctcctccaaagg

SEQ ID NO: 184248 - DNA, 25 bp, Homo sapien
gcagcagcgcgaaccacttggtttg

SEQ ID NO: 184249 - DNA, 25 bp, Homo sapien
cgccatcccgggagtttgcgtcttt

SEQ ID NO: 184250 - DNA, 25 bp, Homo sapien
gcgacgtggccatcattcagccgga

SEQ ID NO: 184251 - DNA, 25 bp, Homo sapien
ctaagttgctgagcgagtcggagcc

SEQ ID NO: 184252 - DNA, 25 bp, Homo sapien
cggccgaagaccaagccggaggtct

SEQ ID NO: 184253 - DNA, 25 bp, Homo sapien
agcagcgcgtcgtcagccagcacag

SEQ ID NO: 184254 - DNA, 25 bp, Homo sapien
cccgtcgcggctggagagctgctct

SEQ ID NO: 184255 - DNA, 25 bp, Homo sapien
cctcgcagctcgcacacccacacaa

SEQ ID NO: 184256 - DNA, 25 bp, Homo sapien
ctctgccgaggctgcaggtaggcac

SEQ ID NO: 184257 - DNA, 25 bp, Homo sapien
ccctgctaagttgctgagcgagtcg

SEQ ID NO: 184258 - DNA, 25 bp, Homo sapien
ccgaggctgcaggtaggcacttccc

SEQ ID NO: 184259 - DNA, 25 bp, Homo sapien
gttcagggcagctacgtaacaccgc

SEQ ID NO: 184260 - DNA, 25 bp, Homo sapien
gagcgtggaacagcccggctcccta

SEQ ID NO: 184261 - DNA, 25 bp, Homo sapien
cgcacagtgagcgtggaacagcccg

SEQ ID NO: 184262 - DNA, 25 bp, Homo sapien
ctagctccgcgccagaaagggctct

SEQ ID NO: 184263 - DNA, 25 bp, Homo sapien
ccgcgccagaaagggctctcgaatc

SEQ ID NO: 184264 - DNA, 25 bp, Homo sapien
ccagaaagggctctcgaatcgcaaa

SEQ ID NO: 184265 - DNA, 25 bp, Homo sapien
ctctcgaatcgcaaaagcaaacgtg

SEQ ID NO: 184266 - DNA, 25 bp, Homo sapien
tcgaatcgcaaaagcaaacgtgttc

SEQ ID NO: 184267 - DNA, 25 bp, Homo sapien
ccagagaaagccagagaaagccagc

SEQ ID NO: 184268 - DNA, 25 bp, Homo sapien
gcagatggacgctgcgaggcacctc

SEQ ID NO: 184269 - DNA, 25 bp, Homo sapien
caggatgagggtcccagggcttacc

SEQ ID NO: 184270 - DNA, 25 bp, Homo sapien
agggcgtacatagcgccgtctgact

SEQ ID NO: 184271 - DNA, 25 bp, Homo sapien
ccagagaaagccagcgaacgcgcct

SEQ ID NO: 184272 - DNA, 25 bp, Homo sapien
cgtctgactccgcagtctgcaatgc

SEQ ID NO: 184273 - DNA, 25 bp, Homo sapien
ctgcaatgcggagcgtcagctgatc

SEQ ID NO: 184274 - DNA, 25 bp, Homo sapien
ccattctggggcagatggacgctgc

SEQ ID NO: 184275 - DNA, 25 bp, Homo sapien
aggtctcacctggacactggctagc

SEQ ID NO: 184276 - DNA, 25 bp, Homo sapien
actggaggcgctcgaattagccaca

SEQ ID NO: 184277 - DNA, 25 bp, Homo sapien
gagacactaaccaacggcagttctg

SEQ ID NO: 184278 - DNA, 25 bp, Homo sapien
ggcgtgaagttctccctggattacc

SEQ ID NO: 184279 - DNA, 25 bp, Homo sapien
ccaagcagtgcttccacgaggaggt

SEQ ID NO: 184280 - DNA, 25 bp, Homo sapien
gagctcaccttcgagctgccggaca

SEQ ID NO: 184281 - DNA, 25 bp, Homo sapien
accgagagcatcatgggcagcactg

SEQ ID NO: 184282 - DNA, 25 bp, Homo sapien
tggggagctggccaaagagatatcc

SEQ ID NO: 184283 - DNA, 25 bp, Homo sapien
cctgacacatcagaggcgcgaagta

SEQ ID NO: 184284 - DNA, 25 bp, Homo sapien
catcgcttcaggaaacggtgttttg

SEQ ID NO: 184285 - DNA, 25 bp, Homo sapien
atcatgcagtttggggcaagttttc

SEQ ID NO: 184286 - DNA, 25 bp, Homo sapien
agcctgcaagcccatgacgtggcga

SEQ ID NO: 184287 - DNA, 25 bp, Homo sapien
gaccgaccggtgcatccaattctta

SEQ ID NO: 184288 - DNA, 25 bp, Homo sapien
agttttcctggttgagcatcgcttc

SEQ ID NO: 184289 - DNA, 25 bp, Homo sapien
accactgccgaacagccgctggaga

SEQ ID NO: 184290 - DNA, 25 bp, Homo sapien
tgaccagctgactctggagcctacc

SEQ ID NO: 184291 - DNA, 25 bp, Homo sapien
agagcgtccagaccacgactagggg

SEQ ID NO: 184292 - DNA, 25 bp, Homo sapien
gatggtaaagatggccggcagtacc

SEQ ID NO: 184293 - DNA, 25 bp, Homo sapien
gctcccaggtggatccgcggcctag

SEQ ID NO: 184294 - DNA, 25 bp, Homo sapien
gcaccttctggctcagtacgcggga

SEQ ID NO: 184295 - DNA, 25 bp, Homo sapien
caggccttcggagggtctgtccgcc

SEQ ID NO: 184296 - DNA, 25 bp, Homo sapien
acagatcagcaatcgctggccgcca

SEQ ID NO: 184297 - DNA, 25 bp, Homo sapien
agcgccagcacggaccatgcacaga

SEQ ID NO: 184298 - DNA, 25 bp, Homo sapien
ccatagtgccaagagcgtccagacc

SEQ ID NO: 184299 - DNA, 25 bp, Homo sapien
cccggaggcgaacagaaggcattcc

SEQ ID NO: 184300 - DNA, 25 bp, Homo sapien
tgacctgcgacggaaagccactgca

SEQ ID NO: 184301 - DNA, 25 bp, Homo sapien
aggcagcgccaatatccggtctctg

SEQ ID NO: 184302 - DNA, 25 bp, Homo sapien
gagttggtgaacacggtcctcgttc

SEQ ID NO: 184303 - DNA, 25 bp, Homo sapien
acgctccaggtcgtctagcaagccg

SEQ ID NO: 184304 - DNA, 25 bp, Homo sapien
tctccacccacttatacggcgtgtg

SEQ ID NO: 184305 - DNA, 25 bp, Homo sapien
gcgtctcgcagctcctcgttattcg

SEQ ID NO: 184306 - DNA, 25 bp, Homo sapien
ccgtcgggcgctaagaagacctagc

SEQ ID NO: 184307 - DNA, 25 bp, Homo sapien
aggtcacagcgctactgccactcca

SEQ ID NO: 184308 - DNA, 25 bp, Homo sapien
cgctatagagaggacgggccctgcc

SEQ ID NO: 184309 - DNA, 25 bp, Homo sapien
ctatagagaggacgggccctgcctg

SEQ ID NO: 184310 - DNA, 25 bp, Homo sapien
atacagccgcgcacggaaatcaatg

SEQ ID NO: 184311 - DNA, 25 bp, Homo sapien
gcgcacggaaatcaatgggccgccc

SEQ ID NO: 184312 - DNA, 25 bp, Homo sapien
cctccgtgtgctccgcagaggcgtg

SEQ ID NO: 184313 - DNA, 25 bp, Homo sapien
agccgcgcacggaaatcaatgggcc

SEQ ID NO: 184314 - DNA, 25 bp, Homo sapien
cagctcggagaaagggcggcgctat

SEQ ID NO: 184315 - DNA, 25 bp, Homo sapien
cggcggcaccgacaatgctgtgctc

SEQ ID NO: 184316 - DNA, 25 bp, Homo sapien
cattttaaaggcgaggcagctggac

SEQ ID NO: 184317 - DNA, 25 bp, Homo sapien
cagctggacgctgttcaagcggaaa

SEQ ID NO: 184318 - DNA, 25 bp, Homo sapien
ggcaccgacaatgctgtgctccagc

SEQ ID NO: 184319 - DNA, 25 bp, Homo sapien
atcggtcccagtgtccacgcgggtc

SEQ ID NO: 184320 - DNA, 25 bp, Homo sapien
cggaaacgcagagagaaacttcagc

SEQ ID NO: 184321 - DNA, 25 bp, Homo sapien
cgcggccgtcctggcattttaaagg

SEQ ID NO: 184322 - DNA, 25 bp, Homo sapien
gctcggcccgacttcagcgagcaga

SEQ ID NO: 184323 - DNA, 25 bp, Homo sapien
aagtctcgcggtgctaccgctctga

SEQ ID NO: 184324 - DNA, 25 bp, Homo sapien
tctggcatgctaagtgggcagcact

SEQ ID NO: 184325 - DNA, 25 bp, Homo sapien
ctctgaatctaaatgggcttctccc

SEQ ID NO: 184326 - DNA, 25 bp, Homo sapien
gggcgcctatcctctccgagcaaga

SEQ ID NO: 184327 - DNA, 25 bp, Homo sapien
tcaaccctccgggtgagtagcggcc

SEQ ID NO: 184328 - DNA, 25 bp, Homo sapien
cagcatcagcaccagagcggcatct

SEQ ID NO: 184329 - DNA, 25 bp, Homo sapien
agcggcatctgcatcccaatcgctg

SEQ ID NO: 184330 - DNA, 25 bp, Homo sapien
ggaccggcttccctctgaatctaaa

SEQ ID NO: 184331 - DNA, 25 bp, Homo sapien
ctcctacgactactcgggatacggc

SEQ ID NO: 184332 - DNA, 25 bp, Homo sapien
caggatgaacggcttctcgctgggt

SEQ ID NO: 184333 - DNA, 25 bp, Homo sapien
gtgcgtgcagcctgcacctcagcga

SEQ ID NO: 184334 - DNA, 25 bp, Homo sapien
gggtcgccaggcctgacttccagct

SEQ ID NO: 184335 - DNA, 25 bp, Homo sapien
gacgccgtcgaggtcttcttctcgc

SEQ ID NO: 184336 - DNA, 25 bp, Homo sapien
actactcgggatacggcgtcagctc

SEQ ID NO: 184337 - DNA, 25 bp, Homo sapien
tcagctcgggcaagccctccgagaa

SEQ ID NO: 184338 - DNA, 25 bp, Homo sapien
ccgactggcagtactcgcagcgcga

SEQ ID NO: 184339 - DNA, 25 bp, Homo sapien
ctgctgatgtttagactgagactcc

SEQ ID NO: 184340 - DNA, 25 bp, Homo sapien
tttctgtttgtctgtccaccctgtg

SEQ ID NO: 184341 - DNA, 25 bp, Homo sapien
ccctgtgctgtgcagtctacctcta

SEQ ID NO: 184342 - DNA, 25 bp, Homo sapien
tcctctgtgggatttctctgagatc

SEQ ID NO: 184343 - DNA, 25 bp, Homo sapien
gcggccagggtctgaacccagattt

SEQ ID NO: 184344 - DNA, 25 bp, Homo sapien
gtcggctccaagaaaggtcgcgtta

SEQ ID NO: 184345 - DNA, 25 bp, Homo sapien
tgagactccaaacgtggcatcgctg

SEQ ID NO: 184346 - DNA, 25 bp, Homo sapien
agactcctgctttccgtagattttc

SEQ ID NO: 184347 - DNA, 25 bp, Homo sapien
attgctccagaagacgcgccatgtc

SEQ ID NO: 184348 - DNA, 25 bp, Homo sapien
gcgccatgtctgcatcattgtaatc

SEQ ID NO: 184349 - DNA, 25 bp, Homo sapien
gtaatcgcgaatatccttcttcttc

SEQ ID NO: 184350 - DNA, 25 bp, Homo sapien
ggcacaaagcaggaccacggccttg

SEQ ID NO: 184351 - DNA, 25 bp, Homo sapien
ggaagccgccattttcgctgcgccg

SEQ ID NO: 184352 - DNA, 25 bp, Homo sapien
ggtccctgagtgctcatttttcgtt

SEQ ID NO: 184353 - DNA, 25 bp, Homo sapien
tcatttttcgttttccgtcagaggc

SEQ ID NO: 184354 - DNA, 25 bp, Homo sapien
gcggacctcccattgctccagaaga

SEQ ID NO: 184355 - DNA, 25 bp, Homo sapien
ggcctgacgcatccgcgagactgca

SEQ ID NO: 184356 - DNA, 25 bp, Homo sapien
tcctccggaatatagcggaagcgcg

SEQ ID NO: 184357 - DNA, 25 bp, Homo sapien
tctgatttcagattcctccggaata

SEQ ID NO: 184358 - DNA, 25 bp, Homo sapien
cctagaggacgcagtttcaagtttc

SEQ ID NO: 184359 - DNA, 25 bp, Homo sapien
agaggatccgaaaccgcgcttcaca

SEQ ID NO: 184360 - DNA, 25 bp, Homo sapien
gcagtttgatgcaatcctagaggac

SEQ ID NO: 184361 - DNA, 25 bp, Homo sapien
tcctccacgctcaagatgcagtttg

SEQ ID NO: 184362 - DNA, 25 bp, Homo sapien
cgcgcttcacatctgaatctgattt

SEQ ID NO: 184363 - DNA, 25 bp, Homo sapien
gttcatggttcctgcaagccctcta

SEQ ID NO: 184364 - DNA, 25 bp, Homo sapien
ctgtgcgcaatcagtgcaggctccc

SEQ ID NO: 184365 - DNA, 25 bp, Homo sapien
cgccgcttcccaagagctggaggca

SEQ ID NO: 184366 - DNA, 25 bp, Homo sapien
gggtcacggcgcctgaagcccacgt

SEQ ID NO: 184367 - DNA, 25 bp, Homo sapien
agaagggactttcctggcagcccgg

SEQ ID NO: 184368 - DNA, 25 bp, Homo sapien
agcgcggacagtgagtttgctctgc

SEQ ID NO: 184369 - DNA, 25 bp, Homo sapien
agccctctaggaggccgaaagctgc

SEQ ID NO: 184370 - DNA, 25 bp, Homo sapien
cttggccagctgagtcgcgacggcc

SEQ ID NO: 184371 - DNA, 25 bp, Homo sapien
ccgcaccgggctgtactctagcgag

SEQ ID NO: 184372 - DNA, 25 bp, Homo sapien
gagaccaaaggggcgattcctccag

SEQ ID NO: 184373 - DNA, 25 bp, Homo sapien
gaaagccactcacccgctggggcgt

SEQ ID NO: 184374 - DNA, 25 bp, Homo sapien
cgaaacccggctgcttgtgggaccg

SEQ ID NO: 184375 - DNA, 25 bp, Homo sapien
gagggcacgaaacccggctgcttgt

SEQ ID NO: 184376 - DNA, 25 bp, Homo sapien
cgtcgagcacgccaggtaaacctga

SEQ ID NO: 184377 - DNA, 25 bp, Homo sapien
ctgtactctagcgaggccagaggct

SEQ ID NO: 184378 - DNA, 25 bp, Homo sapien
taaacctgatggacgaattcccaca

SEQ ID NO: 184379 - DNA, 25 bp, Homo sapien
agaccttgaccaatcgcctggggcc

SEQ ID NO: 184380 - DNA, 25 bp, Homo sapien
cagaacgtgtatggtccgggagtcc

SEQ ID NO: 184381 - DNA, 25 bp, Homo sapien
cgatggcgcagaacgtgtatggtcc

SEQ ID NO: 184382 - DNA, 25 bp, Homo sapien
gggaggcccacttgctgaacagcag

SEQ ID NO: 184383 - DNA, 25 bp, Homo sapien
tcgtcatggcgacgcgccacgctaa

SEQ ID NO: 184384 - DNA, 25 bp, Homo sapien
cagcagggtcccagaccttgaccaa

SEQ ID NO: 184385 - DNA, 25 bp, Homo sapien
ctgtcgcttattggccagcagggtc

SEQ ID NO: 184386 - DNA, 25 bp, Homo sapien
ccacgctaacgcatggtgtcggagg

SEQ ID NO: 184387 - DNA, 25 bp, Homo sapien
cgcctcccggagattggcaggacaa

SEQ ID NO: 184388 - DNA, 25 bp, Homo sapien
tcccgaattggtccaggccctcaga

SEQ ID NO: 184389 - DNA, 25 bp, Homo sapien
cctgagtgcaccgaggctttcagcc

SEQ ID NO: 184390 - DNA, 25 bp, Homo sapien
ggccaggctctccagttagcgtcag

SEQ ID NO: 184391 - DNA, 25 bp, Homo sapien
tgtcccgccggtactggagcatctt

SEQ ID NO: 184392 - DNA, 25 bp, Homo sapien
gcctccttcatgtcccgctgtggga

SEQ ID NO: 184393 - DNA, 25 bp, Homo sapien
tgagatggccaatgacggtctgacc

SEQ ID NO: 184394 - DNA, 25 bp, Homo sapien
agcgtggactcttgtcctgagtgca

SEQ ID NO: 184395 - DNA, 25 bp, Homo sapien
cgctctgctgtcctttgttccggga

SEQ ID NO: 184396 - DNA, 25 bp, Homo sapien
cgggagcgcacgagacacaaaagca

SEQ ID NO: 184397 - DNA, 25 bp, Homo sapien
gcccaactggccctgaaactgagga

SEQ ID NO: 184398 - DNA, 25 bp, Homo sapien
agagtctgtagtccgcccaaaaggg

SEQ ID NO: 184399 - DNA, 25 bp, Homo sapien
gcccgcggttcatagagtcgcccaa

SEQ ID NO: 184400 - DNA, 25 bp, Homo sapien
gagtcgcccaagatcctcacagagg

SEQ ID NO: 184401 - DNA, 25 bp, Homo sapien
ggacgtcttcccaaaacaatgaggc

SEQ ID NO: 184402 - DNA, 25 bp, Homo sapien
tttctgtctccttgggcagcacttc

SEQ ID NO: 184403 - DNA, 25 bp, Homo sapien
tctcgaagcacacggagcagtcgcg

SEQ ID NO: 184404 - DNA, 25 bp, Homo sapien
ccgccggacccatgatgcagatcga

SEQ ID NO: 184405 - DNA, 25 bp, Homo sapien
gcgcggcaatcacttcgctctcgaa

SEQ ID NO: 184406 - DNA, 25 bp, Homo sapien
gaccgctcgaactgggcccagataa

SEQ ID NO: 184407 - DNA, 25 bp, Homo sapien
gtaggtgtacccattgccgttattg

SEQ ID NO: 184408 - DNA, 25 bp, Homo sapien
ttgtttccgttgtgcgcaaagctca

SEQ ID NO: 184409 - DNA, 25 bp, Homo sapien
gtcccgccgccgaaataagagtctg

SEQ ID NO: 184410 - DNA, 25 bp, Homo sapien
tcttctcacagatgcgattggcgca

SEQ ID NO: 184411 - DNA, 25 bp, Homo sapien
ctgcagggctctttggtcatccagg

SEQ ID NO: 184412 - DNA, 25 bp, Homo sapien
ctcccaaaggactgatcaaaggccc

SEQ ID NO: 184413 - DNA, 25 bp, Homo sapien
ctgggctccattccgctttgcagaa

SEQ ID NO: 184414 - DNA, 25 bp, Homo sapien
tgagtcccgggacccattgttcctc

SEQ ID NO: 184415 - DNA, 25 bp, Homo sapien
ggcgcgccgtcagctctgaagacac

SEQ ID NO: 184416 - DNA, 25 bp, Homo sapien
agaagaaagtgcatcccgccagggc

SEQ ID NO: 184417 - DNA, 25 bp, Homo sapien
cggcgacatgctcagaactgggtac

SEQ ID NO: 184418 - DNA, 25 bp, Homo sapien
ggatcccgatactgaacacgccttc

SEQ ID NO: 184419 - DNA, 25 bp, Homo sapien
tgggagactccatgtgatgcaatgc

SEQ ID NO: 184420 - DNA, 25 bp, Homo sapien
ggcggcgacagcatggcactaaccc

SEQ ID NO: 184421 - DNA, 25 bp, Homo sapien
ttccagatgcttcgctgggcctgag

SEQ ID NO: 184422 - DNA, 25 bp, Homo sapien
gaggacctatggcacgtccagggtc

SEQ ID NO: 184423 - DNA, 25 bp, Homo sapien
aaaagcggctgggtgttccagatgc

SEQ ID NO: 184424 - DNA, 25 bp, Homo sapien
tgttgaaaacacagcgcgggcagta

SEQ ID NO: 184425 - DNA, 25 bp, Homo sapien
gagccgccgtctttacattttcatg

SEQ ID NO: 184426 - DNA, 25 bp, Homo sapien
tgtgatgcaatgcagagccgccgtc

SEQ ID NO: 184427 - DNA, 25 bp, Homo sapien
agagccgcagcgagcgggttcctcc

SEQ ID NO: 184428 - DNA, 25 bp, Homo sapien
ttgtagctgcgggtaagaaacggct

SEQ ID NO: 184429 - DNA, 25 bp, Homo sapien
ctggtgtctgtgtcagatttgtagc

SEQ ID NO: 184430 - DNA, 25 bp, Homo sapien
gaaagcatgggagccaagagtatga

SEQ ID NO: 184431 - DNA, 25 bp, Homo sapien
ggggccggctgtcgctcgacctttc

SEQ ID NO: 184432 - DNA, 25 bp, Homo sapien
cgaaagtccgagagctctgcgggtc

SEQ ID NO: 184433 - DNA, 25 bp, Homo sapien
acccacaccgagagcttccgaaagt

SEQ ID NO: 184434 - DNA, 25 bp, Homo sapien
acaccgagagcttccgaaagtccga

SEQ ID NO: 184435 - DNA, 25 bp, Homo sapien
cgcccgccttctacccgctgcaata

SEQ ID NO: 184436 - DNA, 25 bp, Homo sapien
cgctgcaataccgcaggcgcgagct

SEQ ID NO: 184437 - DNA, 25 bp, Homo sapien
tccttcctgtcctgtgagctgcggc

SEQ ID NO: 184438 - DNA, 25 bp, Homo sapien
cgtgcaccaggttcgcgtggacgct

SEQ ID NO: 184439 - DNA, 25 bp, Homo sapien
atatcgtgcaccaggttcgcgtgga

SEQ ID NO: 184440 - DNA, 25 bp, Homo sapien
accggatatcgtgcaccaggttcgc

SEQ ID NO: 184441 - DNA, 25 bp, Homo sapien
ggcaccggatatcgtgcaccaggtt

SEQ ID NO: 184442 - DNA, 25 bp, Homo sapien
gggcggcaccggatatcgtgcacca

SEQ ID NO: 184443 - DNA, 25 bp, Homo sapien
tccagccacgagctcttcaacgagg

SEQ ID NO: 184444 - DNA, 25 bp, Homo sapien
ggatctgtccttacgggccttctga

SEQ ID NO: 184445 - DNA, 25 bp, Homo sapien
ccgtgtttgtggacgacttctacta

SEQ ID NO: 184446 - DNA, 25 bp, Homo sapien
aggctccaaagctggacctgccggg

SEQ ID NO: 184447 - DNA, 25 bp, Homo sapien
ttcaacgaggctgacttcatcccgc

SEQ ID NO: 184448 - DNA, 25 bp, Homo sapien
ggccttctgaggagcctgatctaga

SEQ ID NO: 184449 - DNA, 25 bp, Homo sapien
gccaggcaccatgggcaacgccatt

SEQ ID NO: 184450 - DNA, 25 bp, Homo sapien
tcatcagcttccacgaggatctgtc

SEQ ID NO: 184451 - DNA, 25 bp, Homo sapien
accgaccgacagacctcagtgccca

SEQ ID NO: 184452 - DNA, 25 bp, Homo sapien
cgaccgacagacctcagtgcccacc

SEQ ID NO: 184453 - DNA, 25 bp, Homo sapien
caggatgcacagaccgaccgacaga

SEQ ID NO: 184454 - DNA, 25 bp, Homo sapien
ccaggatgcacagaccgaccgacag

SEQ ID NO: 184455 - DNA, 25 bp, Homo sapien
gccaggatgcacagaccgaccgaca

SEQ ID NO: 184456 - DNA, 25 bp, Homo sapien
cgctcgtgctctccgcccagccacg

SEQ ID NO: 184457 - DNA, 25 bp, Homo sapien
gccgctcgtgctctccgcccagcca

SEQ ID NO: 184458 - DNA, 25 bp, Homo sapien
gctgccgctcgtgctctccgcccag

SEQ ID NO: 184459 - DNA, 25 bp, Homo sapien
cacggcgcaggctgatctgcgcaca

SEQ ID NO: 184460 - DNA, 25 bp, Homo sapien
tcccggacgccttggacgcggttca

SEQ ID NO: 184461 - DNA, 25 bp, Homo sapien
gacgcggttcaggaatccgccgccg

SEQ ID NO: 184462 - DNA, 25 bp, Homo sapien
ggaaccgcttctgccgggatcttcc

SEQ ID NO: 184463 - DNA, 25 bp, Homo sapien
ttccaggaggaaagcgaagttgcga

SEQ ID NO: 184464 - DNA, 25 bp, Homo sapien
tcccagctcggggaaaagcccaggc

SEQ ID NO: 184465 - DNA, 25 bp, Homo sapien
gcaaccggatcacacctgccaggta

SEQ ID NO: 184466 - DNA, 25 bp, Homo sapien
cggttcccaagttgccgggcgcgca

SEQ ID NO: 184467 - DNA, 25 bp, Homo sapien
tgactttcagtttgggggtattcta

SEQ ID NO: 184468 - DNA, 25 bp, Homo sapien
ctatattttatgtaggtgactttca

SEQ ID NO: 184469 - DNA, 25 bp, Homo sapien
tttatgtaggtgactttcagtttgg

SEQ ID NO: 184470 - DNA, 25 bp, Homo sapien
tatgtaggtgactttcagtttgggg

SEQ ID NO: 184471 - DNA, 25 bp, Homo sapien
acacaatctattgagctggatatta

SEQ ID NO: 184472 - DNA, 25 bp, Homo sapien
ctacttacacaatctattgagctgg

SEQ ID NO: 184473 - DNA, 25 bp, Homo sapien
tattctacttacacaatctattgag

SEQ ID NO: 184474 - DNA, 25 bp, Homo sapien
tcagtttgggggtattctacttaca

SEQ ID NO: 184475 - DNA, 25 bp, Homo sapien
tgctggggataatggcgatctcctc

SEQ ID NO: 184476 - DNA, 25 bp, Homo sapien
tctgagcctactcgggagccacaca

SEQ ID NO: 184477 - DNA, 25 bp, Homo sapien
tggcggcctcgagccaaaacaccta

SEQ ID NO: 184478 - DNA, 25 bp, Homo sapien
cccaggcgcgtgtagtacttttcta

SEQ ID NO: 184479 - DNA, 25 bp, Homo sapien
tgtgctctagcgtagcgtccatctc

SEQ ID NO: 184480 - DNA, 25 bp, Homo sapien
gactcaccctgctatcttgttgcgg

SEQ ID NO: 184481 - DNA, 25 bp, Homo sapien
ctgatttttaatgggaccgcccgtg

SEQ ID NO: 184482 - DNA, 25 bp, Homo sapien
acttttctatgatgacccgggccgc

SEQ ID NO: 184483 - DNA, 25 bp, Homo sapien
tcagacgtgagcataggtggcaccc

SEQ ID NO: 184484 - DNA, 25 bp, Homo sapien
cttggggagtaagcaagggaattca

SEQ ID NO: 184485 - DNA, 25 bp, Homo sapien
gcaagggaattcagacgtgagcata

SEQ ID NO: 184486 - DNA, 25 bp, Homo sapien
ccgctccctgggctaatttctcagt

SEQ ID NO: 184487 - DNA, 25 bp, Homo sapien
ctccctgggctaatttctcagtgga

SEQ ID NO: 184488 - DNA, 25 bp, Homo sapien
gcgacaggaggagggcccttcccta

SEQ ID NO: 184489 - DNA, 25 bp, Homo sapien
cggaaaggaacgtactgtgagatgc

SEQ ID NO: 184490 - DNA, 25 bp, Homo sapien
cacccgtgcccttggcttcccgccg

SEQ ID NO: 184491 - DNA, 25 bp, Homo sapien
aatatccagctcaatagattgtgta

SEQ ID NO: 184492 - DNA, 25 bp, Homo sapien
tatccagctcaatagattgtgtaag

SEQ ID NO: 184493 - DNA, 25 bp, Homo sapien
atatccagctcaatagattgtgtaa

SEQ ID NO: 184494 - DNA, 25 bp, Homo sapien
catgttgctcatgttttatgttttt

SEQ ID NO: 184495 - DNA, 25 bp, Homo sapien
taatatccagctcaatagattgtgt

SEQ ID NO: 184496 - DNA, 25 bp, Homo sapien
atgttgctcatgttttatgtttttc

SEQ ID NO: 184497 - DNA, 25 bp, Homo sapien
tgactcagttcatgttccgccgggg

SEQ ID NO: 184498 - DNA, 25 bp, Homo sapien
agcagctcttcctgtgcgacctgta

SEQ ID NO: 184499 - DNA, 25 bp, Homo sapien
agtaccactgcaagaaccgccgctg

SEQ ID NO: 184500 - DNA, 25 bp, Homo sapien
ccttcgccggcaagtataagacctg

SEQ ID NO: 184501 - DNA, 25 bp, Homo sapien
gccgctacatgctggtgcgctacga

SEQ ID NO: 184502 - DNA, 25 bp, Homo sapien
gcggcatctactccacgcagaagaa

SEQ ID NO: 184503 - DNA, 25 bp, Homo sapien
gtggcgcttcagcatgcccttcaag

SEQ ID NO: 184504 - DNA, 25 bp, Homo sapien
tgtggcacatcgagcgcacagtgtc

SEQ ID NO: 184505 - DNA, 25 bp, Homo sapien
gtggctcttaccagcgggaacgcca

SEQ ID NO: 184506 - DNA, 25 bp, Homo sapien
ctctccacagagcacggggtctacg

SEQ ID NO: 184507 - DNA, 25 bp, Homo sapien
ttatgaagctcctacgagccgctcc

SEQ ID NO: 184508 - DNA, 25 bp, Homo sapien
cggcagtgtgagaaagaaacgttcc

SEQ ID NO: 184509 - DNA, 25 bp, Homo sapien
cacgcacgtgggcactatttttgca

SEQ ID NO: 184510 - DNA, 25 bp, Homo sapien
gcgccaagcgaaggtgtgaagccac

SEQ ID NO: 184511 - DNA, 25 bp, Homo sapien
gaagccacgtgacctgcccaggatt

SEQ ID NO: 184512 - DNA, 25 bp, Homo sapien
cggtgctcctttatgtccggtcagc

SEQ ID NO: 184513 - DNA, 25 bp, Homo sapien
ccaccagctggggaaagaacaaaga

SEQ ID NO: 184514 - DNA, 25 bp, Homo sapien
aacgtactgcacctcactgcggaga

SEQ ID NO: 184515 - DNA, 25 bp, Homo sapien
gggcagacctcctcaaaggccatca

SEQ ID NO: 184516 - DNA, 25 bp, Homo sapien
tggccacgttctggagcacaacgta

SEQ ID NO: 184517 - DNA, 25 bp, Homo sapien
tcgtcctcctctgagccgtagaagg

SEQ ID NO: 184518 - DNA, 25 bp, Homo sapien
tttgtgaatcaggtcgatgcgctcc

SEQ ID NO: 184519 - DNA, 25 bp, Homo sapien
tccacgtcgatcagcaggttacaga

SEQ ID NO: 184520 - DNA, 25 bp, Homo sapien
ccgcgttctcctctagtagggattc

SEQ ID NO: 184521 - DNA, 25 bp, Homo sapien
gcgacttggctcgtctccagatcta

SEQ ID NO: 184522 - DNA, 25 bp, Homo sapien
tcttctgccctttaaagcgacttgg

SEQ ID NO: 184523 - DNA, 25 bp, Homo sapien
tccagatctaaaggtgggcgagtct

SEQ ID NO: 184524 - DNA, 25 bp, Homo sapien
gccgcaaaccggagaaacacctgga

SEQ ID NO: 184525 - DNA, 25 bp, Homo sapien
caccgcttgtagtcggaggagaaga

SEQ ID NO: 184526 - DNA, 25 bp, Homo sapien
cgcgcgctgaggtcttaaaggcacc

SEQ ID NO: 184527 - DNA, 25 bp, Homo sapien
tgcgcgcggatttctcaatcagggc

SEQ ID NO: 184528 - DNA, 25 bp, Homo sapien
atccctaggaaatgccctcttcagg

SEQ ID NO: 184529 - DNA, 25 bp, Homo sapien
cggcgccgtgaaccctcaaagcagg

SEQ ID NO: 184530 - DNA, 25 bp, Homo sapien
tccctagctgacacctgagcacgtg

SEQ ID NO: 184531 - DNA, 25 bp, Homo sapien
cagctgttatcttgtgctccgaaac

SEQ ID NO: 184532 - DNA, 25 bp, Homo sapien
tcaaagcaggctttcgcgtaagtcc

SEQ ID NO: 184533 - DNA, 25 bp, Homo sapien
caggcacagtgcgttcctccaaatc

SEQ ID NO: 184534 - DNA, 25 bp, Homo sapien
aggagccctctgtgaccctgagaga

SEQ ID NO: 184535 - DNA, 25 bp, Homo sapien
ggaaacactacgtgcagccgacctg

SEQ ID NO: 184536 - DNA, 25 bp, Homo sapien
cgtaagtcccgacggtctgtcctca

SEQ ID NO: 184537 - DNA, 25 bp, Homo sapien
cggcgcttccagtaatgtcacgctg

SEQ ID NO: 184538 - DNA, 25 bp, Homo sapien
gcatctgtcgcggtgtgtatctttt

SEQ ID NO: 184539 - DNA, 25 bp, Homo sapien
gcaacaaccggatcctgtgcaggtc

SEQ ID NO: 184540 - DNA, 25 bp, Homo sapien
caggcaggcgtatcaggtttcagag

SEQ ID NO: 184541 - DNA, 25 bp, Homo sapien
gagtactgtctctggccaccgagca

SEQ ID NO: 184542 - DNA, 25 bp, Homo sapien
tccgccggaaagagagtggatttac

SEQ ID NO: 184543 - DNA, 25 bp, Homo sapien
ggtcttccctgagtccaacgcgatt

SEQ ID NO: 184544 - DNA, 25 bp, Homo sapien
gggcctcattcatcgcgcttacatt

SEQ ID NO: 184545 - DNA, 25 bp, Homo sapien
ggctgggcatgtgatcagaacgtgt

SEQ ID NO: 184546 - DNA, 25 bp, Homo sapien
cccagaaggcaggatggcgctgggc

SEQ ID NO: 184547 - DNA, 25 bp, Homo sapien
tgtgatcagaacgtgtgggtgaggc

SEQ ID NO: 184548 - DNA, 25 bp, Homo sapien
agccttacctcttgatcttcgcacg

SEQ ID NO: 184549 - DNA, 25 bp, Homo sapien
agagaagcagtgactcccgtgcagg

SEQ ID NO: 184550 - DNA, 25 bp, Homo sapien
gatcttcgcacgctctagttttacg

SEQ ID NO: 184551 - DNA, 25 bp, Homo sapien
acctcttgatcttcgcacgctctag

SEQ ID NO: 184552 - DNA, 25 bp, Homo sapien
tgttgtgtgtaagagaagcagtgac

SEQ ID NO: 184553 - DNA, 25 bp, Homo sapien
atgttggtccgggaaaaccagcctg

SEQ ID NO: 184554 - DNA, 25 bp, Homo sapien
gacagccattgctcgtcctccatga

SEQ ID NO: 184555 - DNA, 25 bp, Homo sapien
ccgctgtactgcgagatggacgaca

SEQ ID NO: 184556 - DNA, 25 bp, Homo sapien
tccagtgcttgatcttgccgctgta

SEQ ID NO: 184557 - DNA, 25 bp, Homo sapien
agccctgcggactcacgtctcggaa

SEQ ID NO: 184558 - DNA, 25 bp, Homo sapien
accatctcgcctagaaggctgctgg

SEQ ID NO: 184559 - DNA, 25 bp, Homo sapien
ccggtaaacaaaagtgccgcagcta

SEQ ID NO: 184560 - DNA, 25 bp, Homo sapien
tttccgtgtaattagccggccaggc

SEQ ID NO: 184561 - DNA, 25 bp, Homo sapien
cgcttccatggcctgggacactgtg

SEQ ID NO: 184562 - DNA, 25 bp, Homo sapien
gttcgtccgcgcttccatggcctgg

SEQ ID NO: 184563 - DNA, 25 bp, Homo sapien
gcgacgcactcttcccggctgaggg

SEQ ID NO: 184564 - DNA, 25 bp, Homo sapien
agcccaagcctgaggccgccgtctc

SEQ ID NO: 184565 - DNA, 25 bp, Homo sapien
ttggctcggactgtcccgtgacagg

SEQ ID NO: 184566 - DNA, 25 bp, Homo sapien
aaatgatttggctcggactgtcccg

SEQ ID NO: 184567 - DNA, 25 bp, Homo sapien
cgcggtttcgattctagcgaaaaat

SEQ ID NO: 184568 - DNA, 25 bp, Homo sapien
cgattctagcgaaaaatgatttggc

SEQ ID NO: 184569 - DNA, 25 bp, Homo sapien
agaccgcggaatggccgaggcagga

SEQ ID NO: 184570 - DNA, 25 bp, Homo sapien
cgcagtcgccgcttttctcccgggc

SEQ ID NO: 184571 - DNA, 25 bp, Homo sapien
ggcgcagcactgtgtgcaccgtccc

SEQ ID NO: 184572 - DNA, 25 bp, Homo sapien
cgccgctccattccgcggggctgcg

SEQ ID NO: 184573 - DNA, 25 bp, Homo sapien
cgagcccggttacgccagccgcggc

SEQ ID NO: 184574 - DNA, 25 bp, Homo sapien
gaggctccgagcccggttacgccag

SEQ ID NO: 184575 - DNA, 25 bp, Homo sapien
aggggcgaagagaccgcggaatggc

SEQ ID NO: 184576 - DNA, 25 bp, Homo sapien
gcagagtgtgcgctcgctccggctt

SEQ ID NO: 184577 - DNA, 25 bp, Homo sapien
ggcgacgttttcgactgcccagcca

SEQ ID NO: 184578 - DNA, 25 bp, Homo sapien
cgatccacacggagagccttagtta

SEQ ID NO: 184579 - DNA, 25 bp, Homo sapien
ttatcgcgagacttgacaggcaccc

SEQ ID NO: 184580 - DNA, 25 bp, Homo sapien
cgctcggttacattggagaactgga

SEQ ID NO: 184581 - DNA, 25 bp, Homo sapien
ttcggcctgagctggattgacatag

SEQ ID NO: 184582 - DNA, 25 bp, Homo sapien
gtactctttgctagaccgaagcccg

SEQ ID NO: 184583 - DNA, 25 bp, Homo sapien
gcatggagggcatcatccaccttta

SEQ ID NO: 184584 - DNA, 25 bp, Homo sapien
ctctgggcgttgtgccagcatttga

SEQ ID NO: 184585 - DNA, 25 bp, Homo sapien
ggacctgctactggccttggtcgtc

SEQ ID NO: 184586 - DNA, 25 bp, Homo sapien
cgcgagtctcttttgttctggaacg

SEQ ID NO: 184587 - DNA, 25 bp, Homo sapien
tggccgcagaacatgcgcgagtctc

SEQ ID NO: 184588 - DNA, 25 bp, Homo sapien
ccagagggcgacaccttaaggccgg

SEQ ID NO: 184589 - DNA, 25 bp, Homo sapien
cccgagtattgggtgttgcccgaag

SEQ ID NO: 184590 - DNA, 25 bp, Homo sapien
cttcttaggcatctcggcgcaaaga

SEQ ID NO: 184591 - DNA, 25 bp, Homo sapien
tggtcgtcgcaccagccttcttagg

SEQ ID NO: 184592 - DNA, 25 bp, Homo sapien
gggcccagcgctcagaaatcaccag

SEQ ID NO: 184593 - DNA, 25 bp, Homo sapien
tcgcctgccagttgtagagaggttc

SEQ ID NO: 184594 - DNA, 25 bp, Homo sapien
ttgcccagtacgaagcgcacatcgc

SEQ ID NO: 184595 - DNA, 25 bp, Homo sapien
atttcgatttcgaccctccggagca

SEQ ID NO: 184596 - DNA, 25 bp, Homo sapien
ctgagccgtcctggttcacagattt

SEQ ID NO: 184597 - DNA, 25 bp, Homo sapien
ctaacgtttagttggcgactgagcc

SEQ ID NO: 184598 - DNA, 25 bp, Homo sapien
gcgcggttgcccacgttatggacaa

SEQ ID NO: 184599 - DNA, 25 bp, Homo sapien
gcacgcttgcctaatgaagacacta

SEQ ID NO: 184600 - DNA, 25 bp, Homo sapien
ctttcaatggtaaaacgcacgcttg

SEQ ID NO: 184601 - DNA, 25 bp, Homo sapien
aacctggccgtgtcagctcgtttgt

SEQ ID NO: 184602 - DNA, 25 bp, Homo sapien
gggagcggaacaaacacggacacta

SEQ ID NO: 184603 - DNA, 25 bp, Homo sapien
ggtcacaggcgtcaatacggccatg

SEQ ID NO: 184604 - DNA, 25 bp, Homo sapien
catttcgggatgttggtgccagcac

SEQ ID NO: 184605 - DNA, 25 bp, Homo sapien
acctggcggcccagcatgagtgagt

SEQ ID NO: 184606 - DNA, 25 bp, Homo sapien
cagctcttcgatgaccggttcccgg

SEQ ID NO: 184607 - DNA, 25 bp, Homo sapien
acctatgtcttcaaccacctggcgg

SEQ ID NO: 184608 - DNA, 25 bp, Homo sapien
tcctctgacaccctcggatctggtt

SEQ ID NO: 184609 - DNA, 25 bp, Homo sapien
ctttcgcggagaaaccgagcgcgcc

SEQ ID NO: 184610 - DNA, 25 bp, Homo sapien
ggagtgcctactccggaggacgccc

SEQ ID NO: 184611 - DNA, 25 bp, Homo sapien
gcgaagaccaggtcgcccgctttgt

SEQ ID NO: 184612 - DNA, 25 bp, Homo sapien
atcttattattgttctcgcgcgcgc

SEQ ID NO: 184613 - DNA, 25 bp, Homo sapien
ctccgaattccttctcgggcagcga

SEQ ID NO: 184614 - DNA, 25 bp, Homo sapien
gtagtccttggtcgccgcgaagatg

SEQ ID NO: 184615 - DNA, 25 bp, Homo sapien
ggcgcgccatcatgaaggggaaaat

SEQ ID NO: 184616 - DNA, 25 bp, Homo sapien
ggcagcgaccgcaaacacgatctta

SEQ ID NO: 184617 - DNA, 25 bp, Homo sapien
tcggaccggacctgtctaaatagcg

SEQ ID NO: 184618 - DNA, 25 bp, Homo sapien
agtcctaacgtcctgggctgaagcc

SEQ ID NO: 184619 - DNA, 25 bp, Homo sapien
ccacaggtggaaacagcaagtccta

SEQ ID NO: 184620 - DNA, 25 bp, Homo sapien
cggccagtgtgaaatatcagctgtt

SEQ ID NO: 184621 - DNA, 25 bp, Homo sapien
tcaacgctcggtctgtgtcccggaa

SEQ ID NO: 184622 - DNA, 25 bp, Homo sapien
ggtccgcagtgaagctggtcaaatc

SEQ ID NO: 184623 - DNA, 25 bp, Homo sapien
cgctttctgaaagacgggccacctc

SEQ ID NO: 184624 - DNA, 25 bp, Homo sapien
cagctgtttcacaaattctgaggta

SEQ ID NO: 184625 - DNA, 25 bp, Homo sapien
tcgcggactcctgagttacggggaa

SEQ ID NO: 184626 - DNA, 25 bp, Homo sapien
gggcttgagacacgagcgccttttc

SEQ ID NO: 184627 - DNA, 25 bp, Homo sapien
ttgcctaccactcgcggggcgattc

SEQ ID NO: 184628 - DNA, 25 bp, Homo sapien
gggcgattccaggagtacctggcaa

SEQ ID NO: 184629 - DNA, 25 bp, Homo sapien
gtacctggcaacaccacagactgcg

SEQ ID NO: 184630 - DNA, 25 bp, Homo sapien
cggcccaggccaagccaagcgtgga

SEQ ID NO: 184631 - DNA, 25 bp, Homo sapien
gttcccgcgctgagcaagtcctgat

SEQ ID NO: 184632 - DNA, 25 bp, Homo sapien
gtcctgatcgcggactcctgagtta

SEQ ID NO: 184633 - DNA, 25 bp, Homo sapien
tcctcgatctgggtgctctgaaggt

SEQ ID NO: 184634 - DNA, 25 bp, Homo sapien
tgccgcgttcgtctcccacaagaag

SEQ ID NO: 184635 - DNA, 25 bp, Homo sapien
tgcattctggctgctacacgctggc

SEQ ID NO: 184636 - DNA, 25 bp, Homo sapien
aacgctgagcccgaggtgtgtcaat

SEQ ID NO: 184637 - DNA, 25 bp, Homo sapien
gcgaaaccgagggactcaacctgtc

SEQ ID NO: 184638 - DNA, 25 bp, Homo sapien
gcggatgtctgaagaccgccctcga

SEQ ID NO: 184639 - DNA, 25 bp, Homo sapien
tgacctgagagtgatgcgaaaccga

SEQ ID NO: 184640 - DNA, 25 bp, Homo sapien
tgtgtcaatgacacggccctcgggg

SEQ ID NO: 184641 - DNA, 25 bp, Homo sapien
ttcctctacgcgagcgcgttctctg

SEQ ID NO: 184642 - DNA, 25 bp, Homo sapien
gaggacccggaattcctctacgcga

SEQ ID NO: 184643 - DNA, 25 bp, Homo sapien
tcctcgtcgtggtgagcgcagccac

SEQ ID NO: 184644 - DNA, 25 bp, Homo sapien
ctgtaggggaaagtgctaaagccgc

SEQ ID NO: 184645 - DNA, 25 bp, Homo sapien
ctaaagccgctgaggtaagaggccg

SEQ ID NO: 184646 - DNA, 25 bp, Homo sapien
cccaggatcctacctgcagggacta

SEQ ID NO: 184647 - DNA, 25 bp, Homo sapien
cctacctgcagggactagaaaaatg

SEQ ID NO: 184648 - DNA, 25 bp, Homo sapien
gcagacgtgcgataggaaatttccc

SEQ ID NO: 184649 - DNA, 25 bp, Homo sapien
tagatctatatcgtcccgcgcccag

SEQ ID NO: 184650 - DNA, 25 bp, Homo sapien
gggccgttgtaaatcggagagattc

SEQ ID NO: 184651 - DNA, 25 bp, Homo sapien
gctcaatttcttcccgcctaggagg

SEQ ID NO: 184652 - DNA, 25 bp, Homo sapien
gcagttccacaaagccagccaggta

SEQ ID NO: 184653 - DNA, 25 bp, Homo sapien
ttcatttgcatatcgccgcggcttg

SEQ ID NO: 184654 - DNA, 25 bp, Homo sapien
cgcgcccagcaagaagcactgtgtg

SEQ ID NO: 184655 - DNA, 25 bp, Homo sapien
tcccggtacccatgacaatctcaga

SEQ ID NO: 184656 - DNA, 25 bp, Homo sapien
tagcccaggtctccacgcaacaatg

SEQ ID NO: 184657 - DNA, 25 bp, Homo sapien
ggggctgcacgtcccagatacttct

SEQ ID NO: 184658 - DNA, 25 bp, Homo sapien
tccacagggttggagtttttcagga

SEQ ID NO: 184659 - DNA, 25 bp, Homo sapien
ttactaagcagaaacctcgcgggtc

SEQ ID NO: 184660 - DNA, 25 bp, Homo sapien
ttgaccactgggtagcgagcgccca

SEQ ID NO: 184661 - DNA, 25 bp, Homo sapien
gtaagacttggagcagtggcctctc

SEQ ID NO: 184662 - DNA, 25 bp, Homo sapien
gccggattccgcacgaggtgttgac

SEQ ID NO: 184663 - DNA, 25 bp, Homo sapien
tttcaggattgggagttactaagca

SEQ ID NO: 184664 - DNA, 25 bp, Homo sapien
cagtggcctctctaagcaagttggg

SEQ ID NO: 184665 - DNA, 25 bp, Homo sapien
ccgcagagttctcggcgtttccgaa

SEQ ID NO: 184666 - DNA, 25 bp, Homo sapien
tgtagacccgggatcctcaaataga

SEQ ID NO: 184667 - DNA, 25 bp, Homo sapien
cagcggtttcttacccgcaagtaca

SEQ ID NO: 184668 - DNA, 25 bp, Homo sapien
gtgctcttggctcccagggtttctt

SEQ ID NO: 184669 - DNA, 25 bp, Homo sapien
cttccggcgccgtaagagaagcgtc

SEQ ID NO: 184670 - DNA, 25 bp, Homo sapien
cgtttccgaagctcttggtgtggcc

SEQ ID NO: 184671 - DNA, 25 bp, Homo sapien
ctggaagctttggtccctggagtgt

SEQ ID NO: 184672 - DNA, 25 bp, Homo sapien
gggtttctttcaccgcgcctcagca

SEQ ID NO: 184673 - DNA, 25 bp, Homo sapien
aaccaccaactggtgtgtgtgtatt

SEQ ID NO: 184674 - DNA, 25 bp, Homo sapien
cctcaggcgatccagctgcgtcagc

SEQ ID NO: 184675 - DNA, 25 bp, Homo sapien
aggctgcacaaccaccaactggtgt

SEQ ID NO: 184676 - DNA, 25 bp, Homo sapien
caggctgcacaaccaccaactggtg

SEQ ID NO: 184677 - DNA, 25 bp, Homo sapien
cgccctgccgtgtgaagccgccgct

SEQ ID NO: 184678 - DNA, 25 bp, Homo sapien
gagaaaggtgcgcgctcacccggcc

SEQ ID NO: 184679 - DNA, 25 bp, Homo sapien
agtcccggcgatcggggccaggcca

SEQ ID NO: 184680 - DNA, 25 bp, Homo sapien
ccaagcctcccgcagtcccggcgat

SEQ ID NO: 184681 - DNA, 25 bp, Homo sapien
caaccgctagagcaggacctggtct

SEQ ID NO: 184682 - DNA, 25 bp, Homo sapien
caggacctggtctcccgagaggtga

SEQ ID NO: 184683 - DNA, 25 bp, Homo sapien
tcaggttcgtctccgggcggactac

SEQ ID NO: 184684 - DNA, 25 bp, Homo sapien
ctccaccaacagaaaggcagaattt

SEQ ID NO: 184685 - DNA, 25 bp, Homo sapien
aggcagaatttccagggccgttctc

SEQ ID NO: 184686 - DNA, 25 bp, Homo sapien
cagggccgttctcggcagccaatga

SEQ ID NO: 184687 - DNA, 25 bp, Homo sapien
tttcgcacgcgaagcaaccgctaga

SEQ ID NO: 184688 - DNA, 25 bp, Homo sapien
tctcctaccgagaagcgcaggcttt

SEQ ID NO: 184689 - DNA, 25 bp, Homo sapien
ctaacgctgctgtctgtcttcgggc

SEQ ID NO: 184690 - DNA, 25 bp, Homo sapien
tacccagctggtagaaaagtcatca

SEQ ID NO: 184691 - DNA, 25 bp, Homo sapien
tcgtctgaaacgaataggcgcctga

SEQ ID NO: 184692 - DNA, 25 bp, Homo sapien
ggcgcctgagatattctcccatttt

SEQ ID NO: 184693 - DNA, 25 bp, Homo sapien
cattttatgggctaacgctgctgtc

SEQ ID NO: 184694 - DNA, 25 bp, Homo sapien
tccggtgctcagtggctagccgaat

SEQ ID NO: 184695 - DNA, 25 bp, Homo sapien
taagaacatgtcacggggccgaatc

SEQ ID NO: 184696 - DNA, 25 bp, Homo sapien
gccgaatagccgtgtttgggacctg

SEQ ID NO: 184697 - DNA, 25 bp, Homo sapien
tgcatctgtcacctcggcggcagcg

SEQ ID NO: 184698 - DNA, 25 bp, Homo sapien
aagctcttgcgtgcaccagttcccg

SEQ ID NO: 184699 - DNA, 25 bp, Homo sapien
cgcggcgaaatcagttaagctcttg

SEQ ID NO: 184700 - DNA, 25 bp, Homo sapien
cttgaggtcgcacctccgctgtgga

SEQ ID NO: 184701 - DNA, 25 bp, Homo sapien
agctgctctgcatctgtcacctcgg

SEQ ID NO: 184702 - DNA, 25 bp, Homo sapien
ccagtcagctgctctgcatctgtca

SEQ ID NO: 184703 - DNA, 25 bp, Homo sapien
ggagattggacccttcccccagtca

SEQ ID NO: 184704 - DNA, 25 bp, Homo sapien
cagaccgcggcgaaatcagttaagc

SEQ ID NO: 184705 - DNA, 25 bp, Homo sapien
ccaaggcgtccctctgagcgagaaa

SEQ ID NO: 184706 - DNA, 25 bp, Homo sapien
tgaagcattccttctagttcccgga

SEQ ID NO: 184707 - DNA, 25 bp, Homo sapien
agcgatgctgtgaccgttgcatttg

SEQ ID NO: 184708 - DNA, 25 bp, Homo sapien
tctgcaaaggcgtcaatgtgtctcc

SEQ ID NO: 184709 - DNA, 25 bp, Homo sapien
aatcgtccctaatgcgctgctcagc

SEQ ID NO: 184710 - DNA, 25 bp, Homo sapien
cctctggtggacagtgtctaacatc

SEQ ID NO: 184711 - DNA, 25 bp, Homo sapien
taccggcaaggaacgagaagcacca

SEQ ID NO: 184712 - DNA, 25 bp, Homo sapien
tggctgttgaaaggcagtccctctg

SEQ ID NO: 184713 - DNA, 25 bp, Homo sapien
cttctgctgcaaggagcgccagcgc

SEQ ID NO: 184714 - DNA, 25 bp, Homo sapien
tcctgctcagctgcggtcgccatgg

SEQ ID NO: 184715 - DNA, 25 bp, Homo sapien
gaactctagcccgtccgcaagagtg

SEQ ID NO: 184716 - DNA, 25 bp, Homo sapien
ccgtccgcaagagtgataagaaatc

SEQ ID NO: 184717 - DNA, 25 bp, Homo sapien
taagaaatcgcagtgtgggcccacg

SEQ ID NO: 184718 - DNA, 25 bp, Homo sapien
cgccgccgtaccgtggtgtacgtgc

SEQ ID NO: 184719 - DNA, 25 bp, Homo sapien
ggtgccagcctccttgagtcaaggg

SEQ ID NO: 184720 - DNA, 25 bp, Homo sapien
gagcctaggactcggaagcgacccg

SEQ ID NO: 184721 - DNA, 25 bp, Homo sapien
gcaaggattccaccagccagtcgtc

SEQ ID NO: 184722 - DNA, 25 bp, Homo sapien
aacgcgcgcacgcaggaaggagcca

SEQ ID NO: 184723 - DNA, 25 bp, Homo sapien
tagtaatctcacaacgcgcgcacgc

SEQ ID NO: 184724 - DNA, 25 bp, Homo sapien
cgtacgatttacaagcgcaaggatt

SEQ ID NO: 184725 - DNA, 25 bp, Homo sapien
ctccgcgaaagctccgggaaaagtg

SEQ ID NO: 184726 - DNA, 25 bp, Homo sapien
acaagcgcggctcttactagtaatc

SEQ ID NO: 184727 - DNA, 25 bp, Homo sapien
ggaaggagccatttcctagagatgg

SEQ ID NO: 184728 - DNA, 25 bp, Homo sapien
caggatccatggcaacgaccgcttc

SEQ ID NO: 184729 - DNA, 25 bp, Homo sapien
caaagacttaccggtggcccagagg

SEQ ID NO: 184730 - DNA, 25 bp, Homo sapien
ccagaggttgcctcgcgagtgcact

SEQ ID NO: 184731 - DNA, 25 bp, Homo sapien
gttgcctcgcgagtgcactcggatc

SEQ ID NO: 184732 - DNA, 25 bp, Homo sapien
gcactcggatcttgctggctcggct

SEQ ID NO: 184733 - DNA, 25 bp, Homo sapien
ggctgccttcgatccttttaaatcc

SEQ ID NO: 184734 - DNA, 25 bp, Homo sapien
cctcccgctaggttaccaggcaggg

SEQ ID NO: 184735 - DNA, 25 bp, Homo sapien
ccttcaggctaaggaccgggcaccg

SEQ ID NO: 184736 - DNA, 25 bp, Homo sapien
gaagcccgccaccttcaggctaagg

SEQ ID NO: 184737 - DNA, 25 bp, Homo sapien
ttctctggtcgagcaagtctcctgc

SEQ ID NO: 184738 - DNA, 25 bp, Homo sapien
agagtccgccgccttaaaatgacta

SEQ ID NO: 184739 - DNA, 25 bp, Homo sapien
ttcaagcgcgtacggtttccatttg

SEQ ID NO: 184740 - DNA, 25 bp, Homo sapien
ggcctctggccacagtctccaaaga

SEQ ID NO: 184741 - DNA, 25 bp, Homo sapien
gacccgggtatcagaccagctcaga

SEQ ID NO: 184742 - DNA, 25 bp, Homo sapien
gctgacagagagactcacgaccttg

SEQ ID NO: 184743 - DNA, 25 bp, Homo sapien
tctcgcctgccaaaaaccgactgga

SEQ ID NO: 184744 - DNA, 25 bp, Homo sapien
atgtgtcgtctgaccgtaggttctc

SEQ ID NO: 184745 - DNA, 25 bp, Homo sapien
gcctgcgcgaatgtccttgtagcca

SEQ ID NO: 184746 - DNA, 25 bp, Homo sapien
gaccaaacatttagggcgcacctga

SEQ ID NO: 184747 - DNA, 25 bp, Homo sapien
ggcagatcctgttcctctagtgggc

SEQ ID NO: 184748 - DNA, 25 bp, Homo sapien
cgagacagctgcgtaggcagatcct

SEQ ID NO: 184749 - DNA, 25 bp, Homo sapien
gtctcagtgaagaggacgcagtccc

SEQ ID NO: 184750 - DNA, 25 bp, Homo sapien
cctatgcgccaggtctcagtgaaga

SEQ ID NO: 184751 - DNA, 25 bp, Homo sapien
gcttgctttcacttaacagcctcga

SEQ ID NO: 184752 - DNA, 25 bp, Homo sapien
ttgtagccagctatgaccaaacatt

SEQ ID NO: 184753 - DNA, 25 bp, Homo sapien
gtctagcccaagctggccagcggtt

SEQ ID NO: 184754 - DNA, 25 bp, Homo sapien
atgaccaggacacccgctgcgcctt

SEQ ID NO: 184755 - DNA, 25 bp, Homo sapien
agacgcggcgctactgcagacacca

SEQ ID NO: 184756 - DNA, 25 bp, Homo sapien
tgccacacgggacatgagcaggccg

SEQ ID NO: 184757 - DNA, 25 bp, Homo sapien
ccctcatatgccacacgggacatga

SEQ ID NO: 184758 - DNA, 25 bp, Homo sapien
agctggccagcggttgacctggctc

SEQ ID NO: 184759 - DNA, 25 bp, Homo sapien
agcaggtgacgacggcccggccacc

SEQ ID NO: 184760 - DNA, 25 bp, Homo sapien
ggggcctgtcctccatgaccaggac

SEQ ID NO: 184761 - DNA, 25 bp, Homo sapien
ggcctcttttctgggtaacagctcc

SEQ ID NO: 184762 - DNA, 25 bp, Homo sapien
tacggagccggaattcgaatttggc

SEQ ID NO: 184763 - DNA, 25 bp, Homo sapien
cccagctgctttgcattgacgccag

SEQ ID NO: 184764 - DNA, 25 bp, Homo sapien
gccgtttctgcgcttctcgacggtg

SEQ ID NO: 184765 - DNA, 25 bp, Homo sapien
cgggagcgtctaaggctagccttgt

SEQ ID NO: 184766 - DNA, 25 bp, Homo sapien
ggtgtccacatctaggcggagtctg

SEQ ID NO: 184767 - DNA, 25 bp, Homo sapien
cctgggtaaggagagcgcaaatctc

SEQ ID NO: 184768 - DNA, 25 bp, Homo sapien
gctccagggctcacacttggtgacc

SEQ ID NO: 184769 - DNA, 25 bp, Homo sapien
ccacagtggcaataaccggcatcca

SEQ ID NO: 184770 - DNA, 25 bp, Homo sapien
ggcaataaccggcatccaccagaga

SEQ ID NO: 184771 - DNA, 25 bp, Homo sapien
ccacagcggcaataaccagcatcca

SEQ ID NO: 184772 - DNA, 25 bp, Homo sapien
ataaccggcatccaccagagaacca

SEQ ID NO: 184773 - DNA, 25 bp, Homo sapien
gcggcaataaccggcatccaccaga

SEQ ID NO: 184774 - DNA, 25 bp, Homo sapien
cagcggcaataaccggcatccacca

SEQ ID NO: 184775 - DNA, 25 bp, Homo sapien
gcaataaccggcatccaccagagaa

SEQ ID NO: 184776 - DNA, 25 bp, Homo sapien
caataaccggcatccaccagagaac

SEQ ID NO: 184777 - DNA, 25 bp, Homo sapien
cttactattggtctcatgcagcgag

SEQ ID NO: 184778 - DNA, 25 bp, Homo sapien
cggtaaacacgtcgggccgcgcctg

SEQ ID NO: 184779 - DNA, 25 bp, Homo sapien
gaagagttgtcccagctcggcccgc

SEQ ID NO: 184780 - DNA, 25 bp, Homo sapien
cgaaggtgaagagttgtcccagctc

SEQ ID NO: 184781 - DNA, 25 bp, Homo sapien
tgtgctctgccgagactgccgtgcc

SEQ ID NO: 184782 - DNA, 25 bp, Homo sapien
gaagcgcctgtgctctgccgagact

SEQ ID NO: 184783 - DNA, 25 bp, Homo sapien
agccgcggtgaagcgcctgtgctct

SEQ ID NO: 184784 - DNA, 25 bp, Homo sapien
ctcatgcagcgagatgggcagttct

SEQ ID NO: 184785 - DNA, 25 bp, Homo sapien
gcggagcacagccttcgaagtaaga

SEQ ID NO: 184786 - DNA, 25 bp, Homo sapien
cgcacttgcagatctttctccagga

SEQ ID NO: 184787 - DNA, 25 bp, Homo sapien
ctccaggagtgagtttaaggtccgc

SEQ ID NO: 184788 - DNA, 25 bp, Homo sapien
tccgcacctccgctctggatggtga

SEQ ID NO: 184789 - DNA, 25 bp, Homo sapien
ggagcacgtgcactttacctgcgca

SEQ ID NO: 184790 - DNA, 25 bp, Homo sapien
ggggaacttgccttgcttcctaagc

SEQ ID NO: 184791 - DNA, 25 bp, Homo sapien
cgtctgtgcacactaacctttaggg

SEQ ID NO: 184792 - DNA, 25 bp, Homo sapien
gctgtgtaaaccctccctgcctgtt

SEQ ID NO: 184793 - DNA, 25 bp, Homo sapien
aggcgcgagcgtgagtgggaagctc

SEQ ID NO: 184794 - DNA, 25 bp, Homo sapien
cagtacctcgaggagaagcgcaggc

SEQ ID NO: 184795 - DNA, 25 bp, Homo sapien
gacctggccaacctgcagaagcagc

SEQ ID NO: 184796 - DNA, 25 bp, Homo sapien
cgagctccctcattgagcaggagaa

SEQ ID NO: 184797 - DNA, 25 bp, Homo sapien
gcccgagctccctcattgagcagga

SEQ ID NO: 184798 - DNA, 25 bp, Homo sapien
ctcgcagcttgtcccgcccgagctc

SEQ ID NO: 184799 - DNA, 25 bp, Homo sapien
ctcactcgcagcttgtcccgcccga

SEQ ID NO: 184800 - DNA, 25 bp, Homo sapien
gtgggaagctcgtgagagggagctg

SEQ ID NO: 184801 - DNA, 25 bp, Homo sapien
cagaacacgatgtttacccgtgagc

SEQ ID NO: 184802 - DNA, 25 bp, Homo sapien
tttacccgtgagcatacgcttgagc

SEQ ID NO: 184803 - DNA, 25 bp, Homo sapien
gccacggcatgaccttctcgggctg

SEQ ID NO: 184804 - DNA, 25 bp, Homo sapien
gggcgcctgaaggtgagatcacaaa

SEQ ID NO: 184805 - DNA, 25 bp, Homo sapien
gagctcatgaggttcatggtgacta

SEQ ID NO: 184806 - DNA, 25 bp, Homo sapien
tgagatcacaaaacacagaacacga

SEQ ID NO: 184807 - DNA, 25 bp, Homo sapien
tgactatgaaaacgcacaaggaggg

SEQ ID NO: 184808 - DNA, 25 bp, Homo sapien
ccacggtgcaaccagtgggcgcaac

SEQ ID NO: 184809 - DNA, 25 bp, Homo sapien
acgtcggtgaacatgcagtgcttgc

SEQ ID NO: 184810 - DNA, 25 bp, Homo sapien
agtgactcagcgttctcctcgttga

SEQ ID NO: 184811 - DNA, 25 bp, Homo sapien
ccgcacatcgtggaactgcagcatg

SEQ ID NO: 184812 - DNA, 25 bp, Homo sapien
ggcacatgcgccaggagaactcata

SEQ ID NO: 184813 - DNA, 25 bp, Homo sapien
ccatgataagcttggtgcgctcgtc

SEQ ID NO: 184814 - DNA, 25 bp, Homo sapien
cagcgcagggcctcatccatgataa

SEQ ID NO: 184815 - DNA, 25 bp, Homo sapien
gggctggtgaccacgccatcattct

SEQ ID NO: 184816 - DNA, 25 bp, Homo sapien
gacttgcgggtctcatggacactga

SEQ ID NO: 184817 - DNA, 25 bp, Homo sapien
tggatactcactgccggagacgatc

SEQ ID NO: 184818 - DNA, 25 bp, Homo sapien
tcggccggctctccacaggcaaaaa

SEQ ID NO: 184819 - DNA, 25 bp, Homo sapien
atgggcagccgaacccttcagtgca

SEQ ID NO: 184820 - DNA, 25 bp, Homo sapien
cggcccgaagagcagcagccaatca

SEQ ID NO: 184821 - DNA, 25 bp, Homo sapien
gcagtctctctttccaggatcaata

SEQ ID NO: 184822 - DNA, 25 bp, Homo sapien
ctgcaaaccgaaacgagggaccctg

SEQ ID NO: 184823 - DNA, 25 bp, Homo sapien
ctgccgctggacagttctgcaaacc

SEQ ID NO: 184824 - DNA, 25 bp, Homo sapien
taggcgccgccaacaaactagtttc

SEQ ID NO: 184825 - DNA, 25 bp, Homo sapien
gcagggctgcaaggtgacttgctaa

SEQ ID NO: 184826 - DNA, 25 bp, Homo sapien
gaccagaaaggagcgcgcgtctaac

SEQ ID NO: 184827 - DNA, 25 bp, Homo sapien
tgctaacgcaatcagaccagaaagg

SEQ ID NO: 184828 - DNA, 25 bp, Homo sapien
ggcaaagtccgctccggagtctgtc

SEQ ID NO: 184829 - DNA, 25 bp, Homo sapien
tctggcggcaagagccctgaacatt

SEQ ID NO: 184830 - DNA, 25 bp, Homo sapien
gccctgaacatttcgcaagcggcga

SEQ ID NO: 184831 - DNA, 25 bp, Homo sapien
ggcgcgtgttatcctgggcacccac

SEQ ID NO: 184832 - DNA, 25 bp, Homo sapien
ccaccggaccgaatcgctgggcagg

SEQ ID NO: 184833 - DNA, 25 bp, Homo sapien
gtcccacctactgggcagaattaaa

SEQ ID NO: 184834 - DNA, 25 bp, Homo sapien
agtgctccgagccttacgaaacgca

SEQ ID NO: 184835 - DNA, 25 bp, Homo sapien
ttccgtaatctagagtctggggctc

SEQ ID NO: 184836 - DNA, 25 bp, Homo sapien
cgcgcagtccttggtctgaatgaca

SEQ ID NO: 184837 - DNA, 25 bp, Homo sapien
gcgctacccggttttgctgcaatcc

SEQ ID NO: 184838 - DNA, 25 bp, Homo sapien
tgcacgacacggaaaggcgctctcc

SEQ ID NO: 184839 - DNA, 25 bp, Homo sapien
acgcacgggttatcggagcgtcttc

SEQ ID NO: 184840 - DNA, 25 bp, Homo sapien
cgcgcggctgcagaaatgtacaagt

SEQ ID NO: 184841 - DNA, 25 bp, Homo sapien
ccaggctgcgagagcttagactgcc

SEQ ID NO: 184842 - DNA, 25 bp, Homo sapien
tgactgtcgctgcagacggaaactg

SEQ ID NO: 184843 - DNA, 25 bp, Homo sapien
cccggaactgctagaacgaaccatt

SEQ ID NO: 184844 - DNA, 25 bp, Homo sapien
ccaacaagcgccatggggatccgtt

SEQ ID NO: 184845 - DNA, 25 bp, Homo sapien
gggtgacccaccatctcagaacatt

SEQ ID NO: 184846 - DNA, 25 bp, Homo sapien
ctatgctcctactcgtgtcccttga

SEQ ID NO: 184847 - DNA, 25 bp, Homo sapien
caccgagcttttcttcccagcaggg

SEQ ID NO: 184848 - DNA, 25 bp, Homo sapien
tggggtcaattcaagtcatgcaggc

SEQ ID NO: 184849 - DNA, 25 bp, Homo sapien
agagcaagtggtcttcctccctagc

SEQ ID NO: 184850 - DNA, 25 bp, Homo sapien
agagagcgcctaatgccgttacttc

SEQ ID NO: 184851 - DNA, 25 bp, Homo sapien
gcccagagccgcaggaaaaaatgtg

SEQ ID NO: 184852 - DNA, 25 bp, Homo sapien
tttgctttgcctgccaccagatctg

SEQ ID NO: 184853 - DNA, 25 bp, Homo sapien
cttgcagtttgtttcgctcggtccc

SEQ ID NO: 184854 - DNA, 25 bp, Homo sapien
ccgcggcgacccatgccaggtaaaa

SEQ ID NO: 184855 - DNA, 25 bp, Homo sapien
ggggcacttcacaaacagcttcctc

SEQ ID NO: 184856 - DNA, 25 bp, Homo sapien
acccgccaaatgtgccttgccaaaa

SEQ ID NO: 184857 - DNA, 25 bp, Homo sapien
catgcctagcctttgggaccgcttc

SEQ ID NO: 184858 - DNA, 25 bp, Homo sapien
tcgccgcgctagtccttataggctg

SEQ ID NO: 184859 - DNA, 25 bp, Homo sapien
ccctcttgtcttacagcggcttcta

SEQ ID NO: 184860 - DNA, 25 bp, Homo sapien
gccttggcttcctatcccatcggga

SEQ ID NO: 184861 - DNA, 25 bp, Homo sapien
tctacgctccggcactctgagttca

SEQ ID NO: 184862 - DNA, 25 bp, Homo sapien
ccgcctgtgcgtttcgttttgaagc

SEQ ID NO: 184863 - DNA, 25 bp, Homo sapien
agccgccgcggatcctttccagaaa

SEQ ID NO: 184864 - DNA, 25 bp, Homo sapien
agaacgttgcttacgtgcgcccgga

SEQ ID NO: 184865 - DNA, 25 bp, Homo sapien
gtgagatcaggcctcccacgcgtca

SEQ ID NO: 184866 - DNA, 25 bp, Homo sapien
gccagcaagtgaccaacgcccgagt

SEQ ID NO: 184867 - DNA, 25 bp, Homo sapien
gacgcctgaactgggctgaccctgc

SEQ ID NO: 184868 - DNA, 25 bp, Homo sapien
acgccacgtgcagaccggaagagac

SEQ ID NO: 184869 - DNA, 25 bp, Homo sapien
ctgccgtccagcgagccaataggcg

SEQ ID NO: 184870 - DNA, 25 bp, Homo sapien
acgagttacgccctcttcaggagtc

SEQ ID NO: 184871 - DNA, 25 bp, Homo sapien
gcccgagtccttcccggtgagatca

SEQ ID NO: 184872 - DNA, 25 bp, Homo sapien
caggcaggctcgaccaatcagaaga

SEQ ID NO: 184873 - DNA, 25 bp, Homo sapien
ggcaagcatccgaggcagccaaaca

SEQ ID NO: 184874 - DNA, 25 bp, Homo sapien
ctgaacccagggcaagcatccgagg

SEQ ID NO: 184875 - DNA, 25 bp, Homo sapien
gggcagcacataccttcccggcgtg

SEQ ID NO: 184876 - DNA, 25 bp, Homo sapien
caggacactgggaggtctgaaccca

SEQ ID NO: 184877 - DNA, 25 bp, Homo sapien
ccacacaggacactgggaggtctga

SEQ ID NO: 184878 - DNA, 25 bp, Homo sapien
accttcccggcgtggtcaggacacg

SEQ ID NO: 184879 - DNA, 25 bp, Homo sapien
ttcctgcgggccgtatcttggcagc

SEQ ID NO: 184880 - DNA, 25 bp, Homo sapien
gcagccaaacaagggcgggctttgt

SEQ ID NO: 184881 - DNA, 25 bp, Homo sapien
cagctactcccggatttctggttaa

SEQ ID NO: 184882 - DNA, 25 bp, Homo sapien
cccttctgaggtcgtggataagcct

SEQ ID NO: 184883 - DNA, 25 bp, Homo sapien
agggcccagcacaaaatgccttcca

SEQ ID NO: 184884 - DNA, 25 bp, Homo sapien
cttctcttctcgaacgtgctttggg

SEQ ID NO: 184885 - DNA, 25 bp, Homo sapien
aaccaaggaccgctcagaggggctc

SEQ ID NO: 184886 - DNA, 25 bp, Homo sapien
agaggggctctcaccctgaacctcg

SEQ ID NO: 184887 - DNA, 25 bp, Homo sapien
gcgcacagtgcacggagctccgaag

SEQ ID NO: 184888 - DNA, 25 bp, Homo sapien
ttttggcaagtcaggacagcgcaca

SEQ ID NO: 184889 - DNA, 25 bp, Homo sapien
acagaggcccggctgtttcgcaagc

SEQ ID NO: 184890 - DNA, 25 bp, Homo sapien
tctcgctgccacaaccctaattatg

SEQ ID NO: 184891 - DNA, 25 bp, Homo sapien
aagcacctcgaacacaatctcgctg

SEQ ID NO: 184892 - DNA, 25 bp, Homo sapien
tgatatttccagtaaaagcacctcg

SEQ ID NO: 184893 - DNA, 25 bp, Homo sapien
aagaggaacacagccctcccttgtc

SEQ ID NO: 184894 - DNA, 25 bp, Homo sapien
ctgcgccctgaacgctgcctgttgt

SEQ ID NO: 184895 - DNA, 25 bp, Homo sapien
ccgagcctcctgtaagctgcttctg

SEQ ID NO: 184896 - DNA, 25 bp, Homo sapien
agagaagcccattctccgcggccgg

SEQ ID NO: 184897 - DNA, 25 bp, Homo sapien
tgcaccctccttagatcgcgtcgtg

SEQ ID NO: 184898 - DNA, 25 bp, Homo sapien
tccgggcacctttcagtgtccattc

SEQ ID NO: 184899 - DNA, 25 bp, Homo sapien
cgcccgtccctatgtatgtgtcaca

SEQ ID NO: 184900 - DNA, 25 bp, Homo sapien
agcgctgctcaaggtctctctctct

SEQ ID NO: 184901 - DNA, 25 bp, Homo sapien
tcgttccaaatcgtggccgacagta

SEQ ID NO: 184902 - DNA, 25 bp, Homo sapien
gctcctcggtgagggtcgttccaaa

SEQ ID NO: 184903 - DNA, 25 bp, Homo sapien
aaaactttcagccagctcctcggtg

SEQ ID NO: 184904 - DNA, 25 bp, Homo sapien
ggagtccaactcttcaaggtaactg

SEQ ID NO: 184905 - DNA, 25 bp, Homo sapien
cctggatctccagcgagacgtcatg

SEQ ID NO: 184906 - DNA, 25 bp, Homo sapien
gttctccgacagcttccaccatttg

SEQ ID NO: 184907 - DNA, 25 bp, Homo sapien
caaaggagcggtgcctcagcccgat

SEQ ID NO: 184908 - DNA, 25 bp, Homo sapien
ccagcgagacgtcatgctctttgtc

SEQ ID NO: 184909 - DNA, 25 bp, Homo sapien
agcggtaacgcccatagtcctccag

SEQ ID NO: 184910 - DNA, 25 bp, Homo sapien
cgtcaatgacctcacagcggtaacg

SEQ ID NO: 184911 - DNA, 25 bp, Homo sapien
gacagcttccaccatttgacacgca

SEQ ID NO: 184912 - DNA, 25 bp, Homo sapien
gtcatgctctttgtcctgccgcagg

SEQ ID NO: 184913 - DNA, 25 bp, Homo sapien
gacggcactggaggcagccgaccct

SEQ ID NO: 184914 - DNA, 25 bp, Homo sapien
ttaaaagggcagaaaggaagcggca

SEQ ID NO: 184915 - DNA, 25 bp, Homo sapien
cagcagtctgatttcggggaaatta

SEQ ID NO: 184916 - DNA, 25 bp, Homo sapien
cccggtccaaggcagcagtctgatt

SEQ ID NO: 184917 - DNA, 25 bp, Homo sapien
caggcagctcctcgacggctagagc

SEQ ID NO: 184918 - DNA, 25 bp, Homo sapien
tctgctccctcacggtgggcacgag

SEQ ID NO: 184919 - DNA, 25 bp, Homo sapien
agccgaccctggacagacgacaggg

SEQ ID NO: 184920 - DNA, 25 bp, Homo sapien
gagcatccaacagatacccaggggc

SEQ ID NO: 184921 - DNA, 25 bp, Homo sapien
ggggctttgtctaagtttgtcaaca

SEQ ID NO: 184922 - DNA, 25 bp, Homo sapien
tccgcccaagctggccagaggcgga

SEQ ID NO: 184923 - DNA, 25 bp, Homo sapien
ccggaataaatcaggcggctcagca

SEQ ID NO: 184924 - DNA, 25 bp, Homo sapien
gccttctcctctgggaccggaataa

SEQ ID NO: 184925 - DNA, 25 bp, Homo sapien
tctaagtttgtcaacagtggaggtg

SEQ ID NO: 184926 - DNA, 25 bp, Homo sapien
gggctgtcacccgatgtcccgagtc

SEQ ID NO: 184927 - DNA, 25 bp, Homo sapien
tggtccgcgatatctgcctcttccg

SEQ ID NO: 184928 - DNA, 25 bp, Homo sapien
agcgcagagacagcagggccgcatc

SEQ ID NO: 184929 - DNA, 25 bp, Homo sapien
ccttctgcccgaggaaccgaggttg

SEQ ID NO: 184930 - DNA, 25 bp, Homo sapien
ccatcacgccgcagcctgaggggat

SEQ ID NO: 184931 - DNA, 25 bp, Homo sapien
atcacacgcaggtaaagccacggcc

SEQ ID NO: 184932 - DNA, 25 bp, Homo sapien
gcgagctgagcacctgtagtcaatc

SEQ ID NO: 184933 - DNA, 25 bp, Homo sapien
aggggttccggctgtatatccatga

SEQ ID NO: 184934 - DNA, 25 bp, Homo sapien
agaagcggctgaactgcccaatgaa

SEQ ID NO: 184935 - DNA, 25 bp, Homo sapien
aggggcctgattacagcccgagata

SEQ ID NO: 184936 - DNA, 25 bp, Homo sapien
gcccaatgaacaagcggtttccgtg

SEQ ID NO: 184937 - DNA, 25 bp, Homo sapien
tgctttgcatttgttgtccggtcgc

SEQ ID NO: 184938 - DNA, 25 bp, Homo sapien
aaggaggctcctgtcctgacttggc

SEQ ID NO: 184939 - DNA, 25 bp, Homo sapien
cctgacttggcgttctggtattttc

SEQ ID NO: 184940 - DNA, 25 bp, Homo sapien
gccgagggtgagctcttacttctga

SEQ ID NO: 184941 - DNA, 25 bp, Homo sapien
tagtttttgtatttgcgctcacggc

SEQ ID NO: 184942 - DNA, 25 bp, Homo sapien
accagctgcttcgtgttatagtttt

SEQ ID NO: 184943 - DNA, 25 bp, Homo sapien
gcgctcacggcttgttaactgaaga

SEQ ID NO: 184944 - DNA, 25 bp, Homo sapien
tttctctggcgtggaaagtaggcgc

SEQ ID NO: 184945 - DNA, 25 bp, Homo sapien
gggacctcgacttggtggccaatga

SEQ ID NO: 184946 - DNA, 25 bp, Homo sapien
ggctctcccaggactggccacattg

SEQ ID NO: 184947 - DNA, 25 bp, Homo sapien
tctgccttggttggtcccttctgat

SEQ ID NO: 184948 - DNA, 25 bp, Homo sapien
aactgggtcgcacccggtctgcctt

SEQ ID NO: 184949 - DNA, 25 bp, Homo sapien
gggagagatgcgtcacccgctaatc

SEQ ID NO: 184950 - DNA, 25 bp, Homo sapien
ctgagctcagcggtcttcagccagc

SEQ ID NO: 184951 - DNA, 25 bp, Homo sapien
agggttccatgcaactccgtgccca

SEQ ID NO: 184952 - DNA, 25 bp, Homo sapien
agcaggattcgaacagggttccatg

SEQ ID NO: 184953 - DNA, 25 bp, Homo sapien
gcagctccacgtcgggcaagggcac

SEQ ID NO: 184954 - DNA, 25 bp, Homo sapien
gctgggcctgcaacagcaagttggc

SEQ ID NO: 184955 - DNA, 25 bp, Homo sapien
cctccgaggatagcacttgcggctg

SEQ ID NO: 184956 - DNA, 25 bp, Homo sapien
gatgtccaatgggttgtgccgcagc

SEQ ID NO: 184957 - DNA, 25 bp, Homo sapien
gccctctcgagagcatctggatgtc

SEQ ID NO: 184958 - DNA, 25 bp, Homo sapien
agatttgctcgtgcagccctctcga

SEQ ID NO: 184959 - DNA, 25 bp, Homo sapien
cagagcccgtgcttctgcaggtgct

SEQ ID NO: 184960 - DNA, 25 bp, Homo sapien
ctccttgcccgaagatttgctcgtg

SEQ ID NO: 184961 - DNA, 25 bp, Homo sapien
acaatgtgaacgtagtcgccgccga

SEQ ID NO: 184962 - DNA, 25 bp, Homo sapien
tcctccctcaggaacgaagtattgg

SEQ ID NO: 184963 - DNA, 25 bp, Homo sapien
tgtctcagcggaggcacatttctaa

SEQ ID NO: 184964 - DNA, 25 bp, Homo sapien
aagtccctgcgagattgcccgccta

SEQ ID NO: 184965 - DNA, 25 bp, Homo sapien
cggaagtaaccacgcccagcaagtc

SEQ ID NO: 184966 - DNA, 25 bp, Homo sapien
cgattcccaccgcacttcaaagatg

SEQ ID NO: 184967 - DNA, 25 bp, Homo sapien
ctcaaggagcaggtggattggtccc

SEQ ID NO: 184968 - DNA, 25 bp, Homo sapien
tcccagcgcgaccaataggagggcc

SEQ ID NO: 184969 - DNA, 25 bp, Homo sapien
gacagcgcgcagagccaagcttatg

SEQ ID NO: 184970 - DNA, 25 bp, Homo sapien
ccttcaggcgccgagaaaaagatac

SEQ ID NO: 184971 - DNA, 25 bp, Homo sapien
ttctcgacatcggtggcagcctcag

SEQ ID NO: 184972 - DNA, 25 bp, Homo sapien
tcaggagctcctacgtcctctaaga

SEQ ID NO: 184973 - DNA, 25 bp, Homo sapien
tcctctaagaggcttggcgtagtcc

SEQ ID NO: 184974 - DNA, 25 bp, Homo sapien
ccacggctctctcctggaattaagc

SEQ ID NO: 184975 - DNA, 25 bp, Homo sapien
aagggtttggccgattctcagactg

SEQ ID NO: 184976 - DNA, 25 bp, Homo sapien
tcgatgttcgccctggactcagtga

SEQ ID NO: 184977 - DNA, 25 bp, Homo sapien
gtccacagtgttccacgcgcacagg

SEQ ID NO: 184978 - DNA, 25 bp, Homo sapien
gaggacggacgcttctcatcagaca

SEQ ID NO: 184979 - DNA, 25 bp, Homo sapien
gacacaccaggcagcctacagtcta

SEQ ID NO: 184980 - DNA, 25 bp, Homo sapien
agtctacacagcagcgagcgctctg

SEQ ID NO: 184981 - DNA, 25 bp, Homo sapien
ggctctcatctcacgaggacgtttc

SEQ ID NO: 184982 - DNA, 25 bp, Homo sapien
ggagtcgacatcctcgttatctgaa

SEQ ID NO: 184983 - DNA, 25 bp, Homo sapien
cgttatctgaatcgtcgctgctgtc

SEQ ID NO: 184984 - DNA, 25 bp, Homo sapien
tggctctcctgtaagtgcgatgcga

SEQ ID NO: 184985 - DNA, 25 bp, Homo sapien
gcagcgttctgtgactccaccgcgg

SEQ ID NO: 184986 - DNA, 25 bp, Homo sapien
ctcaatagcggacaatggagtcccg

SEQ ID NO: 184987 - DNA, 25 bp, Homo sapien
cccgcgctctcaatagcggacaatg

SEQ ID NO: 184988 - DNA, 25 bp, Homo sapien
attcaggcctgcacggcagaggcgc

SEQ ID NO: 184989 - DNA, 25 bp, Homo sapien
gacagagcgagacccaaataacccc

SEQ ID NO: 184990 - DNA, 25 bp, Homo sapien
cggatcggtggcctaatggattcag

SEQ ID NO: 184991 - DNA, 25 bp, Homo sapien
ggacccgcagcgttctgtgactcca

SEQ ID NO: 184992 - DNA, 25 bp, Homo sapien
ctaatggattcaggcctgcacggca

SEQ ID NO: 184993 - DNA, 25 bp, Homo sapien
agcgaggcttccaacccgctgcttg

SEQ ID NO: 184994 - DNA, 25 bp, Homo sapien
tcagcatttggacagcggctctggg

SEQ ID NO: 184995 - DNA, 25 bp, Homo sapien
aaagatcccttctgagctcacacgg

SEQ ID NO: 184996 - DNA, 25 bp, Homo sapien
ccgggaccatccaatccagcgtgga

SEQ ID NO: 184997 - DNA, 25 bp, Homo sapien
ctcggatccctaagtctggagctgc

SEQ ID NO: 184998 - DNA, 25 bp, Homo sapien
ctccattccgcactggtcggggtga

SEQ ID NO: 184999 - DNA, 25 bp, Homo sapien
cctgaagctttccaatgtcatcttg

SEQ ID NO: 185000 - DNA, 25 bp, Homo sapien
aggtggacgaccctcatgccctcag

SEQ ID NO: 185001 - DNA, 25 bp, Homo sapien
ctagctgtatgagtgccacagagcc

SEQ ID NO: 185002 - DNA, 25 bp, Homo sapien
caggctggaacaatccgctcccgga

SEQ ID NO: 185003 - DNA, 25 bp, Homo sapien
tctctctctggggacacttgcagtg

SEQ ID NO: 185004 - DNA, 25 bp, Homo sapien
ttctcacaacttctgcgtgcgagcg

SEQ ID NO: 185005 - DNA, 25 bp, Homo sapien
gccacagagccgtcataaagctaga

SEQ ID NO: 185006 - DNA, 25 bp, Homo sapien
gcccgtttctctctttggttatcta

SEQ ID NO: 185007 - DNA, 25 bp, Homo sapien
atcgaattattcgacgagtcagccc

SEQ ID NO: 185008 - DNA, 25 bp, Homo sapien
caatgcggcctttatcgaattattc

SEQ ID NO: 185009 - DNA, 25 bp, Homo sapien
ctccacaggccggagagttctctgc

SEQ ID NO: 185010 - DNA, 25 bp, Homo sapien
gaggcctcctaggactcagccgcga

SEQ ID NO: 185011 - DNA, 25 bp, Homo sapien
agggtcggaattaggcactcattta

SEQ ID NO: 185012 - DNA, 25 bp, Homo sapien
agcgagcgttactaatccgaagtta

SEQ ID NO: 185013 - DNA, 25 bp, Homo sapien
tctgcccgggccaatgaaatgcgct

SEQ ID NO: 185014 - DNA, 25 bp, Homo sapien
ttacagcgctaattccctgatccgg

SEQ ID NO: 185015 - DNA, 25 bp, Homo sapien
ggatttctccaacccgggtatgcgc

SEQ ID NO: 185016 - DNA, 25 bp, Homo sapien
caactccgaacgctgtgggactgca

SEQ ID NO: 185017 - DNA, 25 bp, Homo sapien
tgtagcacacagtgggcgcaaagta

SEQ ID NO: 185018 - DNA, 25 bp, Homo sapien
ctggcttgttgtgctctgtgacata

SEQ ID NO: 185019 - DNA, 25 bp, Homo sapien
accctcaacctgtgaaatggcttta

SEQ ID NO: 185020 - DNA, 25 bp, Homo sapien
gcagtcacgaactcgccagcagcta

SEQ ID NO: 185021 - DNA, 25 bp, Homo sapien
ccgcggtacggcaagagcctaagca

SEQ ID NO: 185022 - DNA, 25 bp, Homo sapien
tggctttaaccatacacctgctggc

SEQ ID NO: 185023 - DNA, 25 bp, Homo sapien
tccaggatcaggttggtagtgcgcc

SEQ ID NO: 185024 - DNA, 25 bp, Homo sapien
tgcgcctgtgtttttacctgggtca

SEQ ID NO: 185025 - DNA, 25 bp, Homo sapien
tgtgtgagaaaagccagctccggtg

SEQ ID NO: 185026 - DNA, 25 bp, Homo sapien
taagagccctttgcgggattcgccc

SEQ ID NO: 185027 - DNA, 25 bp, Homo sapien
ccggccgcctttgttctctggcata

SEQ ID NO: 185028 - DNA, 25 bp, Homo sapien
caagtacaagttcaagttcagggcc

SEQ ID NO: 185029 - DNA, 25 bp, Homo sapien
cgccatcttccggacaaagtgtcaa

SEQ ID NO: 185030 - DNA, 25 bp, Homo sapien
caggactcacgagcccaagattgtt

SEQ ID NO: 185031 - DNA, 25 bp, Homo sapien
cgcacctgccattaacgttcaatta

SEQ ID NO: 185032 - DNA, 25 bp, Homo sapien
cgcgcggcacaaagagctttttatt

SEQ ID NO: 185033 - DNA, 25 bp, Homo sapien
cactggcgttcggttccgctcctgt

SEQ ID NO: 185034 - DNA, 25 bp, Homo sapien
cctcactgctctgacagataccagg

SEQ ID NO: 185035 - DNA, 25 bp, Homo sapien
ctctgacagataccaggagctggtg

SEQ ID NO: 185036 - DNA, 25 bp, Homo sapien
caggcgccctggctcattatccatc

SEQ ID NO: 185037 - DNA, 25 bp, Homo sapien
acacgggtaggcccgcgtgcccaag

SEQ ID NO: 185038 - DNA, 25 bp, Homo sapien
ccagttccgcagtcgtggctgggtt

SEQ ID NO: 185039 - DNA, 25 bp, Homo sapien
ggcctgatggggcaatcgctggcaa

SEQ ID NO: 185040 - DNA, 25 bp, Homo sapien
attatccatcccggccactggcgtt

SEQ ID NO: 185041 - DNA, 25 bp, Homo sapien
caggcctgggttctgtttcttccta

SEQ ID NO: 185042 - DNA, 25 bp, Homo sapien
tcttaataaatctcggccgcccgca

SEQ ID NO: 185043 - DNA, 25 bp, Homo sapien
ggtttgcgcttacatccgggatgtc

SEQ ID NO: 185044 - DNA, 25 bp, Homo sapien
ctcctggtcaatctgcatcgggcga

SEQ ID NO: 185045 - DNA, 25 bp, Homo sapien
ttttttaagaggcatccgggcaggc

SEQ ID NO: 185046 - DNA, 25 bp, Homo sapien
tgaaggtgcgccagccattattgcc

SEQ ID NO: 185047 - DNA, 25 bp, Homo sapien
ggccgcctctcgtgagcaaaagctg

SEQ ID NO: 185048 - DNA, 25 bp, Homo sapien
gttgttagagattccgcagccgctc

SEQ ID NO: 185049 - DNA, 25 bp, Homo sapien
ggagtttcctagcacgttccattta

SEQ ID NO: 185050 - DNA, 25 bp, Homo sapien
ttatactgaacgcaggcggccgctg

SEQ ID NO: 185051 - DNA, 25 bp, Homo sapien
ctcgactcttgctaatgactgggta

SEQ ID NO: 185052 - DNA, 25 bp, Homo sapien
ttctacgcagaaacgccaatggcca

SEQ ID NO: 185053 - DNA, 25 bp, Homo sapien
cggtgccatcatgccggagaagaca

SEQ ID NO: 185054 - DNA, 25 bp, Homo sapien
aatcgctgcatatcggagtttccta

SEQ ID NO: 185055 - DNA, 25 bp, Homo sapien
cctgcgggaaaaccagacacttctg

SEQ ID NO: 185056 - DNA, 25 bp, Homo sapien
aggtgacttctggacgtaggcttta

SEQ ID NO: 185057 - DNA, 25 bp, Homo sapien
atctgttcagttcactctggtggtc

SEQ ID NO: 185058 - DNA, 25 bp, Homo sapien
tcctattccagatccgccgacagag

SEQ ID NO: 185059 - DNA, 25 bp, Homo sapien
gtggtctctgttccagtctggccta

SEQ ID NO: 185060 - DNA, 25 bp, Homo sapien
ttcattatgtgcaccgtggaggcgc

SEQ ID NO: 185061 - DNA, 25 bp, Homo sapien
accgtgcgaacactggagggattca

SEQ ID NO: 185062 - DNA, 25 bp, Homo sapien
cttggtggttcagagccacacctga

SEQ ID NO: 185063 - DNA, 25 bp, Homo sapien
ccaaaccgggatagtcgcaccgaca

SEQ ID NO: 185064 - DNA, 25 bp, Homo sapien
gaccctctagtttgtaaccgtgcga

SEQ ID NO: 185065 - DNA, 25 bp, Homo sapien
atgtcgctttgctgcagcggggcac

SEQ ID NO: 185066 - DNA, 25 bp, Homo sapien
aacgcagacctacagggccgacttc

SEQ ID NO: 185067 - DNA, 25 bp, Homo sapien
acagggccgacttcctgagggcgaa

SEQ ID NO: 185068 - DNA, 25 bp, Homo sapien
ttcctgagggcgaatgtcgctttgc

SEQ ID NO: 185069 - DNA, 25 bp, Homo sapien
ggcgcagtgaggtgcttttgaacca

SEQ ID NO: 185070 - DNA, 25 bp, Homo sapien
tttgaaccaacgcagacctacaggg

SEQ ID NO: 185071 - DNA, 25 bp, Homo sapien
tgaggtgcttttgaaccaacgcaga

SEQ ID NO: 185072 - DNA, 25 bp, Homo sapien
cgccgtgaagtcaggatgactggga

SEQ ID NO: 185073 - DNA, 25 bp, Homo sapien
cagcgggatgtcagggctgccacac

SEQ ID NO: 185074 - DNA, 25 bp, Homo sapien
ggccaccgacttgagaaggtgcagc

SEQ ID NO: 185075 - DNA, 25 bp, Homo sapien
gatgcctttataggtggccaccgac

SEQ ID NO: 185076 - DNA, 25 bp, Homo sapien
cgatgcggaaggctcgatgccttta

SEQ ID NO: 185077 - DNA, 25 bp, Homo sapien
agaaccactggatcagcgatgcgga

SEQ ID NO: 185078 - DNA, 25 bp, Homo sapien
agcgctctgtgttggagaaggactc

SEQ ID NO: 185079 - DNA, 25 bp, Homo sapien
aggagcctacctggatgacgaagtc

SEQ ID NO: 185080 - DNA, 25 bp, Homo sapien
ggcatttccgcaagactccgtcacg

SEQ ID NO: 185081 - DNA, 25 bp, Homo sapien
cctcgtggtagatttcggaagtgca

SEQ ID NO: 185082 - DNA, 25 bp, Homo sapien
cacagcgacacctcgtggtagattt

SEQ ID NO: 185083 - DNA, 25 bp, Homo sapien
cggtctttgtggctcaggaccttca

SEQ ID NO: 185084 - DNA, 25 bp, Homo sapien
caggaccttcactggggcctgaatc

SEQ ID NO: 185085 - DNA, 25 bp, Homo sapien
ctggggcctgaatcctcttctattc

SEQ ID NO: 185086 - DNA, 25 bp, Homo sapien
tgaatcctcttctattccttcctgc

SEQ ID NO: 185087 - DNA, 25 bp, Homo sapien
cggggatcgctttgccacagcgaca

SEQ ID NO: 185088 - DNA, 25 bp, Homo sapien
tagatttcggaagtgcagcagagac

SEQ ID NO: 185089 - DNA, 25 bp, Homo sapien
gctgccaacaggaagttgaagccca

SEQ ID NO: 185090 - DNA, 25 bp, Homo sapien
gtcttgtaagaagtggaaccagccc

SEQ ID NO: 185091 - DNA, 25 bp, Homo sapien
cagcgcccactggatgccgaaggct

SEQ ID NO: 185092 - DNA, 25 bp, Homo sapien
ccgtagcgctgcaggaaagtcatga

SEQ ID NO: 185093 - DNA, 25 bp, Homo sapien
cgaagcccacgaagaccatcacgtg

SEQ ID NO: 185094 - DNA, 25 bp, Homo sapien
cacgtgcacgtcctggaagcctgcg

SEQ ID NO: 185095 - DNA, 25 bp, Homo sapien
gtctggcgaaggttcgtcccagccc

SEQ ID NO: 185096 - DNA, 25 bp, Homo sapien
ggaaccagccctgcatgagcagcgc

SEQ ID NO: 185097 - DNA, 25 bp, Homo sapien
ttcgttctccatgtcgctcaagttc

SEQ ID NO: 185098 - DNA, 25 bp, Homo sapien
gtagcgatagtagaattcgttctcc

SEQ ID NO: 185099 - DNA, 25 bp, Homo sapien
ctcaagttcttgtgcgtcctctctg

SEQ ID NO: 185100 - DNA, 25 bp, Homo sapien
aggttggtgttccaggccatgctgc

SEQ ID NO: 185101 - DNA, 25 bp, Homo sapien
atcaccataatcacctgcaggagca

SEQ ID NO: 185102 - DNA, 25 bp, Homo sapien
gcctcgaagtcgtagcgcacgaaca

SEQ ID NO: 185103 - DNA, 25 bp, Homo sapien
tctgaccaccagtgggcgtcggcct

SEQ ID NO: 185104 - DNA, 25 bp, Homo sapien
ggcgagacttacttgggtagcgata

SEQ ID NO: 185105 - DNA, 25 bp, Homo sapien
gggcttggtgaacgccgtcttcctc

SEQ ID NO: 185106 - DNA, 25 bp, Homo sapien
tgctagactaccagtgggaccggcc

SEQ ID NO: 185107 - DNA, 25 bp, Homo sapien
ctgatggagacgctgctagactacc

SEQ ID NO: 185108 - DNA, 25 bp, Homo sapien
acgcacggcgccctgatggagacgc

SEQ ID NO: 185109 - DNA, 25 bp, Homo sapien
aggccaggctcgaggatcgcgccca

SEQ ID NO: 185110 - DNA, 25 bp, Homo sapien
gtccgcactcgcagagggagctgct

SEQ ID NO: 185111 - DNA, 25 bp, Homo sapien
cacgaagccgatcctgcggagcagc

SEQ ID NO: 185112 - DNA, 25 bp, Homo sapien
ccgcgtgtctgacttccgcgagctg

SEQ ID NO: 185113 - DNA, 25 bp, Homo sapien
cggacatcaatcatccccgggctgg

SEQ ID NO: 185114 - DNA, 25 bp, Homo sapien
gcagttcccgccggggcttggacaa

SEQ ID NO: 185115 - DNA, 25 bp, Homo sapien
gcttggacaaaggcccaaagttcca

SEQ ID NO: 185116 - DNA, 25 bp, Homo sapien
accacacaggctcgagcgtttccag

SEQ ID NO: 185117 - DNA, 25 bp, Homo sapien
acaggctcgagcgtttccaggtcaa

SEQ ID NO: 185118 - DNA, 25 bp, Homo sapien
tcgagcgtttccaggtcaagggtaa

SEQ ID NO: 185119 - DNA, 25 bp, Homo sapien
tcaagggtaacggagcgtggaccaa

SEQ ID NO: 185120 - DNA, 25 bp, Homo sapien
ggagcgtggaccaagtcccgcgtct

SEQ ID NO: 185121 - DNA, 25 bp, Homo sapien
gaaatgtctccctgtctagcgccca

SEQ ID NO: 185122 - DNA, 25 bp, Homo sapien
ctggcgcccgaagaacagaaatgtc

SEQ ID NO: 185123 - DNA, 25 bp, Homo sapien
actgtaatatttcccaggccggcga

SEQ ID NO: 185124 - DNA, 25 bp, Homo sapien
agtagttcgagttcacttccaggta

SEQ ID NO: 185125 - DNA, 25 bp, Homo sapien
ccagcgcgtttcattctcggagacc

SEQ ID NO: 185126 - DNA, 25 bp, Homo sapien
gctcgcatcccgcagaggaacaaga

SEQ ID NO: 185127 - DNA, 25 bp, Homo sapien
ccttgttggattccatggcggaacc

SEQ ID NO: 185128 - DNA, 25 bp, Homo sapien
agcgctcagcttcatccttgttgga

SEQ ID NO: 185129 - DNA, 25 bp, Homo sapien
cccagggcgctgatgacgttgccca

SEQ ID NO: 185130 - DNA, 25 bp, Homo sapien
tccacgaagtggaacttggagacga

SEQ ID NO: 185131 - DNA, 25 bp, Homo sapien
ggctgctgttgatctggatgctctc

SEQ ID NO: 185132 - DNA, 25 bp, Homo sapien
aagaccgtgtgtgagcggctagaca

SEQ ID NO: 185133 - DNA, 25 bp, Homo sapien
agctcaccgggtgatcttggagtcg

SEQ ID NO: 185134 - DNA, 25 bp, Homo sapien
cccagcgagtctttgaggatcctga

SEQ ID NO: 185135 - DNA, 25 bp, Homo sapien
aggcgatcatcaccgtcttggcgtt

SEQ ID NO: 185136 - DNA, 25 bp, Homo sapien
tctggatgctctccttgagccgctc

SEQ ID NO: 185137 - DNA, 25 bp, Homo sapien
tcccgctccgaaggtgctctgacaa

SEQ ID NO: 185138 - DNA, 25 bp, Homo sapien
ggacggagctccatgaaagttggaa

SEQ ID NO: 185139 - DNA, 25 bp, Homo sapien
gtgattacaaatcgggacccgactc

SEQ ID NO: 185140 - DNA, 25 bp, Homo sapien
cgccggccagtccaaggaagagctt

SEQ ID NO: 185141 - DNA, 25 bp, Homo sapien
ggcacacagcggtaaactctgcctc

SEQ ID NO: 185142 - DNA, 25 bp, Homo sapien
ccgggctcctcatgccgggtcaggt

SEQ ID NO: 185143 - DNA, 25 bp, Homo sapien
actctgcctcgcaataccgtgtggg

SEQ ID NO: 185144 - DNA, 25 bp, Homo sapien
gcgcgctccgatgccgtcatcggga

SEQ ID NO: 185145 - DNA, 25 bp, Homo sapien
tcgggctccatcagcgacagcctgg

SEQ ID NO: 185146 - DNA, 25 bp, Homo sapien
ttgcgcagctggctgtaatgcgtgc

SEQ ID NO: 185147 - DNA, 25 bp, Homo sapien
ccggaagaagctgtcgctgaccctg

SEQ ID NO: 185148 - DNA, 25 bp, Homo sapien
tgaccctgcgctttggcttctcgcg

SEQ ID NO: 185149 - DNA, 25 bp, Homo sapien
tgggttgtcgatgtcccggaattcg

SEQ ID NO: 185150 - DNA, 25 bp, Homo sapien
tgtcccggaattcgctctcgggctc

SEQ ID NO: 185151 - DNA, 25 bp, Homo sapien
ggcgactcagctcttcttgcgcagc

SEQ ID NO: 185152 - DNA, 25 bp, Homo sapien
ggcagccgccttagagtcctggctt

SEQ ID NO: 185153 - DNA, 25 bp, Homo sapien
ctccgtaggagctggcaacgtcctt

SEQ ID NO: 185154 - DNA, 25 bp, Homo sapien
gttgggcccactcacgttgaattta

SEQ ID NO: 185155 - DNA, 25 bp, Homo sapien
gcgggcacactttctgtagagcaac

SEQ ID NO: 185156 - DNA, 25 bp, Homo sapien
cgctggcacctgactcacctgaaga

SEQ ID NO: 185157 - DNA, 25 bp, Homo sapien
tcaagccggaagttgtggttaccaa

SEQ ID NO: 185158 - DNA, 25 bp, Homo sapien
tagcccaaaggccacgagtcgcacg

SEQ ID NO: 185159 - DNA, 25 bp, Homo sapien
acggtcagtcccaggttatccgctg

SEQ ID NO: 185160 - DNA, 25 bp, Homo sapien
aggcgtccatggcttctagcccaaa

SEQ ID NO: 185161 - DNA, 25 bp, Homo sapien
tcgcttcttggagccctgggcatac

SEQ ID NO: 185162 - DNA, 25 bp, Homo sapien
gccctcaagcactggtggccttgtg

SEQ ID NO: 185163 - DNA, 25 bp, Homo sapien
aggccgcagagagcatccaggactc

SEQ ID NO: 185164 - DNA, 25 bp, Homo sapien
tttccctgccttcgcttcttggagc

SEQ ID NO: 185165 - DNA, 25 bp, Homo sapien
agccctgggcatactatggtggcca

SEQ ID NO: 185166 - DNA, 25 bp, Homo sapien
tcgctgaggcctagcacggccgaca

SEQ ID NO: 185167 - DNA, 25 bp, Homo sapien
cgacaggtggccgatatagcggata

SEQ ID NO: 185168 - DNA, 25 bp, Homo sapien
agacccagtcctctgcgtggccttt

SEQ ID NO: 185169 - DNA, 25 bp, Homo sapien
ccttgatcgtttgacctggagagga

SEQ ID NO: 185170 - DNA, 25 bp, Homo sapien
gcgctcgactgtggacacccgagac

SEQ ID NO: 185171 - DNA, 25 bp, Homo sapien
cacctgcttgtgtggacgccaggca

SEQ ID NO: 185172 - DNA, 25 bp, Homo sapien
tccctggtcacacacctgcttgtgt

SEQ ID NO: 185173 - DNA, 25 bp, Homo sapien
cacacagtcggggatatgcggcact

SEQ ID NO: 185174 - DNA, 25 bp, Homo sapien
tttgctccttgatcgtttgacctgg

SEQ ID NO: 185175 - DNA, 25 bp, Homo sapien
agcccgcctttgctccttgatcgtt

SEQ ID NO: 185176 - DNA, 25 bp, Homo sapien
atatgcggcactggcgaatgcacga

SEQ ID NO: 185177 - DNA, 25 bp, Homo sapien
tcctccgattcgtcgggttcgtgcc

SEQ ID NO: 185178 - DNA, 25 bp, Homo sapien
accactggatcttcgcccagggctg

SEQ ID NO: 185179 - DNA, 25 bp, Homo sapien
aaggctgtccctggacgcagtcgtc

SEQ ID NO: 185180 - DNA, 25 bp, Homo sapien
catccgctacatcggccacctatcg

SEQ ID NO: 185181 - DNA, 25 bp, Homo sapien
gcctcctcggccacgaccactggat

SEQ ID NO: 185182 - DNA, 25 bp, Homo sapien
cacctatcggccgtgctgggtctca

SEQ ID NO: 185183 - DNA, 25 bp, Homo sapien
gtccacgacacggatccctgggcaa

SEQ ID NO: 185184 - DNA, 25 bp, Homo sapien
ccgacgcgtctctttggacgccacc

SEQ ID NO: 185185 - DNA, 25 bp, Homo sapien
aagccagcgcatcccgtgcagacgg

SEQ ID NO: 185186 - DNA, 25 bp, Homo sapien
acttgaccgcgagatcgtagtggga

SEQ ID NO: 185187 - DNA, 25 bp, Homo sapien
gggagctcggccaaaagaattcttc

SEQ ID NO: 185188 - DNA, 25 bp, Homo sapien
agaattcttcgctttccctggccct

SEQ ID NO: 185189 - DNA, 25 bp, Homo sapien
ggccacatctggacggcatctgccg

SEQ ID NO: 185190 - DNA, 25 bp, Homo sapien
tggtgcagataacggacccgccaca

SEQ ID NO: 185191 - DNA, 25 bp, Homo sapien
gctttagaccgaggagcgagatcta

SEQ ID NO: 185192 - DNA, 25 bp, Homo sapien
ggctcagagcctcgccctgagtgtc

SEQ ID NO: 185193 - DNA, 25 bp, Homo sapien
cttagcgctcgcagaacgttccgcg

SEQ ID NO: 185194 - DNA, 25 bp, Homo sapien
tgcgaatccggatctatgtccctcg

SEQ ID NO: 185195 - DNA, 25 bp, Homo sapien
tgctgagagcggcactcggaaactt

SEQ ID NO: 185196 - DNA, 25 bp, Homo sapien
gatcacttccggttggtgcgctgct

SEQ ID NO: 185197 - DNA, 25 bp, Homo sapien
atctttgccagccacggttctctca

SEQ ID NO: 185198 - DNA, 25 bp, Homo sapien
cgtggcttcccatggttgttgaaaa

SEQ ID NO: 185199 - DNA, 25 bp, Homo sapien
ggccgcactcacgaaacgctggtag

SEQ ID NO: 185200 - DNA, 25 bp, Homo sapien
tcggccgttcgtcggttatggaaca

SEQ ID NO: 185201 - DNA, 25 bp, Homo sapien
tagatgcggctcattctcccgaccg

SEQ ID NO: 185202 - DNA, 25 bp, Homo sapien
tcaggcgttcctcggcgggatttaa

SEQ ID NO: 185203 - DNA, 25 bp, Homo sapien
agggaccgagctccattcctgcacg

SEQ ID NO: 185204 - DNA, 25 bp, Homo sapien
tcgggaccctctctcgagggcaggc

SEQ ID NO: 185205 - DNA, 25 bp, Homo sapien
ttaagccgatctgtgtcatggggtc

SEQ ID NO: 185206 - DNA, 25 bp, Homo sapien
cagcgcggcaagtagctggagttta

SEQ ID NO: 185207 - DNA, 25 bp, Homo sapien
cacccgatcctgttgcggggttcga

SEQ ID NO: 185208 - DNA, 25 bp, Homo sapien
tgagtctgtgcaaaagcagcgcggc

SEQ ID NO: 185209 - DNA, 25 bp, Homo sapien
ttcgccttccctaaattgctgtctc

SEQ ID NO: 185210 - DNA, 25 bp, Homo sapien
cccacctctgacagccatagagatg

SEQ ID NO: 185211 - DNA, 25 bp, Homo sapien
gctgtctccttataccctccagagt

SEQ ID NO: 185212 - DNA, 25 bp, Homo sapien
ccagacccgagaagtagccggatgc

SEQ ID NO: 185213 - DNA, 25 bp, Homo sapien
gcgcatcagggagagacaggtatcc

SEQ ID NO: 185214 - DNA, 25 bp, Homo sapien
tacggactcctctccaaaagctgag

SEQ ID NO: 185215 - DNA, 25 bp, Homo sapien
cgggaggcaagcaagactacggact

SEQ ID NO: 185216 - DNA, 25 bp, Homo sapien
gagtccaagactcacgcgtccaaac

SEQ ID NO: 185217 - DNA, 25 bp, Homo sapien
tgacggccgcgctgccagcgaccac

SEQ ID NO: 185218 - DNA, 25 bp, Homo sapien
cctgcgttgcagtcgagaaacggct

SEQ ID NO: 185219 - DNA, 25 bp, Homo sapien
acccgccctgcgttgcagtcgagaa

SEQ ID NO: 185220 - DNA, 25 bp, Homo sapien
cactgcccggctctgtccgagggct

SEQ ID NO: 185221 - DNA, 25 bp, Homo sapien
gaataattgacccttcctggcggca

SEQ ID NO: 185222 - DNA, 25 bp, Homo sapien
gcccgggcgccccatgaataattga

SEQ ID NO: 185223 - DNA, 25 bp, Homo sapien
cggagaacccgaggacagagcaggt

SEQ ID NO: 185224 - DNA, 25 bp, Homo sapien
acagagcaggtcttgggagcacgcc

SEQ ID NO: 185225 - DNA, 25 bp, Homo sapien
ctacggctgcccacaaactttattc

SEQ ID NO: 185226 - DNA, 25 bp, Homo sapien
acaaactttattctcggagcgggtg

SEQ ID NO: 185227 - DNA, 25 bp, Homo sapien
ctctccgtcttctcgcggtcatttt

SEQ ID NO: 185228 - DNA, 25 bp, Homo sapien
tctcgcggtcattttcctaattgga

SEQ ID NO: 185229 - DNA, 25 bp, Homo sapien
tttcctaattggatggagctgtggg

SEQ ID NO: 185230 - DNA, 25 bp, Homo sapien
agatcccgcagatccggcccttggg

SEQ ID NO: 185231 - DNA, 25 bp, Homo sapien
ttcaccgcggacttgctaactagtg

SEQ ID NO: 185232 - DNA, 25 bp, Homo sapien
cggacttgctaactagtgcgtatcg

SEQ ID NO: 185233 - DNA, 25 bp, Homo sapien
cacatgctgctgcactcggaggtca

SEQ ID NO: 185234 - DNA, 25 bp, Homo sapien
atcctgggccacaacggcatcaagc

SEQ ID NO: 185235 - DNA, 25 bp, Homo sapien
ggctggacatcaacgtgcagattga

SEQ ID NO: 185236 - DNA, 25 bp, Homo sapien
ggttcgaccgtggaacgccacaaga

SEQ ID NO: 185237 - DNA, 25 bp, Homo sapien
agatgatcgacctcagcgccttcag

SEQ ID NO: 185238 - DNA, 25 bp, Homo sapien
agagcagcgccgtcaagatgatcga

SEQ ID NO: 185239 - DNA, 25 bp, Homo sapien
tttctgtgccaggtgacgacaagga

SEQ ID NO: 185240 - DNA, 25 bp, Homo sapien
tgcccaaggtcaagttcgagaaggt

SEQ ID NO: 185241 - DNA, 25 bp, Homo sapien
gtcagtttctgacgctttagcttaa

SEQ ID NO: 185242 - DNA, 25 bp, Homo sapien
tcgggtccgggacactctcaggacc

SEQ ID NO: 185243 - DNA, 25 bp, Homo sapien
agctccgcaggagctacaggcgtga

SEQ ID NO: 185244 - DNA, 25 bp, Homo sapien
tcccaagctggagagcgaacgagca

SEQ ID NO: 185245 - DNA, 25 bp, Homo sapien
aggtagccggccatcccaagctgga

SEQ ID NO: 185246 - DNA, 25 bp, Homo sapien
ctcccgaaatacctaggggcgcgcg

SEQ ID NO: 185247 - DNA, 25 bp, Homo sapien
gccaatctgagcgaactcttgcttc

SEQ ID NO: 185248 - DNA, 25 bp, Homo sapien
tagcagagccgcttgcgaggctgac

SEQ ID NO: 185249 - DNA, 25 bp, Homo sapien
gggcctttgagcagcgttcacatcg

SEQ ID NO: 185250 - DNA, 25 bp, Homo sapien
cacctgcacgctctgatgggcactg

SEQ ID NO: 185251 - DNA, 25 bp, Homo sapien
ggcgccctctggacaattcccgtaa

SEQ ID NO: 185252 - DNA, 25 bp, Homo sapien
gcccgcatcaggcaaatcccggagg

SEQ ID NO: 185253 - DNA, 25 bp, Homo sapien
ctaacttgggccgaccagcggtcgt

SEQ ID NO: 185254 - DNA, 25 bp, Homo sapien
agtcccttgggctccacggctaact

SEQ ID NO: 185255 - DNA, 25 bp, Homo sapien
tcccaaggtgaaggaccgcacagtc

SEQ ID NO: 185256 - DNA, 25 bp, Homo sapien
atcgagtccatcgttggtgcaaatg

SEQ ID NO: 185257 - DNA, 25 bp, Homo sapien
cttcagttttctttctgcgtaggga

SEQ ID NO: 185258 - DNA, 25 bp, Homo sapien
cctaactccctaggcgcatagcggg

SEQ ID NO: 185259 - DNA, 25 bp, Homo sapien
ccaaaccaacgccactagcagaggg

SEQ ID NO: 185260 - DNA, 25 bp, Homo sapien
cactagcagagggtcccagaggagc

SEQ ID NO: 185261 - DNA, 25 bp, Homo sapien
ccgcttgcgggtgagctctgcccaa

SEQ ID NO: 185262 - DNA, 25 bp, Homo sapien
ctgagtttgccagggcccacttgac

SEQ ID NO: 185263 - DNA, 25 bp, Homo sapien
tcggaggcacgggatccattaggac

SEQ ID NO: 185264 - DNA, 25 bp, Homo sapien
ttcttttttcaaggcgctgcgcgga

SEQ ID NO: 185265 - DNA, 25 bp, Homo sapien
gcagcaacatcgaccacttcaattc

SEQ ID NO: 185266 - DNA, 25 bp, Homo sapien
cacttcaattcctctcagagactcg

SEQ ID NO: 185267 - DNA, 25 bp, Homo sapien
ttcctctcagagactcgatgacacg

SEQ ID NO: 185268 - DNA, 25 bp, Homo sapien
tcgatgacacgagggcggtcacacg

SEQ ID NO: 185269 - DNA, 25 bp, Homo sapien
tcagctggtcctcactgtcgctgtg

SEQ ID NO: 185270 - DNA, 25 bp, Homo sapien
cgtagcggcctttgccccatgtgta

SEQ ID NO: 185271 - DNA, 25 bp, Homo sapien
ggcgcctcctcaccagcttcggctt

SEQ ID NO: 185272 - DNA, 25 bp, Homo sapien
gcttcggcttcagctggtcctcact

SEQ ID NO: 185273 - DNA, 25 bp, Homo sapien
ctcgcctcgagacgcagacaacttt

SEQ ID NO: 185274 - DNA, 25 bp, Homo sapien
cccgaagctgtctctagaggatccc

SEQ ID NO: 185275 - DNA, 25 bp, Homo sapien
aggcagggttcaaggcagcacttac

SEQ ID NO: 185276 - DNA, 25 bp, Homo sapien
ctgcttcgtcaggaacgtcaagtcc

SEQ ID NO: 185277 - DNA, 25 bp, Homo sapien
gctccaagcggtcctaggcgagctg

SEQ ID NO: 185278 - DNA, 25 bp, Homo sapien
aaagtcgcgaggtgcatccgcttcg

SEQ ID NO: 185279 - DNA, 25 bp, Homo sapien
ctgagaagtcactggagctagcgtt

SEQ ID NO: 185280 - DNA, 25 bp, Homo sapien
aaggcagcacttacaggaggatctc

SEQ ID NO: 185281 - DNA, 25 bp, Homo sapien
tgatacaccggaagaatctggcgtc

SEQ ID NO: 185282 - DNA, 25 bp, Homo sapien
ggagggctgcaagtcccatgataca

SEQ ID NO: 185283 - DNA, 25 bp, Homo sapien
tcctgtgaaacgaggaggcggttcc

SEQ ID NO: 185284 - DNA, 25 bp, Homo sapien
cgtggggacagccagtcctgtgaaa

SEQ ID NO: 185285 - DNA, 25 bp, Homo sapien
ccacgggcttgctagaggaagcgct

SEQ ID NO: 185286 - DNA, 25 bp, Homo sapien
ggaactgccctcgtgtccatggcaa

SEQ ID NO: 185287 - DNA, 25 bp, Homo sapien
ccaggacgcttctccaatgggaact

SEQ ID NO: 185288 - DNA, 25 bp, Homo sapien
gctccaaagggcaaacgctgtctcc

SEQ ID NO: 185289 - DNA, 25 bp, Homo sapien
ctgctgtttcgtagccgactgctga

SEQ ID NO: 185290 - DNA, 25 bp, Homo sapien
ctcatttcggccctcacgtttcagg

SEQ ID NO: 185291 - DNA, 25 bp, Homo sapien
agccctctccacagttacaggcaga

SEQ ID NO: 185292 - DNA, 25 bp, Homo sapien
aggagcgtcctgtacctcatttcgg

SEQ ID NO: 185293 - DNA, 25 bp, Homo sapien
cctcagcttgaagcagggcctcgtg

SEQ ID NO: 185294 - DNA, 25 bp, Homo sapien
tttgcgtcgacatggcggttaccct

SEQ ID NO: 185295 - DNA, 25 bp, Homo sapien
cgccgtcagaagactgccgagcgga

SEQ ID NO: 185296 - DNA, 25 bp, Homo sapien
tacccggctacttccgctgctgttt

SEQ ID NO: 185297 - DNA, 25 bp, Homo sapien
gcaggtagatcgctcctgctgctcc

SEQ ID NO: 185298 - DNA, 25 bp, Homo sapien
tgactgccggctgcttccctgggct

SEQ ID NO: 185299 - DNA, 25 bp, Homo sapien
ttcccgcaggactggggacaccagg

SEQ ID NO: 185300 - DNA, 25 bp, Homo sapien
ggaaggcacgggacttgaacctctc

SEQ ID NO: 185301 - DNA, 25 bp, Homo sapien
tccctgaacggagccagatggaagt

SEQ ID NO: 185302 - DNA, 25 bp, Homo sapien
tcggcgccgtttccagttgagagat

SEQ ID NO: 185303 - DNA, 25 bp, Homo sapien
gagttctgagttgccgcggccgcct

SEQ ID NO: 185304 - DNA, 25 bp, Homo sapien
tttccagttgagagatggcggccgc

SEQ ID NO: 185305 - DNA, 25 bp, Homo sapien
gggtcctaagaggacggctgccaca

SEQ ID NO: 185306 - DNA, 25 bp, Homo sapien
tgcagtcgagcgaccgcgtccagac

SEQ ID NO: 185307 - DNA, 25 bp, Homo sapien
aggacggctgccacagcctcatgga

SEQ ID NO: 185308 - DNA, 25 bp, Homo sapien
accgccggtcgacatgatccgctgc

SEQ ID NO: 185309 - DNA, 25 bp, Homo sapien
cgctgtggtggagatgtttccttcc

SEQ ID NO: 185310 - DNA, 25 bp, Homo sapien
gtggagatgtttccttccacagggg

SEQ ID NO: 185311 - DNA, 25 bp, Homo sapien
ctggctgcagtcgagcgaccgcgtc

SEQ ID NO: 185312 - DNA, 25 bp, Homo sapien
cctcgctgtggtggagatgtttcct

SEQ ID NO: 185313 - DNA, 25 bp, Homo sapien
agccctgtcacgaatcccggtcggg

SEQ ID NO: 185314 - DNA, 25 bp, Homo sapien
gccacccagacgttttctcagcggg

SEQ ID NO: 185315 - DNA, 25 bp, Homo sapien
tagctgtggtctctataccgtcggc

SEQ ID NO: 185316 - DNA, 25 bp, Homo sapien
cgtcggcgggataagtcattctctt

SEQ ID NO: 185317 - DNA, 25 bp, Homo sapien
tcttgcttctcgatggtggtcccag

SEQ ID NO: 185318 - DNA, 25 bp, Homo sapien
agctgatctgtgaccctctgaccgc

SEQ ID NO: 185319 - DNA, 25 bp, Homo sapien
cacgcgtgcagtcatgttcctatta

SEQ ID NO: 185320 - DNA, 25 bp, Homo sapien
tggtcccagggtttcagctgatctg

SEQ ID NO: 185321 - DNA, 25 bp, Homo sapien
cttcctcagcagagactcgggctcg

SEQ ID NO: 185322 - DNA, 25 bp, Homo sapien
tccaaggtttcacggcttcctcagc

SEQ ID NO: 185323 - DNA, 25 bp, Homo sapien
ttggaggatgggctctaccttcttc

SEQ ID NO: 185324 - DNA, 25 bp, Homo sapien
cctacggagaccatagcgggatgca

SEQ ID NO: 185325 - DNA, 25 bp, Homo sapien
taattgcagacgaggcgcgattttc

SEQ ID NO: 185326 - DNA, 25 bp, Homo sapien
ggctataaacctgggcgggcattcc

SEQ ID NO: 185327 - DNA, 25 bp, Homo sapien
ggctctgcccgtttcgtggaaaggc

SEQ ID NO: 185328 - DNA, 25 bp, Homo sapien
agcctttcggttagagttgcggata

SEQ ID NO: 185329 - DNA, 25 bp, Homo sapien
acgtcgcgtagacgcagaggccatc

SEQ ID NO: 185330 - DNA, 25 bp, Homo sapien
cccgcggaagttcagtgagaagatc

SEQ ID NO: 185331 - DNA, 25 bp, Homo sapien
tcgcgctgcacacgcagagacaggc

SEQ ID NO: 185332 - DNA, 25 bp, Homo sapien
cccgagaggaaatcgcaaacagctc

SEQ ID NO: 185333 - DNA, 25 bp, Homo sapien
gggcacaggctgtgttctccacgtc

SEQ ID NO: 185334 - DNA, 25 bp, Homo sapien
atccctgggtcggagagtctccgtg

SEQ ID NO: 185335 - DNA, 25 bp, Homo sapien
ttcgagcagctcatgaccgacctca

SEQ ID NO: 185336 - DNA, 25 bp, Homo sapien
atcgcaaacagctcggaggccggcc

SEQ ID NO: 185337 - DNA, 25 bp, Homo sapien
gccgttgcctgagaaccctaggatc

SEQ ID NO: 185338 - DNA, 25 bp, Homo sapien
ccctaggatcacagcgttgggccgg

SEQ ID NO: 185339 - DNA, 25 bp, Homo sapien
ggctccagcgttcagcctgcgtttc

SEQ ID NO: 185340 - DNA, 25 bp, Homo sapien
gcctgcgtttctggacacccgggat

SEQ ID NO: 185341 - DNA, 25 bp, Homo sapien
cccaaacctgcgtcgtggggcttcg

SEQ ID NO: 185342 - DNA, 25 bp, Homo sapien
tggggcttcgccctcctgagatcac

SEQ ID NO: 185343 - DNA, 25 bp, Homo sapien
cctgagatcacccaggcagcctgtg

SEQ ID NO: 185344 - DNA, 25 bp, Homo sapien
gcccggatctaacttggcggtgaca

SEQ ID NO: 185345 - DNA, 25 bp, Homo sapien
atcctgggaggacagcagatacata

SEQ ID NO: 185346 - DNA, 25 bp, Homo sapien
gaagcccgagatgtaaccgtagtca

SEQ ID NO: 185347 - DNA, 25 bp, Homo sapien
cccgtccggactctgattgggcttt

SEQ ID NO: 185348 - DNA, 25 bp, Homo sapien
cagccaatcggaataggcaagcttc

SEQ ID NO: 185349 - DNA, 25 bp, Homo sapien
atcctggttccgtccgctaggagtc

SEQ ID NO: 185350 - DNA, 25 bp, Homo sapien
tcgggttcttccgtttcctgcactg

SEQ ID NO: 185351 - DNA, 25 bp, Homo sapien
aactctgccaaggtctcccggggcg

SEQ ID NO: 185352 - DNA, 25 bp, Homo sapien
gtcggtccgcattgatctagccctg

SEQ ID NO: 185353 - DNA, 25 bp, Homo sapien
cccacagagggttcggtgacgcctg

SEQ ID NO: 185354 - DNA, 25 bp, Homo sapien
ggatccacggccccacagagggttc

SEQ ID NO: 185355 - DNA, 25 bp, Homo sapien
acgcctgggaaggtgccgggatcca

SEQ ID NO: 185356 - DNA, 25 bp, Homo sapien
gatccacggccccacagagggttcg

SEQ ID NO: 185357 - DNA, 25 bp, Homo sapien
cgcctgggaaggtgccgggatccac

SEQ ID NO: 185358 - DNA, 25 bp, Homo sapien
cagagggttcggtgacgcctgggaa

SEQ ID NO: 185359 - DNA, 25 bp, Homo sapien
tgccgggttccacggccccacagag

SEQ ID NO: 185360 - DNA, 25 bp, Homo sapien
acagagggttcggtgacgcctggga

SEQ ID NO: 185361 - DNA, 25 bp, Homo sapien
cgccgctcttcaccagggcacaggg

SEQ ID NO: 185362 - DNA, 25 bp, Homo sapien
ccgctcttcaccagggcacagggaa

SEQ ID NO: 185363 - DNA, 25 bp, Homo sapien
accgctcttcaccagggcacaggga

SEQ ID NO: 185364 - DNA, 25 bp, Homo sapien
acctctgagtgacggcactgcgccg

SEQ ID NO: 185365 - DNA, 25 bp, Homo sapien
tgagtgacggcactgcgccgctctt

SEQ ID NO: 185366 - DNA, 25 bp, Homo sapien
gccgctcttcaccagggcacaggga

SEQ ID NO: 185367 - DNA, 25 bp, Homo sapien
agtgacggcactgcgccgctcttca

SEQ ID NO: 185368 - DNA, 25 bp, Homo sapien
gagtgacggcactgcgccgctcttc

SEQ ID NO: 185369 - DNA, 25 bp, Homo sapien
cacgcacctctgagtgacggcagta

SEQ ID NO: 185370 - DNA, 25 bp, Homo sapien
acctctaagtgacggcactgcgccg

SEQ ID NO: 185371 - DNA, 25 bp, Homo sapien
tcagcgtggactctgaggaggaaac

SEQ ID NO: 185372 - DNA, 25 bp, Homo sapien
ggcagtacaccgctcttcaccaggg

SEQ ID NO: 185373 - DNA, 25 bp, Homo sapien
ggagaagctgctgcaccgctcttca

SEQ ID NO: 185374 - DNA, 25 bp, Homo sapien
aggagacggctacccacctctaagt

SEQ ID NO: 185375 - DNA, 25 bp, Homo sapien
aagtgacggcactgcgccgctcttc

SEQ ID NO: 185376 - DNA, 25 bp, Homo sapien
gagtgacggcagtacaccgctcttc

SEQ ID NO: 185377 - DNA, 25 bp, Homo sapien
acccggtcaggctcaaattcgtcgc

SEQ ID NO: 185378 - DNA, 25 bp, Homo sapien
ccgggagcagacagggcgctccgca

SEQ ID NO: 185379 - DNA, 25 bp, Homo sapien
ggctcaaattcgtcgcccaggagtg

SEQ ID NO: 185380 - DNA, 25 bp, Homo sapien
ccgtggctggtacttttccgcgtgg

SEQ ID NO: 185381 - DNA, 25 bp, Homo sapien
ggcgggatggggagaaaattccgca

SEQ ID NO: 185382 - DNA, 25 bp, Homo sapien
gtcccccaagagtccggctgaggca

SEQ ID NO: 185383 - DNA, 25 bp, Homo sapien
ccgcgaggactttgggatcgcctgc

SEQ ID NO: 185384 - DNA, 25 bp, Homo sapien
cacttaacccggtcaggctcaaatt

SEQ ID NO: 185385 - DNA, 25 bp, Homo sapien
tgaccgcgtgcctgggcgagcccaa

SEQ ID NO: 185386 - DNA, 25 bp, Homo sapien
gggcgagcccaaccacatcactcgg

SEQ ID NO: 185387 - DNA, 25 bp, Homo sapien
cactcggctggagcacgctcaggcg

SEQ ID NO: 185388 - DNA, 25 bp, Homo sapien
tggagcacgctcaggcgcggctcac

SEQ ID NO: 185389 - DNA, 25 bp, Homo sapien
tcaccctgtcctataatcgccgtgg

SEQ ID NO: 185390 - DNA, 25 bp, Homo sapien
tataatcgccgtggcgacctggcca

SEQ ID NO: 185391 - DNA, 25 bp, Homo sapien
ggcgacctggccatccacctggtca

SEQ ID NO: 185392 - DNA, 25 bp, Homo sapien
cacagcccgcgtgcttgcctttgct

SEQ ID NO: 185393 - DNA, 25 bp, Homo sapien
tctctcagcttcagctcggagcacg

SEQ ID NO: 185394 - DNA, 25 bp, Homo sapien
accgcctcttcatggcgcgcggctg

SEQ ID NO: 185395 - DNA, 25 bp, Homo sapien
ccgaaagagtcagtgttgcacgggc

SEQ ID NO: 185396 - DNA, 25 bp, Homo sapien
tgtggccgaaagagtcagtgttgca

SEQ ID NO: 185397 - DNA, 25 bp, Homo sapien
gctccagctcgctgacgcacacctg

SEQ ID NO: 185398 - DNA, 25 bp, Homo sapien
ctgcttctctcagcttcagctcgga

SEQ ID NO: 185399 - DNA, 25 bp, Homo sapien
tggctttcacctggccgcaccaagg

SEQ ID NO: 185400 - DNA, 25 bp, Homo sapien
tggccgcaccaagggcgagactcaa

SEQ ID NO: 185401 - DNA, 25 bp, Homo sapien
gcggatccagctccaagccttaaaa

SEQ ID NO: 185402 - DNA, 25 bp, Homo sapien
agccctcgctacgtgagctcgatca

SEQ ID NO: 185403 - DNA, 25 bp, Homo sapien
ttttataacctctaggccgcgatgg

SEQ ID NO: 185404 - DNA, 25 bp, Homo sapien
tcaagaaagtcctggtccctagggc

SEQ ID NO: 185405 - DNA, 25 bp, Homo sapien
tctggcagctaatgctgcaccgctg

SEQ ID NO: 185406 - DNA, 25 bp, Homo sapien
catgcgaaccatctgcggctgtggc

SEQ ID NO: 185407 - DNA, 25 bp, Homo sapien
cggcgactttcgatagggcaaaaat

SEQ ID NO: 185408 - DNA, 25 bp, Homo sapien
ccgctgcgcgcaacagatgagttca

SEQ ID NO: 185409 - DNA, 25 bp, Homo sapien
agcagacttgctcccggcaaagcca

SEQ ID NO: 185410 - DNA, 25 bp, Homo sapien
cccaagtcctcgatacgcactatag

SEQ ID NO: 185411 - DNA, 25 bp, Homo sapien
gatacgcactatagcaccgagaatg

SEQ ID NO: 185412 - DNA, 25 bp, Homo sapien
caaagccagagcagccgagagtccc

SEQ ID NO: 185413 - DNA, 25 bp, Homo sapien
caccgagaatgacgtggagaccatc

SEQ ID NO: 185414 - DNA, 25 bp, Homo sapien
acgtggagaccatccgggccagcgt

SEQ ID NO: 185415 - DNA, 25 bp, Homo sapien
cctgccacgcctcatgtgccacatg

SEQ ID NO: 185416 - DNA, 25 bp, Homo sapien
acgcctccttggaccctgtggagca

SEQ ID NO: 185417 - DNA, 25 bp, Homo sapien
ttccgagggccagagacccacccag

SEQ ID NO: 185418 - DNA, 25 bp, Homo sapien
agctgcccgtgcgggtacctctagc

SEQ ID NO: 185419 - DNA, 25 bp, Homo sapien
aggaagcgcggaatcaggaactggc

SEQ ID NO: 185420 - DNA, 25 bp, Homo sapien
ctgagtcggtccgaggccgtcccag

SEQ ID NO: 185421 - DNA, 25 bp, Homo sapien
ttccgtggccgtgcggccggctaga

SEQ ID NO: 185422 - DNA, 25 bp, Homo sapien
tccgcaccgggcctgagtcggtccg

SEQ ID NO: 185423 - DNA, 25 bp, Homo sapien
cctgggccaactgaaaccgcgggag

SEQ ID NO: 185424 - DNA, 25 bp, Homo sapien
caggcgttccgagggccagagaccc

SEQ ID NO: 185425 - DNA, 25 bp, Homo sapien
gcacaacgcagaggcgacaaagctc

SEQ ID NO: 185426 - DNA, 25 bp, Homo sapien
gaaaaaattcagtcgcgcgtccctc

SEQ ID NO: 185427 - DNA, 25 bp, Homo sapien
aggtgcctgccctctgtgatccaac

SEQ ID NO: 185428 - DNA, 25 bp, Homo sapien
acccagtctctaagggctgaaaata

SEQ ID NO: 185429 - DNA, 25 bp, Homo sapien
tattgcccggaagctcccgagcaga

SEQ ID NO: 185430 - DNA, 25 bp, Homo sapien
atcgcgctaagtagggcacaacgca

SEQ ID NO: 185431 - DNA, 25 bp, Homo sapien
cccgagcagaatcagatcgcgctaa

SEQ ID NO: 185432 - DNA, 25 bp, Homo sapien
ctgcccgatcatgcgcttactcaag

SEQ ID NO: 185433 - DNA, 25 bp, Homo sapien
agtccctgtcacttaacaaccgaag

SEQ ID NO: 185434 - DNA, 25 bp, Homo sapien
aagcgggcggcactcccttccgata

SEQ ID NO: 185435 - DNA, 25 bp, Homo sapien
gcccagcagtggttgtcagtaagcg

SEQ ID NO: 185436 - DNA, 25 bp, Homo sapien
ctctccggtgcccagcagtggttgt

SEQ ID NO: 185437 - DNA, 25 bp, Homo sapien
tttcccgcgcggcttgaggtactgg

SEQ ID NO: 185438 - DNA, 25 bp, Homo sapien
caaccgaagtaacccgcaatgcgga

SEQ ID NO: 185439 - DNA, 25 bp, Homo sapien
tcccggaagtccctgtcacttaaca

SEQ ID NO: 185440 - DNA, 25 bp, Homo sapien
ttgcgagtcaccgagtttcccgcgc

SEQ ID NO: 185441 - DNA, 25 bp, Homo sapien
cagatgaattcctctggagctgacc

SEQ ID NO: 185442 - DNA, 25 bp, Homo sapien
cttgcgagccgcgaagtcggcagcc

SEQ ID NO: 185443 - DNA, 25 bp, Homo sapien
gagccgcgaagtcggcagcctccag

SEQ ID NO: 185444 - DNA, 25 bp, Homo sapien
gcctcagagcccatcgcgcggatgg

SEQ ID NO: 185445 - DNA, 25 bp, Homo sapien
gcagggacggaacgtttacagcgcc

SEQ ID NO: 185446 - DNA, 25 bp, Homo sapien
ggaggctaattcagcgggccgagtt

SEQ ID NO: 185447 - DNA, 25 bp, Homo sapien
gccgagttgggcctgccccagatga

SEQ ID NO: 185448 - DNA, 25 bp, Homo sapien
cgcgcccaccgatggggtggttgat

SEQ ID NO: 185449 - DNA, 25 bp, Homo sapien
gctgggcctctacaacctactggtt

SEQ ID NO: 185450 - DNA, 25 bp, Homo sapien
tgaccgtagacctcgtgcacttctg

SEQ ID NO: 185451 - DNA, 25 bp, Homo sapien
ggcacgagacaacctctccgcgatg

SEQ ID NO: 185452 - DNA, 25 bp, Homo sapien
ctccgcgatgactgtgagtggtcca

SEQ ID NO: 185453 - DNA, 25 bp, Homo sapien
tgagctgttcaaatgtggagactac

SEQ ID NO: 185454 - DNA, 25 bp, Homo sapien
ggccgggatccagatactttttctc

SEQ ID NO: 185455 - DNA, 25 bp, Homo sapien
tttctctctacaggccagctcagtg

SEQ ID NO: 185456 - DNA, 25 bp, Homo sapien
tactggttgtgaccctgatgaccgt

SEQ ID NO: 185457 - DNA, 25 bp, Homo sapien
gtcttgggcgtcactcctcgccaaa

SEQ ID NO: 185458 - DNA, 25 bp, Homo sapien
cgtgacgggtcctgagccaatccgt

SEQ ID NO: 185459 - DNA, 25 bp, Homo sapien
caccgcccttgctggtgattggccg

SEQ ID NO: 185460 - DNA, 25 bp, Homo sapien
cctcggaggtttcagcccatttcac

SEQ ID NO: 185461 - DNA, 25 bp, Homo sapien
aaagctgcttcctgttggggcatga

SEQ ID NO: 185462 - DNA, 25 bp, Homo sapien
ccaatccgtggaaggtaaaagctgc

SEQ ID NO: 185463 - DNA, 25 bp, Homo sapien
cccagcacgttcgaggagggctaag

SEQ ID NO: 185464 - DNA, 25 bp, Homo sapien
tgtcctctctgtggttctaatccga

SEQ ID NO: 185465 - DNA, 25 bp, Homo sapien
gagctggagctacaccgctttcgtg

SEQ ID NO: 185466 - DNA, 25 bp, Homo sapien
cgcttggagctgtcgggctcagcca

SEQ ID NO: 185467 - DNA, 25 bp, Homo sapien
acgctgctggccaggtgttctcctg

SEQ ID NO: 185468 - DNA, 25 bp, Homo sapien
cccttaatgcgactgtagctgacga

SEQ ID NO: 185469 - DNA, 25 bp, Homo sapien
acaccgctttcgtgacccgtgagca

SEQ ID NO: 185470 - DNA, 25 bp, Homo sapien
gcttcggtttctgcggcttcgggca

SEQ ID NO: 185471 - DNA, 25 bp, Homo sapien
ctgtggccagtccagtttgtctccc

SEQ ID NO: 185472 - DNA, 25 bp, Homo sapien
gcgtcgacatctgccgcgtgagcgc

SEQ ID NO: 185473 - DNA, 25 bp, Homo sapien
gacgcctgaccggaacctgaagcca

SEQ ID NO: 185474 - DNA, 25 bp, Homo sapien
ctctgctgtggcacctttccttagc

SEQ ID NO: 185475 - DNA, 25 bp, Homo sapien
ttagccgcctctccgactgcgagag

SEQ ID NO: 185476 - DNA, 25 bp, Homo sapien
ccgaagcctggatcaggctctgtcc

SEQ ID NO: 185477 - DNA, 25 bp, Homo sapien
aacctgaagccagcggaaatcctga

SEQ ID NO: 185478 - DNA, 25 bp, Homo sapien
cctgagagaaagtctgaaacccact

SEQ ID NO: 185479 - DNA, 25 bp, Homo sapien
cccgaaaccttgtgtgtcgtcactg

SEQ ID NO: 185480 - DNA, 25 bp, Homo sapien
ctgcgagagctgatcgagagctgcc

SEQ ID NO: 185481 - DNA, 25 bp, Homo sapien
tagtttccctcgctcatccaagaag

SEQ ID NO: 185482 - DNA, 25 bp, Homo sapien
ttcaaaccgcgccacggggcgaagc

SEQ ID NO: 185483 - DNA, 25 bp, Homo sapien
gccaagcagcggcacctgagacgct

SEQ ID NO: 185484 - DNA, 25 bp, Homo sapien
cgccgactgccgtgacgatctaggc

SEQ ID NO: 185485 - DNA, 25 bp, Homo sapien
tcctcatggcggacgctccaagcag

SEQ ID NO: 185486 - DNA, 25 bp, Homo sapien
aacaccggcgatgtcactccgcgta

SEQ ID NO: 185487 - DNA, 25 bp, Homo sapien
cccgcgcagtttggattcgaagtgc

SEQ ID NO: 185488 - DNA, 25 bp, Homo sapien
agccgtgagtccaggtccagaccta

SEQ ID NO: 185489 - DNA, 25 bp, Homo sapien
ctccaggcaagagagctactacctc

SEQ ID NO: 185490 - DNA, 25 bp, Homo sapien
cactccaggaatgaatggccacctc

SEQ ID NO: 185491 - DNA, 25 bp, Homo sapien
gaagcgacttcctagatctcccgga

SEQ ID NO: 185492 - DNA, 25 bp, Homo sapien
gaaggacgcccttcgttctgagaag

SEQ ID NO: 185493 - DNA, 25 bp, Homo sapien
tcggagcagccttgtctcagacctg

SEQ ID NO: 185494 - DNA, 25 bp, Homo sapien
tgcccgtcagcaggattccggtcta

SEQ ID NO: 185495 - DNA, 25 bp, Homo sapien
actccgcagcgtacgaggagaaccc

SEQ ID NO: 185496 - DNA, 25 bp, Homo sapien
acggcgtcctgaaagggacatttga

SEQ ID NO: 185497 - DNA, 25 bp, Homo sapien
caaatccggagaccttgcggcctca

SEQ ID NO: 185498 - DNA, 25 bp, Homo sapien
tcccgggaacttgcgtctagtcctc

SEQ ID NO: 185499 - DNA, 25 bp, Homo sapien
gcctgcctgggctgaaatatacacg

SEQ ID NO: 185500 - DNA, 25 bp, Homo sapien
atttgccacccaggtaggggactgc

SEQ ID NO: 185501 - DNA, 25 bp, Homo sapien
agtcctctgacgcatcctagttcgg

SEQ ID NO: 185502 - DNA, 25 bp, Homo sapien
ctgcccgcagcgaatacttttaatg

SEQ ID NO: 185503 - DNA, 25 bp, Homo sapien
gacgacgcccatgatcagctggtta

SEQ ID NO: 185504 - DNA, 25 bp, Homo sapien
tctgatcccgctgagtagaggaccc

SEQ ID NO: 185505 - DNA, 25 bp, Homo sapien
cttctgcccgatcgttgggcgcacg

SEQ ID NO: 185506 - DNA, 25 bp, Homo sapien
cttctgcctgatcgttgggcgcacg

SEQ ID NO: 185507 - DNA, 25 bp, Homo sapien
tccttctgcctgatcgttgggagca

SEQ ID NO: 185508 - DNA, 25 bp, Homo sapien
gatcgttgggagcacactccttctg

SEQ ID NO: 185509 - DNA, 25 bp, Homo sapien
tccttctgcccgatcgttgggcgca

SEQ ID NO: 185510 - DNA, 25 bp, Homo sapien
tccttctgcccgatcgttgggagca

SEQ ID NO: 185511 - DNA, 25 bp, Homo sapien
ttctgcctgatcgttgggcgcacgc

SEQ ID NO: 185512 - DNA, 25 bp, Homo sapien
gatcatgggcacacgctccttctgc

SEQ ID NO: 185513 - DNA, 25 bp, Homo sapien
gacgaggcgcagaggaacaagaaaa

SEQ ID NO: 185514 - DNA, 25 bp, Homo sapien
gaaggtgtcctgcttttccaacatc

SEQ ID NO: 185515 - DNA, 25 bp, Homo sapien
gtcctgcttttccaacatcaagatc

SEQ ID NO: 185516 - DNA, 25 bp, Homo sapien
tcttcctggtgtccgagtgcgccct

SEQ ID NO: 185517 - DNA, 25 bp, Homo sapien
ccgagtgcgccctgatgctggcgca

SEQ ID NO: 185518 - DNA, 25 bp, Homo sapien
gtactcagtattctcccttcctggg

SEQ ID NO: 185519 - DNA, 25 bp, Homo sapien
gcccttcctgggtactcagtattct

SEQ ID NO: 185520 - DNA, 25 bp, Homo sapien
gagctgtgccttccacctctccagc

SEQ ID NO: 185521 - DNA, 25 bp, Homo sapien
tgtacttgctgctcattggggccca

SEQ ID NO: 185522 - DNA, 25 bp, Homo sapien
tgggcgtctcctacatcgacgacca

SEQ ID NO: 185523 - DNA, 25 bp, Homo sapien
accacgtgcggaggaaggactcctc

SEQ ID NO: 185524 - DNA, 25 bp, Homo sapien
accggacggctaccaacatgatgta

SEQ ID NO: 185525 - DNA, 25 bp, Homo sapien
agttcctgacccaccagtacaagta

SEQ ID NO: 185526 - DNA, 25 bp, Homo sapien
cctcttcgtgagctacttcggggca

SEQ ID NO: 185527 - DNA, 25 bp, Homo sapien
aacctggcgctcatcctcttcgtga

SEQ ID NO: 185528 - DNA, 25 bp, Homo sapien
gctagcagcttcgagatcgggaacc

SEQ ID NO: 185529 - DNA, 25 bp, Homo sapien
ttctttgtctccagcacggccgctt

SEQ ID NO: 185530 - DNA, 25 bp, Homo sapien
ctcgcctggctttggacgttcagcc

SEQ ID NO: 185531 - DNA, 25 bp, Homo sapien
agaagggctcgcatagctggactga

SEQ ID NO: 185532 - DNA, 25 bp, Homo sapien
ctttctcgccttggcaaagtgggca

SEQ ID NO: 185533 - DNA, 25 bp, Homo sapien
atcgggtaaatagctgctcccaggc

SEQ ID NO: 185534 - DNA, 25 bp, Homo sapien
tcctcatcttcgcagacatctcaga

SEQ ID NO: 185535 - DNA, 25 bp, Homo sapien
caccatgcagctgcagttccggagc

SEQ ID NO: 185536 - DNA, 25 bp, Homo sapien
agctggcaccactagagaagggctc

SEQ ID NO: 185537 - DNA, 25 bp, Homo sapien
accaacacgttgcaaggagtcattc

SEQ ID NO: 185538 - DNA, 25 bp, Homo sapien
ggctgagctccaggatccgcaccag

SEQ ID NO: 185539 - DNA, 25 bp, Homo sapien
acgccacgatcacggctgccttgag

SEQ ID NO: 185540 - DNA, 25 bp, Homo sapien
ggtggtaaaggcgaacgccacgatc

SEQ ID NO: 185541 - DNA, 25 bp, Homo sapien
cagcaggttggcgatgccgccctgt

SEQ ID NO: 185542 - DNA, 25 bp, Homo sapien
tcaccaaggcgtcgccactgctgtt

SEQ ID NO: 185543 - DNA, 25 bp, Homo sapien
tgcaaggagtcattcgacgggccgc

SEQ ID NO: 185544 - DNA, 25 bp, Homo sapien
ggatccgcaccagcacggaggcctg

SEQ ID NO: 185545 - DNA, 25 bp, Homo sapien
gcgcgcgctttcctcagaggctcgg

SEQ ID NO: 185546 - DNA, 25 bp, Homo sapien
agaacgccagctgcggtggaccgct

SEQ ID NO: 185547 - DNA, 25 bp, Homo sapien
cggggatcaaagaagaacgccagct

SEQ ID NO: 185548 - DNA, 25 bp, Homo sapien
cctttggcgctgagcttttcgtgcg

SEQ ID NO: 185549 - DNA, 25 bp, Homo sapien
gccgcagaaccggtacacgcgcctg

SEQ ID NO: 185550 - DNA, 25 bp, Homo sapien
tgcgaagctggtgaaaaggttgccc

SEQ ID NO: 185551 - DNA, 25 bp, Homo sapien
ttcgaagtgggcctgaggaagcctc

SEQ ID NO: 185552 - DNA, 25 bp, Homo sapien
gctttcctcagaggctcggccgggc

SEQ ID NO: 185553 - DNA, 25 bp, Homo sapien
cagttccgcaaagctgccagcgtgc

SEQ ID NO: 185554 - DNA, 25 bp, Homo sapien
tgctgcaaatccaacgaggcgagtc

SEQ ID NO: 185555 - DNA, 25 bp, Homo sapien
aactgagtggttttacccagccgtg

SEQ ID NO: 185556 - DNA, 25 bp, Homo sapien
ggcgagtcctcttggatcgaattaa

SEQ ID NO: 185557 - DNA, 25 bp, Homo sapien
tcttcccttcgcaacagctttgatg

SEQ ID NO: 185558 - DNA, 25 bp, Homo sapien
ctttgatgaccgtttcccgcctttg

SEQ ID NO: 185559 - DNA, 25 bp, Homo sapien
cgtggcgttttcttcctgagcgaga

SEQ ID NO: 185560 - DNA, 25 bp, Homo sapien
ctctgcgtttgctgctccgtgcaaa

SEQ ID NO: 185561 - DNA, 25 bp, Homo sapien
agtaacgccggcatgtggagtcaca

SEQ ID NO: 185562 - DNA, 25 bp, Homo sapien
acggcggcgcgagaaataaagatca

SEQ ID NO: 185563 - DNA, 25 bp, Homo sapien
ttacggcggccgcaaaatgaggtgt

SEQ ID NO: 185564 - DNA, 25 bp, Homo sapien
ggcgcctgcgtcacaagcactgaag

SEQ ID NO: 185565 - DNA, 25 bp, Homo sapien
aacccaggactgcttctttttcgcg

SEQ ID NO: 185566 - DNA, 25 bp, Homo sapien
gcggtgccgaacacttcctcgcaaa

SEQ ID NO: 185567 - DNA, 25 bp, Homo sapien
acaccttgtggtagcctcgtcggac

SEQ ID NO: 185568 - DNA, 25 bp, Homo sapien
taaagatcagaaggcgccaagcgga

SEQ ID NO: 185569 - DNA, 25 bp, Homo sapien
gaaagcgccgctgcggttgccgcct

SEQ ID NO: 185570 - DNA, 25 bp, Homo sapien
agcaaaatgtccttgagcgcgcgag

SEQ ID NO: 185571 - DNA, 25 bp, Homo sapien
ggaaaagcaaaatgtccttgagcgc

SEQ ID NO: 185572 - DNA, 25 bp, Homo sapien
ttattgtcctttgtccttgggagga

SEQ ID NO: 185573 - DNA, 25 bp, Homo sapien
tagctccttttattgtcctttgtcc

SEQ ID NO: 185574 - DNA, 25 bp, Homo sapien
ctcggacccggtgagtggctcccta

SEQ ID NO: 185575 - DNA, 25 bp, Homo sapien
acgacgccgaaagcgccgctgcggt

SEQ ID NO: 185576 - DNA, 25 bp, Homo sapien
ggctccctagctccttttattgtcc

SEQ ID NO: 185577 - DNA, 25 bp, Homo sapien
aacagcagggtcaacggcggcgcct

SEQ ID NO: 185578 - DNA, 25 bp, Homo sapien
aacgcagtgacgtctggccgcgtgc

SEQ ID NO: 185579 - DNA, 25 bp, Homo sapien
gcgtgcgcatgtcgggcgctttctc

SEQ ID NO: 185580 - DNA, 25 bp, Homo sapien
tgggcggcttctttcctggacgcgt

SEQ ID NO: 185581 - DNA, 25 bp, Homo sapien
ttcctggacgcgtttgctcctggca

SEQ ID NO: 185582 - DNA, 25 bp, Homo sapien
tttgctcctggcagtcttgtccgcc

SEQ ID NO: 185583 - DNA, 25 bp, Homo sapien
ttgtccgcccttgcctgtagcggtc

SEQ ID NO: 185584 - DNA, 25 bp, Homo sapien
gcgcgcctggtaacagcagggtcaa

SEQ ID NO: 185585 - DNA, 25 bp, Homo sapien
cacggctgtctcgtatgggaaggtc

SEQ ID NO: 185586 - DNA, 25 bp, Homo sapien
ccatggtggacacgccaggagatct

SEQ ID NO: 185587 - DNA, 25 bp, Homo sapien
tctacgcgtctagcagaacacaggg

SEQ ID NO: 185588 - DNA, 25 bp, Homo sapien
ggcaggtcccgagtcctatcataca

SEQ ID NO: 185589 - DNA, 25 bp, Homo sapien
tggagtggagcatcttgacatcctc

SEQ ID NO: 185590 - DNA, 25 bp, Homo sapien
tgacatcctccaacgcgtagtaggc

SEQ ID NO: 185591 - DNA, 25 bp, Homo sapien
aggcggccagtgtgaagttcacgtc

SEQ ID NO: 185592 - DNA, 25 bp, Homo sapien
agcttctccttgcacttggccacgg

SEQ ID NO: 185593 - DNA, 25 bp, Homo sapien
cccgaagaggccacagtgcgtgtag

SEQ ID NO: 185594 - DNA, 25 bp, Homo sapien
ttgtgctggctcatgaggtcctcta

SEQ ID NO: 185595 - DNA, 25 bp, Homo sapien
tgaaagctcttctcgtaatggcaga

SEQ ID NO: 185596 - DNA, 25 bp, Homo sapien
aattattgtcgatgagcggccaggc

SEQ ID NO: 185597 - DNA, 25 bp, Homo sapien
ggccatccttggagcagttgtgctg

SEQ ID NO: 185598 - DNA, 25 bp, Homo sapien
ggtgacctgcacgttcaggtaatta

SEQ ID NO: 185599 - DNA, 25 bp, Homo sapien
cctctatgccatggacggccgagtg

SEQ ID NO: 185600 - DNA, 25 bp, Homo sapien
cgtagctgcgcaaggctgcacagaa

SEQ ID NO: 185601 - DNA, 25 bp, Homo sapien
atgaatcggcgaaacttacgtaggt

SEQ ID NO: 185602 - DNA, 25 bp, Homo sapien
gcaccagcttgttcgcgtgactcca

SEQ ID NO: 185603 - DNA, 25 bp, Homo sapien
ctcggagtgccagcagcaccagctt

SEQ ID NO: 185604 - DNA, 25 bp, Homo sapien
tttgacagtgcccaggactcggagt

SEQ ID NO: 185605 - DNA, 25 bp, Homo sapien
cctgtggatgaatccgtaaccattc

SEQ ID NO: 185606 - DNA, 25 bp, Homo sapien
tcctgggcttcttttaatagctgtc

SEQ ID NO: 185607 - DNA, 25 bp, Homo sapien
cgctgcgcggagtctttggcccgtt

SEQ ID NO: 185608 - DNA, 25 bp, Homo sapien
ctgtctggtgaacaaagacatcttc

SEQ ID NO: 185609 - DNA, 25 bp, Homo sapien
atccagctcggcctgttaccactag

SEQ ID NO: 185610 - DNA, 25 bp, Homo sapien
actgtccttggaggcaaatcccagc

SEQ ID NO: 185611 - DNA, 25 bp, Homo sapien
ctggctcatcagtcgcactcagacg

SEQ ID NO: 185612 - DNA, 25 bp, Homo sapien
tccatctcacggcaactcgggcagg

SEQ ID NO: 185613 - DNA, 25 bp, Homo sapien
ctcggaaaaccacggccctagatca

SEQ ID NO: 185614 - DNA, 25 bp, Homo sapien
ggccagaatcccagggctgaacgtc

SEQ ID NO: 185615 - DNA, 25 bp, Homo sapien
cgctcgccgtgaggacctcggaaaa

SEQ ID NO: 185616 - DNA, 25 bp, Homo sapien
ggctgtccttgcaaaccaggcccag

SEQ ID NO: 185617 - DNA, 25 bp, Homo sapien
tcccagcccgcacacggtgtaaggg

SEQ ID NO: 185618 - DNA, 25 bp, Homo sapien
agcgctcgggagacaactgcagagt

SEQ ID NO: 185619 - DNA, 25 bp, Homo sapien
gaggcgcagcaaagctccaaatgtg

SEQ ID NO: 185620 - DNA, 25 bp, Homo sapien
tgcgccagcggccaagtcaagactc

SEQ ID NO: 185621 - DNA, 25 bp, Homo sapien
caagactccttgaatgctcaggtta

SEQ ID NO: 185622 - DNA, 25 bp, Homo sapien
caactttccgaatcgcccgcagggt

SEQ ID NO: 185623 - DNA, 25 bp, Homo sapien
taaggaagaccaaagcagcgccgtg

SEQ ID NO: 185624 - DNA, 25 bp, Homo sapien
cctgctgccaacagctaaagcgata

SEQ ID NO: 185625 - DNA, 25 bp, Homo sapien
gtggccgcgcttgttttcatgatgc

SEQ ID NO: 185626 - DNA, 25 bp, Homo sapien
cccgcaggccgtctaacttattcaa

SEQ ID NO: 185627 - DNA, 25 bp, Homo sapien
tgcagcgcggtctgcagtgagattc

SEQ ID NO: 185628 - DNA, 25 bp, Homo sapien
tacgaatcttcttaacggttgccaa

SEQ ID NO: 185629 - DNA, 25 bp, Homo sapien
ggttgccaacaaaactccgcagctg

SEQ ID NO: 185630 - DNA, 25 bp, Homo sapien
ctgagctgcaagcactggacaaggg

SEQ ID NO: 185631 - DNA, 25 bp, Homo sapien
gcttgggaaatgtaacttacgaatc

SEQ ID NO: 185632 - DNA, 25 bp, Homo sapien
ctaacttattcaaaggcgcggctga

SEQ ID NO: 185633 - DNA, 25 bp, Homo sapien
tgcctgaataaaaacgccgcggccc

SEQ ID NO: 185634 - DNA, 25 bp, Homo sapien
gccacagcgaggacgcgggctcaca

SEQ ID NO: 185635 - DNA, 25 bp, Homo sapien
ggactctgcgctcccgtcagctggg

SEQ ID NO: 185636 - DNA, 25 bp, Homo sapien
gcattgcctgaataaaaacgccgcg

SEQ ID NO: 185637 - DNA, 25 bp, Homo sapien
cggcccgcagtagcggccacagcga

SEQ ID NO: 185638 - DNA, 25 bp, Homo sapien
aaatgggccgtgaacggctcccaca

SEQ ID NO: 185639 - DNA, 25 bp, Homo sapien
tgccggcttcccttaagcattgcct

SEQ ID NO: 185640 - DNA, 25 bp, Homo sapien
gcttcccttaagcattgcctgaata

SEQ ID NO: 185641 - DNA, 25 bp, Homo sapien
aacgtctcgcggtggcccgatgact

SEQ ID NO: 185642 - DNA, 25 bp, Homo sapien
ccctaacgtaccttaaactgctgca

SEQ ID NO: 185643 - DNA, 25 bp, Homo sapien
cctcgactccggaagcggatgatcc

SEQ ID NO: 185644 - DNA, 25 bp, Homo sapien
aggccgcaccgccaagcggtacaag

SEQ ID NO: 185645 - DNA, 25 bp, Homo sapien
agaaagaacctgcaagccgacacca

SEQ ID NO: 185646 - DNA, 25 bp, Homo sapien
cccgatgactcactgaggtggacca

SEQ ID NO: 185647 - DNA, 25 bp, Homo sapien
aactgctgcaaaagaggcgtttctc

SEQ ID NO: 185648 - DNA, 25 bp, Homo sapien
gcaccagctctacggccttggcagg

SEQ ID NO: 185649 - DNA, 25 bp, Homo sapien
tgcgcttccgagtggcgactgcagc

SEQ ID NO: 185650 - DNA, 25 bp, Homo sapien
cccgaacgcggcctcgcacaggtga

SEQ ID NO: 185651 - DNA, 25 bp, Homo sapien
ctccttgcaacacccggccgagctc

SEQ ID NO: 185652 - DNA, 25 bp, Homo sapien
cctgcgcttccgagtggcgactgca

SEQ ID NO: 185653 - DNA, 25 bp, Homo sapien
gtcggaggctgctcaaaggtgacgc

SEQ ID NO: 185654 - DNA, 25 bp, Homo sapien
gctgctcaaaggtgacgcgcggccg

SEQ ID NO: 185655 - DNA, 25 bp, Homo sapien
cgcctccttgcaacacccggccgag

SEQ ID NO: 185656 - DNA, 25 bp, Homo sapien
cctcgcacaggtgagggcggtgccg

SEQ ID NO: 185657 - DNA, 25 bp, Homo sapien
tccgttttcacatatttcttcttgc

SEQ ID NO: 185658 - DNA, 25 bp, Homo sapien
cggctcagcctagtcagtgggtcag

SEQ ID NO: 185659 - DNA, 25 bp, Homo sapien
cccggctcagcctagtcagtgggtc

SEQ ID NO: 185660 - DNA, 25 bp, Homo sapien
agctctgttgtacaccgtccacggc

SEQ ID NO: 185661 - DNA, 25 bp, Homo sapien
tagctctgttgtacaccgtccacgg

SEQ ID NO: 185662 - DNA, 25 bp, Homo sapien
gggtagctctgttgtacaccgtcca

SEQ ID NO: 185663 - DNA, 25 bp, Homo sapien
gagtgggtagctctgttgtacaccg

SEQ ID NO: 185664 - DNA, 25 bp, Homo sapien
gtgggtagctctgttgtacaccgtc

SEQ ID NO: 185665 - DNA, 25 bp, Homo sapien
gcgcggccggcggaaaagcttggtg

SEQ ID NO: 185666 - DNA, 25 bp, Homo sapien
gtcacagtggccagcgtccccggag

SEQ ID NO: 185667 - DNA, 25 bp, Homo sapien
cggccggtgacacccaagaggcgac

SEQ ID NO: 185668 - DNA, 25 bp, Homo sapien
ccggccggtgacacccaagaggcga

SEQ ID NO: 185669 - DNA, 25 bp, Homo sapien
gggaagcgccttatcgcggcgcgca

SEQ ID NO: 185670 - DNA, 25 bp, Homo sapien
agaactttcactgggcgtccgcggc

SEQ ID NO: 185671 - DNA, 25 bp, Homo sapien
ggagaactttcactgggcgtccgcg

SEQ ID NO: 185672 - DNA, 25 bp, Homo sapien
gcccggagaactttcactgggcgtc

SEQ ID NO: 185673 - DNA, 25 bp, Homo sapien
aactcttcttcgtggacaccggctc

SEQ ID NO: 185674 - DNA, 25 bp, Homo sapien
gtactttgaagaccaccagaccctg

SEQ ID NO: 185675 - DNA, 25 bp, Homo sapien
gagcttcctacaacccgtactttga

SEQ ID NO: 185676 - DNA, 25 bp, Homo sapien
ccaggagtccacgttccaggtagcc

SEQ ID NO: 185677 - DNA, 25 bp, Homo sapien
gagcggcccttctacgaactctggg

SEQ ID NO: 185678 - DNA, 25 bp, Homo sapien
gagcagctatgggagaatctggcca

SEQ ID NO: 185679 - DNA, 25 bp, Homo sapien
ggtcccgaacgccaagaagctcagg

SEQ ID NO: 185680 - DNA, 25 bp, Homo sapien
gggttgacctcatcctcgagacaca

SEQ ID NO: 185681 - DNA, 25 bp, Homo sapien
gaacgcagtggctcacaagggcacc

SEQ ID NO: 185682 - DNA, 25 bp, Homo sapien
cgtgtgtattaagggacagcgtgtc

SEQ ID NO: 185683 - DNA, 25 bp, Homo sapien
tctggccttggagaacgcagtggct

SEQ ID NO: 185684 - DNA, 25 bp, Homo sapien
cctgtcccgttctggccttggagaa

SEQ ID NO: 185685 - DNA, 25 bp, Homo sapien
atgatggatggcctgtctgccggcc

SEQ ID NO: 185686 - DNA, 25 bp, Homo sapien
ggctcagcgcacgtacggtccctgt

SEQ ID NO: 185687 - DNA, 25 bp, Homo sapien
agggacagcgtgtcctcccacgttc

SEQ ID NO: 185688 - DNA, 25 bp, Homo sapien
caagggcaccgctagcacgcgaggc

SEQ ID NO: 185689 - DNA, 25 bp, Homo sapien
tcgcggcttgaagccagtggctctc

SEQ ID NO: 185690 - DNA, 25 bp, Homo sapien
ggggcttctaatcactcggtatcga

SEQ ID NO: 185691 - DNA, 25 bp, Homo sapien
catctgctggatgacgagccgctct

SEQ ID NO: 185692 - DNA, 25 bp, Homo sapien
gctctgggctttatccacactaata

SEQ ID NO: 185693 - DNA, 25 bp, Homo sapien
cccggctatttgtgtgtgatcagta

SEQ ID NO: 185694 - DNA, 25 bp, Homo sapien
tttagtgcgctgacatccttagctg

SEQ ID NO: 185695 - DNA, 25 bp, Homo sapien
tccttagctgggcttcggatcgatt

SEQ ID NO: 185696 - DNA, 25 bp, Homo sapien
cctccttcgaggagagatgctctcc

SEQ ID NO: 185697 - DNA, 25 bp, Homo sapien
tctttctccgagcacactgattaga

SEQ ID NO: 185698 - DNA, 25 bp, Homo sapien
atatatttccctgctgttgcgcgcg

SEQ ID NO: 185699 - DNA, 25 bp, Homo sapien
tgccactcgtacctgtccggatata

SEQ ID NO: 185700 - DNA, 25 bp, Homo sapien
ctggtcattaactgtggagtgtctc

SEQ ID NO: 185701 - DNA, 25 bp, Homo sapien
gcaaggtggccaattctgggtcctc

SEQ ID NO: 185702 - DNA, 25 bp, Homo sapien
tgattagacagacgccagacctccg

SEQ ID NO: 185703 - DNA, 25 bp, Homo sapien
agctgtttgtgttgaatgcggcgca

SEQ ID NO: 185704 - DNA, 25 bp, Homo sapien
gtggaccctcgtgccttttgcaaaa

SEQ ID NO: 185705 - DNA, 25 bp, Homo sapien
cgagttgactctttccctatgtgtg

SEQ ID NO: 185706 - DNA, 25 bp, Homo sapien
tcgccatggcaacgtgcgctaagtt

SEQ ID NO: 185707 - DNA, 25 bp, Homo sapien
gcagcagtcgtgtcaaagttcacta

SEQ ID NO: 185708 - DNA, 25 bp, Homo sapien
gagctgatcgcggagaagccacttc

SEQ ID NO: 185709 - DNA, 25 bp, Homo sapien
tctctgttcttttctctccgcggtg

SEQ ID NO: 185710 - DNA, 25 bp, Homo sapien
cctctgcgcacgaaggatgtgcttc

SEQ ID NO: 185711 - DNA, 25 bp, Homo sapien
tgtgcttctaggtggtgatctgccc

SEQ ID NO: 185712 - DNA, 25 bp, Homo sapien
ctcgcggagcctttaagagacgttg

SEQ ID NO: 185713 - DNA, 25 bp, Homo sapien
gctcttctcttcgtattgcagcgga

SEQ ID NO: 185714 - DNA, 25 bp, Homo sapien
gtgagttcactggagtctgcctttc

SEQ ID NO: 185715 - DNA, 25 bp, Homo sapien
ggccgactgatttccttctttactc

SEQ ID NO: 185716 - DNA, 25 bp, Homo sapien
atggcaatggtagtcagcacgtggc

SEQ ID NO: 185717 - DNA, 25 bp, Homo sapien
ggctagcctgctctgggtaaggaca

SEQ ID NO: 185718 - DNA, 25 bp, Homo sapien
acgggaaggtatcggcctctcattt

SEQ ID NO: 185719 - DNA, 25 bp, Homo sapien
aggaacctgagctacacgtgccgcg

SEQ ID NO: 185720 - DNA, 25 bp, Homo sapien
ggctgtttccatttcctttgcattg

SEQ ID NO: 185721 - DNA, 25 bp, Homo sapien
actcctgggatgtgcattaagcggc

SEQ ID NO: 185722 - DNA, 25 bp, Homo sapien
agcgtgtgaaactctgcctcgaatc

SEQ ID NO: 185723 - DNA, 25 bp, Homo sapien
ggctcaaagttagcgggcgacgtcc

SEQ ID NO: 185724 - DNA, 25 bp, Homo sapien
cagctgctacgggaaagtgcctgcc

SEQ ID NO: 185725 - DNA, 25 bp, Homo sapien
ggcgacgtccgaggcttagcctcta

SEQ ID NO: 185726 - DNA, 25 bp, Homo sapien
gagaacccagttagacgcgaaatgc

SEQ ID NO: 185727 - DNA, 25 bp, Homo sapien
tggtcctatgagctgagccaacatg

SEQ ID NO: 185728 - DNA, 25 bp, Homo sapien
gaatctcgcttttgacttggtccta

SEQ ID NO: 185729 - DNA, 25 bp, Homo sapien
gccaggcagccctcgttaataacgc

SEQ ID NO: 185730 - DNA, 25 bp, Homo sapien
ctgtcactttccgaggctcccgcca

SEQ ID NO: 185731 - DNA, 25 bp, Homo sapien
agcgagtacttctctccgcagcctg

SEQ ID NO: 185732 - DNA, 25 bp, Homo sapien
aactgcgaggggagcgagtacttct

SEQ ID NO: 185733 - DNA, 25 bp, Homo sapien
gcagagagaatacgagcccaccacg

SEQ ID NO: 185734 - DNA, 25 bp, Homo sapien
tccctggcagagagaatacgagccc

SEQ ID NO: 185735 - DNA, 25 bp, Homo sapien
gtcccttgttccctggcagagagaa

SEQ ID NO: 185736 - DNA, 25 bp, Homo sapien
gttaataacgcctagacaccgtgcc

SEQ ID NO: 185737 - DNA, 25 bp, Homo sapien
aaatatgtcggcgagcacccaccca

SEQ ID NO: 185738 - DNA, 25 bp, Homo sapien
aagatgaatttagtggcgcggctgc

SEQ ID NO: 185739 - DNA, 25 bp, Homo sapien
gcacccacccaaatgcaatcatttg

SEQ ID NO: 185740 - DNA, 25 bp, Homo sapien
gggattcgccttcagcccagcgagg

SEQ ID NO: 185741 - DNA, 25 bp, Homo sapien
atggatttatcaacggggattcgcc

SEQ ID NO: 185742 - DNA, 25 bp, Homo sapien
ggctgcctccctgaatccgaacggt

SEQ ID NO: 185743 - DNA, 25 bp, Homo sapien
gggaggtttactcagcaaatatgtc

SEQ ID NO: 185744 - DNA, 25 bp, Homo sapien
tccctgaatccgaacggtaatgatg

SEQ ID NO: 185745 - DNA, 25 bp, Homo sapien
ggttctgccagacacacgtagcgca

SEQ ID NO: 185746 - DNA, 25 bp, Homo sapien
tgcaccagcgcgttcttgggcgcca

SEQ ID NO: 185747 - DNA, 25 bp, Homo sapien
tgtcgaacagctcctgcagtgcggc

SEQ ID NO: 185748 - DNA, 25 bp, Homo sapien
gtctgcgacactgtccggtactgca

SEQ ID NO: 185749 - DNA, 25 bp, Homo sapien
ctggacgccactcccaacagggaaa

SEQ ID NO: 185750 - DNA, 25 bp, Homo sapien
caccaggccgggagacattctttcc

SEQ ID NO: 185751 - DNA, 25 bp, Homo sapien
ggcagccgcattgtcaccctcaaaa

SEQ ID NO: 185752 - DNA, 25 bp, Homo sapien
cgggcatctggatgtcgaacagctc

SEQ ID NO: 185753 - DNA, 25 bp, Homo sapien
cctccgggcaggcttcaatgctgca

SEQ ID NO: 185754 - DNA, 25 bp, Homo sapien
ttttacagatctccgcctgcagccg

SEQ ID NO: 185755 - DNA, 25 bp, Homo sapien
ggcggctcacgtggatttttacaga

SEQ ID NO: 185756 - DNA, 25 bp, Homo sapien
tctccaggccggtctctttccttgg

SEQ ID NO: 185757 - DNA, 25 bp, Homo sapien
gcgaacttggctgcagcggcagatc

SEQ ID NO: 185758 - DNA, 25 bp, Homo sapien
agcggcagatctccgaccaaatcgc

SEQ ID NO: 185759 - DNA, 25 bp, Homo sapien
cgggactcttcgcttctgcagcata

SEQ ID NO: 185760 - DNA, 25 bp, Homo sapien
ttctgcagcatacagctggccgagg

SEQ ID NO: 185761 - DNA, 25 bp, Homo sapien
caacactggacggactggttgtcag

SEQ ID NO: 185762 - DNA, 25 bp, Homo sapien
tacgttcgtttaaggacttcagcgc

SEQ ID NO: 185763 - DNA, 25 bp, Homo sapien
ttcagcgcgaagaagagcgaacgtg

SEQ ID NO: 185764 - DNA, 25 bp, Homo sapien
cgaacgtggctagaacctgttgacc

SEQ ID NO: 185765 - DNA, 25 bp, Homo sapien
tgttgacctctcctctggcctggaa

SEQ ID NO: 185766 - DNA, 25 bp, Homo sapien
gtccgcacagctcgtggcaacactg

SEQ ID NO: 185767 - DNA, 25 bp, Homo sapien
ttggccttggcgcactaagcgctcc

SEQ ID NO: 185768 - DNA, 25 bp, Homo sapien
ggcgcacctcgcctggtgcagagtt

SEQ ID NO: 185769 - DNA, 25 bp, Homo sapien
accttggcctaatttgcagctaata

SEQ ID NO: 185770 - DNA, 25 bp, Homo sapien
ttgcaccgtaatcgccaaaaccttg

SEQ ID NO: 185771 - DNA, 25 bp, Homo sapien
agggactagaagaaggatgtgattc

SEQ ID NO: 185772 - DNA, 25 bp, Homo sapien
aggatgtgattcctattattctccc

SEQ ID NO: 185773 - DNA, 25 bp, Homo sapien
cagctaatagatctcgagcgaggga

SEQ ID NO: 185774 - DNA, 25 bp, Homo sapien
agtcgggaagaaaccagtggctttg

SEQ ID NO: 185775 - DNA, 25 bp, Homo sapien
tggctttggagggatcggaaattaa

SEQ ID NO: 185776 - DNA, 25 bp, Homo sapien
gtcgctcggtctgaattgcaccgta

SEQ ID NO: 185777 - DNA, 25 bp, Homo sapien
gcacacccttgggtgattacccggc

SEQ ID NO: 185778 - DNA, 25 bp, Homo sapien
tttgccaagaccgagcggaagccga

SEQ ID NO: 185779 - DNA, 25 bp, Homo sapien
gcccggagggacatttttgccaaga

SEQ ID NO: 185780 - DNA, 25 bp, Homo sapien
cccgtcacaggcgtttgcacatttg

SEQ ID NO: 185781 - DNA, 25 bp, Homo sapien
acatttgtgtgcacgaccactggcg

SEQ ID NO: 185782 - DNA, 25 bp, Homo sapien
ggcgttgagcctctgctagccgcct

SEQ ID NO: 185783 - DNA, 25 bp, Homo sapien
gggctccgcacacccttgggtgatt

SEQ ID NO: 185784 - DNA, 25 bp, Homo sapien
tggctgcgcctaggagttccgccac

SEQ ID NO: 185785 - DNA, 25 bp, Homo sapien
ctcggggttcctaaagcctctgagc

SEQ ID NO: 185786 - DNA, 25 bp, Homo sapien
tcagaagacctgtgcgttgcggctt

SEQ ID NO: 185787 - DNA, 25 bp, Homo sapien
cttctctgagggtttcgattacgga

SEQ ID NO: 185788 - DNA, 25 bp, Homo sapien
tccgggtgacgtacaattaggctgc

SEQ ID NO: 185789 - DNA, 25 bp, Homo sapien
cagcggccaccgagcaatgttaact

SEQ ID NO: 185790 - DNA, 25 bp, Homo sapien
cggaaaatcgggagcgctcagaccc

SEQ ID NO: 185791 - DNA, 25 bp, Homo sapien
ctcagacccacctaggcggagcggt

SEQ ID NO: 185792 - DNA, 25 bp, Homo sapien
tggcggcgtcattccagtttctgca

SEQ ID NO: 185793 - DNA, 25 bp, Homo sapien
cagcccgccctcagagttagctgga

SEQ ID NO: 185794 - DNA, 25 bp, Homo sapien
aggccgctggcaggctgctaattag

SEQ ID NO: 185795 - DNA, 25 bp, Homo sapien
aggctcgagctctatcggcgtccag

SEQ ID NO: 185796 - DNA, 25 bp, Homo sapien
taggggaccagcaacttccattttc

SEQ ID NO: 185797 - DNA, 25 bp, Homo sapien
cccgaggcagcctggctaggctagc

SEQ ID NO: 185798 - DNA, 25 bp, Homo sapien
cgcccgaacgtttccataaatcagg

SEQ ID NO: 185799 - DNA, 25 bp, Homo sapien
gtttccataaatcaggccgctggca

SEQ ID NO: 185800 - DNA, 25 bp, Homo sapien
cccagctcgggcataggaggctcga

SEQ ID NO: 185801 - DNA, 25 bp, Homo sapien
gacgcgaagataatcctgccatctg

SEQ ID NO: 185802 - DNA, 25 bp, Homo sapien
tccgaggtgccaggaactccggtaa

SEQ ID NO: 185803 - DNA, 25 bp, Homo sapien
gtatttcaaagaaaccagcgcggtc

SEQ ID NO: 185804 - DNA, 25 bp, Homo sapien
tgccatctggcaaatcccaaatttg

SEQ ID NO: 185805 - DNA, 25 bp, Homo sapien
ttggtgaccaagctcggaaagcaac

SEQ ID NO: 185806 - DNA, 25 bp, Homo sapien
cggaaagcaacagcgacggctcatc

SEQ ID NO: 185807 - DNA, 25 bp, Homo sapien
tggtcctgccggactctccggagct

SEQ ID NO: 185808 - DNA, 25 bp, Homo sapien
caaagagggaacatgcgtgtatttc

SEQ ID NO: 185809 - DNA, 25 bp, Homo sapien
ctggtatcaagaaacgcgccaggcg

SEQ ID NO: 185810 - DNA, 25 bp, Homo sapien
gccactggtatcaagaaacgcgcca

SEQ ID NO: 185811 - DNA, 25 bp, Homo sapien
ggggcgccactggtatcaagaaacg

SEQ ID NO: 185812 - DNA, 25 bp, Homo sapien
ctcctgacccgacacgctggttgtg

SEQ ID NO: 185813 - DNA, 25 bp, Homo sapien
ccgagtgcaaccttcttatctgctc

SEQ ID NO: 185814 - DNA, 25 bp, Homo sapien
cagctcgctcctgtctggctggccc

SEQ ID NO: 185815 - DNA, 25 bp, Homo sapien
ccgtcaggagctgtatcaagggctg

SEQ ID NO: 185816 - DNA, 25 bp, Homo sapien
tcgccgcacagtctgctccggggcc

SEQ ID NO: 185817 - DNA, 25 bp, Homo sapien
cagccttggcaagacctctccggaa

SEQ ID NO: 185818 - DNA, 25 bp, Homo sapien
gagcccgacgttggggctccttgct

SEQ ID NO: 185819 - DNA, 25 bp, Homo sapien
tccgttgatttggacgctgggaagc

SEQ ID NO: 185820 - DNA, 25 bp, Homo sapien
cctctccggaaacatactcgcgtta

SEQ ID NO: 185821 - DNA, 25 bp, Homo sapien
ctcgcgttaaggaactgggaaagct

SEQ ID NO: 185822 - DNA, 25 bp, Homo sapien
agtgagacgctcagtcctgtgctcc

SEQ ID NO: 185823 - DNA, 25 bp, Homo sapien
ggctccttgctgagtgagacgctca

SEQ ID NO: 185824 - DNA, 25 bp, Homo sapien
ctccctctctccgttgatttggacg

SEQ ID NO: 185825 - DNA, 25 bp, Homo sapien
ccagcggcttttcggtctaaatatc

SEQ ID NO: 185826 - DNA, 25 bp, Homo sapien
taaaggaaggtctacgtccgcgctc

SEQ ID NO: 185827 - DNA, 25 bp, Homo sapien
tttcagcctggccttagctaaggga

SEQ ID NO: 185828 - DNA, 25 bp, Homo sapien
tgcagcagcctcagttatgtttttg

SEQ ID NO: 185829 - DNA, 25 bp, Homo sapien
tcgcgagaacttacttttggccatc

SEQ ID NO: 185830 - DNA, 25 bp, Homo sapien
ggccatcgcacgagcaagtttattc

SEQ ID NO: 185831 - DNA, 25 bp, Homo sapien
caagactcgcgataaccctctgggg

SEQ ID NO: 185832 - DNA, 25 bp, Homo sapien
aggagggatcactgtcttacctgca

SEQ ID NO: 185833 - DNA, 25 bp, Homo sapien
tctggacttcaactcccgacggaaa

SEQ ID NO: 185834 - DNA, 25 bp, Homo sapien
ttgcaagacagagcgaacacggctt

SEQ ID NO: 185835 - DNA, 25 bp, Homo sapien
tgacaggtgttagcaggactccaga

SEQ ID NO: 185836 - DNA, 25 bp, Homo sapien
tcagttgaaaagagaaccgccgccc

SEQ ID NO: 185837 - DNA, 25 bp, Homo sapien
tcctttgctcggctgtcagttgaaa

SEQ ID NO: 185838 - DNA, 25 bp, Homo sapien
cactgccggtcccacaggagttaaa

SEQ ID NO: 185839 - DNA, 25 bp, Homo sapien
cgcctgagcagcacgtgtgtacgca

SEQ ID NO: 185840 - DNA, 25 bp, Homo sapien
ctctcgttttgaggaacgcgcctga

SEQ ID NO: 185841 - DNA, 25 bp, Homo sapien
caccgacggcacttaggagagctta

SEQ ID NO: 185842 - DNA, 25 bp, Homo sapien
tactatttgagtggcaggcgacgcc

SEQ ID NO: 185843 - DNA, 25 bp, Homo sapien
cttgcgggtgtcagtttcaggtaaa

SEQ ID NO: 185844 - DNA, 25 bp, Homo sapien
taccggggcagccagattactacct

SEQ ID NO: 185845 - DNA, 25 bp, Homo sapien
gatccgcggactctcgaaccctaaa

SEQ ID NO: 185846 - DNA, 25 bp, Homo sapien
gacgcccagattggatcggttccga

SEQ ID NO: 185847 - DNA, 25 bp, Homo sapien
cccggcgagttatttcaacagactg

SEQ ID NO: 185848 - DNA, 25 bp, Homo sapien
cgccgggtcacccatgacaaatgtc

SEQ ID NO: 185849 - DNA, 25 bp, Homo sapien
cgggacacacgttccactcagatgg

SEQ ID NO: 185850 - DNA, 25 bp, Homo sapien
ctgcgcttagcagagcctgtttgcc

SEQ ID NO: 185851 - DNA, 25 bp, Homo sapien
ggagcagccctgctaactgagaagg

SEQ ID NO: 185852 - DNA, 25 bp, Homo sapien
ggggagcactttacaaacaccatta

SEQ ID NO: 185853 - DNA, 25 bp, Homo sapien
cagcacctggtgtcagcggctaatt

SEQ ID NO: 185854 - DNA, 25 bp, Homo sapien
ttttaaggtggcgtgttagaccagc

SEQ ID NO: 185855 - DNA, 25 bp, Homo sapien
ctcagatggacgcacgcacagatga

SEQ ID NO: 185856 - DNA, 25 bp, Homo sapien
cgtcctctgacacgggctcggatta

SEQ ID NO: 185857 - DNA, 25 bp, Homo sapien
gagccacagtggacgcatgcggcca

SEQ ID NO: 185858 - DNA, 25 bp, Homo sapien
ccacagtggacgcatgcggccagag

SEQ ID NO: 185859 - DNA, 25 bp, Homo sapien
cacagtggacgcatgcggccagaga

SEQ ID NO: 185860 - DNA, 25 bp, Homo sapien
gaaaggtgagctcaggcgtgcgggt

SEQ ID NO: 185861 - DNA, 25 bp, Homo sapien
cagtggacgcatgcggccagagagc

SEQ ID NO: 185862 - DNA, 25 bp, Homo sapien
agccacagtggacgcatgcggccag

SEQ ID NO: 185863 - DNA, 25 bp, Homo sapien
agccggaaaggtgagctcaggcgtg

SEQ ID NO: 185864 - DNA, 25 bp, Homo sapien
ccagagagccggaaaggtgagctca

SEQ ID NO: 185865 - DNA, 25 bp, Homo sapien
gtggagtacctgaacgtgcgcctca

SEQ ID NO: 185866 - DNA, 25 bp, Homo sapien
gctgtcttctcggaggtggagtacc

SEQ ID NO: 185867 - DNA, 25 bp, Homo sapien
cgagcgcaagggctgctattccagc

SEQ ID NO: 185868 - DNA, 25 bp, Homo sapien
ttgttaaagcgacaggcctctcggc

SEQ ID NO: 185869 - DNA, 25 bp, Homo sapien
cgtgggagcgccaatgaaatgactc

SEQ ID NO: 185870 - DNA, 25 bp, Homo sapien
gattggccaacactccctgatcacg

SEQ ID NO: 185871 - DNA, 25 bp, Homo sapien
ccagtaaacggcctgtgcacgtgca

SEQ ID NO: 185872 - DNA, 25 bp, Homo sapien
gatactgtttcccactgtctgtcca

SEQ ID NO: 185873 - DNA, 25 bp, Homo sapien
ctcacagcggcacgttgtttttaca

SEQ ID NO: 185874 - DNA, 25 bp, Homo sapien
tatagcgggattctcagctctcctg

SEQ ID NO: 185875 - DNA, 25 bp, Homo sapien
gctgccgcctcagtaagagaagtca

SEQ ID NO: 185876 - DNA, 25 bp, Homo sapien
caggttagctatcgctgccgcctca

SEQ ID NO: 185877 - DNA, 25 bp, Homo sapien
gcggccttgggagcttcttaaacaa

SEQ ID NO: 185878 - DNA, 25 bp, Homo sapien
ccgggagccgataggaaagtgcaac

SEQ ID NO: 185879 - DNA, 25 bp, Homo sapien
ggctgcacatcgtttcccgggcatc

SEQ ID NO: 185880 - DNA, 25 bp, Homo sapien
aaaacgtgttccctccgatgcgtgg

SEQ ID NO: 185881 - DNA, 25 bp, Homo sapien
atggggagaacgtagttccacgttg

SEQ ID NO: 185882 - DNA, 25 bp, Homo sapien
cgcagagtttctagctgcagctaaa

SEQ ID NO: 185883 - DNA, 25 bp, Homo sapien
aggccgagcgcccttggattctgtg

SEQ ID NO: 185884 - DNA, 25 bp, Homo sapien
ttccacgttggcacagatgagctgt

SEQ ID NO: 185885 - DNA, 25 bp, Homo sapien
gagtccgcgctctccgcaagtctgt

SEQ ID NO: 185886 - DNA, 25 bp, Homo sapien
ctttggtttgggcaaggctgccatc

SEQ ID NO: 185887 - DNA, 25 bp, Homo sapien
tccgcaagtctgtcctgagatcgcc

SEQ ID NO: 185888 - DNA, 25 bp, Homo sapien
ctgtttacatcgaggcggacgagca

SEQ ID NO: 185889 - DNA, 25 bp, Homo sapien
tccgcgaagggcaggcgttacataa

SEQ ID NO: 185890 - DNA, 25 bp, Homo sapien
ggcgttacataaacccggcgagctc

SEQ ID NO: 185891 - DNA, 25 bp, Homo sapien
tccgcgattcggacatgacacggtc

SEQ ID NO: 185892 - DNA, 25 bp, Homo sapien
cggtaaaggagctcgtgcaaactta

SEQ ID NO: 185893 - DNA, 25 bp, Homo sapien
gaggagccttcagcgttacggtaaa

SEQ ID NO: 185894 - DNA, 25 bp, Homo sapien
tgtcactcggggatgactaagagcc

SEQ ID NO: 185895 - DNA, 25 bp, Homo sapien
ttccagcccaaatcagaggcggtcg

SEQ ID NO: 185896 - DNA, 25 bp, Homo sapien
ggtgggtttccttgactccgcataa

SEQ ID NO: 185897 - DNA, 25 bp, Homo sapien
catcaccggggcaattcagaaaggc

SEQ ID NO: 185898 - DNA, 25 bp, Homo sapien
tcgcgtgtttactgccgagtgggac

SEQ ID NO: 185899 - DNA, 25 bp, Homo sapien
gcaggtggtgccgattaactttgaa

SEQ ID NO: 185900 - DNA, 25 bp, Homo sapien
gtgtggcttactggtacattcaaga

SEQ ID NO: 185901 - DNA, 25 bp, Homo sapien
gcacttcctttgtacgtagttaata

SEQ ID NO: 185902 - DNA, 25 bp, Homo sapien
ggagccgacgtgcattccgacacac

SEQ ID NO: 185903 - DNA, 25 bp, Homo sapien
cctcagcttgtctcttccggggagc

SEQ ID NO: 185904 - DNA, 25 bp, Homo sapien
gtgtcgctccacattcgctgtcttt

SEQ ID NO: 185905 - DNA, 25 bp, Homo sapien
tagggtcggtactggtttccagtca

SEQ ID NO: 185906 - DNA, 25 bp, Homo sapien
tttccagtcacttacgtagcaaacg

SEQ ID NO: 185907 - DNA, 25 bp, Homo sapien
cagtagccgctgatcccgagtgcat

SEQ ID NO: 185908 - DNA, 25 bp, Homo sapien
ccacgttcgggctttccagtacgca

SEQ ID NO: 185909 - DNA, 25 bp, Homo sapien
aatgccgcatgcacgcatttattta

SEQ ID NO: 185910 - DNA, 25 bp, Homo sapien
gctgcaagaaacaatgaagcttttc

SEQ ID NO: 185911 - DNA, 25 bp, Homo sapien
ggaaacgcgctttccagccgcgctg

SEQ ID NO: 185912 - DNA, 25 bp, Homo sapien
gccgcgctgttgttgttttcaatga

SEQ ID NO: 185913 - DNA, 25 bp, Homo sapien
gaaacccgagttgccaccgtcgcag

SEQ ID NO: 185914 - DNA, 25 bp, Homo sapien
tgcgccctgtttgcgaaacccgagt

SEQ ID NO: 185915 - DNA, 25 bp, Homo sapien
tggagaaagtgagtatgtgcccgcc

SEQ ID NO: 185916 - DNA, 25 bp, Homo sapien
gcgccgccttcggagtattgtttcc

SEQ ID NO: 185917 - DNA, 25 bp, Homo sapien
ctgcctctccgggtttgaaaatgga

SEQ ID NO: 185918 - DNA, 25 bp, Homo sapien
tttcctcgcctaggcagatttgggc

SEQ ID NO: 185919 - DNA, 25 bp, Homo sapien
ggggagccgctcattcattttgact

SEQ ID NO: 185920 - DNA, 25 bp, Homo sapien
ggacttcggggcgatcttgcgaact

SEQ ID NO: 185921 - DNA, 25 bp, Homo sapien
ggccaggcatcgacatccgcaacga

SEQ ID NO: 185922 - DNA, 25 bp, Homo sapien
aactgcacggtgatcgagggctacc

SEQ ID NO: 185923 - DNA, 25 bp, Homo sapien
gatcgagggctacctccacatcctg

SEQ ID NO: 185924 - DNA, 25 bp, Homo sapien
gctcacggtcattaccgagtacttg

SEQ ID NO: 185925 - DNA, 25 bp, Homo sapien
cattaccgagtacttgctgctgttc

SEQ ID NO: 185926 - DNA, 25 bp, Homo sapien
agtacttgctgctgttccgagtggc

SEQ ID NO: 185927 - DNA, 25 bp, Homo sapien
atccgcaacgactatcagcagctga

SEQ ID NO: 185928 - DNA, 25 bp, Homo sapien
actatcagcagctgaagcgcctgga

SEQ ID NO: 185929 - DNA, 25 bp, Homo sapien
tccctactcagcctcccgcgaggca

SEQ ID NO: 185930 - DNA, 25 bp, Homo sapien
agcccgttaggatcgcggctgcagc

SEQ ID NO: 185931 - DNA, 25 bp, Homo sapien
ggcgtctcgcgagcccgttaggatc

SEQ ID NO: 185932 - DNA, 25 bp, Homo sapien
ccggtctcccgcaagatggagccgg

SEQ ID NO: 185933 - DNA, 25 bp, Homo sapien
cgagggcaagaccaccgaggcagac

SEQ ID NO: 185934 - DNA, 25 bp, Homo sapien
tacgagacgcgcaaaccgagtcgcc

SEQ ID NO: 185935 - DNA, 25 bp, Homo sapien
gcagcccggctacgagacgcgcaaa

SEQ ID NO: 185936 - DNA, 25 bp, Homo sapien
actgcccgtgcgtttccctactcag

SEQ ID NO: 185937 - DNA, 25 bp, Homo sapien
ctgaggctccttttgtctggcgcgc

SEQ ID NO: 185938 - DNA, 25 bp, Homo sapien
aggagtattagggaggcgatcacca

SEQ ID NO: 185939 - DNA, 25 bp, Homo sapien
atcccgcaaggatgcagcaggagta

SEQ ID NO: 185940 - DNA, 25 bp, Homo sapien
ctgtcagtcaagtgggcatcccgca

SEQ ID NO: 185941 - DNA, 25 bp, Homo sapien
aatcgctgcgttgggaaattccacc

SEQ ID NO: 185942 - DNA, 25 bp, Homo sapien
cgaataacacgccaatcaccagggc

SEQ ID NO: 185943 - DNA, 25 bp, Homo sapien
ccgccgtcgctgcagttgtaaacac

SEQ ID NO: 185944 - DNA, 25 bp, Homo sapien
tgtttactactttccactccgaata

SEQ ID NO: 185945 - DNA, 25 bp, Homo sapien
gtggaccgtgacttctgcgccaaca

SEQ ID NO: 185946 - DNA, 25 bp, Homo sapien
ggcttcatccgcaacggcagccaga

SEQ ID NO: 185947 - DNA, 25 bp, Homo sapien
gtcgcggccacacgtgtggtcacta

SEQ ID NO: 185948 - DNA, 25 bp, Homo sapien
tttgtgatccacgacggcgagtgca

SEQ ID NO: 185949 - DNA, 25 bp, Homo sapien
gccactactactatgccggtgtctg

SEQ ID NO: 185950 - DNA, 25 bp, Homo sapien
cctgtgtagcttgccgccactacta

SEQ ID NO: 185951 - DNA, 25 bp, Homo sapien
gcctgacaacgacacggcctgtgta

SEQ ID NO: 185952 - DNA, 25 bp, Homo sapien
ccgagaacaatgagtgctgccaccc

SEQ ID NO: 185953 - DNA, 25 bp, Homo sapien
ctcaggacacaaggccgagaacggc

SEQ ID NO: 185954 - DNA, 25 bp, Homo sapien
caaacagtaacgtgtgcgcacgcgc

SEQ ID NO: 185955 - DNA, 25 bp, Homo sapien
tgctgatccttggatcctgaatctg

SEQ ID NO: 185956 - DNA, 25 bp, Homo sapien
gccgcaagaacgagcgggccttgcc

SEQ ID NO: 185957 - DNA, 25 bp, Homo sapien
ggatcctgaatctgtgcaaacagta

SEQ ID NO: 185958 - DNA, 25 bp, Homo sapien
tgcccgacagacactcaggacacaa

SEQ ID NO: 185959 - DNA, 25 bp, Homo sapien
ccgcgccagcttcgacgagagacag

SEQ ID NO: 185960 - DNA, 25 bp, Homo sapien
gagagacagccttacgcccacatga

SEQ ID NO: 185961 - DNA, 25 bp, Homo sapien
ctccagcacgtctgggctgccaggt

SEQ ID NO: 185962 - DNA, 25 bp, Homo sapien
ttgcagactgccttcatgcagaccc

SEQ ID NO: 185963 - DNA, 25 bp, Homo sapien
acatgcacgacgagctgtgtgaacg

SEQ ID NO: 185964 - DNA, 25 bp, Homo sapien
ccagaagctgcggatgtcggcgtcc

SEQ ID NO: 185965 - DNA, 25 bp, Homo sapien
cccggtagccttggttcttgccaga

SEQ ID NO: 185966 - DNA, 25 bp, Homo sapien
agactgttccagaatgatcgccttg

SEQ ID NO: 185967 - DNA, 25 bp, Homo sapien
ggcggtgtccatgcccacatgcacg

SEQ ID NO: 185968 - DNA, 25 bp, Homo sapien
acagctacgcgcttgcagactgcct

SEQ ID NO: 185969 - DNA, 25 bp, Homo sapien
cgcactcaccctcgggagcgtttaa

SEQ ID NO: 185970 - DNA, 25 bp, Homo sapien
ttggccctatctccagaaaaccagg

SEQ ID NO: 185971 - DNA, 25 bp, Homo sapien
ctcggataggagcaagagtagcgcc

SEQ ID NO: 185972 - DNA, 25 bp, Homo sapien
tgtgagaatgagacccgtttcccga

SEQ ID NO: 185973 - DNA, 25 bp, Homo sapien
tcaatggctcgacctgccggaaagc

SEQ ID NO: 185974 - DNA, 25 bp, Homo sapien
acctgttgttgcctcgggactgaac

SEQ ID NO: 185975 - DNA, 25 bp, Homo sapien
ccttctccttgtggggacatgtggc

SEQ ID NO: 185976 - DNA, 25 bp, Homo sapien
agcgcccttggatgctgagaaagtg

SEQ ID NO: 185977 - DNA, 25 bp, Homo sapien
ggctgatgacccaacgccgcaggca

SEQ ID NO: 185978 - DNA, 25 bp, Homo sapien
tcggcaacaaccgagcacattgttc

SEQ ID NO: 185979 - DNA, 25 bp, Homo sapien
caggcatccgaggataacctttccc

SEQ ID NO: 185980 - DNA, 25 bp, Homo sapien
aacgccgcaggcatccgaggataac

SEQ ID NO: 185981 - DNA, 25 bp, Homo sapien
gctgacagtcggcaacaaccgagca

SEQ ID NO: 185982 - DNA, 25 bp, Homo sapien
ccaggcccgcggcagttaggccaag

SEQ ID NO: 185983 - DNA, 25 bp, Homo sapien
cctacgcgcctgttttccagcggcc

SEQ ID NO: 185984 - DNA, 25 bp, Homo sapien
tgcccagcctcggaaccctggcatc

SEQ ID NO: 185985 - DNA, 25 bp, Homo sapien
cctcctgcttcttggactttggtga

SEQ ID NO: 185986 - DNA, 25 bp, Homo sapien
gggaaagactcgctattcccgcttc

SEQ ID NO: 185987 - DNA, 25 bp, Homo sapien
tggactttggtgaaattgtggctgc

SEQ ID NO: 185988 - DNA, 25 bp, Homo sapien
acggcgccgctcaagcgaaggctca

SEQ ID NO: 185989 - DNA, 25 bp, Homo sapien
gctacatcccggagttcggttttca

SEQ ID NO: 185990 - DNA, 25 bp, Homo sapien
tcggttttcactggaaacgacacca

SEQ ID NO: 185991 - DNA, 25 bp, Homo sapien
caggtcctccgagtcgggaaagact

SEQ ID NO: 185992 - DNA, 25 bp, Homo sapien
tggagcgcaggccacaccgtgccag

SEQ ID NO: 185993 - DNA, 25 bp, Homo sapien
ctctatgactacgtgtgtcgggtgc

SEQ ID NO: 185994 - DNA, 25 bp, Homo sapien
cccacgaacgcgacgtgagggagct

SEQ ID NO: 185995 - DNA, 25 bp, Homo sapien
cgggaggtgcacgacagctacgcac

SEQ ID NO: 185996 - DNA, 25 bp, Homo sapien
acagctacgcactgctggtggccga

SEQ ID NO: 185997 - DNA, 25 bp, Homo sapien
gacgcggcccacgaacgcgacgtga

SEQ ID NO: 185998 - DNA, 25 bp, Homo sapien
acgagaccgggacaagaccagggca

SEQ ID NO: 185999 - DNA, 25 bp, Homo sapien
caacgcccggctctatgactacgtg

SEQ ID NO: 186000 - DNA, 25 bp, Homo sapien
ccggcaagatgctgtcctggcggct

SEQ ID NO: 186001 - DNA, 25 bp, Homo sapien
ctgtccgcctcgtcgggtgattcaa

SEQ ID NO: 186002 - DNA, 25 bp, Homo sapien
cctatcgtgaaagcgcgagaacaca

SEQ ID NO: 186003 - DNA, 25 bp, Homo sapien
gcaaacgagcattttcccgcgccta

SEQ ID NO: 186004 - DNA, 25 bp, Homo sapien
tctcggccaatacacagatcgcttg

SEQ ID NO: 186005 - DNA, 25 bp, Homo sapien
taccgggtccgtgaaatccctgctg

SEQ ID NO: 186006 - DNA, 25 bp, Homo sapien
tgggctcgctgcttcccaactgtaa

SEQ ID NO: 186007 - DNA, 25 bp, Homo sapien
aacgatctcagtggctggctaactc

SEQ ID NO: 186008 - DNA, 25 bp, Homo sapien
attcaagtggcgaggctctctgacc

SEQ ID NO: 186009 - DNA, 25 bp, Homo sapien
atggcggaccctctttccctacaga

SEQ ID NO: 186010 - DNA, 25 bp, Homo sapien
ggtttcgtccacctctcacctttga

SEQ ID NO: 186011 - DNA, 25 bp, Homo sapien
gggccaaagccgaggtgatttctga

SEQ ID NO: 186012 - DNA, 25 bp, Homo sapien
cctacagaggggctaagaccggcat

SEQ ID NO: 186013 - DNA, 25 bp, Homo sapien
gcgccgctttgacaggccgagtgaa

SEQ ID NO: 186014 - DNA, 25 bp, Homo sapien
ccggcaagccagaagtgcagctgtc

SEQ ID NO: 186015 - DNA, 25 bp, Homo sapien
acacagctagctcttcaggccaggc

SEQ ID NO: 186016 - DNA, 25 bp, Homo sapien
atttctgactgctcactggcgggcc

SEQ ID NO: 186017 - DNA, 25 bp, Homo sapien
aacccaccgagaggataattcagtc

SEQ ID NO: 186018 - DNA, 25 bp, Homo sapien
gtgactctctttgccctacccttgt

SEQ ID NO: 186019 - DNA, 25 bp, Homo sapien
ccgggccctcatcaagtgaccagta

SEQ ID NO: 186020 - DNA, 25 bp, Homo sapien
ttccaggggaacacggtccttcaga

SEQ ID NO: 186021 - DNA, 25 bp, Homo sapien
gtccttcagaggaaagcgagctcca

SEQ ID NO: 186022 - DNA, 25 bp, Homo sapien
ctggccgaggcttgtctcctaaaaa

SEQ ID NO: 186023 - DNA, 25 bp, Homo sapien
tccttgtggaatagcgcccgcttcc

SEQ ID NO: 186024 - DNA, 25 bp, Homo sapien
gcacgcgcagcacagaacgagttcc

SEQ ID NO: 186025 - DNA, 25 bp, Homo sapien
gcggagagctcatcccgggaccaca

SEQ ID NO: 186026 - DNA, 25 bp, Homo sapien
cctaacattccagagggcagaacct

SEQ ID NO: 186027 - DNA, 25 bp, Homo sapien
ttctgcgaaaagatggggcacctca

SEQ ID NO: 186028 - DNA, 25 bp, Homo sapien
cctccaagtcccttctgcgaaaaga

SEQ ID NO: 186029 - DNA, 25 bp, Homo sapien
aacgaaatctcaaacacgcgggctg

SEQ ID NO: 186030 - DNA, 25 bp, Homo sapien
ccctggcttgttttcgcgtctgttc

SEQ ID NO: 186031 - DNA, 25 bp, Homo sapien
cacgcgggctgacaacttcagaaaa

SEQ ID NO: 186032 - DNA, 25 bp, Homo sapien
cgcctgcggattggctacgaacatc

SEQ ID NO: 186033 - DNA, 25 bp, Homo sapien
gctctgagaagcagcatctcgtcgc

SEQ ID NO: 186034 - DNA, 25 bp, Homo sapien
tgagagcctctttcagcacgtggtg

SEQ ID NO: 186035 - DNA, 25 bp, Homo sapien
agagcctctttcagcacgtggtgca

SEQ ID NO: 186036 - DNA, 25 bp, Homo sapien
caggagtgtcttcttgtccctacgc

SEQ ID NO: 186037 - DNA, 25 bp, Homo sapien
gtcttcttgtccctacgcgagtgca

SEQ ID NO: 186038 - DNA, 25 bp, Homo sapien
agcagctctgagaagcagcatctcg

SEQ ID NO: 186039 - DNA, 25 bp, Homo sapien
tgagtgtcttctcgttcccacgcga

SEQ ID NO: 186040 - DNA, 25 bp, Homo sapien
tgtccctacgcgagtgcaggttgga

SEQ ID NO: 186041 - DNA, 25 bp, Homo sapien
gggaaaaggcctctgagatgctcgc

SEQ ID NO: 186042 - DNA, 25 bp, Homo sapien
ccaacggcagcctaacgggtagagg

SEQ ID NO: 186043 - DNA, 25 bp, Homo sapien
agtctcgggaccaacggcagcctaa

SEQ ID NO: 186044 - DNA, 25 bp, Homo sapien
tccctgtcagggttaaggccaagct

SEQ ID NO: 186045 - DNA, 25 bp, Homo sapien
ggaagatgtccctgtcagggttaag

SEQ ID NO: 186046 - DNA, 25 bp, Homo sapien
ccgcgctcccacgaaggttgaggcg

SEQ ID NO: 186047 - DNA, 25 bp, Homo sapien
cctatcggtggcgtcggtcgcaaag

SEQ ID NO: 186048 - DNA, 25 bp, Homo sapien
catccgcgctcccacgaaggttgag

SEQ ID NO: 186049 - DNA, 25 bp, Homo sapien
caggtactggctaagtgcgcgccag

SEQ ID NO: 186050 - DNA, 25 bp, Homo sapien
cgcaggtactggctaagtgcgcgcc

SEQ ID NO: 186051 - DNA, 25 bp, Homo sapien
cacgcgcaggtactggctaagtgcg

SEQ ID NO: 186052 - DNA, 25 bp, Homo sapien
gtgcacgcgcaggtactggctaagt

SEQ ID NO: 186053 - DNA, 25 bp, Homo sapien
cgttgaacgccgaggtgcacgcgca

SEQ ID NO: 186054 - DNA, 25 bp, Homo sapien
caaaggccgcgttgaacgccgaggt

SEQ ID NO: 186055 - DNA, 25 bp, Homo sapien
cgcaaaggccgcgttgaacgccgag

SEQ ID NO: 186056 - DNA, 25 bp, Homo sapien
tactggctaagtgcgcgccagggtg

SEQ ID NO: 186057 - DNA, 25 bp, Homo sapien
agtccgggcgccatgggtcgtagcc

SEQ ID NO: 186058 - DNA, 25 bp, Homo sapien
cggacatcggagaaatccaaccgca

SEQ ID NO: 186059 - DNA, 25 bp, Homo sapien
atcggagaaatccaaccgcagctgc

SEQ ID NO: 186060 - DNA, 25 bp, Homo sapien
gagaaatccaaccgcagctgccagc

SEQ ID NO: 186061 - DNA, 25 bp, Homo sapien
ccatgggtcgtagccgctggtcgtc

SEQ ID NO: 186062 - DNA, 25 bp, Homo sapien
cgtagccgctggtcgtcccgggaag

SEQ ID NO: 186063 - DNA, 25 bp, Homo sapien
cggggcagtgaagggcgatatggac

SEQ ID NO: 186064 - DNA, 25 bp, Homo sapien
cggagaaatccaaccgcagctgcca

SEQ ID NO: 186065 - DNA, 25 bp, Homo sapien
cctgcactgcggcacggagagaaat

SEQ ID NO: 186066 - DNA, 25 bp, Homo sapien
gccagcaggctgctctcaccgtaga

SEQ ID NO: 186067 - DNA, 25 bp, Homo sapien
ccagttttccactcgtagcagcctg

SEQ ID NO: 186068 - DNA, 25 bp, Homo sapien
cgtagcagcctgagtagtcctcgca

SEQ ID NO: 186069 - DNA, 25 bp, Homo sapien
ggatgcgtcgcatttcccttgtgag

SEQ ID NO: 186070 - DNA, 25 bp, Homo sapien
tcccttgtgagttggtgcacgccac

SEQ ID NO: 186071 - DNA, 25 bp, Homo sapien
cccgtcacaagagctgagttcccga

SEQ ID NO: 186072 - DNA, 25 bp, Homo sapien
gccgcgtagaattgggacccgtcac

SEQ ID NO: 186073 - DNA, 25 bp, Homo sapien
tcatgagagacgctcagcccgtggg

SEQ ID NO: 186074 - DNA, 25 bp, Homo sapien
atctacgagagacactcagcccgtg

SEQ ID NO: 186075 - DNA, 25 bp, Homo sapien
gctcagcccgtgagaatctacgaga

SEQ ID NO: 186076 - DNA, 25 bp, Homo sapien
gacgctcagcccgtgagaatctacg

SEQ ID NO: 186077 - DNA, 25 bp, Homo sapien
ctatgagagacgctcagcccgtgag

SEQ ID NO: 186078 - DNA, 25 bp, Homo sapien
tgagaaactatgagagacgctcagc

SEQ ID NO: 186079 - DNA, 25 bp, Homo sapien
tgggaaactacgagacacgctcacc

SEQ ID NO: 186080 - DNA, 25 bp, Homo sapien
ccgtgggaaactacgagacacgctc

SEQ ID NO: 186081 - DNA, 25 bp, Homo sapien
cagcagggcgccgtcacacatggta

SEQ ID NO: 186082 - DNA, 25 bp, Homo sapien
cacggcccgagtagaagcacagctc

SEQ ID NO: 186083 - DNA, 25 bp, Homo sapien
tggccgagcacacggcccgagtaga

SEQ ID NO: 186084 - DNA, 25 bp, Homo sapien
tcgaagcctcgggacaggaagcgca

SEQ ID NO: 186085 - DNA, 25 bp, Homo sapien
ccacctcgaagcctcgggacaggaa

SEQ ID NO: 186086 - DNA, 25 bp, Homo sapien
cgggagcaccacctccacgtcggcc

SEQ ID NO: 186087 - DNA, 25 bp, Homo sapien
tcacacatggtacccgggaccggca

SEQ ID NO: 186088 - DNA, 25 bp, Homo sapien
gctgaaggtacaggtcgcgcccgaa

SEQ ID NO: 186089 - DNA, 25 bp, Homo sapien
ttaaatacaggcgtttcggcctagc

SEQ ID NO: 186090 - DNA, 25 bp, Homo sapien
gcgtttcggcctagctgccgccggt

SEQ ID NO: 186091 - DNA, 25 bp, Homo sapien
cccttgtggggatattgcagaacga

SEQ ID NO: 186092 - DNA, 25 bp, Homo sapien
ctcagtcaggcccttgtggggatat

SEQ ID NO: 186093 - DNA, 25 bp, Homo sapien
tgggaatggccactgtccagaaagc

SEQ ID NO: 186094 - DNA, 25 bp, Homo sapien
ctgcctggctctgggaatggccact

SEQ ID NO: 186095 - DNA, 25 bp, Homo sapien
tgcagaacgagtccgagttactatc

SEQ ID NO: 186096 - DNA, 25 bp, Homo sapien
tggcggcgtccgcttcaccgggaac

SEQ ID NO: 186097 - DNA, 25 bp, Homo sapien
gcttcaaggcgtttcacgggtgtcc

SEQ ID NO: 186098 - DNA, 25 bp, Homo sapien
tccgtggggtatctctccggaaaga

SEQ ID NO: 186099 - DNA, 25 bp, Homo sapien
cgccacggccatttaggacccaggt

SEQ ID NO: 186100 - DNA, 25 bp, Homo sapien
cccaatgtagcctggtccctttatc

SEQ ID NO: 186101 - DNA, 25 bp, Homo sapien
taaccgccgcggctgctatagctac

SEQ ID NO: 186102 - DNA, 25 bp, Homo sapien
tctcgcgacactttccttggccatg

SEQ ID NO: 186103 - DNA, 25 bp, Homo sapien
tctcgcgatagcactgtttaaaatg

SEQ ID NO: 186104 - DNA, 25 bp, Homo sapien
gcatctcaagagtgtccgtggggta

SEQ ID NO: 186105 - DNA, 25 bp, Homo sapien
agggaaggtcgtcctcacgcgctcc

SEQ ID NO: 186106 - DNA, 25 bp, Homo sapien
tggaagccgcttccgtgcagcccgg

SEQ ID NO: 186107 - DNA, 25 bp, Homo sapien
cggcaggacttgaaccggcgcctgc

SEQ ID NO: 186108 - DNA, 25 bp, Homo sapien
ttgaaccggcgcctgctctcgcgga

SEQ ID NO: 186109 - DNA, 25 bp, Homo sapien
tttatcgtggataaaacgcagtccc

SEQ ID NO: 186110 - DNA, 25 bp, Homo sapien
accttcaggtggacacacggggcct

SEQ ID NO: 186111 - DNA, 25 bp, Homo sapien
ctttctcgggaaatggtttatcgtg

SEQ ID NO: 186112 - DNA, 25 bp, Homo sapien
tttcagagccgcgagtaggccctga

SEQ ID NO: 186113 - DNA, 25 bp, Homo sapien
ctggagcgctcctaacggactttgc

SEQ ID NO: 186114 - DNA, 25 bp, Homo sapien
cggactttgcaaggcccagtacacg

SEQ ID NO: 186115 - DNA, 25 bp, Homo sapien
ccaggacaccatctgtgcgagcacg

SEQ ID NO: 186116 - DNA, 25 bp, Homo sapien
cctgggcgcccttttcaggtactgc

SEQ ID NO: 186117 - DNA, 25 bp, Homo sapien
caccatcactcgtgactgggtgaga

SEQ ID NO: 186118 - DNA, 25 bp, Homo sapien
taagcggctcacctgcgctgcacag

SEQ ID NO: 186119 - DNA, 25 bp, Homo sapien
tgcacagctggtacccgggactgct

SEQ ID NO: 186120 - DNA, 25 bp, Homo sapien
cacctgggccttccgtgattccgaa

SEQ ID NO: 186121 - DNA, 25 bp, Homo sapien
attccttccggacgcagatgaggga

SEQ ID NO: 186122 - DNA, 25 bp, Homo sapien
gatgacttccttccggacgcagatg

SEQ ID NO: 186123 - DNA, 25 bp, Homo sapien
gacttccttccggacgcagatgagg

SEQ ID NO: 186124 - DNA, 25 bp, Homo sapien
acttccttccggacgcagatgagcg

SEQ ID NO: 186125 - DNA, 25 bp, Homo sapien
ggatgacttccttccggacgcagat

SEQ ID NO: 186126 - DNA, 25 bp, Homo sapien
acttccttccggacgcagatgagga

SEQ ID NO: 186127 - DNA, 25 bp, Homo sapien
gacgggcggatgattccttccggac

SEQ ID NO: 186128 - DNA, 25 bp, Homo sapien
cggatgacttccttccggacgcaga

SEQ ID NO: 186129 - DNA, 25 bp, Homo sapien
acctctcaatgtgcacgtgctgctc

SEQ ID NO: 186130 - DNA, 25 bp, Homo sapien
cctgccaggcggatgacatcaggaa

SEQ ID NO: 186131 - DNA, 25 bp, Homo sapien
caggaatgctcatcaacttgagggc

SEQ ID NO: 186132 - DNA, 25 bp, Homo sapien
acttgagggcgaagaaatgcttggc

SEQ ID NO: 186133 - DNA, 25 bp, Homo sapien
tggcggtcttctccttcaccgggtg

SEQ ID NO: 186134 - DNA, 25 bp, Homo sapien
ccagtgtgtcgaagtcctgcaggcg

SEQ ID NO: 186135 - DNA, 25 bp, Homo sapien
cttggtagccgccagcgtgctctac

SEQ ID NO: 186136 - DNA, 25 bp, Homo sapien
aagggattccttccggacgcagatg

SEQ ID NO: 186137 - DNA, 25 bp, Homo sapien
tggatgacttccttccggacgcaga

SEQ ID NO: 186138 - DNA, 25 bp, Homo sapien
ggatgattccttccagacgcagatg

SEQ ID NO: 186139 - DNA, 25 bp, Homo sapien
gtggatgattccttccggacgcaga

SEQ ID NO: 186140 - DNA, 25 bp, Homo sapien
aacgggcggatgacttccttcagga

SEQ ID NO: 186141 - DNA, 25 bp, Homo sapien
gatgacttccttccagacgcagatg

SEQ ID NO: 186142 - DNA, 25 bp, Homo sapien
cggatgacttccttcgggacgcaga

SEQ ID NO: 186143 - DNA, 25 bp, Homo sapien
ggatgattccttccggacgcagatg

SEQ ID NO: 186144 - DNA, 25 bp, Homo sapien
gatgattccttccagacgcagatga

SEQ ID NO: 186145 - DNA, 25 bp, Homo sapien
gatgacttccttccggacgcagatg

SEQ ID NO: 186146 - DNA, 25 bp, Homo sapien
gatgacttccttccagacgcagatg

SEQ ID NO: 186147 - DNA, 25 bp, Homo sapien
cggatgacttccttccagacgcaga

SEQ ID NO: 186148 - DNA, 25 bp, Homo sapien
gatgattccttccagacgcagatga

SEQ ID NO: 186149 - DNA, 25 bp, Homo sapien
aacgggcggatgacttccttcagga

SEQ ID NO: 186150 - DNA, 25 bp, Homo sapien
tgacttccttccagacgcagatgag

SEQ ID NO: 186151 - DNA, 25 bp, Homo sapien
gtggatgattccttccggacgcaga

SEQ ID NO: 186152 - DNA, 25 bp, Homo sapien
tggatgacttccttccggacgcaga

SEQ ID NO: 186153 - DNA, 25 bp, Homo sapien
cgccttcggcgaatagtgtctctta

SEQ ID NO: 186154 - DNA, 25 bp, Homo sapien
tcgctatcccaaagagagtccgttc

SEQ ID NO: 186155 - DNA, 25 bp, Homo sapien
tcttagcaacggctttgagtccctc

SEQ ID NO: 186156 - DNA, 25 bp, Homo sapien
gggccaccgtagttcacagaaagta

SEQ ID NO: 186157 - DNA, 25 bp, Homo sapien
tcacaccgccatttgagggaacaca

SEQ ID NO: 186158 - DNA, 25 bp, Homo sapien
ctggctcaggcgaactctcttcaca

SEQ ID NO: 186159 - DNA, 25 bp, Homo sapien
tctcccacttcaggcgaggcattgc

SEQ ID NO: 186160 - DNA, 25 bp, Homo sapien
agcctggaagctaacggggtctcaa

SEQ ID NO: 186161 - DNA, 25 bp, Homo sapien
aggtggcatcgctccacacaggcca

SEQ ID NO: 186162 - DNA, 25 bp, Homo sapien
gcgaaccctctcacggcagctatga

SEQ ID NO: 186163 - DNA, 25 bp, Homo sapien
cggtgattctgtcgcgaaccctctc

SEQ ID NO: 186164 - DNA, 25 bp, Homo sapien
cagcaggtggcatcgctccacacag

SEQ ID NO: 186165 - DNA, 25 bp, Homo sapien
gcagctatgagactgctgcgctccc

SEQ ID NO: 186166 - DNA, 25 bp, Homo sapien
ggggtcccagagctgtgcacacgct

SEQ ID NO: 186167 - DNA, 25 bp, Homo sapien
ccagacgaggaaacctggtctcccg

SEQ ID NO: 186168 - DNA, 25 bp, Homo sapien
cgcccttcgcggtgattctgtcgcg

SEQ ID NO: 186169 - DNA, 25 bp, Homo sapien
ctgcgatgatttccagggtggacga

SEQ ID NO: 186170 - DNA, 25 bp, Homo sapien
catggccaccgctaacggggccgtg

SEQ ID NO: 186171 - DNA, 25 bp, Homo sapien
gcaacctggaggtcaagttcaccaa

SEQ ID NO: 186172 - DNA, 25 bp, Homo sapien
tccgagagcgccaagagagagtccg

SEQ ID NO: 186173 - DNA, 25 bp, Homo sapien
cagaaaccgcacctttcgcgggacg

SEQ ID NO: 186174 - DNA, 25 bp, Homo sapien
ctcggcgctgtgagcctcgaagccg

SEQ ID NO: 186175 - DNA, 25 bp, Homo sapien
ctgcccgctttgatcgcgagtggag

SEQ ID NO: 186176 - DNA, 25 bp, Homo sapien
cgttgactcggagcgcgctggtttt

SEQ ID NO: 186177 - DNA, 25 bp, Homo sapien
tgcgttctcatacccaggggagctg

SEQ ID NO: 186178 - DNA, 25 bp, Homo sapien
gaccgcacaaagatgcgttctcata

SEQ ID NO: 186179 - DNA, 25 bp, Homo sapien
agctatagttagtgtgagcgccacc

SEQ ID NO: 186180 - DNA, 25 bp, Homo sapien
ggggagctggtctcgccactcgacc

SEQ ID NO: 186181 - DNA, 25 bp, Homo sapien
acccgcgccctggatagctatagtt

SEQ ID NO: 186182 - DNA, 25 bp, Homo sapien
gccaagcagtctcccgtgggagtgc

SEQ ID NO: 186183 - DNA, 25 bp, Homo sapien
ccacggagcagcctcgttgcgattg

SEQ ID NO: 186184 - DNA, 25 bp, Homo sapien
agcctcgttgcgattggccgtacgc

SEQ ID NO: 186185 - DNA, 25 bp, Homo sapien
ctcaccgagcagcagattctttgca

SEQ ID NO: 186186 - DNA, 25 bp, Homo sapien
ggtctgcgtttctgtattagcctca

SEQ ID NO: 186187 - DNA, 25 bp, Homo sapien
gcgtggaaccctctgctcttcctga

SEQ ID NO: 186188 - DNA, 25 bp, Homo sapien
tgcaaattgcaggtcgttaacgctt

SEQ ID NO: 186189 - DNA, 25 bp, Homo sapien
cgctttagaacgacacatttctgta

SEQ ID NO: 186190 - DNA, 25 bp, Homo sapien
cccgtgaagagctctacgcacatga

SEQ ID NO: 186191 - DNA, 25 bp, Homo sapien
cgtctgtttaactgttacggccgca

SEQ ID NO: 186192 - DNA, 25 bp, Homo sapien
ggggctcatctgctgattttgctgc

SEQ ID NO: 186193 - DNA, 25 bp, Homo sapien
cccatcgttacgcagcgcgttcgtg

SEQ ID NO: 186194 - DNA, 25 bp, Homo sapien
tgattctcaagagcacgcgggcagt

SEQ ID NO: 186195 - DNA, 25 bp, Homo sapien
cctgctgtgttccacggtgattctc

SEQ ID NO: 186196 - DNA, 25 bp, Homo sapien
gcggtctcgctgcagaatcctccga

SEQ ID NO: 186197 - DNA, 25 bp, Homo sapien
gcgggaaagcgtctggatgtccaca

SEQ ID NO: 186198 - DNA, 25 bp, Homo sapien
tgatttaaatcccacgcccttcgtg

SEQ ID NO: 186199 - DNA, 25 bp, Homo sapien
agtgaccgccgcttttgctgaacgg

SEQ ID NO: 186200 - DNA, 25 bp, Homo sapien
aggggaccgctcagatgattttctc

SEQ ID NO: 186201 - DNA, 25 bp, Homo sapien
gccgatgggaacaggtagctcttct

SEQ ID NO: 186202 - DNA, 25 bp, Homo sapien
tgtacgtggacaatcccgccgcgct

SEQ ID NO: 186203 - DNA, 25 bp, Homo sapien
tctgcacccaccaccgtggcaggtg

SEQ ID NO: 186204 - DNA, 25 bp, Homo sapien
ggaacaggtagctcttctgcaccca

SEQ ID NO: 186205 - DNA, 25 bp, Homo sapien
tgcaggcgctgtgcacagattgcct

SEQ ID NO: 186206 - DNA, 25 bp, Homo sapien
cagcggtctcctctgtacgtggaca

SEQ ID NO: 186207 - DNA, 25 bp, Homo sapien
ctggacgcttcagcggtctcctctg

SEQ ID NO: 186208 - DNA, 25 bp, Homo sapien
attgcctgtgagacgcaggtgccga

SEQ ID NO: 186209 - DNA, 25 bp, Homo sapien
tcgcaaaggcgcagataggaagata

SEQ ID NO: 186210 - DNA, 25 bp, Homo sapien
cggccggaacatctgcttccgggtc

SEQ ID NO: 186211 - DNA, 25 bp, Homo sapien
ggcttttcatccaggttctgtacca

SEQ ID NO: 186212 - DNA, 25 bp, Homo sapien
tacccgtgcgggcagctggcacaga

SEQ ID NO: 186213 - DNA, 25 bp, Homo sapien
ggcgagttcttcgtctcctcctttc

SEQ ID NO: 186214 - DNA, 25 bp, Homo sapien
taccagcgatagcagctcggggttg

SEQ ID NO: 186215 - DNA, 25 bp, Homo sapien
ttctgtaccagcgatagcagctcgg

SEQ ID NO: 186216 - DNA, 25 bp, Homo sapien
tggcacagagatgcgctgctcgcga

SEQ ID NO: 186217 - DNA, 25 bp, Homo sapien
ggtccagtcactaggcagagccttg

SEQ ID NO: 186218 - DNA, 25 bp, Homo sapien
ggccaccgatgccatgaagaacttc

SEQ ID NO: 186219 - DNA, 25 bp, Homo sapien
cctcaggtggccttggcaagcccag

SEQ ID NO: 186220 - DNA, 25 bp, Homo sapien
tgctgtccgagaacgccagaggtac

SEQ ID NO: 186221 - DNA, 25 bp, Homo sapien
tcgtggcgctcatcggcatcagcat

SEQ ID NO: 186222 - DNA, 25 bp, Homo sapien
cacactctggagtcggctaagacca

SEQ ID NO: 186223 - DNA, 25 bp, Homo sapien
agaacttctccgagttccggcagga

SEQ ID NO: 186224 - DNA, 25 bp, Homo sapien
agcctcaacaccgtgctgtccgaga

SEQ ID NO: 186225 - DNA, 25 bp, Homo sapien
gttctgccgactcggacggcagccg

SEQ ID NO: 186226 - DNA, 25 bp, Homo sapien
gcagctatgtcacctcccacggcct

SEQ ID NO: 186227 - DNA, 25 bp, Homo sapien
agaaacctcgttctgccgactcgga

SEQ ID NO: 186228 - DNA, 25 bp, Homo sapien
ggagcccgctcagaaacctcgttct

SEQ ID NO: 186229 - DNA, 25 bp, Homo sapien
gagcgaggatctgccgccgctcagc

SEQ ID NO: 186230 - DNA, 25 bp, Homo sapien
cgcggctccgccgttcaaccgcatg

SEQ ID NO: 186231 - DNA, 25 bp, Homo sapien
accgcatgcgcgacagcgctgaggc

SEQ ID NO: 186232 - DNA, 25 bp, Homo sapien
aaacctcgttctgccgactcggacg

SEQ ID NO: 186233 - DNA, 25 bp, Homo sapien
tgcggggcggaccttcttctcccaa

SEQ ID NO: 186234 - DNA, 25 bp, Homo sapien
caggcagaggcccaaacaagcgggc

SEQ ID NO: 186235 - DNA, 25 bp, Homo sapien
tggacgaatgtaaatacagacaccc

SEQ ID NO: 186236 - DNA, 25 bp, Homo sapien
gcgggtgtggacgaatgtaaataca

SEQ ID NO: 186237 - DNA, 25 bp, Homo sapien
tacgatgccacgtggggaaaaagga

SEQ ID NO: 186238 - DNA, 25 bp, Homo sapien
gtattcccaagtacgatgccacgtg

SEQ ID NO: 186239 - DNA, 25 bp, Homo sapien
gagtttgctttaccaagtattccca

SEQ ID NO: 186240 - DNA, 25 bp, Homo sapien
gtgggcttgatgagtttgctttacc

SEQ ID NO: 186241 - DNA, 25 bp, Homo sapien
tcacgtggccgaagtttgaccaaaa

SEQ ID NO: 186242 - DNA, 25 bp, Homo sapien
ggagctgcccgtgatccgcacctag

SEQ ID NO: 186243 - DNA, 25 bp, Homo sapien
ctcacgtcacgcacggcgcgttatg

SEQ ID NO: 186244 - DNA, 25 bp, Homo sapien
ggcttagctcgccattgcaacagga

SEQ ID NO: 186245 - DNA, 25 bp, Homo sapien
cctgcgcctttaagaggggaccatg

SEQ ID NO: 186246 - DNA, 25 bp, Homo sapien
gctcgcttcagctcggaagcccggg

SEQ ID NO: 186247 - DNA, 25 bp, Homo sapien
gcgcgattggcgcaaaagtgaatga

SEQ ID NO: 186248 - DNA, 25 bp, Homo sapien
acgcacggcgcgttatgaagtggcc

SEQ ID NO: 186249 - DNA, 25 bp, Homo sapien
agagactcctcttggcgttccatga

SEQ ID NO: 186250 - DNA, 25 bp, Homo sapien
actcacccgtggtgtgcaggaagcg

SEQ ID NO: 186251 - DNA, 25 bp, Homo sapien
acccatcatggctgcgcgtcgcaaa

SEQ ID NO: 186252 - DNA, 25 bp, Homo sapien
ttgcgcaaacaagggacagccgagc

SEQ ID NO: 186253 - DNA, 25 bp, Homo sapien
ggcttggttcgcaaaaaagacttgc

SEQ ID NO: 186254 - DNA, 25 bp, Homo sapien
tgggaacgttctgtgctatctcttg

SEQ ID NO: 186255 - DNA, 25 bp, Homo sapien
gaggcaaacgccaacggccgagtga

SEQ ID NO: 186256 - DNA, 25 bp, Homo sapien
ccagtaactaccacaggaagggctt

SEQ ID NO: 186257 - DNA, 25 bp, Homo sapien
tcccaggagcttaaccggatgctca

SEQ ID NO: 186258 - DNA, 25 bp, Homo sapien
ccgaggggaactttctcatgcatta

SEQ ID NO: 186259 - DNA, 25 bp, Homo sapien
ccctgattccagacgttggtgttta

SEQ ID NO: 186260 - DNA, 25 bp, Homo sapien
cacgaggacgcaccaggaagtaatg

SEQ ID NO: 186261 - DNA, 25 bp, Homo sapien
tgctcatctggcaacaacggcaaga

SEQ ID NO: 186262 - DNA, 25 bp, Homo sapien
acggcgctaacagaaggctcccagg

SEQ ID NO: 186263 - DNA, 25 bp, Homo sapien
gaagtaatgaagtcacccgtgcctg

SEQ ID NO: 186264 - DNA, 25 bp, Homo sapien
atgtgtctcgttctgggttgtttcc

SEQ ID NO: 186265 - DNA, 25 bp, Homo sapien
gtctgatgcccagcgactttgcctc

SEQ ID NO: 186266 - DNA, 25 bp, Homo sapien
gactttgcctcgaccacatctgtga

SEQ ID NO: 186267 - DNA, 25 bp, Homo sapien
tgcctcgaccacatctgtgacatcg

SEQ ID NO: 186268 - DNA, 25 bp, Homo sapien
tgtgacatcgccgtccagcatgcgg

SEQ ID NO: 186269 - DNA, 25 bp, Homo sapien
cagcatgcggatgcctgaaagcaca

SEQ ID NO: 186270 - DNA, 25 bp, Homo sapien
tgcctgaaagcacagaggaggctcg

SEQ ID NO: 186271 - DNA, 25 bp, Homo sapien
agctggcactgtaaatgtcgatgta

SEQ ID NO: 186272 - DNA, 25 bp, Homo sapien
tgtcgatgtagttgggtctgatgcc

SEQ ID NO: 186273 - DNA, 25 bp, Homo sapien
tgcgcgacgctctcttcgcggctaa

SEQ ID NO: 186274 - DNA, 25 bp, Homo sapien
gtgcgcgacgctctcttcgcggcta

SEQ ID NO: 186275 - DNA, 25 bp, Homo sapien
ggaacactgcttcccacggctgccg

SEQ ID NO: 186276 - DNA, 25 bp, Homo sapien
tggaacactgcttcccacggctgcc

SEQ ID NO: 186277 - DNA, 25 bp, Homo sapien
tctggaacactgcttcccacggctg

SEQ ID NO: 186278 - DNA, 25 bp, Homo sapien
tggagcacaagcccgaggccgccgt

SEQ ID NO: 186279 - DNA, 25 bp, Homo sapien
gctggagcacaagcccgaggccgcc

SEQ ID NO: 186280 - DNA, 25 bp, Homo sapien
ggggctggagcacaagcccgaggcc

SEQ ID NO: 186281 - DNA, 25 bp, Homo sapien
cctcggcccgcgagttctgctggga

SEQ ID NO: 186282 - DNA, 25 bp, Homo sapien
ctgaggccacacttccgagcgcggg

SEQ ID NO: 186283 - DNA, 25 bp, Homo sapien
gcccaagttgaggtacccgtgcgcc

SEQ ID NO: 186284 - DNA, 25 bp, Homo sapien
aggcatagcggcgacaggctcgcgc

SEQ ID NO: 186285 - DNA, 25 bp, Homo sapien
agtgccgccttttaaagccgctccg

SEQ ID NO: 186286 - DNA, 25 bp, Homo sapien
ggcttctgaggccacacttccgagc

SEQ ID NO: 186287 - DNA, 25 bp, Homo sapien
gtggagtgccgccttttaaagccgc

SEQ ID NO: 186288 - DNA, 25 bp, Homo sapien
ctcacctggcccaagttgaggtacc

SEQ ID NO: 186289 - DNA, 25 bp, Homo sapien
agcctgggaggttgttccatttcca

SEQ ID NO: 186290 - DNA, 25 bp, Homo sapien
ctggttccactgcaggagacctgtt

SEQ ID NO: 186291 - DNA, 25 bp, Homo sapien
gtcatccgtggaccgaaatgcgcgc

SEQ ID NO: 186292 - DNA, 25 bp, Homo sapien
tgcgcgcccgaagcaaccaagagca

SEQ ID NO: 186293 - DNA, 25 bp, Homo sapien
tcgtgcgaaggttccgaggacacta

SEQ ID NO: 186294 - DNA, 25 bp, Homo sapien
atcgcgtggcgtttcatcctaaaga

SEQ ID NO: 186295 - DNA, 25 bp, Homo sapien
tctggccggcctcttgaagatacgc

SEQ ID NO: 186296 - DNA, 25 bp, Homo sapien
accgcccgacagaatgcagaactgc

SEQ ID NO: 186297 - DNA, 25 bp, Homo sapien
cagactttgcacacgtgacatgggg

SEQ ID NO: 186298 - DNA, 25 bp, Homo sapien
cgctcggctgagtccgcttggactt

SEQ ID NO: 186299 - DNA, 25 bp, Homo sapien
atcgatttcaaacacgcctgtggtg

SEQ ID NO: 186300 - DNA, 25 bp, Homo sapien
agaagaccttacagcgcgaagaagc

SEQ ID NO: 186301 - DNA, 25 bp, Homo sapien
ccgctcagcgctggggaaataaatc

SEQ ID NO: 186302 - DNA, 25 bp, Homo sapien
cctgccttggttgtctcgatgttcc

SEQ ID NO: 186303 - DNA, 25 bp, Homo sapien
agccgccttggcagcaaatcctgta

SEQ ID NO: 186304 - DNA, 25 bp, Homo sapien
agcgggctttagttaatcgatttca

SEQ ID NO: 186305 - DNA, 25 bp, Homo sapien
ccggttacctgtgcgccggcctcct

SEQ ID NO: 186306 - DNA, 25 bp, Homo sapien
aaacctttcggtgcgcaccgtctcg

SEQ ID NO: 186307 - DNA, 25 bp, Homo sapien
gccacctcccgcgtgaggcacggcc

SEQ ID NO: 186308 - DNA, 25 bp, Homo sapien
ggcctcgttggagccgaggcctaca

SEQ ID NO: 186309 - DNA, 25 bp, Homo sapien
agggcgacgcggacactcagcgcac

SEQ ID NO: 186310 - DNA, 25 bp, Homo sapien
gacactcagcgcacggcagaagaca

SEQ ID NO: 186311 - DNA, 25 bp, Homo sapien
cgcacggcagaagacagggctcccg

SEQ ID NO: 186312 - DNA, 25 bp, Homo sapien
aggtcgcagttctcggcccggagct

SEQ ID NO: 186313 - DNA, 25 bp, Homo sapien
aggctgccgttggtcccgagactcc

SEQ ID NO: 186314 - DNA, 25 bp, Homo sapien
tgcgaccgacgccaccgataggagg

SEQ ID NO: 186315 - DNA, 25 bp, Homo sapien
ctttgcgaccgacgccaccgatagg

SEQ ID NO: 186316 - DNA, 25 bp, Homo sapien
cctcaaccttcgtgggagcgcggat

SEQ ID NO: 186317 - DNA, 25 bp, Homo sapien
agcttggccttaaccctgacaggga

SEQ ID NO: 186318 - DNA, 25 bp, Homo sapien
cgcgagcatctcagaggccttttcc

SEQ ID NO: 186319 - DNA, 25 bp, Homo sapien
cctctacccgttaggctgccgttgg

SEQ ID NO: 186320 - DNA, 25 bp, Homo sapien
cttaaccctgacagggacatcttcc

SEQ ID NO: 186321 - DNA, 25 bp, Homo sapien
gtactcgcgtcggaacctgcagaca

SEQ ID NO: 186322 - DNA, 25 bp, Homo sapien
tcgcgtcggaacctgcagacacttg

SEQ ID NO: 186323 - DNA, 25 bp, Homo sapien
ctcgcgtcggaacctgcagacactt

SEQ ID NO: 186324 - DNA, 25 bp, Homo sapien
actcgcgtcggaacctgcagacact

SEQ ID NO: 186325 - DNA, 25 bp, Homo sapien
acctgtactcgcgtcggaacctgca

SEQ ID NO: 186326 - DNA, 25 bp, Homo sapien
ctgtactcgcgtcggaacctgcaga

SEQ ID NO: 186327 - DNA, 25 bp, Homo sapien
tactcgcgtcggaacctgcagacac

SEQ ID NO: 186328 - DNA, 25 bp, Homo sapien
cctgtactcgcgtcggaacctgcag

SEQ ID NO: 186329 - DNA, 25 bp, Homo sapien
actcgcgtgggaacgagaagacact

SEQ ID NO: 186330 - DNA, 25 bp, Homo sapien
ctcgcgtgggaacgagaagacactc

SEQ ID NO: 186331 - DNA, 25 bp, Homo sapien
gatgctgcttctcagagctgctgtc

SEQ ID NO: 186332 - DNA, 25 bp, Homo sapien
ccaacctgcactcgcgtgggaacga

SEQ ID NO: 186333 - DNA, 25 bp, Homo sapien
gcgtgggaacgagaagacactcatg

SEQ ID NO: 186334 - DNA, 25 bp, Homo sapien
gcgacgagatgctgcttctcagagc

SEQ ID NO: 186335 - DNA, 25 bp, Homo sapien
gctgcttctcagagctgctgtccaa

SEQ ID NO: 186336 - DNA, 25 bp, Homo sapien
tgctgtccaacctgcactcgcgtgg

SEQ ID NO: 186337 - DNA, 25 bp, Homo sapien
gctgcttctcagagctgctgtccaa

SEQ ID NO: 186338 - DNA, 25 bp, Homo sapien
ccaacctgcactcgcgtgggaacga

SEQ ID NO: 186339 - DNA, 25 bp, Homo sapien
ctgtccaacctgcactcgcgtggga

SEQ ID NO: 186340 - DNA, 25 bp, Homo sapien
tgctgtccaacctgcactcgcgtgg

SEQ ID NO: 186341 - DNA, 25 bp, Homo sapien
ctcgcgtgggaacgagaagacactc

SEQ ID NO: 186342 - DNA, 25 bp, Homo sapien
tgtccaacctgcactcgcgtgggaa

SEQ ID NO: 186343 - DNA, 25 bp, Homo sapien
tcgcgtgggaacgagaagacactca

SEQ ID NO: 186344 - DNA, 25 bp, Homo sapien
tgcttctcagagctgctgtccaacc

SEQ ID NO: 186345 - DNA, 25 bp, Homo sapien
tcgcgtcggaacctgcagacacttg

SEQ ID NO: 186346 - DNA, 25 bp, Homo sapien
cctgtactcgcgtcggaacctgcag

SEQ ID NO: 186347 - DNA, 25 bp, Homo sapien
actcgcgtcggaacctgcagacact

SEQ ID NO: 186348 - DNA, 25 bp, Homo sapien
tgcagacacttgtggaggagtcggc

SEQ ID NO: 186349 - DNA, 25 bp, Homo sapien
acctgtactcgcgtcggaacctgca

SEQ ID NO: 186350 - DNA, 25 bp, Homo sapien
ctgtactcgcgtcggaacctgcaga

SEQ ID NO: 186351 - DNA, 25 bp, Homo sapien
gtactcgcgtcggaacctgcagaca

SEQ ID NO: 186352 - DNA, 25 bp, Homo sapien
ctcgcgtcggaacctgcagacactt

SEQ ID NO: 186353 - DNA, 25 bp, Homo sapien
tgctgtccaacctgcactcgcgtgg

SEQ ID NO: 186354 - DNA, 25 bp, Homo sapien
gctgcttctcagagctgctgtccaa

SEQ ID NO: 186355 - DNA, 25 bp, Homo sapien
ccaacctgcactcgcgtgggaacga

SEQ ID NO: 186356 - DNA, 25 bp, Homo sapien
tgctgcttctcagagctgctgtcca

SEQ ID NO: 186357 - DNA, 25 bp, Homo sapien
ctcgcgtgggaacgagaagacactc

SEQ ID NO: 186358 - DNA, 25 bp, Homo sapien
atgctgcttctcagagctgctgtcc

SEQ ID NO: 186359 - DNA, 25 bp, Homo sapien
tcgcgtgggaacgagaagacactca

SEQ ID NO: 186360 - DNA, 25 bp, Homo sapien
tgtccaacctgcactcgcgtgggaa

SEQ ID NO: 186361 - DNA, 25 bp, Homo sapien
ctacgccttcctcatggagtacatc

SEQ ID NO: 186362 - DNA, 25 bp, Homo sapien
gctgctgccctctatgttctacgtg

SEQ ID NO: 186363 - DNA, 25 bp, Homo sapien
tgtgctgatcctgtactacgccttc

SEQ ID NO: 186364 - DNA, 25 bp, Homo sapien
tggagtacatcgtcctcaacgtggg

SEQ ID NO: 186365 - DNA, 25 bp, Homo sapien
cgggcctttacgatgctgactcgga

SEQ ID NO: 186366 - DNA, 25 bp, Homo sapien
gactcggagctcgacgtctttgatg

SEQ ID NO: 186367 - DNA, 25 bp, Homo sapien
gtacttggagtagggtctcgactgc

SEQ ID NO: 186368 - DNA, 25 bp, Homo sapien
ggcctgttcttcgtcaatgtgctga

SEQ ID NO: 186369 - DNA, 25 bp, Homo sapien
ggcggcacaccagcggcccagatga

SEQ ID NO: 186370 - DNA, 25 bp, Homo sapien
cagttccacgcctgctggagggcag

SEQ ID NO: 186371 - DNA, 25 bp, Homo sapien
ctggaaacggcttagggcccgtcag

SEQ ID NO: 186372 - DNA, 25 bp, Homo sapien
gcaagtcctggaaacggcttagggc

SEQ ID NO: 186373 - DNA, 25 bp, Homo sapien
tcgcgcctccagctgggtctgtgcg

SEQ ID NO: 186374 - DNA, 25 bp, Homo sapien
tcagctcgccaactccgcaggccag

SEQ ID NO: 186375 - DNA, 25 bp, Homo sapien
agcggcccagatgacaccggaagga

SEQ ID NO: 186376 - DNA, 25 bp, Homo sapien
ctcgtcaggcggagacagaagcaga

SEQ ID NO: 186377 - DNA, 25 bp, Homo sapien
ttccctctgcatgtcccatctttgg

SEQ ID NO: 186378 - DNA, 25 bp, Homo sapien
aacacgtgtgctgacctggccatgt

SEQ ID NO: 186379 - DNA, 25 bp, Homo sapien
tgcttagatctgcagcctcatgaga

SEQ ID NO: 186380 - DNA, 25 bp, Homo sapien
catcatcgagatcaacgggcagagc

SEQ ID NO: 186381 - DNA, 25 bp, Homo sapien
ggccacagcccacgagaagatagtc

SEQ ID NO: 186382 - DNA, 25 bp, Homo sapien
gtccaagctctgtccaactcggtcg

SEQ ID NO: 186383 - DNA, 25 bp, Homo sapien
cgaattgcacgtgcacgtattcatc

SEQ ID NO: 186384 - DNA, 25 bp, Homo sapien
cgtattcatcatgtggcgcttttcc

SEQ ID NO: 186385 - DNA, 25 bp, Homo sapien
acctgtgaggaaatccacccgtgga

SEQ ID NO: 186386 - DNA, 25 bp, Homo sapien
gcccgagacctgcttgcctgaggag

SEQ ID NO: 186387 - DNA, 25 bp, Homo sapien
atgtgcctttctgggctgctcagcc

SEQ ID NO: 186388 - DNA, 25 bp, Homo sapien
tcagaagcagagctgcgcgatgtgc

SEQ ID NO: 186389 - DNA, 25 bp, Homo sapien
gcagcggaaacctacatcggccaca

SEQ ID NO: 186390 - DNA, 25 bp, Homo sapien
tgagtcgctgataaacaaggcttgc

SEQ ID NO: 186391 - DNA, 25 bp, Homo sapien
gttggaatcctttcagccctgccga

SEQ ID NO: 186392 - DNA, 25 bp, Homo sapien
gccgaggttatggtgcctgtttcca

SEQ ID NO: 186393 - DNA, 25 bp, Homo sapien
gcaccgaacttgctcacaactgtga

SEQ ID NO: 186394 - DNA, 25 bp, Homo sapien
caggtcggattggacaccaccggaa

SEQ ID NO: 186395 - DNA, 25 bp, Homo sapien
tcctcaggtcggattggacaccacc

SEQ ID NO: 186396 - DNA, 25 bp, Homo sapien
ctgtgactcctcaggtcggattgga

SEQ ID NO: 186397 - DNA, 25 bp, Homo sapien
ttgctcacaactgtgactcctcagg

SEQ ID NO: 186398 - DNA, 25 bp, Homo sapien
gcggcaccgaacttgctcacaactg

SEQ ID NO: 186399 - DNA, 25 bp, Homo sapien
ggaggaccttcccactcgcgatctt

SEQ ID NO: 186400 - DNA, 25 bp, Homo sapien
cacaactgtgactcctcaggtcgga

SEQ ID NO: 186401 - DNA, 25 bp, Homo sapien
agactgcgtgctgcgtcatgaagcc

SEQ ID NO: 186402 - DNA, 25 bp, Homo sapien
ccggttcctcggtttttgcaacatg

SEQ ID NO: 186403 - DNA, 25 bp, Homo sapien
tcggcaaagccgtctctgagaaccc

SEQ ID NO: 186404 - DNA, 25 bp, Homo sapien
ttgcaacatgtctccggcggcaggt

SEQ ID NO: 186405 - DNA, 25 bp, Homo sapien
gaacagcgttttccgtgcagccctg

SEQ ID NO: 186406 - DNA, 25 bp, Homo sapien
gtcggcccgcttgatcggaatcttc

SEQ ID NO: 186407 - DNA, 25 bp, Homo sapien
atgacgtgcttcagtatgtcggccc

SEQ ID NO: 186408 - DNA, 25 bp, Homo sapien
gggtttccgctatggctccagtctc

SEQ ID NO: 186409 - DNA, 25 bp, Homo sapien
cctcacagagggtccgaggcaagtt

SEQ ID NO: 186410 - DNA, 25 bp, Homo sapien
cggcgaagctgactgccacgatgag

SEQ ID NO: 186411 - DNA, 25 bp, Homo sapien
agtaactccgggaatcagcgcaata

SEQ ID NO: 186412 - DNA, 25 bp, Homo sapien
atcagcgcaataggagcgggaacgc

SEQ ID NO: 186413 - DNA, 25 bp, Homo sapien
gggccctggagttattctgctcgga

SEQ ID NO: 186414 - DNA, 25 bp, Homo sapien
tctgctcggagtttcgaactgcgcc

SEQ ID NO: 186415 - DNA, 25 bp, Homo sapien
tcgcggacactcaccgagaagcctg

SEQ ID NO: 186416 - DNA, 25 bp, Homo sapien
cacgatgaggcatccgagcgccatc

SEQ ID NO: 186417 - DNA, 25 bp, Homo sapien
gggccggtcactgctacggagcccg

SEQ ID NO: 186418 - DNA, 25 bp, Homo sapien
cgagcatgtccacccgcagcgaggg

SEQ ID NO: 186419 - DNA, 25 bp, Homo sapien
acgagcatgtccacccgcagcgagg

SEQ ID NO: 186420 - DNA, 25 bp, Homo sapien
gcccgcgcgactcgcacgagcatgt

SEQ ID NO: 186421 - DNA, 25 bp, Homo sapien
tcccacgcagcgtcccacaggctcc

SEQ ID NO: 186422 - DNA, 25 bp, Homo sapien
gggatgggaactcccacgcagcgtc

SEQ ID NO: 186423 - DNA, 25 bp, Homo sapien
caggcactttccgccctgagcgtgg

SEQ ID NO: 186424 - DNA, 25 bp, Homo sapien
ggatctccagcacgccgccccagtc

SEQ ID NO: 186425 - DNA, 25 bp, Homo sapien
tcgccggggaccaaccactcctcca

SEQ ID NO: 186426 - DNA, 25 bp, Homo sapien
tgcgcataccgcagggagtgacatc

SEQ ID NO: 186427 - DNA, 25 bp, Homo sapien
gggagtgacatcagatcgaaactac

SEQ ID NO: 186428 - DNA, 25 bp, Homo sapien
agatcgaaactacagggtttcgccg

SEQ ID NO: 186429 - DNA, 25 bp, Homo sapien
ccgaaccctcactggagccgagttt

SEQ ID NO: 186430 - DNA, 25 bp, Homo sapien
agccgagtttctccgcgagggacct

SEQ ID NO: 186431 - DNA, 25 bp, Homo sapien
ctccgcgagggacctgttgcgtgtc

SEQ ID NO: 186432 - DNA, 25 bp, Homo sapien
gacatcagatcgaaactacagggtt

SEQ ID NO: 186433 - DNA, 25 bp, Homo sapien
ttggaagacagtttccgctgccgtg

SEQ ID NO: 186434 - DNA, 25 bp, Homo sapien
gccgtgcgagtcttcctgtttgttt

SEQ ID NO: 186435 - DNA, 25 bp, Homo sapien
cgcctgtgcaccaaagctttcctta

SEQ ID NO: 186436 - DNA, 25 bp, Homo sapien
agagacttgtccacttgctcctcga

SEQ ID NO: 186437 - DNA, 25 bp, Homo sapien
gagccgatacccgacagttgtttcc

SEQ ID NO: 186438 - DNA, 25 bp, Homo sapien
tcactgggcaaacagcatggtcacg

SEQ ID NO: 186439 - DNA, 25 bp, Homo sapien
ccacggaaggcggaatgcattttct

SEQ ID NO: 186440 - DNA, 25 bp, Homo sapien
tgcattttctgcaaggcgcgtcatg

SEQ ID NO: 186441 - DNA, 25 bp, Homo sapien
ggctggaaattctgagccagaaccc

SEQ ID NO: 186442 - DNA, 25 bp, Homo sapien
atagatcagctctgggccatccgcc

SEQ ID NO: 186443 - DNA, 25 bp, Homo sapien
tccaggcgccgcatagatcagctct

SEQ ID NO: 186444 - DNA, 25 bp, Homo sapien
cgtcaggtatttctggtacttcatc

SEQ ID NO: 186445 - DNA, 25 bp, Homo sapien
tggccatctgcagcaccgtcaggta

SEQ ID NO: 186446 - DNA, 25 bp, Homo sapien
cacagcttcctcttgagcggcagga

SEQ ID NO: 186447 - DNA, 25 bp, Homo sapien
ctcggcgaaaccagtcagcgggcac

SEQ ID NO: 186448 - DNA, 25 bp, Homo sapien
ccagaacccgccgtaatggagcaga

SEQ ID NO: 186449 - DNA, 25 bp, Homo sapien
ctcctccggactcagcgcctccaac

SEQ ID NO: 186450 - DNA, 25 bp, Homo sapien
ccggcgctttctggtacttgctcgc

SEQ ID NO: 186451 - DNA, 25 bp, Homo sapien
cccggcgctttctggtacttgctcg

SEQ ID NO: 186452 - DNA, 25 bp, Homo sapien
cctccggactcagcgcctccaacct

SEQ ID NO: 186453 - DNA, 25 bp, Homo sapien
cggcgctttctggtacttgctcgcg

SEQ ID NO: 186454 - DNA, 25 bp, Homo sapien
gcccggcgctttctggtacttgctc

SEQ ID NO: 186455 - DNA, 25 bp, Homo sapien
gacgtctttattttgccaggcattt

SEQ ID NO: 186456 - DNA, 25 bp, Homo sapien
tttcaatggggattcctttttcaga

SEQ ID NO: 186457 - DNA, 25 bp, Homo sapien
acgtctttattttgccaggcatttt

SEQ ID NO: 186458 - DNA, 25 bp, Homo sapien
agacgtctttattttgccaggcatt

SEQ ID NO: 186459 - DNA, 25 bp, Homo sapien
ttagacgtctttattttgccaggca

SEQ ID NO: 186460 - DNA, 25 bp, Homo sapien
tttagacgtctttattttgccaggc

SEQ ID NO: 186461 - DNA, 25 bp, Homo sapien
agctattttcaatggggattccttt

SEQ ID NO: 186462 - DNA, 25 bp, Homo sapien
tatagctattttcaatggggattcc

SEQ ID NO: 186463 - DNA, 25 bp, Homo sapien
ctatggcgagggctacagcaacacc

SEQ ID NO: 186464 - DNA, 25 bp, Homo sapien
tgcctgccgctatggcagtgccatc

SEQ ID NO: 186465 - DNA, 25 bp, Homo sapien
cagatgtactgcgtgttcaaccaca

SEQ ID NO: 186466 - DNA, 25 bp, Homo sapien
ccttcttggtggtcgacgcgtattt

SEQ ID NO: 186467 - DNA, 25 bp, Homo sapien
ggctacagcaacacccataagtcta

SEQ ID NO: 186468 - DNA, 25 bp, Homo sapien
taacccacgagcgtgacaggtggag

SEQ ID NO: 186469 - DNA, 25 bp, Homo sapien
cccataagtctaagcagatgtactg

SEQ ID NO: 186470 - DNA, 25 bp, Homo sapien
ttcaaccacaacgaggatgcctgcc

SEQ ID NO: 186471 - DNA, 25 bp, Homo sapien
tcttccaggagaaccaggagccaca

SEQ ID NO: 186472 - DNA, 25 bp, Homo sapien
caggagaaccaggagccacagccgc

SEQ ID NO: 186473 - DNA, 25 bp, Homo sapien
gggaagatgtccatgtccgggttca

SEQ ID NO: 186474 - DNA, 25 bp, Homo sapien
acctgctctagggaccgcgacaggg

SEQ ID NO: 186475 - DNA, 25 bp, Homo sapien
gcggctcccgcgttgttggagccca

SEQ ID NO: 186476 - DNA, 25 bp, Homo sapien
caacattaaggtgagtcgccgggtg

SEQ ID NO: 186477 - DNA, 25 bp, Homo sapien
cggaaagcgggtgcccagagtccca

SEQ ID NO: 186478 - DNA, 25 bp, Homo sapien
tttaaactgcggcttgacgggagcc

SEQ ID NO: 186479 - DNA, 25 bp, Homo sapien
gccacgctgagcctaccttcgccca

SEQ ID NO: 186480 - DNA, 25 bp, Homo sapien
gtctgggcgccaccgcttgactccc

SEQ ID NO: 186481 - DNA, 25 bp, Homo sapien
tcccaaagctctgcaagctgcacgg

SEQ ID NO: 186482 - DNA, 25 bp, Homo sapien
cgctccttctcgctgtacatcaaat

SEQ ID NO: 186483 - DNA, 25 bp, Homo sapien
cgcggcctgtactctcctctgaccg

SEQ ID NO: 186484 - DNA, 25 bp, Homo sapien
ctgcaagctgcacggcccgtcggag

SEQ ID NO: 186485 - DNA, 25 bp, Homo sapien
acgcgcggaccaactggcccgacga

SEQ ID NO: 186486 - DNA, 25 bp, Homo sapien
ctgtacatcaaatcagcgaacaccc

SEQ ID NO: 186487 - DNA, 25 bp, Homo sapien
gttctgttgtcctgttgccctttta

SEQ ID NO: 186488 - DNA, 25 bp, Homo sapien
ccggctcctcgcatggggctgtctt

SEQ ID NO: 186489 - DNA, 25 bp, Homo sapien
aagaggcgggtctttaggctcacaa

SEQ ID NO: 186490 - DNA, 25 bp, Homo sapien
tttaggctcacaagagctcggccag

SEQ ID NO: 186491 - DNA, 25 bp, Homo sapien
gatgtctgtgtcaagattcaaggcc

SEQ ID NO: 186492 - DNA, 25 bp, Homo sapien
tcttccacgagaaccaggaggctca

SEQ ID NO: 186493 - DNA, 25 bp, Homo sapien
ggaatggcggcttttgagcccaggc

SEQ ID NO: 186494 - DNA, 25 bp, Homo sapien
tctggacttgtgcacccgcggaaaa

SEQ ID NO: 186495 - DNA, 25 bp, Homo sapien
ccaataccagaagtacaagcaggtg

SEQ ID NO: 186496 - DNA, 25 bp, Homo sapien
aataccagaagtacaagcaggtgga

SEQ ID NO: 186497 - DNA, 25 bp, Homo sapien
cgccaataccagaagtacaagcagg

SEQ ID NO: 186498 - DNA, 25 bp, Homo sapien
cggcgccaataccagaagtacaagc

SEQ ID NO: 186499 - DNA, 25 bp, Homo sapien
cgcggcgccaataccagaagtacaa

SEQ ID NO: 186500 - DNA, 25 bp, Homo sapien
tcgcggcgccaataccagaagtaca

SEQ ID NO: 186501 - DNA, 25 bp, Homo sapien
ctcgcggcgccaataccagaagtac

SEQ ID NO: 186502 - DNA, 25 bp, Homo sapien
tcctcgcggcgccaataccagaagt

SEQ ID NO: 186503 - DNA, 25 bp, Homo sapien
ccgttaccagggcaagatgttcgac

SEQ ID NO: 186504 - DNA, 25 bp, Homo sapien
gccatgagccacatgctgtgcattg

SEQ ID NO: 186505 - DNA, 25 bp, Homo sapien
gcgcccgagagcatgacggacatct

SEQ ID NO: 186506 - DNA, 25 bp, Homo sapien
acggacatctggctgaccatgctca

SEQ ID NO: 186507 - DNA, 25 bp, Homo sapien
tgctacgccatgttcatcggccacg

SEQ ID NO: 186508 - DNA, 25 bp, Homo sapien
tccgccagaagatccacgactacta

SEQ ID NO: 186509 - DNA, 25 bp, Homo sapien
tattgccgcctcctttcgctgagcg

SEQ ID NO: 186510 - DNA, 25 bp, Homo sapien
gcaggtggagcagtacatgtccttc

SEQ ID NO: 186511 - DNA, 25 bp, Homo sapien
gtagcggacctcctccaggatcttg

SEQ ID NO: 186512 - DNA, 25 bp, Homo sapien
ctccacgaagttgggagccgacatc

SEQ ID NO: 186513 - DNA, 25 bp, Homo sapien
cgggcctcttcattcgcaggaacca

SEQ ID NO: 186514 - DNA, 25 bp, Homo sapien
agccgatgtacagcaggttcccgtt

SEQ ID NO: 186515 - DNA, 25 bp, Homo sapien
cgcaaagtctttggacacggcctcc

SEQ ID NO: 186516 - DNA, 25 bp, Homo sapien
cctcgctttcgtcctggcagcggaa

SEQ ID NO: 186517 - DNA, 25 bp, Homo sapien
ggtccaccacacaggcggcgaactt

SEQ ID NO: 186518 - DNA, 25 bp, Homo sapien
ccgacatcaggatgccgatggtgca

SEQ ID NO: 186519 - DNA, 25 bp, Homo sapien
gagcccaaacccaaggccgctgtgt

SEQ ID NO: 186520 - DNA, 25 bp, Homo sapien
tttcgcggctaaaggccgcgcggct

SEQ ID NO: 186521 - DNA, 25 bp, Homo sapien
ccacgctgttttcgcggctaaaggc

SEQ ID NO: 186522 - DNA, 25 bp, Homo sapien
gtccggcaaggcctcttcgccgatg

SEQ ID NO: 186523 - DNA, 25 bp, Homo sapien
agctgccgtgttcccgcccaactgg

SEQ ID NO: 186524 - DNA, 25 bp, Homo sapien
ggagcccaaacccaaggccgctgtg

SEQ ID NO: 186525 - DNA, 25 bp, Homo sapien
gcaaggcctcttcgccgatgccgag

SEQ ID NO: 186526 - DNA, 25 bp, Homo sapien
gccaccgtgcgccacgctgttttcg

SEQ ID NO: 186527 - DNA, 25 bp, Homo sapien
aaatgcagacgtggcagaagaagtg

SEQ ID NO: 186528 - DNA, 25 bp, Homo sapien
ggaacgaagtctaacctggatctgg

SEQ ID NO: 186529 - DNA, 25 bp, Homo sapien
gccttgacgttaggaacgaagtcta

SEQ ID NO: 186530 - DNA, 25 bp, Homo sapien
ctgggagccttgacgttaggaacga

SEQ ID NO: 186531 - DNA, 25 bp, Homo sapien
aagtctaacctggatctggagccgg

SEQ ID NO: 186532 - DNA, 25 bp, Homo sapien
cccgaaatgcagacgtggcagaaga

SEQ ID NO: 186533 - DNA, 25 bp, Homo sapien
ctaaagcgtggaggaggaacttccg

SEQ ID NO: 186534 - DNA, 25 bp, Homo sapien
tgggaagatgaaagaggcgcatgcg

SEQ ID NO: 186535 - DNA, 25 bp, Homo sapien
cgcgccgcccggctacccatccgtg

SEQ ID NO: 186536 - DNA, 25 bp, Homo sapien
ccgcgcccgcgagaaacagcggaga

SEQ ID NO: 186537 - DNA, 25 bp, Homo sapien
acggtcgcagtttcagccgggccgc

SEQ ID NO: 186538 - DNA, 25 bp, Homo sapien
cgacggtcgcagtttcagccgggcc

SEQ ID NO: 186539 - DNA, 25 bp, Homo sapien
ctccgacggtcgcagtttcagccgg

SEQ ID NO: 186540 - DNA, 25 bp, Homo sapien
tcgcctccgacggtcgcagtttcag

SEQ ID NO: 186541 - DNA, 25 bp, Homo sapien
gggtcccagagggccgctcgcctcc

SEQ ID NO: 186542 - DNA, 25 bp, Homo sapien
ccggctacccatccgtgccgcccgc

SEQ ID NO: 186543 - DNA, 25 bp, Homo sapien
cctcgtggaagctgatgaaattgta

SEQ ID NO: 186544 - DNA, 25 bp, Homo sapien
gcaggtccagctttggagcctcctc

SEQ ID NO: 186545 - DNA, 25 bp, Homo sapien
tggagcctcctcctcaatggcgttg

SEQ ID NO: 186546 - DNA, 25 bp, Homo sapien
ccaggtctagatcaggctcctcaga

SEQ ID NO: 186547 - DNA, 25 bp, Homo sapien
gcgggatgaagtcagcctcgttgaa

SEQ ID NO: 186548 - DNA, 25 bp, Homo sapien
cctcgttgaagagctcgtggctgga

SEQ ID NO: 186549 - DNA, 25 bp, Homo sapien
tagaagtcgtccacaaacacgggcc

SEQ ID NO: 186550 - DNA, 25 bp, Homo sapien
ctcagaaggcccgtaaggacagatc

SEQ ID NO: 186551 - DNA, 25 bp, Homo sapien
ggggacagattccaaggacccttgc

SEQ ID NO: 186552 - DNA, 25 bp, Homo sapien
tcaggccaggctagcaacgcaaacc

SEQ ID NO: 186553 - DNA, 25 bp, Homo sapien
caagatgtgagacctatgtgcgcgc

SEQ ID NO: 186554 - DNA, 25 bp, Homo sapien
gcccagccctcacttggacaaaggt

SEQ ID NO: 186555 - DNA, 25 bp, Homo sapien
acccttgcttgaaggctggtcactg

SEQ ID NO: 186556 - DNA, 25 bp, Homo sapien
ggtcactgtttcctttgggcctcca

SEQ ID NO: 186557 - DNA, 25 bp, Homo sapien
agggatgcgtattcccgcgaatcca

SEQ ID NO: 186558 - DNA, 25 bp, Homo sapien
gcgaatccactacacttctctcggg

SEQ ID NO: 186559 - DNA, 25 bp, Homo sapien
tgcggttggatttctccgatgtccg

SEQ ID NO: 186560 - DNA, 25 bp, Homo sapien
cccagtccatatcgcccttcactgc

SEQ ID NO: 186561 - DNA, 25 bp, Homo sapien
ccgggcggtcccaccgccactgcct

SEQ ID NO: 186562 - DNA, 25 bp, Homo sapien
gcgccttcccgggacgaccagcggc

SEQ ID NO: 186563 - DNA, 25 bp, Homo sapien
cagctgcggttggatttctccgatg

SEQ ID NO: 186564 - DNA, 25 bp, Homo sapien
gacgaccagcggctacgacccatgg

SEQ ID NO: 186565 - DNA, 25 bp, Homo sapien
tggcagctgcggttggatttctccg

SEQ ID NO: 186566 - DNA, 25 bp, Homo sapien
gctacgacccatggcgcccggactc

SEQ ID NO: 186567 - DNA, 25 bp, Homo sapien
tcggattacccgctgtcgctgcagt

SEQ ID NO: 186568 - DNA, 25 bp, Homo sapien
tcatgcgccacatcccggtgagtga

SEQ ID NO: 186569 - DNA, 25 bp, Homo sapien
agtcacactgcgacgtgccagcgga

SEQ ID NO: 186570 - DNA, 25 bp, Homo sapien
tcgtccggtcacgactatccgctgg

SEQ ID NO: 186571 - DNA, 25 bp, Homo sapien
tacgcgccgctgctctatctgcagt

SEQ ID NO: 186572 - DNA, 25 bp, Homo sapien
aacttcttgctgagccacggcccgg

SEQ ID NO: 186573 - DNA, 25 bp, Homo sapien
gctgctcttctacggcacagacttc

SEQ ID NO: 186574 - DNA, 25 bp, Homo sapien
gttggtccttctaggggtgctcagt

SEQ ID NO: 186575 - DNA, 25 bp, Homo sapien
tggccgcatgcgtccactgtggctc

SEQ ID NO: 186576 - DNA, 25 bp, Homo sapien
gagctcacctttccggctctctggc

SEQ ID NO: 186577 - DNA, 25 bp, Homo sapien
tgagctcacctttccggctctctgg

SEQ ID NO: 186578 - DNA, 25 bp, Homo sapien
tctctggccgcatgcgtccactgtg

SEQ ID NO: 186579 - DNA, 25 bp, Homo sapien
ctctggccgcatgcgtccactgtgg

SEQ ID NO: 186580 - DNA, 25 bp, Homo sapien
acccgcacgcctgagctcacctttc

SEQ ID NO: 186581 - DNA, 25 bp, Homo sapien
cgcatgcgtccactgtggctcctct

SEQ ID NO: 186582 - DNA, 25 bp, Homo sapien
ctggccgcatgcgtccactgtggct

SEQ ID NO: 186583 - DNA, 25 bp, Homo sapien
gcgccaagcgccacaggaaaagggg

SEQ ID NO: 186584 - DNA, 25 bp, Homo sapien
caagcgccacaggaaaagggggcgc

SEQ ID NO: 186585 - DNA, 25 bp, Homo sapien
gccaagcgccacaggaaaagggggc

SEQ ID NO: 186586 - DNA, 25 bp, Homo sapien
tgcgccaagcgccacaggaaaaggg

SEQ ID NO: 186587 - DNA, 25 bp, Homo sapien
cctgtcggcgtgtggcagcccgcct

SEQ ID NO: 186588 - DNA, 25 bp, Homo sapien
ccctgtcggcgtgtggcagcccgcc

SEQ ID NO: 186589 - DNA, 25 bp, Homo sapien
agggggcgctcctgtccctttgccg

SEQ ID NO: 186590 - DNA, 25 bp, Homo sapien
ctgtcggcgtgtggcagcccgcctg

SEQ ID NO: 186591 - DNA, 25 bp, Homo sapien
gatccgggcccatctctgacgtagt

SEQ ID NO: 186592 - DNA, 25 bp, Homo sapien
gcaatgcgcaggctccatgtcctgg

SEQ ID NO: 186593 - DNA, 25 bp, Homo sapien
catgactgtgctcccgcaatgcgca

SEQ ID NO: 186594 - DNA, 25 bp, Homo sapien
cgtgacgacagtgcctccatgactg

SEQ ID NO: 186595 - DNA, 25 bp, Homo sapien
gctcagccattacgccggcgtgcgg

SEQ ID NO: 186596 - DNA, 25 bp, Homo sapien
ggggtgaccgaattcagctctgcta

SEQ ID NO: 186597 - DNA, 25 bp, Homo sapien
ctgacgtagtgtgaccttgctcatc

SEQ ID NO: 186598 - DNA, 25 bp, Homo sapien
ttccctgtgcaagatgagggtcctg

SEQ ID NO: 186599 - DNA, 25 bp, Homo sapien
gacataccattgaagccattgggga

SEQ ID NO: 186600 - DNA, 25 bp, Homo sapien
gactgacataccattgaagccattg

SEQ ID NO: 186601 - DNA, 25 bp, Homo sapien
ggaacacgactgacataccattgaa

SEQ ID NO: 186602 - DNA, 25 bp, Homo sapien
cgccaggaacacgactgacatacca

SEQ ID NO: 186603 - DNA, 25 bp, Homo sapien
gcagcgggacactgttgttgcgcca

SEQ ID NO: 186604 - DNA, 25 bp, Homo sapien
ccgggtcaacggtctcggcctggca

SEQ ID NO: 186605 - DNA, 25 bp, Homo sapien
aggcactcccgggtcaacggtctcg

SEQ ID NO: 186606 - DNA, 25 bp, Homo sapien
gagggtcaggcactcccgggtcaac

SEQ ID NO: 186607 - DNA, 25 bp, Homo sapien
gcgaccgtcggaggcgagcggccct

SEQ ID NO: 186608 - DNA, 25 bp, Homo sapien
ctgaaactgcgaccgtcggaggcga

SEQ ID NO: 186609 - DNA, 25 bp, Homo sapien
ccggctgaaactgcgaccgtcggag

SEQ ID NO: 186610 - DNA, 25 bp, Homo sapien
cccggctgaaactgcgaccgtcgga

SEQ ID NO: 186611 - DNA, 25 bp, Homo sapien
gcggcccggctgaaactgcgaccgt

SEQ ID NO: 186612 - DNA, 25 bp, Homo sapien
tctccgctgtttctcgcgggcgcgg

SEQ ID NO: 186613 - DNA, 25 bp, Homo sapien
cggcacggatgggtagccgggcggc

SEQ ID NO: 186614 - DNA, 25 bp, Homo sapien
agttttgtgatttgaggaggggtcg

SEQ ID NO: 186615 - DNA, 25 bp, Homo sapien
ccacgcgaacctggtgcacgatatc

SEQ ID NO: 186616 - DNA, 25 bp, Homo sapien
tggtgcacgatatccggtgccgccc

SEQ ID NO: 186617 - DNA, 25 bp, Homo sapien
aacctggtgcacgatatccggtgcc

SEQ ID NO: 186618 - DNA, 25 bp, Homo sapien
cgcgaacctggtgcacgatatccgg

SEQ ID NO: 186619 - DNA, 25 bp, Homo sapien
gcctgcggtattgcagcgggtagaa

SEQ ID NO: 186620 - DNA, 25 bp, Homo sapien
gccgcagctcacaggacaggaagga

SEQ ID NO: 186621 - DNA, 25 bp, Homo sapien
agcgtccacgcgaacctggtgcacg

SEQ ID NO: 186622 - DNA, 25 bp, Homo sapien
gtccacgcgaacctggtgcacgata

SEQ ID NO: 186623 - DNA, 25 bp, Homo sapien
ccaggacccgcatgggagagaccgc

SEQ ID NO: 186624 - DNA, 25 bp, Homo sapien
gcacgcaccgcgtctcatccacaca

SEQ ID NO: 186625 - DNA, 25 bp, Homo sapien
tccacacagcggcagtcactttgcg

SEQ ID NO: 186626 - DNA, 25 bp, Homo sapien
gcggccactatgaggactgagcttc

SEQ ID NO: 186627 - DNA, 25 bp, Homo sapien
agagaccgcggcttcgagacacctg

SEQ ID NO: 186628 - DNA, 25 bp, Homo sapien
ccgcggcttcgagacacctggggac

SEQ ID NO: 186629 - DNA, 25 bp, Homo sapien
ctgcatctccgggacaccacttggg

SEQ ID NO: 186630 - DNA, 25 bp, Homo sapien
ggcagtcactttgcggccactatga

SEQ ID NO: 186631 - DNA, 25 bp, Homo sapien
ccatggacgtgttccaggagggtct

SEQ ID NO: 186632 - DNA, 25 bp, Homo sapien
tgccgcactccgaggccatggacgt

SEQ ID NO: 186633 - DNA, 25 bp, Homo sapien
accttgcgggtgatgttgtgcacgt

SEQ ID NO: 186634 - DNA, 25 bp, Homo sapien
gggcagaacagcagcatggtctcga

SEQ ID NO: 186635 - DNA, 25 bp, Homo sapien
cctcgagctcacattggtcctggca

SEQ ID NO: 186636 - DNA, 25 bp, Homo sapien
aatagacagggcgattctgcgctcc

SEQ ID NO: 186637 - DNA, 25 bp, Homo sapien
caggctgtctcgcacttgtcattgg

SEQ ID NO: 186638 - DNA, 25 bp, Homo sapien
gctgctctgcgatctgccgatccag

SEQ ID NO: 186639 - DNA, 25 bp, Homo sapien
gcgtctacacgacagaggccctgga

SEQ ID NO: 186640 - DNA, 25 bp, Homo sapien
gcagcctgaccctcccgaatggggt

SEQ ID NO: 186641 - DNA, 25 bp, Homo sapien
agccttcttgccgtgctctctcgag

SEQ ID NO: 186642 - DNA, 25 bp, Homo sapien
ccgtgtttgagtaaagcctctccca

SEQ ID NO: 186643 - DNA, 25 bp, Homo sapien
gctggtttccgagtaccgctgaact

SEQ ID NO: 186644 - DNA, 25 bp, Homo sapien
ctggacaagttcctgagccacgtta

SEQ ID NO: 186645 - DNA, 25 bp, Homo sapien
tgggcagcaacgtcggcgtctacac

SEQ ID NO: 186646 - DNA, 25 bp, Homo sapien
gccacgttatctcggcgctggtttc

SEQ ID NO: 186647 - DNA, 25 bp, Homo sapien
accagtgttgttagaacagtcagtc

SEQ ID NO: 186648 - DNA, 25 bp, Homo sapien
ccagtgttgttagaacagtcagtcg

SEQ ID NO: 186649 - DNA, 25 bp, Homo sapien
gagaccggcgctgttagaacagtca

SEQ ID NO: 186650 - DNA, 25 bp, Homo sapien
ccggcgctgttagaacagtcagtcg

SEQ ID NO: 186651 - DNA, 25 bp, Homo sapien
agagaccggcgctgttagaacagtc

SEQ ID NO: 186652 - DNA, 25 bp, Homo sapien
accggcgctgttagaacagtccgtc

SEQ ID NO: 186653 - DNA, 25 bp, Homo sapien
accggcgctgttagaacagtcagtc

SEQ ID NO: 186654 - DNA, 25 bp, Homo sapien
ctccagcgagagaccggcgctgtta

SEQ ID NO: 186655 - DNA, 25 bp, Homo sapien
actacctttgtctctcaccctgggg

SEQ ID NO: 186656 - DNA, 25 bp, Homo sapien
gcctagctgctctttgaccagcgtt

SEQ ID NO: 186657 - DNA, 25 bp, Homo sapien
agtgtccgtcgccttccacacgtgg

SEQ ID NO: 186658 - DNA, 25 bp, Homo sapien
ctcgtgacacgtgtctgagctttcc

SEQ ID NO: 186659 - DNA, 25 bp, Homo sapien
tgagctttccagtcgtggccgtgac

SEQ ID NO: 186660 - DNA, 25 bp, Homo sapien
ctggacggccactcactacctttgt

SEQ ID NO: 186661 - DNA, 25 bp, Homo sapien
ggagcctccacgtcctggtacagag

SEQ ID NO: 186662 - DNA, 25 bp, Homo sapien
tgaccagcgttctctgctctgcgtc

SEQ ID NO: 186663 - DNA, 25 bp, Homo sapien
tcctgaacaactaaaagctgctgcg

SEQ ID NO: 186664 - DNA, 25 bp, Homo sapien
ctaccagtgaacgtgagtgggacgt

SEQ ID NO: 186665 - DNA, 25 bp, Homo sapien
ttgccttctgctaccagtgaacgtg

SEQ ID NO: 186666 - DNA, 25 bp, Homo sapien
gtgccctctgtacttgccttctgct

SEQ ID NO: 186667 - DNA, 25 bp, Homo sapien
tgaggcttagggactccgcgtcctc

SEQ ID NO: 186668 - DNA, 25 bp, Homo sapien
tggggccgtcattcctgaacaacta

SEQ ID NO: 186669 - DNA, 25 bp, Homo sapien
acagtcctcactcgcttacggttcg

SEQ ID NO: 186670 - DNA, 25 bp, Homo sapien
agcgtgccctctgtacttgccttct

SEQ ID NO: 186671 - DNA, 25 bp, Homo sapien
tgcccgaacgctctctggggaacga

SEQ ID NO: 186672 - DNA, 25 bp, Homo sapien
aatgctggacctggaggtagtgccc

SEQ ID NO: 186673 - DNA, 25 bp, Homo sapien
aggcactagatacccgctccaactg

SEQ ID NO: 186674 - DNA, 25 bp, Homo sapien
tctggggaacgagcaatgggaattc

SEQ ID NO: 186675 - DNA, 25 bp, Homo sapien
cattcgctgatccttgctttctcct

SEQ ID NO: 186676 - DNA, 25 bp, Homo sapien
tgggctccaggcactagatacccgc

SEQ ID NO: 186677 - DNA, 25 bp, Homo sapien
ctggcccgatttgcctgtcagttgc

SEQ ID NO: 186678 - DNA, 25 bp, Homo sapien
aggcgagccgaaccaatgctggacc

SEQ ID NO: 186679 - DNA, 25 bp, Homo sapien
cggcgccaggaactccaggagattt

SEQ ID NO: 186680 - DNA, 25 bp, Homo sapien
gggccgcgcatgcacaattacgtca

SEQ ID NO: 186681 - DNA, 25 bp, Homo sapien
ctctgccaccgacttgacagcaata

SEQ ID NO: 186682 - DNA, 25 bp, Homo sapien
gatgtccgcatacgcaaggctctcg

SEQ ID NO: 186683 - DNA, 25 bp, Homo sapien
tctgcgtcgcccttaaaaacgaagc

SEQ ID NO: 186684 - DNA, 25 bp, Homo sapien
cgctgcgcatagagtaagaggccca

SEQ ID NO: 186685 - DNA, 25 bp, Homo sapien
aggagatttcccacgttcacgaaca

SEQ ID NO: 186686 - DNA, 25 bp, Homo sapien
cacttgtgcggctggttaatgagca

SEQ ID NO: 186687 - DNA, 25 bp, Homo sapien
gatgcaactcaaacagcgctcctcg

SEQ ID NO: 186688 - DNA, 25 bp, Homo sapien
gaaggcctgctcgtacagtccctcg

SEQ ID NO: 186689 - DNA, 25 bp, Homo sapien
ttgcgccatttgagacccacagagc

SEQ ID NO: 186690 - DNA, 25 bp, Homo sapien
aacgtctgttggtccttcaggctca

SEQ ID NO: 186691 - DNA, 25 bp, Homo sapien
ccgagccgcacttcagatttcgcag

SEQ ID NO: 186692 - DNA, 25 bp, Homo sapien
agctcagccagttcttcatcccgga

SEQ ID NO: 186693 - DNA, 25 bp, Homo sapien
acctgctgggctaggatgcaactca

SEQ ID NO: 186694 - DNA, 25 bp, Homo sapien
ctgcggtggatcttcagcatctgca

SEQ ID NO: 186695 - DNA, 25 bp, Homo sapien
ctcttcttacgtgttctttcacgga

SEQ ID NO: 186696 - DNA, 25 bp, Homo sapien
cgcatccgccgactggcagctcttc

SEQ ID NO: 186697 - DNA, 25 bp, Homo sapien
ctggcagctcttcttacgtgttctt

SEQ ID NO: 186698 - DNA, 25 bp, Homo sapien
tggcagctcttcttacgtgttcttt

SEQ ID NO: 186699 - DNA, 25 bp, Homo sapien
ggcagctcttcttacgtgttctttc

SEQ ID NO: 186700 - DNA, 25 bp, Homo sapien
gcagctcttcttacgtgttctttca

SEQ ID NO: 186701 - DNA, 25 bp, Homo sapien
agctcttcttacgtgttctttcacg

SEQ ID NO: 186702 - DNA, 25 bp, Homo sapien
tcttacgtgttctttcacggaagcc

SEQ ID NO: 186703 - DNA, 25 bp, Homo sapien
cgcctgtttccagggacgagccacg

SEQ ID NO: 186704 - DNA, 25 bp, Homo sapien
aggtaccgacctaacaacttctgcg

SEQ ID NO: 186705 - DNA, 25 bp, Homo sapien
tgtggggcgcttaggtaccgaccta

SEQ ID NO: 186706 - DNA, 25 bp, Homo sapien
ggtaccgacctaacaacttctgcgc

SEQ ID NO: 186707 - DNA, 25 bp, Homo sapien
cgacctaacaacttctgcgcctgtt

SEQ ID NO: 186708 - DNA, 25 bp, Homo sapien
tctgcgcctgtttccagggacgagc

SEQ ID NO: 186709 - DNA, 25 bp, Homo sapien
ctgagaaagtttggtggccggagac

SEQ ID NO: 186710 - DNA, 25 bp, Homo sapien
tgcgcctgtttccagggacgagcca

SEQ ID NO: 186711 - DNA, 25 bp, Homo sapien
cgagcaggtaagacaccagcgccca

SEQ ID NO: 186712 - DNA, 25 bp, Homo sapien
tagacggcaggaagacccgactttg

SEQ ID NO: 186713 - DNA, 25 bp, Homo sapien
cgcccaaggttagacggcaggaaga

SEQ ID NO: 186714 - DNA, 25 bp, Homo sapien
ggtaagacaccagcgcccaaggtta

SEQ ID NO: 186715 - DNA, 25 bp, Homo sapien
aggctccgctctactccgccgcttc

SEQ ID NO: 186716 - DNA, 25 bp, Homo sapien
ggtccgccgagcaggtaagacacca

SEQ ID NO: 186717 - DNA, 25 bp, Homo sapien
gggcaaagcccatctggtccgccga

SEQ ID NO: 186718 - DNA, 25 bp, Homo sapien
caccagcgcccaaggttagacggca

SEQ ID NO: 186719 - DNA, 25 bp, Homo sapien
gacgtccgtctctctccaggccgga

SEQ ID NO: 186720 - DNA, 25 bp, Homo sapien
tctccaggccggagctattgggagt

SEQ ID NO: 186721 - DNA, 25 bp, Homo sapien
gagctattgggagtggcggatcctc

SEQ ID NO: 186722 - DNA, 25 bp, Homo sapien
ccggatctgggccatggccgagcct

SEQ ID NO: 186723 - DNA, 25 bp, Homo sapien
gtgctggcactcatcttccgccacc

SEQ ID NO: 186724 - DNA, 25 bp, Homo sapien
cgctgctacctgcagcgccgtgtgg

SEQ ID NO: 186725 - DNA, 25 bp, Homo sapien
tcagagacgtccgtctctctccagg

SEQ ID NO: 186726 - DNA, 25 bp, Homo sapien
tggcactcatcttccgccacctgtc

SEQ ID NO: 186727 - DNA, 25 bp, Homo sapien
cgcaccggcgatttctcctgtagaa

SEQ ID NO: 186728 - DNA, 25 bp, Homo sapien
ggcacagaccacctgatccgctgga

SEQ ID NO: 186729 - DNA, 25 bp, Homo sapien
cctgcagtgtttctgcgtcctatta

SEQ ID NO: 186730 - DNA, 25 bp, Homo sapien
aacgcagcactttccgcggctttga

SEQ ID NO: 186731 - DNA, 25 bp, Homo sapien
ttgggtttcctcaagagcctctgga

SEQ ID NO: 186732 - DNA, 25 bp, Homo sapien
tctggccattaccttctaggacttg

SEQ ID NO: 186733 - DNA, 25 bp, Homo sapien
ggcactcacacccttggaatgacta

SEQ ID NO: 186734 - DNA, 25 bp, Homo sapien
gggcttcactgtgcctctggccatt

SEQ ID NO: 186735 - DNA, 25 bp, Homo sapien
gggagggaaagctgactacatgcac

SEQ ID NO: 186736 - DNA, 25 bp, Homo sapien
tggctcctagtgcccggggaagaac

SEQ ID NO: 186737 - DNA, 25 bp, Homo sapien
ccggccctttctgcaccgtcatctc

SEQ ID NO: 186738 - DNA, 25 bp, Homo sapien
tgacccgtgagtggggacgcccaaa

SEQ ID NO: 186739 - DNA, 25 bp, Homo sapien
agggaaaccgagattgggcagaatc

SEQ ID NO: 186740 - DNA, 25 bp, Homo sapien
gaaaccgagattgggcagaatcagc

SEQ ID NO: 186741 - DNA, 25 bp, Homo sapien
ggaaagctgactacatgcacgtccc

SEQ ID NO: 186742 - DNA, 25 bp, Homo sapien
cggcctccgcggtgtggctcctagt

SEQ ID NO: 186743 - DNA, 25 bp, Homo sapien
cgtgcacctttcctagtgaaacccg

SEQ ID NO: 186744 - DNA, 25 bp, Homo sapien
tgcacctttcctagtgaaacccgct

SEQ ID NO: 186745 - DNA, 25 bp, Homo sapien
ttcctagtgaaacccgcttccagtg

SEQ ID NO: 186746 - DNA, 25 bp, Homo sapien
tagtgaaacccgcttccagtgagac

SEQ ID NO: 186747 - DNA, 25 bp, Homo sapien
gtgaaacccgcttccagtgagactc

SEQ ID NO: 186748 - DNA, 25 bp, Homo sapien
aacccgcttccagtgagactccgtg

SEQ ID NO: 186749 - DNA, 25 bp, Homo sapien
cccgcttccagtgagactccgtggg

SEQ ID NO: 186750 - DNA, 25 bp, Homo sapien
cgcttccagtgagactccgtgggtg

SEQ ID NO: 186751 - DNA, 25 bp, Homo sapien
tatcgaccgcgagcggaaacgcctg

SEQ ID NO: 186752 - DNA, 25 bp, Homo sapien
ggttgcccagagcttcagaccctga

SEQ ID NO: 186753 - DNA, 25 bp, Homo sapien
gggaccgcagctatgaccctccatg

SEQ ID NO: 186754 - DNA, 25 bp, Homo sapien
ccgcacaggggtaaattgagcctca

SEQ ID NO: 186755 - DNA, 25 bp, Homo sapien
gggttgtcgtctccgctagaagtag

SEQ ID NO: 186756 - DNA, 25 bp, Homo sapien
cattggatgcactgcctgatgccga

SEQ ID NO: 186757 - DNA, 25 bp, Homo sapien
gagcggccgtcagagactatcgacc

SEQ ID NO: 186758 - DNA, 25 bp, Homo sapien
tcaccgggccagagtacgaggcatt

SEQ ID NO: 186759 - DNA, 25 bp, Homo sapien
tctgtaatgcgtcccggtttcctgt

SEQ ID NO: 186760 - DNA, 25 bp, Homo sapien
cgtgtctgtaatgggtcctggtttc

SEQ ID NO: 186761 - DNA, 25 bp, Homo sapien
tgtaaacccgtgtgtgtcccgtgtc

SEQ ID NO: 186762 - DNA, 25 bp, Homo sapien
gtgtctgtaatgtgtcgcggtttcc

SEQ ID NO: 186763 - DNA, 25 bp, Homo sapien
gtctgtaatgcgtcccggtttcctg

SEQ ID NO: 186764 - DNA, 25 bp, Homo sapien
gtgtctgtaatgtgtcccggtttcc

SEQ ID NO: 186765 - DNA, 25 bp, Homo sapien
cctgtaacccgtgtgtgtcccgtgt

SEQ ID NO: 186766 - DNA, 25 bp, Homo sapien
gtgtcccgtgtctgtaatgtgtccc

SEQ ID NO: 186767 - DNA, 25 bp, Homo sapien
ccttgctgaaacaacctgggagggc

SEQ ID NO: 186768 - DNA, 25 bp, Homo sapien
gccctggccctgttccatctggccg

SEQ ID NO: 186769 - DNA, 25 bp, Homo sapien
ctggcgatgtcgcagaatgcgcacg

SEQ ID NO: 186770 - DNA, 25 bp, Homo sapien
tagtagagcagtgcagcgcgccaca

SEQ ID NO: 186771 - DNA, 25 bp, Homo sapien
acacctggcagcgaggtgtcggtct

SEQ ID NO: 186772 - DNA, 25 bp, Homo sapien
aatgcgcacgatgccgtccaggtac

SEQ ID NO: 186773 - DNA, 25 bp, Homo sapien
tcgcagaatgcgcacgatgccgtcc

SEQ ID NO: 186774 - DNA, 25 bp, Homo sapien
acatcggcgtcctgcacgtagcgct

SEQ ID NO: 186775 - DNA, 25 bp, Homo sapien
caggacgggagccaggatactttaa

SEQ ID NO: 186776 - DNA, 25 bp, Homo sapien
gcaagaattccctcaaccctcgtgg

SEQ ID NO: 186777 - DNA, 25 bp, Homo sapien
gccgtggtttattctgcgagcagca

SEQ ID NO: 186778 - DNA, 25 bp, Homo sapien
cgcacctcacgtcgggaaattgttg

SEQ ID NO: 186779 - DNA, 25 bp, Homo sapien
aaattgttgccgcaggccagccacc

SEQ ID NO: 186780 - DNA, 25 bp, Homo sapien
aggtttagcagctccctcagggcga

SEQ ID NO: 186781 - DNA, 25 bp, Homo sapien
gcctcgggaacgcagtctgcacaga

SEQ ID NO: 186782 - DNA, 25 bp, Homo sapien
taagcgtgtcactctgcaagaattc

SEQ ID NO: 186783 - DNA, 25 bp, Homo sapien
ccggagatacatcaccgagaatgtg

SEQ ID NO: 186784 - DNA, 25 bp, Homo sapien
cggaacgtggtgaagattgccatca

SEQ ID NO: 186785 - DNA, 25 bp, Homo sapien
tgccatcaagatgcgtgacgccatc

SEQ ID NO: 186786 - DNA, 25 bp, Homo sapien
gccgcgagaatgaccactccacttg

SEQ ID NO: 186787 - DNA, 25 bp, Homo sapien
agcgttacgccctgcagtttgcgga

SEQ ID NO: 186788 - DNA, 25 bp, Homo sapien
ctaccggagcgcgatctgttattca

SEQ ID NO: 186789 - DNA, 25 bp, Homo sapien
cagttgatcagtcctcggagccctc

SEQ ID NO: 186790 - DNA, 25 bp, Homo sapien
agcctgacgcactctgagcgttacg

SEQ ID NO: 186791 - DNA, 25 bp, Homo sapien
tgccgatgtggtgcttagtgattgc

SEQ ID NO: 186792 - DNA, 25 bp, Homo sapien
gggccgggctagctatctgacagcc

SEQ ID NO: 186793 - DNA, 25 bp, Homo sapien
ggaaatgtagtctcgcctctttggg

SEQ ID NO: 186794 - DNA, 25 bp, Homo sapien
gtgagacctatttccgtcgcaaaag

SEQ ID NO: 186795 - DNA, 25 bp, Homo sapien
aaagctgacgacttcggtctgcgcc

SEQ ID NO: 186796 - DNA, 25 bp, Homo sapien
gtatttgcctcgcaccatggcggta

SEQ ID NO: 186797 - DNA, 25 bp, Homo sapien
cgccggaagtgcatgagctgccgat

SEQ ID NO: 186798 - DNA, 25 bp, Homo sapien
agtgattgcggtttcggtcgctctc

SEQ ID NO: 186799 - DNA, 25 bp, Homo sapien
ggcccacctcgtagagcacaagctg

SEQ ID NO: 186800 - DNA, 25 bp, Homo sapien
agagaacggcggctcctcttgccct

SEQ ID NO: 186801 - DNA, 25 bp, Homo sapien
ttccaatccgcctcagagcgtaagg

SEQ ID NO: 186802 - DNA, 25 bp, Homo sapien
cgttctagcagaggcggaccaggat

SEQ ID NO: 186803 - DNA, 25 bp, Homo sapien
cctccaatttcagggcgttctagca

SEQ ID NO: 186804 - DNA, 25 bp, Homo sapien
tcacatcgtagaaggagtcctggtc

SEQ ID NO: 186805 - DNA, 25 bp, Homo sapien
ttgccctcctcagaagaaggctttc

SEQ ID NO: 186806 - DNA, 25 bp, Homo sapien
gctccagtgcatccgtcacatcgta

SEQ ID NO: 186807 - DNA, 25 bp, Homo sapien
aagcacactgtagctccgcggttcg

SEQ ID NO: 186808 - DNA, 25 bp, Homo sapien
tagccactcacagggcccaatggga

SEQ ID NO: 186809 - DNA, 25 bp, Homo sapien
gggaatcccgttagttcactggcta

SEQ ID NO: 186810 - DNA, 25 bp, Homo sapien
agtttctttagatagtggccggcca

SEQ ID NO: 186811 - DNA, 25 bp, Homo sapien
cctcctctgtttggggcgctatgag

SEQ ID NO: 186812 - DNA, 25 bp, Homo sapien
gagtccctgtggtttcctcatttag

SEQ ID NO: 186813 - DNA, 25 bp, Homo sapien
ggctccggaaagttggcacatgcga

SEQ ID NO: 186814 - DNA, 25 bp, Homo sapien
gtgtcttccaggtactgcaccctca

SEQ ID NO: 186815 - DNA, 25 bp, Homo sapien
cccgtcgagacctgctcgggctgtg

SEQ ID NO: 186816 - DNA, 25 bp, Homo sapien
cgcggtaggccctgcaacaaggcca

SEQ ID NO: 186817 - DNA, 25 bp, Homo sapien
gaacccgaggcatcgtggtgccatg

SEQ ID NO: 186818 - DNA, 25 bp, Homo sapien
atcatgcgacctgtctctgggtgcc

SEQ ID NO: 186819 - DNA, 25 bp, Homo sapien
cgtcggctcattcagccgcggaagc

SEQ ID NO: 186820 - DNA, 25 bp, Homo sapien
gagctgccgaccgttggtcgctgcc

SEQ ID NO: 186821 - DNA, 25 bp, Homo sapien
gaaggctgtccgacttcacggttcc

SEQ ID NO: 186822 - DNA, 25 bp, Homo sapien
gccgtctgttcgaaggctgtccgac

SEQ ID NO: 186823 - DNA, 25 bp, Homo sapien
cgcgacgtccgcaaaagcataaaaa

SEQ ID NO: 186824 - DNA, 25 bp, Homo sapien
agcctgggtggctacctactataca

SEQ ID NO: 186825 - DNA, 25 bp, Homo sapien
aggggactccctacgagcgaatcgc

SEQ ID NO: 186826 - DNA, 25 bp, Homo sapien
cccgtgctctcttgggtaggattca

SEQ ID NO: 186827 - DNA, 25 bp, Homo sapien
cggttgactcaagagcactgccatc

SEQ ID NO: 186828 - DNA, 25 bp, Homo sapien
atcctgggatgtgcctaaagctcta

SEQ ID NO: 186829 - DNA, 25 bp, Homo sapien
tgttgcatagagagtcaggccggcc

SEQ ID NO: 186830 - DNA, 25 bp, Homo sapien
gctctccctcagtgacaggggtata

SEQ ID NO: 186831 - DNA, 25 bp, Homo sapien
tgacaagtatgaacccgccgctgtt

SEQ ID NO: 186832 - DNA, 25 bp, Homo sapien
agtcggcgtacgaacccagagtctc

SEQ ID NO: 186833 - DNA, 25 bp, Homo sapien
agagtctcctcctaatctgctgaca

SEQ ID NO: 186834 - DNA, 25 bp, Homo sapien
cagaggcgacttgcatcacggagat

SEQ ID NO: 186835 - DNA, 25 bp, Homo sapien
tcattctagctaaccgcgtcgggga

SEQ ID NO: 186836 - DNA, 25 bp, Homo sapien
agcccatcaaggagaagcctcagtc

SEQ ID NO: 186837 - DNA, 25 bp, Homo sapien
agatccagggcttcctcgattgtgc

SEQ ID NO: 186838 - DNA, 25 bp, Homo sapien
tgaattccgcgacgatgcgtgcaga

SEQ ID NO: 186839 - DNA, 25 bp, Homo sapien
ttccgctcgcccacacagttgttga

SEQ ID NO: 186840 - DNA, 25 bp, Homo sapien
acacgcacttgttgcaggcgctgca

SEQ ID NO: 186841 - DNA, 25 bp, Homo sapien
gggaccaagcgccaggcctgagaca

SEQ ID NO: 186842 - DNA, 25 bp, Homo sapien
tgcagtgcttggagcgagcgctcct

SEQ ID NO: 186843 - DNA, 25 bp, Homo sapien
gccgggctgtcctcaccggtagttc

SEQ ID NO: 186844 - DNA, 25 bp, Homo sapien
cacagttgttgagccacttgcagtg

SEQ ID NO: 186845 - DNA, 25 bp, Homo sapien
ctgccatgcgagctgcaaggtctgt

SEQ ID NO: 186846 - DNA, 25 bp, Homo sapien
cacttgcagtggtggtcgaaaccgc

SEQ ID NO: 186847 - DNA, 25 bp, Homo sapien
actgggccggtgagtcctcgagctc

SEQ ID NO: 186848 - DNA, 25 bp, Homo sapien
gctccaggcggaagcgagcccaaag

SEQ ID NO: 186849 - DNA, 25 bp, Homo sapien
gcgcctcagaccctcgcggtaggga

SEQ ID NO: 186850 - DNA, 25 bp, Homo sapien
caaagtcagccagaggttcgggccc

SEQ ID NO: 186851 - DNA, 25 bp, Homo sapien
gccgtgccagatgggccctgccaaa

SEQ ID NO: 186852 - DNA, 25 bp, Homo sapien
agccaggctccgaggtgagaaaccg

SEQ ID NO: 186853 - DNA, 25 bp, Homo sapien
ccaggccagacccagactggctggg

SEQ ID NO: 186854 - DNA, 25 bp, Homo sapien
tggctcaagccaggctccgaggtga

SEQ ID NO: 186855 - DNA, 25 bp, Homo sapien
cggggtcatgtggtcatccgtctac

SEQ ID NO: 186856 - DNA, 25 bp, Homo sapien
ctgatgcatggcagacgagcccgaa

SEQ ID NO: 186857 - DNA, 25 bp, Homo sapien
tccgtctacactgaacatttcgagg

SEQ ID NO: 186858 - DNA, 25 bp, Homo sapien
gggctgctgcaaacgttccggtgca

SEQ ID NO: 186859 - DNA, 25 bp, Homo sapien
acctggtctgttcatctgggctgtc

SEQ ID NO: 186860 - DNA, 25 bp, Homo sapien
ctcgctcctctttgcggctgcgtaa

SEQ ID NO: 186861 - DNA, 25 bp, Homo sapien
tcactgggcatcaggttctcaaggc

SEQ ID NO: 186862 - DNA, 25 bp, Homo sapien
tccacgtggccacatcattctgatg

SEQ ID NO: 186863 - DNA, 25 bp, Homo sapien
gctcctcgagcgcagcaactttggg

SEQ ID NO: 186864 - DNA, 25 bp, Homo sapien
agtggcatgtgctcacctgagcgcg

SEQ ID NO: 186865 - DNA, 25 bp, Homo sapien
cgcggtgctcatcaccggtgagtgc

SEQ ID NO: 186866 - DNA, 25 bp, Homo sapien
tccggctttttccaaatcgaatctg

SEQ ID NO: 186867 - DNA, 25 bp, Homo sapien
cgagcagagaaagcgagtgtccctc

SEQ ID NO: 186868 - DNA, 25 bp, Homo sapien
tgtcctcaggtgtcccgaacaagcg

SEQ ID NO: 186869 - DNA, 25 bp, Homo sapien
tcccgaacaagcgtgagtggcatgt

SEQ ID NO: 186870 - DNA, 25 bp, Homo sapien
ggctcttcataagctcggcccgagg

SEQ ID NO: 186871 - DNA, 25 bp, Homo sapien
ctccgggaagaacgacatggctgct

SEQ ID NO: 186872 - DNA, 25 bp, Homo sapien
aggccaacgcgaagacacgatgatc

SEQ ID NO: 186873 - DNA, 25 bp, Homo sapien
cttccctaagggttgctacgcgaca

SEQ ID NO: 186874 - DNA, 25 bp, Homo sapien
tttgtatggccacacctcgcaccga

SEQ ID NO: 186875 - DNA, 25 bp, Homo sapien
agtagccattgtccacgttaaagta

SEQ ID NO: 186876 - DNA, 25 bp, Homo sapien
gcgcaagcgcctcacgtgaccataa

SEQ ID NO: 186877 - DNA, 25 bp, Homo sapien
ccggtttgctgcacttgacgctgca

SEQ ID NO: 186878 - DNA, 25 bp, Homo sapien
cagaggcgaacaactgcggttctta

SEQ ID NO: 186879 - DNA, 25 bp, Homo sapien
ccagcgcagccatgtgagtgtcccg

SEQ ID NO: 186880 - DNA, 25 bp, Homo sapien
agaacgcagcttctcccacaaaagc

SEQ ID NO: 186881 - DNA, 25 bp, Homo sapien
ggcctaggagctgagctaatcctcc

SEQ ID NO: 186882 - DNA, 25 bp, Homo sapien
cgggcgtggagaacgcagcttctcc

SEQ ID NO: 186883 - DNA, 25 bp, Homo sapien
aagccggagaggatcgtccttgtcg

SEQ ID NO: 186884 - DNA, 25 bp, Homo sapien
ctcctagctctaggggccggcctaa

SEQ ID NO: 186885 - DNA, 25 bp, Homo sapien
acctccgagcgcaaggacagcgcga

SEQ ID NO: 186886 - DNA, 25 bp, Homo sapien
ccatgtgagtgtcccgcgccgtttc

SEQ ID NO: 186887 - DNA, 25 bp, Homo sapien
aatgtaaccagctgaccagggaggg

SEQ ID NO: 186888 - DNA, 25 bp, Homo sapien
gccagggaatgtaaccagctgacca

SEQ ID NO: 186889 - DNA, 25 bp, Homo sapien
ccggcaggaagtgaggccacccgac

SEQ ID NO: 186890 - DNA, 25 bp, Homo sapien
ggaagtgaggccacccgacagcctc

SEQ ID NO: 186891 - DNA, 25 bp, Homo sapien
atacgcttgggcagctgcgagatga

SEQ ID NO: 186892 - DNA, 25 bp, Homo sapien
cctcctatacgcttgggcagctgcg

SEQ ID NO: 186893 - DNA, 25 bp, Homo sapien
tctgcgtcgccgctcggactcagcc

SEQ ID NO: 186894 - DNA, 25 bp, Homo sapien
agctgcgagatgacgtcagccgccg

SEQ ID NO: 186895 - DNA, 25 bp, Homo sapien
ctgtcctgtcattagtgcccgggtc

SEQ ID NO: 186896 - DNA, 25 bp, Homo sapien
cccgggtcaataggagccagtcctt

SEQ ID NO: 186897 - DNA, 25 bp, Homo sapien
actctatgatgtccctgtcggtgcg

SEQ ID NO: 186898 - DNA, 25 bp, Homo sapien
cccgcgcggactcactctatgatgt

SEQ ID NO: 186899 - DNA, 25 bp, Homo sapien
gggatccgactggtactggacaccc

SEQ ID NO: 186900 - DNA, 25 bp, Homo sapien
tgtgcctagcgacaggaaagacctg

SEQ ID NO: 186901 - DNA, 25 bp, Homo sapien
aaacaggcgcttccgcacattcttc

SEQ ID NO: 186902 - DNA, 25 bp, Homo sapien
actcagtttccaggtgggagcctca

SEQ ID NO: 186903 - DNA, 25 bp, Homo sapien
ctagcttaagggttcggaccgactg

SEQ ID NO: 186904 - DNA, 25 bp, Homo sapien
ttccttcctttgtctgccctcgagg

SEQ ID NO: 186905 - DNA, 25 bp, Homo sapien
gctaagccaggtcccggtgccgtat

SEQ ID NO: 186906 - DNA, 25 bp, Homo sapien
ctctaggtgtcacgatggggccgct

SEQ ID NO: 186907 - DNA, 25 bp, Homo sapien
ttcgcgggccgcctctaggtgtcac

SEQ ID NO: 186908 - DNA, 25 bp, Homo sapien
agcgattaaaccgtgcgcggagctg

SEQ ID NO: 186909 - DNA, 25 bp, Homo sapien
catcgcgcccgcttttgaaagttgg

SEQ ID NO: 186910 - DNA, 25 bp, Homo sapien
tctgagcctgtggagcgattaaacc

SEQ ID NO: 186911 - DNA, 25 bp, Homo sapien
tgtttcccgccggagctcgttgggc

SEQ ID NO: 186912 - DNA, 25 bp, Homo sapien
cgacggcatctcctgtgagctccga

SEQ ID NO: 186913 - DNA, 25 bp, Homo sapien
ccaggcttcctgtgtgcgcgctcgt

SEQ ID NO: 186914 - DNA, 25 bp, Homo sapien
tgttggcagaattcgggcgctcctt

SEQ ID NO: 186915 - DNA, 25 bp, Homo sapien
actccaggttcggagcaacgggcag

SEQ ID NO: 186916 - DNA, 25 bp, Homo sapien
caggacctccggtgttggcagaatt

SEQ ID NO: 186917 - DNA, 25 bp, Homo sapien
tctcctgtgagctccgaggtaagcg

SEQ ID NO: 186918 - DNA, 25 bp, Homo sapien
aattcgggcgctccttgctgaacag

SEQ ID NO: 186919 - DNA, 25 bp, Homo sapien
agagcgcttctcattcgaggattcg

SEQ ID NO: 186920 - DNA, 25 bp, Homo sapien
ttcggaccgttttgaggaggattca

SEQ ID NO: 186921 - DNA, 25 bp, Homo sapien
ggccggaagtccagatcagctgatg

SEQ ID NO: 186922 - DNA, 25 bp, Homo sapien
agaactcgcttttccggccttcctg

SEQ ID NO: 186923 - DNA, 25 bp, Homo sapien
tgggagctgtcccaagcttagaaca

SEQ ID NO: 186924 - DNA, 25 bp, Homo sapien
caagagctctcttcaaccaggggaa

SEQ ID NO: 186925 - DNA, 25 bp, Homo sapien
cgcaaacagtcagcggggcccaatt

SEQ ID NO: 186926 - DNA, 25 bp, Homo sapien
tcccggccctaagtctcggagactg

SEQ ID NO: 186927 - DNA, 25 bp, Homo sapien
tccagctcatgcaggacgacgattg

SEQ ID NO: 186928 - DNA, 25 bp, Homo sapien
ggcctcgggcaattagaccactttg

SEQ ID NO: 186929 - DNA, 25 bp, Homo sapien
gtcctgcaccggattgtccagctca

SEQ ID NO: 186930 - DNA, 25 bp, Homo sapien
ttcaacgtccggtgcaagtgagccc

SEQ ID NO: 186931 - DNA, 25 bp, Homo sapien
catgtggcgcttggaaggaacttca

SEQ ID NO: 186932 - DNA, 25 bp, Homo sapien
ggcttcggctcagacatggtgactc

SEQ ID NO: 186933 - DNA, 25 bp, Homo sapien
agctccctggatctggcggataacg

SEQ ID NO: 186934 - DNA, 25 bp, Homo sapien
tcccagagcccttttggatggcctc

SEQ ID NO: 186935 - DNA, 25 bp, Homo sapien
cccagagggtctgacgcagcagccg

SEQ ID NO: 186936 - DNA, 25 bp, Homo sapien
cgctcctcatgggtggtagcggtca

SEQ ID NO: 186937 - DNA, 25 bp, Homo sapien
ctccgggagaagatgcagagccgca

SEQ ID NO: 186938 - DNA, 25 bp, Homo sapien
cccactccggagcgcgtggaattgg

SEQ ID NO: 186939 - DNA, 25 bp, Homo sapien
ccaggccatgcctgtgcgggaccat

SEQ ID NO: 186940 - DNA, 25 bp, Homo sapien
cgagagagggtgtccgtcctccctc

SEQ ID NO: 186941 - DNA, 25 bp, Homo sapien
cggcgctcggtgctcttctggtgct

SEQ ID NO: 186942 - DNA, 25 bp, Homo sapien
ggccaagcctgcgtctgctgcgcgt

SEQ ID NO: 186943 - DNA, 25 bp, Homo sapien
cacagtgcacggtcttgtaaggcca

SEQ ID NO: 186944 - DNA, 25 bp, Homo sapien
cgtcaagattcctgtggtaccggta

SEQ ID NO: 186945 - DNA, 25 bp, Homo sapien
cccgaacggttcagcacatatttat

SEQ ID NO: 186946 - DNA, 25 bp, Homo sapien
cccgatagcatcgtcgaggtgaaga

SEQ ID NO: 186947 - DNA, 25 bp, Homo sapien
tcgaaaccatttcagcaccgtgtga

SEQ ID NO: 186948 - DNA, 25 bp, Homo sapien
gtcactctgacagcggccaggcatt

SEQ ID NO: 186949 - DNA, 25 bp, Homo sapien
ggcatttgggccgttcgtcaagatt

SEQ ID NO: 186950 - DNA, 25 bp, Homo sapien
cgtttactctcatcgcggcgtcact

SEQ ID NO: 186951 - DNA, 25 bp, Homo sapien
gatttctcgggttgttctcatcgga

SEQ ID NO: 186952 - DNA, 25 bp, Homo sapien
tgtgtgggatgatttctcgggttgt

SEQ ID NO: 186953 - DNA, 25 bp, Homo sapien
ttgttgtcagaaggtacctggttgc

SEQ ID NO: 186954 - DNA, 25 bp, Homo sapien
tgtggaatgatttctcgggttgttc

SEQ ID NO: 186955 - DNA, 25 bp, Homo sapien
gttgcatgtgtggaatgatttctcg

SEQ ID NO: 186956 - DNA, 25 bp, Homo sapien
cctggttgcatgtgtggaatgattt

SEQ ID NO: 186957 - DNA, 25 bp, Homo sapien
gtcagaaggtacctggttgcatgtg

SEQ ID NO: 186958 - DNA, 25 bp, Homo sapien
tgggatgatttctcgggttgttctc

SEQ ID NO: 186959 - DNA, 25 bp, Homo sapien
ttctcgtcagaggtacctggccgca

SEQ ID NO: 186960 - DNA, 25 bp, Homo sapien
ctcgtgttgttctcattgggcggta

SEQ ID NO: 186961 - DNA, 25 bp, Homo sapien
tgtcggaaggtacctggtcgttctc

SEQ ID NO: 186962 - DNA, 25 bp, Homo sapien
tctcatcggacagtacctggccgtg

SEQ ID NO: 186963 - DNA, 25 bp, Homo sapien
ctagccgtgtgtaggacgatttctc

SEQ ID NO: 186964 - DNA, 25 bp, Homo sapien
ctctggccgttctcgtcagaaggta

SEQ ID NO: 186965 - DNA, 25 bp, Homo sapien
cacatgtgggacgatttctctggcc

SEQ ID NO: 186966 - DNA, 25 bp, Homo sapien
tctcgtcggatggtacttggccaca

SEQ ID NO: 186967 - DNA, 25 bp, Homo sapien
taaccttcaaacacagggccgcagc

SEQ ID NO: 186968 - DNA, 25 bp, Homo sapien
gtgaccgtcaggctgtttaaccttc

SEQ ID NO: 186969 - DNA, 25 bp, Homo sapien
tcggccgcctgtagttgtcaggaca

SEQ ID NO: 186970 - DNA, 25 bp, Homo sapien
agtgacggatccctatgtcctttgc

SEQ ID NO: 186971 - DNA, 25 bp, Homo sapien
tcactcgagaggttttgccgccagc

SEQ ID NO: 186972 - DNA, 25 bp, Homo sapien
ttcggtgtctaacgttaggtgttca

SEQ ID NO: 186973 - DNA, 25 bp, Homo sapien
gcacaggctggtgtccttattcccg

SEQ ID NO: 186974 - DNA, 25 bp, Homo sapien
gccacccgacgggacttgttgttgc

SEQ ID NO: 186975 - DNA, 25 bp, Homo sapien
actccgcgctgcactggaaaccatg

SEQ ID NO: 186976 - DNA, 25 bp, Homo sapien
caggttattcatttccggcggcgga

SEQ ID NO: 186977 - DNA, 25 bp, Homo sapien
cgggtcctatttctgcggtggaaag

SEQ ID NO: 186978 - DNA, 25 bp, Homo sapien
tggaaagggcgaatcccaaggcgac

SEQ ID NO: 186979 - DNA, 25 bp, Homo sapien
cggagcttaagcagcctggctagga

SEQ ID NO: 186980 - DNA, 25 bp, Homo sapien
catgctccataacggggatgggcct

SEQ ID NO: 186981 - DNA, 25 bp, Homo sapien
gcggcagtttcctaagcttggcttc

SEQ ID NO: 186982 - DNA, 25 bp, Homo sapien
cacgcgcctgcaggcagttggaaca

SEQ ID NO: 186983 - DNA, 25 bp, Homo sapien
aatcggctgtagtggttgactctca

SEQ ID NO: 186984 - DNA, 25 bp, Homo sapien
agcagtcgcggtaccacagcttctc

SEQ ID NO: 186985 - DNA, 25 bp, Homo sapien
tgtagtataaccgtcctcagccata

SEQ ID NO: 186986 - DNA, 25 bp, Homo sapien
agcaactcgggctggtagagaattc

SEQ ID NO: 186987 - DNA, 25 bp, Homo sapien
cctctttggacactgacacgcctta

SEQ ID NO: 186988 - DNA, 25 bp, Homo sapien
ccatcttggagggagctactattgt

SEQ ID NO: 186989 - DNA, 25 bp, Homo sapien
cagcggagtctcttgctggttgacc

SEQ ID NO: 186990 - DNA, 25 bp, Homo sapien
acagcttctcgtccgcgtcgaggta

SEQ ID NO: 186991 - DNA, 25 bp, Homo sapien
agttctcgcactatcgcagctcgcg

SEQ ID NO: 186992 - DNA, 25 bp, Homo sapien
tcgctgtcagggttgtggtcagcca

SEQ ID NO: 186993 - DNA, 25 bp, Homo sapien
tcccgccgccacagttaatgtaact

SEQ ID NO: 186994 - DNA, 25 bp, Homo sapien
taatgtaactctcgcgatgctcccg

SEQ ID NO: 186995 - DNA, 25 bp, Homo sapien
ttgtggtcagccatcgtctcggccc

SEQ ID NO: 186996 - DNA, 25 bp, Homo sapien
gaattgtagttctcgcactatcgca

SEQ ID NO: 186997 - DNA, 25 bp, Homo sapien
tatccagcacgcgtcgcagcagcgt

SEQ ID NO: 186998 - DNA, 25 bp, Homo sapien
tgcgcgggtccgctgtatccagcac

SEQ ID NO: 186999 - DNA, 25 bp, Homo sapien
ttgtagtctccgtgggcatataccc

SEQ ID NO: 187000 - DNA, 25 bp, Homo sapien
ctctggctcaagaacgtgtcgcgtg

SEQ ID NO: 187001 - DNA, 25 bp, Homo sapien
cgtgccaggctgctacaacaactcg

SEQ ID NO: 187002 - DNA, 25 bp, Homo sapien
caggcgacagcgttccaacctaata

SEQ ID NO: 187003 - DNA, 25 bp, Homo sapien
taactcgatctttcccttaggcggc

SEQ ID NO: 187004 - DNA, 25 bp, Homo sapien
tcgcccgaatcctggtccgcagtaa

SEQ ID NO: 187005 - DNA, 25 bp, Homo sapien
tgcagcaatgccgtcgactcaaagg

SEQ ID NO: 187006 - DNA, 25 bp, Homo sapien
tagtctctttctcaggcggtccttc

SEQ ID NO: 187007 - DNA, 25 bp, Homo sapien
ttctctagtcaggaccgtccggatg

SEQ ID NO: 187008 - DNA, 25 bp, Homo sapien
gcccgctccagagtcagcatgggta

SEQ ID NO: 187009 - DNA, 25 bp, Homo sapien
ccgcgcatagcacgccgggaattgt

SEQ ID NO: 187010 - DNA, 25 bp, Homo sapien
attgtagttttctctcggcgcgctc

SEQ ID NO: 187011 - DNA, 25 bp, Homo sapien
tgctacccacctacgaaggatccgg

SEQ ID NO: 187012 - DNA, 25 bp, Homo sapien
actgcgtctcccagagtgcagcggg

SEQ ID NO: 187013 - DNA, 25 bp, Homo sapien
ccaggcctttttctctagtcaggac

SEQ ID NO: 187014 - DNA, 25 bp, Homo sapien
taccgcgccctttgtggagcccgga

SEQ ID NO: 187015 - DNA, 25 bp, Homo sapien
ggcacccgctcggatccaccggctc

SEQ ID NO: 187016 - DNA, 25 bp, Homo sapien
tagcagccgcgcgacctgggttccg

SEQ ID NO: 187017 - DNA, 25 bp, Homo sapien
tcctctccgcgcgatggcactgccg

SEQ ID NO: 187018 - DNA, 25 bp, Homo sapien
tggtggcaacatccaagggagtctg

SEQ ID NO: 187019 - DNA, 25 bp, Homo sapien
cggggtgacatcgagacagcctctg

SEQ ID NO: 187020 - DNA, 25 bp, Homo sapien
cgactccggggtgacatcgagacag

SEQ ID NO: 187021 - DNA, 25 bp, Homo sapien
agcgcaccggatgtgggacaccaaa

SEQ ID NO: 187022 - DNA, 25 bp, Homo sapien
tccgccatctccgagcgaacgctct

SEQ ID NO: 187023 - DNA, 25 bp, Homo sapien
gcacctgcgggacatcctcaagctg

SEQ ID NO: 187024 - DNA, 25 bp, Homo sapien
gggacatcctcaagctggaccggcc

SEQ ID NO: 187025 - DNA, 25 bp, Homo sapien
tagtgaccggcgtcccgctgtctcg

SEQ ID NO: 187026 - DNA, 25 bp, Homo sapien
atcgacatcgaggacgccacgcagc

SEQ ID NO: 187027 - DNA, 25 bp, Homo sapien
ctttcctgacctcgcggacacaggg

SEQ ID NO: 187028 - DNA, 25 bp, Homo sapien
tgggactttcctgacctcgcggaca

SEQ ID NO: 187029 - DNA, 25 bp, Homo sapien
ggacgcttacttcagccccgtggga

SEQ ID NO: 187030 - DNA, 25 bp, Homo sapien
ctcctgcgcgagcatcgacatcgag

SEQ ID NO: 187031 - DNA, 25 bp, Homo sapien
gacgggctgcactccaagcagctag

SEQ ID NO: 187032 - DNA, 25 bp, Homo sapien
cccatgccctgaggccgttgctgtt

SEQ ID NO: 187033 - DNA, 25 bp, Homo sapien
tcagccagggatgatgcgctgctgc

SEQ ID NO: 187034 - DNA, 25 bp, Homo sapien
ctctcagccagggatgatgcgctgc

SEQ ID NO: 187035 - DNA, 25 bp, Homo sapien
actaggctctcagccagggatgatg

SEQ ID NO: 187036 - DNA, 25 bp, Homo sapien
gggctgcactccaagcagctagctc

SEQ ID NO: 187037 - DNA, 25 bp, Homo sapien
agctcccatccaatcaccgtccctc

SEQ ID NO: 187038 - DNA, 25 bp, Homo sapien
ccaagcagctagctcctgcactagg

SEQ ID NO: 187039 - DNA, 25 bp, Homo sapien
gcaggcagcggtcaagttactttga

SEQ ID NO: 187040 - DNA, 25 bp, Homo sapien
gccacgacgctaacgcccgagaatg

SEQ ID NO: 187041 - DNA, 25 bp, Homo sapien
tgtcgtgctggatagcccgtctcca

SEQ ID NO: 187042 - DNA, 25 bp, Homo sapien
tcagctgcgcgctgtgatgacgcca

SEQ ID NO: 187043 - DNA, 25 bp, Homo sapien
cccgtaggcttgttttggcgtcagc

SEQ ID NO: 187044 - DNA, 25 bp, Homo sapien
gtagcccagtttcgggagagtccgc

SEQ ID NO: 187045 - DNA, 25 bp, Homo sapien
cagagcgggtcaggttgatccaacc

SEQ ID NO: 187046 - DNA, 25 bp, Homo sapien
cccgaagaggttgattggcaggcca

SEQ ID NO: 187047 - DNA, 25 bp, Homo sapien
cagcttcagccgagtggtacgtgta

SEQ ID NO: 187048 - DNA, 25 bp, Homo sapien
gtacgtgtagagcaccgggcaaccc

SEQ ID NO: 187049 - DNA, 25 bp, Homo sapien
acccggcagccgtatgccatcaaga

SEQ ID NO: 187050 - DNA, 25 bp, Homo sapien
gtcgggtgcgtcatgccaacatcat

SEQ ID NO: 187051 - DNA, 25 bp, Homo sapien
cgcatcattgccaagggctccttca

SEQ ID NO: 187052 - DNA, 25 bp, Homo sapien
ggagagctctttgaccgcatcattg

SEQ ID NO: 187053 - DNA, 25 bp, Homo sapien
ttcgagacacaggagcgggtgtaca

SEQ ID NO: 187054 - DNA, 25 bp, Homo sapien
aagggctccttcaccgagcgtgacg

SEQ ID NO: 187055 - DNA, 25 bp, Homo sapien
aagtaggctccgatcctcttccgca

SEQ ID NO: 187056 - DNA, 25 bp, Homo sapien
gtctctcttggcgatgcccagcttg

SEQ ID NO: 187057 - DNA, 25 bp, Homo sapien
agggaagtaggctccgatcctcttc

SEQ ID NO: 187058 - DNA, 25 bp, Homo sapien
cctccaggctgagcggagggaagta

SEQ ID NO: 187059 - DNA, 25 bp, Homo sapien
atttctggtgcacgtctagaggggc

SEQ ID NO: 187060 - DNA, 25 bp, Homo sapien
tgggtcttcgcctttatttctggtg

SEQ ID NO: 187061 - DNA, 25 bp, Homo sapien
agggcaaacgttgctgagccgccga

SEQ ID NO: 187062 - DNA, 25 bp, Homo sapien
tctcttggcgatgcccagcttgggc

SEQ ID NO: 187063 - DNA, 25 bp, Homo sapien
gggctcgggagtctcactagatttt

SEQ ID NO: 187064 - DNA, 25 bp, Homo sapien
ttcagtgcctgctcgatactctcgg

SEQ ID NO: 187065 - DNA, 25 bp, Homo sapien
ccgaatcgttagtggctcgcgtatc

SEQ ID NO: 187066 - DNA, 25 bp, Homo sapien
agtggatcttctcgcagctcttgtc

SEQ ID NO: 187067 - DNA, 25 bp, Homo sapien
ataacgcgtgtagctccatcttgga

SEQ ID NO: 187068 - DNA, 25 bp, Homo sapien
acatcgccttttcctgtagcccagg

SEQ ID NO: 187069 - DNA, 25 bp, Homo sapien
tgaagtcaaccgctgcgacgccgtt

SEQ ID NO: 187070 - DNA, 25 bp, Homo sapien
cttgtccgccacgaccgaatcgtta

SEQ ID NO: 187071 - DNA, 25 bp, Homo sapien
aaaaagttgagtccgcaccgacgtg

SEQ ID NO: 187072 - DNA, 25 bp, Homo sapien
ccctcgaggttgtcatagtcgccgc

SEQ ID NO: 187073 - DNA, 25 bp, Homo sapien
gcaccacggtgaagtgaggcatcgt

SEQ ID NO: 187074 - DNA, 25 bp, Homo sapien
cgaggaaaatcgtgtctgcgcgcgc

SEQ ID NO: 187075 - DNA, 25 bp, Homo sapien
ggcgggagcactcctagtggctcca

SEQ ID NO: 187076 - DNA, 25 bp, Homo sapien
tgggattcaccgaagttgaagggcc

SEQ ID NO: 187077 - DNA, 25 bp, Homo sapien
tctcaaatgaggaaccgaggcgaga

SEQ ID NO: 187078 - DNA, 25 bp, Homo sapien
ctcaaaggcaaagacgctgaatctc

SEQ ID NO: 187079 - DNA, 25 bp, Homo sapien
ccgacctctgcaggcgcatccctcg

SEQ ID NO: 187080 - DNA, 25 bp, Homo sapien
gagccgcctcttctgaaggaaaatc

SEQ ID NO: 187081 - DNA, 25 bp, Homo sapien
gactacgcctactgccagcctccag

SEQ ID NO: 187082 - DNA, 25 bp, Homo sapien
gggtggcgtcctctgactacgccta

SEQ ID NO: 187083 - DNA, 25 bp, Homo sapien
ccgcctcttctgaaggaaaatccta

SEQ ID NO: 187084 - DNA, 25 bp, Homo sapien
ttcctactggactccctgccctcgc

SEQ ID NO: 187085 - DNA, 25 bp, Homo sapien
atcctactagctccgggcccataag

SEQ ID NO: 187086 - DNA, 25 bp, Homo sapien
gaaaatcctactagctccgggccca

SEQ ID NO: 187087 - DNA, 25 bp, Homo sapien
gtccacgagtgggaaactccgcatc

SEQ ID NO: 187088 - DNA, 25 bp, Homo sapien
gaaactccgcatcagggcctgcgcg

SEQ ID NO: 187089 - DNA, 25 bp, Homo sapien
ccgacaatggggtccggatcatgac

SEQ ID NO: 187090 - DNA, 25 bp, Homo sapien
ggtccggatcatgacgacccagcct

SEQ ID NO: 187091 - DNA, 25 bp, Homo sapien
tgacgacccagcctcccgaagaggg

SEQ ID NO: 187092 - DNA, 25 bp, Homo sapien
cctacatacccgtccacgagtggga

SEQ ID NO: 187093 - DNA, 25 bp, Homo sapien
gggttgaagtcacgcgactctgaga

SEQ ID NO: 187094 - DNA, 25 bp, Homo sapien
agtcacgcgactctgagaccgacgc

SEQ ID NO: 187095 - DNA, 25 bp, Homo sapien
acctggcggcgtggcctcaagagga

SEQ ID NO: 187096 - DNA, 25 bp, Homo sapien
ctcgattcaggccacctggcggcgt

SEQ ID NO: 187097 - DNA, 25 bp, Homo sapien
ctcaagaggagggtaacgaagtcac

SEQ ID NO: 187098 - DNA, 25 bp, Homo sapien
caggggtggcagtcagagagcctga

SEQ ID NO: 187099 - DNA, 25 bp, Homo sapien
cagagcgcgacgatggagtcccgac

SEQ ID NO: 187100 - DNA, 25 bp, Homo sapien
ggcaccgcccagtacggccaccagg

SEQ ID NO: 187101 - DNA, 25 bp, Homo sapien
taacgaagtcacagggccccgcgaa

SEQ ID NO: 187102 - DNA, 25 bp, Homo sapien
atggagtcccgaccctcgattcagg

SEQ ID NO: 187103 - DNA, 25 bp, Homo sapien
agccaagctgccttcaggatctcac

SEQ ID NO: 187104 - DNA, 25 bp, Homo sapien
cagggatggcccagccgtggcctct

SEQ ID NO: 187105 - DNA, 25 bp, Homo sapien
ccagaacgcggtcctggagcagcca

SEQ ID NO: 187106 - DNA, 25 bp, Homo sapien
ggcctctgccgctcgctggttttca

SEQ ID NO: 187107 - DNA, 25 bp, Homo sapien
ctggttttcacgtgagactgccgcc

SEQ ID NO: 187108 - DNA, 25 bp, Homo sapien
ccgcctctgcatctgaatagagcca

SEQ ID NO: 187109 - DNA, 25 bp, Homo sapien
tgcatctgaatagagccaagctgcc

SEQ ID NO: 187110 - DNA, 25 bp, Homo sapien
gatctcacctgcgtggctgtgcctt

SEQ ID NO: 187111 - DNA, 25 bp, Homo sapien
tcctcggcctcggacacggggctcc

SEQ ID NO: 187112 - DNA, 25 bp, Homo sapien
tgcaaggcagcagtcctcgtagccc

SEQ ID NO: 187113 - DNA, 25 bp, Homo sapien
aggcagcagtcctcgtagccctcgg

SEQ ID NO: 187114 - DNA, 25 bp, Homo sapien
ccagctgccgcacgctacgcagctg

SEQ ID NO: 187115 - DNA, 25 bp, Homo sapien
tggactgcccggtgcctcgcggaca

SEQ ID NO: 187116 - DNA, 25 bp, Homo sapien
ctcacctgccagatgtgcctgaaga

SEQ ID NO: 187117 - DNA, 25 bp, Homo sapien
gccagatgtgcctgaagaaggcgta

SEQ ID NO: 187118 - DNA, 25 bp, Homo sapien
cgtaggctgcaaggcagcagtcctc

SEQ ID NO: 187119 - DNA, 25 bp, Homo sapien
aggggatacagtctctcagtgcaca

SEQ ID NO: 187120 - DNA, 25 bp, Homo sapien
agcagcgagcatgccccagcgcgag

SEQ ID NO: 187121 - DNA, 25 bp, Homo sapien
tacagtctctcagtgcacagagccc

SEQ ID NO: 187122 - DNA, 25 bp, Homo sapien
atgccacgtaccttgcccggccagg

SEQ ID NO: 187123 - DNA, 25 bp, Homo sapien
ccacggggccgtcagcagcgagcat

SEQ ID NO: 187124 - DNA, 25 bp, Homo sapien
gccaactgaggggatacagtctctc

SEQ ID NO: 187125 - DNA, 25 bp, Homo sapien
gaggactcatgccacgtaccttgcc

SEQ ID NO: 187126 - DNA, 25 bp, Homo sapien
tctgcctgccaactgaggggataca

SEQ ID NO: 187127 - DNA, 25 bp, Homo sapien
tccaactgccgctgtagagccactg

SEQ ID NO: 187128 - DNA, 25 bp, Homo sapien
ccgcgttagagccatgtttccctta

SEQ ID NO: 187129 - DNA, 25 bp, Homo sapien
tttttaagagttcagctgcgaggtc

SEQ ID NO: 187130 - DNA, 25 bp, Homo sapien
ctccgaataggggatggcgacatcc

SEQ ID NO: 187131 - DNA, 25 bp, Homo sapien
cgcgtcgactcttccagccttgaga

SEQ ID NO: 187132 - DNA, 25 bp, Homo sapien
ctgcccttagacgagagctttcgca

SEQ ID NO: 187133 - DNA, 25 bp, Homo sapien
cagcctcctgtagtgcgtgcagcac

SEQ ID NO: 187134 - DNA, 25 bp, Homo sapien
tttctgcggcgcaaacgacatggcg

SEQ ID NO: 187135 - DNA, 25 bp, Homo sapien
acgccgatgactactgcaaactgtg

SEQ ID NO: 187136 - DNA, 25 bp, Homo sapien
tcgacatgagctccgcccaatgagg

SEQ ID NO: 187137 - DNA, 25 bp, Homo sapien
ctcgtctggtttagaaggaatcgcc

SEQ ID NO: 187138 - DNA, 25 bp, Homo sapien
accgagttacgcgataggcctgtga

SEQ ID NO: 187139 - DNA, 25 bp, Homo sapien
ctgttcgccgtgttagtggccaatc

SEQ ID NO: 187140 - DNA, 25 bp, Homo sapien
ggccagctttcggaacggaacgctc

SEQ ID NO: 187141 - DNA, 25 bp, Homo sapien
gagctcgacttcaaactcgtctttg

SEQ ID NO: 187142 - DNA, 25 bp, Homo sapien
gagccagccatcaggagtaacacga

SEQ ID NO: 187143 - DNA, 25 bp, Homo sapien
ggcgcacgcttaggatccggattcc

SEQ ID NO: 187144 - DNA, 25 bp, Homo sapien
agcgtgcaagacagaggccttctcc

SEQ ID NO: 187145 - DNA, 25 bp, Homo sapien
gagagttgccgggtatcaccctgta

SEQ ID NO: 187146 - DNA, 25 bp, Homo sapien
tgaggctcctttatggcgcgtttcc

SEQ ID NO: 187147 - DNA, 25 bp, Homo sapien
cggcgggaacatcagcgttgttaga

SEQ ID NO: 187148 - DNA, 25 bp, Homo sapien
ctgcctgctttcgtccctttctgga

SEQ ID NO: 187149 - DNA, 25 bp, Homo sapien
tccggattcctacttccagggctgg

SEQ ID NO: 187150 - DNA, 25 bp, Homo sapien
ccctttgcccagtggagcttggtga

SEQ ID NO: 187151 - DNA, 25 bp, Homo sapien
aaccgcgtgccagatatttggaaga

SEQ ID NO: 187152 - DNA, 25 bp, Homo sapien
tgggcctcatactcgcgaaatttta

SEQ ID NO: 187153 - DNA, 25 bp, Homo sapien
tgttgcctcggggacatgaaagccc

SEQ ID NO: 187154 - DNA, 25 bp, Homo sapien
cgtctaggagtggtgcgaaaacgcc

SEQ ID NO: 187155 - DNA, 25 bp, Homo sapien
cgctaccaagaaagatctcgcagtg

SEQ ID NO: 187156 - DNA, 25 bp, Homo sapien
ggagatccacactcgtctgcccaga

SEQ ID NO: 187157 - DNA, 25 bp, Homo sapien
gctgactccgttgccagaaccaggg

SEQ ID NO: 187158 - DNA, 25 bp, Homo sapien
gaggtcagccgcctttctcaaaacc

SEQ ID NO: 187159 - DNA, 25 bp, Homo sapien
gagagctgaacctgcatcccggacc

SEQ ID NO: 187160 - DNA, 25 bp, Homo sapien
cggatggcctcctgttcctcttgct

SEQ ID NO: 187161 - DNA, 25 bp, Homo sapien
ctgctaatgctgctcgcggacccag

SEQ ID NO: 187162 - DNA, 25 bp, Homo sapien
cggtctgcttctgttccagtcacga

SEQ ID NO: 187163 - DNA, 25 bp, Homo sapien
agcgtattggtatctgtcttgtcac

SEQ ID NO: 187164 - DNA, 25 bp, Homo sapien
tgatctagatctgccggctcacctc

SEQ ID NO: 187165 - DNA, 25 bp, Homo sapien
gagccaggcgatacctcgatccatc

SEQ ID NO: 187166 - DNA, 25 bp, Homo sapien
gcgagtccctattggccagccattt

SEQ ID NO: 187167 - DNA, 25 bp, Homo sapien
gagtccactgcaacttcgggtgtcc

SEQ ID NO: 187168 - DNA, 25 bp, Homo sapien
cgggtgtcctttttgaggagccatt

SEQ ID NO: 187169 - DNA, 25 bp, Homo sapien
gaggagccattttaccctcccagca

SEQ ID NO: 187170 - DNA, 25 bp, Homo sapien
ccgagtgactcgatttcttggtatc

SEQ ID NO: 187171 - DNA, 25 bp, Homo sapien
tcttggtatctttgccagcatgtgg

SEQ ID NO: 187172 - DNA, 25 bp, Homo sapien
ccagcatgtggggttgttgctactt

SEQ ID NO: 187173 - DNA, 25 bp, Homo sapien
tgctacttttattccagccgttttg

SEQ ID NO: 187174 - DNA, 25 bp, Homo sapien
ccagccgttttgatgggtgtgcagt

SEQ ID NO: 187175 - DNA, 25 bp, Homo sapien
agccgaaccctgtgggtcttcgctg

SEQ ID NO: 187176 - DNA, 25 bp, Homo sapien
agaaacgctgtatgggtgcgagccc

SEQ ID NO: 187177 - DNA, 25 bp, Homo sapien
aggccgtttggatccctgtgtgagc

SEQ ID NO: 187178 - DNA, 25 bp, Homo sapien
cccaggtcaagtgcgagataggaac

SEQ ID NO: 187179 - DNA, 25 bp, Homo sapien
agttcacgggctgctcgagccctga

SEQ ID NO: 187180 - DNA, 25 bp, Homo sapien
tgagactgtgcgacggtgaccctga

SEQ ID NO: 187181 - DNA, 25 bp, Homo sapien
cgcacggaactgtgtcccgacgcgg

SEQ ID NO: 187182 - DNA, 25 bp, Homo sapien
tccgactgcaggacggagaacctgt

SEQ ID NO: 187183 - DNA, 25 bp, Homo sapien
gggatagctttccagttctgcttta

SEQ ID NO: 187184 - DNA, 25 bp, Homo sapien
agaggctggactggttcctcctagg

SEQ ID NO: 187185 - DNA, 25 bp, Homo sapien
gtttcgtaccggctgcacccgaaga

SEQ ID NO: 187186 - DNA, 25 bp, Homo sapien
ggccaccaagtggaagacattattc

SEQ ID NO: 187187 - DNA, 25 bp, Homo sapien
cggaggcgtttacaagcgagcacaa

SEQ ID NO: 187188 - DNA, 25 bp, Homo sapien
cctccatagtggctgccgctgagca

SEQ ID NO: 187189 - DNA, 25 bp, Homo sapien
ggctctgtcgcagtactcgtgcctg

SEQ ID NO: 187190 - DNA, 25 bp, Homo sapien
cttcacccggagtacagcggtcctg

SEQ ID NO: 187191 - DNA, 25 bp, Homo sapien
gctgtcctcttaatgctcccgggga

SEQ ID NO: 187192 - DNA, 25 bp, Homo sapien
cttgtactccacagaggctgtcctc

SEQ ID NO: 187193 - DNA, 25 bp, Homo sapien
accgaggccttgtacaggagcttgc

SEQ ID NO: 187194 - DNA, 25 bp, Homo sapien
tgtaaattttgatctggggccgggc

SEQ ID NO: 187195 - DNA, 25 bp, Homo sapien
tcctgctgattatggttgggcgtct

SEQ ID NO: 187196 - DNA, 25 bp, Homo sapien
attgcggattctctgcccgatctcc

SEQ ID NO: 187197 - DNA, 25 bp, Homo sapien
ggcccttgtcttccagccgtgaata

SEQ ID NO: 187198 - DNA, 25 bp, Homo sapien
gggtcgtgtacaaaaccatcgcagc

SEQ ID NO: 187199 - DNA, 25 bp, Homo sapien
gagcggtccgcgatctcatccatca

SEQ ID NO: 187200 - DNA, 25 bp, Homo sapien
attccgagtgtcagtgctttcctcc

SEQ ID NO: 187201 - DNA, 25 bp, Homo sapien
tccacccgcgactccgagaaggatg

SEQ ID NO: 187202 - DNA, 25 bp, Homo sapien
ttcaccagtaacctaggagggtcca

SEQ ID NO: 187203 - DNA, 25 bp, Homo sapien
aagggtcttccctgcatcccaagca

SEQ ID NO: 187204 - DNA, 25 bp, Homo sapien
tttgtaacctcgagcagccgaagtg

SEQ ID NO: 187205 - DNA, 25 bp, Homo sapien
tcccgtcctgagtaatccgagcagc

SEQ ID NO: 187206 - DNA, 25 bp, Homo sapien
tcctgagagcaacgagaacacgtcc

SEQ ID NO: 187207 - DNA, 25 bp, Homo sapien
gctccgcagcagagctagggctgca

SEQ ID NO: 187208 - DNA, 25 bp, Homo sapien
ctcctcgaagagctggtagtcgtcg

SEQ ID NO: 187209 - DNA, 25 bp, Homo sapien
gcaccgcgagactttaccggggaga

SEQ ID NO: 187210 - DNA, 25 bp, Homo sapien
ggttcgcgacttatgggcttgtccc

SEQ ID NO: 187211 - DNA, 25 bp, Homo sapien
taggagtctggaccactgacctctc

SEQ ID NO: 187212 - DNA, 25 bp, Homo sapien
ctgacctctctggacgggtcctaca

SEQ ID NO: 187213 - DNA, 25 bp, Homo sapien
gcgagaagccgcatagctcccgggc

SEQ ID NO: 187214 - DNA, 25 bp, Homo sapien
ggccgtacttgccaagctcctcgaa

SEQ ID NO: 187215 - DNA, 25 bp, Homo sapien
gctgacaaaccatccaacgtcggtt

SEQ ID NO: 187216 - DNA, 25 bp, Homo sapien
agcccgcttggctctgcaagtttgc

SEQ ID NO: 187217 - DNA, 25 bp, Homo sapien
cgctccagctcactgtccttgggta

SEQ ID NO: 187218 - DNA, 25 bp, Homo sapien
cggtgaaagtatccgctgacaaacc

SEQ ID NO: 187219 - DNA, 25 bp, Homo sapien
agcctccggagaacagcccgcttgg

SEQ ID NO: 187220 - DNA, 25 bp, Homo sapien
aagacccgttgcgaaggctgcgcta

SEQ ID NO: 187221 - DNA, 25 bp, Homo sapien
gctcgtggaccaagaggacgcactc

SEQ ID NO: 187222 - DNA, 25 bp, Homo sapien
ggacgcactcggatctggagttctc

SEQ ID NO: 187223 - DNA, 25 bp, Homo sapien
ttgaagaggctttgaggcaccactt

SEQ ID NO: 187224 - DNA, 25 bp, Homo sapien
ttcgcgccttgcaactcgacaactg

SEQ ID NO: 187225 - DNA, 25 bp, Homo sapien
tcttgagtagctagcagaacccgga

SEQ ID NO: 187226 - DNA, 25 bp, Homo sapien
ccacttgggcacgtggagacctctg

SEQ ID NO: 187227 - DNA, 25 bp, Homo sapien
agaacccggaggagctctcagaacc

SEQ ID NO: 187228 - DNA, 25 bp, Homo sapien
gcgcccaactacgtggcttgtgatt

SEQ ID NO: 187229 - DNA, 25 bp, Homo sapien
tttagcacctggtgggtttcgcgcc

SEQ ID NO: 187230 - DNA, 25 bp, Homo sapien
ttgcgagtcggtcttttctgccttc

SEQ ID NO: 187231 - DNA, 25 bp, Homo sapien
caccaccctgcgaaggggactgggc

SEQ ID NO: 187232 - DNA, 25 bp, Homo sapien
cgctgagcctttcatttcggggatg

SEQ ID NO: 187233 - DNA, 25 bp, Homo sapien
cctccgcagatcagaattggagata

SEQ ID NO: 187234 - DNA, 25 bp, Homo sapien
cccttgcaaagaggaggcggacagt

SEQ ID NO: 187235 - DNA, 25 bp, Homo sapien
tttatcgtcagcctcgtcgaaaggg

SEQ ID NO: 187236 - DNA, 25 bp, Homo sapien
tcgaaaggggcgtacgattgctccc

SEQ ID NO: 187237 - DNA, 25 bp, Homo sapien
aattggagataaccgaggcttcggc

SEQ ID NO: 187238 - DNA, 25 bp, Homo sapien
ctggaatacagggacacgcacactc

SEQ ID NO: 187239 - DNA, 25 bp, Homo sapien
cgtcgcaggcagaagagctgactct

SEQ ID NO: 187240 - DNA, 25 bp, Homo sapien
gaagagctgactctccaatctccgc

SEQ ID NO: 187241 - DNA, 25 bp, Homo sapien
gaaatgagcgcgctcaacagcccac

SEQ ID NO: 187242 - DNA, 25 bp, Homo sapien
ggtgtttacttaattagggcctgca

SEQ ID NO: 187243 - DNA, 25 bp, Homo sapien
aattagggcctgcatcccgaggctc

SEQ ID NO: 187244 - DNA, 25 bp, Homo sapien
tgtgtttaaccgtccgcctaatggc

SEQ ID NO: 187245 - DNA, 25 bp, Homo sapien
gcctaatggcttcgtctggctccgg

SEQ ID NO: 187246 - DNA, 25 bp, Homo sapien
cctcgggcataaaaagcgccctgcg

SEQ ID NO: 187247 - DNA, 25 bp, Homo sapien
cagcagagcgcctatgacatccagc

SEQ ID NO: 187248 - DNA, 25 bp, Homo sapien
tgtccggtagccactgcttaccttg

SEQ ID NO: 187249 - DNA, 25 bp, Homo sapien
gaccattttggtgtggaccgcgcga

SEQ ID NO: 187250 - DNA, 25 bp, Homo sapien
gtaagatcctcagggtggaaccgca

SEQ ID NO: 187251 - DNA, 25 bp, Homo sapien
cccagaactgcgagacagaggctga

SEQ ID NO: 187252 - DNA, 25 bp, Homo sapien
gcactgggtgttcttttctcctcta

SEQ ID NO: 187253 - DNA, 25 bp, Homo sapien
ttctcttcccgtactgaggaggctg

SEQ ID NO: 187254 - DNA, 25 bp, Homo sapien
ctcctccgagatgccggatggctga

SEQ ID NO: 187255 - DNA, 25 bp, Homo sapien
tgttcgactatgagggcagcggctc

SEQ ID NO: 187256 - DNA, 25 bp, Homo sapien
gctcctaactacctgttctctgttg

SEQ ID NO: 187257 - DNA, 25 bp, Homo sapien
ctgttctctgttgccgcagaacctg

SEQ ID NO: 187258 - DNA, 25 bp, Homo sapien
cgcagaacctgaaggcggctaacac

SEQ ID NO: 187259 - DNA, 25 bp, Homo sapien
gacaccctcttggtgttcgactatg

SEQ ID NO: 187260 - DNA, 25 bp, Homo sapien
gcctccgaccaagaccaagattacg

SEQ ID NO: 187261 - DNA, 25 bp, Homo sapien
ttacgattatctgaacgagtggggc

SEQ ID NO: 187262 - DNA, 25 bp, Homo sapien
acctgaaggcggctaacacagaccc

SEQ ID NO: 187263 - DNA, 25 bp, Homo sapien
tgtgcagtggtgtctcgggatgggt

SEQ ID NO: 187264 - DNA, 25 bp, Homo sapien
tgtgcagtggtgtctcgggacgggt

SEQ ID NO: 187265 - DNA, 25 bp, Homo sapien
ctcgggacgggtgtgagtggtgtca

SEQ ID NO: 187266 - DNA, 25 bp, Homo sapien
acgggtgtgagtggtgtcacgggac

SEQ ID NO: 187267 - DNA, 25 bp, Homo sapien
tcacgggacgggtgtgagtggtgtc

SEQ ID NO: 187268 - DNA, 25 bp, Homo sapien
cacgggacgggtgtgagtggtgtct

SEQ ID NO: 187269 - DNA, 25 bp, Homo sapien
acgggtgtgagtggtgtctcgggac

SEQ ID NO: 187270 - DNA, 25 bp, Homo sapien
atgggtgtgagtggtgtctcgggat

SEQ ID NO: 187271 - DNA, 25 bp, Homo sapien
tggcgtcggaactgcaaagcacctg

SEQ ID NO: 187272 - DNA, 25 bp, Homo sapien
gagtggtgcattcccggtctaagga

SEQ ID NO: 187273 - DNA, 25 bp, Homo sapien
gccatgccaagaaaggtcgtaaata

SEQ ID NO: 187274 - DNA, 25 bp, Homo sapien
tccgtagaaataaaggcacctgcca

SEQ ID NO: 187275 - DNA, 25 bp, Homo sapien
tcttccaagaaagttcgggtcctga

SEQ ID NO: 187276 - DNA, 25 bp, Homo sapien
ccctgacttgcgagggacgcattcg

SEQ ID NO: 187277 - DNA, 25 bp, Homo sapien
tggggtactggagaataaagacatc

SEQ ID NO: 187278 - DNA, 25 bp, Homo sapien
agcacctgtgagcttgcggaagtca

SEQ ID NO: 187279 - DNA, 25 bp, Homo sapien
gagcattgtctatgcccgtcctcat

SEQ ID NO: 187280 - DNA, 25 bp, Homo sapien
tgttacactccagtcatggcggccc

SEQ ID NO: 187281 - DNA, 25 bp, Homo sapien
gctcaggagacatgcggtctggatc

SEQ ID NO: 187282 - DNA, 25 bp, Homo sapien
ctggatcggattttggaggcattga

SEQ ID NO: 187283 - DNA, 25 bp, Homo sapien
aggcattgaagctgctgctgagccc

SEQ ID NO: 187284 - DNA, 25 bp, Homo sapien
atgcccgtcctcattacgttcttga

SEQ ID NO: 187285 - DNA, 25 bp, Homo sapien
agagccttctgccacacttaacatg

SEQ ID NO: 187286 - DNA, 25 bp, Homo sapien
tcgcgagcgtggtgttacactccag

SEQ ID NO: 187287 - DNA, 25 bp, Homo sapien
tgatggagaagcgtgcgtccttgac

SEQ ID NO: 187288 - DNA, 25 bp, Homo sapien
cttgtgcccttgaaagccgagtgcg

SEQ ID NO: 187289 - DNA, 25 bp, Homo sapien
ccgttgggcgcacaagtttccatgc

SEQ ID NO: 187290 - DNA, 25 bp, Homo sapien
ccctcaaagtttcggaggcttgatg

SEQ ID NO: 187291 - DNA, 25 bp, Homo sapien
aggagaacctcgaccacagcctgca

SEQ ID NO: 187292 - DNA, 25 bp, Homo sapien
ctgcaccagcgcctgattgcacgtg

SEQ ID NO: 187293 - DNA, 25 bp, Homo sapien
cctgggtaatgcctctaattcctgc

SEQ ID NO: 187294 - DNA, 25 bp, Homo sapien
cggctcctgttttgtgaatgaatta

SEQ ID NO: 187295 - DNA, 25 bp, Homo sapien
gtcgcagcacagtgcggagaccgca

SEQ ID NO: 187296 - DNA, 25 bp, Homo sapien
cccaaatctttgtgagcgttgcgga

SEQ ID NO: 187297 - DNA, 25 bp, Homo sapien
ctttgtgagcgttgcggaagcacgc

SEQ ID NO: 187298 - DNA, 25 bp, Homo sapien
cgggccctgatatagagcaggcgcc

SEQ ID NO: 187299 - DNA, 25 bp, Homo sapien
gtcgtgagcgactccaaagtgagtg

SEQ ID NO: 187300 - DNA, 25 bp, Homo sapien
ctcgccaccatgagagccctgctgg

SEQ ID NO: 187301 - DNA, 25 bp, Homo sapien
ggagcctggtcaccgcgggcatctc

SEQ ID NO: 187302 - DNA, 25 bp, Homo sapien
gtgagtgccgcggtcctgagatccc

SEQ ID NO: 187303 - DNA, 25 bp, Homo sapien
cttccctgacctcaaggtggtcatg

SEQ ID NO: 187304 - DNA, 25 bp, Homo sapien
cggtggcactgtgcattgccgcata

SEQ ID NO: 187305 - DNA, 25 bp, Homo sapien
aggaccctgactacttgcgcaagtg

SEQ ID NO: 187306 - DNA, 25 bp, Homo sapien
tgctggacatcttccacgaggtgct

SEQ ID NO: 187307 - DNA, 25 bp, Homo sapien
ccggcttctttgtgtggcgcagcaa

SEQ ID NO: 187308 - DNA, 25 bp, Homo sapien
tgtggcgcagcaacttccatgaggc

SEQ ID NO: 187309 - DNA, 25 bp, Homo sapien
ttgccgcataccaggaggaccctga

SEQ ID NO: 187310 - DNA, 25 bp, Homo sapien
agcaccttctcgtgcatcatgcaga

SEQ ID NO: 187311 - DNA, 25 bp, Homo sapien
ggtctctactctcggccagtatata

SEQ ID NO: 187312 - DNA, 25 bp, Homo sapien
cctaaccttgaagctaggccagtga

SEQ ID NO: 187313 - DNA, 25 bp, Homo sapien
cttgctctgtctgcgggttcctaac

SEQ ID NO: 187314 - DNA, 25 bp, Homo sapien
gaccgaacgcgcttgctctgtctgc

SEQ ID NO: 187315 - DNA, 25 bp, Homo sapien
ctccttgtcccgagggtctccttgt

SEQ ID NO: 187316 - DNA, 25 bp, Homo sapien
cacttccgactatgcgccaggagca

SEQ ID NO: 187317 - DNA, 25 bp, Homo sapien
ctgacctgcaatggcggccgccgag

SEQ ID NO: 187318 - DNA, 25 bp, Homo sapien
ccagtatatatgttggcgggcgtcg

SEQ ID NO: 187319 - DNA, 25 bp, Homo sapien
ctgcctgactggaatgagggtagct

SEQ ID NO: 187320 - DNA, 25 bp, Homo sapien
gtctgtctccgtttgcccgctgaga

SEQ ID NO: 187321 - DNA, 25 bp, Homo sapien
acctcggcccgataagctgacacta

SEQ ID NO: 187322 - DNA, 25 bp, Homo sapien
tgagattgagtaaaaagcagctgcc

SEQ ID NO: 187323 - DNA, 25 bp, Homo sapien
ccctagggaagactcggctgagatt

SEQ ID NO: 187324 - DNA, 25 bp, Homo sapien
agccgccgaagtgtggcttgcagcc

SEQ ID NO: 187325 - DNA, 25 bp, Homo sapien
ttcagtgtggaaaaacggatgcttc

SEQ ID NO: 187326 - DNA, 25 bp, Homo sapien
cgcgagaaccggatgccgatcctca

SEQ ID NO: 187327 - DNA, 25 bp, Homo sapien
tcaaccctccaggtacttcgtgcgg

SEQ ID NO: 187328 - DNA, 25 bp, Homo sapien
ggaagtccctcgacctcacttcgaa

SEQ ID NO: 187329 - DNA, 25 bp, Homo sapien
gggtcctggaagtccctcgacctca

SEQ ID NO: 187330 - DNA, 25 bp, Homo sapien
gctgggcgttcagacagcgatgctc

SEQ ID NO: 187331 - DNA, 25 bp, Homo sapien
gtggggatcagcctcacccgagccg

SEQ ID NO: 187332 - DNA, 25 bp, Homo sapien
aatgacaacgtcaaccctccaggta

SEQ ID NO: 187333 - DNA, 25 bp, Homo sapien
cctgcagtgcgagccgtggacgcta

SEQ ID NO: 187334 - DNA, 25 bp, Homo sapien
gctcggagccgggtggcatctccac

SEQ ID NO: 187335 - DNA, 25 bp, Homo sapien
atcagcatcatcgtgcgggactctc

SEQ ID NO: 187336 - DNA, 25 bp, Homo sapien
atccgctgtcaactcctgccgtgtg

SEQ ID NO: 187337 - DNA, 25 bp, Homo sapien
ggtgcagtcggccacacacttcaaa

SEQ ID NO: 187338 - DNA, 25 bp, Homo sapien
gactctctcatgcagcccgtgagga

SEQ ID NO: 187339 - DNA, 25 bp, Homo sapien
gtgaataccattccatcatccgctg

SEQ ID NO: 187340 - DNA, 25 bp, Homo sapien
ctgggctctctaggtttgaaaaacg

SEQ ID NO: 187341 - DNA, 25 bp, Homo sapien
ttccggttgcatctcgggagcactc

SEQ ID NO: 187342 - DNA, 25 bp, Homo sapien
tgcaaacatccacgagctggcccgg

SEQ ID NO: 187343 - DNA, 25 bp, Homo sapien
tcacctggaccagccgttgcgtcag

SEQ ID NO: 187344 - DNA, 25 bp, Homo sapien
aggagcttctatccgtcctgaggcc

SEQ ID NO: 187345 - DNA, 25 bp, Homo sapien
tccggcgtatgaaccgcgaccactt

SEQ ID NO: 187346 - DNA, 25 bp, Homo sapien
acctgagatctgcaccgcctggaag

SEQ ID NO: 187347 - DNA, 25 bp, Homo sapien
tctcgcagccctcgggaaaggtgac

SEQ ID NO: 187348 - DNA, 25 bp, Homo sapien
accaggcggctgtcaagcactcgca

SEQ ID NO: 187349 - DNA, 25 bp, Homo sapien
gccttcctgcttagactggcagtga

SEQ ID NO: 187350 - DNA, 25 bp, Homo sapien
ccagacgcctcaggtggcgccaata

SEQ ID NO: 187351 - DNA, 25 bp, Homo sapien
gcgagcgaccgacttccgtttccag

SEQ ID NO: 187352 - DNA, 25 bp, Homo sapien
atgctttctcatccggccggcttgc

SEQ ID NO: 187353 - DNA, 25 bp, Homo sapien
ttgggcgctagcgagacgaactatt

SEQ ID NO: 187354 - DNA, 25 bp, Homo sapien
ttccagttaccaaggcacgaggatc

SEQ ID NO: 187355 - DNA, 25 bp, Homo sapien
cacgaggatccggtgttccaaccca

SEQ ID NO: 187356 - DNA, 25 bp, Homo sapien
ctttgactgaagaggagacccgtgt

SEQ ID NO: 187357 - DNA, 25 bp, Homo sapien
gacccgtgtcatgtttgagaagata

SEQ ID NO: 187358 - DNA, 25 bp, Homo sapien
cggtcgtccagactattgggcgcta

SEQ ID NO: 187359 - DNA, 25 bp, Homo sapien
atcagccagtccaggcggtagtggt

SEQ ID NO: 187360 - DNA, 25 bp, Homo sapien
accacatcagccagtccaggcggta

SEQ ID NO: 187361 - DNA, 25 bp, Homo sapien
tggaaggccgcgaaccacatcagcc

SEQ ID NO: 187362 - DNA, 25 bp, Homo sapien
tccttggtgatgctgccgggagacc

SEQ ID NO: 187363 - DNA, 25 bp, Homo sapien
gtagtcctcccacatggcatcgggg

SEQ ID NO: 187364 - DNA, 25 bp, Homo sapien
ttgaactcgtagtcctcccacatgg

SEQ ID NO: 187365 - DNA, 25 bp, Homo sapien
ctggcttgcacttgaactcgtagtc

SEQ ID NO: 187366 - DNA, 25 bp, Homo sapien
ggggtcacctggcttgcacttgaac

SEQ ID NO: 187367 - DNA, 25 bp, Homo sapien
cgggttttgcagtcaacttcgctcc

SEQ ID NO: 187368 - DNA, 25 bp, Homo sapien
tgcctcctggggcttgaagtccaca

SEQ ID NO: 187369 - DNA, 25 bp, Homo sapien
ttctcagacgccgtagttcccgatg

SEQ ID NO: 187370 - DNA, 25 bp, Homo sapien
gctcccgcggccatgatagaaacag

SEQ ID NO: 187371 - DNA, 25 bp, Homo sapien
gtagaacttgagcacccagcgattg

SEQ ID NO: 187372 - DNA, 25 bp, Homo sapien
cccaagggcctgacaagcaaagctg

SEQ ID NO: 187373 - DNA, 25 bp, Homo sapien
caccctgcatgatgtcccggatctg

SEQ ID NO: 187374 - DNA, 25 bp, Homo sapien
cagcgcctcgtggaagtagaacttg

SEQ ID NO: 187375 - DNA, 25 bp, Homo sapien
tatgtccggttcaatggcgactgcg

SEQ ID NO: 187376 - DNA, 25 bp, Homo sapien
ttggctgttgctaggaaccgtctca

SEQ ID NO: 187377 - DNA, 25 bp, Homo sapien
ctcaaggccttatgggccctggtta

SEQ ID NO: 187378 - DNA, 25 bp, Homo sapien
ggcgggatttcgaactgagccactc

SEQ ID NO: 187379 - DNA, 25 bp, Homo sapien
tagttggacctcgaaccagactttc

SEQ ID NO: 187380 - DNA, 25 bp, Homo sapien
gggcgccagtccaaaaatcgcggta

SEQ ID NO: 187381 - DNA, 25 bp, Homo sapien
cgcgggctctcaaggaaagtagtcg

SEQ ID NO: 187382 - DNA, 25 bp, Homo sapien
gagccactcccttcattggtgaaaa

SEQ ID NO: 187383 - DNA, 25 bp, Homo sapien
cccacctggtgataatgcacgagga

SEQ ID NO: 187384 - DNA, 25 bp, Homo sapien
tggcacagcagatctcccacctggt

SEQ ID NO: 187385 - DNA, 25 bp, Homo sapien
tcatacgcgcacgatcgagagcatc

SEQ ID NO: 187386 - DNA, 25 bp, Homo sapien
cgccgcgatgccagtgtttcatacg

SEQ ID NO: 187387 - DNA, 25 bp, Homo sapien
gtggatcctacttctctgtcgcccg

SEQ ID NO: 187388 - DNA, 25 bp, Homo sapien
ctccgtagtcgctgcacagtctgtc

SEQ ID NO: 187389 - DNA, 25 bp, Homo sapien
ggagcatctcgaaaagggaccagta

SEQ ID NO: 187390 - DNA, 25 bp, Homo sapien
tgcccttataaggagcgcccggcgt

SEQ ID NO: 187391 - DNA, 25 bp, Homo sapien
acctagacctggaatcgcccaagtc

SEQ ID NO: 187392 - DNA, 25 bp, Homo sapien
acttcatctcattgctcagcgcgga

SEQ ID NO: 187393 - DNA, 25 bp, Homo sapien
cgccgccaccaggtcgttgcaaata

SEQ ID NO: 187394 - DNA, 25 bp, Homo sapien
ccaagtccctctactcgcgaggtga

SEQ ID NO: 187395 - DNA, 25 bp, Homo sapien
gtcctcggcccagtggaagtcacta

SEQ ID NO: 187396 - DNA, 25 bp, Homo sapien
cgaccgtcagttttcgctgaggaga

SEQ ID NO: 187397 - DNA, 25 bp, Homo sapien
aggcccatgttgctgctgttccctg

SEQ ID NO: 187398 - DNA, 25 bp, Homo sapien
agctgcgatgccctcggacttcatc

SEQ ID NO: 187399 - DNA, 25 bp, Homo sapien
tttgcagcactcaccgaccatggct

SEQ ID NO: 187400 - DNA, 25 bp, Homo sapien
tctcttatatatcctgtccggcccg

SEQ ID NO: 187401 - DNA, 25 bp, Homo sapien
gaccctggccggaactaggctctcg

SEQ ID NO: 187402 - DNA, 25 bp, Homo sapien
tcgcgtgtgtagtgcacggtgcatt

SEQ ID NO: 187403 - DNA, 25 bp, Homo sapien
caaccttgtgggagtcgcgtgtgta

SEQ ID NO: 187404 - DNA, 25 bp, Homo sapien
ctccggctgcaaccttgtgggagtc

SEQ ID NO: 187405 - DNA, 25 bp, Homo sapien
ccggaactaggctctcggtgagctg

SEQ ID NO: 187406 - DNA, 25 bp, Homo sapien
accgaccatggctctggtgcagtcc

SEQ ID NO: 187407 - DNA, 25 bp, Homo sapien
cacaaacttctttctggaagcgttg

SEQ ID NO: 187408 - DNA, 25 bp, Homo sapien
tgcgggaactcgctcttcacctttt

SEQ ID NO: 187409 - DNA, 25 bp, Homo sapien
ggatttaagcgtctccgcccagctc

SEQ ID NO: 187410 - DNA, 25 bp, Homo sapien
cgcccatccaatttgcctgcgggaa

SEQ ID NO: 187411 - DNA, 25 bp, Homo sapien
tttctggaagcgttgggatttaagc

SEQ ID NO: 187412 - DNA, 25 bp, Homo sapien
ctgagcggctggagatgtcattctc

SEQ ID NO: 187413 - DNA, 25 bp, Homo sapien
tggagatgtcattctcgacaaaggg

SEQ ID NO: 187414 - DNA, 25 bp, Homo sapien
aatgggtcaccggaactccacggcg

SEQ ID NO: 187415 - DNA, 25 bp, Homo sapien
ccggctcctatgtccaagtctgggc

SEQ ID NO: 187416 - DNA, 25 bp, Homo sapien
cccagccgcacgtattccggtaagg

SEQ ID NO: 187417 - DNA, 25 bp, Homo sapien
ttcccgatgtcctgcggacagaacg

SEQ ID NO: 187418 - DNA, 25 bp, Homo sapien
aacgctccgcgcgactccacgcact

SEQ ID NO: 187419 - DNA, 25 bp, Homo sapien
ccagatctctctcgtcccggaggga

SEQ ID NO: 187420 - DNA, 25 bp, Homo sapien
cgtacctgcagagccgcatgccgca

SEQ ID NO: 187421 - DNA, 25 bp, Homo sapien
agcttgcgccggctcctatgtccaa

SEQ ID NO: 187422 - DNA, 25 bp, Homo sapien
cctccctgctctactcgcgcgcatg

SEQ ID NO: 187423 - DNA, 25 bp, Homo sapien
ctctctctacctcccgcgaaggcgc

SEQ ID NO: 187424 - DNA, 25 bp, Homo sapien
acccagagaaactggggcgcctcca

SEQ ID NO: 187425 - DNA, 25 bp, Homo sapien
ttggctggctggtccttctcttcct

SEQ ID NO: 187426 - DNA, 25 bp, Homo sapien
cactggcgcaaggtcgcctgcgagc

SEQ ID NO: 187427 - DNA, 25 bp, Homo sapien
aggtcgcctgcgagcgccaggcctt

SEQ ID NO: 187428 - DNA, 25 bp, Homo sapien
ctcggtctggttcccgggtcagcca

SEQ ID NO: 187429 - DNA, 25 bp, Homo sapien
cccacgcctggttggggacctgacg

SEQ ID NO: 187430 - DNA, 25 bp, Homo sapien
gcagttgtcctgtgtcctggctcag

SEQ ID NO: 187431 - DNA, 25 bp, Homo sapien
ccgccggcatccctcgagaatggaa

SEQ ID NO: 187432 - DNA, 25 bp, Homo sapien
tgcccggtggattgttcaccaaact

SEQ ID NO: 187433 - DNA, 25 bp, Homo sapien
ctctttccagcagcctgttgcaatc

SEQ ID NO: 187434 - DNA, 25 bp, Homo sapien
ctccgaaagggccagccgagctcag

SEQ ID NO: 187435 - DNA, 25 bp, Homo sapien
gctggaaatactagtgacgcacctc

SEQ ID NO: 187436 - DNA, 25 bp, Homo sapien
gccctccctaacgtgcgcaggtgaa

SEQ ID NO: 187437 - DNA, 25 bp, Homo sapien
ccctgtccgggtcacaatggcagct

SEQ ID NO: 187438 - DNA, 25 bp, Homo sapien
acaatggcagctcgcgactgggaaa

SEQ ID NO: 187439 - DNA, 25 bp, Homo sapien
gcgagacccaaacaagcccacgtgg

SEQ ID NO: 187440 - DNA, 25 bp, Homo sapien
aactgttgtggctgccgcattgctc

SEQ ID NO: 187441 - DNA, 25 bp, Homo sapien
ggcgcagagccaactccagcttgtc

SEQ ID NO: 187442 - DNA, 25 bp, Homo sapien
cagatgttccggttccacgtgcaga

SEQ ID NO: 187443 - DNA, 25 bp, Homo sapien
tggggacccactggctttggagtaa

SEQ ID NO: 187444 - DNA, 25 bp, Homo sapien
tcccacggcgatgagaagcgttttc

SEQ ID NO: 187445 - DNA, 25 bp, Homo sapien
ctgtgagagcctcgcccaagaaagc

SEQ ID NO: 187446 - DNA, 25 bp, Homo sapien
cgctagctcacgcttccagtgggtt

SEQ ID NO: 187447 - DNA, 25 bp, Homo sapien
cggagtcctcacaaggctgtgcggc

SEQ ID NO: 187448 - DNA, 25 bp, Homo sapien
aggacatgcctgttcgcggggaccc

SEQ ID NO: 187449 - DNA, 25 bp, Homo sapien
ctgccacggagaacaggtggcttgt

SEQ ID NO: 187450 - DNA, 25 bp, Homo sapien
tggcatctttggatgcagcctcctg

SEQ ID NO: 187451 - DNA, 25 bp, Homo sapien
tgttccgaggccaacggcgcatggc

SEQ ID NO: 187452 - DNA, 25 bp, Homo sapien
caagagacggagcagcaggtgttcc

SEQ ID NO: 187453 - DNA, 25 bp, Homo sapien
cttgaggtgatggaatcctgggccc

SEQ ID NO: 187454 - DNA, 25 bp, Homo sapien
gctgtgcggcccacagatgacccgg

SEQ ID NO: 187455 - DNA, 25 bp, Homo sapien
cgtagttgctcaggcttctggttca

SEQ ID NO: 187456 - DNA, 25 bp, Homo sapien
ggccacctgattcagcacaggcatg

SEQ ID NO: 187457 - DNA, 25 bp, Homo sapien
cgctcttcctcgagccgcgtggggt

SEQ ID NO: 187458 - DNA, 25 bp, Homo sapien
gctgcgattcttcagggccgcggat

SEQ ID NO: 187459 - DNA, 25 bp, Homo sapien
catggcggttcttggcgtgcgaacc

SEQ ID NO: 187460 - DNA, 25 bp, Homo sapien
gccgcatccactggttcttccgttg

SEQ ID NO: 187461 - DNA, 25 bp, Homo sapien
tccgttgtttaaagacgcgcggctg

SEQ ID NO: 187462 - DNA, 25 bp, Homo sapien
tcctcggcttgcgtccgtagttgct

SEQ ID NO: 187463 - DNA, 25 bp, Homo sapien
tgccgacggatagagccaatgattg

SEQ ID NO: 187464 - DNA, 25 bp, Homo sapien
ccaatgattgtggatgacagcggca

SEQ ID NO: 187465 - DNA, 25 bp, Homo sapien
ccagacgttctctccgtttggctga

SEQ ID NO: 187466 - DNA, 25 bp, Homo sapien
ttgtggatgacagcggcacagaatg

SEQ ID NO: 187467 - DNA, 25 bp, Homo sapien
cacctgcgagcaagcccaggctggg

SEQ ID NO: 187468 - DNA, 25 bp, Homo sapien
gcattcgctgttggtgccgacggat

SEQ ID NO: 187469 - DNA, 25 bp, Homo sapien
cagcttggggccaacacgcaggacc

SEQ ID NO: 187470 - DNA, 25 bp, Homo sapien
tggtgtctctcactgccagcttggg

SEQ ID NO: 187471 - DNA, 25 bp, Homo sapien
ctattcccgcagacgcgcagctgta

SEQ ID NO: 187472 - DNA, 25 bp, Homo sapien
aagggcccgctgcacctattcccgc

SEQ ID NO: 187473 - DNA, 25 bp, Homo sapien
gaacgcaaggccacactgtccagct

SEQ ID NO: 187474 - DNA, 25 bp, Homo sapien
ctcctagcaccgcagagctctccga

SEQ ID NO: 187475 - DNA, 25 bp, Homo sapien
acccgccacgctccgtccaatcaga

SEQ ID NO: 187476 - DNA, 25 bp, Homo sapien
tcagagcgcgccgacggaaagtgcc

SEQ ID NO: 187477 - DNA, 25 bp, Homo sapien
cggcctcagaccacgacctaccaca

SEQ ID NO: 187478 - DNA, 25 bp, Homo sapien
gacgcgcagctgtaccggcctcaga

SEQ ID NO: 187479 - DNA, 25 bp, Homo sapien
tcaagtcggtcagtagctcagctcc

SEQ ID NO: 187480 - DNA, 25 bp, Homo sapien
tcctggaagggtgagcaaaaagcgc

SEQ ID NO: 187481 - DNA, 25 bp, Homo sapien
ggactatggccaccgactcgtgggc

SEQ ID NO: 187482 - DNA, 25 bp, Homo sapien
tgggtctcccttgtccgggactatg

SEQ ID NO: 187483 - DNA, 25 bp, Homo sapien
cgcatattttcacaagtgggtctcc

SEQ ID NO: 187484 - DNA, 25 bp, Homo sapien
gcgacgtggtgcagcgcatattttc

SEQ ID NO: 187485 - DNA, 25 bp, Homo sapien
cgccgcgcagaatgatgatgtcgca

SEQ ID NO: 187486 - DNA, 25 bp, Homo sapien
tgggaactgacgtcacctgtgctca

SEQ ID NO: 187487 - DNA, 25 bp, Homo sapien
tactaagacgatcctccgcccgagg

SEQ ID NO: 187488 - DNA, 25 bp, Homo sapien
tttttccagagcaacaggtaggctg

SEQ ID NO: 187489 - DNA, 25 bp, Homo sapien
ccgcttttctttggtgggtctgcac

SEQ ID NO: 187490 - DNA, 25 bp, Homo sapien
gctctcctcctcagaaagcgtgaaa

SEQ ID NO: 187491 - DNA, 25 bp, Homo sapien
cattgattggaggagactggacaca

SEQ ID NO: 187492 - DNA, 25 bp, Homo sapien
acttcgatcttgctggccttggcca

SEQ ID NO: 187493 - DNA, 25 bp, Homo sapien
gccttggccagcatgtcgatgatgt

SEQ ID NO: 187494 - DNA, 25 bp, Homo sapien
cgtgagtgacagcaccttgcactga

SEQ ID NO: 187495 - DNA, 25 bp, Homo sapien
gcgacctgaggccagcttggcttca

SEQ ID NO: 187496 - DNA, 25 bp, Homo sapien
ctctcagatgctgctgtggccagct

SEQ ID NO: 187497 - DNA, 25 bp, Homo sapien
actagccgaggacgcctctcagatg

SEQ ID NO: 187498 - DNA, 25 bp, Homo sapien
gttcctagggaggtgcacactagcc

SEQ ID NO: 187499 - DNA, 25 bp, Homo sapien
ttcattctcagaaggccgggctcca

SEQ ID NO: 187500 - DNA, 25 bp, Homo sapien
ggctttgtagtttcgctagggctca

SEQ ID NO: 187501 - DNA, 25 bp, Homo sapien
cgcatcccagggattgtgggctttg

SEQ ID NO: 187502 - DNA, 25 bp, Homo sapien
gatccggaatgaggccaacgcgcgc

SEQ ID NO: 187503 - DNA, 25 bp, Homo sapien
ggtgcaccctccctgactgggagca

SEQ ID NO: 187504 - DNA, 25 bp, Homo sapien
cgacggcaggtacgtcagtccgcga

SEQ ID NO: 187505 - DNA, 25 bp, Homo sapien
gcagcctcgcgttaaagagcccgct

SEQ ID NO: 187506 - DNA, 25 bp, Homo sapien
ggcgcggaggtgaaactacacttcc

SEQ ID NO: 187507 - DNA, 25 bp, Homo sapien
acccacgctggcctatgcggtggct

SEQ ID NO: 187508 - DNA, 25 bp, Homo sapien
cgggagcccacaggtgtttctacgc

SEQ ID NO: 187509 - DNA, 25 bp, Homo sapien
acaggtgtttctacgctcccgcgtc

SEQ ID NO: 187510 - DNA, 25 bp, Homo sapien
tcccgcgtccatttggcctgggtct

SEQ ID NO: 187511 - DNA, 25 bp, Homo sapien
cccggcaggacctcagcctgcgccc

SEQ ID NO: 187512 - DNA, 25 bp, Homo sapien
cacgctggcctctcgccgggacctg

SEQ ID NO: 187513 - DNA, 25 bp, Homo sapien
tgttcttccgccaggccctgcataa

SEQ ID NO: 187514 - DNA, 25 bp, Homo sapien
aggccctgcataaggcgcggcacgt

SEQ ID NO: 187515 - DNA, 25 bp, Homo sapien
tgcgcccgctgatctgggctgctgt

SEQ ID NO: 187516 - DNA, 25 bp, Homo sapien
cgctgatctgggctgctgtccgcga

SEQ ID NO: 187517 - DNA, 25 bp, Homo sapien
gccaggccctgcataaggcgcggca

SEQ ID NO: 187518 - DNA, 25 bp, Homo sapien
cctctcgccgggacctgttcttccg

SEQ ID NO: 187519 - DNA, 25 bp, Homo sapien
gccgcagagccgttcgtatacagcc

SEQ ID NO: 187520 - DNA, 25 bp, Homo sapien
ccatgaaaaagaagaggctcgaccc

SEQ ID NO: 187521 - DNA, 25 bp, Homo sapien
agcgaatgagctcagcggagatttc

SEQ ID NO: 187522 - DNA, 25 bp, Homo sapien
cgtccgacagcgtgaaaagagttga

SEQ ID NO: 187523 - DNA, 25 bp, Homo sapien
aggagagtttcccacagcccggatt

SEQ ID NO: 187524 - DNA, 25 bp, Homo sapien
gttgacaggactactcatatacccg

SEQ ID NO: 187525 - DNA, 25 bp, Homo sapien
aggcgaatcaaggtccgccatcttg

SEQ ID NO: 187526 - DNA, 25 bp, Homo sapien
cggatttcccgactgaaggctccca

SEQ ID NO: 187527 - DNA, 25 bp, Homo sapien
gccatcataagatgcggggcgccga

SEQ ID NO: 187528 - DNA, 25 bp, Homo sapien
ccgtgggcgtcttcacagggacgat

SEQ ID NO: 187529 - DNA, 25 bp, Homo sapien
gtcggtatagaagacgcactcctca

SEQ ID NO: 187530 - DNA, 25 bp, Homo sapien
ttctccaccaggctgtgccggttgg

SEQ ID NO: 187531 - DNA, 25 bp, Homo sapien
ggaactggccctcacccagtgcgtg

SEQ ID NO: 187532 - DNA, 25 bp, Homo sapien
ccgacctgtcgttggtgacggtcct

SEQ ID NO: 187533 - DNA, 25 bp, Homo sapien
atgacttgtcaaactcgggcgggcc

SEQ ID NO: 187534 - DNA, 25 bp, Homo sapien
cattcacggagtagcagtcgtagtc

SEQ ID NO: 187535 - DNA, 25 bp, Homo sapien
gccggcgccaaagaccgttccagga

SEQ ID NO: 187536 - DNA, 25 bp, Homo sapien
aggcactacctttgcgcgccttctt

SEQ ID NO: 187537 - DNA, 25 bp, Homo sapien
tcttctgcagcttcagcgtgtccga

SEQ ID NO: 187538 - DNA, 25 bp, Homo sapien
agcgtgtccgacgacttctttttga

SEQ ID NO: 187539 - DNA, 25 bp, Homo sapien
tctttttgatctcatgccgggctcg

SEQ ID NO: 187540 - DNA, 25 bp, Homo sapien
gggctcgtttgtactctgcagaagg

SEQ ID NO: 187541 - DNA, 25 bp, Homo sapien
aactgccgcagcttggtctcgatgc

SEQ ID NO: 187542 - DNA, 25 bp, Homo sapien
gcagcgcccactcacttggtgaact

SEQ ID NO: 187543 - DNA, 25 bp, Homo sapien
aagtctcagggcactcggctgtcac

SEQ ID NO: 187544 - DNA, 25 bp, Homo sapien
ggcgctcagaagtctcagggcactc

SEQ ID NO: 187545 - DNA, 25 bp, Homo sapien
cgctcagatgggaacacacggaacc

SEQ ID NO: 187546 - DNA, 25 bp, Homo sapien
tgctcagatgggaacacacggaacc

SEQ ID NO: 187547 - DNA, 25 bp, Homo sapien
ggaaccctccggaacagctgtgtaa

SEQ ID NO: 187548 - DNA, 25 bp, Homo sapien
ctcggctgtcacagcgcggcacagg

SEQ ID NO: 187549 - DNA, 25 bp, Homo sapien
ggacggtgctcagatgggaacacac

SEQ ID NO: 187550 - DNA, 25 bp, Homo sapien
tctgcggtcactgctcttgtgcacc

SEQ ID NO: 187551 - DNA, 25 bp, Homo sapien
gcgaagccatgacgtcagtcaggta

SEQ ID NO: 187552 - DNA, 25 bp, Homo sapien
cccgagcggacgtagagcatcggac

SEQ ID NO: 187553 - DNA, 25 bp, Homo sapien
ccgggaagcagttgctgtggtacct

SEQ ID NO: 187554 - DNA, 25 bp, Homo sapien
tggggacgatctccagcccttcgca

SEQ ID NO: 187555 - DNA, 25 bp, Homo sapien
acgggacgctgttactaggactcaa

SEQ ID NO: 187556 - DNA, 25 bp, Homo sapien
caatctctcgccctgtaaactgcgg

SEQ ID NO: 187557 - DNA, 25 bp, Homo sapien
cgtgactgctaaaccggttgccaga

SEQ ID NO: 187558 - DNA, 25 bp, Homo sapien
agcgcgtgagcactgtcgctccttc

SEQ ID NO: 187559 - DNA, 25 bp, Homo sapien
tctccatgctctggctgggccgggc

SEQ ID NO: 187560 - DNA, 25 bp, Homo sapien
gggcgcaggcccattcacggccaga

SEQ ID NO: 187561 - DNA, 25 bp, Homo sapien
atgtcgttgactatggcctggaaga

SEQ ID NO: 187562 - DNA, 25 bp, Homo sapien
ccggttaccttcatgtcgttgacta

SEQ ID NO: 187563 - DNA, 25 bp, Homo sapien
caggacgcgctcagacaaggacaca

SEQ ID NO: 187564 - DNA, 25 bp, Homo sapien
cccattcatggtttggcggtctggg

SEQ ID NO: 187565 - DNA, 25 bp, Homo sapien
ccctagagtcggtcctggatccaaa

SEQ ID NO: 187566 - DNA, 25 bp, Homo sapien
cagaaaccagggctttgaaatccga

SEQ ID NO: 187567 - DNA, 25 bp, Homo sapien
tgttccataagtacgggtggcgttg

SEQ ID NO: 187568 - DNA, 25 bp, Homo sapien
ggcgttggtgacctacctcatccga

SEQ ID NO: 187569 - DNA, 25 bp, Homo sapien
ctcatccgattcatccgataacgtc

SEQ ID NO: 187570 - DNA, 25 bp, Homo sapien
cgataacgtctgcagtaggatggga

SEQ ID NO: 187571 - DNA, 25 bp, Homo sapien
aggctgtccgtgtgccggaacatct

SEQ ID NO: 187572 - DNA, 25 bp, Homo sapien
ccgggactacgtgcagtgcagtgtc

SEQ ID NO: 187573 - DNA, 25 bp, Homo sapien
cagtgtcccgctggtgtgcacggac

SEQ ID NO: 187574 - DNA, 25 bp, Homo sapien
gcacggacccactggtctgcacgga

SEQ ID NO: 187575 - DNA, 25 bp, Homo sapien
cagcggccatgttactcgagtcaca

SEQ ID NO: 187576 - DNA, 25 bp, Homo sapien
cgcgaaatccttctcggggttcatg

SEQ ID NO: 187577 - DNA, 25 bp, Homo sapien
ggctcttacttctcgatctccagcg

SEQ ID NO: 187578 - DNA, 25 bp, Homo sapien
gactcacgagacagcggccatgtta

SEQ ID NO: 187579 - DNA, 25 bp, Homo sapien
tagctcacgcccaactgatggcacg

SEQ ID NO: 187580 - DNA, 25 bp, Homo sapien
gtcacatgactctacagcacttccg

SEQ ID NO: 187581 - DNA, 25 bp, Homo sapien
ggtgggcttctgtagacgttcgtaa

SEQ ID NO: 187582 - DNA, 25 bp, Homo sapien
ccgcttttcgtacagcttgtcattg

SEQ ID NO: 187583 - DNA, 25 bp, Homo sapien
gggctccatacccagcttgaagccg

SEQ ID NO: 187584 - DNA, 25 bp, Homo sapien
ggtaaccacggagccgcacagccta

SEQ ID NO: 187585 - DNA, 25 bp, Homo sapien
ttgccacggtaaccacggagccgca

SEQ ID NO: 187586 - DNA, 25 bp, Homo sapien
ctgttgccgtccgttgccacggtaa

SEQ ID NO: 187587 - DNA, 25 bp, Homo sapien
ctctgaccttggtgcactccgggtc

SEQ ID NO: 187588 - DNA, 25 bp, Homo sapien
tgcactccgggtcccacgtttattc

SEQ ID NO: 187589 - DNA, 25 bp, Homo sapien
tgaggggctccatacccagcttgaa

SEQ ID NO: 187590 - DNA, 25 bp, Homo sapien
cgcactctccatgcgccgcccgagc

SEQ ID NO: 187591 - DNA, 25 bp, Homo sapien
cctaggttttgcttcgcggagtaca

SEQ ID NO: 187592 - DNA, 25 bp, Homo sapien
cgcgaatgccggcagacagggacca

SEQ ID NO: 187593 - DNA, 25 bp, Homo sapien
ggaggcactcaagtcccactgcgca

SEQ ID NO: 187594 - DNA, 25 bp, Homo sapien
taggcctcagctccctaggttttgc

SEQ ID NO: 187595 - DNA, 25 bp, Homo sapien
ttgcttcgcggagtacagaagctgg

SEQ ID NO: 187596 - DNA, 25 bp, Homo sapien
cggccactatggcaacggaagcggc

SEQ ID NO: 187597 - DNA, 25 bp, Homo sapien
gcgcaggcggagcattctttggctc

SEQ ID NO: 187598 - DNA, 25 bp, Homo sapien
ccggagtcacgtgcgccaacgttac

SEQ ID NO: 187599 - DNA, 25 bp, Homo sapien
ccttacctgcacctggccgagctga

SEQ ID NO: 187600 - DNA, 25 bp, Homo sapien
cagaggtaagggccctctaggagtc

SEQ ID NO: 187601 - DNA, 25 bp, Homo sapien
gcgcaggctccagagcgtatataag

SEQ ID NO: 187602 - DNA, 25 bp, Homo sapien
ctccagagcgtatataagggcagcg

SEQ ID NO: 187603 - DNA, 25 bp, Homo sapien
ataagggcagcgtggcgcacaaccc

SEQ ID NO: 187604 - DNA, 25 bp, Homo sapien
cagcgcgagtgccagagcccagccg

SEQ ID NO: 187605 - DNA, 25 bp, Homo sapien
ctgaggtctccgagcggctcgccat

SEQ ID NO: 187606 - DNA, 25 bp, Homo sapien
tctccgagcggctcgccatggctgg

SEQ ID NO: 187607 - DNA, 25 bp, Homo sapien
ccgaccttgcgtagatgactccgcg

SEQ ID NO: 187608 - DNA, 25 bp, Homo sapien
gcagagcccgaccttgcgtagatga

SEQ ID NO: 187609 - DNA, 25 bp, Homo sapien
tgaggtcgcacgctccagcctcagt

SEQ ID NO: 187610 - DNA, 25 bp, Homo sapien
accctggaaccctgcatttggcagc

SEQ ID NO: 187611 - DNA, 25 bp, Homo sapien
tttggcagccacgagagcccatctc

SEQ ID NO: 187612 - DNA, 25 bp, Homo sapien
acctggccgtgctcagagtctgcct

SEQ ID NO: 187613 - DNA, 25 bp, Homo sapien
caccgcctcttggtgagccgcggtg

SEQ ID NO: 187614 - DNA, 25 bp, Homo sapien
agtggccgcaagagcgaccttccca

SEQ ID NO: 187615 - DNA, 25 bp, Homo sapien
ccacggccgacgcataggcagacag

SEQ ID NO: 187616 - DNA, 25 bp, Homo sapien
cgcggggatccacggcagaacagcc

SEQ ID NO: 187617 - DNA, 25 bp, Homo sapien
gcaaggactcctcgtggcttctccg

SEQ ID NO: 187618 - DNA, 25 bp, Homo sapien
ggcctggctcttggattttcctccc

SEQ ID NO: 187619 - DNA, 25 bp, Homo sapien
tgacagggctactcctctgggtcgg

SEQ ID NO: 187620 - DNA, 25 bp, Homo sapien
ggcagctgtgacagggctactcctc

SEQ ID NO: 187621 - DNA, 25 bp, Homo sapien
cttgctaggttagggacccgctgcc

SEQ ID NO: 187622 - DNA, 25 bp, Homo sapien
tccctcggggcaaccagaggacgga

SEQ ID NO: 187623 - DNA, 25 bp, Homo sapien
ttccaatgggcgcaagctattgagc

SEQ ID NO: 187624 - DNA, 25 bp, Homo sapien
cttttagctgcaccgacacatcttc

SEQ ID NO: 187625 - DNA, 25 bp, Homo sapien
cctctctaggagcaaggtcgctgcg

SEQ ID NO: 187626 - DNA, 25 bp, Homo sapien
ttgagccacaaagaccaaagctgga

SEQ ID NO: 187627 - DNA, 25 bp, Homo sapien
gctgggacagcaacgtgcgtttccc

SEQ ID NO: 187628 - DNA, 25 bp, Homo sapien
tgctaaatgctcagggcctcgtggc

SEQ ID NO: 187629 - DNA, 25 bp, Homo sapien
agtgcgtctcaaccggacccagagc

SEQ ID NO: 187630 - DNA, 25 bp, Homo sapien
cccgtcgaccaagtgctaaatgctc

SEQ ID NO: 187631 - DNA, 25 bp, Homo sapien
cgcatgcgcacaggtgagtgcccgc

SEQ ID NO: 187632 - DNA, 25 bp, Homo sapien
agcccgtttaaatgaacaaatgccg

SEQ ID NO: 187633 - DNA, 25 bp, Homo sapien
ctcgtcctaggagcccgtttaaatg

SEQ ID NO: 187634 - DNA, 25 bp, Homo sapien
cctcgcgcaggtgaacacggagttt

SEQ ID NO: 187635 - DNA, 25 bp, Homo sapien
agaaacttgttggttgttgccctca

SEQ ID NO: 187636 - DNA, 25 bp, Homo sapien
tgagctcccggactagcgcgcatgc

SEQ ID NO: 187637 - DNA, 25 bp, Homo sapien
cgttctcaggtgagctcccggacta

SEQ ID NO: 187638 - DNA, 25 bp, Homo sapien
ggaacccggccatggaagatccgtc

SEQ ID NO: 187639 - DNA, 25 bp, Homo sapien
aggagcgagtctggcaacttccaga

SEQ ID NO: 187640 - DNA, 25 bp, Homo sapien
agcctacttcgcttagttttgtgcg

SEQ ID NO: 187641 - DNA, 25 bp, Homo sapien
cgggcaaagcctacttcgcttagtt

SEQ ID NO: 187642 - DNA, 25 bp, Homo sapien
ggcgggcaaagcctacttcgcttag

SEQ ID NO: 187643 - DNA, 25 bp, Homo sapien
gagtctggcaacttccagagccctc

SEQ ID NO: 187644 - DNA, 25 bp, Homo sapien
ggccaggagcgagtctggcaacttc

SEQ ID NO: 187645 - DNA, 25 bp, Homo sapien
ccctctccttgtccgcgcctggggt

SEQ ID NO: 187646 - DNA, 25 bp, Homo sapien
tcctgcttaggtcgctgctccggcg

SEQ ID NO: 187647 - DNA, 25 bp, Homo sapien
caacacgcagggaatatcgacatgg

SEQ ID NO: 187648 - DNA, 25 bp, Homo sapien
tacggacacgggaggaatacggaca

SEQ ID NO: 187649 - DNA, 25 bp, Homo sapien
atacggacacggagggaacagcgac

SEQ ID NO: 187650 - DNA, 25 bp, Homo sapien
ggaacagcaacacgcagggaatatc

SEQ ID NO: 187651 - DNA, 25 bp, Homo sapien
aaggtgcaggtaaggaatacggaca

SEQ ID NO: 187652 - DNA, 25 bp, Homo sapien
cagggaatatcgacatgggtgatgc

SEQ ID NO: 187653 - DNA, 25 bp, Homo sapien
tatcgacatgggtgatgcctgcaaa

SEQ ID NO: 187654 - DNA, 25 bp, Homo sapien
taccaacacgggaggaacagcaaca

SEQ ID NO: 187655 - DNA, 25 bp, Homo sapien
aaatcacctgatgggcaccggtgcc

SEQ ID NO: 187656 - DNA, 25 bp, Homo sapien
cccacttagattcacggcgacatcg

SEQ ID NO: 187657 - DNA, 25 bp, Homo sapien
agcaagtccgttcttcccacttaga

SEQ ID NO: 187658 - DNA, 25 bp, Homo sapien
gcctccaagcagctaacgcggaaaa

SEQ ID NO: 187659 - DNA, 25 bp, Homo sapien
cgatctgtgagcaagtccgttcttc

SEQ ID NO: 187660 - DNA, 25 bp, Homo sapien
ctgcagagagaaacgtgcggtcctg

SEQ ID NO: 187661 - DNA, 25 bp, Homo sapien
tacatggaaccgactgaagctattc

SEQ ID NO: 187662 - DNA, 25 bp, Homo sapien
ggcgacatcgatgcccacagggaaa

SEQ ID NO: 187663 - DNA, 25 bp, Homo sapien
cggggattctctctccaagctgggc

SEQ ID NO: 187664 - DNA, 25 bp, Homo sapien
tgcccgccgccctaggcttggagga

SEQ ID NO: 187665 - DNA, 25 bp, Homo sapien
gtggcggaacctggcaccaccgcag

SEQ ID NO: 187666 - DNA, 25 bp, Homo sapien
cgctggacctaagcagctgccggcg

SEQ ID NO: 187667 - DNA, 25 bp, Homo sapien
tcggcgacccaggattcacagagac

SEQ ID NO: 187668 - DNA, 25 bp, Homo sapien
ggagaaagccctgcgtacttccagc

SEQ ID NO: 187669 - DNA, 25 bp, Homo sapien
cctcccgctggggtgatgtcttcag

SEQ ID NO: 187670 - DNA, 25 bp, Homo sapien
tccttgccggctggcacctcgggta

SEQ ID NO: 187671 - DNA, 25 bp, Homo sapien
gcaggcagcgattaactgggcattt

SEQ ID NO: 187672 - DNA, 25 bp, Homo sapien
accctgccgaggactatttgccaag

SEQ ID NO: 187673 - DNA, 25 bp, Homo sapien
ttccgtgtcctcgtactgcaactta

SEQ ID NO: 187674 - DNA, 25 bp, Homo sapien
cagcaatatgctctcagcgccggga

SEQ ID NO: 187675 - DNA, 25 bp, Homo sapien
cgcagcctgagaaagtcaagggttc

SEQ ID NO: 187676 - DNA, 25 bp, Homo sapien
tgagccctcaaagatcgcagcctga

SEQ ID NO: 187677 - DNA, 25 bp, Homo sapien
tgctgggagttatctgacagacctg

SEQ ID NO: 187678 - DNA, 25 bp, Homo sapien
cctgacacgggtacaagacacaaga

SEQ ID NO: 187679 - DNA, 25 bp, Homo sapien
cccaaacaaggaagcgtcgcctgca

SEQ ID NO: 187680 - DNA, 25 bp, Homo sapien
ccgacgcgaaggcagtgtggcaccc

SEQ ID NO: 187681 - DNA, 25 bp, Homo sapien
ggagtcctgggcgttgctctcccac

SEQ ID NO: 187682 - DNA, 25 bp, Homo sapien
cgggacgagcttgacgccatctccg

SEQ ID NO: 187683 - DNA, 25 bp, Homo sapien
tgtgaaatgggctggtgagtgtccc

SEQ ID NO: 187684 - DNA, 25 bp, Homo sapien
ccggggcccatgaaccgtggacaga

SEQ ID NO: 187685 - DNA, 25 bp, Homo sapien
cccatgaaccgtggacagacggagg

SEQ ID NO: 187686 - DNA, 25 bp, Homo sapien
cctgcgagccaaggtgtccgagtct

SEQ ID NO: 187687 - DNA, 25 bp, Homo sapien
tccggggtttcattggcccgcttca

SEQ ID NO: 187688 - DNA, 25 bp, Homo sapien
tcctgcatgcgctgcaagcgcttgg

SEQ ID NO: 187689 - DNA, 25 bp, Homo sapien
tccaaaggctcattctgtcgacgta

SEQ ID NO: 187690 - DNA, 25 bp, Homo sapien
agcgcttggcttcacggtccctcat

SEQ ID NO: 187691 - DNA, 25 bp, Homo sapien
gggtctcattgtcccgccggctctt

SEQ ID NO: 187692 - DNA, 25 bp, Homo sapien
gccgctgcagccgtacttccaaagg

SEQ ID NO: 187693 - DNA, 25 bp, Homo sapien
ttctgtcgacgtagagcccacttgc

SEQ ID NO: 187694 - DNA, 25 bp, Homo sapien
tggcctctcgctctcggatgagccg

SEQ ID NO: 187695 - DNA, 25 bp, Homo sapien
cagaccttcctggacgtgtaaacgc

SEQ ID NO: 187696 - DNA, 25 bp, Homo sapien
gacggacaaagccaacagcagacag

SEQ ID NO: 187697 - DNA, 25 bp, Homo sapien
gccggacaatggacccgggaccgca

SEQ ID NO: 187698 - DNA, 25 bp, Homo sapien
tcctggacgtgtaaacgccacccta

SEQ ID NO: 187699 - DNA, 25 bp, Homo sapien
gggtctttctctggctgtctcagcc

SEQ ID NO: 187700 - DNA, 25 bp, Homo sapien
ctagtgaggcgcgtgcacgagcctc

SEQ ID NO: 187701 - DNA, 25 bp, Homo sapien
cccaccatcgagttcagccacaaaa

SEQ ID NO: 187702 - DNA, 25 bp, Homo sapien
gcgctgcagacggacaaagccaaca

SEQ ID NO: 187703 - DNA, 25 bp, Homo sapien
cctgatttagcggtctctagttagc

SEQ ID NO: 187704 - DNA, 25 bp, Homo sapien
ggcgcagagtccgagaatcaacagc

SEQ ID NO: 187705 - DNA, 25 bp, Homo sapien
atcctcggcgtcagaggtctctgtc

SEQ ID NO: 187706 - DNA, 25 bp, Homo sapien
ctgcgttcacggcaggattcggtta

SEQ ID NO: 187707 - DNA, 25 bp, Homo sapien
cgccattttggatggtgaaccctga

SEQ ID NO: 187708 - DNA, 25 bp, Homo sapien
cccgcgcccagagcgaaattaaggg

SEQ ID NO: 187709 - DNA, 25 bp, Homo sapien
tcagggatacgcaggcttcgaaacc

SEQ ID NO: 187710 - DNA, 25 bp, Homo sapien
cggcagcagatcttagggagcaact

SEQ ID NO: 187711 - DNA, 25 bp, Homo sapien
ggctgcggtagtacggacaaacacc

SEQ ID NO: 187712 - DNA, 25 bp, Homo sapien
aaacaccgtgcagcggcatctcatc

SEQ ID NO: 187713 - DNA, 25 bp, Homo sapien
gagcatggcgtggagacacctgaaa

SEQ ID NO: 187714 - DNA, 25 bp, Homo sapien
gccaccatctcctccaatggaaggg

SEQ ID NO: 187715 - DNA, 25 bp, Homo sapien
gactcttggattcgaggctgcggta

SEQ ID NO: 187716 - DNA, 25 bp, Homo sapien
tccggggtctcctgcaaatgctcgt

SEQ ID NO: 187717 - DNA, 25 bp, Homo sapien
acctgaaagtgagtcccgcgagtga

SEQ ID NO: 187718 - DNA, 25 bp, Homo sapien
gtgcatttgcacgtggactcggtca

SEQ ID NO: 187719 - DNA, 25 bp, Homo sapien
cgatatacatatttaaagtcacctg

SEQ ID NO: 187720 - DNA, 25 bp, Homo sapien
accacttctcggaagagcccgggcg

SEQ ID NO: 187721 - DNA, 25 bp, Homo sapien
tggctgtcagcaaccacttctcgga

SEQ ID NO: 187722 - DNA, 25 bp, Homo sapien
aagtcacctgtgttgcgctgctcct

SEQ ID NO: 187723 - DNA, 25 bp, Homo sapien
tctccattttccaaaatatccgata

SEQ ID NO: 187724 - DNA, 25 bp, Homo sapien
atttttatttacagccgggcgcgca

SEQ ID NO: 187725 - DNA, 25 bp, Homo sapien
cgtgtgaacgcatgggtgattttta

SEQ ID NO: 187726 - DNA, 25 bp, Homo sapien
ccctttcactttgtggctgtcagca

SEQ ID NO: 187727 - DNA, 25 bp, Homo sapien
tcctgggtcaccgtccgtctctccc

SEQ ID NO: 187728 - DNA, 25 bp, Homo sapien
ctgggtcaccgtccgtctctcccct

SEQ ID NO: 187729 - DNA, 25 bp, Homo sapien
gcgcaggcttcctgggtcaccatca

SEQ ID NO: 187730 - DNA, 25 bp, Homo sapien
gtgcaggcttcctgggtcaccatca

SEQ ID NO: 187731 - DNA, 25 bp, Homo sapien
agtgcaggcttcctgggtcaccatc

SEQ ID NO: 187732 - DNA, 25 bp, Homo sapien
gagtgcaggcttcctgggtcaccat

SEQ ID NO: 187733 - DNA, 25 bp, Homo sapien
cgagtgcaggcttcctgggtcacca

SEQ ID NO: 187734 - DNA, 25 bp, Homo sapien
cgagtgcaggcttcctgggtcaccg

SEQ ID NO: 187735 - DNA, 25 bp, Homo sapien
ggctcggctgacctcagacgtctaa

SEQ ID NO: 187736 - DNA, 25 bp, Homo sapien
cccatctggaaatgacgtgtttaac

SEQ ID NO: 187737 - DNA, 25 bp, Homo sapien
ctcagaggctacgaaaaggcgaaca

SEQ ID NO: 187738 - DNA, 25 bp, Homo sapien
agcttcattcggcaactcgcggaca

SEQ ID NO: 187739 - DNA, 25 bp, Homo sapien
cgtctctgggactgccggaaaacga

SEQ ID NO: 187740 - DNA, 25 bp, Homo sapien
acgtctaaggcgataggcgttgcta

SEQ ID NO: 187741 - DNA, 25 bp, Homo sapien
ggacgatacccagttgccaagacga

SEQ ID NO: 187742 - DNA, 25 bp, Homo sapien
gggtctcaaacgtctcccagagtga

SEQ ID NO: 187743 - DNA, 25 bp, Homo sapien
gcgtttcttgctgctctcgtgattg

SEQ ID NO: 187744 - DNA, 25 bp, Homo sapien
ccgaatagtcgtctgttggcatcga

SEQ ID NO: 187745 - DNA, 25 bp, Homo sapien
gggagaccacttgcggccaagactt

SEQ ID NO: 187746 - DNA, 25 bp, Homo sapien
ttctgtgtttgtgcaaggccgactc

SEQ ID NO: 187747 - DNA, 25 bp, Homo sapien
ggccgactcgagatgttgactcaga

SEQ ID NO: 187748 - DNA, 25 bp, Homo sapien
ccgtgtcagactcctccgaatagtc

SEQ ID NO: 187749 - DNA, 25 bp, Homo sapien
tccgtcggacttttggctgagatcc

SEQ ID NO: 187750 - DNA, 25 bp, Homo sapien
tgctgcatgaacttgaggtaaccgt

SEQ ID NO: 187751 - DNA, 25 bp, Homo sapien
gagccgccgggttctctggctacat

SEQ ID NO: 187752 - DNA, 25 bp, Homo sapien
cacgtcacgtgagccagacgggaca

SEQ ID NO: 187753 - DNA, 25 bp, Homo sapien
agacgggacaccacccacatgcagg

SEQ ID NO: 187754 - DNA, 25 bp, Homo sapien
atcgccgtctctagggtcttgctgt

SEQ ID NO: 187755 - DNA, 25 bp, Homo sapien
acgtggctcaagtgaccgatgccga

SEQ ID NO: 187756 - DNA, 25 bp, Homo sapien
ccaacgtgtttggaacatggggctc

SEQ ID NO: 187757 - DNA, 25 bp, Homo sapien
ctggctacatgtgaccgagaaggca

SEQ ID NO: 187758 - DNA, 25 bp, Homo sapien
ggaacaccaagcaacaggcaccctg

SEQ ID NO: 187759 - DNA, 25 bp, Homo sapien
gaaagcctggtctgggccctcaaac

SEQ ID NO: 187760 - DNA, 25 bp, Homo sapien
gctcaggctctccacaatgtacgcg

SEQ ID NO: 187761 - DNA, 25 bp, Homo sapien
ctcagggtcattcgatggtcatgca

SEQ ID NO: 187762 - DNA, 25 bp, Homo sapien
tcgcacgtcaaacacgcggaagctg

SEQ ID NO: 187763 - DNA, 25 bp, Homo sapien
tgcaccgcgtgggtcacaaacgaac

SEQ ID NO: 187764 - DNA, 25 bp, Homo sapien
gccgaacattcgttgcaggtgacct

SEQ ID NO: 187765 - DNA, 25 bp, Homo sapien
accgtcgctgttcaggtaatccttg

SEQ ID NO: 187766 - DNA, 25 bp, Homo sapien
atacgcaggagcttttggcagaacc

SEQ ID NO: 187767 - DNA, 25 bp, Homo sapien
cgggcaaagcctgacatctacagtc

SEQ ID NO: 187768 - DNA, 25 bp, Homo sapien
gacatctacagtcgtgccgggcgca

SEQ ID NO: 187769 - DNA, 25 bp, Homo sapien
ctcgctcatcaaaggtcaggggccg

SEQ ID NO: 187770 - DNA, 25 bp, Homo sapien
ccggcctagaatcgggcgagaagaa

SEQ ID NO: 187771 - DNA, 25 bp, Homo sapien
gccctcggccactaaaaggagcctg

SEQ ID NO: 187772 - DNA, 25 bp, Homo sapien
cgccatgcgcaacaacgggaaattc

SEQ ID NO: 187773 - DNA, 25 bp, Homo sapien
tgaagcccaactcgcagtttgcagc

SEQ ID NO: 187774 - DNA, 25 bp, Homo sapien
ggccttcggggatccacattacaca

SEQ ID NO: 187775 - DNA, 25 bp, Homo sapien
taatcccgaaaagaggcgctcgggc

SEQ ID NO: 187776 - DNA, 25 bp, Homo sapien
gctggcggcgcttttaatcccgaaa

SEQ ID NO: 187777 - DNA, 25 bp, Homo sapien
cacttacgcggttgcttctccggcg

SEQ ID NO: 187778 - DNA, 25 bp, Homo sapien
agagggaaaagttgccacttacgcg

SEQ ID NO: 187779 - DNA, 25 bp, Homo sapien
tctctgagctcagctggcggaagaa

SEQ ID NO: 187780 - DNA, 25 bp, Homo sapien
caatcccagattcgcgagagcaaaa

SEQ ID NO: 187781 - DNA, 25 bp, Homo sapien
cccaacgtaaacaatcccagattcg

SEQ ID NO: 187782 - DNA, 25 bp, Homo sapien
gcatcctcggatgtctctgagctca

SEQ ID NO: 187783 - DNA, 25 bp, Homo sapien
cgttccgctaactccggctcttctt

SEQ ID NO: 187784 - DNA, 25 bp, Homo sapien
tcttcttcgggctcctcggcagcgc

SEQ ID NO: 187785 - DNA, 25 bp, Homo sapien
cggcagcctcgtccttttgtggtct

SEQ ID NO: 187786 - DNA, 25 bp, Homo sapien
cagcctcgtccttttgtggtctctg

SEQ ID NO: 187787 - DNA, 25 bp, Homo sapien
ttttgtggtctctgcacgggatcca

SEQ ID NO: 187788 - DNA, 25 bp, Homo sapien
gtctctgcacgggatccaaggtgcc

SEQ ID NO: 187789 - DNA, 25 bp, Homo sapien
ctgcacgggatccaaggtgccgcgc

SEQ ID NO: 187790 - DNA, 25 bp, Homo sapien
gaggaaagggttaagctgcccgagc

SEQ ID NO: 187791 - DNA, 25 bp, Homo sapien
cccgtgcgctcatgacacgaaattt

SEQ ID NO: 187792 - DNA, 25 bp, Homo sapien
cctgcggatgcccagaaaagccacg

SEQ ID NO: 187793 - DNA, 25 bp, Homo sapien
cgagatgctgatcccagttcacgga

SEQ ID NO: 187794 - DNA, 25 bp, Homo sapien
ccctctgcgctggatgttgtatagc

SEQ ID NO: 187795 - DNA, 25 bp, Homo sapien
gcagggacattcgacgccagtttcc

SEQ ID NO: 187796 - DNA, 25 bp, Homo sapien
agccgcctccctgtttaattccaga

SEQ ID NO: 187797 - DNA, 25 bp, Homo sapien
acacgaaatttggagcccgtacttg

SEQ ID NO: 187798 - DNA, 25 bp, Homo sapien
ctagtctctttagggccacagatgc

SEQ ID NO: 187799 - DNA, 25 bp, Homo sapien
ctgctcagtgtggtggatcatttca

SEQ ID NO: 187800 - DNA, 25 bp, Homo sapien
tcatttcaaccggtgagcgagcgcc

SEQ ID NO: 187801 - DNA, 25 bp, Homo sapien
gctggtgacccttacttgttcacga

SEQ ID NO: 187802 - DNA, 25 bp, Homo sapien
ttgttcacgagtccagaccagcgtc

SEQ ID NO: 187803 - DNA, 25 bp, Homo sapien
cgttttaccgaaatctggatgatgc

SEQ ID NO: 187804 - DNA, 25 bp, Homo sapien
cggctagctttagttggccctgacc

SEQ ID NO: 187805 - DNA, 25 bp, Homo sapien
gctcgtgtctgtcacttcgttttga

SEQ ID NO: 187806 - DNA, 25 bp, Homo sapien
ctgcctgttccgtttagcctgtttg

SEQ ID NO: 187807 - DNA, 25 bp, Homo sapien
cgagctgtggaagccttgactctta

SEQ ID NO: 187808 - DNA, 25 bp, Homo sapien
tctgcacgtggaaccggaacatctg

SEQ ID NO: 187809 - DNA, 25 bp, Homo sapien
cagtcctaagccaagcagtcccggg

SEQ ID NO: 187810 - DNA, 25 bp, Homo sapien
gaaaacgcttctcatcgccgtggga

SEQ ID NO: 187811 - DNA, 25 bp, Homo sapien
cggaacccactggaagcgtgagcta

SEQ ID NO: 187812 - DNA, 25 bp, Homo sapien
gggcgaggctctcacagagtagatc

SEQ ID NO: 187813 - DNA, 25 bp, Homo sapien
gccaaggcacgagcggacaacctta

SEQ ID NO: 187814 - DNA, 25 bp, Homo sapien
gagcaatgcggcagccacaacagtt

SEQ ID NO: 187815 - DNA, 25 bp, Homo sapien
tggcgactgagaacctcgaatttta

SEQ ID NO: 187816 - DNA, 25 bp, Homo sapien
tcgaattttaacttcgcgtgcccgc

SEQ ID NO: 187817 - DNA, 25 bp, Homo sapien
attggtattggcagtggaccctccc

SEQ ID NO: 187818 - DNA, 25 bp, Homo sapien
cccaatcctttcctagaggtggagg

SEQ ID NO: 187819 - DNA, 25 bp, Homo sapien
tgctgcgagtagacccaatcctttc

SEQ ID NO: 187820 - DNA, 25 bp, Homo sapien
tggcgtcgtctgcagccaataaggc

SEQ ID NO: 187821 - DNA, 25 bp, Homo sapien
aaaaggcctcctgattggcgtcgtc

SEQ ID NO: 187822 - DNA, 25 bp, Homo sapien
gcgatcagctctcacacaaacttta

SEQ ID NO: 187823 - DNA, 25 bp, Homo sapien
agccaggacacaggacaactgcccg

SEQ ID NO: 187824 - DNA, 25 bp, Homo sapien
tctcccaccgggcaggaaggcctgg

SEQ ID NO: 187825 - DNA, 25 bp, Homo sapien
ccgaggaagagaaggaccagccagc

SEQ ID NO: 187826 - DNA, 25 bp, Homo sapien
cccgacgctgattcagggggtcaaa

SEQ ID NO: 187827 - DNA, 25 bp, Homo sapien
tggctgacccgggaaccagaccgag

SEQ ID NO: 187828 - DNA, 25 bp, Homo sapien
aaggcctggcgctcgcaggcgacct

SEQ ID NO: 187829 - DNA, 25 bp, Homo sapien
gctcgcaggcgaccttgcgccagtg

SEQ ID NO: 187830 - DNA, 25 bp, Homo sapien
ccgcgctgagccaggacacaggaca

SEQ ID NO: 187831 - DNA, 25 bp, Homo sapien
cgccggcgccgcgtatttaaatgag

SEQ ID NO: 187832 - DNA, 25 bp, Homo sapien
accgccaggttgttgctccaggtgt

SEQ ID NO: 187833 - DNA, 25 bp, Homo sapien
ttgctgctgaagctgcgatgactga

SEQ ID NO: 187834 - DNA, 25 bp, Homo sapien
tgccctacgaaggacacaaagttgg

SEQ ID NO: 187835 - DNA, 25 bp, Homo sapien
ggccgcgaatagcagcagcagatgc

SEQ ID NO: 187836 - DNA, 25 bp, Homo sapien
cgccatcttgagtccgcggcgagct

SEQ ID NO: 187837 - DNA, 25 bp, Homo sapien
gaggccgtgctggaaaccgcacaca

SEQ ID NO: 187838 - DNA, 25 bp, Homo sapien
gccgacaagcggaacatcctccgta

SEQ ID NO: 187839 - DNA, 25 bp, Homo sapien
agcgaactcggctccttcagtgatc

SEQ ID NO: 187840 - DNA, 25 bp, Homo sapien
ggggtgtctcctgaatcccaatcca

SEQ ID NO: 187841 - DNA, 25 bp, Homo sapien
ttatcccgaagctagaggcccaagg

SEQ ID NO: 187842 - DNA, 25 bp, Homo sapien
gagcccgccgaagactcggtagtta

SEQ ID NO: 187843 - DNA, 25 bp, Homo sapien
ggcaggcatgctcctattggacaga

SEQ ID NO: 187844 - DNA, 25 bp, Homo sapien
tgctctcattggctggtagttcgtc

SEQ ID NO: 187845 - DNA, 25 bp, Homo sapien
ggaccgcgcttgaggaagcctccta

SEQ ID NO: 187846 - DNA, 25 bp, Homo sapien
ttggcaggaatctacgtccgtcacc

SEQ ID NO: 187847 - DNA, 25 bp, Homo sapien
ccatgggctgcggaccctctggcag

SEQ ID NO: 187848 - DNA, 25 bp, Homo sapien
gtgaagcatgctcggcgtaaagcgc

SEQ ID NO: 187849 - DNA, 25 bp, Homo sapien
cacgtgggaggcacacgccctggac

SEQ ID NO: 187850 - DNA, 25 bp, Homo sapien
tggcagcacacacgtgggaggcaca

SEQ ID NO: 187851 - DNA, 25 bp, Homo sapien
tgacgaaggcgcaaacctgttgagc

SEQ ID NO: 187852 - DNA, 25 bp, Homo sapien
catgctcggcgtaaagcgctttgca

SEQ ID NO: 187853 - DNA, 25 bp, Homo sapien
ctgtgggaaaagagcagatgacgaa

SEQ ID NO: 187854 - DNA, 25 bp, Homo sapien
agcgctttgcagacagtcctgggcc

SEQ ID NO: 187855 - DNA, 25 bp, Homo sapien
agaagtttgcaaacgcgaggcccgc

SEQ ID NO: 187856 - DNA, 25 bp, Homo sapien
tgcgagatccgagcaggcagctcca

SEQ ID NO: 187857 - DNA, 25 bp, Homo sapien
ggaaatgaaaccaactcggtcctga

SEQ ID NO: 187858 - DNA, 25 bp, Homo sapien
tggttcttcccatcaccgtccagga

SEQ ID NO: 187859 - DNA, 25 bp, Homo sapien
gtgtgcgtccaatctgtcccgtgca

SEQ ID NO: 187860 - DNA, 25 bp, Homo sapien
cctgcccaggcgagaagtttgcaaa

SEQ ID NO: 187861 - DNA, 25 bp, Homo sapien
cctgcactctgctgactgtaccgga

SEQ ID NO: 187862 - DNA, 25 bp, Homo sapien
cacagttccaaaaagctcgctcttc

SEQ ID NO: 187863 - DNA, 25 bp, Homo sapien
ctcgggctgcacatgctaggtccgg

SEQ ID NO: 187864 - DNA, 25 bp, Homo sapien
cctctcgggctgcacatgctaggtc

SEQ ID NO: 187865 - DNA, 25 bp, Homo sapien
agcacctgaagctgcggctggctgc

SEQ ID NO: 187866 - DNA, 25 bp, Homo sapien
caggaggctccgcagcacctgaagc

SEQ ID NO: 187867 - DNA, 25 bp, Homo sapien
cgtgagtcacatcaaacgtcccgtc

SEQ ID NO: 187868 - DNA, 25 bp, Homo sapien
ggttcggatgcccaacccagttgcc

SEQ ID NO: 187869 - DNA, 25 bp, Homo sapien
gcctggcttaggttcggatgcccaa

SEQ ID NO: 187870 - DNA, 25 bp, Homo sapien
tcaccttgtggtgctggccgtgcat

SEQ ID NO: 187871 - DNA, 25 bp, Homo sapien
caggtcggcgctgatgtcctggccc

SEQ ID NO: 187872 - DNA, 25 bp, Homo sapien
cggagctctcccacgtagtactgct

SEQ ID NO: 187873 - DNA, 25 bp, Homo sapien
tcatttgcataccgcgctcccattg

SEQ ID NO: 187874 - DNA, 25 bp, Homo sapien
ggcgtctgctctgctgccaccctga

SEQ ID NO: 187875 - DNA, 25 bp, Homo sapien
tgagcgcctctaacatcccgggagc

SEQ ID NO: 187876 - DNA, 25 bp, Homo sapien
cgcacgaagctggagaggtcgtaga

SEQ ID NO: 187877 - DNA, 25 bp, Homo sapien
ggcggacatcctcggtggcctgatc

SEQ ID NO: 187878 - DNA, 25 bp, Homo sapien
gcccgtccaggtcggcgctgatgtc

SEQ ID NO: 187879 - DNA, 25 bp, Homo sapien
tccgtcacttggtttgagtcaccca

SEQ ID NO: 187880 - DNA, 25 bp, Homo sapien
tgggtcctccaattgctacaccgcg

SEQ ID NO: 187881 - DNA, 25 bp, Homo sapien
ttggttgacccaagcataggctccg

SEQ ID NO: 187882 - DNA, 25 bp, Homo sapien
ccgtaccctgattgtgggaagcctc

SEQ ID NO: 187883 - DNA, 25 bp, Homo sapien
aacagggttacgtccacgcagctga

SEQ ID NO: 187884 - DNA, 25 bp, Homo sapien
gcgtagacgctgcaacaggcacttt

SEQ ID NO: 187885 - DNA, 25 bp, Homo sapien
cagcactcacgatgcgcagtctctg

SEQ ID NO: 187886 - DNA, 25 bp, Homo sapien
acttgccttaagtcgccacacgcgg

SEQ ID NO: 187887 - DNA, 25 bp, Homo sapien
gcacgaccgggatctgtctgcattc

SEQ ID NO: 187888 - DNA, 25 bp, Homo sapien
ccaaggtttgggaatgtagtgcacg

SEQ ID NO: 187889 - DNA, 25 bp, Homo sapien
tcagctcgcatagtggtgagtccgc

SEQ ID NO: 187890 - DNA, 25 bp, Homo sapien
ctctgcacatcgcacccaggtggtt

SEQ ID NO: 187891 - DNA, 25 bp, Homo sapien
tgcgtttgccttggatcgtttgaaa

SEQ ID NO: 187892 - DNA, 25 bp, Homo sapien
gaccttgaggggaaacatgcgtttg

SEQ ID NO: 187893 - DNA, 25 bp, Homo sapien
ggactgcgcctctttggaccttgag

SEQ ID NO: 187894 - DNA, 25 bp, Homo sapien
tctgcattccctttggttcccgatg

SEQ ID NO: 187895 - DNA, 25 bp, Homo sapien
atgcgtcaggttaacgcagacgccg

SEQ ID NO: 187896 - DNA, 25 bp, Homo sapien
ttgagcacgttgtcccgcatggtgc

SEQ ID NO: 187897 - DNA, 25 bp, Homo sapien
tgtcccgcatggtgccgtagcggac

SEQ ID NO: 187898 - DNA, 25 bp, Homo sapien
ctttgcgggtgacacctggctccac

SEQ ID NO: 187899 - DNA, 25 bp, Homo sapien
cacagagaagtcctcctggttcagc

SEQ ID NO: 187900 - DNA, 25 bp, Homo sapien
ttcggtccatatgcgtcaggttaac

SEQ ID NO: 187901 - DNA, 25 bp, Homo sapien
agcaccacctccaggttgagcacgt

SEQ ID NO: 187902 - DNA, 25 bp, Homo sapien
gttcagctccaggattcggtccata

SEQ ID NO: 187903 - DNA, 25 bp, Homo sapien
cgacaaagatttcgcacgcgcacat

SEQ ID NO: 187904 - DNA, 25 bp, Homo sapien
gccgcgttcagcacgtgcgtgaacc

SEQ ID NO: 187905 - DNA, 25 bp, Homo sapien
gccttctgcagcctatagcggtcca

SEQ ID NO: 187906 - DNA, 25 bp, Homo sapien
tccacgccgtggtactggatgtcca

SEQ ID NO: 187907 - DNA, 25 bp, Homo sapien
ccgccgggtagaagaagacactgag

SEQ ID NO: 187908 - DNA, 25 bp, Homo sapien
ggtctcttactgtggtcgtcgctta

SEQ ID NO: 187909 - DNA, 25 bp, Homo sapien
cgtcgcttagcgctctgtcgatgaa

SEQ ID NO: 187910 - DNA, 25 bp, Homo sapien
agtgtccacgttccagcggccgtgg

SEQ ID NO: 187911 - DNA, 25 bp, Homo sapien
gcggctatgaggcttcgccttcttc

SEQ ID NO: 187912 - DNA, 25 bp, Homo sapien
aaacttcggctactcgtaggcggca

SEQ ID NO: 187913 - DNA, 25 bp, Homo sapien
gtgggagcccaaacttcggctactc

SEQ ID NO: 187914 - DNA, 25 bp, Homo sapien
tgtagtcccgaacgtggatggtcca

SEQ ID NO: 187915 - DNA, 25 bp, Homo sapien
gcctaacaaggcgaagactttcctg

SEQ ID NO: 187916 - DNA, 25 bp, Homo sapien
cggctcatcagaccgcctaacaagg

SEQ ID NO: 187917 - DNA, 25 bp, Homo sapien
tctctttgtcaggagatgcgcctca

SEQ ID NO: 187918 - DNA, 25 bp, Homo sapien
tttcctgagagtccctaaagccgcg

SEQ ID NO: 187919 - DNA, 25 bp, Homo sapien
tccagttggccaggtcgtggtctat

SEQ ID NO: 187920 - DNA, 25 bp, Homo sapien
atgggtactgcaaggcagcggcctt

SEQ ID NO: 187921 - DNA, 25 bp, Homo sapien
agcaggttgctgtagtgggtcacct

SEQ ID NO: 187922 - DNA, 25 bp, Homo sapien
gcgctgaggatgacgaacttgctgt

SEQ ID NO: 187923 - DNA, 25 bp, Homo sapien
aagaaggcgtccacggcgttggtca

SEQ ID NO: 187924 - DNA, 25 bp, Homo sapien
ttggcctgccgtgacagtgtgtccc

SEQ ID NO: 187925 - DNA, 25 bp, Homo sapien
cacaaagatcttgggcggctggttg

SEQ ID NO: 187926 - DNA, 25 bp, Homo sapien
cttgctgtgcgccacaaagatcttg

SEQ ID NO: 187927 - DNA, 25 bp, Homo sapien
catcttctgcagctgccggctaagc

SEQ ID NO: 187928 - DNA, 25 bp, Homo sapien
ggcacatcgtaggtctcctcacgca

SEQ ID NO: 187929 - DNA, 25 bp, Homo sapien
ccgttcacggggcacatcgtacagg

SEQ ID NO: 187930 - DNA, 25 bp, Homo sapien
cacctcaggaggaagcacccgttca

SEQ ID NO: 187931 - DNA, 25 bp, Homo sapien
tgcgggcaaactccaacagctcgtg

SEQ ID NO: 187932 - DNA, 25 bp, Homo sapien
ccttgctcaccgatggaggaacgtc

SEQ ID NO: 187933 - DNA, 25 bp, Homo sapien
gggcctgaccatgtgccaccagcgt

SEQ ID NO: 187934 - DNA, 25 bp, Homo sapien
ggaggcaccgcatacacaccactgt

SEQ ID NO: 187935 - DNA, 25 bp, Homo sapien
gctctccatgcaaataagccgcctg

SEQ ID NO: 187936 - DNA, 25 bp, Homo sapien
ccatgcaaataagccgcctgtcggg

SEQ ID NO: 187937 - DNA, 25 bp, Homo sapien
caaggtgacacagcaggcggccgtc

SEQ ID NO: 187938 - DNA, 25 bp, Homo sapien
cgccagccactttcccgacacagga

SEQ ID NO: 187939 - DNA, 25 bp, Homo sapien
ccggccagggcagaaggagatccca

SEQ ID NO: 187940 - DNA, 25 bp, Homo sapien
tccggcaggaaatgccgctcgctta

SEQ ID NO: 187941 - DNA, 25 bp, Homo sapien
tggcgccctcaccaggtggttcatg

SEQ ID NO: 187942 - DNA, 25 bp, Homo sapien
aatcattaactggagccgggtgctc

SEQ ID NO: 187943 - DNA, 25 bp, Homo sapien
cgagacggcggcacactctggccgt

SEQ ID NO: 187944 - DNA, 25 bp, Homo sapien
tcgtacgtcttcagcgaatcctcca

SEQ ID NO: 187945 - DNA, 25 bp, Homo sapien
cacaagttccttggggcagtgccca

SEQ ID NO: 187946 - DNA, 25 bp, Homo sapien
agagaagaggaacgttccggactga

SEQ ID NO: 187947 - DNA, 25 bp, Homo sapien
cagccacgcctcgaggccagggaga

SEQ ID NO: 187948 - DNA, 25 bp, Homo sapien
gctgaacacaggcacggcagccacg

SEQ ID NO: 187949 - DNA, 25 bp, Homo sapien
ctgcggcatgacctgaagctgaaca

SEQ ID NO: 187950 - DNA, 25 bp, Homo sapien
agtgcccaactcttcgtacgtcttc

SEQ ID NO: 187951 - DNA, 25 bp, Homo sapien
aggtcttgcgggacagcacaggcct

SEQ ID NO: 187952 - DNA, 25 bp, Homo sapien
cagctctcctgaaagaggatggaaa

SEQ ID NO: 187953 - DNA, 25 bp, Homo sapien
ggtactcacaggcacggacatcttg

SEQ ID NO: 187954 - DNA, 25 bp, Homo sapien
agcccgatccagctctcctgaaaga

SEQ ID NO: 187955 - DNA, 25 bp, Homo sapien
ctggcgggcaacagactcctgcctg

SEQ ID NO: 187956 - DNA, 25 bp, Homo sapien
ttcccaggaaagtgagcccatccgc

SEQ ID NO: 187957 - DNA, 25 bp, Homo sapien
tccgcagcgagaggaaaacttccca

SEQ ID NO: 187958 - DNA, 25 bp, Homo sapien
agtcttcccgacctagccatcttgg

SEQ ID NO: 187959 - DNA, 25 bp, Homo sapien
gcctccaacggcaaagctctaggga

SEQ ID NO: 187960 - DNA, 25 bp, Homo sapien
ggcaattcgcttctcgcctcaggcg

SEQ ID NO: 187961 - DNA, 25 bp, Homo sapien
ctcctccgacgtagagaagtcttcg

SEQ ID NO: 187962 - DNA, 25 bp, Homo sapien
ctcgacgctggtcaaactcacaaga

SEQ ID NO: 187963 - DNA, 25 bp, Homo sapien
tgcacatgcgcagagagtactacgt

SEQ ID NO: 187964 - DNA, 25 bp, Homo sapien
gtggttgccctacgacacttccggc

SEQ ID NO: 187965 - DNA, 25 bp, Homo sapien
aacttgtagtcttcggcgctgcctc

SEQ ID NO: 187966 - DNA, 25 bp, Homo sapien
aattcctccatgttgctgccgctcg

SEQ ID NO: 187967 - DNA, 25 bp, Homo sapien
cctcgcgctccatcccgtcgccatt

SEQ ID NO: 187968 - DNA, 25 bp, Homo sapien
ctccaatcacaaggcgccgcagcgc

SEQ ID NO: 187969 - DNA, 25 bp, Homo sapien
cctcagggaccgccgaagaagtgat

SEQ ID NO: 187970 - DNA, 25 bp, Homo sapien
acaaccttcaggctcaggatctgct

SEQ ID NO: 187971 - DNA, 25 bp, Homo sapien
tctctgcatctcacgcccagcggga

SEQ ID NO: 187972 - DNA, 25 bp, Homo sapien
cgtcgccattcaccacagagaaatg

SEQ ID NO: 187973 - DNA, 25 bp, Homo sapien
cagcgtcacctccagccggggtcct

SEQ ID NO: 187974 - DNA, 25 bp, Homo sapien
cgcggcacaaccttcaggctcagga

SEQ ID NO: 187975 - DNA, 25 bp, Homo sapien
agcgcattcctggacgaagtcttga

SEQ ID NO: 187976 - DNA, 25 bp, Homo sapien
aggtccagatccgtgggtgatgtta

SEQ ID NO: 187977 - DNA, 25 bp, Homo sapien
tcgcacaggaagacggagcgcacca

SEQ ID NO: 187978 - DNA, 25 bp, Homo sapien
gcgtagagcgcacggatttctgcca

SEQ ID NO: 187979 - DNA, 25 bp, Homo sapien
cacgatgccgttgtcacgcgccaga

SEQ ID NO: 187980 - DNA, 25 bp, Homo sapien
cccactggaagaggtcggacaggtt

SEQ ID NO: 187981 - DNA, 25 bp, Homo sapien
gcggcgccaaggcagataggcatca

SEQ ID NO: 187982 - DNA, 25 bp, Homo sapien
aagtcttgaaggcttcgcggcgcgc

SEQ ID NO: 187983 - DNA, 25 bp, Homo sapien
gactattaagcgacacccggtgagg

SEQ ID NO: 187984 - DNA, 25 bp, Homo sapien
cgatgccctttccacgttgctgatg

SEQ ID NO: 187985 - DNA, 25 bp, Homo sapien
ccgcggagaatgaagaaccaacgta

SEQ ID NO: 187986 - DNA, 25 bp, Homo sapien
tcagcaaaggctcccaaacgtcgtc

SEQ ID NO: 187987 - DNA, 25 bp, Homo sapien
aggggctgacttgctccttaaggtc

SEQ ID NO: 187988 - DNA, 25 bp, Homo sapien
acaatgaggcgctttcagacgtggc

SEQ ID NO: 187989 - DNA, 25 bp, Homo sapien
ctcctggagactcgaggtagaacga

SEQ ID NO: 187990 - DNA, 25 bp, Homo sapien
tttctcttcactgggagggtccgca

SEQ ID NO: 187991 - DNA, 25 bp, Homo sapien
gacgaagcaaagcagagcccaggtg

SEQ ID NO: 187992 - DNA, 25 bp, Homo sapien
gatgcagcccggacttattcctcca

SEQ ID NO: 187993 - DNA, 25 bp, Homo sapien
tcaggatcgggtggcagaattttaa

SEQ ID NO: 187994 - DNA, 25 bp, Homo sapien
ggtgagaaaccaacgtcaggatcgg

SEQ ID NO: 187995 - DNA, 25 bp, Homo sapien
gcttggccttcacgatgaccatgtg

SEQ ID NO: 187996 - DNA, 25 bp, Homo sapien
tcgaaaaattctgcccgagcttggc

SEQ ID NO: 187997 - DNA, 25 bp, Homo sapien
tcactctcggccttgaatttctgta

SEQ ID NO: 187998 - DNA, 25 bp, Homo sapien
aattttaaacgtgggtgatgcagcc

SEQ ID NO: 187999 - DNA, 25 bp, Homo sapien
tcctgtcgctttggcctccggcatg

SEQ ID NO: 188000 - DNA, 25 bp, Homo sapien
ttggcctccggcatgacgcatgcgc

SEQ ID NO: 188001 - DNA, 25 bp, Homo sapien
tccgcggcagcatctcggttctcct

SEQ ID NO: 188002 - DNA, 25 bp, Homo sapien
ctcgcgtcttttccagtgtgggccc

SEQ ID NO: 188003 - DNA, 25 bp, Homo sapien
ggagcctcgcgtcttttccagtgtg

SEQ ID NO: 188004 - DNA, 25 bp, Homo sapien
cgcttgaggcgcttcactccggcga

SEQ ID NO: 188005 - DNA, 25 bp, Homo sapien
ggcccatctggagcctcgcgtcttt

SEQ ID NO: 188006 - DNA, 25 bp, Homo sapien
ttccggttcggctccgagcagctgc

SEQ ID NO: 188007 - DNA, 25 bp, Homo sapien
acctgcctcagggaccggcgaggaa

SEQ ID NO: 188008 - DNA, 25 bp, Homo sapien
ctcggacgcgcgctatcctggagaa

SEQ ID NO: 188009 - DNA, 25 bp, Homo sapien
ttgcgcagggctagcacagacccac

SEQ ID NO: 188010 - DNA, 25 bp, Homo sapien
ctccaatgagaaggcgctccagccg

SEQ ID NO: 188011 - DNA, 25 bp, Homo sapien
cgttccctcctccaatgagaaggcg

SEQ ID NO: 188012 - DNA, 25 bp, Homo sapien
ggaccagctaccgaagggcagcagc

SEQ ID NO: 188013 - DNA, 25 bp, Homo sapien
ccggtcgccattcaccactgagtta

SEQ ID NO: 188014 - DNA, 25 bp, Homo sapien
caccactgagttaagggaccagcta

SEQ ID NO: 188015 - DNA, 25 bp, Homo sapien
tgccgcgtgcacagtgtcttgcata

SEQ ID NO: 188016 - DNA, 25 bp, Homo sapien
aaggcctcgattggcttgccgatcc

SEQ ID NO: 188017 - DNA, 25 bp, Homo sapien
cctgcacgcgcaggatcttagtgaa

SEQ ID NO: 188018 - DNA, 25 bp, Homo sapien
tgcgcgcattcctagacgaagtatg

SEQ ID NO: 188019 - DNA, 25 bp, Homo sapien
tgcggcacacctcgcgaatcaggcg

SEQ ID NO: 188020 - DNA, 25 bp, Homo sapien
atacgtcctgcttgctgatggtgcc

SEQ ID NO: 188021 - DNA, 25 bp, Homo sapien
cggctcgttgcccagttgaaaaagg

SEQ ID NO: 188022 - DNA, 25 bp, Homo sapien
ctctgtggcatgtaggcatcaaaca

SEQ ID NO: 188023 - DNA, 25 bp, Homo sapien
tccttaggatcaaagctgggctccc

SEQ ID NO: 188024 - DNA, 25 bp, Homo sapien
gcagcacctggtgttggaagcgcac

SEQ ID NO: 188025 - DNA, 25 bp, Homo sapien
cgaccgggtgagagaagagctcata

SEQ ID NO: 188026 - DNA, 25 bp, Homo sapien
ccaagtttggcttctcctggttgcc

SEQ ID NO: 188027 - DNA, 25 bp, Homo sapien
ggcaaccgacggctcacagaaagga

SEQ ID NO: 188028 - DNA, 25 bp, Homo sapien
atagcaaggccgcaccgaaaggagc

SEQ ID NO: 188029 - DNA, 25 bp, Homo sapien
cgatagaacgtttccgtggaccaga

SEQ ID NO: 188030 - DNA, 25 bp, Homo sapien
tcggcctagcttttcgagctgtgta

SEQ ID NO: 188031 - DNA, 25 bp, Homo sapien
ccactcgctgggtaagcacttggtc

SEQ ID NO: 188032 - DNA, 25 bp, Homo sapien
tgtcacctctgtcgtctgggacccg

SEQ ID NO: 188033 - DNA, 25 bp, Homo sapien
gatgttcaaggaggaccactcgctg

SEQ ID NO: 188034 - DNA, 25 bp, Homo sapien
cgagcgaaatatcccgacagggttc

SEQ ID NO: 188035 - DNA, 25 bp, Homo sapien
tgctaggctccgacagccggaagtc

SEQ ID NO: 188036 - DNA, 25 bp, Homo sapien
tcgcagatactgctcacagacgtcc

SEQ ID NO: 188037 - DNA, 25 bp, Homo sapien
ttctcccacagaacacagatgcgtg

SEQ ID NO: 188038 - DNA, 25 bp, Homo sapien
gccgccgccatgaagtggatgttca

SEQ ID NO: 188039 - DNA, 25 bp, Homo sapien
agactcggcaaagttagcccggata

SEQ ID NO: 188040 - DNA, 25 bp, Homo sapien
ctgctgacagttccaggcgtggagc

SEQ ID NO: 188041 - DNA, 25 bp, Homo sapien
tcttagagaggcgtgaaaccggatg

SEQ ID NO: 188042 - DNA, 25 bp, Homo sapien
aagcgagcttaatccgccggtaagg

SEQ ID NO: 188043 - DNA, 25 bp, Homo sapien
acgcgcctagaagaaagcgagctta

SEQ ID NO: 188044 - DNA, 25 bp, Homo sapien
gtggagcgccttcccacgtgaaacg

SEQ ID NO: 188045 - DNA, 25 bp, Homo sapien
catgccgggccctgtagtttttccg

SEQ ID NO: 188046 - DNA, 25 bp, Homo sapien
cgcgtcccggaagatacgatcctca

SEQ ID NO: 188047 - DNA, 25 bp, Homo sapien
agggctgccattgttctccgcctca

SEQ ID NO: 188048 - DNA, 25 bp, Homo sapien
cccggtgcacccatgttaatggctc

SEQ ID NO: 188049 - DNA, 25 bp, Homo sapien
cgttggcccaatcagcggagaagct

SEQ ID NO: 188050 - DNA, 25 bp, Homo sapien
ttcctgcgacacagacagcgttggc

SEQ ID NO: 188051 - DNA, 25 bp, Homo sapien
cagtagctcttgtggggaacattca

SEQ ID NO: 188052 - DNA, 25 bp, Homo sapien
acaccctgtgaggagcctgacgcgt

SEQ ID NO: 188053 - DNA, 25 bp, Homo sapien
cccaggaaagtcaataagcagcacg

SEQ ID NO: 188054 - DNA, 25 bp, Homo sapien
ttccgggagactgagcacaccctgt

SEQ ID NO: 188055 - DNA, 25 bp, Homo sapien
tgcggacgacgtagccatccttacc

SEQ ID NO: 188056 - DNA, 25 bp, Homo sapien
tccgtcaccggtaacgccttgtgga

SEQ ID NO: 188057 - DNA, 25 bp, Homo sapien
cgggtgatttcatctccacgcagta

SEQ ID NO: 188058 - DNA, 25 bp, Homo sapien
cggcagctccatgtccttctacgtg

SEQ ID NO: 188059 - DNA, 25 bp, Homo sapien
tcttctagtagtgctcggcgtcaga

SEQ ID NO: 188060 - DNA, 25 bp, Homo sapien
tcagtcagttgagctctgtgtgcca

SEQ ID NO: 188061 - DNA, 25 bp, Homo sapien
gactcgcagcgacactcacttcttg

SEQ ID NO: 188062 - DNA, 25 bp, Homo sapien
agcactcgtggcagtccctgaagga

SEQ ID NO: 188063 - DNA, 25 bp, Homo sapien
ccgtacacctttcggcccttgagag

SEQ ID NO: 188064 - DNA, 25 bp, Homo sapien
agcccttgcgggagtccacggccag

SEQ ID NO: 188065 - DNA, 25 bp, Homo sapien
caggacggtgctgcagcccttgcgg

SEQ ID NO: 188066 - DNA, 25 bp, Homo sapien
agcaggacggtgctgcagcccttgc

SEQ ID NO: 188067 - DNA, 25 bp, Homo sapien
ttcggcccttgagaggaccggagag

SEQ ID NO: 188068 - DNA, 25 bp, Homo sapien
tttcggcccttgagaggaccggaga

SEQ ID NO: 188069 - DNA, 25 bp, Homo sapien
ctttcggcccttgagaggaccggag

SEQ ID NO: 188070 - DNA, 25 bp, Homo sapien
cacctttcggcccttgagaggaccg

SEQ ID NO: 188071 - DNA, 25 bp, Homo sapien
ctagcttcttggagagctcactgcc

SEQ ID NO: 188072 - DNA, 25 bp, Homo sapien
cgctcctttcctggcgggaggctct

SEQ ID NO: 188073 - DNA, 25 bp, Homo sapien
gtgcgccaggaagccgcctagcttc

SEQ ID NO: 188074 - DNA, 25 bp, Homo sapien
gccgcctagcttcttggagagctca

SEQ ID NO: 188075 - DNA, 25 bp, Homo sapien
agtgtccactaggagcgtcgcgccc

SEQ ID NO: 188076 - DNA, 25 bp, Homo sapien
cgcaggccgtcagaatgtcttgccc

SEQ ID NO: 188077 - DNA, 25 bp, Homo sapien
cacaaagcgcttgcagccgggagct

SEQ ID NO: 188078 - DNA, 25 bp, Homo sapien
tgtcttgcccggaccaggggacaaa

SEQ ID NO: 188079 - DNA, 25 bp, Homo sapien
gcagccgtagccagatccgttgaaa

SEQ ID NO: 188080 - DNA, 25 bp, Homo sapien
tcgcgccctatgtactccgggattg

SEQ ID NO: 188081 - DNA, 25 bp, Homo sapien
tccatcgggactgacgctgcaaaag

SEQ ID NO: 188082 - DNA, 25 bp, Homo sapien
acctgacgtagatccgaagtggccc

SEQ ID NO: 188083 - DNA, 25 bp, Homo sapien
tggcccgcgccatctcaactatgag

SEQ ID NO: 188084 - DNA, 25 bp, Homo sapien
gccgctacggggaagtaatggtatc

SEQ ID NO: 188085 - DNA, 25 bp, Homo sapien
agaggtctcattgcgctcccgaaca

SEQ ID NO: 188086 - DNA, 25 bp, Homo sapien
ggctcatctcgattggcccagaaag

SEQ ID NO: 188087 - DNA, 25 bp, Homo sapien
ggcaccctatgcagggctttgtttc

SEQ ID NO: 188088 - DNA, 25 bp, Homo sapien
acgtgggtaacgctcagctgactcc

SEQ ID NO: 188089 - DNA, 25 bp, Homo sapien
gagatctacgtgaccctggtgcgca

SEQ ID NO: 188090 - DNA, 25 bp, Homo sapien
gctgcccggatagctgcctgatcca

SEQ ID NO: 188091 - DNA, 25 bp, Homo sapien
gcggaacggtgtctccttcacttcg

SEQ ID NO: 188092 - DNA, 25 bp, Homo sapien
tggcttcctaagatggccgcgctgc

SEQ ID NO: 188093 - DNA, 25 bp, Homo sapien
cttgcgcgcgtcgtaagtaaagctg

SEQ ID NO: 188094 - DNA, 25 bp, Homo sapien
ccaagcggcttcagcagctagcgga

SEQ ID NO: 188095 - DNA, 25 bp, Homo sapien
gtcgacttataacagcagcccagga

SEQ ID NO: 188096 - DNA, 25 bp, Homo sapien
aggtgcgctcctccgacgttgcaca

SEQ ID NO: 188097 - DNA, 25 bp, Homo sapien
ttctggacagtatggagcaggaccc

SEQ ID NO: 188098 - DNA, 25 bp, Homo sapien
gagcgcacactggaccgacttctgg

SEQ ID NO: 188099 - DNA, 25 bp, Homo sapien
tcttcgcacacaagcagaactatga

SEQ ID NO: 188100 - DNA, 25 bp, Homo sapien
tacacgtgcaagtgtcgcccgcatc

SEQ ID NO: 188101 - DNA, 25 bp, Homo sapien
cgcacagatcgtgagcacacttaca

SEQ ID NO: 188102 - DNA, 25 bp, Homo sapien
tggcagtaggcggtcgacttataac

SEQ ID NO: 188103 - DNA, 25 bp, Homo sapien
gacccgccaagaaataaaggcgatg

SEQ ID NO: 188104 - DNA, 25 bp, Homo sapien
aggcgatgatttccgaccatgctcg

SEQ ID NO: 188105 - DNA, 25 bp, Homo sapien
cagatgctggagcagcgactggccc

SEQ ID NO: 188106 - DNA, 25 bp, Homo sapien
ctgctctcggagagtgagcctcccg

SEQ ID NO: 188107 - DNA, 25 bp, Homo sapien
gtaggaacctggtccgcagcctcac

SEQ ID NO: 188108 - DNA, 25 bp, Homo sapien
ctcgcgacgaggaggatcccgagcc

SEQ ID NO: 188109 - DNA, 25 bp, Homo sapien
tcctctttgtcctcgcagatgctgg

SEQ ID NO: 188110 - DNA, 25 bp, Homo sapien
cgttctccgcggagtctgtgctaca

SEQ ID NO: 188111 - DNA, 25 bp, Homo sapien
cggtgattggcgaccagcggctccc

SEQ ID NO: 188112 - DNA, 25 bp, Homo sapien
accatcatttaatccgctggcgccg

SEQ ID NO: 188113 - DNA, 25 bp, Homo sapien
cgcactccatggtcaggtgcggacg

SEQ ID NO: 188114 - DNA, 25 bp, Homo sapien
agactgtcggtgtctgcccgcccgt

SEQ ID NO: 188115 - DNA, 25 bp, Homo sapien
agagaaaaggtgacatcgcgcgtga

SEQ ID NO: 188116 - DNA, 25 bp, Homo sapien
agccgccgccgttcacatcgcagcg

SEQ ID NO: 188117 - DNA, 25 bp, Homo sapien
tgtcactggctaaggccgcggcgac

SEQ ID NO: 188118 - DNA, 25 bp, Homo sapien
ctggagcgcctgcaagagaaaaggt

SEQ ID NO: 188119 - DNA, 25 bp, Homo sapien
ccggccttgatcgtagcggaggcca

SEQ ID NO: 188120 - DNA, 25 bp, Homo sapien
cccagggcaatgtcacgacttggtc

SEQ ID NO: 188121 - DNA, 25 bp, Homo sapien
cgacttggtcttcccgaggagccag

SEQ ID NO: 188122 - DNA, 25 bp, Homo sapien
aggagccagtcaggtaaaggctttc

SEQ ID NO: 188123 - DNA, 25 bp, Homo sapien
gtcaggcccggccttgatcgtagcg

SEQ ID NO: 188124 - DNA, 25 bp, Homo sapien
ctcgcctccagcaacccgcagggtc

SEQ ID NO: 188125 - DNA, 25 bp, Homo sapien
tgattttgcagctcccgccagtcca

SEQ ID NO: 188126 - DNA, 25 bp, Homo sapien
ccttttggccgggactgattttgca

SEQ ID NO: 188127 - DNA, 25 bp, Homo sapien
tttctctctttttgcgcgctgggcg

SEQ ID NO: 188128 - DNA, 25 bp, Homo sapien
ccgcgtcaaagcctggtccagtatc

SEQ ID NO: 188129 - DNA, 25 bp, Homo sapien
cggcgagctcaagatccgcgtcaaa

SEQ ID NO: 188130 - DNA, 25 bp, Homo sapien
gggctcaacaagctgcggctcttca

SEQ ID NO: 188131 - DNA, 25 bp, Homo sapien
gccgagcatcccacattcaacagga

SEQ ID NO: 188132 - DNA, 25 bp, Homo sapien
tgcagccattgcacagccgagcatc

SEQ ID NO: 188133 - DNA, 25 bp, Homo sapien
agggcacggctcttgtgaggattac

SEQ ID NO: 188134 - DNA, 25 bp, Homo sapien
gaagattgcgctacgggagttctcc

SEQ ID NO: 188135 - DNA, 25 bp, Homo sapien
cttggacaacataaagggctgattg

SEQ ID NO: 188136 - DNA, 25 bp, Homo sapien
tgcgggtggacttggacaacataaa

SEQ ID NO: 188137 - DNA, 25 bp, Homo sapien
gggcccgagggatggaatgctgccc

SEQ ID NO: 188138 - DNA, 25 bp, Homo sapien
ggggagatagctcaaggcaggccag

SEQ ID NO: 188139 - DNA, 25 bp, Homo sapien
cgttccaggcgaccaagtaccctcg

SEQ ID NO: 188140 - DNA, 25 bp, Homo sapien
cgaccaagtaccctcggcggccctg

SEQ ID NO: 188141 - DNA, 25 bp, Homo sapien
ggcctgcagccacgcttggcgctgt

SEQ ID NO: 188142 - DNA, 25 bp, Homo sapien
caacataaagggctgattgagcggg

SEQ ID NO: 188143 - DNA, 25 bp, Homo sapien
cccacgtgaagaaatgccacacgtg

SEQ ID NO: 188144 - DNA, 25 bp, Homo sapien
gtgaagaaatgccacacgtgtgcgc

SEQ ID NO: 188145 - DNA, 25 bp, Homo sapien
gaagaaatgccacacgtgtgcgctg

SEQ ID NO: 188146 - DNA, 25 bp, Homo sapien
aagaaatgccacacgtgtgcgctgc

SEQ ID NO: 188147 - DNA, 25 bp, Homo sapien
tgaagaaatgccacacgtgtgcgct

SEQ ID NO: 188148 - DNA, 25 bp, Homo sapien
gaaatgccacacgtgtgcgctgcgg

SEQ ID NO: 188149 - DNA, 25 bp, Homo sapien
acgtgaagaaatgccacacgtgtgc

SEQ ID NO: 188150 - DNA, 25 bp, Homo sapien
aaatgccacacgtgtgcgctgcggg

SEQ ID NO: 188151 - DNA, 25 bp, Homo sapien
tggccagaacaacgcggaagtgatt

SEQ ID NO: 188152 - DNA, 25 bp, Homo sapien
gccgctttttggtcaggcgccacct

SEQ ID NO: 188153 - DNA, 25 bp, Homo sapien
gctcctgcaggattggccagaacaa

SEQ ID NO: 188154 - DNA, 25 bp, Homo sapien
agtgattacgggtcgcccagcaacg

SEQ ID NO: 188155 - DNA, 25 bp, Homo sapien
gacaaggctccgctctatctctagc

SEQ ID NO: 188156 - DNA, 25 bp, Homo sapien
cgcgatattgcggagactggatttc

SEQ ID NO: 188157 - DNA, 25 bp, Homo sapien
actggatttcagcttcgtggtcggc

SEQ ID NO: 188158 - DNA, 25 bp, Homo sapien
tcctggcccgaaactggatgcgcac

SEQ ID NO: 188159 - DNA, 25 bp, Homo sapien
cgcgctagggcagtccttttgactt

SEQ ID NO: 188160 - DNA, 25 bp, Homo sapien
gcgcaccggggagttttgatatccc

SEQ ID NO: 188161 - DNA, 25 bp, Homo sapien
cacaatccgagctcctgcaggggtg

SEQ ID NO: 188162 - DNA, 25 bp, Homo sapien
tgcgttgctggcgtctgagcgcacc

SEQ ID NO: 188163 - DNA, 25 bp, Homo sapien
ccaggactgagggactcggtagctt

SEQ ID NO: 188164 - DNA, 25 bp, Homo sapien
agggactcggtagcttcaggcaatc

SEQ ID NO: 188165 - DNA, 25 bp, Homo sapien
gcttcaggcaatcttcgggacccgc

SEQ ID NO: 188166 - DNA, 25 bp, Homo sapien
cttgcgggaccgagtcttgctccct

SEQ ID NO: 188167 - DNA, 25 bp, Homo sapien
gcgcgctctctacctctgtgcaaag

SEQ ID NO: 188168 - DNA, 25 bp, Homo sapien
ggggagttaacacttcatgcttctc

SEQ ID NO: 188169 - DNA, 25 bp, Homo sapien
tccgctgcgcgctttgcataaggaa

SEQ ID NO: 188170 - DNA, 25 bp, Homo sapien
cttcaggctcgggaagatcctccgc

SEQ ID NO: 188171 - DNA, 25 bp, Homo sapien
tgccagttctgatgccattctcctg

SEQ ID NO: 188172 - DNA, 25 bp, Homo sapien
tcggagttgctcattgccagttctg

SEQ ID NO: 188173 - DNA, 25 bp, Homo sapien
ctcctcttctgcttggctctcttta

SEQ ID NO: 188174 - DNA, 25 bp, Homo sapien
aacatattccatggccaggggactg

SEQ ID NO: 188175 - DNA, 25 bp, Homo sapien
acagcagcctcgtttgcaatgaatg

SEQ ID NO: 188176 - DNA, 25 bp, Homo sapien
ttcagccggaggtcgatcttgtgct

SEQ ID NO: 188177 - DNA, 25 bp, Homo sapien
tagcccgtgaaggtgcctgggacca

SEQ ID NO: 188178 - DNA, 25 bp, Homo sapien
tgaatggcttcaaagcccttcccgc

SEQ ID NO: 188179 - DNA, 25 bp, Homo sapien
atccaccacggccacgtcgaaggtg

SEQ ID NO: 188180 - DNA, 25 bp, Homo sapien
cagcgccttcttggcctggatgagc

SEQ ID NO: 188181 - DNA, 25 bp, Homo sapien
aggtcacacagccacgtgggacccg

SEQ ID NO: 188182 - DNA, 25 bp, Homo sapien
taggcggagcagttctccttgtccg

SEQ ID NO: 188183 - DNA, 25 bp, Homo sapien
ggacgagcctagcaggtaaaccttc

SEQ ID NO: 188184 - DNA, 25 bp, Homo sapien
cgagagttcaccgagttgataaaat

SEQ ID NO: 188185 - DNA, 25 bp, Homo sapien
acaaaatacacatttgcgtgagggg

SEQ ID NO: 188186 - DNA, 25 bp, Homo sapien
tcccttcaggctgcgcaacgctgga

SEQ ID NO: 188187 - DNA, 25 bp, Homo sapien
agctccacacaggtgggacgagcct

SEQ ID NO: 188188 - DNA, 25 bp, Homo sapien
cccgctccagaaacttggctgcgga

SEQ ID NO: 188189 - DNA, 25 bp, Homo sapien
gacagaggcaagacacgcagcgagt

SEQ ID NO: 188190 - DNA, 25 bp, Homo sapien
cgcagcgagtgctctcgcgagagtt

SEQ ID NO: 188191 - DNA, 25 bp, Homo sapien
ttttgtctcctagcaacggcgggta

SEQ ID NO: 188192 - DNA, 25 bp, Homo sapien
tgacgcttccgtggggccacttcct

SEQ ID NO: 188193 - DNA, 25 bp, Homo sapien
gcctgagcccagagtttcgcggcct

SEQ ID NO: 188194 - DNA, 25 bp, Homo sapien
cgcggcctccgcgatggtaaatctg

SEQ ID NO: 188195 - DNA, 25 bp, Homo sapien
gcggtcagggcgaaaaagccgactc

SEQ ID NO: 188196 - DNA, 25 bp, Homo sapien
gaaaaagccgactcgcgagcgcgca

SEQ ID NO: 188197 - DNA, 25 bp, Homo sapien
cgatggtaaatctggggtctccgtc

SEQ ID NO: 188198 - DNA, 25 bp, Homo sapien
agcgttgttgacatcccgggaggct

SEQ ID NO: 188199 - DNA, 25 bp, Homo sapien
cgcgcgccaagacctgtcagtttca

SEQ ID NO: 188200 - DNA, 25 bp, Homo sapien
cggcgcgtctattaaacccgagtcg

SEQ ID NO: 188201 - DNA, 25 bp, Homo sapien
gagcttgccgcacgctgacctactt

SEQ ID NO: 188202 - DNA, 25 bp, Homo sapien
cgatgtgtttgcagccagaggtacc

SEQ ID NO: 188203 - DNA, 25 bp, Homo sapien
gccaagacctgtcagtttcacccag

SEQ ID NO: 188204 - DNA, 25 bp, Homo sapien
ctggaaaggcgggatccctctgcag

SEQ ID NO: 188205 - DNA, 25 bp, Homo sapien
agatttccaggctcttggaagagga

SEQ ID NO: 188206 - DNA, 25 bp, Homo sapien
tgacctactttctggggccgatgtg

SEQ ID NO: 188207 - DNA, 25 bp, Homo sapien
agtccactactggtgcaaggttgca

SEQ ID NO: 188208 - DNA, 25 bp, Homo sapien
gggtggctttttcgcaattgtcgca

SEQ ID NO: 188209 - DNA, 25 bp, Homo sapien
caggtcctaacggagcctatgtgta

SEQ ID NO: 188210 - DNA, 25 bp, Homo sapien
gccgagcacataagccaggtcctaa

SEQ ID NO: 188211 - DNA, 25 bp, Homo sapien
gcgtctaagccacaagccgagcaca

SEQ ID NO: 188212 - DNA, 25 bp, Homo sapien
agctgaaccgcttgccagacgccga

SEQ ID NO: 188213 - DNA, 25 bp, Homo sapien
ctgctagggagcagacagctgaacc

SEQ ID NO: 188214 - DNA, 25 bp, Homo sapien
ccgctctacgatcctggggttgctt

SEQ ID NO: 188215 - DNA, 25 bp, Homo sapien
taacggcgttttggcgagggacgca

SEQ ID NO: 188216 - DNA, 25 bp, Homo sapien
ggcctggctccaacaaagcgcccgg

SEQ ID NO: 188217 - DNA, 25 bp, Homo sapien
ctagtcaagagccaccgcctgcagg

SEQ ID NO: 188218 - DNA, 25 bp, Homo sapien
aggcggctctcgaaccctcgcggca

SEQ ID NO: 188219 - DNA, 25 bp, Homo sapien
tacgcgccagttccctggttccctg

SEQ ID NO: 188220 - DNA, 25 bp, Homo sapien
tttgcctgtgagttcttaacggcgt

SEQ ID NO: 188221 - DNA, 25 bp, Homo sapien
ctgtgagttcttaacggcgttttgg

SEQ ID NO: 188222 - DNA, 25 bp, Homo sapien
gccgtgcggaccaacatcctgtgca

SEQ ID NO: 188223 - DNA, 25 bp, Homo sapien
cgttgccttgggttacgaccacgct

SEQ ID NO: 188224 - DNA, 25 bp, Homo sapien
aggcggccagaaacgtcctcacttt

SEQ ID NO: 188225 - DNA, 25 bp, Homo sapien
cggaagtgacgtagcccaacaaagc

SEQ ID NO: 188226 - DNA, 25 bp, Homo sapien
ttgtgagcctcaaagagcccactta

SEQ ID NO: 188227 - DNA, 25 bp, Homo sapien
ccggcctactggcaagagctactca

SEQ ID NO: 188228 - DNA, 25 bp, Homo sapien
ttcctttcgaacgaggcagggactc

SEQ ID NO: 188229 - DNA, 25 bp, Homo sapien
tctggattgcccgttcgaattcctc

SEQ ID NO: 188230 - DNA, 25 bp, Homo sapien
gcccttgtgcctgctaggatattta

SEQ ID NO: 188231 - DNA, 25 bp, Homo sapien
acgtgcctggcttctgcagcaagcg

SEQ ID NO: 188232 - DNA, 25 bp, Homo sapien
gccagggatcccaacagaaataaga

SEQ ID NO: 188233 - DNA, 25 bp, Homo sapien
tcccggctgcatgcaatccctaggg

SEQ ID NO: 188234 - DNA, 25 bp, Homo sapien
agacgcttaagcgacacgtgcctgg

SEQ ID NO: 188235 - DNA, 25 bp, Homo sapien
ggagataaacttaaggccaccgaga

SEQ ID NO: 188236 - DNA, 25 bp, Homo sapien
cgatgcacgcagatgggagataaac

SEQ ID NO: 188237 - DNA, 25 bp, Homo sapien
cgacctcggatacggcgacgcgaaa

SEQ ID NO: 188238 - DNA, 25 bp, Homo sapien
atccctagggcaaaggctactcgcg

SEQ ID NO: 188239 - DNA, 25 bp, Homo sapien
cagaacctacggcatccaggcggtc

SEQ ID NO: 188240 - DNA, 25 bp, Homo sapien
aacgctccacgcgttctcacaggga

SEQ ID NO: 188241 - DNA, 25 bp, Homo sapien
atctctgtacaaatgcgggcggtga

SEQ ID NO: 188242 - DNA, 25 bp, Homo sapien
atggggctcgtgcaagttctttatg

SEQ ID NO: 188243 - DNA, 25 bp, Homo sapien
tgcggtgagttccagctaatgatgt

SEQ ID NO: 188244 - DNA, 25 bp, Homo sapien
cgaggagacccactacgtaacaacg

SEQ ID NO: 188245 - DNA, 25 bp, Homo sapien
gacggccactccctataccttgatg

SEQ ID NO: 188246 - DNA, 25 bp, Homo sapien
agggactcgcccttagaacaagaca

SEQ ID NO: 188247 - DNA, 25 bp, Homo sapien
gcttctgctcagagcgcggagagcc

SEQ ID NO: 188248 - DNA, 25 bp, Homo sapien
gttcgccagtcgctcgcctctgaat

SEQ ID NO: 188249 - DNA, 25 bp, Homo sapien
gatcccggtgcagaagaacatcctg

SEQ ID NO: 188250 - DNA, 25 bp, Homo sapien
agtgccgtgtctgaccctcagcacg

SEQ ID NO: 188251 - DNA, 25 bp, Homo sapien
aatgacttcatgacgcggcttctta

SEQ ID NO: 188252 - DNA, 25 bp, Homo sapien
ggcgtcgcggagaaatgacttcatg

SEQ ID NO: 188253 - DNA, 25 bp, Homo sapien
ttctgattggccatctccagcagcg

SEQ ID NO: 188254 - DNA, 25 bp, Homo sapien
gctcagctctttccgcgaggagtct

SEQ ID NO: 188255 - DNA, 25 bp, Homo sapien
tcctggcatcagaccgcaggccata

SEQ ID NO: 188256 - DNA, 25 bp, Homo sapien
accttcagcgtcagagctcggtctg

SEQ ID NO: 188257 - DNA, 25 bp, Homo sapien
ccttcatggccctgactcggggctg

SEQ ID NO: 188258 - DNA, 25 bp, Homo sapien
ggggctgcccatgaccttcagcgtc

SEQ ID NO: 188259 - DNA, 25 bp, Homo sapien
gcaggccataaaagcgtccagcaga

SEQ ID NO: 188260 - DNA, 25 bp, Homo sapien
tctggtccatgcctgccttggggaa

SEQ ID NO: 188261 - DNA, 25 bp, Homo sapien
tcagagctcggtctggtccatgcct

SEQ ID NO: 188262 - DNA, 25 bp, Homo sapien
aagaagaaggtagcggccgctgtcc

SEQ ID NO: 188263 - DNA, 25 bp, Homo sapien
tttgttatgacttgcgagccgcctg

SEQ ID NO: 188264 - DNA, 25 bp, Homo sapien
tgacgctccggcaaatgctcagctt

SEQ ID NO: 188265 - DNA, 25 bp, Homo sapien
cacttcaaaggcctacgggtcattc

SEQ ID NO: 188266 - DNA, 25 bp, Homo sapien
ccgcggacccagctgaactggcaga

SEQ ID NO: 188267 - DNA, 25 bp, Homo sapien
tatatttctctgtcagcaccgcgga

SEQ ID NO: 188268 - DNA, 25 bp, Homo sapien
tcagggttctatctgcgcgatgatt

SEQ ID NO: 188269 - DNA, 25 bp, Homo sapien
cccgggtttttctgtcagcctgtca

SEQ ID NO: 188270 - DNA, 25 bp, Homo sapien
cacggcgcaggaatgtttaatgttc

SEQ ID NO: 188271 - DNA, 25 bp, Homo sapien
tggccagcccgctggacagcctgga

SEQ ID NO: 188272 - DNA, 25 bp, Homo sapien
gacactttcagtcgggaaggcgtcc

SEQ ID NO: 188273 - DNA, 25 bp, Homo sapien
caccgcggggacactttcagtcggg

SEQ ID NO: 188274 - DNA, 25 bp, Homo sapien
atcaccgcggggacactttcagtcg

SEQ ID NO: 188275 - DNA, 25 bp, Homo sapien
gatcaccgcggggacactttcagtc

SEQ ID NO: 188276 - DNA, 25 bp, Homo sapien
ggtgggctcatcctccggatcaccg

SEQ ID NO: 188277 - DNA, 25 bp, Homo sapien
cagggtgggctcatcctccggatca

SEQ ID NO: 188278 - DNA, 25 bp, Homo sapien
gtcccgcagtgggagacagggcagg

SEQ ID NO: 188279 - DNA, 25 bp, Homo sapien
catgcacccgacgagctaggaggaa

SEQ ID NO: 188280 - DNA, 25 bp, Homo sapien
taacgctggccgacaacagcctggc

SEQ ID NO: 188281 - DNA, 25 bp, Homo sapien
tcagcaagatcctcacctcgaaatt

SEQ ID NO: 188282 - DNA, 25 bp, Homo sapien
acccgcggacctttctcagcaagat

SEQ ID NO: 188283 - DNA, 25 bp, Homo sapien
acattcaggtctgtgtcatccggca

SEQ ID NO: 188284 - DNA, 25 bp, Homo sapien
acgggatgaggtacaaactgctgca

SEQ ID NO: 188285 - DNA, 25 bp, Homo sapien
cggccatggatgtgaccagcagctc

SEQ ID NO: 188286 - DNA, 25 bp, Homo sapien
cgggctcttctgctttgcaacggga

SEQ ID NO: 188287 - DNA, 25 bp, Homo sapien
acctcatcgactgcctcatggtcag

SEQ ID NO: 188288 - DNA, 25 bp, Homo sapien
gccgtgcgaccggaagcccacttta

SEQ ID NO: 188289 - DNA, 25 bp, Homo sapien
agcccggacctggtgtctcaggaag

SEQ ID NO: 188290 - DNA, 25 bp, Homo sapien
cctgaaggaaatccggaacggctgc

SEQ ID NO: 188291 - DNA, 25 bp, Homo sapien
caggaagccacgctgtctgaggccc

SEQ ID NO: 188292 - DNA, 25 bp, Homo sapien
tggcctccagtgagatccacgtgga

SEQ ID NO: 188293 - DNA, 25 bp, Homo sapien
agcgcaggcaacgacagcgagccca

SEQ ID NO: 188294 - DNA, 25 bp, Homo sapien
cgcctgcagcaccatgagcatcgag

SEQ ID NO: 188295 - DNA, 25 bp, Homo sapien
ccagcacaggtggagaacccaactc

SEQ ID NO: 188296 - DNA, 25 bp, Homo sapien
gtcgttttcacgtagtccaagagcc

SEQ ID NO: 188297 - DNA, 25 bp, Homo sapien
cacccacagtggtgccttctgggga

SEQ ID NO: 188298 - DNA, 25 bp, Homo sapien
ggaaatgtagtcgaaacggccgctg

SEQ ID NO: 188299 - DNA, 25 bp, Homo sapien
ccagaaaacatctggggcggaaacg

SEQ ID NO: 188300 - DNA, 25 bp, Homo sapien
gccttgagtgcttgagttttcgccc

SEQ ID NO: 188301 - DNA, 25 bp, Homo sapien
gtgcttcccggtttataacttcatc

SEQ ID NO: 188302 - DNA, 25 bp, Homo sapien
ccgcagcggtgaacgcactgcattc

SEQ ID NO: 188303 - DNA, 25 bp, Homo sapien
gctggcgttcaaaactcctcttttc

SEQ ID NO: 188304 - DNA, 25 bp, Homo sapien
actcctcttttcgagcggctctgcg

SEQ ID NO: 188305 - DNA, 25 bp, Homo sapien
tccctgtctcacttcggtggttgcg

SEQ ID NO: 188306 - DNA, 25 bp, Homo sapien
aggcgcagtccttcccggagacttt

SEQ ID NO: 188307 - DNA, 25 bp, Homo sapien
cccggagacttttggagagcttgca

SEQ ID NO: 188308 - DNA, 25 bp, Homo sapien
gtctgcgtaattatgcgtgtgtctg

SEQ ID NO: 188309 - DNA, 25 bp, Homo sapien
tcccaaagagggcattacccgcaca

SEQ ID NO: 188310 - DNA, 25 bp, Homo sapien
cgcacagcgcaagagttcaggttaa

SEQ ID NO: 188311 - DNA, 25 bp, Homo sapien
tagctacccatcaccacagctgggg

SEQ ID NO: 188312 - DNA, 25 bp, Homo sapien
acgttctctggctgtgcgttccgcc

SEQ ID NO: 188313 - DNA, 25 bp, Homo sapien
aagccgtcggacctgcctcctggag

SEQ ID NO: 188314 - DNA, 25 bp, Homo sapien
tccttcaccttcaccggcgttgagg

SEQ ID NO: 188315 - DNA, 25 bp, Homo sapien
tctcggagtctctatgacgcgcagg

SEQ ID NO: 188316 - DNA, 25 bp, Homo sapien
agcctggaggtctcggagtctctat

SEQ ID NO: 188317 - DNA, 25 bp, Homo sapien
ctatgacgcgcaggtgtctccttca

SEQ ID NO: 188318 - DNA, 25 bp, Homo sapien
gcaggaggttcgcttcatgaattcc

SEQ ID NO: 188319 - DNA, 25 bp, Homo sapien
ttttgtcttcataacgtgggtggcg

SEQ ID NO: 188320 - DNA, 25 bp, Homo sapien
cgcagtagattcttggacaaccttg

SEQ ID NO: 188321 - DNA, 25 bp, Homo sapien
gacaaccttgtctttcgctcggccg

SEQ ID NO: 188322 - DNA, 25 bp, Homo sapien
tgcgcagctgcgtccctcgcgtagt

SEQ ID NO: 188323 - DNA, 25 bp, Homo sapien
ggcagaccgcaaaaaagccgaagtc

SEQ ID NO: 188324 - DNA, 25 bp, Homo sapien
agaggacgacccagaacttggcttc

SEQ ID NO: 188325 - DNA, 25 bp, Homo sapien
caccttcatgcgcagtagattcttg

SEQ ID NO: 188326 - DNA, 25 bp, Homo sapien
gtgttacccacgtgttttgtcttca

SEQ ID NO: 188327 - DNA, 25 bp, Homo sapien
gctcggtgcattggagaaagactca

SEQ ID NO: 188328 - DNA, 25 bp, Homo sapien
tttgagtgcaggaaagcagcgctcc

SEQ ID NO: 188329 - DNA, 25 bp, Homo sapien
gcatcggggtccttttgctcccaga

SEQ ID NO: 188330 - DNA, 25 bp, Homo sapien
agactcagttagaggcgactccaac

SEQ ID NO: 188331 - DNA, 25 bp, Homo sapien
ttgttaaccctcagagcgccacggc

SEQ ID NO: 188332 - DNA, 25 bp, Homo sapien
ttttttgctagcaggggcgacattc

SEQ ID NO: 188333 - DNA, 25 bp, Homo sapien
tcattccgagcccagagatcctagg

SEQ ID NO: 188334 - DNA, 25 bp, Homo sapien
tgcacctcagagatttcgggaagtt

SEQ ID NO: 188335 - DNA, 25 bp, Homo sapien
tgttgttgcgaaggccctgtgtgaa

SEQ ID NO: 188336 - DNA, 25 bp, Homo sapien
cctgtgtgaaagtcgcctgggtttt

SEQ ID NO: 188337 - DNA, 25 bp, Homo sapien
ctgtgtgaaagtcgcctgggttttc

SEQ ID NO: 188338 - DNA, 25 bp, Homo sapien
ccctgtgtgaaagtcgcctgggttt

SEQ ID NO: 188339 - DNA, 25 bp, Homo sapien
tgcgaaggccctgtgtgaaagtcgc

SEQ ID NO: 188340 - DNA, 25 bp, Homo sapien
gttgcgaaggccctgtgtgaaagtc

SEQ ID NO: 188341 - DNA, 25 bp, Homo sapien
ttgcgaaggccctgtgtgaaagtcg

SEQ ID NO: 188342 - DNA, 25 bp, Homo sapien
cgaaggccctgtgtgaaggtcgcct

SEQ ID NO: 188343 - DNA, 25 bp, Homo sapien
gtttctggaagcgtctctggccgag

SEQ ID NO: 188344 - DNA, 25 bp, Homo sapien
gtgcaggacctcacctcggtggtaa

SEQ ID NO: 188345 - DNA, 25 bp, Homo sapien
tctgagacatcaccgccaagctggg

SEQ ID NO: 188346 - DNA, 25 bp, Homo sapien
gtgtaggttacggtctgagacatca

SEQ ID NO: 188347 - DNA, 25 bp, Homo sapien
gactgagcggacaaacggaagtgta

SEQ ID NO: 188348 - DNA, 25 bp, Homo sapien
cgagctgccagtctcgtcgcgagaa

SEQ ID NO: 188349 - DNA, 25 bp, Homo sapien
tccggtgcgggagaaactactactc

SEQ ID NO: 188350 - DNA, 25 bp, Homo sapien
ccgctccttggaacggaagcgcgcg

SEQ ID NO: 188351 - DNA, 25 bp, Homo sapien
tgcaaacctgggaatgtgcgcgctc

SEQ ID NO: 188352 - DNA, 25 bp, Homo sapien
tccgggagccgaaattgagccatga

SEQ ID NO: 188353 - DNA, 25 bp, Homo sapien
gcgccctcacttgccgagactttta

SEQ ID NO: 188354 - DNA, 25 bp, Homo sapien
gactcggagctggatctcaggccac

SEQ ID NO: 188355 - DNA, 25 bp, Homo sapien
gggaggctgtcaaaacccagtcatc

SEQ ID NO: 188356 - DNA, 25 bp, Homo sapien
cgcgttctttgccactgcatcgatt

SEQ ID NO: 188357 - DNA, 25 bp, Homo sapien
ctgaggccattatccaagctgaaac

SEQ ID NO: 188358 - DNA, 25 bp, Homo sapien
tttttagagccaggcacgtgccgtc

SEQ ID NO: 188359 - DNA, 25 bp, Homo sapien
tgcctctgtgtagctgctcccggaa

SEQ ID NO: 188360 - DNA, 25 bp, Homo sapien
catgaaggcacgaacgtcccgggtt

SEQ ID NO: 188361 - DNA, 25 bp, Homo sapien
cgccggccaggattctcaaggaacc

SEQ ID NO: 188362 - DNA, 25 bp, Homo sapien
cgtcggggaatcctttctgtcctca

SEQ ID NO: 188363 - DNA, 25 bp, Homo sapien
gctcccaaagccacgcgaaagtgga

SEQ ID NO: 188364 - DNA, 25 bp, Homo sapien
cccgcggctgttcgggaaaaagctg

SEQ ID NO: 188365 - DNA, 25 bp, Homo sapien
cctggacacgcagcagatactggca

SEQ ID NO: 188366 - DNA, 25 bp, Homo sapien
tcggatccgtccaacacgtcgggga

SEQ ID NO: 188367 - DNA, 25 bp, Homo sapien
gttcctcgaccgcaatcaatcagtt

SEQ ID NO: 188368 - DNA, 25 bp, Homo sapien
cggcggcaacttctaacacgggaga

SEQ ID NO: 188369 - DNA, 25 bp, Homo sapien
gagagacgcccttccacctctggga

SEQ ID NO: 188370 - DNA, 25 bp, Homo sapien
gtcagctcttgtcaatcctcccgtg

SEQ ID NO: 188371 - DNA, 25 bp, Homo sapien
atttcctcagattccgcggcggaga

SEQ ID NO: 188372 - DNA, 25 bp, Homo sapien
agtgttttttccttcgcagtaatcg

SEQ ID NO: 188373 - DNA, 25 bp, Homo sapien
agggaacctgcacacccagtgtttt

SEQ ID NO: 188374 - DNA, 25 bp, Homo sapien
ctcccgtgatttatgtcagcttttg

SEQ ID NO: 188375 - DNA, 25 bp, Homo sapien
cgcggacttcgtgagcttctacggt

SEQ ID NO: 188376 - DNA, 25 bp, Homo sapien
tcttccaccacatcagcaagctgga

SEQ ID NO: 188377 - DNA, 25 bp, Homo sapien
ggcctacgagctgcgcgagaagaca

SEQ ID NO: 188378 - DNA, 25 bp, Homo sapien
aggcttgacggccaggcgtctcctc

SEQ ID NO: 188379 - DNA, 25 bp, Homo sapien
ccagccgcggggcagtaacctttag

SEQ ID NO: 188380 - DNA, 25 bp, Homo sapien
tgttaggaccggagtacaagccgcc

SEQ ID NO: 188381 - DNA, 25 bp, Homo sapien
cacttgtgcagtgcagtcgggaaag

SEQ ID NO: 188382 - DNA, 25 bp, Homo sapien
ggactggccgccctcctcgagtagt

SEQ ID NO: 188383 - DNA, 25 bp, Homo sapien
ggccctgcccttcatccaccatgag

SEQ ID NO: 188384 - DNA, 25 bp, Homo sapien
acaacatcccggtgatccatgcctt

SEQ ID NO: 188385 - DNA, 25 bp, Homo sapien
acgcggtcctctacgcccgccacta

SEQ ID NO: 188386 - DNA, 25 bp, Homo sapien
cctgtcctcatcattggcgcggggc

SEQ ID NO: 188387 - DNA, 25 bp, Homo sapien
ccaccatgagctgtctgccctggag

SEQ ID NO: 188388 - DNA, 25 bp, Homo sapien
tggtcctcgccacaggcacgttcga

SEQ ID NO: 188389 - DNA, 25 bp, Homo sapien
tgtgggcccgcaacgtggtcctcgc

SEQ ID NO: 188390 - DNA, 25 bp, Homo sapien
tcagaccctgtcctcatcattggcg

SEQ ID NO: 188391 - DNA, 25 bp, Homo sapien
ggagtatgaaggaaagatgttctgg

SEQ ID NO: 188392 - DNA, 25 bp, Homo sapien
cgggagttaaggatgggcgcccgcg

SEQ ID NO: 188393 - DNA, 25 bp, Homo sapien
gtcggccggccggatggatggatgg

SEQ ID NO: 188394 - DNA, 25 bp, Homo sapien
tggatgtatagatggattgatggac

SEQ ID NO: 188395 - DNA, 25 bp, Homo sapien
gaagactggttctgggcgttttgta

SEQ ID NO: 188396 - DNA, 25 bp, Homo sapien
gcacgcccgcgggagttaaggatgg

SEQ ID NO: 188397 - DNA, 25 bp, Homo sapien
agatggattgatggacgggtaggca

SEQ ID NO: 188398 - DNA, 25 bp, Homo sapien
atgttctggggtgaagactggttct

SEQ ID NO: 188399 - DNA, 25 bp, Homo sapien
tccatcccggatcctgtccggagcg

SEQ ID NO: 188400 - DNA, 25 bp, Homo sapien
cccacagtggggagccgtgagcccc

SEQ ID NO: 188401 - DNA, 25 bp, Homo sapien
cctccaccggcgcttctcggagtcc

SEQ ID NO: 188402 - DNA, 25 bp, Homo sapien
gtccaggccggtctccagcccagtc

SEQ ID NO: 188403 - DNA, 25 bp, Homo sapien
acgtccaggccggtctccagcccag

SEQ ID NO: 188404 - DNA, 25 bp, Homo sapien
ccgccacgtccaggccggtctccag

SEQ ID NO: 188405 - DNA, 25 bp, Homo sapien
cccgccacgtccaggccggtctcca

SEQ ID NO: 188406 - DNA, 25 bp, Homo sapien
gccgcgacccgcgaggccctcccta

SEQ ID NO: 188407 - DNA, 25 bp, Homo sapien
ggtgggcgccaggatgggcgagccc

SEQ ID NO: 188408 - DNA, 25 bp, Homo sapien
ggggcaccgccgtcatcctggacgt

SEQ ID NO: 188409 - DNA, 25 bp, Homo sapien
ggcaccgccgtcatcctggacgtga

SEQ ID NO: 188410 - DNA, 25 bp, Homo sapien
accgccgtcatcctggacgtgagta

SEQ ID NO: 188411 - DNA, 25 bp, Homo sapien
cgccgtcatcctggacgtgagtacg

SEQ ID NO: 188412 - DNA, 25 bp, Homo sapien
gtcatcctggacgtgagtacgcgcc

SEQ ID NO: 188413 - DNA, 25 bp, Homo sapien
catcctggacgtgagtacgcgccgg

SEQ ID NO: 188414 - DNA, 25 bp, Homo sapien
tcctggacgtgagtacgcgccggcc

SEQ ID NO: 188415 - DNA, 25 bp, Homo sapien
aaccacggagtacctgggcgtcctg

SEQ ID NO: 188416 - DNA, 25 bp, Homo sapien
cgtggcccggttgtcataacaactc

SEQ ID NO: 188417 - DNA, 25 bp, Homo sapien
tcataacaactcagcgggcgcctcg

SEQ ID NO: 188418 - DNA, 25 bp, Homo sapien
cgggagggagactctgaagcttatt

SEQ ID NO: 188419 - DNA, 25 bp, Homo sapien
gggagactctgaagcttatttttag

SEQ ID NO: 188420 - DNA, 25 bp, Homo sapien
ttatttttagagcaccgtcgcccta

SEQ ID NO: 188421 - DNA, 25 bp, Homo sapien
gtcgccctaacaaccaggctggctg

SEQ ID NO: 188422 - DNA, 25 bp, Homo sapien
ctggctggtaaccacggagtacctg

SEQ ID NO: 188423 - DNA, 25 bp, Homo sapien
cccttgggacagcaacgaatgcctc

SEQ ID NO: 188424 - DNA, 25 bp, Homo sapien
aggggacctcagcaacacattcgga

SEQ ID NO: 188425 - DNA, 25 bp, Homo sapien
tcggattctcgaagcaatgtgggca

SEQ ID NO: 188426 - DNA, 25 bp, Homo sapien
ctgcaagatgagcacgtgacctgcc

SEQ ID NO: 188427 - DNA, 25 bp, Homo sapien
tgacctgccgcggacgaaaagaact

SEQ ID NO: 188428 - DNA, 25 bp, Homo sapien
gccgagatgttttctgcccgtgacc

SEQ ID NO: 188429 - DNA, 25 bp, Homo sapien
gtgacctcagcagcacccttgtcag

SEQ ID NO: 188430 - DNA, 25 bp, Homo sapien
cgtgtgacgccctacacccttggga

SEQ ID NO: 188431 - DNA, 25 bp, Homo sapien
gcggtacaggcacgctgtgtccaaa

SEQ ID NO: 188432 - DNA, 25 bp, Homo sapien
gcctgctgtcatggactcgtggaga

SEQ ID NO: 188433 - DNA, 25 bp, Homo sapien
ctgggccaggatctagaaagactgc

SEQ ID NO: 188434 - DNA, 25 bp, Homo sapien
tgtgtccaaacaagcgccggaggcc

SEQ ID NO: 188435 - DNA, 25 bp, Homo sapien
ccagagcagggcgtattgtttcact

SEQ ID NO: 188436 - DNA, 25 bp, Homo sapien
ccggaagcgcacctagaattgagtc

SEQ ID NO: 188437 - DNA, 25 bp, Homo sapien
cgttaagatggcgaagtgtccggtc

SEQ ID NO: 188438 - DNA, 25 bp, Homo sapien
tggacgaaggtctcgcgacatttgc

SEQ ID NO: 188439 - DNA, 25 bp, Homo sapien
agtaaacatgcaccctgagccctcg

SEQ ID NO: 188440 - DNA, 25 bp, Homo sapien
ggcccagtcaacacgagcaaactcg

SEQ ID NO: 188441 - DNA, 25 bp, Homo sapien
ctcggaaatcctggctgaacccacg

SEQ ID NO: 188442 - DNA, 25 bp, Homo sapien
gctgaacccacgaccgctgcatatt

SEQ ID NO: 188443 - DNA, 25 bp, Homo sapien
caccgacaaaggaggcgattgctgg

SEQ ID NO: 188444 - DNA, 25 bp, Homo sapien
agctcagaggggtctcgccaagcag

SEQ ID NO: 188445 - DNA, 25 bp, Homo sapien
tcggtgtcgccgaagtaaacatgca

SEQ ID NO: 188446 - DNA, 25 bp, Homo sapien
ctgtaaagactagggcgccagcggc

SEQ ID NO: 188447 - DNA, 25 bp, Homo sapien
cgtacctgagtgtccagcatcttca

SEQ ID NO: 188448 - DNA, 25 bp, Homo sapien
agggtgcgcagtgaagtctgcccaa

SEQ ID NO: 188449 - DNA, 25 bp, Homo sapien
tgaagtctgcccaacgccacgaaga

SEQ ID NO: 188450 - DNA, 25 bp, Homo sapien
cgccacgaagaggagtcccggaaca

SEQ ID NO: 188451 - DNA, 25 bp, Homo sapien
ccacgaagaggagtcccggaacacg

SEQ ID NO: 188452 - DNA, 25 bp, Homo sapien
agcccgtacctgagtgtccagcatc

SEQ ID NO: 188453 - DNA, 25 bp, Homo sapien
cagcatcttcactccggtgcggtca

SEQ ID NO: 188454 - DNA, 25 bp, Homo sapien
gtgtccagcatcttcactccggtgc

SEQ ID NO: 188455 - DNA, 25 bp, Homo sapien
ctcccagatccaggctcactgaata

SEQ ID NO: 188456 - DNA, 25 bp, Homo sapien
tggaagctcgagacactcccagatc

SEQ ID NO: 188457 - DNA, 25 bp, Homo sapien
ctttccaatgcgcaagggcggctgg

SEQ ID NO: 188458 - DNA, 25 bp, Homo sapien
tcaaaaggtgcactcgctgcagggc

SEQ ID NO: 188459 - DNA, 25 bp, Homo sapien
ttcggggctgcggaattcattaccg

SEQ ID NO: 188460 - DNA, 25 bp, Homo sapien
tcgggttcccgcatcctttccaatg

SEQ ID NO: 188461 - DNA, 25 bp, Homo sapien
tgctgcgggtcctctcgggttcccg

SEQ ID NO: 188462 - DNA, 25 bp, Homo sapien
caggctcactgaatatcaaaaggtg

SEQ ID NO: 188463 - DNA, 25 bp, Homo sapien
ctcgtggtgcgtggaactcaagtaa

SEQ ID NO: 188464 - DNA, 25 bp, Homo sapien
gaactcaagtaagtcccggccagcc

SEQ ID NO: 188465 - DNA, 25 bp, Homo sapien
ctgactgcccagtgcggaactgtgc

SEQ ID NO: 188466 - DNA, 25 bp, Homo sapien
cgataaagctgtgggcatggagttt

SEQ ID NO: 188467 - DNA, 25 bp, Homo sapien
tggcccagacaaacgcgataaagct

SEQ ID NO: 188468 - DNA, 25 bp, Homo sapien
tcaggcgtggcccagacaaacgcga

SEQ ID NO: 188469 - DNA, 25 bp, Homo sapien
cggctaacggctcagaaagggcgcc

SEQ ID NO: 188470 - DNA, 25 bp, Homo sapien
cggctggctacagcccggctaacgg

SEQ ID NO: 188471 - DNA, 25 bp, Homo sapien
ctccaaggctacagaactcagtcgg

SEQ ID NO: 188472 - DNA, 25 bp, Homo sapien
gtcggatccgcaataacgacaggcc

SEQ ID NO: 188473 - DNA, 25 bp, Homo sapien
cagctacccacggtcttccggtttg

SEQ ID NO: 188474 - DNA, 25 bp, Homo sapien
ggcaccacgagggaaatctcaagta

SEQ ID NO: 188475 - DNA, 25 bp, Homo sapien
ggcgcatgcgtgcacttacgtgacc

SEQ ID NO: 188476 - DNA, 25 bp, Homo sapien
gcatagcctgaaacgatcctagaca

SEQ ID NO: 188477 - DNA, 25 bp, Homo sapien
gcctcgtcgtggtcgtctggaaaat

SEQ ID NO: 188478 - DNA, 25 bp, Homo sapien
aagccctcagacaaggcagcctcga

SEQ ID NO: 188479 - DNA, 25 bp, Homo sapien
cgacgacggcagtcgtaggaagccc

SEQ ID NO: 188480 - DNA, 25 bp, Homo sapien
gcctagcgcctcagatcttcgttgg

SEQ ID NO: 188481 - DNA, 25 bp, Homo sapien
cccacgtgaaggcacccgccctgcg

SEQ ID NO: 188482 - DNA, 25 bp, Homo sapien
ttcgttggcggccatggcttcggct

SEQ ID NO: 188483 - DNA, 25 bp, Homo sapien
cttctcagggcgctgacgacgacgg

SEQ ID NO: 188484 - DNA, 25 bp, Homo sapien
ctggctgcatcgttgcagatcagcc

SEQ ID NO: 188485 - DNA, 25 bp, Homo sapien
cagcgcgagatagggcctagcgcct

SEQ ID NO: 188486 - DNA, 25 bp, Homo sapien
cggccatggcttcggcttctcaggg

SEQ ID NO: 188487 - DNA, 25 bp, Homo sapien
ccgaactcacgtgtgcaacggcgca

SEQ ID NO: 188488 - DNA, 25 bp, Homo sapien
tccttctcggccacgtagaccaaag

SEQ ID NO: 188489 - DNA, 25 bp, Homo sapien
tctcggccacgtagaccaaagggga

SEQ ID NO: 188490 - DNA, 25 bp, Homo sapien
gccacgtagaccaaaggggagaaga

SEQ ID NO: 188491 - DNA, 25 bp, Homo sapien
agcaggccgaactcacgtgtgcaac

SEQ ID NO: 188492 - DNA, 25 bp, Homo sapien
tcacgtgtgcaacggcgcacggtga

SEQ ID NO: 188493 - DNA, 25 bp, Homo sapien
gggctcctcagacaccgccagcgac

SEQ ID NO: 188494 - DNA, 25 bp, Homo sapien
aaggagcaggccgaactcacgtgtg

SEQ ID NO: 188495 - DNA, 25 bp, Homo sapien
tagctccgacagagcctgagtttgc

SEQ ID NO: 188496 - DNA, 25 bp, Homo sapien
cagagctgcacgatctcctcgtagc

SEQ ID NO: 188497 - DNA, 25 bp, Homo sapien
cgtcgtaatcatcgcagagctgcac

SEQ ID NO: 188498 - DNA, 25 bp, Homo sapien
gaactcctggctgtcctcgtcgtaa

SEQ ID NO: 188499 - DNA, 25 bp, Homo sapien
cgctggggctcctgtcgaagaagaa

SEQ ID NO: 188500 - DNA, 25 bp, Homo sapien
tcgcgcagccggttcatgcacaggc

SEQ ID NO: 188501 - DNA, 25 bp, Homo sapien
ccggactgcgggttttccaccatct

SEQ ID NO: 188502 - DNA, 25 bp, Homo sapien
ctgagtttgctcaggcggctcagcg

SEQ ID NO: 188503 - DNA, 25 bp, Homo sapien
aatatctggaaacgggcattgcctg

SEQ ID NO: 188504 - DNA, 25 bp, Homo sapien
ccctcttctgtgtgcgtctggaagg

SEQ ID NO: 188505 - DNA, 25 bp, Homo sapien
gcagctgcaggaggcagatcatccg

SEQ ID NO: 188506 - DNA, 25 bp, Homo sapien
gaggcagatcatccgggctctgtgc

SEQ ID NO: 188507 - DNA, 25 bp, Homo sapien
ggctctgtgcctcttgctacttctc

SEQ ID NO: 188508 - DNA, 25 bp, Homo sapien
gctacttctcctccacgccggctct

SEQ ID NO: 188509 - DNA, 25 bp, Homo sapien
tctgccaagaatatctggaaacggg

SEQ ID NO: 188510 - DNA, 25 bp, Homo sapien
tctggaaacgggcattgcctgcgag

SEQ ID NO: 188511 - DNA, 25 bp, Homo sapien
ccagagctgctgacaccgccctctc

SEQ ID NO: 188512 - DNA, 25 bp, Homo sapien
agctgggcttaaagctgggccacct

SEQ ID NO: 188513 - DNA, 25 bp, Homo sapien
aggacaggtgaacagagctgtcccg

SEQ ID NO: 188514 - DNA, 25 bp, Homo sapien
aactgggacgggcgctccttgagca

SEQ ID NO: 188515 - DNA, 25 bp, Homo sapien
atgcgcctacgcctgcctagaagct

SEQ ID NO: 188516 - DNA, 25 bp, Homo sapien
tacgcctgcctagaagctgtgccgc

SEQ ID NO: 188517 - DNA, 25 bp, Homo sapien
gctgctgctacaacggatgcgccta

SEQ ID NO: 188518 - DNA, 25 bp, Homo sapien
gctacaacggatgcgcctacgcctg

SEQ ID NO: 188519 - DNA, 25 bp, Homo sapien
tagggacgcaggcaacgcctgcgcc

SEQ ID NO: 188520 - DNA, 25 bp, Homo sapien
ctcaccatggtcgagggacgcgtct

SEQ ID NO: 188521 - DNA, 25 bp, Homo sapien
ggacgcgtctccgagttcctgaaga

SEQ ID NO: 188522 - DNA, 25 bp, Homo sapien
gttcgcgctgcgatccgcgaactcg

SEQ ID NO: 188523 - DNA, 25 bp, Homo sapien
ccctggctctggaaagaagctgtcc

SEQ ID NO: 188524 - DNA, 25 bp, Homo sapien
aaagaagctgtcctcacagcaaccg

SEQ ID NO: 188525 - DNA, 25 bp, Homo sapien
cctgccgcgggcaggtagacagcta

SEQ ID NO: 188526 - DNA, 25 bp, Homo sapien
tagacagctacctggtaaccgggtc

SEQ ID NO: 188527 - DNA, 25 bp, Homo sapien
gtgctctcatcagacctctctcttg

SEQ ID NO: 188528 - DNA, 25 bp, Homo sapien
gcgcttggtgatcgtgctctcatca

SEQ ID NO: 188529 - DNA, 25 bp, Homo sapien
tcctcgcaggcagcatttggcgctt

SEQ ID NO: 188530 - DNA, 25 bp, Homo sapien
actacatccgaggtgcgctttgggt

SEQ ID NO: 188531 - DNA, 25 bp, Homo sapien
ggggcctgctcactacatccgaggt

SEQ ID NO: 188532 - DNA, 25 bp, Homo sapien
ttcttcagctcgttccttctcaaac

SEQ ID NO: 188533 - DNA, 25 bp, Homo sapien
cactccaagacgtctgaacctgtca

SEQ ID NO: 188534 - DNA, 25 bp, Homo sapien
gttcccgttcactccaagacgtctg

SEQ ID NO: 188535 - DNA, 25 bp, Homo sapien
cctacctgtgcactgctggatgaag

SEQ ID NO: 188536 - DNA, 25 bp, Homo sapien
tggatgaagtgctggtactccgctc

SEQ ID NO: 188537 - DNA, 25 bp, Homo sapien
ggtggagccgtcatatttaaaagtc

SEQ ID NO: 188538 - DNA, 25 bp, Homo sapien
ctctttgtcgatcttggtggccatc

SEQ ID NO: 188539 - DNA, 25 bp, Homo sapien
gcggcgcttgcagaggacaatctaa

SEQ ID NO: 188540 - DNA, 25 bp, Homo sapien
gacaatctaacagacgcgctggcca

SEQ ID NO: 188541 - DNA, 25 bp, Homo sapien
aaagttcctaccagatgacggccga

SEQ ID NO: 188542 - DNA, 25 bp, Homo sapien
ctggcacgccgtcccggaataaggc

SEQ ID NO: 188543 - DNA, 25 bp, Homo sapien
cgtcgctttctccaacgctgaggtc

SEQ ID NO: 188544 - DNA, 25 bp, Homo sapien
ggcctgcctttgaagggacggagtc

SEQ ID NO: 188545 - DNA, 25 bp, Homo sapien
ctcgcacttcctggcggagccatgg

SEQ ID NO: 188546 - DNA, 25 bp, Homo sapien
acttcctggcggagccatggctgcg

SEQ ID NO: 188547 - DNA, 25 bp, Homo sapien
aaagagctcccagcgcacgcgtcgg

SEQ ID NO: 188548 - DNA, 25 bp, Homo sapien
ccggtgtcagcagcgtcgctttctc

SEQ ID NO: 188549 - DNA, 25 bp, Homo sapien
gcggccgttgcgctgagttccgcct

SEQ ID NO: 188550 - DNA, 25 bp, Homo sapien
ctttctccaacgctgaggtcgggag

SEQ ID NO: 188551 - DNA, 25 bp, Homo sapien
cgcagctccctgcttatcgctaagt

SEQ ID NO: 188552 - DNA, 25 bp, Homo sapien
gccggccctcgtcacccttcactca

SEQ ID NO: 188553 - DNA, 25 bp, Homo sapien
ccttcactcagagccgcctgattag

SEQ ID NO: 188554 - DNA, 25 bp, Homo sapien
agccgcctgattagcatcagggttc

SEQ ID NO: 188555 - DNA, 25 bp, Homo sapien
tagcatcagggttccgctcgcctct

SEQ ID NO: 188556 - DNA, 25 bp, Homo sapien
gcttccacgcggagcctcagctgtg

SEQ ID NO: 188557 - DNA, 25 bp, Homo sapien
gcttatcgctaagtgagatctgtgg

SEQ ID NO: 188558 - DNA, 25 bp, Homo sapien
gagcctcagctgtgcagcgcctgac

SEQ ID NO: 188559 - DNA, 25 bp, Homo sapien
tctccatgcagaagctgtgtgtcta

SEQ ID NO: 188560 - DNA, 25 bp, Homo sapien
gtgcagcgactacttcaactccatg

SEQ ID NO: 188561 - DNA, 25 bp, Homo sapien
tcaccatcggcatgcgggaagcttt

SEQ ID NO: 188562 - DNA, 25 bp, Homo sapien
ggcgcctcctacattgggctcaagg

SEQ ID NO: 188563 - DNA, 25 bp, Homo sapien
gacacctgctacctggacgccaaga

SEQ ID NO: 188564 - DNA, 25 bp, Homo sapien
aaccacttcggcacgctgtccttta

SEQ ID NO: 188565 - DNA, 25 bp, Homo sapien
tggagctcagtgacgacacctgcta

SEQ ID NO: 188566 - DNA, 25 bp, Homo sapien
gcggcaacattgactacgtcctgga

SEQ ID NO: 188567 - DNA, 25 bp, Homo sapien
cgcatctacatcctgggcggctaca

SEQ ID NO: 188568 - DNA, 25 bp, Homo sapien
gccacgcgggcaccatctacaaaga

SEQ ID NO: 188569 - DNA, 25 bp, Homo sapien
gaacactgccttctccaagaccgtg

SEQ ID NO: 188570 - DNA, 25 bp, Homo sapien
tacagcccgcagtgcaaccagtgga

SEQ ID NO: 188571 - DNA, 25 bp, Homo sapien
caacatcgagtccatggagcgcttc

SEQ ID NO: 188572 - DNA, 25 bp, Homo sapien
gggtgacagcatctactccatcggg

SEQ ID NO: 188573 - DNA, 25 bp, Homo sapien
tgctatgctacgaccaccggacaga

SEQ ID NO: 188574 - DNA, 25 bp, Homo sapien
caaagacttcgtgtacatctcgggg

SEQ ID NO: 188575 - DNA, 25 bp, Homo sapien
taatgcgaacactcccgaggcccgg

SEQ ID NO: 188576 - DNA, 25 bp, Homo sapien
ggaggatcgcggagtcccaatgaaa

SEQ ID NO: 188577 - DNA, 25 bp, Homo sapien
cgcggcaacgggatcttcataaacc

SEQ ID NO: 188578 - DNA, 25 bp, Homo sapien
cctcggggatctaatgcgaacactc

SEQ ID NO: 188579 - DNA, 25 bp, Homo sapien
ccagaccctcctcggggatctaatg

SEQ ID NO: 188580 - DNA, 25 bp, Homo sapien
cgggatcttcataaaccagaccctc

SEQ ID NO: 188581 - DNA, 25 bp, Homo sapien
aggtagccgccggtctgcgccttcg

SEQ ID NO: 188582 - DNA, 25 bp, Homo sapien
gtcccaatgaaacgggcagccatgg

SEQ ID NO: 188583 - DNA, 25 bp, Homo sapien
ccggcacccactcgcatcccagggc

SEQ ID NO: 188584 - DNA, 25 bp, Homo sapien
tctccggctgctcctattgagctgt

SEQ ID NO: 188585 - DNA, 25 bp, Homo sapien
ctacaagaggcggtacgctgagccc

SEQ ID NO: 188586 - DNA, 25 bp, Homo sapien
cggtgatgctcggtcctaccagcgc

SEQ ID NO: 188587 - DNA, 25 bp, Homo sapien
gctgctaccgcgtctgctggacgcg

SEQ ID NO: 188588 - DNA, 25 bp, Homo sapien
tgagcgtctccttgtccctagccgg

SEQ ID NO: 188589 - DNA, 25 bp, Homo sapien
ggagctgagcgtctccttgtcccta

SEQ ID NO: 188590 - DNA, 25 bp, Homo sapien
attgagctgtctgctcgctgtgccc

SEQ ID NO: 188591 - DNA, 25 bp, Homo sapien
tcgctaagacagagatgccgccaaa

SEQ ID NO: 188592 - DNA, 25 bp, Homo sapien
aactccagaaggtcgcaggtgtgcg

SEQ ID NO: 188593 - DNA, 25 bp, Homo sapien
atgcccttagcggagtgtgtacccg

SEQ ID NO: 188594 - DNA, 25 bp, Homo sapien
cgccaaactgaagtccggaggagaa

SEQ ID NO: 188595 - DNA, 25 bp, Homo sapien
cagttcattgagaaaaggcagcttt

SEQ ID NO: 188596 - DNA, 25 bp, Homo sapien
ggaggctcttacaaactggcagttc

SEQ ID NO: 188597 - DNA, 25 bp, Homo sapien
tgaacccgacgaggtcagtgacgtc

SEQ ID NO: 188598 - DNA, 25 bp, Homo sapien
agccaagcaaatgcctcagcccgga

SEQ ID NO: 188599 - DNA, 25 bp, Homo sapien
acgcccgtgaatgagtgcaacccgg

SEQ ID NO: 188600 - DNA, 25 bp, Homo sapien
gctcctcgcctgctgggaggcaaag

SEQ ID NO: 188601 - DNA, 25 bp, Homo sapien
cagccgagtctgacggcgccggttc

SEQ ID NO: 188602 - DNA, 25 bp, Homo sapien
gtcgccgcagcagccgagtctgacg

SEQ ID NO: 188603 - DNA, 25 bp, Homo sapien
cgcgtccggttgactgacagctcgc

SEQ ID NO: 188604 - DNA, 25 bp, Homo sapien
gaatgagtgcaacccgggccgctgc

SEQ ID NO: 188605 - DNA, 25 bp, Homo sapien
agagcgctcccaccgagcgtgggca

SEQ ID NO: 188606 - DNA, 25 bp, Homo sapien
tgtcacgtgacaccaagcgctggcc

SEQ ID NO: 188607 - DNA, 25 bp, Homo sapien
acgtgtccgtgcatttggccgggac

SEQ ID NO: 188608 - DNA, 25 bp, Homo sapien
gcatttggccgggacgaccacctca

SEQ ID NO: 188609 - DNA, 25 bp, Homo sapien
cgggacgaccacctcagaggccaag

SEQ ID NO: 188610 - DNA, 25 bp, Homo sapien
gcacatccgctccaatgaggtgacg

SEQ ID NO: 188611 - DNA, 25 bp, Homo sapien
tgccgtccaggaaggagacactgct

SEQ ID NO: 188612 - DNA, 25 bp, Homo sapien
aaggagacactgcttcccgtgggcc

SEQ ID NO: 188613 - DNA, 25 bp, Homo sapien
tccaatgaggtgacgtgtccgtgca

SEQ ID NO: 188614 - DNA, 25 bp, Homo sapien
tccgctccaatgaggtgacgtgtcc

SEQ ID NO: 188615 - DNA, 25 bp, Homo sapien
tgtgtaaccgccgtgtccaggagcg

SEQ ID NO: 188616 - DNA, 25 bp, Homo sapien
ccagcttctggacggtgtccacaga

SEQ ID NO: 188617 - DNA, 25 bp, Homo sapien
aacactctggccagtgcgctggaga

SEQ ID NO: 188618 - DNA, 25 bp, Homo sapien
tgcacatctgggaacactctggcca

SEQ ID NO: 188619 - DNA, 25 bp, Homo sapien
cccgcggtgcacatctgggaacact

SEQ ID NO: 188620 - DNA, 25 bp, Homo sapien
gtgcgccttttatcacccgcggtgc

SEQ ID NO: 188621 - DNA, 25 bp, Homo sapien
ccagcgcacacgttgcaaacatctg

SEQ ID NO: 188622 - DNA, 25 bp, Homo sapien
tgctgacaggaaccagtgcgccttt

SEQ ID NO: 188623 - DNA, 25 bp, Homo sapien
atgccgggtgccctcatggcacttc

SEQ ID NO: 188624 - DNA, 25 bp, Homo sapien
tggcacttctcggttgcacgctggt

SEQ ID NO: 188625 - DNA, 25 bp, Homo sapien
ggcacttctcggttgcacgctggtt

SEQ ID NO: 188626 - DNA, 25 bp, Homo sapien
acgctggttagtattgggcgccgac

SEQ ID NO: 188627 - DNA, 25 bp, Homo sapien
gcacttctcggttgcacgctggtta

SEQ ID NO: 188628 - DNA, 25 bp, Homo sapien
cacgctggttagtattgggcgccga

SEQ ID NO: 188629 - DNA, 25 bp, Homo sapien
tgcacgctggttagtattgggcgcc

SEQ ID NO: 188630 - DNA, 25 bp, Homo sapien
cacttctcggttgcacgctggttag

SEQ ID NO: 188631 - DNA, 25 bp, Homo sapien
tttgccatagctagcaacgggcagc

SEQ ID NO: 188632 - DNA, 25 bp, Homo sapien
cgcgtggatattgctactcattcta

SEQ ID NO: 188633 - DNA, 25 bp, Homo sapien
agcgcatccatcttgggctcgtgga

SEQ ID NO: 188634 - DNA, 25 bp, Homo sapien
acctccatggtcaccgggatgatga

SEQ ID NO: 188635 - DNA, 25 bp, Homo sapien
ccaggaaagcccaccacatgcgttg

SEQ ID NO: 188636 - DNA, 25 bp, Homo sapien
agcgtccgccagagcaagatgatga

SEQ ID NO: 188637 - DNA, 25 bp, Homo sapien
ggcagcacacggtccacaggtactt

SEQ ID NO: 188638 - DNA, 25 bp, Homo sapien
cgagatatatacagcgagccgccgc

SEQ ID NO: 188639 - DNA, 25 bp, Homo sapien
cacaaaatagatagaggagccggcc

SEQ ID NO: 188640 - DNA, 25 bp, Homo sapien
cggctccggctggacacaaaataga

SEQ ID NO: 188641 - DNA, 25 bp, Homo sapien
ggcaatgaatcatcgcgcgcggctc

SEQ ID NO: 188642 - DNA, 25 bp, Homo sapien
ccaggagacccttcagacggctaga

SEQ ID NO: 188643 - DNA, 25 bp, Homo sapien
agctccagccgctgatgggtttcgg

SEQ ID NO: 188644 - DNA, 25 bp, Homo sapien
ccgcgtcctgattgacctttactta

SEQ ID NO: 188645 - DNA, 25 bp, Homo sapien
tttacttaaagaccagctccagccg

SEQ ID NO: 188646 - DNA, 25 bp, Homo sapien
agccggccgctattgtgcgcagttt

SEQ ID NO: 188647 - DNA, 25 bp, Homo sapien
cgactccacagttcgcggaggggca

SEQ ID NO: 188648 - DNA, 25 bp, Homo sapien
ccaggttttcgaggcccatccggct

SEQ ID NO: 188649 - DNA, 25 bp, Homo sapien
cctcagagacgcaccggcttagaca

SEQ ID NO: 188650 - DNA, 25 bp, Homo sapien
ctcgggtgtagcttcttcccaagga

SEQ ID NO: 188651 - DNA, 25 bp, Homo sapien
gaagagttctgccacccggctgcca

SEQ ID NO: 188652 - DNA, 25 bp, Homo sapien
catccatggcgcagactccgagaga

SEQ ID NO: 188653 - DNA, 25 bp, Homo sapien
gacaaacgatggtcgcgtcggcctc

SEQ ID NO: 188654 - DNA, 25 bp, Homo sapien
ttcccaaggagcctcggaagagttc

SEQ ID NO: 188655 - DNA, 25 bp, Homo sapien
aggtctccgagttcatgtctcacgg

SEQ ID NO: 188656 - DNA, 25 bp, Homo sapien
gtctccgagttcacgtctcacggcg

SEQ ID NO: 188657 - DNA, 25 bp, Homo sapien
cgacggctctctcacatccacaggt

SEQ ID NO: 188658 - DNA, 25 bp, Homo sapien
acgacggctctctcacatccacagg

SEQ ID NO: 188659 - DNA, 25 bp, Homo sapien
cacaggtctccgagttcatgtctca

SEQ ID NO: 188660 - DNA, 25 bp, Homo sapien
gtctccgagttcatgtctcacggcg

SEQ ID NO: 188661 - DNA, 25 bp, Homo sapien
cacaggtctccgagttcacgtctca

SEQ ID NO: 188662 - DNA, 25 bp, Homo sapien
acaggtctccgagttcacgtctcac

SEQ ID NO: 188663 - DNA, 25 bp, Homo sapien
cacgccggtggacaagcgcatgtac

SEQ ID NO: 188664 - DNA, 25 bp, Homo sapien
tgtcggagctgtcggacaccgaccc

SEQ ID NO: 188665 - DNA, 25 bp, Homo sapien
agactccgacctgtcggagctgtcg

SEQ ID NO: 188666 - DNA, 25 bp, Homo sapien
aggagacgcgagactccgacctgtc

SEQ ID NO: 188667 - DNA, 25 bp, Homo sapien
agcgcatgtactggctcaagcggcc

SEQ ID NO: 188668 - DNA, 25 bp, Homo sapien
cctgcttcatctgcggcggcggcat

SEQ ID NO: 188669 - DNA, 25 bp, Homo sapien
caagcagcggctcatggcagccgtg

SEQ ID NO: 188670 - DNA, 25 bp, Homo sapien
gcgagtggaacgtcgcctacgcgct

SEQ ID NO: 188671 - DNA, 25 bp, Homo sapien
gcctgccagaacgaggagctcatca

SEQ ID NO: 188672 - DNA, 25 bp, Homo sapien
gcttgggcgagaaggagcccttctt

SEQ ID NO: 188673 - DNA, 25 bp, Homo sapien
gggaaggagttccagctcaacgtga

SEQ ID NO: 188674 - DNA, 25 bp, Homo sapien
ccatctgctacatctgtggggctga

SEQ ID NO: 188675 - DNA, 25 bp, Homo sapien
gggcttcctgggcaggtaccaccag

SEQ ID NO: 188676 - DNA, 25 bp, Homo sapien
agctcatcacctccgtgcagggctt

SEQ ID NO: 188677 - DNA, 25 bp, Homo sapien
gcaacgccaggagcgccatgcattt

SEQ ID NO: 188678 - DNA, 25 bp, Homo sapien
aagcgctgtgaagtccgcagctgcc

SEQ ID NO: 188679 - DNA, 25 bp, Homo sapien
ttcgtctgtgttggcgttcgcctgt

SEQ ID NO: 188680 - DNA, 25 bp, Homo sapien
gtctgtgttggcgttcgcctgtgtt

SEQ ID NO: 188681 - DNA, 25 bp, Homo sapien
cgttcgcctgtgttggggttcacca

SEQ ID NO: 188682 - DNA, 25 bp, Homo sapien
cctgtgttggggttcaccatatgtt

SEQ ID NO: 188683 - DNA, 25 bp, Homo sapien
ggggttcaccatatgttggggttca

SEQ ID NO: 188684 - DNA, 25 bp, Homo sapien
gttcaccatatgttggggttcacca

SEQ ID NO: 188685 - DNA, 25 bp, Homo sapien
ttcaccatatgttggggttcaccac

SEQ ID NO: 188686 - DNA, 25 bp, Homo sapien
tgtgttggggttcaccatatgttgg

SEQ ID NO: 188687 - DNA, 25 bp, Homo sapien
gagctgaccttacgggcgccggggc

SEQ ID NO: 188688 - DNA, 25 bp, Homo sapien
caggagctgaccttacgggcgccgg

SEQ ID NO: 188689 - DNA, 25 bp, Homo sapien
tggagccaggagctgaccttacggg

SEQ ID NO: 188690 - DNA, 25 bp, Homo sapien
agaccattgggtggcgttctggccc

SEQ ID NO: 188691 - DNA, 25 bp, Homo sapien
cagaccattgggtggcgttctggcc

SEQ ID NO: 188692 - DNA, 25 bp, Homo sapien
ccagaccattgggtggcgttctggc

SEQ ID NO: 188693 - DNA, 25 bp, Homo sapien
gggtggggctcatactcctcgtccc

SEQ ID NO: 188694 - DNA, 25 bp, Homo sapien
tcctctgccaccacgggggtggggc

SEQ ID NO: 188695 - DNA, 25 bp, Homo sapien
ccgccattagctgggtgcacacgca

SEQ ID NO: 188696 - DNA, 25 bp, Homo sapien
ctgtctttggccgtgctctgcaagg

SEQ ID NO: 188697 - DNA, 25 bp, Homo sapien
gtatcctgcgttcccatcatcgtca

SEQ ID NO: 188698 - DNA, 25 bp, Homo sapien
agcctaggctcccttttctaacagg

SEQ ID NO: 188699 - DNA, 25 bp, Homo sapien
tttctaacaggctccgctttggatg

SEQ ID NO: 188700 - DNA, 25 bp, Homo sapien
tttgggctgcacacttcctagcgtg

SEQ ID NO: 188701 - DNA, 25 bp, Homo sapien
cacgcaggcccgaggaagcctaggc

SEQ ID NO: 188702 - DNA, 25 bp, Homo sapien
ctttggatgtctgagtttgggctgc

SEQ ID NO: 188703 - DNA, 25 bp, Homo sapien
aggccgggagaattgagaatctgcc

SEQ ID NO: 188704 - DNA, 25 bp, Homo sapien
gaattgagaatctgcccggcgggtc

SEQ ID NO: 188705 - DNA, 25 bp, Homo sapien
cccggcgggtcgtgctttagctgtc

SEQ ID NO: 188706 - DNA, 25 bp, Homo sapien
atcacagcatgtggcgcgaggacaa

SEQ ID NO: 188707 - DNA, 25 bp, Homo sapien
tttagctgtcgctgtagggcgactc

SEQ ID NO: 188708 - DNA, 25 bp, Homo sapien
agggcgactcttggcgtgtaatcac

SEQ ID NO: 188709 - DNA, 25 bp, Homo sapien
ttggcgtgtaatcacagcatgtggc

SEQ ID NO: 188710 - DNA, 25 bp, Homo sapien
cgaggacaaagaacatgacagcaga

SEQ ID NO: 188711 - DNA, 25 bp, Homo sapien
gcccgccacagctggactcttgttt

SEQ ID NO: 188712 - DNA, 25 bp, Homo sapien
tggactcttgtttctccagcgcctc

SEQ ID NO: 188713 - DNA, 25 bp, Homo sapien
cagatgagtgttctgcggtgtcact

SEQ ID NO: 188714 - DNA, 25 bp, Homo sapien
ttctgcggtgtcactgagaactctg

SEQ ID NO: 188715 - DNA, 25 bp, Homo sapien
cggtgtcactgagaactctggctca

SEQ ID NO: 188716 - DNA, 25 bp, Homo sapien
ggctccagcgggtcactctgcccgc

SEQ ID NO: 188717 - DNA, 25 bp, Homo sapien
ctcatgcacgaggccagctggaggc

SEQ ID NO: 188718 - DNA, 25 bp, Homo sapien
actgagaactctggctcatgcacga

SEQ ID NO: 188719 - DNA, 25 bp, Homo sapien
aggaccgccacacacatgcgctggg

SEQ ID NO: 188720 - DNA, 25 bp, Homo sapien
accacagagaagctgatgacagtga

SEQ ID NO: 188721 - DNA, 25 bp, Homo sapien
cagagaagctgatgacagtgaatgc

SEQ ID NO: 188722 - DNA, 25 bp, Homo sapien
cgccacacacatgcgctgggggcag

SEQ ID NO: 188723 - DNA, 25 bp, Homo sapien
gaggggccaggaccgccacacacat

SEQ ID NO: 188724 - DNA, 25 bp, Homo sapien
ggaccgccacacacatgcgctgggg

SEQ ID NO: 188725 - DNA, 25 bp, Homo sapien
tggctgcaataaaacaaccacagag

SEQ ID NO: 188726 - DNA, 25 bp, Homo sapien
cagtgaatgctgacaaggatgtgga

SEQ ID NO: 188727 - DNA, 25 bp, Homo sapien
agccagccgaggattccttgggctt

SEQ ID NO: 188728 - DNA, 25 bp, Homo sapien
gctccgcgcagggtaaacaccaggc

SEQ ID NO: 188729 - DNA, 25 bp, Homo sapien
ccgaggattccttgggcttggttat

SEQ ID NO: 188730 - DNA, 25 bp, Homo sapien
caaggctcattaagcgccggtgttc

SEQ ID NO: 188731 - DNA, 25 bp, Homo sapien
gcttggttattaaaggctccgcgca

SEQ ID NO: 188732 - DNA, 25 bp, Homo sapien
gcaggagaaggttcgcctgtgccaa

SEQ ID NO: 188733 - DNA, 25 bp, Homo sapien
cgctcagaggcgctcagcaacaagc

SEQ ID NO: 188734 - DNA, 25 bp, Homo sapien
cctgtgccaaggctcattaagcgcc

SEQ ID NO: 188735 - DNA, 25 bp, Homo sapien
caggcactcggagacacagctcaca

SEQ ID NO: 188736 - DNA, 25 bp, Homo sapien
tgcagacgcacgagacagacacaga

SEQ ID NO: 188737 - DNA, 25 bp, Homo sapien
aacacacagacgaaagcaggcactc

SEQ ID NO: 188738 - DNA, 25 bp, Homo sapien
acagctcacagacatggcataggca

SEQ ID NO: 188739 - DNA, 25 bp, Homo sapien
acatggcataggcacgggtgcacgc

SEQ ID NO: 188740 - DNA, 25 bp, Homo sapien
gggcacgtccagacatgcagacgca

SEQ ID NO: 188741 - DNA, 25 bp, Homo sapien
gggcccagctgtgcactgccagctg

SEQ ID NO: 188742 - DNA, 25 bp, Homo sapien
cagacacagacacagtacatacacg

SEQ ID NO: 188743 - DNA, 25 bp, Homo sapien
cccagggcagggtgattgtgctcct

SEQ ID NO: 188744 - DNA, 25 bp, Homo sapien
gcgaatgaatgagcgctggccgcct

SEQ ID NO: 188745 - DNA, 25 bp, Homo sapien
ccacggttaccaccgccacggcagg

SEQ ID NO: 188746 - DNA, 25 bp, Homo sapien
ccctgtcaggtcagcggcgccttat

SEQ ID NO: 188747 - DNA, 25 bp, Homo sapien
cacggcagggccagtctctttgtct

SEQ ID NO: 188748 - DNA, 25 bp, Homo sapien
tctctttcatgagcggcagcctcca

SEQ ID NO: 188749 - DNA, 25 bp, Homo sapien
ctttgtctctttcatgagcggcagc

SEQ ID NO: 188750 - DNA, 25 bp, Homo sapien
tttcatgagcggcagcctccaggca

SEQ ID NO: 188751 - DNA, 25 bp, Homo sapien
gatcacgacccagacagactcacgg

SEQ ID NO: 188752 - DNA, 25 bp, Homo sapien
ggatcacgacccagacagactcacg

SEQ ID NO: 188753 - DNA, 25 bp, Homo sapien
tgacagcacgggatcacgacccaga

SEQ ID NO: 188754 - DNA, 25 bp, Homo sapien
cgacccagacacagactcacggtga

SEQ ID NO: 188755 - DNA, 25 bp, Homo sapien
gggatcacgacccagacacagactc

SEQ ID NO: 188756 - DNA, 25 bp, Homo sapien
ggatcacgacccagacacagactca

SEQ ID NO: 188757 - DNA, 25 bp, Homo sapien
acccagacagactcacggtgacagc

SEQ ID NO: 188758 - DNA, 25 bp, Homo sapien
tcacgacccagacagactcacggtg

SEQ ID NO: 188759 - DNA, 25 bp, Homo sapien
gcctcagaggtttctgcccgtgctc

SEQ ID NO: 188760 - DNA, 25 bp, Homo sapien
ccgtggcagcctcagaggtttctgc

SEQ ID NO: 188761 - DNA, 25 bp, Homo sapien
tgagcatcagggctggaaagtcgcc

SEQ ID NO: 188762 - DNA, 25 bp, Homo sapien
ctaccgtgtttgcaggccacacttg

SEQ ID NO: 188763 - DNA, 25 bp, Homo sapien
cccagatctgatcctttgagcatca

SEQ ID NO: 188764 - DNA, 25 bp, Homo sapien
gcgtctctgatccaacgcctgctgt

SEQ ID NO: 188765 - DNA, 25 bp, Homo sapien
ggccacacttgcagagcgcgtctct

SEQ ID NO: 188766 - DNA, 25 bp, Homo sapien
attggccttccgtcctccttcggag

SEQ ID NO: 188767 - DNA, 25 bp, Homo sapien
cgcaccattagcactcgagagcctt

SEQ ID NO: 188768 - DNA, 25 bp, Homo sapien
gcctgccgttctgggagggcatcat

SEQ ID NO: 188769 - DNA, 25 bp, Homo sapien
agggcatcatccttcatcccgcagg

SEQ ID NO: 188770 - DNA, 25 bp, Homo sapien
tggattacagctaatgagcctgctc

SEQ ID NO: 188771 - DNA, 25 bp, Homo sapien
gagccttcctcggattaaagccgtg

SEQ ID NO: 188772 - DNA, 25 bp, Homo sapien
cggctgtgcatcagtgtgcccgtaa

SEQ ID NO: 188773 - DNA, 25 bp, Homo sapien
gtgcccgtaattgttcctgtaattg

SEQ ID NO: 188774 - DNA, 25 bp, Homo sapien
ccgccgcgttaaggacagatggatt

SEQ ID NO: 188775 - DNA, 25 bp, Homo sapien
cgataagcactgagtggaagcttcc

SEQ ID NO: 188776 - DNA, 25 bp, Homo sapien
gaaccattactgtgcccgggagacc

SEQ ID NO: 188777 - DNA, 25 bp, Homo sapien
gaagcttccagagagggaaccatta

SEQ ID NO: 188778 - DNA, 25 bp, Homo sapien
ccgggatggttacaacaggtttatg

SEQ ID NO: 188779 - DNA, 25 bp, Homo sapien
tttatgctgcgtgagcgatggcgtt

SEQ ID NO: 188780 - DNA, 25 bp, Homo sapien
gcgtttgcatggctgacgccgagca

SEQ ID NO: 188781 - DNA, 25 bp, Homo sapien
ccgctgggacccaacagtgttgaaa

SEQ ID NO: 188782 - DNA, 25 bp, Homo sapien
cctccaaggccgtcgtcagggatga

SEQ ID NO: 188783 - DNA, 25 bp, Homo sapien
ctcatggcctcacatgctgtgcggg

SEQ ID NO: 188784 - DNA, 25 bp, Homo sapien
acggagccagtgtccgcctcatggc

SEQ ID NO: 188785 - DNA, 25 bp, Homo sapien
agatgccctgacaggcgcgtcggct

SEQ ID NO: 188786 - DNA, 25 bp, Homo sapien
agggacacggctcctggcccgagat

SEQ ID NO: 188787 - DNA, 25 bp, Homo sapien
tccaaggtttatctctgctcacaga

SEQ ID NO: 188788 - DNA, 25 bp, Homo sapien
gtcgcgaaaggccttgcgtgtgccc

SEQ ID NO: 188789 - DNA, 25 bp, Homo sapien
ggctccgccgtgaagaacgacaagc

SEQ ID NO: 188790 - DNA, 25 bp, Homo sapien
ctgtgcgggagataaagcaggctcc

SEQ ID NO: 188791 - DNA, 25 bp, Homo sapien
ccctcggtacttcttggctgtttgg

SEQ ID NO: 188792 - DNA, 25 bp, Homo sapien
tatcgccctgcgaagcatggagctg

SEQ ID NO: 188793 - DNA, 25 bp, Homo sapien
cgccgcctcttttatttacgagaag

SEQ ID NO: 188794 - DNA, 25 bp, Homo sapien
catgaaaattgatcgaggggctctc

SEQ ID NO: 188795 - DNA, 25 bp, Homo sapien
ctttcgctttcattaggggagacaa

SEQ ID NO: 188796 - DNA, 25 bp, Homo sapien
ggggaagctcgcaagtgaaactatt

SEQ ID NO: 188797 - DNA, 25 bp, Homo sapien
gcagccgcccactgtttgcaaacgg

SEQ ID NO: 188798 - DNA, 25 bp, Homo sapien
cagccagctttccaatttaccgata

SEQ ID NO: 188799 - DNA, 25 bp, Homo sapien
gcaggagagcaattcccacccttaa

SEQ ID NO: 188800 - DNA, 25 bp, Homo sapien
cacccttaaactcggaggccgtgct

SEQ ID NO: 188801 - DNA, 25 bp, Homo sapien
ccggctgcaggagagcaattcccac

SEQ ID NO: 188802 - DNA, 25 bp, Homo sapien
ggccgtgctccggattactaatttc

SEQ ID NO: 188803 - DNA, 25 bp, Homo sapien
ccgggcgcactgacagtgagtgtca

SEQ ID NO: 188804 - DNA, 25 bp, Homo sapien
tgacagtgagtgtcatccatctccc

SEQ ID NO: 188805 - DNA, 25 bp, Homo sapien
gccaggactcacagagcggctcgct

SEQ ID NO: 188806 - DNA, 25 bp, Homo sapien
aacctcgttagcgaggagcgcgccg

SEQ ID NO: 188807 - DNA, 25 bp, Homo sapien
caggtaacgcccagaacgagtgctt

SEQ ID NO: 188808 - DNA, 25 bp, Homo sapien
tgagtctacgaacagggaagcagcc

SEQ ID NO: 188809 - DNA, 25 bp, Homo sapien
gaaaggacccgtcccagcgagccag

SEQ ID NO: 188810 - DNA, 25 bp, Homo sapien
cgcggggccaacgaacgcccacatt

SEQ ID NO: 188811 - DNA, 25 bp, Homo sapien
cgccggctgctgagtctacgaacag

SEQ ID NO: 188812 - DNA, 25 bp, Homo sapien
ccagaacgagtgcttctcccggtgg

SEQ ID NO: 188813 - DNA, 25 bp, Homo sapien
ggagcgggactgacgcgctcctctc

SEQ ID NO: 188814 - DNA, 25 bp, Homo sapien
ggacttcagggccatgctggctgtc

SEQ ID NO: 188815 - DNA, 25 bp, Homo sapien
gggcacttcagtgttgctcaccctg

SEQ ID NO: 188816 - DNA, 25 bp, Homo sapien
acttagaaatgtgcggtggagactc

SEQ ID NO: 188817 - DNA, 25 bp, Homo sapien
gacaccgcgacaccctcattagatg

SEQ ID NO: 188818 - DNA, 25 bp, Homo sapien
aagagactttccgagacagccagcc

SEQ ID NO: 188819 - DNA, 25 bp, Homo sapien
gcctccctcggtgttgcttaagctt

SEQ ID NO: 188820 - DNA, 25 bp, Homo sapien
tccgacggcgaagtgtgtcatcccg

SEQ ID NO: 188821 - DNA, 25 bp, Homo sapien
agcgacctcggtgcttcctaagaga

SEQ ID NO: 188822 - DNA, 25 bp, Homo sapien
ccaccaaatggaaagagggctcctt

SEQ ID NO: 188823 - DNA, 25 bp, Homo sapien
ctcagaagtagggacgcgctagatc

SEQ ID NO: 188824 - DNA, 25 bp, Homo sapien
agggcacacaggctggttctgctcc

SEQ ID NO: 188825 - DNA, 25 bp, Homo sapien
taaattatagcgtccggccaaggcc

SEQ ID NO: 188826 - DNA, 25 bp, Homo sapien
cttttcgtttgtggtctgcccggag

SEQ ID NO: 188827 - DNA, 25 bp, Homo sapien
ccgcaggtaggagccagtaacggcc

SEQ ID NO: 188828 - DNA, 25 bp, Homo sapien
ccgccagcgtcatcgggaacagatg

SEQ ID NO: 188829 - DNA, 25 bp, Homo sapien
tgaaagtcgaaacccgcaccgcagc

SEQ ID NO: 188830 - DNA, 25 bp, Homo sapien
gccaccgtgtggtgcgtaaattata

SEQ ID NO: 188831 - DNA, 25 bp, Homo sapien
tgtcctcctgcaagttcgcgggttt

SEQ ID NO: 188832 - DNA, 25 bp, Homo sapien
tggaatgaaaactttgcggcgacgc

SEQ ID NO: 188833 - DNA, 25 bp, Homo sapien
gacggtggctccagcatgtatcagc

SEQ ID NO: 188834 - DNA, 25 bp, Homo sapien
tttagacaaacactgggcgacggtg

SEQ ID NO: 188835 - DNA, 25 bp, Homo sapien
cccgggtgagataagcagtttagac

SEQ ID NO: 188836 - DNA, 25 bp, Homo sapien
cgacagcagcaggtgtttcttggcc

SEQ ID NO: 188837 - DNA, 25 bp, Homo sapien
gtttgcggctgaaacccgacacctc

SEQ ID NO: 188838 - DNA, 25 bp, Homo sapien
gggtgctgcactactttaagagtta

SEQ ID NO: 188839 - DNA, 25 bp, Homo sapien
tcgcgtcaaatgttgctgccatctg

SEQ ID NO: 188840 - DNA, 25 bp, Homo sapien
tgctgccatctgttgcctgacttcc

SEQ ID NO: 188841 - DNA, 25 bp, Homo sapien
tccgggaccagtccgtggccgtgaa

SEQ ID NO: 188842 - DNA, 25 bp, Homo sapien
tggccgtgaacctcagtcgcaggac

SEQ ID NO: 188843 - DNA, 25 bp, Homo sapien
aacctcagtcgcaggaccgtcggct

SEQ ID NO: 188844 - DNA, 25 bp, Homo sapien
tcgcaggaccgtcggctcctaggag

SEQ ID NO: 188845 - DNA, 25 bp, Homo sapien
ccgcttaggataatcgcgtcaaatg

SEQ ID NO: 188846 - DNA, 25 bp, Homo sapien
acacagcagccgcttaggataatcg

SEQ ID NO: 188847 - DNA, 25 bp, Homo sapien
tctcagacagagacgcacagggtcc

SEQ ID NO: 188848 - DNA, 25 bp, Homo sapien
agctgcaccgcggtttggatttgcg

SEQ ID NO: 188849 - DNA, 25 bp, Homo sapien
tttctgtttttagcatctccgggca

SEQ ID NO: 188850 - DNA, 25 bp, Homo sapien
actctgtgcccagtaaggggccaca

SEQ ID NO: 188851 - DNA, 25 bp, Homo sapien
tcccgccagtcttctgagggcattg

SEQ ID NO: 188852 - DNA, 25 bp, Homo sapien
cgcgtcagtggccacagcagttgtc

SEQ ID NO: 188853 - DNA, 25 bp, Homo sapien
ctgaacttggccctgggaggaaaga

SEQ ID NO: 188854 - DNA, 25 bp, Homo sapien
ttccttttctgtaacgtggggcaga

SEQ ID NO: 188855 - DNA, 25 bp, Homo sapien
cgcgccatcctccagctttgccgcc

SEQ ID NO: 188856 - DNA, 25 bp, Homo sapien
agcaggtctcgtctttcccacgccg

SEQ ID NO: 188857 - DNA, 25 bp, Homo sapien
cggcgtgcacgctcacagcaggtct

SEQ ID NO: 188858 - DNA, 25 bp, Homo sapien
ctgcggcgtgcacgctcacagcagg

SEQ ID NO: 188859 - DNA, 25 bp, Homo sapien
aacaggcggaggagcccagaggtaa

SEQ ID NO: 188860 - DNA, 25 bp, Homo sapien
gctcgccaaacaggcggaggagccc

SEQ ID NO: 188861 - DNA, 25 bp, Homo sapien
gcgctgcgcaagctcgccaaacagg

SEQ ID NO: 188862 - DNA, 25 bp, Homo sapien
cgcaagctcgccaaacaggcggagg

SEQ ID NO: 188863 - DNA, 25 bp, Homo sapien
ctgccggggagacgcgataaaactg

SEQ ID NO: 188864 - DNA, 25 bp, Homo sapien
agacgccacagtgcggcacgcatgc

SEQ ID NO: 188865 - DNA, 25 bp, Homo sapien
tgcaaacgattctgcctgccacgtc

SEQ ID NO: 188866 - DNA, 25 bp, Homo sapien
accctgcctcgggtgtcatctgacg

SEQ ID NO: 188867 - DNA, 25 bp, Homo sapien
gtcatctgacgaggatgccaagcta

SEQ ID NO: 188868 - DNA, 25 bp, Homo sapien
tgccaagctacaagggctgcggtga

SEQ ID NO: 188869 - DNA, 25 bp, Homo sapien
gagactcagagacacgctaccaatg

SEQ ID NO: 188870 - DNA, 25 bp, Homo sapien
acctcgccgaagcagctgccgggga

SEQ ID NO: 188871 - DNA, 25 bp, Homo sapien
agctgagaaggccaaagttcagaga

SEQ ID NO: 188872 - DNA, 25 bp, Homo sapien
gccgccgttaggacagttctgagct

SEQ ID NO: 188873 - DNA, 25 bp, Homo sapien
agagccgccgttaggacagttctga

SEQ ID NO: 188874 - DNA, 25 bp, Homo sapien
caagtcgcaagacggcagccacagc

SEQ ID NO: 188875 - DNA, 25 bp, Homo sapien
ccaaagttcagagaggacaagtcgc

SEQ ID NO: 188876 - DNA, 25 bp, Homo sapien
gaccctcgggcagctgagaaggcca

SEQ ID NO: 188877 - DNA, 25 bp, Homo sapien
cacgtttccccgtccatggaactgg

SEQ ID NO: 188878 - DNA, 25 bp, Homo sapien
ttcagagaggacaagtcgcaagacg

SEQ ID NO: 188879 - DNA, 25 bp, Homo sapien
cgtgggaatgcttccaccgtggagc

SEQ ID NO: 188880 - DNA, 25 bp, Homo sapien
ggaaatctgcctctcaaagaaaaca

SEQ ID NO: 188881 - DNA, 25 bp, Homo sapien
gcctcggaaatctgcctctcaaaga

SEQ ID NO: 188882 - DNA, 25 bp, Homo sapien
ggaccacggagcagggaccacagac

SEQ ID NO: 188883 - DNA, 25 bp, Homo sapien
tgggaatgcttccaccgtggagccg

SEQ ID NO: 188884 - DNA, 25 bp, Homo sapien
atcctcatgagctgccgtgggaatg

SEQ ID NO: 188885 - DNA, 25 bp, Homo sapien
agacccatcctcatgagctgccgtg

SEQ ID NO: 188886 - DNA, 25 bp, Homo sapien
gctgcctcggaaatctgcctctcaa

SEQ ID NO: 188887 - DNA, 25 bp, Homo sapien
cttctccctggaacgcagggggtcg

SEQ ID NO: 188888 - DNA, 25 bp, Homo sapien
gtcgcggcgtgacttcagccttgcg

SEQ ID NO: 188889 - DNA, 25 bp, Homo sapien
gcggctgctgctacttggtctcctg

SEQ ID NO: 188890 - DNA, 25 bp, Homo sapien
tagggcggctgctgctacttggtct

SEQ ID NO: 188891 - DNA, 25 bp, Homo sapien
agcctcgttggtggacgcaggccgc

SEQ ID NO: 188892 - DNA, 25 bp, Homo sapien
cccttttgcagctgtgaggtggagc

SEQ ID NO: 188893 - DNA, 25 bp, Homo sapien
cgcccttttgcagctgtgaggtgga

SEQ ID NO: 188894 - DNA, 25 bp, Homo sapien
cccgcccttttgcagctgtgaggtg

SEQ ID NO: 188895 - DNA, 25 bp, Homo sapien
aaacgcatctccagctagaaacccg

SEQ ID NO: 188896 - DNA, 25 bp, Homo sapien
ccagggtccagcatctaagctcacg

SEQ ID NO: 188897 - DNA, 25 bp, Homo sapien
gcatctaagctcacgctgttcagca

SEQ ID NO: 188898 - DNA, 25 bp, Homo sapien
ccggcaaaacgcatctccagctaga

SEQ ID NO: 188899 - DNA, 25 bp, Homo sapien
cgcacctcccgctgtcagtttgggt

SEQ ID NO: 188900 - DNA, 25 bp, Homo sapien
ccgctgtcagtttgggtttgatgac

SEQ ID NO: 188901 - DNA, 25 bp, Homo sapien
tttgatgactgtggcacgtgatggc

SEQ ID NO: 188902 - DNA, 25 bp, Homo sapien
tcacgctgttcagcacataatccgc

SEQ ID NO: 188903 - DNA, 25 bp, Homo sapien
cttccatgctcgctgctggcctggt

SEQ ID NO: 188904 - DNA, 25 bp, Homo sapien
ggtagttaccgttctgttctctcca

SEQ ID NO: 188905 - DNA, 25 bp, Homo sapien
ctcggtctacagtgcgctggagagt

SEQ ID NO: 188906 - DNA, 25 bp, Homo sapien
gcctgaccacggtgaggccacgccc

SEQ ID NO: 188907 - DNA, 25 bp, Homo sapien
catgctcgctgctggcctggtcagg

SEQ ID NO: 188908 - DNA, 25 bp, Homo sapien
tcggctggggagtctttacctctcc

SEQ ID NO: 188909 - DNA, 25 bp, Homo sapien
ccgagctcggctggggagtctttac

SEQ ID NO: 188910 - DNA, 25 bp, Homo sapien
gcctgtggctttggggcctgaccac

SEQ ID NO: 188911 - DNA, 25 bp, Homo sapien
ggattccagcgccttttccggcgac

SEQ ID NO: 188912 - DNA, 25 bp, Homo sapien
gcatttaatcctctcggagtgggga

SEQ ID NO: 188913 - DNA, 25 bp, Homo sapien
ggctcagcggggcatttaatcctct

SEQ ID NO: 188914 - DNA, 25 bp, Homo sapien
attagcaggtgatgtacggctcctc

SEQ ID NO: 188915 - DNA, 25 bp, Homo sapien
cgcttaatggaacacggtgccgcca

SEQ ID NO: 188916 - DNA, 25 bp, Homo sapien
agcagtgtaccaccgcggcgcttaa

SEQ ID NO: 188917 - DNA, 25 bp, Homo sapien
gtccttaccgcctcgggaacattga

SEQ ID NO: 188918 - DNA, 25 bp, Homo sapien
caaagctgtggccatgagtctccga

SEQ ID NO: 188919 - DNA, 25 bp, Homo sapien
cgtcctgggcactgagaagagtgaa

SEQ ID NO: 188920 - DNA, 25 bp, Homo sapien
gtcctgggcactgagaagagtgaac

SEQ ID NO: 188921 - DNA, 25 bp, Homo sapien
ggcactgagaagagtgaacggggtc

SEQ ID NO: 188922 - DNA, 25 bp, Homo sapien
tgatgccccgtcctgggcactgaga

SEQ ID NO: 188923 - DNA, 25 bp, Homo sapien
cccgtcctgggcactgagaagagtg

SEQ ID NO: 188924 - DNA, 25 bp, Homo sapien
ccgtcctgggcactgagaagagtga

SEQ ID NO: 188925 - DNA, 25 bp, Homo sapien
cccatcctgggcactgagaagagtg

SEQ ID NO: 188926 - DNA, 25 bp, Homo sapien
tcctgggcactgagaagagtgaacg

SEQ ID NO: 188927 - DNA, 25 bp, Homo sapien
ccgctccttggccaagagcagcttg

SEQ ID NO: 188928 - DNA, 25 bp, Homo sapien
aggtcctggaagtggtcccgctcct

SEQ ID NO: 188929 - DNA, 25 bp, Homo sapien
gacgacgccgttcaggtagagaatg

SEQ ID NO: 188930 - DNA, 25 bp, Homo sapien
caccgaggccatcgccaggtggagc

SEQ ID NO: 188931 - DNA, 25 bp, Homo sapien
ttgttcacagcgaacggcgggactg

SEQ ID NO: 188932 - DNA, 25 bp, Homo sapien
aggcacctgagagtgaaggccttca

SEQ ID NO: 188933 - DNA, 25 bp, Homo sapien
ctccggagcgcagccatgttggctg

SEQ ID NO: 188934 - DNA, 25 bp, Homo sapien
aggctctgctgacactgggcgagca

SEQ ID NO: 188935 - DNA, 25 bp, Homo sapien
aggaattcgacctcggcagcgtcca

SEQ ID NO: 188936 - DNA, 25 bp, Homo sapien
acctggcgctgtcaggatctcctgc

SEQ ID NO: 188937 - DNA, 25 bp, Homo sapien
ccagcctataggaaggcggtagaca

SEQ ID NO: 188938 - DNA, 25 bp, Homo sapien
agagcgcagtctcgctttcctcatc

SEQ ID NO: 188939 - DNA, 25 bp, Homo sapien
ggggataatggtaaccagctccttc

SEQ ID NO: 188940 - DNA, 25 bp, Homo sapien
tcctcatccgagaagcgggaacggc

SEQ ID NO: 188941 - DNA, 25 bp, Homo sapien
gccagctttggtgtcccttcacctg

SEQ ID NO: 188942 - DNA, 25 bp, Homo sapien
cccgatgaggtagatcttgtccaga

SEQ ID NO: 188943 - DNA, 25 bp, Homo sapien
ttcactatcacctgggtcctgacgc

SEQ ID NO: 188944 - DNA, 25 bp, Homo sapien
ctgacgcctcgcagcaaggagcgca

SEQ ID NO: 188945 - DNA, 25 bp, Homo sapien
cacgcacgtacacacgacagagaga

SEQ ID NO: 188946 - DNA, 25 bp, Homo sapien
acgtccaggtgcttgtcgttcagga

SEQ ID NO: 188947 - DNA, 25 bp, Homo sapien
cacaggtctgaccataaatgtttaa

SEQ ID NO: 188948 - DNA, 25 bp, Homo sapien
ctcacggtgcagtgtacacaggtct

SEQ ID NO: 188949 - DNA, 25 bp, Homo sapien
ctaattacttaacacgccgcgtcgt

SEQ ID NO: 188950 - DNA, 25 bp, Homo sapien
ccatcaagcgtcctggctgctggca

SEQ ID NO: 188951 - DNA, 25 bp, Homo sapien
tccagctctcaggaatggcgttctg

SEQ ID NO: 188952 - DNA, 25 bp, Homo sapien
ccgtgtctccgcagcaaagtctgca

SEQ ID NO: 188953 - DNA, 25 bp, Homo sapien
cagagccgggccaagtttcccaaag

SEQ ID NO: 188954 - DNA, 25 bp, Homo sapien
attcccaaggaactcgtgacggcgc

SEQ ID NO: 188955 - DNA, 25 bp, Homo sapien
gcccttcgcggttgcaaacctgctt

SEQ ID NO: 188956 - DNA, 25 bp, Homo sapien
ctcgatagagtggaaatggttcctc

SEQ ID NO: 188957 - DNA, 25 bp, Homo sapien
aaacctgctttgatgccctgggagc

SEQ ID NO: 188958 - DNA, 25 bp, Homo sapien
ccctaagtgaggcagttcataaata

SEQ ID NO: 188959 - DNA, 25 bp, Homo sapien
ttcagcaggaagcaccgaatgggcc

SEQ ID NO: 188960 - DNA, 25 bp, Homo sapien
cctttccgcgcttaccagggtgaga

SEQ ID NO: 188961 - DNA, 25 bp, Homo sapien
caccatcttgcagtaggcctgggtg

SEQ ID NO: 188962 - DNA, 25 bp, Homo sapien
tcggctcctggaaaagcgactcgcg

SEQ ID NO: 188963 - DNA, 25 bp, Homo sapien
gcattttacgacgttcgcagcgcta

SEQ ID NO: 188964 - DNA, 25 bp, Homo sapien
gagtcttcctcgatcccgtggtgct

SEQ ID NO: 188965 - DNA, 25 bp, Homo sapien
gagccatcaagtctgcacgtccgca

SEQ ID NO: 188966 - DNA, 25 bp, Homo sapien
cagggtgagagccacctccagcatg

SEQ ID NO: 188967 - DNA, 25 bp, Homo sapien
catctgctttggtgcagcaggacgc

SEQ ID NO: 188968 - DNA, 25 bp, Homo sapien
agcgaccctcctgtgacgctgagag

SEQ ID NO: 188969 - DNA, 25 bp, Homo sapien
tgggacacagcagcggggcactcac

SEQ ID NO: 188970 - DNA, 25 bp, Homo sapien
acagcccgacacagcatctgctttg

SEQ ID NO: 188971 - DNA, 25 bp, Homo sapien
aaatgcgtggggacaagtcacctgc

SEQ ID NO: 188972 - DNA, 25 bp, Homo sapien
ctgcggaatacaaatgcgtggggac

SEQ ID NO: 188973 - DNA, 25 bp, Homo sapien
ccctcacgatctgcggaatacaaat

SEQ ID NO: 188974 - DNA, 25 bp, Homo sapien
ggcactcactgggaagcacagcgac

SEQ ID NO: 188975 - DNA, 25 bp, Homo sapien
cgtccagttacagtgggaaccttca

SEQ ID NO: 188976 - DNA, 25 bp, Homo sapien
agtgggaaccttcaccgtcagcaca

SEQ ID NO: 188977 - DNA, 25 bp, Homo sapien
agctctcctgggaactcctgggcca

SEQ ID NO: 188978 - DNA, 25 bp, Homo sapien
gctgtcgccagcaagccttgtcctg

SEQ ID NO: 188979 - DNA, 25 bp, Homo sapien
cggcactcacagtacacgaaggcta

SEQ ID NO: 188980 - DNA, 25 bp, Homo sapien
ccttcaggagcacgatccgggtcag

SEQ ID NO: 188981 - DNA, 25 bp, Homo sapien
tccgggtcagccagaaggtgcccgt

SEQ ID NO: 188982 - DNA, 25 bp, Homo sapien
gctccggatccgagtacccagtctt

SEQ ID NO: 188983 - DNA, 25 bp, Homo sapien
aactcggagtccagattggggccga

SEQ ID NO: 188984 - DNA, 25 bp, Homo sapien
tgcttccctgcggtgagcccacaga

SEQ ID NO: 188985 - DNA, 25 bp, Homo sapien
ccggttgagcaactcggagtccaga

SEQ ID NO: 188986 - DNA, 25 bp, Homo sapien
cagattggggccgaggcaaccacaa

SEQ ID NO: 188987 - DNA, 25 bp, Homo sapien
gccgaggcaaccacaagcccatgga

SEQ ID NO: 188988 - DNA, 25 bp, Homo sapien
caagcccatggacgccgcagcggga

SEQ ID NO: 188989 - DNA, 25 bp, Homo sapien
accgtgcaggggctgtgcttccctg

SEQ ID NO: 188990 - DNA, 25 bp, Homo sapien
gaacaggaaaagcatggccggttga

SEQ ID NO: 188991 - DNA, 25 bp, Homo sapien
gtttaacacaggacaccagcttctc

SEQ ID NO: 188992 - DNA, 25 bp, Homo sapien
cgctcgctgcattgctgatgtgtga

SEQ ID NO: 188993 - DNA, 25 bp, Homo sapien
aagccttgcgttctgagctcagcga

SEQ ID NO: 188994 - DNA, 25 bp, Homo sapien
cagacgcttgctggatggagacgcc

SEQ ID NO: 188995 - DNA, 25 bp, Homo sapien
ttctccaccgggaggaagccttgcg

SEQ ID NO: 188996 - DNA, 25 bp, Homo sapien
ggacgcgtggatttcctttccttgc

SEQ ID NO: 188997 - DNA, 25 bp, Homo sapien
tccttgctttgcctggcgaggctgc

SEQ ID NO: 188998 - DNA, 25 bp, Homo sapien
ctcgcatcccgacgtgtttaacaca

SEQ ID NO: 188999 - DNA, 25 bp, Homo sapien
caccttcgatgctcctgtttcagtc

SEQ ID NO: 189000 - DNA, 25 bp, Homo sapien
ggcctcctttgaagctgggattctc

SEQ ID NO: 189001 - DNA, 25 bp, Homo sapien
tgcccaatatccagcgctcgtgaag

SEQ ID NO: 189002 - DNA, 25 bp, Homo sapien
ccgcgcgagccaagctgacgctatt

SEQ ID NO: 189003 - DNA, 25 bp, Homo sapien
gctagtttctggctgtggattctga

SEQ ID NO: 189004 - DNA, 25 bp, Homo sapien
attctgattaatgggccgcaggcgc

SEQ ID NO: 189005 - DNA, 25 bp, Homo sapien
tttctcggaaagcagagcacttcga

SEQ ID NO: 189006 - DNA, 25 bp, Homo sapien
gcggcgggcatcactgcccaatatc

SEQ ID NO: 189007 - DNA, 25 bp, Homo sapien
tgacgccgcatcttcctgagcagct

SEQ ID NO: 189008 - DNA, 25 bp, Homo sapien
ggactccacactgcgcttggctagg

SEQ ID NO: 189009 - DNA, 25 bp, Homo sapien
ggttcggtttcaggatctcacctca

SEQ ID NO: 189010 - DNA, 25 bp, Homo sapien
actggtcaaggcaggttcggtttca

SEQ ID NO: 189011 - DNA, 25 bp, Homo sapien
cccatgtttcgttgccgttggaagg

SEQ ID NO: 189012 - DNA, 25 bp, Homo sapien
acggacgactcccaaagaggaatcg

SEQ ID NO: 189013 - DNA, 25 bp, Homo sapien
tggcagccacgctgttgcaacatga

SEQ ID NO: 189014 - DNA, 25 bp, Homo sapien
atcgttggtggaagtcccatgtttc

SEQ ID NO: 189015 - DNA, 25 bp, Homo sapien
ttcaccatgatgaccgctgccggga

SEQ ID NO: 189016 - DNA, 25 bp, Homo sapien
cgcttactggaagccgcaccgaggc

SEQ ID NO: 189017 - DNA, 25 bp, Homo sapien
caccgtcacctggtggcgcttactg

SEQ ID NO: 189018 - DNA, 25 bp, Homo sapien
caagagagacttccggcatgccttt

SEQ ID NO: 189019 - DNA, 25 bp, Homo sapien
cgcgcgtctgtctgtcaagagagac

SEQ ID NO: 189020 - DNA, 25 bp, Homo sapien
tcggccaccgtagagtgtcccacgt

SEQ ID NO: 189021 - DNA, 25 bp, Homo sapien
ctcgggaggccagattagagaaacg

SEQ ID NO: 189022 - DNA, 25 bp, Homo sapien
tgcttctggactcgccgctaacaca

SEQ ID NO: 189023 - DNA, 25 bp, Homo sapien
gtgactaccgcctctgtgaccgacg

SEQ ID NO: 189024 - DNA, 25 bp, Homo sapien
gcctctgtgactaccgcctctatga

SEQ ID NO: 189025 - DNA, 25 bp, Homo sapien
gcctctatgaccgacgctggtacta

SEQ ID NO: 189026 - DNA, 25 bp, Homo sapien
gaccgacgctggtactacgactgta

SEQ ID NO: 189027 - DNA, 25 bp, Homo sapien
gccattgttcctaccgcctctgtga

SEQ ID NO: 189028 - DNA, 25 bp, Homo sapien
tacgactgtagccattgttcctgcc

SEQ ID NO: 189029 - DNA, 25 bp, Homo sapien
tgtgactaccgcctctgtgaccgac

SEQ ID NO: 189030 - DNA, 25 bp, Homo sapien
agccattgttcctaccgcctctgtg

SEQ ID NO: 189031 - DNA, 25 bp, Homo sapien
ccgcccgcgaagctgttgcagggac

SEQ ID NO: 189032 - DNA, 25 bp, Homo sapien
ttctcccgtctcagggccttgatgc

SEQ ID NO: 189033 - DNA, 25 bp, Homo sapien
gcccgtgcctgtgaagctggcatca

SEQ ID NO: 189034 - DNA, 25 bp, Homo sapien
tggcatcagcgaagacctcagacgg

SEQ ID NO: 189035 - DNA, 25 bp, Homo sapien
cgccttccacgggacttgggtccag

SEQ ID NO: 189036 - DNA, 25 bp, Homo sapien
tccagggacccaagacggggatctg

SEQ ID NO: 189037 - DNA, 25 bp, Homo sapien
tgccagccgccttcaggctgtgggt

SEQ ID NO: 189038 - DNA, 25 bp, Homo sapien
ttccgaagcgaagtagttacccaga

SEQ ID NO: 189039 - DNA, 25 bp, Homo sapien
tgcgccgggccttggcactgaccct

SEQ ID NO: 189040 - DNA, 25 bp, Homo sapien
ggcaggtctgcctgaccggccaccc

SEQ ID NO: 189041 - DNA, 25 bp, Homo sapien
cttgctcccgggaacatcctgcggg

SEQ ID NO: 189042 - DNA, 25 bp, Homo sapien
cgggcgggctcactgcttgctcccg

SEQ ID NO: 189043 - DNA, 25 bp, Homo sapien
aactcaccggtttctgggagctggt

SEQ ID NO: 189044 - DNA, 25 bp, Homo sapien
tgcaacccaaactcaccggtttctg

SEQ ID NO: 189045 - DNA, 25 bp, Homo sapien
gtgagctccacgaagtctgcgccgg

SEQ ID NO: 189046 - DNA, 25 bp, Homo sapien
ccaaactcaccggtttctgggagct

SEQ ID NO: 189047 - DNA, 25 bp, Homo sapien
tctttgtgcaatgacagccgtcctc

SEQ ID NO: 189048 - DNA, 25 bp, Homo sapien
cgagccttcgggagtgactgattcc

SEQ ID NO: 189049 - DNA, 25 bp, Homo sapien
gactgattccctgtccgagtgtgga

SEQ ID NO: 189050 - DNA, 25 bp, Homo sapien
ctttgtttttatctggcctgccctg

SEQ ID NO: 189051 - DNA, 25 bp, Homo sapien
tggccctcaagcgaacgctccgtgt

SEQ ID NO: 189052 - DNA, 25 bp, Homo sapien
cgctccgtgtcattactgcgcttga

SEQ ID NO: 189053 - DNA, 25 bp, Homo sapien
cgtttgtcaatcagcaccgagcatt

SEQ ID NO: 189054 - DNA, 25 bp, Homo sapien
cgctcaggtaccagctcgtttgtca

SEQ ID NO: 189055 - DNA, 25 bp, Homo sapien
cccgcgctggcggacaaattgcagc

SEQ ID NO: 189056 - DNA, 25 bp, Homo sapien
gtgcgcacgggtttgacaaatcata

SEQ ID NO: 189057 - DNA, 25 bp, Homo sapien
tagcttgccgcccttcctttcaaag

SEQ ID NO: 189058 - DNA, 25 bp, Homo sapien
ctggccacccatcacgacagattaa

SEQ ID NO: 189059 - DNA, 25 bp, Homo sapien
gttatgcagagaatggaacccgcgc

SEQ ID NO: 189060 - DNA, 25 bp, Homo sapien
tgggtgtgcaactccagagcttctg

SEQ ID NO: 189061 - DNA, 25 bp, Homo sapien
cctcggctgctcaacgtcaaggcta

SEQ ID NO: 189062 - DNA, 25 bp, Homo sapien
gtcaaggctacacaacccgtcaagg

SEQ ID NO: 189063 - DNA, 25 bp, Homo sapien
ccgtagtattcgctgtttcccgttg

SEQ ID NO: 189064 - DNA, 25 bp, Homo sapien
gtatgatcctgatacccggggcctg

SEQ ID NO: 189065 - DNA, 25 bp, Homo sapien
aggcgtcaccctctagcggcaatct

SEQ ID NO: 189066 - DNA, 25 bp, Homo sapien
cgtctaccttggattccgacccagg

SEQ ID NO: 189067 - DNA, 25 bp, Homo sapien
agtaatggaccttcgatctgctttc

SEQ ID NO: 189068 - DNA, 25 bp, Homo sapien
gtctgcgttccctggttcacaacca

SEQ ID NO: 189069 - DNA, 25 bp, Homo sapien
gtaacccgggagtctcacatctgcg

SEQ ID NO: 189070 - DNA, 25 bp, Homo sapien
acgcagcgactatctggcggttctc

SEQ ID NO: 189071 - DNA, 25 bp, Homo sapien
gcacagcgcttcatggaattttctc

SEQ ID NO: 189072 - DNA, 25 bp, Homo sapien
caatgtggacatctcggagctcagc

SEQ ID NO: 189073 - DNA, 25 bp, Homo sapien
tcagcagcgaggtcatgggcaccat

SEQ ID NO: 189074 - DNA, 25 bp, Homo sapien
tgggcaccatggacgccttcgacgt

SEQ ID NO: 189075 - DNA, 25 bp, Homo sapien
tcgacgtccacgagttcgaccagta

SEQ ID NO: 189076 - DNA, 25 bp, Homo sapien
gacctgcaggcctccagctactatg

SEQ ID NO: 189077 - DNA, 25 bp, Homo sapien
ctaggtctgactttgctggaatttc

SEQ ID NO: 189078 - DNA, 25 bp, Homo sapien
cgggcgccagaacatcgacttcagc

SEQ ID NO: 189079 - DNA, 25 bp, Homo sapien
ggttgaaaggatccgagccaccctc

SEQ ID NO: 189080 - DNA, 25 bp, Homo sapien
ctccagcgcgctggttgaaaggatc

SEQ ID NO: 189081 - DNA, 25 bp, Homo sapien
ggtgacacggcccttgctcttcagc

SEQ ID NO: 189082 - DNA, 25 bp, Homo sapien
ccggttgttcccaatgcaaagcagc

SEQ ID NO: 189083 - DNA, 25 bp, Homo sapien
ctgcttcctctgacctggctgcaga

SEQ ID NO: 189084 - DNA, 25 bp, Homo sapien
ccgactttgcatctggacttttcta

SEQ ID NO: 189085 - DNA, 25 bp, Homo sapien
gacttttctagtaacggaccagctc

SEQ ID NO: 189086 - DNA, 25 bp, Homo sapien
ggctgcagagatgagaccgccctcc

SEQ ID NO: 189087 - DNA, 25 bp, Homo sapien
gcccggcacgacagcaagttgcatg

SEQ ID NO: 189088 - DNA, 25 bp, Homo sapien
gcgctcaaagccaagccgcatgtga

SEQ ID NO: 189089 - DNA, 25 bp, Homo sapien
tctagctcctggaccacccatgggg

SEQ ID NO: 189090 - DNA, 25 bp, Homo sapien
gctcaagggctacgactggagtctg

SEQ ID NO: 189091 - DNA, 25 bp, Homo sapien
gtgctccctccttagaaagggctca

SEQ ID NO: 189092 - DNA, 25 bp, Homo sapien
agcaagttgcatgcggctctctgga

SEQ ID NO: 189093 - DNA, 25 bp, Homo sapien
cgagtgtcctctggttgggtttcaa

SEQ ID NO: 189094 - DNA, 25 bp, Homo sapien
aacttgttgctcaggacaggccgcc

SEQ ID NO: 189095 - DNA, 25 bp, Homo sapien
gcgctcctccggcagccgtgaagtt

SEQ ID NO: 189096 - DNA, 25 bp, Homo sapien
ctccctcggagcgggatctggttcc

SEQ ID NO: 189097 - DNA, 25 bp, Homo sapien
cccgctcgggttacggcgcgctctc

SEQ ID NO: 189098 - DNA, 25 bp, Homo sapien
tccggcagccgtgaagtttcgtttc

SEQ ID NO: 189099 - DNA, 25 bp, Homo sapien
gccctaccttgaggcgtcgtttgaa

SEQ ID NO: 189100 - DNA, 25 bp, Homo sapien
taccttgaggcgtcgtttgaacctc

SEQ ID NO: 189101 - DNA, 25 bp, Homo sapien
cttgaggcgtcgtttgaacctcgcc

SEQ ID NO: 189102 - DNA, 25 bp, Homo sapien
cgtcgtttgaacctcgcctcgcggg

SEQ ID NO: 189103 - DNA, 25 bp, Homo sapien
gcggagggcgcattaacacttgctc

SEQ ID NO: 189104 - DNA, 25 bp, Homo sapien
cctgagcgccctctgcatatgagtg

SEQ ID NO: 189105 - DNA, 25 bp, Homo sapien
acacgcatgggtgtgtttacacgtc

SEQ ID NO: 189106 - DNA, 25 bp, Homo sapien
acacgtctgtttgcgtaatttaccg

SEQ ID NO: 189107 - DNA, 25 bp, Homo sapien
aatttaccgggtttgcatgtgcatc

SEQ ID NO: 189108 - DNA, 25 bp, Homo sapien
tgagtgactgagcacgccgcttatt

SEQ ID NO: 189109 - DNA, 25 bp, Homo sapien
ctgctgggcgagtccgaaaaatccc

SEQ ID NO: 189110 - DNA, 25 bp, Homo sapien
cgccgcacttgcgatttgctacagg

SEQ ID NO: 189111 - DNA, 25 bp, Homo sapien
atggcgtcctcttccatgcactcgg

SEQ ID NO: 189112 - DNA, 25 bp, Homo sapien
tctgcctgaactctgagccaccgtg

SEQ ID NO: 189113 - DNA, 25 bp, Homo sapien
tgtcttctctttcaacgccatggcg

SEQ ID NO: 189114 - DNA, 25 bp, Homo sapien
gagccaccgtggctaactcttctgc

SEQ ID NO: 189115 - DNA, 25 bp, Homo sapien
tcgccttgcaggcatcccgcggtat

SEQ ID NO: 189116 - DNA, 25 bp, Homo sapien
ggagcactgctcctctgcctgaact

SEQ ID NO: 189117 - DNA, 25 bp, Homo sapien
cgcccagcatgtgtgaccgaaagga

SEQ ID NO: 189118 - DNA, 25 bp, Homo sapien
gtatcactcgcagtcgcccagcatg

SEQ ID NO: 189119 - DNA, 25 bp, Homo sapien
ctgttgcgcttgttgacttcgtgga

SEQ ID NO: 189120 - DNA, 25 bp, Homo sapien
gcctaaatcaggcatcggcgcggtc

SEQ ID NO: 189121 - DNA, 25 bp, Homo sapien
tccgtgcgcgttgatatgattggcc

SEQ ID NO: 189122 - DNA, 25 bp, Homo sapien
cggcgaatcgtggttctcttttcct

SEQ ID NO: 189123 - DNA, 25 bp, Homo sapien
tcctccttggctgtctgaagataga

SEQ ID NO: 189124 - DNA, 25 bp, Homo sapien
gtcatctgccgcgtatccgagccat

SEQ ID NO: 189125 - DNA, 25 bp, Homo sapien
ttgagctataggcacgcgaagcccg

SEQ ID NO: 189126 - DNA, 25 bp, Homo sapien
cctgggtcccagtacttgagctata

SEQ ID NO: 189127 - DNA, 25 bp, Homo sapien
gaggcgtcctaggtagaattaattc

SEQ ID NO: 189128 - DNA, 25 bp, Homo sapien
caggttttcttctgcggagtctcca

SEQ ID NO: 189129 - DNA, 25 bp, Homo sapien
ggcaaagcccggtttcctgttcatc

SEQ ID NO: 189130 - DNA, 25 bp, Homo sapien
atctccttgccttcgcttcagcggg

SEQ ID NO: 189131 - DNA, 25 bp, Homo sapien
gcttgtgcaggaaaaccggtccgga

SEQ ID NO: 189132 - DNA, 25 bp, Homo sapien
aagcgcgcccagcatgtgcaagtca

SEQ ID NO: 189133 - DNA, 25 bp, Homo sapien
taggatcagctaacacagaggcgtc

SEQ ID NO: 189134 - DNA, 25 bp, Homo sapien
ctcctgagtctggtgcgaaattatg

SEQ ID NO: 189135 - DNA, 25 bp, Homo sapien
ctcaaggcccgagcctgcacgattg

SEQ ID NO: 189136 - DNA, 25 bp, Homo sapien
gggctctcttcaggtcactcacacg

SEQ ID NO: 189137 - DNA, 25 bp, Homo sapien
gctgtccacgaggtcacttgtccct

SEQ ID NO: 189138 - DNA, 25 bp, Homo sapien
gcaggcctctcgagtgccatcggaa

SEQ ID NO: 189139 - DNA, 25 bp, Homo sapien
tgagaagaattgagacccgagcagc

SEQ ID NO: 189140 - DNA, 25 bp, Homo sapien
cactgagcggtgacttctgagaaga

SEQ ID NO: 189141 - DNA, 25 bp, Homo sapien
ggttcccaacgtaaacatcggctgc

SEQ ID NO: 189142 - DNA, 25 bp, Homo sapien
ctctgcgcgctgtgagatgaaccgc

SEQ ID NO: 189143 - DNA, 25 bp, Homo sapien
ggattcttaccctgacctctgcata

SEQ ID NO: 189144 - DNA, 25 bp, Homo sapien
tcgggacccattgccggttgaaaca

SEQ ID NO: 189145 - DNA, 25 bp, Homo sapien
gccggccttgattgctcctcatgta

SEQ ID NO: 189146 - DNA, 25 bp, Homo sapien
ttcagccggcagctctttaaagcgg

SEQ ID NO: 189147 - DNA, 25 bp, Homo sapien
ggccatcctttgagaaacacccgtg

SEQ ID NO: 189148 - DNA, 25 bp, Homo sapien
cctgcgtctgcttgtctatgtcttt

SEQ ID NO: 189149 - DNA, 25 bp, Homo sapien
ccaagccctggagttactgaagtga

SEQ ID NO: 189150 - DNA, 25 bp, Homo sapien
ctgaagtgaacaagtccctggtctc

SEQ ID NO: 189151 - DNA, 25 bp, Homo sapien
ttctcgtagtagttccctggttggc

SEQ ID NO: 189152 - DNA, 25 bp, Homo sapien
cctctgggacccgattccgcgttcg

SEQ ID NO: 189153 - DNA, 25 bp, Homo sapien
aggaacacgcgaggccctctgggac

SEQ ID NO: 189154 - DNA, 25 bp, Homo sapien
tattccaggaacacgcgaggccctc

SEQ ID NO: 189155 - DNA, 25 bp, Homo sapien
tcgccgcttattattccaggaacac

SEQ ID NO: 189156 - DNA, 25 bp, Homo sapien
tacctttaggctttatcgccgctta

SEQ ID NO: 189157 - DNA, 25 bp, Homo sapien
ttggcctcaagatgacgccaacacc

SEQ ID NO: 189158 - DNA, 25 bp, Homo sapien
ccctggttggcctcaagatgacgcc

SEQ ID NO: 189159 - DNA, 25 bp, Homo sapien
agcgagcagaattactaccgggctg

SEQ ID NO: 189160 - DNA, 25 bp, Homo sapien
aggagcgggcccacctcaaggagcc

SEQ ID NO: 189161 - DNA, 25 bp, Homo sapien
ggccatccagaacgcgcccgagaag

SEQ ID NO: 189162 - DNA, 25 bp, Homo sapien
cgagccgtctcggaagcagcatgca

SEQ ID NO: 189163 - DNA, 25 bp, Homo sapien
gcgcccgagaagaagatcaccttga

SEQ ID NO: 189164 - DNA, 25 bp, Homo sapien
cgcttcaaaaagaaggacgtgtcca

SEQ ID NO: 189165 - DNA, 25 bp, Homo sapien
tctattccggccacccggagcagta

SEQ ID NO: 189166 - DNA, 25 bp, Homo sapien
cgcctaaggacctggtgaagccgcc

SEQ ID NO: 189167 - DNA, 25 bp, Homo sapien
cacacttctgcaaacgcgcggggct

SEQ ID NO: 189168 - DNA, 25 bp, Homo sapien
gccggagttctacagctgaaacctc

SEQ ID NO: 189169 - DNA, 25 bp, Homo sapien
ctcccggagactttgcacacttctg

SEQ ID NO: 189170 - DNA, 25 bp, Homo sapien
tctcggactcctagggcttgagcct

SEQ ID NO: 189171 - DNA, 25 bp, Homo sapien
tgtgcgtctccaaaccgcgactaga

SEQ ID NO: 189172 - DNA, 25 bp, Homo sapien
cgggcagtatttatcaccgtacaaa

SEQ ID NO: 189173 - DNA, 25 bp, Homo sapien
ggttgcatagtgacaccggtttatc

SEQ ID NO: 189174 - DNA, 25 bp, Homo sapien
ctcgctggacccacgttagaggagc

SEQ ID NO: 189175 - DNA, 25 bp, Homo sapien
tccgctgagcgaaaggccacagctc

SEQ ID NO: 189176 - DNA, 25 bp, Homo sapien
aaaatgatctttgcctgggtcggcc

SEQ ID NO: 189177 - DNA, 25 bp, Homo sapien
tctccgaagagctccgacaagtcca

SEQ ID NO: 189178 - DNA, 25 bp, Homo sapien
gcatagacagcatcctggcgggaaa

SEQ ID NO: 189179 - DNA, 25 bp, Homo sapien
ccgccttcaggggacgaactcctag

SEQ ID NO: 189180 - DNA, 25 bp, Homo sapien
tgcaggttcccgacacggtactcca

SEQ ID NO: 189181 - DNA, 25 bp, Homo sapien
cgctgcctggacatgtttgagaacg

SEQ ID NO: 189182 - DNA, 25 bp, Homo sapien
acccgcatgtccagggcggctttta

SEQ ID NO: 189183 - DNA, 25 bp, Homo sapien
ctccttggtaggcaaaatgggtctg

SEQ ID NO: 189184 - DNA, 25 bp, Homo sapien
catctttcgggccttggcatggagc

SEQ ID NO: 189185 - DNA, 25 bp, Homo sapien
tgccaggaagccgacggcatctttc

SEQ ID NO: 189186 - DNA, 25 bp, Homo sapien
tcccaggcgaatcccagagctggtt

SEQ ID NO: 189187 - DNA, 25 bp, Homo sapien
gcgtcagcaggcttcagtcagaatg

SEQ ID NO: 189188 - DNA, 25 bp, Homo sapien
agtgctttttatggacgtgggctgc

SEQ ID NO: 189189 - DNA, 25 bp, Homo sapien
tcgcagacccgtttcatgcagcgtc

SEQ ID NO: 189190 - DNA, 25 bp, Homo sapien
tctgaccaagcaacgctaacttttg

SEQ ID NO: 189191 - DNA, 25 bp, Homo sapien
actgcgtgtgctccaaaattctgtc

SEQ ID NO: 189192 - DNA, 25 bp, Homo sapien
cgctgggaactcagcggatgatgtc

SEQ ID NO: 189193 - DNA, 25 bp, Homo sapien
ctcacccttggctgacacgctggga

SEQ ID NO: 189194 - DNA, 25 bp, Homo sapien
aaattctgtcttccgagggcgcgtg

SEQ ID NO: 189195 - DNA, 25 bp, Homo sapien
agaaggcagccatcgttatccaaga

SEQ ID NO: 189196 - DNA, 25 bp, Homo sapien
ttatccaagaatgccactgcgtgtg

SEQ ID NO: 189197 - DNA, 25 bp, Homo sapien
gggtcgcttggttcagtccaccaca

SEQ ID NO: 189198 - DNA, 25 bp, Homo sapien
acagagctcccaaacctcgttcgtg

SEQ ID NO: 189199 - DNA, 25 bp, Homo sapien
ggccagcactttggatgcggttgaa

SEQ ID NO: 189200 - DNA, 25 bp, Homo sapien
gaagacagatgtgcttttcgcgtaa

SEQ ID NO: 189201 - DNA, 25 bp, Homo sapien
ccatatggaagaccggtggccagca

SEQ ID NO: 189202 - DNA, 25 bp, Homo sapien
ccactccgggagaccatatggaaga

SEQ ID NO: 189203 - DNA, 25 bp, Homo sapien
acctgctcctgtcggaagacggttg

SEQ ID NO: 189204 - DNA, 25 bp, Homo sapien
tcacagaaagagctaagggacctcc

SEQ ID NO: 189205 - DNA, 25 bp, Homo sapien
tgaaccagcgcgcatcacagaaaga

SEQ ID NO: 189206 - DNA, 25 bp, Homo sapien
ctcggaaacgccgatggaatgaacc

SEQ ID NO: 189207 - DNA, 25 bp, Homo sapien
ccggagcctatatgcatgtgcatta

SEQ ID NO: 189208 - DNA, 25 bp, Homo sapien
acatctggtgactaatggccgcggc

SEQ ID NO: 189209 - DNA, 25 bp, Homo sapien
acggcctcactagcggctgcaaaca

SEQ ID NO: 189210 - DNA, 25 bp, Homo sapien
tgctgtcatgcattgtacacctgtg

SEQ ID NO: 189211 - DNA, 25 bp, Homo sapien
acctgtgcttgttcatgcgtgttca

SEQ ID NO: 189212 - DNA, 25 bp, Homo sapien
tgttcacataggtacacgcatcacg

SEQ ID NO: 189213 - DNA, 25 bp, Homo sapien
cgccttggcagcagaaggtgacatc

SEQ ID NO: 189214 - DNA, 25 bp, Homo sapien
aggatcgatgccctggtttccgaag

SEQ ID NO: 189215 - DNA, 25 bp, Homo sapien
acttgcgtccgatgagcaaaggcgg

SEQ ID NO: 189216 - DNA, 25 bp, Homo sapien
aaaggcgggttccacgctggatcac

SEQ ID NO: 189217 - DNA, 25 bp, Homo sapien
gggttccacgctggatcaccagtga

SEQ ID NO: 189218 - DNA, 25 bp, Homo sapien
ggctagacttgcgtccgatgagcaa

SEQ ID NO: 189219 - DNA, 25 bp, Homo sapien
cgggttccacgctggatcaccagtg

SEQ ID NO: 189220 - DNA, 25 bp, Homo sapien
gctagacttgcgtccgatgagcaaa

SEQ ID NO: 189221 - DNA, 25 bp, Homo sapien
ctggatcaccagtgagccacggtga

SEQ ID NO: 189222 - DNA, 25 bp, Homo sapien
cgtccgatgagcaaaggcgggttcc

SEQ ID NO: 189223 - DNA, 25 bp, Homo sapien
gagctctgtaatcgttgccgtcagc

SEQ ID NO: 189224 - DNA, 25 bp, Homo sapien
tcgcagatccctgaaaaacgagctc

SEQ ID NO: 189225 - DNA, 25 bp, Homo sapien
cagcgggtgtacaattgcagcctta

SEQ ID NO: 189226 - DNA, 25 bp, Homo sapien
gccttatgtttcctgccgctgttta

SEQ ID NO: 189227 - DNA, 25 bp, Homo sapien
gtttaccttcctgagcggcgcccag

SEQ ID NO: 189228 - DNA, 25 bp, Homo sapien
ggcgcccagagatgcacacacgctg

SEQ ID NO: 189229 - DNA, 25 bp, Homo sapien
acacacgctgccctgaagcgggacg

SEQ ID NO: 189230 - DNA, 25 bp, Homo sapien
tgggccgcaactgtcatcgcagatc

SEQ ID NO: 189231 - DNA, 25 bp, Homo sapien
ctgttctggcgcatagcagatgcca

SEQ ID NO: 189232 - DNA, 25 bp, Homo sapien
ccagcgcggcttctgactttatagc

SEQ ID NO: 189233 - DNA, 25 bp, Homo sapien
atagctttttcttggcctgtgcgga

SEQ ID NO: 189234 - DNA, 25 bp, Homo sapien
ctgagctgcgcacactcgctgtgtg

SEQ ID NO: 189235 - DNA, 25 bp, Homo sapien
tgactcaggcttgggtaagaaaaca

SEQ ID NO: 189236 - DNA, 25 bp, Homo sapien
gggcctttcggagaatccgcgcagc

SEQ ID NO: 189237 - DNA, 25 bp, Homo sapien
gccggggacaatatctgctctgttc

SEQ ID NO: 189238 - DNA, 25 bp, Homo sapien
aacacccggtttcccagcagactgg

SEQ ID NO: 189239 - DNA, 25 bp, Homo sapien
acctgatccccgagctcggacctga

SEQ ID NO: 189240 - DNA, 25 bp, Homo sapien
aggtgtggacctaacccccagcacg

SEQ ID NO: 189241 - DNA, 25 bp, Homo sapien
ccagcatggacctgaccccagggcg

SEQ ID NO: 189242 - DNA, 25 bp, Homo sapien
tccccgagctcggacctgaccccca

SEQ ID NO: 189243 - DNA, 25 bp, Homo sapien
tgatccccgagctcggacctgaccc

SEQ ID NO: 189244 - DNA, 25 bp, Homo sapien
ctgatccccgagctcggacctgacc

SEQ ID NO: 189245 - DNA, 25 bp, Homo sapien
gatccccgagctcggacctgacccc

SEQ ID NO: 189246 - DNA, 25 bp, Homo sapien
acccccagcatggacctgaccccag

SEQ ID NO: 189247 - DNA, 25 bp, Homo sapien
gccctgcgtcttgcataggcgcttc

SEQ ID NO: 189248 - DNA, 25 bp, Homo sapien
cgcggaattggaagcagtcgtcacc

SEQ ID NO: 189249 - DNA, 25 bp, Homo sapien
gtgagtgccaacctgcagagcccga

SEQ ID NO: 189250 - DNA, 25 bp, Homo sapien
cggctcgcacgcatatggcttctta

SEQ ID NO: 189251 - DNA, 25 bp, Homo sapien
ttcttatggctgacgcgccctttca

SEQ ID NO: 189252 - DNA, 25 bp, Homo sapien
cagctgattggtccctcacgagaga

SEQ ID NO: 189253 - DNA, 25 bp, Homo sapien
taggcgcttctggtaaaatcactcc

SEQ ID NO: 189254 - DNA, 25 bp, Homo sapien
tggggctcgaatcgtgacttttaga

SEQ ID NO: 189255 - DNA, 25 bp, Homo sapien
tcgggcagctggatccgatgcctca

SEQ ID NO: 189256 - DNA, 25 bp, Homo sapien
tgaagttgcgctggttctcgaggtc

SEQ ID NO: 189257 - DNA, 25 bp, Homo sapien
ctcattgaagttgcgctggttctcg

SEQ ID NO: 189258 - DNA, 25 bp, Homo sapien
cgatgcgggagagctcattgaagtt

SEQ ID NO: 189259 - DNA, 25 bp, Homo sapien
cacctccaggacgatgcgggagagc

SEQ ID NO: 189260 - DNA, 25 bp, Homo sapien
atcctcaccaggtgtcccatctggg

SEQ ID NO: 189261 - DNA, 25 bp, Homo sapien
ctgctcggccgcagctacggcatcc

SEQ ID NO: 189262 - DNA, 25 bp, Homo sapien
cagctggatccgatgcctcaggtcg

SEQ ID NO: 189263 - DNA, 25 bp, Homo sapien
tgtccattgaaacaacgcgcgttcc

SEQ ID NO: 189264 - DNA, 25 bp, Homo sapien
gacgcgaagatctccaccagcagct

SEQ ID NO: 189265 - DNA, 25 bp, Homo sapien
cccgtgacgggcatgagaaaagaaa

SEQ ID NO: 189266 - DNA, 25 bp, Homo sapien
tggtgatgccgagtgcaaaacgtta

SEQ ID NO: 189267 - DNA, 25 bp, Homo sapien
ccggtgagtagaaagatgcgcctta

SEQ ID NO: 189268 - DNA, 25 bp, Homo sapien
atgcgccttacagcctccaaataca

SEQ ID NO: 189269 - DNA, 25 bp, Homo sapien
gcctagaagcccttttgtccattga

SEQ ID NO: 189270 - DNA, 25 bp, Homo sapien
acgcctcctccagatggtgtcggtg

SEQ ID NO: 189271 - DNA, 25 bp, Homo sapien
tgacgcgtcgcgagtcacctgacca

SEQ ID NO: 189272 - DNA, 25 bp, Homo sapien
cagcgccgcaccttcggtgagtgtc

SEQ ID NO: 189273 - DNA, 25 bp, Homo sapien
accatgccgtcggagaagaccttca

SEQ ID NO: 189274 - DNA, 25 bp, Homo sapien
agatccctgcaccatgccgtcggag

SEQ ID NO: 189275 - DNA, 25 bp, Homo sapien
tggctatcgccagagtcggattcgc

SEQ ID NO: 189276 - DNA, 25 bp, Homo sapien
agatacaagggaagtggctatcgcc

SEQ ID NO: 189277 - DNA, 25 bp, Homo sapien
gggcagcaccaccaagtctctctgg

SEQ ID NO: 189278 - DNA, 25 bp, Homo sapien
caccaagtctctctggaggggaaag

SEQ ID NO: 189279 - DNA, 25 bp, Homo sapien
tggccggctccggaatgataatggc

SEQ ID NO: 189280 - DNA, 25 bp, Homo sapien
actgacaagtcattacgggctgctg

SEQ ID NO: 189281 - DNA, 25 bp, Homo sapien
ggcgaaggcgctgcattttaatgaa

SEQ ID NO: 189282 - DNA, 25 bp, Homo sapien
ggctgctgaatgaccgatgagatgc

SEQ ID NO: 189283 - DNA, 25 bp, Homo sapien
atccgagtgtgaatttctgcgtccg

SEQ ID NO: 189284 - DNA, 25 bp, Homo sapien
ctttgtatgcgcgaccagcaggcct

SEQ ID NO: 189285 - DNA, 25 bp, Homo sapien
atgaatcgttattgccggcgaggcc

SEQ ID NO: 189286 - DNA, 25 bp, Homo sapien
ggcgaggcctttgtctttctttatc

SEQ ID NO: 189287 - DNA, 25 bp, Homo sapien
gctcgctgctggcaaactctcaagt

SEQ ID NO: 189288 - DNA, 25 bp, Homo sapien
cgcccatgcacgttcaagacgactg

SEQ ID NO: 189289 - DNA, 25 bp, Homo sapien
ctcacggatgggtggttccattttc

SEQ ID NO: 189290 - DNA, 25 bp, Homo sapien
ctctgcgctgtgtagctcctactta

SEQ ID NO: 189291 - DNA, 25 bp, Homo sapien
tcctacttacagctgacgattctcg

SEQ ID NO: 189292 - DNA, 25 bp, Homo sapien
ggacggcctccctggagatgtcaca

SEQ ID NO: 189293 - DNA, 25 bp, Homo sapien
acgattctcgacttcggacggcctc

SEQ ID NO: 189294 - DNA, 25 bp, Homo sapien
ctctcaagtccaagtgtgcggctcc

SEQ ID NO: 189295 - DNA, 25 bp, Homo sapien
gtaccttggcaaaacagtcggatcc

SEQ ID NO: 189296 - DNA, 25 bp, Homo sapien
actaatgggcttccctcgtgcggct

SEQ ID NO: 189297 - DNA, 25 bp, Homo sapien
cagtcggatccaaacctattatttg

SEQ ID NO: 189298 - DNA, 25 bp, Homo sapien
tgccgggtaccttggcaaaacagtc

SEQ ID NO: 189299 - DNA, 25 bp, Homo sapien
cgtaattggatcctcgctgcctcct

SEQ ID NO: 189300 - DNA, 25 bp, Homo sapien
gtagcagccgtaattggatcctcgc

SEQ ID NO: 189301 - DNA, 25 bp, Homo sapien
cgaccgggcagtagcagccgtaatt

SEQ ID NO: 189302 - DNA, 25 bp, Homo sapien
ttatttgactaatgggcttccctcg

SEQ ID NO: 189303 - DNA, 25 bp, Homo sapien
aatgtttcctgtggagccgccaccg

SEQ ID NO: 189304 - DNA, 25 bp, Homo sapien
aaactgctttcagggacggaggaca

SEQ ID NO: 189305 - DNA, 25 bp, Homo sapien
accgccactgctgctatagaaactg

SEQ ID NO: 189306 - DNA, 25 bp, Homo sapien
tcggattcgaggcaggaatgtttcc

SEQ ID NO: 189307 - DNA, 25 bp, Homo sapien
gcagccacaggacgtgcacacaatg

SEQ ID NO: 189308 - DNA, 25 bp, Homo sapien
tagctgacagtcaggccactcgagc

SEQ ID NO: 189309 - DNA, 25 bp, Homo sapien
ctggaagtagttggcgtagctgaca

SEQ ID NO: 189310 - DNA, 25 bp, Homo sapien
tgctgcacatgggactgaagggcaa

SEQ ID NO: 189311 - DNA, 25 bp, Homo sapien
tgcatcgcactgtcggcaggtgctc

SEQ ID NO: 189312 - DNA, 25 bp, Homo sapien
gtctgtcattctcctcagcgctgtc

SEQ ID NO: 189313 - DNA, 25 bp, Homo sapien
agaggagcagccatcaactagcgcc

SEQ ID NO: 189314 - DNA, 25 bp, Homo sapien
ctgagagtcagaaaacgaacacgcc

SEQ ID NO: 189315 - DNA, 25 bp, Homo sapien
acggtgacggatgcagcagagattc

SEQ ID NO: 189316 - DNA, 25 bp, Homo sapien
aaatggcagcgatgctcaacacccg

SEQ ID NO: 189317 - DNA, 25 bp, Homo sapien
tggagtactccgaggaactgccttc

SEQ ID NO: 189318 - DNA, 25 bp, Homo sapien
cgcacgtgcccttacgtctgtcatt

SEQ ID NO: 189319 - DNA, 25 bp, Homo sapien
gtatgagtaacccatctgcccgaca

SEQ ID NO: 189320 - DNA, 25 bp, Homo sapien
tgtgtacgagtaacccacctgcccg

SEQ ID NO: 189321 - DNA, 25 bp, Homo sapien
gccctctctgtgtacgagtaaccca

SEQ ID NO: 189322 - DNA, 25 bp, Homo sapien
tctctgtgtacgagtaacccacctg

SEQ ID NO: 189323 - DNA, 25 bp, Homo sapien
gagtaacccatctgcccgacacacg

SEQ ID NO: 189324 - DNA, 25 bp, Homo sapien
tatgagtaacccatctgcccgacac

SEQ ID NO: 189325 - DNA, 25 bp, Homo sapien
cgggccctctctgtgtatgagtaac

SEQ ID NO: 189326 - DNA, 25 bp, Homo sapien
cacgggccctctctgtgtatgagta

SEQ ID NO: 189327 - DNA, 25 bp, Homo sapien
atgcacctagaaccactgatacgcc

SEQ ID NO: 189328 - DNA, 25 bp, Homo sapien
gcatgcacctagaaccactgatacg

SEQ ID NO: 189329 - DNA, 25 bp, Homo sapien
ttgcatgcacctagaaccactgata

SEQ ID NO: 189330 - DNA, 25 bp, Homo sapien
tcattgcatgcacctagaaccactg

SEQ ID NO: 189331 - DNA, 25 bp, Homo sapien
gctgcccatcattgcatgcacctag

SEQ ID NO: 189332 - DNA, 25 bp, Homo sapien
tgcccatcattgcatgcacctagaa

SEQ ID NO: 189333 - DNA, 25 bp, Homo sapien
gaacacacacgcctccacacatcgc

SEQ ID NO: 189334 - DNA, 25 bp, Homo sapien
gagtccgctgcccatcattgcatgc

SEQ ID NO: 189335 - DNA, 25 bp, Homo sapien
accacgctcgagctgtgcggccatg

SEQ ID NO: 189336 - DNA, 25 bp, Homo sapien
gaggctccaccacgctcgagctgtg

SEQ ID NO: 189337 - DNA, 25 bp, Homo sapien
ggacaggcagcccatcctggtggac

SEQ ID NO: 189338 - DNA, 25 bp, Homo sapien
tacgcagccattgctgtgcaccgcg

SEQ ID NO: 189339 - DNA, 25 bp, Homo sapien
tcctggggcctacgcagccattgct

SEQ ID NO: 189340 - DNA, 25 bp, Homo sapien
cacccagcacagtttgcacgtgaga

SEQ ID NO: 189341 - DNA, 25 bp, Homo sapien
ttgcgtcccagtgaggacaccggga

SEQ ID NO: 189342 - DNA, 25 bp, Homo sapien
ccgtccggagcttgcgtcccagtga

SEQ ID NO: 189343 - DNA, 25 bp, Homo sapien
attttgacgacggagggtcctactg

SEQ ID NO: 189344 - DNA, 25 bp, Homo sapien
caaggcgaatacaccggctcgtgga

SEQ ID NO: 189345 - DNA, 25 bp, Homo sapien
cccttctgtggatctctggggaagt

SEQ ID NO: 189346 - DNA, 25 bp, Homo sapien
tctggaaccgagttacatgcatgtc

SEQ ID NO: 189347 - DNA, 25 bp, Homo sapien
cgcctgagtccgttttcaccgtttg

SEQ ID NO: 189348 - DNA, 25 bp, Homo sapien
cgactctgctgtgtcgatcgcctga

SEQ ID NO: 189349 - DNA, 25 bp, Homo sapien
cggcgcagctcgaaaaggaataatc

SEQ ID NO: 189350 - DNA, 25 bp, Homo sapien
gcggcaacacgtaccagggcacctg

SEQ ID NO: 189351 - DNA, 25 bp, Homo sapien
tcccaggataaaggcaggtccctgc

SEQ ID NO: 189352 - DNA, 25 bp, Homo sapien
ccgggataaacgctggtccctgcac

SEQ ID NO: 189353 - DNA, 25 bp, Homo sapien
ctcccaggataaacgctggtccctg

SEQ ID NO: 189354 - DNA, 25 bp, Homo sapien
caggataaacgctggtccctgcaca

SEQ ID NO: 189355 - DNA, 25 bp, Homo sapien
tcccaggataaacgctggtccctgc

SEQ ID NO: 189356 - DNA, 25 bp, Homo sapien
tcccgggataaacgctggtccctgc

SEQ ID NO: 189357 - DNA, 25 bp, Homo sapien
cgggataaacgctggtccctgcaca

SEQ ID NO: 189358 - DNA, 25 bp, Homo sapien
ctcccgggataaacgctggtccctg

SEQ ID NO: 189359 - DNA, 25 bp, Homo sapien
aagctgcgcaagtcggagtccaaga

SEQ ID NO: 189360 - DNA, 25 bp, Homo sapien
agcagaacatcctcgtcggcggcaa

SEQ ID NO: 189361 - DNA, 25 bp, Homo sapien
tgaccttcccggacggcaccaagga

SEQ ID NO: 189362 - DNA, 25 bp, Homo sapien
ctggccagccaacgcagcaagcaga

SEQ ID NO: 189363 - DNA, 25 bp, Homo sapien
tggcccacagtgactccgagatcct

SEQ ID NO: 189364 - DNA, 25 bp, Homo sapien
tgaggacgtccatcaactccctgcg

SEQ ID NO: 189365 - DNA, 25 bp, Homo sapien
cggcggcaagcgcaagaacctcatc

SEQ ID NO: 189366 - DNA, 25 bp, Homo sapien
agcagagctcctttcgcagcgaggc

SEQ ID NO: 189367 - DNA, 25 bp, Homo sapien
ctgcatctcccggtggcacaggggc

SEQ ID NO: 189368 - DNA, 25 bp, Homo sapien
aggccgtgctccgtggatctcctct

SEQ ID NO: 189369 - DNA, 25 bp, Homo sapien
gctccaggtagctgcacacgcatta

SEQ ID NO: 189370 - DNA, 25 bp, Homo sapien
gctgcacacgcattacaaacatctc

SEQ ID NO: 189371 - DNA, 25 bp, Homo sapien
ctcgttaatcttctcggaggtcctg

SEQ ID NO: 189372 - DNA, 25 bp, Homo sapien
cgaggcctgtggtagccctgccctt

SEQ ID NO: 189373 - DNA, 25 bp, Homo sapien
ttagtaaggaaatcgccgctgcatc

SEQ ID NO: 189374 - DNA, 25 bp, Homo sapien
cctgcccttggagcactgagaatta

SEQ ID NO: 189375 - DNA, 25 bp, Homo sapien
catctgagagctcgccagaggactg

SEQ ID NO: 189376 - DNA, 25 bp, Homo sapien
gagcccgctgagcttcctttgaaaa

SEQ ID NO: 189377 - DNA, 25 bp, Homo sapien
acatttcaatcttccatggggtctg

SEQ ID NO: 189378 - DNA, 25 bp, Homo sapien
gtcatcttcttgcaaaaggcgggga

SEQ ID NO: 189379 - DNA, 25 bp, Homo sapien
cccatctggcagaagagtcatcttc

SEQ ID NO: 189380 - DNA, 25 bp, Homo sapien
cgggcctcaccacttcaggaatgta

SEQ ID NO: 189381 - DNA, 25 bp, Homo sapien
ccggctggagcatttcctttcatta

SEQ ID NO: 189382 - DNA, 25 bp, Homo sapien
gtcacctgttcctcccatctgagag

SEQ ID NO: 189383 - DNA, 25 bp, Homo sapien
actccgcaccggcttttgcgggcgg

SEQ ID NO: 189384 - DNA, 25 bp, Homo sapien
acacttcaacttgctcggctccggg

SEQ ID NO: 189385 - DNA, 25 bp, Homo sapien
ccgggcgagttgattcacttactca

SEQ ID NO: 189386 - DNA, 25 bp, Homo sapien
cctttggaaatagaatagccaatgt

SEQ ID NO: 189387 - DNA, 25 bp, Homo sapien
taacgccgagttccttttcactgtc

SEQ ID NO: 189388 - DNA, 25 bp, Homo sapien
ccttttcactgtctgtggacattaa

SEQ ID NO: 189389 - DNA, 25 bp, Homo sapien
agccaatgtaatctgacacttcaac

SEQ ID NO: 189390 - DNA, 25 bp, Homo sapien
gtctgtggacattaaaaaagcgagc

SEQ ID NO: 189391 - DNA, 25 bp, Homo sapien
tgaacagccggggaagtgaaagacc

SEQ ID NO: 189392 - DNA, 25 bp, Homo sapien
cgtcctctccgggagcttacgggag

SEQ ID NO: 189393 - DNA, 25 bp, Homo sapien
gtgggagagacattgacgaaatatt

SEQ ID NO: 189394 - DNA, 25 bp, Homo sapien
cgaaatattacccatcgcaggagtc

SEQ ID NO: 189395 - DNA, 25 bp, Homo sapien
cgcaggagtcaggtgcacacagtga

SEQ ID NO: 189396 - DNA, 25 bp, Homo sapien
gcacacagtgatgatagttccggga

SEQ ID NO: 189397 - DNA, 25 bp, Homo sapien
cagaaggtcaggtgcgcacggtgat

SEQ ID NO: 189398 - DNA, 25 bp, Homo sapien
tcaggtgcatgcggtgattgttccg

SEQ ID NO: 189399 - DNA, 25 bp, Homo sapien
atgcacgtaggacggcatgggattc

SEQ ID NO: 189400 - DNA, 25 bp, Homo sapien
cacacgtgtagcgtgcacgtgcatg

SEQ ID NO: 189401 - DNA, 25 bp, Homo sapien
acgtaggacggcatgggattccacg

SEQ ID NO: 189402 - DNA, 25 bp, Homo sapien
acacttgggggcacacgtgtagcgt

SEQ ID NO: 189403 - DNA, 25 bp, Homo sapien
ccacgcagaatgcacgtaggacggc

SEQ ID NO: 189404 - DNA, 25 bp, Homo sapien
atggacgaacggaacagggatgctg

SEQ ID NO: 189405 - DNA, 25 bp, Homo sapien
ggggcacctgccagaaccctggctg

SEQ ID NO: 189406 - DNA, 25 bp, Homo sapien
ggccactccacgcagaatgcacgta

SEQ ID NO: 189407 - DNA, 25 bp, Homo sapien
taccagaggccgaagcgtcagacct

SEQ ID NO: 189408 - DNA, 25 bp, Homo sapien
ctcctgtgacgacatcgaggtgctg

SEQ ID NO: 189409 - DNA, 25 bp, Homo sapien
gtcgcccacttctcgaggcaggtgt

SEQ ID NO: 189410 - DNA, 25 bp, Homo sapien
atgacttccgcacccgaggttcggg

SEQ ID NO: 189411 - DNA, 25 bp, Homo sapien
taccggatggagatgaaacccttgc

SEQ ID NO: 189412 - DNA, 25 bp, Homo sapien
agactgcggtccaaggcccagaaca

SEQ ID NO: 189413 - DNA, 25 bp, Homo sapien
agaaatccttgcctgtcgctctaga

SEQ ID NO: 189414 - DNA, 25 bp, Homo sapien
ctgcgttgggacttgaccttctccc

SEQ ID NO: 189415 - DNA, 25 bp, Homo sapien
agcgtctttactgaaggtccttccg

SEQ ID NO: 189416 - DNA, 25 bp, Homo sapien
aaacgtgctgtgagcaggaatcgcg

SEQ ID NO: 189417 - DNA, 25 bp, Homo sapien
ctctcgttacaaaccagcgtcttta

SEQ ID NO: 189418 - DNA, 25 bp, Homo sapien
tgcaggaatcgcgagtgagttccat

SEQ ID NO: 189419 - DNA, 25 bp, Homo sapien
cctggttttcgagcaggaaacgtgc

SEQ ID NO: 189420 - DNA, 25 bp, Homo sapien
cgcaatggatgtgtggacagagcta

SEQ ID NO: 189421 - DNA, 25 bp, Homo sapien
ctgaaggtccttccgctgcagagct

SEQ ID NO: 189422 - DNA, 25 bp, Homo sapien
cgtgtgacactttggaacgcttctc

SEQ ID NO: 189423 - DNA, 25 bp, Homo sapien
gaggccctgggctttcgtgccggcc

SEQ ID NO: 189424 - DNA, 25 bp, Homo sapien
tggcaccgagtacggcgtgtcccag

SEQ ID NO: 189425 - DNA, 25 bp, Homo sapien
tgggcaagaacgtggcaccgagtac

SEQ ID NO: 189426 - DNA, 25 bp, Homo sapien
ccacagcgaggaactgggcaagaac

SEQ ID NO: 189427 - DNA, 25 bp, Homo sapien
agccagcagctcaccacagcgagga

SEQ ID NO: 189428 - DNA, 25 bp, Homo sapien
ggaaaggcttcctaacagccagcag

SEQ ID NO: 189429 - DNA, 25 bp, Homo sapien
ccgcagccgagggaaaggcttccta

SEQ ID NO: 189430 - DNA, 25 bp, Homo sapien
tcgtgccggccgctcacgccctacg

SEQ ID NO: 189431 - DNA, 25 bp, Homo sapien
cctcttccgagtccgtctcctccag

SEQ ID NO: 189432 - DNA, 25 bp, Homo sapien
tcctcactgtcctcttccgagtccg

SEQ ID NO: 189433 - DNA, 25 bp, Homo sapien
agcccgagcccgctcacctcagtcc

SEQ ID NO: 189434 - DNA, 25 bp, Homo sapien
cccgagcccgctcacctcagtcctc

SEQ ID NO: 189435 - DNA, 25 bp, Homo sapien
ctcctctccgctgtcttcgtcgtcg

SEQ ID NO: 189436 - DNA, 25 bp, Homo sapien
caccctcggcgccctcaacctcctc

SEQ ID NO: 189437 - DNA, 25 bp, Homo sapien
tgtcctcttccgagtccgtctcctc

SEQ ID NO: 189438 - DNA, 25 bp, Homo sapien
tctccgctgtcttcgtcgtcgaccc

SEQ ID NO: 189439 - DNA, 25 bp, Homo sapien
gaatgaacgcacatacacgtcagcg

SEQ ID NO: 189440 - DNA, 25 bp, Homo sapien
cacatacacgtcagcgcagctgagg

SEQ ID NO: 189441 - DNA, 25 bp, Homo sapien
cgcacatacacgtcagcgcagctga

SEQ ID NO: 189442 - DNA, 25 bp, Homo sapien
atgaacgcacatacacgtcagcgca

SEQ ID NO: 189443 - DNA, 25 bp, Homo sapien
gcagaatgaacgcacatacacgtca

SEQ ID NO: 189444 - DNA, 25 bp, Homo sapien
gtttcttcaaaagcagaatgaacgc

SEQ ID NO: 189445 - DNA, 25 bp, Homo sapien
cctgagtttcttcaaaagcagaatg

SEQ ID NO: 189446 - DNA, 25 bp, Homo sapien
gaacgcacatacacgtcagcgcagc

SEQ ID NO: 189447 - DNA, 25 bp, Homo sapien
tccatcctgtgcaggtccaggcagt

SEQ ID NO: 189448 - DNA, 25 bp, Homo sapien
cctcaaggctgtcttcgtcctcaga

SEQ ID NO: 189449 - DNA, 25 bp, Homo sapien
ttcacagccagcatggcgttggagc

SEQ ID NO: 189450 - DNA, 25 bp, Homo sapien
gcttgctttcgagggacgcgacaca

SEQ ID NO: 189451 - DNA, 25 bp, Homo sapien
agcacaggcgagaagtgtcggcaca

SEQ ID NO: 189452 - DNA, 25 bp, Homo sapien
ccgtcaatctgaccgtggaggcagg

SEQ ID NO: 189453 - DNA, 25 bp, Homo sapien
agggtcctgttctccgtcaatctga

SEQ ID NO: 189454 - DNA, 25 bp, Homo sapien
cacccgggacaaaggacagacgtgc

SEQ ID NO: 189455 - DNA, 25 bp, Homo sapien
ggcatctcacgttttgcggggcttg

SEQ ID NO: 189456 - DNA, 25 bp, Homo sapien
acctttgccagacgcaggtccagca

SEQ ID NO: 189457 - DNA, 25 bp, Homo sapien
ggtccagcaacccatcaagagcaca

SEQ ID NO: 189458 - DNA, 25 bp, Homo sapien
acagctcgggcaagcagcgaccgca

SEQ ID NO: 189459 - DNA, 25 bp, Homo sapien
accacacaaccacaggtgatgagcc

SEQ ID NO: 189460 - DNA, 25 bp, Homo sapien
acatcagtgcacaggaggcatctca

SEQ ID NO: 189461 - DNA, 25 bp, Homo sapien
ccaaccacgtgtcgcgagagcagca

SEQ ID NO: 189462 - DNA, 25 bp, Homo sapien
gggagacgccgcaccacatcagtgc

SEQ ID NO: 189463 - DNA, 25 bp, Homo sapien
aaacgcccgtgacaccacactaaga

SEQ ID NO: 189464 - DNA, 25 bp, Homo sapien
aggttcggtcttggagctccgtctt

SEQ ID NO: 189465 - DNA, 25 bp, Homo sapien
gcggacagacacacgtggagactca

SEQ ID NO: 189466 - DNA, 25 bp, Homo sapien
tcggcgcacagaaatggagtcactt

SEQ ID NO: 189467 - DNA, 25 bp, Homo sapien
tctccgctcggaaacaggtgctcgt

SEQ ID NO: 189468 - DNA, 25 bp, Homo sapien
cgcgagcgcttagacaccttcttct

SEQ ID NO: 189469 - DNA, 25 bp, Homo sapien
ggggcagttcctacggcctccagct

SEQ ID NO: 189470 - DNA, 25 bp, Homo sapien
ccacactaagaaaagcaagcacgtt

SEQ ID NO: 189471 - DNA, 25 bp, Homo sapien
tggagcctcgcaaccgcagtatgcg

SEQ ID NO: 189472 - DNA, 25 bp, Homo sapien
tgagcctcctggcaaagccctttgt

SEQ ID NO: 189473 - DNA, 25 bp, Homo sapien
ttgtcaacgtcaacagaagcatctg

SEQ ID NO: 189474 - DNA, 25 bp, Homo sapien
acagaagcatctggcgtcctttctg

SEQ ID NO: 189475 - DNA, 25 bp, Homo sapien
gtcctttctggtcgcggacgtcaga

SEQ ID NO: 189476 - DNA, 25 bp, Homo sapien
cagagctggctgctccggcactcag

SEQ ID NO: 189477 - DNA, 25 bp, Homo sapien
accgcagtatgcgaaggttgcatca

SEQ ID NO: 189478 - DNA, 25 bp, Homo sapien
gttgcatcaccctcgcggggtctaa

SEQ ID NO: 189479 - DNA, 25 bp, Homo sapien
cttccaattaattgcctgggcgggg

SEQ ID NO: 189480 - DNA, 25 bp, Homo sapien
caagtttgaaatgtgagctgcctcc

SEQ ID NO: 189481 - DNA, 25 bp, Homo sapien
tgagctgcctccgattcatactcgc

SEQ ID NO: 189482 - DNA, 25 bp, Homo sapien
ctggagacgccaaggcaggtctgct

SEQ ID NO: 189483 - DNA, 25 bp, Homo sapien
aataattgatgtgtgcggtgcggta

SEQ ID NO: 189484 - DNA, 25 bp, Homo sapien
ctggagacgggcgatgaataattga

SEQ ID NO: 189485 - DNA, 25 bp, Homo sapien
ctcgcacaagtgttgcttccaatta

SEQ ID NO: 189486 - DNA, 25 bp, Homo sapien
gcctatgattggcttcgcccgggaa

SEQ ID NO: 189487 - DNA, 25 bp, Homo sapien
tgctccacgttccagaccggggcag

SEQ ID NO: 189488 - DNA, 25 bp, Homo sapien
ttgctccacgttccagaccggggca

SEQ ID NO: 189489 - DNA, 25 bp, Homo sapien
agcttgctccacgttccagaccggg

SEQ ID NO: 189490 - DNA, 25 bp, Homo sapien
tgagcttgctccacgttccagaccg

SEQ ID NO: 189491 - DNA, 25 bp, Homo sapien
gaaaccgtcgcctgagcttgctcca

SEQ ID NO: 189492 - DNA, 25 bp, Homo sapien
ggaaaccgtcgcctgagcttgctcc

SEQ ID NO: 189493 - DNA, 25 bp, Homo sapien
tccggccaccccgtctgtcctgtcc

SEQ ID NO: 189494 - DNA, 25 bp, Homo sapien
ccggccaccctgtccgccctgtcca

SEQ ID NO: 189495 - DNA, 25 bp, Homo sapien
gtcacgctccaaggcccagaatagg

SEQ ID NO: 189496 - DNA, 25 bp, Homo sapien
gcccagaataggaggtcggtgctca

SEQ ID NO: 189497 - DNA, 25 bp, Homo sapien
gtcggtgctcattcctcacgtagtg

SEQ ID NO: 189498 - DNA, 25 bp, Homo sapien
ttcctcacgtagtgggcaaatccta

SEQ ID NO: 189499 - DNA, 25 bp, Homo sapien
cacgtagtgggcaaatcctagggca

SEQ ID NO: 189500 - DNA, 25 bp, Homo sapien
gcgggcaatgccagagaacggtccc

SEQ ID NO: 189501 - DNA, 25 bp, Homo sapien
cggaggcacgcacgtgctgtggcca

SEQ ID NO: 189502 - DNA, 25 bp, Homo sapien
gagtttgcgggcgtcacgctccaag

SEQ ID NO: 189503 - DNA, 25 bp, Homo sapien
agccgtccgcgctcttggcggccag

SEQ ID NO: 189504 - DNA, 25 bp, Homo sapien
atgcccgagccgataatggtcccca

SEQ ID NO: 189505 - DNA, 25 bp, Homo sapien
cgagccgataatggtccccacgatg

SEQ ID NO: 189506 - DNA, 25 bp, Homo sapien
gataatggtccccacgatgatggcc

SEQ ID NO: 189507 - DNA, 25 bp, Homo sapien
gatgcccgagccgataatggtcccc

SEQ ID NO: 189508 - DNA, 25 bp, Homo sapien
cgcggcccagcgagcagtgtgcgcg

SEQ ID NO: 189509 - DNA, 25 bp, Homo sapien
cccagcctggcgggctattcccagg

SEQ ID NO: 189510 - DNA, 25 bp, Homo sapien
gccgataatggtccccacgatgatg

SEQ ID NO: 189511 - DNA, 25 bp, Homo sapien
gcccacgatggagaagacgccgcac

SEQ ID NO: 189512 - DNA, 25 bp, Homo sapien
tggcgaagaccagggccacgatgta

SEQ ID NO: 189513 - DNA, 25 bp, Homo sapien
ccagggccacgatgtactgcgatga

SEQ ID NO: 189514 - DNA, 25 bp, Homo sapien
ccacgatgtactgcgatgaaggccg

SEQ ID NO: 189515 - DNA, 25 bp, Homo sapien
gcagctcgatccagagcttgaggaa

SEQ ID NO: 189516 - DNA, 25 bp, Homo sapien
agagcgcgcccacgatggagaagac

SEQ ID NO: 189517 - DNA, 25 bp, Homo sapien
ccgtgggcgtcacgaagatgcccga

SEQ ID NO: 189518 - DNA, 25 bp, Homo sapien
agtcgccgcccgatttggagatggt

SEQ ID NO: 189519 - DNA, 25 bp, Homo sapien
gactcctcttgatcgatggaatcga

SEQ ID NO: 189520 - DNA, 25 bp, Homo sapien
acatgtcagtgcgacccacagcggg

SEQ ID NO: 189521 - DNA, 25 bp, Homo sapien
ctggagctgctgaatgtgcacaaca

SEQ ID NO: 189522 - DNA, 25 bp, Homo sapien
cttcacccgggcctggttcaggagc

SEQ ID NO: 189523 - DNA, 25 bp, Homo sapien
gcgcagcagcttagagcagaacaga

SEQ ID NO: 189524 - DNA, 25 bp, Homo sapien
ctgtccttcagcagactcctcttga

SEQ ID NO: 189525 - DNA, 25 bp, Homo sapien
gcttggtgctttcccgcttccactt

SEQ ID NO: 189526 - DNA, 25 bp, Homo sapien
tggaatcgaagtcaggcgcagcagc

SEQ ID NO: 189527 - DNA, 25 bp, Homo sapien
cccgcgcgtcctgagagaccgagaa

SEQ ID NO: 189528 - DNA, 25 bp, Homo sapien
agcccgcgtaggtccagtaatccca

SEQ ID NO: 189529 - DNA, 25 bp, Homo sapien
caacgggctccttctggatgatcca

SEQ ID NO: 189530 - DNA, 25 bp, Homo sapien
ccatgaagcgccatcgtgccagtta

SEQ ID NO: 189531 - DNA, 25 bp, Homo sapien
gatgatccaggtgaccgactcggtc

SEQ ID NO: 189532 - DNA, 25 bp, Homo sapien
ctgagagaccgagaagcacaggacg

SEQ ID NO: 189533 - DNA, 25 bp, Homo sapien
ccagttacgggcacggctcacctgg

SEQ ID NO: 189534 - DNA, 25 bp, Homo sapien
tggggccacttcaacgggctccttc

SEQ ID NO: 189535 - DNA, 25 bp, Homo sapien
agctccatcctgagcgtttcacgga

SEQ ID NO: 189536 - DNA, 25 bp, Homo sapien
cggcctcccgtcttcggaacgagag

SEQ ID NO: 189537 - DNA, 25 bp, Homo sapien
gactcgcgttgcagcgcacgtccga

SEQ ID NO: 189538 - DNA, 25 bp, Homo sapien
ccacagaggagctaaggaaaacgcc

SEQ ID NO: 189539 - DNA, 25 bp, Homo sapien
cgtttcacggacatggccctcttca

SEQ ID NO: 189540 - DNA, 25 bp, Homo sapien
gccaccgaatgaggctcgatgaaac

SEQ ID NO: 189541 - DNA, 25 bp, Homo sapien
ctcgatgaaacctcgactcgcgttg

SEQ ID NO: 189542 - DNA, 25 bp, Homo sapien
ggaacgagagttaatccacagagga

SEQ ID NO: 189543 - DNA, 25 bp, Homo sapien
aggacggacgccattatcgcatctc

SEQ ID NO: 189544 - DNA, 25 bp, Homo sapien
cccagcaacccttggtgcggggaca

SEQ ID NO: 189545 - DNA, 25 bp, Homo sapien
gaatgcatggctcccagcttgcgca

SEQ ID NO: 189546 - DNA, 25 bp, Homo sapien
tgagggagctaatgcgtattcattc

SEQ ID NO: 189547 - DNA, 25 bp, Homo sapien
agatgcaaattcctcagaccgtcca

SEQ ID NO: 189548 - DNA, 25 bp, Homo sapien
tgattgttctcacgcaggccatggg

SEQ ID NO: 189549 - DNA, 25 bp, Homo sapien
cacacggtaattgcagctcccgcag

SEQ ID NO: 189550 - DNA, 25 bp, Homo sapien
agaccgtccactgaggtgattgttc

SEQ ID NO: 189551 - DNA, 25 bp, Homo sapien
tgtgaatgcgcttcccgtaaatatg

SEQ ID NO: 189552 - DNA, 25 bp, Homo sapien
tcccgtaaatatggcagaacgcctt

SEQ ID NO: 189553 - DNA, 25 bp, Homo sapien
gaacgccttcacctttcaccagatg

SEQ ID NO: 189554 - DNA, 25 bp, Homo sapien
cggtccctgctgtcatcatggcatg

SEQ ID NO: 189555 - DNA, 25 bp, Homo sapien
gcttggcatttccttgccggtgtga

SEQ ID NO: 189556 - DNA, 25 bp, Homo sapien
ctgccgctacgtgtcctcaagtgag

SEQ ID NO: 189557 - DNA, 25 bp, Homo sapien
tccctgagcagagtgctgccgctgc

SEQ ID NO: 189558 - DNA, 25 bp, Homo sapien
tgccagtctgcgttttctgccgaaa

SEQ ID NO: 189559 - DNA, 25 bp, Homo sapien
catgccggggcttttggaaacgcta

SEQ ID NO: 189560 - DNA, 25 bp, Homo sapien
agttggcatctcagttcgcaggcgg

SEQ ID NO: 189561 - DNA, 25 bp, Homo sapien
acgccgaggaatgggagccgcaaca

SEQ ID NO: 189562 - DNA, 25 bp, Homo sapien
ccgcaacaagcctggagggactgtt

SEQ ID NO: 189563 - DNA, 25 bp, Homo sapien
actgttgtgacctcgctgcccgtgt

SEQ ID NO: 189564 - DNA, 25 bp, Homo sapien
cagctccacatgacggctgctgtgc

SEQ ID NO: 189565 - DNA, 25 bp, Homo sapien
gccgaagcagtggtgcctctttgaa

SEQ ID NO: 189566 - DNA, 25 bp, Homo sapien
cctctttgaactctcgggcatgccg

SEQ ID NO: 189567 - DNA, 25 bp, Homo sapien
cccagcacacctgtggagttggcta

SEQ ID NO: 189568 - DNA, 25 bp, Homo sapien
gagttggctactgggcagctcagac

SEQ ID NO: 189569 - DNA, 25 bp, Homo sapien
gggcacgcacatgctcacgtttata

SEQ ID NO: 189570 - DNA, 25 bp, Homo sapien
cctttgtctgtacttcgaagctgga

SEQ ID NO: 189571 - DNA, 25 bp, Homo sapien
ctggacagagatagtggtgtaaaca

SEQ ID NO: 189572 - DNA, 25 bp, Homo sapien
tggtgtaaacaggatgcagcagagc

SEQ ID NO: 189573 - DNA, 25 bp, Homo sapien
agcagagcatggagtgttgcccgtc

SEQ ID NO: 189574 - DNA, 25 bp, Homo sapien
cccggattttctgctttgttttcat

SEQ ID NO: 189575 - DNA, 25 bp, Homo sapien
cgggaacctgggcaagccaataaag

SEQ ID NO: 189576 - DNA, 25 bp, Homo sapien
tacctggacgtggacgccaacggga

SEQ ID NO: 189577 - DNA, 25 bp, Homo sapien
gcaggggtagtccacggacaggcct

SEQ ID NO: 189578 - DNA, 25 bp, Homo sapien
gtgtacctggacgtggacgccaacg

SEQ ID NO: 189579 - DNA, 25 bp, Homo sapien
ctcctcctccgggaacccgctcgtg

SEQ ID NO: 189580 - DNA, 25 bp, Homo sapien
cgtcagtttgagttctgtgttctcc

SEQ ID NO: 189581 - DNA, 25 bp, Homo sapien
gcgcgcgacgtcagtttgagttctg

SEQ ID NO: 189582 - DNA, 25 bp, Homo sapien
tgggcaagccaataaaggctgcggc

SEQ ID NO: 189583 - DNA, 25 bp, Homo sapien
agacacgtctccatgcacgcacttg

SEQ ID NO: 189584 - DNA, 25 bp, Homo sapien
gcacgtgcacggctgtacttacctg

SEQ ID NO: 189585 - DNA, 25 bp, Homo sapien
tgcgcggctggacttacctgtcctt

SEQ ID NO: 189586 - DNA, 25 bp, Homo sapien
gcggctgtacttgcctgtccttcca

SEQ ID NO: 189587 - DNA, 25 bp, Homo sapien
ggctgtacttaccaggccttccaga

SEQ ID NO: 189588 - DNA, 25 bp, Homo sapien
gcacgcacttgcacggctgtactta

SEQ ID NO: 189589 - DNA, 25 bp, Homo sapien
tgcgcggctgtacttacctgtcctt

SEQ ID NO: 189590 - DNA, 25 bp, Homo sapien
agacgcgtctccatacacgcacgtg

SEQ ID NO: 189591 - DNA, 25 bp, Homo sapien
acccgtctgtgattgtgaacccata

SEQ ID NO: 189592 - DNA, 25 bp, Homo sapien
cccatcgtgcaaagtactgcccatt

SEQ ID NO: 189593 - DNA, 25 bp, Homo sapien
aaagtactgcccattcccaagcgga

SEQ ID NO: 189594 - DNA, 25 bp, Homo sapien
tgtggctgtgacacggaacccagcg

SEQ ID NO: 189595 - DNA, 25 bp, Homo sapien
cgcagcgacccgtctgtgattgtga

SEQ ID NO: 189596 - DNA, 25 bp, Homo sapien
ggctccaaccaaacgggccaagctg

SEQ ID NO: 189597 - DNA, 25 bp, Homo sapien
cccaagcggaagaatgtgtggaaac

SEQ ID NO: 189598 - DNA, 25 bp, Homo sapien
tgtgaacccataaaagtggctggtg

SEQ ID NO: 189599 - DNA, 25 bp, Homo sapien
ggcgtcggcagaacaccattgtggt

SEQ ID NO: 189600 - DNA, 25 bp, Homo sapien
gaaagcgctgaccttcgcgtgctgc

SEQ ID NO: 189601 - DNA, 25 bp, Homo sapien
ctgcttgcggctcttaccacatcgg

SEQ ID NO: 189602 - DNA, 25 bp, Homo sapien
tttttcccgtttagcgctgtgcctg

SEQ ID NO: 189603 - DNA, 25 bp, Homo sapien
aggccagcgactctgtgtccagctg

SEQ ID NO: 189604 - DNA, 25 bp, Homo sapien
agcatcgggagcaacgtcacgctca

SEQ ID NO: 189605 - DNA, 25 bp, Homo sapien
accctgaactcggaaggtgcgtcca

SEQ ID NO: 189606 - DNA, 25 bp, Homo sapien
accacatcgggctggtgtgtttttt

SEQ ID NO: 189607 - DNA, 25 bp, Homo sapien
aacgtgtagccacgctatgctgtgc

SEQ ID NO: 189608 - DNA, 25 bp, Homo sapien
cgtggaaaggagaacgtgtagccac

SEQ ID NO: 189609 - DNA, 25 bp, Homo sapien
gaacgtgtagccacgctatgctgtg

SEQ ID NO: 189610 - DNA, 25 bp, Homo sapien
ccacgctatgctgtgccgattcaca

SEQ ID NO: 189611 - DNA, 25 bp, Homo sapien
cacgtggaaaggagaacgtgtagcc

SEQ ID NO: 189612 - DNA, 25 bp, Homo sapien
agccacgctatgctgtgccgattca

SEQ ID NO: 189613 - DNA, 25 bp, Homo sapien
tgtgccgattcacacacctcgcagt

SEQ ID NO: 189614 - DNA, 25 bp, Homo sapien
ctatgctgtgccgattcacacacct

SEQ ID NO: 189615 - DNA, 25 bp, Homo sapien
ttcgtgcacgtggaaaggagaacgt

SEQ ID NO: 189616 - DNA, 25 bp, Homo sapien
tccatggaatgccattcgtgcacgt

SEQ ID NO: 189617 - DNA, 25 bp, Homo sapien
atgcacgtggaaaggagaacgtgta

SEQ ID NO: 189618 - DNA, 25 bp, Homo sapien
cagctatgcacgtggaaaggagaac

SEQ ID NO: 189619 - DNA, 25 bp, Homo sapien
ggaacaccagctatgcacgtggaaa

SEQ ID NO: 189620 - DNA, 25 bp, Homo sapien
gtccacggaacaccagctatgcacg

SEQ ID NO: 189621 - DNA, 25 bp, Homo sapien
agtcacacacatcgcagtccacgga

SEQ ID NO: 189622 - DNA, 25 bp, Homo sapien
tgtgctgtgccgagtcacacacatc

SEQ ID NO: 189623 - DNA, 25 bp, Homo sapien
gctcaccatctacggcatccggtgt

SEQ ID NO: 189624 - DNA, 25 bp, Homo sapien
tcttccaccgcgaggtgcaggctgt

SEQ ID NO: 189625 - DNA, 25 bp, Homo sapien
tacggcatccggtgtaagtcgggcc

SEQ ID NO: 189626 - DNA, 25 bp, Homo sapien
caagcacgggaagaagcagctggac

SEQ ID NO: 189627 - DNA, 25 bp, Homo sapien
aggctgtgtccaacctctcggggca

SEQ ID NO: 189628 - DNA, 25 bp, Homo sapien
accaactgccgcacggccgagaaga

SEQ ID NO: 189629 - DNA, 25 bp, Homo sapien
acatgctgcacatcagcaccaactg

SEQ ID NO: 189630 - DNA, 25 bp, Homo sapien
atgcgggtacgctgcgccatcatcc

SEQ ID NO: 189631 - DNA, 25 bp, Homo sapien
agcgtccaggatctcagcatgccgg

SEQ ID NO: 189632 - DNA, 25 bp, Homo sapien
ggtcctccttgccagcgtccatggt

SEQ ID NO: 189633 - DNA, 25 bp, Homo sapien
gtccatggtccatttgctccacaga

SEQ ID NO: 189634 - DNA, 25 bp, Homo sapien
ccgtcctcctggcttctaacgaaga

SEQ ID NO: 189635 - DNA, 25 bp, Homo sapien
ctcaggggagcgtgaaatgtaaatc

SEQ ID NO: 189636 - DNA, 25 bp, Homo sapien
gtaaatctgatctcgaaacagggcg

SEQ ID NO: 189637 - DNA, 25 bp, Homo sapien
ggcagagcattcagcgtccaggatc

SEQ ID NO: 189638 - DNA, 25 bp, Homo sapien
cacagagcccgtctgcttcagaagc

SEQ ID NO: 189639 - DNA, 25 bp, Homo sapien
tcgactccaagtgccgcacggcgtg

SEQ ID NO: 189640 - DNA, 25 bp, Homo sapien
agcctggcggtcaagagcttctcgc

SEQ ID NO: 189641 - DNA, 25 bp, Homo sapien
ttctcgcggagaacgcccaactcgt

SEQ ID NO: 189642 - DNA, 25 bp, Homo sapien
tgggcctcccggaagtcttctggat

SEQ ID NO: 189643 - DNA, 25 bp, Homo sapien
ttctcacgatttgccgggtgactcc

SEQ ID NO: 189644 - DNA, 25 bp, Homo sapien
tcaagcagagcatcgactccaagtg

SEQ ID NO: 189645 - DNA, 25 bp, Homo sapien
cgactggtaccgaatcaagcagagc

SEQ ID NO: 189646 - DNA, 25 bp, Homo sapien
gccggccgttgtattctcacgattt

SEQ ID NO: 189647 - DNA, 25 bp, Homo sapien
tgtggccacgcacttcgtttccatt

SEQ ID NO: 189648 - DNA, 25 bp, Homo sapien
gcagttacacgttgcacggggcctc

SEQ ID NO: 189649 - DNA, 25 bp, Homo sapien
ctccttgtgtcgtcagtccgtgaca

SEQ ID NO: 189650 - DNA, 25 bp, Homo sapien
tgagccttgccttcccgcagttaca

SEQ ID NO: 189651 - DNA, 25 bp, Homo sapien
cggtcacctggttggcgtgaacctt

SEQ ID NO: 189652 - DNA, 25 bp, Homo sapien
tccattttcacacgtagttcagagc

SEQ ID NO: 189653 - DNA, 25 bp, Homo sapien
ggaaagcgtcgtgcactcgtcccac

SEQ ID NO: 189654 - DNA, 25 bp, Homo sapien
ccgtgacacgccacgtgtgtgatga

SEQ ID NO: 189655 - DNA, 25 bp, Homo sapien
acactgaagtgatggcatggccgcc

SEQ ID NO: 189656 - DNA, 25 bp, Homo sapien
gtgcacagctgatcgccgtggcctc

SEQ ID NO: 189657 - DNA, 25 bp, Homo sapien
ggtcgccactccagggcagcgacat

SEQ ID NO: 189658 - DNA, 25 bp, Homo sapien
agggcagcgacatccaggttcagta

SEQ ID NO: 189659 - DNA, 25 bp, Homo sapien
cagcgacatccaggttcagtacgtg

SEQ ID NO: 189660 - DNA, 25 bp, Homo sapien
tgcagctggcgccagtgagtgacca

SEQ ID NO: 189661 - DNA, 25 bp, Homo sapien
cgccagtgagtgaccacacggccgg

SEQ ID NO: 189662 - DNA, 25 bp, Homo sapien
tgctgcagggtgcacagctgatcgc

SEQ ID NO: 189663 - DNA, 25 bp, Homo sapien
tgccgttccagataggagcgctgca

SEQ ID NO: 189664 - DNA, 25 bp, Homo sapien
ccgcgacagccgtgtgatgatgtca

SEQ ID NO: 189665 - DNA, 25 bp, Homo sapien
acccgtgtcctgtagaaggtctggc

SEQ ID NO: 189666 - DNA, 25 bp, Homo sapien
actctgcgtggtgtttggttccaca

SEQ ID NO: 189667 - DNA, 25 bp, Homo sapien
ttgtcgccgacctcactggagatgc

SEQ ID NO: 189668 - DNA, 25 bp, Homo sapien
aggcaaactcgttcggcagcgctta

SEQ ID NO: 189669 - DNA, 25 bp, Homo sapien
gcgcttattttatgtggtgtgaacc

SEQ ID NO: 189670 - DNA, 25 bp, Homo sapien
aaccttggcctgtccgtgaagaaca

SEQ ID NO: 189671 - DNA, 25 bp, Homo sapien
tgcacgcgacggcagtagtagccca

SEQ ID NO: 189672 - DNA, 25 bp, Homo sapien
tctggtcggacacgtccaggccgtc

SEQ ID NO: 189673 - DNA, 25 bp, Homo sapien
tccttgctctggtcggacacgtcca

SEQ ID NO: 189674 - DNA, 25 bp, Homo sapien
ggtgctccttgctctggtcggacac

SEQ ID NO: 189675 - DNA, 25 bp, Homo sapien
acggcagtagtagcccaggaccttg

SEQ ID NO: 189676 - DNA, 25 bp, Homo sapien
gtcactgcacgcgacggcagtagta

SEQ ID NO: 189677 - DNA, 25 bp, Homo sapien
cacagggaagcagcgtctcctcggg

SEQ ID NO: 189678 - DNA, 25 bp, Homo sapien
cagtagtagcccaggaccttgcact

SEQ ID NO: 189679 - DNA, 25 bp, Homo sapien
tccgcggggaacagcatcctatcaa

SEQ ID NO: 189680 - DNA, 25 bp, Homo sapien
tctcccttttgcagacggccgaagc

SEQ ID NO: 189681 - DNA, 25 bp, Homo sapien
gcacggggccatccagattcagtga

SEQ ID NO: 189682 - DNA, 25 bp, Homo sapien
cagcggctgcacgtgttctgctgaa

SEQ ID NO: 189683 - DNA, 25 bp, Homo sapien
ttctgctgaagtgcgtctgaaggcc

SEQ ID NO: 189684 - DNA, 25 bp, Homo sapien
gtgcgtgtttctcattctgccttaa

SEQ ID NO: 189685 - DNA, 25 bp, Homo sapien
ccctttcgtttgagtcctgctgttg

SEQ ID NO: 189686 - DNA, 25 bp, Homo sapien
tctgccttaaagtcactggctgttc

SEQ ID NO: 189687 - DNA, 25 bp, Homo sapien
cgatggtgacgatcgcgatgccttc

SEQ ID NO: 189688 - DNA, 25 bp, Homo sapien
atccggattgacgatggtgacgatc

SEQ ID NO: 189689 - DNA, 25 bp, Homo sapien
attcgatgcgattgggccatccgga

SEQ ID NO: 189690 - DNA, 25 bp, Homo sapien
gatgccttcaggctcgcaaccgagg

SEQ ID NO: 189691 - DNA, 25 bp, Homo sapien
tgcacgcaggggaacgtgccatccg

SEQ ID NO: 189692 - DNA, 25 bp, Homo sapien
agacacgcctgctcgctccagggta

SEQ ID NO: 189693 - DNA, 25 bp, Homo sapien
gctcgctccagggtaagtgcagtgt

SEQ ID NO: 189694 - DNA, 25 bp, Homo sapien
ttcacgcaggctggattcgatgcga

SEQ ID NO: 189695 - DNA, 25 bp, Homo sapien
ggctatgattctttgaaacctgatg

SEQ ID NO: 189696 - DNA, 25 bp, Homo sapien
acagctgtgagccagaacgccaggc

SEQ ID NO: 189697 - DNA, 25 bp, Homo sapien
ataaatagggtgtccgttgggctgc

SEQ ID NO: 189698 - DNA, 25 bp, Homo sapien
gcagatcggagacgcagccttttca

SEQ ID NO: 189699 - DNA, 25 bp, Homo sapien
ttcttgaagccacatctgcagtatc

SEQ ID NO: 189700 - DNA, 25 bp, Homo sapien
ctgcagtatcagctcaagtggaaga

SEQ ID NO: 189701 - DNA, 25 bp, Homo sapien
cgggacctatggaaagaaggctatg

SEQ ID NO: 189702 - DNA, 25 bp, Homo sapien
ggaagaacttgccttcaaatgtaca

SEQ ID NO: 189703 - DNA, 25 bp, Homo sapien
ggagccctttcatcaccagcgcaga

SEQ ID NO: 189704 - DNA, 25 bp, Homo sapien
ggcttcctgctgcaatgatcgctga

SEQ ID NO: 189705 - DNA, 25 bp, Homo sapien
tgtctggcagccgtgactttctatc

SEQ ID NO: 189706 - DNA, 25 bp, Homo sapien
gcggctcctaaatatgcctgggacc

SEQ ID NO: 189707 - DNA, 25 bp, Homo sapien
cccgtccacgtgctaggaaatggca

SEQ ID NO: 189708 - DNA, 25 bp, Homo sapien
tctgcgctgagctcactcgattctg

SEQ ID NO: 189709 - DNA, 25 bp, Homo sapien
ttaagccggccacaaaccagcgagc

SEQ ID NO: 189710 - DNA, 25 bp, Homo sapien
tctgtgcaaaacaagcagtgggctg

SEQ ID NO: 189711 - DNA, 25 bp, Homo sapien
gggtggaatgatcctccatggcacg

SEQ ID NO: 189712 - DNA, 25 bp, Homo sapien
agggggtggaatgatcctccatggc

SEQ ID NO: 189713 - DNA, 25 bp, Homo sapien
gagggggtggaatgatcctccatgg

SEQ ID NO: 189714 - DNA, 25 bp, Homo sapien
ggagggggtggaatgatcctccatg

SEQ ID NO: 189715 - DNA, 25 bp, Homo sapien
acggagggggtggaatgatcctcca

SEQ ID NO: 189716 - DNA, 25 bp, Homo sapien
cacggagggggtggaatgatcctcc

SEQ ID NO: 189717 - DNA, 25 bp, Homo sapien
gcacggagggggtggaatgatcctc

SEQ ID NO: 189718 - DNA, 25 bp, Homo sapien
cggagggggtggaatgatcctccat

SEQ ID NO: 189719 - DNA, 25 bp, Homo sapien
gaggacgtgggtggtgttactgtga

SEQ ID NO: 189720 - DNA, 25 bp, Homo sapien
ccatgcggcgtttcttggccgcagg

SEQ ID NO: 189721 - DNA, 25 bp, Homo sapien
ggtcctcagccatgcggcgtttctt

SEQ ID NO: 189722 - DNA, 25 bp, Homo sapien
tcctcagccatgcggcgtttcttgg

SEQ ID NO: 189723 - DNA, 25 bp, Homo sapien
cctcagccatgcggcgtttcttggc

SEQ ID NO: 189724 - DNA, 25 bp, Homo sapien
ctcagccatgcggcgtttcttggcc

SEQ ID NO: 189725 - DNA, 25 bp, Homo sapien
gtcctcagccatgcggcgtttcttg

SEQ ID NO: 189726 - DNA, 25 bp, Homo sapien
gccatgcggcgtttcttggccgcag

SEQ ID NO: 189727 - DNA, 25 bp, Homo sapien
ttggatcacactctgtcacttggtg

SEQ ID NO: 189728 - DNA, 25 bp, Homo sapien
ggattgcatcccgtcactcaatagg

SEQ ID NO: 189729 - DNA, 25 bp, Homo sapien
tgatcgcaccctgtcacttgctgcg

SEQ ID NO: 189730 - DNA, 25 bp, Homo sapien
gcagccactgtgatcgcaacctgtc

SEQ ID NO: 189731 - DNA, 25 bp, Homo sapien
catcacttgctacggccacgatggc

SEQ ID NO: 189732 - DNA, 25 bp, Homo sapien
gatcacattcccgtcactcgctatg

SEQ ID NO: 189733 - DNA, 25 bp, Homo sapien
gtggccacggcagccactcggatca

SEQ ID NO: 189734 - DNA, 25 bp, Homo sapien
atggccacggcaaccactcggattg

SEQ ID NO: 189735 - DNA, 25 bp, Homo sapien
tggacaaaccgcacgccgcagacag

SEQ ID NO: 189736 - DNA, 25 bp, Homo sapien
ggacaaaccgcacgccgcagacagc

SEQ ID NO: 189737 - DNA, 25 bp, Homo sapien
agacagccggtatagtcagttctgc

SEQ ID NO: 189738 - DNA, 25 bp, Homo sapien
cagacagccggtatagtcagttctg

SEQ ID NO: 189739 - DNA, 25 bp, Homo sapien
gcagacagccggtatagtcagttct

SEQ ID NO: 189740 - DNA, 25 bp, Homo sapien
cgcagacagccggtatagtcagttc

SEQ ID NO: 189741 - DNA, 25 bp, Homo sapien
gacaaaccgcacgccgcagacagcc

SEQ ID NO: 189742 - DNA, 25 bp, Homo sapien
gacagccggtatagtcagttctgcc

SEQ ID NO: 189743 - DNA, 25 bp, Homo sapien
cgtggctcggttccacggcgggcag

SEQ ID NO: 189744 - DNA, 25 bp, Homo sapien
ggtgtcggcagagacaggcggaagt

SEQ ID NO: 189745 - DNA, 25 bp, Homo sapien
tctcctgttcctgcgtggctcggtt

SEQ ID NO: 189746 - DNA, 25 bp, Homo sapien
cggaagtggcgtcccgatgaggacg

SEQ ID NO: 189747 - DNA, 25 bp, Homo sapien
gtgcttctcctgttcctgcgtggct

SEQ ID NO: 189748 - DNA, 25 bp, Homo sapien
gtgtgcttctcctgttcctgcgtgg

SEQ ID NO: 189749 - DNA, 25 bp, Homo sapien
cggcgttcgcctggcatttctggcg

SEQ ID NO: 189750 - DNA, 25 bp, Homo sapien
cagcgcggcgttcgcctggcatttc

SEQ ID NO: 189751 - DNA, 25 bp, Homo sapien
tcagacacacgaagacagcaataca

SEQ ID NO: 189752 - DNA, 25 bp, Homo sapien
cagatgttacctcggctggtctcag

SEQ ID NO: 189753 - DNA, 25 bp, Homo sapien
tacagatgttacctcggctggtctc

SEQ ID NO: 189754 - DNA, 25 bp, Homo sapien
cacgaagacagcaatacagatgtta

SEQ ID NO: 189755 - DNA, 25 bp, Homo sapien
gtggttcagacacacgaagacagca

SEQ ID NO: 189756 - DNA, 25 bp, Homo sapien
cgcactcagtggttcagacacacga

SEQ ID NO: 189757 - DNA, 25 bp, Homo sapien
ccacgcactcagtggttcagacaca

SEQ ID NO: 189758 - DNA, 25 bp, Homo sapien
gacagcaatacagatgttacctcgg

SEQ ID NO: 189759 - DNA, 25 bp, Homo sapien
tgaatcacggcctggagttccgatg

SEQ ID NO: 189760 - DNA, 25 bp, Homo sapien
ctgcacccaggaagtgatcccagtc

SEQ ID NO: 189761 - DNA, 25 bp, Homo sapien
tgatcccagtcactcggtgctcggg

SEQ ID NO: 189762 - DNA, 25 bp, Homo sapien
cataccgatggcttcaggtgcctca

SEQ ID NO: 189763 - DNA, 25 bp, Homo sapien
ctctccatgtgtggacatcgctgtc

SEQ ID NO: 189764 - DNA, 25 bp, Homo sapien
agttccgatgcttcgtggccactct

SEQ ID NO: 189765 - DNA, 25 bp, Homo sapien
gctgcacttggggtcatgccacagc

SEQ ID NO: 189766 - DNA, 25 bp, Homo sapien
cctctccatcggctttgaatcacgg

SEQ ID NO: 189767 - DNA, 25 bp, Homo sapien
cggcttcagaaaggcaaggatgctc

SEQ ID NO: 189768 - DNA, 25 bp, Homo sapien
ggaccctggtctaatggtgccacgc

SEQ ID NO: 189769 - DNA, 25 bp, Homo sapien
tgaatctattgcacagtgggtggga

SEQ ID NO: 189770 - DNA, 25 bp, Homo sapien
gggagagctgcctgtgaatctattg

SEQ ID NO: 189771 - DNA, 25 bp, Homo sapien
tgcaaagtcgggatggaaacgcctg

SEQ ID NO: 189772 - DNA, 25 bp, Homo sapien
ggtgaagagaaatcaacgcggcgtc

SEQ ID NO: 189773 - DNA, 25 bp, Homo sapien
aacgcctgtgtaagagtgctgagca

SEQ ID NO: 189774 - DNA, 25 bp, Homo sapien
ctgctacagagcagcgggtgccagc

SEQ ID NO: 189775 - DNA, 25 bp, Homo sapien
gctgcatgtgtgcaagccgctccgt

SEQ ID NO: 189776 - DNA, 25 bp, Homo sapien
gcaagccgctccgtgttggaaaatg

SEQ ID NO: 189777 - DNA, 25 bp, Homo sapien
gtgcaagccgctccgtgttggaaaa

SEQ ID NO: 189778 - DNA, 25 bp, Homo sapien
tgtgcaagccgctccgtgttggaaa

SEQ ID NO: 189779 - DNA, 25 bp, Homo sapien
gtgtgcaagccgctccgtgttggaa

SEQ ID NO: 189780 - DNA, 25 bp, Homo sapien
gcatgtgtgcaagccgctccgtgtt

SEQ ID NO: 189781 - DNA, 25 bp, Homo sapien
ctgcatgtgtgcaagccgctccgtg

SEQ ID NO: 189782 - DNA, 25 bp, Homo sapien
tgcatgtgtgcaagccgctccgtgt

SEQ ID NO: 189783 - DNA, 25 bp, Homo sapien
gcaaccagagaaggcgccacgccat

SEQ ID NO: 189784 - DNA, 25 bp, Homo sapien
cggaggccggtctgcaaccagagaa

SEQ ID NO: 189785 - DNA, 25 bp, Homo sapien
tccgctctcccagctgagctgtctt

SEQ ID NO: 189786 - DNA, 25 bp, Homo sapien
cggcagggagcgaatgcactccagc

SEQ ID NO: 189787 - DNA, 25 bp, Homo sapien
cgtggccagcaacagaaggccggca

SEQ ID NO: 189788 - DNA, 25 bp, Homo sapien
gaggaaccgcagaagggaccgcacc

SEQ ID NO: 189789 - DNA, 25 bp, Homo sapien
ccataggggaccgaggaaccgcaga

SEQ ID NO: 189790 - DNA, 25 bp, Homo sapien
tctgcaaccagagaaggcgccacgc

SEQ ID NO: 189791 - DNA, 25 bp, Homo sapien
agtgattcgcccgagtcacacggcg

SEQ ID NO: 189792 - DNA, 25 bp, Homo sapien
ggctccgtgcgaacgtccattattc

SEQ ID NO: 189793 - DNA, 25 bp, Homo sapien
ccattattccttggctgtttgaagc

SEQ ID NO: 189794 - DNA, 25 bp, Homo sapien
tttgaagccagacacggcccagctg

SEQ ID NO: 189795 - DNA, 25 bp, Homo sapien
tcacgccaggggctgatagataagc

SEQ ID NO: 189796 - DNA, 25 bp, Homo sapien
tgatagataagcaaggccgcagccc

SEQ ID NO: 189797 - DNA, 25 bp, Homo sapien
cctcagggaggagaagtgattcgcc

SEQ ID NO: 189798 - DNA, 25 bp, Homo sapien
gcgctgggaagcatggcgtccaccc

SEQ ID NO: 189799 - DNA, 25 bp, Homo sapien
agtgggattgtgacacccgtggacc

SEQ ID NO: 189800 - DNA, 25 bp, Homo sapien
acagagtggccagaggtgtctcata

SEQ ID NO: 189801 - DNA, 25 bp, Homo sapien
attgtgacacccgtggaccaggaga

SEQ ID NO: 189802 - DNA, 25 bp, Homo sapien
gtgtgggttttgaaatagaatctta

SEQ ID NO: 189803 - DNA, 25 bp, Homo sapien
agtggccagaggtgtctcataaccc

SEQ ID NO: 189804 - DNA, 25 bp, Homo sapien
taagccacatagagctgctagggta

SEQ ID NO: 189805 - DNA, 25 bp, Homo sapien
ccaggccttgtctgtttttctgggc

SEQ ID NO: 189806 - DNA, 25 bp, Homo sapien
gtttttctgggcatcctgggaactg

SEQ ID NO: 189807 - DNA, 25 bp, Homo sapien
tgatgccatacgtgtggatgtcaca

SEQ ID NO: 189808 - DNA, 25 bp, Homo sapien
acacgtgtggatgtcacgcttgtgc

SEQ ID NO: 189809 - DNA, 25 bp, Homo sapien
acgtgtggatgtcacgcttgtgcgc

SEQ ID NO: 189810 - DNA, 25 bp, Homo sapien
cgctgatgtcacgcgtgtggatgtc

SEQ ID NO: 189811 - DNA, 25 bp, Homo sapien
atgtcgcgtgtgtgctgatgccata

SEQ ID NO: 189812 - DNA, 25 bp, Homo sapien
tcgcgtgtgtgctgatgccatacgt

SEQ ID NO: 189813 - DNA, 25 bp, Homo sapien
tgtgctgatgccatacgtgtggatg

SEQ ID NO: 189814 - DNA, 25 bp, Homo sapien
ccatacgtgtggatgtcacacgtgt

SEQ ID NO: 189815 - DNA, 25 bp, Homo sapien
tggcacagcctgtggatcatccacc

SEQ ID NO: 189816 - DNA, 25 bp, Homo sapien
tctcgtcacagagcagagggccgca

SEQ ID NO: 189817 - DNA, 25 bp, Homo sapien
ggcagtgctctcgtcacagagcaga

SEQ ID NO: 189818 - DNA, 25 bp, Homo sapien
gacacagcgtccctgaaccaagggg

SEQ ID NO: 189819 - DNA, 25 bp, Homo sapien
gaggctggacacagcgtccctgaac

SEQ ID NO: 189820 - DNA, 25 bp, Homo sapien
gatcatccaccaggggtgcctgagg

SEQ ID NO: 189821 - DNA, 25 bp, Homo sapien
cagggctgaccgtggcacagcctgt

SEQ ID NO: 189822 - DNA, 25 bp, Homo sapien
ctcagagtgtctccgatggggaggc

SEQ ID NO: 189823 - DNA, 25 bp, Homo sapien
ccacgtagatatcagtgcacggtta

SEQ ID NO: 189824 - DNA, 25 bp, Homo sapien
tgcacggttagtgctgcgtcacacc

SEQ ID NO: 189825 - DNA, 25 bp, Homo sapien
gccgacactcggtcagtaccgtgta

SEQ ID NO: 189826 - DNA, 25 bp, Homo sapien
agtgctgcaccacactgacgcttgg

SEQ ID NO: 189827 - DNA, 25 bp, Homo sapien
accgacgctcggtcagtaccatgta

SEQ ID NO: 189828 - DNA, 25 bp, Homo sapien
tgacgctcagtcagtaccacgtaga

SEQ ID NO: 189829 - DNA, 25 bp, Homo sapien
gctgtgccacgctgacacttggtca

SEQ ID NO: 189830 - DNA, 25 bp, Homo sapien
ccatgtagatatcagtgcacggtta

SEQ ID NO: 189831 - DNA, 25 bp, Homo sapien
tgatcctaagcagaggcgtggcctg

SEQ ID NO: 189832 - DNA, 25 bp, Homo sapien
agccattttcaccaacttccggtgg

SEQ ID NO: 189833 - DNA, 25 bp, Homo sapien
tcagccgcgtcagggtctgcagctc

SEQ ID NO: 189834 - DNA, 25 bp, Homo sapien
gaccagttgcactcggaagccattt

SEQ ID NO: 189835 - DNA, 25 bp, Homo sapien
cctgtgaagggccaccgtgccacaa

SEQ ID NO: 189836 - DNA, 25 bp, Homo sapien
accacgcagcgcatgtgatcctaag

SEQ ID NO: 189837 - DNA, 25 bp, Homo sapien
ggggcaccgtgttagcaacaacgaa

SEQ ID NO: 189838 - DNA, 25 bp, Homo sapien
accgtgccacaaaagctgagctgcc

SEQ ID NO: 189839 - DNA, 25 bp, Homo sapien
cgcagaggtcggagaaaagatttta

SEQ ID NO: 189840 - DNA, 25 bp, Homo sapien
gaaccgcagaggtcggagaaaagat

SEQ ID NO: 189841 - DNA, 25 bp, Homo sapien
aaccgcagaggtcggagaaaagatt

SEQ ID NO: 189842 - DNA, 25 bp, Homo sapien
gtcgggaaccgcagaggtcggagaa

SEQ ID NO: 189843 - DNA, 25 bp, Homo sapien
tcgggaaccgcagaggtcggagaaa

SEQ ID NO: 189844 - DNA, 25 bp, Homo sapien
gcagaggtcggagaaaagattttag

SEQ ID NO: 189845 - DNA, 25 bp, Homo sapien
cagaggtcggagaaaagattttagg

SEQ ID NO: 189846 - DNA, 25 bp, Homo sapien
ccgcagaggtcggagaaaagatttt

SEQ ID NO: 189847 - DNA, 25 bp, Homo sapien
gcagaatctgcactctcggtcccag

SEQ ID NO: 189848 - DNA, 25 bp, Homo sapien
cccggcctgcattgctccagcccgg

SEQ ID NO: 189849 - DNA, 25 bp, Homo sapien
cagctgtctgaagaaaatccggaga

SEQ ID NO: 189850 - DNA, 25 bp, Homo sapien
tgagaaggacacttcgaaggggctc

SEQ ID NO: 189851 - DNA, 25 bp, Homo sapien
ttgggcgtgagaaggacacttcgaa

SEQ ID NO: 189852 - DNA, 25 bp, Homo sapien
ctcagccgggaggtgacgcgcaccc

SEQ ID NO: 189853 - DNA, 25 bp, Homo sapien
ccaggacgaggataaggttgggcgt

SEQ ID NO: 189854 - DNA, 25 bp, Homo sapien
gagcagaatctgcactctcggtccc

SEQ ID NO: 189855 - DNA, 25 bp, Homo sapien
gggcgcttttcacccaaacctgtgc

SEQ ID NO: 189856 - DNA, 25 bp, Homo sapien
ctgcctgtcacgtcagtgtcccggc

SEQ ID NO: 189857 - DNA, 25 bp, Homo sapien
tgccagtacctggacccatcacatg

SEQ ID NO: 189858 - DNA, 25 bp, Homo sapien
aggccaggtgaatcggaactcacct

SEQ ID NO: 189859 - DNA, 25 bp, Homo sapien
aatcggaggccaggtgaatcggaac

SEQ ID NO: 189860 - DNA, 25 bp, Homo sapien
cccatcacatgggaggcggctgcga

SEQ ID NO: 189861 - DNA, 25 bp, Homo sapien
cccaggaaatcggaggccaggtgaa

SEQ ID NO: 189862 - DNA, 25 bp, Homo sapien
agcctccgatggactcagagcccag

SEQ ID NO: 189863 - DNA, 25 bp, Homo sapien
tgaacgggcccattcatgcgccagc

SEQ ID NO: 189864 - DNA, 25 bp, Homo sapien
tactgtgggcctttctcgcaggctc

SEQ ID NO: 189865 - DNA, 25 bp, Homo sapien
aggcactgccattccttgggcccag

SEQ ID NO: 189866 - DNA, 25 bp, Homo sapien
ctcgcaggctctggataaatgactg

SEQ ID NO: 189867 - DNA, 25 bp, Homo sapien
atcaatgcgccttttactgtgggcc

SEQ ID NO: 189868 - DNA, 25 bp, Homo sapien
cacaagggccagttgtctgcacgcc

SEQ ID NO: 189869 - DNA, 25 bp, Homo sapien
actgagggcattcatggcaggttca

SEQ ID NO: 189870 - DNA, 25 bp, Homo sapien
ggactgcggacgtctgactccttca

SEQ ID NO: 189871 - DNA, 25 bp, Homo sapien
aagttggctggacgtctagacccgt

SEQ ID NO: 189872 - DNA, 25 bp, Homo sapien
cggtcgggatgaggacggcgcctcc

SEQ ID NO: 189873 - DNA, 25 bp, Homo sapien
tccgtgggcagtttgggaagcgccc

SEQ ID NO: 189874 - DNA, 25 bp, Homo sapien
aagcgcccgggcaacgtactggcga

SEQ ID NO: 189875 - DNA, 25 bp, Homo sapien
ccattcatcgcggatcggagccggg

SEQ ID NO: 189876 - DNA, 25 bp, Homo sapien
ctccgagcgcggcataggcttgcga

SEQ ID NO: 189877 - DNA, 25 bp, Homo sapien
cccagaggcttttgcagagccggga

SEQ ID NO: 189878 - DNA, 25 bp, Homo sapien
cttttgcagagccgggaagttggct

SEQ ID NO: 189879 - DNA, 25 bp, Homo sapien
cccgagtccggaggaccagaaagtg

SEQ ID NO: 189880 - DNA, 25 bp, Homo sapien
ggccttggccctcctcaggtgctat

SEQ ID NO: 189881 - DNA, 25 bp, Homo sapien
tcctcaggtgctatcggccgtccag

SEQ ID NO: 189882 - DNA, 25 bp, Homo sapien
tcattcctgtgagtccacgtcactc

SEQ ID NO: 189883 - DNA, 25 bp, Homo sapien
gtctgggttcaccaggctggcttca

SEQ ID NO: 189884 - DNA, 25 bp, Homo sapien
ctgcttgcggttgctggtcccgagt

SEQ ID NO: 189885 - DNA, 25 bp, Homo sapien
ccagaaagtgagaccagcgacaacg

SEQ ID NO: 189886 - DNA, 25 bp, Homo sapien
gtcagcacagcctccagatgttctt

SEQ ID NO: 189887 - DNA, 25 bp, Homo sapien
ggagtgccctcccagcggaagaaaa

SEQ ID NO: 189888 - DNA, 25 bp, Homo sapien
cagctgtggccggtctataaataca

SEQ ID NO: 189889 - DNA, 25 bp, Homo sapien
gtggccggtctataaatacattcta

SEQ ID NO: 189890 - DNA, 25 bp, Homo sapien
gcggaccagcccgtgtgcattcctg

SEQ ID NO: 189891 - DNA, 25 bp, Homo sapien
gccaagcggtcactcccggtgagtg

SEQ ID NO: 189892 - DNA, 25 bp, Homo sapien
cccggtgagtgggagcatgcccaca

SEQ ID NO: 189893 - DNA, 25 bp, Homo sapien
cccgcggcatccgattgttagctga

SEQ ID NO: 189894 - DNA, 25 bp, Homo sapien
atacattctaaacgcggaccagccc

SEQ ID NO: 189895 - DNA, 25 bp, Homo sapien
tatttctgagatcaacgcctgcctc

SEQ ID NO: 189896 - DNA, 25 bp, Homo sapien
gcgctgctgaccacatcaccgtagt

SEQ ID NO: 189897 - DNA, 25 bp, Homo sapien
gttccaaacgacagtgacaacggtg

SEQ ID NO: 189898 - DNA, 25 bp, Homo sapien
catcaccgtagtgaatgacttcttt

SEQ ID NO: 189899 - DNA, 25 bp, Homo sapien
tgacttctttctcacggcggctggc

SEQ ID NO: 189900 - DNA, 25 bp, Homo sapien
gctgcgagttctggaacgttccaaa

SEQ ID NO: 189901 - DNA, 25 bp, Homo sapien
caacgcctgcctcagggaacagttg

SEQ ID NO: 189902 - DNA, 25 bp, Homo sapien
cgcgttacagtgaacacggatgcaa

SEQ ID NO: 189903 - DNA, 25 bp, Homo sapien
aggcaggcccaaaacgcgttccctg

SEQ ID NO: 189904 - DNA, 25 bp, Homo sapien
ctgttccggaaggatctggactcgg

SEQ ID NO: 189905 - DNA, 25 bp, Homo sapien
gagctcattctgaagatcgtgcagc

SEQ ID NO: 189906 - DNA, 25 bp, Homo sapien
tcgtgcagcagaagaacaggcgcca

SEQ ID NO: 189907 - DNA, 25 bp, Homo sapien
gcaggctccgcgagtacgacttcgc

SEQ ID NO: 189908 - DNA, 25 bp, Homo sapien
gtacgacttcgcctcggagtccgag

SEQ ID NO: 189909 - DNA, 25 bp, Homo sapien
ccagagaggatgagccacagaaacc

SEQ ID NO: 189910 - DNA, 25 bp, Homo sapien
cagttgaagctgttccggaaggatc

SEQ ID NO: 189911 - DNA, 25 bp, Homo sapien
cctgtccgaggatgaactggagatc

SEQ ID NO: 189912 - DNA, 25 bp, Homo sapien
ctctatggcagcctgtctgcgaaca

SEQ ID NO: 189913 - DNA, 25 bp, Homo sapien
ttggtcaccgaattagaaagtcagc

SEQ ID NO: 189914 - DNA, 25 bp, Homo sapien
aaaggtgctcagtaagacgtgtccc

SEQ ID NO: 189915 - DNA, 25 bp, Homo sapien
cctcacgcgcgttggagaatccact

SEQ ID NO: 189916 - DNA, 25 bp, Homo sapien
tagccattttcctgatctctcgggg

SEQ ID NO: 189917 - DNA, 25 bp, Homo sapien
acgaggacacgttctcggcagctga

SEQ ID NO: 189918 - DNA, 25 bp, Homo sapien
tgctcttatgagtcacctgtccgag

SEQ ID NO: 189919 - DNA, 25 bp, Homo sapien
atgtctacgggaagcgctgtgagaa

SEQ ID NO: 189920 - DNA, 25 bp, Homo sapien
ccatgaggacccgtgggaggacgag

SEQ ID NO: 189921 - DNA, 25 bp, Homo sapien
aggacgaggatcccgcaggtctgcc

SEQ ID NO: 189922 - DNA, 25 bp, Homo sapien
tgcccacggacctcagcgactccag

SEQ ID NO: 189923 - DNA, 25 bp, Homo sapien
acccgcatgtctacgggaagcgctg

SEQ ID NO: 189924 - DNA, 25 bp, Homo sapien
aagaggaacccgcatgtctacggga

SEQ ID NO: 189925 - DNA, 25 bp, Homo sapien
ttgactagaaagaggaacccgcatg

SEQ ID NO: 189926 - DNA, 25 bp, Homo sapien
cggtcgcttgactagaaagaggaac

SEQ ID NO: 189927 - DNA, 25 bp, Homo sapien
tggatgtacaacgagcacctgcgtg

SEQ ID NO: 189928 - DNA, 25 bp, Homo sapien
tggccgacgtctggatgtacaacga

SEQ ID NO: 189929 - DNA, 25 bp, Homo sapien
cacctgcaggagaggcacgcgcaga

SEQ ID NO: 189930 - DNA, 25 bp, Homo sapien
acctgctacatgtgcgtggagcgca

SEQ ID NO: 189931 - DNA, 25 bp, Homo sapien
gcgagctggacctgcacaagctggc

SEQ ID NO: 189932 - DNA, 25 bp, Homo sapien
gtgcaaagtgtgcttccagcgcttc

SEQ ID NO: 189933 - DNA, 25 bp, Homo sapien
gcgggcctcctacaagtgcaaagtg

SEQ ID NO: 189934 - DNA, 25 bp, Homo sapien
accttctgaacagcatcacggaacc

SEQ ID NO: 189935 - DNA, 25 bp, Homo sapien
gcctaatcaatttcgtctccctctg

SEQ ID NO: 189936 - DNA, 25 bp, Homo sapien
atctgcatatgcagcacggcgcggg

SEQ ID NO: 189937 - DNA, 25 bp, Homo sapien
ggagtgaggctcatctgcatatgca

SEQ ID NO: 189938 - DNA, 25 bp, Homo sapien
tctcgttgaatatgaaccgtcaggg

SEQ ID NO: 189939 - DNA, 25 bp, Homo sapien
cctgcattggctgtctcgttgaata

SEQ ID NO: 189940 - DNA, 25 bp, Homo sapien
tgtcctcgccctgcattggctgtct

SEQ ID NO: 189941 - DNA, 25 bp, Homo sapien
gcagcgaaagttgggcaggaaactt

SEQ ID NO: 189942 - DNA, 25 bp, Homo sapien
gatccgctatctgcctcgcggctga

SEQ ID NO: 189943 - DNA, 25 bp, Homo sapien
gcgtgtcctctcctcgaggcggctg

SEQ ID NO: 189944 - DNA, 25 bp, Homo sapien
cgagtcattcctccggtgaagtatg

SEQ ID NO: 189945 - DNA, 25 bp, Homo sapien
ctccggtgaagtatgcccgtgcgtc

SEQ ID NO: 189946 - DNA, 25 bp, Homo sapien
cacggggtgtaggacaaatgctacc

SEQ ID NO: 189947 - DNA, 25 bp, Homo sapien
agggtggcacatgtccgtcactgcc

SEQ ID NO: 189948 - DNA, 25 bp, Homo sapien
cgtcactgccacaggcggttccgaa

SEQ ID NO: 189949 - DNA, 25 bp, Homo sapien
acagtgactgtgctgttagcccggc

SEQ ID NO: 189950 - DNA, 25 bp, Homo sapien
ctggctctgcactggcgtgtcctct

SEQ ID NO: 189951 - DNA, 25 bp, Homo sapien
caagtttccacaggtcggctgagcg

SEQ ID NO: 189952 - DNA, 25 bp, Homo sapien
cctcgggtcctgtgccgagagcttc

SEQ ID NO: 189953 - DNA, 25 bp, Homo sapien
cacccacgttcgtctgcaccatcta

SEQ ID NO: 189954 - DNA, 25 bp, Homo sapien
catctacgcccgtgtcacaaacagc

SEQ ID NO: 189955 - DNA, 25 bp, Homo sapien
ccaagctcgtggctgaaaacaggac

SEQ ID NO: 189956 - DNA, 25 bp, Homo sapien
ctcgtggctgaaaacaggactgacg

SEQ ID NO: 189957 - DNA, 25 bp, Homo sapien
caggactgacgacggaccaagtttc

SEQ ID NO: 189958 - DNA, 25 bp, Homo sapien
tgacgacggaccaagtttccacagg

SEQ ID NO: 189959 - DNA, 25 bp, Homo sapien
ttgtgatcttatctcgcgcggttga

SEQ ID NO: 189960 - DNA, 25 bp, Homo sapien
gccaagcgcgccgtaatctaatctc

SEQ ID NO: 189961 - DNA, 25 bp, Homo sapien
ctgcaagtcccgtcctgataagatc

SEQ ID NO: 189962 - DNA, 25 bp, Homo sapien
ggttgactctcccaggctttgtatc

SEQ ID NO: 189963 - DNA, 25 bp, Homo sapien
tgccctagcgctgaagtcctgaacc

SEQ ID NO: 189964 - DNA, 25 bp, Homo sapien
tgacacctcctggaccctgcaagtg

SEQ ID NO: 189965 - DNA, 25 bp, Homo sapien
tgcacgccactaagtttctcgctgg

SEQ ID NO: 189966 - DNA, 25 bp, Homo sapien
tgagaactaagctgtcggggccact

SEQ ID NO: 189967 - DNA, 25 bp, Homo sapien
tgacacgtgaggatgtggcacggtg

SEQ ID NO: 189968 - DNA, 25 bp, Homo sapien
tgtggcatagggaaacacatcctcg

SEQ ID NO: 189969 - DNA, 25 bp, Homo sapien
gggaaacacatcctcgccgagcgca

SEQ ID NO: 189970 - DNA, 25 bp, Homo sapien
tagggaaacacatcctcgccgagcg

SEQ ID NO: 189971 - DNA, 25 bp, Homo sapien
tcgccgagcgcacagtgggagctcc

SEQ ID NO: 189972 - DNA, 25 bp, Homo sapien
gcatagggaaacacatcctcgccga

SEQ ID NO: 189973 - DNA, 25 bp, Homo sapien
acatcctcgccgagcgcacagtggg

SEQ ID NO: 189974 - DNA, 25 bp, Homo sapien
tgaggatgtggcatagggaaacaca

SEQ ID NO: 189975 - DNA, 25 bp, Homo sapien
tctatcagtggctatcaggcccatc

SEQ ID NO: 189976 - DNA, 25 bp, Homo sapien
gccgcaccgataggatgtggacttg

SEQ ID NO: 189977 - DNA, 25 bp, Homo sapien
tgaatgttgagtaagcgcaggccgc

SEQ ID NO: 189978 - DNA, 25 bp, Homo sapien
accttcagcgtcgataaagtttccg

SEQ ID NO: 189979 - DNA, 25 bp, Homo sapien
ttctccggagtgaagcaatctcatg

SEQ ID NO: 189980 - DNA, 25 bp, Homo sapien
accttcaccctgtgcggtggtcctt

SEQ ID NO: 189981 - DNA, 25 bp, Homo sapien
tcagcccttatcacccatctgggga

SEQ ID NO: 189982 - DNA, 25 bp, Homo sapien
aaagtttccgagttcagcggtgatg

SEQ ID NO: 189983 - DNA, 25 bp, Homo sapien
cgcgataacacagcagcgcaggagc

SEQ ID NO: 189984 - DNA, 25 bp, Homo sapien
ctccttatctgatctaggagccagg

SEQ ID NO: 189985 - DNA, 25 bp, Homo sapien
gccagccttagtgccgcacgcaggt

SEQ ID NO: 189986 - DNA, 25 bp, Homo sapien
agcacatgtggactccgaggccctt

SEQ ID NO: 189987 - DNA, 25 bp, Homo sapien
ggagcctccgttactgcacatgtga

SEQ ID NO: 189988 - DNA, 25 bp, Homo sapien
cgtggtacagccagagctctccctg

SEQ ID NO: 189989 - DNA, 25 bp, Homo sapien
cgtcggcacacgctgctcgtggtac

SEQ ID NO: 189990 - DNA, 25 bp, Homo sapien
ctggcaccgcccgtagtgatagcgt

SEQ ID NO: 189991 - DNA, 25 bp, Homo sapien
ggccggggccacgttccaacatgca

SEQ ID NO: 189992 - DNA, 25 bp, Homo sapien
ccgggaggacgtctgcagacactgc

SEQ ID NO: 189993 - DNA, 25 bp, Homo sapien
ggaacccgccctgacctcagtgctg

SEQ ID NO: 189994 - DNA, 25 bp, Homo sapien
accatttcctcacgttcctgtcggg

SEQ ID NO: 189995 - DNA, 25 bp, Homo sapien
atttcctcacgttcctgtcggggcg

SEQ ID NO: 189996 - DNA, 25 bp, Homo sapien
ggctggtttgcagagcctcccacct

SEQ ID NO: 189997 - DNA, 25 bp, Homo sapien
ctgtctgcccgacggaaaacagatg

SEQ ID NO: 189998 - DNA, 25 bp, Homo sapien
ctgcccgacggaaaacagatggccc

SEQ ID NO: 189999 - DNA, 25 bp, Homo sapien
tcctcaggaccaggcggtgccctat

SEQ ID NO: 190000 - DNA, 25 bp, Homo sapien
gctgttatctctcggggcggcccgt

SEQ ID NO: 190001 - DNA, 25 bp, Homo sapien
ccaaggaggctctgtgggctgttat

SEQ ID NO: 190002 - DNA, 25 bp, Homo sapien
aggctgagctatcacccgcggggaa

SEQ ID NO: 190003 - DNA, 25 bp, Homo sapien
gtggctacggcctatcagacccaca

SEQ ID NO: 190004 - DNA, 25 bp, Homo sapien
tggccaaccgctgcagtggctacgg

SEQ ID NO: 190005 - DNA, 25 bp, Homo sapien
gtgccctatcggctcccgcagatat

SEQ ID NO: 190006 - DNA, 25 bp, Homo sapien
cggctcccgcagatatgaatttctg

SEQ ID NO: 190007 - DNA, 25 bp, Homo sapien
cggagagctgtcctggcatgcacat

SEQ ID NO: 190008 - DNA, 25 bp, Homo sapien
tgtcctggcatgcacatggccattg

SEQ ID NO: 190009 - DNA, 25 bp, Homo sapien
tcccagagccctaaaaaggatcagg

SEQ ID NO: 190010 - DNA, 25 bp, Homo sapien
gtcttgacttcccatgatctcctgg

SEQ ID NO: 190011 - DNA, 25 bp, Homo sapien
ccatgatctcctggccctgttactg

SEQ ID NO: 190012 - DNA, 25 bp, Homo sapien
tggccctacctgatacctggtggtc

SEQ ID NO: 190013 - DNA, 25 bp, Homo sapien
ctggtggtcccagagccctaaaaag

SEQ ID NO: 190014 - DNA, 25 bp, Homo sapien
tgcacatggccattgtcttgacttc

SEQ ID NO: 190015 - DNA, 25 bp, Homo sapien
atctgactaatctcgccggcggagc

SEQ ID NO: 190016 - DNA, 25 bp, Homo sapien
acctcaaggcctgctatcgggtgga

SEQ ID NO: 190017 - DNA, 25 bp, Homo sapien
gccggcggagcgtctacgcaaacct

SEQ ID NO: 190018 - DNA, 25 bp, Homo sapien
tgggccgagctccatctgactaatc

SEQ ID NO: 190019 - DNA, 25 bp, Homo sapien
ctgggaatcctcacccgagtgtgtg

SEQ ID NO: 190020 - DNA, 25 bp, Homo sapien
tttcctgcctgaggcccacgaaggg

SEQ ID NO: 190021 - DNA, 25 bp, Homo sapien
gctctgtccactatttcctgcctga

SEQ ID NO: 190022 - DNA, 25 bp, Homo sapien
tgccgtgagcgatccggtccagcat

SEQ ID NO: 190023 - DNA, 25 bp, Homo sapien
gcccgatgacatctcagtaatcagg

SEQ ID NO: 190024 - DNA, 25 bp, Homo sapien
gtaatcagggtggaggatagcttca

SEQ ID NO: 190025 - DNA, 25 bp, Homo sapien
ctgactggtacctatcgacttggtc

SEQ ID NO: 190026 - DNA, 25 bp, Homo sapien
tcgacttggtcaaattggagatccc

SEQ ID NO: 190027 - DNA, 25 bp, Homo sapien
ctcagcaacgagcatcttcacagta

SEQ ID NO: 190028 - DNA, 25 bp, Homo sapien
tcttcacagtatctacgagagcagc

SEQ ID NO: 190029 - DNA, 25 bp, Homo sapien
tcaacgacaagcttcagggcctggg

SEQ ID NO: 190030 - DNA, 25 bp, Homo sapien
ggtgcgcccagtgcatcaacgacaa

SEQ ID NO: 190031 - DNA, 25 bp, Homo sapien
ggctgccctcagagcgctcgccacc

SEQ ID NO: 190032 - DNA, 25 bp, Homo sapien
gcctttagctgtcgttcctccaacc

SEQ ID NO: 190033 - DNA, 25 bp, Homo sapien
atgcccgtttgtgggtctctgcaca

SEQ ID NO: 190034 - DNA, 25 bp, Homo sapien
gcccgtttgtgggtctctgcacaca

SEQ ID NO: 190035 - DNA, 25 bp, Homo sapien
cggacggcagatccggggctgccct

SEQ ID NO: 190036 - DNA, 25 bp, Homo sapien
cacccgcctttagctgtcgttcctc

SEQ ID NO: 190037 - DNA, 25 bp, Homo sapien
aaggctgtgtgcggtctcttcggca

SEQ ID NO: 190038 - DNA, 25 bp, Homo sapien
ctgcacacacggtggccggacggca

SEQ ID NO: 190039 - DNA, 25 bp, Homo sapien
cgttgttccttccatctcggctgtc

SEQ ID NO: 190040 - DNA, 25 bp, Homo sapien
actcctatctgtgaacggggaaggg

SEQ ID NO: 190041 - DNA, 25 bp, Homo sapien
ccgctcggcgactcctatctgtgaa

SEQ ID NO: 190042 - DNA, 25 bp, Homo sapien
atctcggctgtcccgagtgccacag

SEQ ID NO: 190043 - DNA, 25 bp, Homo sapien
agcgcatgtcacgttgttccttcca

SEQ ID NO: 190044 - DNA, 25 bp, Homo sapien
gcggctccgtctcccttctcgctag

SEQ ID NO: 190045 - DNA, 25 bp, Homo sapien
tcggcgactcctatctgtgaacggg

SEQ ID NO: 190046 - DNA, 25 bp, Homo sapien
ttctcgctagcgcatgtcacgttgt

SEQ ID NO: 190047 - DNA, 25 bp, Homo sapien
tgcgtgcagcgtcagcacagttgcg

SEQ ID NO: 190048 - DNA, 25 bp, Homo sapien
ccacagaaaaatcgggggtgcgtgc

SEQ ID NO: 190049 - DNA, 25 bp, Homo sapien
ccggatgggagcctcaccctccttc

SEQ ID NO: 190050 - DNA, 25 bp, Homo sapien
ctcgggaccgccacagaaaaatcgg

SEQ ID NO: 190051 - DNA, 25 bp, Homo sapien
gcctgccctccactcgggaccgcca

SEQ ID NO: 190052 - DNA, 25 bp, Homo sapien
ccacatacgcggggtgcactcggcg

SEQ ID NO: 190053 - DNA, 25 bp, Homo sapien
ggtgccggatgggagcctcaccctc

SEQ ID NO: 190054 - DNA, 25 bp, Homo sapien
tgcagcgtcagcacagttgcggcgc

SEQ ID NO: 190055 - DNA, 25 bp, Homo sapien
gcccactgctgtcccgagagacaaa

SEQ ID NO: 190056 - DNA, 25 bp, Homo sapien
cacagacgagaagcccaaagagacc

SEQ ID NO: 190057 - DNA, 25 bp, Homo sapien
cctcaaggtgcacacggacacgctg

SEQ ID NO: 190058 - DNA, 25 bp, Homo sapien
agctccctggagatccacatgcgca

SEQ ID NO: 190059 - DNA, 25 bp, Homo sapien
tccctggagtcccaaggttaagctg

SEQ ID NO: 190060 - DNA, 25 bp, Homo sapien
actgtgggctatctgggtagtcagc

SEQ ID NO: 190061 - DNA, 25 bp, Homo sapien
ccgggaaaacccacatgcaagcaca

SEQ ID NO: 190062 - DNA, 25 bp, Homo sapien
tgcctgatctgcctgtcggccttca

SEQ ID NO: 190063 - DNA, 25 bp, Homo sapien
actacgtgcacaagcgcctctactg

SEQ ID NO: 190064 - DNA, 25 bp, Homo sapien
atcgacctgagcaagaagccgcggc

SEQ ID NO: 190065 - DNA, 25 bp, Homo sapien
tgcacaagcggtactactgcgcctc

SEQ ID NO: 190066 - DNA, 25 bp, Homo sapien
tgcgaggcctgcaacatccgcttca

SEQ ID NO: 190067 - DNA, 25 bp, Homo sapien
ctggccgactaccacgagtgcacgg

SEQ ID NO: 190068 - DNA, 25 bp, Homo sapien
acctggcgcacaagaagtactcgtg

SEQ ID NO: 190069 - DNA, 25 bp, Homo sapien
ggacctgctggagcatttccgcctg

SEQ ID NO: 190070 - DNA, 25 bp, Homo sapien
tacgtgcttcgagtgcgagatcacc

SEQ ID NO: 190071 - DNA, 25 bp, Homo sapien
agttaaagatgtgcggtgagtcccg

SEQ ID NO: 190072 - DNA, 25 bp, Homo sapien
gggtgtgagtcaggcatcctcccgt

SEQ ID NO: 190073 - DNA, 25 bp, Homo sapien
aggcatcctcccgttccctggtggt

SEQ ID NO: 190074 - DNA, 25 bp, Homo sapien
gggaaatgacaaaagagtctcgctc

SEQ ID NO: 190075 - DNA, 25 bp, Homo sapien
ccctggtggtgtgagtcccgcatcc

SEQ ID NO: 190076 - DNA, 25 bp, Homo sapien
ctccaggggtgtgagtcccatgtcc

SEQ ID NO: 190077 - DNA, 25 bp, Homo sapien
gggttcaagcgttcatcctgccgca

SEQ ID NO: 190078 - DNA, 25 bp, Homo sapien
cccagcagatgggattaggagttaa

SEQ ID NO: 190079 - DNA, 25 bp, Homo sapien
aggggaccttgagacaggcaccacc

SEQ ID NO: 190080 - DNA, 25 bp, Homo sapien
gaagggccaagggacgtcttctcca

SEQ ID NO: 190081 - DNA, 25 bp, Homo sapien
agcctggagccagaacctgtgaaga

SEQ ID NO: 190082 - DNA, 25 bp, Homo sapien
tcgcggcctgatgacgtcgcacaat

SEQ ID NO: 190083 - DNA, 25 bp, Homo sapien
cagcccgacgaagaccgccttaagt

SEQ ID NO: 190084 - DNA, 25 bp, Homo sapien
taaagcaggaagtatcagcccgacg

SEQ ID NO: 190085 - DNA, 25 bp, Homo sapien
attccggaggtaagcatttaatatc

SEQ ID NO: 190086 - DNA, 25 bp, Homo sapien
cagcccacgggaaaggtaagaattg

SEQ ID NO: 190087 - DNA, 25 bp, Homo sapien
tcctgtttaaattgccacctggtcg

SEQ ID NO: 190088 - DNA, 25 bp, Homo sapien
gcctgtccttgagcggagccagctc

SEQ ID NO: 190089 - DNA, 25 bp, Homo sapien
cacggcacagcccactgggcttgaa

SEQ ID NO: 190090 - DNA, 25 bp, Homo sapien
gccgtgtcagtgtggcctccctgga

SEQ ID NO: 190091 - DNA, 25 bp, Homo sapien
cgtgcatgagctcccgcatctgtaa

SEQ ID NO: 190092 - DNA, 25 bp, Homo sapien
ctgggatcctccacgtgcatgagct

SEQ ID NO: 190093 - DNA, 25 bp, Homo sapien
cttgaacgcgggtcacgccacggct

SEQ ID NO: 190094 - DNA, 25 bp, Homo sapien
tgcgcacagacgcagcacggcacag

SEQ ID NO: 190095 - DNA, 25 bp, Homo sapien
agtcttgcccaacccggtatttctg

SEQ ID NO: 190096 - DNA, 25 bp, Homo sapien
cagccaacgtcccatgacgattttg

SEQ ID NO: 190097 - DNA, 25 bp, Homo sapien
aggacactcctgtgcccgagggctc

SEQ ID NO: 190098 - DNA, 25 bp, Homo sapien
tcgttccgcatctccggaccagggt

SEQ ID NO: 190099 - DNA, 25 bp, Homo sapien
ggtatttctgcgcttgcctcagcca

SEQ ID NO: 190100 - DNA, 25 bp, Homo sapien
acagcgctgagaacacgcggaaggt

SEQ ID NO: 190101 - DNA, 25 bp, Homo sapien
gtcccacctcagaaccagagcaaag

SEQ ID NO: 190102 - DNA, 25 bp, Homo sapien
acacacctgcgttgtgggcagccgg

SEQ ID NO: 190103 - DNA, 25 bp, Homo sapien
tgaggaccgctatccacagaagctg

SEQ ID NO: 190104 - DNA, 25 bp, Homo sapien
cgctatccacagaagctggccttcg

SEQ ID NO: 190105 - DNA, 25 bp, Homo sapien
ctggccttcgccgagtgcctgtgca

SEQ ID NO: 190106 - DNA, 25 bp, Homo sapien
cgagtgcctgtgcagaggctgtatc

SEQ ID NO: 190107 - DNA, 25 bp, Homo sapien
cagaggctgtatcgatgcacggacg

SEQ ID NO: 190108 - DNA, 25 bp, Homo sapien
ggccgcgagacagctgcgctcaact

SEQ ID NO: 190109 - DNA, 25 bp, Homo sapien
cgtcccgcagtgtggacacggatga

SEQ ID NO: 190110 - DNA, 25 bp, Homo sapien
gtggacacggatgaggaccgctatc

SEQ ID NO: 190111 - DNA, 25 bp, Homo sapien
cttgctgaaaggtttacctttggag

SEQ ID NO: 190112 - DNA, 25 bp, Homo sapien
cctgctctggtcacaatgtggggtc

SEQ ID NO: 190113 - DNA, 25 bp, Homo sapien
tgctctggtcacaatgtggggtcgc

SEQ ID NO: 190114 - DNA, 25 bp, Homo sapien
gctctggtcacaatgtggggtcgcc

SEQ ID NO: 190115 - DNA, 25 bp, Homo sapien
ctctggtcacaatgtggggtcgccc

SEQ ID NO: 190116 - DNA, 25 bp, Homo sapien
aattttcggtaatacaaacctgcag

SEQ ID NO: 190117 - DNA, 25 bp, Homo sapien
accagtgggagcatgaccaggaggt

SEQ ID NO: 190118 - DNA, 25 bp, Homo sapien
atttcattcctgctcatgcctttca

SEQ ID NO: 190119 - DNA, 25 bp, Homo sapien
tacccgggatttcgtgtgctgctga

SEQ ID NO: 190120 - DNA, 25 bp, Homo sapien
ggctcgatgggcgtccactgctcgc

SEQ ID NO: 190121 - DNA, 25 bp, Homo sapien
ggctgcttgatggtgcctccgatct

SEQ ID NO: 190122 - DNA, 25 bp, Homo sapien
acacgacctcgtcggtcaccgggat

SEQ ID NO: 190123 - DNA, 25 bp, Homo sapien
gtccggggcgaggtcacacgacctc

SEQ ID NO: 190124 - DNA, 25 bp, Homo sapien
tcccggcttcgctgcatttattgca

SEQ ID NO: 190125 - DNA, 25 bp, Homo sapien
ggcgatgctgatgttaatgaaactg

SEQ ID NO: 190126 - DNA, 25 bp, Homo sapien
aatgaaactggaatgcggcccggct

SEQ ID NO: 190127 - DNA, 25 bp, Homo sapien
ggacgccagcgcctgttcgttggcc

SEQ ID NO: 190128 - DNA, 25 bp, Homo sapien
ggggtctcagaactcctccttccag

SEQ ID NO: 190129 - DNA, 25 bp, Homo sapien
gctgcaacttcctccttcgcggagt

SEQ ID NO: 190130 - DNA, 25 bp, Homo sapien
ctgacgtgcactcactcaggccgga

SEQ ID NO: 190131 - DNA, 25 bp, Homo sapien
tggcgacacgaacccggctgggaca

SEQ ID NO: 190132 - DNA, 25 bp, Homo sapien
tgggacactgctaggcgcgcactgc

SEQ ID NO: 190133 - DNA, 25 bp, Homo sapien
cggagacccgcatctgtagggtgca

SEQ ID NO: 190134 - DNA, 25 bp, Homo sapien
tgtaagtagcccgaggtcccggctg

SEQ ID NO: 190135 - DNA, 25 bp, Homo sapien
agacacgcgctacagcgcgagcgca

SEQ ID NO: 190136 - DNA, 25 bp, Homo sapien
actcggcccggaactgcaaggcaca

SEQ ID NO: 190137 - DNA, 25 bp, Homo sapien
ggaagtctcgctcccggatgcagcg

SEQ ID NO: 190138 - DNA, 25 bp, Homo sapien
gcgaagctggggaagtctcgctccc

SEQ ID NO: 190139 - DNA, 25 bp, Homo sapien
gtggaactggttgctgtccttcatg

SEQ ID NO: 190140 - DNA, 25 bp, Homo sapien
gcagcacaagcctagacacgcgcta

SEQ ID NO: 190141 - DNA, 25 bp, Homo sapien
gtctccacggcagcacaagcctaga

SEQ ID NO: 190142 - DNA, 25 bp, Homo sapien
tgctgtccttcatggtcagctgggc

SEQ ID NO: 190143 - DNA, 25 bp, Homo sapien
gccacttgccgagcgatgctgtcct

SEQ ID NO: 190144 - DNA, 25 bp, Homo sapien
gagaggtcactctccacgccgtaga

SEQ ID NO: 190145 - DNA, 25 bp, Homo sapien
gagccacttctgagaggtcactctc

SEQ ID NO: 190146 - DNA, 25 bp, Homo sapien
cggcgagccacttctgagaggtcac

SEQ ID NO: 190147 - DNA, 25 bp, Homo sapien
gctctcccatctgccactccacaaa

SEQ ID NO: 190148 - DNA, 25 bp, Homo sapien
gaggtcactctccacgccgtagaca

SEQ ID NO: 190149 - DNA, 25 bp, Homo sapien
gagcgatgctgtccttcccgtcggc

SEQ ID NO: 190150 - DNA, 25 bp, Homo sapien
acttgccgagcgatgctgtccttcc

SEQ ID NO: 190151 - DNA, 25 bp, Homo sapien
gcggcttcgctaagcacaccatctg

SEQ ID NO: 190152 - DNA, 25 bp, Homo sapien
gcgtggtgcttcagctgaagtctta

SEQ ID NO: 190153 - DNA, 25 bp, Homo sapien
accatctgctcggttttgtgcgagg

SEQ ID NO: 190154 - DNA, 25 bp, Homo sapien
gtctctgaggatggcggacagttcc

SEQ ID NO: 190155 - DNA, 25 bp, Homo sapien
aagtcttattccacggcggcttcgc

SEQ ID NO: 190156 - DNA, 25 bp, Homo sapien
cggacagttccaggggtgataaacg

SEQ ID NO: 190157 - DNA, 25 bp, Homo sapien
gtgataaacgcggacacctggcaga

SEQ ID NO: 190158 - DNA, 25 bp, Homo sapien
gaggctctttcacgcacagcactga

SEQ ID NO: 190159 - DNA, 25 bp, Homo sapien
cttgatgaccgcgatgttgaccggc

SEQ ID NO: 190160 - DNA, 25 bp, Homo sapien
ctgtgccctccttgaagctcttgga

SEQ ID NO: 190161 - DNA, 25 bp, Homo sapien
gtcgggcgcacgcattacctctcag

SEQ ID NO: 190162 - DNA, 25 bp, Homo sapien
tcctcacgcgctaccacaggattgg

SEQ ID NO: 190163 - DNA, 25 bp, Homo sapien
aggccatggtcccaccgcgcagtga

SEQ ID NO: 190164 - DNA, 25 bp, Homo sapien
tgtacaagtgactgccgccagcggc

SEQ ID NO: 190165 - DNA, 25 bp, Homo sapien
ccgcggcactcacagtacttgatga

SEQ ID NO: 190166 - DNA, 25 bp, Homo sapien
gttgaccggcgctgtacaagtgact

SEQ ID NO: 190167 - DNA, 25 bp, Homo sapien
tcgacctcgctgacttccaaggcgt

SEQ ID NO: 190168 - DNA, 25 bp, Homo sapien
agcttcctcgatccgtggcaggagg

SEQ ID NO: 190169 - DNA, 25 bp, Homo sapien
gagggtcgacctcgctgacttccaa

SEQ ID NO: 190170 - DNA, 25 bp, Homo sapien
tctttgaggggtacaatggcggccc

SEQ ID NO: 190171 - DNA, 25 bp, Homo sapien
gttcaggctgtctttgaggggtaca

SEQ ID NO: 190172 - DNA, 25 bp, Homo sapien
ggaccaccgtgtgggcagcaccagc

SEQ ID NO: 190173 - DNA, 25 bp, Homo sapien
caagcagtttttccggagccccgtg

SEQ ID NO: 190174 - DNA, 25 bp, Homo sapien
ccagagcttcctcgatccgtggcag

SEQ ID NO: 190175 - DNA, 25 bp, Homo sapien
aatgacgctcactctgcggcctggc

SEQ ID NO: 190176 - DNA, 25 bp, Homo sapien
aggctcattagcatagcgcgccgcc

SEQ ID NO: 190177 - DNA, 25 bp, Homo sapien
tgtgtggaaaccgagcgagaatctc

SEQ ID NO: 190178 - DNA, 25 bp, Homo sapien
gcgagaatctcttccacagaatgtg

SEQ ID NO: 190179 - DNA, 25 bp, Homo sapien
cccttgctgcggagaatgacgctca

SEQ ID NO: 190180 - DNA, 25 bp, Homo sapien
ggtagtcagtacctctctgcgtctc

SEQ ID NO: 190181 - DNA, 25 bp, Homo sapien
tggagtgcgttttcaccaggaagga

SEQ ID NO: 190182 - DNA, 25 bp, Homo sapien
cggtccttggagaacccttgctgcg

SEQ ID NO: 190183 - DNA, 25 bp, Homo sapien
cgcaccagcgttctttcatttactc

SEQ ID NO: 190184 - DNA, 25 bp, Homo sapien
attgtccctgcgtgacgatgtcctg

SEQ ID NO: 190185 - DNA, 25 bp, Homo sapien
gagggcagttccctcaatagctgcc

SEQ ID NO: 190186 - DNA, 25 bp, Homo sapien
tcacgtcgccggctgctctttcagg

SEQ ID NO: 190187 - DNA, 25 bp, Homo sapien
tcggtcagaatctaccctgccgctt

SEQ ID NO: 190188 - DNA, 25 bp, Homo sapien
acgatgtcctggtcgcctgtgagct

SEQ ID NO: 190189 - DNA, 25 bp, Homo sapien
ggcattgaagcagcctcggtcagaa

SEQ ID NO: 190190 - DNA, 25 bp, Homo sapien
catttactcaaccaagggtgagggc

SEQ ID NO: 190191 - DNA, 25 bp, Homo sapien
cggccagaagcaccgaagaacccag

SEQ ID NO: 190192 - DNA, 25 bp, Homo sapien
tgcgacacaggagcggggacatccc

SEQ ID NO: 190193 - DNA, 25 bp, Homo sapien
tcagtccggtgaggtgcgctcccga

SEQ ID NO: 190194 - DNA, 25 bp, Homo sapien
cctcctgtgagctcagtccggtgag

SEQ ID NO: 190195 - DNA, 25 bp, Homo sapien
tggcccgtattcaggcccggaggct

SEQ ID NO: 190196 - DNA, 25 bp, Homo sapien
ttcttcccacgagggggtatcatgg

SEQ ID NO: 190197 - DNA, 25 bp, Homo sapien
tcatggctttgaagagacggcggca

SEQ ID NO: 190198 - DNA, 25 bp, Homo sapien
acaggagcggggacatccctgaccc

SEQ ID NO: 190199 - DNA, 25 bp, Homo sapien
agcgagttattcagtgcgcgtcacc

SEQ ID NO: 190200 - DNA, 25 bp, Homo sapien
tgcgcgtcaccctgaaggactcatg

SEQ ID NO: 190201 - DNA, 25 bp, Homo sapien
accctgaaggactcatggacactcc

SEQ ID NO: 190202 - DNA, 25 bp, Homo sapien
tgctgctcgggcagccaagttccca

SEQ ID NO: 190203 - DNA, 25 bp, Homo sapien
aggctcctgggccttgtactgtccc

SEQ ID NO: 190204 - DNA, 25 bp, Homo sapien
tgtcccggtgacaagcgagttattc

SEQ ID NO: 190205 - DNA, 25 bp, Homo sapien
cactgctcaccacgcggttggggtc

SEQ ID NO: 190206 - DNA, 25 bp, Homo sapien
tcgcttggggcaggcactgctcacc

SEQ ID NO: 190207 - DNA, 25 bp, Homo sapien
aggggacttactccactggctcgcg

SEQ ID NO: 190208 - DNA, 25 bp, Homo sapien
ctagcactcggggaatgcctgtcaa

SEQ ID NO: 190209 - DNA, 25 bp, Homo sapien
gcggaacatagccatcccggggcca

SEQ ID NO: 190210 - DNA, 25 bp, Homo sapien
aggccaccaggctgcggaacatagc

SEQ ID NO: 190211 - DNA, 25 bp, Homo sapien
ggccggtgatagacctccaggcaga

SEQ ID NO: 190212 - DNA, 25 bp, Homo sapien
gcccggtgaaccgaagcagcagtcg

SEQ ID NO: 190213 - DNA, 25 bp, Homo sapien
tgctgccctctgagtaccggagcgc

SEQ ID NO: 190214 - DNA, 25 bp, Homo sapien
tgtcaagcggtgacggccacctaga

SEQ ID NO: 190215 - DNA, 25 bp, Homo sapien
cacttgatcatggtctccggtgagc

SEQ ID NO: 190216 - DNA, 25 bp, Homo sapien
tgagcttggcgtacaactcctcctc

SEQ ID NO: 190217 - DNA, 25 bp, Homo sapien
gagtctcccgcaccaggaagatgtc

SEQ ID NO: 190218 - DNA, 25 bp, Homo sapien
gcacggcagctcctcgaacataatg

SEQ ID NO: 190219 - DNA, 25 bp, Homo sapien
acttgccgatgaccagcacgatgga

SEQ ID NO: 190220 - DNA, 25 bp, Homo sapien
tgggctgaccttgtcactgaaaatg

SEQ ID NO: 190221 - DNA, 25 bp, Homo sapien
gacgcagtgtccttctctgacagca

SEQ ID NO: 190222 - DNA, 25 bp, Homo sapien
atgacccaccattcgaggaagccgg

SEQ ID NO: 190223 - DNA, 25 bp, Homo sapien
gcttataccgatggctgccgctcct

SEQ ID NO: 190224 - DNA, 25 bp, Homo sapien
atggctgccgctcctttccgtgctg

SEQ ID NO: 190225 - DNA, 25 bp, Homo sapien
cttccttcttctaaaacgtagactg

SEQ ID NO: 190226 - DNA, 25 bp, Homo sapien
acgtagactgatgcgcctcgtatca

SEQ ID NO: 190227 - DNA, 25 bp, Homo sapien
atgcgcctcgtatcacggggcctga

SEQ ID NO: 190228 - DNA, 25 bp, Homo sapien
gcctgagctccacttggggttctgg

SEQ ID NO: 190229 - DNA, 25 bp, Homo sapien
cgaccctggcttccacctgaatgtg

SEQ ID NO: 190230 - DNA, 25 bp, Homo sapien
cacctgaatgtggtcttcggtggtg

SEQ ID NO: 190231 - DNA, 25 bp, Homo sapien
ccgaaggcatgacggcccgatctgt

SEQ ID NO: 190232 - DNA, 25 bp, Homo sapien
catggcccacaggaagacgagcacg

SEQ ID NO: 190233 - DNA, 25 bp, Homo sapien
gttgccggtcacagtcagtctcctg

SEQ ID NO: 190234 - DNA, 25 bp, Homo sapien
cgtccgcatcagtccctggtacaga

SEQ ID NO: 190235 - DNA, 25 bp, Homo sapien
tctgtcatgctgctgagtggctcct

SEQ ID NO: 190236 - DNA, 25 bp, Homo sapien
ggaagccgagtcacagagaatcctg

SEQ ID NO: 190237 - DNA, 25 bp, Homo sapien
gagaatcctgctctatggcctgacc

SEQ ID NO: 190238 - DNA, 25 bp, Homo sapien
gcctggcttgtgtacagctgatcca

SEQ ID NO: 190239 - DNA, 25 bp, Homo sapien
aggtatcggaagacggccaccttca

SEQ ID NO: 190240 - DNA, 25 bp, Homo sapien
gaggctcaccgacagcatgttcttg

SEQ ID NO: 190241 - DNA, 25 bp, Homo sapien
cgttgtacagaatgaggcagtccca

SEQ ID NO: 190242 - DNA, 25 bp, Homo sapien
agcaccagccagaacaggtatcgga

SEQ ID NO: 190243 - DNA, 25 bp, Homo sapien
cttcagcatgtcaaggtaggacctg

SEQ ID NO: 190244 - DNA, 25 bp, Homo sapien
acgtggaacccacctgcagtggata

SEQ ID NO: 190245 - DNA, 25 bp, Homo sapien
tgtgcgctcagctgagaacacctgc

SEQ ID NO: 190246 - DNA, 25 bp, Homo sapien
tagcccagcccgaagatgctgatgc

SEQ ID NO: 190247 - DNA, 25 bp, Homo sapien
ggtcagctcgtgcacgatgcagtta

SEQ ID NO: 190248 - DNA, 25 bp, Homo sapien
ctgtgggcaagcagcgctgagccat

SEQ ID NO: 190249 - DNA, 25 bp, Homo sapien
gatgcagttatcagcctcggtgtcg

SEQ ID NO: 190250 - DNA, 25 bp, Homo sapien
accttgcagtgtgcggtactcacca

SEQ ID NO: 190251 - DNA, 25 bp, Homo sapien
gcacccagccataccttgcagtgtg

SEQ ID NO: 190252 - DNA, 25 bp, Homo sapien
atgcgagagcgccaggcggccacca

SEQ ID NO: 190253 - DNA, 25 bp, Homo sapien
gtcactgacaccgacccgtggatgt

SEQ ID NO: 190254 - DNA, 25 bp, Homo sapien
gcaccacgtgctgtgggcaagcagc

SEQ ID NO: 190255 - DNA, 25 bp, Homo sapien
atatctcacacacgccacgacacgg

SEQ ID NO: 190256 - DNA, 25 bp, Homo sapien
cgttaactaggtcgccaacagagga

SEQ ID NO: 190257 - DNA, 25 bp, Homo sapien
aactaggtcgccaacagaggatggc

SEQ ID NO: 190258 - DNA, 25 bp, Homo sapien
cagaggacagcgcacccacggccca

SEQ ID NO: 190259 - DNA, 25 bp, Homo sapien
ccacggcccagctcgtcacaccgcc

SEQ ID NO: 190260 - DNA, 25 bp, Homo sapien
agccagagccgtggaagccgcctcg

SEQ ID NO: 190261 - DNA, 25 bp, Homo sapien
ctcgcgcttccgtacatatctcaca

SEQ ID NO: 190262 - DNA, 25 bp, Homo sapien
gagatgggcgttaactaggtcgcca

SEQ ID NO: 190263 - DNA, 25 bp, Homo sapien
gaggcctaaccagagggtggacaca

SEQ ID NO: 190264 - DNA, 25 bp, Homo sapien
ctccacgcctgcacaggagctgaaa

SEQ ID NO: 190265 - DNA, 25 bp, Homo sapien
cactagccgaggaccacgactgtca

SEQ ID NO: 190266 - DNA, 25 bp, Homo sapien
cgtacagtcctgtggcactagccga

SEQ ID NO: 190267 - DNA, 25 bp, Homo sapien
ctgggtgatctgtcccgtacagtcc

SEQ ID NO: 190268 - DNA, 25 bp, Homo sapien
ggagctgaggctgcatcacagagca

SEQ ID NO: 190269 - DNA, 25 bp, Homo sapien
ggtggacacacctgcggccatcagg

SEQ ID NO: 190270 - DNA, 25 bp, Homo sapien
tgtcacctccacattgcagacgagg

SEQ ID NO: 190271 - DNA, 25 bp, Homo sapien
cctgtgcaaagccaaggatttcctc

SEQ ID NO: 190272 - DNA, 25 bp, Homo sapien
tccctcccggctgttccaggcgcac

SEQ ID NO: 190273 - DNA, 25 bp, Homo sapien
tggacacttcctgaacgcgtgtgtc

SEQ ID NO: 190274 - DNA, 25 bp, Homo sapien
ggcctgcacgtggacacttcctgaa

SEQ ID NO: 190275 - DNA, 25 bp, Homo sapien
ctgggaacctgcatctggggctgac

SEQ ID NO: 190276 - DNA, 25 bp, Homo sapien
ccaaggatttcctcggagccggagc

SEQ ID NO: 190277 - DNA, 25 bp, Homo sapien
cccagggcctgtgcaaagccaagga

SEQ ID NO: 190278 - DNA, 25 bp, Homo sapien
agccggcgcagctgcaagcacacgt

SEQ ID NO: 190279 - DNA, 25 bp, Homo sapien
caggccctcctgagactctatgccc

SEQ ID NO: 190280 - DNA, 25 bp, Homo sapien
tcctgagactctatgcccgtccacc

SEQ ID NO: 190281 - DNA, 25 bp, Homo sapien
cccaggccctcctgagactctatgc

SEQ ID NO: 190282 - DNA, 25 bp, Homo sapien
aggccctcctgagactctatgcccg

SEQ ID NO: 190283 - DNA, 25 bp, Homo sapien
cctgagactctatgcccgtccaccc

SEQ ID NO: 190284 - DNA, 25 bp, Homo sapien
ccctcctgagactctatgcccgtcc

SEQ ID NO: 190285 - DNA, 25 bp, Homo sapien
ctgagactctatgcccgtccacccg

SEQ ID NO: 190286 - DNA, 25 bp, Homo sapien
ccaggccctcctgagactctatgcc

SEQ ID NO: 190287 - DNA, 25 bp, Homo sapien
aatcgggtggccacgcacgtcggcc

SEQ ID NO: 190288 - DNA, 25 bp, Homo sapien
cacgtcggcctaaggggccctggca

SEQ ID NO: 190289 - DNA, 25 bp, Homo sapien
ggacagccgtccactgcacacctca

SEQ ID NO: 190290 - DNA, 25 bp, Homo sapien
tccaccgtggagaaacatgaacgtg

SEQ ID NO: 190291 - DNA, 25 bp, Homo sapien
caaaaatacggcctgcggtgggtgt

SEQ ID NO: 190292 - DNA, 25 bp, Homo sapien
tgaacgtgagcaaaaatacggcctg

SEQ ID NO: 190293 - DNA, 25 bp, Homo sapien
gatcctcacccgcacacaggaaggg

SEQ ID NO: 190294 - DNA, 25 bp, Homo sapien
tgcaacccagcgtccaccgtggaga

SEQ ID NO: 190295 - DNA, 25 bp, Homo sapien
gaccgatcaaaacgcagtctgtctg

SEQ ID NO: 190296 - DNA, 25 bp, Homo sapien
cgaccgatcaaaacgcagtctgtct

SEQ ID NO: 190297 - DNA, 25 bp, Homo sapien
tcaaaacgcagtctgtctgggagcc

SEQ ID NO: 190298 - DNA, 25 bp, Homo sapien
cgatcaaaacgcagtctgtctggga

SEQ ID NO: 190299 - DNA, 25 bp, Homo sapien
aaaacgcagtctgtctgggagcctc

SEQ ID NO: 190300 - DNA, 25 bp, Homo sapien
aacgcagtctgtctgggagcctcag

SEQ ID NO: 190301 - DNA, 25 bp, Homo sapien
cgcagtctgtctgggagcctcaggc

SEQ ID NO: 190302 - DNA, 25 bp, Homo sapien
gagcctcaggcaggcggctctagat

SEQ ID NO: 190303 - DNA, 25 bp, Homo sapien
tgcaaaccgtcccacttgtccgtgg

SEQ ID NO: 190304 - DNA, 25 bp, Homo sapien
tgcttcccagatcaatcacacgtgg

SEQ ID NO: 190305 - DNA, 25 bp, Homo sapien
ccacctggagcgaggcaagggctcc

SEQ ID NO: 190306 - DNA, 25 bp, Homo sapien
gctccgaaagggcttttacaatcaa

SEQ ID NO: 190307 - DNA, 25 bp, Homo sapien
tggcggactcccaatgcaaaccgtc

SEQ ID NO: 190308 - DNA, 25 bp, Homo sapien
ttgtccgtgggttaattccatccga

SEQ ID NO: 190309 - DNA, 25 bp, Homo sapien
tgccgtgtccatggcggactcccaa

SEQ ID NO: 190310 - DNA, 25 bp, Homo sapien
gggttaattccatccgactgcttcc

SEQ ID NO: 190311 - DNA, 25 bp, Homo sapien
gcgtgcccgagcgactttcgctttg

SEQ ID NO: 190312 - DNA, 25 bp, Homo sapien
gcccgcgggcctttataagctcggc

SEQ ID NO: 190313 - DNA, 25 bp, Homo sapien
gccgagcacgtgcggctccatggct

SEQ ID NO: 190314 - DNA, 25 bp, Homo sapien
agccagtacaggaccgcgccgagca

SEQ ID NO: 190315 - DNA, 25 bp, Homo sapien
cagcagcagccagtacaggaccgcg

SEQ ID NO: 190316 - DNA, 25 bp, Homo sapien
gcctggcgcgctcatgcttcaggaa

SEQ ID NO: 190317 - DNA, 25 bp, Homo sapien
ctcatgcttcaggaatgcgggcgcc

SEQ ID NO: 190318 - DNA, 25 bp, Homo sapien
tgcccgagcgactttcgctttgctc

SEQ ID NO: 190319 - DNA, 25 bp, Homo sapien
agccacacgcgggatccggagaccg

SEQ ID NO: 190320 - DNA, 25 bp, Homo sapien
ggggaagcgcctttaccagctcgag

SEQ ID NO: 190321 - DNA, 25 bp, Homo sapien
aagcgcctttaccagctcgagcctg

SEQ ID NO: 190322 - DNA, 25 bp, Homo sapien
gcctggattgcgctcattctgaccc

SEQ ID NO: 190323 - DNA, 25 bp, Homo sapien
ggagaccgcgctaaagtcccacgca

SEQ ID NO: 190324 - DNA, 25 bp, Homo sapien
ctttccttgctttcgccgcgcactc

SEQ ID NO: 190325 - DNA, 25 bp, Homo sapien
tccgctaccagtggcagccgcaagc

SEQ ID NO: 190326 - DNA, 25 bp, Homo sapien
gctgtttgcctggattgcgctcatt

SEQ ID NO: 190327 - DNA, 25 bp, Homo sapien
tttgccaaggtccagcggggcgtcc

SEQ ID NO: 190328 - DNA, 25 bp, Homo sapien
tccgagacgcccacctttgccaagg

SEQ ID NO: 190329 - DNA, 25 bp, Homo sapien
atcgtgggcatgctccacaaccgct

SEQ ID NO: 190330 - DNA, 25 bp, Homo sapien
gggactcgtgctgccctacaagtac

SEQ ID NO: 190331 - DNA, 25 bp, Homo sapien
gagatgttccgcagcatggacacca

SEQ ID NO: 190332 - DNA, 25 bp, Homo sapien
tgccctacaagtaccaggtgctggc

SEQ ID NO: 190333 - DNA, 25 bp, Homo sapien
atggacaccatcgtgggcatgctcc

SEQ ID NO: 190334 - DNA, 25 bp, Homo sapien
cgtccaggacatgatgcgtaggtga

SEQ ID NO: 190335 - DNA, 25 bp, Homo sapien
ctcctaggcgccatcgattttaaga

SEQ ID NO: 190336 - DNA, 25 bp, Homo sapien
cactcgcctgcgatgtagtcgatgc

SEQ ID NO: 190337 - DNA, 25 bp, Homo sapien
ctgagcagaacgttcgaaccggaca

SEQ ID NO: 190338 - DNA, 25 bp, Homo sapien
gtaccgtatttcatggactcctagg

SEQ ID NO: 190339 - DNA, 25 bp, Homo sapien
tcgccggaagcctgtaccgtatttc

SEQ ID NO: 190340 - DNA, 25 bp, Homo sapien
ggcctgtgcgtgcacctgaatacca

SEQ ID NO: 190341 - DNA, 25 bp, Homo sapien
cttgtctcgggctacgcttctgact

SEQ ID NO: 190342 - DNA, 25 bp, Homo sapien
agtgcgagtcaaggcgcccttcctt

SEQ ID NO: 190343 - DNA, 25 bp, Homo sapien
gtgtggctcgtttttgccgactaga

SEQ ID NO: 190344 - DNA, 25 bp, Homo sapien
ccaggagcgacaccgcagacctgtg

SEQ ID NO: 190345 - DNA, 25 bp, Homo sapien
catctccactgtgctcggtgggctc

SEQ ID NO: 190346 - DNA, 25 bp, Homo sapien
acgcccagcccgtgtaaacaggtga

SEQ ID NO: 190347 - DNA, 25 bp, Homo sapien
aatcctgcgcggcagatccaggggc

SEQ ID NO: 190348 - DNA, 25 bp, Homo sapien
agaggcttcagctgggccttttcgc

SEQ ID NO: 190349 - DNA, 25 bp, Homo sapien
tctggccctggaaagaggcttcagc

SEQ ID NO: 190350 - DNA, 25 bp, Homo sapien
ggtgctctcctgttacatccgccgg

SEQ ID NO: 190351 - DNA, 25 bp, Homo sapien
gctgccctggtgcagcgttgttctg

SEQ ID NO: 190352 - DNA, 25 bp, Homo sapien
cagttgcacacgttgagctggggct

SEQ ID NO: 190353 - DNA, 25 bp, Homo sapien
atgaccgcccagttgcacacgttga

SEQ ID NO: 190354 - DNA, 25 bp, Homo sapien
gctggacgaccgaggtgatcctgct

SEQ ID NO: 190355 - DNA, 25 bp, Homo sapien
tgctggccacggttcatcctgggcc

SEQ ID NO: 190356 - DNA, 25 bp, Homo sapien
tctgaggcacgagggcctcaccact

SEQ ID NO: 190357 - DNA, 25 bp, Homo sapien
acgccgccgcgtgtgctctgaggca

SEQ ID NO: 190358 - DNA, 25 bp, Homo sapien
gggaccaaggcctcctggtgctgct

SEQ ID NO: 190359 - DNA, 25 bp, Homo sapien
cggcaatgccggggaccgatgccca

SEQ ID NO: 190360 - DNA, 25 bp, Homo sapien
ggcaatgccggggaccgatgcccag

SEQ ID NO: 190361 - DNA, 25 bp, Homo sapien
caatgccggggaccgatgcccagga

SEQ ID NO: 190362 - DNA, 25 bp, Homo sapien
aatgccggggaccgatgcccaggac

SEQ ID NO: 190363 - DNA, 25 bp, Homo sapien
ccaggacggccctcgcaggcggcaa

SEQ ID NO: 190364 - DNA, 25 bp, Homo sapien
acggccctcgcaggcggcaatgccg

SEQ ID NO: 190365 - DNA, 25 bp, Homo sapien
acggccctcgcaggcggcaatgccc

SEQ ID NO: 190366 - DNA, 25 bp, Homo sapien
caggacggccctcgcaggcggcaat

SEQ ID NO: 190367 - DNA, 25 bp, Homo sapien
cgagggctggtagaacgatctagac

SEQ ID NO: 190368 - DNA, 25 bp, Homo sapien
cagccggcgcgtacacatggggcct

SEQ ID NO: 190369 - DNA, 25 bp, Homo sapien
ggaaaacacgatccgcagccagccg

SEQ ID NO: 190370 - DNA, 25 bp, Homo sapien
ctttcgagggaaaacacgatccgca

SEQ ID NO: 190371 - DNA, 25 bp, Homo sapien
cggagacacaaacggccctacgcgt

SEQ ID NO: 190372 - DNA, 25 bp, Homo sapien
tagcaaaaccacttctttcgaggga

SEQ ID NO: 190373 - DNA, 25 bp, Homo sapien
tacacatggggcctggaaaagaaga

SEQ ID NO: 190374 - DNA, 25 bp, Homo sapien
cgatctagacgaaacactgaactta

SEQ ID NO: 190375 - DNA, 25 bp, Homo sapien
gagtctcatgccaacgtctcccaga

SEQ ID NO: 190376 - DNA, 25 bp, Homo sapien
gtctcccagagctacacagttcctg

SEQ ID NO: 190377 - DNA, 25 bp, Homo sapien
ctcatgccaacgtctcccagagcta

SEQ ID NO: 190378 - DNA, 25 bp, Homo sapien
agctacacagttcctgagtctcatg

SEQ ID NO: 190379 - DNA, 25 bp, Homo sapien
agttcctgagtctcatgccaacgtc

SEQ ID NO: 190380 - DNA, 25 bp, Homo sapien
atcgtctcccagacctacgcgggtc

SEQ ID NO: 190381 - DNA, 25 bp, Homo sapien
catcgtctcccagacctacgcgggt

SEQ ID NO: 190382 - DNA, 25 bp, Homo sapien
gggtcccgagtctcatgccaacgtc

SEQ ID NO: 190383 - DNA, 25 bp, Homo sapien
gccaccgagagggacctggttccga

SEQ ID NO: 190384 - DNA, 25 bp, Homo sapien
cggcagtatacgtggctccagtccc

SEQ ID NO: 190385 - DNA, 25 bp, Homo sapien
cccacgtgacacacggcagtatacg

SEQ ID NO: 190386 - DNA, 25 bp, Homo sapien
acagtcattaccagcacccacgtga

SEQ ID NO: 190387 - DNA, 25 bp, Homo sapien
atgtctcctcaccacacagtcatta

SEQ ID NO: 190388 - DNA, 25 bp, Homo sapien
gtgactggaccacggatgtctcctc

SEQ ID NO: 190389 - DNA, 25 bp, Homo sapien
gagagccttcctgcctgtctgacca

SEQ ID NO: 190390 - DNA, 25 bp, Homo sapien
gtctgaccaagcacagcaagcccta

SEQ ID NO: 190391 - DNA, 25 bp, Homo sapien
agcctcaggccgacctcctcatgcc

SEQ ID NO: 190392 - DNA, 25 bp, Homo sapien
tggagagagccacaccgtcgtcctc

SEQ ID NO: 190393 - DNA, 25 bp, Homo sapien
ttcctatggagagagccacaccgtc

SEQ ID NO: 190394 - DNA, 25 bp, Homo sapien
ccagggcttcctatggagagagcca

SEQ ID NO: 190395 - DNA, 25 bp, Homo sapien
gtctcttaatgaagtccagggcttc

SEQ ID NO: 190396 - DNA, 25 bp, Homo sapien
ggtgccgtgcctgtctcttaatgaa

SEQ ID NO: 190397 - DNA, 25 bp, Homo sapien
cgtgcgtggcgtcgacagcccagta

SEQ ID NO: 190398 - DNA, 25 bp, Homo sapien
tcgacagcccagtagaggaaaaagg

SEQ ID NO: 190399 - DNA, 25 bp, Homo sapien
acaggggacactcgtgcgcccacgt

SEQ ID NO: 190400 - DNA, 25 bp, Homo sapien
cggccacaggggacactcgtgcgcc

SEQ ID NO: 190401 - DNA, 25 bp, Homo sapien
aggggacactcgtgcgcccacgtcc

SEQ ID NO: 190402 - DNA, 25 bp, Homo sapien
gccacaggggacactcgtgcgccca

SEQ ID NO: 190403 - DNA, 25 bp, Homo sapien
ccggccacaggggacactcgtgcgc

SEQ ID NO: 190404 - DNA, 25 bp, Homo sapien
caggggacactcgtgcgcccacgtc

SEQ ID NO: 190405 - DNA, 25 bp, Homo sapien
ggggacactcgtgcgcccacgtccg

SEQ ID NO: 190406 - DNA, 25 bp, Homo sapien
ccacaggggacactcgtgcgcccac

SEQ ID NO: 190407 - DNA, 25 bp, Homo sapien
tccactgaaagacgcgtggcccttg

SEQ ID NO: 190408 - DNA, 25 bp, Homo sapien
aacgagtagacagacgcgtgacaga

SEQ ID NO: 190409 - DNA, 25 bp, Homo sapien
tagacagacgcgtgacagacgaggc

SEQ ID NO: 190410 - DNA, 25 bp, Homo sapien
acagacgaggcacgcgcaggtttac

SEQ ID NO: 190411 - DNA, 25 bp, Homo sapien
cgcaggtttacaaggggctgccacg

SEQ ID NO: 190412 - DNA, 25 bp, Homo sapien
ggcacggcacccattccactgaaag

SEQ ID NO: 190413 - DNA, 25 bp, Homo sapien
tgcagctcagcgttgtccccaagac

SEQ ID NO: 190414 - DNA, 25 bp, Homo sapien
gcgtctccaccacctgggtggggca

SEQ ID NO: 190415 - DNA, 25 bp, Homo sapien
ccatggcaaccacgggagccgcgga

SEQ ID NO: 190416 - DNA, 25 bp, Homo sapien
aaggcaccttaggaaatgggacctg

SEQ ID NO: 190417 - DNA, 25 bp, Homo sapien
ttccctgggcttagaaggcacctta

SEQ ID NO: 190418 - DNA, 25 bp, Homo sapien
cgctttctttctacttcttccctgg

SEQ ID NO: 190419 - DNA, 25 bp, Homo sapien
gcctggactgcctcgtgaccagtgg

SEQ ID NO: 190420 - DNA, 25 bp, Homo sapien
gcactcacgtcgtccatgagcagga

SEQ ID NO: 190421 - DNA, 25 bp, Homo sapien
cgctgtcccggtcatgcagcacagt

SEQ ID NO: 190422 - DNA, 25 bp, Homo sapien
tgtgcatcgcggtgattgccaagga

SEQ ID NO: 190423 - DNA, 25 bp, Homo sapien
gcatctcacagcatctacaggccaa

SEQ ID NO: 190424 - DNA, 25 bp, Homo sapien
cacgtcacacactggcctgtttgtc

SEQ ID NO: 190425 - DNA, 25 bp, Homo sapien
ggcgctaacccgactattgcatctc

SEQ ID NO: 190426 - DNA, 25 bp, Homo sapien
ggccaaacccatagtacgtcagacg

SEQ ID NO: 190427 - DNA, 25 bp, Homo sapien
ttattacacggacacggcgctaacc

SEQ ID NO: 190428 - DNA, 25 bp, Homo sapien
gcgaacgttcgctttattacacgga

SEQ ID NO: 190429 - DNA, 25 bp, Homo sapien
aacagccaggcgacagcgaacgttc

SEQ ID NO: 190430 - DNA, 25 bp, Homo sapien
gccgaagcctcctgggacccaagga

SEQ ID NO: 190431 - DNA, 25 bp, Homo sapien
cacgtggtgatgcttctcccagtcc

SEQ ID NO: 190432 - DNA, 25 bp, Homo sapien
gcttctcccagtcccgatgctggca

SEQ ID NO: 190433 - DNA, 25 bp, Homo sapien
gatgctggcagaaggacccgcagta

SEQ ID NO: 190434 - DNA, 25 bp, Homo sapien
acccgcagtagcgtgccgcgttgca

SEQ ID NO: 190435 - DNA, 25 bp, Homo sapien
gtgccgcgttgcagccgctgcacgt

SEQ ID NO: 190436 - DNA, 25 bp, Homo sapien
agccgctgcacgtctcactggcttt

SEQ ID NO: 190437 - DNA, 25 bp, Homo sapien
tccaggcaccgggtcggccaccacg

SEQ ID NO: 190438 - DNA, 25 bp, Homo sapien
acacacgtggtgatgcttctcccag

SEQ ID NO: 190439 - DNA, 25 bp, Homo sapien
ccgggtggccctacctcgctggagt

SEQ ID NO: 190440 - DNA, 25 bp, Homo sapien
tgatgaccgtcagggcgtcctcgga

SEQ ID NO: 190441 - DNA, 25 bp, Homo sapien
gctccatcttggcacgctccgtggt

SEQ ID NO: 190442 - DNA, 25 bp, Homo sapien
gcacgctccgtggtgatgagctcgt

SEQ ID NO: 190443 - DNA, 25 bp, Homo sapien
tgatgagctcgtgcgctttgcgctc

SEQ ID NO: 190444 - DNA, 25 bp, Homo sapien
acggctttctgcagctccgacatgg

SEQ ID NO: 190445 - DNA, 25 bp, Homo sapien
cgctggagtcctcctgctggttgat

SEQ ID NO: 190446 - DNA, 25 bp, Homo sapien
cctcctgctggttgatgaccgtcag

SEQ ID NO: 190447 - DNA, 25 bp, Homo sapien
tggttgagctcctcgcggtcggcct

SEQ ID NO: 190448 - DNA, 25 bp, Homo sapien
gcacctgcgcagcaccgtgagcgag

SEQ ID NO: 190449 - DNA, 25 bp, Homo sapien
gcgagcgccgcgtcttctccaccat

SEQ ID NO: 190450 - DNA, 25 bp, Homo sapien
ctccaccatgtccatgatgcagttc

SEQ ID NO: 190451 - DNA, 25 bp, Homo sapien
gcagccttcagcacctcagagggac

SEQ ID NO: 190452 - DNA, 25 bp, Homo sapien
gagggaccgggacgcaccagacact

SEQ ID NO: 190453 - DNA, 25 bp, Homo sapien
cccggacaggatgggtgcccgacca

SEQ ID NO: 190454 - DNA, 25 bp, Homo sapien
tagcgccgcgcccagtggttgagct

SEQ ID NO: 190455 - DNA, 25 bp, Homo sapien
caagcccgacctcacgcagggccca

SEQ ID NO: 190456 - DNA, 25 bp, Homo sapien
cggggagagaaccaggtgtggtgga

SEQ ID NO: 190457 - DNA, 25 bp, Homo sapien
cccgacctcacgcagggcccactgt

SEQ ID NO: 190458 - DNA, 25 bp, Homo sapien
ccagagggcgccagaagccggcggt

SEQ ID NO: 190459 - DNA, 25 bp, Homo sapien
cagaagccggcggtcccgacaccgc

SEQ ID NO: 190460 - DNA, 25 bp, Homo sapien
ccgacaccgcggttcaaacgcaggg

SEQ ID NO: 190461 - DNA, 25 bp, Homo sapien
caccgcggttcaaacgcagggaccg

SEQ ID NO: 190462 - DNA, 25 bp, Homo sapien
cgacaccgcggttcaaacgcaggga

SEQ ID NO: 190463 - DNA, 25 bp, Homo sapien
tggccgactcttccgccgtggctgt

SEQ ID NO: 190464 - DNA, 25 bp, Homo sapien
ctctttcgtggtagctgcgcccacg

SEQ ID NO: 190465 - DNA, 25 bp, Homo sapien
tactctttcgtggtagctgcgccca

SEQ ID NO: 190466 - DNA, 25 bp, Homo sapien
gtggccaactcttctgcggtggctg

SEQ ID NO: 190467 - DNA, 25 bp, Homo sapien
ggcagtggccgacttccacggtggc

SEQ ID NO: 190468 - DNA, 25 bp, Homo sapien
agtgaccccggcagtggccgacttc

SEQ ID NO: 190469 - DNA, 25 bp, Homo sapien
actcttccgccgtggctgtgcccat

SEQ ID NO: 190470 - DNA, 25 bp, Homo sapien
tgcccatgggagacgtgagtgacgc

SEQ ID NO: 190471 - DNA, 25 bp, Homo sapien
aagtggtgggccatggctatgtcct

SEQ ID NO: 190472 - DNA, 25 bp, Homo sapien
cgggctgctcaccaagcggccgatg

SEQ ID NO: 190473 - DNA, 25 bp, Homo sapien
ccatggctatgtcctccaggcggta

SEQ ID NO: 190474 - DNA, 25 bp, Homo sapien
cgatggcgctctcgtagctcccggg

SEQ ID NO: 190475 - DNA, 25 bp, Homo sapien
accaagcggccgatggcgctctcgt

SEQ ID NO: 190476 - DNA, 25 bp, Homo sapien
tgcatggccgtttgctgaggtgctc

SEQ ID NO: 190477 - DNA, 25 bp, Homo sapien
ttcagggtgcatggccgtttgctga

SEQ ID NO: 190478 - DNA, 25 bp, Homo sapien
ctatgtcctccaggcggtagtgcgg

SEQ ID NO: 190479 - DNA, 25 bp, Homo sapien
actccgcagcatgcggccgaaggac

SEQ ID NO: 190480 - DNA, 25 bp, Homo sapien
cgggtaaagactccgcagcatgcgg

SEQ ID NO: 190481 - DNA, 25 bp, Homo sapien
ccacgtgtgcgggtaaagactccgc

SEQ ID NO: 190482 - DNA, 25 bp, Homo sapien
gggatccgtatgcagaccctgcctt

SEQ ID NO: 190483 - DNA, 25 bp, Homo sapien
ccggtgtacgggatccgtatgcaga

SEQ ID NO: 190484 - DNA, 25 bp, Homo sapien
tcgtccttggctccaggctggcact

SEQ ID NO: 190485 - DNA, 25 bp, Homo sapien
accctgcctttgacgcctgtgtgta

SEQ ID NO: 190486 - DNA, 25 bp, Homo sapien
gcctcaagacccacgtgtgcgggta

SEQ ID NO: 190487 - DNA, 25 bp, Homo sapien
ggacgtttcaaatccctggacgatg

SEQ ID NO: 190488 - DNA, 25 bp, Homo sapien
cgtttcaaatccctggacgatgccc

SEQ ID NO: 190489 - DNA, 25 bp, Homo sapien
gacgtttcaaatccctggacgatgc

SEQ ID NO: 190490 - DNA, 25 bp, Homo sapien
ctccaggggacgtttcaaatccctg

SEQ ID NO: 190491 - DNA, 25 bp, Homo sapien
ggacacttcaaatccctggacgacg

SEQ ID NO: 190492 - DNA, 25 bp, Homo sapien
ctccagggacacttcaaatccctgg

SEQ ID NO: 190493 - DNA, 25 bp, Homo sapien
cctcctccagggacacttcaaatcc

SEQ ID NO: 190494 - DNA, 25 bp, Homo sapien
aatccctggacgatgccccgcgatt

SEQ ID NO: 190495 - DNA, 25 bp, Homo sapien
ccacccatgcctgaggaggaggctt

SEQ ID NO: 190496 - DNA, 25 bp, Homo sapien
cctcctgaagcttggaatgaaactc

SEQ ID NO: 190497 - DNA, 25 bp, Homo sapien
atgaaactcctcgatcgtcaatgtc

SEQ ID NO: 190498 - DNA, 25 bp, Homo sapien
cgtcaatgtcgagttctgcagggga

SEQ ID NO: 190499 - DNA, 25 bp, Homo sapien
acatcagcaccgctcggcatgtgag

SEQ ID NO: 190500 - DNA, 25 bp, Homo sapien
cgctcggcatgtgagccagcgccga

SEQ ID NO: 190501 - DNA, 25 bp, Homo sapien
gacgggtttcgcattaccttcagga

SEQ ID NO: 190502 - DNA, 25 bp, Homo sapien
ttcaggaagggaatgacaaacggcc

SEQ ID NO: 190503 - DNA, 25 bp, Homo sapien
ggctgggctctacacctgcacacag

SEQ ID NO: 190504 - DNA, 25 bp, Homo sapien
acacacatcccatgcggcaaatggg

SEQ ID NO: 190505 - DNA, 25 bp, Homo sapien
cgacccgtggtctagtggcacctgc

SEQ ID NO: 190506 - DNA, 25 bp, Homo sapien
tctagtggcacctgcgaagtgcgcc

SEQ ID NO: 190507 - DNA, 25 bp, Homo sapien
ggctgcgcggttatcacacacatcc

SEQ ID NO: 190508 - DNA, 25 bp, Homo sapien
catgcggcaaatgggctccgaggaa

SEQ ID NO: 190509 - DNA, 25 bp, Homo sapien
cgaggaaccgaagacacacagcagg

SEQ ID NO: 190510 - DNA, 25 bp, Homo sapien
ctgcacacaggctgcgcggttatca

SEQ ID NO: 190511 - DNA, 25 bp, Homo sapien
ccacgacaggtgtgttcctaagtta

SEQ ID NO: 190512 - DNA, 25 bp, Homo sapien
aacgatcttagcagcgccttcctgg

SEQ ID NO: 190513 - DNA, 25 bp, Homo sapien
cggcaccgataacggcgtcgtattc

SEQ ID NO: 190514 - DNA, 25 bp, Homo sapien
cgtcaccatgggagacctcactgca

SEQ ID NO: 190515 - DNA, 25 bp, Homo sapien
ggatagccacttgcggtcacccagc

SEQ ID NO: 190516 - DNA, 25 bp, Homo sapien
tttctccagaacacgagggactgtc

SEQ ID NO: 190517 - DNA, 25 bp, Homo sapien
ggcacaagcgctttcattcccacga

SEQ ID NO: 190518 - DNA, 25 bp, Homo sapien
actgtcgtcaggactgtggaccttc

SEQ ID NO: 190519 - DNA, 25 bp, Homo sapien
gagagacggcccgtggtttgtacca

SEQ ID NO: 190520 - DNA, 25 bp, Homo sapien
gggctggggtatactgcaaatttaa

SEQ ID NO: 190521 - DNA, 25 bp, Homo sapien
tcgcaagctgcctggtagagagacg

SEQ ID NO: 190522 - DNA, 25 bp, Homo sapien
taccagaccggagggctcttccgaa

SEQ ID NO: 190523 - DNA, 25 bp, Homo sapien
tctcactagaaaccgtggccagctc

SEQ ID NO: 190524 - DNA, 25 bp, Homo sapien
cccaggacctgcaaaatcgtgagtg

SEQ ID NO: 190525 - DNA, 25 bp, Homo sapien
cagcggtctccctctacctatgtgg

SEQ ID NO: 190526 - DNA, 25 bp, Homo sapien
gcaaatttaacacagcagcggtctc

SEQ ID NO: 190527 - DNA, 25 bp, Homo sapien
acctgaggagttgcagctgtgagca

SEQ ID NO: 190528 - DNA, 25 bp, Homo sapien
tccggagcacggtcactccggggtg

SEQ ID NO: 190529 - DNA, 25 bp, Homo sapien
tcctggagcgcggtgtacactgctc

SEQ ID NO: 190530 - DNA, 25 bp, Homo sapien
ctggagcgcggtgtacactgctccg

SEQ ID NO: 190531 - DNA, 25 bp, Homo sapien
gcggaatccggaggcacgcggaccc

SEQ ID NO: 190532 - DNA, 25 bp, Homo sapien
ctctaccctgaaagtcctccaggca

SEQ ID NO: 190533 - DNA, 25 bp, Homo sapien
tgggaaggtcctccggctcatcttt

SEQ ID NO: 190534 - DNA, 25 bp, Homo sapien
agctgtgagcaggttcggtggtgcc

SEQ ID NO: 190535 - DNA, 25 bp, Homo sapien
gctcgtaggatggacggacatgcca

SEQ ID NO: 190536 - DNA, 25 bp, Homo sapien
cgtgacactctggatcccgaagcta

SEQ ID NO: 190537 - DNA, 25 bp, Homo sapien
acctgcgtgctcgtgacactctgga

SEQ ID NO: 190538 - DNA, 25 bp, Homo sapien
aacaagggctcatggccaccacctg

SEQ ID NO: 190539 - DNA, 25 bp, Homo sapien
agccgtcacccaacaagggctcatg

SEQ ID NO: 190540 - DNA, 25 bp, Homo sapien
atgccacggcgcaaggagtcaccac

SEQ ID NO: 190541 - DNA, 25 bp, Homo sapien
cggacatgccacatttcctaaggtg

SEQ ID NO: 190542 - DNA, 25 bp, Homo sapien
tcccgaagctagagcagacagtgcc

SEQ ID NO: 190543 - DNA, 25 bp, Homo sapien
cgagagtcatccgtccacggccgcc

SEQ ID NO: 190544 - DNA, 25 bp, Homo sapien
ggaggacaccactacatcccgggtg

SEQ ID NO: 190545 - DNA, 25 bp, Homo sapien
ggaggacgccactgctttaaacagc

SEQ ID NO: 190546 - DNA, 25 bp, Homo sapien
cgccactgctttaaacagctgttta

SEQ ID NO: 190547 - DNA, 25 bp, Homo sapien
tttccttcagaatcacacggtccca

SEQ ID NO: 190548 - DNA, 25 bp, Homo sapien
cacagcttcctctgggaaaggcaca

SEQ ID NO: 190549 - DNA, 25 bp, Homo sapien
gcacagatgtgcaaagaggagaccc

SEQ ID NO: 190550 - DNA, 25 bp, Homo sapien
gctgggacggaggacaccactacat

SEQ ID NO: 190551 - DNA, 25 bp, Homo sapien
gctttctgcgcgagaatcggccagt

SEQ ID NO: 190552 - DNA, 25 bp, Homo sapien
ccctcccagggagcagtcagatgat

SEQ ID NO: 190553 - DNA, 25 bp, Homo sapien
tgcgacaaggcctgtggctttctgc

SEQ ID NO: 190554 - DNA, 25 bp, Homo sapien
ctccagccggtcagtgccttggcaa

SEQ ID NO: 190555 - DNA, 25 bp, Homo sapien
ggggtttcagcacccactctcacta

SEQ ID NO: 190556 - DNA, 25 bp, Homo sapien
agagcctccatctggtgccgtcggt

SEQ ID NO: 190557 - DNA, 25 bp, Homo sapien
gtggccactcctcagacagcgcggg

SEQ ID NO: 190558 - DNA, 25 bp, Homo sapien
acacccgtccacagggagggagtgc

SEQ ID NO: 190559 - DNA, 25 bp, Homo sapien
cgcagatgctgacacgggcaaccct

SEQ ID NO: 190560 - DNA, 25 bp, Homo sapien
acctgctccctcaggaggtgggatc

SEQ ID NO: 190561 - DNA, 25 bp, Homo sapien
cctgctgggctgcacgggccacgat

SEQ ID NO: 190562 - DNA, 25 bp, Homo sapien
atggaaaggcgcctcgtgacacgct

SEQ ID NO: 190563 - DNA, 25 bp, Homo sapien
ctcgtgacacgctgcggtcagctca

SEQ ID NO: 190564 - DNA, 25 bp, Homo sapien
ggtcagctcagaaaagccgcagatg

SEQ ID NO: 190565 - DNA, 25 bp, Homo sapien
agccaacactgacccgaagacaggt

SEQ ID NO: 190566 - DNA, 25 bp, Homo sapien
cctgcccagtgtggggcgtcctctg

SEQ ID NO: 190567 - DNA, 25 bp, Homo sapien
ccctgccgtgggcaccaactttgaa

SEQ ID NO: 190568 - DNA, 25 bp, Homo sapien
ctcgcccgagagtctcacggggccc

SEQ ID NO: 190569 - DNA, 25 bp, Homo sapien
ggaccacctttagcctgcggggcag

SEQ ID NO: 190570 - DNA, 25 bp, Homo sapien
ggcggcgccctaagaactggccgtg

SEQ ID NO: 190571 - DNA, 25 bp, Homo sapien
tgccgtgggcaccaactttgaaaac

SEQ ID NO: 190572 - DNA, 25 bp, Homo sapien
gtccgggagtcgctgctccttccag

SEQ ID NO: 190573 - DNA, 25 bp, Homo sapien
acactcgcgactcggtccgggagtc

SEQ ID NO: 190574 - DNA, 25 bp, Homo sapien
ggacggcgcacactcgcgactcggt

SEQ ID NO: 190575 - DNA, 25 bp, Homo sapien
cagcaccatgctcaatgcagtcagc

SEQ ID NO: 190576 - DNA, 25 bp, Homo sapien
ctcaatgcagtcagcctcgcaggtg

SEQ ID NO: 190577 - DNA, 25 bp, Homo sapien
aggaaaatgagaattcgatgccttt

SEQ ID NO: 190578 - DNA, 25 bp, Homo sapien
cgatgccttttctgtaactgtgcga

SEQ ID NO: 190579 - DNA, 25 bp, Homo sapien
gcgagacacactgcctgggagcgac

SEQ ID NO: 190580 - DNA, 25 bp, Homo sapien
gccttttctgtaactgtgcgagaca

SEQ ID NO: 190581 - DNA, 25 bp, Homo sapien
ttctgtaactgtgcgagacacactg

SEQ ID NO: 190582 - DNA, 25 bp, Homo sapien
actgtgcgagacacactgcctggga

SEQ ID NO: 190583 - DNA, 25 bp, Homo sapien
aggctctgggttttaggatgtgtcc

SEQ ID NO: 190584 - DNA, 25 bp, Homo sapien
tccaggctctgggttttaggatgtg

SEQ ID NO: 190585 - DNA, 25 bp, Homo sapien
ctctgggttttaggatgtgtccact

SEQ ID NO: 190586 - DNA, 25 bp, Homo sapien
tgggttttaggatgtgtccactggc

SEQ ID NO: 190587 - DNA, 25 bp, Homo sapien
tgtgtccactggcaacatgaaactg

SEQ ID NO: 190588 - DNA, 25 bp, Homo sapien
tgtccactggcaacatgaaactggg

SEQ ID NO: 190589 - DNA, 25 bp, Homo sapien
cactggcaacatgaaactggggagc

SEQ ID NO: 190590 - DNA, 25 bp, Homo sapien
ctggcaacatgaaactggggagctg

SEQ ID NO: 190591 - DNA, 25 bp, Homo sapien
cgccatcaacatgcagacagcctga

SEQ ID NO: 190592 - DNA, 25 bp, Homo sapien
tccagatagaataagcacgcacggc

SEQ ID NO: 190593 - DNA, 25 bp, Homo sapien
tgccgtgggaaatatggagtttacc

SEQ ID NO: 190594 - DNA, 25 bp, Homo sapien
cggccgcgctattactgagacctta

SEQ ID NO: 190595 - DNA, 25 bp, Homo sapien
cagcctgagcgactggcattccaga

SEQ ID NO: 190596 - DNA, 25 bp, Homo sapien
gagaccttattaatccgcctgcagg

SEQ ID NO: 190597 - DNA, 25 bp, Homo sapien
cgcctgcaggcgtttaaatgccgtg

SEQ ID NO: 190598 - DNA, 25 bp, Homo sapien
gcctgataaggcctcgtagcctgcg

SEQ ID NO: 190599 - DNA, 25 bp, Homo sapien
ctctgcggccgtcatggagagagct

SEQ ID NO: 190600 - DNA, 25 bp, Homo sapien
gcatctggttgctgtgaagctgctg

SEQ ID NO: 190601 - DNA, 25 bp, Homo sapien
cccatgcatctggttgctgtgaagc

SEQ ID NO: 190602 - DNA, 25 bp, Homo sapien
tttgggtcacagtgtgctgctgaga

SEQ ID NO: 190603 - DNA, 25 bp, Homo sapien
agcaggtcgccacgatgtgtggaca

SEQ ID NO: 190604 - DNA, 25 bp, Homo sapien
cagtcagcagctgagcttagacttc

SEQ ID NO: 190605 - DNA, 25 bp, Homo sapien
tgagcttagacttccggaacccagg

SEQ ID NO: 190606 - DNA, 25 bp, Homo sapien
ccacagcccgtgtttgggtcacagt

SEQ ID NO: 190607 - DNA, 25 bp, Homo sapien
cagcggcctatagggcttacaggac

SEQ ID NO: 190608 - DNA, 25 bp, Homo sapien
tgccgaacagtagcagcggcctata

SEQ ID NO: 190609 - DNA, 25 bp, Homo sapien
taaaccagaggcagccacacggaca

SEQ ID NO: 190610 - DNA, 25 bp, Homo sapien
cgttaaaaacaactgggtggctgtg

SEQ ID NO: 190611 - DNA, 25 bp, Homo sapien
atagggcttacaggactcggtgcac

SEQ ID NO: 190612 - DNA, 25 bp, Homo sapien
agccgcacgcgcacgtactggggct

SEQ ID NO: 190613 - DNA, 25 bp, Homo sapien
gcccagaccggcagtggccttcatg

SEQ ID NO: 190614 - DNA, 25 bp, Homo sapien
ccagaacctaaaccagaggcagcca

SEQ ID NO: 190615 - DNA, 25 bp, Homo sapien
tggaacgtgctttatttccacacca

SEQ ID NO: 190616 - DNA, 25 bp, Homo sapien
tatggcctcgctgattctccgcgca

SEQ ID NO: 190617 - DNA, 25 bp, Homo sapien
agccgctcattctggtgcagctgcc

SEQ ID NO: 190618 - DNA, 25 bp, Homo sapien
aactccgggctgcagtgcttctgca

SEQ ID NO: 190619 - DNA, 25 bp, Homo sapien
agggctgggatgctttgtccctcca

SEQ ID NO: 190620 - DNA, 25 bp, Homo sapien
acaccatttgttccgtggaacgtgc

SEQ ID NO: 190621 - DNA, 25 bp, Homo sapien
ttccacaccacacgcagagcttatt

SEQ ID NO: 190622 - DNA, 25 bp, Homo sapien
tgcttctgcacattaacaccatttg

SEQ ID NO: 190623 - DNA, 25 bp, Homo sapien
ctcccgccacggctgccagcgatcg

SEQ ID NO: 190624 - DNA, 25 bp, Homo sapien
acgcagatgccaggcgcccacaccc

SEQ ID NO: 190625 - DNA, 25 bp, Homo sapien
cacctctgccaactgctgccgcctc

SEQ ID NO: 190626 - DNA, 25 bp, Homo sapien
agccgctggcatacgtcggtggcac

SEQ ID NO: 190627 - DNA, 25 bp, Homo sapien
tacgtcggtggcacgcgtccatcct

SEQ ID NO: 190628 - DNA, 25 bp, Homo sapien
cgtccatcctcaccgcaagctgccc

SEQ ID NO: 190629 - DNA, 25 bp, Homo sapien
gcgtctcgcggctgagtataggcac

SEQ ID NO: 190630 - DNA, 25 bp, Homo sapien
tctggcacccgacgcagatgccagg

SEQ ID NO: 190631 - DNA, 25 bp, Homo sapien
cacgtcacatcgaggagcctcctga

SEQ ID NO: 190632 - DNA, 25 bp, Homo sapien
atcgagtgccaaccctggctcctgt

SEQ ID NO: 190633 - DNA, 25 bp, Homo sapien
ggaggaacctcagcccgcagctctg

SEQ ID NO: 190634 - DNA, 25 bp, Homo sapien
ggaaacacggatccacgtcacatcg

SEQ ID NO: 190635 - DNA, 25 bp, Homo sapien
cctgcgtttcttctcttgaaaggcg

SEQ ID NO: 190636 - DNA, 25 bp, Homo sapien
aggcgtttattcatcgagtgccaac

SEQ ID NO: 190637 - DNA, 25 bp, Homo sapien
attgctctccctcttacgtaaacca

SEQ ID NO: 190638 - DNA, 25 bp, Homo sapien
agcctcctgattgggcgtaccttcc

SEQ ID NO: 190639 - DNA, 25 bp, Homo sapien
tgtctgcaagcttgtccgtccggca

SEQ ID NO: 190640 - DNA, 25 bp, Homo sapien
ttgcgacagcgacaaacaggacacc

SEQ ID NO: 190641 - DNA, 25 bp, Homo sapien
gtcctctctcgggacgctgtctgca

SEQ ID NO: 190642 - DNA, 25 bp, Homo sapien
cacatgttcctcaaagcggggtttt

SEQ ID NO: 190643 - DNA, 25 bp, Homo sapien
agcctgggtttcagtggcattcaga

SEQ ID NO: 190644 - DNA, 25 bp, Homo sapien
cgcctctggaggctgattctttcgg

SEQ ID NO: 190645 - DNA, 25 bp, Homo sapien
cgttgccgagcaaccgaagcatggc

SEQ ID NO: 190646 - DNA, 25 bp, Homo sapien
aggacgttcagcatccattgcgaca

SEQ ID NO: 190647 - DNA, 25 bp, Homo sapien
aagctgctgtatctgagggagcccg

SEQ ID NO: 190648 - DNA, 25 bp, Homo sapien
tctgccatcggaaccgcgggtttct

SEQ ID NO: 190649 - DNA, 25 bp, Homo sapien
ctgtttcctgagtttggttcccgtg

SEQ ID NO: 190650 - DNA, 25 bp, Homo sapien
ccctgcatttggcagacctgatgcg

SEQ ID NO: 190651 - DNA, 25 bp, Homo sapien
ggggagcccatttggccttctctga

SEQ ID NO: 190652 - DNA, 25 bp, Homo sapien
cttctctgattggtctggagttgca

SEQ ID NO: 190653 - DNA, 25 bp, Homo sapien
gtgaggccacctcaggaagctgctg

SEQ ID NO: 190654 - DNA, 25 bp, Homo sapien
ggtgcgattcccaccaggacctctg

SEQ ID NO: 190655 - DNA, 25 bp, Homo sapien
ttcccgtgggctctgcgctttctcg

SEQ ID NO: 190656 - DNA, 25 bp, Homo sapien
gaccggcgcccagcggacactggaa

SEQ ID NO: 190657 - DNA, 25 bp, Homo sapien
gcggacactggaagcatctgaactg

SEQ ID NO: 190658 - DNA, 25 bp, Homo sapien
catctgaactggtgtgcagtgcagc

SEQ ID NO: 190659 - DNA, 25 bp, Homo sapien
agtgcagccctgatttcccgtgggc

SEQ ID NO: 190660 - DNA, 25 bp, Homo sapien
gcgctttctcgtgggctccttcctt

SEQ ID NO: 190661 - DNA, 25 bp, Homo sapien
gtgggctccgcgctttcccttgggc

SEQ ID NO: 190662 - DNA, 25 bp, Homo sapien
ccgcgggctctgcactttcccactg

SEQ ID NO: 190663 - DNA, 25 bp, Homo sapien
aggacctgtcacgtgtggacctgtc

SEQ ID NO: 190664 - DNA, 25 bp, Homo sapien
ggacctgtcacgtgaggacctgtca

SEQ ID NO: 190665 - DNA, 25 bp, Homo sapien
gactgtcacgtgtggacctgtcata

SEQ ID NO: 190666 - DNA, 25 bp, Homo sapien
ctgtcacgtgtggacctgtcataca

SEQ ID NO: 190667 - DNA, 25 bp, Homo sapien
tggacctgtcacgtgaggacctgtc

SEQ ID NO: 190668 - DNA, 25 bp, Homo sapien
tcacgtgtggacctgtcatacatgc

SEQ ID NO: 190669 - DNA, 25 bp, Homo sapien
tgtggacctgtcacgtgtgaacctg

SEQ ID NO: 190670 - DNA, 25 bp, Homo sapien
ggacctgtcacgtgtggacctgtca

SEQ ID NO: 190671 - DNA, 25 bp, Homo sapien
cgaactccattactggggggcctct

SEQ ID NO: 190672 - DNA, 25 bp, Homo sapien
ggcacctctcggaccctcattggaa

SEQ ID NO: 190673 - DNA, 25 bp, Homo sapien
cctctcggaccctcattggaaattg

SEQ ID NO: 190674 - DNA, 25 bp, Homo sapien
cggaccctcattggaaattgaaaga

SEQ ID NO: 190675 - DNA, 25 bp, Homo sapien
ttggaaattgaaagagggcgcagcc

SEQ ID NO: 190676 - DNA, 25 bp, Homo sapien
gggcgcagccattggcaagaccgct

SEQ ID NO: 190677 - DNA, 25 bp, Homo sapien
cagccattggcaagaccgctgtggg

SEQ ID NO: 190678 - DNA, 25 bp, Homo sapien
tgggagctctataagccgcccctgg

SEQ ID NO: 190679 - DNA, 25 bp, Homo sapien
gcgttgttgacgtcaccttctggga

SEQ ID NO: 190680 - DNA, 25 bp, Homo sapien
ccaacagtcagcgttgttgacgtca

SEQ ID NO: 190681 - DNA, 25 bp, Homo sapien
cccatcgtgcccgtgtccagtgtgt

SEQ ID NO: 190682 - DNA, 25 bp, Homo sapien
tcatcgtgcccatgatctgggcccg

SEQ ID NO: 190683 - DNA, 25 bp, Homo sapien
tggccctcatcgtgcccatgatctg

SEQ ID NO: 190684 - DNA, 25 bp, Homo sapien
atcgtgccgatgtccagcacatggc

SEQ ID NO: 190685 - DNA, 25 bp, Homo sapien
gtgtccagcacatggccccatcgtg

SEQ ID NO: 190686 - DNA, 25 bp, Homo sapien
cgtgcccatgtccagcgcgtggctg

SEQ ID NO: 190687 - DNA, 25 bp, Homo sapien
gcgcgccgttctgatctgggcagcc

SEQ ID NO: 190688 - DNA, 25 bp, Homo sapien
gggtccgtgttcaggcatcctcaga

SEQ ID NO: 190689 - DNA, 25 bp, Homo sapien
gttcaggcatcctcagaacgaatcg

SEQ ID NO: 190690 - DNA, 25 bp, Homo sapien
acgccgagcctctcgtgtccggtgg

SEQ ID NO: 190691 - DNA, 25 bp, Homo sapien
gcagccctgggctagcggagaccac

SEQ ID NO: 190692 - DNA, 25 bp, Homo sapien
agcaatccgcgttgggagtggtccc

SEQ ID NO: 190693 - DNA, 25 bp, Homo sapien
aggcccagcaatccgcgttgggagt

SEQ ID NO: 190694 - DNA, 25 bp, Homo sapien
tagcggagaccacggcgccttgcct

SEQ ID NO: 190695 - DNA, 25 bp, Homo sapien
ttgcgaggaacgacggctaaaaaca

SEQ ID NO: 190696 - DNA, 25 bp, Homo sapien
cttacgaatgcaaagggtgtccctc

SEQ ID NO: 190697 - DNA, 25 bp, Homo sapien
ccagcctgagtgcaggggacactct

SEQ ID NO: 190698 - DNA, 25 bp, Homo sapien
catttacgtgacgatggacacgtcc

SEQ ID NO: 190699 - DNA, 25 bp, Homo sapien
gctaaaaacaggagaggccacgtca

SEQ ID NO: 190700 - DNA, 25 bp, Homo sapien
gtaacagcaaactacgcctggggtc

SEQ ID NO: 190701 - DNA, 25 bp, Homo sapien
cccacgcaagaagccggtgtcctta

SEQ ID NO: 190702 - DNA, 25 bp, Homo sapien
tttcatggtctcagtcatttacgtg

SEQ ID NO: 190703 - DNA, 25 bp, Homo sapien
gacgcagttcggaccctggatcaca

SEQ ID NO: 190704 - DNA, 25 bp, Homo sapien
acgcagttcggaccctggatcacag

SEQ ID NO: 190705 - DNA, 25 bp, Homo sapien
agacgcagttcggaccctggatcac

SEQ ID NO: 190706 - DNA, 25 bp, Homo sapien
actcagacgcagttcggaccctgga

SEQ ID NO: 190707 - DNA, 25 bp, Homo sapien
agaccccactcagacgcagttcaga

SEQ ID NO: 190708 - DNA, 25 bp, Homo sapien
cactcagacgcagttcagaccctgg

SEQ ID NO: 190709 - DNA, 25 bp, Homo sapien
tcagacgcagttcggaccctggatc

SEQ ID NO: 190710 - DNA, 25 bp, Homo sapien
actcagacgcagttcagaccctgga

SEQ ID NO: 190711 - DNA, 25 bp, Homo sapien
ctggcctttggggacagaatcgccc

SEQ ID NO: 190712 - DNA, 25 bp, Homo sapien
gtgttcacccgtgccctggcctttg

SEQ ID NO: 190713 - DNA, 25 bp, Homo sapien
cccagtggcccgctcggacaggagc

SEQ ID NO: 190714 - DNA, 25 bp, Homo sapien
aggaagtggtcttctgcacacagcc

SEQ ID NO: 190715 - DNA, 25 bp, Homo sapien
agacacagaggaagtggtcttctgc

SEQ ID NO: 190716 - DNA, 25 bp, Homo sapien
ttggggacagaatcgccctggttga

SEQ ID NO: 190717 - DNA, 25 bp, Homo sapien
acagaatcgccctggttgaccagca

SEQ ID NO: 190718 - DNA, 25 bp, Homo sapien
cagaggaagtggtcttctgcacaca

SEQ ID NO: 190719 - DNA, 25 bp, Homo sapien
cattcgcttttctgtggagtcattc

SEQ ID NO: 190720 - DNA, 25 bp, Homo sapien
tcactggccacgcaggacggctctg

SEQ ID NO: 190721 - DNA, 25 bp, Homo sapien
gtgagatacagggacgcaggccctc

SEQ ID NO: 190722 - DNA, 25 bp, Homo sapien
ccatcctgcagacccgtgtgagata

SEQ ID NO: 190723 - DNA, 25 bp, Homo sapien
ggagtcattcacagttgtcaccatc

SEQ ID NO: 190724 - DNA, 25 bp, Homo sapien
ccgtgatggtttcggtgaccgcaca

SEQ ID NO: 190725 - DNA, 25 bp, Homo sapien
tcggtgaccgcacagcactccgggt

SEQ ID NO: 190726 - DNA, 25 bp, Homo sapien
ctccgggccagaagcacatcttttc

SEQ ID NO: 190727 - DNA, 25 bp, Homo sapien
tacacgcgtgctccgttttccgtgc

SEQ ID NO: 190728 - DNA, 25 bp, Homo sapien
tgtcccgttgcgtgcatgctgtccc

SEQ ID NO: 190729 - DNA, 25 bp, Homo sapien
gtccttcgtgtctttcacctccgcg

SEQ ID NO: 190730 - DNA, 25 bp, Homo sapien
tcgtgtctttcacctccgcgcctgc

SEQ ID NO: 190731 - DNA, 25 bp, Homo sapien
agccttgtcccgttgcgtgcatgct

SEQ ID NO: 190732 - DNA, 25 bp, Homo sapien
gccttgtcccgttgcgtgcatgctg

SEQ ID NO: 190733 - DNA, 25 bp, Homo sapien
gctacacgcgtgctccgttttccgt

SEQ ID NO: 190734 - DNA, 25 bp, Homo sapien
cgcctcggcaccatcctgctacacg

SEQ ID NO: 190735 - DNA, 25 bp, Homo sapien
tgcggctcaccagctcttcctgaag

SEQ ID NO: 190736 - DNA, 25 bp, Homo sapien
tttcaacgccgtgtgggcgagatct

SEQ ID NO: 190737 - DNA, 25 bp, Homo sapien
gccatggaaggaatgcggctcacca

SEQ ID NO: 190738 - DNA, 25 bp, Homo sapien
ctccgtgtggaacaccgcgggtaga

SEQ ID NO: 190739 - DNA, 25 bp, Homo sapien
acacccttcggtgctccgtgtggaa

SEQ ID NO: 190740 - DNA, 25 bp, Homo sapien
atgggcgacgcgagaacccgctaac

SEQ ID NO: 190741 - DNA, 25 bp, Homo sapien
gtgtcctgggcctcccttaggtgct

SEQ ID NO: 190742 - DNA, 25 bp, Homo sapien
ttcctgaagctttatgggcgacgcg

SEQ ID NO: 190743 - DNA, 25 bp, Homo sapien
cagcgtggactcagacatgataagc

SEQ ID NO: 190744 - DNA, 25 bp, Homo sapien
tgacccttgaagtgccggaaatctc

SEQ ID NO: 190745 - DNA, 25 bp, Homo sapien
acatgataagcgttcaggcactccc

SEQ ID NO: 190746 - DNA, 25 bp, Homo sapien
gacaggaagtcccacgtctgctctg

SEQ ID NO: 190747 - DNA, 25 bp, Homo sapien
aggtcatgcccgtgctgacgccaca

SEQ ID NO: 190748 - DNA, 25 bp, Homo sapien
ctaaaccacaggcagagcgaggctg

SEQ ID NO: 190749 - DNA, 25 bp, Homo sapien
ccctcgatgctgacccttgaagtgc

SEQ ID NO: 190750 - DNA, 25 bp, Homo sapien
gagttcactgcactgaccctcgatg

SEQ ID NO: 190751 - DNA, 25 bp, Homo sapien
acccgtgtttattggaatcctgctg

SEQ ID NO: 190752 - DNA, 25 bp, Homo sapien
agcgcctgcgccagtgttttcttct

SEQ ID NO: 190753 - DNA, 25 bp, Homo sapien
ccagtgttttcttctcctgtcggga

SEQ ID NO: 190754 - DNA, 25 bp, Homo sapien
gggctgatctctgacctcctgtctg

SEQ ID NO: 190755 - DNA, 25 bp, Homo sapien
aggtgcacgtggacccgtgtttatt

SEQ ID NO: 190756 - DNA, 25 bp, Homo sapien
aatcctgctgtgatcagacccgggg

SEQ ID NO: 190757 - DNA, 25 bp, Homo sapien
ctgtgaacatctgcaggctgttggg

SEQ ID NO: 190758 - DNA, 25 bp, Homo sapien
gtggcctcctgtgaacatctgcagg

SEQ ID NO: 190759 - DNA, 25 bp, Homo sapien
atcgccatgaaggttcgtttctgtc

SEQ ID NO: 190760 - DNA, 25 bp, Homo sapien
cgtttctgtcatggctcagtgcagc

SEQ ID NO: 190761 - DNA, 25 bp, Homo sapien
cgcggaacagtaaccagaacaatcg

SEQ ID NO: 190762 - DNA, 25 bp, Homo sapien
ttctggacttttccgcggaacagta

SEQ ID NO: 190763 - DNA, 25 bp, Homo sapien
gcgtcaagaaaccacgacacttggt

SEQ ID NO: 190764 - DNA, 25 bp, Homo sapien
cggcaggcgacactttctccacaaa

SEQ ID NO: 190765 - DNA, 25 bp, Homo sapien
acctctgtcgcgagaggcctacggg

SEQ ID NO: 190766 - DNA, 25 bp, Homo sapien
tctccacaaaaagcgtcaagaaacc

SEQ ID NO: 190767 - DNA, 25 bp, Homo sapien
agggttctcacacccactgaaggca

SEQ ID NO: 190768 - DNA, 25 bp, Homo sapien
aacgtggggctcatctgcctctctc

SEQ ID NO: 190769 - DNA, 25 bp, Homo sapien
ctgctttgcacatgagccgctgagg

SEQ ID NO: 190770 - DNA, 25 bp, Homo sapien
tgtgaatcacgagcttggggccaaa

SEQ ID NO: 190771 - DNA, 25 bp, Homo sapien
ggccggcaagctcaggctcacacgg

SEQ ID NO: 190772 - DNA, 25 bp, Homo sapien
ggctcacacggggagccaccaggct

SEQ ID NO: 190773 - DNA, 25 bp, Homo sapien
accaggctggactgggtgcagctta

SEQ ID NO: 190774 - DNA, 25 bp, Homo sapien
agctgccggcacagacaagagcacg

SEQ ID NO: 190775 - DNA, 25 bp, Homo sapien
cggaactgggtagagacgggcctgc

SEQ ID NO: 190776 - DNA, 25 bp, Homo sapien
cagacgtccggaactgggtagagac

SEQ ID NO: 190777 - DNA, 25 bp, Homo sapien
ggatctgctggggacacagacccac

SEQ ID NO: 190778 - DNA, 25 bp, Homo sapien
aactgggtagagacgggcctgccgt

SEQ ID NO: 190779 - DNA, 25 bp, Homo sapien
gggatctgctggggacacagaccca

SEQ ID NO: 190780 - DNA, 25 bp, Homo sapien
ccggaactgggtagagatgggccgt

SEQ ID NO: 190781 - DNA, 25 bp, Homo sapien
gatctgctggggacacagacccacg

SEQ ID NO: 190782 - DNA, 25 bp, Homo sapien
acagacgtccggaactgggtagaga

SEQ ID NO: 190783 - DNA, 25 bp, Homo sapien
ccgtcagaggcctccttcgtgctgt

SEQ ID NO: 190784 - DNA, 25 bp, Homo sapien
ttggcccaggtaaggcatcggcacc

SEQ ID NO: 190785 - DNA, 25 bp, Homo sapien
ccgcctgccaacacgctgtcactca

SEQ ID NO: 190786 - DNA, 25 bp, Homo sapien
aggcctccttcgtgctgtcactcag

SEQ ID NO: 190787 - DNA, 25 bp, Homo sapien
gtcactcagcctggacgcgcttctt

SEQ ID NO: 190788 - DNA, 25 bp, Homo sapien
cacttgcgctgtcactcagcctgga

SEQ ID NO: 190789 - DNA, 25 bp, Homo sapien
gtcctcgggctgttggcccaggtaa

SEQ ID NO: 190790 - DNA, 25 bp, Homo sapien
cgcttcttcgggtcgcgggtgcact

SEQ ID NO: 190791 - DNA, 25 bp, Homo sapien
agccttccgtgagggcagccccatg

SEQ ID NO: 190792 - DNA, 25 bp, Homo sapien
gagggcgtgcagtcaaaccatttcg

SEQ ID NO: 190793 - DNA, 25 bp, Homo sapien
cccttcatgcgcttcactgggcatg

SEQ ID NO: 190794 - DNA, 25 bp, Homo sapien
gcacgtgcagttcccacattgcgcg

SEQ ID NO: 190795 - DNA, 25 bp, Homo sapien
ccacgcagcctctccgcatgctccc

SEQ ID NO: 190796 - DNA, 25 bp, Homo sapien
ccaacgtgctctccagcggcgcgca

SEQ ID NO: 190797 - DNA, 25 bp, Homo sapien
gtcaaaccatttcgcccgggcagtc

SEQ ID NO: 190798 - DNA, 25 bp, Homo sapien
tgcagttcccacattgcgcgcagct

SEQ ID NO: 190799 - DNA, 25 bp, Homo sapien
acgcatctgtctttgttgcagagcc

SEQ ID NO: 190800 - DNA, 25 bp, Homo sapien
tgcctttgcccttgtgctacgcagc

SEQ ID NO: 190801 - DNA, 25 bp, Homo sapien
cggtactgtgggacgcatctgtctt

SEQ ID NO: 190802 - DNA, 25 bp, Homo sapien
atggaggaggcccaccaccctgtac

SEQ ID NO: 190803 - DNA, 25 bp, Homo sapien
ccagggctccaggagacggtactgt

SEQ ID NO: 190804 - DNA, 25 bp, Homo sapien
ggaagccgccttgcgccaatgggca

SEQ ID NO: 190805 - DNA, 25 bp, Homo sapien
gggctcacgtgcctttgcccttgtg

SEQ ID NO: 190806 - DNA, 25 bp, Homo sapien
atcagcgtatccgagaaccacaagc

SEQ ID NO: 190807 - DNA, 25 bp, Homo sapien
gagcagcctctgaacgtgaccgtgt

SEQ ID NO: 190808 - DNA, 25 bp, Homo sapien
gaggggcatgcaaacccgtggtcct

SEQ ID NO: 190809 - DNA, 25 bp, Homo sapien
cgcactggtcatcgtgctggccagc

SEQ ID NO: 190810 - DNA, 25 bp, Homo sapien
agggttactcattgtgcccagagga

SEQ ID NO: 190811 - DNA, 25 bp, Homo sapien
gtgaacgaccatgcacctgtgctgg

SEQ ID NO: 190812 - DNA, 25 bp, Homo sapien
gcctgtgcagcgagccacaccaagg

SEQ ID NO: 190813 - DNA, 25 bp, Homo sapien
gcctcagccaggtcaacggtgcgct

SEQ ID NO: 190814 - DNA, 25 bp, Homo sapien
gcaccctgtccatcgagatcctgga

SEQ ID NO: 190815 - DNA, 25 bp, Homo sapien
tgtcctcaactacgatgagcaagga

SEQ ID NO: 190816 - DNA, 25 bp, Homo sapien
agccggcctctccttaccagccaag

SEQ ID NO: 190817 - DNA, 25 bp, Homo sapien
tcctccatgccagacacgccctttc

SEQ ID NO: 190818 - DNA, 25 bp, Homo sapien
ggttctggaagcagtctcggggcaa

SEQ ID NO: 190819 - DNA, 25 bp, Homo sapien
cgagacaatgtcctcaactacgatg

SEQ ID NO: 190820 - DNA, 25 bp, Homo sapien
ctcaactacgatgagcaaggaggcg

SEQ ID NO: 190821 - DNA, 25 bp, Homo sapien
cccaggacgaccttcgagacaatgt

SEQ ID NO: 190822 - DNA, 25 bp, Homo sapien
cagtgctggtcctgctcgtggcact

SEQ ID NO: 190823 - DNA, 25 bp, Homo sapien
cgcaccctcgcggaagaaactacta

SEQ ID NO: 190824 - DNA, 25 bp, Homo sapien
tccagaggcctgatccttacgtccg

SEQ ID NO: 190825 - DNA, 25 bp, Homo sapien
cgtgcagctccctgtgaaagttagc

SEQ ID NO: 190826 - DNA, 25 bp, Homo sapien
tgtcttacagctgatccggttcttg

SEQ ID NO: 190827 - DNA, 25 bp, Homo sapien
cttcactttgaacagggcgtgtttc

SEQ ID NO: 190828 - DNA, 25 bp, Homo sapien
tggcacattgtgttgggaccgaagc

SEQ ID NO: 190829 - DNA, 25 bp, Homo sapien
cgctggtcttggagtaatcgaatcc

SEQ ID NO: 190830 - DNA, 25 bp, Homo sapien
cgcgacgagcacttcctggctgtac

SEQ ID NO: 190831 - DNA, 25 bp, Homo sapien
tgcaactcaactcgcactgcgtgtg

SEQ ID NO: 190832 - DNA, 25 bp, Homo sapien
tcgctctgcgtatgcaactcagctc

SEQ ID NO: 190833 - DNA, 25 bp, Homo sapien
tgcaactcaactcgcactgcgtatg

SEQ ID NO: 190834 - DNA, 25 bp, Homo sapien
gctcgctctgcgtatgcaactcagc

SEQ ID NO: 190835 - DNA, 25 bp, Homo sapien
agctcgctctgcgtatgcaactcag

SEQ ID NO: 190836 - DNA, 25 bp, Homo sapien
tcagctcgctctgcgtatgcaactc

SEQ ID NO: 190837 - DNA, 25 bp, Homo sapien
ctcgcactgcgtatgcaactcaact

SEQ ID NO: 190838 - DNA, 25 bp, Homo sapien
agctcgcactgcgtatgcaactcag

SEQ ID NO: 190839 - DNA, 25 bp, Homo sapien
caggtaggtcgcgtttattttcaag

SEQ ID NO: 190840 - DNA, 25 bp, Homo sapien
aacatcacggtggatcctgtgggtc

SEQ ID NO: 190841 - DNA, 25 bp, Homo sapien
tgactcccggtttgtcttattttgc

SEQ ID NO: 190842 - DNA, 25 bp, Homo sapien
ttcaagtccgactgttttcgcggta

SEQ ID NO: 190843 - DNA, 25 bp, Homo sapien
ctgagagcagcctctccgcgggact

SEQ ID NO: 190844 - DNA, 25 bp, Homo sapien
ttagagccactaagaagcgggaccc

SEQ ID NO: 190845 - DNA, 25 bp, Homo sapien
agaactgacgcctttcgctcggatc

SEQ ID NO: 190846 - DNA, 25 bp, Homo sapien
ccttccgagaaccaggtaggtcgcg

SEQ ID NO: 190847 - DNA, 25 bp, Homo sapien
cgctgcacgcactgtcccccacgcg

SEQ ID NO: 190848 - DNA, 25 bp, Homo sapien
ccagggttcccggaggccagacgtg

SEQ ID NO: 190849 - DNA, 25 bp, Homo sapien
agtcgagcaggtgaagcggccctgc

SEQ ID NO: 190850 - DNA, 25 bp, Homo sapien
cagtgccgcgcggacatcggggctc

SEQ ID NO: 190851 - DNA, 25 bp, Homo sapien
ggacatcggggctcccccgttcaga

SEQ ID NO: 190852 - DNA, 25 bp, Homo sapien
tgccctcggctgttatccccactgg

SEQ ID NO: 190853 - DNA, 25 bp, Homo sapien
gggtttcaccctgtgtgcgcagccc

SEQ ID NO: 190854 - DNA, 25 bp, Homo sapien
ggggtttcaccctgtgtgcgcagcc

SEQ ID NO: 190855 - DNA, 25 bp, Homo sapien
ccgtctcctaatgcggaaatctgca

SEQ ID NO: 190856 - DNA, 25 bp, Homo sapien
caggacccgtcttcgggagcccgag

SEQ ID NO: 190857 - DNA, 25 bp, Homo sapien
tcctgggaagccacgcaggacccgt

SEQ ID NO: 190858 - DNA, 25 bp, Homo sapien
gctgacagcagtaccctcctgggaa

SEQ ID NO: 190859 - DNA, 25 bp, Homo sapien
tgcgctgacgctcgctgacagcagt

SEQ ID NO: 190860 - DNA, 25 bp, Homo sapien
tcggcatcctttctagtgcgcctgc

SEQ ID NO: 190861 - DNA, 25 bp, Homo sapien
cctaatgcggaaatctgcacccagg

SEQ ID NO: 190862 - DNA, 25 bp, Homo sapien
cgcactgcacgtgtcggcatccttt

SEQ ID NO: 190863 - DNA, 25 bp, Homo sapien
cctctcgtcgttgctgttgggacgg

SEQ ID NO: 190864 - DNA, 25 bp, Homo sapien
gactcagtgtgactcaggcctcgcc

SEQ ID NO: 190865 - DNA, 25 bp, Homo sapien
agggcaggcgcgctctgtgcaaaac

SEQ ID NO: 190866 - DNA, 25 bp, Homo sapien
ctctgtgcaaaaccgagtcgtgtgc

SEQ ID NO: 190867 - DNA, 25 bp, Homo sapien
caaaaccgagtcgtgtgcgggccca

SEQ ID NO: 190868 - DNA, 25 bp, Homo sapien
cgtcgtcaaaatacaccacgaggtc

SEQ ID NO: 190869 - DNA, 25 bp, Homo sapien
gcagtgactcagtgtgactcaggcc

SEQ ID NO: 190870 - DNA, 25 bp, Homo sapien
ccgaaagcgcattccgtcgtcaaaa

SEQ ID NO: 190871 - DNA, 25 bp, Homo sapien
gccggcaacaatacaaagtcgtcgt

SEQ ID NO: 190872 - DNA, 25 bp, Homo sapien
gtcatgccggcaacaatacaaagtc

SEQ ID NO: 190873 - DNA, 25 bp, Homo sapien
tcccgcggtgtcatgccggcaacaa

SEQ ID NO: 190874 - DNA, 25 bp, Homo sapien
ggtcgccgttttcaaacagaagctg

SEQ ID NO: 190875 - DNA, 25 bp, Homo sapien
cgccgttttcaaacagaagctgccg

SEQ ID NO: 190876 - DNA, 25 bp, Homo sapien
cagtcctgggcagccgtgcggccct

SEQ ID NO: 190877 - DNA, 25 bp, Homo sapien
cgttttcaaacagaagctgccgtgt

SEQ ID NO: 190878 - DNA, 25 bp, Homo sapien
cgcccggcatggtctcctcatcccg

SEQ ID NO: 190879 - DNA, 25 bp, Homo sapien
agccggcgcgacctactttcagcga

SEQ ID NO: 190880 - DNA, 25 bp, Homo sapien
taccgcctatttccgtccagcaaga

SEQ ID NO: 190881 - DNA, 25 bp, Homo sapien
gccaactctgtgtctgggtttttca

SEQ ID NO: 190882 - DNA, 25 bp, Homo sapien
accggctagccaggcttttcttata

SEQ ID NO: 190883 - DNA, 25 bp, Homo sapien
ttgccctctctggtcacagtcctgg

SEQ ID NO: 190884 - DNA, 25 bp, Homo sapien
ctccgcaatgagagcaagcatactg

SEQ ID NO: 190885 - DNA, 25 bp, Homo sapien
gcgcatctgacggttgtctcggtta

SEQ ID NO: 190886 - DNA, 25 bp, Homo sapien
gcgaggcagtctgttctggttcaca

SEQ ID NO: 190887 - DNA, 25 bp, Homo sapien
ctcggggaatctctgtggagacttc

SEQ ID NO: 190888 - DNA, 25 bp, Homo sapien
cctgtcttccatcgagggtggcatg

SEQ ID NO: 190889 - DNA, 25 bp, Homo sapien
gcaggcaaacttctccgcgggaacc

SEQ ID NO: 190890 - DNA, 25 bp, Homo sapien
cacaggccagctcacagggttttca

SEQ ID NO: 190891 - DNA, 25 bp, Homo sapien
accatctgcggcatctttagtctgc

SEQ ID NO: 190892 - DNA, 25 bp, Homo sapien
cttgcagttgctgaagaaggactcc

SEQ ID NO: 190893 - DNA, 25 bp, Homo sapien
cggctgccgtccaggaagctatttt

SEQ ID NO: 190894 - DNA, 25 bp, Homo sapien
tgtaaacttgagaagacgccctctg

SEQ ID NO: 190895 - DNA, 25 bp, Homo sapien
accctggggttcgacccgagagcag

SEQ ID NO: 190896 - DNA, 25 bp, Homo sapien
gcagcttcaccacctacaagacagt

SEQ ID NO: 190897 - DNA, 25 bp, Homo sapien
caagacagtaacacccgcgtcaggg

SEQ ID NO: 190898 - DNA, 25 bp, Homo sapien
taacacccgcgtcagggactgctgg

SEQ ID NO: 190899 - DNA, 25 bp, Homo sapien
gactgctggagaagcacaactcctc

SEQ ID NO: 190900 - DNA, 25 bp, Homo sapien
gagaagcacaactcctctaccgttc

SEQ ID NO: 190901 - DNA, 25 bp, Homo sapien
cccagggactgcctggcgaggctct

SEQ ID NO: 190902 - DNA, 25 bp, Homo sapien
tctcgcctttcctgttgctctgctg

SEQ ID NO: 190903 - DNA, 25 bp, Homo sapien
gctagagtgcgtcccagtgcaaagc

SEQ ID NO: 190904 - DNA, 25 bp, Homo sapien
gtgctagagtgcgtcccagtgcaaa

SEQ ID NO: 190905 - DNA, 25 bp, Homo sapien
gcttccgcttgctggctcgctccct

SEQ ID NO: 190906 - DNA, 25 bp, Homo sapien
ggcagcttccgcttgctggctcgct

SEQ ID NO: 190907 - DNA, 25 bp, Homo sapien
gaagggcagcttccgcttgctggct

SEQ ID NO: 190908 - DNA, 25 bp, Homo sapien
ttggcgcccgcggtgaagggcagct

SEQ ID NO: 190909 - DNA, 25 bp, Homo sapien
gctgcctgtggagggctgactgcag

SEQ ID NO: 190910 - DNA, 25 bp, Homo sapien
tagagtgcgtcccagtgcaaagccg

SEQ ID NO: 190911 - DNA, 25 bp, Homo sapien
gacacgtgcgctacctcccaggagg

SEQ ID NO: 190912 - DNA, 25 bp, Homo sapien
cacgtgcgctacctcccaggaggga

SEQ ID NO: 190913 - DNA, 25 bp, Homo sapien
gagacggtgcgacacacacagcgct

SEQ ID NO: 190914 - DNA, 25 bp, Homo sapien
tcccaggagggagacggtgcgacac

SEQ ID NO: 190915 - DNA, 25 bp, Homo sapien
agacacgtgcgctacctcccaggag

SEQ ID NO: 190916 - DNA, 25 bp, Homo sapien
ctcccaggagggagacggtgcgaca

SEQ ID NO: 190917 - DNA, 25 bp, Homo sapien
cctcccaggagggagacggtgcgac

SEQ ID NO: 190918 - DNA, 25 bp, Homo sapien
acacgtgcgctacctcccaggaggg

SEQ ID NO: 190919 - DNA, 25 bp, Homo sapien
tagatcttggcgtctgggcctcaaa

SEQ ID NO: 190920 - DNA, 25 bp, Homo sapien
aaggtccttgggttaactctctctg

SEQ ID NO: 190921 - DNA, 25 bp, Homo sapien
tgggcctcaaagcacaacacaggta

SEQ ID NO: 190922 - DNA, 25 bp, Homo sapien
cacaggtactgacaggtaggtctcc

SEQ ID NO: 190923 - DNA, 25 bp, Homo sapien
accatgggcacttggtcccttctct

SEQ ID NO: 190924 - DNA, 25 bp, Homo sapien
ggttaactctctctgcacaaacgtg

SEQ ID NO: 190925 - DNA, 25 bp, Homo sapien
tctggcacggatggaccagcccaca

SEQ ID NO: 190926 - DNA, 25 bp, Homo sapien
tctcagggcccttctagatcttggc

SEQ ID NO: 190927 - DNA, 25 bp, Homo sapien
tgcacacacgggcaactttacaacc

SEQ ID NO: 190928 - DNA, 25 bp, Homo sapien
ctcactgagattaagaggggctctg

SEQ ID NO: 190929 - DNA, 25 bp, Homo sapien
agcccgagcctctcactgagattaa

SEQ ID NO: 190930 - DNA, 25 bp, Homo sapien
tggggaaagagccacacgtcctcct

SEQ ID NO: 190931 - DNA, 25 bp, Homo sapien
cctgacactcagagctggggaaaga

SEQ ID NO: 190932 - DNA, 25 bp, Homo sapien
gcgcacggcaagatggatcctgaca

SEQ ID NO: 190933 - DNA, 25 bp, Homo sapien
cgggcaactttacaacctggcctgg

SEQ ID NO: 190934 - DNA, 25 bp, Homo sapien
ctcacagcacggacggggtcgacaa

SEQ ID NO: 190935 - DNA, 25 bp, Homo sapien
cgtggagcacagacagagaagatca

SEQ ID NO: 190936 - DNA, 25 bp, Homo sapien
gggagcaccgagagagaagatcact

SEQ ID NO: 190937 - DNA, 25 bp, Homo sapien
ggagcaccgagagagaagatcactg

SEQ ID NO: 190938 - DNA, 25 bp, Homo sapien
gcgtggagcacagacagagaagatc

SEQ ID NO: 190939 - DNA, 25 bp, Homo sapien
gagaagatcactggggcgaacaccg

SEQ ID NO: 190940 - DNA, 25 bp, Homo sapien
tcactggggcaaacaccgagtgtgg

SEQ ID NO: 190941 - DNA, 25 bp, Homo sapien
aagaagatcactggggcgaacaccg

SEQ ID NO: 190942 - DNA, 25 bp, Homo sapien
aaagaagatcactggggcgaacacc

SEQ ID NO: 190943 - DNA, 25 bp, Homo sapien
tctacattctcaacctggcagtggc

SEQ ID NO: 190944 - DNA, 25 bp, Homo sapien
ggggcgccgtcttcatcatctacac

SEQ ID NO: 190945 - DNA, 25 bp, Homo sapien
ggcctctacttcttcgtggtcatcc

SEQ ID NO: 190946 - DNA, 25 bp, Homo sapien
tcctgtctctgtgcatgtcgctgcc

SEQ ID NO: 190947 - DNA, 25 bp, Homo sapien
accagtgtcttctgcctgacagtca

SEQ ID NO: 190948 - DNA, 25 bp, Homo sapien
cagtggccgacgtcctgtacatgct

SEQ ID NO: 190949 - DNA, 25 bp, Homo sapien
tggtgctgcgcttcgccaagatgaa

SEQ ID NO: 190950 - DNA, 25 bp, Homo sapien
ggctgcctttcctggccacgcagaa

SEQ ID NO: 190951 - DNA, 25 bp, Homo sapien
gaccatcacccgtccatgtctgggg

SEQ ID NO: 190952 - DNA, 25 bp, Homo sapien
gggatgggaccatcacccgtccatg

SEQ ID NO: 190953 - DNA, 25 bp, Homo sapien
ggagtcagggatgggaccatcaccc

SEQ ID NO: 190954 - DNA, 25 bp, Homo sapien
ggatgggaccatcacccgtccatgt

SEQ ID NO: 190955 - DNA, 25 bp, Homo sapien
acggagtcagggatgggaccatcac

SEQ ID NO: 190956 - DNA, 25 bp, Homo sapien
catcacccgtccatgtctgggggcg

SEQ ID NO: 190957 - DNA, 25 bp, Homo sapien
agtcagggatgggaccatcacccgt

SEQ ID NO: 190958 - DNA, 25 bp, Homo sapien
gtcagggatgggaccatcacccgtc

SEQ ID NO: 190959 - DNA, 25 bp, Homo sapien
gccaccttcacgagagtaagagaga

SEQ ID NO: 190960 - DNA, 25 bp, Homo sapien
acgccaccttcacgagagtaagaga

SEQ ID NO: 190961 - DNA, 25 bp, Homo sapien
ctgggcacgccaccttcacgagagt

SEQ ID NO: 190962 - DNA, 25 bp, Homo sapien
ccaccttcacgagagtaagagagaa

SEQ ID NO: 190963 - DNA, 25 bp, Homo sapien
cacgccaccttcacgagagtaagag

SEQ ID NO: 190964 - DNA, 25 bp, Homo sapien
accttcacgagagtaagagagaagg

SEQ ID NO: 190965 - DNA, 25 bp, Homo sapien
gggcacgccaccttcacgagagtaa

SEQ ID NO: 190966 - DNA, 25 bp, Homo sapien
ggctgggcacgccaccttcacgaga

SEQ ID NO: 190967 - DNA, 25 bp, Homo sapien
ctcccgggctcccaggaggtgcggg

SEQ ID NO: 190968 - DNA, 25 bp, Homo sapien
ttttggctcgaactgagtgcatttc

SEQ ID NO: 190969 - DNA, 25 bp, Homo sapien
gctcgaactgagtgcatttcctctc

SEQ ID NO: 190970 - DNA, 25 bp, Homo sapien
cgaactgagtgcatttcctctcggg

SEQ ID NO: 190971 - DNA, 25 bp, Homo sapien
actgagtgcatttcctctcgggccg

SEQ ID NO: 190972 - DNA, 25 bp, Homo sapien
gctgaccggactggccctgctccgc

SEQ ID NO: 190973 - DNA, 25 bp, Homo sapien
tggctcgaactgagtgcatttcctc

SEQ ID NO: 190974 - DNA, 25 bp, Homo sapien
agtgcatttcctctcgggccggccg

SEQ ID NO: 190975 - DNA, 25 bp, Homo sapien
ttgacagcctctctggcggtccgga

SEQ ID NO: 190976 - DNA, 25 bp, Homo sapien
tcctgcgtaagggcgcatgcgacac

SEQ ID NO: 190977 - DNA, 25 bp, Homo sapien
aggcgggattgacagcctctctggc

SEQ ID NO: 190978 - DNA, 25 bp, Homo sapien
cgccgtgagttagtgcgctaatgga

SEQ ID NO: 190979 - DNA, 25 bp, Homo sapien
tgtgcacgtcacagcgccgtgagtt

SEQ ID NO: 190980 - DNA, 25 bp, Homo sapien
ccgcaggggctgtgcacgtcacagc

SEQ ID NO: 190981 - DNA, 25 bp, Homo sapien
ctcccggtgcggacgctactgatgg

SEQ ID NO: 190982 - DNA, 25 bp, Homo sapien
acccattattggtccctcacgatcg

SEQ ID NO: 190983 - DNA, 25 bp, Homo sapien
tttcaggccaacatggccgtgctgc

SEQ ID NO: 190984 - DNA, 25 bp, Homo sapien
ggcctctactcgcaggcgggattcc

SEQ ID NO: 190985 - DNA, 25 bp, Homo sapien
cctgtgaccgaaccctgcgggtgac

SEQ ID NO: 190986 - DNA, 25 bp, Homo sapien
cctgggaatacaaggccggcttcaa

SEQ ID NO: 190987 - DNA, 25 bp, Homo sapien
ccacgaggtagacgggctcaggctc

SEQ ID NO: 190988 - DNA, 25 bp, Homo sapien
ccgcggatcacgcaggcgcggcttt

SEQ ID NO: 190989 - DNA, 25 bp, Homo sapien
caggacggagcgctccgaagtcaga

SEQ ID NO: 190990 - DNA, 25 bp, Homo sapien
tgcaacttcagtcctcgtcctcggg

SEQ ID NO: 190991 - DNA, 25 bp, Homo sapien
gtgagcctctcgtcccggctgctgg

SEQ ID NO: 190992 - DNA, 25 bp, Homo sapien
tgacgtcgttaccaccgctgggtct

SEQ ID NO: 190993 - DNA, 25 bp, Homo sapien
accaccgctgggtctgtggcggttt

SEQ ID NO: 190994 - DNA, 25 bp, Homo sapien
gatgatgtcgttcccgctgctgtgt

SEQ ID NO: 190995 - DNA, 25 bp, Homo sapien
ctggagatgatgtcgttcccgctgc

SEQ ID NO: 190996 - DNA, 25 bp, Homo sapien
aggtgttctggagatgatgtcgttc

SEQ ID NO: 190997 - DNA, 25 bp, Homo sapien
ctggtgttctggaaatgacgtcgtt

SEQ ID NO: 190998 - DNA, 25 bp, Homo sapien
cgctggtgttctggaaatgacgtcg

SEQ ID NO: 190999 - DNA, 25 bp, Homo sapien
cccgacgtaggatggcgaagtctca

SEQ ID NO: 191000 - DNA, 25 bp, Homo sapien
cccgacgtaggatgccgaagtctca

SEQ ID NO: 191001 - DNA, 25 bp, Homo sapien
acgtaggatgccgaagtctcagccc

SEQ ID NO: 191002 - DNA, 25 bp, Homo sapien
agcccccgacgtaggatgccgaagt

SEQ ID NO: 191003 - DNA, 25 bp, Homo sapien
ccgacgtaggatgccgaagtctcag

SEQ ID NO: 191004 - DNA, 25 bp, Homo sapien
ccgacgtaggatggcgaagtctcag

SEQ ID NO: 191005 - DNA, 25 bp, Homo sapien
acgtaggatggcgaagtctcagccc

SEQ ID NO: 191006 - DNA, 25 bp, Homo sapien
taggatgccgaagtctcagcccccg

SEQ ID NO: 191007 - DNA, 25 bp, Homo sapien
acaggcctcccttcaacgtagtcat

SEQ ID NO: 191008 - DNA, 25 bp, Homo sapien
aatctcactggggaagagaaaagcc

SEQ ID NO: 191009 - DNA, 25 bp, Homo sapien
tcatggaagcgcacaggatagggcc

SEQ ID NO: 191010 - DNA, 25 bp, Homo sapien
ttggttacgtcagccggtccatggc

SEQ ID NO: 191011 - DNA, 25 bp, Homo sapien
caagtcaaagagcactggaggcacc

SEQ ID NO: 191012 - DNA, 25 bp, Homo sapien
gctcctgtgctggaaagcgttgatg

SEQ ID NO: 191013 - DNA, 25 bp, Homo sapien
gaagcccagcggttcacacaggcct

SEQ ID NO: 191014 - DNA, 25 bp, Homo sapien
agcccaagccttgttggttacgtca

SEQ ID NO: 191015 - DNA, 25 bp, Homo sapien
accctgatacatagcggcccggtgg

SEQ ID NO: 191016 - DNA, 25 bp, Homo sapien
gagctgtgcttgaacccggcgccgc

SEQ ID NO: 191017 - DNA, 25 bp, Homo sapien
aaggccgagctgtgcttgaacccgg

SEQ ID NO: 191018 - DNA, 25 bp, Homo sapien
tcctgacacatagcccggtggggag

SEQ ID NO: 191019 - DNA, 25 bp, Homo sapien
gccatcctgacacatagcccggtgg

SEQ ID NO: 191020 - DNA, 25 bp, Homo sapien
catcctaacacatagcggcccgggg

SEQ ID NO: 191021 - DNA, 25 bp, Homo sapien
gtggccatcctaacacatagcggcc

SEQ ID NO: 191022 - DNA, 25 bp, Homo sapien
agggtggccaccctgatacatagcg

SEQ ID NO: 191023 - DNA, 25 bp, Homo sapien
ccgtaagatccgcaggtgagccctg

SEQ ID NO: 191024 - DNA, 25 bp, Homo sapien
ggtcctggcctttgggcatcatcca

SEQ ID NO: 191025 - DNA, 25 bp, Homo sapien
ggccctgctatcatcccagagtgca

SEQ ID NO: 191026 - DNA, 25 bp, Homo sapien
agttcctcctttcggggctctgatt

SEQ ID NO: 191027 - DNA, 25 bp, Homo sapien
attctcagcggcaacatgtctgcga

SEQ ID NO: 191028 - DNA, 25 bp, Homo sapien
ttactcagggcccaggaatcacggc

SEQ ID NO: 191029 - DNA, 25 bp, Homo sapien
cgcgttagcccgcaagacaggactc

SEQ ID NO: 191030 - DNA, 25 bp, Homo sapien
tgcgcttctctccaccagacgtaag

SEQ ID NO: 191031 - DNA, 25 bp, Homo sapien
tctcagaaggcgctagtctcctgcc

SEQ ID NO: 191032 - DNA, 25 bp, Homo sapien
ctctggcccgagctaaaggggaaga

SEQ ID NO: 191033 - DNA, 25 bp, Homo sapien
gatgcaccgtttctcacaccggctg

SEQ ID NO: 191034 - DNA, 25 bp, Homo sapien
tcgcctgcctcggtgatgcaccgtt

SEQ ID NO: 191035 - DNA, 25 bp, Homo sapien
ctccggcgcctgcagaactgatcgg

SEQ ID NO: 191036 - DNA, 25 bp, Homo sapien
cctgcagaactgatcggggatagtc

SEQ ID NO: 191037 - DNA, 25 bp, Homo sapien
atagtctcaggaggcgctagtcacg

SEQ ID NO: 191038 - DNA, 25 bp, Homo sapien
atagtctcaggaggcacgagtcgcc

SEQ ID NO: 191039 - DNA, 25 bp, Homo sapien
caccggccgtcagcacacggggtag

SEQ ID NO: 191040 - DNA, 25 bp, Homo sapien
tgagtgcccggagatggctccgacc

SEQ ID NO: 191041 - DNA, 25 bp, Homo sapien
aaggcggaagcctctgtgccaaggc

SEQ ID NO: 191042 - DNA, 25 bp, Homo sapien
ctctaaggcggaagcctctgtgcca

SEQ ID NO: 191043 - DNA, 25 bp, Homo sapien
ctctctaaggcggaagcctctgtgc

SEQ ID NO: 191044 - DNA, 25 bp, Homo sapien
cctttctctctaaggcggaagcctc

SEQ ID NO: 191045 - DNA, 25 bp, Homo sapien
gggcgcctttctctctaaggcggaa

SEQ ID NO: 191046 - DNA, 25 bp, Homo sapien
gagtgcccggagatggctccgaccc

SEQ ID NO: 191047 - DNA, 25 bp, Homo sapien
gcctggaaatgggatcctagagatc

SEQ ID NO: 191048 - DNA, 25 bp, Homo sapien
tgtctgcctgggtccgaacccgggc

SEQ ID NO: 191049 - DNA, 25 bp, Homo sapien
cccggggaattagaagctgtctcct

SEQ ID NO: 191050 - DNA, 25 bp, Homo sapien
ggaattagaagctgtctcctcccgg

SEQ ID NO: 191051 - DNA, 25 bp, Homo sapien
ctaaatgcttgttgatggaggtggc

SEQ ID NO: 191052 - DNA, 25 bp, Homo sapien
caggcgcccactaaatgcttgttga

SEQ ID NO: 191053 - DNA, 25 bp, Homo sapien
aggtggcgagtacccgaaaccagcg

SEQ ID NO: 191054 - DNA, 25 bp, Homo sapien
tacccgaaaccagcggagcctggaa

SEQ ID NO: 191055 - DNA, 25 bp, Homo sapien
cccagacgccgaggctgatctaggg

SEQ ID NO: 191056 - DNA, 25 bp, Homo sapien
cctacccaggcccagactgagaccc

SEQ ID NO: 191057 - DNA, 25 bp, Homo sapien
tgtagtgcaaccaggaagccgcagg

SEQ ID NO: 191058 - DNA, 25 bp, Homo sapien
gggaccctcactcacctggccacgg

SEQ ID NO: 191059 - DNA, 25 bp, Homo sapien
cagagccgcattcgccctcctgcag

SEQ ID NO: 191060 - DNA, 25 bp, Homo sapien
gggtgggcatttcctaagtcctctc

SEQ ID NO: 191061 - DNA, 25 bp, Homo sapien
tcctgcaggggtgggcatttcctaa

SEQ ID NO: 191062 - DNA, 25 bp, Homo sapien
cccacgcctgtagtgcaaccaggaa

SEQ ID NO: 191063 - DNA, 25 bp, Homo sapien
cggaacatcccatcacctgcagaca

SEQ ID NO: 191064 - DNA, 25 bp, Homo sapien
cggaacatcccgtcacccgctgaca

SEQ ID NO: 191065 - DNA, 25 bp, Homo sapien
cgtcacccgctgacacggaacatct

SEQ ID NO: 191066 - DNA, 25 bp, Homo sapien
cggaacatctcacctgtcacacgga

SEQ ID NO: 191067 - DNA, 25 bp, Homo sapien
ggaacatctcacctgtcacacggaa

SEQ ID NO: 191068 - DNA, 25 bp, Homo sapien
atggaacatctcacccatcacacgg

SEQ ID NO: 191069 - DNA, 25 bp, Homo sapien
gtcacccgctgacacagaacatctc

SEQ ID NO: 191070 - DNA, 25 bp, Homo sapien
gtcacccgctgacacggaacatctc

SEQ ID NO: 191071 - DNA, 25 bp, Homo sapien
gaacaacggctacgtggagctctcc

SEQ ID NO: 191072 - DNA, 25 bp, Homo sapien
ggacatctcggggaacaacggctac

SEQ ID NO: 191073 - DNA, 25 bp, Homo sapien
gtcacggtcgccatcatcactgtca

SEQ ID NO: 191074 - DNA, 25 bp, Homo sapien
atcatcactgtcaccgccattagct

SEQ ID NO: 191075 - DNA, 25 bp, Homo sapien
gctacgtggagctctccttccgggc

SEQ ID NO: 191076 - DNA, 25 bp, Homo sapien
cctgccaggtgatcgccgaggacat

SEQ ID NO: 191077 - DNA, 25 bp, Homo sapien
tggctatgtcccgtgtgagacgtgt

SEQ ID NO: 191078 - DNA, 25 bp, Homo sapien
cagcgctgacctcgcgtggctatgt

SEQ ID NO: 191079 - DNA, 25 bp, Homo sapien
ttgcagatgcgctggttcgtgtttt

SEQ ID NO: 191080 - DNA, 25 bp, Homo sapien
tgttatttgcagatgcgctggttcg

SEQ ID NO: 191081 - DNA, 25 bp, Homo sapien
tgtcacccgcgtgttatttgcagat

SEQ ID NO: 191082 - DNA, 25 bp, Homo sapien
ttatttgcagatgcgctggttcgtg

SEQ ID NO: 191083 - DNA, 25 bp, Homo sapien
gtgtcacccgcgtgttatttgcaga

SEQ ID NO: 191084 - DNA, 25 bp, Homo sapien
cccgcgtcacccatagatacgcaca

SEQ ID NO: 191085 - DNA, 25 bp, Homo sapien
gcgctggttcgtgttttgttgaacg

SEQ ID NO: 191086 - DNA, 25 bp, Homo sapien
gatgcgctggttcgtgttttgttga

SEQ ID NO: 191087 - DNA, 25 bp, Homo sapien
ttcaccgacatgcaggtcctggacg

SEQ ID NO: 191088 - DNA, 25 bp, Homo sapien
ccgggagctcaagaacgtgagtgtc

SEQ ID NO: 191089 - DNA, 25 bp, Homo sapien
gtggtgaccgacatggccgacacac

SEQ ID NO: 191090 - DNA, 25 bp, Homo sapien
gccgacacacgggaggccattgtgc

SEQ ID NO: 191091 - DNA, 25 bp, Homo sapien
ggccattgtgcgtgcctcacgcctg

SEQ ID NO: 191092 - DNA, 25 bp, Homo sapien
gggcaacgccgacttcaccgacatg

SEQ ID NO: 191093 - DNA, 25 bp, Homo sapien
acagttcgtgcccttccgggagctc

SEQ ID NO: 191094 - DNA, 25 bp, Homo sapien
gctccgggacatcgtacagttcgtg

SEQ ID NO: 191095 - DNA, 25 bp, Homo sapien
aaggccgccgacgtggagacccagc

SEQ ID NO: 191096 - DNA, 25 bp, Homo sapien
gcggggtcagtggagaaaaggccgc

SEQ ID NO: 191097 - DNA, 25 bp, Homo sapien
aggccgccgacgtggagacccagcg

SEQ ID NO: 191098 - DNA, 25 bp, Homo sapien
aaaggccgccgacgtggagacccag

SEQ ID NO: 191099 - DNA, 25 bp, Homo sapien
aaggccgccgacgtggagacccagt

SEQ ID NO: 191100 - DNA, 25 bp, Homo sapien
ccagtgcggggtcagtggagaaaag

SEQ ID NO: 191101 - DNA, 25 bp, Homo sapien
aggccgccgacgtggagacccagtg

SEQ ID NO: 191102 - DNA, 25 bp, Homo sapien
ccagcgcggggtcggtggagaaaag

SEQ ID NO: 191103 - DNA, 25 bp, Homo sapien
ctcttaccgtccatggccacaatga

SEQ ID NO: 191104 - DNA, 25 bp, Homo sapien
cacttccggtcgcacgggatgctct

SEQ ID NO: 191105 - DNA, 25 bp, Homo sapien
gcggcgatcgaaccgaccaagctgc

SEQ ID NO: 191106 - DNA, 25 bp, Homo sapien
accttttgtgagtcgctcccggctc

SEQ ID NO: 191107 - DNA, 25 bp, Homo sapien
ccgctggcgcgaggaccttttgtga

SEQ ID NO: 191108 - DNA, 25 bp, Homo sapien
tgggctcacccatgggcctttccaa

SEQ ID NO: 191109 - DNA, 25 bp, Homo sapien
tgggcctttccaaaagcaaagagaa

SEQ ID NO: 191110 - DNA, 25 bp, Homo sapien
gccacaatgacaggagcagcactcg

SEQ ID NO: 191111 - DNA, 25 bp, Homo sapien
cagccggtgaaggagcacttttgct

SEQ ID NO: 191112 - DNA, 25 bp, Homo sapien
tttgctttgtacgtggcaacgctcg

SEQ ID NO: 191113 - DNA, 25 bp, Homo sapien
acttttgctttgtacgtggcaacgc

SEQ ID NO: 191114 - DNA, 25 bp, Homo sapien
gcacttttgctttgtacgtggcaac

SEQ ID NO: 191115 - DNA, 25 bp, Homo sapien
gagcacttttgctttgtacgtggca

SEQ ID NO: 191116 - DNA, 25 bp, Homo sapien
ccggtgaaggagcacttttgctttg

SEQ ID NO: 191117 - DNA, 25 bp, Homo sapien
ccgagctcgtagcagtggcactcca

SEQ ID NO: 191118 - DNA, 25 bp, Homo sapien
aaggagcacttttgctttgtacgtg

SEQ ID NO: 191119 - DNA, 25 bp, Homo sapien
tacacccgcgacgagttcgagcttg

SEQ ID NO: 191120 - DNA, 25 bp, Homo sapien
gccacttgtttgtggggagaattta

SEQ ID NO: 191121 - DNA, 25 bp, Homo sapien
gcttcttcacggtgcctccggaaca

SEQ ID NO: 191122 - DNA, 25 bp, Homo sapien
cagatccgtctgaagtgtattcgta

SEQ ID NO: 191123 - DNA, 25 bp, Homo sapien
gagcgtctcttggtaaccgttgcta

SEQ ID NO: 191124 - DNA, 25 bp, Homo sapien
aaataaggcccgaactgcagcagtc

SEQ ID NO: 191125 - DNA, 25 bp, Homo sapien
ccgggacttgggaagagcaagctcc

SEQ ID NO: 191126 - DNA, 25 bp, Homo sapien
tgtattcgtaaggagggcttcttca

SEQ ID NO: 191127 - DNA, 25 bp, Homo sapien
gctcaacaaatcactgcacacagtc

SEQ ID NO: 191128 - DNA, 25 bp, Homo sapien
acagtcggcgctcaaccaatcacag

SEQ ID NO: 191129 - DNA, 25 bp, Homo sapien
agtcggcgctcaaccaatcacagca

SEQ ID NO: 191130 - DNA, 25 bp, Homo sapien
acagtcggcgctcaacaaatcactg

SEQ ID NO: 191131 - DNA, 25 bp, Homo sapien
acaaatcactgcacacagtcggcgc

SEQ ID NO: 191132 - DNA, 25 bp, Homo sapien
agtcggcgctcaatcaatccctgca

SEQ ID NO: 191133 - DNA, 25 bp, Homo sapien
caacaaatcactgcacacagtcggc

SEQ ID NO: 191134 - DNA, 25 bp, Homo sapien
aatcaatccctgcacacagtcggcg

SEQ ID NO: 191135 - DNA, 25 bp, Homo sapien
tggaacatgcgcacccagacggcgt

SEQ ID NO: 191136 - DNA, 25 bp, Homo sapien
agaggtctccgtgctcgccgtagat

SEQ ID NO: 191137 - DNA, 25 bp, Homo sapien
cgttgtcccggtcgcgctggaacat

SEQ ID NO: 191138 - DNA, 25 bp, Homo sapien
agcatcaggctctgggcctgcatga

SEQ ID NO: 191139 - DNA, 25 bp, Homo sapien
tgctcgccgtagatggcgttgtccc

SEQ ID NO: 191140 - DNA, 25 bp, Homo sapien
ctgaaggtgatgtagaggtctccgt

SEQ ID NO: 191141 - DNA, 25 bp, Homo sapien
acacagtcggcgctgaagctccgct

SEQ ID NO: 191142 - DNA, 25 bp, Homo sapien
ccggcttgaccaggtggccgctgaa

SEQ ID NO: 191143 - DNA, 25 bp, Homo sapien
gcagaggatcagaggcaccaccaga

SEQ ID NO: 191144 - DNA, 25 bp, Homo sapien
agactctcagagtgggttattaccc

SEQ ID NO: 191145 - DNA, 25 bp, Homo sapien
gccagcttcttcgaaaggcccattt

SEQ ID NO: 191146 - DNA, 25 bp, Homo sapien
gccaaagtctccagagccgctcgga

SEQ ID NO: 191147 - DNA, 25 bp, Homo sapien
agggtgaaactcaggccaaagtctc

SEQ ID NO: 191148 - DNA, 25 bp, Homo sapien
ggggctggactgcattttttggaca

SEQ ID NO: 191149 - DNA, 25 bp, Homo sapien
gtcatattccgtggccgctccaaca

SEQ ID NO: 191150 - DNA, 25 bp, Homo sapien
cccgggcgctcagtcatattccgtg

SEQ ID NO: 191151 - DNA, 25 bp, Homo sapien
gtcagcagacgtctggccgcagtga

SEQ ID NO: 191152 - DNA, 25 bp, Homo sapien
ctgtgggctgcatactggccgagct

SEQ ID NO: 191153 - DNA, 25 bp, Homo sapien
aggtccactgttctctgcagggctg

SEQ ID NO: 191154 - DNA, 25 bp, Homo sapien
ttccgagatccaccagatcgacttg

SEQ ID NO: 191155 - DNA, 25 bp, Homo sapien
tccaccagatcgacttgatcgtgca

SEQ ID NO: 191156 - DNA, 25 bp, Homo sapien
tgggcacgcccagtgagaacatctg

SEQ ID NO: 191157 - DNA, 25 bp, Homo sapien
cccagtgagaacatctggccggtgg

SEQ ID NO: 191158 - DNA, 25 bp, Homo sapien
ctggccgcagtgaggtccactgttc

SEQ ID NO: 191159 - DNA, 25 bp, Homo sapien
ggtgacggcgctacctgtctgtccc

SEQ ID NO: 191160 - DNA, 25 bp, Homo sapien
cgctccaggcactggcggtagtcct

SEQ ID NO: 191161 - DNA, 25 bp, Homo sapien
gtcagggacctaaggccgcgcccag

SEQ ID NO: 191162 - DNA, 25 bp, Homo sapien
agcctgggtacctcggccttccagg

SEQ ID NO: 191163 - DNA, 25 bp, Homo sapien
ccttcgcccggcagatggagctgcg

SEQ ID NO: 191164 - DNA, 25 bp, Homo sapien
accggtatcgttcacgacgccgctg

SEQ ID NO: 191165 - DNA, 25 bp, Homo sapien
cacctgcattacctggcggggattg

SEQ ID NO: 191166 - DNA, 25 bp, Homo sapien
gttatcgaccgcacccttctctaga

SEQ ID NO: 191167 - DNA, 25 bp, Homo sapien
tcgtactccaggatggcggcgtaaa

SEQ ID NO: 191168 - DNA, 25 bp, Homo sapien
gtcagggcgacttggctgcaaaacc

SEQ ID NO: 191169 - DNA, 25 bp, Homo sapien
tggcatccacaggtgccgcgctatg

SEQ ID NO: 191170 - DNA, 25 bp, Homo sapien
agcgacttgcattacctcctgacag

SEQ ID NO: 191171 - DNA, 25 bp, Homo sapien
gcctgaaggcccagctacctgagca

SEQ ID NO: 191172 - DNA, 25 bp, Homo sapien
cggattcctcttgagcttggccttc

SEQ ID NO: 191173 - DNA, 25 bp, Homo sapien
gctgggctcctcctacaaagcctgg

SEQ ID NO: 191174 - DNA, 25 bp, Homo sapien
cgcacatggtcctgttcgtactcca

SEQ ID NO: 191175 - DNA, 25 bp, Homo sapien
ctgtctcctgggtcgtcccgacagt

SEQ ID NO: 191176 - DNA, 25 bp, Homo sapien
gccgggcctcttcgccgtcttgaga

SEQ ID NO: 191177 - DNA, 25 bp, Homo sapien
catgggcgtctaaccgcggcagcca

SEQ ID NO: 191178 - DNA, 25 bp, Homo sapien
cgtctcccacggtaagaggcggtga

SEQ ID NO: 191179 - DNA, 25 bp, Homo sapien
aggccagcgctccattggcgacaga

SEQ ID NO: 191180 - DNA, 25 bp, Homo sapien
agcggagcctaacgccgggtcctct

SEQ ID NO: 191181 - DNA, 25 bp, Homo sapien
tcctctaggaacctcgggccgggca

SEQ ID NO: 191182 - DNA, 25 bp, Homo sapien
tccgctgccatgaagcgggaccggc

SEQ ID NO: 191183 - DNA, 25 bp, Homo sapien
acccacgagtcggacatggccttgg

SEQ ID NO: 191184 - DNA, 25 bp, Homo sapien
ctcaagcgtggttcctgccgggaat

SEQ ID NO: 191185 - DNA, 25 bp, Homo sapien
ccctcaggtcgaggccttgcgtcgt

SEQ ID NO: 191186 - DNA, 25 bp, Homo sapien
tagtttttgcgtttggctttgccgc

SEQ ID NO: 191187 - DNA, 25 bp, Homo sapien
ccaaccaagccgaggcaggctcaga

SEQ ID NO: 191188 - DNA, 25 bp, Homo sapien
cgcaggtctcgggaaactaacggag

SEQ ID NO: 191189 - DNA, 25 bp, Homo sapien
actggggttggtcctgaagagacca

SEQ ID NO: 191190 - DNA, 25 bp, Homo sapien
gaagagaccacctggccaaccaagc

SEQ ID NO: 191191 - DNA, 25 bp, Homo sapien
tgtcaccgcgtgtccgagcgcgcgg

SEQ ID NO: 191192 - DNA, 25 bp, Homo sapien
ggccactgcgggctttgtctgctca

SEQ ID NO: 191193 - DNA, 25 bp, Homo sapien
cgttcccagcggcaaacctcccagg

SEQ ID NO: 191194 - DNA, 25 bp, Homo sapien
gcccgggcttttgtgggcatcggcc

SEQ ID NO: 191195 - DNA, 25 bp, Homo sapien
tgctgaaggcctacgagcagccgct

SEQ ID NO: 191196 - DNA, 25 bp, Homo sapien
acgagcagccgctcaacgaggagca

SEQ ID NO: 191197 - DNA, 25 bp, Homo sapien
cctggaggtcaccttgcccggggct

SEQ ID NO: 191198 - DNA, 25 bp, Homo sapien
gtcaccgcagtgtcccgggctggat

SEQ ID NO: 191199 - DNA, 25 bp, Homo sapien
atgtgaatctgtgaacctgcccgca

SEQ ID NO: 191200 - DNA, 25 bp, Homo sapien
cccgtgtgaatctgtgaacctgccc

SEQ ID NO: 191201 - DNA, 25 bp, Homo sapien
ccgtgtgaatctgtgaacctgcctg

SEQ ID NO: 191202 - DNA, 25 bp, Homo sapien
gtgtgaatctgtgaacctgcccgca

SEQ ID NO: 191203 - DNA, 25 bp, Homo sapien
gcctggataagcatagcccgtgtga

SEQ ID NO: 191204 - DNA, 25 bp, Homo sapien
tagcccatgtgaatctgtgaacctg

SEQ ID NO: 191205 - DNA, 25 bp, Homo sapien
cctggataagcatagcccgtgtgaa

SEQ ID NO: 191206 - DNA, 25 bp, Homo sapien
cccataagcatagcccgtgtgaatc

SEQ ID NO: 191207 - DNA, 25 bp, Homo sapien
cttcgccatctaccgcgcgctggac

SEQ ID NO: 191208 - DNA, 25 bp, Homo sapien
tcatggccaacaacgacagcgagga

SEQ ID NO: 191209 - DNA, 25 bp, Homo sapien
ggactggcaaggacgtctcttcgtg

SEQ ID NO: 191210 - DNA, 25 bp, Homo sapien
caaggacgtctcttcgtggacagaa

SEQ ID NO: 191211 - DNA, 25 bp, Homo sapien
ttcgtggacagaaagtcaggtcgtc

SEQ ID NO: 191212 - DNA, 25 bp, Homo sapien
aaagtcaggtcgtcggtgcgactgc

SEQ ID NO: 191213 - DNA, 25 bp, Homo sapien
gaggagcgcgaactcagccctcagc

SEQ ID NO: 191214 - DNA, 25 bp, Homo sapien
gagcggctcatcgacctcatggcca

SEQ ID NO: 191215 - DNA, 25 bp, Homo sapien
ctcctgggacatgcttctaacgttc

SEQ ID NO: 191216 - DNA, 25 bp, Homo sapien
cctgggacatgcttctaacgttccc

SEQ ID NO: 191217 - DNA, 25 bp, Homo sapien
cctcctgggacatgcttctaacgtt

SEQ ID NO: 191218 - DNA, 25 bp, Homo sapien
tcctctctctcagctcccccttggc

SEQ ID NO: 191219 - DNA, 25 bp, Homo sapien
tcaagatcccatggcccatcttccg

SEQ ID NO: 191220 - DNA, 25 bp, Homo sapien
ggcccgtcatccgtcttctctctca

SEQ ID NO: 191221 - DNA, 25 bp, Homo sapien
tcccatggcccgtcatccgtcttct

SEQ ID NO: 191222 - DNA, 25 bp, Homo sapien
catgcttctaacgttccccacaatt

SEQ ID NO: 191223 - DNA, 25 bp, Homo sapien
cacagatgctgcagaagcttcggga

SEQ ID NO: 191224 - DNA, 25 bp, Homo sapien
gacgagccgcatctggagacgcctc

SEQ ID NO: 191225 - DNA, 25 bp, Homo sapien
tgacgagcacgtgtggtcacagatg

SEQ ID NO: 191226 - DNA, 25 bp, Homo sapien
ggggcccgtcttgcatctgccattc

SEQ ID NO: 191227 - DNA, 25 bp, Homo sapien
ggccaaaatgcccagctgtctcttt

SEQ ID NO: 191228 - DNA, 25 bp, Homo sapien
ttcgagtcctatggcctgggccaaa

SEQ ID NO: 191229 - DNA, 25 bp, Homo sapien
cccagataccttttcgagtcctatg

SEQ ID NO: 191230 - DNA, 25 bp, Homo sapien
agctgtctcttttccggctggtcga

SEQ ID NO: 191231 - DNA, 25 bp, Homo sapien
cggacccagcgaagctaggggaaca

SEQ ID NO: 191232 - DNA, 25 bp, Homo sapien
gcgaagctaggggaacaaatcccaa

SEQ ID NO: 191233 - DNA, 25 bp, Homo sapien
agttcgggcctttccggtgcgctca

SEQ ID NO: 191234 - DNA, 25 bp, Homo sapien
aggcaacgagagctcgcgcctcagg

SEQ ID NO: 191235 - DNA, 25 bp, Homo sapien
tcgcgcctcaggagccagtgtaggc

SEQ ID NO: 191236 - DNA, 25 bp, Homo sapien
caggagccagtgtaggcgccgcaaa

SEQ ID NO: 191237 - DNA, 25 bp, Homo sapien
tgctcgacgcccaaggcccaacggt

SEQ ID NO: 191238 - DNA, 25 bp, Homo sapien
gcccaacggtcagaaccgcctctgc

SEQ ID NO: 191239 - DNA, 25 bp, Homo sapien
acaggacgcagtcacggcaccgccc

SEQ ID NO: 191240 - DNA, 25 bp, Homo sapien
cgcacaggacgcagtcacggcaccg

SEQ ID NO: 191241 - DNA, 25 bp, Homo sapien
gcacaggacgcagtcacggcaccgc

SEQ ID NO: 191242 - DNA, 25 bp, Homo sapien
cacaggacgcagtcacggcaccgcc

SEQ ID NO: 191243 - DNA, 25 bp, Homo sapien
caggacgcagtcacggcaccgccca

SEQ ID NO: 191244 - DNA, 25 bp, Homo sapien
aggacgcagtcacggcaccgcccag

SEQ ID NO: 191245 - DNA, 25 bp, Homo sapien
ggacgcagtcacggcaccgcccagg

SEQ ID NO: 191246 - DNA, 25 bp, Homo sapien
acgcagtcacggcaccgcccaggtc

SEQ ID NO: 191247 - DNA, 25 bp, Homo sapien
ttgtgccttccttgactccgtggcc

SEQ ID NO: 191248 - DNA, 25 bp, Homo sapien
ctgcctccctgtggtatccaaaccc

SEQ ID NO: 191249 - DNA, 25 bp, Homo sapien
accgcccacccttgcgccctcatgc

SEQ ID NO: 191250 - DNA, 25 bp, Homo sapien
cggtggtcctttgcctcccacagcc

SEQ ID NO: 191251 - DNA, 25 bp, Homo sapien
ccttgtgccttccttgactccgtgg

SEQ ID NO: 191252 - DNA, 25 bp, Homo sapien
tgtgccttccttgactccgtggccc

SEQ ID NO: 191253 - DNA, 25 bp, Homo sapien
cttgtgccttccttgactccgtggc

SEQ ID NO: 191254 - DNA, 25 bp, Homo sapien
cccggtggtcctttgcctcccacag

SEQ ID NO: 191255 - DNA, 25 bp, Homo sapien
gggcccggaactacaagctgcgcaa

SEQ ID NO: 191256 - DNA, 25 bp, Homo sapien
gagttccagctcacgcccttcgaga

SEQ ID NO: 191257 - DNA, 25 bp, Homo sapien
tacaagctgcgcaaggtcatggtga

SEQ ID NO: 191258 - DNA, 25 bp, Homo sapien
gctcacgcccttcgagatgctgatg

SEQ ID NO: 191259 - DNA, 25 bp, Homo sapien
acgcccttcgagatgctgatgcagg

SEQ ID NO: 191260 - DNA, 25 bp, Homo sapien
aggtgcaagagcaggagttcaaccc

SEQ ID NO: 191261 - DNA, 25 bp, Homo sapien
atccgggcccggaactacaagctgc

SEQ ID NO: 191262 - DNA, 25 bp, Homo sapien
atgctgatgcaggacatccgggccc

SEQ ID NO: 191263 - DNA, 25 bp, Homo sapien
gcgccttgcatttcgatctccgtga

SEQ ID NO: 191264 - DNA, 25 bp, Homo sapien
gccgcggagttagactgggttctaa

SEQ ID NO: 191265 - DNA, 25 bp, Homo sapien
tcgatctccgtgatgacgatgacgc

SEQ ID NO: 191266 - DNA, 25 bp, Homo sapien
ctctctccagacgtcgtggtcgttc

SEQ ID NO: 191267 - DNA, 25 bp, Homo sapien
ccgacagccgagttttctgcgcttc

SEQ ID NO: 191268 - DNA, 25 bp, Homo sapien
cgccgccgctgaagcgggaaagttc

SEQ ID NO: 191269 - DNA, 25 bp, Homo sapien
agctgaaatgctgcaggcacggtgc

SEQ ID NO: 191270 - DNA, 25 bp, Homo sapien
gcgtccgagtcaacaaccgcttcga

SEQ ID NO: 191271 - DNA, 25 bp, Homo sapien
ttgtccgtgtacacagatgggcttc

SEQ ID NO: 191272 - DNA, 25 bp, Homo sapien
ctgtccgtgtacacagatgggcttc

SEQ ID NO: 191273 - DNA, 25 bp, Homo sapien
gcctgtcacacgtgttgtccgtgta

SEQ ID NO: 191274 - DNA, 25 bp, Homo sapien
gttcgtgtacacagacgggctcctg

SEQ ID NO: 191275 - DNA, 25 bp, Homo sapien
ttcggagcctgtcacacgtgttgtc

SEQ ID NO: 191276 - DNA, 25 bp, Homo sapien
tgttcgtgtacacagacgggctcct

SEQ ID NO: 191277 - DNA, 25 bp, Homo sapien
gttgtccgtgtgcacagatgggctt

SEQ ID NO: 191278 - DNA, 25 bp, Homo sapien
tgtccgtgtacacagatgggcttcg

SEQ ID NO: 191279 - DNA, 25 bp, Homo sapien
ccgtcatctccctgtgggaaaagca

SEQ ID NO: 191280 - DNA, 25 bp, Homo sapien
tggggcttctcactgctgcccttgc

SEQ ID NO: 191281 - DNA, 25 bp, Homo sapien
gaccgtcgcagtagtgccgtgtgat

SEQ ID NO: 191282 - DNA, 25 bp, Homo sapien
tctctcagccgttcctggggaccgt

SEQ ID NO: 191283 - DNA, 25 bp, Homo sapien
cctgggcatgtcaggttctgagttc

SEQ ID NO: 191284 - DNA, 25 bp, Homo sapien
ggctctaggccaagcgagctccatc

SEQ ID NO: 191285 - DNA, 25 bp, Homo sapien
aggcgagcagctcagattcccggcc

SEQ ID NO: 191286 - DNA, 25 bp, Homo sapien
gcgagctccatccatactcagagga

SEQ ID NO: 191287 - DNA, 25 bp, Homo sapien
ccgcagaggtgaccgaaaagccgta

SEQ ID NO: 191288 - DNA, 25 bp, Homo sapien
ttctcctttcgcaggcactgagcgc

SEQ ID NO: 191289 - DNA, 25 bp, Homo sapien
tgtaaatgggtcacgctctgccgtc

SEQ ID NO: 191290 - DNA, 25 bp, Homo sapien
tggtccactgtttctcctataaatg

SEQ ID NO: 191291 - DNA, 25 bp, Homo sapien
tgagtgtgtcgctccctggtccact

SEQ ID NO: 191292 - DNA, 25 bp, Homo sapien
tcggccagttgcctgaagtagggaa

SEQ ID NO: 191293 - DNA, 25 bp, Homo sapien
atttctctgttggtcggagtcggcc

SEQ ID NO: 191294 - DNA, 25 bp, Homo sapien
gccgtatgatgatgttcccgatttc

SEQ ID NO: 191295 - DNA, 25 bp, Homo sapien
cgtgctgtacgtccacatgctggcc

SEQ ID NO: 191296 - DNA, 25 bp, Homo sapien
tggccagtgtcgtcttcagcacgct

SEQ ID NO: 191297 - DNA, 25 bp, Homo sapien
gcactgcgctaccacagcatcgtga

SEQ ID NO: 191298 - DNA, 25 bp, Homo sapien
tggaccgctacatctccatcttcta

SEQ ID NO: 191299 - DNA, 25 bp, Homo sapien
tgacgtgatcacctgcagctccatg

SEQ ID NO: 191300 - DNA, 25 bp, Homo sapien
ctgcagcagctggacaatgtcattg

SEQ ID NO: 191301 - DNA, 25 bp, Homo sapien
cgtggtcttcttcctggctatgctg

SEQ ID NO: 191302 - DNA, 25 bp, Homo sapien
ttcatcgcctactacgaccacgtgg

SEQ ID NO: 191303 - DNA, 25 bp, Homo sapien
aagctcctttggacgctcatggcag

SEQ ID NO: 191304 - DNA, 25 bp, Homo sapien
tcagagcaccttgtctgccaaaaga

SEQ ID NO: 191305 - DNA, 25 bp, Homo sapien
ttccgagctctgatccgacgctttg

SEQ ID NO: 191306 - DNA, 25 bp, Homo sapien
cctggcttgtgcgtccttgtgacaa

SEQ ID NO: 191307 - DNA, 25 bp, Homo sapien
tgagtcagatagaagccgctgccca

SEQ ID NO: 191308 - DNA, 25 bp, Homo sapien
tgcacgcagtctccgacctcagaga

SEQ ID NO: 191309 - DNA, 25 bp, Homo sapien
tctctgaccagtaaacgcatctcca

SEQ ID NO: 191310 - DNA, 25 bp, Homo sapien
cgacgctttgtttcttctcagtggg

SEQ ID NO: 191311 - DNA, 25 bp, Homo sapien
ttgggcctggactcgagatgacctt

SEQ ID NO: 191312 - DNA, 25 bp, Homo sapien
ggggttctcctcacagccgtgattt

SEQ ID NO: 191313 - DNA, 25 bp, Homo sapien
acagccgtgatttcctcggcccgaa

SEQ ID NO: 191314 - DNA, 25 bp, Homo sapien
tggagtagccgaacgtcccccgaga

SEQ ID NO: 191315 - DNA, 25 bp, Homo sapien
gctccaccctgtccctttgttggag

SEQ ID NO: 191316 - DNA, 25 bp, Homo sapien
ggactcgagatgaccttggtccagg

SEQ ID NO: 191317 - DNA, 25 bp, Homo sapien
aggaccaggctctccatcggcgcag

SEQ ID NO: 191318 - DNA, 25 bp, Homo sapien
cgagaggctagagccgccccgattt

SEQ ID NO: 191319 - DNA, 25 bp, Homo sapien
ccgggctatgcagaaacaccggggc

SEQ ID NO: 191320 - DNA, 25 bp, Homo sapien
aagcgctgcgcgaggtcagcaccaa

SEQ ID NO: 191321 - DNA, 25 bp, Homo sapien
tctcgcctgaaagacctgcggagcc

SEQ ID NO: 191322 - DNA, 25 bp, Homo sapien
gcctggccgtctcagccaatgggag

SEQ ID NO: 191323 - DNA, 25 bp, Homo sapien
ggagcctttgtcctccgcgcgggct

SEQ ID NO: 191324 - DNA, 25 bp, Homo sapien
cccactgccgcagagctgaatctgg

SEQ ID NO: 191325 - DNA, 25 bp, Homo sapien
ctccactcccgcagctgataggggg

SEQ ID NO: 191326 - DNA, 25 bp, Homo sapien
ctgccgcagagctgaatctggaccc

SEQ ID NO: 191327 - DNA, 25 bp, Homo sapien
tgcgtaaaaggaccgctggggcaca

SEQ ID NO: 191328 - DNA, 25 bp, Homo sapien
tgcccgcttagggtcgtgtctttta

SEQ ID NO: 191329 - DNA, 25 bp, Homo sapien
agggcacggtttctagcgttgttca

SEQ ID NO: 191330 - DNA, 25 bp, Homo sapien
ggcccgcgccaactttcttaggagc

SEQ ID NO: 191331 - DNA, 25 bp, Homo sapien
tggaaaaaccctgcgcccagacgtc

SEQ ID NO: 191332 - DNA, 25 bp, Homo sapien
cccgcaagccttgagtgacgccggt

SEQ ID NO: 191333 - DNA, 25 bp, Homo sapien
gtggcgccaaccttcgcgaattgtt

SEQ ID NO: 191334 - DNA, 25 bp, Homo sapien
accgaccgagcgctgtgcgtaaaag

SEQ ID NO: 191335 - DNA, 25 bp, Homo sapien
ggatgccacgttcccatgtctgtgt

SEQ ID NO: 191336 - DNA, 25 bp, Homo sapien
cacgttcccatgtctgtgtcctggg

SEQ ID NO: 191337 - DNA, 25 bp, Homo sapien
cacgttcccacgtctgtgtcctggg

SEQ ID NO: 191338 - DNA, 25 bp, Homo sapien
ggatgccacgttcccatgcctgtgt

SEQ ID NO: 191339 - DNA, 25 bp, Homo sapien
acgttcccatgcctgtgtcctgggg

SEQ ID NO: 191340 - DNA, 25 bp, Homo sapien
acgttcccacgcctgtgtcctgggg

SEQ ID NO: 191341 - DNA, 25 bp, Homo sapien
ggatgccacgttcccacgcctgtgt

SEQ ID NO: 191342 - DNA, 25 bp, Homo sapien
ggatgccacgttcccacgtctgtgt

SEQ ID NO: 191343 - DNA, 25 bp, Homo sapien
gagctcctccatgctgtgggcgcca

SEQ ID NO: 191344 - DNA, 25 bp, Homo sapien
ctgtgggcgccacattgtccgacca

SEQ ID NO: 191345 - DNA, 25 bp, Homo sapien
tgctgtgggcgccacattgtccgac

SEQ ID NO: 191346 - DNA, 25 bp, Homo sapien
gcccggcgggtaaggtgagaccaca

SEQ ID NO: 191347 - DNA, 25 bp, Homo sapien
cgggtaaggtgagaccacagccagg

SEQ ID NO: 191348 - DNA, 25 bp, Homo sapien
cctccatgctgtgggcgccacattg

SEQ ID NO: 191349 - DNA, 25 bp, Homo sapien
cctgcgcctcgtgctctggctggga

SEQ ID NO: 191350 - DNA, 25 bp, Homo sapien
gtgggcgccacattgtccgaccagc

SEQ ID NO: 191351 - DNA, 25 bp, Homo sapien
ccaagtgaagctgctcgcagctgga

SEQ ID NO: 191352 - DNA, 25 bp, Homo sapien
cgttgctcatcagcaaggtgcgtga

SEQ ID NO: 191353 - DNA, 25 bp, Homo sapien
tcatcagcaaggtgcgtgaggagta

SEQ ID NO: 191354 - DNA, 25 bp, Homo sapien
tcagcaaggtgcgtgaggagtatcc

SEQ ID NO: 191355 - DNA, 25 bp, Homo sapien
caaggtgcgtgaggagtatcccgac

SEQ ID NO: 191356 - DNA, 25 bp, Homo sapien
gaggagtatcccgaccgcatcatga

SEQ ID NO: 191357 - DNA, 25 bp, Homo sapien
agggcgagatgtacgaagacgacga

SEQ ID NO: 191358 - DNA, 25 bp, Homo sapien
ggagtatcccgaccgcatcatgaac

SEQ ID NO: 191359 - DNA, 25 bp, Homo sapien
tcagggcaagcgcaccaggcgcata

SEQ ID NO: 191360 - DNA, 25 bp, Homo sapien
ccaggcgcatatgctggccttcatc

SEQ ID NO: 191361 - DNA, 25 bp, Homo sapien
tatgctggccttcatctgtcctcag

SEQ ID NO: 191362 - DNA, 25 bp, Homo sapien
ggcagctgaatcttccacgcgagaa

SEQ ID NO: 191363 - DNA, 25 bp, Homo sapien
tccacgcgagaagcctaagagtagg

SEQ ID NO: 191364 - DNA, 25 bp, Homo sapien
gaaagcaggaataacgccagggccc

SEQ ID NO: 191365 - DNA, 25 bp, Homo sapien
tcctgtgtaaagagggtagagccgc

SEQ ID NO: 191366 - DNA, 25 bp, Homo sapien
agcaggcctgctctgtgtgtaaaca

SEQ ID NO: 191367 - DNA, 25 bp, Homo sapien
cacaccggggtgacttctcaggttc

SEQ ID NO: 191368 - DNA, 25 bp, Homo sapien
ggaatggccatcctgtccctgcgag

SEQ ID NO: 191369 - DNA, 25 bp, Homo sapien
gtgatgacaccgcttcctggtggtc

SEQ ID NO: 191370 - DNA, 25 bp, Homo sapien
acttctcaggttctcggggtggcag

SEQ ID NO: 191371 - DNA, 25 bp, Homo sapien
gacaggacgctgttgactccgcaca

SEQ ID NO: 191372 - DNA, 25 bp, Homo sapien
cagcagccctagaggaatggccatc

SEQ ID NO: 191373 - DNA, 25 bp, Homo sapien
aggtgccgaacccacggccaggctt

SEQ ID NO: 191374 - DNA, 25 bp, Homo sapien
tggcagctgcagtgatgacaccgct

SEQ ID NO: 191375 - DNA, 25 bp, Homo sapien
caggacctcctggacgtgcatgccg

SEQ ID NO: 191376 - DNA, 25 bp, Homo sapien
cagcattttgtggagaacgacgaga

SEQ ID NO: 191377 - DNA, 25 bp, Homo sapien
gacgagatgtactctgtccaggacc

SEQ ID NO: 191378 - DNA, 25 bp, Homo sapien
tcttcgccaagcacatcaagctgga

SEQ ID NO: 191379 - DNA, 25 bp, Homo sapien
ttgtggagaacgacgagatgtactc

SEQ ID NO: 191380 - DNA, 25 bp, Homo sapien
ctgggacttggcagctccaggatcg

SEQ ID NO: 191381 - DNA, 25 bp, Homo sapien
cagctccaggatcggcagcattttg

SEQ ID NO: 191382 - DNA, 25 bp, Homo sapien
ggctgctcgctcaccgagatccaca

SEQ ID NO: 191383 - DNA, 25 bp, Homo sapien
attcccgctgtttactggatgcccg

SEQ ID NO: 191384 - DNA, 25 bp, Homo sapien
tcggacatcggaaccgggacctcca

SEQ ID NO: 191385 - DNA, 25 bp, Homo sapien
acctcctcgcgaaccagctttgtgg

SEQ ID NO: 191386 - DNA, 25 bp, Homo sapien
taggaccgctctcccattgcgcatg

SEQ ID NO: 191387 - DNA, 25 bp, Homo sapien
ctggcgatcaaaccctcgaacggtc

SEQ ID NO: 191388 - DNA, 25 bp, Homo sapien
gccgatgcccgatttaagataagtc

SEQ ID NO: 191389 - DNA, 25 bp, Homo sapien
gaaataagtgttgatgccgatgccc

SEQ ID NO: 191390 - DNA, 25 bp, Homo sapien
cagcctccttgctcggctttgtaaa

SEQ ID NO: 191391 - DNA, 25 bp, Homo sapien
caagcgcccagctccttgatgacga

SEQ ID NO: 191392 - DNA, 25 bp, Homo sapien
cgacacggcaagaccctggtggaga

SEQ ID NO: 191393 - DNA, 25 bp, Homo sapien
tccttgatgacgaggtccggcacct

SEQ ID NO: 191394 - DNA, 25 bp, Homo sapien
tccgcactggcaggttgtgcagttt

SEQ ID NO: 191395 - DNA, 25 bp, Homo sapien
cgaccgcacgtgcatgatgctcggg

SEQ ID NO: 191396 - DNA, 25 bp, Homo sapien
agcagctgtgctccgggtagatcac

SEQ ID NO: 191397 - DNA, 25 bp, Homo sapien
acccagagtgcctacgcccaggtaa

SEQ ID NO: 191398 - DNA, 25 bp, Homo sapien
gcaggctcatcctgggttccgcact

SEQ ID NO: 191399 - DNA, 25 bp, Homo sapien
ccgggccacctttacgtgcacgtgg

SEQ ID NO: 191400 - DNA, 25 bp, Homo sapien
cggcccgggctacctttatatgcac

SEQ ID NO: 191401 - DNA, 25 bp, Homo sapien
ggcccgggctacctttacatgcacg

SEQ ID NO: 191402 - DNA, 25 bp, Homo sapien
ccgggctacctttacgtgcacgtgg

SEQ ID NO: 191403 - DNA, 25 bp, Homo sapien
cgggccacctttacgtgcacgtggg

SEQ ID NO: 191404 - DNA, 25 bp, Homo sapien
cgggctacctttatatgcacgtggg

SEQ ID NO: 191405 - DNA, 25 bp, Homo sapien
ctttacatgcacgtgcggtgggact

SEQ ID NO: 191406 - DNA, 25 bp, Homo sapien
ttatatgcacgtggggtgggacttc

SEQ ID NO: 191407 - DNA, 25 bp, Homo sapien
tccgggccacccaccaaggagcgtg

SEQ ID NO: 191408 - DNA, 25 bp, Homo sapien
tcttccaggtacttgcgtgtggggc

SEQ ID NO: 191409 - DNA, 25 bp, Homo sapien
ctcttgttctcttccaggtacttgc

SEQ ID NO: 191410 - DNA, 25 bp, Homo sapien
gggctgaactcacctccggtgccgg

SEQ ID NO: 191411 - DNA, 25 bp, Homo sapien
gggctcaggacgaaactccgggcca

SEQ ID NO: 191412 - DNA, 25 bp, Homo sapien
gacgcgcttgcaagcggccagcgtc

SEQ ID NO: 191413 - DNA, 25 bp, Homo sapien
ctgggcgaacaaagcggacgcgctt

SEQ ID NO: 191414 - DNA, 25 bp, Homo sapien
acaccaccgggacctggctgcgccc

SEQ ID NO: 191415 - DNA, 25 bp, Homo sapien
gagggctgctccttaggtccctgtt

SEQ ID NO: 191416 - DNA, 25 bp, Homo sapien
aacttgctctaacttcctcggccga

SEQ ID NO: 191417 - DNA, 25 bp, Homo sapien
cctttctttgtctgaggccgacttc

SEQ ID NO: 191418 - DNA, 25 bp, Homo sapien
gctgctccttaggtccctgtttggc

SEQ ID NO: 191419 - DNA, 25 bp, Homo sapien
ttgctcgctagaggttggaggcctc

SEQ ID NO: 191420 - DNA, 25 bp, Homo sapien
ggcactcctggttcggtagccctcg

SEQ ID NO: 191421 - DNA, 25 bp, Homo sapien
atgggccaccctttcggctcagtca

SEQ ID NO: 191422 - DNA, 25 bp, Homo sapien
ctttgtctgccaggattgctcgcta

SEQ ID NO: 191423 - DNA, 25 bp, Homo sapien
ctcggtacacggagaccctgggaat

SEQ ID NO: 191424 - DNA, 25 bp, Homo sapien
cggcgacattttcccaacgttcaca

SEQ ID NO: 191425 - DNA, 25 bp, Homo sapien
tagggacgcactcccgcctttggca

SEQ ID NO: 191426 - DNA, 25 bp, Homo sapien
tcttgtgacttatcgcggcatcgcc

SEQ ID NO: 191427 - DNA, 25 bp, Homo sapien
ttctggaattgagagctcggtgctc

SEQ ID NO: 191428 - DNA, 25 bp, Homo sapien
ctccgtggggcaaactcaggatgct

SEQ ID NO: 191429 - DNA, 25 bp, Homo sapien
cacaggggtggtcatagaacgccca

SEQ ID NO: 191430 - DNA, 25 bp, Homo sapien
tctcgcgaggatcttgtgacttatc

SEQ ID NO: 191431 - DNA, 25 bp, Homo sapien
accactgcctggtgaatctctgtag

SEQ ID NO: 191432 - DNA, 25 bp, Homo sapien
actgcctggtgaatctctgtagacc

SEQ ID NO: 191433 - DNA, 25 bp, Homo sapien
gatcattctctgtagaccggccgga

SEQ ID NO: 191434 - DNA, 25 bp, Homo sapien
gcactgcctggtcattctctgtaga

SEQ ID NO: 191435 - DNA, 25 bp, Homo sapien
ccactgcctggtgaatctctgtaga

SEQ ID NO: 191436 - DNA, 25 bp, Homo sapien
cactgcctggtgaatctctgtagac

SEQ ID NO: 191437 - DNA, 25 bp, Homo sapien
ccactgcctggtcattctctgtaga

SEQ ID NO: 191438 - DNA, 25 bp, Homo sapien
ggccggaaccactgcctggtgaatc

SEQ ID NO: 191439 - DNA, 25 bp, Homo sapien
tgtgtggagtccctttgtgtgcact

SEQ ID NO: 191440 - DNA, 25 bp, Homo sapien
cactgctggctctcatgctgctgct

SEQ ID NO: 191441 - DNA, 25 bp, Homo sapien
cgaggcatgacacagctgcggctcc

SEQ ID NO: 191442 - DNA, 25 bp, Homo sapien
cacggtcatggtgtccgaggcatga

SEQ ID NO: 191443 - DNA, 25 bp, Homo sapien
agtcgcccacgaggtaagggtgcca

SEQ ID NO: 191444 - DNA, 25 bp, Homo sapien
tctccacgtagtcgcccacgaggta

SEQ ID NO: 191445 - DNA, 25 bp, Homo sapien
tgccagcattgctcgtggtactgca

SEQ ID NO: 191446 - DNA, 25 bp, Homo sapien
tgctgctgctatgccaacggttcga

SEQ ID NO: 191447 - DNA, 25 bp, Homo sapien
caacgccggtgtttccgactgagcc

SEQ ID NO: 191448 - DNA, 25 bp, Homo sapien
agcctgtagtgctgccagccaatca

SEQ ID NO: 191449 - DNA, 25 bp, Homo sapien
ccaatcggcagtcaggaggtgctaa

SEQ ID NO: 191450 - DNA, 25 bp, Homo sapien
gcctgtcagtcatgggcacaacccg

SEQ ID NO: 191451 - DNA, 25 bp, Homo sapien
gcacaacccggttttgggctcagga

SEQ ID NO: 191452 - DNA, 25 bp, Homo sapien
ttgcgtgcaaccatctggaatcctc

SEQ ID NO: 191453 - DNA, 25 bp, Homo sapien
cagccaatcagcgttgagaccaagg

SEQ ID NO: 191454 - DNA, 25 bp, Homo sapien
caggcgcagtttcgcggttttatta

SEQ ID NO: 191455 - DNA, 25 bp, Homo sapien
tatctgatccgcaaggcggcgttgc

SEQ ID NO: 191456 - DNA, 25 bp, Homo sapien
accgtgaggacagagcttcctccct

SEQ ID NO: 191457 - DNA, 25 bp, Homo sapien
acttggggccgcgtccacagtgaga

SEQ ID NO: 191458 - DNA, 25 bp, Homo sapien
gccgcccaggcgaagatgaggaaaa

SEQ ID NO: 191459 - DNA, 25 bp, Homo sapien
ggaaaaagcttcctgttgccgttga

SEQ ID NO: 191460 - DNA, 25 bp, Homo sapien
cttcctgttgccgttgagtgtagcg

SEQ ID NO: 191461 - DNA, 25 bp, Homo sapien
gagcgcggccgtgtttccctgtccg

SEQ ID NO: 191462 - DNA, 25 bp, Homo sapien
cgcgcttgagccgtatctgatccgc

SEQ ID NO: 191463 - DNA, 25 bp, Homo sapien
ctggccctccgatgacatctgcagg

SEQ ID NO: 191464 - DNA, 25 bp, Homo sapien
cagctcattcctcacgtcggccatt

SEQ ID NO: 191465 - DNA, 25 bp, Homo sapien
tcagtctctccaggcttagctccag

SEQ ID NO: 191466 - DNA, 25 bp, Homo sapien
gtcagtctctccaggcttagctcca

SEQ ID NO: 191467 - DNA, 25 bp, Homo sapien
agtcagtctctccaggcttagctcc

SEQ ID NO: 191468 - DNA, 25 bp, Homo sapien
aagtcagtctctccaggcttagctc

SEQ ID NO: 191469 - DNA, 25 bp, Homo sapien
tggccctccgatgacatctgcaggc

SEQ ID NO: 191470 - DNA, 25 bp, Homo sapien
cattcctcacgtcggccattccagg

SEQ ID NO: 191471 - DNA, 25 bp, Homo sapien
ctgcgccatcgtgcgggctgaagac

SEQ ID NO: 191472 - DNA, 25 bp, Homo sapien
tgctggtacctgcacagcggctgtt

SEQ ID NO: 191473 - DNA, 25 bp, Homo sapien
caggctccggctgagtccacaaggc

SEQ ID NO: 191474 - DNA, 25 bp, Homo sapien
cgggtagcgtgcttcaccctcaggt

SEQ ID NO: 191475 - DNA, 25 bp, Homo sapien
ccagctggtgtgtgtctccttgctg

SEQ ID NO: 191476 - DNA, 25 bp, Homo sapien
tgtctccttgctgggttctgcctcg

SEQ ID NO: 191477 - DNA, 25 bp, Homo sapien
cagcacccgtgagcgcacattacgt

SEQ ID NO: 191478 - DNA, 25 bp, Homo sapien
tccacaaggcgggtagcgtgcttca

SEQ ID NO: 191479 - DNA, 25 bp, Homo sapien
tcagcacggcactctcttgggtcct

SEQ ID NO: 191480 - DNA, 25 bp, Homo sapien
acaaattctggaacgcgtttggcga

SEQ ID NO: 191481 - DNA, 25 bp, Homo sapien
gcagctccggaaggcagtgacctcg

SEQ ID NO: 191482 - DNA, 25 bp, Homo sapien
cagtgacctcgaggcagcctcagca

SEQ ID NO: 191483 - DNA, 25 bp, Homo sapien
tgggtcctcttccaggctcacactg

SEQ ID NO: 191484 - DNA, 25 bp, Homo sapien
agacctgcatgtccgcgtcttgtga

SEQ ID NO: 191485 - DNA, 25 bp, Homo sapien
ctgtgcatcttgcttccgggtattc

SEQ ID NO: 191486 - DNA, 25 bp, Homo sapien
ccggcgcacctgtggacaaattctg

SEQ ID NO: 191487 - DNA, 25 bp, Homo sapien
aggcggcagaaaacctgtgtgacta

SEQ ID NO: 191488 - DNA, 25 bp, Homo sapien
gccctcttgtggtcgtaggtatctg

SEQ ID NO: 191489 - DNA, 25 bp, Homo sapien
gggtcattctagtccggctgcctca

SEQ ID NO: 191490 - DNA, 25 bp, Homo sapien
ctgcgttcgcgtgcaacattaaaca

SEQ ID NO: 191491 - DNA, 25 bp, Homo sapien
cccacatgggctggtgaaaaatgaa

SEQ ID NO: 191492 - DNA, 25 bp, Homo sapien
tccagggtggcaccatcaccgttct

SEQ ID NO: 191493 - DNA, 25 bp, Homo sapien
cctctatcgcacaaaatgggcgcta

SEQ ID NO: 191494 - DNA, 25 bp, Homo sapien
cacacccaggttgcgaagccgagtg

SEQ ID NO: 191495 - DNA, 25 bp, Homo sapien
tcaccgtttaacacggcaactctta

SEQ ID NO: 191496 - DNA, 25 bp, Homo sapien
tgctgctgcgtctaaaccgtcctga

SEQ ID NO: 191497 - DNA, 25 bp, Homo sapien
ttccacacagacaactgcgaaggtg

SEQ ID NO: 191498 - DNA, 25 bp, Homo sapien
cagcggcaataaaatcggatgtttc

SEQ ID NO: 191499 - DNA, 25 bp, Homo sapien
ggatgtttccgcacacagcaccgtc

SEQ ID NO: 191500 - DNA, 25 bp, Homo sapien
caccgtcacaggctatcaccgttta

SEQ ID NO: 191501 - DNA, 25 bp, Homo sapien
ctcttaaaatcattgctgctgcgtc

SEQ ID NO: 191502 - DNA, 25 bp, Homo sapien
cgctgtccacccagcggcaataaaa

SEQ ID NO: 191503 - DNA, 25 bp, Homo sapien
catccatgttccaggcgtgcgggca

SEQ ID NO: 191504 - DNA, 25 bp, Homo sapien
tgggcttctctctgacgctcagcga

SEQ ID NO: 191505 - DNA, 25 bp, Homo sapien
ttccggcagatggatgttcagagca

SEQ ID NO: 191506 - DNA, 25 bp, Homo sapien
cctcacgtcgcgttgaggtggtccc

SEQ ID NO: 191507 - DNA, 25 bp, Homo sapien
gccgtttatgtcctttctcggtgga

SEQ ID NO: 191508 - DNA, 25 bp, Homo sapien
ctcactggaccgtctgccgtttatg

SEQ ID NO: 191509 - DNA, 25 bp, Homo sapien
cgatttcccgtctcgtctcactgga

SEQ ID NO: 191510 - DNA, 25 bp, Homo sapien
gcatcaccgctctcaggacgatttc

SEQ ID NO: 191511 - DNA, 25 bp, Homo sapien
cctcttcaacttgcgcgaagcgggc

SEQ ID NO: 191512 - DNA, 25 bp, Homo sapien
ggggcgcgtttgtctctaataagaa

SEQ ID NO: 191513 - DNA, 25 bp, Homo sapien
gagctcggcgtgtcaccctccgaga

SEQ ID NO: 191514 - DNA, 25 bp, Homo sapien
gccttggcggccacggtcttcttct

SEQ ID NO: 191515 - DNA, 25 bp, Homo sapien
ggccacggtcttcttctgcctcggt

SEQ ID NO: 191516 - DNA, 25 bp, Homo sapien
ttctgcctcggtcagaccacgcggc

SEQ ID NO: 191517 - DNA, 25 bp, Homo sapien
gccgctcagcccgaagtttcctgcg

SEQ ID NO: 191518 - DNA, 25 bp, Homo sapien
cgggaccctcttcaacttgcgcgaa

SEQ ID NO: 191519 - DNA, 25 bp, Homo sapien
ggcacccgtctggaaagggccagtc

SEQ ID NO: 191520 - DNA, 25 bp, Homo sapien
ttggcagagtctccgttacagactg

SEQ ID NO: 191521 - DNA, 25 bp, Homo sapien
tccggacatccgaactggtctcaga

SEQ ID NO: 191522 - DNA, 25 bp, Homo sapien
tactgaccttgcatcgtggggaccc

SEQ ID NO: 191523 - DNA, 25 bp, Homo sapien
tggcatctctgaacactcggcgctg

SEQ ID NO: 191524 - DNA, 25 bp, Homo sapien
cctgagacagcccttcatggcatct

SEQ ID NO: 191525 - DNA, 25 bp, Homo sapien
ctctgagatggggaaggatatatca

SEQ ID NO: 191526 - DNA, 25 bp, Homo sapien
acactttgtcttagcagcgtccgga

SEQ ID NO: 191527 - DNA, 25 bp, Homo sapien
gggcgtgacgccagcaggctgagct

SEQ ID NO: 191528 - DNA, 25 bp, Homo sapien
ggacgtcatcttgttcccgccagga

SEQ ID NO: 191529 - DNA, 25 bp, Homo sapien
gacgtcatcttgttcccgccaggaa

SEQ ID NO: 191530 - DNA, 25 bp, Homo sapien
cttgttcccgccaggaagtgggcgt

SEQ ID NO: 191531 - DNA, 25 bp, Homo sapien
gctaccccgatggactcgggactca

SEQ ID NO: 191532 - DNA, 25 bp, Homo sapien
tcccagacccgcttctgcggccggg

SEQ ID NO: 191533 - DNA, 25 bp, Homo sapien
cccgtgggacgtcatcttgttcccg

SEQ ID NO: 191534 - DNA, 25 bp, Homo sapien
cgtcatcttgttcccgccaggaagt

SEQ ID NO: 191535 - DNA, 25 bp, Homo sapien
cctcagtggctcatgttggcgtaac

SEQ ID NO: 191536 - DNA, 25 bp, Homo sapien
agctgcagaagagacgtcccgttcc

SEQ ID NO: 191537 - DNA, 25 bp, Homo sapien
gcctgtcaaacactccggggatgga

SEQ ID NO: 191538 - DNA, 25 bp, Homo sapien
gtccaagccacggtcgcacagtcaa

SEQ ID NO: 191539 - DNA, 25 bp, Homo sapien
cgcgttacctttgtttatgcagatg

SEQ ID NO: 191540 - DNA, 25 bp, Homo sapien
ttaaggagcgaccactcaccctggg

SEQ ID NO: 191541 - DNA, 25 bp, Homo sapien
acaactctaagtcacgcgggcccag

SEQ ID NO: 191542 - DNA, 25 bp, Homo sapien
ccggacggttgatgaatgtgctcca

SEQ ID NO: 191543 - DNA, 25 bp, Homo sapien
gaaccttggattcctgacacacggg

SEQ ID NO: 191544 - DNA, 25 bp, Homo sapien
ttggggcgtctcccatcgggaaatg

SEQ ID NO: 191545 - DNA, 25 bp, Homo sapien
ccgtggggatgaaacgggctctttg

SEQ ID NO: 191546 - DNA, 25 bp, Homo sapien
cctgtggggtatgggcctcctgtca

SEQ ID NO: 191547 - DNA, 25 bp, Homo sapien
cctcctgtcagcagcccgtcccggt

SEQ ID NO: 191548 - DNA, 25 bp, Homo sapien
gccgcccgcgaatgtcaggaacctt

SEQ ID NO: 191549 - DNA, 25 bp, Homo sapien
ttggattcctgacacacgggtgcgg

SEQ ID NO: 191550 - DNA, 25 bp, Homo sapien
cgcgaatgtcaggaaccttggattc

SEQ ID NO: 191551 - DNA, 25 bp, Homo sapien
cgccttggtcctcgccagcatgccc

SEQ ID NO: 191552 - DNA, 25 bp, Homo sapien
tgtgcgggccgtgctttcgcctccg

SEQ ID NO: 191553 - DNA, 25 bp, Homo sapien
ttcgcctccgcccatcagccggctc

SEQ ID NO: 191554 - DNA, 25 bp, Homo sapien
ccaccgagagacacttcagagctgt

SEQ ID NO: 191555 - DNA, 25 bp, Homo sapien
caccgagagacacttcagagctgtg

SEQ ID NO: 191556 - DNA, 25 bp, Homo sapien
cttcagagctgtgcgggccgtgctt

SEQ ID NO: 191557 - DNA, 25 bp, Homo sapien
gctgtgcgggccgtgctttcgcctc

SEQ ID NO: 191558 - DNA, 25 bp, Homo sapien
tcgcctccgcccatcagccggctcc

SEQ ID NO: 191559 - DNA, 25 bp, Homo sapien
tgtcagacgtcaccgggatgatgct

SEQ ID NO: 191560 - DNA, 25 bp, Homo sapien
ccagctgggtctgaggcgtctgttc

SEQ ID NO: 191561 - DNA, 25 bp, Homo sapien
gtctgaggcgtctgttctgggctct

SEQ ID NO: 191562 - DNA, 25 bp, Homo sapien
ccagcctgcaggtgtcagacgtcac

SEQ ID NO: 191563 - DNA, 25 bp, Homo sapien
tcactgaactctgaagccagcctgc

SEQ ID NO: 191564 - DNA, 25 bp, Homo sapien
ccagcagccttcactgaactctgaa

SEQ ID NO: 191565 - DNA, 25 bp, Homo sapien
ttctcgcccacagacgagagggtca

SEQ ID NO: 191566 - DNA, 25 bp, Homo sapien
gttctgggctcttctcgcccacaga

SEQ ID NO: 191567 - DNA, 25 bp, Homo sapien
agcctgaagttcagggccgagggcc

SEQ ID NO: 191568 - DNA, 25 bp, Homo sapien
ccggctctgacatttacacactgca

SEQ ID NO: 191569 - DNA, 25 bp, Homo sapien
ccctcctcatggtacggtgcgggga

SEQ ID NO: 191570 - DNA, 25 bp, Homo sapien
ggcaccctcggagacagcctgaagt

SEQ ID NO: 191571 - DNA, 25 bp, Homo sapien
tctgacatttacacactgcagccgc

SEQ ID NO: 191572 - DNA, 25 bp, Homo sapien
ggctctgacatttacacactgcagc

SEQ ID NO: 191573 - DNA, 25 bp, Homo sapien
acagctagcggctcacggtcacacg

SEQ ID NO: 191574 - DNA, 25 bp, Homo sapien
gacggcgtctgaccgaggcccaccc

SEQ ID NO: 191575 - DNA, 25 bp, Homo sapien
acttccgcagcaggtcggggcacac

SEQ ID NO: 191576 - DNA, 25 bp, Homo sapien
cgaacttccgcagcaggtcggggca

SEQ ID NO: 191577 - DNA, 25 bp, Homo sapien
tccgcagcaggtcggggcacacctg

SEQ ID NO: 191578 - DNA, 25 bp, Homo sapien
tgcctctgcaggacgacctcaggct

SEQ ID NO: 191579 - DNA, 25 bp, Homo sapien
gcaggacgacctcaggctggctcca

SEQ ID NO: 191580 - DNA, 25 bp, Homo sapien
gtgtcctgcaccgagccgtccctac

SEQ ID NO: 191581 - DNA, 25 bp, Homo sapien
tctccatgacgcacctcagcatgga

SEQ ID NO: 191582 - DNA, 25 bp, Homo sapien
tgacgcacctcagcatggatgaacc

SEQ ID NO: 191583 - DNA, 25 bp, Homo sapien
cgctgttcgctggagtttgactctc

SEQ ID NO: 191584 - DNA, 25 bp, Homo sapien
tggtctctccagaagagtgctggcc

SEQ ID NO: 191585 - DNA, 25 bp, Homo sapien
gctgaagaacaggtgcacctcaccg

SEQ ID NO: 191586 - DNA, 25 bp, Homo sapien
cgaaggtgaagaccggctcctagga

SEQ ID NO: 191587 - DNA, 25 bp, Homo sapien
acagcggcgctgttcgctggagttt

SEQ ID NO: 191588 - DNA, 25 bp, Homo sapien
agaccggctcctaggatgagtgaag

SEQ ID NO: 191589 - DNA, 25 bp, Homo sapien
tacgctgtagcgactgcatcgtgtg

SEQ ID NO: 191590 - DNA, 25 bp, Homo sapien
ccgggagttacgctgtagcgactgc

SEQ ID NO: 191591 - DNA, 25 bp, Homo sapien
cgcagaacttctgggccaaccactg

SEQ ID NO: 191592 - DNA, 25 bp, Homo sapien
ctcagcagggctctgagaactgcca

SEQ ID NO: 191593 - DNA, 25 bp, Homo sapien
acctgtcaccgcgtggggaatgacg

SEQ ID NO: 191594 - DNA, 25 bp, Homo sapien
atcttcacgccctggtcggggtcct

SEQ ID NO: 191595 - DNA, 25 bp, Homo sapien
tcggggtcctgcatgctcacgacca

SEQ ID NO: 191596 - DNA, 25 bp, Homo sapien
gcaccttcctcagatgcggcatctg

SEQ ID NO: 191597 - DNA, 25 bp, Homo sapien
tgtagccatgctgcaccaggacggc

SEQ ID NO: 191598 - DNA, 25 bp, Homo sapien
ctgccagactccaggaaaacccagg

SEQ ID NO: 191599 - DNA, 25 bp, Homo sapien
cgcattgcagaacacggggcgttgc

SEQ ID NO: 191600 - DNA, 25 bp, Homo sapien
ccacagagcataatgtgaggcgaga

SEQ ID NO: 191601 - DNA, 25 bp, Homo sapien
ggcgtcgcccacagagcataatgtg

SEQ ID NO: 191602 - DNA, 25 bp, Homo sapien
acagattgagaccaggcgtcgccca

SEQ ID NO: 191603 - DNA, 25 bp, Homo sapien
ccggagctgggttttcacacagatt

SEQ ID NO: 191604 - DNA, 25 bp, Homo sapien
tgtgcgtccgcattgcagaacacgg

SEQ ID NO: 191605 - DNA, 25 bp, Homo sapien
tccctgtccctgcacaccgggtcag

SEQ ID NO: 191606 - DNA, 25 bp, Homo sapien
ttcacacagattgagaccaggcgtc

SEQ ID NO: 191607 - DNA, 25 bp, Homo sapien
ttcgtaattgcacacgcagggcctg

SEQ ID NO: 191608 - DNA, 25 bp, Homo sapien
aagctgttgcttcctctgcggcaga

SEQ ID NO: 191609 - DNA, 25 bp, Homo sapien
ttttgaataagaatgcgcggctccc

SEQ ID NO: 191610 - DNA, 25 bp, Homo sapien
acggcgttctcatcctccggcgatt

SEQ ID NO: 191611 - DNA, 25 bp, Homo sapien
tcctcaacgggtggccacgtaatgc

SEQ ID NO: 191612 - DNA, 25 bp, Homo sapien
ctgggaacgtctctgtacctctgca

SEQ ID NO: 191613 - DNA, 25 bp, Homo sapien
ggggatctcctgtaccacccactga

SEQ ID NO: 191614 - DNA, 25 bp, Homo sapien
cgtaatgcttcctggccggtgaatg

SEQ ID NO: 191615 - DNA, 25 bp, Homo sapien
ttcctgatgagccaacgccgagggc

SEQ ID NO: 191616 - DNA, 25 bp, Homo sapien
gtgaccctgggcatgttccggccct

SEQ ID NO: 191617 - DNA, 25 bp, Homo sapien
gtgtgctccttaacccgcggcgaca

SEQ ID NO: 191618 - DNA, 25 bp, Homo sapien
cggcgacacatggttcgagcacgtg

SEQ ID NO: 191619 - DNA, 25 bp, Homo sapien
cgagcacgtgagcatgctggtaatc

SEQ ID NO: 191620 - DNA, 25 bp, Homo sapien
gctggtaatcatgctcaactgcgtg

SEQ ID NO: 191621 - DNA, 25 bp, Homo sapien
tcatgctcaactgcgtgaccctggg

SEQ ID NO: 191622 - DNA, 25 bp, Homo sapien
ttccggccctgtgaggacgttgagt

SEQ ID NO: 191623 - DNA, 25 bp, Homo sapien
gtgcggtcgctgcacatatgcccca

SEQ ID NO: 191624 - DNA, 25 bp, Homo sapien
ccaccgcgcagtcgctgcacatatg

SEQ ID NO: 191625 - DNA, 25 bp, Homo sapien
caccgtgcggtcgctgcacatatgc

SEQ ID NO: 191626 - DNA, 25 bp, Homo sapien
gtgcagtcgctgcacatatgcccca

SEQ ID NO: 191627 - DNA, 25 bp, Homo sapien
ccgcccaccgcgcagtcgctgcaca

SEQ ID NO: 191628 - DNA, 25 bp, Homo sapien
ccaccgtgcggtcgctgcacatatg

SEQ ID NO: 191629 - DNA, 25 bp, Homo sapien
cccaccgtgcggtcgctgcacatat

SEQ ID NO: 191630 - DNA, 25 bp, Homo sapien
accgtgcggtcgctgcacatatgcc

SEQ ID NO: 191631 - DNA, 25 bp, Homo sapien
ccatcttccaggtgggcggcaagat

SEQ ID NO: 191632 - DNA, 25 bp, Homo sapien
agggcgaggagaacccgttcatctg

SEQ ID NO: 191633 - DNA, 25 bp, Homo sapien
tcacgccgagacaacggcatgcaga

SEQ ID NO: 191634 - DNA, 25 bp, Homo sapien
cggcatgcagaagtgctcgcacatc

SEQ ID NO: 191635 - DNA, 25 bp, Homo sapien
agtactacaacgtgtgccgctcggg

SEQ ID NO: 191636 - DNA, 25 bp, Homo sapien
cacaacggtgccatcaacttcgaca

SEQ ID NO: 191637 - DNA, 25 bp, Homo sapien
acttcgacaacatcggctacgcctg

SEQ ID NO: 191638 - DNA, 25 bp, Homo sapien
cggctacgcctggattgccatcttc

SEQ ID NO: 191639 - DNA, 25 bp, Homo sapien
ccgcaaggtcaagcggcgcagcttg

SEQ ID NO: 191640 - DNA, 25 bp, Homo sapien
gtgggccacatattccgcaaggtca

SEQ ID NO: 191641 - DNA, 25 bp, Homo sapien
agctgctgaagtacgtgggccacat

SEQ ID NO: 191642 - DNA, 25 bp, Homo sapien
gagcctggcagctgctacgaagagc

SEQ ID NO: 191643 - DNA, 25 bp, Homo sapien
attgccacgcagttctcggagacga

SEQ ID NO: 191644 - DNA, 25 bp, Homo sapien
tggcgaatcagagactcgctcactc

SEQ ID NO: 191645 - DNA, 25 bp, Homo sapien
cacagtagggctcagtggcgaatca

SEQ ID NO: 191646 - DNA, 25 bp, Homo sapien
actcgaacaggcagcgcacagtagg

SEQ ID NO: 191647 - DNA, 25 bp, Homo sapien
actcagatggccgtggcgtctatga

SEQ ID NO: 191648 - DNA, 25 bp, Homo sapien
ccgtgcgacggacacaccaggccca

SEQ ID NO: 191649 - DNA, 25 bp, Homo sapien
caggacgtccggcacggtgaccgct

SEQ ID NO: 191650 - DNA, 25 bp, Homo sapien
atggccgtggcgtctatgaattcac

SEQ ID NO: 191651 - DNA, 25 bp, Homo sapien
ctcggaaagtggagactcagatggc

SEQ ID NO: 191652 - DNA, 25 bp, Homo sapien
ctcagcggctcggaaagtggagact

SEQ ID NO: 191653 - DNA, 25 bp, Homo sapien
cgtactgcacccgtgccctggagga

SEQ ID NO: 191654 - DNA, 25 bp, Homo sapien
tatgaattcacgcaggacgtccggc

SEQ ID NO: 191655 - DNA, 25 bp, Homo sapien
cagcaacatcgtgttcaccagcatg

SEQ ID NO: 191656 - DNA, 25 bp, Homo sapien
gcggccctctgggctacatccggaa

SEQ ID NO: 191657 - DNA, 25 bp, Homo sapien
cgggtgcggcctcctgaactgtccc

SEQ ID NO: 191658 - DNA, 25 bp, Homo sapien
agcccgaggagctgactaatgctct

SEQ ID NO: 191659 - DNA, 25 bp, Homo sapien
gagctgactaatgctctggagatca

SEQ ID NO: 191660 - DNA, 25 bp, Homo sapien
ctggagatcagcaacatcgtgttca

SEQ ID NO: 191661 - DNA, 25 bp, Homo sapien
accagcatgtttgccctggagatgc

SEQ ID NO: 191662 - DNA, 25 bp, Homo sapien
atcgtgttcaccagcatgtttgccc

SEQ ID NO: 191663 - DNA, 25 bp, Homo sapien
aggtctgcagaagcaacgctgctga

SEQ ID NO: 191664 - DNA, 25 bp, Homo sapien
tgagcctccggccacacaggtggaa

SEQ ID NO: 191665 - DNA, 25 bp, Homo sapien
gctgtcactcatgggcatcacgctg

SEQ ID NO: 191666 - DNA, 25 bp, Homo sapien
atgcgcgtgcttcgcattgcccgtg

SEQ ID NO: 191667 - DNA, 25 bp, Homo sapien
cggccctagtgctgaagctgctgaa

SEQ ID NO: 191668 - DNA, 25 bp, Homo sapien
aagctgctgaagatggctacgggca

SEQ ID NO: 191669 - DNA, 25 bp, Homo sapien
ctggacactgtggtgcaagctctcc

SEQ ID NO: 191670 - DNA, 25 bp, Homo sapien
gcaggctttcccacggaggtctgca

SEQ ID NO: 191671 - DNA, 25 bp, Homo sapien
agacgcagttcggaccctggatcac

SEQ ID NO: 191672 - DNA, 25 bp, Homo sapien
tcagacgcagttcggaccctggatc

SEQ ID NO: 191673 - DNA, 25 bp, Homo sapien
agaccccactcagacgcagttcgga

SEQ ID NO: 191674 - DNA, 25 bp, Homo sapien
cactcagacgcagttcggaccctgg

SEQ ID NO: 191675 - DNA, 25 bp, Homo sapien
ctcagacgcagttcagaccctggat

SEQ ID NO: 191676 - DNA, 25 bp, Homo sapien
acgcagttcggaccctggatcacag

SEQ ID NO: 191677 - DNA, 25 bp, Homo sapien
cgcagttcggaccctggatcacagc

SEQ ID NO: 191678 - DNA, 25 bp, Homo sapien
cactcagacgcagttcagaccctgg

SEQ ID NO: 191679 - DNA, 25 bp, Homo sapien
cccgcagagtgcagtgaagacaacc

SEQ ID NO: 191680 - DNA, 25 bp, Homo sapien
aggatgctctcgctgcccaacgaca

SEQ ID NO: 191681 - DNA, 25 bp, Homo sapien
caaacctggttgcacgcaaggtgtc

SEQ ID NO: 191682 - DNA, 25 bp, Homo sapien
cttcagcaacttcggcatggccttc

SEQ ID NO: 191683 - DNA, 25 bp, Homo sapien
gcccgtctacttcgtgaccttcgtg

SEQ ID NO: 191684 - DNA, 25 bp, Homo sapien
tcccgtgaggacaagcactgcctga

SEQ ID NO: 191685 - DNA, 25 bp, Homo sapien
agctacatgttcaggcccgtggtgc

SEQ ID NO: 191686 - DNA, 25 bp, Homo sapien
actggaacgggatcatgaaggtacc

SEQ ID NO: 191687 - DNA, 25 bp, Homo sapien
tgtggtcccgccctactgatgaccg

SEQ ID NO: 191688 - DNA, 25 bp, Homo sapien
gccctactgatgaccgtgaacctgt

SEQ ID NO: 191689 - DNA, 25 bp, Homo sapien
atgaccgtgaacctgtagggtgttg

SEQ ID NO: 191690 - DNA, 25 bp, Homo sapien
gtgtggccgcggataatgagaccct

SEQ ID NO: 191691 - DNA, 25 bp, Homo sapien
ccgcggataatgagaccctggggat

SEQ ID NO: 191692 - DNA, 25 bp, Homo sapien
cttctgtgcggggtcctggcacgcc

SEQ ID NO: 191693 - DNA, 25 bp, Homo sapien
cgggatgagctcaccgcagtcgcgc

SEQ ID NO: 191694 - DNA, 25 bp, Homo sapien
tcggcccagacagaagctccctcag

SEQ ID NO: 191695 - DNA, 25 bp, Homo sapien
tcgtccgcgatgacatgctgtgtgc

SEQ ID NO: 191696 - DNA, 25 bp, Homo sapien
cgccatacccgctgaaggaggtgga

SEQ ID NO: 191697 - DNA, 25 bp, Homo sapien
accacctttgcaacgcggaatatca

SEQ ID NO: 191698 - DNA, 25 bp, Homo sapien
gcggaatatcacaccggcctccata

SEQ ID NO: 191699 - DNA, 25 bp, Homo sapien
acagctttcaaatcgtccgcgatga

SEQ ID NO: 191700 - DNA, 25 bp, Homo sapien
tgtgcggggagcgaaaatcacgact

SEQ ID NO: 191701 - DNA, 25 bp, Homo sapien
gcgaaaatcacgactcctgccaggt

SEQ ID NO: 191702 - DNA, 25 bp, Homo sapien
ctccatacgggccacagctttcaaa

SEQ ID NO: 191703 - DNA, 25 bp, Homo sapien
agtcgcacagatcaggggctgcaag

SEQ ID NO: 191704 - DNA, 25 bp, Homo sapien
cagcgggaggtgatttctccgtcaa

SEQ ID NO: 191705 - DNA, 25 bp, Homo sapien
gaggtgatttctccgtcaaacacgg

SEQ ID NO: 191706 - DNA, 25 bp, Homo sapien
tttctccgtcaaacacggaagcctg

SEQ ID NO: 191707 - DNA, 25 bp, Homo sapien
aggaggagcaattaatttcggtctc

SEQ ID NO: 191708 - DNA, 25 bp, Homo sapien
taatttcggtctcctcccggcagcg

SEQ ID NO: 191709 - DNA, 25 bp, Homo sapien
aacacggaagcctgccgtggccgca

SEQ ID NO: 191710 - DNA, 25 bp, Homo sapien
ggtgtcctgtgagtcgcacagatca

SEQ ID NO: 191711 - DNA, 25 bp, Homo sapien
gaagcagcacctgtgagtgtcgccc

SEQ ID NO: 191712 - DNA, 25 bp, Homo sapien
actggcctggcccttagaggaagcg

SEQ ID NO: 191713 - DNA, 25 bp, Homo sapien
tctgagctctgggacccatggcgtc

SEQ ID NO: 191714 - DNA, 25 bp, Homo sapien
gagtcggggcaggaatctaaaccta

SEQ ID NO: 191715 - DNA, 25 bp, Homo sapien
cctggcattgaagcagcacctgtga

SEQ ID NO: 191716 - DNA, 25 bp, Homo sapien
cccagaggacaggaaacacacttcc

SEQ ID NO: 191717 - DNA, 25 bp, Homo sapien
gacgcatgtccacacagagcccgga

SEQ ID NO: 191718 - DNA, 25 bp, Homo sapien
tttcctcatctggaacctggcattg

SEQ ID NO: 191719 - DNA, 25 bp, Homo sapien
gcattcggccttttgtacggggtca

SEQ ID NO: 191720 - DNA, 25 bp, Homo sapien
actggccaattgcaaggggtttcac

SEQ ID NO: 191721 - DNA, 25 bp, Homo sapien
tcccgtcggtcatgctcgcattcgg

SEQ ID NO: 191722 - DNA, 25 bp, Homo sapien
gtttacagacgctccctcacatcgg

SEQ ID NO: 191723 - DNA, 25 bp, Homo sapien
ccttaggcctcagtggtctttgacc

SEQ ID NO: 191724 - DNA, 25 bp, Homo sapien
cctgcgacgcttcagaggatcctta

SEQ ID NO: 191725 - DNA, 25 bp, Homo sapien
cccggtttagggagcatccacactt

SEQ ID NO: 191726 - DNA, 25 bp, Homo sapien
gcctttggagatctcggcttccttt

SEQ ID NO: 191727 - DNA, 25 bp, Homo sapien
ccaggccaccgtatgttaggagcaa

SEQ ID NO: 191728 - DNA, 25 bp, Homo sapien
ctcatgaactgggagtgcgccattc

SEQ ID NO: 191729 - DNA, 25 bp, Homo sapien
tcccgatggcacgatgaacctcatg

SEQ ID NO: 191730 - DNA, 25 bp, Homo sapien
atgccgccacgctgatatgcttttg

SEQ ID NO: 191731 - DNA, 25 bp, Homo sapien
gccggttcttggtggttttgctcaa

SEQ ID NO: 191732 - DNA, 25 bp, Homo sapien
aaggagggcttcatttctgtgtgca

SEQ ID NO: 191733 - DNA, 25 bp, Homo sapien
gccatggggatactccgctcagatc

SEQ ID NO: 191734 - DNA, 25 bp, Homo sapien
actttgaacatgtcggggatcgccc

SEQ ID NO: 191735 - DNA, 25 bp, Homo sapien
cgctcacgcgtgttcgcactcagga

SEQ ID NO: 191736 - DNA, 25 bp, Homo sapien
caggaagctgcctgcggatgttgca

SEQ ID NO: 191737 - DNA, 25 bp, Homo sapien
gtgtgccctgtgcatctccatggta

SEQ ID NO: 191738 - DNA, 25 bp, Homo sapien
aagcagcacggcttgagggccaaca

SEQ ID NO: 191739 - DNA, 25 bp, Homo sapien
tggaatccgccagcgacgcagcctg

SEQ ID NO: 191740 - DNA, 25 bp, Homo sapien
cgaagcagtcgccaggaagcagcct

SEQ ID NO: 191741 - DNA, 25 bp, Homo sapien
cgtatcgcttgaggaacttctgcga

SEQ ID NO: 191742 - DNA, 25 bp, Homo sapien
atctccatggtacctgaagtccagg

SEQ ID NO: 191743 - DNA, 25 bp, Homo sapien
gggaggagtttaaagtgacacacta

SEQ ID NO: 191744 - DNA, 25 bp, Homo sapien
ggcgtccgcccagcagttgctcagt

SEQ ID NO: 191745 - DNA, 25 bp, Homo sapien
gcccagcagttgctcagtcgtcggc

SEQ ID NO: 191746 - DNA, 25 bp, Homo sapien
aaactgaggccgcgcatgcttggag

SEQ ID NO: 191747 - DNA, 25 bp, Homo sapien
cgcaggtcctcgtaaggccctttag

SEQ ID NO: 191748 - DNA, 25 bp, Homo sapien
cccgaaatccctgcgagtgcaaagc

SEQ ID NO: 191749 - DNA, 25 bp, Homo sapien
aatccctgcgagtgcaaagcggccc

SEQ ID NO: 191750 - DNA, 25 bp, Homo sapien
ttaaagtgacacactagacccgccc

SEQ ID NO: 191751 - DNA, 25 bp, Homo sapien
ctgccacctggttctcaagctgatc

SEQ ID NO: 191752 - DNA, 25 bp, Homo sapien
tctcaagctgatcactacgcaggtg

SEQ ID NO: 191753 - DNA, 25 bp, Homo sapien
ctctgcgttgcagagggatacggcc

SEQ ID NO: 191754 - DNA, 25 bp, Homo sapien
tgtgcagggacactgccacctggtt

SEQ ID NO: 191755 - DNA, 25 bp, Homo sapien
cagtgcctcgcgtgtgcagggacac

SEQ ID NO: 191756 - DNA, 25 bp, Homo sapien
cgctggttcaagctggagccacgct

SEQ ID NO: 191757 - DNA, 25 bp, Homo sapien
cgtcgaccgctggttcaagctggag

SEQ ID NO: 191758 - DNA, 25 bp, Homo sapien
tgatcactacgcaggtggggaaagt

SEQ ID NO: 191759 - DNA, 25 bp, Homo sapien
cacgaagaaaatgcgccaagggtca

SEQ ID NO: 191760 - DNA, 25 bp, Homo sapien
gcgcagcttactggggaggtcacaa

SEQ ID NO: 191761 - DNA, 25 bp, Homo sapien
gtcacaagagcagtttgcgccttcc

SEQ ID NO: 191762 - DNA, 25 bp, Homo sapien
gctctcggagtgctgagggaaactc

SEQ ID NO: 191763 - DNA, 25 bp, Homo sapien
gaaactcgcagaggtatcccagctg

SEQ ID NO: 191764 - DNA, 25 bp, Homo sapien
gtcgcatgcttgtgacgcaccactg

SEQ ID NO: 191765 - DNA, 25 bp, Homo sapien
tccgaggccagcatgcactgtctgt

SEQ ID NO: 191766 - DNA, 25 bp, Homo sapien
cgcaccactggacgcatgacataga

SEQ ID NO: 191767 - DNA, 25 bp, Homo sapien
tggcaggacggacgtgggaactgca

SEQ ID NO: 191768 - DNA, 25 bp, Homo sapien
ctgcaggggcacaggccctacgtga

SEQ ID NO: 191769 - DNA, 25 bp, Homo sapien
gaactgcaggggcacaggccctacg

SEQ ID NO: 191770 - DNA, 25 bp, Homo sapien
caaggtggcgcccatctgagcgaca

SEQ ID NO: 191771 - DNA, 25 bp, Homo sapien
aaggtggcgcccatctgagcgacag

SEQ ID NO: 191772 - DNA, 25 bp, Homo sapien
cacaggccctacgtgagctgcgtgg

SEQ ID NO: 191773 - DNA, 25 bp, Homo sapien
ggcacaggccctacgtgagctgcgt

SEQ ID NO: 191774 - DNA, 25 bp, Homo sapien
gcgcccatctgagcgacaggaggga

SEQ ID NO: 191775 - DNA, 25 bp, Homo sapien
aatggacaaactgtatgacgtgggc

SEQ ID NO: 191776 - DNA, 25 bp, Homo sapien
acgggagactcgtgggagtcacctc

SEQ ID NO: 191777 - DNA, 25 bp, Homo sapien
tctgcagaaaggagacgggagactc

SEQ ID NO: 191778 - DNA, 25 bp, Homo sapien
cgagagccagcgctctgcagaaagg

SEQ ID NO: 191779 - DNA, 25 bp, Homo sapien
aactgtatgacgtgggcgagagcca

SEQ ID NO: 191780 - DNA, 25 bp, Homo sapien
gacaaactgtatgacgtgggcgaga

SEQ ID NO: 191781 - DNA, 25 bp, Homo sapien
cggccaggacttaggacagggctgg

SEQ ID NO: 191782 - DNA, 25 bp, Homo sapien
cgtgggggtcaaagacaaatggaca

SEQ ID NO: 191783 - DNA, 25 bp, Homo sapien
tacatggtgggcagctatggcccga

SEQ ID NO: 191784 - DNA, 25 bp, Homo sapien
gacagaggacagctctgatgccctc

SEQ ID NO: 191785 - DNA, 25 bp, Homo sapien
cctccctagtggacaagaccgtcta

SEQ ID NO: 191786 - DNA, 25 bp, Homo sapien
cctatctggtggtgtccctcttcac

SEQ ID NO: 191787 - DNA, 25 bp, Homo sapien
accgtctacatggtgggcagctatg

SEQ ID NO: 191788 - DNA, 25 bp, Homo sapien
cgagcgcccaggagtatgagtttgt

SEQ ID NO: 191789 - DNA, 25 bp, Homo sapien
agtatgagtttgtgactccggtgga

SEQ ID NO: 191790 - DNA, 25 bp, Homo sapien
cctagtggacaagaccgtctacatg

SEQ ID NO: 191791 - DNA, 25 bp, Homo sapien
tgtgctcctgcaggcttaagtgacc

SEQ ID NO: 191792 - DNA, 25 bp, Homo sapien
gaccctggagcagaaccggtttgga

SEQ ID NO: 191793 - DNA, 25 bp, Homo sapien
gacgcctgagcgtccgttgccatta

SEQ ID NO: 191794 - DNA, 25 bp, Homo sapien
cgttgccattacgaggcggctgagc

SEQ ID NO: 191795 - DNA, 25 bp, Homo sapien
ccctggacgccaacggtgagttgca

SEQ ID NO: 191796 - DNA, 25 bp, Homo sapien
ggacgctgcaccctgtatacgacga

SEQ ID NO: 191797 - DNA, 25 bp, Homo sapien
tggctgtccaccaacgacttcgctg

SEQ ID NO: 191798 - DNA, 25 bp, Homo sapien
tgttcaccgtcatggaccacgactg

SEQ ID NO: 191799 - DNA, 25 bp, Homo sapien
cagaccgccgaatctgtggcccagg

SEQ ID NO: 191800 - DNA, 25 bp, Homo sapien
atccttcacccgtgtctggtgagtg

SEQ ID NO: 191801 - DNA, 25 bp, Homo sapien
tccaggccaagagggatccttcacc

SEQ ID NO: 191802 - DNA, 25 bp, Homo sapien
gtgaacaacccgttcttgcctcagg

SEQ ID NO: 191803 - DNA, 25 bp, Homo sapien
tgccgcttcccgtagggtgaacaac

SEQ ID NO: 191804 - DNA, 25 bp, Homo sapien
ggctccacggaagctgcacgagaga

SEQ ID NO: 191805 - DNA, 25 bp, Homo sapien
aaatgaagacgacctcgggcaggcc

SEQ ID NO: 191806 - DNA, 25 bp, Homo sapien
ccgtggtcacgtgaccgtcacttca

SEQ ID NO: 191807 - DNA, 25 bp, Homo sapien
gccgggcgtggattgtctcccacgt

SEQ ID NO: 191808 - DNA, 25 bp, Homo sapien
cgtggattgtctcccacgtctgtgg

SEQ ID NO: 191809 - DNA, 25 bp, Homo sapien
attgtctcccacgtctgtggggtgg

SEQ ID NO: 191810 - DNA, 25 bp, Homo sapien
gtggggcctggatactcccccgcat

SEQ ID NO: 191811 - DNA, 25 bp, Homo sapien
ggcgtggatcgtctcccgcatgtgc

SEQ ID NO: 191812 - DNA, 25 bp, Homo sapien
tgggcgtggatactcccccgcgtct

SEQ ID NO: 191813 - DNA, 25 bp, Homo sapien
gatcgtctcccgcatgtgcggggtc

SEQ ID NO: 191814 - DNA, 25 bp, Homo sapien
cctgtggggtcaggcgtggatagtc

SEQ ID NO: 191815 - DNA, 25 bp, Homo sapien
aacgcctacagtgggatcctcgggt

SEQ ID NO: 191816 - DNA, 25 bp, Homo sapien
accttccgctggaacgcctacagtg

SEQ ID NO: 191817 - DNA, 25 bp, Homo sapien
gcagggatcccaaagcagcagcgca

SEQ ID NO: 191818 - DNA, 25 bp, Homo sapien
cagcatctggcacgagtgggagatc

SEQ ID NO: 191819 - DNA, 25 bp, Homo sapien
gtgggagatcgccaacaacaccttc

SEQ ID NO: 191820 - DNA, 25 bp, Homo sapien
aacaacaccttcacgggcatgtgga

SEQ ID NO: 191821 - DNA, 25 bp, Homo sapien
aaagcaaccggctggcccatgtgtc

SEQ ID NO: 191822 - DNA, 25 bp, Homo sapien
tgcgtctacgcgctgacgttcgaga

SEQ ID NO: 191823 - DNA, 25 bp, Homo sapien
tgtgacctcactggccacatggatg

SEQ ID NO: 191824 - DNA, 25 bp, Homo sapien
agtcacgtttctgctgcggccgaaa

SEQ ID NO: 191825 - DNA, 25 bp, Homo sapien
cggggatgcgttctcagtcacgttt

SEQ ID NO: 191826 - DNA, 25 bp, Homo sapien
gtcgccgtaaaccacagatgcctgt

SEQ ID NO: 191827 - DNA, 25 bp, Homo sapien
agaaacacgtcggtgccgcttccca

SEQ ID NO: 191828 - DNA, 25 bp, Homo sapien
gatgcctgttcctgctcaactccta

SEQ ID NO: 191829 - DNA, 25 bp, Homo sapien
ccctgagcagaagggtcaggtcatc

SEQ ID NO: 191830 - DNA, 25 bp, Homo sapien
tggatgagctccgatgataactggc

SEQ ID NO: 191831 - DNA, 25 bp, Homo sapien
cgtcatggctgaggagcccaccggc

SEQ ID NO: 191832 - DNA, 25 bp, Homo sapien
cgccaggcctctgcccaaacatctg

SEQ ID NO: 191833 - DNA, 25 bp, Homo sapien
atggcgagtgtagcgatggtgctct

SEQ ID NO: 191834 - DNA, 25 bp, Homo sapien
aggcgtcatggctgaggagcccacc

SEQ ID NO: 191835 - DNA, 25 bp, Homo sapien
accagtcagcgaagggagtaccgcc

SEQ ID NO: 191836 - DNA, 25 bp, Homo sapien
gcgaagggagtaccgccaggcctct

SEQ ID NO: 191837 - DNA, 25 bp, Homo sapien
caaacatctgccatgggcggcagcc

SEQ ID NO: 191838 - DNA, 25 bp, Homo sapien
caggtgcagagccggccagcgacct

SEQ ID NO: 191839 - DNA, 25 bp, Homo sapien
agggcagccggagtatcctcgtgcc

SEQ ID NO: 191840 - DNA, 25 bp, Homo sapien
agtggcctccactcccacggagaca

SEQ ID NO: 191841 - DNA, 25 bp, Homo sapien
ctgtggcgccacctggcaacactgt

SEQ ID NO: 191842 - DNA, 25 bp, Homo sapien
acgccagccgtgagggaatttccgg

SEQ ID NO: 191843 - DNA, 25 bp, Homo sapien
tcgtccacacgccagccgtgaggga

SEQ ID NO: 191844 - DNA, 25 bp, Homo sapien
ccacactgtgtggagaccgtgctcc

SEQ ID NO: 191845 - DNA, 25 bp, Homo sapien
agccggagtatcctcgtgccgcggt

SEQ ID NO: 191846 - DNA, 25 bp, Homo sapien
tgtgtggagaccgtgctccaccacc

SEQ ID NO: 191847 - DNA, 25 bp, Homo sapien
tgcccacacgcaaaatggacgctga

SEQ ID NO: 191848 - DNA, 25 bp, Homo sapien
tagctgtgcttctgtcctcgggcaa

SEQ ID NO: 191849 - DNA, 25 bp, Homo sapien
tcgggcaacaaggtgctgagtcatc

SEQ ID NO: 191850 - DNA, 25 bp, Homo sapien
cgccggaggaactgtgctctttgag

SEQ ID NO: 191851 - DNA, 25 bp, Homo sapien
cccgtgattggctgctcgtactatt

SEQ ID NO: 191852 - DNA, 25 bp, Homo sapien
gttccctgcaacaatcctcaactgg

SEQ ID NO: 191853 - DNA, 25 bp, Homo sapien
gacgctgactatgacgttccctgca

SEQ ID NO: 191854 - DNA, 25 bp, Homo sapien
cgtcctttcgatgttgcgtcatgca

SEQ ID NO: 191855 - DNA, 25 bp, Homo sapien
cggctctgccgtgacacagcacatt

SEQ ID NO: 191856 - DNA, 25 bp, Homo sapien
gactcaggtgaaacacggtcgaccc

SEQ ID NO: 191857 - DNA, 25 bp, Homo sapien
acagcacattcaaggcgccgcggtc

SEQ ID NO: 191858 - DNA, 25 bp, Homo sapien
ggacacgcgaggacaagctacagac

SEQ ID NO: 191859 - DNA, 25 bp, Homo sapien
agctacagactgctcggaactcagg

SEQ ID NO: 191860 - DNA, 25 bp, Homo sapien
gaaattcccgtaccacgcgggctga

SEQ ID NO: 191861 - DNA, 25 bp, Homo sapien
cgagtaacgagacccgcaccttggc

SEQ ID NO: 191862 - DNA, 25 bp, Homo sapien
gccagaggtcttcaggcagaaagcc

SEQ ID NO: 191863 - DNA, 25 bp, Homo sapien
ccagggagagcttcccagacccgga

SEQ ID NO: 191864 - DNA, 25 bp, Homo sapien
gtgctggacttaccgaggacggcct

SEQ ID NO: 191865 - DNA, 25 bp, Homo sapien
ccgctgcaaacacggccaggtggtt

SEQ ID NO: 191866 - DNA, 25 bp, Homo sapien
ggccaggtggttctgttcaaagaca

SEQ ID NO: 191867 - DNA, 25 bp, Homo sapien
ggccaacttctacgccctggcgagg

SEQ ID NO: 191868 - DNA, 25 bp, Homo sapien
cagacccggagggactctgaccgca

SEQ ID NO: 191869 - DNA, 25 bp, Homo sapien
tctgaccgcaccgaggagaaacacc

SEQ ID NO: 191870 - DNA, 25 bp, Homo sapien
gacataaacaccgtgagcgcgcacc

SEQ ID NO: 191871 - DNA, 25 bp, Homo sapien
agccctaacgcgacatcaggcacga

SEQ ID NO: 191872 - DNA, 25 bp, Homo sapien
cggacgtcaaccagatggctttgcg

SEQ ID NO: 191873 - DNA, 25 bp, Homo sapien
ccagatggctttgcgagccgagagt

SEQ ID NO: 191874 - DNA, 25 bp, Homo sapien
tgccctaacgcgatgccacgggtca

SEQ ID NO: 191875 - DNA, 25 bp, Homo sapien
acatcaggcacgagggtgggaaacc

SEQ ID NO: 191876 - DNA, 25 bp, Homo sapien
ggcctgtacctgcttgctgtcttgc

SEQ ID NO: 191877 - DNA, 25 bp, Homo sapien
ccaaggatgcatgagcgctgcccta

SEQ ID NO: 191878 - DNA, 25 bp, Homo sapien
tacctgcttgctgtcttgctcgctg

SEQ ID NO: 191879 - DNA, 25 bp, Homo sapien
ttcttccgcaatgggaaccgcacgc

SEQ ID NO: 191880 - DNA, 25 bp, Homo sapien
gagtttggtgtgacggagtacccta

SEQ ID NO: 191881 - DNA, 25 bp, Homo sapien
tgacggagtaccctacgctcaagtt

SEQ ID NO: 191882 - DNA, 25 bp, Homo sapien
acgctcaagttcttccgcaatggga

SEQ ID NO: 191883 - DNA, 25 bp, Homo sapien
cgcacccggaggagtacacaggtga

SEQ ID NO: 191884 - DNA, 25 bp, Homo sapien
ccctgcaggaccacgggacgctgag

SEQ ID NO: 191885 - DNA, 25 bp, Homo sapien
accacgggacgctgagggcattgcc

SEQ ID NO: 191886 - DNA, 25 bp, Homo sapien
ccgagtcaatggtggtcacgctggc

SEQ ID NO: 191887 - DNA, 25 bp, Homo sapien
gcacgaagttggcatctgaaaaatg

SEQ ID NO: 191888 - DNA, 25 bp, Homo sapien
tcgggcactgctccgtcttgtagct

SEQ ID NO: 191889 - DNA, 25 bp, Homo sapien
gcaggctcacctgtactggaaccgc

SEQ ID NO: 191890 - DNA, 25 bp, Homo sapien
cgcctgtcccggctattgtggtagt

SEQ ID NO: 191891 - DNA, 25 bp, Homo sapien
gcacgcatagccctggcggcacagg

SEQ ID NO: 191892 - DNA, 25 bp, Homo sapien
accagccggagtcctctgagcacgg

SEQ ID NO: 191893 - DNA, 25 bp, Homo sapien
cttgtagctgcccagcacgaagttg

SEQ ID NO: 191894 - DNA, 25 bp, Homo sapien
tattgtggtagtgtgggcacgcata

SEQ ID NO: 191895 - DNA, 25 bp, Homo sapien
cgagatcacgctgatgcccacagga

SEQ ID NO: 191896 - DNA, 25 bp, Homo sapien
tgacccgggacagccaatcgcgggc

SEQ ID NO: 191897 - DNA, 25 bp, Homo sapien
gcgccttttctatttctttaccgca

SEQ ID NO: 191898 - DNA, 25 bp, Homo sapien
tttaccgcaatctgtttaaagagaa

SEQ ID NO: 191899 - DNA, 25 bp, Homo sapien
taaagagaaaagcaagcgcctgccc

SEQ ID NO: 191900 - DNA, 25 bp, Homo sapien
ggggcttcacacgtgacccgggaca

SEQ ID NO: 191901 - DNA, 25 bp, Homo sapien
tgtcgcgcggaacaaaaggcctttc

SEQ ID NO: 191902 - DNA, 25 bp, Homo sapien
aaggccacgcccacatgggagctgc

SEQ ID NO: 191903 - DNA, 25 bp, Homo sapien
ctgacctgtagtgggtcggcttctc

SEQ ID NO: 191904 - DNA, 25 bp, Homo sapien
ctcaggagcctcaacccagggtcga

SEQ ID NO: 191905 - DNA, 25 bp, Homo sapien
aggtacctacaaacacagacagcgc

SEQ ID NO: 191906 - DNA, 25 bp, Homo sapien
gctccgtcctgaactccttcaggta

SEQ ID NO: 191907 - DNA, 25 bp, Homo sapien
gctttcgaaaccgacggcattttca

SEQ ID NO: 191908 - DNA, 25 bp, Homo sapien
gcacacgccggtggcttcgttgtac

SEQ ID NO: 191909 - DNA, 25 bp, Homo sapien
cgcgcacttgtgctgtgaaaacagg

SEQ ID NO: 191910 - DNA, 25 bp, Homo sapien
tacttggagcagtacacgtcggggc

SEQ ID NO: 191911 - DNA, 25 bp, Homo sapien
atagcgtcacttccgtcgccggaaa

SEQ ID NO: 191912 - DNA, 25 bp, Homo sapien
gaagcccagcctatgagcctcagcg

SEQ ID NO: 191913 - DNA, 25 bp, Homo sapien
attgctgccttgactcctcgactga

SEQ ID NO: 191914 - DNA, 25 bp, Homo sapien
tgcctcggagcagttctgaaccgtc

SEQ ID NO: 191915 - DNA, 25 bp, Homo sapien
cggacgttgtcctcagagagttgtc

SEQ ID NO: 191916 - DNA, 25 bp, Homo sapien
acgactacagaacgtggtcccagta

SEQ ID NO: 191917 - DNA, 25 bp, Homo sapien
gccggggcacacaagacacgattca

SEQ ID NO: 191918 - DNA, 25 bp, Homo sapien
cgttcggctgcgaagagctctttcc

SEQ ID NO: 191919 - DNA, 25 bp, Homo sapien
gggtctcatttcctcacccttggcg

SEQ ID NO: 191920 - DNA, 25 bp, Homo sapien
atccctgctgagacccgcaagatgg

SEQ ID NO: 191921 - DNA, 25 bp, Homo sapien
atcacagggccggtgtttccaggct

SEQ ID NO: 191922 - DNA, 25 bp, Homo sapien
acccttggcgtccaggacagtgacc

SEQ ID NO: 191923 - DNA, 25 bp, Homo sapien
gacagtgaccagcaccgacgaggcc

SEQ ID NO: 191924 - DNA, 25 bp, Homo sapien
tgggtcctccactggagttccctcg

SEQ ID NO: 191925 - DNA, 25 bp, Homo sapien
cggccattccacagcatgcggcaga

SEQ ID NO: 191926 - DNA, 25 bp, Homo sapien
ctttcaggacagaacacaggggccc

SEQ ID NO: 191927 - DNA, 25 bp, Homo sapien
tgcgcctgcacaaacactccacggt

SEQ ID NO: 191928 - DNA, 25 bp, Homo sapien
gctgtcgccaaatatttgccagccc

SEQ ID NO: 191929 - DNA, 25 bp, Homo sapien
tgacaatgctgtcgccaaatatttg

SEQ ID NO: 191930 - DNA, 25 bp, Homo sapien
tgcccagtctgcgatgacaatgctg

SEQ ID NO: 191931 - DNA, 25 bp, Homo sapien
cgggctctatttgcccagtctgcga

SEQ ID NO: 191932 - DNA, 25 bp, Homo sapien
ttgccgggcgctaaagcaaacgggc

SEQ ID NO: 191933 - DNA, 25 bp, Homo sapien
ggcgagccagctgcgcctgcacaaa

SEQ ID NO: 191934 - DNA, 25 bp, Homo sapien
ggcgctaaagcaaacgggctctatt

SEQ ID NO: 191935 - DNA, 25 bp, Homo sapien
atccgagccgtgtcatcctcttagc

SEQ ID NO: 191936 - DNA, 25 bp, Homo sapien
ggagcggagaagtccttccatcttc

SEQ ID NO: 191937 - DNA, 25 bp, Homo sapien
gcgcttctccagagctggcatccta

SEQ ID NO: 191938 - DNA, 25 bp, Homo sapien
tctccgcttgctgggaaccagagct

SEQ ID NO: 191939 - DNA, 25 bp, Homo sapien
gcgggtgcaatctgcccattgatga

SEQ ID NO: 191940 - DNA, 25 bp, Homo sapien
gggttggattgctacctgggttcta

SEQ ID NO: 191941 - DNA, 25 bp, Homo sapien
tctaagcgcccacatgctacgtgtc

SEQ ID NO: 191942 - DNA, 25 bp, Homo sapien
tctgcgccgctaattggtctcgtca

SEQ ID NO: 191943 - DNA, 25 bp, Homo sapien
ggacccagatgcctgcgacgtctac

SEQ ID NO: 191944 - DNA, 25 bp, Homo sapien
gagctctactatgcggacctggtgc

SEQ ID NO: 191945 - DNA, 25 bp, Homo sapien
cagctgctacgcttttcagagctca

SEQ ID NO: 191946 - DNA, 25 bp, Homo sapien
cagcgacgacatccggcggtacttt

SEQ ID NO: 191947 - DNA, 25 bp, Homo sapien
agctcttcgactacgggctgcagca

SEQ ID NO: 191948 - DNA, 25 bp, Homo sapien
cggcggtactttggccgcaaggata

SEQ ID NO: 191949 - DNA, 25 bp, Homo sapien
ccgcaaggataaggggcaggaccca

SEQ ID NO: 191950 - DNA, 25 bp, Homo sapien
gcttttcagagctcatcagcgacga

SEQ ID NO: 191951 - DNA, 25 bp, Homo sapien
caatgcacgttacgccgcggtggaa

SEQ ID NO: 191952 - DNA, 25 bp, Homo sapien
tgtcgcccacgtttgcagccgcgct

SEQ ID NO: 191953 - DNA, 25 bp, Homo sapien
gggctgttccgaccacacaggtgcc

SEQ ID NO: 191954 - DNA, 25 bp, Homo sapien
aacgggatgcccgtgggtgtcaccg

SEQ ID NO: 191955 - DNA, 25 bp, Homo sapien
tccgaccacacaggtgcccgaggga

SEQ ID NO: 191956 - DNA, 25 bp, Homo sapien
gcggcgcctacgcaatgcacgttac

SEQ ID NO: 191957 - DNA, 25 bp, Homo sapien
tacgcaatgcacgttacgccgcggt

SEQ ID NO: 191958 - DNA, 25 bp, Homo sapien
gggtgaagctctgcgcacgaggccc

SEQ ID NO: 191959 - DNA, 25 bp, Homo sapien
gcaactgcctcagctctgagccctg

SEQ ID NO: 191960 - DNA, 25 bp, Homo sapien
agagtgggcgagtctggcggtgccc

SEQ ID NO: 191961 - DNA, 25 bp, Homo sapien
gtggcgcgctcacagcgctgcttgt

SEQ ID NO: 191962 - DNA, 25 bp, Homo sapien
ggcgcgctcacagcgctgcttgtgc

SEQ ID NO: 191963 - DNA, 25 bp, Homo sapien
acagcgctgcttgtgctcccgcagg

SEQ ID NO: 191964 - DNA, 25 bp, Homo sapien
agcgctgcttgtgctcccgcaggca

SEQ ID NO: 191965 - DNA, 25 bp, Homo sapien
gcgctgcttgtgctcccgcaggcag

SEQ ID NO: 191966 - DNA, 25 bp, Homo sapien
gcgtggcgcgctcacagcgctgctt

SEQ ID NO: 191967 - DNA, 25 bp, Homo sapien
gctgagaggatttctttatttcgcg

SEQ ID NO: 191968 - DNA, 25 bp, Homo sapien
caaaggcgggctgagaggatttctt

SEQ ID NO: 191969 - DNA, 25 bp, Homo sapien
agtcccaggctgttggacgtggtct

SEQ ID NO: 191970 - DNA, 25 bp, Homo sapien
tcccgaaagtcccaggctgttggac

SEQ ID NO: 191971 - DNA, 25 bp, Homo sapien
acgcctttctcactccacacggtgc

SEQ ID NO: 191972 - DNA, 25 bp, Homo sapien
agccgctgtctttcacgcctttctc

SEQ ID NO: 191973 - DNA, 25 bp, Homo sapien
gcccgggagttttcttcttgcgtca

SEQ ID NO: 191974 - DNA, 25 bp, Homo sapien
cgccgactctgaggcccgggagttt

SEQ ID NO: 191975 - DNA, 25 bp, Homo sapien
tcctggcgaatatactgcgcaagtc

SEQ ID NO: 191976 - DNA, 25 bp, Homo sapien
tactcgcccagctgttcctgacggg

SEQ ID NO: 191977 - DNA, 25 bp, Homo sapien
tccaccgtctcatgctgcgagaagc

SEQ ID NO: 191978 - DNA, 25 bp, Homo sapien
tcgcccacagaggtgaatgccgata

SEQ ID NO: 191979 - DNA, 25 bp, Homo sapien
tgtcccattccacaggcaagccatg

SEQ ID NO: 191980 - DNA, 25 bp, Homo sapien
acgcctacctgtggtcgtccatgtc

SEQ ID NO: 191981 - DNA, 25 bp, Homo sapien
gagtagtgagttcccagtccctgag

SEQ ID NO: 191982 - DNA, 25 bp, Homo sapien
ggcaccctgtctctatcctggcgaa

SEQ ID NO: 191983 - DNA, 25 bp, Homo sapien
ccaagtcaaggtccgctgcagactg

SEQ ID NO: 191984 - DNA, 25 bp, Homo sapien
cctgtcaggccctgcagaggatctc

SEQ ID NO: 191985 - DNA, 25 bp, Homo sapien
ttgaagaggacctccctgtcaggcc

SEQ ID NO: 191986 - DNA, 25 bp, Homo sapien
acagttctcccaaacttgaagagga

SEQ ID NO: 191987 - DNA, 25 bp, Homo sapien
gaaggggaaccctgacctcatccca

SEQ ID NO: 191988 - DNA, 25 bp, Homo sapien
ctgctcataatggaaggggaaccct

SEQ ID NO: 191989 - DNA, 25 bp, Homo sapien
ggtccgctgcagactgctcataatg

SEQ ID NO: 191990 - DNA, 25 bp, Homo sapien
gcagtcctcaacggccaagtcaagg

SEQ ID NO: 191991 - DNA, 25 bp, Homo sapien
tgtcggtggctacctgctcacacca

SEQ ID NO: 191992 - DNA, 25 bp, Homo sapien
taggcgtctcggaagtccttcagcc

SEQ ID NO: 191993 - DNA, 25 bp, Homo sapien
ggttggaccgctccacaaacacctg

SEQ ID NO: 191994 - DNA, 25 bp, Homo sapien
agcctggcacgcaccttgtgcttta

SEQ ID NO: 191995 - DNA, 25 bp, Homo sapien
accttgtgctttaggagaacgatga

SEQ ID NO: 191996 - DNA, 25 bp, Homo sapien
ctgttccggccagatttcccatctg

SEQ ID NO: 191997 - DNA, 25 bp, Homo sapien
agatttcccatctgggcatgggccc

SEQ ID NO: 191998 - DNA, 25 bp, Homo sapien
ctcgtcctgggacacgtggatggac

SEQ ID NO: 191999 - DNA, 25 bp, Homo sapien
aggagcccggccacacatgcccgtc

SEQ ID NO: 192000 - DNA, 25 bp, Homo sapien
tgtgaagccgctggacaggaaacgc

SEQ ID NO: 192001 - DNA, 25 bp, Homo sapien
acagttacctctgcgggctggtgag

SEQ ID NO: 192002 - DNA, 25 bp, Homo sapien
tcccacagttacctctgcgggctgg

SEQ ID NO: 192003 - DNA, 25 bp, Homo sapien
caatgacgccgaccttctcacgccg

SEQ ID NO: 192004 - DNA, 25 bp, Homo sapien
tgtgctcatcacctccctgccggag

SEQ ID NO: 192005 - DNA, 25 bp, Homo sapien
ccgaccttctcacgccgcctcaggc

SEQ ID NO: 192006 - DNA, 25 bp, Homo sapien
catgcccgtcacacgccaccaactc

SEQ ID NO: 192007 - DNA, 25 bp, Homo sapien
gaggacaacgcccacggcccgtgaa

SEQ ID NO: 192008 - DNA, 25 bp, Homo sapien
acagggagatcccaaagagccggcc

SEQ ID NO: 192009 - DNA, 25 bp, Homo sapien
ggctgcgctgccacagtacacgctg

SEQ ID NO: 192010 - DNA, 25 bp, Homo sapien
tgaaccacgtgaggtgcgacacttt

SEQ ID NO: 192011 - DNA, 25 bp, Homo sapien
gcgacacttttgtcctgccctggga

SEQ ID NO: 192012 - DNA, 25 bp, Homo sapien
atgccgcaagacctggctcagctgc

SEQ ID NO: 192013 - DNA, 25 bp, Homo sapien
gcctggtccagactccacacatggg

SEQ ID NO: 192014 - DNA, 25 bp, Homo sapien
agactccacacatgggctgcgctgc

SEQ ID NO: 192015 - DNA, 25 bp, Homo sapien
cagcccatgcgcttctggaactcgg

SEQ ID NO: 192016 - DNA, 25 bp, Homo sapien
cctgcaggggctggcaatcccgcga

SEQ ID NO: 192017 - DNA, 25 bp, Homo sapien
tcctcccgtagcctaagcgagcctc

SEQ ID NO: 192018 - DNA, 25 bp, Homo sapien
cccatgcgcttctggaactcggcgg

SEQ ID NO: 192019 - DNA, 25 bp, Homo sapien
cacgaaggcaactgtggccgtgacg

SEQ ID NO: 192020 - DNA, 25 bp, Homo sapien
gtagatcagcacgaaggcaactgtg

SEQ ID NO: 192021 - DNA, 25 bp, Homo sapien
cccgcgacgagtagatcagcacgaa

SEQ ID NO: 192022 - DNA, 25 bp, Homo sapien
tggcaatcccgcgacgagtagatca

SEQ ID NO: 192023 - DNA, 25 bp, Homo sapien
tatggccgtccgctccaggcgcagt

SEQ ID NO: 192024 - DNA, 25 bp, Homo sapien
gcctcagcgggcacagccgagaggc

SEQ ID NO: 192025 - DNA, 25 bp, Homo sapien
cccgcagcatgagggcgttgagctc

SEQ ID NO: 192026 - DNA, 25 bp, Homo sapien
ctgagggcgttgtaaggcagccaca

SEQ ID NO: 192027 - DNA, 25 bp, Homo sapien
ggcgttgtaaggcagccacagctgc

SEQ ID NO: 192028 - DNA, 25 bp, Homo sapien
gggcctgaaggcctcgccaggaacc

SEQ ID NO: 192029 - DNA, 25 bp, Homo sapien
tcgccaggaaccctgcgtatggccg

SEQ ID NO: 192030 - DNA, 25 bp, Homo sapien
ggaaccctgcgtatggccgtccgct

SEQ ID NO: 192031 - DNA, 25 bp, Homo sapien
tgggcctacagagaggagaccgttc

SEQ ID NO: 192032 - DNA, 25 bp, Homo sapien
ggagaccgttccttccaacacacag

SEQ ID NO: 192033 - DNA, 25 bp, Homo sapien
cctgcggagacgaagtcccgcttct

SEQ ID NO: 192034 - DNA, 25 bp, Homo sapien
tcagcgggcactgggcctacagaga

SEQ ID NO: 192035 - DNA, 25 bp, Homo sapien
caaagcattggacccggtgcggccc

SEQ ID NO: 192036 - DNA, 25 bp, Homo sapien
acacacagggcgagggcaaagcatt

SEQ ID NO: 192037 - DNA, 25 bp, Homo sapien
tctctgtgtctctgcggaagtactc

SEQ ID NO: 192038 - DNA, 25 bp, Homo sapien
gaagtcccgcttctctgtgtctctg

SEQ ID NO: 192039 - DNA, 25 bp, Homo sapien
ccagaaggaccgatgctcagagaca

SEQ ID NO: 192040 - DNA, 25 bp, Homo sapien
agagacacgcgtgacgcggcccttc

SEQ ID NO: 192041 - DNA, 25 bp, Homo sapien
agaaggaccgatgctcagagacacg

SEQ ID NO: 192042 - DNA, 25 bp, Homo sapien
ttcctggagaccagaaggaccggtg

SEQ ID NO: 192043 - DNA, 25 bp, Homo sapien
agaaggaccggtgctcagagacacg

SEQ ID NO: 192044 - DNA, 25 bp, Homo sapien
gagaccagaaggaccggtgctcaga

SEQ ID NO: 192045 - DNA, 25 bp, Homo sapien
tcctggagaccagaaggaccggtgc

SEQ ID NO: 192046 - DNA, 25 bp, Homo sapien
tcctggagaccagaaggaccgatgc

SEQ ID NO: 192047 - DNA, 25 bp, Homo sapien
agctcaccgtgtgattgatccgccg

SEQ ID NO: 192048 - DNA, 25 bp, Homo sapien
agagcagccttcttggttacggtga

SEQ ID NO: 192049 - DNA, 25 bp, Homo sapien
tgatctccaccgtccggaaggcctg

SEQ ID NO: 192050 - DNA, 25 bp, Homo sapien
cccgggattatgaagggcccagtgt

SEQ ID NO: 192051 - DNA, 25 bp, Homo sapien
cgctgagtcccacaaaggacagttt

SEQ ID NO: 192052 - DNA, 25 bp, Homo sapien
aggacagtttctggccaacatctga

SEQ ID NO: 192053 - DNA, 25 bp, Homo sapien
acttcacagccagcggttgttatgc

SEQ ID NO: 192054 - DNA, 25 bp, Homo sapien
ccgtgaggatcccaatgagggcgca

SEQ ID NO: 192055 - DNA, 25 bp, Homo sapien
ggatcatctcaacaggagtcccgca

SEQ ID NO: 192056 - DNA, 25 bp, Homo sapien
ggccacgaaacagatcttccgaagg

SEQ ID NO: 192057 - DNA, 25 bp, Homo sapien
cacaaacgtatcagaagggcagccc

SEQ ID NO: 192058 - DNA, 25 bp, Homo sapien
tggctgtacaggacggcatctgagc

SEQ ID NO: 192059 - DNA, 25 bp, Homo sapien
gggtgttgccaacatcaggatcatc

SEQ ID NO: 192060 - DNA, 25 bp, Homo sapien
cccagagacgatgagtgaacggcca

SEQ ID NO: 192061 - DNA, 25 bp, Homo sapien
cttccgaaggccttgtggctccaga

SEQ ID NO: 192062 - DNA, 25 bp, Homo sapien
cggcagagctcaaacggacgcaagg

SEQ ID NO: 192063 - DNA, 25 bp, Homo sapien
tgtgacctgcaacggcaaccaccga

SEQ ID NO: 192064 - DNA, 25 bp, Homo sapien
ttccttgccataggcggcggctaaa

SEQ ID NO: 192065 - DNA, 25 bp, Homo sapien
ttctgcccacgcgactgcaaaggcg

SEQ ID NO: 192066 - DNA, 25 bp, Homo sapien
ttagaagtcccgaagcatgcatccg

SEQ ID NO: 192067 - DNA, 25 bp, Homo sapien
cgacggcgaccatgtgacctgcaac

SEQ ID NO: 192068 - DNA, 25 bp, Homo sapien
ttcttagagacgttggccatggccc

SEQ ID NO: 192069 - DNA, 25 bp, Homo sapien
ggccggaccaggacaccttcttaga

SEQ ID NO: 192070 - DNA, 25 bp, Homo sapien
cgagggcaggcctttccttgccata

SEQ ID NO: 192071 - DNA, 25 bp, Homo sapien
caccagcttgttgtcattgtcctcg

SEQ ID NO: 192072 - DNA, 25 bp, Homo sapien
cgatccacgtggagccagtacctgc

SEQ ID NO: 192073 - DNA, 25 bp, Homo sapien
tgctagtgcagcattggccagcgtc

SEQ ID NO: 192074 - DNA, 25 bp, Homo sapien
ctctttcccgatggcaaggtttgca

SEQ ID NO: 192075 - DNA, 25 bp, Homo sapien
tcccagatagccaagccagacatgc

SEQ ID NO: 192076 - DNA, 25 bp, Homo sapien
cctgggtggacgtccagatgacaca

SEQ ID NO: 192077 - DNA, 25 bp, Homo sapien
ggggatctcatagccctccctgaag

SEQ ID NO: 192078 - DNA, 25 bp, Homo sapien
acgctgtcttgttcctggcccagca

SEQ ID NO: 192079 - DNA, 25 bp, Homo sapien
ctctacgatgggacctggcttggga

SEQ ID NO: 192080 - DNA, 25 bp, Homo sapien
gagcctcgaccaatgctgctgcgca

SEQ ID NO: 192081 - DNA, 25 bp, Homo sapien
acgtactctgtctcggagagctcca

SEQ ID NO: 192082 - DNA, 25 bp, Homo sapien
agctccatgtccgacacggctggta

SEQ ID NO: 192083 - DNA, 25 bp, Homo sapien
acggctggtaccacgtgcagcaccg

SEQ ID NO: 192084 - DNA, 25 bp, Homo sapien
acctcctgcacatacctagggaaca

SEQ ID NO: 192085 - DNA, 25 bp, Homo sapien
acaacccgcgtcaaaggtggctgtg

SEQ ID NO: 192086 - DNA, 25 bp, Homo sapien
ggaccctcaggacgcacgtactctg

SEQ ID NO: 192087 - DNA, 25 bp, Homo sapien
caggctccggaaccggacgtcaacg

SEQ ID NO: 192088 - DNA, 25 bp, Homo sapien
ccggacgtcaacgttgtaggacacg

SEQ ID NO: 192089 - DNA, 25 bp, Homo sapien
gaccggttgactgcctgagccacag

SEQ ID NO: 192090 - DNA, 25 bp, Homo sapien
caccgaggcctgtgaccggttgact

SEQ ID NO: 192091 - DNA, 25 bp, Homo sapien
gcgtgtctactttccggcctcggcg

SEQ ID NO: 192092 - DNA, 25 bp, Homo sapien
aggcccgcagccgcgtgtctacttt

SEQ ID NO: 192093 - DNA, 25 bp, Homo sapien
tcgcccagggtgaggtccaaggccc

SEQ ID NO: 192094 - DNA, 25 bp, Homo sapien
tgtaggacacgttgtagttgctggc

SEQ ID NO: 192095 - DNA, 25 bp, Homo sapien
gtccatgtcacaggtcgtcttcccg

SEQ ID NO: 192096 - DNA, 25 bp, Homo sapien
cctgagcttgtgtggattatttccg

SEQ ID NO: 192097 - DNA, 25 bp, Homo sapien
cgtcctccgcagattcgcgctgaga

SEQ ID NO: 192098 - DNA, 25 bp, Homo sapien
gaatggcgactggagccacctctca

SEQ ID NO: 192099 - DNA, 25 bp, Homo sapien
aactgagaatgttccctgggcacag

SEQ ID NO: 192100 - DNA, 25 bp, Homo sapien
tggcactcccggttgagacaactga

SEQ ID NO: 192101 - DNA, 25 bp, Homo sapien
caagctgagccctgtgtccatgtca

SEQ ID NO: 192102 - DNA, 25 bp, Homo sapien
cagaggctcaagaaaacccgcggga

SEQ ID NO: 192103 - DNA, 25 bp, Homo sapien
gcagcgccacgtcagcaaggctgtc

SEQ ID NO: 192104 - DNA, 25 bp, Homo sapien
cctgtccggtgcttgcagaactgct

SEQ ID NO: 192105 - DNA, 25 bp, Homo sapien
tgaagtgccgcctggacagtagcct

SEQ ID NO: 192106 - DNA, 25 bp, Homo sapien
agaggtcgttagtgcccggatccac

SEQ ID NO: 192107 - DNA, 25 bp, Homo sapien
ctgaaattccaggtgagcgggccgt

SEQ ID NO: 192108 - DNA, 25 bp, Homo sapien
tcctgctgcaggtacgtgcctcctg

SEQ ID NO: 192109 - DNA, 25 bp, Homo sapien
tccagacttgcggagcgtccgtgtg

SEQ ID NO: 192110 - DNA, 25 bp, Homo sapien
ggctgtcctcatctgcctggcgcaa

SEQ ID NO: 192111 - DNA, 25 bp, Homo sapien
acctccgcacggtgagatccgggct

SEQ ID NO: 192112 - DNA, 25 bp, Homo sapien
ggcctccagggtgagcctctctagc

SEQ ID NO: 192113 - DNA, 25 bp, Homo sapien
gacgcgatgctggttgctgcggctc

SEQ ID NO: 192114 - DNA, 25 bp, Homo sapien
tgacgggcggcccttcgtctcacct

SEQ ID NO: 192115 - DNA, 25 bp, Homo sapien
cttcgtctcaccttccgtcctcggg

SEQ ID NO: 192116 - DNA, 25 bp, Homo sapien
aggcagcgcgacctccgcacggtga

SEQ ID NO: 192117 - DNA, 25 bp, Homo sapien
tccgcacggtgagatccgggctcag

SEQ ID NO: 192118 - DNA, 25 bp, Homo sapien
caagaccaggcacgcagtccggggc

SEQ ID NO: 192119 - DNA, 25 bp, Homo sapien
ccgacttcctgggataagggcatgt

SEQ ID NO: 192120 - DNA, 25 bp, Homo sapien
cgcctaccaaggcgcggttgctgtg

SEQ ID NO: 192121 - DNA, 25 bp, Homo sapien
tcatctcctggagcacggtgcccac

SEQ ID NO: 192122 - DNA, 25 bp, Homo sapien
ggccctgggcgtgttctcatctcct

SEQ ID NO: 192123 - DNA, 25 bp, Homo sapien
gccgctgcagcgttgcttttgctgt

SEQ ID NO: 192124 - DNA, 25 bp, Homo sapien
ttcctgggataagggcatgtggctc

SEQ ID NO: 192125 - DNA, 25 bp, Homo sapien
gcttttgctgtgaggccgacttcct

SEQ ID NO: 192126 - DNA, 25 bp, Homo sapien
gactgcgtggctttaggatgaggct

SEQ ID NO: 192127 - DNA, 25 bp, Homo sapien
tagtgcagccagtccgctaaaaata

SEQ ID NO: 192128 - DNA, 25 bp, Homo sapien
ggctttgtagcgaggccaggtcttc

SEQ ID NO: 192129 - DNA, 25 bp, Homo sapien
cccggcctgccgctatttatagtgc

SEQ ID NO: 192130 - DNA, 25 bp, Homo sapien
tccgctaaaaatacactgggcctgg

SEQ ID NO: 192131 - DNA, 25 bp, Homo sapien
atccggtacggagagtgcagatgca

SEQ ID NO: 192132 - DNA, 25 bp, Homo sapien
ccgcatccggtacggagagtgcaga

SEQ ID NO: 192133 - DNA, 25 bp, Homo sapien
ccgctatttatagtgcagccagtcc

SEQ ID NO: 192134 - DNA, 25 bp, Homo sapien
aggccaggtcttcggccgcatccgg

SEQ ID NO: 192135 - DNA, 25 bp, Homo sapien
acaggcggatggcattcttgaaggc

SEQ ID NO: 192136 - DNA, 25 bp, Homo sapien
aggccgccaggtttcctgtctcgtt

SEQ ID NO: 192137 - DNA, 25 bp, Homo sapien
ctgtctcgttggctatttgcgcagc

SEQ ID NO: 192138 - DNA, 25 bp, Homo sapien
tgcgcagcctagaaagacaaagaac

SEQ ID NO: 192139 - DNA, 25 bp, Homo sapien
cttaccttctggacattgccctgga

SEQ ID NO: 192140 - DNA, 25 bp, Homo sapien
ggcagcccaagaccatggattctcc

SEQ ID NO: 192141 - DNA, 25 bp, Homo sapien
tgtagaagtgcaccgcctgcccgac

SEQ ID NO: 192142 - DNA, 25 bp, Homo sapien
cccgtggtaccttgcacaggcggat

SEQ ID NO: 192143 - DNA, 25 bp, Homo sapien
taagtccaattgttttcctgatgcc

SEQ ID NO: 192144 - DNA, 25 bp, Homo sapien
cggcctcccgagtgactctgttttc

SEQ ID NO: 192145 - DNA, 25 bp, Homo sapien
actgggacttggctttctccggata

SEQ ID NO: 192146 - DNA, 25 bp, Homo sapien
ctttctccggataagcggcggcacc

SEQ ID NO: 192147 - DNA, 25 bp, Homo sapien
tcagcgatgaccgtgcagagactcg

SEQ ID NO: 192148 - DNA, 25 bp, Homo sapien
atcctcaacaacgtggcggccttca

SEQ ID NO: 192149 - DNA, 25 bp, Homo sapien
cgaggcaccgtcaaacgtaagtcca

SEQ ID NO: 192150 - DNA, 25 bp, Homo sapien
ctccaactgggtgtgccagacgctg

SEQ ID NO: 192151 - DNA, 25 bp, Homo sapien
tcgtgcgttctgtcaggcatctgaa

SEQ ID NO: 192152 - DNA, 25 bp, Homo sapien
acagatgaccgtgtgattgaatctc

SEQ ID NO: 192153 - DNA, 25 bp, Homo sapien
ccacgtggctccgtcaccacgcatg

SEQ ID NO: 192154 - DNA, 25 bp, Homo sapien
cgtctcgttttggatatttacgtca

SEQ ID NO: 192155 - DNA, 25 bp, Homo sapien
atctctctgtatttcgtgcgttctg

SEQ ID NO: 192156 - DNA, 25 bp, Homo sapien
tgtgattgaatctcgaggcaggcga

SEQ ID NO: 192157 - DNA, 25 bp, Homo sapien
aatctcgaggcaggcgagccagagc

SEQ ID NO: 192158 - DNA, 25 bp, Homo sapien
tggatatttacgtcatctctctgta

SEQ ID NO: 192159 - DNA, 25 bp, Homo sapien
tgcagttcgacatgatgcgcgcctg

SEQ ID NO: 192160 - DNA, 25 bp, Homo sapien
gccgctgcattccaactggcgagta

SEQ ID NO: 192161 - DNA, 25 bp, Homo sapien
agaccacgaaagtggcgtgacggct

SEQ ID NO: 192162 - DNA, 25 bp, Homo sapien
aggccatggccgctgcattccaact

SEQ ID NO: 192163 - DNA, 25 bp, Homo sapien
tttccgaggcaaacagagaccacga

SEQ ID NO: 192164 - DNA, 25 bp, Homo sapien
atgcgcgcctgcaacctggtggcca

SEQ ID NO: 192165 - DNA, 25 bp, Homo sapien
ccaactggcgagtaagtacctgggc

SEQ ID NO: 192166 - DNA, 25 bp, Homo sapien
gctcttggcccacagtgcagttcga

SEQ ID NO: 192167 - DNA, 25 bp, Homo sapien
gcctctgggtctcactggcgtccga

SEQ ID NO: 192168 - DNA, 25 bp, Homo sapien
tcgtcagggtaggatctgggccacc

SEQ ID NO: 192169 - DNA, 25 bp, Homo sapien
cctttcttcgtcagggtaggatctg

SEQ ID NO: 192170 - DNA, 25 bp, Homo sapien
cctgcctgctctggtgctaggacga

SEQ ID NO: 192171 - DNA, 25 bp, Homo sapien
accgtcctccgcaggagccacctgg

SEQ ID NO: 192172 - DNA, 25 bp, Homo sapien
gtcccgttttcaccgcatgcctagg

SEQ ID NO: 192173 - DNA, 25 bp, Homo sapien
ttttcaccgcatgcctagggccgcg

SEQ ID NO: 192174 - DNA, 25 bp, Homo sapien
cgacgtgaacctttcttcgtcaggg

SEQ ID NO: 192175 - DNA, 25 bp, Homo sapien
cctcaatgatccactgcatgatttt

SEQ ID NO: 192176 - DNA, 25 bp, Homo sapien
ccactgcatgattttctggttcttc

SEQ ID NO: 192177 - DNA, 25 bp, Homo sapien
gcggtgcctgctgatctccttttcc

SEQ ID NO: 192178 - DNA, 25 bp, Homo sapien
taaggctcccgtggtgcagccgccg

SEQ ID NO: 192179 - DNA, 25 bp, Homo sapien
tcctggcatctgtaaggctcccgtg

SEQ ID NO: 192180 - DNA, 25 bp, Homo sapien
tggcatttcttttgcacgccacgcc

SEQ ID NO: 192181 - DNA, 25 bp, Homo sapien
cccgactcagccttcttggcatttc

SEQ ID NO: 192182 - DNA, 25 bp, Homo sapien
tggttcttctccgcatcctccgagg

SEQ ID NO: 192183 - DNA, 25 bp, Homo sapien
cgagacacgtgtgcgtttactgtta

SEQ ID NO: 192184 - DNA, 25 bp, Homo sapien
acgaccacacgcacttcagggtgga

SEQ ID NO: 192185 - DNA, 25 bp, Homo sapien
tgtcggtcatatgtctgtacgtgtc

SEQ ID NO: 192186 - DNA, 25 bp, Homo sapien
tctgcgccatgcgtgcgagacacgt

SEQ ID NO: 192187 - DNA, 25 bp, Homo sapien
acctgctatcgtggaacagcctaga

SEQ ID NO: 192188 - DNA, 25 bp, Homo sapien
gagtcaccatgctgagtcgcccttc

SEQ ID NO: 192189 - DNA, 25 bp, Homo sapien
ggctggacaatgactacgtggagtc

SEQ ID NO: 192190 - DNA, 25 bp, Homo sapien
ccagctttcctggttagcgcaacgc

SEQ ID NO: 192191 - DNA, 25 bp, Homo sapien
gccgagaggggatttggaacaaaca

SEQ ID NO: 192192 - DNA, 25 bp, Homo sapien
caggaaggatcctccgagcgctgtg

SEQ ID NO: 192193 - DNA, 25 bp, Homo sapien
ggcacaaagagggacgagaagaccc

SEQ ID NO: 192194 - DNA, 25 bp, Homo sapien
gacgggctcaagaagctgggcaagc

SEQ ID NO: 192195 - DNA, 25 bp, Homo sapien
ctcccggccgcaggatgacagtgaa

SEQ ID NO: 192196 - DNA, 25 bp, Homo sapien
tttggaacaaacaacggcggccatg

SEQ ID NO: 192197 - DNA, 25 bp, Homo sapien
gcccggacccgcaaccgtgcccaga

SEQ ID NO: 192198 - DNA, 25 bp, Homo sapien
acaacggcggccatgttgagagcgc

SEQ ID NO: 192199 - DNA, 25 bp, Homo sapien
cgggacgagctttttctaggagaga

SEQ ID NO: 192200 - DNA, 25 bp, Homo sapien
tccagcggacggtactgagaagcca

SEQ ID NO: 192201 - DNA, 25 bp, Homo sapien
gtttgatgcaacacgaccctcaggg

SEQ ID NO: 192202 - DNA, 25 bp, Homo sapien
ccgacccagcgagtgaccaaacata

SEQ ID NO: 192203 - DNA, 25 bp, Homo sapien
tgcatctctcgtttgtcccgtttcg

SEQ ID NO: 192204 - DNA, 25 bp, Homo sapien
gccatagtccgacgagcgacctgga

SEQ ID NO: 192205 - DNA, 25 bp, Homo sapien
ggccaggttattccgctctgcaaga

SEQ ID NO: 192206 - DNA, 25 bp, Homo sapien
tagccttcctcggtgacgctgagta

SEQ ID NO: 192207 - DNA, 25 bp, Homo sapien
ccgcccggcgttgatgaaaaaggtg

SEQ ID NO: 192208 - DNA, 25 bp, Homo sapien
ggctgtctgtccaccaatccaaaga

SEQ ID NO: 192209 - DNA, 25 bp, Homo sapien
ctcgaccagtcgcttccgaggcgga

SEQ ID NO: 192210 - DNA, 25 bp, Homo sapien
ctccgagaaaagtccggtctcgttg

SEQ ID NO: 192211 - DNA, 25 bp, Homo sapien
gttctcgcgaaaaggaggccatccc

SEQ ID NO: 192212 - DNA, 25 bp, Homo sapien
cgagttcactctggtggccgagttt

SEQ ID NO: 192213 - DNA, 25 bp, Homo sapien
aggctggcgtcacaacactactggc

SEQ ID NO: 192214 - DNA, 25 bp, Homo sapien
gcgtcggtcctttcagtggcgaaaa

SEQ ID NO: 192215 - DNA, 25 bp, Homo sapien
ctgtctctcccgttttccagaggga

SEQ ID NO: 192216 - DNA, 25 bp, Homo sapien
ccggtgcttccgtgcaacacgtttc

SEQ ID NO: 192217 - DNA, 25 bp, Homo sapien
aagtccttctcaagcgcaggggaga

SEQ ID NO: 192218 - DNA, 25 bp, Homo sapien
cgacctggaggcaccaagtccttct

SEQ ID NO: 192219 - DNA, 25 bp, Homo sapien
gtgatgaagattcccgcgacctgga

SEQ ID NO: 192220 - DNA, 25 bp, Homo sapien
ttgacgactttgtctgccaggacgc

SEQ ID NO: 192221 - DNA, 25 bp, Homo sapien
gcctgatcatctgaggggcaacttc

SEQ ID NO: 192222 - DNA, 25 bp, Homo sapien
ggcctgcggctacagcctatggtga

SEQ ID NO: 192223 - DNA, 25 bp, Homo sapien
caccttcttcgaggggctgtacgag

SEQ ID NO: 192224 - DNA, 25 bp, Homo sapien
tagattctagaacgcagattcctgg

SEQ ID NO: 192225 - DNA, 25 bp, Homo sapien
aacttagggtcttctggtggcgaga

SEQ ID NO: 192226 - DNA, 25 bp, Homo sapien
tcgtggagcacagaggacaagaaca

SEQ ID NO: 192227 - DNA, 25 bp, Homo sapien
gcacagaggacaagaacaccttctt

SEQ ID NO: 192228 - DNA, 25 bp, Homo sapien
agaacaccttcttcgaggggctgta

SEQ ID NO: 192229 - DNA, 25 bp, Homo sapien
ctgttagattctagaacgcagattc

SEQ ID NO: 192230 - DNA, 25 bp, Homo sapien
gcttcctctttgctgttagattcta

SEQ ID NO: 192231 - DNA, 25 bp, Homo sapien
actgtacactgacaccgctgccggg

SEQ ID NO: 192232 - DNA, 25 bp, Homo sapien
agatcctgggcatccagagtgggca

SEQ ID NO: 192233 - DNA, 25 bp, Homo sapien
actccaaggccttctgcacagtgca

SEQ ID NO: 192234 - DNA, 25 bp, Homo sapien
gcactcagcggaagacactcgagga

SEQ ID NO: 192235 - DNA, 25 bp, Homo sapien
tcatgctccgcaccgatgcaggaga

SEQ ID NO: 192236 - DNA, 25 bp, Homo sapien
aggtgacactgcacttgttcccagg

SEQ ID NO: 192237 - DNA, 25 bp, Homo sapien
tgttcccaggcgagaactgtacact

SEQ ID NO: 192238 - DNA, 25 bp, Homo sapien
tgcaagcagagtgccaaggacgccc

SEQ ID NO: 192239 - DNA, 25 bp, Homo sapien
tccgaaagcctcacgctggccgaag

SEQ ID NO: 192240 - DNA, 25 bp, Homo sapien
cccgccagccggctggctcagcagc

SEQ ID NO: 192241 - DNA, 25 bp, Homo sapien
aaagcctcacgctggccgaagtcta

SEQ ID NO: 192242 - DNA, 25 bp, Homo sapien
gctggccgaagtctacctcatgatg

SEQ ID NO: 192243 - DNA, 25 bp, Homo sapien
gtctacctcatgatgggcaagccca

SEQ ID NO: 192244 - DNA, 25 bp, Homo sapien
gcaagcccagcaagctgcagctgga

SEQ ID NO: 192245 - DNA, 25 bp, Homo sapien
ctgcagctggagtacgactggctgg

SEQ ID NO: 192246 - DNA, 25 bp, Homo sapien
tggaacctgcagacctccgaaagcc

SEQ ID NO: 192247 - DNA, 25 bp, Homo sapien
cccattttgtctgtgggatgcgtgt

SEQ ID NO: 192248 - DNA, 25 bp, Homo sapien
gcggcgccgaccgttcaaagcctaa

SEQ ID NO: 192249 - DNA, 25 bp, Homo sapien
cgaccgttcaaagcctaagtcgtcg

SEQ ID NO: 192250 - DNA, 25 bp, Homo sapien
atgattggcgtcttggcgcccaatg

SEQ ID NO: 192251 - DNA, 25 bp, Homo sapien
cggcggtcgacatgttccaggtccc

SEQ ID NO: 192252 - DNA, 25 bp, Homo sapien
ccgcgttccgtgtggtgcgttccgt

SEQ ID NO: 192253 - DNA, 25 bp, Homo sapien
tgcggcccattttgtctgtgggatg

SEQ ID NO: 192254 - DNA, 25 bp, Homo sapien
gcccgccgcccaatgcgagctccca

SEQ ID NO: 192255 - DNA, 25 bp, Homo sapien
gcgtgtgcgcattctgctgcccacg

SEQ ID NO: 192256 - DNA, 25 bp, Homo sapien
ttctaacgcctgtctccttgtcttg

SEQ ID NO: 192257 - DNA, 25 bp, Homo sapien
cttgtcttgccctctgtgctgtcgc

SEQ ID NO: 192258 - DNA, 25 bp, Homo sapien
atgctgaccatccatgtggcgtgtg

SEQ ID NO: 192259 - DNA, 25 bp, Homo sapien
gaccgtccatatgagcgtgtgcgca

SEQ ID NO: 192260 - DNA, 25 bp, Homo sapien
tgctgaccgtccgtgtgagcatctg

SEQ ID NO: 192261 - DNA, 25 bp, Homo sapien
ctgtctccttatcgtcacatgctga

SEQ ID NO: 192262 - DNA, 25 bp, Homo sapien
gtctgtgtgaccgtccgtgtaagcg

SEQ ID NO: 192263 - DNA, 25 bp, Homo sapien
ggactatggcgtgggctccaagaac

SEQ ID NO: 192264 - DNA, 25 bp, Homo sapien
tgaaatgtccgagtcaggccagtcc

SEQ ID NO: 192265 - DNA, 25 bp, Homo sapien
ttagtgtccacaggatgaaatgtcc

SEQ ID NO: 192266 - DNA, 25 bp, Homo sapien
ctccctgtgtttggccttagtgtcc

SEQ ID NO: 192267 - DNA, 25 bp, Homo sapien
agggacctgcagtgactcgctctcc

SEQ ID NO: 192268 - DNA, 25 bp, Homo sapien
cgggcgaggcaaagtgcaaagcatt

SEQ ID NO: 192269 - DNA, 25 bp, Homo sapien
gctccaagaacagcaagcgtgcccg

SEQ ID NO: 192270 - DNA, 25 bp, Homo sapien
tggccggataagcagagccactcgg

SEQ ID NO: 192271 - DNA, 25 bp, Homo sapien
cacgtctcccgagaagaagaaggtg

SEQ ID NO: 192272 - DNA, 25 bp, Homo sapien
cctgacctgcgaccgcgaaggagac

SEQ ID NO: 192273 - DNA, 25 bp, Homo sapien
tgggaatggagtcaagccagcgcca

SEQ ID NO: 192274 - DNA, 25 bp, Homo sapien
cccaatgaggacgacgctgggaatg

SEQ ID NO: 192275 - DNA, 25 bp, Homo sapien
ccctgcccttgcagctgtggtgtgc

SEQ ID NO: 192276 - DNA, 25 bp, Homo sapien
gagtgccggtgacacccgacctcgg

SEQ ID NO: 192277 - DNA, 25 bp, Homo sapien
caccatgaaggtgagcccgcgagga

SEQ ID NO: 192278 - DNA, 25 bp, Homo sapien
acacgcggatgaagaacgtgccggt

SEQ ID NO: 192279 - DNA, 25 bp, Homo sapien
atcgtgtggcaggtgtcctacaccc

SEQ ID NO: 192280 - DNA, 25 bp, Homo sapien
ggagggctacatcgacttccgcatt

SEQ ID NO: 192281 - DNA, 25 bp, Homo sapien
gctacatcgacttccgcattggtga

SEQ ID NO: 192282 - DNA, 25 bp, Homo sapien
tgaagcccgtgctgtccaaggcaga

SEQ ID NO: 192283 - DNA, 25 bp, Homo sapien
tgctgtccaaggcagagcgcagtca

SEQ ID NO: 192284 - DNA, 25 bp, Homo sapien
acatcatcgtgtggcaggtgtccta

SEQ ID NO: 192285 - DNA, 25 bp, Homo sapien
gcctggcccgacctgtacataggac

SEQ ID NO: 192286 - DNA, 25 bp, Homo sapien
cagagcgcagtcacatcatcgtgtg

SEQ ID NO: 192287 - DNA, 25 bp, Homo sapien
acacgctgtacgtgctcgtccagga

SEQ ID NO: 192288 - DNA, 25 bp, Homo sapien
gtccaggatgctctcagggttctcc

SEQ ID NO: 192289 - DNA, 25 bp, Homo sapien
ccctgacttgggtacgtgcttcccg

SEQ ID NO: 192290 - DNA, 25 bp, Homo sapien
tctcagggttctcctcgtgtgcatc

SEQ ID NO: 192291 - DNA, 25 bp, Homo sapien
gttctcctcgtgtgcatcccggagc

SEQ ID NO: 192292 - DNA, 25 bp, Homo sapien
agcccatgtccacacagcggggcgg

SEQ ID NO: 192293 - DNA, 25 bp, Homo sapien
gtgccactggcatcttggccacgtg

SEQ ID NO: 192294 - DNA, 25 bp, Homo sapien
ggtgtcctcagcacacgctgtacgt

SEQ ID NO: 192295 - DNA, 25 bp, Homo sapien
accagccgccagtcatggtacatga

SEQ ID NO: 192296 - DNA, 25 bp, Homo sapien
cgttctgcgataatcatggcccgga

SEQ ID NO: 192297 - DNA, 25 bp, Homo sapien
gggttccatgcgtatcctctgcaca

SEQ ID NO: 192298 - DNA, 25 bp, Homo sapien
cacccgctggttctggcattctaga

SEQ ID NO: 192299 - DNA, 25 bp, Homo sapien
tacatgacgtgttcgatctcccgcg

SEQ ID NO: 192300 - DNA, 25 bp, Homo sapien
gaggcgtctgcacacacttgctgtg

SEQ ID NO: 192301 - DNA, 25 bp, Homo sapien
tccagcagctcggacactaactgta

SEQ ID NO: 192302 - DNA, 25 bp, Homo sapien
ttcatagcttctgccgggatccagg

SEQ ID NO: 192303 - DNA, 25 bp, Homo sapien
cacggcgcgcaacgttgccattgta

SEQ ID NO: 192304 - DNA, 25 bp, Homo sapien
cgctgggagggagtcaatttattct

SEQ ID NO: 192305 - DNA, 25 bp, Homo sapien
tgccattgtaaaccggccttggagt

SEQ ID NO: 192306 - DNA, 25 bp, Homo sapien
gttcttcgaggcagagccgcacata

SEQ ID NO: 192307 - DNA, 25 bp, Homo sapien
ggttgcagcacgaggcttgttcttc

SEQ ID NO: 192308 - DNA, 25 bp, Homo sapien
atttaatgctctgttcgcgggcccg

SEQ ID NO: 192309 - DNA, 25 bp, Homo sapien
cccagacactgacttcggggttcca

SEQ ID NO: 192310 - DNA, 25 bp, Homo sapien
agctcgtcagaatccaggcccaacg

SEQ ID NO: 192311 - DNA, 25 bp, Homo sapien
cggcggctgcaactcatgctcagga

SEQ ID NO: 192312 - DNA, 25 bp, Homo sapien
agcccagcttgttgtgtagcacctg

SEQ ID NO: 192313 - DNA, 25 bp, Homo sapien
tgtgtagcacctgcttgaggcccgg

SEQ ID NO: 192314 - DNA, 25 bp, Homo sapien
ggtgaccttcatgctgctccgggcc

SEQ ID NO: 192315 - DNA, 25 bp, Homo sapien
cagcggcagaccctccagcgtgtct

SEQ ID NO: 192316 - DNA, 25 bp, Homo sapien
gagcgggtgaccttcatgctgctcc

SEQ ID NO: 192317 - DNA, 25 bp, Homo sapien
gctgcaactcatgctcaggacccag

SEQ ID NO: 192318 - DNA, 25 bp, Homo sapien
aggacccagcccagcttgttgtgta

SEQ ID NO: 192319 - DNA, 25 bp, Homo sapien
tgcccattggttggaaggcccttcg

SEQ ID NO: 192320 - DNA, 25 bp, Homo sapien
gacaaagctattgccgagaggtttc

SEQ ID NO: 192321 - DNA, 25 bp, Homo sapien
tgtcagtcctaatccaacgttccta

SEQ ID NO: 192322 - DNA, 25 bp, Homo sapien
tcccaagcggttggagacaaagctc

SEQ ID NO: 192323 - DNA, 25 bp, Homo sapien
ggagacaaagctcgcgcgcacattg

SEQ ID NO: 192324 - DNA, 25 bp, Homo sapien
gcacacctgtctcggagcttcggga

SEQ ID NO: 192325 - DNA, 25 bp, Homo sapien
atcgagagctcctccggcaagctga

SEQ ID NO: 192326 - DNA, 25 bp, Homo sapien
aaagtaggtccgtgtcatcgtctgc

SEQ ID NO: 192327 - DNA, 25 bp, Homo sapien
gctgtgcaccagtgcgaccgcggct

SEQ ID NO: 192328 - DNA, 25 bp, Homo sapien
gccgctccttgcaggtgggaatcct

SEQ ID NO: 192329 - DNA, 25 bp, Homo sapien
catctcgctcatgtctgtgggcttc

SEQ ID NO: 192330 - DNA, 25 bp, Homo sapien
gctgggcacccgtcttcctggaccg

SEQ ID NO: 192331 - DNA, 25 bp, Homo sapien
aatcctggatgtggacctgtgtggc

SEQ ID NO: 192332 - DNA, 25 bp, Homo sapien
ctgtgccgctccttgcaggtgggaa

SEQ ID NO: 192333 - DNA, 25 bp, Homo sapien
cagctgcccgcatcccggtggaggc

SEQ ID NO: 192334 - DNA, 25 bp, Homo sapien
gaccgggagcagagcatctcgctca

SEQ ID NO: 192335 - DNA, 25 bp, Homo sapien
agttcccagagaggttcatgaccgc

SEQ ID NO: 192336 - DNA, 25 bp, Homo sapien
ctccagcctgctcagacggttgttg

SEQ ID NO: 192337 - DNA, 25 bp, Homo sapien
ctattccagccgaggttgaggtccc

SEQ ID NO: 192338 - DNA, 25 bp, Homo sapien
aacacgtttgccttgatggcccgca

SEQ ID NO: 192339 - DNA, 25 bp, Homo sapien
tcatgaccgccacgttggtgaggcc

SEQ ID NO: 192340 - DNA, 25 bp, Homo sapien
tggcacaggttctctaggcccagca

SEQ ID NO: 192341 - DNA, 25 bp, Homo sapien
gaaggttccggagacagttcccaga

SEQ ID NO: 192342 - DNA, 25 bp, Homo sapien
tgtggtctagcgtgagcacctcaag

SEQ ID NO: 192343 - DNA, 25 bp, Homo sapien
ccaggcacttgacgttcagagaccc

SEQ ID NO: 192344 - DNA, 25 bp, Homo sapien
cttcaacaaagcaggcgaccgcgtg

SEQ ID NO: 192345 - DNA, 25 bp, Homo sapien
caaagcaggcgaccgcgtgtgctcc

SEQ ID NO: 192346 - DNA, 25 bp, Homo sapien
ggtcgccaggcacttgacgttcaga

SEQ ID NO: 192347 - DNA, 25 bp, Homo sapien
acaaatgtgtcctgaagtgtggcac

SEQ ID NO: 192348 - DNA, 25 bp, Homo sapien
tgctcacgaagtaacaaatgtgtcc

SEQ ID NO: 192349 - DNA, 25 bp, Homo sapien
ctccgggcttgctcacgaagtaaca

SEQ ID NO: 192350 - DNA, 25 bp, Homo sapien
tcgaacacgcacctgtgaacacggc

SEQ ID NO: 192351 - DNA, 25 bp, Homo sapien
cggccttaggcacctgcgcaacaga

SEQ ID NO: 192352 - DNA, 25 bp, Homo sapien
ccaggccattgtcccgcttctggga

SEQ ID NO: 192353 - DNA, 25 bp, Homo sapien
ctacaggggcacttgatgggaatca

SEQ ID NO: 192354 - DNA, 25 bp, Homo sapien
tcctctccgggatgccgtaggcatc

SEQ ID NO: 192355 - DNA, 25 bp, Homo sapien
acagcgttccgaggcagttggtcct

SEQ ID NO: 192356 - DNA, 25 bp, Homo sapien
ctcttttttggcaccgcacagtgga

SEQ ID NO: 192357 - DNA, 25 bp, Homo sapien
gcgctcgcgctcaacttgttttgtc

SEQ ID NO: 192358 - DNA, 25 bp, Homo sapien
ccgagctgcccaggactgcaaaaca

SEQ ID NO: 192359 - DNA, 25 bp, Homo sapien
tgtggtcgctggattccaaaagacg

SEQ ID NO: 192360 - DNA, 25 bp, Homo sapien
gcggcttctccacaggacgctcggg

SEQ ID NO: 192361 - DNA, 25 bp, Homo sapien
tctcacagccgcgtgtggctctgtg

SEQ ID NO: 192362 - DNA, 25 bp, Homo sapien
aggggtctccgtgcgctctcacagc

SEQ ID NO: 192363 - DNA, 25 bp, Homo sapien
ttagagggacaagacagccgcaggc

SEQ ID NO: 192364 - DNA, 25 bp, Homo sapien
ctccttcttgggagttagagggaca

SEQ ID NO: 192365 - DNA, 25 bp, Homo sapien
ctggattccaaaagacggtgcgccg

SEQ ID NO: 192366 - DNA, 25 bp, Homo sapien
ggccacagcctcgtgcaggtgcgac

SEQ ID NO: 192367 - DNA, 25 bp, Homo sapien
tgtcaatcaaggtgctgagcatccc

SEQ ID NO: 192368 - DNA, 25 bp, Homo sapien
tggcccgtcatctggtagaacctgc

SEQ ID NO: 192369 - DNA, 25 bp, Homo sapien
gccgccctgggccttcttgaggcag

SEQ ID NO: 192370 - DNA, 25 bp, Homo sapien
agtgcttgtccgtgacgacccgttt

SEQ ID NO: 192371 - DNA, 25 bp, Homo sapien
tgacgacccgtttcaggcccaggaa

SEQ ID NO: 192372 - DNA, 25 bp, Homo sapien
aggaagtcctgcacgcggccgacct

SEQ ID NO: 192373 - DNA, 25 bp, Homo sapien
acgatcagcttcgtgtccggggaca

SEQ ID NO: 192374 - DNA, 25 bp, Homo sapien
ggacggcgctccaggctgtgtccac

SEQ ID NO: 192375 - DNA, 25 bp, Homo sapien
gggaccctctgtttgaagaccgatc

SEQ ID NO: 192376 - DNA, 25 bp, Homo sapien
ggctcgcttgactccggcatcttca

SEQ ID NO: 192377 - DNA, 25 bp, Homo sapien
taggcgccgagcaccagggccacga

SEQ ID NO: 192378 - DNA, 25 bp, Homo sapien
cgcgctcgtagcacctgtcgaagaa

SEQ ID NO: 192379 - DNA, 25 bp, Homo sapien
cggcaggtgcataggccaagccttg

SEQ ID NO: 192380 - DNA, 25 bp, Homo sapien
aggaaaagcgtcgatccgggcactc

SEQ ID NO: 192381 - DNA, 25 bp, Homo sapien
agcgggagcctcatcgccaggccaa

SEQ ID NO: 192382 - DNA, 25 bp, Homo sapien
tcttcacgccaacgatgagcgcttg

SEQ ID NO: 192383 - DNA, 25 bp, Homo sapien
gcgaacttctgaggctccacgcgga

SEQ ID NO: 192384 - DNA, 25 bp, Homo sapien
accgacgcggcccactcaccatgcg

SEQ ID NO: 192385 - DNA, 25 bp, Homo sapien
cctccttcggcacccggtacgtgcg

SEQ ID NO: 192386 - DNA, 25 bp, Homo sapien
agcacgacaccgacgcggagcgcga

SEQ ID NO: 192387 - DNA, 25 bp, Homo sapien
gcacgcgcttcagccgctcctccag

SEQ ID NO: 192388 - DNA, 25 bp, Homo sapien
ccaggcggtggatgagctcctccgc

SEQ ID NO: 192389 - DNA, 25 bp, Homo sapien
cggcggcaagaaaacagcacgacac

SEQ ID NO: 192390 - DNA, 25 bp, Homo sapien
ggatgagctcctccgcgaacttctg

SEQ ID NO: 192391 - DNA, 25 bp, Homo sapien
cgaccctgcacggagctttcatgtg

SEQ ID NO: 192392 - DNA, 25 bp, Homo sapien
cggccgaaacagaccgttcctcgtg

SEQ ID NO: 192393 - DNA, 25 bp, Homo sapien
catctcagagtagagcccgggccgt

SEQ ID NO: 192394 - DNA, 25 bp, Homo sapien
gcctctctaccacgtgactgcggag

SEQ ID NO: 192395 - DNA, 25 bp, Homo sapien
gccgccgcaagcatctcagagtaga

SEQ ID NO: 192396 - DNA, 25 bp, Homo sapien
cctggacgtgaggagccttccaagc

SEQ ID NO: 192397 - DNA, 25 bp, Homo sapien
ggctcggactctgaagcccaattca

SEQ ID NO: 192398 - DNA, 25 bp, Homo sapien
attcatggccggaaaccagcgcagc

SEQ ID NO: 192399 - DNA, 25 bp, Homo sapien
ggctcaggtcggataccgccaactg

SEQ ID NO: 192400 - DNA, 25 bp, Homo sapien
gaaacgccgcgcctaccaggttatg

SEQ ID NO: 192401 - DNA, 25 bp, Homo sapien
agcgaggaaaacaccgggccactga

SEQ ID NO: 192402 - DNA, 25 bp, Homo sapien
ccgatacaggtacccggcacgcaga

SEQ ID NO: 192403 - DNA, 25 bp, Homo sapien
gttgttggcctcgatgaccttgatg

SEQ ID NO: 192404 - DNA, 25 bp, Homo sapien
taggtgatcttctcgctctgcagga

SEQ ID NO: 192405 - DNA, 25 bp, Homo sapien
tggaacaccctgtcgtccttggccg

SEQ ID NO: 192406 - DNA, 25 bp, Homo sapien
gcgttctcctcgaagatggcacctg

SEQ ID NO: 192407 - DNA, 25 bp, Homo sapien
tggaccacgcaaaactctaggactg

SEQ ID NO: 192408 - DNA, 25 bp, Homo sapien
gtgcgcctagcacagcttccacgga

SEQ ID NO: 192409 - DNA, 25 bp, Homo sapien
tccagccgagatcagtgcgaccagc

SEQ ID NO: 192410 - DNA, 25 bp, Homo sapien
agggaggcccggattcctcactaca

SEQ ID NO: 192411 - DNA, 25 bp, Homo sapien
tgcgctttcatcttctctcccggtt

SEQ ID NO: 192412 - DNA, 25 bp, Homo sapien
ggatgcagtcgccacaaccagatac

SEQ ID NO: 192413 - DNA, 25 bp, Homo sapien
gcactcacacatacaccaagggcta

SEQ ID NO: 192414 - DNA, 25 bp, Homo sapien
tcccaacttccggaaagacgactgc

SEQ ID NO: 192415 - DNA, 25 bp, Homo sapien
gagggatcacggtgtctcagacaga

SEQ ID NO: 192416 - DNA, 25 bp, Homo sapien
cagacgcttcctggtggctgctctg

SEQ ID NO: 192417 - DNA, 25 bp, Homo sapien
caagggtctgaagtatggtctgttc

SEQ ID NO: 192418 - DNA, 25 bp, Homo sapien
gcacctgccactgagagagcggaaa

SEQ ID NO: 192419 - DNA, 25 bp, Homo sapien
cctgctggtcagtcctgcgcacggt

SEQ ID NO: 192420 - DNA, 25 bp, Homo sapien
ggtcacttcgtgaagcccggcaaac

SEQ ID NO: 192421 - DNA, 25 bp, Homo sapien
tgcactccctgtagcggtcacttcg

SEQ ID NO: 192422 - DNA, 25 bp, Homo sapien
ctcagacagagttcctttttattcc

SEQ ID NO: 192423 - DNA, 25 bp, Homo sapien
agctggccctggacaagaacctggc

SEQ ID NO: 192424 - DNA, 25 bp, Homo sapien
tcagggctggtccaatacgatcttc

SEQ ID NO: 192425 - DNA, 25 bp, Homo sapien
cttgccgctgccaactgaccaaagg

SEQ ID NO: 192426 - DNA, 25 bp, Homo sapien
ggccgcaggaccaaccaggttcaaa

SEQ ID NO: 192427 - DNA, 25 bp, Homo sapien
ttcccggcttgggagagacatcacc

SEQ ID NO: 192428 - DNA, 25 bp, Homo sapien
cccagcgccatcactttggagtgta

SEQ ID NO: 192429 - DNA, 25 bp, Homo sapien
ttgactccttgggaccactcctggg

SEQ ID NO: 192430 - DNA, 25 bp, Homo sapien
tccagtccctggtactaagcccgga

SEQ ID NO: 192431 - DNA, 25 bp, Homo sapien
gcgtcctctgtagcgggcgacctag

SEQ ID NO: 192432 - DNA, 25 bp, Homo sapien
tggatcctccaatgcctccggggtc

SEQ ID NO: 192433 - DNA, 25 bp, Homo sapien
ctacatgatgaaagcgttcgacctc

SEQ ID NO: 192434 - DNA, 25 bp, Homo sapien
catgccggacagctgggacaaggat

SEQ ID NO: 192435 - DNA, 25 bp, Homo sapien
gacctcatcgtggaccgacccgtga

SEQ ID NO: 192436 - DNA, 25 bp, Homo sapien
cgacccgtgaccctcgtgagaggta

SEQ ID NO: 192437 - DNA, 25 bp, Homo sapien
gaccctcgtgagaggtacgaagccc

SEQ ID NO: 192438 - DNA, 25 bp, Homo sapien
gcccaatcccatcgtctacatgatg

SEQ ID NO: 192439 - DNA, 25 bp, Homo sapien
gcgggccgagctcctataagacaac

SEQ ID NO: 192440 - DNA, 25 bp, Homo sapien
tgcagcgaccaacaggactcacgtg

SEQ ID NO: 192441 - DNA, 25 bp, Homo sapien
aactagtcagtgtggcctacgcatc

SEQ ID NO: 192442 - DNA, 25 bp, Homo sapien
tcatccgccatttgctgggaaaagc

SEQ ID NO: 192443 - DNA, 25 bp, Homo sapien
agcgtggctgatacctacctcctta

SEQ ID NO: 192444 - DNA, 25 bp, Homo sapien
ttgcgctctcctcttcacttaggta

SEQ ID NO: 192445 - DNA, 25 bp, Homo sapien
cccgaagagtggctataaacgtccg

SEQ ID NO: 192446 - DNA, 25 bp, Homo sapien
agacaacctgtgattggctccgcgg

SEQ ID NO: 192447 - DNA, 25 bp, Homo sapien
cattgccagcaagggtcccagcagc

SEQ ID NO: 192448 - DNA, 25 bp, Homo sapien
gtgctcgccacaactgctaccggga

SEQ ID NO: 192449 - DNA, 25 bp, Homo sapien
tgctaccgggagctgcacaacgcct

SEQ ID NO: 192450 - DNA, 25 bp, Homo sapien
acaacgcctggagcgtgcgccagga

SEQ ID NO: 192451 - DNA, 25 bp, Homo sapien
tgctgctgtccctcctgcggcgtgt

SEQ ID NO: 192452 - DNA, 25 bp, Homo sapien
gctggaccaagccaccagtgtcgtt

SEQ ID NO: 192453 - DNA, 25 bp, Homo sapien
ccaccagtgtcgttcgtagagagct

SEQ ID NO: 192454 - DNA, 25 bp, Homo sapien
cagagcaccggcagcattgccagca

SEQ ID NO: 192455 - DNA, 25 bp, Homo sapien
cccagaacgccgaaaagcaggagta

SEQ ID NO: 192456 - DNA, 25 bp, Homo sapien
aacgctggctacaaatgccttttta

SEQ ID NO: 192457 - DNA, 25 bp, Homo sapien
cccgaagcaaagatggcgccaagtg

SEQ ID NO: 192458 - DNA, 25 bp, Homo sapien
ttctgtgaagagttcggtgctaacc

SEQ ID NO: 192459 - DNA, 25 bp, Homo sapien
gggaccctagcaggtttcagctgga

SEQ ID NO: 192460 - DNA, 25 bp, Homo sapien
tgggctcatcgagaagccggctatg

SEQ ID NO: 192461 - DNA, 25 bp, Homo sapien
ggcgaagaaccacctctgagcagtc

SEQ ID NO: 192462 - DNA, 25 bp, Homo sapien
tgggccgcttcaagaccaagtgagc

SEQ ID NO: 192463 - DNA, 25 bp, Homo sapien
acatcgtgcggcactacgggacaca

SEQ ID NO: 192464 - DNA, 25 bp, Homo sapien
tggctgtgctgactgcccactacag

SEQ ID NO: 192465 - DNA, 25 bp, Homo sapien
aggaccggtcatgcctggctgtgct

SEQ ID NO: 192466 - DNA, 25 bp, Homo sapien
gtggtcactgcaggaccggtcatgc

SEQ ID NO: 192467 - DNA, 25 bp, Homo sapien
cacggatgccgccatccgcgtgtgg

SEQ ID NO: 192468 - DNA, 25 bp, Homo sapien
tacgggacacaccacttccgaggct

SEQ ID NO: 192469 - DNA, 25 bp, Homo sapien
cgcgtctgggacatcgtgcggcact

SEQ ID NO: 192470 - DNA, 25 bp, Homo sapien
ctcgcccggtgtcgtgcagtgagtt

SEQ ID NO: 192471 - DNA, 25 bp, Homo sapien
tctgcgtcacgtggaacaccaactc

SEQ ID NO: 192472 - DNA, 25 bp, Homo sapien
gtggaacaccaactcgcggcactgc

SEQ ID NO: 192473 - DNA, 25 bp, Homo sapien
cgatgagggtcctgttgcccacaga

SEQ ID NO: 192474 - DNA, 25 bp, Homo sapien
aagacgatgagggtcctgttgccca

SEQ ID NO: 192475 - DNA, 25 bp, Homo sapien
cagtcatggcagattggctgggcaa

SEQ ID NO: 192476 - DNA, 25 bp, Homo sapien
cgaccagaaaggttggcggccagtc

SEQ ID NO: 192477 - DNA, 25 bp, Homo sapien
cgactgcggcgcgaccagaaaggtt

SEQ ID NO: 192478 - DNA, 25 bp, Homo sapien
tgctgcgcttctgcgtcacgtggaa

SEQ ID NO: 192479 - DNA, 25 bp, Homo sapien
cctgaaaaggcctatcccgcgtgtc

SEQ ID NO: 192480 - DNA, 25 bp, Homo sapien
agccaccagcctgtgcgcaagaagc

SEQ ID NO: 192481 - DNA, 25 bp, Homo sapien
gttaggcgcataccgctgctcccta

SEQ ID NO: 192482 - DNA, 25 bp, Homo sapien
cttgccacacggtcaagccgcagtg

SEQ ID NO: 192483 - DNA, 25 bp, Homo sapien
cttcctctaggtgcggagaccaagc

SEQ ID NO: 192484 - DNA, 25 bp, Homo sapien
gctctgagcctccagactgtggatg

SEQ ID NO: 192485 - DNA, 25 bp, Homo sapien
agccgcggtctgacgtttccaacac

SEQ ID NO: 192486 - DNA, 25 bp, Homo sapien
cattctccttgcttgagtctgctga

SEQ ID NO: 192487 - DNA, 25 bp, Homo sapien
cacactgctcttttactggagaaag

SEQ ID NO: 192488 - DNA, 25 bp, Homo sapien
ttacagccttcatccgcgcgtgggt

SEQ ID NO: 192489 - DNA, 25 bp, Homo sapien
ggtgcagttccctgcccgatttctc

SEQ ID NO: 192490 - DNA, 25 bp, Homo sapien
acttcaagacgtggatgcggacgca

SEQ ID NO: 192491 - DNA, 25 bp, Homo sapien
cgcgctccgagatgatggacgacct

SEQ ID NO: 192492 - DNA, 25 bp, Homo sapien
caacacggactttgcctgggtgtca

SEQ ID NO: 192493 - DNA, 25 bp, Homo sapien
cgcaggcacgcaggacactcagaac

SEQ ID NO: 192494 - DNA, 25 bp, Homo sapien
cgggcctgcgtcgacttcaagacgt

SEQ ID NO: 192495 - DNA, 25 bp, Homo sapien
cacgccttgtttccgggccactttg

SEQ ID NO: 192496 - DNA, 25 bp, Homo sapien
aatacgctttctcatgcgaaggccc

SEQ ID NO: 192497 - DNA, 25 bp, Homo sapien
agacggccacatgcagggtcagctc

SEQ ID NO: 192498 - DNA, 25 bp, Homo sapien
acctcataggccgtggctgtcatca

SEQ ID NO: 192499 - DNA, 25 bp, Homo sapien
gggtcggtaccaaaaatcagcctgc

SEQ ID NO: 192500 - DNA, 25 bp, Homo sapien
tgctcaccgagaacccaaacgagtg

SEQ ID NO: 192501 - DNA, 25 bp, Homo sapien
ggtgccacgccttcgcacagaggta

SEQ ID NO: 192502 - DNA, 25 bp, Homo sapien
tgtggctctgcagtttcaaggtggc

SEQ ID NO: 192503 - DNA, 25 bp, Homo sapien
cccgggctgaacagagacagcggtc

SEQ ID NO: 192504 - DNA, 25 bp, Homo sapien
aggacctgtcccaaggataaccgca

SEQ ID NO: 192505 - DNA, 25 bp, Homo sapien
cagctcgtccgcaacctaatgaaag

SEQ ID NO: 192506 - DNA, 25 bp, Homo sapien
cgcgcaattgcccacatttcacaga

SEQ ID NO: 192507 - DNA, 25 bp, Homo sapien
tggtctgccgattccgcaggtgaca

SEQ ID NO: 192508 - DNA, 25 bp, Homo sapien
ccaagaatggtcaagggcctccagg

SEQ ID NO: 192509 - DNA, 25 bp, Homo sapien
gccctactgggctgacggctacacg

SEQ ID NO: 192510 - DNA, 25 bp, Homo sapien
ccgcacctctacgtggtccggaagg

SEQ ID NO: 192511 - DNA, 25 bp, Homo sapien
ccggtgcacagttcctaagggcgca

SEQ ID NO: 192512 - DNA, 25 bp, Homo sapien
ggtcagtcggccttttctagaattc

SEQ ID NO: 192513 - DNA, 25 bp, Homo sapien
ctgtataaacgcagtctcatgggga

SEQ ID NO: 192514 - DNA, 25 bp, Homo sapien
gggcgcagaactccgggatgaacaa

SEQ ID NO: 192515 - DNA, 25 bp, Homo sapien
tgcccaagccttcagggaggcagca

SEQ ID NO: 192516 - DNA, 25 bp, Homo sapien
ggcacgttctgacgcgcaccagatc

SEQ ID NO: 192517 - DNA, 25 bp, Homo sapien
tcagcccacatattcaacccggaag

SEQ ID NO: 192518 - DNA, 25 bp, Homo sapien
tggggaaatccacctgtcgctcgag

SEQ ID NO: 192519 - DNA, 25 bp, Homo sapien
tcactcactctcatcctcgccggcc

SEQ ID NO: 192520 - DNA, 25 bp, Homo sapien
cttgagaggtcaccgccggtcgcct

SEQ ID NO: 192521 - DNA, 25 bp, Homo sapien
ctggaccccgtgagctttgcgcggc

SEQ ID NO: 192522 - DNA, 25 bp, Homo sapien
ggtctaatttcagtccctttccgca

SEQ ID NO: 192523 - DNA, 25 bp, Homo sapien
ttcagtccctttccgcagcccttac

SEQ ID NO: 192524 - DNA, 25 bp, Homo sapien
tactccgtttttcctgttctcgtga

SEQ ID NO: 192525 - DNA, 25 bp, Homo sapien
ggacggaattctccgaggggcagga

SEQ ID NO: 192526 - DNA, 25 bp, Homo sapien
ggaccttgagaggtcaccgccggtc

SEQ ID NO: 192527 - DNA, 25 bp, Homo sapien
acgcaggtgttctccatcgccgtct

SEQ ID NO: 192528 - DNA, 25 bp, Homo sapien
tcgggcccatcgtcaacgagggcta

SEQ ID NO: 192529 - DNA, 25 bp, Homo sapien
cgagggctacgtgaacaccgacagc

SEQ ID NO: 192530 - DNA, 25 bp, Homo sapien
gctgctcgatgtgcgcttccagcaa

SEQ ID NO: 192531 - DNA, 25 bp, Homo sapien
ttccagcaaatcagcagcgtccgcg

SEQ ID NO: 192532 - DNA, 25 bp, Homo sapien
gcttcttctccatcctcagctgggt

SEQ ID NO: 192533 - DNA, 25 bp, Homo sapien
gcctgggcaccgacatgtcactctt

SEQ ID NO: 192534 - DNA, 25 bp, Homo sapien
cgcactgttcgcaggactctggtcc

SEQ ID NO: 192535 - DNA, 25 bp, Homo sapien
gcaggtcccggcaactcttgtaata

SEQ ID NO: 192536 - DNA, 25 bp, Homo sapien
aactcttgtaatactgggctgcgga

SEQ ID NO: 192537 - DNA, 25 bp, Homo sapien
ttctcgcggttgcagaagtccgtgt

SEQ ID NO: 192538 - DNA, 25 bp, Homo sapien
tcttgaactcgctgaagcgggcctc

SEQ ID NO: 192539 - DNA, 25 bp, Homo sapien
gcagctcattaaagaccttctggaa

SEQ ID NO: 192540 - DNA, 25 bp, Homo sapien
ttgttcttcttggacttggtgctca

SEQ ID NO: 192541 - DNA, 25 bp, Homo sapien
tgccacgcgctcttcttgttcttct

SEQ ID NO: 192542 - DNA, 25 bp, Homo sapien
ctacgtgatgatcctggcgatggct

SEQ ID NO: 192543 - DNA, 25 bp, Homo sapien
cgcgtagctgaactgcaggtcgatg

SEQ ID NO: 192544 - DNA, 25 bp, Homo sapien
aggtccttgcgcgagtaccacttgc

SEQ ID NO: 192545 - DNA, 25 bp, Homo sapien
acagaaagtgcttctcccggaagtg

SEQ ID NO: 192546 - DNA, 25 bp, Homo sapien
tgctcacgcaggtaggcatagtcgc

SEQ ID NO: 192547 - DNA, 25 bp, Homo sapien
aagcagctcatcattgtccaggtag

SEQ ID NO: 192548 - DNA, 25 bp, Homo sapien
aggtagcgctcgtcacagaacttgc

SEQ ID NO: 192549 - DNA, 25 bp, Homo sapien
gtcatcggggtcaccctgcatgcga

SEQ ID NO: 192550 - DNA, 25 bp, Homo sapien
tgcagcggccttcctcacacagaaa

SEQ ID NO: 192551 - DNA, 25 bp, Homo sapien
atcaggtgacaaggcccggctaccc

SEQ ID NO: 192552 - DNA, 25 bp, Homo sapien
tttccatggcgccttcacggcacga

SEQ ID NO: 192553 - DNA, 25 bp, Homo sapien
cagccggggatgcatcaggtgacaa

SEQ ID NO: 192554 - DNA, 25 bp, Homo sapien
aagggaataccaatggccgccagcc

SEQ ID NO: 192555 - DNA, 25 bp, Homo sapien
gaaacgtgttccaagcagctgctaa

SEQ ID NO: 192556 - DNA, 25 bp, Homo sapien
tccaggacagagaagaaacgtgttc

SEQ ID NO: 192557 - DNA, 25 bp, Homo sapien
ctgcggagctttccaggacagagaa

SEQ ID NO: 192558 - DNA, 25 bp, Homo sapien
cttcacggcacgaggctcaagccga

SEQ ID NO: 192559 - DNA, 25 bp, Homo sapien
acacggcgcagtagcgctgctcgca

SEQ ID NO: 192560 - DNA, 25 bp, Homo sapien
catcttggtagagcagcggtagcac

SEQ ID NO: 192561 - DNA, 25 bp, Homo sapien
tctgggccacgcgtgtcacgtcaac

SEQ ID NO: 192562 - DNA, 25 bp, Homo sapien
cacggccggacctcagtgaggcaaa

SEQ ID NO: 192563 - DNA, 25 bp, Homo sapien
gctcgcagagcacccgcatcttggt

SEQ ID NO: 192564 - DNA, 25 bp, Homo sapien
atgagccgaccgctcgaaggtccgc

SEQ ID NO: 192565 - DNA, 25 bp, Homo sapien
tagaggccgctctaccatgagccga

SEQ ID NO: 192566 - DNA, 25 bp, Homo sapien
gtgtcacgtcaacactcgccgggct

SEQ ID NO: 192567 - DNA, 25 bp, Homo sapien
ccacggccttgctgtgttctcgtta

SEQ ID NO: 192568 - DNA, 25 bp, Homo sapien
tcgttagagacttcggagagacgtc

SEQ ID NO: 192569 - DNA, 25 bp, Homo sapien
aagagctttccctgggcaggctcga

SEQ ID NO: 192570 - DNA, 25 bp, Homo sapien
tccctggacttcagcggagctggcc

SEQ ID NO: 192571 - DNA, 25 bp, Homo sapien
gctgcgtcgctcaccctatctgtgg

SEQ ID NO: 192572 - DNA, 25 bp, Homo sapien
gtggtacaagcacgtggcgagtccc

SEQ ID NO: 192573 - DNA, 25 bp, Homo sapien
caaacccagccgagccggttcgtgg

SEQ ID NO: 192574 - DNA, 25 bp, Homo sapien
gtctgcttgtgtactttgccgtcta

SEQ ID NO: 192575 - DNA, 25 bp, Homo sapien
accgcctggtcgaggtcaacggcgt

SEQ ID NO: 192576 - DNA, 25 bp, Homo sapien
aggaagctcagtcctgcacgggggt

SEQ ID NO: 192577 - DNA, 25 bp, Homo sapien
cgccttcggagtcccggcgcaggaa

SEQ ID NO: 192578 - DNA, 25 bp, Homo sapien
aggacgcggacgttgtcgggaggca

SEQ ID NO: 192579 - DNA, 25 bp, Homo sapien
tcaacggcgtcaacgtggagggcga

SEQ ID NO: 192580 - DNA, 25 bp, Homo sapien
tggtcgaggtcaacggcgtcaacgt

SEQ ID NO: 192581 - DNA, 25 bp, Homo sapien
gcctggtcgaggtcaacggcgtcaa

SEQ ID NO: 192582 - DNA, 25 bp, Homo sapien
ggcagttcatccggcgcgtggaacc

SEQ ID NO: 192583 - DNA, 25 bp, Homo sapien
tttgatgccacacctggccacgcgg

SEQ ID NO: 192584 - DNA, 25 bp, Homo sapien
ccagcatcaaggcacgggaggacga

SEQ ID NO: 192585 - DNA, 25 bp, Homo sapien
cccgagacagatgaacacttcaagc

SEQ ID NO: 192586 - DNA, 25 bp, Homo sapien
ggctcattgaggtaccggcccacca

SEQ ID NO: 192587 - DNA, 25 bp, Homo sapien
gggtcacacccaccgaggagcacgt

SEQ ID NO: 192588 - DNA, 25 bp, Homo sapien
ccggccagtacatccgctctgtgga

SEQ ID NO: 192589 - DNA, 25 bp, Homo sapien
acttcaagcggcttcgggtcacacc

SEQ ID NO: 192590 - DNA, 25 bp, Homo sapien
cggtggctgtgatgaatatttgatg

SEQ ID NO: 192591 - DNA, 25 bp, Homo sapien
gaccaccgagcctgcgaagacctag

SEQ ID NO: 192592 - DNA, 25 bp, Homo sapien
tggtctgacccatcactgcggccca

SEQ ID NO: 192593 - DNA, 25 bp, Homo sapien
ccgcatagtaaagcggcagagaact

SEQ ID NO: 192594 - DNA, 25 bp, Homo sapien
tgcatcaggcgtctctgaccaccga

SEQ ID NO: 192595 - DNA, 25 bp, Homo sapien
gaagacctagctgattacgaccagg

SEQ ID NO: 192596 - DNA, 25 bp, Homo sapien
tacgaccaggaaacaggaggggaca

SEQ ID NO: 192597 - DNA, 25 bp, Homo sapien
gcgttaggattctctcagtcccgga

SEQ ID NO: 192598 - DNA, 25 bp, Homo sapien
cggcagagaacttgcatcaggcgtc

SEQ ID NO: 192599 - DNA, 25 bp, Homo sapien
cccgtggacaccctgttgactttgc

SEQ ID NO: 192600 - DNA, 25 bp, Homo sapien
cctcgtaagccatagcgcatgcgcg

SEQ ID NO: 192601 - DNA, 25 bp, Homo sapien
acccgggaaggacgcctggcctctg

SEQ ID NO: 192602 - DNA, 25 bp, Homo sapien
ggacaccctgttgactttgcacttc

SEQ ID NO: 192603 - DNA, 25 bp, Homo sapien
gaccggcaccgctgttgcctcgtaa

SEQ ID NO: 192604 - DNA, 25 bp, Homo sapien
caccgctgttgcctcgtaagccata

SEQ ID NO: 192605 - DNA, 25 bp, Homo sapien
tgttgactttgcacttccctcccgg

SEQ ID NO: 192606 - DNA, 25 bp, Homo sapien
gttgcctcgtaagccatagcgcatg

SEQ ID NO: 192607 - DNA, 25 bp, Homo sapien
acatggcttgtctcctaaccttgga

SEQ ID NO: 192608 - DNA, 25 bp, Homo sapien
tctccactgcctaggaaccctgagg

SEQ ID NO: 192609 - DNA, 25 bp, Homo sapien
tgatgccgcctccatgtgaaacctg

SEQ ID NO: 192610 - DNA, 25 bp, Homo sapien
cggcgtctgtcgtggcaaacaaaag

SEQ ID NO: 192611 - DNA, 25 bp, Homo sapien
atttggcgcttctgatccatcgggc

SEQ ID NO: 192612 - DNA, 25 bp, Homo sapien
ccgcttcccgtgtcataggtggaca

SEQ ID NO: 192613 - DNA, 25 bp, Homo sapien
aacggcaccgacttgacatggcttg

SEQ ID NO: 192614 - DNA, 25 bp, Homo sapien
gtccgaggtccgtcaggattcatcc

SEQ ID NO: 192615 - DNA, 25 bp, Homo sapien
gcggcagtcctaacccgtgcactga

SEQ ID NO: 192616 - DNA, 25 bp, Homo sapien
atcctcgcgctcaaggcggtcatgc

SEQ ID NO: 192617 - DNA, 25 bp, Homo sapien
atgccggactcctgcggactacaca

SEQ ID NO: 192618 - DNA, 25 bp, Homo sapien
gtgatgcaaggatcgccggcctttc

SEQ ID NO: 192619 - DNA, 25 bp, Homo sapien
cgcgcaatgccgctaccggaagtgc

SEQ ID NO: 192620 - DNA, 25 bp, Homo sapien
gagctccgagcatcccttagtttta

SEQ ID NO: 192621 - DNA, 25 bp, Homo sapien
agctcctgcttcacatgggtagagg

SEQ ID NO: 192622 - DNA, 25 bp, Homo sapien
ctgcggaccgcaatctttgggaaaa

SEQ ID NO: 192623 - DNA, 25 bp, Homo sapien
gtagattcggcgtcctcgcaaactg

SEQ ID NO: 192624 - DNA, 25 bp, Homo sapien
aacgcccaggagtctggtgatgtcg

SEQ ID NO: 192625 - DNA, 25 bp, Homo sapien
ttgggccctgagtgtacggcataca

SEQ ID NO: 192626 - DNA, 25 bp, Homo sapien
tgtacggcatacacacttctgctgc

SEQ ID NO: 192627 - DNA, 25 bp, Homo sapien
tagatcctagtgtccgtgcgtagcc

SEQ ID NO: 192628 - DNA, 25 bp, Homo sapien
cagtgacgggtttggacacactgtc

SEQ ID NO: 192629 - DNA, 25 bp, Homo sapien
cccagtgcgtggtctgtctgttgct

SEQ ID NO: 192630 - DNA, 25 bp, Homo sapien
cggcagccaagtgtgcacacgtctc

SEQ ID NO: 192631 - DNA, 25 bp, Homo sapien
gtgctgtcctttgtgctgctcatca

SEQ ID NO: 192632 - DNA, 25 bp, Homo sapien
gctgtctctgttgtgcacgtgctcc

SEQ ID NO: 192633 - DNA, 25 bp, Homo sapien
ggctcagggctatttctccgtgggc

SEQ ID NO: 192634 - DNA, 25 bp, Homo sapien
tgtgctgctcatcaacaggcagttc

SEQ ID NO: 192635 - DNA, 25 bp, Homo sapien
tgctggacgtgctgtcctttgtgct

SEQ ID NO: 192636 - DNA, 25 bp, Homo sapien
ttgtgcacgtgctcccgcagagccg

SEQ ID NO: 192637 - DNA, 25 bp, Homo sapien
gctctgcctgggacttcggtcctgc

SEQ ID NO: 192638 - DNA, 25 bp, Homo sapien
ggcagttctatgaggtgcgtgtcca

SEQ ID NO: 192639 - DNA, 25 bp, Homo sapien
gtgcttgtgctctctgcccagctgt

SEQ ID NO: 192640 - DNA, 25 bp, Homo sapien
ctgcccagctgtgctgaagtcccga

SEQ ID NO: 192641 - DNA, 25 bp, Homo sapien
aagtcccgagggacatgtccgctgc

SEQ ID NO: 192642 - DNA, 25 bp, Homo sapien
acatgtccgctgcttgcgggtcggt

SEQ ID NO: 192643 - DNA, 25 bp, Homo sapien
tcctgaggaattggaagtgtcacga

SEQ ID NO: 192644 - DNA, 25 bp, Homo sapien
tcaccagccttctgaacgaggagct

SEQ ID NO: 192645 - DNA, 25 bp, Homo sapien
agtgtcacgagatgtggccctcgtt

SEQ ID NO: 192646 - DNA, 25 bp, Homo sapien
ctgcggtgctcaccagccttctgaa

SEQ ID NO: 192647 - DNA, 25 bp, Homo sapien
ggctgccgcacctctacaggaactt

SEQ ID NO: 192648 - DNA, 25 bp, Homo sapien
ccgctaggccttgcggcagaaagcc

SEQ ID NO: 192649 - DNA, 25 bp, Homo sapien
gtgtgttcgccatctccctgccgta

SEQ ID NO: 192650 - DNA, 25 bp, Homo sapien
gcagtatgccagtgtgttcgccatc

SEQ ID NO: 192651 - DNA, 25 bp, Homo sapien
acctctacaggaactttgccgcgga

SEQ ID NO: 192652 - DNA, 25 bp, Homo sapien
cagagcagccgtgttggccttcaga

SEQ ID NO: 192653 - DNA, 25 bp, Homo sapien
ccatcgctgccgtgggcagagcagc

SEQ ID NO: 192654 - DNA, 25 bp, Homo sapien
aactttgccgcggagcagtatgcca

SEQ ID NO: 192655 - DNA, 25 bp, Homo sapien
gtctttccgagcgaggtcctcagcc

SEQ ID NO: 192656 - DNA, 25 bp, Homo sapien
ccgttctctgggacaatgtggtcca

SEQ ID NO: 192657 - DNA, 25 bp, Homo sapien
gctccgaccagtaggcctggtcttc

SEQ ID NO: 192658 - DNA, 25 bp, Homo sapien
taacctagtgctcccgtgggcttcg

SEQ ID NO: 192659 - DNA, 25 bp, Homo sapien
atgtcggtctctagcctcctgagtc

SEQ ID NO: 192660 - DNA, 25 bp, Homo sapien
cgccaggaggccgtaacctagtgct

SEQ ID NO: 192661 - DNA, 25 bp, Homo sapien
tcctgagtctgctccgaccagtagg

SEQ ID NO: 192662 - DNA, 25 bp, Homo sapien
gtggtccacgtgattctcaagctga

SEQ ID NO: 192663 - DNA, 25 bp, Homo sapien
ccgggatcgggtccgttccatgtcg

SEQ ID NO: 192664 - DNA, 25 bp, Homo sapien
catgtgagacagaccaaggaggcgc

SEQ ID NO: 192665 - DNA, 25 bp, Homo sapien
ccaccctgtgcgtgggattctcttc

SEQ ID NO: 192666 - DNA, 25 bp, Homo sapien
tggcaccctcgtaccagcctgggga

SEQ ID NO: 192667 - DNA, 25 bp, Homo sapien
ctcgtaccagcctggggactaagtc

SEQ ID NO: 192668 - DNA, 25 bp, Homo sapien
taccagcctggggactaagtccacc

SEQ ID NO: 192669 - DNA, 25 bp, Homo sapien
ggggactaagtccaccctgtgcgtg

SEQ ID NO: 192670 - DNA, 25 bp, Homo sapien
tcgacaccggctgtcccgagcccag

SEQ ID NO: 192671 - DNA, 25 bp, Homo sapien
cactgtgacgacaagcgtgggaacc

SEQ ID NO: 192672 - DNA, 25 bp, Homo sapien
gatacgtcttctccaacttcacggc

SEQ ID NO: 192673 - DNA, 25 bp, Homo sapien
agctccacgggcaagctgggtttca

SEQ ID NO: 192674 - DNA, 25 bp, Homo sapien
tgggtttcacgctccctgtcttcta

SEQ ID NO: 192675 - DNA, 25 bp, Homo sapien
cttctaggtctcctgtgggcgagtt

SEQ ID NO: 192676 - DNA, 25 bp, Homo sapien
tggcaggaccaaaacctggctggtt

SEQ ID NO: 192677 - DNA, 25 bp, Homo sapien
cggtcgttactaggcctggactcgg

SEQ ID NO: 192678 - DNA, 25 bp, Homo sapien
cttcacggctgtcccgaagaggtcc

SEQ ID NO: 192679 - DNA, 25 bp, Homo sapien
ccatcgagcgagtcgtctcctcgga

SEQ ID NO: 192680 - DNA, 25 bp, Homo sapien
ggtggccggccctctgtggacctct

SEQ ID NO: 192681 - DNA, 25 bp, Homo sapien
gaggttacaccatctccgactcggc

SEQ ID NO: 192682 - DNA, 25 bp, Homo sapien
tgcagactctgcaggacatcctcgg

SEQ ID NO: 192683 - DNA, 25 bp, Homo sapien
ctgcaggacatcctcggggaccctg

SEQ ID NO: 192684 - DNA, 25 bp, Homo sapien
ctgagccctgaggttaaggcccggt

SEQ ID NO: 192685 - DNA, 25 bp, Homo sapien
gttaaggcccggtcacagtcaggga

SEQ ID NO: 192686 - DNA, 25 bp, Homo sapien
accctggacggggaaagtgctgcct

SEQ ID NO: 192687 - DNA, 25 bp, Homo sapien
gccagaaacgaaaccctgagaagca

SEQ ID NO: 192688 - DNA, 25 bp, Homo sapien
ttacagcgacggtgcggcttccctg

SEQ ID NO: 192689 - DNA, 25 bp, Homo sapien
ttcaggcctgttacagcgacggtgc

SEQ ID NO: 192690 - DNA, 25 bp, Homo sapien
tgggcagcttcaggcctgttacagc

SEQ ID NO: 192691 - DNA, 25 bp, Homo sapien
ttttccacttgcagctccgcgctgg

SEQ ID NO: 192692 - DNA, 25 bp, Homo sapien
ccaggtgtttttccacttgcagctc

SEQ ID NO: 192693 - DNA, 25 bp, Homo sapien
cgagcagattcttgtccaggtgttt

SEQ ID NO: 192694 - DNA, 25 bp, Homo sapien
gtccgcccgagcagattcttgtcca

SEQ ID NO: 192695 - DNA, 25 bp, Homo sapien
gcgccacctggtcgaagctagtgaa

SEQ ID NO: 192696 - DNA, 25 bp, Homo sapien
acacagggtagagagcccagtccca

SEQ ID NO: 192697 - DNA, 25 bp, Homo sapien
agtcacctaccaggatggccagctg

SEQ ID NO: 192698 - DNA, 25 bp, Homo sapien
ctctggcagagctcggcataatgtc

SEQ ID NO: 192699 - DNA, 25 bp, Homo sapien
tgtcttgccaaagacggaccactgg

SEQ ID NO: 192700 - DNA, 25 bp, Homo sapien
accactggcgcacgaagcgtagctg

SEQ ID NO: 192701 - DNA, 25 bp, Homo sapien
agcctgcggacgagaaatctgtctg

SEQ ID NO: 192702 - DNA, 25 bp, Homo sapien
gccctcaccttgaccaaaagcagga

SEQ ID NO: 192703 - DNA, 25 bp, Homo sapien
agcgcaaaagggctgcgtcgcctag

SEQ ID NO: 192704 - DNA, 25 bp, Homo sapien
aaagggctgcgtcgcctagaaggca

SEQ ID NO: 192705 - DNA, 25 bp, Homo sapien
gcgcaaaagggctgcgtcgcctaga

SEQ ID NO: 192706 - DNA, 25 bp, Homo sapien
cggaagcgcaaaagggctgcgtcgc

SEQ ID NO: 192707 - DNA, 25 bp, Homo sapien
cgcaaaagggctgcgtcgcctagaa

SEQ ID NO: 192708 - DNA, 25 bp, Homo sapien
caaaagggctgcgtcgcctagaagg

SEQ ID NO: 192709 - DNA, 25 bp, Homo sapien
aaaagggctgcgtcgcctagaaggc

SEQ ID NO: 192710 - DNA, 25 bp, Homo sapien
ggaagcgcaaaagggctgcgtcgcc

SEQ ID NO: 192711 - DNA, 25 bp, Homo sapien
ttggcatatatttggcccaggatcc

SEQ ID NO: 192712 - DNA, 25 bp, Homo sapien
gcacagagccggcacagccaagccc

SEQ ID NO: 192713 - DNA, 25 bp, Homo sapien
gtcgttgttggcatatatttggccc

SEQ ID NO: 192714 - DNA, 25 bp, Homo sapien
cggacccaccttgtcgttgttggca

SEQ ID NO: 192715 - DNA, 25 bp, Homo sapien
cccaccttgtcgttgttggcatata

SEQ ID NO: 192716 - DNA, 25 bp, Homo sapien
cctgcggacccaccttgtcgttgtt

SEQ ID NO: 192717 - DNA, 25 bp, Homo sapien
tatttggcccaggatccagccctcg

SEQ ID NO: 192718 - DNA, 25 bp, Homo sapien
ccttgtcgttgttggcatatatttg

SEQ ID NO: 192719 - DNA, 25 bp, Homo sapien
agagccacacgggatacttgtgtag

SEQ ID NO: 192720 - DNA, 25 bp, Homo sapien
agtagatgggaatgggcacgtcctc

SEQ ID NO: 192721 - DNA, 25 bp, Homo sapien
ggaatgggcacgtcctccacacgct

SEQ ID NO: 192722 - DNA, 25 bp, Homo sapien
cgctgcccgttcttggggttgatct

SEQ ID NO: 192723 - DNA, 25 bp, Homo sapien
ggcaggcgggaacagatgccctccc

SEQ ID NO: 192724 - DNA, 25 bp, Homo sapien
cacgggatacttgtgtagaggcatc

SEQ ID NO: 192725 - DNA, 25 bp, Homo sapien
cttgtgtagaggcatcgcgagcctg

SEQ ID NO: 192726 - DNA, 25 bp, Homo sapien
cccatgaggcctatagtgcacggga

SEQ ID NO: 192727 - DNA, 25 bp, Homo sapien
ttcccggtgacgtaggccgtgagcc

SEQ ID NO: 192728 - DNA, 25 bp, Homo sapien
gaagaccagcacgtgcaggctccgg

SEQ ID NO: 192729 - DNA, 25 bp, Homo sapien
gccgcaccgctcaccgtgttgttga

SEQ ID NO: 192730 - DNA, 25 bp, Homo sapien
tctgtgcccgcaggtacacatgctc

SEQ ID NO: 192731 - DNA, 25 bp, Homo sapien
tcaaagacgcgcacatccgcctggg

SEQ ID NO: 192732 - DNA, 25 bp, Homo sapien
acgtgatgttgtcgcccgtctgcac

SEQ ID NO: 192733 - DNA, 25 bp, Homo sapien
gtgttgttgacctccaggcgcacgt

SEQ ID NO: 192734 - DNA, 25 bp, Homo sapien
cccatgtcgaaggtccacgtgatgt

SEQ ID NO: 192735 - DNA, 25 bp, Homo sapien
gggcctccaagtagttgcgctgtga

SEQ ID NO: 192736 - DNA, 25 bp, Homo sapien
acgtgggcctccaagtagttgcgct

SEQ ID NO: 192737 - DNA, 25 bp, Homo sapien
aacgtgggcctccaagtagttgcgc

SEQ ID NO: 192738 - DNA, 25 bp, Homo sapien
tcaacgtgggcctccaagtagttgc

SEQ ID NO: 192739 - DNA, 25 bp, Homo sapien
gtcaacgtgggcctccaagtagttg

SEQ ID NO: 192740 - DNA, 25 bp, Homo sapien
gcaggtcaacgtgggcctccaagta

SEQ ID NO: 192741 - DNA, 25 bp, Homo sapien
gcctccaagtagttgcgctgtgatc

SEQ ID NO: 192742 - DNA, 25 bp, Homo sapien
cgcgcaggtcaacgtgggcctccaa

SEQ ID NO: 192743 - DNA, 25 bp, Homo sapien
caagctgggtgttctctgggctcat

SEQ ID NO: 192744 - DNA, 25 bp, Homo sapien
aggctgaaggtgtactccacgccag

SEQ ID NO: 192745 - DNA, 25 bp, Homo sapien
cctcccagcggtactcagtctggta

SEQ ID NO: 192746 - DNA, 25 bp, Homo sapien
caccgtcacattggcctggatgctc

SEQ ID NO: 192747 - DNA, 25 bp, Homo sapien
tccagttttaaagcagagcccggcc

SEQ ID NO: 192748 - DNA, 25 bp, Homo sapien
ggtcgtaggactcgctcccatccag

SEQ ID NO: 192749 - DNA, 25 bp, Homo sapien
tgccacgcactgacctgtgtcgaag

SEQ ID NO: 192750 - DNA, 25 bp, Homo sapien
agctcaccaggttggaggcgttcac

SEQ ID NO: 192751 - DNA, 25 bp, Homo sapien
tccagctgtaggagacgttggtgcc

SEQ ID NO: 192752 - DNA, 25 bp, Homo sapien
cagctgtaggagacgttggtgccat

SEQ ID NO: 192753 - DNA, 25 bp, Homo sapien
ctgtaggagacgttggtgccatccc

SEQ ID NO: 192754 - DNA, 25 bp, Homo sapien
gtaggagacgttggtgccatcccta

SEQ ID NO: 192755 - DNA, 25 bp, Homo sapien
aggagacgttggtgccatccctaac

SEQ ID NO: 192756 - DNA, 25 bp, Homo sapien
taagagatggtaggacccccaggga

SEQ ID NO: 192757 - DNA, 25 bp, Homo sapien
gaaggtgtaagagatggtaggaccc

SEQ ID NO: 192758 - DNA, 25 bp, Homo sapien
ggagacgttggtgccatccctaacc

SEQ ID NO: 192759 - DNA, 25 bp, Homo sapien
tgacgatgatattgaaggtgcccac

SEQ ID NO: 192760 - DNA, 25 bp, Homo sapien
ctccaaggaccaagtgtatacgaca

SEQ ID NO: 192761 - DNA, 25 bp, Homo sapien
tccctgccgtcatggtgaccaagtg

SEQ ID NO: 192762 - DNA, 25 bp, Homo sapien
ctgagacccagctgactgcgttgga

SEQ ID NO: 192763 - DNA, 25 bp, Homo sapien
tgctgaggccactcacaggcacctg

SEQ ID NO: 192764 - DNA, 25 bp, Homo sapien
ccatggtgacatgagggccacgctt

SEQ ID NO: 192765 - DNA, 25 bp, Homo sapien
ccagcatccgggaagaccatggtga

SEQ ID NO: 192766 - DNA, 25 bp, Homo sapien
gagcacccaggaatagcgcacatca

SEQ ID NO: 192767 - DNA, 25 bp, Homo sapien
tgaggacggtactcgcggctctgcc

SEQ ID NO: 192768 - DNA, 25 bp, Homo sapien
gccaccacctaacagcaagaatgca

SEQ ID NO: 192769 - DNA, 25 bp, Homo sapien
agcaagaatgcagcggggtccgcac

SEQ ID NO: 192770 - DNA, 25 bp, Homo sapien
gtccgcacatcagggcgggcactga

SEQ ID NO: 192771 - DNA, 25 bp, Homo sapien
gcggaactcaggcagtgccactcgc

SEQ ID NO: 192772 - DNA, 25 bp, Homo sapien
tgccactcgccagcttacgtcaaaa

SEQ ID NO: 192773 - DNA, 25 bp, Homo sapien
cgccagcttacgtcaaaagaacaaa

SEQ ID NO: 192774 - DNA, 25 bp, Homo sapien
caaaaggagtgaggacggtactcgc

SEQ ID NO: 192775 - DNA, 25 bp, Homo sapien
tgtccaggaagaagacccccaagag

SEQ ID NO: 192776 - DNA, 25 bp, Homo sapien
acgcgccgcccaacgggcccttgca

SEQ ID NO: 192777 - DNA, 25 bp, Homo sapien
cggcggtgtcgacttctacgacgtc

SEQ ID NO: 192778 - DNA, 25 bp, Homo sapien
tgtcgacttctacgacgtcgccttc

SEQ ID NO: 192779 - DNA, 25 bp, Homo sapien
gacttctacgacgtcgccttcaagg

SEQ ID NO: 192780 - DNA, 25 bp, Homo sapien
ccccgtggggcttgcacggtgcatc

SEQ ID NO: 192781 - DNA, 25 bp, Homo sapien
cgggagcacactgagcgcccgcccg

SEQ ID NO: 192782 - DNA, 25 bp, Homo sapien
cgcttggcggcggtgtcgacttcta

SEQ ID NO: 192783 - DNA, 25 bp, Homo sapien
acgcacggccgaggaccggcagaac

SEQ ID NO: 192784 - DNA, 25 bp, Homo sapien
cccgacccagggagaatcaaggcca

SEQ ID NO: 192785 - DNA, 25 bp, Homo sapien
cagaacccgctggattggcagctca

SEQ ID NO: 192786 - DNA, 25 bp, Homo sapien
tccgtgacccagcaagtgtcgagac

SEQ ID NO: 192787 - DNA, 25 bp, Homo sapien
ccacttttcgggttggaagactgag

SEQ ID NO: 192788 - DNA, 25 bp, Homo sapien
cctcaccttccaggcggggaggaag

SEQ ID NO: 192789 - DNA, 25 bp, Homo sapien
tgagcgcgctcctaacctggctctg

SEQ ID NO: 192790 - DNA, 25 bp, Homo sapien
tacttaccaaagcaggtgacactcg

SEQ ID NO: 192791 - DNA, 25 bp, Homo sapien
cctaacggtgagtgacggatgaaca

SEQ ID NO: 192792 - DNA, 25 bp, Homo sapien
cttatgcagagtccgtgaagcctaa

SEQ ID NO: 192793 - DNA, 25 bp, Homo sapien
gcatttcttttggagacggtctctc

SEQ ID NO: 192794 - DNA, 25 bp, Homo sapien
cgttgtttccaccaatcgtaccgtg

SEQ ID NO: 192795 - DNA, 25 bp, Homo sapien
ctgtcattgggctatcctggcggaa

SEQ ID NO: 192796 - DNA, 25 bp, Homo sapien
gaaactgtcccacctctgtcattgg

SEQ ID NO: 192797 - DNA, 25 bp, Homo sapien
cgggcgaggctcaagcttttataga

SEQ ID NO: 192798 - DNA, 25 bp, Homo sapien
gttcgtcccaagatcgtagcacatg

SEQ ID NO: 192799 - DNA, 25 bp, Homo sapien
ttaagcgtgttagtgctgcgtggcc

SEQ ID NO: 192800 - DNA, 25 bp, Homo sapien
cctggtcgcatggttaagcgtgtga

SEQ ID NO: 192801 - DNA, 25 bp, Homo sapien
taagcgtgttagtgctgcgtggcct

SEQ ID NO: 192802 - DNA, 25 bp, Homo sapien
cctggtcgcatggttaagcgtgtta

SEQ ID NO: 192803 - DNA, 25 bp, Homo sapien
gtcgcatggttaagcgtgttagtgc

SEQ ID NO: 192804 - DNA, 25 bp, Homo sapien
cagcctggtcgcatggttaagcgtg

SEQ ID NO: 192805 - DNA, 25 bp, Homo sapien
tcgcatggttaagcgtgttagtgct

SEQ ID NO: 192806 - DNA, 25 bp, Homo sapien
ctggcctggtcgcatggttaagcgt

SEQ ID NO: 192807 - DNA, 25 bp, Homo sapien
gaccagaatggaaacgaccttcgga

SEQ ID NO: 192808 - DNA, 25 bp, Homo sapien
atgtgagtgggctccacatgtgcac

SEQ ID NO: 192809 - DNA, 25 bp, Homo sapien
agtgggctccacatgtgcacgtcct

SEQ ID NO: 192810 - DNA, 25 bp, Homo sapien
tgcacgtcctccttgtgtcccggaa

SEQ ID NO: 192811 - DNA, 25 bp, Homo sapien
tcctccttgtgtcccggaatgaggc

SEQ ID NO: 192812 - DNA, 25 bp, Homo sapien
gtcccggaatgaggccaggtctcct

SEQ ID NO: 192813 - DNA, 25 bp, Homo sapien
cctccctctagaccagaatggaaac

SEQ ID NO: 192814 - DNA, 25 bp, Homo sapien
aatgaggccaggtctcctccgtcct

SEQ ID NO: 192815 - DNA, 25 bp, Homo sapien
tcagggttcagagcccaccggaacc

SEQ ID NO: 192816 - DNA, 25 bp, Homo sapien
agcagctcaaggcaccgttagctac

SEQ ID NO: 192817 - DNA, 25 bp, Homo sapien
aggcaccgttagctacgtgcggccc

SEQ ID NO: 192818 - DNA, 25 bp, Homo sapien
ggctgtaaaagccatccgtctaccc

SEQ ID NO: 192819 - DNA, 25 bp, Homo sapien
ccgctgactggctgtaaaagccatc

SEQ ID NO: 192820 - DNA, 25 bp, Homo sapien
ccaccgctgactggctgtaaaagcc

SEQ ID NO: 192821 - DNA, 25 bp, Homo sapien
ctcccaccgctgactggctgtaaaa

SEQ ID NO: 192822 - DNA, 25 bp, Homo sapien
accggaaccggaagccgatctgccg

SEQ ID NO: 192823 - DNA, 25 bp, Homo sapien
cccaggtctggagtatggacaacat

SEQ ID NO: 192824 - DNA, 25 bp, Homo sapien
atcctacgaccggtccctcagggtg

SEQ ID NO: 192825 - DNA, 25 bp, Homo sapien
ccaaagtcttcagtgcatcctacga

SEQ ID NO: 192826 - DNA, 25 bp, Homo sapien
tctcgacgccagaccagaccaaagt

SEQ ID NO: 192827 - DNA, 25 bp, Homo sapien
tatgccctggcggtcatctcgacgc

SEQ ID NO: 192828 - DNA, 25 bp, Homo sapien
acgtgggcaccgtgtatgccctggc

SEQ ID NO: 192829 - DNA, 25 bp, Homo sapien
tgatctgcacgcagaccctgctgcg

SEQ ID NO: 192830 - DNA, 25 bp, Homo sapien
atggacaacatgatctgcacgcaga

SEQ ID NO: 192831 - DNA, 25 bp, Homo sapien
ggcgctggcttccaccttggccaag

SEQ ID NO: 192832 - DNA, 25 bp, Homo sapien
gcggaccgggaaagaccctgctcac

SEQ ID NO: 192833 - DNA, 25 bp, Homo sapien
gcacggtgccagtgccattatggta

SEQ ID NO: 192834 - DNA, 25 bp, Homo sapien
ccattatggtacacggacagtggcg

SEQ ID NO: 192835 - DNA, 25 bp, Homo sapien
gcctgcgcttgaccgtgtcagactc

SEQ ID NO: 192836 - DNA, 25 bp, Homo sapien
ctcggtcaggatgaacttgacgttc

SEQ ID NO: 192837 - DNA, 25 bp, Homo sapien
gacgttctcctgctggttctgcttg

SEQ ID NO: 192838 - DNA, 25 bp, Homo sapien
cctcagaccaccgagtaaggaggtg

SEQ ID NO: 192839 - DNA, 25 bp, Homo sapien
ctggcggcgcatggaaagctcacct

SEQ ID NO: 192840 - DNA, 25 bp, Homo sapien
ctgcagctggaacgcggtgagccac

SEQ ID NO: 192841 - DNA, 25 bp, Homo sapien
tggctcacggcctcagagctctgga

SEQ ID NO: 192842 - DNA, 25 bp, Homo sapien
tcagagctctggaagacacaaggca

SEQ ID NO: 192843 - DNA, 25 bp, Homo sapien
gaagacacaaggcacccactgcagg

SEQ ID NO: 192844 - DNA, 25 bp, Homo sapien
agcctggcccgtgagtgatcctcag

SEQ ID NO: 192845 - DNA, 25 bp, Homo sapien
gtgagtgatcctcagtccgcggtcc

SEQ ID NO: 192846 - DNA, 25 bp, Homo sapien
agctcacctcgggagtcatgcggct

SEQ ID NO: 192847 - DNA, 25 bp, Homo sapien
ggtcattgcccgtccggttgtcatg

SEQ ID NO: 192848 - DNA, 25 bp, Homo sapien
atccggatgctgctcgaggacctgg

SEQ ID NO: 192849 - DNA, 25 bp, Homo sapien
tgctcgaggacctggccagtaaggt

SEQ ID NO: 192850 - DNA, 25 bp, Homo sapien
tttcgcagagtctcctgcccagtgc

SEQ ID NO: 192851 - DNA, 25 bp, Homo sapien
cgggaagtagcccacccggtcattg

SEQ ID NO: 192852 - DNA, 25 bp, Homo sapien
ggttgtcatggatgcagcccttcca

SEQ ID NO: 192853 - DNA, 25 bp, Homo sapien
gtcatggatgcagcccttccaccgg

SEQ ID NO: 192854 - DNA, 25 bp, Homo sapien
ttgacaatggcctcgcccagggagg

SEQ ID NO: 192855 - DNA, 25 bp, Homo sapien
cgagggattgtgaagaggaatctcc

SEQ ID NO: 192856 - DNA, 25 bp, Homo sapien
tcaggcgttcctggcccagggttcc

SEQ ID NO: 192857 - DNA, 25 bp, Homo sapien
ccgccaggctgtcaggcgttcctgg

SEQ ID NO: 192858 - DNA, 25 bp, Homo sapien
gcggtccctacgtcctccgccttca

SEQ ID NO: 192859 - DNA, 25 bp, Homo sapien
tagggactgtcacctcccgggtcgc

SEQ ID NO: 192860 - DNA, 25 bp, Homo sapien
gggtctgctagggactgtcacctcc

SEQ ID NO: 192861 - DNA, 25 bp, Homo sapien
cctgcaaagcgtgttattaaacgtg

SEQ ID NO: 192862 - DNA, 25 bp, Homo sapien
tgtgaagaggaatctcccaataatg

SEQ ID NO: 192863 - DNA, 25 bp, Homo sapien
ctcgccgtcctggacacggcggagt

SEQ ID NO: 192864 - DNA, 25 bp, Homo sapien
aacggacagccgtgtcagaagggca

SEQ ID NO: 192865 - DNA, 25 bp, Homo sapien
taactctacgctcggcctcgatcga

SEQ ID NO: 192866 - DNA, 25 bp, Homo sapien
agggcaccggaacagcgcgacccga

SEQ ID NO: 192867 - DNA, 25 bp, Homo sapien
cagaactttggtctcgtcccaccca

SEQ ID NO: 192868 - DNA, 25 bp, Homo sapien
tctcgccctagggagccatcgataa

SEQ ID NO: 192869 - DNA, 25 bp, Homo sapien
tagggagccatcgataactctacgc

SEQ ID NO: 192870 - DNA, 25 bp, Homo sapien
acagcccgggaaacggacagccgtg

SEQ ID NO: 192871 - DNA, 25 bp, Homo sapien
ccgcttccgccggtgaatggtcagt

SEQ ID NO: 192872 - DNA, 25 bp, Homo sapien
cagtgctggagtttgaacagggccc

SEQ ID NO: 192873 - DNA, 25 bp, Homo sapien
tgaaccatctcaacgccatttgcgc

SEQ ID NO: 192874 - DNA, 25 bp, Homo sapien
ggactctgctttcggtaaataggaa

SEQ ID NO: 192875 - DNA, 25 bp, Homo sapien
gctaagtcaatcagcagtcgcccga

SEQ ID NO: 192876 - DNA, 25 bp, Homo sapien
acacacttgactgggtttggggagc

SEQ ID NO: 192877 - DNA, 25 bp, Homo sapien
ctcggggctgaaatcaacacacttg

SEQ ID NO: 192878 - DNA, 25 bp, Homo sapien
gcgaggcagtgagacttccaccgcc

SEQ ID NO: 192879 - DNA, 25 bp, Homo sapien
ctgctgttgttggtgatgaagccca

SEQ ID NO: 192880 - DNA, 25 bp, Homo sapien
agcacgccgtcgcagtcgaacagca

SEQ ID NO: 192881 - DNA, 25 bp, Homo sapien
cgatcattggctaccggccttggga

SEQ ID NO: 192882 - DNA, 25 bp, Homo sapien
tccaaccggcattcggagtgaagcg

SEQ ID NO: 192883 - DNA, 25 bp, Homo sapien
gcgctcgctgcggaaatgcgccaga

SEQ ID NO: 192884 - DNA, 25 bp, Homo sapien
ccattggaagcgagtggtcagccta

SEQ ID NO: 192885 - DNA, 25 bp, Homo sapien
gctgaagtgcgggtcaaagcccacc

SEQ ID NO: 192886 - DNA, 25 bp, Homo sapien
ttgtccatgttggtgcccacgagca

SEQ ID NO: 192887 - DNA, 25 bp, Homo sapien
cctgtccttaggtacggaagcgctg

SEQ ID NO: 192888 - DNA, 25 bp, Homo sapien
cgcgttctctggctctcaaatccga

SEQ ID NO: 192889 - DNA, 25 bp, Homo sapien
gtgcagcctcgaacataggtccttc

SEQ ID NO: 192890 - DNA, 25 bp, Homo sapien
tggctggcaatctgctccaccgtaa

SEQ ID NO: 192891 - DNA, 25 bp, Homo sapien
ctttaaggccacaccgctatccagg

SEQ ID NO: 192892 - DNA, 25 bp, Homo sapien
cgcggcccgttgttatgacgacatg

SEQ ID NO: 192893 - DNA, 25 bp, Homo sapien
cctctctggtgtgcgtccacaagtg

SEQ ID NO: 192894 - DNA, 25 bp, Homo sapien
cccggtgtagacattcgcagacgcc

SEQ ID NO: 192895 - DNA, 25 bp, Homo sapien
tgagcgccgcttccgctgtggcgac

SEQ ID NO: 192896 - DNA, 25 bp, Homo sapien
ccaaggcctacctgctcaagaagca

SEQ ID NO: 192897 - DNA, 25 bp, Homo sapien
tgcgggaagctctacaagaccattg

SEQ ID NO: 192898 - DNA, 25 bp, Homo sapien
gctctacaagaccattgcccatgtg

SEQ ID NO: 192899 - DNA, 25 bp, Homo sapien
agaccattgcccatgtgcgtggcca

SEQ ID NO: 192900 - DNA, 25 bp, Homo sapien
atgtgcgtggccaccggcgcgtcca

SEQ ID NO: 192901 - DNA, 25 bp, Homo sapien
ctgctcaagaagcaccaggaggtgc

SEQ ID NO: 192902 - DNA, 25 bp, Homo sapien
cgactgcgggaagctctacaagacc

SEQ ID NO: 192903 - DNA, 25 bp, Homo sapien
cacagtgttggtggagttctcgtcc

SEQ ID NO: 192904 - DNA, 25 bp, Homo sapien
cggtcatcgtctagcatgaggtctg

SEQ ID NO: 192905 - DNA, 25 bp, Homo sapien
acggaagacccgcacacagtgttgg

SEQ ID NO: 192906 - DNA, 25 bp, Homo sapien
ttctcgtccgtggtagctgacaccc

SEQ ID NO: 192907 - DNA, 25 bp, Homo sapien
ccacggagatcatcgagggcaccca

SEQ ID NO: 192908 - DNA, 25 bp, Homo sapien
gccggccaccagatcatcgtgcaga

SEQ ID NO: 192909 - DNA, 25 bp, Homo sapien
tgacacccaggagtatatcatcgag

SEQ ID NO: 192910 - DNA, 25 bp, Homo sapien
ggccactgtgaccatggtgtcatca

SEQ ID NO: 192911 - DNA, 25 bp, Homo sapien
ccggagcccaagaagtcgcagtact

SEQ ID NO: 192912 - DNA, 25 bp, Homo sapien
cgcagtactgcagcgtgtcgtagct

SEQ ID NO: 192913 - DNA, 25 bp, Homo sapien
tccaccaggaagaatcgccgcactg

SEQ ID NO: 192914 - DNA, 25 bp, Homo sapien
gccatgcacaggatggtgacccaga

SEQ ID NO: 192915 - DNA, 25 bp, Homo sapien
ttcaggactgtcttgagccgtgcca

SEQ ID NO: 192916 - DNA, 25 bp, Homo sapien
cgagggccactcacgtatttcagga

SEQ ID NO: 192917 - DNA, 25 bp, Homo sapien
acggtactgcctttcgcaggctgca

SEQ ID NO: 192918 - DNA, 25 bp, Homo sapien
taggcgtagacggaggcctccacca

SEQ ID NO: 192919 - DNA, 25 bp, Homo sapien
ttcaacgccgactgcagctatgtgc

SEQ ID NO: 192920 - DNA, 25 bp, Homo sapien
tgtacctggacgtgatcgacaagtg

SEQ ID NO: 192921 - DNA, 25 bp, Homo sapien
agatcgacgcgctctacgacgtgta

SEQ ID NO: 192922 - DNA, 25 bp, Homo sapien
gcgagcccttcgtggtcaagttctc

SEQ ID NO: 192923 - DNA, 25 bp, Homo sapien
tcggtcgtggacacctacctgtacc

SEQ ID NO: 192924 - DNA, 25 bp, Homo sapien
gccgggaccagtacaaggagatgta

SEQ ID NO: 192925 - DNA, 25 bp, Homo sapien
cgcatcggagccttcaacattcaga

SEQ ID NO: 192926 - DNA, 25 bp, Homo sapien
tgtccgagcacgagtacagctttgt

SEQ ID NO: 192927 - DNA, 25 bp, Homo sapien
acagaagccaccagcgccatcttga

SEQ ID NO: 192928 - DNA, 25 bp, Homo sapien
agctactgcagtatcggcgctggaa

SEQ ID NO: 192929 - DNA, 25 bp, Homo sapien
gcaggctcttctacagcgcgggaca

SEQ ID NO: 192930 - DNA, 25 bp, Homo sapien
catcttgaccgcaacgcgcgggata

SEQ ID NO: 192931 - DNA, 25 bp, Homo sapien
cgacagacgtggttctccgacagca

SEQ ID NO: 192932 - DNA, 25 bp, Homo sapien
gttctaaacacaaaccgagcgtcga

SEQ ID NO: 192933 - DNA, 25 bp, Homo sapien
gagcggcaaggttctgtttcgaaac

SEQ ID NO: 192934 - DNA, 25 bp, Homo sapien
tgaagcagccacgaccagctcagcg

SEQ ID NO: 192935 - DNA, 25 bp, Homo sapien
cggcgccgctctgacgtcagagtca

SEQ ID NO: 192936 - DNA, 25 bp, Homo sapien
ttcgtgcggtcaaaatccactggtg

SEQ ID NO: 192937 - DNA, 25 bp, Homo sapien
tgacgtaaacgcctggcccaatggg

SEQ ID NO: 192938 - DNA, 25 bp, Homo sapien
tggggacgttcaaggtgtctcctag

SEQ ID NO: 192939 - DNA, 25 bp, Homo sapien
ctagccggtaaagtccctgggactg

SEQ ID NO: 192940 - DNA, 25 bp, Homo sapien
gcacgcttactggagcgggcacatg

SEQ ID NO: 192941 - DNA, 25 bp, Homo sapien
gccagcgaggaagcgttaaagagtc

SEQ ID NO: 192942 - DNA, 25 bp, Homo sapien
gggcacatgggtagcctgttgaacc

SEQ ID NO: 192943 - DNA, 25 bp, Homo sapien
aggaggtgcagtacctccgcgtctc

SEQ ID NO: 192944 - DNA, 25 bp, Homo sapien
atttcttgcagtagtgggcggcgac

SEQ ID NO: 192945 - DNA, 25 bp, Homo sapien
ctgggacactcactatatttcttgc

SEQ ID NO: 192946 - DNA, 25 bp, Homo sapien
agtgaccacgtcctgaggacgcagg

SEQ ID NO: 192947 - DNA, 25 bp, Homo sapien
ctctgcagtgaccacgtcctgagga

SEQ ID NO: 192948 - DNA, 25 bp, Homo sapien
ccaggccactcagacgcagaggagc

SEQ ID NO: 192949 - DNA, 25 bp, Homo sapien
caaggcggtacagaggaacgcacca

SEQ ID NO: 192950 - DNA, 25 bp, Homo sapien
cagtacctccgcgtctcgtagttct

SEQ ID NO: 192951 - DNA, 25 bp, Homo sapien
gacggttctgccgtactcgcccaag

SEQ ID NO: 192952 - DNA, 25 bp, Homo sapien
agctccgaggagtagttgatggcca

SEQ ID NO: 192953 - DNA, 25 bp, Homo sapien
tgcagctgaggttgcaccggagact

SEQ ID NO: 192954 - DNA, 25 bp, Homo sapien
gccttcttcaggaacatggcccaga

SEQ ID NO: 192955 - DNA, 25 bp, Homo sapien
agcctgcagtgcgtctttcagatgc

SEQ ID NO: 192956 - DNA, 25 bp, Homo sapien
cgccagctgtatgcggccttcttca

SEQ ID NO: 192957 - DNA, 25 bp, Homo sapien
aactgagaagggcacgacggttctg

SEQ ID NO: 192958 - DNA, 25 bp, Homo sapien
accggagactcccagagcgttgaaa

SEQ ID NO: 192959 - DNA, 25 bp, Homo sapien
tgtgacctggattccgcggttcctg

SEQ ID NO: 192960 - DNA, 25 bp, Homo sapien
agggcgtaaaggacacgcgcaaata

SEQ ID NO: 192961 - DNA, 25 bp, Homo sapien
cgcgcaaataaaggtctgtggccca

SEQ ID NO: 192962 - DNA, 25 bp, Homo sapien
ctgtggcccaggaaaacttcaagtc

SEQ ID NO: 192963 - DNA, 25 bp, Homo sapien
tcaagtcctgaaatcggtgcaccaa

SEQ ID NO: 192964 - DNA, 25 bp, Homo sapien
cggtgcaccaaggatactttaaggc

SEQ ID NO: 192965 - DNA, 25 bp, Homo sapien
ggtcggggctgtgtaatcatttacc

SEQ ID NO: 192966 - DNA, 25 bp, Homo sapien
ctacccaaggacgtcccgaggcgtg

SEQ ID NO: 192967 - DNA, 25 bp, Homo sapien
ctccaatgccgtcggaggggtccat

SEQ ID NO: 192968 - DNA, 25 bp, Homo sapien
tgcatgggcttacatgaggcgtttg

SEQ ID NO: 192969 - DNA, 25 bp, Homo sapien
ccagtgttgagcttgacagcggtgc

SEQ ID NO: 192970 - DNA, 25 bp, Homo sapien
tcgcagactctcctctgcatgggct

SEQ ID NO: 192971 - DNA, 25 bp, Homo sapien
acagcggtgcgctcctcctcgatga

SEQ ID NO: 192972 - DNA, 25 bp, Homo sapien
tgtgctgactctcccggaccctgtt

SEQ ID NO: 192973 - DNA, 25 bp, Homo sapien
cgacccatgcggtgtgagccgctgc

SEQ ID NO: 192974 - DNA, 25 bp, Homo sapien
tccctgccgacccatgcggtgtgag

SEQ ID NO: 192975 - DNA, 25 bp, Homo sapien
tcaccgtatttctgcttgaggaaca

SEQ ID NO: 192976 - DNA, 25 bp, Homo sapien
gaacagcgaggacccgcagcactgc

SEQ ID NO: 192977 - DNA, 25 bp, Homo sapien
agcaggtcagcctcgtccatgaagt

SEQ ID NO: 192978 - DNA, 25 bp, Homo sapien
tccatgaagtgggtggtcagcacga

SEQ ID NO: 192979 - DNA, 25 bp, Homo sapien
cagcacgatggtgcggtcacttttc

SEQ ID NO: 192980 - DNA, 25 bp, Homo sapien
cacagtctcgcgacgctggtagagc

SEQ ID NO: 192981 - DNA, 25 bp, Homo sapien
tgggctcgtccagtatcagcacctg

SEQ ID NO: 192982 - DNA, 25 bp, Homo sapien
ctgccgctgaagaagatcccagatg

SEQ ID NO: 192983 - DNA, 25 bp, Homo sapien
tgcgcagtcagccaccctgcgagta

SEQ ID NO: 192984 - DNA, 25 bp, Homo sapien
cggtggcctctgacaggaatgactc

SEQ ID NO: 192985 - DNA, 25 bp, Homo sapien
agcggagtcgccctcacttaaggag

SEQ ID NO: 192986 - DNA, 25 bp, Homo sapien
aggaatgactctgcgcacgtgcgtt

SEQ ID NO: 192987 - DNA, 25 bp, Homo sapien
gcggcgaggaaccttctggaattcg

SEQ ID NO: 192988 - DNA, 25 bp, Homo sapien
cttcacacccggaaactcgactttg

SEQ ID NO: 192989 - DNA, 25 bp, Homo sapien
gcactgtctttccttgggccctcgt

SEQ ID NO: 192990 - DNA, 25 bp, Homo sapien
tcgactttggccgtttctccatttc

SEQ ID NO: 192991 - DNA, 25 bp, Homo sapien
cgagctctttaacccggggcggatg

SEQ ID NO: 192992 - DNA, 25 bp, Homo sapien
agagggctggctcgagctctttaac

SEQ ID NO: 192993 - DNA, 25 bp, Homo sapien
aatgttcgaattcgcgtcctggcgc

SEQ ID NO: 192994 - DNA, 25 bp, Homo sapien
ccaatcagcggccaatgttcgaatt

SEQ ID NO: 192995 - DNA, 25 bp, Homo sapien
ggtcagcggcgaagcccgaacccat

SEQ ID NO: 192996 - DNA, 25 bp, Homo sapien
ttagaagcgccacgtcgaggctgtc

SEQ ID NO: 192997 - DNA, 25 bp, Homo sapien
gcacggcctcgtcttagaagcgcca

SEQ ID NO: 192998 - DNA, 25 bp, Homo sapien
tctccacctgaagcaggcggcggaa

SEQ ID NO: 192999 - DNA, 25 bp, Homo sapien
attgcaattggagcagagcctgcgc

SEQ ID NO: 193000 - DNA, 25 bp, Homo sapien
tgctgcatgcctggtacgcggaccc

SEQ ID NO: 193001 - DNA, 25 bp, Homo sapien
gcgcgtttgccgtcggctgctgcat

SEQ ID NO: 193002 - DNA, 25 bp, Homo sapien
cgtggctcttcagaggcggcaaatt

SEQ ID NO: 193003 - DNA, 25 bp, Homo sapien
ctgcgcacagcgacaattgcaattg

SEQ ID NO: 193004 - DNA, 25 bp, Homo sapien
cggcaaattgcaaggagacgccgcc

SEQ ID NO: 193005 - DNA, 25 bp, Homo sapien
tggacgcctgcgcacagcgacaatt

SEQ ID NO: 193006 - DNA, 25 bp, Homo sapien
ccctgcaagagaagcgcgataatgg

SEQ ID NO: 193007 - DNA, 25 bp, Homo sapien
ctcctgggaccctcagctgttgggc

SEQ ID NO: 193008 - DNA, 25 bp, Homo sapien
ggcgactcgggaaactccaggaaga

SEQ ID NO: 193009 - DNA, 25 bp, Homo sapien
cgctggggctgctaatccggccacg

SEQ ID NO: 193010 - DNA, 25 bp, Homo sapien
ggactctagactcccgctcctggga

SEQ ID NO: 193011 - DNA, 25 bp, Homo sapien
ctcggagacaccacccgccggtcgt

SEQ ID NO: 193012 - DNA, 25 bp, Homo sapien
ggctggagtttcagctcggagacac

SEQ ID NO: 193013 - DNA, 25 bp, Homo sapien
gcggtcgcgctgactcagagctcag

SEQ ID NO: 193014 - DNA, 25 bp, Homo sapien
ctaatccggccacgggctatttttg

SEQ ID NO: 193015 - DNA, 25 bp, Homo sapien
gctggaagtgcaccgacaccacgtc

SEQ ID NO: 193016 - DNA, 25 bp, Homo sapien
gaagtgcaccgacaccacgtccatg

SEQ ID NO: 193017 - DNA, 25 bp, Homo sapien
gagggcgtgtccgaacacaccctca

SEQ ID NO: 193018 - DNA, 25 bp, Homo sapien
ccgcatcacggagggcgtgtccgaa

SEQ ID NO: 193019 - DNA, 25 bp, Homo sapien
cccgctgtccatgccggtgttcagg

SEQ ID NO: 193020 - DNA, 25 bp, Homo sapien
acagcaggtaccttgttggcccgca

SEQ ID NO: 193021 - DNA, 25 bp, Homo sapien
cacaggccgcttgcagacagcaggt

SEQ ID NO: 193022 - DNA, 25 bp, Homo sapien
tgtcccgtgccaaggtaaatgagga

SEQ ID NO: 193023 - DNA, 25 bp, Homo sapien
cgccaaaacccagaggtagcagctg

SEQ ID NO: 193024 - DNA, 25 bp, Homo sapien
gcctcgctgcattctgccgttcggt

SEQ ID NO: 193025 - DNA, 25 bp, Homo sapien
ggcagagaaggccaccggccgtttc

SEQ ID NO: 193026 - DNA, 25 bp, Homo sapien
cgtccaacgtcgcatttcagctttt

SEQ ID NO: 193027 - DNA, 25 bp, Homo sapien
ttcagcttttgacttggcgcgcaga

SEQ ID NO: 193028 - DNA, 25 bp, Homo sapien
cgcctctggagccaatgggctctga

SEQ ID NO: 193029 - DNA, 25 bp, Homo sapien
ctgccttcggagctcggttggaaac

SEQ ID NO: 193030 - DNA, 25 bp, Homo sapien
tttcttctggaaccctttgggcaga

SEQ ID NO: 193031 - DNA, 25 bp, Homo sapien
cgtctccgcagggtcggaaatcctc

SEQ ID NO: 193032 - DNA, 25 bp, Homo sapien
tccgcagggtcggaaatcctcttgg

SEQ ID NO: 193033 - DNA, 25 bp, Homo sapien
ggctcggtgagattgcaacagattc

SEQ ID NO: 193034 - DNA, 25 bp, Homo sapien
acagattctgatacgccctgccctg

SEQ ID NO: 193035 - DNA, 25 bp, Homo sapien
tcgtctggaagagtgactgtgtcac

SEQ ID NO: 193036 - DNA, 25 bp, Homo sapien
catggtgtcgtctggaagagtgact

SEQ ID NO: 193037 - DNA, 25 bp, Homo sapien
acaggccttctttgatggccgtgcc

SEQ ID NO: 193038 - DNA, 25 bp, Homo sapien
ccgttgcctcctctccgcacgggac

SEQ ID NO: 193039 - DNA, 25 bp, Homo sapien
ggccctgttcctcggcattgcgggc

SEQ ID NO: 193040 - DNA, 25 bp, Homo sapien
aggcttttgagctggtcttcgtgag

SEQ ID NO: 193041 - DNA, 25 bp, Homo sapien
tgtcatcgctctaggcccagcggga

SEQ ID NO: 193042 - DNA, 25 bp, Homo sapien
tcttcgtgagcctgcgcttctgctc

SEQ ID NO: 193043 - DNA, 25 bp, Homo sapien
tgctgctgacggcaggcacgctctt

SEQ ID NO: 193044 - DNA, 25 bp, Homo sapien
agcccgcgtctgaatctgcttctga

SEQ ID NO: 193045 - DNA, 25 bp, Homo sapien
tgccaggactggtgaacgccgccct

SEQ ID NO: 193046 - DNA, 25 bp, Homo sapien
tgcttctgattccagctctgcgatg

SEQ ID NO: 193047 - DNA, 25 bp, Homo sapien
gcgccctgtgttagtgagtgaccct

SEQ ID NO: 193048 - DNA, 25 bp, Homo sapien
tggaacgccttgacccttgctgggc

SEQ ID NO: 193049 - DNA, 25 bp, Homo sapien
tggcagctaccgcatcagcctaaag

SEQ ID NO: 193050 - DNA, 25 bp, Homo sapien
tctacccagactgtgactcgcactg

SEQ ID NO: 193051 - DNA, 25 bp, Homo sapien
tgtccctgcaaggatggcgtcactg

SEQ ID NO: 193052 - DNA, 25 bp, Homo sapien
tgcaaccagaccacaggccagtgtc

SEQ ID NO: 193053 - DNA, 25 bp, Homo sapien
agctccctgctgttgtcccgtctat

SEQ ID NO: 193054 - DNA, 25 bp, Homo sapien
aggactatggtaggtgccctcaggc

SEQ ID NO: 193055 - DNA, 25 bp, Homo sapien
gagcttcctggcctttgagtcgtcc

SEQ ID NO: 193056 - DNA, 25 bp, Homo sapien
gtaccagcgcctgatccgggacatt

SEQ ID NO: 193057 - DNA, 25 bp, Homo sapien
aggtgcccagctactgcctgaatgc

SEQ ID NO: 193058 - DNA, 25 bp, Homo sapien
tgacgccagcgtgtacagcgacatc

SEQ ID NO: 193059 - DNA, 25 bp, Homo sapien
gcaagatcctcctgtgcctggccaa

SEQ ID NO: 193060 - DNA, 25 bp, Homo sapien
acgtcttcctggtggagggctacaa

SEQ ID NO: 193061 - DNA, 25 bp, Homo sapien
gctgctggagaaagcgttcgccatc

SEQ ID NO: 193062 - DNA, 25 bp, Homo sapien
gcaggacatccgcacgttcgtcaga

SEQ ID NO: 193063 - DNA, 25 bp, Homo sapien
cgagatcgcatcgtctctgctttca

SEQ ID NO: 193064 - DNA, 25 bp, Homo sapien
agggcttagcaaccgcagccatggc

SEQ ID NO: 193065 - DNA, 25 bp, Homo sapien
acctgggctttgatcttatctgaga

SEQ ID NO: 193066 - DNA, 25 bp, Homo sapien
acttgtgagtccaaaagggcttagc

SEQ ID NO: 193067 - DNA, 25 bp, Homo sapien
gcctttgttgcgcaggtgaccttcc

SEQ ID NO: 193068 - DNA, 25 bp, Homo sapien
agtaccttcgaggtgaggcctgcgc

SEQ ID NO: 193069 - DNA, 25 bp, Homo sapien
acgacgtgaacatccgcacctctga

SEQ ID NO: 193070 - DNA, 25 bp, Homo sapien
ctctgctttcagtcgttgtccgcgc

SEQ ID NO: 193071 - DNA, 25 bp, Homo sapien
ctgggtgcagattcacgggatgaaa

SEQ ID NO: 193072 - DNA, 25 bp, Homo sapien
gcagcgactgcctcatcgtcggtga

SEQ ID NO: 193073 - DNA, 25 bp, Homo sapien
ctgcagcctgaggtgcagcgctacg

SEQ ID NO: 193074 - DNA, 25 bp, Homo sapien
ggggcttcatctgctcgagccacca

SEQ ID NO: 193075 - DNA, 25 bp, Homo sapien
atcattcagccgtgcgctgctccgg

SEQ ID NO: 193076 - DNA, 25 bp, Homo sapien
tgcttccgggtttgatcattcagcc

SEQ ID NO: 193077 - DNA, 25 bp, Homo sapien
cgtcatcgccctgtgtgcttccggg

SEQ ID NO: 193078 - DNA, 25 bp, Homo sapien
tgccctccaagaccgagtccatgtt

SEQ ID NO: 193079 - DNA, 25 bp, Homo sapien
ctggtatttagagcgcagcggctga

SEQ ID NO: 193080 - DNA, 25 bp, Homo sapien
attctgcgggcaggtgacatcacac

SEQ ID NO: 193081 - DNA, 25 bp, Homo sapien
gccattttgttctgcggtgctggta

SEQ ID NO: 193082 - DNA, 25 bp, Homo sapien
actctgacgtaatcccgagctgtcg

SEQ ID NO: 193083 - DNA, 25 bp, Homo sapien
tccggtgtgtgacgtcactctgacg

SEQ ID NO: 193084 - DNA, 25 bp, Homo sapien
tccaacgctgcggagatccagaggc

SEQ ID NO: 193085 - DNA, 25 bp, Homo sapien
cccacggtgcgaagtggtacggctc

SEQ ID NO: 193086 - DNA, 25 bp, Homo sapien
cccgtatgctaatgaagcacacacc

SEQ ID NO: 193087 - DNA, 25 bp, Homo sapien
aaagttcttggatgtgacgggcctg

SEQ ID NO: 193088 - DNA, 25 bp, Homo sapien
gaggccgcatcttggacccagagaa

SEQ ID NO: 193089 - DNA, 25 bp, Homo sapien
tcagtcagctgaaggtcacgtgggc

SEQ ID NO: 193090 - DNA, 25 bp, Homo sapien
ggagcggcccttgtctcccagctat

SEQ ID NO: 193091 - DNA, 25 bp, Homo sapien
ctgtgtatgcggatgatttagaatt

SEQ ID NO: 193092 - DNA, 25 bp, Homo sapien
tgtcctagtgcccatcgtctgtttc

SEQ ID NO: 193093 - DNA, 25 bp, Homo sapien
tacatgcgcagtgtcctagtgccca

SEQ ID NO: 193094 - DNA, 25 bp, Homo sapien
atcctgcgcggagggaaactgctca

SEQ ID NO: 193095 - DNA, 25 bp, Homo sapien
ttcaacgccatgctgcctgtgagtg

SEQ ID NO: 193096 - DNA, 25 bp, Homo sapien
ggccgctgcatcttctatgggatga

SEQ ID NO: 193097 - DNA, 25 bp, Homo sapien
ttccaggacttgctggccacctacg

SEQ ID NO: 193098 - DNA, 25 bp, Homo sapien
aagtctgaatccaggtcccgcaggg

SEQ ID NO: 193099 - DNA, 25 bp, Homo sapien
ctgggccaggtgcaaagtctgaatc

SEQ ID NO: 193100 - DNA, 25 bp, Homo sapien
agccacgaagtgatccgggcgctga

SEQ ID NO: 193101 - DNA, 25 bp, Homo sapien
acaatgtccgcatcgtgacgctggc

SEQ ID NO: 193102 - DNA, 25 bp, Homo sapien
gatgattgcagatggcacgcacacc

SEQ ID NO: 193103 - DNA, 25 bp, Homo sapien
cgtttcgtcccgtgtgtgaactgga

SEQ ID NO: 193104 - DNA, 25 bp, Homo sapien
tgagtccaggctgacgcgcaactct

SEQ ID NO: 193105 - DNA, 25 bp, Homo sapien
ttacgtatcacgcacaggtggatcc

SEQ ID NO: 193106 - DNA, 25 bp, Homo sapien
cttctgtcgggccaattaggatcgc

SEQ ID NO: 193107 - DNA, 25 bp, Homo sapien
gagcccgcggtttaagacccagatc

SEQ ID NO: 193108 - DNA, 25 bp, Homo sapien
acatccaggccagagactgcgtttg

SEQ ID NO: 193109 - DNA, 25 bp, Homo sapien
tggatcccactacgacccagcttgg

SEQ ID NO: 193110 - DNA, 25 bp, Homo sapien
ggcgcgcgtcaccttctctagttaa

SEQ ID NO: 193111 - DNA, 25 bp, Homo sapien
gcctggagccgagcctccagggtta

SEQ ID NO: 193112 - DNA, 25 bp, Homo sapien
tagaggaaccgccctgggcttccac

SEQ ID NO: 193113 - DNA, 25 bp, Homo sapien
acctttcggttctgtctgtagagga

SEQ ID NO: 193114 - DNA, 25 bp, Homo sapien
cagggttacctttcggttctgtctg

SEQ ID NO: 193115 - DNA, 25 bp, Homo sapien
tggagccgagcctccagggttacct

SEQ ID NO: 193116 - DNA, 25 bp, Homo sapien
ttctgtctgtagaggaaccgccctg

SEQ ID NO: 193117 - DNA, 25 bp, Homo sapien
tttgttttcggcttggcgcagcctg

SEQ ID NO: 193118 - DNA, 25 bp, Homo sapien
gaaagtttgttttcggcttggcgca

SEQ ID NO: 193119 - DNA, 25 bp, Homo sapien
atatgcgctttttggtcggggtctg

SEQ ID NO: 193120 - DNA, 25 bp, Homo sapien
tgtcaccagcggttccctttcactg

SEQ ID NO: 193121 - DNA, 25 bp, Homo sapien
cctgtttcctcgagaccgtgtaatg

SEQ ID NO: 193122 - DNA, 25 bp, Homo sapien
cggttccctttcactgaggccgtgg

SEQ ID NO: 193123 - DNA, 25 bp, Homo sapien
ggggtctttgtgcatcgaagcctgc

SEQ ID NO: 193124 - DNA, 25 bp, Homo sapien
cgtgagttatatgcgctttttggtc

SEQ ID NO: 193125 - DNA, 25 bp, Homo sapien
gctgagaggctctgttcctgtttcc

SEQ ID NO: 193126 - DNA, 25 bp, Homo sapien
tcgaagcctgcacgtgagttatatg

SEQ ID NO: 193127 - DNA, 25 bp, Homo sapien
ggagccagcgtagaagcacagcatc

SEQ ID NO: 193128 - DNA, 25 bp, Homo sapien
ccagctgtagaaggacagcctctgc

SEQ ID NO: 193129 - DNA, 25 bp, Homo sapien
tggcactgccgtaccagctgtagaa

SEQ ID NO: 193130 - DNA, 25 bp, Homo sapien
tctcccgggagacctgcaggagcca

SEQ ID NO: 193131 - DNA, 25 bp, Homo sapien
acacggtgatctccgcgtcggtgca

SEQ ID NO: 193132 - DNA, 25 bp, Homo sapien
gcgggcagccacctacacggtgatc

SEQ ID NO: 193133 - DNA, 25 bp, Homo sapien
attgcttctcggtgtggtgctcagc

SEQ ID NO: 193134 - DNA, 25 bp, Homo sapien
aacgttgacggaggcattgcttctc

SEQ ID NO: 193135 - DNA, 25 bp, Homo sapien
tgtcctcatgccctccgttgagcgg

SEQ ID NO: 193136 - DNA, 25 bp, Homo sapien
ccgcgcagcccttgattgtcacaga

SEQ ID NO: 193137 - DNA, 25 bp, Homo sapien
ttgattgtcacagatcgtgagtccg

SEQ ID NO: 193138 - DNA, 25 bp, Homo sapien
aggcgtctttgagccggtgagccat

SEQ ID NO: 193139 - DNA, 25 bp, Homo sapien
gctggccgtttgtgtgcagctcact

SEQ ID NO: 193140 - DNA, 25 bp, Homo sapien
gcagctcactgtccaggcgcgtgtc

SEQ ID NO: 193141 - DNA, 25 bp, Homo sapien
tgcatggtccgccatgtgcgacacc

SEQ ID NO: 193142 - DNA, 25 bp, Homo sapien
ccaccggcagaatgtgctggccgtt

SEQ ID NO: 193143 - DNA, 25 bp, Homo sapien
gtattcacgttttctcgtttgcgcg

SEQ ID NO: 193144 - DNA, 25 bp, Homo sapien
acgtacccggctttcaaagtgcttg

SEQ ID NO: 193145 - DNA, 25 bp, Homo sapien
ttgtcgtcgccacctaagagctagc

SEQ ID NO: 193146 - DNA, 25 bp, Homo sapien
agagctagcgtttcctcgtttgtag

SEQ ID NO: 193147 - DNA, 25 bp, Homo sapien
cggagggccactttagcattggtgc

SEQ ID NO: 193148 - DNA, 25 bp, Homo sapien
ggtgcagaaagatctccaagctcta

SEQ ID NO: 193149 - DNA, 25 bp, Homo sapien
aggatcctgccctcttcgaaaaagg

SEQ ID NO: 193150 - DNA, 25 bp, Homo sapien
tacgaatatacgcataggatcctgc

SEQ ID NO: 193151 - DNA, 25 bp, Homo sapien
ttcggttcccgtgaggcccaggcag

SEQ ID NO: 193152 - DNA, 25 bp, Homo sapien
gttcgcgctcggctgtcctagctca

SEQ ID NO: 193153 - DNA, 25 bp, Homo sapien
ccgctagggccgctctcagactgga

SEQ ID NO: 193154 - DNA, 25 bp, Homo sapien
aggcgcggatcgctgaagtcagccc

SEQ ID NO: 193155 - DNA, 25 bp, Homo sapien
tcagagaaatgcagggctctggcca

SEQ ID NO: 193156 - DNA, 25 bp, Homo sapien
ggctgtcctagctcacggggcgacc

SEQ ID NO: 193157 - DNA, 25 bp, Homo sapien
tgcggctccaagatgcgcttaacgc

SEQ ID NO: 193158 - DNA, 25 bp, Homo sapien
tacagggagccgtttgcctgggttc

SEQ ID NO: 193159 - DNA, 25 bp, Homo sapien
acaggctagtgagtttccacccaca

SEQ ID NO: 193160 - DNA, 25 bp, Homo sapien
cctgctggtggttgtagtctttgct

SEQ ID NO: 193161 - DNA, 25 bp, Homo sapien
ctcctcatttccgtggccgtggaca

SEQ ID NO: 193162 - DNA, 25 bp, Homo sapien
gggtgggtcattttctcctcatttc

SEQ ID NO: 193163 - DNA, 25 bp, Homo sapien
agtccgtcacgtgggagaacctgca

SEQ ID NO: 193164 - DNA, 25 bp, Homo sapien
acctgccggctatgtcggaagacga

SEQ ID NO: 193165 - DNA, 25 bp, Homo sapien
cgacgaggactgctatggcaatgta

SEQ ID NO: 193166 - DNA, 25 bp, Homo sapien
acccacgtgtgatttgtagccgaaa

SEQ ID NO: 193167 - DNA, 25 bp, Homo sapien
ggtggcttcttgtgcctcccttaaa

SEQ ID NO: 193168 - DNA, 25 bp, Homo sapien
ccggactcggacaaggtgaggacca

SEQ ID NO: 193169 - DNA, 25 bp, Homo sapien
agctcggtttcactccctccggaag

SEQ ID NO: 193170 - DNA, 25 bp, Homo sapien
ctgcttttcccggatggaacttccg

SEQ ID NO: 193171 - DNA, 25 bp, Homo sapien
ggaacttccgcctgccatgtgaccg

SEQ ID NO: 193172 - DNA, 25 bp, Homo sapien
ggcgatattaaaagccggactcttc

SEQ ID NO: 193173 - DNA, 25 bp, Homo sapien
tcctgtacctcttgagccaggccga

SEQ ID NO: 193174 - DNA, 25 bp, Homo sapien
acgccgctgtgtcaggacccgaaat

SEQ ID NO: 193175 - DNA, 25 bp, Homo sapien
cgtgggaagaagagcaccctcacgc

SEQ ID NO: 193176 - DNA, 25 bp, Homo sapien
ttgcgagaatcgagcgcagcctgtg

SEQ ID NO: 193177 - DNA, 25 bp, Homo sapien
gcagcctgtgctggttgtgtaagcc

SEQ ID NO: 193178 - DNA, 25 bp, Homo sapien
ctggttgtgtaagccgtgggacaca

SEQ ID NO: 193179 - DNA, 25 bp, Homo sapien
agccgtgggacacacgggaaagcca

SEQ ID NO: 193180 - DNA, 25 bp, Homo sapien
cccacccgcgtgaagaagagcaacc

SEQ ID NO: 193181 - DNA, 25 bp, Homo sapien
ccgcccgtgggaagaagagcaccct

SEQ ID NO: 193182 - DNA, 25 bp, Homo sapien
cgaacctttgcgagaatcgagcgca

SEQ ID NO: 193183 - DNA, 25 bp, Homo sapien
cgcatcggtctgcactgggcagcgt

SEQ ID NO: 193184 - DNA, 25 bp, Homo sapien
ctcctccgagttcacgcggggcgtg

SEQ ID NO: 193185 - DNA, 25 bp, Homo sapien
ggcagcgtctgactccgtttctgtt

SEQ ID NO: 193186 - DNA, 25 bp, Homo sapien
tccgtgtctgcgcatcggtctgcac

SEQ ID NO: 193187 - DNA, 25 bp, Homo sapien
cctcgccgtgaaggctgagggtttc

SEQ ID NO: 193188 - DNA, 25 bp, Homo sapien
tggctcagaacagctcgaggcctcg

SEQ ID NO: 193189 - DNA, 25 bp, Homo sapien
gctggcttggctcagaacagctcga

SEQ ID NO: 193190 - DNA, 25 bp, Homo sapien
gtctgactccgtttctgttctgggc

SEQ ID NO: 193191 - DNA, 25 bp, Homo sapien
gcaccctgtgggtggaaactcacta

SEQ ID NO: 193192 - DNA, 25 bp, Homo sapien
cgtcttccgacatagccggcaggta

SEQ ID NO: 193193 - DNA, 25 bp, Homo sapien
ttgccatagcagtcctcgtcgtctt

SEQ ID NO: 193194 - DNA, 25 bp, Homo sapien
tcccggccagcttacattgccatag

SEQ ID NO: 193195 - DNA, 25 bp, Homo sapien
catgaagcccagtgcacggaggacc

SEQ ID NO: 193196 - DNA, 25 bp, Homo sapien
aggttctcccacgtgacggactcga

SEQ ID NO: 193197 - DNA, 25 bp, Homo sapien
ttcggctacaaatcacacgtgggtc

SEQ ID NO: 193198 - DNA, 25 bp, Homo sapien
ctgtccacggccacggaaatgagga

SEQ ID NO: 193199 - DNA, 25 bp, Homo sapien
acggccagcacattctgccggtggc

SEQ ID NO: 193200 - DNA, 25 bp, Homo sapien
cggactcacgatctgtgacaatcaa

SEQ ID NO: 193201 - DNA, 25 bp, Homo sapien
ccgacacgcgcctggacagtgagct

SEQ ID NO: 193202 - DNA, 25 bp, Homo sapien
tggctcaccggctcaaagacgcctg

SEQ ID NO: 193203 - DNA, 25 bp, Homo sapien
ccgctcaacggagggcatgaggaca

SEQ ID NO: 193204 - DNA, 25 bp, Homo sapien
ggtgtcgcacatggcggaccatgca

SEQ ID NO: 193205 - DNA, 25 bp, Homo sapien
ctgtgacaatcaagggctgcgcggt

SEQ ID NO: 193206 - DNA, 25 bp, Homo sapien
acagtgagctgcacacaaacggcca

SEQ ID NO: 193207 - DNA, 25 bp, Homo sapien
cgcatataactcacgtgcaggcttc

SEQ ID NO: 193208 - DNA, 25 bp, Homo sapien
ggaaacaggaacagagcctctcagc

SEQ ID NO: 193209 - DNA, 25 bp, Homo sapien
ccacggcctcagtgaaagggaaccg

SEQ ID NO: 193210 - DNA, 25 bp, Homo sapien
cccgaccaaaaagcgcatataactc

SEQ ID NO: 193211 - DNA, 25 bp, Homo sapien
acacggtctcgaggaaacaggaaca

SEQ ID NO: 193212 - DNA, 25 bp, Homo sapien
tgcaggcttcgatgcacaaagaccc

SEQ ID NO: 193213 - DNA, 25 bp, Homo sapien
cgccattacacggtctcgaggaaac

SEQ ID NO: 193214 - DNA, 25 bp, Homo sapien
cagtgaaagggaaccgctggtgaca

SEQ ID NO: 193215 - DNA, 25 bp, Homo sapien
ggtcctggctatgggcctcgcgtct

SEQ ID NO: 193216 - DNA, 25 bp, Homo sapien
ctggctatgggcctcgcgtctgcgc

SEQ ID NO: 193217 - DNA, 25 bp, Homo sapien
ccgctcggggcctcctcagagtcct

SEQ ID NO: 193218 - DNA, 25 bp, Homo sapien
ttccctaagctgaactccagcaacg

SEQ ID NO: 193219 - DNA, 25 bp, Homo sapien
aagctgaactccagcaacggcggcc

SEQ ID NO: 193220 - DNA, 25 bp, Homo sapien
gcggccctcacgctgtgcccgcgac

SEQ ID NO: 193221 - DNA, 25 bp, Homo sapien
atcgtcccttcgccgcggtctgagt

SEQ ID NO: 193222 - DNA, 25 bp, Homo sapien
ccagctaggtggtggtcctggctat

SEQ ID NO: 193223 - DNA, 25 bp, Homo sapien
ggacctcgcgcgaaccaatcccagg

SEQ ID NO: 193224 - DNA, 25 bp, Homo sapien
gggcggttcctctacagacagaacc

SEQ ID NO: 193225 - DNA, 25 bp, Homo sapien
cctctacagacagaaccgaaaggta

SEQ ID NO: 193226 - DNA, 25 bp, Homo sapien
cagacagaaccgaaaggtaaccctg

SEQ ID NO: 193227 - DNA, 25 bp, Homo sapien
tccaggctgcgccaagccgaaaaca

SEQ ID NO: 193228 - DNA, 25 bp, Homo sapien
tgcgccaagccgaaaacaaactttc

SEQ ID NO: 193229 - DNA, 25 bp, Homo sapien
cgccgcagccaagcagcgccctcgg

SEQ ID NO: 193230 - DNA, 25 bp, Homo sapien
cagggcggttcctctacagacagaa

SEQ ID NO: 193231 - DNA, 25 bp, Homo sapien
ctaggacacgaagcgccccaaaggg

SEQ ID NO: 193232 - DNA, 25 bp, Homo sapien
caggtgcgtgtcagatccacgcttt

SEQ ID NO: 193233 - DNA, 25 bp, Homo sapien
gggcctgagtcaggcgcctcagcac

SEQ ID NO: 193234 - DNA, 25 bp, Homo sapien
cgacctccgcctgggaccgagagga

SEQ ID NO: 193235 - DNA, 25 bp, Homo sapien
ctcggaacacgcaggaaattctccc

SEQ ID NO: 193236 - DNA, 25 bp, Homo sapien
gcgcgctcggaacacgcaggaaatt

SEQ ID NO: 193237 - DNA, 25 bp, Homo sapien
tgcgcccggggtgtcacaatcccgc

SEQ ID NO: 193238 - DNA, 25 bp, Homo sapien
gccagatgagcgcacaggtgcgccc

SEQ ID NO: 193239 - DNA, 25 bp, Homo sapien
aggccgatcccgacctggactcaga

SEQ ID NO: 193240 - DNA, 25 bp, Homo sapien
acacgccctgcttcgtgcggaggag

SEQ ID NO: 193241 - DNA, 25 bp, Homo sapien
ctgtaccgcttatgccaggccgatc

SEQ ID NO: 193242 - DNA, 25 bp, Homo sapien
aagtgggtccgactcaacgtcggcg

SEQ ID NO: 193243 - DNA, 25 bp, Homo sapien
ccctggcagcgtgtccaagtgggtc

SEQ ID NO: 193244 - DNA, 25 bp, Homo sapien
ggacagaactcagaggacgctatta

SEQ ID NO: 193245 - DNA, 25 bp, Homo sapien
gtcgaggctgatgtccgctgctccc

SEQ ID NO: 193246 - DNA, 25 bp, Homo sapien
actcagacaaggtgagggcctcacg

SEQ ID NO: 193247 - DNA, 25 bp, Homo sapien
cgagatgggatatcaggtctctcct

SEQ ID NO: 193248 - DNA, 25 bp, Homo sapien
ggcacaaggaggacatttccgtctc

SEQ ID NO: 193249 - DNA, 25 bp, Homo sapien
aggccgcgcagacattaactcattc

SEQ ID NO: 193250 - DNA, 25 bp, Homo sapien
tcgcaggccggatcttatcgctggc

SEQ ID NO: 193251 - DNA, 25 bp, Homo sapien
cccggcgtgagtcagaaatcacctt

SEQ ID NO: 193252 - DNA, 25 bp, Homo sapien
ccgagtgcgataggggacttttgaa

SEQ ID NO: 193253 - DNA, 25 bp, Homo sapien
gactggcttaattccgtcacgcaaa

SEQ ID NO: 193254 - DNA, 25 bp, Homo sapien
gggacttttgaacttgccaattaga

SEQ ID NO: 193255 - DNA, 25 bp, Homo sapien
agctcctgacaaaggcggcttctgc

SEQ ID NO: 193256 - DNA, 25 bp, Homo sapien
ctctgttttttccaagtgccacgtg

SEQ ID NO: 193257 - DNA, 25 bp, Homo sapien
cccgctcgatcctgaagatcgtgtg

SEQ ID NO: 193258 - DNA, 25 bp, Homo sapien
ggaagcgttcttggtgctacacaca

SEQ ID NO: 193259 - DNA, 25 bp, Homo sapien
tggaaaagcagcctgggcttcactg

SEQ ID NO: 193260 - DNA, 25 bp, Homo sapien
tcagtgtccagcacgtcgtggcctc

SEQ ID NO: 193261 - DNA, 25 bp, Homo sapien
accaggccctagtctcggtcaggga

SEQ ID NO: 193262 - DNA, 25 bp, Homo sapien
cgctggtttctctcgacctcgcaga

SEQ ID NO: 193263 - DNA, 25 bp, Homo sapien
tgcccccgcagaagtggcttccgtt

SEQ ID NO: 193264 - DNA, 25 bp, Homo sapien
tcaggacccactgctccgcgatgag

SEQ ID NO: 193265 - DNA, 25 bp, Homo sapien
agtgcgcagccgtcaggacccactg

SEQ ID NO: 193266 - DNA, 25 bp, Homo sapien
gcggactcacttgcggaagcagtgc

SEQ ID NO: 193267 - DNA, 25 bp, Homo sapien
tgtccacggtgctgaaccggtcgcg

SEQ ID NO: 193268 - DNA, 25 bp, Homo sapien
ggccactcgccctcctgcgtgtcct

SEQ ID NO: 193269 - DNA, 25 bp, Homo sapien
atgctgacttgccagggccactcgc

SEQ ID NO: 193270 - DNA, 25 bp, Homo sapien
cttccgttgcgctggatgctgactt

SEQ ID NO: 193271 - DNA, 25 bp, Homo sapien
ccatgaagtggagttttatgctgga

SEQ ID NO: 193272 - DNA, 25 bp, Homo sapien
gcaggctccatgaagtggagtttta

SEQ ID NO: 193273 - DNA, 25 bp, Homo sapien
agcacgagcgaggtgcaggctccat

SEQ ID NO: 193274 - DNA, 25 bp, Homo sapien
ttttatgctggagatgagcacaggc

SEQ ID NO: 193275 - DNA, 25 bp, Homo sapien
gagatgagcacaggcccggctatgc

SEQ ID NO: 193276 - DNA, 25 bp, Homo sapien
gaaggaagcgcccagagccgactcc

SEQ ID NO: 193277 - DNA, 25 bp, Homo sapien
gactcctccgtgacctagccctgaa

SEQ ID NO: 193278 - DNA, 25 bp, Homo sapien
gttggcctcggttcctggaccctga

SEQ ID NO: 193279 - DNA, 25 bp, Homo sapien
ttatttggggcacggcgctgacgtc

SEQ ID NO: 193280 - DNA, 25 bp, Homo sapien
ctcccagcctcatggtccgggctcc

SEQ ID NO: 193281 - DNA, 25 bp, Homo sapien
aggggtgcagaaggggcgctcccag

SEQ ID NO: 193282 - DNA, 25 bp, Homo sapien
ggtgcggccgttcccgcctcagcct

SEQ ID NO: 193283 - DNA, 25 bp, Homo sapien
agaggctcggggaggaagttatttg

SEQ ID NO: 193284 - DNA, 25 bp, Homo sapien
gctgccatcccttggaaggggcggg

SEQ ID NO: 193285 - DNA, 25 bp, Homo sapien
ccggctgccatcccttggaaggggc

SEQ ID NO: 193286 - DNA, 25 bp, Homo sapien
cagccttgtccgcgcgcgtcgtggt

SEQ ID NO: 193287 - DNA, 25 bp, Homo sapien
acgcagttagtcgtgctgacgtgca

SEQ ID NO: 193288 - DNA, 25 bp, Homo sapien
ggtgaaaccttccttgtgcctgaaa

SEQ ID NO: 193289 - DNA, 25 bp, Homo sapien
tggccaacgggacgcttagtctttc

SEQ ID NO: 193290 - DNA, 25 bp, Homo sapien
ctccgttcttcgttgcactggccaa

SEQ ID NO: 193291 - DNA, 25 bp, Homo sapien
aggcctacgaatacgcggtgtctta

SEQ ID NO: 193292 - DNA, 25 bp, Homo sapien
gccgaaattacatccgggctccgcg

SEQ ID NO: 193293 - DNA, 25 bp, Homo sapien
accgcggctgggatatcgtctccca

SEQ ID NO: 193294 - DNA, 25 bp, Homo sapien
ggctcgctcgggaaacccaaagtca

SEQ ID NO: 193295 - DNA, 25 bp, Homo sapien
tgccctggtgaagcggcctaatcct

SEQ ID NO: 193296 - DNA, 25 bp, Homo sapien
gggcagcggcaccaacggctacgtc

SEQ ID NO: 193297 - DNA, 25 bp, Homo sapien
aacggctacgtccagcgcaacctgt

SEQ ID NO: 193298 - DNA, 25 bp, Homo sapien
cacggggccatgtacaacgggatcg

SEQ ID NO: 193299 - DNA, 25 bp, Homo sapien
ggcctaatcctgacatcctggacca

SEQ ID NO: 193300 - DNA, 25 bp, Homo sapien
ggtgaagcggcctaatcctgacatc

SEQ ID NO: 193301 - DNA, 25 bp, Homo sapien
agcggcctaatcctgacatcctgga

SEQ ID NO: 193302 - DNA, 25 bp, Homo sapien
agcggcctgactacaagggagagga

SEQ ID NO: 193303 - DNA, 25 bp, Homo sapien
cccagctagacgcagtggtcgctca

SEQ ID NO: 193304 - DNA, 25 bp, Homo sapien
agaactcccaccaggcgtaggtctc

SEQ ID NO: 193305 - DNA, 25 bp, Homo sapien
gcgtaggtctcggtctagaacacca

SEQ ID NO: 193306 - DNA, 25 bp, Homo sapien
ctaggcgcagatctaggacccgatc

SEQ ID NO: 193307 - DNA, 25 bp, Homo sapien
cgatcaccagtacgacgcaggtctc

SEQ ID NO: 193308 - DNA, 25 bp, Homo sapien
tctcgtagtagatcaccagccagga

SEQ ID NO: 193309 - DNA, 25 bp, Homo sapien
aagtggcaggtcacgctctagaacc

SEQ ID NO: 193310 - DNA, 25 bp, Homo sapien
tgccaggcggagatcacgatccaga

SEQ ID NO: 193311 - DNA, 25 bp, Homo sapien
cgcccggcgagttggcagcctgggc

SEQ ID NO: 193312 - DNA, 25 bp, Homo sapien
gagcctgctagtgcgccacggctcg

SEQ ID NO: 193313 - DNA, 25 bp, Homo sapien
tgcgccacggctcgggtgagtgggg

SEQ ID NO: 193314 - DNA, 25 bp, Homo sapien
cgctcggcctttgtgcgcgcacgtg

SEQ ID NO: 193315 - DNA, 25 bp, Homo sapien
ctcggcctttgtgcgcgcacgtgcg

SEQ ID NO: 193316 - DNA, 25 bp, Homo sapien
ctttgtgcgcgcacgtgcgggctgg

SEQ ID NO: 193317 - DNA, 25 bp, Homo sapien
aaggcgccggctcgcacccgcacgc

SEQ ID NO: 193318 - DNA, 25 bp, Homo sapien
tccgagttggggaaggcgccggctc

SEQ ID NO: 193319 - DNA, 25 bp, Homo sapien
cagctgactggcgttcaccgcagtg

SEQ ID NO: 193320 - DNA, 25 bp, Homo sapien
gaccttatttcacgccagctgactg

SEQ ID NO: 193321 - DNA, 25 bp, Homo sapien
ttcaccgcagtgtgagtgtcggccg

SEQ ID NO: 193322 - DNA, 25 bp, Homo sapien
gcgttccatcgcgtgctacctacgg

SEQ ID NO: 193323 - DNA, 25 bp, Homo sapien
atcgcgtgctacctacggcgtctgc

SEQ ID NO: 193324 - DNA, 25 bp, Homo sapien
ggctccgcgaactcttcgggcgctt

SEQ ID NO: 193325 - DNA, 25 bp, Homo sapien
tgcgctcggctcttttcgtgtccgg

SEQ ID NO: 193326 - DNA, 25 bp, Homo sapien
tccacgcgaaagagcccgcgagagt

SEQ ID NO: 193327 - DNA, 25 bp, Homo sapien
tcccgttcccgctcaaggagagaga

SEQ ID NO: 193328 - DNA, 25 bp, Homo sapien
gctctagatctcgaacgccactgtt

SEQ ID NO: 193329 - DNA, 25 bp, Homo sapien
cggtcacccgaaggagatctcgatc

SEQ ID NO: 193330 - DNA, 25 bp, Homo sapien
ccaccagtaaccaggaggcgatctc

SEQ ID NO: 193331 - DNA, 25 bp, Homo sapien
acgtaggtccagatctcgaacttca

SEQ ID NO: 193332 - DNA, 25 bp, Homo sapien
cccgtggaaacgctctagatctcga

SEQ ID NO: 193333 - DNA, 25 bp, Homo sapien
aggctctggttatcactcaaggtca

SEQ ID NO: 193334 - DNA, 25 bp, Homo sapien
cccgacgtcgagataggtctggatc

SEQ ID NO: 193335 - DNA, 25 bp, Homo sapien
ggcccggcacgaggtctaaacatcg

SEQ ID NO: 193336 - DNA, 25 bp, Homo sapien
caggctccgcatttggggtcttctg

SEQ ID NO: 193337 - DNA, 25 bp, Homo sapien
ccgccattttaagtgatctggaagc

SEQ ID NO: 193338 - DNA, 25 bp, Homo sapien
tcgacgatgcgcttcagttcgaaca

SEQ ID NO: 193339 - DNA, 25 bp, Homo sapien
ccgcttgaggatgccctcgacgatg

SEQ ID NO: 193340 - DNA, 25 bp, Homo sapien
ttacatcgcggacagcgtaggcgtc

SEQ ID NO: 193341 - DNA, 25 bp, Homo sapien
cttatgacctgtgaagagccctggg

SEQ ID NO: 193342 - DNA, 25 bp, Homo sapien
tcgccggccgctactgtttacatcg

SEQ ID NO: 193343 - DNA, 25 bp, Homo sapien
cccaacgatccgactggacatgcgg

SEQ ID NO: 193344 - DNA, 25 bp, Homo sapien
ctgggatttccagtcagatggagga

SEQ ID NO: 193345 - DNA, 25 bp, Homo sapien
ttttgttccctagaagccgcgctgg

SEQ ID NO: 193346 - DNA, 25 bp, Homo sapien
ctctgagtgagaggaggttttgttc

SEQ ID NO: 193347 - DNA, 25 bp, Homo sapien
ccttgtagcggtcgccactctggga

SEQ ID NO: 193348 - DNA, 25 bp, Homo sapien
agcggcacccttactccttgtagcg

SEQ ID NO: 193349 - DNA, 25 bp, Homo sapien
cacgtccgcgcccacgtggtagagg

SEQ ID NO: 193350 - DNA, 25 bp, Homo sapien
cacgcggtactcagctggcagtgcc

SEQ ID NO: 193351 - DNA, 25 bp, Homo sapien
tctcaagtaactaatgggtcctagg

SEQ ID NO: 193352 - DNA, 25 bp, Homo sapien
accgggaaattcacgcgctggtggc

SEQ ID NO: 193353 - DNA, 25 bp, Homo sapien
gggtcacttcttgtgtcctgcagag

SEQ ID NO: 193354 - DNA, 25 bp, Homo sapien
cgcctgaggagacgccaccgatgtg

SEQ ID NO: 193355 - DNA, 25 bp, Homo sapien
ggggcccatctactgctctctgttc

SEQ ID NO: 193356 - DNA, 25 bp, Homo sapien
gggtccctagcgtcaccttcttggc

SEQ ID NO: 193357 - DNA, 25 bp, Homo sapien
ctctctgttccaggtcccgagaacg

SEQ ID NO: 193358 - DNA, 25 bp, Homo sapien
cccgagaacgtgatgctctcaagta

SEQ ID NO: 193359 - DNA, 25 bp, Homo sapien
gaccatccgaggaccatgcggccga

SEQ ID NO: 193360 - DNA, 25 bp, Homo sapien
ggcggcgcactgctttgaaacgtga

SEQ ID NO: 193361 - DNA, 25 bp, Homo sapien
acgggtcatcacgtcgcgcatcgtg

SEQ ID NO: 193362 - DNA, 25 bp, Homo sapien
ttcctgctgcacacacgcgagggga

SEQ ID NO: 193363 - DNA, 25 bp, Homo sapien
gggaggatctccagtgtcacctact

SEQ ID NO: 193364 - DNA, 25 bp, Homo sapien
tctgttggcgtggaaagtaactaac

SEQ ID NO: 193365 - DNA, 25 bp, Homo sapien
cccgggatcgagaactctgttggcg

SEQ ID NO: 193366 - DNA, 25 bp, Homo sapien
gattcccacgtatgcggagtgagcc

SEQ ID NO: 193367 - DNA, 25 bp, Homo sapien
gactcctttctgtccgtttccgaca

SEQ ID NO: 193368 - DNA, 25 bp, Homo sapien
tttccggcggacttcctgtgcgatc

SEQ ID NO: 193369 - DNA, 25 bp, Homo sapien
ttcgctaaacttccggtgggctcca

SEQ ID NO: 193370 - DNA, 25 bp, Homo sapien
ttcccgcgctcttccggaggttgag

SEQ ID NO: 193371 - DNA, 25 bp, Homo sapien
ggtcgcagggactcctttctgtccg

SEQ ID NO: 193372 - DNA, 25 bp, Homo sapien
tcgctacgactctgccaacaggggg

SEQ ID NO: 193373 - DNA, 25 bp, Homo sapien
ggatgctcacgcagccacgtcacgg

SEQ ID NO: 193374 - DNA, 25 bp, Homo sapien
ggctccaagagagtttccggcggac

SEQ ID NO: 193375 - DNA, 25 bp, Homo sapien
cgccgcagatccagatccagatgtg

SEQ ID NO: 193376 - DNA, 25 bp, Homo sapien
aggtagatgagcctatttacggcgg

SEQ ID NO: 193377 - DNA, 25 bp, Homo sapien
atctggccgcctttcagatccgagc

SEQ ID NO: 193378 - DNA, 25 bp, Homo sapien
gcctgttgcgctcggcacagccctc

SEQ ID NO: 193379 - DNA, 25 bp, Homo sapien
tctccacccaggagcggtgcgcaga

SEQ ID NO: 193380 - DNA, 25 bp, Homo sapien
aggccgccgcagatccagatccaga

SEQ ID NO: 193381 - DNA, 25 bp, Homo sapien
ccagaggtagaggtagatgagccta

SEQ ID NO: 193382 - DNA, 25 bp, Homo sapien
cagatccagatgtggatctggccgc

SEQ ID NO: 193383 - DNA, 25 bp, Homo sapien
gcgacgccgacggtaactggagacc

SEQ ID NO: 193384 - DNA, 25 bp, Homo sapien
cccagaggcaagcagcggaggacga

SEQ ID NO: 193385 - DNA, 25 bp, Homo sapien
gaccgaggcgcgctgcgtacttgct

SEQ ID NO: 193386 - DNA, 25 bp, Homo sapien
ctcctcgagggaggcacagacctga

SEQ ID NO: 193387 - DNA, 25 bp, Homo sapien
cacaaaacggtgcttccccagaggc

SEQ ID NO: 193388 - DNA, 25 bp, Homo sapien
acgccgacggtaactggagaccgag

SEQ ID NO: 193389 - DNA, 25 bp, Homo sapien
cctcctgcggcaggaacaacacaaa

SEQ ID NO: 193390 - DNA, 25 bp, Homo sapien
accggctcctcgagggaggcacaga

SEQ ID NO: 193391 - DNA, 25 bp, Homo sapien
ggcctcgtttctcttcctggctttg

SEQ ID NO: 193392 - DNA, 25 bp, Homo sapien
ccagctgctcattggcctgtgtctg

SEQ ID NO: 193393 - DNA, 25 bp, Homo sapien
atcaggaaaagcgtctcagtcctcc

SEQ ID NO: 193394 - DNA, 25 bp, Homo sapien
atggacagcgctggttttcaatacc

SEQ ID NO: 193395 - DNA, 25 bp, Homo sapien
ggctttgcgtgtcccgaccactaaa

SEQ ID NO: 193396 - DNA, 25 bp, Homo sapien
agccagcttggtgtccggggacact

SEQ ID NO: 193397 - DNA, 25 bp, Homo sapien
cgggccacgcccaaaatatcaggaa

SEQ ID NO: 193398 - DNA, 25 bp, Homo sapien
ccagccagcggaagtgcggttaact

SEQ ID NO: 193399 - DNA, 25 bp, Homo sapien
acccactggtgctgggataacctcg

SEQ ID NO: 193400 - DNA, 25 bp, Homo sapien
agtgtcccaggaaagcagcgcccag

SEQ ID NO: 193401 - DNA, 25 bp, Homo sapien
gcagtggcttccatgagcctaaaca

SEQ ID NO: 193402 - DNA, 25 bp, Homo sapien
tgcgtcgtcaaggatgcagagctta

SEQ ID NO: 193403 - DNA, 25 bp, Homo sapien
taaactaatagacgagggctggacc

SEQ ID NO: 193404 - DNA, 25 bp, Homo sapien
ggccagggctggaccaataacgaga

SEQ ID NO: 193405 - DNA, 25 bp, Homo sapien
tgacggcgacactcaatcccgggtg

SEQ ID NO: 193406 - DNA, 25 bp, Homo sapien
tggaccaatgggcaggggctaaact

SEQ ID NO: 193407 - DNA, 25 bp, Homo sapien
cggcacctgctcaacggccatgatg

SEQ ID NO: 193408 - DNA, 25 bp, Homo sapien
tcctgtcccggtagaggcccaggct

SEQ ID NO: 193409 - DNA, 25 bp, Homo sapien
gccatctggatcctgtcccggtaga

SEQ ID NO: 193410 - DNA, 25 bp, Homo sapien
tatagcgtggtgcacagacgcagcc

SEQ ID NO: 193411 - DNA, 25 bp, Homo sapien
gcctggtatagcgtggtgcacagac

SEQ ID NO: 193412 - DNA, 25 bp, Homo sapien
atggccttgtcctctgcgcgctcag

SEQ ID NO: 193413 - DNA, 25 bp, Homo sapien
ggccatgatggccttgtcctctgcg

SEQ ID NO: 193414 - DNA, 25 bp, Homo sapien
gtgcacttgacagcggagaagcgtc

SEQ ID NO: 193415 - DNA, 25 bp, Homo sapien
gctccaccttgctaatctgatcgaa

SEQ ID NO: 193416 - DNA, 25 bp, Homo sapien
agcttctggcaattgcagtccttca

SEQ ID NO: 193417 - DNA, 25 bp, Homo sapien
ccgcccgacattcttgacgtcgttg

SEQ ID NO: 193418 - DNA, 25 bp, Homo sapien
ccacgcggatctgctcgtagctcag

SEQ ID NO: 193419 - DNA, 25 bp, Homo sapien
cccggatgacgtccaggtctaaata

SEQ ID NO: 193420 - DNA, 25 bp, Homo sapien
ccttcacgtacttgatgaggtcggc

SEQ ID NO: 193421 - DNA, 25 bp, Homo sapien
gtccgattcggagtacagttccttg

SEQ ID NO: 193422 - DNA, 25 bp, Homo sapien
gagacttctccatcaggatcacgcg

SEQ ID NO: 193423 - DNA, 25 bp, Homo sapien
tggcggctctgtcacgcccctgaag

SEQ ID NO: 193424 - DNA, 25 bp, Homo sapien
gcctggcagccattactgtagcgct

SEQ ID NO: 193425 - DNA, 25 bp, Homo sapien
aaagggcctggcagccattactgta

SEQ ID NO: 193426 - DNA, 25 bp, Homo sapien
ggccaaccagcgcagaaagggcctg

SEQ ID NO: 193427 - DNA, 25 bp, Homo sapien
cgggctgaggccaaccagcgcagaa

SEQ ID NO: 193428 - DNA, 25 bp, Homo sapien
tcccgccaaaggagaagctgccttc

SEQ ID NO: 193429 - DNA, 25 bp, Homo sapien
ctgtgatcccgccaaaggagaagct

SEQ ID NO: 193430 - DNA, 25 bp, Homo sapien
gccattactgtagcgctggcggctc

SEQ ID NO: 193431 - DNA, 25 bp, Homo sapien
gggacgtgcgccgtagccaatcagc

SEQ ID NO: 193432 - DNA, 25 bp, Homo sapien
ccaatcagcgtgtgaagcagggcgc

SEQ ID NO: 193433 - DNA, 25 bp, Homo sapien
cagggaacctggcatttattcctgc

SEQ ID NO: 193434 - DNA, 25 bp, Homo sapien
catcgccctgtgaggcagatgagca

SEQ ID NO: 193435 - DNA, 25 bp, Homo sapien
atccctgcggtactctgcagtcatg

SEQ ID NO: 193436 - DNA, 25 bp, Homo sapien
tgcagtcatgtgactcgccgcctgg

SEQ ID NO: 193437 - DNA, 25 bp, Homo sapien
tggcatttattcctgcccggactgc

SEQ ID NO: 193438 - DNA, 25 bp, Homo sapien
cggactgcccactcatgctgcggag

SEQ ID NO: 193439 - DNA, 25 bp, Homo sapien
tacagaacgcggaggacatctaggg

SEQ ID NO: 193440 - DNA, 25 bp, Homo sapien
acatggacccgccagacctgtggct

SEQ ID NO: 193441 - DNA, 25 bp, Homo sapien
tggacgattttggtccctgagggtc

SEQ ID NO: 193442 - DNA, 25 bp, Homo sapien
taaactcgacaccagggaaggcatc

SEQ ID NO: 193443 - DNA, 25 bp, Homo sapien
tggttaccacatccactgctttttg

SEQ ID NO: 193444 - DNA, 25 bp, Homo sapien
gcgtcacaggaaaacagcaaccagg

SEQ ID NO: 193445 - DNA, 25 bp, Homo sapien
ggaaattgcaatggcgtccacactg

SEQ ID NO: 193446 - DNA, 25 bp, Homo sapien
atttcagaggaaccgccggggatgt

SEQ ID NO: 193447 - DNA, 25 bp, Homo sapien
ttgctgcgcatgctctgaagtagcg

SEQ ID NO: 193448 - DNA, 25 bp, Homo sapien
ttcctgcgggcagcctcagatactg

SEQ ID NO: 193449 - DNA, 25 bp, Homo sapien
gcctcagatactggggaccgtcctg

SEQ ID NO: 193450 - DNA, 25 bp, Homo sapien
cgtcctggggtctcaattaagcgcc

SEQ ID NO: 193451 - DNA, 25 bp, Homo sapien
ctttacgccaagagcgtcctgttca

SEQ ID NO: 193452 - DNA, 25 bp, Homo sapien
ggacgccgccgtccaatctcgggat

SEQ ID NO: 193453 - DNA, 25 bp, Homo sapien
cggtcccagtgaccttgcacttttg

SEQ ID NO: 193454 - DNA, 25 bp, Homo sapien
agtagcgcgcctgagcgttccgcaa

SEQ ID NO: 193455 - DNA, 25 bp, Homo sapien
atctttcttctccatcgacaccggg

SEQ ID NO: 193456 - DNA, 25 bp, Homo sapien
tcttctccatcgacaccggggcaga

SEQ ID NO: 193457 - DNA, 25 bp, Homo sapien
ggtgcctgggcctgacagaacctcc

SEQ ID NO: 193458 - DNA, 25 bp, Homo sapien
ggaagatcctcgcgggtcccagcac

SEQ ID NO: 193459 - DNA, 25 bp, Homo sapien
gaggcgccagctggaagatcctcgc

SEQ ID NO: 193460 - DNA, 25 bp, Homo sapien
agcacactcgcgtgaggcgccagct

SEQ ID NO: 193461 - DNA, 25 bp, Homo sapien
tcctccagagcacactcgcgtgagg

SEQ ID NO: 193462 - DNA, 25 bp, Homo sapien
tctccatcgacaccggggcagagac

SEQ ID NO: 193463 - DNA, 25 bp, Homo sapien
acttgaaccggcaccgacctgaggg

SEQ ID NO: 193464 - DNA, 25 bp, Homo sapien
ctgtccgaatgcttccaggtgaatg

SEQ ID NO: 193465 - DNA, 25 bp, Homo sapien
ctttgccgtgcaggcctgtccgaat

SEQ ID NO: 193466 - DNA, 25 bp, Homo sapien
ctgggagcctgcacagtccaggtaa

SEQ ID NO: 193467 - DNA, 25 bp, Homo sapien
gcgagggtgacctatccttggttga

SEQ ID NO: 193468 - DNA, 25 bp, Homo sapien
accgcccagagctcgctgagacaga

SEQ ID NO: 193469 - DNA, 25 bp, Homo sapien
ttctgtatctcccattttaagggcc

SEQ ID NO: 193470 - DNA, 25 bp, Homo sapien
acagagagacgcctctaggggcaga

SEQ ID NO: 193471 - DNA, 25 bp, Homo sapien
aggtcacaggtcagcaaaaacagtc

SEQ ID NO: 193472 - DNA, 25 bp, Homo sapien
ctattatctgggacttggcctgacc

SEQ ID NO: 193473 - DNA, 25 bp, Homo sapien
ggatctactttggtacgggcctcga

SEQ ID NO: 193474 - DNA, 25 bp, Homo sapien
tgaccatacaaacgccgagggttgc

SEQ ID NO: 193475 - DNA, 25 bp, Homo sapien
atctgtttcctgtctatcctcggta

SEQ ID NO: 193476 - DNA, 25 bp, Homo sapien
tccgagaagcctagcgcgaaggata

SEQ ID NO: 193477 - DNA, 25 bp, Homo sapien
gtccagcctgcggaaagatcacttt

SEQ ID NO: 193478 - DNA, 25 bp, Homo sapien
acacctgagatgctgtgctgcgccc

SEQ ID NO: 193479 - DNA, 25 bp, Homo sapien
agtctgccgtcgactgttccggacg

SEQ ID NO: 193480 - DNA, 25 bp, Homo sapien
caggaagtccctacggcctcctggg

SEQ ID NO: 193481 - DNA, 25 bp, Homo sapien
gctggcgtagtgtttgggtccataa

SEQ ID NO: 193482 - DNA, 25 bp, Homo sapien
agctgctcgcgccaaaaattccaaa

SEQ ID NO: 193483 - DNA, 25 bp, Homo sapien
ctcgaggcaagggaaccaggaattg

SEQ ID NO: 193484 - DNA, 25 bp, Homo sapien
aagccctggcgaacagagcagtgga

SEQ ID NO: 193485 - DNA, 25 bp, Homo sapien
aaagggaccgccatcccggtgctcg

SEQ ID NO: 193486 - DNA, 25 bp, Homo sapien
aggcgcacaggattctccgcgctgg

SEQ ID NO: 193487 - DNA, 25 bp, Homo sapien
ctcccgaggtaccaggtcacggctg

SEQ ID NO: 193488 - DNA, 25 bp, Homo sapien
gggacccgtagaccgcgagcgcact

SEQ ID NO: 193489 - DNA, 25 bp, Homo sapien
cccttgacagctgccgggtgggacc

SEQ ID NO: 193490 - DNA, 25 bp, Homo sapien
tgattggctgccaagggtagccctt

SEQ ID NO: 193491 - DNA, 25 bp, Homo sapien
cggagcgcgctcatatctctgattg

SEQ ID NO: 193492 - DNA, 25 bp, Homo sapien
tgtgcagcgcctgatagccaggcta

SEQ ID NO: 193493 - DNA, 25 bp, Homo sapien
atccgcagatcctcaagccaggtgg

SEQ ID NO: 193494 - DNA, 25 bp, Homo sapien
cggtgtcgcagcgaatccgcagatc

SEQ ID NO: 193495 - DNA, 25 bp, Homo sapien
ggacgaaggtgccaaggcccgtatc

SEQ ID NO: 193496 - DNA, 25 bp, Homo sapien
gcggacctcggctgggctactccat

SEQ ID NO: 193497 - DNA, 25 bp, Homo sapien
cgccatcatccaggacttctacaac

SEQ ID NO: 193498 - DNA, 25 bp, Homo sapien
ctgtgtgctggacggcgcacgccat

SEQ ID NO: 193499 - DNA, 25 bp, Homo sapien
tgctcatccctgtgtgctggacggc

SEQ ID NO: 193500 - DNA, 25 bp, Homo sapien
ggcatcctggtgctcatccctgtgt

SEQ ID NO: 193501 - DNA, 25 bp, Homo sapien
aggcccgtatcgtgctcaccgcggg

SEQ ID NO: 193502 - DNA, 25 bp, Homo sapien
gtgccaaggcccgtatcgtgctcac

SEQ ID NO: 193503 - DNA, 25 bp, Homo sapien
aggctcggtcctccactgagacgca

SEQ ID NO: 193504 - DNA, 25 bp, Homo sapien
ccttaaaaaccggagctggcgcttg

SEQ ID NO: 193505 - DNA, 25 bp, Homo sapien
gcatcgccactctgggcaggatcca

SEQ ID NO: 193506 - DNA, 25 bp, Homo sapien
gcaggatccaacgtcgctccagctg

SEQ ID NO: 193507 - DNA, 25 bp, Homo sapien
gctgctcttgacgactccacagata

SEQ ID NO: 193508 - DNA, 25 bp, Homo sapien
tccgcaagttcctggaccggcagct

SEQ ID NO: 193509 - DNA, 25 bp, Homo sapien
cgtcttaggccaggatgtgctccct

SEQ ID NO: 193510 - DNA, 25 bp, Homo sapien
accgcccaggaagccggtgaggata

SEQ ID NO: 193511 - DNA, 25 bp, Homo sapien
tgcactgcatgaaaaagactctgtc

SEQ ID NO: 193512 - DNA, 25 bp, Homo sapien
gcagagaccctgtccctgacggcag

SEQ ID NO: 193513 - DNA, 25 bp, Homo sapien
ggcccttaggcctctggccgagtta

SEQ ID NO: 193514 - DNA, 25 bp, Homo sapien
ggttctatagctgcagtggccgcaa

SEQ ID NO: 193515 - DNA, 25 bp, Homo sapien
cccggactcacctgcgaaggagata

SEQ ID NO: 193516 - DNA, 25 bp, Homo sapien
aggaccctatcacctcggaggcttg

SEQ ID NO: 193517 - DNA, 25 bp, Homo sapien
agggaaattcctaggccgagtgtcg

SEQ ID NO: 193518 - DNA, 25 bp, Homo sapien
gcgtgcgaatcccaggcttgtcaga

SEQ ID NO: 193519 - DNA, 25 bp, Homo sapien
ggcgctgacgccgaatacctgtgaa

SEQ ID NO: 193520 - DNA, 25 bp, Homo sapien
cgccgaatacctgtgaaaaagactc

SEQ ID NO: 193521 - DNA, 25 bp, Homo sapien
atacctgtgaaaaagactcggggag

SEQ ID NO: 193522 - DNA, 25 bp, Homo sapien
cgctgacgccgaatacctgtgaaaa

SEQ ID NO: 193523 - DNA, 25 bp, Homo sapien
ggcctccgggaagcaatcagggcag

SEQ ID NO: 193524 - DNA, 25 bp, Homo sapien
gctcccggttccaggcgagttcgca

SEQ ID NO: 193525 - DNA, 25 bp, Homo sapien
tccaggcgagttcgcagctgcgcgc

SEQ ID NO: 193526 - DNA, 25 bp, Homo sapien
cctgggaagcgagcgcagccttggt

SEQ ID NO: 193527 - DNA, 25 bp, Homo sapien
caggtggccttcaaacagctcgctc

SEQ ID NO: 193528 - DNA, 25 bp, Homo sapien
gactcacgttattcgagccggccga

SEQ ID NO: 193529 - DNA, 25 bp, Homo sapien
cggtgacttcagtgcccagctatgc

SEQ ID NO: 193530 - DNA, 25 bp, Homo sapien
tgtgccctctataccatgtggggtg

SEQ ID NO: 193531 - DNA, 25 bp, Homo sapien
gcctggtccgtacagggtctaacta

SEQ ID NO: 193532 - DNA, 25 bp, Homo sapien
tgtttagtctaggaaggggcacgcc

SEQ ID NO: 193533 - DNA, 25 bp, Homo sapien
gcttcattcacaatccgggcctcag

SEQ ID NO: 193534 - DNA, 25 bp, Homo sapien
cccgcgccaggactttgttgaatga

SEQ ID NO: 193535 - DNA, 25 bp, Homo sapien
ccttctggggtttgtagttcacgca

SEQ ID NO: 193536 - DNA, 25 bp, Homo sapien
gctgctgcaggatcattgggttttg

SEQ ID NO: 193537 - DNA, 25 bp, Homo sapien
gttcgggacggtacgcaccagccac

SEQ ID NO: 193538 - DNA, 25 bp, Homo sapien
aggaaccgctctaggcacgtaaggc

SEQ ID NO: 193539 - DNA, 25 bp, Homo sapien
acgtaaggcctcgtgaggttgcgtc

SEQ ID NO: 193540 - DNA, 25 bp, Homo sapien
acttgtagttctggagatggagcga

SEQ ID NO: 193541 - DNA, 25 bp, Homo sapien
ttcatcctgcagaccagtcctgagc

SEQ ID NO: 193542 - DNA, 25 bp, Homo sapien
ttgtagttcacgcatggctgggacg

SEQ ID NO: 193543 - DNA, 25 bp, Homo sapien
accttctggcggatggcgcgcagca

SEQ ID NO: 193544 - DNA, 25 bp, Homo sapien
cggaggcgctcagctccttctggcg

SEQ ID NO: 193545 - DNA, 25 bp, Homo sapien
agctgctgcccgatcaccacctgca

SEQ ID NO: 193546 - DNA, 25 bp, Homo sapien
accacctgcatgtcgtcctgcggga

SEQ ID NO: 193547 - DNA, 25 bp, Homo sapien
tctcgctccagcgagacgcggttga

SEQ ID NO: 193548 - DNA, 25 bp, Homo sapien
cgtgagcgccaccttctggcggatg

SEQ ID NO: 193549 - DNA, 25 bp, Homo sapien
gcagaagacgcgtttgagggcgcta

SEQ ID NO: 193550 - DNA, 25 bp, Homo sapien
ctccttctggcgctgtgagcgcagc

SEQ ID NO: 193551 - DNA, 25 bp, Homo sapien
tctgactgcaacgaggcagccgaca

SEQ ID NO: 193552 - DNA, 25 bp, Homo sapien
ttccagctgtggacggtcccgcaga

SEQ ID NO: 193553 - DNA, 25 bp, Homo sapien
gtcagcgggacgcacgcaacgccga

SEQ ID NO: 193554 - DNA, 25 bp, Homo sapien
aggctgttcccgttcctggatcgct

SEQ ID NO: 193555 - DNA, 25 bp, Homo sapien
gtgcacctccctcagcggatatata

SEQ ID NO: 193556 - DNA, 25 bp, Homo sapien
cggatatatacagtttcctcgccta

SEQ ID NO: 193557 - DNA, 25 bp, Homo sapien
tcctcgcctatagagcagggccgca

SEQ ID NO: 193558 - DNA, 25 bp, Homo sapien
ggctgtgggccagttctgactgcaa

SEQ ID NO: 193559 - DNA, 25 bp, Homo sapien
cgcagctcttcatttcgctccagaa

SEQ ID NO: 193560 - DNA, 25 bp, Homo sapien
caaggctaggtcctcgggctcctca

SEQ ID NO: 193561 - DNA, 25 bp, Homo sapien
gctccaagtgctgggcgctcagcgt

SEQ ID NO: 193562 - DNA, 25 bp, Homo sapien
acagcaggtctttctccttctgctg

SEQ ID NO: 193563 - DNA, 25 bp, Homo sapien
gcacaaaggggaagaagccctcgtc

SEQ ID NO: 193564 - DNA, 25 bp, Homo sapien
cgccgctccagcacaaaggggaaga

SEQ ID NO: 193565 - DNA, 25 bp, Homo sapien
tccagaagcatcttgccgagctccg

SEQ ID NO: 193566 - DNA, 25 bp, Homo sapien
gagctccgcggccaacagcaggtct

SEQ ID NO: 193567 - DNA, 25 bp, Homo sapien
tgagtgtcacggtggtcccagccca

SEQ ID NO: 193568 - DNA, 25 bp, Homo sapien
cctgctcgcaggacgtgagtgtcac

SEQ ID NO: 193569 - DNA, 25 bp, Homo sapien
gggctcaccacccactaggcacaca

SEQ ID NO: 193570 - DNA, 25 bp, Homo sapien
gggcccgacacaacagctttaccag

SEQ ID NO: 193571 - DNA, 25 bp, Homo sapien
tccgcacctagctgcccaggtgttg

SEQ ID NO: 193572 - DNA, 25 bp, Homo sapien
gtcagagggcccgacacaacagctt

SEQ ID NO: 193573 - DNA, 25 bp, Homo sapien
cgcggctcggagtttctgtttactt

SEQ ID NO: 193574 - DNA, 25 bp, Homo sapien
cctccacgcgagagacagggacctg

SEQ ID NO: 193575 - DNA, 25 bp, Homo sapien
cttaccgcatatcggggtgcgcccg

SEQ ID NO: 193576 - DNA, 25 bp, Homo sapien
gcgcagtggctgcagcatttaaatg

SEQ ID NO: 193577 - DNA, 25 bp, Homo sapien
tctcaaccatcctgggattcccggg

SEQ ID NO: 193578 - DNA, 25 bp, Homo sapien
cgaagattgggccatttcccttgcc

SEQ ID NO: 193579 - DNA, 25 bp, Homo sapien
ttgtcgctggacgtccgaagattgg

SEQ ID NO: 193580 - DNA, 25 bp, Homo sapien
ttcgagaaagcagaagcgagccctg

SEQ ID NO: 193581 - DNA, 25 bp, Homo sapien
gctgcaaccgcgcacagctggagct

SEQ ID NO: 193582 - DNA, 25 bp, Homo sapien
ctcccggcatctagaggggcccaaa

SEQ ID NO: 193583 - DNA, 25 bp, Homo sapien
tccaggtgacacctacttcttcaag

SEQ ID NO: 193584 - DNA, 25 bp, Homo sapien
gggagccatccagaccgaacagcgc

SEQ ID NO: 193585 - DNA, 25 bp, Homo sapien
ccgtgtccgaaacctgcgattgtca

SEQ ID NO: 193586 - DNA, 25 bp, Homo sapien
ggaccgggactcaagctctgctcct

SEQ ID NO: 193587 - DNA, 25 bp, Homo sapien
acgatgtcaccgtcagcaacgcagg

SEQ ID NO: 193588 - DNA, 25 bp, Homo sapien
acgccgtgttctcgtggccacagaa

SEQ ID NO: 193589 - DNA, 25 bp, Homo sapien
cccagttctgggtgttccaggaccg

SEQ ID NO: 193590 - DNA, 25 bp, Homo sapien
attgtcagtgcgagctcaaccaggc

SEQ ID NO: 193591 - DNA, 25 bp, Homo sapien
ggaatgttttccatcccgccacgcg

SEQ ID NO: 193592 - DNA, 25 bp, Homo sapien
tccaacggtctcaggaatgttttcc

SEQ ID NO: 193593 - DNA, 25 bp, Homo sapien
tggactcggtcctcagatcctcgga

SEQ ID NO: 193594 - DNA, 25 bp, Homo sapien
ttccggatggactggtgttcccagc

SEQ ID NO: 193595 - DNA, 25 bp, Homo sapien
tgccttgccagtaggtgactcaacg

SEQ ID NO: 193596 - DNA, 25 bp, Homo sapien
ggtgcttcccagttctgaggcgatt

SEQ ID NO: 193597 - DNA, 25 bp, Homo sapien
agtggcctctgcgtttctgttgaaa

SEQ ID NO: 193598 - DNA, 25 bp, Homo sapien
ttctgttgaaaggtaccgactacgc

SEQ ID NO: 193599 - DNA, 25 bp, Homo sapien
ggcgcttcggccttactctcaggag

SEQ ID NO: 193600 - DNA, 25 bp, Homo sapien
cactctgcgcacaggaaggcgggtt

SEQ ID NO: 193601 - DNA, 25 bp, Homo sapien
aggtgcttgctcaggtgcgagctct

SEQ ID NO: 193602 - DNA, 25 bp, Homo sapien
cgaccgcacgtctgacagctgtagg

SEQ ID NO: 193603 - DNA, 25 bp, Homo sapien
cagtgggagcacaggacatcggtca

SEQ ID NO: 193604 - DNA, 25 bp, Homo sapien
gccaggttggagctattgcggaaac

SEQ ID NO: 193605 - DNA, 25 bp, Homo sapien
cagatcctgggtctggccgaaactc

SEQ ID NO: 193606 - DNA, 25 bp, Homo sapien
tgcacccgttggtggctgaccagct

SEQ ID NO: 193607 - DNA, 25 bp, Homo sapien
gtccgccaagctagggtgagctgcc

SEQ ID NO: 193608 - DNA, 25 bp, Homo sapien
tggcgcctcatggatcgggatcctc

SEQ ID NO: 193609 - DNA, 25 bp, Homo sapien
ggtggactctcccttcattaagacc

SEQ ID NO: 193610 - DNA, 25 bp, Homo sapien
cccggcaagccggaagttgcaatgg

SEQ ID NO: 193611 - DNA, 25 bp, Homo sapien
ggctccagcgtctgcgttctgtgaa

SEQ ID NO: 193612 - DNA, 25 bp, Homo sapien
gttctgtgaacctagccgctgggct

SEQ ID NO: 193613 - DNA, 25 bp, Homo sapien
cctccggattctcacgcgctggtgt

SEQ ID NO: 193614 - DNA, 25 bp, Homo sapien
aggccttcgaccaggcagcctcagt

SEQ ID NO: 193615 - DNA, 25 bp, Homo sapien
ccacggaggggtgatcgtgaacatc

SEQ ID NO: 193616 - DNA, 25 bp, Homo sapien
gccttcaagaccgtgatggacatcg

SEQ ID NO: 193617 - DNA, 25 bp, Homo sapien
ggacatcgataccagcggcaccttc

SEQ ID NO: 193618 - DNA, 25 bp, Homo sapien
ccttcaatgtgtctcgtgtgctcta

SEQ ID NO: 193619 - DNA, 25 bp, Homo sapien
tcttccgggtgggtgtactcccagc

SEQ ID NO: 193620 - DNA, 25 bp, Homo sapien
gtgaacatcactgccaccctgggga

SEQ ID NO: 193621 - DNA, 25 bp, Homo sapien
ttgtgcgctctgtgagaagttcttc

SEQ ID NO: 193622 - DNA, 25 bp, Homo sapien
gccttgtccttcaacgccttcaaga

SEQ ID NO: 193623 - DNA, 25 bp, Homo sapien
taccactgcctcgactgcggcaaga

SEQ ID NO: 193624 - DNA, 25 bp, Homo sapien
tacgcctgcccgttgtgcggcaaga

SEQ ID NO: 193625 - DNA, 25 bp, Homo sapien
aagtgcttcagccagcgttccaacc

SEQ ID NO: 193626 - DNA, 25 bp, Homo sapien
acactggggtcaagccctatccgtg

SEQ ID NO: 193627 - DNA, 25 bp, Homo sapien
tcggacttggtcacccaccagggca

SEQ ID NO: 193628 - DNA, 25 bp, Homo sapien
tgccggaagagcttcagccaccact

SEQ ID NO: 193629 - DNA, 25 bp, Homo sapien
cctacgcctgcactgactgcgggaa

SEQ ID NO: 193630 - DNA, 25 bp, Homo sapien
caagggcttcagctggcactcgcac

SEQ ID NO: 193631 - DNA, 25 bp, Homo sapien
gcccagaggactccctgtcaatttg

SEQ ID NO: 193632 - DNA, 25 bp, Homo sapien
caatcacggctgaagtttgtgcccg

SEQ ID NO: 193633 - DNA, 25 bp, Homo sapien
tccaggatcctgtctttgaagcatt

SEQ ID NO: 193634 - DNA, 25 bp, Homo sapien
tggaccttcgctacagacctcagtc

SEQ ID NO: 193635 - DNA, 25 bp, Homo sapien
agccactgacttcctgggtctatca

SEQ ID NO: 193636 - DNA, 25 bp, Homo sapien
tatcaccgagatgccgagcctcctg

SEQ ID NO: 193637 - DNA, 25 bp, Homo sapien
tcctagagagcatacggcgcagggc

SEQ ID NO: 193638 - DNA, 25 bp, Homo sapien
cgtcgccggcatgactgaatccagg

SEQ ID NO: 193639 - DNA, 25 bp, Homo sapien
taaggcgacccgaagacagaggatc

SEQ ID NO: 193640 - DNA, 25 bp, Homo sapien
ctttcggccctcacctactagttgg

SEQ ID NO: 193641 - DNA, 25 bp, Homo sapien
acgcgtatggagtttctgtcttcta

SEQ ID NO: 193642 - DNA, 25 bp, Homo sapien
ggcagcctgagaattcttcctgttc

SEQ ID NO: 193643 - DNA, 25 bp, Homo sapien
cttcctgttcattggccatcggtca

SEQ ID NO: 193644 - DNA, 25 bp, Homo sapien
gtaaatctagatgcagagcctcgcc

SEQ ID NO: 193645 - DNA, 25 bp, Homo sapien
tggctccaacatcaagcaccgggct

SEQ ID NO: 193646 - DNA, 25 bp, Homo sapien
cttgcgtagcgtagtttcccagcga

SEQ ID NO: 193647 - DNA, 25 bp, Homo sapien
gcaagagcttctcgctgcgctccta

SEQ ID NO: 193648 - DNA, 25 bp, Homo sapien
agaagccacacaagtgccctgagtg

SEQ ID NO: 193649 - DNA, 25 bp, Homo sapien
ctggtgcgccaccaaggcgtgcaca

SEQ ID NO: 193650 - DNA, 25 bp, Homo sapien
ccttctcctgttccgagtgcggcaa

SEQ ID NO: 193651 - DNA, 25 bp, Homo sapien
aagagcttcaagcagcgcgcgcacc

SEQ ID NO: 193652 - DNA, 25 bp, Homo sapien
agcagctggcttggccggaaacccg

SEQ ID NO: 193653 - DNA, 25 bp, Homo sapien
tggcagccgagaagccgcacagctg

SEQ ID NO: 193654 - DNA, 25 bp, Homo sapien
atcagagcctgcacgccaagatggc

SEQ ID NO: 193655 - DNA, 25 bp, Homo sapien
atgctccactccattggcactaacg

SEQ ID NO: 193656 - DNA, 25 bp, Homo sapien
gcggcactaatgacccgctcctttg

SEQ ID NO: 193657 - DNA, 25 bp, Homo sapien
aatgacccgctcctttgacattggt

SEQ ID NO: 193658 - DNA, 25 bp, Homo sapien
tggtgtcccactccattgtcactaa

SEQ ID NO: 193659 - DNA, 25 bp, Homo sapien
ttgtcactaacgtccggctccatcg

SEQ ID NO: 193660 - DNA, 25 bp, Homo sapien
actatgtccagctccgtcggcacta

SEQ ID NO: 193661 - DNA, 25 bp, Homo sapien
acgtccagctccaacggcactggtg

SEQ ID NO: 193662 - DNA, 25 bp, Homo sapien
cagcactaatgctccactccattgg

SEQ ID NO: 193663 - DNA, 25 bp, Homo sapien
cccgactgcgatgaactccgcaagg

SEQ ID NO: 193664 - DNA, 25 bp, Homo sapien
ctgcgatgaactccgcaaggcctgc

SEQ ID NO: 193665 - DNA, 25 bp, Homo sapien
atgaactccgcaaggcctgcctgga

SEQ ID NO: 193666 - DNA, 25 bp, Homo sapien
tggagatccgcagctcgctccggcg

SEQ ID NO: 193667 - DNA, 25 bp, Homo sapien
tgctgagacggtggccagatcccag

SEQ ID NO: 193668 - DNA, 25 bp, Homo sapien
tggccagatcccagcgccattcttg

SEQ ID NO: 193669 - DNA, 25 bp, Homo sapien
agcgccattcttgcctccatccacc

SEQ ID NO: 193670 - DNA, 25 bp, Homo sapien
tcctcaggtcaacaggcgggtgtgc

SEQ ID NO: 193671 - DNA, 25 bp, Homo sapien
agggctcgaactcacagtcccgggc

SEQ ID NO: 193672 - DNA, 25 bp, Homo sapien
cactctaagcatgcgcgttaaagcg

SEQ ID NO: 193673 - DNA, 25 bp, Homo sapien
ccctcactctaagcatgcgcgttaa

SEQ ID NO: 193674 - DNA, 25 bp, Homo sapien
ggtttccacccagcagcctcagcgg

SEQ ID NO: 193675 - DNA, 25 bp, Homo sapien
ctcgaactcacagtcccgggcccgc

SEQ ID NO: 193676 - DNA, 25 bp, Homo sapien
gctcgccagggctcgaactcacagt

SEQ ID NO: 193677 - DNA, 25 bp, Homo sapien
tcactctaagcatgcgcgttaaagc

SEQ ID NO: 193678 - DNA, 25 bp, Homo sapien
ccgcggcggcggtttccacccagca

SEQ ID NO: 193679 - DNA, 25 bp, Homo sapien
tttgcgccgtcgaaaatggaaatca

SEQ ID NO: 193680 - DNA, 25 bp, Homo sapien
gcagcggattctgacggcgtcagca

SEQ ID NO: 193681 - DNA, 25 bp, Homo sapien
tctcactaaaacgtttggcctgctc

SEQ ID NO: 193682 - DNA, 25 bp, Homo sapien
tccatggaaagccagaagacccttt

SEQ ID NO: 193683 - DNA, 25 bp, Homo sapien
tcagagaagattctagccggtctca

SEQ ID NO: 193684 - DNA, 25 bp, Homo sapien
ccggtctcaaaggaaggatgcagtt

SEQ ID NO: 193685 - DNA, 25 bp, Homo sapien
tggaaatcaaaggaacgcgatgctc

SEQ ID NO: 193686 - DNA, 25 bp, Homo sapien
cgcgatgctctaacggactcgagga

SEQ ID NO: 193687 - DNA, 25 bp, Homo sapien
cccgtttgggaagaaatgaactctg

SEQ ID NO: 193688 - DNA, 25 bp, Homo sapien
agacgggatcccttcctaggatgcc

SEQ ID NO: 193689 - DNA, 25 bp, Homo sapien
tcatccctgtttagggccggcagcg

SEQ ID NO: 193690 - DNA, 25 bp, Homo sapien
cagagaacgtttgtcgtcctggctc

SEQ ID NO: 193691 - DNA, 25 bp, Homo sapien
tgtggacctccaagtacagacgtca

SEQ ID NO: 193692 - DNA, 25 bp, Homo sapien
agggtcctgcactcgggtttcacat

SEQ ID NO: 193693 - DNA, 25 bp, Homo sapien
tcctccttaggctcccagtaaaatg

SEQ ID NO: 193694 - DNA, 25 bp, Homo sapien
accagcttcctgtgatcgaaaccga

SEQ ID NO: 193695 - DNA, 25 bp, Homo sapien
cgccggctttgcctgtgaaagattc

SEQ ID NO: 193696 - DNA, 25 bp, Homo sapien
tcgcgcgctgtccagagtactcagt

SEQ ID NO: 193697 - DNA, 25 bp, Homo sapien
catcgcgttcgcttacttctctaga

SEQ ID NO: 193698 - DNA, 25 bp, Homo sapien
cggtgagctgatttccgggttctta

SEQ ID NO: 193699 - DNA, 25 bp, Homo sapien
gacttcgtattctccgctctccata

SEQ ID NO: 193700 - DNA, 25 bp, Homo sapien
tggcgggaagcaccatctttgctcc

SEQ ID NO: 193701 - DNA, 25 bp, Homo sapien
gcgccttatctttctggaacccaag

SEQ ID NO: 193702 - DNA, 25 bp, Homo sapien
aaacgtcgatgccagctctaggagc

SEQ ID NO: 193703 - DNA, 25 bp, Homo sapien
gtgggcctctgacgcagagaaagac

SEQ ID NO: 193704 - DNA, 25 bp, Homo sapien
agagaaagacccagatccagctacc

SEQ ID NO: 193705 - DNA, 25 bp, Homo sapien
gggccagtcaccctgacactcagga

SEQ ID NO: 193706 - DNA, 25 bp, Homo sapien
ggaatccacgggtcagacccgcttc

SEQ ID NO: 193707 - DNA, 25 bp, Homo sapien
cgtgtgaacgaggaatccacgggtc

SEQ ID NO: 193708 - DNA, 25 bp, Homo sapien
tcagcaaaggtatttcgtgtgaacg

SEQ ID NO: 193709 - DNA, 25 bp, Homo sapien
agtcggggctcagcaaaggtatttc

SEQ ID NO: 193710 - DNA, 25 bp, Homo sapien
agacccagatccagctacctcgggg

SEQ ID NO: 193711 - DNA, 25 bp, Homo sapien
tcttgccagggacgtcacgtcacgc

SEQ ID NO: 193712 - DNA, 25 bp, Homo sapien
ccgctctggcgaaacgaggaatatg

SEQ ID NO: 193713 - DNA, 25 bp, Homo sapien
ctagcctctcgggagcatggcgtcg

SEQ ID NO: 193714 - DNA, 25 bp, Homo sapien
ttagttctccgggtacctcaggcgc

SEQ ID NO: 193715 - DNA, 25 bp, Homo sapien
ctggcgaaacgaggaatatgacata

SEQ ID NO: 193716 - DNA, 25 bp, Homo sapien
ctgcctctacagcaagccggcgagg

SEQ ID NO: 193717 - DNA, 25 bp, Homo sapien
ggaatatgacatacagcaaaacacc

SEQ ID NO: 193718 - DNA, 25 bp, Homo sapien
gcaccactagcctctcgggagcatg

SEQ ID NO: 193719 - DNA, 25 bp, Homo sapien
catgggaacctctcaagagctggca

SEQ ID NO: 193720 - DNA, 25 bp, Homo sapien
accgcagttggtagtgctggatccc

SEQ ID NO: 193721 - DNA, 25 bp, Homo sapien
ggcccactaaagtgctgccagctga

SEQ ID NO: 193722 - DNA, 25 bp, Homo sapien
cctcgaatttcctggctcagtggga

SEQ ID NO: 193723 - DNA, 25 bp, Homo sapien
tcggcaggtctggactgaaaacgtc

SEQ ID NO: 193724 - DNA, 25 bp, Homo sapien
tgtccaaatttcacccggagcccga

SEQ ID NO: 193725 - DNA, 25 bp, Homo sapien
agaggctgacactgagcgtcgcttc

SEQ ID NO: 193726 - DNA, 25 bp, Homo sapien
ttcccacgtggaacctcaattcaag

SEQ ID NO: 193727 - DNA, 25 bp, Homo sapien
tcagcgtcagcctttagggttcgag

SEQ ID NO: 193728 - DNA, 25 bp, Homo sapien
gctgcctgctattgggaggttccca

SEQ ID NO: 193729 - DNA, 25 bp, Homo sapien
ggcctttattgaacacccattggtg

SEQ ID NO: 193730 - DNA, 25 bp, Homo sapien
gcccacgtgggaaactcgctttctg

SEQ ID NO: 193731 - DNA, 25 bp, Homo sapien
gagctcagccatcctgggcacttga

SEQ ID NO: 193732 - DNA, 25 bp, Homo sapien
gcccttctggattgtggtagcgcca

SEQ ID NO: 193733 - DNA, 25 bp, Homo sapien
gtggcctaagccgtcttctccgaga

SEQ ID NO: 193734 - DNA, 25 bp, Homo sapien
cgtgcactccgtcaggcctttattg

SEQ ID NO: 193735 - DNA, 25 bp, Homo sapien
cggacgttggcccagctctgagtcg

SEQ ID NO: 193736 - DNA, 25 bp, Homo sapien
tcggctttgagcagcctcaagggga

SEQ ID NO: 193737 - DNA, 25 bp, Homo sapien
agggttttgtctggctccttgcttc

SEQ ID NO: 193738 - DNA, 25 bp, Homo sapien
gttttgtctggctccttgcttcctc

SEQ ID NO: 193739 - DNA, 25 bp, Homo sapien
aaagcgaggtgcagggtagaatctc

SEQ ID NO: 193740 - DNA, 25 bp, Homo sapien
cagggtagaatctcccgggccgcct

SEQ ID NO: 193741 - DNA, 25 bp, Homo sapien
gtgtcccggacgttggcccagctct

SEQ ID NO: 193742 - DNA, 25 bp, Homo sapien
ggcgtcggctttgagcagcctcaag

SEQ ID NO: 193743 - DNA, 25 bp, Homo sapien
tttctctcgttcactatggcgtccc

SEQ ID NO: 193744 - DNA, 25 bp, Homo sapien
gactcctttctggaggatcagacga

SEQ ID NO: 193745 - DNA, 25 bp, Homo sapien
gggaatgggagttttctctcgttca

SEQ ID NO: 193746 - DNA, 25 bp, Homo sapien
agactgcagagctctacggggaatg

SEQ ID NO: 193747 - DNA, 25 bp, Homo sapien
cgcgaggacgcagactgcagagctc

SEQ ID NO: 193748 - DNA, 25 bp, Homo sapien
ctccgcgaagcccatgcgggctgga

SEQ ID NO: 193749 - DNA, 25 bp, Homo sapien
gatcagacgagtcgggctccgcgaa

SEQ ID NO: 193750 - DNA, 25 bp, Homo sapien
gggagttttctctcgttcactatgg

SEQ ID NO: 193751 - DNA, 25 bp, Homo sapien
ctgtgacgtcacaaccggtgccttg

SEQ ID NO: 193752 - DNA, 25 bp, Homo sapien
ccggtgccttgtttccggtgcagaa

SEQ ID NO: 193753 - DNA, 25 bp, Homo sapien
cggcagtctgcgcttgagacgttaa

SEQ ID NO: 193754 - DNA, 25 bp, Homo sapien
acgttaagacttgagacaggccaga

SEQ ID NO: 193755 - DNA, 25 bp, Homo sapien
agcctctctgtggttctgcctggaa

SEQ ID NO: 193756 - DNA, 25 bp, Homo sapien
gcaggtggttggctctagtcatcca

SEQ ID NO: 193757 - DNA, 25 bp, Homo sapien
ctccgccgtcaaagctctgctgaga

SEQ ID NO: 193758 - DNA, 25 bp, Homo sapien
ttccgctggtcaaggaacaccttta

SEQ ID NO: 193759 - DNA, 25 bp, Homo sapien
tttcccgagggcaggtacacttcga

SEQ ID NO: 193760 - DNA, 25 bp, Homo sapien
cgcatctttcccgagggcaggtaca

SEQ ID NO: 193761 - DNA, 25 bp, Homo sapien
tcccgagggcaggtacacttcgaag

SEQ ID NO: 193762 - DNA, 25 bp, Homo sapien
ggtacacttcgaagggcctgcactc

SEQ ID NO: 193763 - DNA, 25 bp, Homo sapien
ttcgaagggcctgcactccttctgc

SEQ ID NO: 193764 - DNA, 25 bp, Homo sapien
ctccgaggccttctctctgcgtttg

SEQ ID NO: 193765 - DNA, 25 bp, Homo sapien
ctctctgcgtttgctcaggggcttc

SEQ ID NO: 193766 - DNA, 25 bp, Homo sapien
tctgcgtttgctcaggggcttcctc

SEQ ID NO: 193767 - DNA, 25 bp, Homo sapien
agcgagacccgacctgcacgcaatt

SEQ ID NO: 193768 - DNA, 25 bp, Homo sapien
gtcttctgccgaggggcccacataa

SEQ ID NO: 193769 - DNA, 25 bp, Homo sapien
tgcacatgcgcggaacactcccaga

SEQ ID NO: 193770 - DNA, 25 bp, Homo sapien
tgccgaaagtgcgtcttctgccgag

SEQ ID NO: 193771 - DNA, 25 bp, Homo sapien
acgtctcccagaggtctccgagtcg

SEQ ID NO: 193772 - DNA, 25 bp, Homo sapien
tggtctgattggcagccgcaacagc

SEQ ID NO: 193773 - DNA, 25 bp, Homo sapien
cctatagctgcttttcgccggaggg

SEQ ID NO: 193774 - DNA, 25 bp, Homo sapien
cataaggcgcgacagacactccagc

SEQ ID NO: 193775 - DNA, 25 bp, Homo sapien
atccggggaagctgattaacaattc

SEQ ID NO: 193776 - DNA, 25 bp, Homo sapien
gcctggcttgggaaaggattcatcc

SEQ ID NO: 193777 - DNA, 25 bp, Homo sapien
gcgttttcccaagcgctccggagta

SEQ ID NO: 193778 - DNA, 25 bp, Homo sapien
caggcttgttttcttcgcttggatc

SEQ ID NO: 193779 - DNA, 25 bp, Homo sapien
gaaacctgacctaatgggcgctgga

SEQ ID NO: 193780 - DNA, 25 bp, Homo sapien
cgctggagttcgcaaaacgtgaccc

SEQ ID NO: 193781 - DNA, 25 bp, Homo sapien
gacgcctaacttgcgcgctgagatt

SEQ ID NO: 193782 - DNA, 25 bp, Homo sapien
tcggtctaaaatcggaagcaggtgc

SEQ ID NO: 193783 - DNA, 25 bp, Homo sapien
tatggtggttctcgcacgcacagcc

SEQ ID NO: 193784 - DNA, 25 bp, Homo sapien
ggcccacgagcctcctccaaccgcc

SEQ ID NO: 193785 - DNA, 25 bp, Homo sapien
ctccggtgtatggtggttctcgcac

SEQ ID NO: 193786 - DNA, 25 bp, Homo sapien
ctcctgctccgcatcggctcacacg

SEQ ID NO: 193787 - DNA, 25 bp, Homo sapien
acagccgcaggggtttcctctccta

SEQ ID NO: 193788 - DNA, 25 bp, Homo sapien
caggggtttcctctcctagactcga

SEQ ID NO: 193789 - DNA, 25 bp, Homo sapien
tcctagactcgaggcggtggcgcac

SEQ ID NO: 193790 - DNA, 25 bp, Homo sapien
ttcctctcctagactcgaggcggtg

SEQ ID NO: 193791 - DNA, 25 bp, Homo sapien
ctgtttctgacctagcgagtggccc

SEQ ID NO: 193792 - DNA, 25 bp, Homo sapien
tacaaggccctctaggcttcagcgg

SEQ ID NO: 193793 - DNA, 25 bp, Homo sapien
tctggatactcggtggcattaaccc

SEQ ID NO: 193794 - DNA, 25 bp, Homo sapien
cagcagtttctctggcgaggaagta

SEQ ID NO: 193795 - DNA, 25 bp, Homo sapien
agggaggcagccattttccgtaggc

SEQ ID NO: 193796 - DNA, 25 bp, Homo sapien
ccgtcgggcacgagaaaccattctc

SEQ ID NO: 193797 - DNA, 25 bp, Homo sapien
ccgcttttcgcagctgtatcccaga

SEQ ID NO: 193798 - DNA, 25 bp, Homo sapien
gcatttccgtgtccggccgatgtca

SEQ ID NO: 193799 - DNA, 25 bp, Homo sapien
cactctctcctaggccaacgaggtg

SEQ ID NO: 193800 - DNA, 25 bp, Homo sapien
aacctgaaggggacgcagacagtgc

SEQ ID NO: 193801 - DNA, 25 bp, Homo sapien
tgactgctggcgcactctctcctag

SEQ ID NO: 193802 - DNA, 25 bp, Homo sapien
acgaggtgacggacagcgcgtacat

SEQ ID NO: 193803 - DNA, 25 bp, Homo sapien
agtgtgagaccttcacggacgagga

SEQ ID NO: 193804 - DNA, 25 bp, Homo sapien
gacgaggacaccagcaccctggtgc

SEQ ID NO: 193805 - DNA, 25 bp, Homo sapien
tgggctccgagagcacctacagtga

SEQ ID NO: 193806 - DNA, 25 bp, Homo sapien
tgcaccctgagctgcaacctgaagg

SEQ ID NO: 193807 - DNA, 25 bp, Homo sapien
ttagaaccacactcgcgcgactggc

SEQ ID NO: 193808 - DNA, 25 bp, Homo sapien
tccggcgtgacgcagtagaaaaggt

SEQ ID NO: 193809 - DNA, 25 bp, Homo sapien
acagcttccggcgtgacgcagtaga

SEQ ID NO: 193810 - DNA, 25 bp, Homo sapien
gtgctccgcaacagcttccggcgtg

SEQ ID NO: 193811 - DNA, 25 bp, Homo sapien
tggccctcttgaggtcccggcgtgc

SEQ ID NO: 193812 - DNA, 25 bp, Homo sapien
tctttacaggcttagctactgcgca

SEQ ID NO: 193813 - DNA, 25 bp, Homo sapien
cgcgactggctcctctctttacagg

SEQ ID NO: 193814 - DNA, 25 bp, Homo sapien
ggcggtcctttagaaccacactcgc

SEQ ID NO: 193815 - DNA, 25 bp, Homo sapien
taccgtttagcacccggcgacatgc

SEQ ID NO: 193816 - DNA, 25 bp, Homo sapien
ttggggcaagctacctgcgacagct

SEQ ID NO: 193817 - DNA, 25 bp, Homo sapien
tggcctcgcttagctctaccgttta

SEQ ID NO: 193818 - DNA, 25 bp, Homo sapien
gcaggaggctgttcgctacctcaca

SEQ ID NO: 193819 - DNA, 25 bp, Homo sapien
cgggccctgtcagtagttgtcctca

SEQ ID NO: 193820 - DNA, 25 bp, Homo sapien
caggcgcagcaaccaatagacggta

SEQ ID NO: 193821 - DNA, 25 bp, Homo sapien
gggatgcactgcgacggtattgaca

SEQ ID NO: 193822 - DNA, 25 bp, Homo sapien
cagcttgaacttttcctagggattc

SEQ ID NO: 193823 - DNA, 25 bp, Homo sapien
cctgccctttgattggtcgaagttc

SEQ ID NO: 193824 - DNA, 25 bp, Homo sapien
acgctctcatgctcctttacgcagg

SEQ ID NO: 193825 - DNA, 25 bp, Homo sapien
cgaagaacgccacggccactgcaaa

SEQ ID NO: 193826 - DNA, 25 bp, Homo sapien
cgcccgaccgagacgcgacgaagaa

SEQ ID NO: 193827 - DNA, 25 bp, Homo sapien
cggttaataacaggcctcgcgctcc

SEQ ID NO: 193828 - DNA, 25 bp, Homo sapien
tggggaatgccttcttcaagacgcc

SEQ ID NO: 193829 - DNA, 25 bp, Homo sapien
cgccacagggacttcgtgacaaagc

SEQ ID NO: 193830 - DNA, 25 bp, Homo sapien
aagggaccaattccgctgccaagtt

SEQ ID NO: 193831 - DNA, 25 bp, Homo sapien
cacctgctttcagttgttggccagc

SEQ ID NO: 193832 - DNA, 25 bp, Homo sapien
tcctcatgggtaccctgtggggtgt

SEQ ID NO: 193833 - DNA, 25 bp, Homo sapien
acaatttgcaactagagggtggtcc

SEQ ID NO: 193834 - DNA, 25 bp, Homo sapien
ccgcgatgagtggtcgggacaattt

SEQ ID NO: 193835 - DNA, 25 bp, Homo sapien
aggatgcgctgagccctacaacacc

SEQ ID NO: 193836 - DNA, 25 bp, Homo sapien
tacataactcgttgcgggctccgcg

SEQ ID NO: 193837 - DNA, 25 bp, Homo sapien
gccctcgcgagcttaggatgcgcct

SEQ ID NO: 193838 - DNA, 25 bp, Homo sapien
ggtgaagggccaggccatttccgtc

SEQ ID NO: 193839 - DNA, 25 bp, Homo sapien
cgagtacagccggaccatgtgatgt

SEQ ID NO: 193840 - DNA, 25 bp, Homo sapien
atgcgcagagcatgcccatccgtgg

SEQ ID NO: 193841 - DNA, 25 bp, Homo sapien
accatgtgatgtcggctgggcagcc

SEQ ID NO: 193842 - DNA, 25 bp, Homo sapien
ggagctgccagccatctaactgggc

SEQ ID NO: 193843 - DNA, 25 bp, Homo sapien
catctaactgggctcgtcggcctgc

SEQ ID NO: 193844 - DNA, 25 bp, Homo sapien
tgctacacgggctcgggaacagaac

SEQ ID NO: 193845 - DNA, 25 bp, Homo sapien
cttctgttttctgcaaggagctgcc

SEQ ID NO: 193846 - DNA, 25 bp, Homo sapien
acagaacatcgtgggcatgcgcaga

SEQ ID NO: 193847 - DNA, 25 bp, Homo sapien
caggtagcggtacatggccacaagc

SEQ ID NO: 193848 - DNA, 25 bp, Homo sapien
gtagcggtacatggccacaagcgga

SEQ ID NO: 193849 - DNA, 25 bp, Homo sapien
tgatggtcgcgaaacaggcgcgctt

SEQ ID NO: 193850 - DNA, 25 bp, Homo sapien
tggtcgcgaaacaggcgcgctttct

SEQ ID NO: 193851 - DNA, 25 bp, Homo sapien
cggggctctcaggtatgtgcgccgc

SEQ ID NO: 193852 - DNA, 25 bp, Homo sapien
gctggcctctgtagggcgctcagag

SEQ ID NO: 193853 - DNA, 25 bp, Homo sapien
cagcaacagcgcttcgcccaggtag

SEQ ID NO: 193854 - DNA, 25 bp, Homo sapien
gcaacagcgcttcgcccaggtagcg

SEQ ID NO: 193855 - DNA, 25 bp, Homo sapien
actcagcacatggttgcagggcttg

SEQ ID NO: 193856 - DNA, 25 bp, Homo sapien
tcttgaagaagttggggtcgtcctc

SEQ ID NO: 193857 - DNA, 25 bp, Homo sapien
agaagccctccaccatcttgaagaa

SEQ ID NO: 193858 - DNA, 25 bp, Homo sapien
tggcgccgcgatcgaagaagccctc

SEQ ID NO: 193859 - DNA, 25 bp, Homo sapien
ttgatgatccgcaggatgccgcgca

SEQ ID NO: 193860 - DNA, 25 bp, Homo sapien
ttgcagggcttgatgatccgcagga

SEQ ID NO: 193861 - DNA, 25 bp, Homo sapien
cacatggttgcagggcttgatgatc

SEQ ID NO: 193862 - DNA, 25 bp, Homo sapien
atggggaaggagagactcagcacat

SEQ ID NO: 193863 - DNA, 25 bp, Homo sapien
accaaacgctatttccgctccaggg

SEQ ID NO: 193864 - DNA, 25 bp, Homo sapien
actctccggtcttcgcaagggccga

SEQ ID NO: 193865 - DNA, 25 bp, Homo sapien
ctttcgatcagctggccctggactc

SEQ ID NO: 193866 - DNA, 25 bp, Homo sapien
gggccaagatcctgactttcgatca

SEQ ID NO: 193867 - DNA, 25 bp, Homo sapien
ccaaacttaaggtgtgtgcgctgcc

SEQ ID NO: 193868 - DNA, 25 bp, Homo sapien
gcttaacggatgacgcgagggttca

SEQ ID NO: 193869 - DNA, 25 bp, Homo sapien
ccggatgatccggaagatgaagctt

SEQ ID NO: 193870 - DNA, 25 bp, Homo sapien
tccgctccagggaccagaagttcga

SEQ ID NO: 193871 - DNA, 25 bp, Homo sapien
gttgtgcagcccgagccgtctgcgc

SEQ ID NO: 193872 - DNA, 25 bp, Homo sapien
ctttccggcctgttgtgcagcccga

SEQ ID NO: 193873 - DNA, 25 bp, Homo sapien
tttccggcctgttgtgcagcccgag

SEQ ID NO: 193874 - DNA, 25 bp, Homo sapien
cggcctgttgtgcagcccgagccgt

SEQ ID NO: 193875 - DNA, 25 bp, Homo sapien
gcctgttgtgcagcccgagccgtct

SEQ ID NO: 193876 - DNA, 25 bp, Homo sapien
tctgggcgcccacagtgatcccgtc

SEQ ID NO: 193877 - DNA, 25 bp, Homo sapien
ttccggcctgttgtgcagcccgagc

SEQ ID NO: 193878 - DNA, 25 bp, Homo sapien
tgtgcagcccgagccgtctgcgcgt

SEQ ID NO: 193879 - DNA, 25 bp, Homo sapien
cgggtcttccagagattcagggctc

SEQ ID NO: 193880 - DNA, 25 bp, Homo sapien
cctgtgtaggcgatccctgaggctt

SEQ ID NO: 193881 - DNA, 25 bp, Homo sapien
tttccgcgacctccgcagtaaggca

SEQ ID NO: 193882 - DNA, 25 bp, Homo sapien
ctggggacctgagcgttatgtcttt

SEQ ID NO: 193883 - DNA, 25 bp, Homo sapien
ttggttgccatagagatcgtcgagc

SEQ ID NO: 193884 - DNA, 25 bp, Homo sapien
gccgcgtcttcgcttcgctttttgt

SEQ ID NO: 193885 - DNA, 25 bp, Homo sapien
tgcgccgtccaagggtccattggtt

SEQ ID NO: 193886 - DNA, 25 bp, Homo sapien
ttttgtttgtccctgaccgtgcgcc

SEQ ID NO: 193887 - DNA, 25 bp, Homo sapien
aggaagcgcaggaacacgtccagcc

SEQ ID NO: 193888 - DNA, 25 bp, Homo sapien
ggccctcctggatgcgccatagtaa

SEQ ID NO: 193889 - DNA, 25 bp, Homo sapien
aagaggtcgaagatggccctcctgg

SEQ ID NO: 193890 - DNA, 25 bp, Homo sapien
tgcagctcatgcaggcagtgcaaca

SEQ ID NO: 193891 - DNA, 25 bp, Homo sapien
agggcattgaccctcggagacaaga

SEQ ID NO: 193892 - DNA, 25 bp, Homo sapien
ctcctgaaatgcgtgaggaagccca

SEQ ID NO: 193893 - DNA, 25 bp, Homo sapien
caggatacgccgctctcagtgaaga

SEQ ID NO: 193894 - DNA, 25 bp, Homo sapien
gcaacacgttgatggcccgtgcaca

SEQ ID NO: 193895 - DNA, 25 bp, Homo sapien
aagtccttgccgacctgcccatggg

SEQ ID NO: 193896 - DNA, 25 bp, Homo sapien
ccgagcagatgagtcggtcggcaca

SEQ ID NO: 193897 - DNA, 25 bp, Homo sapien
tgcctcaccagggtggtcttgccca

SEQ ID NO: 193898 - DNA, 25 bp, Homo sapien
cagaggcggacgaagtgcctcacca

SEQ ID NO: 193899 - DNA, 25 bp, Homo sapien
atcccggaaggtcagaggcagcacc

SEQ ID NO: 193900 - DNA, 25 bp, Homo sapien
acacagcttctcgtgggtgttgaga

SEQ ID NO: 193901 - DNA, 25 bp, Homo sapien
agtcggtcggcacacagcttctcgt

SEQ ID NO: 193902 - DNA, 25 bp, Homo sapien
accagcgagaagtccttgccgacct

SEQ ID NO: 193903 - DNA, 25 bp, Homo sapien
gttgtgtgtagtggccctggcacct

SEQ ID NO: 193904 - DNA, 25 bp, Homo sapien
cgcacgcgttgtgtgtagtggccct

SEQ ID NO: 193905 - DNA, 25 bp, Homo sapien
tgtgtgtagtggccctggcacctcc

SEQ ID NO: 193906 - DNA, 25 bp, Homo sapien
tagtggccctggcacctccacgccc

SEQ ID NO: 193907 - DNA, 25 bp, Homo sapien
gtgtagtggccctggcacctccacg

SEQ ID NO: 193908 - DNA, 25 bp, Homo sapien
tgtgtagtggccctggcacctccac

SEQ ID NO: 193909 - DNA, 25 bp, Homo sapien
gtgtgtagtggccctggcacctcca

SEQ ID NO: 193910 - DNA, 25 bp, Homo sapien
tctgagcgcacgcgttgtgtgtagt

SEQ ID NO: 193911 - DNA, 25 bp, Homo sapien
cgaattcagaaagctcggcctgcta

SEQ ID NO: 193912 - DNA, 25 bp, Homo sapien
tcccacagagccgaattcagaaagc

SEQ ID NO: 193913 - DNA, 25 bp, Homo sapien
gacagtcacggctgtcggcggcctc

SEQ ID NO: 193914 - DNA, 25 bp, Homo sapien
attcagaaagctcggcctgctattc

SEQ ID NO: 193915 - DNA, 25 bp, Homo sapien
cgcgcccgaggacttctcttgcaat

SEQ ID NO: 193916 - DNA, 25 bp, Homo sapien
cccgaggacttctcttgcaatttcc

SEQ ID NO: 193917 - DNA, 25 bp, Homo sapien
cctcgttcatcctgcggctggggct

SEQ ID NO: 193918 - DNA, 25 bp, Homo sapien
acgtcccacagagccgaattcagaa

SEQ ID NO: 193919 - DNA, 25 bp, Homo sapien
ctcacagcaggcgagggatgaatga

SEQ ID NO: 193920 - DNA, 25 bp, Homo sapien
gaccaccgtggggatccggatccgc

SEQ ID NO: 193921 - DNA, 25 bp, Homo sapien
gggctgccaaagactctaacggctc

SEQ ID NO: 193922 - DNA, 25 bp, Homo sapien
gagacgggcgagaaaggctcttctc

SEQ ID NO: 193923 - DNA, 25 bp, Homo sapien
aggctcttctcccttaggaaagaga

SEQ ID NO: 193924 - DNA, 25 bp, Homo sapien
gaacggcccgaaatgacaggacctc

SEQ ID NO: 193925 - DNA, 25 bp, Homo sapien
accttcttaacggagactcgcgcgc

SEQ ID NO: 193926 - DNA, 25 bp, Homo sapien
cgccgcggcaccttcttaacggaga

SEQ ID NO: 193927 - DNA, 25 bp, Homo sapien
gagctcctcaggacaacatgtcagg

SEQ ID NO: 193928 - DNA, 25 bp, Homo sapien
agcggtagaactcctcatgttgcca

SEQ ID NO: 193929 - DNA, 25 bp, Homo sapien
tgttgccactcacggacatccttgg

SEQ ID NO: 193930 - DNA, 25 bp, Homo sapien
acatccttggggtccatcatccaga

SEQ ID NO: 193931 - DNA, 25 bp, Homo sapien
gtgcaggggagacacacaaggctct

SEQ ID NO: 193932 - DNA, 25 bp, Homo sapien
ctgacgaatacagtgtgggccgtga

SEQ ID NO: 193933 - DNA, 25 bp, Homo sapien
cgtccgtcttatagtgcagggtgta

SEQ ID NO: 193934 - DNA, 25 bp, Homo sapien
gtcgtgttcaccacgcacgtcttct

SEQ ID NO: 193935 - DNA, 25 bp, Homo sapien
cgtgtctgcgacctttgtgaatccc

SEQ ID NO: 193936 - DNA, 25 bp, Homo sapien
acgtgcgctacctgactggaccgaa

SEQ ID NO: 193937 - DNA, 25 bp, Homo sapien
tccagccgaggaaaaggcagccaag

SEQ ID NO: 193938 - DNA, 25 bp, Homo sapien
ccgtgaccttggatcgcgttgtcaa

SEQ ID NO: 193939 - DNA, 25 bp, Homo sapien
aatggggcggatgtcagtatccacg

SEQ ID NO: 193940 - DNA, 25 bp, Homo sapien
cctagctgtgcgcattcctggaatg

SEQ ID NO: 193941 - DNA, 25 bp, Homo sapien
gtgaatcccggccatccgtctaggc

SEQ ID NO: 193942 - DNA, 25 bp, Homo sapien
aggggtaaagcacgatccatggaac

SEQ ID NO: 193943 - DNA, 25 bp, Homo sapien
ggccgctaagcctgggccacagttc

SEQ ID NO: 193944 - DNA, 25 bp, Homo sapien
agcctggagcactctctgcctcaga

SEQ ID NO: 193945 - DNA, 25 bp, Homo sapien
agtgggccaaatgcagtttcagacc

SEQ ID NO: 193946 - DNA, 25 bp, Homo sapien
agaccaactgacgaccctaactgtg

SEQ ID NO: 193947 - DNA, 25 bp, Homo sapien
accctaactgtgtgagcgacaatca

SEQ ID NO: 193948 - DNA, 25 bp, Homo sapien
gacaatcacctgtgagcctcgaatg

SEQ ID NO: 193949 - DNA, 25 bp, Homo sapien
ccacctcagtctccgggaagaaaag

SEQ ID NO: 193950 - DNA, 25 bp, Homo sapien
agtcagaaagcacctcgcgagcctg

SEQ ID NO: 193951 - DNA, 25 bp, Homo sapien
cactcgttgcaggtgtagacaaagc

SEQ ID NO: 193952 - DNA, 25 bp, Homo sapien
gtagacaaagcggtcctggccctgg

SEQ ID NO: 193953 - DNA, 25 bp, Homo sapien
cgcccatccatgaggtcacagctga

SEQ ID NO: 193954 - DNA, 25 bp, Homo sapien
ggagaactcccagtgcttgtctctg

SEQ ID NO: 193955 - DNA, 25 bp, Homo sapien
ccacgtggtgcttgcactcgttgca

SEQ ID NO: 193956 - DNA, 25 bp, Homo sapien
agcatgcagagcgtggaccacttgg

SEQ ID NO: 193957 - DNA, 25 bp, Homo sapien
gtgtgcagctccaccagcatgcaga

SEQ ID NO: 193958 - DNA, 25 bp, Homo sapien
tgaggaaggcgtcgcgcccatccat

SEQ ID NO: 193959 - DNA, 25 bp, Homo sapien
caactcgggcccagtgacagtcctg

SEQ ID NO: 193960 - DNA, 25 bp, Homo sapien
aaacaaacccacacgctgcacttta

SEQ ID NO: 193961 - DNA, 25 bp, Homo sapien
gcggatggatgcgtaggacattacc

SEQ ID NO: 193962 - DNA, 25 bp, Homo sapien
tgcactttacttcttccctcctgga

SEQ ID NO: 193963 - DNA, 25 bp, Homo sapien
tgcaccgggcgtgtgctgaccaact

SEQ ID NO: 193964 - DNA, 25 bp, Homo sapien
cagtgacagtcctgcgacgaacttc

SEQ ID NO: 193965 - DNA, 25 bp, Homo sapien
gctcgatcggtatccgcgaccacga

SEQ ID NO: 193966 - DNA, 25 bp, Homo sapien
tccctcctggagtgccactagggtc

SEQ ID NO: 193967 - DNA, 25 bp, Homo sapien
caactgctccaaagtggtcgaggca

SEQ ID NO: 193968 - DNA, 25 bp, Homo sapien
acagcttttgttctgatggcgacca

SEQ ID NO: 193969 - DNA, 25 bp, Homo sapien
atcggggcttaagcctggacgctca

SEQ ID NO: 193970 - DNA, 25 bp, Homo sapien
tgcaggttacagaccgcccttgggt

SEQ ID NO: 193971 - DNA, 25 bp, Homo sapien
tctctttccagagcctgaacgggga

SEQ ID NO: 193972 - DNA, 25 bp, Homo sapien
gcccgcgggacacttctacgaatac

SEQ ID NO: 193973 - DNA, 25 bp, Homo sapien
atggcggctgttgattcctcaatta

SEQ ID NO: 193974 - DNA, 25 bp, Homo sapien
tccgggctgagccacagcttttgtt

SEQ ID NO: 193975 - DNA, 25 bp, Homo sapien
tcgcaagtctgagcgctccggctct

SEQ ID NO: 193976 - DNA, 25 bp, Homo sapien
tggcacggtgcctccagaaacccaa

SEQ ID NO: 193977 - DNA, 25 bp, Homo sapien
gccagaggctggctctgaatcccag

SEQ ID NO: 193978 - DNA, 25 bp, Homo sapien
acgctcgctcagtcccggagcttgg

SEQ ID NO: 193979 - DNA, 25 bp, Homo sapien
gcctcgtttggggtcgcaagtctga

SEQ ID NO: 193980 - DNA, 25 bp, Homo sapien
agcgctccggctctggttggcgcta

SEQ ID NO: 193981 - DNA, 25 bp, Homo sapien
ctctggcgcaggcagatcatcgacc

SEQ ID NO: 193982 - DNA, 25 bp, Homo sapien
cggagcttgggacttctgaagacgc

SEQ ID NO: 193983 - DNA, 25 bp, Homo sapien
tgctgtcttggcctgcatgcatgtg

SEQ ID NO: 193984 - DNA, 25 bp, Homo sapien
ggagctgtcgtgacatgcccccttc

SEQ ID NO: 193985 - DNA, 25 bp, Homo sapien
catttgctgtcttggcctgcatgca

SEQ ID NO: 193986 - DNA, 25 bp, Homo sapien
gtgcccggctggcatttgctgtctt

SEQ ID NO: 193987 - DNA, 25 bp, Homo sapien
tcttggcctgcatgcatgtgggcga

SEQ ID NO: 193988 - DNA, 25 bp, Homo sapien
atgcatgtgggcgagcccctaaacc

SEQ ID NO: 193989 - DNA, 25 bp, Homo sapien
cagggagcgcggctcacccacagcc

SEQ ID NO: 193990 - DNA, 25 bp, Homo sapien
ctggcatttgctgtcttggcctgca

SEQ ID NO: 193991 - DNA, 25 bp, Homo sapien
tgggaagaggatccacctccacgtg

SEQ ID NO: 193992 - DNA, 25 bp, Homo sapien
gggcccgtcctctcggtggtctgac

SEQ ID NO: 193993 - DNA, 25 bp, Homo sapien
gcctggcgtccacttcctggataag

SEQ ID NO: 193994 - DNA, 25 bp, Homo sapien
ctctgctgcagaggcagaatccgcg

SEQ ID NO: 193995 - DNA, 25 bp, Homo sapien
ccttcagcatccctgggcggaaaga

SEQ ID NO: 193996 - DNA, 25 bp, Homo sapien
aacgtgggcgagctcccttcagcat

SEQ ID NO: 193997 - DNA, 25 bp, Homo sapien
caggcccaacccagaacgtgggcga

SEQ ID NO: 193998 - DNA, 25 bp, Homo sapien
agagcataggccaagggccaagctc

SEQ ID NO: 193999 - DNA, 25 bp, Homo sapien
ttggcgaactcgaacaggatctgca

SEQ ID NO: 194000 - DNA, 25 bp, Homo sapien
ccgacgcggagcttgaagttgaacc

SEQ ID NO: 194001 - DNA, 25 bp, Homo sapien
cggtagctctcttcgctcacctgga

SEQ ID NO: 194002 - DNA, 25 bp, Homo sapien
ccggcttgcttaggagctcgtcaaa

SEQ ID NO: 194003 - DNA, 25 bp, Homo sapien
agaggttactgctcggcgcttccaa

SEQ ID NO: 194004 - DNA, 25 bp, Homo sapien
ggtcacgcggcaccgaactattgca

SEQ ID NO: 194005 - DNA, 25 bp, Homo sapien
ttgttgttgaagtcgtccaccacgc

SEQ ID NO: 194006 - DNA, 25 bp, Homo sapien
ggaggcggtagctgacttcaaattc

SEQ ID NO: 194007 - DNA, 25 bp, Homo sapien
gcccgcaagcagtgctggccgcgta

SEQ ID NO: 194008 - DNA, 25 bp, Homo sapien
cggccgagcctgtgaacactgggaa

SEQ ID NO: 194009 - DNA, 25 bp, Homo sapien
tggccgcgtacctgtctgggcacag

SEQ ID NO: 194010 - DNA, 25 bp, Homo sapien
gttacagtagtgcacgacggcaatc

SEQ ID NO: 194011 - DNA, 25 bp, Homo sapien
gcacgacggcaatcagcgcggccga

SEQ ID NO: 194012 - DNA, 25 bp, Homo sapien
agctgagctggcagaagttacagta

SEQ ID NO: 194013 - DNA, 25 bp, Homo sapien
gcaaggtggccacgcaccctggtgc

SEQ ID NO: 194014 - DNA, 25 bp, Homo sapien
caacctcgggcaaggtggccacgca

SEQ ID NO: 194015 - DNA, 25 bp, Homo sapien
ccagtgcgggaagcgacaccaggat

SEQ ID NO: 194016 - DNA, 25 bp, Homo sapien
acaccatcctgcgagaggcatgggg

SEQ ID NO: 194017 - DNA, 25 bp, Homo sapien
acgtggtagccagccggcgatccac

SEQ ID NO: 194018 - DNA, 25 bp, Homo sapien
gcgcttggtgcaggccatgacgtcc

SEQ ID NO: 194019 - DNA, 25 bp, Homo sapien
tgcaggccatgacgtcctccaggaa

SEQ ID NO: 194020 - DNA, 25 bp, Homo sapien
cccgatgcagtgacgtggtagccag

SEQ ID NO: 194021 - DNA, 25 bp, Homo sapien
aggaagaacaccatcctgcgagagg

SEQ ID NO: 194022 - DNA, 25 bp, Homo sapien
gccatgacgtcctccaggaagaaca

SEQ ID NO: 194023 - DNA, 25 bp, Homo sapien
gaagttcagaccttgagcgctccca

SEQ ID NO: 194024 - DNA, 25 bp, Homo sapien
caggcaccatctgttcctgtggttc

SEQ ID NO: 194025 - DNA, 25 bp, Homo sapien
cctgccagcaaaacggggagagtta

SEQ ID NO: 194026 - DNA, 25 bp, Homo sapien
ggggtcaccagtacctgccagcaaa

SEQ ID NO: 194027 - DNA, 25 bp, Homo sapien
gatcttgacgcgcacgctgttgctg

SEQ ID NO: 194028 - DNA, 25 bp, Homo sapien
ccctctcgaacagctggggcagctt

SEQ ID NO: 194029 - DNA, 25 bp, Homo sapien
tcaccgagtcgaacttggggtccca

SEQ ID NO: 194030 - DNA, 25 bp, Homo sapien
tagaagagcgcataccggaaccggc

SEQ ID NO: 194031 - DNA, 25 bp, Homo sapien
actcggcacgcctttgggataaatc

SEQ ID NO: 194032 - DNA, 25 bp, Homo sapien
ttcacgggcctagcctccaaagctg

SEQ ID NO: 194033 - DNA, 25 bp, Homo sapien
cctgaaggcgcctgccgtggaagaa

SEQ ID NO: 194034 - DNA, 25 bp, Homo sapien
gaagaagccgctggccgcaacgttt

SEQ ID NO: 194035 - DNA, 25 bp, Homo sapien
ctggccgcaacgtttgggaaatcaa

SEQ ID NO: 194036 - DNA, 25 bp, Homo sapien
tcaaaatgttgccttcccactcggc

SEQ ID NO: 194037 - DNA, 25 bp, Homo sapien
ctctgtaagcaatgaatgcgggccc

SEQ ID NO: 194038 - DNA, 25 bp, Homo sapien
cacgcctttgggataaatcgaagtt

SEQ ID NO: 194039 - DNA, 25 bp, Homo sapien
ataactgagggcagcagtcggcctt

SEQ ID NO: 194040 - DNA, 25 bp, Homo sapien
agattcagccaggtgcccactttcc

SEQ ID NO: 194041 - DNA, 25 bp, Homo sapien
cagccacgcggtgaatgcctgagag

SEQ ID NO: 194042 - DNA, 25 bp, Homo sapien
tcccgatcgaggatctggagatctc

SEQ ID NO: 194043 - DNA, 25 bp, Homo sapien
tcagggccttttcggtcccgatcga

SEQ ID NO: 194044 - DNA, 25 bp, Homo sapien
tcactgcacaagttcagggcctttt

SEQ ID NO: 194045 - DNA, 25 bp, Homo sapien
tcccggactcaatggcaagtcactg

SEQ ID NO: 194046 - DNA, 25 bp, Homo sapien
tccctcagacgaaggaagagtggtc

SEQ ID NO: 194047 - DNA, 25 bp, Homo sapien
tgacacggcaatgtttcggatactc

SEQ ID NO: 194048 - DNA, 25 bp, Homo sapien
gcgccctctgttgatcctcttagga

SEQ ID NO: 194049 - DNA, 25 bp, Homo sapien
tctggcctatgagaactgagctgtc

SEQ ID NO: 194050 - DNA, 25 bp, Homo sapien
tgtcttacgaaaagtcctgtcaccc

SEQ ID NO: 194051 - DNA, 25 bp, Homo sapien
ggcagtctcccatcgcactgagatt

SEQ ID NO: 194052 - DNA, 25 bp, Homo sapien
ctcggcagaaggacgagcagctcct

SEQ ID NO: 194053 - DNA, 25 bp, Homo sapien
tgtgcttcacaaaaacgtcaggtcc

SEQ ID NO: 194054 - DNA, 25 bp, Homo sapien
gaacctttcgtcagcgcgagctcca

SEQ ID NO: 194055 - DNA, 25 bp, Homo sapien
gccgcagctcaatcatctcccgccg

SEQ ID NO: 194056 - DNA, 25 bp, Homo sapien
ctcccagatgtccggggagcctatg

SEQ ID NO: 194057 - DNA, 25 bp, Homo sapien
gggagcctatgccttcgtccttgtc

SEQ ID NO: 194058 - DNA, 25 bp, Homo sapien
atcatgcgcaccgagcgctccttgt

SEQ ID NO: 194059 - DNA, 25 bp, Homo sapien
gagcctatgccttcgtccttgtcct

SEQ ID NO: 194060 - DNA, 25 bp, Homo sapien
cgcagagcaagaggcgcgaccccag

SEQ ID NO: 194061 - DNA, 25 bp, Homo sapien
acgccctctgcaccgcgcgccgtgc

SEQ ID NO: 194062 - DNA, 25 bp, Homo sapien
gcaccgcgcgccgtgcccagcagag

SEQ ID NO: 194063 - DNA, 25 bp, Homo sapien
aggcgctagcgtccaccagcctgtg

SEQ ID NO: 194064 - DNA, 25 bp, Homo sapien
ggggtcgttcaaaatgcagatgtcc

SEQ ID NO: 194065 - DNA, 25 bp, Homo sapien
caaacttgcgcacgccgtagaacgc

SEQ ID NO: 194066 - DNA, 25 bp, Homo sapien
aggtcccaaacttgcgcacgccgta

SEQ ID NO: 194067 - DNA, 25 bp, Homo sapien
gccctggggagccatttcgctcctg

SEQ ID NO: 194068 - DNA, 25 bp, Homo sapien
gttcaaaatgcagatgtccgggccc

SEQ ID NO: 194069 - DNA, 25 bp, Homo sapien
attctgcaggcgctagcgtccacca

SEQ ID NO: 194070 - DNA, 25 bp, Homo sapien
ggagccatttcgctcctggagcagc

SEQ ID NO: 194071 - DNA, 25 bp, Homo sapien
ggcaccttctgagtgggcaccatga

SEQ ID NO: 194072 - DNA, 25 bp, Homo sapien
ccgtcccggcagctaagaaaggcta

SEQ ID NO: 194073 - DNA, 25 bp, Homo sapien
accacgtgggtctgtttgcaattta

SEQ ID NO: 194074 - DNA, 25 bp, Homo sapien
tgaaatactccatagcgatcggccc

SEQ ID NO: 194075 - DNA, 25 bp, Homo sapien
gtcccgcgatcagccggagaatgca

SEQ ID NO: 194076 - DNA, 25 bp, Homo sapien
atcagatgtctgtttcaaggcggga

SEQ ID NO: 194077 - DNA, 25 bp, Homo sapien
tccgcggagtaaggaattgcatgta

SEQ ID NO: 194078 - DNA, 25 bp, Homo sapien
cggccgagctacatgcgccactatg

SEQ ID NO: 194079 - DNA, 25 bp, Homo sapien
ggagaggttcctgacggcccgccca

SEQ ID NO: 194080 - DNA, 25 bp, Homo sapien
caggagaggttcctgacggcccgcc

SEQ ID NO: 194081 - DNA, 25 bp, Homo sapien
actgcaggccaggtaggagaggttc

SEQ ID NO: 194082 - DNA, 25 bp, Homo sapien
gcaggccaggtaggagaagttcccc

SEQ ID NO: 194083 - DNA, 25 bp, Homo sapien
tgcaggccaggtaggagaagttccc

SEQ ID NO: 194084 - DNA, 25 bp, Homo sapien
ctgcaggccaggtaggagaggttcc

SEQ ID NO: 194085 - DNA, 25 bp, Homo sapien
cccagaaactgcaggccaggtagga

SEQ ID NO: 194086 - DNA, 25 bp, Homo sapien
ggccaggtaggagaggttcttgaca

SEQ ID NO: 194087 - DNA, 25 bp, Homo sapien
tacccccggaggatgctgtcggcgc

SEQ ID NO: 194088 - DNA, 25 bp, Homo sapien
ctcaaaaatgtgtcgctcgcgcttc

SEQ ID NO: 194089 - DNA, 25 bp, Homo sapien
cttggtcacgactcaaaaatgtgtc

SEQ ID NO: 194090 - DNA, 25 bp, Homo sapien
ggagggagtttccacttggtcacga

SEQ ID NO: 194091 - DNA, 25 bp, Homo sapien
cggcttgttcatattcatgaggcgg

SEQ ID NO: 194092 - DNA, 25 bp, Homo sapien
ccagccggcttgttcatattcatga

SEQ ID NO: 194093 - DNA, 25 bp, Homo sapien
aaatgtgtcgctcgcgcttctccgc

SEQ ID NO: 194094 - DNA, 25 bp, Homo sapien
ctcaccagccggcttgttcatattc

SEQ ID NO: 194095 - DNA, 25 bp, Homo sapien
cacaggtcgccggacccagagagtc

SEQ ID NO: 194096 - DNA, 25 bp, Homo sapien
tcggcccttccggacgcccgcacag

SEQ ID NO: 194097 - DNA, 25 bp, Homo sapien
gggctgaagcgcagcgattcccgcc

SEQ ID NO: 194098 - DNA, 25 bp, Homo sapien
catctcccggctaatgtttaacccg

SEQ ID NO: 194099 - DNA, 25 bp, Homo sapien
ccagagagtcggcccttaatagccc

SEQ ID NO: 194100 - DNA, 25 bp, Homo sapien
gacccagagagtcggcccttaatag

SEQ ID NO: 194101 - DNA, 25 bp, Homo sapien
ggacccagagagtcggcccttaata

SEQ ID NO: 194102 - DNA, 25 bp, Homo sapien
gccggacccagagagtcggccctta

SEQ ID NO: 194103 - DNA, 25 bp, Homo sapien
gtgtatccgctcactgcactcgctg

SEQ ID NO: 194104 - DNA, 25 bp, Homo sapien
ctgatgtccaggagggatctagacc

SEQ ID NO: 194105 - DNA, 25 bp, Homo sapien
tggacgcaggtggtcccaaatgctg

SEQ ID NO: 194106 - DNA, 25 bp, Homo sapien
aaccaagcggaagctcggattgctc

SEQ ID NO: 194107 - DNA, 25 bp, Homo sapien
gggcctcgtcgttattctaccgtga

SEQ ID NO: 194108 - DNA, 25 bp, Homo sapien
ctaccgtgagggaaactgagaccga

SEQ ID NO: 194109 - DNA, 25 bp, Homo sapien
gcagagaggcattcctgccgccttc

SEQ ID NO: 194110 - DNA, 25 bp, Homo sapien
cgagtctgtggttcaacacgaggca

SEQ ID NO: 194111 - DNA, 25 bp, Homo sapien
agatggcaaggggtccatactcgcc

SEQ ID NO: 194112 - DNA, 25 bp, Homo sapien
gtacccggagcctgggcatgaagtt

SEQ ID NO: 194113 - DNA, 25 bp, Homo sapien
tgcctcctcccttggccgggagagt

SEQ ID NO: 194114 - DNA, 25 bp, Homo sapien
tttgggacaagtcaggcacttgtta

SEQ ID NO: 194115 - DNA, 25 bp, Homo sapien
gacaagtcaggcacttgttactccc

SEQ ID NO: 194116 - DNA, 25 bp, Homo sapien
gggtccctcgagctctcggtctttc

SEQ ID NO: 194117 - DNA, 25 bp, Homo sapien
cgggccattgtgagccctcgccgag

SEQ ID NO: 194118 - DNA, 25 bp, Homo sapien
agggaggagaagcacgcacagcttc

SEQ ID NO: 194119 - DNA, 25 bp, Homo sapien
ctgccagggcgggatccttggctac

SEQ ID NO: 194120 - DNA, 25 bp, Homo sapien
tagttccttttgcagctggaggagc

SEQ ID NO: 194121 - DNA, 25 bp, Homo sapien
cccgctctaattagttccttttgca

SEQ ID NO: 194122 - DNA, 25 bp, Homo sapien
agcagccattgtctcggccagggtg

SEQ ID NO: 194123 - DNA, 25 bp, Homo sapien
aactgaggaacggaaggctccacca

SEQ ID NO: 194124 - DNA, 25 bp, Homo sapien
catcccaggctgagtgctcgagaga

SEQ ID NO: 194125 - DNA, 25 bp, Homo sapien
gatccttggctacctggcctggccg

SEQ ID NO: 194126 - DNA, 25 bp, Homo sapien
gtcgggcacacaatagcagccattg

SEQ ID NO: 194127 - DNA, 25 bp, Homo sapien
ttgcctcagtctaagggcgggccac

SEQ ID NO: 194128 - DNA, 25 bp, Homo sapien
gcagctaagcacatcggtcagacgt

SEQ ID NO: 194129 - DNA, 25 bp, Homo sapien
gtcagaggtcaaggaaagccgcaga

SEQ ID NO: 194130 - DNA, 25 bp, Homo sapien
cggcctcttccaggcagacggtttt

SEQ ID NO: 194131 - DNA, 25 bp, Homo sapien
taggcacagcgcgaccacgtttgcc

SEQ ID NO: 194132 - DNA, 25 bp, Homo sapien
ggagtctcaattgcccgcgtgctta

SEQ ID NO: 194133 - DNA, 25 bp, Homo sapien
cccagtgcgctggagcagctaagca

SEQ ID NO: 194134 - DNA, 25 bp, Homo sapien
tgggcatgcgcattgcctcagtcta

SEQ ID NO: 194135 - DNA, 25 bp, Homo sapien
ttaaggcgcgacctgcctccagcga

SEQ ID NO: 194136 - DNA, 25 bp, Homo sapien
gcaaacccacgacgggcaaggtctc

SEQ ID NO: 194137 - DNA, 25 bp, Homo sapien
gacgcggactcgaacgcagttgctt

SEQ ID NO: 194138 - DNA, 25 bp, Homo sapien
cgccgcctcccggtgagtttctgtg

SEQ ID NO: 194139 - DNA, 25 bp, Homo sapien
acgcagttgcttcgggacccaggac

SEQ ID NO: 194140 - DNA, 25 bp, Homo sapien
ccaggaaagactgaggccgcggcct

SEQ ID NO: 194141 - DNA, 25 bp, Homo sapien
ggcccgacccgccaggaaagactga

SEQ ID NO: 194142 - DNA, 25 bp, Homo sapien
ccgggactcttaaggcgcgacctgc

SEQ ID NO: 194143 - DNA, 25 bp, Homo sapien
acgtctcctgcggtgcttgcttgcg

SEQ ID NO: 194144 - DNA, 25 bp, Homo sapien
gtcaccgagcgccagagcgagtcac

SEQ ID NO: 194145 - DNA, 25 bp, Homo sapien
gccggaacttggacaccctgaagcg

SEQ ID NO: 194146 - DNA, 25 bp, Homo sapien
caggtgcacgctgagcaaccgcgac

SEQ ID NO: 194147 - DNA, 25 bp, Homo sapien
cgccctgataccgaggggacggact

SEQ ID NO: 194148 - DNA, 25 bp, Homo sapien
accctgaagcggttcatggcgacgg

SEQ ID NO: 194149 - DNA, 25 bp, Homo sapien
taaagaaagagcttgcgccagcggc

SEQ ID NO: 194150 - DNA, 25 bp, Homo sapien
cactgacacacttgggctcgccggg

SEQ ID NO: 194151 - DNA, 25 bp, Homo sapien
ttccaacttccgagtggcggtttca

SEQ ID NO: 194152 - DNA, 25 bp, Homo sapien
cagggcctagaaaagagtgagtctc

SEQ ID NO: 194153 - DNA, 25 bp, Homo sapien
cttccgacgcggatgcacaattgcc

SEQ ID NO: 194154 - DNA, 25 bp, Homo sapien
tgcacggcgagtctacctaacaaca

SEQ ID NO: 194155 - DNA, 25 bp, Homo sapien
cccattggttgtctagcacagaata

SEQ ID NO: 194156 - DNA, 25 bp, Homo sapien
cgcggagacggcatgagtaaaactc

SEQ ID NO: 194157 - DNA, 25 bp, Homo sapien
cccgagcgctgctgacattgagacc

SEQ ID NO: 194158 - DNA, 25 bp, Homo sapien
caattcgtcgtaagtctcagggtca

SEQ ID NO: 194159 - DNA, 25 bp, Homo sapien
gacgaatccggtccagagatctggg

SEQ ID NO: 194160 - DNA, 25 bp, Homo sapien
gccaatcccgacgtgtcggccgaaa

SEQ ID NO: 194161 - DNA, 25 bp, Homo sapien
ggagctgcgcgctaggcgccaactc

SEQ ID NO: 194162 - DNA, 25 bp, Homo sapien
attctgcggccgagtccactgcaga

SEQ ID NO: 194163 - DNA, 25 bp, Homo sapien
cgcctgtcccgagatatcggggtcc

SEQ ID NO: 194164 - DNA, 25 bp, Homo sapien
ggcaagacgcctgtcccgagatatc

SEQ ID NO: 194165 - DNA, 25 bp, Homo sapien
ttcccgccaggagcgacaaaggaca

SEQ ID NO: 194166 - DNA, 25 bp, Homo sapien
cccattgtctatgcatcgagtatgt

SEQ ID NO: 194167 - DNA, 25 bp, Homo sapien
cacggaccggggttcgcatctcgga

SEQ ID NO: 194168 - DNA, 25 bp, Homo sapien
acgggcgacacgcaccggtgtttgc

SEQ ID NO: 194169 - DNA, 25 bp, Homo sapien
caccggtgtttgcatctcggagcag

SEQ ID NO: 194170 - DNA, 25 bp, Homo sapien
accggggttcgcatctcggagcagc

SEQ ID NO: 194171 - DNA, 25 bp, Homo sapien
gggcgacacgcaccggtgtttgcat

SEQ ID NO: 194172 - DNA, 25 bp, Homo sapien
accggtgtttgcatctcggagcagc

SEQ ID NO: 194173 - DNA, 25 bp, Homo sapien
acacggaccggggttcgcatctcgg

SEQ ID NO: 194174 - DNA, 25 bp, Homo sapien
acaccggtgtttgcatctcggagca

SEQ ID NO: 194175 - DNA, 25 bp, Homo sapien
cggcccttttcagccgtgagaacta

SEQ ID NO: 194176 - DNA, 25 bp, Homo sapien
gctgtctcaagcttctcggggtttt

SEQ ID NO: 194177 - DNA, 25 bp, Homo sapien
tcggcaccaagactcgctacgagga

SEQ ID NO: 194178 - DNA, 25 bp, Homo sapien
tgcggctcatcaccagttccaagca

SEQ ID NO: 194179 - DNA, 25 bp, Homo sapien
ctgcatggatagcagcgccgccttc

SEQ ID NO: 194180 - DNA, 25 bp, Homo sapien
gtggcagcactaccaccctggcttg

SEQ ID NO: 194181 - DNA, 25 bp, Homo sapien
ctcctagagaacagcgaagcgcatc

SEQ ID NO: 194182 - DNA, 25 bp, Homo sapien
ccgccagaggttggtacctcctaga

SEQ ID NO: 194183 - DNA, 25 bp, Homo sapien
tctcccagcgtcacggctatgctgg

SEQ ID NO: 194184 - DNA, 25 bp, Homo sapien
ggaggcctgaatggctctctttggc

SEQ ID NO: 194185 - DNA, 25 bp, Homo sapien
ggacgccgctctccagaagtcgtct

SEQ ID NO: 194186 - DNA, 25 bp, Homo sapien
caggccttcggacctgggcttggcc

SEQ ID NO: 194187 - DNA, 25 bp, Homo sapien
ctcggtccaggccttcggacctggg

SEQ ID NO: 194188 - DNA, 25 bp, Homo sapien
acaaggggcgtgtcatctctaggcc

SEQ ID NO: 194189 - DNA, 25 bp, Homo sapien
cccggcaagggcgtgtcagctacaa

SEQ ID NO: 194190 - DNA, 25 bp, Homo sapien
cctgaatggctctctttggcgtccc

SEQ ID NO: 194191 - DNA, 25 bp, Homo sapien
tggcaatttccacaaccttccctga

SEQ ID NO: 194192 - DNA, 25 bp, Homo sapien
cctgcaagacggagatggcaatttc

SEQ ID NO: 194193 - DNA, 25 bp, Homo sapien
cgcccagaggcttctaggacttgta

SEQ ID NO: 194194 - DNA, 25 bp, Homo sapien
aagccgtctccgaatgcgtccagtc

SEQ ID NO: 194195 - DNA, 25 bp, Homo sapien
gaatgcgtccagtcgactcaccgtc

SEQ ID NO: 194196 - DNA, 25 bp, Homo sapien
agctggcagtcgcacttctgtcaca

SEQ ID NO: 194197 - DNA, 25 bp, Homo sapien
ctgtcacaaggaggcgggtagactt

SEQ ID NO: 194198 - DNA, 25 bp, Homo sapien
acaacccgctctgagaggctgggga

SEQ ID NO: 194199 - DNA, 25 bp, Homo sapien
cagctgcgtgttctggcaccagacg

SEQ ID NO: 194200 - DNA, 25 bp, Homo sapien
tctgaagttctgtccgccaggcacc

SEQ ID NO: 194201 - DNA, 25 bp, Homo sapien
acgtgtccctgcctggctagagtcc

SEQ ID NO: 194202 - DNA, 25 bp, Homo sapien
tgttctggcaccagacgtgtccctg

SEQ ID NO: 194203 - DNA, 25 bp, Homo sapien
ccgctggggccatgaccttgcgtgt

SEQ ID NO: 194204 - DNA, 25 bp, Homo sapien
aggccgcgctgaaccactccatgtg

SEQ ID NO: 194205 - DNA, 25 bp, Homo sapien
ctgcgtggtctctgaagttctgtcc

SEQ ID NO: 194206 - DNA, 25 bp, Homo sapien
tgaaccactccatgtgccggggccg

SEQ ID NO: 194207 - DNA, 25 bp, Homo sapien
tctttgctaagacctagggaccctg

SEQ ID NO: 194208 - DNA, 25 bp, Homo sapien
tggcatcgctctgtgttaaatagta

SEQ ID NO: 194209 - DNA, 25 bp, Homo sapien
aggcacgtccatgtcgccctcattg

SEQ ID NO: 194210 - DNA, 25 bp, Homo sapien
cacagatctgtgcatgggcgcaaac

SEQ ID NO: 194211 - DNA, 25 bp, Homo sapien
acggtgtctgaaaactgagtgccta

SEQ ID NO: 194212 - DNA, 25 bp, Homo sapien
ccacgtctgtgcatgggcgcaaatg

SEQ ID NO: 194213 - DNA, 25 bp, Homo sapien
ctcaggttcgtgcataggcgttttt

SEQ ID NO: 194214 - DNA, 25 bp, Homo sapien
ccgtgtctgaactgtgagcgcctac

SEQ ID NO: 194215 - DNA, 25 bp, Homo sapien
tatcgctaccctccgaagtccggtg

SEQ ID NO: 194216 - DNA, 25 bp, Homo sapien
tccaggcgaactcggcctatcgcta

SEQ ID NO: 194217 - DNA, 25 bp, Homo sapien
aggaacctgcccgagccgtacctgg

SEQ ID NO: 194218 - DNA, 25 bp, Homo sapien
ctcagctccgtccttgcaacagggg

SEQ ID NO: 194219 - DNA, 25 bp, Homo sapien
ccggcgcatcgcttctgcctagaaa

SEQ ID NO: 194220 - DNA, 25 bp, Homo sapien
tgcctagaaaactctcattgtcatc

SEQ ID NO: 194221 - DNA, 25 bp, Homo sapien
tcatcagattgacctcaccgcgggg

SEQ ID NO: 194222 - DNA, 25 bp, Homo sapien
tggaggacatcgacatccaggcgaa

SEQ ID NO: 194223 - DNA, 25 bp, Homo sapien
acgtgaggttgaggaccatgtattc

SEQ ID NO: 194224 - DNA, 25 bp, Homo sapien
tcccagaagtccctgcaatacgtga

SEQ ID NO: 194225 - DNA, 25 bp, Homo sapien
gaccatgtattctgagcatccttga

SEQ ID NO: 194226 - DNA, 25 bp, Homo sapien
tccttgaaatccacaggtccctgca

SEQ ID NO: 194227 - DNA, 25 bp, Homo sapien
tctgggcgtcaggtcaggaatccag

SEQ ID NO: 194228 - DNA, 25 bp, Homo sapien
tctcagtgttccttggcagggctgt

SEQ ID NO: 194229 - DNA, 25 bp, Homo sapien
gtctctgaggatgcccagctgtcca

SEQ ID NO: 194230 - DNA, 25 bp, Homo sapien
aggccatgctctcagtgttccttgg

SEQ ID NO: 194231 - DNA, 25 bp, Homo sapien
ctactgccaggcatcggaggagttc

SEQ ID NO: 194232 - DNA, 25 bp, Homo sapien
gcatcggaggagttcctgaacggca

SEQ ID NO: 194233 - DNA, 25 bp, Homo sapien
gtggccatcaccatctactgccagg

SEQ ID NO: 194234 - DNA, 25 bp, Homo sapien
ggagttcaccttcgacgccgatgcc

SEQ ID NO: 194235 - DNA, 25 bp, Homo sapien
tacagcctggagttcaccttcgacg

SEQ ID NO: 194236 - DNA, 25 bp, Homo sapien
cccgggtgctctacagcctggagtt

SEQ ID NO: 194237 - DNA, 25 bp, Homo sapien
tctccaccgcctggggtaggtacaa

SEQ ID NO: 194238 - DNA, 25 bp, Homo sapien
taggtacaaagacgatgccgacagc

SEQ ID NO: 194239 - DNA, 25 bp, Homo sapien
gctgctgcgttttgcaatcgcgccc

SEQ ID NO: 194240 - DNA, 25 bp, Homo sapien
aatggacgttgcaggcggaactaac

SEQ ID NO: 194241 - DNA, 25 bp, Homo sapien
gaaaagctctcggtccgtgggcgaa

SEQ ID NO: 194242 - DNA, 25 bp, Homo sapien
ctctcggtccgtgggcgaaacgcca

SEQ ID NO: 194243 - DNA, 25 bp, Homo sapien
ggcgaaacgccaggtgcgctggccc

SEQ ID NO: 194244 - DNA, 25 bp, Homo sapien
cgttgcaggcggaactaacgtcgct

SEQ ID NO: 194245 - DNA, 25 bp, Homo sapien
gcggaactaacgtcgctgctgcgtt

SEQ ID NO: 194246 - DNA, 25 bp, Homo sapien
aacgtcgctgctgcgttttgcaatc

SEQ ID NO: 194247 - DNA, 25 bp, Homo sapien
tcgcggctatcgaccacatcctgga

SEQ ID NO: 194248 - DNA, 25 bp, Homo sapien
cgtcccacctggctacgagcccatc

SEQ ID NO: 194249 - DNA, 25 bp, Homo sapien
aggcatctcggacggcctgtcccag

SEQ ID NO: 194250 - DNA, 25 bp, Homo sapien
cacctattcaggcatctcggacggc

SEQ ID NO: 194251 - DNA, 25 bp, Homo sapien
ctctttatgaagaaatcacctattc

SEQ ID NO: 194252 - DNA, 25 bp, Homo sapien
cgctcaacggcctccgggctgtctc

SEQ ID NO: 194253 - DNA, 25 bp, Homo sapien
tacgagcccatctcgctgctcgagg

SEQ ID NO: 194254 - DNA, 25 bp, Homo sapien
gcggctatcgaccacatcctggaca

SEQ ID NO: 194255 - DNA, 25 bp, Homo sapien
tgggcaccctccatgcccacgagga

SEQ ID NO: 194256 - DNA, 25 bp, Homo sapien
tcattcgtggttcccctggagcctt

SEQ ID NO: 194257 - DNA, 25 bp, Homo sapien
tgcctcaggcctgtcggttctcgta

SEQ ID NO: 194258 - DNA, 25 bp, Homo sapien
ccctggagccttgcggtgtatagag

SEQ ID NO: 194259 - DNA, 25 bp, Homo sapien
tcaggcctgtcggttctcgtagaag

SEQ ID NO: 194260 - DNA, 25 bp, Homo sapien
ctgtcggttctcgtagaagagtgtc

SEQ ID NO: 194261 - DNA, 25 bp, Homo sapien
tcggttctcgtagaagagtgtcagg

SEQ ID NO: 194262 - DNA, 25 bp, Homo sapien
tctcgtagaagagtgtcaggaaggc

SEQ ID NO: 194263 - DNA, 25 bp, Homo sapien
cactgagaacgcaggccctaaattc

SEQ ID NO: 194264 - DNA, 25 bp, Homo sapien
tggacgtctcacaagatattacatg

SEQ ID NO: 194265 - DNA, 25 bp, Homo sapien
cgtgaaaatggccagagtgactctt

SEQ ID NO: 194266 - DNA, 25 bp, Homo sapien
attcatcaccctgcgtggcgtcatg

SEQ ID NO: 194267 - DNA, 25 bp, Homo sapien
ctgtatgatatccagctgggcctgc

SEQ ID NO: 194268 - DNA, 25 bp, Homo sapien
gcgcgacgtctagcctctgtatgat

SEQ ID NO: 194269 - DNA, 25 bp, Homo sapien
gtgttccactgcgtggcgcacacca

SEQ ID NO: 194270 - DNA, 25 bp, Homo sapien
ggcgtcatgctcaaatctgtccgtg

SEQ ID NO: 194271 - DNA, 25 bp, Homo sapien
aagaggctctgtgtggaattcccgg

SEQ ID NO: 194272 - DNA, 25 bp, Homo sapien
tgcggagcctttttatacctccttc

SEQ ID NO: 194273 - DNA, 25 bp, Homo sapien
gacgtgtctgcggagcctttttata

SEQ ID NO: 194274 - DNA, 25 bp, Homo sapien
cagcatgtcggggatcaagaagcaa

SEQ ID NO: 194275 - DNA, 25 bp, Homo sapien
aaagacggtaggcttccaggcgccg

SEQ ID NO: 194276 - DNA, 25 bp, Homo sapien
cgactctgggaatctgcgctccttg

SEQ ID NO: 194277 - DNA, 25 bp, Homo sapien
ctgtgtggaattcccggggcagtcc

SEQ ID NO: 194278 - DNA, 25 bp, Homo sapien
ggggatcaagaagcaaaagacggta

SEQ ID NO: 194279 - DNA, 25 bp, Homo sapien
agaatgaggcctgcgcaagggtcct

SEQ ID NO: 194280 - DNA, 25 bp, Homo sapien
ggcgctacgctacgaaggcagcgta

SEQ ID NO: 194281 - DNA, 25 bp, Homo sapien
caagtgcacctaagagcgggagtct

SEQ ID NO: 194282 - DNA, 25 bp, Homo sapien
tggccgtttaatggcgtccctccgc

SEQ ID NO: 194283 - DNA, 25 bp, Homo sapien
ccacgcgtctgtgacgccgctgatg

SEQ ID NO: 194284 - DNA, 25 bp, Homo sapien
tgacgccaaggcattctcccgagag

SEQ ID NO: 194285 - DNA, 25 bp, Homo sapien
ccgccctgcagcctgataagcttga

SEQ ID NO: 194286 - DNA, 25 bp, Homo sapien
caggaccaagcacagcacgcagcgt

SEQ ID NO: 194287 - DNA, 25 bp, Homo sapien
cccgtgcttgttggctcttgctgag

SEQ ID NO: 194288 - DNA, 25 bp, Homo sapien
cggcttgtcctggagcggtggccgc

SEQ ID NO: 194289 - DNA, 25 bp, Homo sapien
gccgtgcctgatggcggcttgtcct

SEQ ID NO: 194290 - DNA, 25 bp, Homo sapien
agcctcggtctgtggaggcagcacc

SEQ ID NO: 194291 - DNA, 25 bp, Homo sapien
tccttagcctcggtctgtggaggca

SEQ ID NO: 194292 - DNA, 25 bp, Homo sapien
gcgcggctccttagcctcggtctgt

SEQ ID NO: 194293 - DNA, 25 bp, Homo sapien
cttgttggctcttgctgagctgcgc

SEQ ID NO: 194294 - DNA, 25 bp, Homo sapien
ttggctcttgctgagctgcgcggct

SEQ ID NO: 194295 - DNA, 25 bp, Homo sapien
ttgcagatgcagatgcgtttcgacg

SEQ ID NO: 194296 - DNA, 25 bp, Homo sapien
ctcgcgcatgctcttaagtggcagc

SEQ ID NO: 194297 - DNA, 25 bp, Homo sapien
tcagtgccaagatgtcgacggcggc

SEQ ID NO: 194298 - DNA, 25 bp, Homo sapien
atgtcaaccttgagccaccacggca

SEQ ID NO: 194299 - DNA, 25 bp, Homo sapien
tacctgagctcgcacctgaccgagg

SEQ ID NO: 194300 - DNA, 25 bp, Homo sapien
ccaaggaagatgttcgtcgcccaca

SEQ ID NO: 194301 - DNA, 25 bp, Homo sapien
accgcagggaatttcggctgtccgc

SEQ ID NO: 194302 - DNA, 25 bp, Homo sapien
tgcatggcaggcgaaggccatctcc

SEQ ID NO: 194303 - DNA, 25 bp, Homo sapien
ctgttggcgtctggttgccataaca

SEQ ID NO: 194304 - DNA, 25 bp, Homo sapien
gtcctccagtcacgcggcgagcaag

SEQ ID NO: 194305 - DNA, 25 bp, Homo sapien
aatgagctagtggtgtttgtcctgc

SEQ ID NO: 194306 - DNA, 25 bp, Homo sapien
caggggaaccaatcccattgcagga

SEQ ID NO: 194307 - DNA, 25 bp, Homo sapien
gtctagtaatgtaaagctccgctga

SEQ ID NO: 194308 - DNA, 25 bp, Homo sapien
tgcgcctgcagggagttgaacaaaa

SEQ ID NO: 194309 - DNA, 25 bp, Homo sapien
gctacggcgcacagggcattactgt

SEQ ID NO: 194310 - DNA, 25 bp, Homo sapien
ctggaggctgtttatagcgctgtca

SEQ ID NO: 194311 - DNA, 25 bp, Homo sapien
ggagggaccaccagtgctctcgctc

SEQ ID NO: 194312 - DNA, 25 bp, Homo sapien
cgccgggccctccgacaggagagaa

SEQ ID NO: 194313 - DNA, 25 bp, Homo sapien
agaaggaagatgatagagacggaca

SEQ ID NO: 194314 - DNA, 25 bp, Homo sapien
agagacggacatcctccagaaagtc

SEQ ID NO: 194315 - DNA, 25 bp, Homo sapien
tccagaaagtcacccgggatgcctg

SEQ ID NO: 194316 - DNA, 25 bp, Homo sapien
cggcccgaccagcagtgacaaaggt

SEQ ID NO: 194317 - DNA, 25 bp, Homo sapien
gagtcagctcccagatccaaaatgc

SEQ ID NO: 194318 - DNA, 25 bp, Homo sapien
acgctgcggagtcagctcccagatc

SEQ ID NO: 194319 - DNA, 25 bp, Homo sapien
ttggagcggtcgctaaagcccttcc

SEQ ID NO: 194320 - DNA, 25 bp, Homo sapien
tgctgaagttggagcggtcgctaaa

SEQ ID NO: 194321 - DNA, 25 bp, Homo sapien
accctctggtgcgtgctgaagttgg

SEQ ID NO: 194322 - DNA, 25 bp, Homo sapien
tgtgtgcaccctctggtgcgtgctg

SEQ ID NO: 194323 - DNA, 25 bp, Homo sapien
cgctgaagtgcgagctgttgttgaa

SEQ ID NO: 194324 - DNA, 25 bp, Homo sapien
tcggcaaggagcctgcccccatgtg

SEQ ID NO: 194325 - DNA, 25 bp, Homo sapien
gctaaagcccttcccacagactagg

SEQ ID NO: 194326 - DNA, 25 bp, Homo sapien
cacagactaggcacttgtaaggccg

SEQ ID NO: 194327 - DNA, 25 bp, Homo sapien
tccaggtctggcgaaccctgaagcc

SEQ ID NO: 194328 - DNA, 25 bp, Homo sapien
tttcccgtctcatccctcaggtgga

SEQ ID NO: 194329 - DNA, 25 bp, Homo sapien
gcaccattggctaagccggccgttg

SEQ ID NO: 194330 - DNA, 25 bp, Homo sapien
tccgcgacgtgcactgtggttaatg

SEQ ID NO: 194331 - DNA, 25 bp, Homo sapien
tgtggtcctcaaaggcacgcattgt

SEQ ID NO: 194332 - DNA, 25 bp, Homo sapien
cacgcattgtgggtaacgtagtcca

SEQ ID NO: 194333 - DNA, 25 bp, Homo sapien
aacgtagtccagcacctcggtgacc

SEQ ID NO: 194334 - DNA, 25 bp, Homo sapien
ggtaacgtagccgtggcaccattgg

SEQ ID NO: 194335 - DNA, 25 bp, Homo sapien
cgggtgagcagcaacgcagcataca

SEQ ID NO: 194336 - DNA, 25 bp, Homo sapien
cagcatacacagcaggcgtacactc

SEQ ID NO: 194337 - DNA, 25 bp, Homo sapien
acacagcaggcgtacactcaacgta

SEQ ID NO: 194338 - DNA, 25 bp, Homo sapien
tctttcccaaagcatcggctaggac

SEQ ID NO: 194339 - DNA, 25 bp, Homo sapien
ccaaagcatcggctaggactcagcc

SEQ ID NO: 194340 - DNA, 25 bp, Homo sapien
ggctaggactcagcccgccggaaac

SEQ ID NO: 194341 - DNA, 25 bp, Homo sapien
ctcagcccgccggaaacaaatttgg

SEQ ID NO: 194342 - DNA, 25 bp, Homo sapien
acaaatttggggacgccggattcag

SEQ ID NO: 194343 - DNA, 25 bp, Homo sapien
tattggcccgcttggctccattggt

SEQ ID NO: 194344 - DNA, 25 bp, Homo sapien
tgcccgcacacaggtacttatataa

SEQ ID NO: 194345 - DNA, 25 bp, Homo sapien
gctccattggtcgtggttccaaccc

SEQ ID NO: 194346 - DNA, 25 bp, Homo sapien
cgctcactcattggccggcaggaca

SEQ ID NO: 194347 - DNA, 25 bp, Homo sapien
cccaggatatgatagggcgctctgc

SEQ ID NO: 194348 - DNA, 25 bp, Homo sapien
tgcttcaacacagcgtgcacctcgt

SEQ ID NO: 194349 - DNA, 25 bp, Homo sapien
gtcgttaccttgaggatgtcctgca

SEQ ID NO: 194350 - DNA, 25 bp, Homo sapien
agccgcacactgtaggcgctcagga

SEQ ID NO: 194351 - DNA, 25 bp, Homo sapien
ggcaactctgcttggccgcaggccg

SEQ ID NO: 194352 - DNA, 25 bp, Homo sapien
agcgccagtgagctaccctgacgga

SEQ ID NO: 194353 - DNA, 25 bp, Homo sapien
ttcggctcgtgacaacgaagcgccc

SEQ ID NO: 194354 - DNA, 25 bp, Homo sapien
ggagcgcagagactcccggctcctt

SEQ ID NO: 194355 - DNA, 25 bp, Homo sapien
atcattggtcgaccgaggggcacgt

SEQ ID NO: 194356 - DNA, 25 bp, Homo sapien
gagcgcataaaaaggcagctccagg

SEQ ID NO: 194357 - DNA, 25 bp, Homo sapien
gatcaaagccggtgcccgacgtggc

SEQ ID NO: 194358 - DNA, 25 bp, Homo sapien
cgcccgtgttctttggagcgctcct

SEQ ID NO: 194359 - DNA, 25 bp, Homo sapien
cctgtgcgacaatcagacctggttc

SEQ ID NO: 194360 - DNA, 25 bp, Homo sapien
actcgctaaggctctgcgtttaaca

SEQ ID NO: 194361 - DNA, 25 bp, Homo sapien
gcgcacctgatgtctgcttaagcta

SEQ ID NO: 194362 - DNA, 25 bp, Homo sapien
acgcaacctgggagagaacgcttcc

SEQ ID NO: 194363 - DNA, 25 bp, Homo sapien
ggaaccagctactcacccaggggca

SEQ ID NO: 194364 - DNA, 25 bp, Homo sapien
gacgcccttggaggttaatcctcta

SEQ ID NO: 194365 - DNA, 25 bp, Homo sapien
tctaggttcgcctggttctgaagtc

SEQ ID NO: 194366 - DNA, 25 bp, Homo sapien
tacctttgggaaggcgcttatcaca

SEQ ID NO: 194367 - DNA, 25 bp, Homo sapien
tgtggttctcttccctcagaaagtc

SEQ ID NO: 194368 - DNA, 25 bp, Homo sapien
agcctcttgaggtcatccagttccc

SEQ ID NO: 194369 - DNA, 25 bp, Homo sapien
agcaccaccttctgcgtatgggtta

SEQ ID NO: 194370 - DNA, 25 bp, Homo sapien
tgctcttgagcctctggatctcttg

SEQ ID NO: 194371 - DNA, 25 bp, Homo sapien
ttccgtcgctgccatgttgatttcc

SEQ ID NO: 194372 - DNA, 25 bp, Homo sapien
tcatgttccgcaggtctcgtgtttc

SEQ ID NO: 194373 - DNA, 25 bp, Homo sapien
atgggttaccttctcacgggcctca

SEQ ID NO: 194374 - DNA, 25 bp, Homo sapien
gcaggttttgcctctccagctgtaa

SEQ ID NO: 194375 - DNA, 25 bp, Homo sapien
tacgttcgcttcacacggacgcagc

SEQ ID NO: 194376 - DNA, 25 bp, Homo sapien
acccgctcagggtttggctacagaa

SEQ ID NO: 194377 - DNA, 25 bp, Homo sapien
ccttgcttccgtgtggcattcgaga

SEQ ID NO: 194378 - DNA, 25 bp, Homo sapien
gggtcctggatgtctccgtcatgtt

SEQ ID NO: 194379 - DNA, 25 bp, Homo sapien
agcgatgtctcagatacctcggatc

SEQ ID NO: 194380 - DNA, 25 bp, Homo sapien
tcggatcacacagagcacgtcgcca

SEQ ID NO: 194381 - DNA, 25 bp, Homo sapien
tcgccaaggcttgttttgtctgttc

SEQ ID NO: 194382 - DNA, 25 bp, Homo sapien
tcgcctgcgtcctgcatgtttgagc

SEQ ID NO: 194383 - DNA, 25 bp, Homo sapien
ctccacaagctccaggcggaggttc

SEQ ID NO: 194384 - DNA, 25 bp, Homo sapien
gagatcgctgacctccctctcggtg

SEQ ID NO: 194385 - DNA, 25 bp, Homo sapien
catattggcgggtgagatcgctgac

SEQ ID NO: 194386 - DNA, 25 bp, Homo sapien
tggcagcctcgtcctcatattggcg

SEQ ID NO: 194387 - DNA, 25 bp, Homo sapien
tccctctggctagcgcgagccttgg

SEQ ID NO: 194388 - DNA, 25 bp, Homo sapien
ggcccatatctttcggagcagctcc

SEQ ID NO: 194389 - DNA, 25 bp, Homo sapien
tcctccaaggcccatatctttcgga

SEQ ID NO: 194390 - DNA, 25 bp, Homo sapien
gcggaggttcgccacttcactttcc

SEQ ID NO: 194391 - DNA, 25 bp, Homo sapien
gcacagtggggctgtatttgccttt

SEQ ID NO: 194392 - DNA, 25 bp, Homo sapien
gagtcccgcactccgggttcagttc

SEQ ID NO: 194393 - DNA, 25 bp, Homo sapien
ggccctcaaggcaatgctccctggg

SEQ ID NO: 194394 - DNA, 25 bp, Homo sapien
ctctgcgcaagagcgaccctgggac

SEQ ID NO: 194395 - DNA, 25 bp, Homo sapien
cgccaggaacacttgcgcggtctca

SEQ ID NO: 194396 - DNA, 25 bp, Homo sapien
tcctgaagagcgagttcatggtggc

SEQ ID NO: 194397 - DNA, 25 bp, Homo sapien
ctcatccaggtgactattcccggtc

SEQ ID NO: 194398 - DNA, 25 bp, Homo sapien
cattcctacactgcccgggaggtct

SEQ ID NO: 194399 - DNA, 25 bp, Homo sapien
ttcccgtctgataagtgacacagca

SEQ ID NO: 194400 - DNA, 25 bp, Homo sapien
ctagctggtggaacgattgttggta

SEQ ID NO: 194401 - DNA, 25 bp, Homo sapien
cgtctgataagtgacacagcagata

SEQ ID NO: 194402 - DNA, 25 bp, Homo sapien
gctgcctttcccgtctgataagtga

SEQ ID NO: 194403 - DNA, 25 bp, Homo sapien
taacaggtgctagctggtggaacga

SEQ ID NO: 194404 - DNA, 25 bp, Homo sapien
cctacgagaagcgtttccccacgtg

SEQ ID NO: 194405 - DNA, 25 bp, Homo sapien
acacagcagataaggaggtcgcgct

SEQ ID NO: 194406 - DNA, 25 bp, Homo sapien
ctggtggaacgattgttggtaatga

SEQ ID NO: 194407 - DNA, 25 bp, Homo sapien
aacgagcactgcagctacacggtga

SEQ ID NO: 194408 - DNA, 25 bp, Homo sapien
tgagcacgtggtcttcgtgcagaca

SEQ ID NO: 194409 - DNA, 25 bp, Homo sapien
tcgtgcagacaaacatcttgaactg

SEQ ID NO: 194410 - DNA, 25 bp, Homo sapien
acatcttgaactggaaggagaggac

SEQ ID NO: 194411 - DNA, 25 bp, Homo sapien
tcgccaaccgcgtggtggtgaacga

SEQ ID NO: 194412 - DNA, 25 bp, Homo sapien
agaggacgctcctcatcgaagcgca

SEQ ID NO: 194413 - DNA, 25 bp, Homo sapien
agcgcacaatgagaccttcgccaac

SEQ ID NO: 194414 - DNA, 25 bp, Homo sapien
ttcccttgcagatcgcaggtgttga

SEQ ID NO: 194415 - DNA, 25 bp, Homo sapien
cactcgcccgagttcatgcggaaga

SEQ ID NO: 194416 - DNA, 25 bp, Homo sapien
cggactgaattacctgcgctctttt

SEQ ID NO: 194417 - DNA, 25 bp, Homo sapien
gtggccgctttcagctcggactgaa

SEQ ID NO: 194418 - DNA, 25 bp, Homo sapien
acccgtggaggtcgccatattggac

SEQ ID NO: 194419 - DNA, 25 bp, Homo sapien
ttcccagaggaagccgaatagtgca

SEQ ID NO: 194420 - DNA, 25 bp, Homo sapien
tccctgaagtgcgacacgaaggtgc

SEQ ID NO: 194421 - DNA, 25 bp, Homo sapien
cggatcccgaactgcgcgttctgca

SEQ ID NO: 194422 - DNA, 25 bp, Homo sapien
aggccaactctcgtgctcgcggttg

SEQ ID NO: 194423 - DNA, 25 bp, Homo sapien
accctcctggggttctgcagtgagt

SEQ ID NO: 194424 - DNA, 25 bp, Homo sapien
agatggcggcctcatgcttggtcct

SEQ ID NO: 194425 - DNA, 25 bp, Homo sapien
cagtaccacgcgctgtcgttggcca

SEQ ID NO: 194426 - DNA, 25 bp, Homo sapien
cgttggccatgcacggcttctcggt

SEQ ID NO: 194427 - DNA, 25 bp, Homo sapien
ggagggacgatgctctctcagccgt

SEQ ID NO: 194428 - DNA, 25 bp, Homo sapien
agtgctcctttagtcgccgcctttg

SEQ ID NO: 194429 - DNA, 25 bp, Homo sapien
ttgggcagctctccgagattagacg

SEQ ID NO: 194430 - DNA, 25 bp, Homo sapien
tcagccgttgatcctcggttctaac

SEQ ID NO: 194431 - DNA, 25 bp, Homo sapien
accagggtaagcctgcctcggtgcc

SEQ ID NO: 194432 - DNA, 25 bp, Homo sapien
taccgtaggagatgatggccgtgct

SEQ ID NO: 194433 - DNA, 25 bp, Homo sapien
cccgaggtcacctgttagtgaagac

SEQ ID NO: 194434 - DNA, 25 bp, Homo sapien
ttagtgaagactgccgggttctcga

SEQ ID NO: 194435 - DNA, 25 bp, Homo sapien
ctctcggagagtgtgaccgagcctc

SEQ ID NO: 194436 - DNA, 25 bp, Homo sapien
cgtgtctgcgactgcaccagggtaa

SEQ ID NO: 194437 - DNA, 25 bp, Homo sapien
gtcccatgtgaccaggcctgtggta

SEQ ID NO: 194438 - DNA, 25 bp, Homo sapien
tcgatggcccattctgcaaggtaga

SEQ ID NO: 194439 - DNA, 25 bp, Homo sapien
ggccaggatgattgttatgagggcg

SEQ ID NO: 194440 - DNA, 25 bp, Homo sapien
gatgattgttatgagggcggggcct

SEQ ID NO: 194441 - DNA, 25 bp, Homo sapien
aggatgattgttatgagggcggggc

SEQ ID NO: 194442 - DNA, 25 bp, Homo sapien
caggatgattgttatgagggcgggg

SEQ ID NO: 194443 - DNA, 25 bp, Homo sapien
ccaggatgattgttatgagggcggg

SEQ ID NO: 194444 - DNA, 25 bp, Homo sapien
ggtcacctggtccttttcacctgtg

SEQ ID NO: 194445 - DNA, 25 bp, Homo sapien
tctctaggcaaaggctgttacagtc

SEQ ID NO: 194446 - DNA, 25 bp, Homo sapien
cgctggcgacacaatagcaggttgc

SEQ ID NO: 194447 - DNA, 25 bp, Homo sapien
tccacgccgcggaaatctaggggta

SEQ ID NO: 194448 - DNA, 25 bp, Homo sapien
tcctcgcctcgcgttgctgcaaaag

SEQ ID NO: 194449 - DNA, 25 bp, Homo sapien
caggcagctacactgggcatgctca

SEQ ID NO: 194450 - DNA, 25 bp, Homo sapien
tgcgctcagttctctcctctcggaa

SEQ ID NO: 194451 - DNA, 25 bp, Homo sapien
tatgtgttcacgttcagcacgctcg

SEQ ID NO: 194452 - DNA, 25 bp, Homo sapien
aggagccccgttggactctgcggct

SEQ ID NO: 194453 - DNA, 25 bp, Homo sapien
gccaggagccccgttggactctgcg

SEQ ID NO: 194454 - DNA, 25 bp, Homo sapien
acgggtaggggagagcgaccgcctg

SEQ ID NO: 194455 - DNA, 25 bp, Homo sapien
ctgtctgggacttttgtcggtccca

SEQ ID NO: 194456 - DNA, 25 bp, Homo sapien
atctgtctgggacttttgtcggtcc

SEQ ID NO: 194457 - DNA, 25 bp, Homo sapien
tctggccacgggtaggggagagcga

SEQ ID NO: 194458 - DNA, 25 bp, Homo sapien
ctgggacttttgtcggtcccacctg

SEQ ID NO: 194459 - DNA, 25 bp, Homo sapien
catctgtctgggacttttgtcggtc

SEQ ID NO: 194460 - DNA, 25 bp, Homo sapien
tgggtcaggtccagaaggtctcatg

SEQ ID NO: 194461 - DNA, 25 bp, Homo sapien
ggcggagtcattgcctctgcaccca

SEQ ID NO: 194462 - DNA, 25 bp, Homo sapien
tcgccgggagttctaggtaagtcca

SEQ ID NO: 194463 - DNA, 25 bp, Homo sapien
tacaagcgctcttgctggccgtctg

SEQ ID NO: 194464 - DNA, 25 bp, Homo sapien
gcgctgccctgaagtggttctccaa

SEQ ID NO: 194465 - DNA, 25 bp, Homo sapien
actccgagcttcttgcccaggcaga

SEQ ID NO: 194466 - DNA, 25 bp, Homo sapien
ggattgagagtccttgcgctccaga

SEQ ID NO: 194467 - DNA, 25 bp, Homo sapien
cgccgcctccagcttatggtgagtg

SEQ ID NO: 194468 - DNA, 25 bp, Homo sapien
aggtgccctggtcagccggcagcac

SEQ ID NO: 194469 - DNA, 25 bp, Homo sapien
ttccctccatgctccgcttcgcccg

SEQ ID NO: 194470 - DNA, 25 bp, Homo sapien
gccagaggtgaccaggtccggctct

SEQ ID NO: 194471 - DNA, 25 bp, Homo sapien
aggtgaccaggtccggctctcagca

SEQ ID NO: 194472 - DNA, 25 bp, Homo sapien
gggccatggggagctccgcctcctc

SEQ ID NO: 194473 - DNA, 25 bp, Homo sapien
tccctggccgcagagaccgagtcgg

SEQ ID NO: 194474 - DNA, 25 bp, Homo sapien
gccgcagagaccgagtcggaccaca

SEQ ID NO: 194475 - DNA, 25 bp, Homo sapien
gagaccgagtcggaccacagcttcc

SEQ ID NO: 194476 - DNA, 25 bp, Homo sapien
cgcgcacgacagatgactggagtca

SEQ ID NO: 194477 - DNA, 25 bp, Homo sapien
cagctcggagctttgcaagtgcctc

SEQ ID NO: 194478 - DNA, 25 bp, Homo sapien
aaacattgggcgtctcatttggcga

SEQ ID NO: 194479 - DNA, 25 bp, Homo sapien
ccgggtgttgattgcctccttgcac

SEQ ID NO: 194480 - DNA, 25 bp, Homo sapien
tttacattgctagcacgtgggtgcc

SEQ ID NO: 194481 - DNA, 25 bp, Homo sapien
ggaggcactttgcagccgacaatga

SEQ ID NO: 194482 - DNA, 25 bp, Homo sapien
atgcccttcaggtacggcgagcgaa

SEQ ID NO: 194483 - DNA, 25 bp, Homo sapien
agccgctgtccaacgttagcgcaga

SEQ ID NO: 194484 - DNA, 25 bp, Homo sapien
catgatgcagcatcctctgacgggg

SEQ ID NO: 194485 - DNA, 25 bp, Homo sapien
cccagctttcgtgtgccttgacttt

SEQ ID NO: 194486 - DNA, 25 bp, Homo sapien
ggcgccagagagacatgatgcagca

SEQ ID NO: 194487 - DNA, 25 bp, Homo sapien
cggtgccttatgtaggttctgagga

SEQ ID NO: 194488 - DNA, 25 bp, Homo sapien
cgcttcggtgccttatgtaggttct

SEQ ID NO: 194489 - DNA, 25 bp, Homo sapien
gtctgccctcggtggctgctttcct

SEQ ID NO: 194490 - DNA, 25 bp, Homo sapien
acttacagcaggtaaggcgcgcgtc

SEQ ID NO: 194491 - DNA, 25 bp, Homo sapien
gccttgacttttatgtacttacagc

SEQ ID NO: 194492 - DNA, 25 bp, Homo sapien
ccacggttcccgagcacacattaaa

SEQ ID NO: 194493 - DNA, 25 bp, Homo sapien
ccacagtaagtggacgtgtttgcta

SEQ ID NO: 194494 - DNA, 25 bp, Homo sapien
ctggcaccgccacagtaagtggacg

SEQ ID NO: 194495 - DNA, 25 bp, Homo sapien
acgagcgctcagaccgtctctggca

SEQ ID NO: 194496 - DNA, 25 bp, Homo sapien
gcgccagagtacacaggccagacca

SEQ ID NO: 194497 - DNA, 25 bp, Homo sapien
gagcacacattaaacctgtaccctc

SEQ ID NO: 194498 - DNA, 25 bp, Homo sapien
agtacacaggccagaccacggttcc

SEQ ID NO: 194499 - DNA, 25 bp, Homo sapien
cgcccagacgcactccgagcagagc

SEQ ID NO: 194500 - DNA, 25 bp, Homo sapien
agctgtttgcgagcgcatgatggtc

SEQ ID NO: 194501 - DNA, 25 bp, Homo sapien
agtgccaggcttcccgtatccagca

SEQ ID NO: 194502 - DNA, 25 bp, Homo sapien
tgcgagcgcatgatggtcttgactc

SEQ ID NO: 194503 - DNA, 25 bp, Homo sapien
accgtgtacaacaccttcagggccg

SEQ ID NO: 194504 - DNA, 25 bp, Homo sapien
ggtcgcaccgtgtacaacaccttca

SEQ ID NO: 194505 - DNA, 25 bp, Homo sapien
aggccgcggtcgcaccgtgtacaac

SEQ ID NO: 194506 - DNA, 25 bp, Homo sapien
ttcccgtatccagcagccaccgccg

SEQ ID NO: 194507 - DNA, 25 bp, Homo sapien
cgagcgcatgatggtcttgactccc

SEQ ID NO: 194508 - DNA, 25 bp, Homo sapien
aagagacacagcgcctcccggaagg

SEQ ID NO: 194509 - DNA, 25 bp, Homo sapien
gcggcggctgaatacgctatgtaga

SEQ ID NO: 194510 - DNA, 25 bp, Homo sapien
agggccttctcctccaagagacaca

SEQ ID NO: 194511 - DNA, 25 bp, Homo sapien
aagctgatgtccacctggtccagga

SEQ ID NO: 194512 - DNA, 25 bp, Homo sapien
ggctcatatggcctggtcctgcctc

SEQ ID NO: 194513 - DNA, 25 bp, Homo sapien
cagcgcccaggctcatatggcctgg

SEQ ID NO: 194514 - DNA, 25 bp, Homo sapien
gatggagatcggtcggtgaagctcc

SEQ ID NO: 194515 - DNA, 25 bp, Homo sapien
acgctatgtagacgctgatcccagc

SEQ ID NO: 194516 - DNA, 25 bp, Homo sapien
ttgaaatccgagctcccacagatcg

SEQ ID NO: 194517 - DNA, 25 bp, Homo sapien
cgccgagcctgactttgaaatccga

SEQ ID NO: 194518 - DNA, 25 bp, Homo sapien
tcgcccgcgaccagagcgaaggcta

SEQ ID NO: 194519 - DNA, 25 bp, Homo sapien
ccagagcgaaggctacaggtgcccg

SEQ ID NO: 194520 - DNA, 25 bp, Homo sapien
gaccgcctgttatggcggccgccta

SEQ ID NO: 194521 - DNA, 25 bp, Homo sapien
atggcggccgcctaagtcccacaga

SEQ ID NO: 194522 - DNA, 25 bp, Homo sapien
cctaagtcccacagagacgggagtc

SEQ ID NO: 194523 - DNA, 25 bp, Homo sapien
ctggcgccgagcctgactttgaaat

SEQ ID NO: 194524 - DNA, 25 bp, Homo sapien
attggctgtggcgaaagcgagggcc

SEQ ID NO: 194525 - DNA, 25 bp, Homo sapien
atcggatcccgcagatcggagacgg

SEQ ID NO: 194526 - DNA, 25 bp, Homo sapien
aacccggcggatcggatcccgcaga

SEQ ID NO: 194527 - DNA, 25 bp, Homo sapien
ccgcaagtcggaacccggcggatcg

SEQ ID NO: 194528 - DNA, 25 bp, Homo sapien
ggaactcggggcgcgcatcccgcaa

SEQ ID NO: 194529 - DNA, 25 bp, Homo sapien
gagcagacacccagcgctgccggaa

SEQ ID NO: 194530 - DNA, 25 bp, Homo sapien
ggaagtcgagcagacacccagcgct

SEQ ID NO: 194531 - DNA, 25 bp, Homo sapien
cgtggcgggcgcacccattggctgt

SEQ ID NO: 194532 - DNA, 25 bp, Homo sapien
gctgtctcaggtctccctctgtaga

SEQ ID NO: 194533 - DNA, 25 bp, Homo sapien
tccgtccttgaggagcaaacctggg

SEQ ID NO: 194534 - DNA, 25 bp, Homo sapien
ctagcgctctttggttccgtgctcc

SEQ ID NO: 194535 - DNA, 25 bp, Homo sapien
acgatcagcacctgcgccatggcga

SEQ ID NO: 194536 - DNA, 25 bp, Homo sapien
tgtcccacacagcaaggtacaaggg

SEQ ID NO: 194537 - DNA, 25 bp, Homo sapien
ggcgtttagacaacccacctgagtc

SEQ ID NO: 194538 - DNA, 25 bp, Homo sapien
agcgttttcgccttagactttcttg

SEQ ID NO: 194539 - DNA, 25 bp, Homo sapien
agactttcttgggtgcaggcccaca

SEQ ID NO: 194540 - DNA, 25 bp, Homo sapien
ccctaagagcgcatgctcgaatgta

SEQ ID NO: 194541 - DNA, 25 bp, Homo sapien
tggggctatcgaccacccagggtag

SEQ ID NO: 194542 - DNA, 25 bp, Homo sapien
agcgctctgcctcttcgacgtggat

SEQ ID NO: 194543 - DNA, 25 bp, Homo sapien
tagaaactggggacatggcagcgcc

SEQ ID NO: 194544 - DNA, 25 bp, Homo sapien
caacgtgtcttgtaaggtgcggcta

SEQ ID NO: 194545 - DNA, 25 bp, Homo sapien
ccgagttcctcgtgccaacgtgtct

SEQ ID NO: 194546 - DNA, 25 bp, Homo sapien
tcgaatgtacaaggcgggcgtgatc

SEQ ID NO: 194547 - DNA, 25 bp, Homo sapien
ggctgccgctactcccaggcgttat

SEQ ID NO: 194548 - DNA, 25 bp, Homo sapien
gggctcccgcccaaaggcaaaagca

SEQ ID NO: 194549 - DNA, 25 bp, Homo sapien
cctgcacgcagagaacaggtggcca

SEQ ID NO: 194550 - DNA, 25 bp, Homo sapien
tggccaggcgggaagtactacccga

SEQ ID NO: 194551 - DNA, 25 bp, Homo sapien
cgcctagaatccttgccgctgttgc

SEQ ID NO: 194552 - DNA, 25 bp, Homo sapien
ccgagctagaagaccctgcaggatg

SEQ ID NO: 194553 - DNA, 25 bp, Homo sapien
gcttcgctccgactgagagcgcgga

SEQ ID NO: 194554 - DNA, 25 bp, Homo sapien
aggacctttgtgtccgcgccttaga

SEQ ID NO: 194555 - DNA, 25 bp, Homo sapien
aagtttttctccagcgcctaaggca

SEQ ID NO: 194556 - DNA, 25 bp, Homo sapien
ccatgcggcgccaccggaagcagag

SEQ ID NO: 194557 - DNA, 25 bp, Homo sapien
ccctgcggcgccactggaggcagag

SEQ ID NO: 194558 - DNA, 25 bp, Homo sapien
ccatgcggcgccactggaggcagag

SEQ ID NO: 194559 - DNA, 25 bp, Homo sapien
cagagggaagacacgtgccccatgc

SEQ ID NO: 194560 - DNA, 25 bp, Homo sapien
cgccaccggaagcagagggaagaca

SEQ ID NO: 194561 - DNA, 25 bp, Homo sapien
agagggaagacacgtgccccatgcg

SEQ ID NO: 194562 - DNA, 25 bp, Homo sapien
gcgccaccggaagcagagggaagac

SEQ ID NO: 194563 - DNA, 25 bp, Homo sapien
cccatgcggcgccactggaggcaga

SEQ ID NO: 194564 - DNA, 25 bp, Homo sapien
ccagtgagcatctccacgtgtgccg

SEQ ID NO: 194565 - DNA, 25 bp, Homo sapien
ggtggcaccggagcgcctcccagtt

SEQ ID NO: 194566 - DNA, 25 bp, Homo sapien
tgctcctcctgcgtgtggtggcacc

SEQ ID NO: 194567 - DNA, 25 bp, Homo sapien
ctcccagtgagcatctccacgtgtg

SEQ ID NO: 194568 - DNA, 25 bp, Homo sapien
tcccagttcctggtgttaccgcacc

SEQ ID NO: 194569 - DNA, 25 bp, Homo sapien
accctgatggacagagagacgcggc

SEQ ID NO: 194570 - DNA, 25 bp, Homo sapien
tgcgagttaccctgatggacagaga

SEQ ID NO: 194571 - DNA, 25 bp, Homo sapien
ccgatgaacagggagacgcggcaga

SEQ ID NO: 194572 - DNA, 25 bp, Homo sapien
acaacatctgcgttccttgcaggta

SEQ ID NO: 194573 - DNA, 25 bp, Homo sapien
tcggaaaccaacagcgcccgggtca

SEQ ID NO: 194574 - DNA, 25 bp, Homo sapien
atttacaactcagggcgctttgtgc

SEQ ID NO: 194575 - DNA, 25 bp, Homo sapien
tgcctgagcgctcgaatttacaact

SEQ ID NO: 194576 - DNA, 25 bp, Homo sapien
agtccgcctcccaacctgggtgaga

SEQ ID NO: 194577 - DNA, 25 bp, Homo sapien
tttcgcacggttgcaagcgcacacc

SEQ ID NO: 194578 - DNA, 25 bp, Homo sapien
ttgcaggtattttcgaacgtaagcc

SEQ ID NO: 194579 - DNA, 25 bp, Homo sapien
ccgacgctaggcagtgctgttagaa

SEQ ID NO: 194580 - DNA, 25 bp, Homo sapien
atgtcacatccgcatggggggccgc

SEQ ID NO: 194581 - DNA, 25 bp, Homo sapien
cgtgaaatgtcacatccgcatgggg

SEQ ID NO: 194582 - DNA, 25 bp, Homo sapien
tggcggcggcgtgaaatgtcacatc

SEQ ID NO: 194583 - DNA, 25 bp, Homo sapien
gcggcggcgtgaaatgtcacatccg

SEQ ID NO: 194584 - DNA, 25 bp, Homo sapien
ggcggcgtgaaatgtcacatccgca

SEQ ID NO: 194585 - DNA, 25 bp, Homo sapien
cggcgtgaaatgtcacatccgcatg

SEQ ID NO: 194586 - DNA, 25 bp, Homo sapien
aatggcggcggcgtgaaatgtcaca

SEQ ID NO: 194587 - DNA, 25 bp, Homo sapien
ggcgtgaaatgtcacatccgcatgg

SEQ ID NO: 194588 - DNA, 25 bp, Homo sapien
ctgttattgtcgttacttacccttg

SEQ ID NO: 194589 - DNA, 25 bp, Homo sapien
ggttcaggtcccagcctagcgcgcc

SEQ ID NO: 194590 - DNA, 25 bp, Homo sapien
agcttggggtcagcgcctagaagtt

SEQ ID NO: 194591 - DNA, 25 bp, Homo sapien
ggtcagcgcctagaagttcctgtta

SEQ ID NO: 194592 - DNA, 25 bp, Homo sapien
aaagacccaggagcggcaatgagga

SEQ ID NO: 194593 - DNA, 25 bp, Homo sapien
tgtcgttacttacccttgcccgctg

SEQ ID NO: 194594 - DNA, 25 bp, Homo sapien
cccgaaagacccaggagcggcaatg

SEQ ID NO: 194595 - DNA, 25 bp, Homo sapien
gcgcctagaagttcctgttattgtc

SEQ ID NO: 194596 - DNA, 25 bp, Homo sapien
ttggctcggacgcaaccactgtcag

SEQ ID NO: 194597 - DNA, 25 bp, Homo sapien
caggagccgcactcgactttgcatc

SEQ ID NO: 194598 - DNA, 25 bp, Homo sapien
cggatccgactaataggggcccttg

SEQ ID NO: 194599 - DNA, 25 bp, Homo sapien
gcggtgcttctcctgtcagcatgtg

SEQ ID NO: 194600 - DNA, 25 bp, Homo sapien
gtgcgcatgcgcatcccttctagct

SEQ ID NO: 194601 - DNA, 25 bp, Homo sapien
ggcagacaggccgaagaaccaatca

SEQ ID NO: 194602 - DNA, 25 bp, Homo sapien
cagggcctgtacacgccggaaaagc

SEQ ID NO: 194603 - DNA, 25 bp, Homo sapien
cccagccaattggttacgtcaggca

SEQ ID NO: 194604 - DNA, 25 bp, Homo sapien
ctgcgcacttcctcagactgctgta

SEQ ID NO: 194605 - DNA, 25 bp, Homo sapien
ctcccagacggacgtggactgtaca

SEQ ID NO: 194606 - DNA, 25 bp, Homo sapien
tctccctctgggacgtacctgtagc

SEQ ID NO: 194607 - DNA, 25 bp, Homo sapien
gcacagccctgcgtacctgcaaata

SEQ ID NO: 194608 - DNA, 25 bp, Homo sapien
tgttgccaagtcctaggtgcacgtg

SEQ ID NO: 194609 - DNA, 25 bp, Homo sapien
agcctttctactgcgggcgctgttg

SEQ ID NO: 194610 - DNA, 25 bp, Homo sapien
ctgcagtctgcagtgctcacaagcc

SEQ ID NO: 194611 - DNA, 25 bp, Homo sapien
actccaagaggcctcgacgttcctg

SEQ ID NO: 194612 - DNA, 25 bp, Homo sapien
gttcccgtcgcatgtggagcccgca

SEQ ID NO: 194613 - DNA, 25 bp, Homo sapien
cctctgctctccgtttcaggctgtg

SEQ ID NO: 194614 - DNA, 25 bp, Homo sapien
tgctctccgtttcaggctgtgcacc

SEQ ID NO: 194615 - DNA, 25 bp, Homo sapien
cacctgcatgcctgtggcacgagtg

SEQ ID NO: 194616 - DNA, 25 bp, Homo sapien
cacgagtgggcacacgtgttcccgt

SEQ ID NO: 194617 - DNA, 25 bp, Homo sapien
cccgcggcagcccacagccctctgc

SEQ ID NO: 194618 - DNA, 25 bp, Homo sapien
ggcacacgtgttcccgtcgcatgtg

SEQ ID NO: 194619 - DNA, 25 bp, Homo sapien
acacgtgttcccgtcgcatgtggag

SEQ ID NO: 194620 - DNA, 25 bp, Homo sapien
ccgggagaccagacgctagtcaata

SEQ ID NO: 194621 - DNA, 25 bp, Homo sapien
aggcgctagtcaatacacgcaatcc

SEQ ID NO: 194622 - DNA, 25 bp, Homo sapien
aatcccactctaccaggagaccggg

SEQ ID NO: 194623 - DNA, 25 bp, Homo sapien
aggagaccgggcactcgccaacaca

SEQ ID NO: 194624 - DNA, 25 bp, Homo sapien
gaccaggcgctcgtcaatacactca

SEQ ID NO: 194625 - DNA, 25 bp, Homo sapien
caggcgctagtcaatacacgcaatc

SEQ ID NO: 194626 - DNA, 25 bp, Homo sapien
caggcgctcgtcaatacactcaatc

SEQ ID NO: 194627 - DNA, 25 bp, Homo sapien
gagaccaggcgctagtcaatacacg

SEQ ID NO: 194628 - DNA, 25 bp, Homo sapien
gcattgactaaagattacaggaaga

SEQ ID NO: 194629 - DNA, 25 bp, Homo sapien
cctcttcttctgtctagtatgatca

SEQ ID NO: 194630 - DNA, 25 bp, Homo sapien
agaggaagatttgccctcctacttc

SEQ ID NO: 194631 - DNA, 25 bp, Homo sapien
tggtgaaggctccaagatggccatc

SEQ ID NO: 194632 - DNA, 25 bp, Homo sapien
cccagcatccatataagtcacgctg

SEQ ID NO: 194633 - DNA, 25 bp, Homo sapien
ataagtcacgctgcacctttggcac

SEQ ID NO: 194634 - DNA, 25 bp, Homo sapien
cggacaaatgaacctcgccccagag

SEQ ID NO: 194635 - DNA, 25 bp, Homo sapien
tgtctagtatgatcacagtgattgg

SEQ ID NO: 194636 - DNA, 25 bp, Homo sapien
tgccattggtccataatcagctggg

SEQ ID NO: 194637 - DNA, 25 bp, Homo sapien
tgggcgtagggagacctacttcagc

SEQ ID NO: 194638 - DNA, 25 bp, Homo sapien
gtcctggccggaccagcattgttaa

SEQ ID NO: 194639 - DNA, 25 bp, Homo sapien
cctaccggacgtttgcggcgaagct

SEQ ID NO: 194640 - DNA, 25 bp, Homo sapien
ggcgaagctgccctgactgaaaagc

SEQ ID NO: 194641 - DNA, 25 bp, Homo sapien
tctccaccgttttcgcagagggata

SEQ ID NO: 194642 - DNA, 25 bp, Homo sapien
gcccactctagctggctgtgcctga

SEQ ID NO: 194643 - DNA, 25 bp, Homo sapien
ctgccgcatattcgcgctgccattg

SEQ ID NO: 194644 - DNA, 25 bp, Homo sapien
ctgctcccggtccagtaagtggagg

SEQ ID NO: 194645 - DNA, 25 bp, Homo sapien
aagaagtcgctcctcgccgctcggg

SEQ ID NO: 194646 - DNA, 25 bp, Homo sapien
gggaatccctcacgcgacctgggga

SEQ ID NO: 194647 - DNA, 25 bp, Homo sapien
cctgcttcggctcaaaaggcgtggg

SEQ ID NO: 194648 - DNA, 25 bp, Homo sapien
ctcaaaaggcgtgggaagctgtccc

SEQ ID NO: 194649 - DNA, 25 bp, Homo sapien
tcccgggatggcgaagtggaattct

SEQ ID NO: 194650 - DNA, 25 bp, Homo sapien
ttactgtcaccaattccgggggctg

SEQ ID NO: 194651 - DNA, 25 bp, Homo sapien
cacctcggccctcccgttactgtca

SEQ ID NO: 194652 - DNA, 25 bp, Homo sapien
tccagccggcacttggtcatgacca

SEQ ID NO: 194653 - DNA, 25 bp, Homo sapien
atgcccatgcacttctccttgtcga

SEQ ID NO: 194654 - DNA, 25 bp, Homo sapien
ccttgatggcgagctcgtgctccag

SEQ ID NO: 194655 - DNA, 25 bp, Homo sapien
agctgcagcgtgtcctgtgtctccc

SEQ ID NO: 194656 - DNA, 25 bp, Homo sapien
cgcagccgcagcttgagggtctgca

SEQ ID NO: 194657 - DNA, 25 bp, Homo sapien
ggtgtcgtcgatggtgaacacctcg

SEQ ID NO: 194658 - DNA, 25 bp, Homo sapien
ctccttgtcgatgcagagggtgttg

SEQ ID NO: 194659 - DNA, 25 bp, Homo sapien
gggaaggtcttacgcatgcccatgc

SEQ ID NO: 194660 - DNA, 25 bp, Homo sapien
cgtgtgttagactttggacctggcc

SEQ ID NO: 194661 - DNA, 25 bp, Homo sapien
cgtggtgtatgatgacgccacgccg

SEQ ID NO: 194662 - DNA, 25 bp, Homo sapien
tgccgggtatgtggggcgtgtgtta

SEQ ID NO: 194663 - DNA, 25 bp, Homo sapien
tgtgttagactttggacctggcctg

SEQ ID NO: 194664 - DNA, 25 bp, Homo sapien
ttagactttggacctggcctgcggg

SEQ ID NO: 194665 - DNA, 25 bp, Homo sapien
tcaggccgtggtgtatgatgacgcc

SEQ ID NO: 194666 - DNA, 25 bp, Homo sapien
tgttagactttggacctggcctgcg

SEQ ID NO: 194667 - DNA, 25 bp, Homo sapien
aggccgtggtgtatgatgacgccac

SEQ ID NO: 194668 - DNA, 25 bp, Homo sapien
ttccgagacttatttcgcgcggtcg

SEQ ID NO: 194669 - DNA, 25 bp, Homo sapien
cggcaggctagaaggtattgtattc

SEQ ID NO: 194670 - DNA, 25 bp, Homo sapien
tcaacaggaacttagaggcgcaggc

SEQ ID NO: 194671 - DNA, 25 bp, Homo sapien
cttgtctctgcgcagactgtccagg

SEQ ID NO: 194672 - DNA, 25 bp, Homo sapien
tgctctaactgtggtcttgtctctg

SEQ ID NO: 194673 - DNA, 25 bp, Homo sapien
ttccggtgaccacgaaggcggcaaa

SEQ ID NO: 194674 - DNA, 25 bp, Homo sapien
gcccacaaggcggaaatgtacgaca

SEQ ID NO: 194675 - DNA, 25 bp, Homo sapien
atgactgacaggaacgaggccttta

SEQ ID NO: 194676 - DNA, 25 bp, Homo sapien
cgaatggtgtggacggcgcataaac

SEQ ID NO: 194677 - DNA, 25 bp, Homo sapien
gctgcagtgcaaagccctctccacc

SEQ ID NO: 194678 - DNA, 25 bp, Homo sapien
aacggcctggggaactgcggacaga

SEQ ID NO: 194679 - DNA, 25 bp, Homo sapien
cgcccaggagagaaagcggcggcag

SEQ ID NO: 194680 - DNA, 25 bp, Homo sapien
gcctaaggcgcagtcgcaggctggg

SEQ ID NO: 194681 - DNA, 25 bp, Homo sapien
acggcgcataaacgtggatgtagcg

SEQ ID NO: 194682 - DNA, 25 bp, Homo sapien
atgtaggcagcagacggtggacgct

SEQ ID NO: 194683 - DNA, 25 bp, Homo sapien
tggacggcgcataaacgtggatgta

SEQ ID NO: 194684 - DNA, 25 bp, Homo sapien
cgcaacgactctgcgcgggaaccag

SEQ ID NO: 194685 - DNA, 25 bp, Homo sapien
cgcccttcttgtacgccagactttg

SEQ ID NO: 194686 - DNA, 25 bp, Homo sapien
gcaggaaagcctggcggcagcttct

SEQ ID NO: 194687 - DNA, 25 bp, Homo sapien
tatgcaaaatgtagggccgggaaac

SEQ ID NO: 194688 - DNA, 25 bp, Homo sapien
ccagcggacgagctgccacagactt

SEQ ID NO: 194689 - DNA, 25 bp, Homo sapien
gtaggtgaccaaagtctcctctgta

SEQ ID NO: 194690 - DNA, 25 bp, Homo sapien
tgagaatcgaggctccgagactgtc

SEQ ID NO: 194691 - DNA, 25 bp, Homo sapien
ccgagactgtcagctacttgctcaa

SEQ ID NO: 194692 - DNA, 25 bp, Homo sapien
gcggccgatgaggttttcagccaca

SEQ ID NO: 194693 - DNA, 25 bp, Homo sapien
gaagctgctccgaggttgcaccctc

SEQ ID NO: 194694 - DNA, 25 bp, Homo sapien
tggcttcctgcacagcacgtgcgga

SEQ ID NO: 194695 - DNA, 25 bp, Homo sapien
agcgcaagatggcttcctgcacagc

SEQ ID NO: 194696 - DNA, 25 bp, Homo sapien
tgaccgcgttctgctcatcctagac

SEQ ID NO: 194697 - DNA, 25 bp, Homo sapien
atcttgaagagacctgaccgcgttc

SEQ ID NO: 194698 - DNA, 25 bp, Homo sapien
gaggttttcagccacatcttgaaga

SEQ ID NO: 194699 - DNA, 25 bp, Homo sapien
ggccgcctggtccagagcctgagca

SEQ ID NO: 194700 - DNA, 25 bp, Homo sapien
ctgggagccctactcgggccatcgg

SEQ ID NO: 194701 - DNA, 25 bp, Homo sapien
ctcttttctgggcacccgcctcacg

SEQ ID NO: 194702 - DNA, 25 bp, Homo sapien
agcagaaggtgcttgcgaggtacct

SEQ ID NO: 194703 - DNA, 25 bp, Homo sapien
ttgcgaggtacctgaagcggctgca

SEQ ID NO: 194704 - DNA, 25 bp, Homo sapien
ctggaatttggcagcacgtggtaca

SEQ ID NO: 194705 - DNA, 25 bp, Homo sapien
atttggcagcacgtggtacaggagc

SEQ ID NO: 194706 - DNA, 25 bp, Homo sapien
aaggtgcttgcgaggtacctgaagc

SEQ ID NO: 194707 - DNA, 25 bp, Homo sapien
ggcagcacgtggtacaggagctccc

SEQ ID NO: 194708 - DNA, 25 bp, Homo sapien
aaaatgcactttggcggctgatcgc

SEQ ID NO: 194709 - DNA, 25 bp, Homo sapien
ctggctctaggggaggaaaaaatgc

SEQ ID NO: 194710 - DNA, 25 bp, Homo sapien
ctgcggacaccaagggttgctagtg

SEQ ID NO: 194711 - DNA, 25 bp, Homo sapien
cagcaaagctccatctgtcggcaga

SEQ ID NO: 194712 - DNA, 25 bp, Homo sapien
agcccgcgcgactggaaccagcaaa

SEQ ID NO: 194713 - DNA, 25 bp, Homo sapien
ccgggaccatcgcagtgacaattta

SEQ ID NO: 194714 - DNA, 25 bp, Homo sapien
cttccacctgcgagctttttctgca

SEQ ID NO: 194715 - DNA, 25 bp, Homo sapien
cagggtttcagatgcgaaagtcgca

SEQ ID NO: 194716 - DNA, 25 bp, Homo sapien
tgaacacagttcaaacctagacata

SEQ ID NO: 194717 - DNA, 25 bp, Homo sapien
aaggatctctcgaccgcccgggcgg

SEQ ID NO: 194718 - DNA, 25 bp, Homo sapien
tgcacgcgctaattggccggctcaa

SEQ ID NO: 194719 - DNA, 25 bp, Homo sapien
ccctagcgtctgagttgctttcctg

SEQ ID NO: 194720 - DNA, 25 bp, Homo sapien
ctggttcgggtctgccctcagatct

SEQ ID NO: 194721 - DNA, 25 bp, Homo sapien
gatctcaaatcgaattcgctctgcg

SEQ ID NO: 194722 - DNA, 25 bp, Homo sapien
attcgctctgcgtatcgaatagggg

SEQ ID NO: 194723 - DNA, 25 bp, Homo sapien
ctagacataatgctaaggccgcaaa

SEQ ID NO: 194724 - DNA, 25 bp, Homo sapien
ccggttccggctgaatgtcagtgct

SEQ ID NO: 194725 - DNA, 25 bp, Homo sapien
ccttggaccacctcaagtgagtgtg

SEQ ID NO: 194726 - DNA, 25 bp, Homo sapien
tccggcatgagaccgtgagacgaga

SEQ ID NO: 194727 - DNA, 25 bp, Homo sapien
ccacgcgggtgaactgcatttccca

SEQ ID NO: 194728 - DNA, 25 bp, Homo sapien
ccttgtagtccgttcgcggagtcct

SEQ ID NO: 194729 - DNA, 25 bp, Homo sapien
ggccatggcaagacttcccgcaaca

SEQ ID NO: 194730 - DNA, 25 bp, Homo sapien
gggactgcgcccaaagcttccaatt

SEQ ID NO: 194731 - DNA, 25 bp, Homo sapien
ccgccttttgtggatggccgtaggc

SEQ ID NO: 194732 - DNA, 25 bp, Homo sapien
tgcatttccacagtcggcagggtcc

SEQ ID NO: 194733 - DNA, 25 bp, Homo sapien
cacgcacagtcaattcaggcaggtc

SEQ ID NO: 194734 - DNA, 25 bp, Homo sapien
ttagtgctccgaacggcagctgcca

SEQ ID NO: 194735 - DNA, 25 bp, Homo sapien
cggccactgggtttagtgctccgaa

SEQ ID NO: 194736 - DNA, 25 bp, Homo sapien
ccctctagtcaggagtggcaggaaa

SEQ ID NO: 194737 - DNA, 25 bp, Homo sapien
tgtcgctgtgttttccctctagtca

SEQ ID NO: 194738 - DNA, 25 bp, Homo sapien
aaaggctttctatgatctgtcgctg

SEQ ID NO: 194739 - DNA, 25 bp, Homo sapien
tgccgtcccattgttaaaggctttc

SEQ ID NO: 194740 - DNA, 25 bp, Homo sapien
agcgtcgaatcgctgacccttgtcc

SEQ ID NO: 194741 - DNA, 25 bp, Homo sapien
gacacgctgagcgtcgaatcgctga

SEQ ID NO: 194742 - DNA, 25 bp, Homo sapien
tctgcgaggacacggctgacacgct

SEQ ID NO: 194743 - DNA, 25 bp, Homo sapien
cccagcaagaacgtggccaggagcg

SEQ ID NO: 194744 - DNA, 25 bp, Homo sapien
ctctaagcccagcaagaacgtggcc

SEQ ID NO: 194745 - DNA, 25 bp, Homo sapien
gaagcagactctaagcccagcaaga

SEQ ID NO: 194746 - DNA, 25 bp, Homo sapien
tcaacgaaacggaagcagactctaa

SEQ ID NO: 194747 - DNA, 25 bp, Homo sapien
cctccgcagcctcaccggcatgccc

SEQ ID NO: 194748 - DNA, 25 bp, Homo sapien
cctggaactccaactcggcgacttc

SEQ ID NO: 194749 - DNA, 25 bp, Homo sapien
caagcgttatcgtttcctggaactc

SEQ ID NO: 194750 - DNA, 25 bp, Homo sapien
ctgcctgacgttggtccccatcaag

SEQ ID NO: 194751 - DNA, 25 bp, Homo sapien
agaggtttcaacaagcgttatcgtt

SEQ ID NO: 194752 - DNA, 25 bp, Homo sapien
ccaggccacaagaaagaggtttcaa

SEQ ID NO: 194753 - DNA, 25 bp, Homo sapien
gcgacttccccgaagaccggctgtg

SEQ ID NO: 194754 - DNA, 25 bp, Homo sapien
cccatcaagccatgtgacgagacca

SEQ ID NO: 194755 - DNA, 25 bp, Homo sapien
agccatgtgacgagaccaggccaca

SEQ ID NO: 194756 - DNA, 25 bp, Homo sapien
ctgttagagcagattcccggccttg

SEQ ID NO: 194757 - DNA, 25 bp, Homo sapien
tgcatccatgcccttctccgagtgg

SEQ ID NO: 194758 - DNA, 25 bp, Homo sapien
cctggctgtctacgggcagattgct

SEQ ID NO: 194759 - DNA, 25 bp, Homo sapien
ggcagattgcttgggctttcacaga

SEQ ID NO: 194760 - DNA, 25 bp, Homo sapien
cagggaaggcagcatcacggagttc

SEQ ID NO: 194761 - DNA, 25 bp, Homo sapien
cagaagcccgctgttagagcagatt

SEQ ID NO: 194762 - DNA, 25 bp, Homo sapien
ttgggtctctctgctccagctggac

SEQ ID NO: 194763 - DNA, 25 bp, Homo sapien
acggagttcgctcggctccacagaa

SEQ ID NO: 194764 - DNA, 25 bp, Homo sapien
cggtgagtgccttgcccagatccct

SEQ ID NO: 194765 - DNA, 25 bp, Homo sapien
ggcgtcagctggacaaaagccgacc

SEQ ID NO: 194766 - DNA, 25 bp, Homo sapien
cgagaactgggaaccacgtgaaggc

SEQ ID NO: 194767 - DNA, 25 bp, Homo sapien
aggcaggacgtaccacgagaactgg

SEQ ID NO: 194768 - DNA, 25 bp, Homo sapien
aagccgacccgacttcatttgtctg

SEQ ID NO: 194769 - DNA, 25 bp, Homo sapien
cccggctggtagacagcactcctga

SEQ ID NO: 194770 - DNA, 25 bp, Homo sapien
cggcacgagcaaaggccctgaaaca

SEQ ID NO: 194771 - DNA, 25 bp, Homo sapien
agcactcctgatgcacgggacgagg

SEQ ID NO: 194772 - DNA, 25 bp, Homo sapien
tgcgccagtcttttaaaccggctcg

SEQ ID NO: 194773 - DNA, 25 bp, Homo sapien
gaaaatgggctctgtactccgcgga

SEQ ID NO: 194774 - DNA, 25 bp, Homo sapien
aagtccgcgcggatccgttcagcct

SEQ ID NO: 194775 - DNA, 25 bp, Homo sapien
agactgcattgtcggctgccacctg

SEQ ID NO: 194776 - DNA, 25 bp, Homo sapien
cgttcagcctcagtggacacagcta

SEQ ID NO: 194777 - DNA, 25 bp, Homo sapien
ggcgagcacggagcaccaagtccgc

SEQ ID NO: 194778 - DNA, 25 bp, Homo sapien
tgctaccatcctacagaaggggcca

SEQ ID NO: 194779 - DNA, 25 bp, Homo sapien
tgccacctggttgtgtgctaccatc

SEQ ID NO: 194780 - DNA, 25 bp, Homo sapien
ccttcgagagcagtgtctgcgccta

SEQ ID NO: 194781 - DNA, 25 bp, Homo sapien
tgcgagcgttcgctcaggctcctca

SEQ ID NO: 194782 - DNA, 25 bp, Homo sapien
aggagcgtcttttgcgccttctgca

SEQ ID NO: 194783 - DNA, 25 bp, Homo sapien
tctgcgcctatagtgagactggcca

SEQ ID NO: 194784 - DNA, 25 bp, Homo sapien
actggccatgggtcctctcgtagac

SEQ ID NO: 194785 - DNA, 25 bp, Homo sapien
tctcgtagacctcgacgtgctccgg

SEQ ID NO: 194786 - DNA, 25 bp, Homo sapien
tgctgcctgtacacctcgtgcgagc

SEQ ID NO: 194787 - DNA, 25 bp, Homo sapien
cttgctcttgcccatgcaactgctg

SEQ ID NO: 194788 - DNA, 25 bp, Homo sapien
ccttctgacgtcgaccattggccgg

SEQ ID NO: 194789 - DNA, 25 bp, Homo sapien
gacgtcgaccattggccggctctgc

SEQ ID NO: 194790 - DNA, 25 bp, Homo sapien
cagcgcgctcctgattggtggctga

SEQ ID NO: 194791 - DNA, 25 bp, Homo sapien
ccgccactcaaggtgctggcggagc

SEQ ID NO: 194792 - DNA, 25 bp, Homo sapien
ggcggccctgtctagtcccaggtaa

SEQ ID NO: 194793 - DNA, 25 bp, Homo sapien
tctagtcccaggtaatgcccgggcc

SEQ ID NO: 194794 - DNA, 25 bp, Homo sapien
cgatcttgttgttgacactcgaacg

SEQ ID NO: 194795 - DNA, 25 bp, Homo sapien
gttgccgaggccagattcgatcttg

SEQ ID NO: 194796 - DNA, 25 bp, Homo sapien
gggcttttcgtgagctcgtctctga

SEQ ID NO: 194797 - DNA, 25 bp, Homo sapien
acacacaggtgttcaaagacgcttc

SEQ ID NO: 194798 - DNA, 25 bp, Homo sapien
actggcacggaacacaccctgaggc

SEQ ID NO: 194799 - DNA, 25 bp, Homo sapien
ggggaagctctttcacttcggagga

SEQ ID NO: 194800 - DNA, 25 bp, Homo sapien
ttcggaggattgctcaacaaccatg

SEQ ID NO: 194801 - DNA, 25 bp, Homo sapien
aacgctggaggacttgcttttcttg

SEQ ID NO: 194802 - DNA, 25 bp, Homo sapien
tcgtctctgatctcgcgcaagagtg

SEQ ID NO: 194803 - DNA, 25 bp, Homo sapien
gagaccactgcgctccacgttgagg

SEQ ID NO: 194804 - DNA, 25 bp, Homo sapien
gagctgaacccaaccggagacgcgg

SEQ ID NO: 194805 - DNA, 25 bp, Homo sapien
gacgcaggagctgaacccaaccgga

SEQ ID NO: 194806 - DNA, 25 bp, Homo sapien
gtcactagagagaatcgcgcctttt

SEQ ID NO: 194807 - DNA, 25 bp, Homo sapien
ggaaatctcaacctgagtcactaga

SEQ ID NO: 194808 - DNA, 25 bp, Homo sapien
ggggatatttctggaaatctcaacc

SEQ ID NO: 194809 - DNA, 25 bp, Homo sapien
caaatagcatttgggaattcgttgg

SEQ ID NO: 194810 - DNA, 25 bp, Homo sapien
gtgtccttcccggatcttgcgcgaa

SEQ ID NO: 194811 - DNA, 25 bp, Homo sapien
ttcccggatcttgcgcgaagtcgcg

SEQ ID NO: 194812 - DNA, 25 bp, Homo sapien
gcgaacgactgatgcccagcttcct

SEQ ID NO: 194813 - DNA, 25 bp, Homo sapien
tccgctgtaagcaggcgggaccaag

SEQ ID NO: 194814 - DNA, 25 bp, Homo sapien
cagtttcctccgctgtaagcaggcg

SEQ ID NO: 194815 - DNA, 25 bp, Homo sapien
cgaagcaaggtcattcacctcagcg

SEQ ID NO: 194816 - DNA, 25 bp, Homo sapien
actcttccgtgcagcgtgcctcagt

SEQ ID NO: 194817 - DNA, 25 bp, Homo sapien
ggagtatgcagcactcttccgtgca

SEQ ID NO: 194818 - DNA, 25 bp, Homo sapien
ctcagctctcgaggagtatgcagca

SEQ ID NO: 194819 - DNA, 25 bp, Homo sapien
cttcctcccgaagcaaggtcattca

SEQ ID NO: 194820 - DNA, 25 bp, Homo sapien
ccgcccgtcctcagctacgctcccg

SEQ ID NO: 194821 - DNA, 25 bp, Homo sapien
tcttcaaaattctgggagctccggg

SEQ ID NO: 194822 - DNA, 25 bp, Homo sapien
tcaaaattctgggagctccggggag

SEQ ID NO: 194823 - DNA, 25 bp, Homo sapien
acactggggttcacctgtccgcggc

SEQ ID NO: 194824 - DNA, 25 bp, Homo sapien
gtgggcatgcctagctcccctggtc

SEQ ID NO: 194825 - DNA, 25 bp, Homo sapien
cccagcgagggccacactggggttc

SEQ ID NO: 194826 - DNA, 25 bp, Homo sapien
tccgtcgggccgattcgagctacct

SEQ ID NO: 194827 - DNA, 25 bp, Homo sapien
catttcggggttcttcaaaattctg

SEQ ID NO: 194828 - DNA, 25 bp, Homo sapien
tcgtgtccaccattctcactacagg

SEQ ID NO: 194829 - DNA, 25 bp, Homo sapien
ggcctccgcattccgacattacatg

SEQ ID NO: 194830 - DNA, 25 bp, Homo sapien
catgctcccagtcgccggctttata

SEQ ID NO: 194831 - DNA, 25 bp, Homo sapien
cctacgtaaatgcacggaagccttc

SEQ ID NO: 194832 - DNA, 25 bp, Homo sapien
gcggggaatacttggaaccttgaca

SEQ ID NO: 194833 - DNA, 25 bp, Homo sapien
ttgacaccgctgtagtctgctctcg

SEQ ID NO: 194834 - DNA, 25 bp, Homo sapien
ggaagcctcgccataatgtccgcgg

SEQ ID NO: 194835 - DNA, 25 bp, Homo sapien
ccctcggcactaaagcgggacgata

SEQ ID NO: 194836 - DNA, 25 bp, Homo sapien
agcccaagacgctgaatcgggatcc

SEQ ID NO: 194837 - DNA, 25 bp, Homo sapien
caagactgattaaccagcaccgggg

SEQ ID NO: 194838 - DNA, 25 bp, Homo sapien
gacgcgctcggactcaagactgatt

SEQ ID NO: 194839 - DNA, 25 bp, Homo sapien
caatgggaaggccacgttgcgcact

SEQ ID NO: 194840 - DNA, 25 bp, Homo sapien
ggcagaagtgggtcacgttattctc

SEQ ID NO: 194841 - DNA, 25 bp, Homo sapien
acattttgccgagggaatggcaggc

SEQ ID NO: 194842 - DNA, 25 bp, Homo sapien
tcaccagagcagacagaaataacca

SEQ ID NO: 194843 - DNA, 25 bp, Homo sapien
attaatgcgccaagctctccgccgg

SEQ ID NO: 194844 - DNA, 25 bp, Homo sapien
cacctcgtgaagaggcgcgtgtgca

SEQ ID NO: 194845 - DNA, 25 bp, Homo sapien
tccatcttgtttccacctcgtgaag

SEQ ID NO: 194846 - DNA, 25 bp, Homo sapien
tgttctttatccagctgcttccgtg

SEQ ID NO: 194847 - DNA, 25 bp, Homo sapien
gaggtaaccgccacactgcttccaa

SEQ ID NO: 194848 - DNA, 25 bp, Homo sapien
agtccgccgagcacgcactcgggtt

SEQ ID NO: 194849 - DNA, 25 bp, Homo sapien
cccacgtgtgtaaaggggagagaca

SEQ ID NO: 194850 - DNA, 25 bp, Homo sapien
ccaggccgcaggaccagggaaagca

SEQ ID NO: 194851 - DNA, 25 bp, Homo sapien
gaaccgagcctctgtgcgtcatttc

SEQ ID NO: 194852 - DNA, 25 bp, Homo sapien
ccctgccaaatggacgcagccagga

SEQ ID NO: 194853 - DNA, 25 bp, Homo sapien
ttcttccagcgaggcatccgcacgg

SEQ ID NO: 194854 - DNA, 25 bp, Homo sapien
agccaccagcagtgttcgctccggg

SEQ ID NO: 194855 - DNA, 25 bp, Homo sapien
cgggcagcgtatcgaatgtgaaagc

SEQ ID NO: 194856 - DNA, 25 bp, Homo sapien
gggagctgccagaacacatctcacc

SEQ ID NO: 194857 - DNA, 25 bp, Homo sapien
ggggctctgtctgaacccatcagtc

SEQ ID NO: 194858 - DNA, 25 bp, Homo sapien
agcagcgcatgcagcttcttccagc

SEQ ID NO: 194859 - DNA, 25 bp, Homo sapien
tctgctgtctccctggacggagttg

SEQ ID NO: 194860 - DNA, 25 bp, Homo sapien
tccgtggttattggcggcgccgcca

SEQ ID NO: 194861 - DNA, 25 bp, Homo sapien
gaactacaagttccggcagcgcccg

SEQ ID NO: 194862 - DNA, 25 bp, Homo sapien
cggtagttctctgttctggccgccc

SEQ ID NO: 194863 - DNA, 25 bp, Homo sapien
cttcgcctcggtagttctctgttct

SEQ ID NO: 194864 - DNA, 25 bp, Homo sapien
aaccctcctcctcgtgtgtgtgagc

SEQ ID NO: 194865 - DNA, 25 bp, Homo sapien
tccacactcgcgacgacgacagagg

SEQ ID NO: 194866 - DNA, 25 bp, Homo sapien
ggccgggagctagcgacaaagatcc

SEQ ID NO: 194867 - DNA, 25 bp, Homo sapien
gccactgcccggatccatgatcggg

SEQ ID NO: 194868 - DNA, 25 bp, Homo sapien
tcgcatccctctctgggacgaagtc

SEQ ID NO: 194869 - DNA, 25 bp, Homo sapien
catcactcgtgggaacctcaggaag

SEQ ID NO: 194870 - DNA, 25 bp, Homo sapien
gtctcgggtttaccctgagtctcca

SEQ ID NO: 194871 - DNA, 25 bp, Homo sapien
tccacaccgggtccggcgacttgga

SEQ ID NO: 194872 - DNA, 25 bp, Homo sapien
cgacttggatctgcgccgcggttta

SEQ ID NO: 194873 - DNA, 25 bp, Homo sapien
tgtctcccggcctgtctggagctcg

SEQ ID NO: 194874 - DNA, 25 bp, Homo sapien
ctgctcacctgcgggtctctgatct

SEQ ID NO: 194875 - DNA, 25 bp, Homo sapien
atctgcgccgcggtttacgttccgg

SEQ ID NO: 194876 - DNA, 25 bp, Homo sapien
ttgcggtctatccagcggcgatcga

SEQ ID NO: 194877 - DNA, 25 bp, Homo sapien
tctgagaacccggttgcggtctatc

SEQ ID NO: 194878 - DNA, 25 bp, Homo sapien
cggcgatcgagaaacgagccctttg

SEQ ID NO: 194879 - DNA, 25 bp, Homo sapien
gtgaccgtcagctcaggaaatcaga

SEQ ID NO: 194880 - DNA, 25 bp, Homo sapien
ctagagagaccacgcacgcaggctc

SEQ ID NO: 194881 - DNA, 25 bp, Homo sapien
caccgcacagcggaaagagggctcc

SEQ ID NO: 194882 - DNA, 25 bp, Homo sapien
gtagctcgggtgttttctgagaacc

SEQ ID NO: 194883 - DNA, 25 bp, Homo sapien
acgagccctttgcacagggaaccgc

SEQ ID NO: 194884 - DNA, 25 bp, Homo sapien
tgcttcagtgcggacgaaccatgga

SEQ ID NO: 194885 - DNA, 25 bp, Homo sapien
caggcgtggtcaatacgtgcttcaa

SEQ ID NO: 194886 - DNA, 25 bp, Homo sapien
aggcgtggtcaatacgtgcttcaac

SEQ ID NO: 194887 - DNA, 25 bp, Homo sapien
acaggcgtggtcaatacgtgcttca

SEQ ID NO: 194888 - DNA, 25 bp, Homo sapien
tagtcaatacctgcttcaacgcgga

SEQ ID NO: 194889 - DNA, 25 bp, Homo sapien
cgtgcttcaacgaggacgaaccatg

SEQ ID NO: 194890 - DNA, 25 bp, Homo sapien
cgaaccgtggaaacaggcttagtca

SEQ ID NO: 194891 - DNA, 25 bp, Homo sapien
atacgtgcttcagtgcggacgaacc

SEQ ID NO: 194892 - DNA, 25 bp, Homo sapien
gagtgtttgctgagctcgggtctgt

SEQ ID NO: 194893 - DNA, 25 bp, Homo sapien
tgtccccggctggagtaagtgtttg

SEQ ID NO: 194894 - DNA, 25 bp, Homo sapien
ctgagctccggtctgtgcgtgcgtc

SEQ ID NO: 194895 - DNA, 25 bp, Homo sapien
ttgctgagctcgggtctgtgcacgt

SEQ ID NO: 194896 - DNA, 25 bp, Homo sapien
cgtgtccccggctggagtaagtgtt

SEQ ID NO: 194897 - DNA, 25 bp, Homo sapien
gtttgctgagctcgggtctgtgcac

SEQ ID NO: 194898 - DNA, 25 bp, Homo sapien
tgtttgctgagctcgggtctgtgca

SEQ ID NO: 194899 - DNA, 25 bp, Homo sapien
tgagtgtttgctgagctcgggtctg

SEQ ID NO: 194900 - DNA, 25 bp, Homo sapien
gcgtgacaaccacgtccacctggtg

SEQ ID NO: 194901 - DNA, 25 bp, Homo sapien
aaccacgtccacctggtgatcctga

SEQ ID NO: 194902 - DNA, 25 bp, Homo sapien
tggtgatcctgagagcacacgattc

SEQ ID NO: 194903 - DNA, 25 bp, Homo sapien
gagagcacacgattcccaacagtta

SEQ ID NO: 194904 - DNA, 25 bp, Homo sapien
ttaaactaatcagtcttcgagccgc

SEQ ID NO: 194905 - DNA, 25 bp, Homo sapien
ttcgagccgcatgataccgtgaccc

SEQ ID NO: 194906 - DNA, 25 bp, Homo sapien
agcctgtgaacagccggcccaaagc

SEQ ID NO: 194907 - DNA, 25 bp, Homo sapien
cgcccggagagcctgtgaacagccg

SEQ ID NO: 194908 - DNA, 25 bp, Homo sapien
cgccctttgatctcggggcgggact

SEQ ID NO: 194909 - DNA, 25 bp, Homo sapien
aaccgctggacctgtcccgctttgg

SEQ ID NO: 194910 - DNA, 25 bp, Homo sapien
agcaggctttgatgcagctatggcg

SEQ ID NO: 194911 - DNA, 25 bp, Homo sapien
cggagcgcacacctgaacaaaaggt

SEQ ID NO: 194912 - DNA, 25 bp, Homo sapien
tgcagccgacatggcgagcgagttt

SEQ ID NO: 194913 - DNA, 25 bp, Homo sapien
ctggaatccctaagagcaggctttg

SEQ ID NO: 194914 - DNA, 25 bp, Homo sapien
aagccgcgcgacttcacacagaaca

SEQ ID NO: 194915 - DNA, 25 bp, Homo sapien
cgagcgagtttctggccttcactta

SEQ ID NO: 194916 - DNA, 25 bp, Homo sapien
tcgtgggcatcttcaccaagctggg

SEQ ID NO: 194917 - DNA, 25 bp, Homo sapien
ttcaactgcagctcgggcgacttca

SEQ ID NO: 194918 - DNA, 25 bp, Homo sapien
acttcatcttctgctgcgggacttg

SEQ ID NO: 194919 - DNA, 25 bp, Homo sapien
ggcttccggttctgctgcacgttta

SEQ ID NO: 194920 - DNA, 25 bp, Homo sapien
tgcacgtttaagaagcggcgactga

SEQ ID NO: 194921 - DNA, 25 bp, Homo sapien
cggcgactgaaccaaagcacctgca

SEQ ID NO: 194922 - DNA, 25 bp, Homo sapien
cggggctacttcgatgtcatgggcc

SEQ ID NO: 194923 - DNA, 25 bp, Homo sapien
cggttgcttcctcaccgagctgtgc

SEQ ID NO: 194924 - DNA, 25 bp, Homo sapien
ctcggctctcttcggctttctgaga

SEQ ID NO: 194925 - DNA, 25 bp, Homo sapien
actccgagagtgttgagggcctcct

SEQ ID NO: 194926 - DNA, 25 bp, Homo sapien
ggaactgctcgacactgacgggcta

SEQ ID NO: 194927 - DNA, 25 bp, Homo sapien
ttcggcctactctccactaggagtc

SEQ ID NO: 194928 - DNA, 25 bp, Homo sapien
gctctcttcggttgagttcggccta

SEQ ID NO: 194929 - DNA, 25 bp, Homo sapien
gcgttcggcccacgatcatctcagt

SEQ ID NO: 194930 - DNA, 25 bp, Homo sapien
ctgagttcggccaacgcttgccttc

SEQ ID NO: 194931 - DNA, 25 bp, Homo sapien
agtctcagctctcctcggctacgtt

SEQ ID NO: 194932 - DNA, 25 bp, Homo sapien
cgggcacttaagttgcgcgcttgca

SEQ ID NO: 194933 - DNA, 25 bp, Homo sapien
tttgtcgccaccgtccaagcctttg

SEQ ID NO: 194934 - DNA, 25 bp, Homo sapien
cctcagtgtccatctcgactgcaga

SEQ ID NO: 194935 - DNA, 25 bp, Homo sapien
gcgggcctggtgaacatcccgcgtc

SEQ ID NO: 194936 - DNA, 25 bp, Homo sapien
cccttcccagtcacgggagtgggcg

SEQ ID NO: 194937 - DNA, 25 bp, Homo sapien
gtggcagcggtcacctttgtcgcca

SEQ ID NO: 194938 - DNA, 25 bp, Homo sapien
cgtttatggagcctctgctgtgtgc

SEQ ID NO: 194939 - DNA, 25 bp, Homo sapien
atctcgactgcagagttggccctgc

SEQ ID NO: 194940 - DNA, 25 bp, Homo sapien
cgacaccgtccggaggaggtgctaa

SEQ ID NO: 194941 - DNA, 25 bp, Homo sapien
ggccttctggaagccaccgagttcc

SEQ ID NO: 194942 - DNA, 25 bp, Homo sapien
agccaccgagttccgcggtgctgtc

SEQ ID NO: 194943 - DNA, 25 bp, Homo sapien
tccgcggtgctgtctggagccgtac

SEQ ID NO: 194944 - DNA, 25 bp, Homo sapien
tctggagccgtacggttcgcgtttg

SEQ ID NO: 194945 - DNA, 25 bp, Homo sapien
ccctcttgctggtgcggatgggaaa

SEQ ID NO: 194946 - DNA, 25 bp, Homo sapien
gtccctctcgatgttggtttcttcg

SEQ ID NO: 194947 - DNA, 25 bp, Homo sapien
ggtcgagtcagcgtccctctcgatg

SEQ ID NO: 194948 - DNA, 25 bp, Homo sapien
gaagtttgcgccctacacgcggcct

SEQ ID NO: 194949 - DNA, 25 bp, Homo sapien
ggcgggaagtttgcgccctacacgc

SEQ ID NO: 194950 - DNA, 25 bp, Homo sapien
ctgccgccaacttcgggaggtgcga

SEQ ID NO: 194951 - DNA, 25 bp, Homo sapien
cctctgccgccaacttcgggaggtg

SEQ ID NO: 194952 - DNA, 25 bp, Homo sapien
cctgatggataagcgctgacggccc

SEQ ID NO: 194953 - DNA, 25 bp, Homo sapien
ctgacctcgcgctcgccgcacccgc

SEQ ID NO: 194954 - DNA, 25 bp, Homo sapien
gcctcgcagacttggcggctccgct

SEQ ID NO: 194955 - DNA, 25 bp, Homo sapien
cgctgacacccatcacgccgcggcg

SEQ ID NO: 194956 - DNA, 25 bp, Homo sapien
atagaggttcgcgagaccgccatcg

SEQ ID NO: 194957 - DNA, 25 bp, Homo sapien
gtcgggccgataaggaaacctgcta

SEQ ID NO: 194958 - DNA, 25 bp, Homo sapien
ctgctaccattccttggcttcctgg

SEQ ID NO: 194959 - DNA, 25 bp, Homo sapien
ttcctgggtgcctcactctagaggg

SEQ ID NO: 194960 - DNA, 25 bp, Homo sapien
agactccgagtcgagccgtcccgaa

SEQ ID NO: 194961 - DNA, 25 bp, Homo sapien
tcccgaagcgctacatcgctggcgg

SEQ ID NO: 194962 - DNA, 25 bp, Homo sapien
tgcagacgacagaatcgcccgcggg

SEQ ID NO: 194963 - DNA, 25 bp, Homo sapien
tcgaacccgacttctgagatacagg

SEQ ID NO: 194964 - DNA, 25 bp, Homo sapien
tgctctcttagcaaaggctgtttta

SEQ ID NO: 194965 - DNA, 25 bp, Homo sapien
tccaaacgcagagggtcttgccggc

SEQ ID NO: 194966 - DNA, 25 bp, Homo sapien
cctcggactatttgttcagccaatc

SEQ ID NO: 194967 - DNA, 25 bp, Homo sapien
gcatgcgccgtaggcgtttctaaga

SEQ ID NO: 194968 - DNA, 25 bp, Homo sapien
tttctaagagatggagcccgtcctc

SEQ ID NO: 194969 - DNA, 25 bp, Homo sapien
tggcaggtccacagctctaccagcg

SEQ ID NO: 194970 - DNA, 25 bp, Homo sapien
gcgtcgcctacgcatgctctcttag

SEQ ID NO: 194971 - DNA, 25 bp, Homo sapien
gcaagactcgctgggtccaaacgca

SEQ ID NO: 194972 - DNA, 25 bp, Homo sapien
ccgctcgggaaactgactcgctgcg

SEQ ID NO: 194973 - DNA, 25 bp, Homo sapien
agtgcctgggcttggaaattgacga

SEQ ID NO: 194974 - DNA, 25 bp, Homo sapien
cgcttgtctgggctgcgattgccgc

SEQ ID NO: 194975 - DNA, 25 bp, Homo sapien
tttaaggctgggctccaatcgaggc

SEQ ID NO: 194976 - DNA, 25 bp, Homo sapien
ctccacggtggaggatttaaggctg

SEQ ID NO: 194977 - DNA, 25 bp, Homo sapien
tacccttcttctccacggtggagga

SEQ ID NO: 194978 - DNA, 25 bp, Homo sapien
ccatcacttggatctcgtctgggga

SEQ ID NO: 194979 - DNA, 25 bp, Homo sapien
tgcagaaaaggattttctacgctcc

SEQ ID NO: 194980 - DNA, 25 bp, Homo sapien
ctgattatctccattctgcagagtg

SEQ ID NO: 194981 - DNA, 25 bp, Homo sapien
gttggaggagtaagtacaaggctcc

SEQ ID NO: 194982 - DNA, 25 bp, Homo sapien
tacaaggctcctagggtgcacggtc

SEQ ID NO: 194983 - DNA, 25 bp, Homo sapien
tgcacggtccgcagccggaaaagac

SEQ ID NO: 194984 - DNA, 25 bp, Homo sapien
cccaagaggcgcaccggcttaagga

SEQ ID NO: 194985 - DNA, 25 bp, Homo sapien
catggtctcggcctagcaggccagg

SEQ ID NO: 194986 - DNA, 25 bp, Homo sapien
cggacacgcactgctcctgattatc

SEQ ID NO: 194987 - DNA, 25 bp, Homo sapien
gaatcaagtcctcgaggggtgcatg

SEQ ID NO: 194988 - DNA, 25 bp, Homo sapien
gagcggcctctcctctatggtcacg

SEQ ID NO: 194989 - DNA, 25 bp, Homo sapien
ccactctgtcttgttacttccggta

SEQ ID NO: 194990 - DNA, 25 bp, Homo sapien
tgtgctgagaataatggcccggttg

SEQ ID NO: 194991 - DNA, 25 bp, Homo sapien
ccggaccagaattgatgaggcttct

SEQ ID NO: 194992 - DNA, 25 bp, Homo sapien
aggcttctgatagtcgccacgctga

SEQ ID NO: 194993 - DNA, 25 bp, Homo sapien
cggtctaattgtcgaggcacgttcc

SEQ ID NO: 194994 - DNA, 25 bp, Homo sapien
gcggtattacgcatgcgcccacttc

SEQ ID NO: 194995 - DNA, 25 bp, Homo sapien
gccacgctgagtttacggtctaatt

SEQ ID NO: 194996 - DNA, 25 bp, Homo sapien
aggaaaaggcgctcttttgatgtta

SEQ ID NO: 194997 - DNA, 25 bp, Homo sapien
ggaaaaggcgctcttttgatgttat

SEQ ID NO: 194998 - DNA, 25 bp, Homo sapien
gaggaaaaggcgctcttttgatgtt

SEQ ID NO: 194999 - DNA, 25 bp, Homo sapien
gggctctagggcaactaggaacttg

SEQ ID NO: 195000 - DNA, 25 bp, Homo sapien
tgagcattagaagagcgagctgggg

SEQ ID NO: 195001 - DNA, 25 bp, Homo sapien
tgggtgagcattagaagagcgagct

SEQ ID NO: 195002 - DNA, 25 bp, Homo sapien
gtgtgggtgagcattagaagagcga

SEQ ID NO: 195003 - DNA, 25 bp, Homo sapien
aaaaggcgctcttttgatgttatta

SEQ ID NO: 195004 - DNA, 25 bp, Homo sapien
tcagcgtagccaggccgacagacag

SEQ ID NO: 195005 - DNA, 25 bp, Homo sapien
cggggcgatggagaaagacgccagg

SEQ ID NO: 195006 - DNA, 25 bp, Homo sapien
ttgacgctcagctcgccgcaggtcg

SEQ ID NO: 195007 - DNA, 25 bp, Homo sapien
agcagttgacgctcagctcgccgca

SEQ ID NO: 195008 - DNA, 25 bp, Homo sapien
caggccgacagacagcgcagttcac

SEQ ID NO: 195009 - DNA, 25 bp, Homo sapien
tcggcggcgcagcagttgacgctca

SEQ ID NO: 195010 - DNA, 25 bp, Homo sapien
ccgcatggaggttgccgtgacgctc

SEQ ID NO: 195011 - DNA, 25 bp, Homo sapien
ccgggtcagcgtagccaggccgaca

SEQ ID NO: 195012 - DNA, 25 bp, Homo sapien
gtcccagcgtctgtctgtcgctaag

SEQ ID NO: 195013 - DNA, 25 bp, Homo sapien
ggccacgggaggtgaaaacaggcga

SEQ ID NO: 195014 - DNA, 25 bp, Homo sapien
taagtctctgggcagactgctcggc

SEQ ID NO: 195015 - DNA, 25 bp, Homo sapien
tctgtctgtcgctaagtctctgggc

SEQ ID NO: 195016 - DNA, 25 bp, Homo sapien
cttctgtcgtcgtgggtcccagcgt

SEQ ID NO: 195017 - DNA, 25 bp, Homo sapien
ggccatcggcgccttctgtcgtcgt

SEQ ID NO: 195018 - DNA, 25 bp, Homo sapien
aggcgcggccatcggcgccttctgt

SEQ ID NO: 195019 - DNA, 25 bp, Homo sapien
tgtcgctaagtctctgggcagactg

SEQ ID NO: 195020 - DNA, 25 bp, Homo sapien
gatggtctcgtttccttgccgagca

SEQ ID NO: 195021 - DNA, 25 bp, Homo sapien
cctgccagatgtcgcgcggagtcct

SEQ ID NO: 195022 - DNA, 25 bp, Homo sapien
tggagtccttggagcccttacctct

SEQ ID NO: 195023 - DNA, 25 bp, Homo sapien
tgcgccttagttctctcttctgggg

SEQ ID NO: 195024 - DNA, 25 bp, Homo sapien
agtcggacgtggagatcaactactc

SEQ ID NO: 195025 - DNA, 25 bp, Homo sapien
tccttgccgagcatgcgccttagtt

SEQ ID NO: 195026 - DNA, 25 bp, Homo sapien
tcttccgaggctatgctgtccgcgg

SEQ ID NO: 195027 - DNA, 25 bp, Homo sapien
cctctagaaggcagagatggtctcg

SEQ ID NO: 195028 - DNA, 25 bp, Homo sapien
aggacctgacccgagccctcggtga

SEQ ID NO: 195029 - DNA, 25 bp, Homo sapien
tgggcgaggacctgacccgagccct

SEQ ID NO: 195030 - DNA, 25 bp, Homo sapien
ccctcggtgactacgccagggtgga

SEQ ID NO: 195031 - DNA, 25 bp, Homo sapien
ggagctgctcaccattcaccaggcg

SEQ ID NO: 195032 - DNA, 25 bp, Homo sapien
tgctcaccattcaccaggcgctgga

SEQ ID NO: 195033 - DNA, 25 bp, Homo sapien
ttcaccaggcgctggagcaggccgt

SEQ ID NO: 195034 - DNA, 25 bp, Homo sapien
cctcgacctctctgtgaaacgtgcg

SEQ ID NO: 195035 - DNA, 25 bp, Homo sapien
tctgtgaaacgtgcgcccgccaagg

SEQ ID NO: 195036 - DNA, 25 bp, Homo sapien
ctgccatcatgaggtaagggttttc

SEQ ID NO: 195037 - DNA, 25 bp, Homo sapien
tattcatttccagcgcagttctgcg

SEQ ID NO: 195038 - DNA, 25 bp, Homo sapien
cagttctgcggccttttcaggggcc

SEQ ID NO: 195039 - DNA, 25 bp, Homo sapien
ccgagtggacgcttctcgggagtcc

SEQ ID NO: 195040 - DNA, 25 bp, Homo sapien
tttcaaaccgggctgcttttattca

SEQ ID NO: 195041 - DNA, 25 bp, Homo sapien
tttccagctgccattccctcggtgt

SEQ ID NO: 195042 - DNA, 25 bp, Homo sapien
ctgcgtcggccttggtttcaaaccg

SEQ ID NO: 195043 - DNA, 25 bp, Homo sapien
ctgctacgtgccacgggtctcctta

SEQ ID NO: 195044 - DNA, 25 bp, Homo sapien
cacagcgctgtgagtagcgggccca

SEQ ID NO: 195045 - DNA, 25 bp, Homo sapien
cagatggcaccctgcccaccgcttc

SEQ ID NO: 195046 - DNA, 25 bp, Homo sapien
cgcttcccgcccacgcactttagcc

SEQ ID NO: 195047 - DNA, 25 bp, Homo sapien
ccggatgccagtccctcatcgctgg

SEQ ID NO: 195048 - DNA, 25 bp, Homo sapien
cgcggacgccacagcgctgtgagta

SEQ ID NO: 195049 - DNA, 25 bp, Homo sapien
gcggccctgctaaataaggaacgcc

SEQ ID NO: 195050 - DNA, 25 bp, Homo sapien
ctaaataaggaacgcctggagccgc

SEQ ID NO: 195051 - DNA, 25 bp, Homo sapien
gccatgcgcgcgctgccctaacgat

SEQ ID NO: 195052 - DNA, 25 bp, Homo sapien
gcctcgcatcgctatgtgctgcctg

SEQ ID NO: 195053 - DNA, 25 bp, Homo sapien
ccctggcaatggtggacagtcccgc

SEQ ID NO: 195054 - DNA, 25 bp, Homo sapien
ccgtcctcggtgcagagtgacgaga

SEQ ID NO: 195055 - DNA, 25 bp, Homo sapien
ggaggccgcctacagcatcgtggcc

SEQ ID NO: 195056 - DNA, 25 bp, Homo sapien
cgaggtgagtgtctgctgcccactc

SEQ ID NO: 195057 - DNA, 25 bp, Homo sapien
ttgggcccacactgaccgttgacac

SEQ ID NO: 195058 - DNA, 25 bp, Homo sapien
gagagcctcgacctcagcatccaga

SEQ ID NO: 195059 - DNA, 25 bp, Homo sapien
ccctcggacacggagatcttctctg

SEQ ID NO: 195060 - DNA, 25 bp, Homo sapien
ccggagaacggcagcgagcctgaga

SEQ ID NO: 195061 - DNA, 25 bp, Homo sapien
ccctatgcgctatggagagagttcc

SEQ ID NO: 195062 - DNA, 25 bp, Homo sapien
caggcctgcgccaatggctgcacgt

SEQ ID NO: 195063 - DNA, 25 bp, Homo sapien
gccaacatctgcttgccgctggacg

SEQ ID NO: 195064 - DNA, 25 bp, Homo sapien
tggagccaacatctgcttgccgctg

SEQ ID NO: 195065 - DNA, 25 bp, Homo sapien
gtgccctggagccaacatctgcttg

SEQ ID NO: 195066 - DNA, 25 bp, Homo sapien
cctgagagcaggtccccggacaaca

SEQ ID NO: 195067 - DNA, 25 bp, Homo sapien
tgcgctatggagagagttcctcttc

SEQ ID NO: 195068 - DNA, 25 bp, Homo sapien
tgctggcatctaatgccttcgagaa

SEQ ID NO: 195069 - DNA, 25 bp, Homo sapien
ctggcatctaatgccttcgagaacc

SEQ ID NO: 195070 - DNA, 25 bp, Homo sapien
ctgggacccttaaggctgggccgca

SEQ ID NO: 195071 - DNA, 25 bp, Homo sapien
cgtcccgcacgtggcttgggagcct

SEQ ID NO: 195072 - DNA, 25 bp, Homo sapien
cacctgtgctccgtcccgcacgtgg

SEQ ID NO: 195073 - DNA, 25 bp, Homo sapien
ctgcacttggaggcggtgccgtcct

SEQ ID NO: 195074 - DNA, 25 bp, Homo sapien
ccgagtgcagctgcacttggaggcg

SEQ ID NO: 195075 - DNA, 25 bp, Homo sapien
gctccgtcccgcacgtggcttggga

SEQ ID NO: 195076 - DNA, 25 bp, Homo sapien
gagggccgctgcctcaattgcagca

SEQ ID NO: 195077 - DNA, 25 bp, Homo sapien
gtggtcgccctcaacaggtgagcca

SEQ ID NO: 195078 - DNA, 25 bp, Homo sapien
gccactgcgaggagttctgtgtcta

SEQ ID NO: 195079 - DNA, 25 bp, Homo sapien
tcaccaccaaggtgcacttcgaatg

SEQ ID NO: 195080 - DNA, 25 bp, Homo sapien
acggcgagggatacaccttcacgct

SEQ ID NO: 195081 - DNA, 25 bp, Homo sapien
tctgtgtctacaagggcagcctctc

SEQ ID NO: 195082 - DNA, 25 bp, Homo sapien
gctgcacgtacgttcagcaacaaga

SEQ ID NO: 195083 - DNA, 25 bp, Homo sapien
tggtgctggatgagaccaccacatc

SEQ ID NO: 195084 - DNA, 25 bp, Homo sapien
gcctgttccattctcgagggatgcc

SEQ ID NO: 195085 - DNA, 25 bp, Homo sapien
gcgtcactagtatttccagcctttc

SEQ ID NO: 195086 - DNA, 25 bp, Homo sapien
tttggtgaacaatccaccgggcatc

SEQ ID NO: 195087 - DNA, 25 bp, Homo sapien
ccttcacctgcgcacgttagggagg

SEQ ID NO: 195088 - DNA, 25 bp, Homo sapien
tggcgcccaggtacggaatcccaga

SEQ ID NO: 195089 - DNA, 25 bp, Homo sapien
tttcccagtcgcgagctgccattgt

SEQ ID NO: 195090 - DNA, 25 bp, Homo sapien
agctgccattgtgacccggacaggg

SEQ ID NO: 195091 - DNA, 25 bp, Homo sapien
cctccttggcgaatggcctgttcca

SEQ ID NO: 195092 - DNA, 25 bp, Homo sapien
acatggccgcaaggcctcacgggaa

SEQ ID NO: 195093 - DNA, 25 bp, Homo sapien
gggacgcaaggacgaagcaacgttc

SEQ ID NO: 195094 - DNA, 25 bp, Homo sapien
gaagcaacgttcaccgcaggctgcg

SEQ ID NO: 195095 - DNA, 25 bp, Homo sapien
ggcagcccgctgaagtctaaagaag

SEQ ID NO: 195096 - DNA, 25 bp, Homo sapien
cggatgtgccaacagcgccaagttt

SEQ ID NO: 195097 - DNA, 25 bp, Homo sapien
ccaagtttcaagtctgtgtcgcgtg

SEQ ID NO: 195098 - DNA, 25 bp, Homo sapien
ccactcacctccaaaggcgggtggg

SEQ ID NO: 195099 - DNA, 25 bp, Homo sapien
cctggaataacctcctgcttcacgg

SEQ ID NO: 195100 - DNA, 25 bp, Homo sapien
ctagtgcgtgagtataaggagagac

SEQ ID NO: 195101 - DNA, 25 bp, Homo sapien
tcctgagctttcgtcccagatacgc

SEQ ID NO: 195102 - DNA, 25 bp, Homo sapien
tttcgtcccagatacgcagaaggaa

SEQ ID NO: 195103 - DNA, 25 bp, Homo sapien
ctagagcgccgctgaaacccgctcc

SEQ ID NO: 195104 - DNA, 25 bp, Homo sapien
tgaaacccgctcctcgttctacttg

SEQ ID NO: 195105 - DNA, 25 bp, Homo sapien
ttgttccagccagcgctagtgcgtg

SEQ ID NO: 195106 - DNA, 25 bp, Homo sapien
cagccagcgctagtgcgtgagtata

SEQ ID NO: 195107 - DNA, 25 bp, Homo sapien
gagctttcgtcccagatacgcagaa

SEQ ID NO: 195108 - DNA, 25 bp, Homo sapien
acctcgggatggctgcaccgcagtc

SEQ ID NO: 195109 - DNA, 25 bp, Homo sapien
cgtccacaagcacgggaagtacccg

SEQ ID NO: 195110 - DNA, 25 bp, Homo sapien
tcggcggcagacgtccacaagcacg

SEQ ID NO: 195111 - DNA, 25 bp, Homo sapien
tgcaccgcagtcctgcatgtctggg

SEQ ID NO: 195112 - DNA, 25 bp, Homo sapien
cagacgtccacaagcacgggaagta

SEQ ID NO: 195113 - DNA, 25 bp, Homo sapien
agcacgggaagtacccgcagcacct

SEQ ID NO: 195114 - DNA, 25 bp, Homo sapien
tggctgcaccgcagtcctgcatgtc

SEQ ID NO: 195115 - DNA, 25 bp, Homo sapien
cggcagacgtccacaagcacgggaa

SEQ ID NO: 195116 - DNA, 25 bp, Homo sapien
cgcgccgacgcacccaagttagggt

SEQ ID NO: 195117 - DNA, 25 bp, Homo sapien
ggacgtctcgcggttatgtaatgca

SEQ ID NO: 195118 - DNA, 25 bp, Homo sapien
gccaaaccgctctaggactgccgga

SEQ ID NO: 195119 - DNA, 25 bp, Homo sapien
cgcggggatccgctctaagtactgt

SEQ ID NO: 195120 - DNA, 25 bp, Homo sapien
ctgcctggccggcaaagaggattta

SEQ ID NO: 195121 - DNA, 25 bp, Homo sapien
tcggccttcgaaatgcaccggctca

SEQ ID NO: 195122 - DNA, 25 bp, Homo sapien
gaaaatcccagtgctcggccttcga

SEQ ID NO: 195123 - DNA, 25 bp, Homo sapien
acagggcaagtgagcacgtgtctcc

SEQ ID NO: 195124 - DNA, 25 bp, Homo sapien
gctctcctgcggttaaacggtggcc

SEQ ID NO: 195125 - DNA, 25 bp, Homo sapien
gaacatcctctagcctctgaatcca

SEQ ID NO: 195126 - DNA, 25 bp, Homo sapien
cctctagcctctgaatccagcaagg

SEQ ID NO: 195127 - DNA, 25 bp, Homo sapien
ctagcctctgaatccagcaaggccg

SEQ ID NO: 195128 - DNA, 25 bp, Homo sapien
agcaaggccgcgctcatatcagctc

SEQ ID NO: 195129 - DNA, 25 bp, Homo sapien
tatcagctctcctgcggttaaacgg

SEQ ID NO: 195130 - DNA, 25 bp, Homo sapien
cctgaacatcctctagcctctgaat

SEQ ID NO: 195131 - DNA, 25 bp, Homo sapien
gctcatatcagctctcctgcggtta

SEQ ID NO: 195132 - DNA, 25 bp, Homo sapien
gagagccagatgtgcttgtcaaaga

SEQ ID NO: 195133 - DNA, 25 bp, Homo sapien
gccagatgtgcttgtcaaagaagcc

SEQ ID NO: 195134 - DNA, 25 bp, Homo sapien
tgcccaacctcccacggagtgggaa

SEQ ID NO: 195135 - DNA, 25 bp, Homo sapien
cgtctccaccgaaagccagtcattg

SEQ ID NO: 195136 - DNA, 25 bp, Homo sapien
agccagtcattgaccaggaagaagg

SEQ ID NO: 195137 - DNA, 25 bp, Homo sapien
accacacggcgttggcgcccaggaa

SEQ ID NO: 195138 - DNA, 25 bp, Homo sapien
ggccggtcccatatggagagccaga

SEQ ID NO: 195139 - DNA, 25 bp, Homo sapien
ttgtcgtgccacactcggatcttcc

SEQ ID NO: 195140 - DNA, 25 bp, Homo sapien
gtcacgtgcaagctgtgccttctca

SEQ ID NO: 195141 - DNA, 25 bp, Homo sapien
ttacatccgctgtcggctcctgtga

SEQ ID NO: 195142 - DNA, 25 bp, Homo sapien
ttctcaggatagagccgagcccacc

SEQ ID NO: 195143 - DNA, 25 bp, Homo sapien
tcccaggagcacagggtcactcaca

SEQ ID NO: 195144 - DNA, 25 bp, Homo sapien
cgtcctcctcgctgaagtactggca

SEQ ID NO: 195145 - DNA, 25 bp, Homo sapien
tactggcacagggacgtgtacaggc

SEQ ID NO: 195146 - DNA, 25 bp, Homo sapien
cccagcctgtcttgacgaggatctc

SEQ ID NO: 195147 - DNA, 25 bp, Homo sapien
acgaggatctcgtacttgaagcggc

SEQ ID NO: 195148 - DNA, 25 bp, Homo sapien
cggtgtagttgctgatatagccaaa

SEQ ID NO: 195149 - DNA, 25 bp, Homo sapien
ggattggagtccaccagaaagatga

SEQ ID NO: 195150 - DNA, 25 bp, Homo sapien
gtgaccacagcaccgacggaggcct

SEQ ID NO: 195151 - DNA, 25 bp, Homo sapien
cccagtccgagttgttgggcacctt

SEQ ID NO: 195152 - DNA, 25 bp, Homo sapien
agcgtatagttgagctgcagatgca

SEQ ID NO: 195153 - DNA, 25 bp, Homo sapien
ccaccttggtggagacggtgtagtt

SEQ ID NO: 195154 - DNA, 25 bp, Homo sapien
cagaaagatgagctgcaccacgtca

SEQ ID NO: 195155 - DNA, 25 bp, Homo sapien
caccttcacggtgatggcgcgctct

SEQ ID NO: 195156 - DNA, 25 bp, Homo sapien
agcgtgaaggtgtatccctcgccgt

SEQ ID NO: 195157 - DNA, 25 bp, Homo sapien
tgtagacacagaactcctcgcagtg

SEQ ID NO: 195158 - DNA, 25 bp, Homo sapien
tgctgcaattgaggcagcggccctc

SEQ ID NO: 195159 - DNA, 25 bp, Homo sapien
tcttgttgctgaacgtacgtgcagc

SEQ ID NO: 195160 - DNA, 25 bp, Homo sapien
agtactcgatgacgtgctggggatc

SEQ ID NO: 195161 - DNA, 25 bp, Homo sapien
gcccgtggatgtggtggtctcatcc

SEQ ID NO: 195162 - DNA, 25 bp, Homo sapien
gagaggctgcccttgtagacacaga

SEQ ID NO: 195163 - DNA, 25 bp, Homo sapien
ggctcacctgttgagggcgaccaca

SEQ ID NO: 195164 - DNA, 25 bp, Homo sapien
acctgctgctgagcgacgcccgctc

SEQ ID NO: 195165 - DNA, 25 bp, Homo sapien
ggtgccatctggctccgcccttctc

SEQ ID NO: 195166 - DNA, 25 bp, Homo sapien
ggccagcgatgagggactggcatcc

SEQ ID NO: 195167 - DNA, 25 bp, Homo sapien
tactcacagcgctgtggcgtccgcg

SEQ ID NO: 195168 - DNA, 25 bp, Homo sapien
tgggcccgctactcacagcgctgtg

SEQ ID NO: 195169 - DNA, 25 bp, Homo sapien
ggcgttccttatttagcagggccgc

SEQ ID NO: 195170 - DNA, 25 bp, Homo sapien
gcggctccaggcgttccttatttag

SEQ ID NO: 195171 - DNA, 25 bp, Homo sapien
ctccgctccacagggtcggcagcag

SEQ ID NO: 195172 - DNA, 25 bp, Homo sapien
gctgctttacggctcgctcgtctcg

SEQ ID NO: 195173 - DNA, 25 bp, Homo sapien
gtgtgtgtgggtcgctcaatcgctc

SEQ ID NO: 195174 - DNA, 25 bp, Homo sapien
aacgtgctgctttacggctcgctcg

SEQ ID NO: 195175 - DNA, 25 bp, Homo sapien
tttacggctcgctcgtctcggccgg

SEQ ID NO: 195176 - DNA, 25 bp, Homo sapien
caccaacgtgctgctttacggctcg

SEQ ID NO: 195177 - DNA, 25 bp, Homo sapien
gggacgcgctgcaacagcggctgca

SEQ ID NO: 195178 - DNA, 25 bp, Homo sapien
tcaatcgctccggagcttctggagg

SEQ ID NO: 195179 - DNA, 25 bp, Homo sapien
gggtcgctcaatcgctccggagctt

SEQ ID NO: 195180 - DNA, 25 bp, Homo sapien
tggtggtgaccttccacgccaactt

SEQ ID NO: 195181 - DNA, 25 bp, Homo sapien
tggccacgttggtggtgaccttcca

SEQ ID NO: 195182 - DNA, 25 bp, Homo sapien
acccgtggcccaccaacgtgctgct

SEQ ID NO: 195183 - DNA, 25 bp, Homo sapien
cgccaacttcaactacgtgtggctg

SEQ ID NO: 195184 - DNA, 25 bp, Homo sapien
tgctggccaagttgctgtgcgacca

SEQ ID NO: 195185 - DNA, 25 bp, Homo sapien
ccaagttgctgtgcgaccaggtggt

SEQ ID NO: 195186 - DNA, 25 bp, Homo sapien
cgcccatcgcggtctcggccttcta

SEQ ID NO: 195187 - DNA, 25 bp, Homo sapien
cgaccaggtggtcggtgcgcccatc

SEQ ID NO: 195188 - DNA, 25 bp, Homo sapien
acccatctggaagccgagaagcctc

SEQ ID NO: 195189 - DNA, 25 bp, Homo sapien
cggcccgttaaaacgctgctggctg

SEQ ID NO: 195190 - DNA, 25 bp, Homo sapien
ccctgcagcccgcaacgggaatgga

SEQ ID NO: 195191 - DNA, 25 bp, Homo sapien
aagcaatctttgtccacccatctgg

SEQ ID NO: 195192 - DNA, 25 bp, Homo sapien
cgacttaggagtcccggatccgtca

SEQ ID NO: 195193 - DNA, 25 bp, Homo sapien
cagctcgcagctggtcctgtgaagt

SEQ ID NO: 195194 - DNA, 25 bp, Homo sapien
aggatcctctctccgcctgggatgc

SEQ ID NO: 195195 - DNA, 25 bp, Homo sapien
ccacggggatcagcgatggaattaa

SEQ ID NO: 195196 - DNA, 25 bp, Homo sapien
gaggccggcgtattttcctgaaatg

SEQ ID NO: 195197 - DNA, 25 bp, Homo sapien
agtgccttgccaccggtgcgttcct

SEQ ID NO: 195198 - DNA, 25 bp, Homo sapien
tccaggcagcgttctgcagcatctc

SEQ ID NO: 195199 - DNA, 25 bp, Homo sapien
aaagtttccaaacgacgctgctctg

SEQ ID NO: 195200 - DNA, 25 bp, Homo sapien
aacgacgctgctctgcgctgattgg

SEQ ID NO: 195201 - DNA, 25 bp, Homo sapien
attttcctgaaatgcgcggcccgca

SEQ ID NO: 195202 - DNA, 25 bp, Homo sapien
cctaaaaagttaggcactgagtgcc

SEQ ID NO: 195203 - DNA, 25 bp, Homo sapien
cggtaccgtagagcagcagccaatg

SEQ ID NO: 195204 - DNA, 25 bp, Homo sapien
tgcgggatgcttgagaacgtcttcc

SEQ ID NO: 195205 - DNA, 25 bp, Homo sapien
aggccggagcgtccaaatctccctg

SEQ ID NO: 195206 - DNA, 25 bp, Homo sapien
ggacgcctctctttatagacccgga

SEQ ID NO: 195207 - DNA, 25 bp, Homo sapien
gtgcacggaacaggtgcgcaccgca

SEQ ID NO: 195208 - DNA, 25 bp, Homo sapien
gcgcaccgcacaagggcgcacggaa

SEQ ID NO: 195209 - DNA, 25 bp, Homo sapien
ggtcgcagacgctccggatccctag

SEQ ID NO: 195210 - DNA, 25 bp, Homo sapien
tgagaacgtcttccctgagtcggtt

SEQ ID NO: 195211 - DNA, 25 bp, Homo sapien
tccctgagtcggttccggccgcaaa

SEQ ID NO: 195212 - DNA, 25 bp, Homo sapien
gacttacgcggcctgttctttctcc

SEQ ID NO: 195213 - DNA, 25 bp, Homo sapien
tcattctccggcgtctttatttccc

SEQ ID NO: 195214 - DNA, 25 bp, Homo sapien
tggaggtcattctccggcgtcttta

SEQ ID NO: 195215 - DNA, 25 bp, Homo sapien
aggcggcctcgctggaggtcattct

SEQ ID NO: 195216 - DNA, 25 bp, Homo sapien
gatggaagccgttgtgcagcagccc

SEQ ID NO: 195217 - DNA, 25 bp, Homo sapien
ccggcatttcttggccggggagtca

SEQ ID NO: 195218 - DNA, 25 bp, Homo sapien
ggccgcgcgacttcaaacgcggctt

SEQ ID NO: 195219 - DNA, 25 bp, Homo sapien
gcttccgattcagcagccgcagagc

SEQ ID NO: 195220 - DNA, 25 bp, Homo sapien
tgacgcctgtaaaagccaacccatg

SEQ ID NO: 195221 - DNA, 25 bp, Homo sapien
gtagtgaatgtcgaccagagactcc

SEQ ID NO: 195222 - DNA, 25 bp, Homo sapien
ctcagtttatgagctctgcggttga

SEQ ID NO: 195223 - DNA, 25 bp, Homo sapien
gtggtctgtagccaataggcgcaca

SEQ ID NO: 195224 - DNA, 25 bp, Homo sapien
tttccacaagatgaaggcccgacgc

SEQ ID NO: 195225 - DNA, 25 bp, Homo sapien
aatcagcgagcgctctcggaaggcc

SEQ ID NO: 195226 - DNA, 25 bp, Homo sapien
cgcaggccctcacaccgaagaatga

SEQ ID NO: 195227 - DNA, 25 bp, Homo sapien
tgccacagtcgccatttttcaacgg

SEQ ID NO: 195228 - DNA, 25 bp, Homo sapien
ccaggtccagtcagtttctcaggtg

SEQ ID NO: 195229 - DNA, 25 bp, Homo sapien
ttgtcccggtttgcaggaaagggca

SEQ ID NO: 195230 - DNA, 25 bp, Homo sapien
cccttcgcagttgtcccggtttgca

SEQ ID NO: 195231 - DNA, 25 bp, Homo sapien
gtccagtcagtttctcaggtgagga

SEQ ID NO: 195232 - DNA, 25 bp, Homo sapien
cgggttccacgaaggccaggtccag

SEQ ID NO: 195233 - DNA, 25 bp, Homo sapien
acctgttcacttggggaggctggga

SEQ ID NO: 195234 - DNA, 25 bp, Homo sapien
gctgtgggcccttcgcagttgtccc

SEQ ID NO: 195235 - DNA, 25 bp, Homo sapien
ctggggccttcctggaatcccgcag

SEQ ID NO: 195236 - DNA, 25 bp, Homo sapien
tgggcctaagccttggaggatctgg

SEQ ID NO: 195237 - DNA, 25 bp, Homo sapien
agttcctgcggagcagagcgtgggg

SEQ ID NO: 195238 - DNA, 25 bp, Homo sapien
gaaacttgggtgactcagttcctgc

SEQ ID NO: 195239 - DNA, 25 bp, Homo sapien
ggctccgacccgctctgggtacgtg

SEQ ID NO: 195240 - DNA, 25 bp, Homo sapien
cgatggctccgacccgctctgggta

SEQ ID NO: 195241 - DNA, 25 bp, Homo sapien
ccgagaggtggctggtccggctgcc

SEQ ID NO: 195242 - DNA, 25 bp, Homo sapien
ttccggaaggcgagccaacgctccc

SEQ ID NO: 195243 - DNA, 25 bp, Homo sapien
gcttctgcagcgccgatggctccga

SEQ ID NO: 195244 - DNA, 25 bp, Homo sapien
cgggccttcgccacatctttattgc

SEQ ID NO: 195245 - DNA, 25 bp, Homo sapien
cggtgtcccagtcaacagcgtggta

SEQ ID NO: 195246 - DNA, 25 bp, Homo sapien
tggacatgttccgacagggctcata

SEQ ID NO: 195247 - DNA, 25 bp, Homo sapien
tctggctagtcaggcgaagtttgca

SEQ ID NO: 195248 - DNA, 25 bp, Homo sapien
ccctggccgccattgtttgaatttg

SEQ ID NO: 195249 - DNA, 25 bp, Homo sapien
ggagagcttcttccggtagccactg

SEQ ID NO: 195250 - DNA, 25 bp, Homo sapien
agcgcactactaaagcccggctagc

SEQ ID NO: 195251 - DNA, 25 bp, Homo sapien
cgtggtacttatgacagccgcgaga

SEQ ID NO: 195252 - DNA, 25 bp, Homo sapien
aatagataagtctgcggtgtgggct

SEQ ID NO: 195253 - DNA, 25 bp, Homo sapien
ccctgggccacagagaagagacaga

SEQ ID NO: 195254 - DNA, 25 bp, Homo sapien
ccgctggatgctgccatgcagagca

SEQ ID NO: 195255 - DNA, 25 bp, Homo sapien
tgctgccatgcagagcatgttcttg

SEQ ID NO: 195256 - DNA, 25 bp, Homo sapien
agcatgttcttggtgactgtgtggc

SEQ ID NO: 195257 - DNA, 25 bp, Homo sapien
ggccacgcaccgtcttgggtggtct

SEQ ID NO: 195258 - DNA, 25 bp, Homo sapien
tggacagccctcctgctactgggac

SEQ ID NO: 195259 - DNA, 25 bp, Homo sapien
ctgctactgggactgcttctgagca

SEQ ID NO: 195260 - DNA, 25 bp, Homo sapien
ccgggctctgctttaaaactggatg

SEQ ID NO: 195261 - DNA, 25 bp, Homo sapien
agcactcctacctgaggcctgggga

SEQ ID NO: 195262 - DNA, 25 bp, Homo sapien
ctgtggggcactactgctttgtgtt

SEQ ID NO: 195263 - DNA, 25 bp, Homo sapien
tgagcccagagaacacccagcttgc

SEQ ID NO: 195264 - DNA, 25 bp, Homo sapien
ggtgaacgcctccaacctggtgagc

SEQ ID NO: 195265 - DNA, 25 bp, Homo sapien
gcagcacggtcaccattccacggga

SEQ ID NO: 195266 - DNA, 25 bp, Homo sapien
ctggcgtggagtacaccttcagcct

SEQ ID NO: 195267 - DNA, 25 bp, Homo sapien
cttcgacacaggtcagtgcgtggca

SEQ ID NO: 195268 - DNA, 25 bp, Homo sapien
ggctcacggcctacgtcaccgggaa

SEQ ID NO: 195269 - DNA, 25 bp, Homo sapien
acgtgcgcctggaggtcaacaacac

SEQ ID NO: 195270 - DNA, 25 bp, Homo sapien
ctgcgggcacagaactgcacagtga

SEQ ID NO: 195271 - DNA, 25 bp, Homo sapien
tgcagacgggcgacaacatcacgtg

SEQ ID NO: 195272 - DNA, 25 bp, Homo sapien
acatcacgtggaccttcgacatggg

SEQ ID NO: 195273 - DNA, 25 bp, Homo sapien
ctcagcgtggacatgagcctggccg

SEQ ID NO: 195274 - DNA, 25 bp, Homo sapien
tcaacaacacggtgagcggtgcggc

SEQ ID NO: 195275 - DNA, 25 bp, Homo sapien
tggagcatgtgtacctgcgggcaca

SEQ ID NO: 195276 - DNA, 25 bp, Homo sapien
ctccaacgcagtcagctgggtctca

SEQ ID NO: 195277 - DNA, 25 bp, Homo sapien
gccggcagtgatgtgcgctattcct

SEQ ID NO: 195278 - DNA, 25 bp, Homo sapien
cgtgggcaccttcaatatcatcgtc

SEQ ID NO: 195279 - DNA, 25 bp, Homo sapien
gcccaggacagcatcttcgtctatg

SEQ ID NO: 195280 - DNA, 25 bp, Homo sapien
tcgtatacacttggtccttggagga

SEQ ID NO: 195281 - DNA, 25 bp, Homo sapien
gtcaccatggtcttcccggatgctg

SEQ ID NO: 195282 - DNA, 25 bp, Homo sapien
tgggtctcagccacgtacaacctca

SEQ ID NO: 195283 - DNA, 25 bp, Homo sapien
aagcgtggccctcatgtcaccatgg

SEQ ID NO: 195284 - DNA, 25 bp, Homo sapien
ggccaaagctgagatgacttgcctg

SEQ ID NO: 195285 - DNA, 25 bp, Homo sapien
tgccacacgtgttgggcagcagacc

SEQ ID NO: 195286 - DNA, 25 bp, Homo sapien
catcatgctgtatggggtggacagc

SEQ ID NO: 195287 - DNA, 25 bp, Homo sapien
tggaagatccgagtgtggcacgaca

SEQ ID NO: 195288 - DNA, 25 bp, Homo sapien
tcaatgactggctttcggtggagac

SEQ ID NO: 195289 - DNA, 25 bp, Homo sapien
acttgcctgggatgccacacgtgtt

SEQ ID NO: 195290 - DNA, 25 bp, Homo sapien
cttcttcctggtcaatgactggctt

SEQ ID NO: 195291 - DNA, 25 bp, Homo sapien
taccacggcccacgtgggcatcatg

SEQ ID NO: 195292 - DNA, 25 bp, Homo sapien
tgcggcccagccttaagggtcccag

SEQ ID NO: 195293 - DNA, 25 bp, Homo sapien
gctcccaagccacgtgcgggacgga

SEQ ID NO: 195294 - DNA, 25 bp, Homo sapien
ggaaagcagggactggggaacagac

SEQ ID NO: 195295 - DNA, 25 bp, Homo sapien
cccaagccacgtgcgggacggagca

SEQ ID NO: 195296 - DNA, 25 bp, Homo sapien
gaggacggcaccgcctccaagtgca

SEQ ID NO: 195297 - DNA, 25 bp, Homo sapien
cgcctccaagtgcagctgcactcgg

SEQ ID NO: 195298 - DNA, 25 bp, Homo sapien
aggctcccaagccacgtgcgggacg

SEQ ID NO: 195299 - DNA, 25 bp, Homo sapien
ttctcgaaggcattagatgccagca

SEQ ID NO: 195300 - DNA, 25 bp, Homo sapien
agcagatgttggctccagggcacca

SEQ ID NO: 195301 - DNA, 25 bp, Homo sapien
gaactctctccatagcgcatagggg

SEQ ID NO: 195302 - DNA, 25 bp, Homo sapien
cgcgggaacggagaagaggaactct

SEQ ID NO: 195303 - DNA, 25 bp, Homo sapien
tccagcggcaagcagatgttggctc

SEQ ID NO: 195304 - DNA, 25 bp, Homo sapien
ctgttgtccggggacctgctctcag

SEQ ID NO: 195305 - DNA, 25 bp, Homo sapien
aggctcgctgccgttctccggggtc

SEQ ID NO: 195306 - DNA, 25 bp, Homo sapien
agaggaactctctccatagcgcata

SEQ ID NO: 195307 - DNA, 25 bp, Homo sapien
acgtgcagccattggcgcaggcctg

SEQ ID NO: 195308 - DNA, 25 bp, Homo sapien
ggcccaggacaccaggacgaacaga

SEQ ID NO: 195309 - DNA, 25 bp, Homo sapien
gcgctgagcacaggtcggtgttaca

SEQ ID NO: 195310 - DNA, 25 bp, Homo sapien
cacgaggaggttctcggcatcctgc

SEQ ID NO: 195311 - DNA, 25 bp, Homo sapien
acaccaggacgaacagactggggac

SEQ ID NO: 195312 - DNA, 25 bp, Homo sapien
ccgtgccagaggcatcaggggtccc

SEQ ID NO: 195313 - DNA, 25 bp, Homo sapien
tgagaggccgtcctgccgtgccaga

SEQ ID NO: 195314 - DNA, 25 bp, Homo sapien
tacctccacgggctcgtgcggggct

SEQ ID NO: 195315 - DNA, 25 bp, Homo sapien
cgctcccacgaggaggttctcggca

SEQ ID NO: 195316 - DNA, 25 bp, Homo sapien
gtacgacaccgagacctggttgggc

SEQ ID NO: 195317 - DNA, 25 bp, Homo sapien
tgcaaggagaccgactgggattccc

SEQ ID NO: 195318 - DNA, 25 bp, Homo sapien
cccgcagctaagagtccagcttgtg

SEQ ID NO: 195319 - DNA, 25 bp, Homo sapien
gttcctttgggcaaacccgcagcta

SEQ ID NO: 195320 - DNA, 25 bp, Homo sapien
cccatgtgaggtcggagtgtcctcc

SEQ ID NO: 195321 - DNA, 25 bp, Homo sapien
ctgggtctctggaaagccattttta

SEQ ID NO: 195322 - DNA, 25 bp, Homo sapien
tgagtcctcccttagttcttcgcgc

SEQ ID NO: 195323 - DNA, 25 bp, Homo sapien
ttgctttcaggttctttcaggttcc

SEQ ID NO: 195324 - DNA, 25 bp, Homo sapien
gcgggactgtccaccattgccaggg

SEQ ID NO: 195325 - DNA, 25 bp, Homo sapien
cagagcgggtgcaccgctggagacc

SEQ ID NO: 195326 - DNA, 25 bp, Homo sapien
agaagatctccgtgtccgaggggca

SEQ ID NO: 195327 - DNA, 25 bp, Homo sapien
ccagagaagatctccgtgtccgagg

SEQ ID NO: 195328 - DNA, 25 bp, Homo sapien
ttgccagagaagatctccgtgtccg

SEQ ID NO: 195329 - DNA, 25 bp, Homo sapien
ttctccaccaccaggcggtagcagt

SEQ ID NO: 195330 - DNA, 25 bp, Homo sapien
ggcgggactgtccaccattgccagg

SEQ ID NO: 195331 - DNA, 25 bp, Homo sapien
tctccaccaccaggcggtagcagtg

SEQ ID NO: 195332 - DNA, 25 bp, Homo sapien
cgggtgttccctgtgagcccgagtc

SEQ ID NO: 195333 - DNA, 25 bp, Homo sapien
ctgtgagcccgagtccgcttcagga

SEQ ID NO: 195334 - DNA, 25 bp, Homo sapien
tggcaacccagcaccggggaagccg

SEQ ID NO: 195335 - DNA, 25 bp, Homo sapien
gaagccgtcagctgctgtgacaata

SEQ ID NO: 195336 - DNA, 25 bp, Homo sapien
gctgctgtgacaataaaacctgccc

SEQ ID NO: 195337 - DNA, 25 bp, Homo sapien
cgcaggctcggtcccgggtccatgt

SEQ ID NO: 195338 - DNA, 25 bp, Homo sapien
gcactgaggccgaaagtgcctgcca

SEQ ID NO: 195339 - DNA, 25 bp, Homo sapien
agtgcctgccagacggcacggtctg

SEQ ID NO: 195340 - DNA, 25 bp, Homo sapien
gcgggactgtccaccattgccaggg

SEQ ID NO: 195341 - DNA, 25 bp, Homo sapien
tctccaccaccaggcggtagcagtg

SEQ ID NO: 195342 - DNA, 25 bp, Homo sapien
tcactctgcaccgaggacgggcaca

SEQ ID NO: 195343 - DNA, 25 bp, Homo sapien
aggtcgaggctctcgtcactctgca

SEQ ID NO: 195344 - DNA, 25 bp, Homo sapien
agtgggcagcagacactcacctcgg

SEQ ID NO: 195345 - DNA, 25 bp, Homo sapien
gtgtcaacggtcagtgtgggcccaa

SEQ ID NO: 195346 - DNA, 25 bp, Homo sapien
agaagatctccgtgtccgaggggca

SEQ ID NO: 195347 - DNA, 25 bp, Homo sapien
gcccaggcagcacatagcgatgcga

SEQ ID NO: 195348 - DNA, 25 bp, Homo sapien
gcccgcggacagcatagcctcggaa

SEQ ID NO: 195349 - DNA, 25 bp, Homo sapien
cgagaccatctctgccttctagagg

SEQ ID NO: 195350 - DNA, 25 bp, Homo sapien
tgctcggcaaggaaacgagaccatc

SEQ ID NO: 195351 - DNA, 25 bp, Homo sapien
agaactaaggcgcatgctcggcaag

SEQ ID NO: 195352 - DNA, 25 bp, Homo sapien
gtccgacttgacgaagccaccgcag

SEQ ID NO: 195353 - DNA, 25 bp, Homo sapien
gtagttgatctccacgtccgacttg

SEQ ID NO: 195354 - DNA, 25 bp, Homo sapien
taagggctccaaggactccacaccg

SEQ ID NO: 195355 - DNA, 25 bp, Homo sapien
gcctcggaagaggtaagggctccaa

SEQ ID NO: 195356 - DNA, 25 bp, Homo sapien
gccgagcagtctgcccagagactta

SEQ ID NO: 195357 - DNA, 25 bp, Homo sapien
acagaaggcgccgatggccgcgcct

SEQ ID NO: 195358 - DNA, 25 bp, Homo sapien
cccacgacgacagaaggcgccgatg

SEQ ID NO: 195359 - DNA, 25 bp, Homo sapien
acgctgggacccacgacgacagaag

SEQ ID NO: 195360 - DNA, 25 bp, Homo sapien
gcccagagacttagcgacagacaga

SEQ ID NO: 195361 - DNA, 25 bp, Homo sapien
ggagctcgaatcccagccggaccag

SEQ ID NO: 195362 - DNA, 25 bp, Homo sapien
acctcgcctgttttcacctcccgtg

SEQ ID NO: 195363 - DNA, 25 bp, Homo sapien
cttagcgacagacagacgctgggac

SEQ ID NO: 195364 - DNA, 25 bp, Homo sapien
tggctgtcacctcgctcagcaggtg

SEQ ID NO: 195365 - DNA, 25 bp, Homo sapien
agttgcccgcgatcgtcagcagcgt

SEQ ID NO: 195366 - DNA, 25 bp, Homo sapien
ggcagctccacagttcgcagcagca

SEQ ID NO: 195367 - DNA, 25 bp, Homo sapien
gccgctgctgttaacgtccatcatc

SEQ ID NO: 195368 - DNA, 25 bp, Homo sapien
cacatgacgtccatggcgatgaaga

SEQ ID NO: 195369 - DNA, 25 bp, Homo sapien
tcagcagcgtgatgagcgtcaggat

SEQ ID NO: 195370 - DNA, 25 bp, Homo sapien
tcacaactttctcgactctgccgta

SEQ ID NO: 195371 - DNA, 25 bp, Homo sapien
actctgccgtagttgatctgttccc

SEQ ID NO: 195372 - DNA, 25 bp, Homo sapien
cgccgatggcagacggatgaaattg

SEQ ID NO: 195373 - DNA, 25 bp, Homo sapien
gacaccgagaccgaaccttagattg

SEQ ID NO: 195374 - DNA, 25 bp, Homo sapien
tggctctcctctatgcctgtccagg

SEQ ID NO: 195375 - DNA, 25 bp, Homo sapien
gctaccgcctagctgggcagtcgaa

SEQ ID NO: 195376 - DNA, 25 bp, Homo sapien
gcgctgcctcagcactaaagggaga

SEQ ID NO: 195377 - DNA, 25 bp, Homo sapien
tctcagagagtgctactcaccggcg

SEQ ID NO: 195378 - DNA, 25 bp, Homo sapien
agctatcgcgagactttcaaaggcc

SEQ ID NO: 195379 - DNA, 25 bp, Homo sapien
tccaggaaccggcaaggccaggatc

SEQ ID NO: 195380 - DNA, 25 bp, Homo sapien
ctcctcattggacagaccgagctta

SEQ ID NO: 195381 - DNA, 25 bp, Homo sapien
cctcgactcctactcgcggtgatga

SEQ ID NO: 195382 - DNA, 25 bp, Homo sapien
ggtgatgaatcacgcgccctcctcg

SEQ ID NO: 195383 - DNA, 25 bp, Homo sapien
gggcctgcgacacttcatcttttcc

SEQ ID NO: 195384 - DNA, 25 bp, Homo sapien
gctttcgcagccgaggagactctct

SEQ ID NO: 195385 - DNA, 25 bp, Homo sapien
actctctggaaaatgggctactcga

SEQ ID NO: 195386 - DNA, 25 bp, Homo sapien
tcgaagagagatgctccgttgcctc

SEQ ID NO: 195387 - DNA, 25 bp, Homo sapien
tctcggggatgcagtctctacaagc

SEQ ID NO: 195388 - DNA, 25 bp, Homo sapien
cttctgtgatgtcagcgccggaacc

SEQ ID NO: 195389 - DNA, 25 bp, Homo sapien
atgtcagcgccggaacctggaatcc

SEQ ID NO: 195390 - DNA, 25 bp, Homo sapien
cccactccggcttctgtgatgtcag

SEQ ID NO: 195391 - DNA, 25 bp, Homo sapien
cctctgcggtccctgatgctcggct

SEQ ID NO: 195392 - DNA, 25 bp, Homo sapien
ggagccttgccggatctcccgggct

SEQ ID NO: 195393 - DNA, 25 bp, Homo sapien
accgctggatggagccttgccggat

SEQ ID NO: 195394 - DNA, 25 bp, Homo sapien
ctgcttgtcgccaccgctggatgga

SEQ ID NO: 195395 - DNA, 25 bp, Homo sapien
cggcagccggcggtccatccaggta

SEQ ID NO: 195396 - DNA, 25 bp, Homo sapien
agcgactttgcagactcactggtga

SEQ ID NO: 195397 - DNA, 25 bp, Homo sapien
tgatggacatgcaagcgacccaatg

SEQ ID NO: 195398 - DNA, 25 bp, Homo sapien
ccctgattggcgagcgtgtaggaaa

SEQ ID NO: 195399 - DNA, 25 bp, Homo sapien
ggcggatacaaacaacgtggacttc

SEQ ID NO: 195400 - DNA, 25 bp, Homo sapien
cagacgtgcagacaggccaatggct

SEQ ID NO: 195401 - DNA, 25 bp, Homo sapien
ttccgcctcatcgagcgccgattgg

SEQ ID NO: 195402 - DNA, 25 bp, Homo sapien
ctgtcccagaacctcagcgactttg

SEQ ID NO: 195403 - DNA, 25 bp, Homo sapien
cgattggccgcaccgccttagagag

SEQ ID NO: 195404 - DNA, 25 bp, Homo sapien
cctggggagtgacgcaattgcaccc

SEQ ID NO: 195405 - DNA, 25 bp, Homo sapien
ccagcgttccgagtcgaggacagtt

SEQ ID NO: 195406 - DNA, 25 bp, Homo sapien
agcgcgactgcgtgacttcggcctc

SEQ ID NO: 195407 - DNA, 25 bp, Homo sapien
ggttcgtaacgtcacaggcctgcga

SEQ ID NO: 195408 - DNA, 25 bp, Homo sapien
ctagggaattttcgcttgaggtttg

SEQ ID NO: 195409 - DNA, 25 bp, Homo sapien
cgccggtctagcgagctagggaatt

SEQ ID NO: 195410 - DNA, 25 bp, Homo sapien
gcagtcacagtcctgcgccggtcta

SEQ ID NO: 195411 - DNA, 25 bp, Homo sapien
cagttggcgacactgaaaattcagc

SEQ ID NO: 195412 - DNA, 25 bp, Homo sapien
tctgaaacggcaaccctgaggggct

SEQ ID NO: 195413 - DNA, 25 bp, Homo sapien
cccgcgatctcgactttgttgaacg

SEQ ID NO: 195414 - DNA, 25 bp, Homo sapien
cccacctcatgtgttcagagcttga

SEQ ID NO: 195415 - DNA, 25 bp, Homo sapien
cccgagcactgcaggttctttcatc

SEQ ID NO: 195416 - DNA, 25 bp, Homo sapien
gcgcgccaagggcaaagaaggtctc

SEQ ID NO: 195417 - DNA, 25 bp, Homo sapien
tcctggatcgcgtagagatcggctc

SEQ ID NO: 195418 - DNA, 25 bp, Homo sapien
tgctgcgcgttatatatggtacata

SEQ ID NO: 195419 - DNA, 25 bp, Homo sapien
cgaaccctgcgaggctctgttgcaa

SEQ ID NO: 195420 - DNA, 25 bp, Homo sapien
acagcttcgacgtgctggtgccact

SEQ ID NO: 195421 - DNA, 25 bp, Homo sapien
ggcatgtcggtgcactacaccctca

SEQ ID NO: 195422 - DNA, 25 bp, Homo sapien
gggcagcgcctacgagcaacataaa

SEQ ID NO: 195423 - DNA, 25 bp, Homo sapien
cttccgcggagacttcatccaggtg

SEQ ID NO: 195424 - DNA, 25 bp, Homo sapien
agttactacgagcatgaggtgcgcc

SEQ ID NO: 195425 - DNA, 25 bp, Homo sapien
ccgcagctggaaggaacacttgagc

SEQ ID NO: 195426 - DNA, 25 bp, Homo sapien
agcatcctgctggagagttactacg

SEQ ID NO: 195427 - DNA, 25 bp, Homo sapien
tgcctctaccatgtcctgcggggaa

SEQ ID NO: 195428 - DNA, 25 bp, Homo sapien
atacgctcttccactgcgtcctggg

SEQ ID NO: 195429 - DNA, 25 bp, Homo sapien
tgctgtccacgtggcaaaggctgcc

SEQ ID NO: 195430 - DNA, 25 bp, Homo sapien
tgcccaaggcactgagggaagccgc

SEQ ID NO: 195431 - DNA, 25 bp, Homo sapien
cagttgacctcctggccgctttcga

SEQ ID NO: 195432 - DNA, 25 bp, Homo sapien
ctggccgctttcgacgggcacgccc

SEQ ID NO: 195433 - DNA, 25 bp, Homo sapien
ggcacgcccgggaacttgcagcagc

SEQ ID NO: 195434 - DNA, 25 bp, Homo sapien
gaacttgcagcagcgcggttgctgt

SEQ ID NO: 195435 - DNA, 25 bp, Homo sapien
cggttgctgtccacgtggcaaaggc

SEQ ID NO: 195436 - DNA, 25 bp, Homo sapien
tagacctgttgcgtccagggcgcaa

SEQ ID NO: 195437 - DNA, 25 bp, Homo sapien
cgcgggcgaaaatggcgtacatcca

SEQ ID NO: 195438 - DNA, 25 bp, Homo sapien
tgggcgcccgatatctccgaaccgg

SEQ ID NO: 195439 - DNA, 25 bp, Homo sapien
ggctaggctcccacaaacttgcttc

SEQ ID NO: 195440 - DNA, 25 bp, Homo sapien
agcaggatgggctgacctgtgtacc

SEQ ID NO: 195441 - DNA, 25 bp, Homo sapien
tgctgcagacttcatggcaggctgc

SEQ ID NO: 195442 - DNA, 25 bp, Homo sapien
gacgcagcacctccgtttgggacgc

SEQ ID NO: 195443 - DNA, 25 bp, Homo sapien
ttaacttgaggctcccatccacgca

SEQ ID NO: 195444 - DNA, 25 bp, Homo sapien
tctatgacttgctcccactgggctg

SEQ ID NO: 195445 - DNA, 25 bp, Homo sapien
cgcctctgctagttgtttggcacca

SEQ ID NO: 195446 - DNA, 25 bp, Homo sapien
ggcaccagccactttgaagccaatc

SEQ ID NO: 195447 - DNA, 25 bp, Homo sapien
tcacgcagggagcttgtctatttgc

SEQ ID NO: 195448 - DNA, 25 bp, Homo sapien
gctgcagcagcgtctaattagatcc

SEQ ID NO: 195449 - DNA, 25 bp, Homo sapien
tccgggtccctcaaacatgtcgcag

SEQ ID NO: 195450 - DNA, 25 bp, Homo sapien
tgagttgactgctcagccctccaga

SEQ ID NO: 195451 - DNA, 25 bp, Homo sapien
ctgcgaagcttgaggttgcaaaccc

SEQ ID NO: 195452 - DNA, 25 bp, Homo sapien
acccatcgagtttggcgttctcagc

SEQ ID NO: 195453 - DNA, 25 bp, Homo sapien
ggagatcctgtccaagtaccagctg

SEQ ID NO: 195454 - DNA, 25 bp, Homo sapien
cgacgatgtggactctctgacagac

SEQ ID NO: 195455 - DNA, 25 bp, Homo sapien
cctcgactccaacagcgacgatgtg

SEQ ID NO: 195456 - DNA, 25 bp, Homo sapien
ccgacgactatttcaggaagttcga

SEQ ID NO: 195457 - DNA, 25 bp, Homo sapien
ccttcggtgctcagacggacctata

SEQ ID NO: 195458 - DNA, 25 bp, Homo sapien
gaaggagcccatccaaccttcggtg

SEQ ID NO: 195459 - DNA, 25 bp, Homo sapien
taccagctgggcatgctgcacttca

SEQ ID NO: 195460 - DNA, 25 bp, Homo sapien
cgtctggtggccatcaggtaaggct

SEQ ID NO: 195461 - DNA, 25 bp, Homo sapien
tgcttacttcaccatgtccgatccg

SEQ ID NO: 195462 - DNA, 25 bp, Homo sapien
cggtgaatagaggtctcggatgcca

SEQ ID NO: 195463 - DNA, 25 bp, Homo sapien
attctcagaagaaagcgatcggccc

SEQ ID NO: 195464 - DNA, 25 bp, Homo sapien
tttgcattaagaaagcttccgggga

SEQ ID NO: 195465 - DNA, 25 bp, Homo sapien
ctgcaggtgcaggaagaaaagaata

SEQ ID NO: 195466 - DNA, 25 bp, Homo sapien
agcaggaactggctcaattctcaga

SEQ ID NO: 195467 - DNA, 25 bp, Homo sapien
acccgtttctcaggtgcttacttca

SEQ ID NO: 195468 - DNA, 25 bp, Homo sapien
ggctcaaagctgaagacgcgcagta

SEQ ID NO: 195469 - DNA, 25 bp, Homo sapien
agcagcactagcagcaggaaggaga

SEQ ID NO: 195470 - DNA, 25 bp, Homo sapien
gcacaatggcggcagcagacacatc

SEQ ID NO: 195471 - DNA, 25 bp, Homo sapien
tgcaagagggcaccggctcaaagct

SEQ ID NO: 195472 - DNA, 25 bp, Homo sapien
cccagccaatcagggatcgggattc

SEQ ID NO: 195473 - DNA, 25 bp, Homo sapien
cgcgcagtagaacgaagaggctgcc

SEQ ID NO: 195474 - DNA, 25 bp, Homo sapien
gacacatccagagagggagtcggcc

SEQ ID NO: 195475 - DNA, 25 bp, Homo sapien
ctcctggggcagtagaacgagaagc

SEQ ID NO: 195476 - DNA, 25 bp, Homo sapien
agcattacgtcctccatcgcgggcg

SEQ ID NO: 195477 - DNA, 25 bp, Homo sapien
tctggcgaggcgaaattggcgccct

SEQ ID NO: 195478 - DNA, 25 bp, Homo sapien
cagtaccatttgagccattcgcttc

SEQ ID NO: 195479 - DNA, 25 bp, Homo sapien
cgagctgcgctctgtcagtaccatt

SEQ ID NO: 195480 - DNA, 25 bp, Homo sapien
gcgtgctggccgtaagcattacgtc

SEQ ID NO: 195481 - DNA, 25 bp, Homo sapien
gttgcagcctgagatccgtaatatg

SEQ ID NO: 195482 - DNA, 25 bp, Homo sapien
gatggtagtgttctggtggcccaac

SEQ ID NO: 195483 - DNA, 25 bp, Homo sapien
attcgcttcctgacaaggcccgtgg

SEQ ID NO: 195484 - DNA, 25 bp, Homo sapien
agatggccgtctttccttggtaagg

SEQ ID NO: 195485 - DNA, 25 bp, Homo sapien
taccgcggtccagcggagcaatctg

SEQ ID NO: 195486 - DNA, 25 bp, Homo sapien
tgaacctcagtttgcgtcttcgctc

SEQ ID NO: 195487 - DNA, 25 bp, Homo sapien
ttgaccgtagaatccctggccgcta

SEQ ID NO: 195488 - DNA, 25 bp, Homo sapien
aattcctctctgtcgggttctggtg

SEQ ID NO: 195489 - DNA, 25 bp, Homo sapien
cctgggtctgagagtgtgaattcct

SEQ ID NO: 195490 - DNA, 25 bp, Homo sapien
tttaccatcatgacgcccgcaggcg

SEQ ID NO: 195491 - DNA, 25 bp, Homo sapien
ggaccacccggcactgtagacagct

SEQ ID NO: 195492 - DNA, 25 bp, Homo sapien
ttgttccctcgtggcatcagtcagc

SEQ ID NO: 195493 - DNA, 25 bp, Homo sapien
ttttgttccctcgtggcatcagtca

SEQ ID NO: 195494 - DNA, 25 bp, Homo sapien
gtcagcgtggattcagcaaggtttt

SEQ ID NO: 195495 - DNA, 25 bp, Homo sapien
ctcgtggcatcagtcagcgtggatt

SEQ ID NO: 195496 - DNA, 25 bp, Homo sapien
tttgttccctcgtggcatcagtcag

SEQ ID NO: 195497 - DNA, 25 bp, Homo sapien
caaggttttgttccctcgtggcatc

SEQ ID NO: 195498 - DNA, 25 bp, Homo sapien
agcgtggattcgcaaggttttgttc

SEQ ID NO: 195499 - DNA, 25 bp, Homo sapien
gttccctcgtggcatcagtcagcgt

SEQ ID NO: 195500 - DNA, 25 bp, Homo sapien
ttacctcgtggcattaatcagcgtg

SEQ ID NO: 195501 - DNA, 25 bp, Homo sapien
atcagcgtggattcagcaaggtttt

SEQ ID NO: 195502 - DNA, 25 bp, Homo sapien
tgtacgtgaaaatgcacacccgtgg

SEQ ID NO: 195503 - DNA, 25 bp, Homo sapien
gctactgtcagcgtggattcagcaa

SEQ ID NO: 195504 - DNA, 25 bp, Homo sapien
acacccgtgggtgttcgctactgtc

SEQ ID NO: 195505 - DNA, 25 bp, Homo sapien
ggctgcttctgtcgataggcatgta

SEQ ID NO: 195506 - DNA, 25 bp, Homo sapien
ctgtcgataggcatgtacgtgaaaa

SEQ ID NO: 195507 - DNA, 25 bp, Homo sapien
cttgtggcatcagtcagcgtggatt

SEQ ID NO: 195508 - DNA, 25 bp, Homo sapien
agcagatctgcaagggtaggaaacc

SEQ ID NO: 195509 - DNA, 25 bp, Homo sapien
ccgagccgtcaagcaagaatctgtg

SEQ ID NO: 195510 - DNA, 25 bp, Homo sapien
acatagtgcgcctcaagcccagctg

SEQ ID NO: 195511 - DNA, 25 bp, Homo sapien
gccgtgacccggaagtccacttcga

SEQ ID NO: 195512 - DNA, 25 bp, Homo sapien
gcactcaccggtgggcgaaatttcc

SEQ ID NO: 195513 - DNA, 25 bp, Homo sapien
caagcctccgcatcaacagactggg

SEQ ID NO: 195514 - DNA, 25 bp, Homo sapien
agtaagatccgtacctccaaggctc

SEQ ID NO: 195515 - DNA, 25 bp, Homo sapien
tctacagactcgtcgttcacccgga

SEQ ID NO: 195516 - DNA, 25 bp, Homo sapien
gtagatccatttgcgggaacactcc

SEQ ID NO: 195517 - DNA, 25 bp, Homo sapien
tagccaatacacttaccgagggagg

SEQ ID NO: 195518 - DNA, 25 bp, Homo sapien
ctagcccggatctcagagacgattc

SEQ ID NO: 195519 - DNA, 25 bp, Homo sapien
ccggagcccaagctcgtagcttcta

SEQ ID NO: 195520 - DNA, 25 bp, Homo sapien
tggatctctacctggtccgggcaca

SEQ ID NO: 195521 - DNA, 25 bp, Homo sapien
ccctcctgggagacttggatctcta

SEQ ID NO: 195522 - DNA, 25 bp, Homo sapien
actaggacacggctgggctccttta

SEQ ID NO: 195523 - DNA, 25 bp, Homo sapien
gtgcgcccgtaagcagtccagacga

SEQ ID NO: 195524 - DNA, 25 bp, Homo sapien
acgggcacgaaacccaagccgcagg

SEQ ID NO: 195525 - DNA, 25 bp, Homo sapien
tcacctggtaaaccgaggcacagca

SEQ ID NO: 195526 - DNA, 25 bp, Homo sapien
cagcaagaggctgtagtagaccacg

SEQ ID NO: 195527 - DNA, 25 bp, Homo sapien
tgtagtagaccacgggcacgaaacc

SEQ ID NO: 195528 - DNA, 25 bp, Homo sapien
gggaccaccaagacagcgagctgtt

SEQ ID NO: 195529 - DNA, 25 bp, Homo sapien
gtgcgtgtgctccatgagcgcgccc

SEQ ID NO: 195530 - DNA, 25 bp, Homo sapien
gactggctcctacccttggccgtga

SEQ ID NO: 195531 - DNA, 25 bp, Homo sapien
ctgcccgcctggagtcttggctcag

SEQ ID NO: 195532 - DNA, 25 bp, Homo sapien
gagctccaggaatggcgcactcatc

SEQ ID NO: 195533 - DNA, 25 bp, Homo sapien
ctcatccacgtctgtgcagccgaga

SEQ ID NO: 195534 - DNA, 25 bp, Homo sapien
tagctgcccaccacattgacacatg

SEQ ID NO: 195535 - DNA, 25 bp, Homo sapien
ccgcggggcatacgcacaagtagct

SEQ ID NO: 195536 - DNA, 25 bp, Homo sapien
cggatgcgtgccattgagccacatg

SEQ ID NO: 195537 - DNA, 25 bp, Homo sapien
acggacgcatcccacaggcagcagt

SEQ ID NO: 195538 - DNA, 25 bp, Homo sapien
tcaggttgtagacgtagtagccgcc

SEQ ID NO: 195539 - DNA, 25 bp, Homo sapien
aggtgcacgtcgtaacggcctcatc

SEQ ID NO: 195540 - DNA, 25 bp, Homo sapien
ggggcgcagtctccactgcagatca

SEQ ID NO: 195541 - DNA, 25 bp, Homo sapien
ccaatggctcgtgcgtggaggtaac

SEQ ID NO: 195542 - DNA, 25 bp, Homo sapien
tgtggcgtctccagtggctacaacg

SEQ ID NO: 195543 - DNA, 25 bp, Homo sapien
cgtttctctcctgaacaccagttga

SEQ ID NO: 195544 - DNA, 25 bp, Homo sapien
ctaaagccttggacaggcggcgtcc

SEQ ID NO: 195545 - DNA, 25 bp, Homo sapien
cccgaggggatttcggttgctctct

SEQ ID NO: 195546 - DNA, 25 bp, Homo sapien
gcggcgtccagccatgcaagcaaga

SEQ ID NO: 195547 - DNA, 25 bp, Homo sapien
tgatggcccgccttcctaaaaggcc

SEQ ID NO: 195548 - DNA, 25 bp, Homo sapien
aagcctcattccgtgctgcgccagg

SEQ ID NO: 195549 - DNA, 25 bp, Homo sapien
cgcgaactggtgacgtcggatatga

SEQ ID NO: 195550 - DNA, 25 bp, Homo sapien
ccgccatggtgtgcgcaaactgaga

SEQ ID NO: 195551 - DNA, 25 bp, Homo sapien
ttggccagcacatactgagccttgc

SEQ ID NO: 195552 - DNA, 25 bp, Homo sapien
gcgctcgttcatattgcaggtgatg

SEQ ID NO: 195553 - DNA, 25 bp, Homo sapien
atgtcgtcgccgtattcgttgagga

SEQ ID NO: 195554 - DNA, 25 bp, Homo sapien
cggtaccttttctggcccatacatg

SEQ ID NO: 195555 - DNA, 25 bp, Homo sapien
cctaaggccggtctgcaatcgtgaa

SEQ ID NO: 195556 - DNA, 25 bp, Homo sapien
gatcgttggcaccttcgctttttta

SEQ ID NO: 195557 - DNA, 25 bp, Homo sapien
gaggcgcctttccaaccgtgccaga

SEQ ID NO: 195558 - DNA, 25 bp, Homo sapien
ttgaaagctgtcaagcccgtgtagc

SEQ ID NO: 195559 - DNA, 25 bp, Homo sapien
gcaccttccttctttgccaggcaga

SEQ ID NO: 195560 - DNA, 25 bp, Homo sapien
ttctcttctgcgtttcccgggctag

SEQ ID NO: 195561 - DNA, 25 bp, Homo sapien
tccgttcaaaaagcccgcgaggctg

SEQ ID NO: 195562 - DNA, 25 bp, Homo sapien
agtcgctcgacttctacttccggtc

SEQ ID NO: 195563 - DNA, 25 bp, Homo sapien
tccaagtccagctgccggaagtcgc

SEQ ID NO: 195564 - DNA, 25 bp, Homo sapien
cctactggaccagcctgtgctcggt

SEQ ID NO: 195565 - DNA, 25 bp, Homo sapien
gacctggaactggtgctcccacaga

SEQ ID NO: 195566 - DNA, 25 bp, Homo sapien
agctcagcttattgttggatgcggc

SEQ ID NO: 195567 - DNA, 25 bp, Homo sapien
gcaaagacctagcaacccggaggga

SEQ ID NO: 195568 - DNA, 25 bp, Homo sapien
agccgtcgccaagtaagggcaaaga

SEQ ID NO: 195569 - DNA, 25 bp, Homo sapien
ggacctgcctcacggaagtggctcg

SEQ ID NO: 195570 - DNA, 25 bp, Homo sapien
ctggctggggaacgttgacccacac

SEQ ID NO: 195571 - DNA, 25 bp, Homo sapien
gcgtcacgacgcacataaagacgta

SEQ ID NO: 195572 - DNA, 25 bp, Homo sapien
cgcgctttgcaaagccttgggcgcc

SEQ ID NO: 195573 - DNA, 25 bp, Homo sapien
cttggcgcgcctttgccggatcctt

SEQ ID NO: 195574 - DNA, 25 bp, Homo sapien
tcctgcttatgagtcgccgggacgg

SEQ ID NO: 195575 - DNA, 25 bp, Homo sapien
taaggggcgtctcctgcttatgagt

SEQ ID NO: 195576 - DNA, 25 bp, Homo sapien
tctggctccctctcgggacgctctt

SEQ ID NO: 195577 - DNA, 25 bp, Homo sapien
agtgtaaggggcgtctcctgcttat

SEQ ID NO: 195578 - DNA, 25 bp, Homo sapien
cttcgcttcgcctgcaaacgcggtg

SEQ ID NO: 195579 - DNA, 25 bp, Homo sapien
tctcgggacgctctttccttcttcc

SEQ ID NO: 195580 - DNA, 25 bp, Homo sapien
tgggtcccttccagcaacggattcc

SEQ ID NO: 195581 - DNA, 25 bp, Homo sapien
ggcgagatgggtcccttccagcaac

SEQ ID NO: 195582 - DNA, 25 bp, Homo sapien
tcaggaacgctggtacccggctcat

SEQ ID NO: 195583 - DNA, 25 bp, Homo sapien
tacccggctcatctcgccacctgtg

SEQ ID NO: 195584 - DNA, 25 bp, Homo sapien
tgtgccttctaacctcagtctccgc

SEQ ID NO: 195585 - DNA, 25 bp, Homo sapien
gtgccctttatgagcgcgcccgctg

SEQ ID NO: 195586 - DNA, 25 bp, Homo sapien
gagaagttggccagggccgtctcta

SEQ ID NO: 195587 - DNA, 25 bp, Homo sapien
gtaccctcggctgtgccctttatga

SEQ ID NO: 195588 - DNA, 25 bp, Homo sapien
tgaggagccccaaccagatggacgc

SEQ ID NO: 195589 - DNA, 25 bp, Homo sapien
ggcgaggcttgagcagtgagtgctc

SEQ ID NO: 195590 - DNA, 25 bp, Homo sapien
cggcgcgcggagctcgaaagcgcgc

SEQ ID NO: 195591 - DNA, 25 bp, Homo sapien
atcaggctacagactcgcccgcggg

SEQ ID NO: 195592 - DNA, 25 bp, Homo sapien
aggatcaggctacagactcgcccgc

SEQ ID NO: 195593 - DNA, 25 bp, Homo sapien
cgcgcaggatcaggctacagactcg

SEQ ID NO: 195594 - DNA, 25 bp, Homo sapien
cacctcctggtgtgcctctggcggg

SEQ ID NO: 195595 - DNA, 25 bp, Homo sapien
ttgagcagtgagtgctcgggagccc

SEQ ID NO: 195596 - DNA, 25 bp, Homo sapien
cgtcccgatggtgaactgcctaact

SEQ ID NO: 195597 - DNA, 25 bp, Homo sapien
tcccgatggtgaactgccaaacttt

SEQ ID NO: 195598 - DNA, 25 bp, Homo sapien
gtcccgatggtgaactgcctaactc

SEQ ID NO: 195599 - DNA, 25 bp, Homo sapien
gaactgcctaaacctcgtcccgatg

SEQ ID NO: 195600 - DNA, 25 bp, Homo sapien
tcccgatggtgaactgccgaactct

SEQ ID NO: 195601 - DNA, 25 bp, Homo sapien
tcccgatggtgaactgctaactctg

SEQ ID NO: 195602 - DNA, 25 bp, Homo sapien
cccgatggtgaactgcctaactcta

SEQ ID NO: 195603 - DNA, 25 bp, Homo sapien
cccgatggtgaactgccaaacttta

SEQ ID NO: 195604 - DNA, 25 bp, Homo sapien
tctgctccaggacggaatcttttgg

SEQ ID NO: 195605 - DNA, 25 bp, Homo sapien
ccagctgaaggtgaccatggcacac

SEQ ID NO: 195606 - DNA, 25 bp, Homo sapien
actgaggaggttcttgcgtgctccc

SEQ ID NO: 195607 - DNA, 25 bp, Homo sapien
ccctttcagggacttggggcatagg

SEQ ID NO: 195608 - DNA, 25 bp, Homo sapien
tgctaaactccagtagaccctgagg

SEQ ID NO: 195609 - DNA, 25 bp, Homo sapien
ctgcgggataataggtggaacaaac

SEQ ID NO: 195610 - DNA, 25 bp, Homo sapien
caaactggggactacactcgtgggc

SEQ ID NO: 195611 - DNA, 25 bp, Homo sapien
gagcagcggctcatgaatcttctta

SEQ ID NO: 195612 - DNA, 25 bp, Homo sapien
tgtgccctcaacgaacactccctgg

SEQ ID NO: 195613 - DNA, 25 bp, Homo sapien
ctctctccgtagagcccgtgttctg

SEQ ID NO: 195614 - DNA, 25 bp, Homo sapien
agcccgtgttctggtactacgtgaa

SEQ ID NO: 195615 - DNA, 25 bp, Homo sapien
ctggtactacgtgaaggaggtcctc

SEQ ID NO: 195616 - DNA, 25 bp, Homo sapien
gtgaaggaggtcctcaacaagcacg

SEQ ID NO: 195617 - DNA, 25 bp, Homo sapien
agcgcttctactccctgcgccacat

SEQ ID NO: 195618 - DNA, 25 bp, Homo sapien
tgcgccacatcgcctcagacgtggg

SEQ ID NO: 195619 - DNA, 25 bp, Homo sapien
gctacctgcacatgctcctggccga

SEQ ID NO: 195620 - DNA, 25 bp, Homo sapien
ttgcgtgacggttccacgtcaccga

SEQ ID NO: 195621 - DNA, 25 bp, Homo sapien
gggtttgcgtgacggttccacgtca

SEQ ID NO: 195622 - DNA, 25 bp, Homo sapien
tccgcctcttgggtttgcgtgacgg

SEQ ID NO: 195623 - DNA, 25 bp, Homo sapien
gttcgggtgatgatggttccacgtc

SEQ ID NO: 195624 - DNA, 25 bp, Homo sapien
atgatggttccacgtcagcggccct

SEQ ID NO: 195625 - DNA, 25 bp, Homo sapien
ttcgggtgatgatggttccacgtca

SEQ ID NO: 195626 - DNA, 25 bp, Homo sapien
tgatgatggttccacgtcagcggcc

SEQ ID NO: 195627 - DNA, 25 bp, Homo sapien
ccgcctcttgggtttgcgtgacggt

SEQ ID NO: 195628 - DNA, 25 bp, Homo sapien
caggcgagagcgacacctccagaca

SEQ ID NO: 195629 - DNA, 25 bp, Homo sapien
tcacccaagtttgcgcctcaggcga

SEQ ID NO: 195630 - DNA, 25 bp, Homo sapien
gggacgccagactcctcacccaagt

SEQ ID NO: 195631 - DNA, 25 bp, Homo sapien
tttccttcactctgaggccggcgcg

SEQ ID NO: 195632 - DNA, 25 bp, Homo sapien
gtttctgtttcactttccttcactc

SEQ ID NO: 195633 - DNA, 25 bp, Homo sapien
ccgcggcgggtgctgtttctgtttc

SEQ ID NO: 195634 - DNA, 25 bp, Homo sapien
tgcccttggaggcggcaccggacct

SEQ ID NO: 195635 - DNA, 25 bp, Homo sapien
gcttcggagctgtgcctacctcggc

SEQ ID NO: 195636 - DNA, 25 bp, Homo sapien
agggtggaagggcatgatatgacgc

SEQ ID NO: 195637 - DNA, 25 bp, Homo sapien
gggcatgatatgacgctcggaaggt

SEQ ID NO: 195638 - DNA, 25 bp, Homo sapien
gaagggcatgatatgacgctcggaa

SEQ ID NO: 195639 - DNA, 25 bp, Homo sapien
gtggaagggcatgatatgacgctcg

SEQ ID NO: 195640 - DNA, 25 bp, Homo sapien
ggtggaagggcatgatatgacgctc

SEQ ID NO: 195641 - DNA, 25 bp, Homo sapien
gggtggaagggcatgatatgacgct

SEQ ID NO: 195642 - DNA, 25 bp, Homo sapien
aagggcatgatatgacgctcggaag

SEQ ID NO: 195643 - DNA, 25 bp, Homo sapien
agggcatgatatgacgctcggaagg

SEQ ID NO: 195644 - DNA, 25 bp, Homo sapien
cttgagattatcatccgctgagggt

SEQ ID NO: 195645 - DNA, 25 bp, Homo sapien
ggtgtcttgagattatcatccgctg

SEQ ID NO: 195646 - DNA, 25 bp, Homo sapien
tattatcatctgctgagggtggagc

SEQ ID NO: 195647 - DNA, 25 bp, Homo sapien
acgctcggcaggtgtcttgatatta

SEQ ID NO: 195648 - DNA, 25 bp, Homo sapien
tgatattatcatctgctgagggtgg

SEQ ID NO: 195649 - DNA, 25 bp, Homo sapien
ttgagattatcatccgctgagggtg

SEQ ID NO: 195650 - DNA, 25 bp, Homo sapien
cggaaggtgtcttgagattatcatc

SEQ ID NO: 195651 - DNA, 25 bp, Homo sapien
cggcaggtgtcttgatattatcatc

SEQ ID NO: 195652 - DNA, 25 bp, Homo sapien
gcccgagctcatgatggcgaccacg

SEQ ID NO: 195653 - DNA, 25 bp, Homo sapien
cgaccacgatgacggccacgccctt

SEQ ID NO: 195654 - DNA, 25 bp, Homo sapien
cgagctcatgatggcgaccacgatg

SEQ ID NO: 195655 - DNA, 25 bp, Homo sapien
gatgcccgagctcatgatggcgacc

SEQ ID NO: 195656 - DNA, 25 bp, Homo sapien
gagtggcaggctacgagcttggctg

SEQ ID NO: 195657 - DNA, 25 bp, Homo sapien
tcacgcacggagtggcaggctacga

SEQ ID NO: 195658 - DNA, 25 bp, Homo sapien
actcacgcacggagtggcaggctac

SEQ ID NO: 195659 - DNA, 25 bp, Homo sapien
catgatggcgaccacgatgacggcc

SEQ ID NO: 195660 - DNA, 25 bp, Homo sapien
cgagcgccttttgttccgcagcgca

SEQ ID NO: 195661 - DNA, 25 bp, Homo sapien
tgaatcccagaacgtacaaagggtc

SEQ ID NO: 195662 - DNA, 25 bp, Homo sapien
cgctcgtaagtgctccggatggaaa

SEQ ID NO: 195663 - DNA, 25 bp, Homo sapien
acccgctccctgtacgtgaacatga

SEQ ID NO: 195664 - DNA, 25 bp, Homo sapien
tacgtgaacatgactagcggcccgg

SEQ ID NO: 195665 - DNA, 25 bp, Homo sapien
cggcaggaaggagaaccaccaggta

SEQ ID NO: 195666 - DNA, 25 bp, Homo sapien
cctcttgttgtctcgttgaatccca

SEQ ID NO: 195667 - DNA, 25 bp, Homo sapien
aagagacccggccagatccattacc

SEQ ID NO: 195668 - DNA, 25 bp, Homo sapien
cggacgcccgagatgtgggaaatcc

SEQ ID NO: 195669 - DNA, 25 bp, Homo sapien
gcgccggtcccactagaacctcatc

SEQ ID NO: 195670 - DNA, 25 bp, Homo sapien
tcactcctggcaggacgcgcccgct

SEQ ID NO: 195671 - DNA, 25 bp, Homo sapien
gctagatggcgccaagactcactcc

SEQ ID NO: 195672 - DNA, 25 bp, Homo sapien
tccagcaggcgctagatggcgccaa

SEQ ID NO: 195673 - DNA, 25 bp, Homo sapien
gagcagatcgcctccctgggtccgg

SEQ ID NO: 195674 - DNA, 25 bp, Homo sapien
agctgtccgcggagcagatcgcctc

SEQ ID NO: 195675 - DNA, 25 bp, Homo sapien
cgcgttctcccgcaggtgagcagag

SEQ ID NO: 195676 - DNA, 25 bp, Homo sapien
ctagagcgccgctaaaacgcgctct

SEQ ID NO: 195677 - DNA, 25 bp, Homo sapien
tgagtgcgcgagtgtaaggagagac

SEQ ID NO: 195678 - DNA, 25 bp, Homo sapien
gcgccgctaaaacgcgctcttcgtt

SEQ ID NO: 195679 - DNA, 25 bp, Homo sapien
cgacaaacaacgtgtgaagcagcgg

SEQ ID NO: 195680 - DNA, 25 bp, Homo sapien
cccgacaaacaacgtgtgaagcagc

SEQ ID NO: 195681 - DNA, 25 bp, Homo sapien
tctcccgacaaacaacgtgtgaagc

SEQ ID NO: 195682 - DNA, 25 bp, Homo sapien
cgcatctcccgacaaacaacgtgtg

SEQ ID NO: 195683 - DNA, 25 bp, Homo sapien
aaaacgcgctcttcgttctacttgg

SEQ ID NO: 195684 - DNA, 25 bp, Homo sapien
tctgtcccggaagttgcgcgtgcca

SEQ ID NO: 195685 - DNA, 25 bp, Homo sapien
aaggaagcggcctgaatcttaccca

SEQ ID NO: 195686 - DNA, 25 bp, Homo sapien
tgaatcttacccagtcctcgacgcg

SEQ ID NO: 195687 - DNA, 25 bp, Homo sapien
tgtgaagcagcggtgccgccattgg

SEQ ID NO: 195688 - DNA, 25 bp, Homo sapien
gccattgggccgaactaacgcgacc

SEQ ID NO: 195689 - DNA, 25 bp, Homo sapien
gggccgaactaacgcgaccgctgcg

SEQ ID NO: 195690 - DNA, 25 bp, Homo sapien
cacagcctctgtcccggaagttgcg

SEQ ID NO: 195691 - DNA, 25 bp, Homo sapien
ttgcgcgtgccagcgcaaccttcag

SEQ ID NO: 195692 - DNA, 25 bp, Homo sapien
atgatggttccacgtcagcggccct

SEQ ID NO: 195693 - DNA, 25 bp, Homo sapien
gttcgggtgatgatggttccacgtc

SEQ ID NO: 195694 - DNA, 25 bp, Homo sapien
ttcgggtgatgatggttccacgtca

SEQ ID NO: 195695 - DNA, 25 bp, Homo sapien
tgatgatggttccacgtcagcggcc

SEQ ID NO: 195696 - DNA, 25 bp, Homo sapien
tccgcctcttgggtttgcgtgacgg

SEQ ID NO: 195697 - DNA, 25 bp, Homo sapien
ccgcctcttgggtttgcgtgacggt

SEQ ID NO: 195698 - DNA, 25 bp, Homo sapien
ttgcgtgacggttccacgtcaccga

SEQ ID NO: 195699 - DNA, 25 bp, Homo sapien
gggtttgcgtgacggttccacgtca

SEQ ID NO: 195700 - DNA, 25 bp, Homo sapien
tcagctgcatgagaactaaaaaaga

SEQ ID NO: 195701 - DNA, 25 bp, Homo sapien
gctgaggtcctggaaagcaagctct

SEQ ID NO: 195702 - DNA, 25 bp, Homo sapien
ggcgcagttatgttggatgacaata

SEQ ID NO: 195703 - DNA, 25 bp, Homo sapien
gtctgtgggacacgaggccagtaca

SEQ ID NO: 195704 - DNA, 25 bp, Homo sapien
acgaggccagtacagtcgtgatttc

SEQ ID NO: 195705 - DNA, 25 bp, Homo sapien
gtcgtgatttctgttcagctgcatg

SEQ ID NO: 195706 - DNA, 25 bp, Homo sapien
aagctctgcatttgccaggctgagg

SEQ ID NO: 195707 - DNA, 25 bp, Homo sapien
agcagttcataagctctgcatttgc

SEQ ID NO: 195708 - DNA, 25 bp, Homo sapien
tacccaatacctctgcagaaaggtg

SEQ ID NO: 195709 - DNA, 25 bp, Homo sapien
gggcctccagtgcaggtgtcatccc

SEQ ID NO: 195710 - DNA, 25 bp, Homo sapien
agtggcaggaatctcctgaagcctc

SEQ ID NO: 195711 - DNA, 25 bp, Homo sapien
acacagcggcgaatacgttgaacga

SEQ ID NO: 195712 - DNA, 25 bp, Homo sapien
ctacgccgggcttcgatacccaata

SEQ ID NO: 195713 - DNA, 25 bp, Homo sapien
gtaaggacttcacccagcgagaggc

SEQ ID NO: 195714 - DNA, 25 bp, Homo sapien
ccctgtttcacggagctaaagatcc

SEQ ID NO: 195715 - DNA, 25 bp, Homo sapien
tgaagcctccaacgtccaggaacgc

SEQ ID NO: 195716 - DNA, 25 bp, Homo sapien
gcctgtgcccagtcatcaacatcaa

SEQ ID NO: 195717 - DNA, 25 bp, Homo sapien
cctcctgctggaagacgggcagctc

SEQ ID NO: 195718 - DNA, 25 bp, Homo sapien
tccagttttgcttctgaggggctca

SEQ ID NO: 195719 - DNA, 25 bp, Homo sapien
caatcttattagtgggcagaaagcc

SEQ ID NO: 195720 - DNA, 25 bp, Homo sapien
tggcctgccagaagagaccgggacc

SEQ ID NO: 195721 - DNA, 25 bp, Homo sapien
cggggagatggataaactgaccatc

SEQ ID NO: 195722 - DNA, 25 bp, Homo sapien
actggatcaacaccggggagtctgc

SEQ ID NO: 195723 - DNA, 25 bp, Homo sapien
caggatgtctctttctggccgccga

SEQ ID NO: 195724 - DNA, 25 bp, Homo sapien
gtccgtgaagggtagtctgtgccta

SEQ ID NO: 195725 - DNA, 25 bp, Homo sapien
ccgtcaggaggcctgcgtttaccct

SEQ ID NO: 195726 - DNA, 25 bp, Homo sapien
ctactggtaccactcggacactcta

SEQ ID NO: 195727 - DNA, 25 bp, Homo sapien
ccgaccctttgcagggctcgacttg

SEQ ID NO: 195728 - DNA, 25 bp, Homo sapien
cgactgcccgtccttagtccaggtt

SEQ ID NO: 195729 - DNA, 25 bp, Homo sapien
ggtctcctcgtcatctcgggcgaca

SEQ ID NO: 195730 - DNA, 25 bp, Homo sapien
cgggcgacactctgcaaacaatatg

SEQ ID NO: 195731 - DNA, 25 bp, Homo sapien
gtgcctacgtcctgccctactggta

SEQ ID NO: 195732 - DNA, 25 bp, Homo sapien
cgcgggtctccacctgagagaatgc

SEQ ID NO: 195733 - DNA, 25 bp, Homo sapien
gcgggtctccacctgagagaatgca

SEQ ID NO: 195734 - DNA, 25 bp, Homo sapien
tccacctgagagaatgcaggtgctc

SEQ ID NO: 195735 - DNA, 25 bp, Homo sapien
tctccacctgagagaatgcaggtgc

SEQ ID NO: 195736 - DNA, 25 bp, Homo sapien
cctgagagaatgcaggtgctcccgc

SEQ ID NO: 195737 - DNA, 25 bp, Homo sapien
gggtctccacctgagagaatgcagg

SEQ ID NO: 195738 - DNA, 25 bp, Homo sapien
agcgaagcccggacgcgggccaggg

SEQ ID NO: 195739 - DNA, 25 bp, Homo sapien
cctggcggcgcggagactggcgcag

SEQ ID NO: 195740 - DNA, 25 bp, Homo sapien
ccttgcgcccttcctgtgttttggc

SEQ ID NO: 195741 - DNA, 25 bp, Homo sapien
cccgagtctctttccatgttttgac

SEQ ID NO: 195742 - DNA, 25 bp, Homo sapien
atgttttgaccacgcccttgacccg

SEQ ID NO: 195743 - DNA, 25 bp, Homo sapien
tgacccgcccttcaaattgggcacg

SEQ ID NO: 195744 - DNA, 25 bp, Homo sapien
ccttccatgtttgggcacgccttct

SEQ ID NO: 195745 - DNA, 25 bp, Homo sapien
gcacgccttctgagtcctggtcacg

SEQ ID NO: 195746 - DNA, 25 bp, Homo sapien
cctgtccggtttctgatatgggcca

SEQ ID NO: 195747 - DNA, 25 bp, Homo sapien
atgggccaaggctcacagcttcctc

SEQ ID NO: 195748 - DNA, 25 bp, Homo sapien
aagttggtcactccctcgaattgcc

SEQ ID NO: 195749 - DNA, 25 bp, Homo sapien
ctgccggatgctaggccagccttga

SEQ ID NO: 195750 - DNA, 25 bp, Homo sapien
aggacggaagttggtcactccctcg

SEQ ID NO: 195751 - DNA, 25 bp, Homo sapien
cagccttgagcaggagaaccggaca

SEQ ID NO: 195752 - DNA, 25 bp, Homo sapien
gcgcgccctgggatcggtccatcta

SEQ ID NO: 195753 - DNA, 25 bp, Homo sapien
gagaaccggacactgtgtactcagc

SEQ ID NO: 195754 - DNA, 25 bp, Homo sapien
gcgctaaccattgcacctggggctg

SEQ ID NO: 195755 - DNA, 25 bp, Homo sapien
ggggagccaagacttagcgctaacc

SEQ ID NO: 195756 - DNA, 25 bp, Homo sapien
ttcgcagctgaaccggattagcctc

SEQ ID NO: 195757 - DNA, 25 bp, Homo sapien
gctcacggcctgcatgaatggcgcg

SEQ ID NO: 195758 - DNA, 25 bp, Homo sapien
ggcttgagccggaccgcactcacga

SEQ ID NO: 195759 - DNA, 25 bp, Homo sapien
ctgggctagattcccgagtaggcca

SEQ ID NO: 195760 - DNA, 25 bp, Homo sapien
tctgacttccttgacctgacacctg

SEQ ID NO: 195761 - DNA, 25 bp, Homo sapien
tgggaggcctcctacggaagaaaca

SEQ ID NO: 195762 - DNA, 25 bp, Homo sapien
tgaccacccgcgagggagcagaaac

SEQ ID NO: 195763 - DNA, 25 bp, Homo sapien
aaacccattggacagcgaggctcgg

SEQ ID NO: 195764 - DNA, 25 bp, Homo sapien
ctgagcgaactcaagcgcctcttca

SEQ ID NO: 195765 - DNA, 25 bp, Homo sapien
cgggcacagacagcttcaacgggca

SEQ ID NO: 195766 - DNA, 25 bp, Homo sapien
cagagacagtttgtgctcacgctga

SEQ ID NO: 195767 - DNA, 25 bp, Homo sapien
ttcaatctgcacttggccagcctgc

SEQ ID NO: 195768 - DNA, 25 bp, Homo sapien
acacactcttcagcggcatctcgga

SEQ ID NO: 195769 - DNA, 25 bp, Homo sapien
atctcggaccgcatgctacaggaca

SEQ ID NO: 195770 - DNA, 25 bp, Homo sapien
gaggaggagcccatggacacttccc

SEQ ID NO: 195771 - DNA, 25 bp, Homo sapien
aggccttcgtggaggccacctttca

SEQ ID NO: 195772 - DNA, 25 bp, Homo sapien
cgcctcggggctgatattcaactgc

SEQ ID NO: 195773 - DNA, 25 bp, Homo sapien
gccaatggtgggtccggaataaaca

SEQ ID NO: 195774 - DNA, 25 bp, Homo sapien
cggtatcgagggcaagcagccaatg

SEQ ID NO: 195775 - DNA, 25 bp, Homo sapien
ccgagcggcagggacttcgtccaat

SEQ ID NO: 195776 - DNA, 25 bp, Homo sapien
aacgtggcactttggcagaaccctc

SEQ ID NO: 195777 - DNA, 25 bp, Homo sapien
cagcatctcggctgggtcttctagg

SEQ ID NO: 195778 - DNA, 25 bp, Homo sapien
tctaccaggttttccgccagcatct

SEQ ID NO: 195779 - DNA, 25 bp, Homo sapien
tcaactgcgcattagcaaggccgtg

SEQ ID NO: 195780 - DNA, 25 bp, Homo sapien
cactagtggagatccccgccgacag

SEQ ID NO: 195781 - DNA, 25 bp, Homo sapien
ggccgcactagtggagatccccgcc

SEQ ID NO: 195782 - DNA, 25 bp, Homo sapien
gccgcactagtggagatccccgccg

SEQ ID NO: 195783 - DNA, 25 bp, Homo sapien
gcactagtggagatccccgccgaca

SEQ ID NO: 195784 - DNA, 25 bp, Homo sapien
actagtggagatccccgccgacagg

SEQ ID NO: 195785 - DNA, 25 bp, Homo sapien
ctagtggagatccccgccgacagga

SEQ ID NO: 195786 - DNA, 25 bp, Homo sapien
tagtggagatccccgccgacaggac

SEQ ID NO: 195787 - DNA, 25 bp, Homo sapien
ccgcactagtggagatccccgccga

SEQ ID NO: 195788 - DNA, 25 bp, Homo sapien
cgcggagctggaatgactggcaacc

SEQ ID NO: 195789 - DNA, 25 bp, Homo sapien
gggaaggtaatgagccgcagagccc

SEQ ID NO: 195790 - DNA, 25 bp, Homo sapien
tggcaacccaggtgggtgaccggcc

SEQ ID NO: 195791 - DNA, 25 bp, Homo sapien
ccccgccgacaggacccgcctctct

SEQ ID NO: 195792 - DNA, 25 bp, Homo sapien
cggagctggaatgactggcaaccca

SEQ ID NO: 195793 - DNA, 25 bp, Homo sapien
gagctggaatgactggcaacccagg

SEQ ID NO: 195794 - DNA, 25 bp, Homo sapien
gctggaatgactggcaacccaggtg

SEQ ID NO: 195795 - DNA, 25 bp, Homo sapien
tcgtgtcggggaaggtaatgagccg

SEQ ID NO: 195796 - DNA, 25 bp, Homo sapien
tgacgtggaaccatcatcacccgaa

SEQ ID NO: 195797 - DNA, 25 bp, Homo sapien
gtggaaccgtcacgcaaacccaaga

SEQ ID NO: 195798 - DNA, 25 bp, Homo sapien
ctgacgtggaaccatcatcacccga

SEQ ID NO: 195799 - DNA, 25 bp, Homo sapien
gtcggtgacgtggaaccgtcacgca

SEQ ID NO: 195800 - DNA, 25 bp, Homo sapien
gaaccgtcacgcaaacccaagaggc

SEQ ID NO: 195801 - DNA, 25 bp, Homo sapien
ggccgctgacgtggaaccatcatca

SEQ ID NO: 195802 - DNA, 25 bp, Homo sapien
accgtcacgcaaacccaagaggcgg

SEQ ID NO: 195803 - DNA, 25 bp, Homo sapien
agggccgctgacgtggaaccatcat

SEQ ID NO: 195804 - DNA, 25 bp, Homo sapien
tctctaagaggcagagggatgtgca

SEQ ID NO: 195805 - DNA, 25 bp, Homo sapien
gggccgcagggatccttgcaccgac

SEQ ID NO: 195806 - DNA, 25 bp, Homo sapien
cacctggtctctgttgtccgtgggc

SEQ ID NO: 195807 - DNA, 25 bp, Homo sapien
ccacttaccgcgtaatgcgccaata

SEQ ID NO: 195808 - DNA, 25 bp, Homo sapien
agcagcgtccacctggtctctgttg

SEQ ID NO: 195809 - DNA, 25 bp, Homo sapien
taaaccaatgaacgaagcagcgtcc

SEQ ID NO: 195810 - DNA, 25 bp, Homo sapien
cgcgtaatgcgccaataaaccaatg

SEQ ID NO: 195811 - DNA, 25 bp, Homo sapien
tccttctttatttctcccgaatgtg

SEQ ID NO: 195812 - DNA, 25 bp, Homo sapien
acacgtctgtagacgctgaggaaac

SEQ ID NO: 195813 - DNA, 25 bp, Homo sapien
cggcaccgtggacacgtctgtagac

SEQ ID NO: 195814 - DNA, 25 bp, Homo sapien
gcatgagcggcaccgtggacacgtc

SEQ ID NO: 195815 - DNA, 25 bp, Homo sapien
tgggagcagcgccaagtgcctccac

SEQ ID NO: 195816 - DNA, 25 bp, Homo sapien
cagtaccagttcacgagcaggcggg

SEQ ID NO: 195817 - DNA, 25 bp, Homo sapien
caagagctggcgcagtaccagttca

SEQ ID NO: 195818 - DNA, 25 bp, Homo sapien
ggaaactgactgtcagggcggctcc

SEQ ID NO: 195819 - DNA, 25 bp, Homo sapien
cgctgaggaaactgactgtcagggc

SEQ ID NO: 195820 - DNA, 25 bp, Homo sapien
acgtgcagagagctatctgggcatc

SEQ ID NO: 195821 - DNA, 25 bp, Homo sapien
cgcttatctgctcccaagcacgtga

SEQ ID NO: 195822 - DNA, 25 bp, Homo sapien
ccggcgcctagaggccgcttatctg

SEQ ID NO: 195823 - DNA, 25 bp, Homo sapien
attcgaaccacagctccaggccttg

SEQ ID NO: 195824 - DNA, 25 bp, Homo sapien
gctgcctgcacaaattcgaaccaca

SEQ ID NO: 195825 - DNA, 25 bp, Homo sapien
cctggtgcagctcattaggcagaga

SEQ ID NO: 195826 - DNA, 25 bp, Homo sapien
ccctgtgttcctagcgcgcagagtt

SEQ ID NO: 195827 - DNA, 25 bp, Homo sapien
agttgcagcgaacctacctggtgca

SEQ ID NO: 195828 - DNA, 25 bp, Homo sapien
cgcgatctcgacctggattcgtgtc

SEQ ID NO: 195829 - DNA, 25 bp, Homo sapien
ccatggagccatggcctatagggtc

SEQ ID NO: 195830 - DNA, 25 bp, Homo sapien
cctcccggaggagtactatgccttg

SEQ ID NO: 195831 - DNA, 25 bp, Homo sapien
cggctgacgtcaggccactccttaa

SEQ ID NO: 195832 - DNA, 25 bp, Homo sapien
atttcccgaagagccagatcgcggc

SEQ ID NO: 195833 - DNA, 25 bp, Homo sapien
cccatcgcctaggaccgggagatgc

SEQ ID NO: 195834 - DNA, 25 bp, Homo sapien
atgccttgacaccttcgtttcaccg

SEQ ID NO: 195835 - DNA, 25 bp, Homo sapien
atgctggaaatgcaaccgcctgttc

SEQ ID NO: 195836 - DNA, 25 bp, Homo sapien
gacgcatcttcaacatgtcccgaga

SEQ ID NO: 195837 - DNA, 25 bp, Homo sapien
gctgcagtacttcccgctagctcag

SEQ ID NO: 195838 - DNA, 25 bp, Homo sapien
tccgcatcggcatgtacgtgctgca

SEQ ID NO: 195839 - DNA, 25 bp, Homo sapien
cgtgtcatggaacgccatccgcatc

SEQ ID NO: 195840 - DNA, 25 bp, Homo sapien
gacatcccgacctttgagggcctct

SEQ ID NO: 195841 - DNA, 25 bp, Homo sapien
cgtgccatctctgattacacgcaga

SEQ ID NO: 195842 - DNA, 25 bp, Homo sapien
gtcccgagacaccaagctgatcgtg

SEQ ID NO: 195843 - DNA, 25 bp, Homo sapien
tcacttcgtcagtggcgagcgactc

SEQ ID NO: 195844 - DNA, 25 bp, Homo sapien
cgcgcattcaggagaggctatgcca

SEQ ID NO: 195845 - DNA, 25 bp, Homo sapien
gtgcaggtccagcactccagtcctg

SEQ ID NO: 195846 - DNA, 25 bp, Homo sapien
cacctctgtcgagagatgcaattta

SEQ ID NO: 195847 - DNA, 25 bp, Homo sapien
atgcaatttaccaccagctcggagg

SEQ ID NO: 195848 - DNA, 25 bp, Homo sapien
cagtaggctcgaaatcccagaaacc

SEQ ID NO: 195849 - DNA, 25 bp, Homo sapien
ccgcagcgctgctttcacaatcaga

SEQ ID NO: 195850 - DNA, 25 bp, Homo sapien
aaagggccactttgtgagccgcagc

SEQ ID NO: 195851 - DNA, 25 bp, Homo sapien
tgctgctgcaaaaaccactgaaagg

SEQ ID NO: 195852 - DNA, 25 bp, Homo sapien
caggcgccgttaccttggacatggc

SEQ ID NO: 195853 - DNA, 25 bp, Homo sapien
cccagcgccaggtactcggcgaaga

SEQ ID NO: 195854 - DNA, 25 bp, Homo sapien
aagagctcggtgttgctgaggcact

SEQ ID NO: 195855 - DNA, 25 bp, Homo sapien
gcggctcatgaagctgcccaccgag

SEQ ID NO: 195856 - DNA, 25 bp, Homo sapien
cagcgtcttgagaacgcggctcatg

SEQ ID NO: 195857 - DNA, 25 bp, Homo sapien
ccgccatgttcactgtgggacggta

SEQ ID NO: 195858 - DNA, 25 bp, Homo sapien
ctgcagcgtggcgttcatgaagcac

SEQ ID NO: 195859 - DNA, 25 bp, Homo sapien
cgctccgaaacagccgcttgctgaa

SEQ ID NO: 195860 - DNA, 25 bp, Homo sapien
gatttctgcacaggactcgcccttc

SEQ ID NO: 195861 - DNA, 25 bp, Homo sapien
cgaagccagtcgagagccactcaga

SEQ ID NO: 195862 - DNA, 25 bp, Homo sapien
gacctgtccgctactgttccttcta

SEQ ID NO: 195863 - DNA, 25 bp, Homo sapien
ctggaatgctttctccggggtgact

SEQ ID NO: 195864 - DNA, 25 bp, Homo sapien
tggttggattcgctccagcgccttc

SEQ ID NO: 195865 - DNA, 25 bp, Homo sapien
cagacgtggcttccgccacaggaca

SEQ ID NO: 195866 - DNA, 25 bp, Homo sapien
tcagggccctgaggttgagttcaag

SEQ ID NO: 195867 - DNA, 25 bp, Homo sapien
cgcacgagccttggaccctttggaa

SEQ ID NO: 195868 - DNA, 25 bp, Homo sapien
caagaagaatctgcccgtgacgggc

SEQ ID NO: 195869 - DNA, 25 bp, Homo sapien
tcctcgccatggcacccggagagaa

SEQ ID NO: 195870 - DNA, 25 bp, Homo sapien
gcctcctctggatcgggttcacact

SEQ ID NO: 195871 - DNA, 25 bp, Homo sapien
cccggagagaagatcaaagccaaaa

SEQ ID NO: 195872 - DNA, 25 bp, Homo sapien
cggtggtactgcctcaacaccaaca

SEQ ID NO: 195873 - DNA, 25 bp, Homo sapien
taaagagctgatgcggtggtactgc

SEQ ID NO: 195874 - DNA, 25 bp, Homo sapien
ggttcacactgactgccgtggccct

SEQ ID NO: 195875 - DNA, 25 bp, Homo sapien
tcaggcgccgaccattaaagagctg

SEQ ID NO: 195876 - DNA, 25 bp, Homo sapien
cgcctgtactggtgagcgcgatgct

SEQ ID NO: 195877 - DNA, 25 bp, Homo sapien
cccgagcaggtatgacggcgaaccc

SEQ ID NO: 195878 - DNA, 25 bp, Homo sapien
ccagtgtccctgaacctggcgtgtg

SEQ ID NO: 195879 - DNA, 25 bp, Homo sapien
tattcgtggcgcatgtgggtatcgc

SEQ ID NO: 195880 - DNA, 25 bp, Homo sapien
ggtctgtggacatattcgtggcgca

SEQ ID NO: 195881 - DNA, 25 bp, Homo sapien
ctaggtgaacgggacaggtacacgc

SEQ ID NO: 195882 - DNA, 25 bp, Homo sapien
agcgcgatgcttcgcctaggtgaac

SEQ ID NO: 195883 - DNA, 25 bp, Homo sapien
cttgtgatatgtactgaggggacgt

SEQ ID NO: 195884 - DNA, 25 bp, Homo sapien
ttgccgagggtatttgctgtccatg

SEQ ID NO: 195885 - DNA, 25 bp, Homo sapien
ctgagtgcctcacgcaagttcggtg

SEQ ID NO: 195886 - DNA, 25 bp, Homo sapien
aagttcggtgacctctgcccagccg

SEQ ID NO: 195887 - DNA, 25 bp, Homo sapien
cggcgtggttcacctcttggatgaa

SEQ ID NO: 195888 - DNA, 25 bp, Homo sapien
ttcacgtcgaagtcgtctgccagga

SEQ ID NO: 195889 - DNA, 25 bp, Homo sapien
tctgccaggaacttggagaagtcca

SEQ ID NO: 195890 - DNA, 25 bp, Homo sapien
tggccgttaccatagtgactgcagg

SEQ ID NO: 195891 - DNA, 25 bp, Homo sapien
gcctggcgtccagaacttaagagtt

SEQ ID NO: 195892 - DNA, 25 bp, Homo sapien
gccgactcggttcccgccacagccg

SEQ ID NO: 195893 - DNA, 25 bp, Homo sapien
gaaggcctgccaggctactcactga

SEQ ID NO: 195894 - DNA, 25 bp, Homo sapien
agccacagctccagcgacgctgccg

SEQ ID NO: 195895 - DNA, 25 bp, Homo sapien
tgcgccgaaggcctgccaggctact

SEQ ID NO: 195896 - DNA, 25 bp, Homo sapien
cgcggtcgccgccatcgctccagcc

SEQ ID NO: 195897 - DNA, 25 bp, Homo sapien
tcttcagccgctgtagcgtcctggc

SEQ ID NO: 195898 - DNA, 25 bp, Homo sapien
agccgctgtagcgtcctggcgctct

SEQ ID NO: 195899 - DNA, 25 bp, Homo sapien
actgcctcttcagccgctgtagcgt

SEQ ID NO: 195900 - DNA, 25 bp, Homo sapien
tctccgagctcaagggcgccaaaag

SEQ ID NO: 195901 - DNA, 25 bp, Homo sapien
ccgcggtcttgctcacggagctcaa

SEQ ID NO: 195902 - DNA, 25 bp, Homo sapien
agctgctcagggtcatcaagatcaa

SEQ ID NO: 195903 - DNA, 25 bp, Homo sapien
aggacaacgagaaccagcggctgca

SEQ ID NO: 195904 - DNA, 25 bp, Homo sapien
aggtcaagaccgtgctgctgtccga

SEQ ID NO: 195905 - DNA, 25 bp, Homo sapien
acgctggtgatccaagcggacaaga

SEQ ID NO: 195906 - DNA, 25 bp, Homo sapien
gcactgctcagtgccctgcgtgatg

SEQ ID NO: 195907 - DNA, 25 bp, Homo sapien
gcatgagcagcataagaccgcggtc

SEQ ID NO: 195908 - DNA, 25 bp, Homo sapien
ttgaaagagtcgcagcaggcgcctc

SEQ ID NO: 195909 - DNA, 25 bp, Homo sapien
tggcgttccctgttacccgctagct

SEQ ID NO: 195910 - DNA, 25 bp, Homo sapien
tattctgccgtacccagtttttgga

SEQ ID NO: 195911 - DNA, 25 bp, Homo sapien
actcctacatggacgcggcgcagta

SEQ ID NO: 195912 - DNA, 25 bp, Homo sapien
gtgctttttaacatcgacggtcaag

SEQ ID NO: 195913 - DNA, 25 bp, Homo sapien
tactacggaaactcggtcagggcca

SEQ ID NO: 195914 - DNA, 25 bp, Homo sapien
ctgccgttcctggttcatttacaaa

SEQ ID NO: 195915 - DNA, 25 bp, Homo sapien
ctcgtcgcgagagtgtgttttgaaa

SEQ ID NO: 195916 - DNA, 25 bp, Homo sapien
cggcagccggcgagctgtttataca

SEQ ID NO: 195917 - DNA, 25 bp, Homo sapien
ctatccagtagaaacccttgcgcgg

SEQ ID NO: 195918 - DNA, 25 bp, Homo sapien
cgggcgcagggaatcgaattaaacg

SEQ ID NO: 195919 - DNA, 25 bp, Homo sapien
ttctctcctttgaacaggcgctggg

SEQ ID NO: 195920 - DNA, 25 bp, Homo sapien
gtgcgcgctccaatacccgggatct

SEQ ID NO: 195921 - DNA, 25 bp, Homo sapien
gctttacctgtgctatagtcctatc

SEQ ID NO: 195922 - DNA, 25 bp, Homo sapien
ctctccgcatttcagctcgcaaggg

SEQ ID NO: 195923 - DNA, 25 bp, Homo sapien
tctgggcggttattgtctttctcta

SEQ ID NO: 195924 - DNA, 25 bp, Homo sapien
tccggtgaatgttagacagcaacta

SEQ ID NO: 195925 - DNA, 25 bp, Homo sapien
gggacggcttcttctatctcgaatt

SEQ ID NO: 195926 - DNA, 25 bp, Homo sapien
tgcctcttaactgggccgcctaata

SEQ ID NO: 195927 - DNA, 25 bp, Homo sapien
atcccgggcttcttagcaaaaatgc

SEQ ID NO: 195928 - DNA, 25 bp, Homo sapien
ttgacgcgcggagaagcatttttca

SEQ ID NO: 195929 - DNA, 25 bp, Homo sapien
cccatggcagcttttggtcttacgc

SEQ ID NO: 195930 - DNA, 25 bp, Homo sapien
gggacttctctcttcggctctgagg

SEQ ID NO: 195931 - DNA, 25 bp, Homo sapien
cttcaccgcatgaaaggaatccttc

SEQ ID NO: 195932 - DNA, 25 bp, Homo sapien
tgcacttcgccgcaggtaaccgggg

SEQ ID NO: 195933 - DNA, 25 bp, Homo sapien
tcaagaggctggtgacgcctgagaa

SEQ ID NO: 195934 - DNA, 25 bp, Homo sapien
ttcagcagaacccaccgcaaagatg

SEQ ID NO: 195935 - DNA, 25 bp, Homo sapien
ttcaggacccggacggcggattcgc

SEQ ID NO: 195936 - DNA, 25 bp, Homo sapien
atccggtgacagcagggagccaagc

SEQ ID NO: 195937 - DNA, 25 bp, Homo sapien
ccaggatcatgtcgggtcgccgctg

SEQ ID NO: 195938 - DNA, 25 bp, Homo sapien
agagctgttcgaggcgtgccgcaac

SEQ ID NO: 195939 - DNA, 25 bp, Homo sapien
gacacggcgggcaggaaatccaccc

SEQ ID NO: 195940 - DNA, 25 bp, Homo sapien
tggagaagatctggaggcccaaccg

SEQ ID NO: 195941 - DNA, 25 bp, Homo sapien
catgcggcacggcatggagaagatc

SEQ ID NO: 195942 - DNA, 25 bp, Homo sapien
ggagctatcccgcatcgtgctcatg

SEQ ID NO: 195943 - DNA, 25 bp, Homo sapien
cgtcatcgagtccttcacggagcta

SEQ ID NO: 195944 - DNA, 25 bp, Homo sapien
ccctgtgcaacttcaacgtcatcga

SEQ ID NO: 195945 - DNA, 25 bp, Homo sapien
cccgcgcgtacgcagagaagaactg

SEQ ID NO: 195946 - DNA, 25 bp, Homo sapien
ctgcacctggccttcaagcggcagg

SEQ ID NO: 195947 - DNA, 25 bp, Homo sapien
atcttggttggaaaccggctgcacc

SEQ ID NO: 195948 - DNA, 25 bp, Homo sapien
aatagcacacgtgggcttctccctg

SEQ ID NO: 195949 - DNA, 25 bp, Homo sapien
gtcacgtccgccagggttacctgtg

SEQ ID NO: 195950 - DNA, 25 bp, Homo sapien
ccgccatgtgggatggaatagcaca

SEQ ID NO: 195951 - DNA, 25 bp, Homo sapien
acttccggggactgcttccagccaa

SEQ ID NO: 195952 - DNA, 25 bp, Homo sapien
aggcgggtctccatagaaacctcca

SEQ ID NO: 195953 - DNA, 25 bp, Homo sapien
gcggtgggtgttgtacacaatcatc

SEQ ID NO: 195954 - DNA, 25 bp, Homo sapien
agtctcctcaggagcgccgccatgt

SEQ ID NO: 195955 - DNA, 25 bp, Homo sapien
attcattcgggaacattcgtggggc

SEQ ID NO: 195956 - DNA, 25 bp, Homo sapien
actaaactgtgcagacgtcgccgtc

SEQ ID NO: 195957 - DNA, 25 bp, Homo sapien
gaacaactgcttggtgtcacaacta

SEQ ID NO: 195958 - DNA, 25 bp, Homo sapien
catggctacgccaacccaggatgca

SEQ ID NO: 195959 - DNA, 25 bp, Homo sapien
aaggacacgagacgccatggctacg

SEQ ID NO: 195960 - DNA, 25 bp, Homo sapien
actaaggccggctgcaaagtcccga

SEQ ID NO: 195961 - DNA, 25 bp, Homo sapien
cacgagtcacctgcgcgagcactaa

SEQ ID NO: 195962 - DNA, 25 bp, Homo sapien
agcggcagcaaagtcaccacgagtc

SEQ ID NO: 195963 - DNA, 25 bp, Homo sapien
taaacacctttaggcagcggggctg

SEQ ID NO: 195964 - DNA, 25 bp, Homo sapien
gccgcctaaaggagagccgcgctgt

SEQ ID NO: 195965 - DNA, 25 bp, Homo sapien
ttaaatccaccattcggcctgcgca

SEQ ID NO: 195966 - DNA, 25 bp, Homo sapien
agccggaatctctgaaagactgacc

SEQ ID NO: 195967 - DNA, 25 bp, Homo sapien
tctgagtacatcgagacggtgcgcg

SEQ ID NO: 195968 - DNA, 25 bp, Homo sapien
gagttgggcgagctgctctacaaca

SEQ ID NO: 195969 - DNA, 25 bp, Homo sapien
ctgtcgatgagtcccagtgggccac

SEQ ID NO: 195970 - DNA, 25 bp, Homo sapien
tcagtgcgcgatcagctgacccacg

SEQ ID NO: 195971 - DNA, 25 bp, Homo sapien
ctgaccgactgactctgacaggatc

SEQ ID NO: 195972 - DNA, 25 bp, Homo sapien
ggctctgctcggatcgaggtctgca

SEQ ID NO: 195973 - DNA, 25 bp, Homo sapien
gtgcctaagtctctgctgctcaagc

SEQ ID NO: 195974 - DNA, 25 bp, Homo sapien
tcccagcgccgcgtttgaattcggg

SEQ ID NO: 195975 - DNA, 25 bp, Homo sapien
cgcgcaggcttttgtaacgttccca

SEQ ID NO: 195976 - DNA, 25 bp, Homo sapien
ggcgtccgtgtcaatcaggttttcc

SEQ ID NO: 195977 - DNA, 25 bp, Homo sapien
aggctatcccacgtgttcgggcgtc

SEQ ID NO: 195978 - DNA, 25 bp, Homo sapien
agtgaaccgcaggagctttcccgga

SEQ ID NO: 195979 - DNA, 25 bp, Homo sapien
ctgctcaagccgcaccagagggaga

SEQ ID NO: 195980 - DNA, 25 bp, Homo sapien
acttggcgtcggtccctggctctca

SEQ ID NO: 195981 - DNA, 25 bp, Homo sapien
cgaccagactttggggacttggcgt

SEQ ID NO: 195982 - DNA, 25 bp, Homo sapien
gcccacttatggagaacttgccacg

SEQ ID NO: 195983 - DNA, 25 bp, Homo sapien
tggactcagcgtcccgagcagcagc

SEQ ID NO: 195984 - DNA, 25 bp, Homo sapien
ccgagttgggaccacccaggcgtga

SEQ ID NO: 195985 - DNA, 25 bp, Homo sapien
agggattttactgagcccacttatg

SEQ ID NO: 195986 - DNA, 25 bp, Homo sapien
cccgcgaccagactttggggacttg

SEQ ID NO: 195987 - DNA, 25 bp, Homo sapien
ggctctcacctgtggactcagcgtc

SEQ ID NO: 195988 - DNA, 25 bp, Homo sapien
agcctctcccgtgcggatcgcaaaa

SEQ ID NO: 195989 - DNA, 25 bp, Homo sapien
gcccgggtcttgaacctggatcttc

SEQ ID NO: 195990 - DNA, 25 bp, Homo sapien
tccagcccggctcgaagctgaaggc

SEQ ID NO: 195991 - DNA, 25 bp, Homo sapien
ccagaggaatccaggcacccaggtg

SEQ ID NO: 195992 - DNA, 25 bp, Homo sapien
tcccgacggggacagtattcggcga

SEQ ID NO: 195993 - DNA, 25 bp, Homo sapien
gcacattgttttccattcgcccggg

SEQ ID NO: 195994 - DNA, 25 bp, Homo sapien
tcggagctgaaacagcccgttgttc

SEQ ID NO: 195995 - DNA, 25 bp, Homo sapien
gcggatcgcaaaatctcggagctga

SEQ ID NO: 195996 - DNA, 25 bp, Homo sapien
gagcctttgctccacctgactagga

SEQ ID NO: 195997 - DNA, 25 bp, Homo sapien
gaggagagcaccgtgcgcttcgccc

SEQ ID NO: 195998 - DNA, 25 bp, Homo sapien
atggacagtcctgccgttgccctgt

SEQ ID NO: 195999 - DNA, 25 bp, Homo sapien
cgcaaaggcgccctccggcagaaga

SEQ ID NO: 196000 - DNA, 25 bp, Homo sapien
cgtgcatgaggtcaagaaccacaaa

SEQ ID NO: 196001 - DNA, 25 bp, Homo sapien
ccgggactcccggatggacagtcct

SEQ ID NO: 196002 - DNA, 25 bp, Homo sapien
ccgggcgccgatatgtaaagcagct

SEQ ID NO: 196003 - DNA, 25 bp, Homo sapien
gctgtgcacgcttagccgcgaggcc

SEQ ID NO: 196004 - DNA, 25 bp, Homo sapien
ggactctgtcttttctccagtttga

SEQ ID NO: 196005 - DNA, 25 bp, Homo sapien
ccagagtgcgctacgggcttcgctc

SEQ ID NO: 196006 - DNA, 25 bp, Homo sapien
tgtcctcggctccagaaactttgcg

SEQ ID NO: 196007 - DNA, 25 bp, Homo sapien
tccagaaactttgcgcggagagtgg

SEQ ID NO: 196008 - DNA, 25 bp, Homo sapien
agctgcatgagggagctgtcccttc

SEQ ID NO: 196009 - DNA, 25 bp, Homo sapien
gcaccacggaccttaaagcctaggc

SEQ ID NO: 196010 - DNA, 25 bp, Homo sapien
gcaacaggcggggagctgtcccttc

SEQ ID NO: 196011 - DNA, 25 bp, Homo sapien
aagcctaggcgttaagacgacggag

SEQ ID NO: 196012 - DNA, 25 bp, Homo sapien
tggactgaccgctactgactgcacc

SEQ ID NO: 196013 - DNA, 25 bp, Homo sapien
ccctcccttttgaagcagatggttc

SEQ ID NO: 196014 - DNA, 25 bp, Homo sapien
gctctttcagtttccgcgctttgga

SEQ ID NO: 196015 - DNA, 25 bp, Homo sapien
tttggagtcacaaagcgcggggtca

SEQ ID NO: 196016 - DNA, 25 bp, Homo sapien
cgcccgtgcaatccctgcttaagag

SEQ ID NO: 196017 - DNA, 25 bp, Homo sapien
cgcgtccgccatagtacctggcttg

SEQ ID NO: 196018 - DNA, 25 bp, Homo sapien
caatccacggagagagagacccgcc

SEQ ID NO: 196019 - DNA, 25 bp, Homo sapien
ctcggactcttaacgtgtggactga

SEQ ID NO: 196020 - DNA, 25 bp, Homo sapien
gaaggtaacgtgactgcggagctca

SEQ ID NO: 196021 - DNA, 25 bp, Homo sapien
accgcctccattcagcggaggaatg

SEQ ID NO: 196022 - DNA, 25 bp, Homo sapien
ctccattcagcggaggaatgtgggc

SEQ ID NO: 196023 - DNA, 25 bp, Homo sapien
agcttcgcccggagcatcgcagcat

SEQ ID NO: 196024 - DNA, 25 bp, Homo sapien
ggagcatcgcagcatcgcgcagcgc

SEQ ID NO: 196025 - DNA, 25 bp, Homo sapien
accggtgcccggagcatctatctcc

SEQ ID NO: 196026 - DNA, 25 bp, Homo sapien
gggcggtgctgccactcgccacgtt

SEQ ID NO: 196027 - DNA, 25 bp, Homo sapien
gttcacattcctccacgtgcacgcg

SEQ ID NO: 196028 - DNA, 25 bp, Homo sapien
acctgcccaatctgcgggtccagtt

SEQ ID NO: 196029 - DNA, 25 bp, Homo sapien
ccgattcgccttttctgggttgaga

SEQ ID NO: 196030 - DNA, 25 bp, Homo sapien
taagatgggcgagctttccgtctcc

SEQ ID NO: 196031 - DNA, 25 bp, Homo sapien
cgcgcatctcgtttttgtgtgtgtg

SEQ ID NO: 196032 - DNA, 25 bp, Homo sapien
gcagcagctccgttttcacgcgcat

SEQ ID NO: 196033 - DNA, 25 bp, Homo sapien
ggtccagttgctagggcctccatct

SEQ ID NO: 196034 - DNA, 25 bp, Homo sapien
gtgacattttcttccgcacccggag

SEQ ID NO: 196035 - DNA, 25 bp, Homo sapien
gggcattcacttccggtctggggcc

SEQ ID NO: 196036 - DNA, 25 bp, Homo sapien
ctgctcgcggagtaactgcaagatc

SEQ ID NO: 196037 - DNA, 25 bp, Homo sapien
atggccaacggcatgaacgcggtca

SEQ ID NO: 196038 - DNA, 25 bp, Homo sapien
cggtcatgatgcacggccgttccta

SEQ ID NO: 196039 - DNA, 25 bp, Homo sapien
ctcaagaggtccaagtccatccgtc

SEQ ID NO: 196040 - DNA, 25 bp, Homo sapien
gccgcctacgtggagactgtccaca

SEQ ID NO: 196041 - DNA, 25 bp, Homo sapien
gcctggttggcctttcttatttata

SEQ ID NO: 196042 - DNA, 25 bp, Homo sapien
cctgtgaattcatgcgctgcgagtg

SEQ ID NO: 196043 - DNA, 25 bp, Homo sapien
cactggtgacttcatggccacgcca

SEQ ID NO: 196044 - DNA, 25 bp, Homo sapien
acagaagtcaccgttgttgagccca

SEQ ID NO: 196045 - DNA, 25 bp, Homo sapien
tagggacagaagtcaccgttgttga

SEQ ID NO: 196046 - DNA, 25 bp, Homo sapien
ggtctactccccgagggcgatgctc

SEQ ID NO: 196047 - DNA, 25 bp, Homo sapien
cagggcagcgatcccagctggctcg

SEQ ID NO: 196048 - DNA, 25 bp, Homo sapien
tgagcccagggcagcgatcccagct

SEQ ID NO: 196049 - DNA, 25 bp, Homo sapien
tcaccgttgttgagcccagggcagc

SEQ ID NO: 196050 - DNA, 25 bp, Homo sapien
aagtcaccgttgttgagcccagggc

SEQ ID NO: 196051 - DNA, 25 bp, Homo sapien
agaagtcaccgttgttgagcccagg

SEQ ID NO: 196052 - DNA, 25 bp, Homo sapien
tttccacctggaattgcgacgcggg

SEQ ID NO: 196053 - DNA, 25 bp, Homo sapien
cctgcttttccacctggaattgcga

SEQ ID NO: 196054 - DNA, 25 bp, Homo sapien
ccacctggaattgcgacgcgggcga

SEQ ID NO: 196055 - DNA, 25 bp, Homo sapien
aagatgcttccttgtgcaagaagcg

SEQ ID NO: 196056 - DNA, 25 bp, Homo sapien
ttccttgtgcaagaagcgcctgtcg

SEQ ID NO: 196057 - DNA, 25 bp, Homo sapien
cttgtgcaagaagcgcctgtcgggc

SEQ ID NO: 196058 - DNA, 25 bp, Homo sapien
atggccactagacagagggagtctt

SEQ ID NO: 196059 - DNA, 25 bp, Homo sapien
gagggagtcttccttcacctcctgc

SEQ ID NO: 196060 - DNA, 25 bp, Homo sapien
ccgagaccaactgggctgaccgagg

SEQ ID NO: 196061 - DNA, 25 bp, Homo sapien
tcccaggtcagactcgggcttcatc

SEQ ID NO: 196062 - DNA, 25 bp, Homo sapien
agcggcccgagaccaactgggctga

SEQ ID NO: 196063 - DNA, 25 bp, Homo sapien
agactcgggcttcatcctctcttgc

SEQ ID NO: 196064 - DNA, 25 bp, Homo sapien
gtgaagcagctagccgaccaagccc

SEQ ID NO: 196065 - DNA, 25 bp, Homo sapien
gcgcgtgaagcagctagccgaccaa

SEQ ID NO: 196066 - DNA, 25 bp, Homo sapien
cccagctcggccttctggtctctgc

SEQ ID NO: 196067 - DNA, 25 bp, Homo sapien
ccgcaggaagtgaccgggcaagaac

SEQ ID NO: 196068 - DNA, 25 bp, Homo sapien
cggctcctacatggttcacagctga

SEQ ID NO: 196069 - DNA, 25 bp, Homo sapien
cgtcccagatggtcgccaaggacca

SEQ ID NO: 196070 - DNA, 25 bp, Homo sapien
ggtccagagccgaccggcccatagt

SEQ ID NO: 196071 - DNA, 25 bp, Homo sapien
agaagcatcgggtgtagtcctcgca

SEQ ID NO: 196072 - DNA, 25 bp, Homo sapien
ggcccatagtcaggtcggccacctg

SEQ ID NO: 196073 - DNA, 25 bp, Homo sapien
catcggagttttagcacagggcagc

SEQ ID NO: 196074 - DNA, 25 bp, Homo sapien
tagggctacacccagacggctccta

SEQ ID NO: 196075 - DNA, 25 bp, Homo sapien
cctgctgatgaggttgaactgcttc

SEQ ID NO: 196076 - DNA, 25 bp, Homo sapien
cctcttctgttgctttctccctgtg

SEQ ID NO: 196077 - DNA, 25 bp, Homo sapien
gattgcgatactctcctactgttta

SEQ ID NO: 196078 - DNA, 25 bp, Homo sapien
tggccactaggcagagggaatcctc

SEQ ID NO: 196079 - DNA, 25 bp, Homo sapien
tgctgttccacctcgagctgcgacg

SEQ ID NO: 196080 - DNA, 25 bp, Homo sapien
gggcgacttctccagacacctaaga

SEQ ID NO: 196081 - DNA, 25 bp, Homo sapien
tgtgggcggtgccaaaataattatc

SEQ ID NO: 196082 - DNA, 25 bp, Homo sapien
ccagcaagcagaaaccgggcgactt

SEQ ID NO: 196083 - DNA, 25 bp, Homo sapien
cctatcgtcaaatttccgggttatg

SEQ ID NO: 196084 - DNA, 25 bp, Homo sapien
cacagagggattctagggaacctgc

SEQ ID NO: 196085 - DNA, 25 bp, Homo sapien
attctagggaacctgccgtcgcgag

SEQ ID NO: 196086 - DNA, 25 bp, Homo sapien
agtcccgcttcaggcggagaatcta

SEQ ID NO: 196087 - DNA, 25 bp, Homo sapien
agggatctgttccttgtacctggtc

SEQ ID NO: 196088 - DNA, 25 bp, Homo sapien
ttgtacctggtccagggttgcggtc

SEQ ID NO: 196089 - DNA, 25 bp, Homo sapien
tttctggcggaagtatctgtgcgtg

SEQ ID NO: 196090 - DNA, 25 bp, Homo sapien
tctggggccacttgttggccctcgc

SEQ ID NO: 196091 - DNA, 25 bp, Homo sapien
gactcgtcgctgagggactttaaga

SEQ ID NO: 196092 - DNA, 25 bp, Homo sapien
gcaccaccgacgaggatctcgcagg

SEQ ID NO: 196093 - DNA, 25 bp, Homo sapien
aagcgcaggagtccagcaccaccga

SEQ ID NO: 196094 - DNA, 25 bp, Homo sapien
tgatcacggctcagagcgcgctgcc

SEQ ID NO: 196095 - DNA, 25 bp, Homo sapien
tgcaattccctctggcgctgcagga

SEQ ID NO: 196096 - DNA, 25 bp, Homo sapien
tacctgtgctacagcctcctgggcg

SEQ ID NO: 196097 - DNA, 25 bp, Homo sapien
tatgtgcaccttgtccctgtctgtc

SEQ ID NO: 196098 - DNA, 25 bp, Homo sapien
ccggcgcgcaagctgctttttatgt

SEQ ID NO: 196099 - DNA, 25 bp, Homo sapien
gcggctgaaaccatgtccgggcagc

SEQ ID NO: 196100 - DNA, 25 bp, Homo sapien
gcggaaaggacggatgaattaatga

SEQ ID NO: 196101 - DNA, 25 bp, Homo sapien
cccggcatccgctggacggaagaga

SEQ ID NO: 196102 - DNA, 25 bp, Homo sapien
cgctgcaaactttggcctctgcagc

SEQ ID NO: 196103 - DNA, 25 bp, Homo sapien
tgcggtctccgacgggacttggcct

SEQ ID NO: 196104 - DNA, 25 bp, Homo sapien
agctgtgcggtctccgacgggactt

SEQ ID NO: 196105 - DNA, 25 bp, Homo sapien
tctggggtacgagaccaggagctgt

SEQ ID NO: 196106 - DNA, 25 bp, Homo sapien
taatgaattagggatagatgaaaga

SEQ ID NO: 196107 - DNA, 25 bp, Homo sapien
agagaggagctcctcccgtagcttt

SEQ ID NO: 196108 - DNA, 25 bp, Homo sapien
acctgcttccagaagtgcgcgcggc

SEQ ID NO: 196109 - DNA, 25 bp, Homo sapien
cgacagcgacgctcgcagcttcgga

SEQ ID NO: 196110 - DNA, 25 bp, Homo sapien
tcgctcctcgttggggaccaaggcc

SEQ ID NO: 196111 - DNA, 25 bp, Homo sapien
gccctcgttggtcttcctctctgag

SEQ ID NO: 196112 - DNA, 25 bp, Homo sapien
tcgtgacagggcctccgcttcttgc

SEQ ID NO: 196113 - DNA, 25 bp, Homo sapien
gcgaggaggcaaccactcagcagca

SEQ ID NO: 196114 - DNA, 25 bp, Homo sapien
aggagtcatgctccgcggtttccgc

SEQ ID NO: 196115 - DNA, 25 bp, Homo sapien
gctccgctgttctcagaccacgttt

SEQ ID NO: 196116 - DNA, 25 bp, Homo sapien
ccctaaggaaaggtgcttgtagctc

SEQ ID NO: 196117 - DNA, 25 bp, Homo sapien
ttccgccgtcaggtcccaaatatga

SEQ ID NO: 196118 - DNA, 25 bp, Homo sapien
gctatatgtgtgtccgctgctttta

SEQ ID NO: 196119 - DNA, 25 bp, Homo sapien
cctgcgcgggttttatactctgcta

SEQ ID NO: 196120 - DNA, 25 bp, Homo sapien
aatgcaatttagctcgtcgccggcc

SEQ ID NO: 196121 - DNA, 25 bp, Homo sapien
cgtcccagctgaagagaggttagtc

SEQ ID NO: 196122 - DNA, 25 bp, Homo sapien
cggtgagcgatcgatactcctatgc

SEQ ID NO: 196123 - DNA, 25 bp, Homo sapien
tccaggcactgcgtcgtgatcagac

SEQ ID NO: 196124 - DNA, 25 bp, Homo sapien
gttagatcccaaattacgcccgctc

SEQ ID NO: 196125 - DNA, 25 bp, Homo sapien
ctccgtttgcgccattgccctggtg

SEQ ID NO: 196126 - DNA, 25 bp, Homo sapien
gcccgtccgttgagtgacgcacttc

SEQ ID NO: 196127 - DNA, 25 bp, Homo sapien
gttcccattggtggcctgcggctta

SEQ ID NO: 196128 - DNA, 25 bp, Homo sapien
cgcgaacgcggcgttcccattggtg

SEQ ID NO: 196129 - DNA, 25 bp, Homo sapien
gttccgcctcgtgggttagatccca

SEQ ID NO: 196130 - DNA, 25 bp, Homo sapien
cccaggccgcgctagcggatacggt

SEQ ID NO: 196131 - DNA, 25 bp, Homo sapien
cggatacggtcgcaaggtggactct

SEQ ID NO: 196132 - DNA, 25 bp, Homo sapien
agggcacctgtgtcactctccgaaa

SEQ ID NO: 196133 - DNA, 25 bp, Homo sapien
ctgtagtccagataccgcggggcac

SEQ ID NO: 196134 - DNA, 25 bp, Homo sapien
gggcacgtcggaagctgataaacta

SEQ ID NO: 196135 - DNA, 25 bp, Homo sapien
tcctgttaaaggaccagcagtcgcc

SEQ ID NO: 196136 - DNA, 25 bp, Homo sapien
cgcagcacgtgcaagatgggatcct

SEQ ID NO: 196137 - DNA, 25 bp, Homo sapien
taagacagttgctgcccgcggagac

SEQ ID NO: 196138 - DNA, 25 bp, Homo sapien
ccgaaatttgtgtcagcgctgcgcc

SEQ ID NO: 196139 - DNA, 25 bp, Homo sapien
tgctggtttacaggcgcctcagctc

SEQ ID NO: 196140 - DNA, 25 bp, Homo sapien
cgctgctatatggacgccgaggcct

SEQ ID NO: 196141 - DNA, 25 bp, Homo sapien
ccctgatcagatgtatggcaacgtg

SEQ ID NO: 196142 - DNA, 25 bp, Homo sapien
tgcgggctgacttcccactctctgt

SEQ ID NO: 196143 - DNA, 25 bp, Homo sapien
cggctttgagacctacgaggcatgc

SEQ ID NO: 196144 - DNA, 25 bp, Homo sapien
gagggcaacggcaacaacttccaca

SEQ ID NO: 196145 - DNA, 25 bp, Homo sapien
gcagtgccatcccttcgtgtacggt

SEQ ID NO: 196146 - DNA, 25 bp, Homo sapien
tgccctgcaagcacgtgctcagctg

SEQ ID NO: 196147 - DNA, 25 bp, Homo sapien
gagagaacctgatcatgcgccctga

SEQ ID NO: 196148 - DNA, 25 bp, Homo sapien
gcctctagctctgacctgcatctga

SEQ ID NO: 196149 - DNA, 25 bp, Homo sapien
gagcatcaggtcaaagtccacgttg

SEQ ID NO: 196150 - DNA, 25 bp, Homo sapien
aacactttgctggaggacggccctc

SEQ ID NO: 196151 - DNA, 25 bp, Homo sapien
gtttttccggaagatcaggcatttg

SEQ ID NO: 196152 - DNA, 25 bp, Homo sapien
gctttattctgagcaggctgggccc

SEQ ID NO: 196153 - DNA, 25 bp, Homo sapien
gccggcagcaggacatgctttattc

SEQ ID NO: 196154 - DNA, 25 bp, Homo sapien
aggtgtcctgctgctctgaagagcc

SEQ ID NO: 196155 - DNA, 25 bp, Homo sapien
gggagatcttcccattgatggcata

SEQ ID NO: 196156 - DNA, 25 bp, Homo sapien
ttgcgaaggtatcgcccgggcacgc

SEQ ID NO: 196157 - DNA, 25 bp, Homo sapien
ccaaagccggtgctggcagtgagac

SEQ ID NO: 196158 - DNA, 25 bp, Homo sapien
cgcatgcaaatctgccgggcgccgg

SEQ ID NO: 196159 - DNA, 25 bp, Homo sapien
aagcgcgcggcaagacacccagcga

SEQ ID NO: 196160 - DNA, 25 bp, Homo sapien
agagttctccgctgggcgtgacctc

SEQ ID NO: 196161 - DNA, 25 bp, Homo sapien
ggatccactgcagagttctccgctg

SEQ ID NO: 196162 - DNA, 25 bp, Homo sapien
ttccgagaccaaggggatccactgc

SEQ ID NO: 196163 - DNA, 25 bp, Homo sapien
gcgtgggcgttttattccgagacca

SEQ ID NO: 196164 - DNA, 25 bp, Homo sapien
gaggtcgggctgttattctcccatc

SEQ ID NO: 196165 - DNA, 25 bp, Homo sapien
ctcctgcgtgcagggttccaaaggc

SEQ ID NO: 196166 - DNA, 25 bp, Homo sapien
ggtcgctcccgaggctcctcataga

SEQ ID NO: 196167 - DNA, 25 bp, Homo sapien
tccagagcgacttcgtccaacaacg

SEQ ID NO: 196168 - DNA, 25 bp, Homo sapien
gcgcgtccattgctacttcagtcgg

SEQ ID NO: 196169 - DNA, 25 bp, Homo sapien
agtggagctccaccgtcattggtcc

SEQ ID NO: 196170 - DNA, 25 bp, Homo sapien
ctcatagaagctgatgcccgggtgc

SEQ ID NO: 196171 - DNA, 25 bp, Homo sapien
tgcaaacagtgtagaggccgcttcc

SEQ ID NO: 196172 - DNA, 25 bp, Homo sapien
cagatgccggtgtggaaattcctga

SEQ ID NO: 196173 - DNA, 25 bp, Homo sapien
tcctcgcacgagtaccagatgccgg

SEQ ID NO: 196174 - DNA, 25 bp, Homo sapien
tcgccggtctcccagctgtagagcg

SEQ ID NO: 196175 - DNA, 25 bp, Homo sapien
gccgcggcggctagtcttcatgccg

SEQ ID NO: 196176 - DNA, 25 bp, Homo sapien
agctccgcgcgcgaagttggcagct

SEQ ID NO: 196177 - DNA, 25 bp, Homo sapien
cgcgagtgcacctcggctaggagcc

SEQ ID NO: 196178 - DNA, 25 bp, Homo sapien
ggtaggagctctgccttgcacctct

SEQ ID NO: 196179 - DNA, 25 bp, Homo sapien
gctgcgtgccctggcaccagtgcgt

SEQ ID NO: 196180 - DNA, 25 bp, Homo sapien
tgacaggcctcgaccgcgcggccca

SEQ ID NO: 196181 - DNA, 25 bp, Homo sapien
gcgggccggcagccatcttggtaaa

SEQ ID NO: 196182 - DNA, 25 bp, Homo sapien
cccgccttcttaccacgccctctct

SEQ ID NO: 196183 - DNA, 25 bp, Homo sapien
accaatccggaatcgagcggggcga

SEQ ID NO: 196184 - DNA, 25 bp, Homo sapien
gctggaaccggaccaatccggaatc

SEQ ID NO: 196185 - DNA, 25 bp, Homo sapien
gagccgcccgctagtaccgcgcggc

SEQ ID NO: 196186 - DNA, 25 bp, Homo sapien
gcagcctcaacccacacggccactg

SEQ ID NO: 196187 - DNA, 25 bp, Homo sapien
agcccgggctgccattttagtaaag

SEQ ID NO: 196188 - DNA, 25 bp, Homo sapien
cctgcccaggctggcgatgatgctg

SEQ ID NO: 196189 - DNA, 25 bp, Homo sapien
aagtgcagagccctgaagccgacgg

SEQ ID NO: 196190 - DNA, 25 bp, Homo sapien
ggcaagtgcagagccctgaagccga

SEQ ID NO: 196191 - DNA, 25 bp, Homo sapien
cgggcaacctgagtgagaaggcaca

SEQ ID NO: 196192 - DNA, 25 bp, Homo sapien
agccctgaagccgacgggctgctga

SEQ ID NO: 196193 - DNA, 25 bp, Homo sapien
ccaccgaggcgacgggcaacctgag

SEQ ID NO: 196194 - DNA, 25 bp, Homo sapien
tgaagccgacgggctgctgaccctg

SEQ ID NO: 196195 - DNA, 25 bp, Homo sapien
tgcagagccctgaagccgacgggct

SEQ ID NO: 196196 - DNA, 25 bp, Homo sapien
tcccaagatccggtcattacaactc

SEQ ID NO: 196197 - DNA, 25 bp, Homo sapien
agccgaggctgaaggacgtctcttt

SEQ ID NO: 196198 - DNA, 25 bp, Homo sapien
taaagctccaggacttgggcgactg

SEQ ID NO: 196199 - DNA, 25 bp, Homo sapien
ccggggacagcaagagacactctca

SEQ ID NO: 196200 - DNA, 25 bp, Homo sapien
ctccggtacatagaaatcccaaatc

SEQ ID NO: 196201 - DNA, 25 bp, Homo sapien
ctcggtatttagaagacagcaagcc

SEQ ID NO: 196202 - DNA, 25 bp, Homo sapien
agcggagacttcctcggtatttaga

SEQ ID NO: 196203 - DNA, 25 bp, Homo sapien
cccaaatctaggcagccggggacag

SEQ ID NO: 196204 - DNA, 25 bp, Homo sapien
gcccagccaaggaggtgttccgctt

SEQ ID NO: 196205 - DNA, 25 bp, Homo sapien
ctccctgaggacacggtgaagcgct

SEQ ID NO: 196206 - DNA, 25 bp, Homo sapien
ccgcgacatcaagcccgagaacgtg

SEQ ID NO: 196207 - DNA, 25 bp, Homo sapien
agaacgtgctgctgttcgaccgcga

SEQ ID NO: 196208 - DNA, 25 bp, Homo sapien
gtgagcggcaccatcccttacacgg

SEQ ID NO: 196209 - DNA, 25 bp, Homo sapien
ggccatcgagatctgcgtctgagtc

SEQ ID NO: 196210 - DNA, 25 bp, Homo sapien
tgctcatcttctgcgtgctcaccgg

SEQ ID NO: 196211 - DNA, 25 bp, Homo sapien
cgacgccttcttcgaggagttcgtg

SEQ ID NO: 196212 - DNA, 25 bp, Homo sapien
ctctggaaactagcgcctcagctgc

SEQ ID NO: 196213 - DNA, 25 bp, Homo sapien
gccgctcagctctctggaaactagc

SEQ ID NO: 196214 - DNA, 25 bp, Homo sapien
cccgcgtcagcaaagagcggagctg

SEQ ID NO: 196215 - DNA, 25 bp, Homo sapien
acgctcagttgtgcgtgccgacgcc

SEQ ID NO: 196216 - DNA, 25 bp, Homo sapien
acttccggcgcgctgacgctcagtt

SEQ ID NO: 196217 - DNA, 25 bp, Homo sapien
cctgtcggtgagcttacgtcacttc

SEQ ID NO: 196218 - DNA, 25 bp, Homo sapien
cgccgagctaagctcctgtcggtga

SEQ ID NO: 196219 - DNA, 25 bp, Homo sapien
cgcttttatttaggcgcgtgccgcc

SEQ ID NO: 196220 - DNA, 25 bp, Homo sapien
gagagccacggcaacctccagacgg

SEQ ID NO: 196221 - DNA, 25 bp, Homo sapien
ccggggtgacgagaaggagaagacg

SEQ ID NO: 196222 - DNA, 25 bp, Homo sapien
aggtggcgcccctcgcactgcacct

SEQ ID NO: 196223 - DNA, 25 bp, Homo sapien
gggccaggaaccatggggcacagcc

SEQ ID NO: 196224 - DNA, 25 bp, Homo sapien
gcgccacagcaacctctaggcagtg

SEQ ID NO: 196225 - DNA, 25 bp, Homo sapien
ggcgtcagttgctgcaccgccgact

SEQ ID NO: 196226 - DNA, 25 bp, Homo sapien
gcggcgtcagttgctgcaccgccga

SEQ ID NO: 196227 - DNA, 25 bp, Homo sapien
cagcaacctctaggcagtgcccaca

SEQ ID NO: 196228 - DNA, 25 bp, Homo sapien
ctgtaagatagggacagggcgaccc

SEQ ID NO: 196229 - DNA, 25 bp, Homo sapien
tcccgcggtgacctcctggagcagt

SEQ ID NO: 196230 - DNA, 25 bp, Homo sapien
agcccgccgtctgatgaggattgtt

SEQ ID NO: 196231 - DNA, 25 bp, Homo sapien
agccgtagtcggactgactacactg

SEQ ID NO: 196232 - DNA, 25 bp, Homo sapien
tggtccaacttgtgtccctcaccaa

SEQ ID NO: 196233 - DNA, 25 bp, Homo sapien
tcgcgcttctggtccaacttgtgtc

SEQ ID NO: 196234 - DNA, 25 bp, Homo sapien
ccgctgtgattaatgtactgacgaa

SEQ ID NO: 196235 - DNA, 25 bp, Homo sapien
gaggattgttattctaagtgcaata

SEQ ID NO: 196236 - DNA, 25 bp, Homo sapien
taaaacacgaagatcggcggggcgc

SEQ ID NO: 196237 - DNA, 25 bp, Homo sapien
gggaagcgccgactaactacactgg

SEQ ID NO: 196238 - DNA, 25 bp, Homo sapien
tcgcgaatcctaccgcgcgttggtg

SEQ ID NO: 196239 - DNA, 25 bp, Homo sapien
tcccagtggccttcgcgccataagg

SEQ ID NO: 196240 - DNA, 25 bp, Homo sapien
cacgaagcacgaggcccaaaaaata

SEQ ID NO: 196241 - DNA, 25 bp, Homo sapien
ctcgctgtccgaaccggtggtgaaa

SEQ ID NO: 196242 - DNA, 25 bp, Homo sapien
cggacaaggacgactcggactcgct

SEQ ID NO: 196243 - DNA, 25 bp, Homo sapien
ccctgacagcggaaacgccgagaga

SEQ ID NO: 196244 - DNA, 25 bp, Homo sapien
gggcgctggtcctcaagatctcccg

SEQ ID NO: 196245 - DNA, 25 bp, Homo sapien
atggcctccaggcagcaacggcctt

SEQ ID NO: 196246 - DNA, 25 bp, Homo sapien
aaagccggccagttcctgggtcgca

SEQ ID NO: 196247 - DNA, 25 bp, Homo sapien
gaaatgttagtgaggtccggccacg

SEQ ID NO: 196248 - DNA, 25 bp, Homo sapien
tgctggaaccctgacgtgcagcagg

SEQ ID NO: 196249 - DNA, 25 bp, Homo sapien
tcggcgagctcctgaaatgccggca

SEQ ID NO: 196250 - DNA, 25 bp, Homo sapien
cgcccgcagtccgttaagtgcgagc

SEQ ID NO: 196251 - DNA, 25 bp, Homo sapien
tgccagtttcccaaagggcgcaagc

SEQ ID NO: 196252 - DNA, 25 bp, Homo sapien
gaccctgaggcctgtacctttaaga

SEQ ID NO: 196253 - DNA, 25 bp, Homo sapien
ggcgggaatactcaccctcggaatc

SEQ ID NO: 196254 - DNA, 25 bp, Homo sapien
agcctcccatcgcatcaagttcagg

SEQ ID NO: 196255 - DNA, 25 bp, Homo sapien
ggtgacaaggatcaacgcccgattg

SEQ ID NO: 196256 - DNA, 25 bp, Homo sapien
ctgcactatgcagaggccgtttgtc

SEQ ID NO: 196257 - DNA, 25 bp, Homo sapien
ccgtttgtcggatcacgtgacagca

SEQ ID NO: 196258 - DNA, 25 bp, Homo sapien
cccatcacgtgctcagaggttttcc

SEQ ID NO: 196259 - DNA, 25 bp, Homo sapien
ggtccagggtcatagagtgtccaaa

SEQ ID NO: 196260 - DNA, 25 bp, Homo sapien
tcgagaagctcctcacagcgtcgct

SEQ ID NO: 196261 - DNA, 25 bp, Homo sapien
agtcgcgtgcacctctcgagaagct

SEQ ID NO: 196262 - DNA, 25 bp, Homo sapien
ccagaggaggtgctgccaacagctg

SEQ ID NO: 196263 - DNA, 25 bp, Homo sapien
gaacgagtggaatcccgaagccggc

SEQ ID NO: 196264 - DNA, 25 bp, Homo sapien
gaagccggccccatggtcctctgtg

SEQ ID NO: 196265 - DNA, 25 bp, Homo sapien
ctcctagacgtctctgtcccaagga

SEQ ID NO: 196266 - DNA, 25 bp, Homo sapien
tctctgtcccaaggagtcgcgtgca

SEQ ID NO: 196267 - DNA, 25 bp, Homo sapien
gtcccaaggagtcgcgtgcacctct

SEQ ID NO: 196268 - DNA, 25 bp, Homo sapien
agcggtgtgccaagtgaaaactaca

SEQ ID NO: 196269 - DNA, 25 bp, Homo sapien
cggttctcgacgtgccgccaatctt

SEQ ID NO: 196270 - DNA, 25 bp, Homo sapien
tcgcagtttccagcccgacgagctt

SEQ ID NO: 196271 - DNA, 25 bp, Homo sapien
acgcaggtctgtgatcatccgcaga

SEQ ID NO: 196272 - DNA, 25 bp, Homo sapien
tccgcgcgcgactacgctcataaaa

SEQ ID NO: 196273 - DNA, 25 bp, Homo sapien
gggtcacgtcacagaggaacgacta

SEQ ID NO: 196274 - DNA, 25 bp, Homo sapien
ccgccaatcttcgaacgcaggtctg

SEQ ID NO: 196275 - DNA, 25 bp, Homo sapien
actacgcatgcgtgcaaggtcctcc

SEQ ID NO: 196276 - DNA, 25 bp, Homo sapien
tccaacagcggcaggatacggagga

SEQ ID NO: 196277 - DNA, 25 bp, Homo sapien
gggcttggtgccagcaaagggacct

SEQ ID NO: 196278 - DNA, 25 bp, Homo sapien
aggcccgaaggccatcgcccgtgcg

SEQ ID NO: 196279 - DNA, 25 bp, Homo sapien
tgcggcgcggcgcatagaggtcccg

SEQ ID NO: 196280 - DNA, 25 bp, Homo sapien
ggcccactccaacagcggcaggata

SEQ ID NO: 196281 - DNA, 25 bp, Homo sapien
atacggaggagttagggcggctcca

SEQ ID NO: 196282 - DNA, 25 bp, Homo sapien
gtgtccctgtgagccctgccgcgcc

SEQ ID NO: 196283 - DNA, 25 bp, Homo sapien
gcgggagtaggaggcgcgcctatgg

SEQ ID NO: 196284 - DNA, 25 bp, Homo sapien
gagcgtagagctacgttgctcgagc

SEQ ID NO: 196285 - DNA, 25 bp, Homo sapien
tgctgcagcacgtccccggcggaga

SEQ ID NO: 196286 - DNA, 25 bp, Homo sapien
cgcgcacacccagctcgtgccgtcc

SEQ ID NO: 196287 - DNA, 25 bp, Homo sapien
gctcgagcaacgtagagcagcacgt

SEQ ID NO: 196288 - DNA, 25 bp, Homo sapien
cgctcgtagagcgtagagctacgtt

SEQ ID NO: 196289 - DNA, 25 bp, Homo sapien
agctacggcacgctcgtagagcgta

SEQ ID NO: 196290 - DNA, 25 bp, Homo sapien
gagacgagcgagctacggcacgctc

SEQ ID NO: 196291 - DNA, 25 bp, Homo sapien
tggtcggaggcttcctgcaccgcct

SEQ ID NO: 196292 - DNA, 25 bp, Homo sapien
gcctcgaccgccgtaggaaggcgct

SEQ ID NO: 196293 - DNA, 25 bp, Homo sapien
ggagcctgagacaagacccgacgcc

SEQ ID NO: 196294 - DNA, 25 bp, Homo sapien
cccagccgctccacgtcgctctgca

SEQ ID NO: 196295 - DNA, 25 bp, Homo sapien
cgtcgctctgcagagcggctctcca

SEQ ID NO: 196296 - DNA, 25 bp, Homo sapien
gcctggcctcgaccgccgtaggaag

SEQ ID NO: 196297 - DNA, 25 bp, Homo sapien
tgcatgggcctgaggcaccgacaca

SEQ ID NO: 196298 - DNA, 25 bp, Homo sapien
tcttccaggcgtactgggcgcgcct

SEQ ID NO: 196299 - DNA, 25 bp, Homo sapien
accggcccgggtgagcttacctgca

SEQ ID NO: 196300 - DNA, 25 bp, Homo sapien
taggattcgcgacgcctgcagccaa

SEQ ID NO: 196301 - DNA, 25 bp, Homo sapien
gagttgtagtctcccagtgtagtta

SEQ ID NO: 196302 - DNA, 25 bp, Homo sapien
ttctctctcggcgtttccgctgtca

SEQ ID NO: 196303 - DNA, 25 bp, Homo sapien
tattttttgggcctcgtgcttcgtg

SEQ ID NO: 196304 - DNA, 25 bp, Homo sapien
ccgtcgccatgtcgcggtttttcac

SEQ ID NO: 196305 - DNA, 25 bp, Homo sapien
tcaccaccggttcggacagcgagtc

SEQ ID NO: 196306 - DNA, 25 bp, Homo sapien
acagcgagtccgagtcgtccttgtc

SEQ ID NO: 196307 - DNA, 25 bp, Homo sapien
atcccgacaccaacgcgcggtagga

SEQ ID NO: 196308 - DNA, 25 bp, Homo sapien
gacctggggccaggttcaagcagca

SEQ ID NO: 196309 - DNA, 25 bp, Homo sapien
cggaaccagctaggggtgggcacct

SEQ ID NO: 196310 - DNA, 25 bp, Homo sapien
ccaggcggaaccagctaggggtggg

SEQ ID NO: 196311 - DNA, 25 bp, Homo sapien
caccctggatgccacgcctcggccc

SEQ ID NO: 196312 - DNA, 25 bp, Homo sapien
acacaccctggatgccacgcctcgg

SEQ ID NO: 196313 - DNA, 25 bp, Homo sapien
ccagcggacacacaccctggatgcc

SEQ ID NO: 196314 - DNA, 25 bp, Homo sapien
gcaagcccagcggacacacaccctg

SEQ ID NO: 196315 - DNA, 25 bp, Homo sapien
gcccagcggacacacaccctggatg

SEQ ID NO: 196316 - DNA, 25 bp, Homo sapien
aatcctcatcagacggcgggctacc

SEQ ID NO: 196317 - DNA, 25 bp, Homo sapien
ggttcgtcagtacattaatcacagc

SEQ ID NO: 196318 - DNA, 25 bp, Homo sapien
tgcacttagaataacaatcctcatc

SEQ ID NO: 196319 - DNA, 25 bp, Homo sapien
tgggtcgccctgtccctatcttaca

SEQ ID NO: 196320 - DNA, 25 bp, Homo sapien
cctgtccctatcttacagctgggga

SEQ ID NO: 196321 - DNA, 25 bp, Homo sapien
ggccagtgtagtcagtccgactacg

SEQ ID NO: 196322 - DNA, 25 bp, Homo sapien
gacacaagttggaccagaagcgcga

SEQ ID NO: 196323 - DNA, 25 bp, Homo sapien
actgctccaggaggtcaccgcggga

SEQ ID NO: 196324 - DNA, 25 bp, Homo sapien
cactgcctagaggttgctgtggcgc

SEQ ID NO: 196325 - DNA, 25 bp, Homo sapien
cgtcttctccttctcgtcaccccgg

SEQ ID NO: 196326 - DNA, 25 bp, Homo sapien
tgtgccccatggttcctggcccgcg

SEQ ID NO: 196327 - DNA, 25 bp, Homo sapien
tcggcggtgcagcaactgacgccgc

SEQ ID NO: 196328 - DNA, 25 bp, Homo sapien
agtcggcggtgcagcaactgacgcc

SEQ ID NO: 196329 - DNA, 25 bp, Homo sapien
tctggaggttgccgtggctctcgtt

SEQ ID NO: 196330 - DNA, 25 bp, Homo sapien
ccgtctggaggttgccgtggctctc

SEQ ID NO: 196331 - DNA, 25 bp, Homo sapien
aggtgcagtgcgaggggcgccacct

SEQ ID NO: 196332 - DNA, 25 bp, Homo sapien
ccaggggcccaccagacgttgcgtg

SEQ ID NO: 196333 - DNA, 25 bp, Homo sapien
tcccacctccggctgtaggtgcggc

SEQ ID NO: 196334 - DNA, 25 bp, Homo sapien
ggcccaccagacgttgcgtgcggca

SEQ ID NO: 196335 - DNA, 25 bp, Homo sapien
accagacgttgcgtgcggcactgcg

SEQ ID NO: 196336 - DNA, 25 bp, Homo sapien
tgcgggagccatctcctttggcatc

SEQ ID NO: 196337 - DNA, 25 bp, Homo sapien
gggagccatctcctttggcatcgcc

SEQ ID NO: 196338 - DNA, 25 bp, Homo sapien
atcgccccttgtctcgggccggtgg

SEQ ID NO: 196339 - DNA, 25 bp, Homo sapien
accgcgagtgcctggcggagcaggc

SEQ ID NO: 196340 - DNA, 25 bp, Homo sapien
cgcgcggcccacagtttggccaatg

SEQ ID NO: 196341 - DNA, 25 bp, Homo sapien
tctcggggcctagtcagggctcgca

SEQ ID NO: 196342 - DNA, 25 bp, Homo sapien
gagccgaaggcatcttggcgccgca

SEQ ID NO: 196343 - DNA, 25 bp, Homo sapien
cccttcccggtctggccagtaggag

SEQ ID NO: 196344 - DNA, 25 bp, Homo sapien
ccctcaggtccgaacaggtcggacg

SEQ ID NO: 196345 - DNA, 25 bp, Homo sapien
gcttcagccaatggggagtctgctg

SEQ ID NO: 196346 - DNA, 25 bp, Homo sapien
acttgggagcgggttgctgcctccc

SEQ ID NO: 196347 - DNA, 25 bp, Homo sapien
ccgccgcagcaacaccaggagaggc

SEQ ID NO: 196348 - DNA, 25 bp, Homo sapien
tcactcttcgtgatggctgcagtca

SEQ ID NO: 196349 - DNA, 25 bp, Homo sapien
ctacgcgggtcttgcgagatatctg

SEQ ID NO: 196350 - DNA, 25 bp, Homo sapien
aggctcatgggcgtagtagttctca

SEQ ID NO: 196351 - DNA, 25 bp, Homo sapien
aacgtagttctctctggcggtcgca

SEQ ID NO: 196352 - DNA, 25 bp, Homo sapien
cggccgccattgtggtcatactcgc

SEQ ID NO: 196353 - DNA, 25 bp, Homo sapien
ttgtcgcgcacgtaagtcttcttgg

SEQ ID NO: 196354 - DNA, 25 bp, Homo sapien
acattcacatgtggcttgtcgcgca

SEQ ID NO: 196355 - DNA, 25 bp, Homo sapien
acatggccgatggtacccacattca

SEQ ID NO: 196356 - DNA, 25 bp, Homo sapien
ggccggttctctatggtcgacatcg

SEQ ID NO: 196357 - DNA, 25 bp, Homo sapien
tcggagtatatggaccaccgggccc

SEQ ID NO: 196358 - DNA, 25 bp, Homo sapien
ggtctcttccttcagcgacgggaaa

SEQ ID NO: 196359 - DNA, 25 bp, Homo sapien
tgaagccctacgagattcacaccgt

SEQ ID NO: 196360 - DNA, 25 bp, Homo sapien
tgcaactggagaaggcactgaagcc

SEQ ID NO: 196361 - DNA, 25 bp, Homo sapien
acgctctggtgggatccaagcactt

SEQ ID NO: 196362 - DNA, 25 bp, Homo sapien
ctcatcatctcgctggtttccggtg

SEQ ID NO: 196363 - DNA, 25 bp, Homo sapien
gtggtcgcttttaggtgcaactgga

SEQ ID NO: 196364 - DNA, 25 bp, Homo sapien
cgagtcccgagcatcccattgtaca

SEQ ID NO: 196365 - DNA, 25 bp, Homo sapien
gaaaccggagcttccctgccttggc

SEQ ID NO: 196366 - DNA, 25 bp, Homo sapien
tttgctccttgacatttgcctgctg

SEQ ID NO: 196367 - DNA, 25 bp, Homo sapien
ccgtcgcgttaagcacaagctggca

SEQ ID NO: 196368 - DNA, 25 bp, Homo sapien
acgaaagcctccctgtgccttggtc

SEQ ID NO: 196369 - DNA, 25 bp, Homo sapien
aggactcgctcctagtggcgggaaa

SEQ ID NO: 196370 - DNA, 25 bp, Homo sapien
gctttaagggtgttctcagccaaaa

SEQ ID NO: 196371 - DNA, 25 bp, Homo sapien
accctcgcggcttcaagagcttgga

SEQ ID NO: 196372 - DNA, 25 bp, Homo sapien
aggaggtggccgatcgcgcctacac

SEQ ID NO: 196373 - DNA, 25 bp, Homo sapien
ccgggatccgggtgatcatgatcac

SEQ ID NO: 196374 - DNA, 25 bp, Homo sapien
tcactggggacaacaagggcacagc

SEQ ID NO: 196375 - DNA, 25 bp, Homo sapien
tctgccggcgaattggcatctttgg

SEQ ID NO: 196376 - DNA, 25 bp, Homo sapien
cctacacgggccgagagttcgacga

SEQ ID NO: 196377 - DNA, 25 bp, Homo sapien
gctgaacagcgggaagcctgccgac

SEQ ID NO: 196378 - DNA, 25 bp, Homo sapien
acagccattgccatctgccggcgaa

SEQ ID NO: 196379 - DNA, 25 bp, Homo sapien
gcaaggaggtcacgggctccatcca

SEQ ID NO: 196380 - DNA, 25 bp, Homo sapien
ccatctgcatcttgtccgggccgtt

SEQ ID NO: 196381 - DNA, 25 bp, Homo sapien
caggagcggtgattccatctgcatc

SEQ ID NO: 196382 - DNA, 25 bp, Homo sapien
gaagaagctgtcctctaccgcgttg

SEQ ID NO: 196383 - DNA, 25 bp, Homo sapien
ctggaagagcatggtcccgttgact

SEQ ID NO: 196384 - DNA, 25 bp, Homo sapien
aagtgcctccgaagactgggttgac

SEQ ID NO: 196385 - DNA, 25 bp, Homo sapien
caggctgcattcacgctttggtgcg

SEQ ID NO: 196386 - DNA, 25 bp, Homo sapien
tcacgttgctggagaagggcttttt

SEQ ID NO: 196387 - DNA, 25 bp, Homo sapien
ggtccggaaagcgttatcctccatc

SEQ ID NO: 196388 - DNA, 25 bp, Homo sapien
tccttaagaggtcttgcccggcgtc

SEQ ID NO: 196389 - DNA, 25 bp, Homo sapien
gggtgctgcctacactccatctctt

SEQ ID NO: 196390 - DNA, 25 bp, Homo sapien
agcctggcttgcgttaccgcgaatt

SEQ ID NO: 196391 - DNA, 25 bp, Homo sapien
gcttcatttttctgagcgcctcgga

SEQ ID NO: 196392 - DNA, 25 bp, Homo sapien
ttgcctcagcgcaaacggcggattc

SEQ ID NO: 196393 - DNA, 25 bp, Homo sapien
cggtggccagtttcactcagtcctc

SEQ ID NO: 196394 - DNA, 25 bp, Homo sapien
tttcaagcccggaagaggatcctta

SEQ ID NO: 196395 - DNA, 25 bp, Homo sapien
tctctccgtgaccttggaagccctg

SEQ ID NO: 196396 - DNA, 25 bp, Homo sapien
gctgtgcgccaagccttctggagct

SEQ ID NO: 196397 - DNA, 25 bp, Homo sapien
cccgtcttatggaaacccgagcagc

SEQ ID NO: 196398 - DNA, 25 bp, Homo sapien
ccagagtccattcgcagagcccaaa

SEQ ID NO: 196399 - DNA, 25 bp, Homo sapien
aggcctcggccctagatttagattc

SEQ ID NO: 196400 - DNA, 25 bp, Homo sapien
tcgtaatcaagagcagaacttcgcc

SEQ ID NO: 196401 - DNA, 25 bp, Homo sapien
ccagagcctgaagtcgtaatcaaga

SEQ ID NO: 196402 - DNA, 25 bp, Homo sapien
ccaggacccagagcctgaagtcgta

SEQ ID NO: 196403 - DNA, 25 bp, Homo sapien
cccgagcagcgacgtccaggcggat

SEQ ID NO: 196404 - DNA, 25 bp, Homo sapien
tatgaggcgcgagttttgtgagcac

SEQ ID NO: 196405 - DNA, 25 bp, Homo sapien
gcgtatgggatgagactagggcaga

SEQ ID NO: 196406 - DNA, 25 bp, Homo sapien
tgagcaccgtgggtgtgagcagcat

SEQ ID NO: 196407 - DNA, 25 bp, Homo sapien
cagcatgtggtattgggtgtgtgcg

SEQ ID NO: 196408 - DNA, 25 bp, Homo sapien
atgccgttctgcgtggatgtatgag

SEQ ID NO: 196409 - DNA, 25 bp, Homo sapien
ggacatgccgttctgcgtggatgta

SEQ ID NO: 196410 - DNA, 25 bp, Homo sapien
gtatcctgagcgacgtgtggcgtgg

SEQ ID NO: 196411 - DNA, 25 bp, Homo sapien
cagaggtggacatgccgttctgcgt

SEQ ID NO: 196412 - DNA, 25 bp, Homo sapien
tttccacagggaattccaggcccgc

SEQ ID NO: 196413 - DNA, 25 bp, Homo sapien
ccttaccgctcgaggactacatttc

SEQ ID NO: 196414 - DNA, 25 bp, Homo sapien
acgagcaggctgtttgtccaatgca

SEQ ID NO: 196415 - DNA, 25 bp, Homo sapien
gtcaccgacagcgatgaggaaattc

SEQ ID NO: 196416 - DNA, 25 bp, Homo sapien
gcgtcccgggataacagcaacagtg

SEQ ID NO: 196417 - DNA, 25 bp, Homo sapien
ccctgcgactaaccaagccggaaga

SEQ ID NO: 196418 - DNA, 25 bp, Homo sapien
aggaaattctggaggtcgccaccgc

SEQ ID NO: 196419 - DNA, 25 bp, Homo sapien
tgtccaatgcaaggcgaaagtcgct

SEQ ID NO: 196420 - DNA, 25 bp, Homo sapien
gacgctctttttgacgctccaggga

SEQ ID NO: 196421 - DNA, 25 bp, Homo sapien
tccacctagtcacggggacgctctt

SEQ ID NO: 196422 - DNA, 25 bp, Homo sapien
cggccggccgtcacatgacatgtga

SEQ ID NO: 196423 - DNA, 25 bp, Homo sapien
acgcccaagaggcttccgtagtcgg

SEQ ID NO: 196424 - DNA, 25 bp, Homo sapien
cgcgtcacatgaccggctttaagca

SEQ ID NO: 196425 - DNA, 25 bp, Homo sapien
ctttaagcaacatggcggctgccgt

SEQ ID NO: 196426 - DNA, 25 bp, Homo sapien
ctccgcgctgtgtgtctactgagac

SEQ ID NO: 196427 - DNA, 25 bp, Homo sapien
ccttctcagtggtgctctgtgcttc

SEQ ID NO: 196428 - DNA, 25 bp, Homo sapien
aatggcggaagtggcaccgttgcca

SEQ ID NO: 196429 - DNA, 25 bp, Homo sapien
gcgccgccatgacggcggaagtaat

SEQ ID NO: 196430 - DNA, 25 bp, Homo sapien
gtgtatcgcattcggggctcagtct

SEQ ID NO: 196431 - DNA, 25 bp, Homo sapien
acaagaccctgaagggcgccgtgta

SEQ ID NO: 196432 - DNA, 25 bp, Homo sapien
cacttcttctgggtgctgtcggtga

SEQ ID NO: 196433 - DNA, 25 bp, Homo sapien
cgagtggaagcgctccgccaagcag

SEQ ID NO: 196434 - DNA, 25 bp, Homo sapien
tcttcagacacttccgggtggacga

SEQ ID NO: 196435 - DNA, 25 bp, Homo sapien
gattcgcggctggagcaaccctgga

SEQ ID NO: 196436 - DNA, 25 bp, Homo sapien
cgcaacttccgggacagaggctgtg

SEQ ID NO: 196437 - DNA, 25 bp, Homo sapien
ccaatggcggcaccgctgcttcaca

SEQ ID NO: 196438 - DNA, 25 bp, Homo sapien
ctgaaggttgcgctggcacgcgcaa

SEQ ID NO: 196439 - DNA, 25 bp, Homo sapien
ctggcacgcgcaacttccgggacag

SEQ ID NO: 196440 - DNA, 25 bp, Homo sapien
cacgcgcaacttccgggacagaggc

SEQ ID NO: 196441 - DNA, 25 bp, Homo sapien
gacagaggctgtggctggaaggagc

SEQ ID NO: 196442 - DNA, 25 bp, Homo sapien
cagcggtcgcgttagttcggcccaa

SEQ ID NO: 196443 - DNA, 25 bp, Homo sapien
gtcgcgttagttcggcccaatggcg

SEQ ID NO: 196444 - DNA, 25 bp, Homo sapien
ggctccgggtttcttcctcctgtca

SEQ ID NO: 196445 - DNA, 25 bp, Homo sapien
gaggtgggagaagccatcttcctgc

SEQ ID NO: 196446 - DNA, 25 bp, Homo sapien
tcttcctcctgtcacgcccgggtct

SEQ ID NO: 196447 - DNA, 25 bp, Homo sapien
cgggtctcccgcgtctcctcggtct

SEQ ID NO: 196448 - DNA, 25 bp, Homo sapien
tcccgcgccacctacatcccggccg

SEQ ID NO: 196449 - DNA, 25 bp, Homo sapien
cgcccggcgcgtgtgctctgaaagt

SEQ ID NO: 196450 - DNA, 25 bp, Homo sapien
tgtgctctgaaagtgcgagctgccg

SEQ ID NO: 196451 - DNA, 25 bp, Homo sapien
aggctgcttccctagccgctgccgc

SEQ ID NO: 196452 - DNA, 25 bp, Homo sapien
gtggcacgaggggtcggcggtataa

SEQ ID NO: 196453 - DNA, 25 bp, Homo sapien
atcctctgtggcacgaggggtcggc

SEQ ID NO: 196454 - DNA, 25 bp, Homo sapien
cacgaggggtcggcggtataatcct

SEQ ID NO: 196455 - DNA, 25 bp, Homo sapien
ggcacgaggggtcggcggtataatc

SEQ ID NO: 196456 - DNA, 25 bp, Homo sapien
tctgtggcacgaggggtcggcggta

SEQ ID NO: 196457 - DNA, 25 bp, Homo sapien
cctctgtggcacgaggggtcggcgg

SEQ ID NO: 196458 - DNA, 25 bp, Homo sapien
tcctctgtggcacgaggggtcggcg

SEQ ID NO: 196459 - DNA, 25 bp, Homo sapien
ggtcggcggtataatcctccgtggc

SEQ ID NO: 196460 - DNA, 25 bp, Homo sapien
cttagctgcagtgcgtgtgacagtc

SEQ ID NO: 196461 - DNA, 25 bp, Homo sapien
gcattcgtcactcttagctgcagtg

SEQ ID NO: 196462 - DNA, 25 bp, Homo sapien
attcgtcactcttagctgcagtgcg

SEQ ID NO: 196463 - DNA, 25 bp, Homo sapien
tcgtcactcttagctgcagtgcgtg

SEQ ID NO: 196464 - DNA, 25 bp, Homo sapien
gtcactcttagctgcagtgcgtgtg

SEQ ID NO: 196465 - DNA, 25 bp, Homo sapien
tcactcttagctgcagtgcgtgtga

SEQ ID NO: 196466 - DNA, 25 bp, Homo sapien
ctcttagctgcagtgcgtgtgacag

SEQ ID NO: 196467 - DNA, 25 bp, Homo sapien
actcttagctgcagtgcgtgtgaca

SEQ ID NO: 196468 - DNA, 25 bp, Homo sapien
cggcggtgttactgtcacggtcacc

SEQ ID NO: 196469 - DNA, 25 bp, Homo sapien
gacgtcggcggtgttactgtcacgg

SEQ ID NO: 196470 - DNA, 25 bp, Homo sapien
acgtcggcggtgttactgtcacggt

SEQ ID NO: 196471 - DNA, 25 bp, Homo sapien
cgtcggcggtgttactgtcacggtc

SEQ ID NO: 196472 - DNA, 25 bp, Homo sapien
gtcggcggtgttactgtcacggtca

SEQ ID NO: 196473 - DNA, 25 bp, Homo sapien
tcggcggtgttactgtcacggtcac

SEQ ID NO: 196474 - DNA, 25 bp, Homo sapien
ggacgtcggcggtgttactgtcacg

SEQ ID NO: 196475 - DNA, 25 bp, Homo sapien
aggacgtcggcggtgttactgtcac

SEQ ID NO: 196476 - DNA, 25 bp, Homo sapien
accagaacgcctgggtcaccgcggc

SEQ ID NO: 196477 - DNA, 25 bp, Homo sapien
acacgtcaggacacgtggcagctcc

SEQ ID NO: 196478 - DNA, 25 bp, Homo sapien
cgcctgacctcacccgagggtggga

SEQ ID NO: 196479 - DNA, 25 bp, Homo sapien
tgtcgacggcgtctcgtatgaatcc

SEQ ID NO: 196480 - DNA, 25 bp, Homo sapien
gcgagagccctcaaccagggacgga

SEQ ID NO: 196481 - DNA, 25 bp, Homo sapien
tggaactcggaggacagagcttgtc

SEQ ID NO: 196482 - DNA, 25 bp, Homo sapien
cactggctggaaaatggaactcgga

SEQ ID NO: 196483 - DNA, 25 bp, Homo sapien
cagagcttgtcgacggcgtctcgta

SEQ ID NO: 196484 - DNA, 25 bp, Homo sapien
tcgcgcctggagatgatgacagaga

SEQ ID NO: 196485 - DNA, 25 bp, Homo sapien
caagcaaatcgccaggttcaccctg

SEQ ID NO: 196486 - DNA, 25 bp, Homo sapien
aggttcaccctgcaaccgaacgagg

SEQ ID NO: 196487 - DNA, 25 bp, Homo sapien
caaccgaacgaggtgctgacggccc

SEQ ID NO: 196488 - DNA, 25 bp, Homo sapien
ggtccttaaacagctttgagaacga

SEQ ID NO: 196489 - DNA, 25 bp, Homo sapien
gaacgactgtgtgagtgcgatccga

SEQ ID NO: 196490 - DNA, 25 bp, Homo sapien
cgcaggtcctcactcgggacaagtc

SEQ ID NO: 196491 - DNA, 25 bp, Homo sapien
gccgaatctcacctgcaagcaaatc

SEQ ID NO: 196492 - DNA, 25 bp, Homo sapien
cacagcaggtatagtcggttctgcc

SEQ ID NO: 196493 - DNA, 25 bp, Homo sapien
atgccgcacacagcaggtatagtcg

SEQ ID NO: 196494 - DNA, 25 bp, Homo sapien
gacaaactgcatgccgcacacagca

SEQ ID NO: 196495 - DNA, 25 bp, Homo sapien
tgcatgccgcacacagcaggtatag

SEQ ID NO: 196496 - DNA, 25 bp, Homo sapien
cgcacacagcaggtatagtcggttc

SEQ ID NO: 196497 - DNA, 25 bp, Homo sapien
tgtctctaacccgaataccaagcct

SEQ ID NO: 196498 - DNA, 25 bp, Homo sapien
ctggacaaactgcatgccgcacaca

SEQ ID NO: 196499 - DNA, 25 bp, Homo sapien
cacacagcaggtatagtcggttctg

SEQ ID NO: 196500 - DNA, 25 bp, Homo sapien
ccagcctgatgtgttcggtgactca

SEQ ID NO: 196501 - DNA, 25 bp, Homo sapien
cgtccacgtggtcagccagcctgat

SEQ ID NO: 196502 - DNA, 25 bp, Homo sapien
cctgcttccaaccaatttcgctttg

SEQ ID NO: 196503 - DNA, 25 bp, Homo sapien
cggtgactcagccaaagcttaaaac

SEQ ID NO: 196504 - DNA, 25 bp, Homo sapien
gctgcgtgtcagagaatgagtgttt

SEQ ID NO: 196505 - DNA, 25 bp, Homo sapien
gagaatgagtgtttcccgatggaac

SEQ ID NO: 196506 - DNA, 25 bp, Homo sapien
agaaatggccgcagactctccctgc

SEQ ID NO: 196507 - DNA, 25 bp, Homo sapien
tttcgctttgcggtgctcacctgta

SEQ ID NO: 196508 - DNA, 25 bp, Homo sapien
gcgagaggcatttacgacctcagcg

SEQ ID NO: 196509 - DNA, 25 bp, Homo sapien
cgtgcgagaggcatttacgacctca

SEQ ID NO: 196510 - DNA, 25 bp, Homo sapien
gattagggacgctccacggacttca

SEQ ID NO: 196511 - DNA, 25 bp, Homo sapien
ccagtgattagggacgctccacgga

SEQ ID NO: 196512 - DNA, 25 bp, Homo sapien
cgcaaagcagaacccccagtgatta

SEQ ID NO: 196513 - DNA, 25 bp, Homo sapien
tggagctgtgagtagcaccgctgtc

SEQ ID NO: 196514 - DNA, 25 bp, Homo sapien
ctgcagagttctggagctgtgagta

SEQ ID NO: 196515 - DNA, 25 bp, Homo sapien
ttctggagctgtgagtagcaccgct

SEQ ID NO: 196516 - DNA, 25 bp, Homo sapien
tgttgaagccgctccgggttggaaa

SEQ ID NO: 196517 - DNA, 25 bp, Homo sapien
accctcaggggcgaagaggccgaag

SEQ ID NO: 196518 - DNA, 25 bp, Homo sapien
tcaggggcgaagaggccgaagacag

SEQ ID NO: 196519 - DNA, 25 bp, Homo sapien
gctgcatgtgttgaagccgctccgg

SEQ ID NO: 196520 - DNA, 25 bp, Homo sapien
ctgcatgtgttgaagccgctccggg

SEQ ID NO: 196521 - DNA, 25 bp, Homo sapien
gcatgtgttgaagccgctccgggtt

SEQ ID NO: 196522 - DNA, 25 bp, Homo sapien
tgaagccgctccgggttggaaaatg

SEQ ID NO: 196523 - DNA, 25 bp, Homo sapien
tgcatgtgttgaagccgctccgggt

SEQ ID NO: 196524 - DNA, 25 bp, Homo sapien
caggacacgccggagacactggacc

SEQ ID NO: 196525 - DNA, 25 bp, Homo sapien
agctggctgccgagatgcaggacac

SEQ ID NO: 196526 - DNA, 25 bp, Homo sapien
gcatttgaggaagcggctgtgactc

SEQ ID NO: 196527 - DNA, 25 bp, Homo sapien
gggatgcggtcagccaaagcatttg

SEQ ID NO: 196528 - DNA, 25 bp, Homo sapien
gtaaaataaacacggctctcgctgg

SEQ ID NO: 196529 - DNA, 25 bp, Homo sapien
gtcaaagtcgcacacggggcttctg

SEQ ID NO: 196530 - DNA, 25 bp, Homo sapien
agctgatcttggcaggtcgcgtcct

SEQ ID NO: 196531 - DNA, 25 bp, Homo sapien
acagcaccgagacctcagtgtcggg

SEQ ID NO: 196532 - DNA, 25 bp, Homo sapien
tgaatctgggtcttgcgtctgtaac

SEQ ID NO: 196533 - DNA, 25 bp, Homo sapien
ttgagccaggacacaacaccgcgga

SEQ ID NO: 196534 - DNA, 25 bp, Homo sapien
ttaatgtcactgttggcgcggatga

SEQ ID NO: 196535 - DNA, 25 bp, Homo sapien
ggtcttgcgtctgtaacgtgcgccg

SEQ ID NO: 196536 - DNA, 25 bp, Homo sapien
gccaagcggattgagccaggacaca

SEQ ID NO: 196537 - DNA, 25 bp, Homo sapien
ggtgttagccaagcggattgagcca

SEQ ID NO: 196538 - DNA, 25 bp, Homo sapien
ttcttcctggtttttaatgtcactg

SEQ ID NO: 196539 - DNA, 25 bp, Homo sapien
gcaggcggtgagtgatttcttcctg

SEQ ID NO: 196540 - DNA, 25 bp, Homo sapien
gcggagtctgcgaaacaaaaccgcc

SEQ ID NO: 196541 - DNA, 25 bp, Homo sapien
tctgcggagtctgcgaaacaaaacc

SEQ ID NO: 196542 - DNA, 25 bp, Homo sapien
gattctgcggagtctgcgaaacaaa

SEQ ID NO: 196543 - DNA, 25 bp, Homo sapien
ccagattctgcggagtctgcgaaac

SEQ ID NO: 196544 - DNA, 25 bp, Homo sapien
cgaagcgggccagagaggtgtcctc

SEQ ID NO: 196545 - DNA, 25 bp, Homo sapien
tgcggagtctgcgaaacaaaaccgc

SEQ ID NO: 196546 - DNA, 25 bp, Homo sapien
cccaccggcttgtgagtgggaagca

SEQ ID NO: 196547 - DNA, 25 bp, Homo sapien
gccacccaccggcttgtgagtggga

SEQ ID NO: 196548 - DNA, 25 bp, Homo sapien
ccggaggtcagcctgtcccaagagc

SEQ ID NO: 196549 - DNA, 25 bp, Homo sapien
agcctgtcccaagagcgctcagacg

SEQ ID NO: 196550 - DNA, 25 bp, Homo sapien
gctcagacgcctccaacgcggatgg

SEQ ID NO: 196551 - DNA, 25 bp, Homo sapien
ccggtttccatagccttgagccctg

SEQ ID NO: 196552 - DNA, 25 bp, Homo sapien
cagctggaggcctctgacatccaca

SEQ ID NO: 196553 - DNA, 25 bp, Homo sapien
gaggcctctgacatccacacggctg

SEQ ID NO: 196554 - DNA, 25 bp, Homo sapien
ggcacccacgtgttgactcacgagt

SEQ ID NO: 196555 - DNA, 25 bp, Homo sapien
tgactcacgagtcggctgaggtgcc

SEQ ID NO: 196556 - DNA, 25 bp, Homo sapien
gtccaggcttttcgcgcttgccatg

SEQ ID NO: 196557 - DNA, 25 bp, Homo sapien
tgctcgtcgggtccagcagcacaat

SEQ ID NO: 196558 - DNA, 25 bp, Homo sapien
cagggcgctttttcggcgtctacct

SEQ ID NO: 196559 - DNA, 25 bp, Homo sapien
tggaccctaggtcacggcaatcaac

SEQ ID NO: 196560 - DNA, 25 bp, Homo sapien
cgatgctgaatggtacgcgctcgcc

SEQ ID NO: 196561 - DNA, 25 bp, Homo sapien
gcttgccatgtgtcagccaatcaga

SEQ ID NO: 196562 - DNA, 25 bp, Homo sapien
tggggttcactgtcaacactgctcg

SEQ ID NO: 196563 - DNA, 25 bp, Homo sapien
ggctgggttccagcatagggctctt

SEQ ID NO: 196564 - DNA, 25 bp, Homo sapien
ggcggggctcacaggaacattcctg

SEQ ID NO: 196565 - DNA, 25 bp, Homo sapien
acccactaggtctgtgacgtgcgcg

SEQ ID NO: 196566 - DNA, 25 bp, Homo sapien
tactgcctgaatccctggtacccgg

SEQ ID NO: 196567 - DNA, 25 bp, Homo sapien
gtggggctcactgtcaaccctgttc

SEQ ID NO: 196568 - DNA, 25 bp, Homo sapien
ccattggccgaggtccctgttaaga

SEQ ID NO: 196569 - DNA, 25 bp, Homo sapien
acaagcctgctgagagggacccact

SEQ ID NO: 196570 - DNA, 25 bp, Homo sapien
ccctgggaatctcggcgttagaact

SEQ ID NO: 196571 - DNA, 25 bp, Homo sapien
ccatggagattgtgctcgtcgtgca

SEQ ID NO: 196572 - DNA, 25 bp, Homo sapien
atgatggttccacgtcagcggccct

SEQ ID NO: 196573 - DNA, 25 bp, Homo sapien
gggtttgcgtgacggttccacgtca

SEQ ID NO: 196574 - DNA, 25 bp, Homo sapien
tccgcctcttgggtttgcgtgacgg

SEQ ID NO: 196575 - DNA, 25 bp, Homo sapien
ttgcgtgacggttccacgtcaccga

SEQ ID NO: 196576 - DNA, 25 bp, Homo sapien
gttcgggtgatgatggttccacgtc

SEQ ID NO: 196577 - DNA, 25 bp, Homo sapien
tgatgatggttccacgtcagcggcc

SEQ ID NO: 196578 - DNA, 25 bp, Homo sapien
ccgcctcttgggtttgcgtgacggt

SEQ ID NO: 196579 - DNA, 25 bp, Homo sapien
ttcgggtgatgatggttccacgtca

SEQ ID NO: 196580 - DNA, 25 bp, Homo sapien
gcatgcagtctgtagagtccgtcca

SEQ ID NO: 196581 - DNA, 25 bp, Homo sapien
ttcctgtgtcgtggctcagggaatc

SEQ ID NO: 196582 - DNA, 25 bp, Homo sapien
agctttcaggatttggcacaatttc

SEQ ID NO: 196583 - DNA, 25 bp, Homo sapien
aataccgaagaacaggggcctgctc

SEQ ID NO: 196584 - DNA, 25 bp, Homo sapien
ggcctgctcattcccggcatgctgt

SEQ ID NO: 196585 - DNA, 25 bp, Homo sapien
agtccgtccacacgaagaagactcc

SEQ ID NO: 196586 - DNA, 25 bp, Homo sapien
ttagaagccaggaatcacgtgactg

SEQ ID NO: 196587 - DNA, 25 bp, Homo sapien
ggaccacctgctacatggagttaga

SEQ ID NO: 196588 - DNA, 25 bp, Homo sapien
tgaaggggcgccgacttctcttcca

SEQ ID NO: 196589 - DNA, 25 bp, Homo sapien
ccgacttctcttccagggccatgcg

SEQ ID NO: 196590 - DNA, 25 bp, Homo sapien
gaaggggcgccgacttctcttccag

SEQ ID NO: 196591 - DNA, 25 bp, Homo sapien
aaggggcgccgacttctcttccagg

SEQ ID NO: 196592 - DNA, 25 bp, Homo sapien
aggggcgccgacttctcttccaggg

SEQ ID NO: 196593 - DNA, 25 bp, Homo sapien
ggggcgccgacttctcttccagggc

SEQ ID NO: 196594 - DNA, 25 bp, Homo sapien
cgcctgagcccgcaacgcagaatga

SEQ ID NO: 196595 - DNA, 25 bp, Homo sapien
cgccgacttctcttccagggccatg

SEQ ID NO: 196596 - DNA, 25 bp, Homo sapien
caccactttctttggcagacggaag

SEQ ID NO: 196597 - DNA, 25 bp, Homo sapien
gcagaagcggcggactggggccctc

SEQ ID NO: 196598 - DNA, 25 bp, Homo sapien
aggggtctagccgtcggcccacgct

SEQ ID NO: 196599 - DNA, 25 bp, Homo sapien
gctcaccactttctttggcagacgg

SEQ ID NO: 196600 - DNA, 25 bp, Homo sapien
actttctttggcagacggaagtctc

SEQ ID NO: 196601 - DNA, 25 bp, Homo sapien
ttctttggcagacggaagtctcgcc

SEQ ID NO: 196602 - DNA, 25 bp, Homo sapien
tttggcagacggaagtctcgccagg

SEQ ID NO: 196603 - DNA, 25 bp, Homo sapien
cacgctcaccactttctttggcaga

SEQ ID NO: 196604 - DNA, 25 bp, Homo sapien
atcgaagctggtgccggtggccaga

SEQ ID NO: 196605 - DNA, 25 bp, Homo sapien
gctggtggagaagtatgggctcctg

SEQ ID NO: 196606 - DNA, 25 bp, Homo sapien
ccacgccaggcttccggctggtgga

SEQ ID NO: 196607 - DNA, 25 bp, Homo sapien
cacgaggaagaccacgccaggcttc

SEQ ID NO: 196608 - DNA, 25 bp, Homo sapien
tggcaggcacgaggaagaccacgcc

SEQ ID NO: 196609 - DNA, 25 bp, Homo sapien
tgcagtggcattgccagtgctgccg

SEQ ID NO: 196610 - DNA, 25 bp, Homo sapien
ctggcccgctgcagtggcattgcca

SEQ ID NO: 196611 - DNA, 25 bp, Homo sapien
aacgggtggccctcaacacgctggc

SEQ ID NO: 196612 - DNA, 25 bp, Homo sapien
catgcgcgctccagcgtcctgacca

SEQ ID NO: 196613 - DNA, 25 bp, Homo sapien
caagaaactgccgagagtgaaggga

SEQ ID NO: 196614 - DNA, 25 bp, Homo sapien
ggagggatggttgctaacgcaactc

SEQ ID NO: 196615 - DNA, 25 bp, Homo sapien
caatggctgcgaggcccatgcgcgc

SEQ ID NO: 196616 - DNA, 25 bp, Homo sapien
tccagtcgtcaatggctgcgaggcc

SEQ ID NO: 196617 - DNA, 25 bp, Homo sapien
cagctcgcgtccagtcgtcaatggc

SEQ ID NO: 196618 - DNA, 25 bp, Homo sapien
tcggggtttgtaccgcagctcgcgt

SEQ ID NO: 196619 - DNA, 25 bp, Homo sapien
tgctaacgcaactctctgcagggca

SEQ ID NO: 196620 - DNA, 25 bp, Homo sapien
ttccagacatcaacggctgcgcggc

SEQ ID NO: 196621 - DNA, 25 bp, Homo sapien
gcgcgtagtcttgattggtggaacc

SEQ ID NO: 196622 - DNA, 25 bp, Homo sapien
taccgacgtctggagtttagtggga

SEQ ID NO: 196623 - DNA, 25 bp, Homo sapien
cggcggcgatctcaggtacttgagc

SEQ ID NO: 196624 - DNA, 25 bp, Homo sapien
cgtcgccaacatccctgcgtagggg

SEQ ID NO: 196625 - DNA, 25 bp, Homo sapien
acatccctgcgtaggggtttgtatc

SEQ ID NO: 196626 - DNA, 25 bp, Homo sapien
gtttgtatcgcagcgcgcttccaga

SEQ ID NO: 196627 - DNA, 25 bp, Homo sapien
aaggcgggatagtggcgacccacac

SEQ ID NO: 196628 - DNA, 25 bp, Homo sapien
tggaggacctgcactctggcgccca

SEQ ID NO: 196629 - DNA, 25 bp, Homo sapien
gaagcagcacgaccgcccattgtca

SEQ ID NO: 196630 - DNA, 25 bp, Homo sapien
accaaagacggagcagacggccacc

SEQ ID NO: 196631 - DNA, 25 bp, Homo sapien
tgcgggttctcaccaccaaagacgg

SEQ ID NO: 196632 - DNA, 25 bp, Homo sapien
gctcccggaccggtgcgggttctca

SEQ ID NO: 196633 - DNA, 25 bp, Homo sapien
tccacgctggccctcagccacagtg

SEQ ID NO: 196634 - DNA, 25 bp, Homo sapien
cactctgcggagatctccacgctgg

SEQ ID NO: 196635 - DNA, 25 bp, Homo sapien
cccagcagcactggtccggccactc

SEQ ID NO: 196636 - DNA, 25 bp, Homo sapien
gagggatttcctgcttaagtgtcgc

SEQ ID NO: 196637 - DNA, 25 bp, Homo sapien
gggagggatttcctgcttaagtgtc

SEQ ID NO: 196638 - DNA, 25 bp, Homo sapien
gtttggtggatttggggcgcaccac

SEQ ID NO: 196639 - DNA, 25 bp, Homo sapien
ctcggaaaggcctgtggtgcggttt

SEQ ID NO: 196640 - DNA, 25 bp, Homo sapien
cttaagtgtcgctgtgacggcctgg

SEQ ID NO: 196641 - DNA, 25 bp, Homo sapien
ctgcttaagtgtcgctgtgacggcc

SEQ ID NO: 196642 - DNA, 25 bp, Homo sapien
ttcctgcttaagtgtcgctgtgacg

SEQ ID NO: 196643 - DNA, 25 bp, Homo sapien
gatttcctgcttaagtgtcgctgtg

SEQ ID NO: 196644 - DNA, 25 bp, Homo sapien
cacaagctgtcgcactcggacgaga

SEQ ID NO: 196645 - DNA, 25 bp, Homo sapien
gcaagagcttctcccggtgtgcacg

SEQ ID NO: 196646 - DNA, 25 bp, Homo sapien
gcgcttcaagcgcaaggaccgcatg

SEQ ID NO: 196647 - DNA, 25 bp, Homo sapien
ccggaagaaccatgcctgcgagatg

SEQ ID NO: 196648 - DNA, 25 bp, Homo sapien
tatgaagatgccgaccatggtgccc

SEQ ID NO: 196649 - DNA, 25 bp, Homo sapien
aggcacgaagccatccacacgggag

SEQ ID NO: 196650 - DNA, 25 bp, Homo sapien
agaacggctacaatctccggaggca

SEQ ID NO: 196651 - DNA, 25 bp, Homo sapien
acatgacggcgctgtgcacaagccc

SEQ ID NO: 196652 - DNA, 25 bp, Homo sapien
agtggaccgaccgacggctgacgcc

SEQ ID NO: 196653 - DNA, 25 bp, Homo sapien
ccaggaatcccggtgaccgttggcg

SEQ ID NO: 196654 - DNA, 25 bp, Homo sapien
gggacttaagaaggaggcgtctctc

SEQ ID NO: 196655 - DNA, 25 bp, Homo sapien
gctgcggctgctgcaaaagccagca

SEQ ID NO: 196656 - DNA, 25 bp, Homo sapien
ccagcccaccgaaggcgagggaagc

SEQ ID NO: 196657 - DNA, 25 bp, Homo sapien
tgacaggggatcgaaggagataacc

SEQ ID NO: 196658 - DNA, 25 bp, Homo sapien
gccctaaacgcgcagcaagaaaacc

SEQ ID NO: 196659 - DNA, 25 bp, Homo sapien
ttgcctgggtaacgcgtggctccct

SEQ ID NO: 196660 - DNA, 25 bp, Homo sapien
ggcggcgactcttacctcacaaagg

SEQ ID NO: 196661 - DNA, 25 bp, Homo sapien
ggaccctgataagaaatggcccttc

SEQ ID NO: 196662 - DNA, 25 bp, Homo sapien
ggcgcatcctgctgcttcctggaaa

SEQ ID NO: 196663 - DNA, 25 bp, Homo sapien
cgcctctcagtgctattgtccctgg

SEQ ID NO: 196664 - DNA, 25 bp, Homo sapien
atgccggaccaagccctacagcaga

SEQ ID NO: 196665 - DNA, 25 bp, Homo sapien
ctcgaggctcttggtgagcagaacc

SEQ ID NO: 196666 - DNA, 25 bp, Homo sapien
agggctgaccttgttgctaccgaca

SEQ ID NO: 196667 - DNA, 25 bp, Homo sapien
gcttcggaaggagtttctgccaccc

SEQ ID NO: 196668 - DNA, 25 bp, Homo sapien
ctgggtggtatacgcatgcgacttc

SEQ ID NO: 196669 - DNA, 25 bp, Homo sapien
ccggatgctgcatgagtctgaaaca

SEQ ID NO: 196670 - DNA, 25 bp, Homo sapien
ctccagtatctgtcgtcgcagggtc

SEQ ID NO: 196671 - DNA, 25 bp, Homo sapien
acgtggcccacaactgaaaggtctg

SEQ ID NO: 196672 - DNA, 25 bp, Homo sapien
acggcatctgacttgacgtggccca

SEQ ID NO: 196673 - DNA, 25 bp, Homo sapien
ttactcgcgcatgtgcaagccttcc

SEQ ID NO: 196674 - DNA, 25 bp, Homo sapien
tgagactcgcctccaatctcggttg

SEQ ID NO: 196675 - DNA, 25 bp, Homo sapien
ttagctccaggtgcgtacggcatct

SEQ ID NO: 196676 - DNA, 25 bp, Homo sapien
aagacccgtgtggtcagctaccgcg

SEQ ID NO: 196677 - DNA, 25 bp, Homo sapien
acaacgctgcggtgcaggtgtacga

SEQ ID NO: 196678 - DNA, 25 bp, Homo sapien
tggggcctgacttcttcacagacgt

SEQ ID NO: 196679 - DNA, 25 bp, Homo sapien
acgactaccgagagaagcgagcccg

SEQ ID NO: 196680 - DNA, 25 bp, Homo sapien
ggtggctctccatgggtctggctct

SEQ ID NO: 196681 - DNA, 25 bp, Homo sapien
tcctgaggagcagttcacagtgttg

SEQ ID NO: 196682 - DNA, 25 bp, Homo sapien
acagtgttgtccctctcagctgggc

SEQ ID NO: 196683 - DNA, 25 bp, Homo sapien
agacgtcatcaccatcgaaacggcg

SEQ ID NO: 196684 - DNA, 25 bp, Homo sapien
tggatcagaggacccgggacgccct

SEQ ID NO: 196685 - DNA, 25 bp, Homo sapien
ccgtggcctctgtcactttcgatga

SEQ ID NO: 196686 - DNA, 25 bp, Homo sapien
gacttccataagaactcagcccgca

SEQ ID NO: 196687 - DNA, 25 bp, Homo sapien
gcatcattcgcactgctgtctttgg

SEQ ID NO: 196688 - DNA, 25 bp, Homo sapien
ctgtctttggctttgagacctcgga

SEQ ID NO: 196689 - DNA, 25 bp, Homo sapien
tgcagtcagtggagcctgtggatca

SEQ ID NO: 196690 - DNA, 25 bp, Homo sapien
gtccagctggccatcgagatcacca

SEQ ID NO: 196691 - DNA, 25 bp, Homo sapien
cccaaaacgggctggtggtcagcag

SEQ ID NO: 196692 - DNA, 25 bp, Homo sapien
atattttcgtctggcatcgcggcgc

SEQ ID NO: 196693 - DNA, 25 bp, Homo sapien
tgggcacgaacaggaagatattttc

SEQ ID NO: 196694 - DNA, 25 bp, Homo sapien
aaagcgtccagcaggccgctgagca

SEQ ID NO: 196695 - DNA, 25 bp, Homo sapien
tggcgaagacaatccgggcataacc

SEQ ID NO: 196696 - DNA, 25 bp, Homo sapien
tgctctggagatgccagtgctgtcc

SEQ ID NO: 196697 - DNA, 25 bp, Homo sapien
gtgggcagcactcaccgatgaggtt

SEQ ID NO: 196698 - DNA, 25 bp, Homo sapien
gcagcgtgtccatcgaaagcgtcca

SEQ ID NO: 196699 - DNA, 25 bp, Homo sapien
tcaccgatgaggttgggcacgaaca

SEQ ID NO: 196700 - DNA, 25 bp, Homo sapien
ggccggctcactcttttggcaggcg

SEQ ID NO: 196701 - DNA, 25 bp, Homo sapien
cgagtttggaggctgcgttttaact

SEQ ID NO: 196702 - DNA, 25 bp, Homo sapien
ccaggctcgcactggtaggtgagca

SEQ ID NO: 196703 - DNA, 25 bp, Homo sapien
tccaagacaggtcccactggcaagt

SEQ ID NO: 196704 - DNA, 25 bp, Homo sapien
tgtcggagcctagcagctcgtagcc

SEQ ID NO: 196705 - DNA, 25 bp, Homo sapien
cccgagcgaagggatggaacccaga

SEQ ID NO: 196706 - DNA, 25 bp, Homo sapien
cttgaagaagatccaggaaggaccc

SEQ ID NO: 196707 - DNA, 25 bp, Homo sapien
cactggcaagtgagaatgtcggagc

SEQ ID NO: 196708 - DNA, 25 bp, Homo sapien
gccgctttcggtgtttgccaggctc

SEQ ID NO: 196709 - DNA, 25 bp, Homo sapien
gggaggcacctccagcgacaactct

SEQ ID NO: 196710 - DNA, 25 bp, Homo sapien
cttctttcgcattgcgggacggctg

SEQ ID NO: 196711 - DNA, 25 bp, Homo sapien
gacggactggcctcagcatccttgc

SEQ ID NO: 196712 - DNA, 25 bp, Homo sapien
ggagcgcccttttcagcaccagcgg

SEQ ID NO: 196713 - DNA, 25 bp, Homo sapien
tcggctctgattttccctccggagc

SEQ ID NO: 196714 - DNA, 25 bp, Homo sapien
ctaacaggcggcctcggctctgatt

SEQ ID NO: 196715 - DNA, 25 bp, Homo sapien
acccggctgatttgctgtgccactg

SEQ ID NO: 196716 - DNA, 25 bp, Homo sapien
tcgaagctttatgagtgccaacacc

SEQ ID NO: 196717 - DNA, 25 bp, Homo sapien
gtgccaacaccttcggcaatgccgg

SEQ ID NO: 196718 - DNA, 25 bp, Homo sapien
ccctgccattttgcgggacttcggg

SEQ ID NO: 196719 - DNA, 25 bp, Homo sapien
gctgtaccaagcaggccggtgccaa

SEQ ID NO: 196720 - DNA, 25 bp, Homo sapien
aatgccggcttttccgttctcctgc

SEQ ID NO: 196721 - DNA, 25 bp, Homo sapien
cgggtgctaccagctcctgctgtac

SEQ ID NO: 196722 - DNA, 25 bp, Homo sapien
agctgggacttctcagggactaccc

SEQ ID NO: 196723 - DNA, 25 bp, Homo sapien
gagctcctggagagcagcttccctg

SEQ ID NO: 196724 - DNA, 25 bp, Homo sapien
ccctgcccgatgtggaaagcgaagt

SEQ ID NO: 196725 - DNA, 25 bp, Homo sapien
ctttgagcatggtgtcctgtcccgt

SEQ ID NO: 196726 - DNA, 25 bp, Homo sapien
tgtagtgcaacgagccgcccacgtt

SEQ ID NO: 196727 - DNA, 25 bp, Homo sapien
ttcacgtatttgctgttcggggtca

SEQ ID NO: 196728 - DNA, 25 bp, Homo sapien
gtcgacgtgcgctcctctctggtct

SEQ ID NO: 196729 - DNA, 25 bp, Homo sapien
gtctcgagtcaccaggaccagatcg

SEQ ID NO: 196730 - DNA, 25 bp, Homo sapien
accagatcgaggatgcggccgaccc

SEQ ID NO: 196731 - DNA, 25 bp, Homo sapien
cggccgctgaacatggctttgagca

SEQ ID NO: 196732 - DNA, 25 bp, Homo sapien
caggcgccaggtgagctgttcaccc

SEQ ID NO: 196733 - DNA, 25 bp, Homo sapien
tgttggtgtccctgactggggcttg

SEQ ID NO: 196734 - DNA, 25 bp, Homo sapien
cacgtgggtgttggtgtccctgact

SEQ ID NO: 196735 - DNA, 25 bp, Homo sapien
agctgttcacccctacgtgttttgg

SEQ ID NO: 196736 - DNA, 25 bp, Homo sapien
gctcaggcgccaggtgagctgttca

SEQ ID NO: 196737 - DNA, 25 bp, Homo sapien
agctgaggtgcaagggctcaggcgc

SEQ ID NO: 196738 - DNA, 25 bp, Homo sapien
gttctcgattggtcagcggcagcag

SEQ ID NO: 196739 - DNA, 25 bp, Homo sapien
tacgtgttttggctgcacgtgggtg

SEQ ID NO: 196740 - DNA, 25 bp, Homo sapien
aaaatgcccgcgacaagcttctggg

SEQ ID NO: 196741 - DNA, 25 bp, Homo sapien
gacgtttctcgcacttgctccctgg

SEQ ID NO: 196742 - DNA, 25 bp, Homo sapien
ggatgccgagtcctcaccgggaacc

SEQ ID NO: 196743 - DNA, 25 bp, Homo sapien
acagcccaaaaatgcccgcgacaag

SEQ ID NO: 196744 - DNA, 25 bp, Homo sapien
gcgacaagcttctggggcagttctc

SEQ ID NO: 196745 - DNA, 25 bp, Homo sapien
ctcgccagtctctctggagggagcc

SEQ ID NO: 196746 - DNA, 25 bp, Homo sapien
ggcagttctcgccagtctctctgga

SEQ ID NO: 196747 - DNA, 25 bp, Homo sapien
agcctacgggttctgcgacgtttct

SEQ ID NO: 196748 - DNA, 25 bp, Homo sapien
attctgtggccaaactgcaagcggc

SEQ ID NO: 196749 - DNA, 25 bp, Homo sapien
caagcggccgttgctaaaatgggaa

SEQ ID NO: 196750 - DNA, 25 bp, Homo sapien
ccaggagagggttttgcactacgaa

SEQ ID NO: 196751 - DNA, 25 bp, Homo sapien
ctcctctttcgacagccgttgggta

SEQ ID NO: 196752 - DNA, 25 bp, Homo sapien
agttcacgtcgtgctcctctttcga

SEQ ID NO: 196753 - DNA, 25 bp, Homo sapien
acgattgtcggtggaagttcacgtc

SEQ ID NO: 196754 - DNA, 25 bp, Homo sapien
gtccttcgcctgcagtatttaaacg

SEQ ID NO: 196755 - DNA, 25 bp, Homo sapien
caaacggtttcatcgaggtggattc

SEQ ID NO: 196756 - DNA, 25 bp, Homo sapien
tttgaccgattgagttttcccagcg

SEQ ID NO: 196757 - DNA, 25 bp, Homo sapien
ccctagcaacaagctcgggctcaga

SEQ ID NO: 196758 - DNA, 25 bp, Homo sapien
gagcagtctattttcccgccttttc

SEQ ID NO: 196759 - DNA, 25 bp, Homo sapien
gctacaatcgttcagctattctcgg

SEQ ID NO: 196760 - DNA, 25 bp, Homo sapien
tggttgctaacctcggagcagtcta

SEQ ID NO: 196761 - DNA, 25 bp, Homo sapien
ccttttccaggttagatggttgcta

SEQ ID NO: 196762 - DNA, 25 bp, Homo sapien
tcccagcgtcgacgcgcaaagattc

SEQ ID NO: 196763 - DNA, 25 bp, Homo sapien
ttcctcgcacttggaggcccttttc

SEQ ID NO: 196764 - DNA, 25 bp, Homo sapien
agcatgcggcccaggttcgccagca

SEQ ID NO: 196765 - DNA, 25 bp, Homo sapien
ctgggcaaccagctggagtacaaca

SEQ ID NO: 196766 - DNA, 25 bp, Homo sapien
ctggagtacaacaagcggcgtgagc

SEQ ID NO: 196767 - DNA, 25 bp, Homo sapien
cagcaccagacggagctgggcaacc

SEQ ID NO: 196768 - DNA, 25 bp, Homo sapien
ccagcagcccaagagcctcaaagta

SEQ ID NO: 196769 - DNA, 25 bp, Homo sapien
ctcaaagtacgtgcaggccagcgcc

SEQ ID NO: 196770 - DNA, 25 bp, Homo sapien
acaacaagcggcgtgagcaagagtt

SEQ ID NO: 196771 - DNA, 25 bp, Homo sapien
agttgcggcagaagcatgcggccca

SEQ ID NO: 196772 - DNA, 25 bp, Homo sapien
gttctgctgcgcctgtcacccatgg

SEQ ID NO: 196773 - DNA, 25 bp, Homo sapien
gtgcgccggggcatatctcgactct

SEQ ID NO: 196774 - DNA, 25 bp, Homo sapien
gtcacccatggccttccgggccctg

SEQ ID NO: 196775 - DNA, 25 bp, Homo sapien
gaccggggtctgtttgcactgtacc

SEQ ID NO: 196776 - DNA, 25 bp, Homo sapien
ctcgactctggttgcgggttctgct

SEQ ID NO: 196777 - DNA, 25 bp, Homo sapien
atatctcgactctggttgcgggttc

SEQ ID NO: 196778 - DNA, 25 bp, Homo sapien
ctgtaccccaaaaccaacaaggatg

SEQ ID NO: 196779 - DNA, 25 bp, Homo sapien
cggggcatatctcgactctggttgc

SEQ ID NO: 196780 - DNA, 25 bp, Homo sapien
cattagagtcaggaacggcgctttc

SEQ ID NO: 196781 - DNA, 25 bp, Homo sapien
tctcactggtcacgggcaacagcta

SEQ ID NO: 196782 - DNA, 25 bp, Homo sapien
gttagaaaccaattcggcgccggca

SEQ ID NO: 196783 - DNA, 25 bp, Homo sapien
tgagctaagtacctccgccgcacga

SEQ ID NO: 196784 - DNA, 25 bp, Homo sapien
cgagaactttgccagacgagacttg

SEQ ID NO: 196785 - DNA, 25 bp, Homo sapien
cgccattttgctcaacccgggattg

SEQ ID NO: 196786 - DNA, 25 bp, Homo sapien
ctcggaagaagctacgggtgaactc

SEQ ID NO: 196787 - DNA, 25 bp, Homo sapien
ttgtagtcctgacggcacagccttg

SEQ ID NO: 196788 - DNA, 25 bp, Homo sapien
agggacccacaggttgacaggagca

SEQ ID NO: 196789 - DNA, 25 bp, Homo sapien
agccgccagaatcgccgggtgttcc

SEQ ID NO: 196790 - DNA, 25 bp, Homo sapien
cacgcactcgcaaacacgcgggctc

SEQ ID NO: 196791 - DNA, 25 bp, Homo sapien
caaacacgcgggctccctgcgccac

SEQ ID NO: 196792 - DNA, 25 bp, Homo sapien
accaccggcctcgttgtcatggcga

SEQ ID NO: 196793 - DNA, 25 bp, Homo sapien
ttgtcatggcgacgccggctcatct

SEQ ID NO: 196794 - DNA, 25 bp, Homo sapien
tccgtagggacccacaggttgacag

SEQ ID NO: 196795 - DNA, 25 bp, Homo sapien
gtgttccccaactactcctgggaga

SEQ ID NO: 196796 - DNA, 25 bp, Homo sapien
cgtggatggccaagagatgtgcctc

SEQ ID NO: 196797 - DNA, 25 bp, Homo sapien
gggccgagggacttcctctgaccaa

SEQ ID NO: 196798 - DNA, 25 bp, Homo sapien
catccgttttcctgcagccgcggat

SEQ ID NO: 196799 - DNA, 25 bp, Homo sapien
agccgcggatgcaacctgtggaaga

SEQ ID NO: 196800 - DNA, 25 bp, Homo sapien
ccgctgctgccacctagtgggagac

SEQ ID NO: 196801 - DNA, 25 bp, Homo sapien
ccacctagtgggagacgcctgctac

SEQ ID NO: 196802 - DNA, 25 bp, Homo sapien
tcgttcccggctgagcactaaggag

SEQ ID NO: 196803 - DNA, 25 bp, Homo sapien
gagacgcctgctactcctctcggtt

SEQ ID NO: 196804 - DNA, 25 bp, Homo sapien
atgcagctctgagccacagccgcgg

SEQ ID NO: 196805 - DNA, 25 bp, Homo sapien
ggcaagcggtcagcggtcaccaccg

SEQ ID NO: 196806 - DNA, 25 bp, Homo sapien
tgccgcccggcacagacaccgcaca

SEQ ID NO: 196807 - DNA, 25 bp, Homo sapien
caccgcacatggcatcatcatagag

SEQ ID NO: 196808 - DNA, 25 bp, Homo sapien
tggcatcatcatagagactccgtgc

SEQ ID NO: 196809 - DNA, 25 bp, Homo sapien
ggaaaatgatggcaccgaccagaca

SEQ ID NO: 196810 - DNA, 25 bp, Homo sapien
tggcaccgaccagacaccgagaaac

SEQ ID NO: 196811 - DNA, 25 bp, Homo sapien
accgagaaaccggacctgcagcggc

SEQ ID NO: 196812 - DNA, 25 bp, Homo sapien
aatccgtgaattgcccgcggcccga

SEQ ID NO: 196813 - DNA, 25 bp, Homo sapien
cttggcgcggaatccgtgaattgcc

SEQ ID NO: 196814 - DNA, 25 bp, Homo sapien
attggacctagcttggcgcggaatc

SEQ ID NO: 196815 - DNA, 25 bp, Homo sapien
tccctcggacgattggacctagctt

SEQ ID NO: 196816 - DNA, 25 bp, Homo sapien
aacaccgctctggtcaccatggcaa

SEQ ID NO: 196817 - DNA, 25 bp, Homo sapien
tacaaacaccgctctggtcaccatg

SEQ ID NO: 196818 - DNA, 25 bp, Homo sapien
catctgatgaggatccgacccaggc

SEQ ID NO: 196819 - DNA, 25 bp, Homo sapien
tccaacgtccggcatctgatgagga

SEQ ID NO: 196820 - DNA, 25 bp, Homo sapien
cctgaggtcctctaactgcgcaatg

SEQ ID NO: 196821 - DNA, 25 bp, Homo sapien
gtgacacgcgctgcagccgcgaaga

SEQ ID NO: 196822 - DNA, 25 bp, Homo sapien
taacgcacgactgcgcgatgtggcc

SEQ ID NO: 196823 - DNA, 25 bp, Homo sapien
cctgggaggcgaaactcagcttcct

SEQ ID NO: 196824 - DNA, 25 bp, Homo sapien
ccaacattctggctgagtcacggcg

SEQ ID NO: 196825 - DNA, 25 bp, Homo sapien
cgctcctcgtaaaggaaaaagctcg

SEQ ID NO: 196826 - DNA, 25 bp, Homo sapien
ttccgaggctaaatcggctgcgttc

SEQ ID NO: 196827 - DNA, 25 bp, Homo sapien
agccggacgagatgaaggaccattc

SEQ ID NO: 196828 - DNA, 25 bp, Homo sapien
gttcctgccctgactccaataaatg

SEQ ID NO: 196829 - DNA, 25 bp, Homo sapien
tacccgaggggagtaaacagatgcc

SEQ ID NO: 196830 - DNA, 25 bp, Homo sapien
ccctcctggcagagcagtaacttta

SEQ ID NO: 196831 - DNA, 25 bp, Homo sapien
aatcccgggactctggcagctacgg

SEQ ID NO: 196832 - DNA, 25 bp, Homo sapien
acaaagcctgacgtccgaatcccgg

SEQ ID NO: 196833 - DNA, 25 bp, Homo sapien
ggcttcccatatcgcacaaagattg

SEQ ID NO: 196834 - DNA, 25 bp, Homo sapien
cgatctgggctctgtgttctcagta

SEQ ID NO: 196835 - DNA, 25 bp, Homo sapien
gtcgaggcctccacacagacgggaa

SEQ ID NO: 196836 - DNA, 25 bp, Homo sapien
ccgtcattactttaacaggcggtga

SEQ ID NO: 196837 - DNA, 25 bp, Homo sapien
tgcgctcgtcggctcattcattcat

SEQ ID NO: 196838 - DNA, 25 bp, Homo sapien
gggaacttccgactgcgtccttcgc

SEQ ID NO: 196839 - DNA, 25 bp, Homo sapien
ggcgccttcctgtacgtttgctctg

SEQ ID NO: 196840 - DNA, 25 bp, Homo sapien
ccagctcctgcgtgatgaccaggtc

SEQ ID NO: 196841 - DNA, 25 bp, Homo sapien
tgtggccctcgagggatcacccatt

SEQ ID NO: 196842 - DNA, 25 bp, Homo sapien
gtttgctctggtcagacgatcggga

SEQ ID NO: 196843 - DNA, 25 bp, Homo sapien
ggcacagaaagtcgcgcagtggaaa

SEQ ID NO: 196844 - DNA, 25 bp, Homo sapien
gaggggccgctcataaatccagtga

SEQ ID NO: 196845 - DNA, 25 bp, Homo sapien
gctgaatcaccactttgcaacccga

SEQ ID NO: 196846 - DNA, 25 bp, Homo sapien
gcggcggcctcacgtaaaatgaatc

SEQ ID NO: 196847 - DNA, 25 bp, Homo sapien
cggtaccgcattagccagcgcagtc

SEQ ID NO: 196848 - DNA, 25 bp, Homo sapien
ccggaccctgcaggtgttggaacaa

SEQ ID NO: 196849 - DNA, 25 bp, Homo sapien
cacacggggctatgttttctgaggc

SEQ ID NO: 196850 - DNA, 25 bp, Homo sapien
gtcgccgggatcaccgcaaacgctt

SEQ ID NO: 196851 - DNA, 25 bp, Homo sapien
gcacccagactttcccaggcgggga

SEQ ID NO: 196852 - DNA, 25 bp, Homo sapien
tgattccaagtcctgccgtcactgg
